United States Patent 7,888,497 (BIOINFORMATICALLY DETECTABLE GROUP OF NOVEL REGULATORY OLIGONUCLEOTIDES AND USES THEREOF) - sequence listing, part 65

SEQ ID NO: 2735516 - DNA, 19 bp, Homo sapiens
gcgctgcctgtgtggtgtc

SEQ ID NO: 2735517 - DNA, 17 bp, Homo sapiens
gcgcttagaaacatgtt

SEQ ID NO: 2735518 - DNA, 13 bp, Homo sapiens
gcggcgcagaggg

SEQ ID NO: 2735519 - DNA, 19 bp, Homo sapiens
gcgggagtgggggctgtgc

SEQ ID NO: 2735520 - DNA, 15 bp, Homo sapiens
gcgggatggtcctgg

SEQ ID NO: 2735521 - DNA, 15 bp, Homo sapiens
gcgggcagcacagca

SEQ ID NO: 2735522 - DNA, 20 bp, Homo sapiens
gcgggggagccaacagcagc

SEQ ID NO: 2735523 - DNA, 19 bp, Homo sapiens
gcgggtggatcacctgagg

SEQ ID NO: 2735524 - DNA, 20 bp, Homo sapiens
gcgtgtcaactttcatttga

SEQ ID NO: 2735525 - DNA, 19 bp, Homo sapiens
gcgtgtcgtgggtgtgtgt

SEQ ID NO: 2735526 - DNA, 21 bp, Homo sapiens
gctaaagttatatttgtctgt

SEQ ID NO: 2735527 - DNA, 16 bp, Homo sapiens
gctaagcctgatgatg

SEQ ID NO: 2735528 - DNA, 22 bp, Homo sapiens
gctaaggaagacacagcccaga

SEQ ID NO: 2735529 - DNA, 13 bp, Homo sapiens
gctacaataaatg

SEQ ID NO: 2735530 - DNA, 15 bp, Homo sapiens
gctacaataaatgct

SEQ ID NO: 2735531 - DNA, 13 bp, Homo sapiens
gctaccctccctg

SEQ ID NO: 2735532 - DNA, 19 bp, Homo sapiens
gctaccctccctgctgtcc

SEQ ID NO: 2735533 - DNA, 14 bp, Homo sapiens
gctagccatatatt

SEQ ID NO: 2735534 - DNA, 12 bp, Homo sapiens
gctagggctgga

SEQ ID NO: 2735535 - DNA, 18 bp, Homo sapiens
gctagtctcttctcagag

SEQ ID NO: 2735536 - DNA, 21 bp, Homo sapiens
gctagtctcttctcagagcag

SEQ ID NO: 2735537 - DNA, 15 bp, Homo sapiens
gctataaagaaaaga

SEQ ID NO: 2735538 - DNA, 19 bp, Homo sapiens
gctatatgccttaagccaa

SEQ ID NO: 2735539 - DNA, 20 bp, Homo sapiens
gctattcaggaggctgaggc

SEQ ID NO: 2735540 - DNA, 19 bp, Homo sapiens
gctcactgcaagctctgcc

SEQ ID NO: 2735541 - DNA, 20 bp, Homo sapiens
gctcagcaatagggtgcagt

SEQ ID NO: 2735542 - DNA, 12 bp, Homo sapiens
gctcagcagccc

SEQ ID NO: 2735543 - DNA, 17 bp, Homo sapiens
gctcagtctcaggagca

SEQ ID NO: 2735544 - DNA, 12 bp, Homo sapiens
gctccacagtgt

SEQ ID NO: 2735545 - DNA, 17 bp, Homo sapiens
gctccagaatgtgctgc

SEQ ID NO: 2735546 - DNA, 18 bp, Homo sapiens
gctccagaatgtgctgcc

SEQ ID NO: 2735547 - DNA, 19 bp, Homo sapiens
gctccagaatgtgctgcct

SEQ ID NO: 2735548 - DNA, 13 bp, Homo sapiens
gctccatgctggt

SEQ ID NO: 2735549 - DNA, 18 bp, Homo sapiens
gctcccagtgtcttcctg

SEQ ID NO: 2735550 - DNA, 20 bp, Homo sapiens
gctcccagtgtcttcctgtg

SEQ ID NO: 2735551 - DNA, 12 bp, Homo sapiens
gctcccctgagg

SEQ ID NO: 2735552 - DNA, 17 bp, Homo sapiens
gctccccttgcccttcc

SEQ ID NO: 2735553 - DNA, 17 bp, Homo sapiens
gctcccgagctactctc

SEQ ID NO: 2735554 - DNA, 16 bp, Homo sapiens
gctccgtgagcccttg

SEQ ID NO: 2735555 - DNA, 17 bp, Homo sapiens
gctccgtgagcccttgg

SEQ ID NO: 2735556 - DNA, 16 bp, Homo sapiens
gctcctcccctgccgc

SEQ ID NO: 2735557 - DNA, 23 bp, Homo sapiens
gctcctcccctgccgcctcccgg

SEQ ID NO: 2735558 - DNA, 13 bp, Homo sapiens
gctcctccctctg

SEQ ID NO: 2735559 - DNA, 15 bp, Homo sapiens
gctcctccctctgcc

SEQ ID NO: 2735560 - DNA, 15 bp, Homo sapiens
gctcctgctcattgt

SEQ ID NO: 2735561 - DNA, 11 bp, Homo sapiens
gctcctgctgc

SEQ ID NO: 2735562 - DNA, 12 bp, Homo sapiens
gctcctgctgca

SEQ ID NO: 2735563 - DNA, 14 bp, Homo sapiens
gctcctgctgcacc

SEQ ID NO: 2735564 - DNA, 19 bp, Homo sapiens
gctcctgtccctacccact

SEQ ID NO: 2735565 - DNA, 21 bp, Homo sapiens
gctcctgtccctacccactct

SEQ ID NO: 2735566 - DNA, 23 bp, Homo sapiens
gctcctgtccctacccactcttt

SEQ ID NO: 2735567 - DNA, 13 bp, Homo sapiens
gctcctgtgccct

SEQ ID NO: 2735568 - DNA, 15 bp, Homo sapiens
gctcctgtgccctta

SEQ ID NO: 2735569 - DNA, 12 bp, Homo sapiens
gctcgggcccag

SEQ ID NO: 2735570 - DNA, 15 bp, Homo sapiens
gctctacacaacatg

SEQ ID NO: 2735571 - DNA, 20 bp, Homo sapiens
gaaaaagttaagatagcttt

SEQ ID NO: 2735572 - DNA, 24 bp, Homo sapiens
gaaaaatgtcactgaagtgattga

SEQ ID NO: 2735573 - DNA, 22 bp, Homo sapiens
gaaaacaattgttctgggtgat

SEQ ID NO: 2735574 - DNA, 15 bp, Homo sapiens
gaaaacccccagcat

SEQ ID NO: 2735575 - DNA, 15 bp, Homo sapiens
gaaaaccctaagtgt

SEQ ID NO: 2735576 - DNA, 21 bp, Homo sapiens
gaaaaccctaagtgtggatgt

SEQ ID NO: 2735577 - DNA, 15 bp, Homo sapiens
gaaaacctgttttta

SEQ ID NO: 2735578 - DNA, 16 bp, Homo sapiens
gaaaactaaggatttt

SEQ ID NO: 2735579 - DNA, 16 bp, Homo sapiens
gaaaagccatatctag

SEQ ID NO: 2735580 - DNA, 22 bp, Homo sapiens
gaaaagccatatctagtcaata

SEQ ID NO: 2735581 - DNA, 14 bp, Homo sapiens
gaaaagggctcaga

SEQ ID NO: 2735582 - DNA, 14 bp, Homo sapiens
gaaaaggttttatt

SEQ ID NO: 2735583 - DNA, 18 bp, Homo sapiens
gaaaatagggtccttgaa

SEQ ID NO: 2735584 - DNA, 18 bp, Homo sapiens
gaaaatgtgtctgcaaca

SEQ ID NO: 2735585 - DNA, 14 bp, Homo sapiens
gaaacaatttaaat

SEQ ID NO: 2735586 - DNA, 12 bp, Homo sapiens
gaaacagcctgg

SEQ ID NO: 2735587 - DNA, 13 bp, Homo sapiens
gaaaccagaaaag

SEQ ID NO: 2735588 - DNA, 16 bp, Homo sapiens
gaaaccagaaaagcaa

SEQ ID NO: 2735589 - DNA, 19 bp, Homo sapiens
gaaacctgtccataaagta

SEQ ID NO: 2735590 - DNA, 12 bp, Homo sapiens
gaaacctttcta

SEQ ID NO: 2735591 - DNA, 18 bp, Homo sapiens
gaaactttgatctctgct

SEQ ID NO: 2735592 - DNA, 21 bp, Homo sapiens
gaaagaattctattttgctgg

SEQ ID NO: 2735593 - DNA, 14 bp, Homo sapiens
gaaagacatcaatg

SEQ ID NO: 2735594 - DNA, 18 bp, Homo sapiens
gaaagcaccgcagcatgt

SEQ ID NO: 2735595 - DNA, 20 bp, Homo sapiens
gaaagcaccgcagcatgtgg

SEQ ID NO: 2735596 - DNA, 17 bp, Homo sapiens
gaaaggattttaccaaa

SEQ ID NO: 2735597 - DNA, 21 bp, Homo sapiens
gaaaggattttaccaaagcat

SEQ ID NO: 2735598 - DNA, 24 bp, Homo sapiens
gaaaggattttaccaaagcatcaa

SEQ ID NO: 2735599 - DNA, 12 bp, Homo sapiens
gaaagggaaagc

SEQ ID NO: 2735600 - DNA, 19 bp, Homo sapiens
gaaagtatttttgaaagaa

SEQ ID NO: 2735601 - DNA, 17 bp, Homo sapiens
gaaagtcagatgcccag

SEQ ID NO: 2735602 - DNA, 17 bp, Homo sapiens
gaaagtgaataaacttc

SEQ ID NO: 2735603 - DNA, 22 bp, Homo sapiens
gaaagtgaataaacttcagcac

SEQ ID NO: 2735604 - DNA, 14 bp, Homo sapiens
gaaatcagagctgg

SEQ ID NO: 2735605 - DNA, 23 bp, Homo sapiens
gaaatcagagctggcagcctcca

SEQ ID NO: 2735606 - DNA, 12 bp, Homo sapiens
gaaatcatatta

SEQ ID NO: 2735607 - DNA, 18 bp, Homo sapiens
gaaatcctggtttgtaat

SEQ ID NO: 2735608 - DNA, 20 bp, Homo sapiens
gaaatcgccttatgagaaca

SEQ ID NO: 2735609 - DNA, 20 bp, Homo sapiens
gaaattcaacctgtgtctta

SEQ ID NO: 2735610 - DNA, 21 bp, Homo sapiens
gaaattcaacctgtgtcttat

SEQ ID NO: 2735611 - DNA, 11 bp, Homo sapiens
gaaatttattc

SEQ ID NO: 2735612 - DNA, 20 bp, Homo sapiens
gaaatttccactcaggtctg

SEQ ID NO: 2735613 - DNA, 19 bp, Homo sapiens
gaaattttactgacagaaa

SEQ ID NO: 2735614 - DNA, 20 bp, Homo sapiens
gaaatttttttccagaattg

SEQ ID NO: 2735615 - DNA, 14 bp, Homo sapiens
gaacaatcacaaaa

SEQ ID NO: 2735616 - DNA, 15 bp, Homo sapiens
gaacacactcagcag

SEQ ID NO: 2735617 - DNA, 16 bp, Homo sapiens
gaacacccactggcca

SEQ ID NO: 2735618 - DNA, 16 bp, Homo sapiens
gaacacccggaaagac

SEQ ID NO: 2735619 - DNA, 18 bp, Homo sapiens
gaacacccggaaagactg

SEQ ID NO: 2735620 - DNA, 19 bp, Homo sapiens
gaacacccggaaagactga

SEQ ID NO: 2735621 - DNA, 22 bp, Homo sapiens
gaacacgtccagaatttttcat

SEQ ID NO: 2735622 - DNA, 18 bp, Homo sapiens
gaacatggtgtgtgtctc

SEQ ID NO: 2735623 - DNA, 19 bp, Homo sapiens
gaacatggtgtgtgtctct

SEQ ID NO: 2735624 - DNA, 21 bp, Homo sapiens
gaacatggtgtgtgtctctga

SEQ ID NO: 2735625 - DNA, 13 bp, Homo sapiens
gaacattgcaata

SEQ ID NO: 2735626 - DNA, 15 bp, Homo sapiens
gaacattgcaataga

SEQ ID NO: 2735627 - DNA, 17 bp, Homo sapiens
gaacattgcaatagaaa

SEQ ID NO: 2735628 - DNA, 20 bp, Homo sapiens
gaaccagccgtattttacat

SEQ ID NO: 2735629 - DNA, 16 bp, Homo sapiens
gaacccaggaggtgga

SEQ ID NO: 2735630 - DNA, 15 bp, Homo sapiens
gaacctttcccttgt

SEQ ID NO: 2735631 - DNA, 16 bp, Homo sapiens
gaacctttcccttgtg

SEQ ID NO: 2735632 - DNA, 14 bp, Homo sapiens
gaacgttttaaagc

SEQ ID NO: 2735633 - DNA, 15 bp, Homo sapiens
gaactccccagggcc

SEQ ID NO: 2735634 - DNA, 18 bp, Homo sapiens
gaactccgctggatgggg

SEQ ID NO: 2735635 - DNA, 21 bp, Homo sapiens
gaactctaccctggtaggaaa

SEQ ID NO: 2735636 - DNA, 15 bp, Homo sapiens
gaactctgcaggcag

SEQ ID NO: 2735637 - DNA, 12 bp, Homo sapiens
gaactgctgggg

SEQ ID NO: 2735638 - DNA, 16 bp, Homo sapiens
gaactgctggggctgg

SEQ ID NO: 2735639 - DNA, 19 bp, Homo sapiens
gaactgctggggctggtga

SEQ ID NO: 2735640 - DNA, 19 bp, Homo sapiens
gaactggacgcccagctga

SEQ ID NO: 2735641 - DNA, 13 bp, Homo sapiens
gaactgtgctccc

SEQ ID NO: 2735642 - DNA, 13 bp, Homo sapiens
gaacttgatggct

SEQ ID NO: 2735643 - DNA, 17 bp, Homo sapiens
gaactttgccttaagtt

SEQ ID NO: 2735644 - DNA, 16 bp, Homo sapiens
gaactttttttccccc

SEQ ID NO: 2735645 - DNA, 16 bp, Homo sapiens
gaagaaaatgagatgg

SEQ ID NO: 2735646 - DNA, 12 bp, Homo sapiens
gaagaaacaaaa

SEQ ID NO: 2735647 - DNA, 21 bp, Homo sapiens
gaagaaacccttccacgtgta

SEQ ID NO: 2735648 - DNA, 16 bp, Homo sapiens
gaagaaccgcattttg

SEQ ID NO: 2735649 - DNA, 15 bp, Homo sapiens
gaagaactgcatggg

SEQ ID NO: 2735650 - DNA, 21 bp, Homo sapiens
gaagaactgcatggggagtac

SEQ ID NO: 2735651 - DNA, 13 bp, Homo sapiens
gaagaagttttaa

SEQ ID NO: 2735652 - DNA, 15 bp, Homo sapiens
gaagactgtgacatc

SEQ ID NO: 2735653 - DNA, 20 bp, Homo sapiens
gaagacttcaatattaaatg

SEQ ID NO: 2735654 - DNA, 12 bp, Homo sapiens
gaagagaggcac

SEQ ID NO: 2735655 - DNA, 17 bp, Homo sapiens
gaagagaggcacctgct

SEQ ID NO: 2735656 - DNA, 20 bp, Homo sapiens
gaagagaggcacctgctgga

SEQ ID NO: 2735657 - DNA, 21 bp, Homo sapiens
gaagagccttcacatgaaatt

SEQ ID NO: 2735658 - DNA, 15 bp, Homo sapiens
gaagaggcctttcta

SEQ ID NO: 2735659 - DNA, 17 bp, Homo sapiens
gaagaggggtcttttat

SEQ ID NO: 2735660 - DNA, 18 bp, Homo sapiens
gaagcaaacacacagact

SEQ ID NO: 2735661 - DNA, 11 bp, Homo sapiens
gaagcaggagt

SEQ ID NO: 2735662 - DNA, 23 bp, Homo sapiens
gaagcaggttgaggggctcctgg

SEQ ID NO: 2735663 - DNA, 17 bp, Homo sapiens
gaagcatcctccccacc

SEQ ID NO: 2735664 - DNA, 22 bp, Homo sapiens
gaagcatcctccccaccagagc

SEQ ID NO: 2735665 - DNA, 22 bp, Homo sapiens
gaagccatccctttttttacat

SEQ ID NO: 2735666 - DNA, 20 bp, Homo sapiens
gaagctatttcctttgcgca

SEQ ID NO: 2735667 - DNA, 20 bp, Homo sapiens
gaaggactggccgtggctcc

SEQ ID NO: 2735668 - DNA, 12 bp, Homo sapiens
gaaggatttctt

SEQ ID NO: 2735669 - DNA, 14 bp, Homo sapiens
gaaggcctcccctg

SEQ ID NO: 2735670 - DNA, 18 bp, Homo sapiens
gaaggctgggtccagggg

SEQ ID NO: 2735671 - DNA, 13 bp, Homo sapiens
gaagggaaggaag

SEQ ID NO: 2735672 - DNA, 17 bp, Homo sapiens
gaagggcctgctctgct

SEQ ID NO: 2735673 - DNA, 19 bp, Homo sapiens
gaagggcctgctctgcttt

SEQ ID NO: 2735674 - DNA, 14 bp, Homo sapiens
gaagtgcagctcag

SEQ ID NO: 2735675 - DNA, 16 bp, Homo sapiens
gaagtgcagctcagga

SEQ ID NO: 2735676 - DNA, 12 bp, Homo sapiens
gaataaacttca

SEQ ID NO: 2735677 - DNA, 13 bp, Homo sapiens
gaataaacttcag

SEQ ID NO: 2735678 - DNA, 13 bp, Homo sapiens
gaatacttgaagt

SEQ ID NO: 2735679 - DNA, 16 bp, Homo sapiens
gaatagaggccaaatt

SEQ ID NO: 2735680 - DNA, 15 bp, Homo sapiens
gaatattaagaaaca

SEQ ID NO: 2735681 - DNA, 20 bp, Homo sapiens
gaatcaagatgtcagactgg

SEQ ID NO: 2735682 - DNA, 21 bp, Homo sapiens
gaatcaagatgtcagactggc

SEQ ID NO: 2735683 - DNA, 18 bp, Homo sapiens
gaatcagattcaggagct

SEQ ID NO: 2735684 - DNA, 19 bp, Homo sapiens
gaatcctgccacacatgct

SEQ ID NO: 2735685 - DNA, 17 bp, Homo sapiens
gaatcctgggcccccag

SEQ ID NO: 2735686 - DNA, 15 bp, Homo sapiens
gaatgaagcatgtag

SEQ ID NO: 2735687 - DNA, 15 bp, Homo sapiens
gaatgaggaacaatc

SEQ ID NO: 2735688 - DNA, 16 bp, Homo sapiens
gaatgccgggcccctc

SEQ ID NO: 2735689 - DNA, 12 bp, Homo sapiens
gaatgggaaagt

SEQ ID NO: 2735690 - DNA, 16 bp, Homo sapiens
gaatggtttttgttga

SEQ ID NO: 2735691 - DNA, 15 bp, Homo sapiens
gaatgtcataaagaa

SEQ ID NO: 2735692 - DNA, 13 bp, Homo sapiens
gaatgtcccagag

SEQ ID NO: 2735693 - DNA, 14 bp, Homo sapiens
gaatgtgctgcctt

SEQ ID NO: 2735694 - DNA, 17 bp, Homo sapiens
gaattaactccattcca

SEQ ID NO: 2735695 - DNA, 15 bp, Homo sapiens
gaattacccttcctc

SEQ ID NO: 2735696 - DNA, 16 bp, Homo sapiens
gaattacccttcctca

SEQ ID NO: 2735697 - DNA, 20 bp, Homo sapiens
gaattacccttcctcatctg

SEQ ID NO: 2735698 - DNA, 16 bp, Homo sapiens
gaattcacaaacaaat

SEQ ID NO: 2735699 - DNA, 21 bp, Homo sapiens
gagtcaaagctgaccatggat

SEQ ID NO: 2735700 - DNA, 19 bp, Homo sapiens
gagtcacccctctgtccag

SEQ ID NO: 2735701 - DNA, 20 bp, Homo sapiens
gagtcacccctctgtccagc

SEQ ID NO: 2735702 - DNA, 24 bp, Homo sapiens
gagtcacccctctgtccagccagc

SEQ ID NO: 2735703 - DNA, 11 bp, Homo sapiens
gagtcagcctt

SEQ ID NO: 2735704 - DNA, 20 bp, Homo sapiens
gagtccagggcgggagtggg

SEQ ID NO: 2735705 - DNA, 21 bp, Homo sapiens
gagtctcgctctgctgcccag

SEQ ID NO: 2735706 - DNA, 11 bp, Homo sapiens
gagtctctcca

SEQ ID NO: 2735707 - DNA, 12 bp, Homo sapiens
gagtctctccag

SEQ ID NO: 2735708 - DNA, 15 bp, Homo sapiens
gagtctctccagcct

SEQ ID NO: 2735709 - DNA, 17 bp, Homo sapiens
gagtctggcaaacatgt

SEQ ID NO: 2735710 - DNA, 12 bp, Homo sapiens
gagtctgtctca

SEQ ID NO: 2735711 - DNA, 18 bp, Homo sapiens
gagtcttcactgctctgc

SEQ ID NO: 2735712 - DNA, 13 bp, Homo sapiens
gagtgagaccctg

SEQ ID NO: 2735713 - DNA, 13 bp, Homo sapiens
gagtgctgcagct

SEQ ID NO: 2735714 - DNA, 15 bp, Homo sapiens
gagtgctgcagcttt

SEQ ID NO: 2735715 - DNA, 23 bp, Homo sapiens
gagtgctgcagctttgggaaagc

SEQ ID NO: 2735716 - DNA, 18 bp, Homo sapiens
gagtggcattggcagcag

SEQ ID NO: 2735717 - DNA, 20 bp, Homo sapiens
gagtgtcctgtctgctgggc

SEQ ID NO: 2735718 - DNA, 15 bp, Homo sapiens
gagtgtctctgcctg

SEQ ID NO: 2735719 - DNA, 19 bp, Homo sapiens
gagttcaagaccagcctgg

SEQ ID NO: 2735720 - DNA, 23 bp, Homo sapiens
gagttcattcaaaatgtccagct

SEQ ID NO: 2735721 - DNA, 17 bp, Homo sapiens
gagttcgagaccagcct

SEQ ID NO: 2735722 - DNA, 22 bp, Homo sapiens
gagttctttgcaagcttattta

SEQ ID NO: 2735723 - DNA, 20 bp, Homo sapiens
gagttgtggaaagcctctgc

SEQ ID NO: 2735724 - DNA, 22 bp, Homo sapiens
gagtttgctgtatacaaacagg

SEQ ID NO: 2735725 - DNA, 19 bp, Homo sapiens
gataaggcagaactaggag

SEQ ID NO: 2735726 - DNA, 21 bp, Homo sapiens
gataataaatgcttcttaaag

SEQ ID NO: 2735727 - DNA, 22 bp, Homo sapiens
gatacagtcattatttaaagca

SEQ ID NO: 2735728 - DNA, 22 bp, Homo sapiens
gatactttaatttttataaata

SEQ ID NO: 2735729 - DNA, 14 bp, Homo sapiens
gatagtgcctctgc

SEQ ID NO: 2735730 - DNA, 23 bp, Homo sapiens
gatataataaatatatatttatc

SEQ ID NO: 2735731 - DNA, 19 bp, Homo sapiens
gatatccacaaatgctatt

SEQ ID NO: 2735732 - DNA, 17 bp, Homo sapiens
gatatccccagggaaac

SEQ ID NO: 2735733 - DNA, 17 bp, Homo sapiens
gatatgaaaaataaata

SEQ ID NO: 2735734 - DNA, 16 bp, Homo sapiens
gatattgaccatgtga

SEQ ID NO: 2735735 - DNA, 17 bp, Homo sapiens
gatcaagccaaaaaaga

SEQ ID NO: 2735736 - DNA, 24 bp, Homo sapiens
gatcacgccactgcactccagcct

SEQ ID NO: 2735737 - DNA, 11 bp, Homo sapiens
gatcagcctcc

SEQ ID NO: 2735738 - DNA, 20 bp, Homo sapiens
gatcatataagcaagacagt

SEQ ID NO: 2735739 - DNA, 18 bp, Homo sapiens
gatcattacatggctgtg

SEQ ID NO: 2735740 - DNA, 22 bp, Homo sapiens
gatcccccaagtgtcctggacc

SEQ ID NO: 2735741 - DNA, 22 bp, Homo sapiens
gatcccctgtcccctggggctg

SEQ ID NO: 2735742 - DNA, 23 bp, Homo sapiens
gatccgacttgaattttcccact

SEQ ID NO: 2735743 - DNA, 19 bp, Homo sapiens
gatctgcccgcctcggcct

SEQ ID NO: 2735744 - DNA, 15 bp, Homo sapiens
gatctgcttccctgg

SEQ ID NO: 2735745 - DNA, 19 bp, Homo sapiens
gatcttgctggcagggcct

SEQ ID NO: 2735746 - DNA, 14 bp, Homo sapiens
gatctttaaataca

SEQ ID NO: 2735747 - DNA, 19 bp, Homo sapiens
gatctttaaatacagtcaa

SEQ ID NO: 2735748 - DNA, 23 bp, Homo sapiens
gatgaaaagccatatctagtcaa

SEQ ID NO: 2735749 - DNA, 17 bp, Homo sapiens
gatgaaaccgtccctga

SEQ ID NO: 2735750 - DNA, 17 bp, Homo sapiens
gatgagaaaactgagag

SEQ ID NO: 2735751 - DNA, 14 bp, Homo sapiens
gatgatgatgaaaa

SEQ ID NO: 2735752 - DNA, 23 bp, Homo sapiens
gatgcattcccggtgcagaacag

SEQ ID NO: 2735753 - DNA, 15 bp, Homo sapiens
gatgccacaccaagc

SEQ ID NO: 2735754 - DNA, 19 bp, Homo sapiens
gatgccacaccaagctgtg

SEQ ID NO: 2735755 - DNA, 21 bp, Homo sapiens
gatgccacaccaagctgtgcc

SEQ ID NO: 2735756 - DNA, 14 bp, Homo sapiens
gatgctgcctgagt

SEQ ID NO: 2735757 - DNA, 11 bp, Homo sapiens
gatgctggcct

SEQ ID NO: 2735758 - DNA, 12 bp, Homo sapiens
gatgctggcctc

SEQ ID NO: 2735759 - DNA, 22 bp, Homo sapiens
gatgctggcctcttggcacctg

SEQ ID NO: 2735760 - DNA, 12 bp, Homo sapiens
gatgctgggctg

SEQ ID NO: 2735761 - DNA, 13 bp, Homo sapiens
gatgctgggctgg

SEQ ID NO: 2735762 - DNA, 17 bp, Homo sapiens
gatgctgggctgggtgc

SEQ ID NO: 2735763 - DNA, 16 bp, Homo sapiens
gatggagaaacaggct

SEQ ID NO: 2735764 - DNA, 13 bp, Homo sapiens
gatggtcctgggg

SEQ ID NO: 2735765 - DNA, 21 bp, Homo sapiens
gatggtcctggggctctgtgc

SEQ ID NO: 2735766 - DNA, 20 bp, Homo sapiens
gatgtgctcccaccaggcag

SEQ ID NO: 2735767 - DNA, 21 bp, Homo sapiens
gatgtgctcccaccaggcagc

SEQ ID NO: 2735768 - DNA, 19 bp, Homo sapiens
gatgtggatggaggtgatg

SEQ ID NO: 2735769 - DNA, 20 bp, Homo sapiens
gattaaacagcaaagccata

SEQ ID NO: 2735770 - DNA, 13 bp, Homo sapiens
gcactctgtgccc

SEQ ID NO: 2735771 - DNA, 12 bp, Homo sapiens
gcactgaaaacc

SEQ ID NO: 2735772 - DNA, 21 bp, Homo sapiens
gcactgcccagggaagccctc

SEQ ID NO: 2735773 - DNA, 18 bp, Homo sapiens
gcactgctgggtggccca

SEQ ID NO: 2735774 - DNA, 12 bp, Homo sapiens
gcactgtcctgc

SEQ ID NO: 2735775 - DNA, 17 bp, Homo sapiens
gcactttataagccaat

SEQ ID NO: 2735776 - DNA, 14 bp, Homo sapiens
gcagaactgctggg

SEQ ID NO: 2735777 - DNA, 18 bp, Homo sapiens
gcagaactgctggggctg

SEQ ID NO: 2735778 - DNA, 21 bp, Homo sapiens
gcagaagccccaactgtgatc

SEQ ID NO: 2735779 - DNA, 13 bp, Homo sapiens
gcagaatcctggg

SEQ ID NO: 2735780 - DNA, 15 bp, Homo sapiens
gcagaatcctgggcc

SEQ ID NO: 2735781 - DNA, 16 bp, Homo sapiens
gcagaatcctgggccc

SEQ ID NO: 2735782 - DNA, 18 bp, Homo sapiens
gcagacagtgtcagagtc

SEQ ID NO: 2735783 - DNA, 15 bp, Homo sapiens
gcagaggaggagaaa

SEQ ID NO: 2735784 - DNA, 17 bp, Homo sapiens
gcagaggagtccagggc

SEQ ID NO: 2735785 - DNA, 12 bp, Homo sapiens
gcagaggcagcg

SEQ ID NO: 2735786 - DNA, 13 bp, Homo sapiens
gcagaggggcagg

SEQ ID NO: 2735787 - DNA, 18 bp, Homo sapiens
gcagaggggcaggccctg

SEQ ID NO: 2735788 - DNA, 20 bp, Homo sapiens
gcagaggggcaggccctgca

SEQ ID NO: 2735789 - DNA, 12 bp, Homo sapiens
gcagaggggctt

SEQ ID NO: 2735790 - DNA, 19 bp, Homo sapiens
gcagaggggctttctggag

SEQ ID NO: 2735791 - DNA, 20 bp, Homo sapiens
gcagaggggctttctggaga

SEQ ID NO: 2735792 - DNA, 16 bp, Homo sapiens
gcagaggtgagcagag

SEQ ID NO: 2735793 - DNA, 19 bp, Homo sapiens
gcagagttctttgcaagct

SEQ ID NO: 2735794 - DNA, 15 bp, Homo sapiens
gcagatagtgcctct

SEQ ID NO: 2735795 - DNA, 15 bp, Homo sapiens
gcagatctttaaata

SEQ ID NO: 2735796 - DNA, 20 bp, Homo sapiens
gcagatggatccacgtgctc

SEQ ID NO: 2735797 - DNA, 21 bp, Homo sapiens
gcagatgggcctgtgtgcacc

SEQ ID NO: 2735798 - DNA, 16 bp, Homo sapiens
gcagattacaataaat

SEQ ID NO: 2735799 - DNA, 17 bp, Homo sapiens
gcagcaggtgctgctac

SEQ ID NO: 2735800 - DNA, 19 bp, Homo sapiens
gcagcaggtgctgctaccc

SEQ ID NO: 2735801 - DNA, 19 bp, Homo sapiens
gcagcatgtggggaagcaa

SEQ ID NO: 2735802 - DNA, 22 bp, Homo sapiens
gcagccacgaacacgcatgcct

SEQ ID NO: 2735803 - DNA, 19 bp, Homo sapiens
gcagccccaccccaccctg

SEQ ID NO: 2735804 - DNA, 14 bp, Homo sapiens
gcagccgcctccct

SEQ ID NO: 2735805 - DNA, 15 bp, Homo sapiens
gcagcctccagtgct

SEQ ID NO: 2735806 - DNA, 17 bp, Homo sapiens
gcagcctccagtgctgg

SEQ ID NO: 2735807 - DNA, 18 bp, Homo sapiens
gcagcctccagtgctggc

SEQ ID NO: 2735808 - DNA, 15 bp, Homo sapiens
gcagcctccagtggg

SEQ ID NO: 2735809 - DNA, 22 bp, Homo sapiens
gcagcctccagtgggaggacag

SEQ ID NO: 2735810 - DNA, 22 bp, Homo sapiens
gcagcgagctatgatcgcgcca

SEQ ID NO: 2735811 - DNA, 24 bp, Homo sapiens
gcagcgagttgtggaaagcctctg

SEQ ID NO: 2735812 - DNA, 13 bp, Homo sapiens
gcagcgcctgtcc

SEQ ID NO: 2735813 - DNA, 21 bp, Homo sapiens
gcagcgcctgtcccctcacag

SEQ ID NO: 2735814 - DNA, 13 bp, Homo sapiens
gcagctccagctg

SEQ ID NO: 2735815 - DNA, 13 bp, Homo sapiens
gcagctgctgcca

SEQ ID NO: 2735816 - DNA, 14 bp, Homo sapiens
gcagctgctgccac

SEQ ID NO: 2735817 - DNA, 15 bp, Homo sapiens
gcagctgctgccact

SEQ ID NO: 2735818 - DNA, 13 bp, Homo sapiens
gcagctggctctc

SEQ ID NO: 2735819 - DNA, 11 bp, Homo sapiens
gcagctgggcc

SEQ ID NO: 2735820 - DNA, 16 bp, Homo sapiens
gcagctgggcccacag

SEQ ID NO: 2735821 - DNA, 23 bp, Homo sapiens
gcagctgggcccacagcccccac

SEQ ID NO: 2735822 - DNA, 13 bp, Homo sapiens
gcagcttcagttg

SEQ ID NO: 2735823 - DNA, 15 bp, Homo sapiens
gcagcttctgccact

SEQ ID NO: 2735824 - DNA, 15 bp, Homo sapiens
gcaggaaaccccagc

SEQ ID NO: 2735825 - DNA, 15 bp, Homo sapiens
gcaggaaatcagagc

SEQ ID NO: 2735826 - DNA, 19 bp, Homo sapiens
gcaggaaatcagagctggc

SEQ ID NO: 2735827 - DNA, 20 bp, Homo sapiens
gcaggaaatcagagctggca

SEQ ID NO: 2735828 - DNA, 22 bp, Homo sapiens
gcaggaaatcagagctggcagc

SEQ ID NO: 2735829 - DNA, 15 bp, Homo sapiens
gcaggaaccggaggg

SEQ ID NO: 2735830 - DNA, 15 bp, Homo sapiens
gcaggagagcttccc

SEQ ID NO: 2735831 - DNA, 18 bp, Homo sapiens
gcttccagcttcctctga

SEQ ID NO: 2735832 - DNA, 22 bp, Homo sapiens
gcttccagcttcctctgagccg

SEQ ID NO: 2735833 - DNA, 18 bp, Homo sapiens
gcttcccctccaccctaa

SEQ ID NO: 2735834 - DNA, 15 bp, Homo sapiens
gcttccctctgcctg

SEQ ID NO: 2735835 - DNA, 17 bp, Homo sapiens
gcttccctggggcccca

SEQ ID NO: 2735836 - DNA, 15 bp, Homo sapiens
gcttcctctgagccg

SEQ ID NO: 2735837 - DNA, 17 bp, Homo sapiens
gcttcctctgagccgca

SEQ ID NO: 2735838 - DNA, 13 bp, Homo sapiens
gcttcctggaccg

SEQ ID NO: 2735839 - DNA, 23 bp, Homo sapiens
gcttctccacaacctcctcctcc

SEQ ID NO: 2735840 - DNA, 12 bp, Homo sapiens
gcttctgccact

SEQ ID NO: 2735841 - DNA, 19 bp, Homo sapiens
gcttctgccacttcccagg

SEQ ID NO: 2735842 - DNA, 16 bp, Homo sapiens
gcttctgcctcagctt

SEQ ID NO: 2735843 - DNA, 12 bp, Homo sapiens
gcttctgctggg

SEQ ID NO: 2735844 - DNA, 17 bp, Homo sapiens
gcttctgctgggctggg

SEQ ID NO: 2735845 - DNA, 13 bp, Homo sapiens
gcttctggagccc

SEQ ID NO: 2735846 - DNA, 18 bp, Homo sapiens
gcttctggagcccttggg

SEQ ID NO: 2735847 - DNA, 18 bp, Homo sapiens
gcttctggctttgttctt

SEQ ID NO: 2735848 - DNA, 14 bp, Homo sapiens
gcttgaacccagga

SEQ ID NO: 2735849 - DNA, 15 bp, Homo sapiens
gcttgaacccaggag

SEQ ID NO: 2735850 - DNA, 15 bp, Homo sapiens
gcttgactctactcc

SEQ ID NO: 2735851 - DNA, 18 bp, Homo sapiens
gcttgcctcggctcctgc

SEQ ID NO: 2735852 - DNA, 16 bp, Homo sapiens
gcttggcttcccctcc

SEQ ID NO: 2735853 - DNA, 19 bp, Homo sapiens
gcttgtggactctctgcct

SEQ ID NO: 2735854 - DNA, 20 bp, Homo sapiens
gcttgtggactctctgcctg

SEQ ID NO: 2735855 - DNA, 22 bp, Homo sapiens
gcttgttgtttttaagtcctgt

SEQ ID NO: 2735856 - DNA, 18 bp, Homo sapiens
gctttagctggagggaga

SEQ ID NO: 2735857 - DNA, 22 bp, Homo sapiens
gctttaggactgacatttctat

SEQ ID NO: 2735858 - DNA, 17 bp, Homo sapiens
gctttataccccatttg

SEQ ID NO: 2735859 - DNA, 15 bp, Homo sapiens
gctttatcaggggac

SEQ ID NO: 2735860 - DNA, 23 bp, Homo sapiens
gctttcctaaagtctctgctgct

SEQ ID NO: 2735861 - DNA, 12 bp, Homo sapiens
gctttctcagtg

SEQ ID NO: 2735862 - DNA, 13 bp, Homo sapiens
gctttctggagag

SEQ ID NO: 2735863 - DNA, 14 bp, Homo sapiens
gctttgttcttgtc

SEQ ID NO: 2735864 - DNA, 14 bp, Homo sapiens
gcttttcctgtctg

SEQ ID NO: 2735865 - DNA, 15 bp, Homo sapiens
gcttttcctgtctgt

SEQ ID NO: 2735866 - DNA, 23 bp, Homo sapiens
gcttttcgaactgtgctcccacg

SEQ ID NO: 2735867 - DNA, 15 bp, Homo sapiens
gcttttctcccagaa

SEQ ID NO: 2735868 - DNA, 17 bp, Homo sapiens
gctttttgtattaacaa

SEQ ID NO: 2735869 - DNA, 13 bp, Homo sapiens
ggaaaaaggcttc

SEQ ID NO: 2735870 - DNA, 22 bp, Homo sapiens
ggaaaagggctcagagctgctg

SEQ ID NO: 2735871 - DNA, 19 bp, Homo sapiens
ggaaaattagcttttagtt

SEQ ID NO: 2735872 - DNA, 23 bp, Homo sapiens
ggaaacctgtgaaagctgcactc

SEQ ID NO: 2735873 - DNA, 19 bp, Homo sapiens
gggctcagagctgctgagc

SEQ ID NO: 2735874 - DNA, 17 bp, Homo sapiens
gggctcagatcctgggc

SEQ ID NO: 2735875 - DNA, 20 bp, Homo sapiens
gggctcagggaccacagcaa

SEQ ID NO: 2735876 - DNA, 15 bp, Homo sapiens
gggctccctcctgga

SEQ ID NO: 2735877 - DNA, 11 bp, Homo sapiens
gggctcctgga

SEQ ID NO: 2735878 - DNA, 12 bp, Homo sapiens
gggctcctggaa

SEQ ID NO: 2735879 - DNA, 14 bp, Homo sapiens
gggctcctgtgccc

SEQ ID NO: 2735880 - DNA, 15 bp, Homo sapiens
gggctcctgtgccct

SEQ ID NO: 2735881 - DNA, 12 bp, Homo sapiens
gggctctgcccc

SEQ ID NO: 2735882 - DNA, 20 bp, Homo sapiens
gggctctgccccagctctgg

SEQ ID NO: 2735883 - DNA, 21 bp, Homo sapiens
gggctctgccccagctctggc

SEQ ID NO: 2735884 - DNA, 16 bp, Homo sapiens
gggctctgtgggctgc

SEQ ID NO: 2735885 - DNA, 19 bp, Homo sapiens
gggctctgtgggctgcact

SEQ ID NO: 2735886 - DNA, 17 bp, Homo sapiens
gggctgagccctggcag

SEQ ID NO: 2735887 - DNA, 20 bp, Homo sapiens
gggctgcactctgtgcccat

SEQ ID NO: 2735888 - DNA, 15 bp, Homo sapiens
gggctgcccgctccc

SEQ ID NO: 2735889 - DNA, 19 bp, Homo sapiens
gggctgcccgctcccagtg

SEQ ID NO: 2735890 - DNA, 12 bp, Homo sapiens
gggctgctgggg

SEQ ID NO: 2735891 - DNA, 20 bp, Homo sapiens
gggctgctgggggctcccct

SEQ ID NO: 2735892 - DNA, 22 bp, Homo sapiens
gggctgggttggcgcaccctcc

SEQ ID NO: 2735893 - DNA, 20 bp, Homo sapiens
gggctgtcggtgtgctgtca

SEQ ID NO: 2735894 - DNA, 21 bp, Homo sapiens
gggctgtcggtgtgctgtcag

SEQ ID NO: 2735895 - DNA, 13 bp, Homo sapiens
gggcttccctggg

SEQ ID NO: 2735896 - DNA, 18 bp, Homo sapiens
gggcttgtggactctctg

SEQ ID NO: 2735897 - DNA, 14 bp, Homo sapiens
ggggaccactgggc

SEQ ID NO: 2735898 - DNA, 19 bp, Homo sapiens
ggggaggatcactggagcc

SEQ ID NO: 2735899 - DNA, 21 bp, Homo sapiens
ggggcaacaaggtgcacagac

SEQ ID NO: 2735900 - DNA, 13 bp, Homo sapiens
ggggcaggccctg

SEQ ID NO: 2735901 - DNA, 16 bp, Homo sapiens
ggggcaggccctgcac

SEQ ID NO: 2735902 - DNA, 16 bp, Homo sapiens
ggggcatgctggggca

SEQ ID NO: 2735903 - DNA, 20 bp, Homo sapiens
ggggcccgttgtctccctgg

SEQ ID NO: 2735904 - DNA, 17 bp, Homo sapiens
ggggctccccttgccct

SEQ ID NO: 2735905 - DNA, 20 bp, Homo sapiens
ggggctccccttgcccttcc

SEQ ID NO: 2735906 - DNA, 12 bp, Homo sapiens
ggggctcctgga

SEQ ID NO: 2735907 - DNA, 21 bp, Homo sapiens
ggggctcctggaaaggctcag

SEQ ID NO: 2735908 - DNA, 17 bp, Homo sapiens
ggggctcgccccaccca

SEQ ID NO: 2735909 - DNA, 12 bp, Homo sapiens
ggggctgctggg

SEQ ID NO: 2735910 - DNA, 10 bp, Homo sapiens
ggggctgggt

SEQ ID NO: 2735911 - DNA, 19 bp, Homo sapiens
ggggctgggttggcgcacc

SEQ ID NO: 2735912 - DNA, 21 bp, Homo sapiens
ggggctggtgaggccggccct

SEQ ID NO: 2735913 - DNA, 13 bp, Homo sapiens
gggggctcccctt

SEQ ID NO: 2735914 - DNA, 11 bp, Homo sapiens
ggggggaggca

SEQ ID NO: 2735915 - DNA, 22 bp, Homo sapiens
ggggtccttcaagttagctcag

SEQ ID NO: 2735916 - DNA, 21 bp, Homo sapiens
gggtaccaggcacatggctgg

SEQ ID NO: 2735917 - DNA, 13 bp, Homo sapiens
gggtcctcggccc

SEQ ID NO: 2735918 - DNA, 13 bp, Homo sapiens
gggtgagagagga

SEQ ID NO: 2735919 - DNA, 15 bp, Homo sapiens
gggtgatttctagaa

SEQ ID NO: 2735920 - DNA, 19 bp, Homo sapiens
gggtgcgaccccatctgcc

SEQ ID NO: 2735921 - DNA, 11 bp, Homo sapiens
gggtggcccat

SEQ ID NO: 2735922 - DNA, 19 bp, Homo sapiens
gggtgttgtagtagctgaa

SEQ ID NO: 2735923 - DNA, 22 bp, Homo sapiens
gggttcaaggactaacgaacgt

SEQ ID NO: 2735924 - DNA, 14 bp, Homo sapiens
gggttcctcttccc

SEQ ID NO: 2735925 - DNA, 22 bp, Homo sapiens
gggttggcgcaccctcccctcc

SEQ ID NO: 2735926 - DNA, 17 bp, Homo sapiens
gggtttacaacaaacac

SEQ ID NO: 2735927 - DNA, 14 bp, Homo sapiens
gggtttggcccctg

SEQ ID NO: 2735928 - DNA, 16 bp, Homo sapiens
gggttttccaccctgg

SEQ ID NO: 2735929 - DNA, 19 bp, Homo sapiens
ggtaactcttggccagagc

SEQ ID NO: 2735930 - DNA, 21 bp, Homo sapiens
ggtaactcttggccagagctg

SEQ ID NO: 2735931 - DNA, 23 bp, Homo sapiens
ggtaccaggcacatggctggggg

SEQ ID NO: 2735932 - DNA, 18 bp, Homo sapiens
ggtactgaaggcttctgc

SEQ ID NO: 2735933 - DNA, 11 bp, Homo sapiens
ggtagaagcca

SEQ ID NO: 2735934 - DNA, 15 bp, Homo sapiens
ggtagcgagctgctc

SEQ ID NO: 2735935 - DNA, 16 bp, Homo sapiens
ggtagcgagctgctct

SEQ ID NO: 2735936 - DNA, 19 bp, Homo sapiens
ggtagcgagctgctctgct

SEQ ID NO: 2735937 - DNA, 20 bp, Homo sapiens
ggtagcgagctgctctgcta

SEQ ID NO: 2735938 - DNA, 22 bp, Homo sapiens
ggtaggaaagcaccgcagcatg

SEQ ID NO: 2735939 - DNA, 14 bp, Homo sapiens
ggtagtactgggaa

SEQ ID NO: 2735940 - DNA, 22 bp, Homo sapiens
ggtatcgttcgcttgttttaaa

SEQ ID NO: 2735941 - DNA, 23 bp, Homo sapiens
ggtatctgcatgtaaaatcttca

SEQ ID NO: 2735942 - DNA, 12 bp, Homo sapiens
ggtatgatcatt

SEQ ID NO: 2735943 - DNA, 22 bp, Homo sapiens
ggtattttaggcagggatttga

SEQ ID NO: 2735944 - DNA, 17 bp, Homo sapiens
ggtccaacccagcctga

SEQ ID NO: 2735945 - DNA, 18 bp, Homo sapiens
ggtccaggggagggaaaa

SEQ ID NO: 2735946 - DNA, 14 bp, Homo sapiens
ggtcccacccagga

SEQ ID NO: 2735947 - DNA, 15 bp, Homo sapiens
ggtcccacccaggaa

SEQ ID NO: 2735948 - DNA, 12 bp, Homo sapiens
ggtcccacttcc

SEQ ID NO: 2735949 - DNA, 21 bp, Homo sapiens
ggtcccgaggatgctgtcagg

SEQ ID NO: 2735950 - DNA, 22 bp, Homo sapiens
ggtcccgtgaaaacactcgtgt

SEQ ID NO: 2735951 - DNA, 15 bp, Homo sapiens
ggtcctcggcccatc

SEQ ID NO: 2735952 - DNA, 20 bp, Homo sapiens
ggtcctcggcccatctgtcc

SEQ ID NO: 2735953 - DNA, 22 bp, Homo sapiens
ggtcctggggctctgtgcaggg

SEQ ID NO: 2735954 - DNA, 23 bp, Homo sapiens
ggtcctggggctctgtgcaggga

SEQ ID NO: 2735955 - DNA, 16 bp, Homo sapiens
ggtccttccaggcccc

SEQ ID NO: 2735956 - DNA, 20 bp, Homo sapiens
ggtcgggagttcaagaccag

SEQ ID NO: 2735957 - DNA, 20 bp, Homo sapiens
ggtctccatgaagaagctgg

SEQ ID NO: 2735958 - DNA, 19 bp, Homo sapiens
ggtctcgaactcctgacct

SEQ ID NO: 2735959 - DNA, 19 bp, Homo sapiens
ggtctcgctgatgctgggc

SEQ ID NO: 2735960 - DNA, 18 bp, Homo sapiens
ggtctgctcgggcccagg

SEQ ID NO: 2735961 - DNA, 19 bp, Homo sapiens
ggtctgctcgggcccaggc

SEQ ID NO: 2735962 - DNA, 13 bp, Homo sapiens
ggtcttctgcatc

SEQ ID NO: 2735963 - DNA, 17 bp, Homo sapiens
ggtcttgatctcctgag

SEQ ID NO: 2735964 - DNA, 20 bp, Homo sapiens
ggtgacccatttcaggaggt

SEQ ID NO: 2735965 - DNA, 17 bp, Homo sapiens
ggtgacggactcagact

SEQ ID NO: 2735966 - DNA, 22 bp, Homo sapiens
ggtgacggtcctttaggcagcc

SEQ ID NO: 2735967 - DNA, 18 bp, Homo sapiens
ggtgacttgcctggggcc

SEQ ID NO: 2735968 - DNA, 23 bp, Homo sapiens
ggtgaggccggccctgcccctcc

SEQ ID NO: 2735969 - DNA, 22 bp, Homo sapiens
ggtgcacagtaatatgaaagcc

SEQ ID NO: 2735970 - DNA, 18 bp, Homo sapiens
ggtgccaggctgtaagca

SEQ ID NO: 2735971 - DNA, 17 bp, Homo sapiens
ggtgccggtaccagcct

SEQ ID NO: 2735972 - DNA, 18 bp, Homo sapiens
ggtgcctgattcggctgt

SEQ ID NO: 2735973 - DNA, 15 bp, Homo sapiens
gtcccctggggctgg

SEQ ID NO: 2735974 - DNA, 16 bp, Homo sapiens
gtcccctggggctggt

SEQ ID NO: 2735975 - DNA, 23 bp, Homo sapiens
gtcccgcttattctcctccctgt

SEQ ID NO: 2735976 - DNA, 13 bp, Homo sapiens
gtccctacccact

SEQ ID NO: 2735977 - DNA, 14 bp, Homo sapiens
gtccctacccactc

SEQ ID NO: 2735978 - DNA, 20 bp, Homo sapiens
gtccctacccactctttgct

SEQ ID NO: 2735979 - DNA, 18 bp, Homo sapiens
gtccctgactctctgtga

SEQ ID NO: 2735980 - DNA, 12 bp, Homo sapiens
gtccctggggca

SEQ ID NO: 2735981 - DNA, 16 bp, Homo sapiens
gtccctggggcactcc

SEQ ID NO: 2735982 - DNA, 17 bp, Homo sapiens
gtccctggggcactccc

SEQ ID NO: 2735983 - DNA, 19 bp, Homo sapiens
gtccctggggcactccccc

SEQ ID NO: 2735984 - DNA, 20 bp, Homo sapiens
gtccctggggcactccccca

SEQ ID NO: 2735985 - DNA, 21 bp, Homo sapiens
gtccctggggcactcccccag

SEQ ID NO: 2735986 - DNA, 22 bp, Homo sapiens
gtccctggggcactcccccagg

SEQ ID NO: 2735987 - DNA, 12 bp, Homo sapiens
gtccgcctctgc

SEQ ID NO: 2735988 - DNA, 19 bp, Homo sapiens
gtccggagcgaccctggct

SEQ ID NO: 2735989 - DNA, 14 bp, Homo sapiens
gtcctagagctcct

SEQ ID NO: 2735990 - DNA, 17 bp, Homo sapiens
gtcctagagctcctgtc

SEQ ID NO: 2735991 - DNA, 20 bp, Homo sapiens
gtcctagagctcctgtccct

SEQ ID NO: 2735992 - DNA, 22 bp, Homo sapiens
gtcctaggccacaccatctcct

SEQ ID NO: 2735993 - DNA, 20 bp, Homo sapiens
gtcctcaaagaagtggttct

SEQ ID NO: 2735994 - DNA, 19 bp, Homo sapiens
gtcctcggcccatctgtcc

SEQ ID NO: 2735995 - DNA, 12 bp, Homo sapiens
gtcctctccacc

SEQ ID NO: 2735996 - DNA, 20 bp, Homo sapiens
gtcctctccacctagtggct

SEQ ID NO: 2735997 - DNA, 17 bp, Homo sapiens
gtcctgacttcaggggc

SEQ ID NO: 2735998 - DNA, 20 bp, Homo sapiens
gtcctgaggagtgtcctgtc

SEQ ID NO: 2735999 - DNA, 22 bp, Homo sapiens
gtcctgaggagtgtcctgtctg

SEQ ID NO: 2736000 - DNA, 14 bp, Homo sapiens
gtcctgctggcctg

SEQ ID NO: 2736001 - DNA, 16 bp, Homo sapiens
gtcctgctggcctgct

SEQ ID NO: 2736002 - DNA, 13 bp, Homo sapiens
gtcctggaatgaa

SEQ ID NO: 2736003 - DNA, 19 bp, Homo sapiens
gtcctggaatgaagcatgt

SEQ ID NO: 2736004 - DNA, 23 bp, Homo sapiens
gtcctggaccctggcctaaagaa

SEQ ID NO: 2736005 - DNA, 20 bp, Homo sapiens
gtcctgggagaacctcaggc

SEQ ID NO: 2736006 - DNA, 15 bp, Homo sapiens
gtcctggggctctgt

SEQ ID NO: 2736007 - DNA, 17 bp, Homo sapiens
gtcctggggctctgtgc

SEQ ID NO: 2736008 - DNA, 18 bp, Homo sapiens
gtcctggtacagcagggt

SEQ ID NO: 2736009 - DNA, 21 bp, Homo sapiens
gtcctggtacagcagggtctt

SEQ ID NO: 2736010 - DNA, 19 bp, Homo sapiens
gtcctgtcagtgccgccgc

SEQ ID NO: 2736011 - DNA, 19 bp, Homo sapiens
gtcctgtccggagcgaccc

SEQ ID NO: 2736012 - DNA, 15 bp, Homo sapiens
gtcctgtctgctggg

SEQ ID NO: 2736013 - DNA, 15 bp, Homo sapiens
gtccttactcagagc

SEQ ID NO: 2736014 - DNA, 20 bp, Homo sapiens
gtccttactcagagctgcgg

SEQ ID NO: 2736015 - DNA, 22 bp, Homo sapiens
gtccttactcagagctgcgggc

SEQ ID NO: 2736016 - DNA, 15 bp, Homo sapiens
gtcctttaggcagcc

SEQ ID NO: 2736017 - DNA, 21 bp, Homo sapiens
gtcctttaggcagcctgccgc

SEQ ID NO: 2736018 - DNA, 16 bp, Homo sapiens
gtcctttgttgctgtt

SEQ ID NO: 2736019 - DNA, 17 bp, Homo sapiens
gtccttttgtaccatgg

SEQ ID NO: 2736020 - DNA, 14 bp, Homo sapiens
gtcctttttgtaac

SEQ ID NO: 2736021 - DNA, 16 bp, Homo sapiens
gtcgactttgagctgg

SEQ ID NO: 2736022 - DNA, 13 bp, Homo sapiens
gtcgcgctgcctg

SEQ ID NO: 2736023 - DNA, 17 bp, Homo sapiens
gtcgcgctgcctgtgtg

SEQ ID NO: 2736024 - DNA, 13 bp, Homo sapiens
gtcgtgtccagcc

SEQ ID NO: 2736025 - DNA, 16 bp, Homo sapiens
gtcgtgtctgctgttg

SEQ ID NO: 2736026 - DNA, 14 bp, Homo sapiens
gtctaaagagcttt

SEQ ID NO: 2736027 - DNA, 16 bp, Homo sapiens
gtctaaagtttacagt

SEQ ID NO: 2736028 - DNA, 20 bp, Homo sapiens
gtctactcattccccggggc

SEQ ID NO: 2736029 - DNA, 12 bp, Homo sapiens
gtctagtagaac

SEQ ID NO: 2736030 - DNA, 17 bp, Homo sapiens
gtctcaactactcagct

SEQ ID NO: 2736031 - DNA, 16 bp, Homo sapiens
gtctcaattttgtatt

SEQ ID NO: 2736032 - DNA, 18 bp, Homo sapiens
gtctcaattttgtattta

SEQ ID NO: 2736033 - DNA, 14 bp, Homo sapiens
gtctcacactcctc

SEQ ID NO: 2736034 - DNA, 16 bp, Homo sapiens
gtctcacactcctcct

SEQ ID NO: 2736035 - DNA, 20 bp, Homo sapiens
gtctcacactcctcctgcca

SEQ ID NO: 2736036 - DNA, 21 bp, Homo sapiens
gtctcacactcctcctgccag

SEQ ID NO: 2736037 - DNA, 24 bp, Homo sapiens
gtctcagactctttttgtacctgg

SEQ ID NO: 2736038 - DNA, 12 bp, Homo sapiens
gtctcaggagca

SEQ ID NO: 2736039 - DNA, 23 bp, Homo sapiens
gtctcccgcttggggcatttgtg

SEQ ID NO: 2736040 - DNA, 12 bp, Homo sapiens
gtctccctggcc

SEQ ID NO: 2736041 - DNA, 14 bp, Homo sapiens
gtctccctggccct

SEQ ID NO: 2736042 - DNA, 15 bp, Homo sapiens
gtctccctggccctc

SEQ ID NO: 2736043 - DNA, 16 bp, Homo sapiens
gtctccctggccctca

SEQ ID NO: 2736044 - DNA, 12 bp, Homo sapiens
gtctcctccacc

SEQ ID NO: 2736045 - DNA, 18 bp, Homo sapiens
gtctcctgtatcatttct

SEQ ID NO: 2736046 - DNA, 16 bp, Homo sapiens
gtctcggtggtaccag

SEQ ID NO: 2736047 - DNA, 12 bp, Homo sapiens
gtctctccagcc

SEQ ID NO: 2736048 - DNA, 14 bp, Homo sapiens
gtctctccagcctc

SEQ ID NO: 2736049 - DNA, 24 bp, Homo sapiens
gtctctccagcctcacagatgctg

SEQ ID NO: 2736050 - DNA, 12 bp, Homo sapiens
gtctctctgcct

SEQ ID NO: 2736051 - DNA, 14 bp, Homo sapiens
gtctctctgcctgc

SEQ ID NO: 2736052 - DNA, 17 bp, Homo sapiens
gtctctctgcctgctgg

SEQ ID NO: 2736053 - DNA, 18 bp, Homo sapiens
gtctctctgcctgctggg

SEQ ID NO: 2736054 - DNA, 21 bp, Homo sapiens
gtctctctgcctgctgggctc

SEQ ID NO: 2736055 - DNA, 19 bp, Homo sapiens
gtctctgcctggagcaggg

SEQ ID NO: 2736056 - DNA, 22 bp, Homo sapiens
gtctctgcctggagcaggggtg

SEQ ID NO: 2736057 - DNA, 15 bp, Homo sapiens
gtctcttctcagagc

SEQ ID NO: 2736058 - DNA, 16 bp, Homo sapiens
gtctcttctcagagca

SEQ ID NO: 2736059 - DNA, 17 bp, Homo sapiens
gtctcttgactggctca

SEQ ID NO: 2736060 - DNA, 13 bp, Homo sapiens
gtctgcttctgca

SEQ ID NO: 2736061 - DNA, 16 bp, Homo sapiens
gtctgtccaacccctc

SEQ ID NO: 2736062 - DNA, 22 bp, Homo sapiens
gtctgtccaacccctcccccac

SEQ ID NO: 2736063 - DNA, 15 bp, Homo sapiens
gtctgtctgctctta

SEQ ID NO: 2736064 - DNA, 16 bp, Homo sapiens
gtctgtctgctcttat

SEQ ID NO: 2736065 - DNA, 23 bp, Homo sapiens
gtctgtctgctcttatttttgta

SEQ ID NO: 2736066 - DNA, 20 bp, Homo sapiens
gtctgtctttgcaaaggact

SEQ ID NO: 2736067 - DNA, 21 bp, Homo sapiens
gtctgtgaaagtctcctgtat

SEQ ID NO: 2736068 - DNA, 13 bp, Homo sapiens
gtctgtgctctgt

SEQ ID NO: 2736069 - DNA, 22 bp, Homo sapiens
gtctgtgttgcgtgtcgtgggt

SEQ ID NO: 2736070 - DNA, 21 bp, Homo sapiens
gtctgttccccatggccactt

SEQ ID NO: 2736071 - DNA, 13 bp, Homo sapiens
gtcttactttgtg

SEQ ID NO: 2736072 - DNA, 17 bp, Homo sapiens
gtcttcactgctctgcc

SEQ ID NO: 2736073 - DNA, 16 bp, Homo sapiens
gtcttccaaccccagc

SEQ ID NO: 2736074 - DNA, 18 bp, Homo sapiens
gtcttccaaccccagctg

SEQ ID NO: 2736075 - DNA, 14 bp, Homo sapiens
gtcttcctgtgggg

SEQ ID NO: 2736076 - DNA, 17 bp, Homo sapiens
gtcttcttgtgtcctga

SEQ ID NO: 2736077 - DNA, 14 bp, Homo sapiens
gtcttgatctcctg

SEQ ID NO: 2736078 - DNA, 15 bp, Homo sapiens
gtcttgatctcctga

SEQ ID NO: 2736079 - DNA, 16 bp, Homo sapiens
gtcttggttagagaag

SEQ ID NO: 2736080 - DNA, 12 bp, Homo sapiens
gtctttctttgc

SEQ ID NO: 2736081 - DNA, 17 bp, Homo sapiens
gtctttctttgctgctg

SEQ ID NO: 2736082 - DNA, 19 bp, Homo sapiens
gtctttctttgctgctgtg

SEQ ID NO: 2736083 - DNA, 18 bp, Homo sapiens
ggttgaggggctcctgga

SEQ ID NO: 2736084 - DNA, 13 bp, Homo sapiens
ggttgcagggagc

SEQ ID NO: 2736085 - DNA, 22 bp, Homo sapiens
ggttggaaaagaaatcaatttt

SEQ ID NO: 2736086 - DNA, 17 bp, Homo sapiens
ggttggcgcaccctccc

SEQ ID NO: 2736087 - DNA, 12 bp, Homo sapiens
ggtttcaattta

SEQ ID NO: 2736088 - DNA, 21 bp, Homo sapiens
ggtttcccagtgagcctctgc

SEQ ID NO: 2736089 - DNA, 15 bp, Homo sapiens
gtaaaaagaaattgt

SEQ ID NO: 2736090 - DNA, 15 bp, Homo sapiens
gtaaaaagattatat

SEQ ID NO: 2736091 - DNA, 21 bp, Homo sapiens
gtaaaaagattatatatcata

SEQ ID NO: 2736092 - DNA, 14 bp, Homo sapiens
gtaaaatcttcagc

SEQ ID NO: 2736093 - DNA, 18 bp, Homo sapiens
gtaaatactccattattt

SEQ ID NO: 2736094 - DNA, 23 bp, Homo sapiens
gtaaatgaagggtcatttctctt

SEQ ID NO: 2736095 - DNA, 14 bp, Homo sapiens
gtaactcagacatt

SEQ ID NO: 2736096 - DNA, 18 bp, Homo sapiens
gtaactcagacattccaa

SEQ ID NO: 2736097 - DNA, 16 bp, Homo sapiens
gtaactcttggccaga

SEQ ID NO: 2736098 - DNA, 17 bp, Homo sapiens
gtaagacttgattggtt

SEQ ID NO: 2736099 - DNA, 16 bp, Homo sapiens
gtaagctctatctgca

SEQ ID NO: 2736100 - DNA, 20 bp, Homo sapiens
gtaagcttagattttctgta

SEQ ID NO: 2736101 - DNA, 18 bp, Homo sapiens
gtaagtaccactcaggcc

SEQ ID NO: 2736102 - DNA, 20 bp, Homo sapiens
gtaagtataacaaactatgt

SEQ ID NO: 2736103 - DNA, 19 bp, Homo sapiens
gtaagtttatgtctaaaga

SEQ ID NO: 2736104 - DNA, 13 bp, Homo sapiens
gtaataaatacac

SEQ ID NO: 2736105 - DNA, 15 bp, Homo sapiens
gtaataaatacacag

SEQ ID NO: 2736106 - DNA, 12 bp, Homo sapiens
gtaatatattgc

SEQ ID NO: 2736107 - DNA, 13 bp, Homo sapiens
gtaatatattgct

SEQ ID NO: 2736108 - DNA, 23 bp, Homo sapiens
gtaattattgtgatttcccgtgg

SEQ ID NO: 2736109 - DNA, 21 bp, Homo sapiens
gtaatttgtatctgaaggaga

SEQ ID NO: 2736110 - DNA, 17 bp, Homo sapiens
gtaatttttaaagcaaa

SEQ ID NO: 2736111 - DNA, 20 bp, Homo sapiens
gtacaaagatatgctaagca

SEQ ID NO: 2736112 - DNA, 21 bp, Homo sapiens
gtacagttatttatgcctctg

SEQ ID NO: 2736113 - DNA, 18 bp, Homo sapiens
gtacagttcataattcac

SEQ ID NO: 2736114 - DNA, 18 bp, Homo sapiens
gtacatcttgtaagacac

SEQ ID NO: 2736115 - DNA, 17 bp, Homo sapiens
gtacattcatctggagg

SEQ ID NO: 2736116 - DNA, 16 bp, Homo sapiens
gtaccacaccctgcct

SEQ ID NO: 2736117 - DNA, 20 bp, Homo sapiens
gtaccacaccctgcctgctg

SEQ ID NO: 2736118 - DNA, 22 bp, Homo sapiens
gtaccacaccctgcctgctgtg

SEQ ID NO: 2736119 - DNA, 17 bp, Homo sapiens
gtaccatattgctctta

SEQ ID NO: 2736120 - DNA, 18 bp, Homo sapiens
gtacccccgcccaggctg

SEQ ID NO: 2736121 - DNA, 23 bp, Homo sapiens
gtacccccgcccaggctggccag

SEQ ID NO: 2736122 - DNA, 15 bp, Homo sapiens
gtacctgattgtatt

SEQ ID NO: 2736123 - DNA, 17 bp, Homo sapiens
gtacctggtgacccctt

SEQ ID NO: 2736124 - DNA, 16 bp, Homo sapiens
gtaccttaatttgact

SEQ ID NO: 2736125 - DNA, 12 bp, Homo sapiens
gtactatctttg

SEQ ID NO: 2736126 - DNA, 14 bp, Homo sapiens
gtactatctttgtc

SEQ ID NO: 2736127 - DNA, 23 bp, Homo sapiens
gtactcaggaggctgaggggagg

SEQ ID NO: 2736128 - DNA, 16 bp, Homo sapiens
gtacttcagtcttgga

SEQ ID NO: 2736129 - DNA, 17 bp, Homo sapiens
gtacttcagtcttggag

SEQ ID NO: 2736130 - DNA, 20 bp, Homo sapiens
gtacttcccaattgccacat

SEQ ID NO: 2736131 - DNA, 11 bp, Homo sapiens
gtagaagccag

SEQ ID NO: 2736132 - DNA, 19 bp, Homo sapiens
gtagccccgggctgaccca

SEQ ID NO: 2736133 - DNA, 15 bp, Homo sapiens
gtagccttgcccgga

SEQ ID NO: 2736134 - DNA, 17 bp, Homo sapiens
gtagtcgtcaagttgca

SEQ ID NO: 2736135 - DNA, 11 bp, Homo sapiens
gtagtgtcttc

SEQ ID NO: 2736136 - DNA, 17 bp, Homo sapiens
gtagttccaggactcag

SEQ ID NO: 2736137 - DNA, 12 bp, Homo sapiens
gtataaggatct

SEQ ID NO: 2736138 - DNA, 17 bp, Homo sapiens
gtataaggatcttttgt

SEQ ID NO: 2736139 - DNA, 19 bp, Homo sapiens
gtataaggatcttttgtaa

SEQ ID NO: 2736140 - DNA, 18 bp, Homo sapiens
gtataattaattgtcatt

SEQ ID NO: 2736141 - DNA, 15 bp, Homo sapiens
gtataggataaatta

SEQ ID NO: 2736142 - DNA, 19 bp, Homo sapiens
gtatatctggccacactgg

SEQ ID NO: 2736143 - DNA, 16 bp, Homo sapiens
gtatatgtatatctat

SEQ ID NO: 2736144 - DNA, 17 bp, Homo sapiens
gtatatgtatatctata

SEQ ID NO: 2736145 - DNA, 14 bp, Homo sapiens
gtatattagtttga

SEQ ID NO: 2736146 - DNA, 14 bp, Homo sapiens
gtatcccactagcc

SEQ ID NO: 2736147 - DNA, 15 bp, Homo sapiens
gtatctgcatgtaaa

SEQ ID NO: 2736148 - DNA, 20 bp, Homo sapiens
gtatctgcatgtaaaatctt

SEQ ID NO: 2736149 - DNA, 17 bp, Homo sapiens
gtatctggtatctgcat

SEQ ID NO: 2736150 - DNA, 23 bp, Homo sapiens
gtatgggaagccatattcacacc

SEQ ID NO: 2736151 - DNA, 20 bp, Homo sapiens
gtatgtacagttcataaatt

SEQ ID NO: 2736152 - DNA, 13 bp, Homo sapiens
gtattagccagga

SEQ ID NO: 2736153 - DNA, 20 bp, Homo sapiens
gtatttaagaaagggaaagc

SEQ ID NO: 2736154 - DNA, 21 bp, Homo sapiens
gtatttaatgatttttgtgta

SEQ ID NO: 2736155 - DNA, 19 bp, Homo sapiens
gtattttaggcagggattt

SEQ ID NO: 2736156 - DNA, 16 bp, Homo sapiens
gtatttttatttaaat

SEQ ID NO: 2736157 - DNA, 20 bp, Homo sapiens
gtatttttgaaagaattcta

SEQ ID NO: 2736158 - DNA, 22 bp, Homo sapiens
gtattttttttttaaataaaag

SEQ ID NO: 2736159 - DNA, 18 bp, Homo sapiens
gtcaaagcggatgctggc

SEQ ID NO: 2736160 - DNA, 19 bp, Homo sapiens
gtcaacactcttcttgagc

SEQ ID NO: 2736161 - DNA, 20 bp, Homo sapiens
gtcaagttccctcctgcagc

SEQ ID NO: 2736162 - DNA, 17 bp, Homo sapiens
gtcaataactctgattt

SEQ ID NO: 2736163 - DNA, 16 bp, Homo sapiens
gtcacagctcttgttt

SEQ ID NO: 2736164 - DNA, 14 bp, Homo sapiens
gtcaccatgcaagg

SEQ ID NO: 2736165 - DNA, 15 bp, Homo sapiens
gtcaccatgcaaggg

SEQ ID NO: 2736166 - DNA, 16 bp, Homo sapiens
gtcaccctgcagagct

SEQ ID NO: 2736167 - DNA, 19 bp, Homo sapiens
gtcactggctgcctccact

SEQ ID NO: 2736168 - DNA, 16 bp, Homo sapiens
gtcagactgctgggac

SEQ ID NO: 2736169 - DNA, 18 bp, Homo sapiens
gtcagactggctggctgc

SEQ ID NO: 2736170 - DNA, 22 bp, Homo sapiens
gtcagactggctggctgcagtg

SEQ ID NO: 2736171 - DNA, 15 bp, Homo sapiens
gtcagtaaatactcc

SEQ ID NO: 2736172 - DNA, 22 bp, Homo sapiens
gtcataactagaactgaatttt

SEQ ID NO: 2736173 - DNA, 17 bp, Homo sapiens
gtcatcaaaacctgcgc

SEQ ID NO: 2736174 - DNA, 12 bp, Homo sapiens
gtcatgtgccac

SEQ ID NO: 2736175 - DNA, 19 bp, Homo sapiens
gtcattaagcgggatccca

SEQ ID NO: 2736176 - DNA, 14 bp, Homo sapiens
gtcattatttaaag

SEQ ID NO: 2736177 - DNA, 17 bp, Homo sapiens
gtcattcctaatgcatt

SEQ ID NO: 2736178 - DNA, 15 bp, Homo sapiens
gtcatttctcttttt

SEQ ID NO: 2736179 - DNA, 21 bp, Homo sapiens
gtcatttgacaacacatgtgg

SEQ ID NO: 2736180 - DNA, 22 bp, Homo sapiens
gtccaaaatatttgtgatttac

SEQ ID NO: 2736181 - DNA, 14 bp, Homo sapiens
gtccaacccagcct

SEQ ID NO: 2736182 - DNA, 15 bp, Homo sapiens
gtccaacctgcctgt

SEQ ID NO: 2736183 - DNA, 19 bp, Homo sapiens
gtccagaccattgtcttcc

SEQ ID NO: 2736184 - DNA, 20 bp, Homo sapiens
gtccagaccattgtcttcca

SEQ ID NO: 2736185 - DNA, 15 bp, Homo sapiens
gtccagccagctcct

SEQ ID NO: 2736186 - DNA, 21 bp, Homo sapiens
gtccagcttctcttgaaaact

SEQ ID NO: 2736187 - DNA, 23 bp, Homo sapiens
gtccagtcctttgttgctgttgc

SEQ ID NO: 2736188 - DNA, 22 bp, Homo sapiens
cttccaccagagcaggggctgc

SEQ ID NO: 2736189 - DNA, 16 bp, Homo sapiens
cttccaggcccccacc

SEQ ID NO: 2736190 - DNA, 12 bp, Homo sapiens
cttccatttcta

SEQ ID NO: 2736191 - DNA, 12 bp, Homo sapiens
cttcccccaagg

SEQ ID NO: 2736192 - DNA, 15 bp, Homo sapiens
cttcccccaccctgg

SEQ ID NO: 2736193 - DNA, 16 bp, Homo sapiens
cttcccccaccctggg

SEQ ID NO: 2736194 - DNA, 11 bp, Homo sapiens
cttcccctcca

SEQ ID NO: 2736195 - DNA, 22 bp, Homo sapiens
cttcccctcctacccctcccag

SEQ ID NO: 2736196 - DNA, 16 bp, Homo sapiens
cttccccttgtccctg

SEQ ID NO: 2736197 - DNA, 17 bp, Homo sapiens
cttccccttgtccctgg

SEQ ID NO: 2736198 - DNA, 18 bp, Homo sapiens
cttccccttgtccctggg

SEQ ID NO: 2736199 - DNA, 19 bp, Homo sapiens
cttccccttgtccctgggg

SEQ ID NO: 2736200 - DNA, 21 bp, Homo sapiens
cttccccttgtccctggggca

SEQ ID NO: 2736201 - DNA, 19 bp, Homo sapiens
cttccctccccacagtcct

SEQ ID NO: 2736202 - DNA, 15 bp, Homo sapiens
cttccctctgcctga

SEQ ID NO: 2736203 - DNA, 22 bp, Homo sapiens
cttccctgcttttctcccagaa

SEQ ID NO: 2736204 - DNA, 17 bp, Homo sapiens
cttccctgggcctcagc

SEQ ID NO: 2736205 - DNA, 13 bp, Homo sapiens
cttccctggggcc

SEQ ID NO: 2736206 - DNA, 16 bp, Homo sapiens
cttccctggggcccca

SEQ ID NO: 2736207 - DNA, 23 bp, Homo sapiens
cttcctacacccttggacttgag

SEQ ID NO: 2736208 - DNA, 14 bp, Homo sapiens
cttcctcatctgtg

SEQ ID NO: 2736209 - DNA, 15 bp, Homo sapiens
cttcctcatctgtgc

SEQ ID NO: 2736210 - DNA, 19 bp, Homo sapiens
cttcctcatctgtgcctgt

SEQ ID NO: 2736211 - DNA, 14 bp, Homo sapiens
cttcctctgagccg

SEQ ID NO: 2736212 - DNA, 22 bp, Homo sapiens
cttcctgacccggattggccct

SEQ ID NO: 2736213 - DNA, 18 bp, Homo sapiens
cttcctggaccggggcct

SEQ ID NO: 2736214 - DNA, 22 bp, Homo sapiens
cttcctggtgaggcccagcctg

SEQ ID NO: 2736215 - DNA, 21 bp, Homo sapiens
cttccttaattcactcccaca

SEQ ID NO: 2736216 - DNA, 13 bp, Homo sapiens
cttctcagagcag

SEQ ID NO: 2736217 - DNA, 22 bp, Homo sapiens
cttctcagagcagcactggggt

SEQ ID NO: 2736218 - DNA, 17 bp, Homo sapiens
ttaaattttaaggtaga

SEQ ID NO: 2736219 - DNA, 15 bp, Homo sapiens
ttaacaaagttactg

SEQ ID NO: 2736220 - DNA, 22 bp, Homo sapiens
ttaacaggttttcttctaatca

SEQ ID NO: 2736221 - DNA, 10 bp, Homo sapiens
ttaactctgc

SEQ ID NO: 2736222 - DNA, 16 bp, Homo sapiens
ttaactctgcaggaaa

SEQ ID NO: 2736223 - DNA, 20 bp, Homo sapiens
ttaagaaacaatttaaattg

SEQ ID NO: 2736224 - DNA, 12 bp, Homo sapiens
ttaagcatgagt

SEQ ID NO: 2736225 - DNA, 18 bp, Homo sapiens
ttaagcatgagtggcctt

SEQ ID NO: 2736226 - DNA, 17 bp, Homo sapiens
ttaataggataaattaa

SEQ ID NO: 2736227 - DNA, 19 bp, Homo sapiens
ttaataggatgaatgggaa

SEQ ID NO: 2736228 - DNA, 15 bp, Homo sapiens
ttaatctgttgtttg

SEQ ID NO: 2736229 - DNA, 20 bp, Homo sapiens
ttaatctgtttgtttggcac

SEQ ID NO: 2736230 - DNA, 18 bp, Homo sapiens
ttaatggaaacatgctgt

SEQ ID NO: 2736231 - DNA, 15 bp, Homo sapiens
ttaattcactcccac

SEQ ID NO: 2736232 - DNA, 12 bp, Homo sapiens
ttaattcattaa

SEQ ID NO: 2736233 - DNA, 20 bp, Homo sapiens
ttaattcattaatctgtttg

SEQ ID NO: 2736234 - DNA, 16 bp, Homo sapiens
ttaatttttataaata

SEQ ID NO: 2736235 - DNA, 15 bp, Homo sapiens
ttacaacaaacactg

SEQ ID NO: 2736236 - DNA, 20 bp, Homo sapiens
ttacagatcatataagcaag

SEQ ID NO: 2736237 - DNA, 15 bp, Homo sapiens
ttacagtaaataaat

SEQ ID NO: 2736238 - DNA, 16 bp, Homo sapiens
ttacagtgtatttaag

SEQ ID NO: 2736239 - DNA, 16 bp, Homo sapiens
ttacataatttgcaat

SEQ ID NO: 2736240 - DNA, 14 bp, Homo sapiens
ttacatacagtgat

SEQ ID NO: 2736241 - DNA, 15 bp, Homo sapiens
ttacatacagtgata

SEQ ID NO: 2736242 - DNA, 17 bp, Homo sapiens
ttacatgaattgcattt

SEQ ID NO: 2736243 - DNA, 15 bp, Homo sapiens
ttacatggctgtggt

SEQ ID NO: 2736244 - DNA, 10 bp, Homo sapiens
ttacatttca

SEQ ID NO: 2736245 - DNA, 20 bp, Homo sapiens
ttaccattattttacagtct

SEQ ID NO: 2736246 - DNA, 14 bp, Homo sapiens
ttacccttcctcat

SEQ ID NO: 2736247 - DNA, 22 bp, Homo sapiens
ttacccttcctcatctgtgcct

SEQ ID NO: 2736248 - DNA, 12 bp, Homo sapiens
ttactaaagtca

SEQ ID NO: 2736249 - DNA, 15 bp, Homo sapiens
ttactcagagctgcg

SEQ ID NO: 2736250 - DNA, 22 bp, Homo sapiens
ttactcagtgaaatcatattaa

SEQ ID NO: 2736251 - DNA, 15 bp, Homo sapiens
ttactgacagaaatg

SEQ ID NO: 2736252 - DNA, 13 bp, Homo sapiens
ttactgtcccagg

SEQ ID NO: 2736253 - DNA, 20 bp, Homo sapiens
ttacttacaaaagcagcttt

SEQ ID NO: 2736254 - DNA, 17 bp, Homo sapiens
ttacttccatgatactt

SEQ ID NO: 2736255 - DNA, 11 bp, Homo sapiens
ttacttctctt

SEQ ID NO: 2736256 - DNA, 14 bp, Homo sapiens
ttactttttaaaca

SEQ ID NO: 2736257 - DNA, 18 bp, Homo sapiens
ttactttttaaacagtgt

SEQ ID NO: 2736258 - DNA, 16 bp, Homo sapiens
ttagaaaatcagattt

SEQ ID NO: 2736259 - DNA, 22 bp, Homo sapiens
ttagaaccagccgtattttaca

SEQ ID NO: 2736260 - DNA, 19 bp, Homo sapiens
ttagaagatctgcttccct

SEQ ID NO: 2736261 - DNA, 18 bp, Homo sapiens
ttagaatcaagtctgtga

SEQ ID NO: 2736262 - DNA, 14 bp, Homo sapiens
ttagagtcagcctt

SEQ ID NO: 2736263 - DNA, 14 bp, Homo sapiens
ttagcaatcatttt

SEQ ID NO: 2736264 - DNA, 17 bp, Homo sapiens
ttagcaatcattttata

SEQ ID NO: 2736265 - DNA, 20 bp, Homo sapiens
ttagcttcatatctaattta

SEQ ID NO: 2736266 - DNA, 21 bp, Homo sapiens
ttaggagttcgagaccagcct

SEQ ID NO: 2736267 - DNA, 19 bp, Homo sapiens
ttaggcagggatttgagga

SEQ ID NO: 2736268 - DNA, 13 bp, Homo sapiens
ttaggtgccaggc

SEQ ID NO: 2736269 - DNA, 20 bp, Homo sapiens
ttagtcattattattacttt

SEQ ID NO: 2736270 - DNA, 23 bp, Homo sapiens
ttataaacctctaatttattttg

SEQ ID NO: 2736271 - DNA, 14 bp, Homo sapiens
tgcaatgtcctgca

SEQ ID NO: 2736272 - DNA, 18 bp, Homo sapiens
tgcaatgtttttgtgtag

SEQ ID NO: 2736273 - DNA, 19 bp, Homo sapiens
tgcaatgtttttgtgtaga

SEQ ID NO: 2736274 - DNA, 14 bp, Homo sapiens
tgcaattgagggct

SEQ ID NO: 2736275 - DNA, 18 bp, Homo sapiens
tgcaatttcaggaattta

SEQ ID NO: 2736276 - DNA, 17 bp, Homo sapiens
tgcacagacctcagaga

SEQ ID NO: 2736277 - DNA, 19 bp, Homo sapiens
tgcacagagggcgctcctg

SEQ ID NO: 2736278 - DNA, 16 bp, Homo sapiens
tgcacagcttcctgag

SEQ ID NO: 2736279 - DNA, 18 bp, Homo sapiens
tgcacattggaagctccc

SEQ ID NO: 2736280 - DNA, 12 bp, Homo sapiens
tgcaccaaagac

SEQ ID NO: 2736281 - DNA, 16 bp, Homo sapiens
tgcaccaacccagccg

SEQ ID NO: 2736282 - DNA, 16 bp, Homo sapiens
tgcaccattctttctt

SEQ ID NO: 2736283 - DNA, 15 bp, Homo sapiens
tgcaccccctcctgc

SEQ ID NO: 2736284 - DNA, 16 bp, Homo sapiens
tgcacctatggcccag

SEQ ID NO: 2736285 - DNA, 20 bp, Homo sapiens
tgcacctgccagcctggctt

SEQ ID NO: 2736286 - DNA, 18 bp, Homo sapiens
tgcacgtcaccctcctga

SEQ ID NO: 2736287 - DNA, 21 bp, Homo sapiens
tgcacgttaacagcgtgtcaa

SEQ ID NO: 2736288 - DNA, 18 bp, Homo sapiens
tgcactaaataaactact

SEQ ID NO: 2736289 - DNA, 19 bp, Homo sapiens
tgcactaaataaactactt

SEQ ID NO: 2736290 - DNA, 15 bp, Homo sapiens
tgcactccagcctgg

SEQ ID NO: 2736291 - DNA, 16 bp, Homo sapiens
tgcactccagcctggg

SEQ ID NO: 2736292 - DNA, 18 bp, Homo sapiens
tgcactccagcctgggcg

SEQ ID NO: 2736293 - DNA, 20 bp, Homo sapiens
tgcactctctctctgttaaa

SEQ ID NO: 2736294 - DNA, 12 bp, Homo sapiens
tgcactctgtgc

SEQ ID NO: 2736295 - DNA, 15 bp, Homo sapiens
tgcactgtatgctgg

SEQ ID NO: 2736296 - DNA, 15 bp, Homo sapiens
tgcactgtcctgctc

SEQ ID NO: 2736297 - DNA, 21 bp, Homo sapiens
tgcactgtcctgctccacagt

SEQ ID NO: 2736298 - DNA, 22 bp, Homo sapiens
tgcactgtcctgctccacagtg

SEQ ID NO: 2736299 - DNA, 23 bp, Homo sapiens
tgcactgtcctgctccacagtgt

SEQ ID NO: 2736300 - DNA, 13 bp, Homo sapiens
tgcagaggggaaa

SEQ ID NO: 2736301 - DNA, 13 bp, Homo sapiens
tgcagaggggcag

SEQ ID NO: 2736302 - DNA, 21 bp, Homo sapiens
tgcagaggggcaggccctgca

SEQ ID NO: 2736303 - DNA, 22 bp, Homo sapiens
tgcagaggggcaggccctgcac

SEQ ID NO: 2736304 - DNA, 21 bp, Homo sapiens
tgcagaggggctttctggaga

SEQ ID NO: 2736305 - DNA, 16 bp, Homo sapiens
tgcagaggtgagcaga

SEQ ID NO: 2736306 - DNA, 21 bp, Homo sapiens
tgcagccccgcgcctccttcc

SEQ ID NO: 2736307 - DNA, 22 bp, Homo sapiens
tgcagccttaaacagtgtccag

SEQ ID NO: 2736308 - DNA, 18 bp, Homo sapiens
tgcagcttcctgtcaaca

SEQ ID NO: 2736309 - DNA, 18 bp, Homo sapiens
tgcaggaaatcagagctg

SEQ ID NO: 2736310 - DNA, 19 bp, Homo sapiens
tgcaggaaatcagagctgg

SEQ ID NO: 2736311 - DNA, 17 bp, Homo sapiens
tgcaggcccagcagact

SEQ ID NO: 2736312 - DNA, 24 bp, Homo sapiens
tgcagggaggaggtggcagccctg

SEQ ID NO: 2736313 - DNA, 18 bp, Homo sapiens
tgcaggggactgggccat

SEQ ID NO: 2736314 - DNA, 19 bp, Homo sapiens
tgcaggtctccatgaagaa

SEQ ID NO: 2736315 - DNA, 17 bp, Homo sapiens
gctaccctccctgctgt

SEQ ID NO: 2736316 - DNA, 15 bp, Homo sapiens
gctactcagaagcct

SEQ ID NO: 2736317 - DNA, 18 bp, Homo sapiens
gctactcagaagcctgag

SEQ ID NO: 2736318 - DNA, 18 bp, Homo sapiens
gctagctatttctatgta

SEQ ID NO: 2736319 - DNA, 23 bp, Homo sapiens
gctaggggaaggactggccgtgg

SEQ ID NO: 2736320 - DNA, 23 bp, Homo sapiens
gctatattttcatgacttttcca

SEQ ID NO: 2736321 - DNA, 15 bp, Homo sapiens
gctattcccttctga

SEQ ID NO: 2736322 - DNA, 18 bp, Homo sapiens
gctattcccttctgatct

SEQ ID NO: 2736323 - DNA, 14 bp, Homo sapiens
gctatttctatgta

SEQ ID NO: 2736324 - DNA, 17 bp, Homo sapiens
gctcagagctgctgagc

SEQ ID NO: 2736325 - DNA, 20 bp, Homo sapiens
gctcagagctgctgagcagg

SEQ ID NO: 2736326 - DNA, 16 bp, Homo sapiens
gctcaggaggcttgga

SEQ ID NO: 2736327 - DNA, 21 bp, Homo sapiens
gctcagtctcaggagcatggg

SEQ ID NO: 2736328 - DNA, 17 bp, Homo sapiens
gctcagtgatctcactt

SEQ ID NO: 2736329 - DNA, 16 bp, Homo sapiens
gctcattgtggccagt

SEQ ID NO: 2736330 - DNA, 23 bp, Homo sapiens
gctcccagtgtcttcctgtgggg

SEQ ID NO: 2736331 - DNA, 15 bp, Homo sapiens
gctcccccgggaggg

SEQ ID NO: 2736332 - DNA, 21 bp, Homo sapiens
gctcccccgggaggggcccgc

SEQ ID NO: 2736333 - DNA, 20 bp, Homo sapiens
gctcccctgaggctggcatc

SEQ ID NO: 2736334 - DNA, 19 bp, Homo sapiens
gctccccttgcccttcctg

SEQ ID NO: 2736335 - DNA, 19 bp, Homo sapiens
gctcccgagctactctctt

SEQ ID NO: 2736336 - DNA, 20 bp, Homo sapiens
gctcccgagctactctcttg

SEQ ID NO: 2736337 - DNA, 15 bp, Homo sapiens
gctccctcctggagc

SEQ ID NO: 2736338 - DNA, 20 bp, Homo sapiens
gctccctggtgagggagcct

SEQ ID NO: 2736339 - DNA, 22 bp, Homo sapiens
gctccctggtgagggagcctcg

SEQ ID NO: 2736340 - DNA, 15 bp, Homo sapiens
gctcctagcccagca

SEQ ID NO: 2736341 - DNA, 12 bp, Homo sapiens
gctcctcccctg

SEQ ID NO: 2736342 - DNA, 15 bp, Homo sapiens
gctcctcccctgccg

SEQ ID NO: 2736343 - DNA, 17 bp, Homo sapiens
gctcctcccctgccgcc

SEQ ID NO: 2736344 - DNA, 19 bp, Homo sapiens
gctcctcccctgccgcctc

SEQ ID NO: 2736345 - DNA, 18 bp, Homo sapiens
gctcctccctctgcctca

SEQ ID NO: 2736346 - DNA, 22 bp, Homo sapiens
gctcctgctcattgtggccagt

SEQ ID NO: 2736347 - DNA, 12 bp, Homo sapiens
gctcctgtccct

SEQ ID NO: 2736348 - DNA, 12 bp, Homo sapiens
gctcctgtgccc

SEQ ID NO: 2736349 - DNA, 17 bp, Homo sapiens
gctcgccccacccaggg

SEQ ID NO: 2736350 - DNA, 20 bp, Homo sapiens
gctctacacaacatgtatgt

SEQ ID NO: 2736351 - DNA, 19 bp, Homo sapiens
gctctaccctgcagcttgg

SEQ ID NO: 2736352 - DNA, 18 bp, Homo sapiens
gctctatgtgggaaaaaa

SEQ ID NO: 2736353 - DNA, 19 bp, Homo sapiens
gctctcggcttcaccaggg

SEQ ID NO: 2736354 - DNA, 15 bp, Homo sapiens
gctctgaggagtgga

SEQ ID NO: 2736355 - DNA, 18 bp, Homo sapiens
gctctgccccagctctgg

SEQ ID NO: 2736356 - DNA, 19 bp, Homo sapiens
gctctgccccagctctggc

SEQ ID NO: 2736357 - DNA, 23 bp, Homo sapiens
gctctgcccccaactcccggagg

SEQ ID NO: 2736358 - DNA, 15 bp, Homo sapiens
gctctgcctcccgtg

SEQ ID NO: 2736359 - DNA, 15 bp, Homo sapiens
gctctgcctctaact

SEQ ID NO: 2736360 - DNA, 22 bp, Homo sapiens
gctctgcctctaactccctcct

SEQ ID NO: 2736361 - DNA, 22 bp, Homo sapiens
gctctgctggaagaactgcatg

SEQ ID NO: 2736362 - DNA, 20 bp, Homo sapiens
gctctgcttttcctgtctgt

SEQ ID NO: 2736363 - DNA, 15 bp, Homo sapiens
gctctggcctccaag

SEQ ID NO: 2736364 - DNA, 16 bp, Homo sapiens
gctctgtcaccctggc

SEQ ID NO: 2736365 - DNA, 19 bp, Homo sapiens
gctctgtcaccctggccac

SEQ ID NO: 2736366 - DNA, 20 bp, Homo sapiens
gctctgtcaccctggccacc

SEQ ID NO: 2736367 - DNA, 13 bp, Homo sapiens
gctctgtccttgt

SEQ ID NO: 2736368 - DNA, 24 bp, Homo sapiens
gctctgtgggctgcactctgtgcc

SEQ ID NO: 2736369 - DNA, 17 bp, Homo sapiens
gctcttacttcccccac

SEQ ID NO: 2736370 - DNA, 23 bp, Homo sapiens
gctcttacttcccccaccctggg

SEQ ID NO: 2736371 - DNA, 14 bp, Homo sapiens
gctgaacagtgctc

SEQ ID NO: 2736372 - DNA, 19 bp, Homo sapiens
gctgaacagtgctctgcct

SEQ ID NO: 2736373 - DNA, 18 bp, Homo sapiens
gctgacagagccagaggc

SEQ ID NO: 2736374 - DNA, 14 bp, Homo sapiens
gctgagactgcggg

SEQ ID NO: 2736375 - DNA, 14 bp, Homo sapiens
gctgagctggccta

SEQ ID NO: 2736376 - DNA, 14 bp, Homo sapiens
gctgaggcaccaga

SEQ ID NO: 2736377 - DNA, 13 bp, Homo sapiens
gctgaggcctccc

SEQ ID NO: 2736378 - DNA, 16 bp, Homo sapiens
gctgagggcatctctg

SEQ ID NO: 2736379 - DNA, 20 bp, Homo sapiens
gctgagggcatctctgagtg

SEQ ID NO: 2736380 - DNA, 22 bp, Homo sapiens
gctgaggggaggatcactggag

SEQ ID NO: 2736381 - DNA, 16 bp, Homo sapiens
gctgatgctgggctgg

SEQ ID NO: 2736382 - DNA, 16 bp, Homo sapiens
gctgcaattgagggct

SEQ ID NO: 2736383 - DNA, 16 bp, Homo sapiens
gctgcaccaacccagc

SEQ ID NO: 2736384 - DNA, 19 bp, Homo sapiens
gctgcaccaacccagccgc

SEQ ID NO: 2736385 - DNA, 21 bp, Homo sapiens
gctgcaccaacccagccgctg

SEQ ID NO: 2736386 - DNA, 21 bp, Homo sapiens
gctgcacctgccagcctggct

SEQ ID NO: 2736387 - DNA, 17 bp, Homo sapiens
gctgcacgtcaccctcc

SEQ ID NO: 2736388 - DNA, 14 bp, Homo sapiens
gctgcactctgtgc

SEQ ID NO: 2736389 - DNA, 16 bp, Homo sapiens
gctgcactctgtgccc

SEQ ID NO: 2736390 - DNA, 19 bp, Homo sapiens
gctgcactctgtgcccatg

SEQ ID NO: 2736391 - DNA, 13 bp, Homo sapiens
gctgcagaggggc

SEQ ID NO: 2736392 - DNA, 21 bp, Homo sapiens
gctgcagaggggcaggccctg

SEQ ID NO: 2736393 - DNA, 13 bp, Homo sapiens
gctgccactctgc

SEQ ID NO: 2736394 - DNA, 16 bp, Homo sapiens
gctgccactctgctgc

SEQ ID NO: 2736395 - DNA, 22 bp, Homo sapiens
gctgccatggcgtgtccctctc

SEQ ID NO: 2736396 - DNA, 14 bp, Homo sapiens
gctgcccgctccca

SEQ ID NO: 2736397 - DNA, 17 bp, Homo sapiens
gctgcccggcgccctct

SEQ ID NO: 2736398 - DNA, 12 bp, Homo sapiens
gctgcctccact

SEQ ID NO: 2736399 - DNA, 20 bp, Homo sapiens
gctgcctccactcccacttc

SEQ ID NO: 2736400 - DNA, 15 bp, Homo sapiens
gctgcctgtacagaa

SEQ ID NO: 2736401 - DNA, 14 bp, Homo sapiens
gctgcgggctgagg

SEQ ID NO: 2736402 - DNA, 15 bp, Homo sapiens
gctgcgggctgaggg

SEQ ID NO: 2736403 - DNA, 21 bp, Homo sapiens
gctgcgtcagaccagtactgg

SEQ ID NO: 2736404 - DNA, 23 bp, Homo sapiens
gctgctaatcctgaggctggtag

SEQ ID NO: 2736405 - DNA, 17 bp, Homo sapiens
gctgctaccctccctgc

SEQ ID NO: 2736406 - DNA, 23 bp, Homo sapiens
gctgctgagcaggaaccggaggg

SEQ ID NO: 2736407 - DNA, 17 bp, Homo sapiens
gctgctgccactctgct

SEQ ID NO: 2736408 - DNA, 18 bp, Homo sapiens
gctgctggcccacagctc

SEQ ID NO: 2736409 - DNA, 20 bp, Homo sapiens
gctgctggcccacagctctg

SEQ ID NO: 2736410 - DNA, 18 bp, Homo sapiens
gctggaagaactgcatgg

SEQ ID NO: 2736411 - DNA, 22 bp, Homo sapiens
gctggaaggtactgaaggcttc

SEQ ID NO: 2736412 - DNA, 13 bp, Homo sapiens
gctggacaaccca

SEQ ID NO: 2736413 - DNA, 16 bp, Homo sapiens
gctggacggcattcct

SEQ ID NO: 2736414 - DNA, 16 bp, Homo sapiens
gctggagaagcccatg

SEQ ID NO: 2736415 - DNA, 16 bp, Homo sapiens
gctggatggctcccct

SEQ ID NO: 2736416 - DNA, 20 bp, Homo sapiens
gctggcaatgccctacctgc

SEQ ID NO: 2736417 - DNA, 17 bp, Homo sapiens
gctggcagcctccagtg

SEQ ID NO: 2736418 - DNA, 12 bp, Homo sapiens
gctggcagggcc

SEQ ID NO: 2736419 - DNA, 15 bp, Homo sapiens
gctggcatcctggct

SEQ ID NO: 2736420 - DNA, 17 bp, Homo sapiens
gctggcatcctggctgg

SEQ ID NO: 2736421 - DNA, 21 bp, Homo sapiens
gctggcatcctggctggctgt

SEQ ID NO: 2736422 - DNA, 13 bp, Homo sapiens
gctggccacagaa

SEQ ID NO: 2736423 - DNA, 14 bp, Homo sapiens
gctggccagcccca

SEQ ID NO: 2736424 - DNA, 18 bp, Homo sapiens
gctggccagccccacagc

SEQ ID NO: 2736425 - DNA, 21 bp, Homo sapiens
gctggccagccccacagccca

SEQ ID NO: 2736426 - DNA, 22 bp, Homo sapiens
gctggccagccccacagcccac

SEQ ID NO: 2736427 - DNA, 15 bp, Homo sapiens
gctggcccacagctc

SEQ ID NO: 2736428 - DNA, 18 bp, Homo sapiens
gctggcccacagctctgc

SEQ ID NO: 2736429 - DNA, 22 bp, Homo sapiens
gctggcctctagaacacccact

SEQ ID NO: 2736430 - DNA, 11 bp, Homo sapiens
gctggcctgct

SEQ ID NO: 2736431 - DNA, 13 bp, Homo sapiens
gctggcctgctct

SEQ ID NO: 2736432 - DNA, 16 bp, Homo sapiens
gctggcggcgcagagg

SEQ ID NO: 2736433 - DNA, 14 bp, Homo sapiens
gctggctgcagtga

SEQ ID NO: 2736434 - DNA, 12 bp, Homo sapiens
gctggctgctgg

SEQ ID NO: 2736435 - DNA, 14 bp, Homo sapiens
gctggctggggcct

SEQ ID NO: 2736436 - DNA, 16 bp, Homo sapiens
gctggctgtgtcctct

SEQ ID NO: 2736437 - DNA, 22 bp, Homo sapiens
gctgggaccccagctagggctg

SEQ ID NO: 2736438 - DNA, 15 bp, Homo sapiens
gctgggcccacagcc

SEQ ID NO: 2736439 - DNA, 16 bp, Homo sapiens
ggcaggtctgggccag

SEQ ID NO: 2736440 - DNA, 23 bp, Homo sapiens
ggcagtgaacacactcagcagcc

SEQ ID NO: 2736441 - DNA, 20 bp, Homo sapiens
ggcagttctgtgtcctcgca

SEQ ID NO: 2736442 - DNA, 23 bp, Homo sapiens
ggcatcacagggcagagccggga

SEQ ID NO: 2736443 - DNA, 15 bp, Homo sapiens
ggcatcaggaaagga

SEQ ID NO: 2736444 - DNA, 14 bp, Homo sapiens
ggcatcctggctgg

SEQ ID NO: 2736445 - DNA, 16 bp, Homo sapiens
ggcatcctggctggct

SEQ ID NO: 2736446 - DNA, 18 bp, Homo sapiens
ggcatcctggctggctgt

SEQ ID NO: 2736447 - DNA, 16 bp, Homo sapiens
ggcatccttctgcctt

SEQ ID NO: 2736448 - DNA, 19 bp, Homo sapiens
ggcatccttctgccttttt

SEQ ID NO: 2736449 - DNA, 20 bp, Homo sapiens
ggcatctctgagtgtctctg

SEQ ID NO: 2736450 - DNA, 22 bp, Homo sapiens
ggcatctctgagtgtctctgcc

SEQ ID NO: 2736451 - DNA, 23 bp, Homo sapiens
ggcatctctgagtgtctctgcct

SEQ ID NO: 2736452 - DNA, 16 bp, Homo sapiens
ggcatcttgctgctaa

SEQ ID NO: 2736453 - DNA, 21 bp, Homo sapiens
ggcatgacactctagtgactt

SEQ ID NO: 2736454 - DNA, 13 bp, Homo sapiens
ggcatgctggggc

SEQ ID NO: 2736455 - DNA, 21 bp, Homo sapiens
ggcattctctctgctcagtga

SEQ ID NO: 2736456 - DNA, 18 bp, Homo sapiens
ggcattggcagcaggtgc

SEQ ID NO: 2736457 - DNA, 21 bp, Homo sapiens
ggcattggcagcaggtgctgc

SEQ ID NO: 2736458 - DNA, 22 bp, Homo sapiens
ggcatttggtgagagtcaaagc

SEQ ID NO: 2736459 - DNA, 15 bp, Homo sapiens
ggccaacaaggactc

SEQ ID NO: 2736460 - DNA, 17 bp, Homo sapiens
ggccaaggtttcccagt

SEQ ID NO: 2736461 - DNA, 23 bp, Homo sapiens
ggccaaggtttcccagtgagcct

SEQ ID NO: 2736462 - DNA, 21 bp, Homo sapiens
ggccaccagcttccctctgcc

SEQ ID NO: 2736463 - DNA, 24 bp, Homo sapiens
ggccaccagcttccctctgcctga

SEQ ID NO: 2736464 - DNA, 16 bp, Homo sapiens
ggccacgtctgtgctc

SEQ ID NO: 2736465 - DNA, 17 bp, Homo sapiens
ggccactccccagtgct

SEQ ID NO: 2736466 - DNA, 15 bp, Homo sapiens
ggccagcaggcagcg

SEQ ID NO: 2736467 - DNA, 17 bp, Homo sapiens
ggccagcaggcagcgcc

SEQ ID NO: 2736468 - DNA, 18 bp, Homo sapiens
ggccagcaggcagcgcct

SEQ ID NO: 2736469 - DNA, 13 bp, Homo sapiens
ggccagccccaca

SEQ ID NO: 2736470 - DNA, 23 bp, Homo sapiens
ggccagccccacagcccacgtcc

SEQ ID NO: 2736471 - DNA, 14 bp, Homo sapiens
ggccagtcctagag

SEQ ID NO: 2736472 - DNA, 15 bp, Homo sapiens
ggccagtcctagagc

SEQ ID NO: 2736473 - DNA, 18 bp, Homo sapiens
ggccagtcctagagctcc

SEQ ID NO: 2736474 - DNA, 24 bp, Homo sapiens
ggccagtcctagagctcctgtccc

SEQ ID NO: 2736475 - DNA, 18 bp, Homo sapiens
ggccatcttccaggtggg

SEQ ID NO: 2736476 - DNA, 20 bp, Homo sapiens
ggcccagagcgaggaaagga

SEQ ID NO: 2736477 - DNA, 15 bp, Homo sapiens
ggcccagccactgca

SEQ ID NO: 2736478 - DNA, 12 bp, Homo sapiens
ggcccagcctgt

SEQ ID NO: 2736479 - DNA, 14 bp, Homo sapiens
ggcccagctccccc

SEQ ID NO: 2736480 - DNA, 13 bp, Homo sapiens
ggcccaggccatc

SEQ ID NO: 2736481 - DNA, 16 bp, Homo sapiens
ggcccatcagtgtacc

SEQ ID NO: 2736482 - DNA, 13 bp, Homo sapiens
ggcccatcccccc

SEQ ID NO: 2736483 - DNA, 18 bp, Homo sapiens
ggcccatcccccctcacc

SEQ ID NO: 2736484 - DNA, 19 bp, Homo sapiens
ggcccatcccccctcacca

SEQ ID NO: 2736485 - DNA, 20 bp, Homo sapiens
ggcccatctgtccatcctcc

SEQ ID NO: 2736486 - DNA, 23 bp, Homo sapiens
ggcccatctgtccatcctcctct

SEQ ID NO: 2736487 - DNA, 11 bp, Homo sapiens
ggccccagcct

SEQ ID NO: 2736488 - DNA, 12 bp, Homo sapiens
ggccccagcctg

SEQ ID NO: 2736489 - DNA, 20 bp, Homo sapiens
ggccccagcctggcccagct

SEQ ID NO: 2736490 - DNA, 13 bp, Homo sapiens
ggccccaggccct

SEQ ID NO: 2736491 - DNA, 22 bp, Homo sapiens
ggcccccagagacctttgccca

SEQ ID NO: 2736492 - DNA, 23 bp, Homo sapiens
ggcccctcaggggaagctgctag

SEQ ID NO: 2736493 - DNA, 14 bp, Homo sapiens
ggccccttctccag

SEQ ID NO: 2736494 - DNA, 21 bp, Homo sapiens
ggccccttctccagcaagcag

SEQ ID NO: 2736495 - DNA, 23 bp, Homo sapiens
ggccccttctccagcaagcagtg

SEQ ID NO: 2736496 - DNA, 17 bp, Homo sapiens
ggcccgcttgcctcggc

SEQ ID NO: 2736497 - DNA, 19 bp, Homo sapiens
ggcccgcttgcctcggctc

SEQ ID NO: 2736498 - DNA, 23 bp, Homo sapiens
ggcccgcttgcctcggctcctgc

SEQ ID NO: 2736499 - DNA, 20 bp, Homo sapiens
ggcccgttgtctccctggcc

SEQ ID NO: 2736500 - DNA, 22 bp, Homo sapiens
ggcccgttgtctccctggccct

SEQ ID NO: 2736501 - DNA, 21 bp, Homo sapiens
ggccctaggattcctccccca

SEQ ID NO: 2736502 - DNA, 22 bp, Homo sapiens
ggccctaggattcctcccccag

SEQ ID NO: 2736503 - DNA, 23 bp, Homo sapiens
ggccctcaaggcctcccacagtg

SEQ ID NO: 2736504 - DNA, 12 bp, Homo sapiens
ggccctgcccct

SEQ ID NO: 2736505 - DNA, 14 bp, Homo sapiens
ggccctgcccctcc

SEQ ID NO: 2736506 - DNA, 17 bp, Homo sapiens
ggccctgcccctccccc

SEQ ID NO: 2736507 - DNA, 12 bp, Homo sapiens
ggccggccctgc

SEQ ID NO: 2736508 - DNA, 15 bp, Homo sapiens
ggccggccctgcccc

SEQ ID NO: 2736509 - DNA, 16 bp, Homo sapiens
ggccggccctgcccct

SEQ ID NO: 2736510 - DNA, 13 bp, Homo sapiens
ggcctcccacagt

SEQ ID NO: 2736511 - DNA, 14 bp, Homo sapiens
ggcctcccacagtg

SEQ ID NO: 2736512 - DNA, 18 bp, Homo sapiens
ggcctcgcctggcctgag

SEQ ID NO: 2736513 - DNA, 19 bp, Homo sapiens
ggcctcggaggctcctccc

SEQ ID NO: 2736514 - DNA, 20 bp, Homo sapiens
ggcctctagaacacccactg

SEQ ID NO: 2736515 - DNA, 17 bp, Homo sapiens
ggcctctgtgcagacag

SEQ ID NO: 2736516 - DNA, 21 bp, Homo sapiens
ggcctcttggcacctgcctag

SEQ ID NO: 2736517 - DNA, 13 bp, Homo sapiens
ggcctgacctcca

SEQ ID NO: 2736518 - DNA, 14 bp, Homo sapiens
ggcctgacctccag

SEQ ID NO: 2736519 - DNA, 20 bp, Homo sapiens
ggcctgacctccagtcctgc

SEQ ID NO: 2736520 - DNA, 22 bp, Homo sapiens
ggcctgacctccagtcctgctg

SEQ ID NO: 2736521 - DNA, 18 bp, Homo sapiens
ggcctgccttgaagccac

SEQ ID NO: 2736522 - DNA, 11 bp, Homo sapiens
ggcctgctctg

SEQ ID NO: 2736523 - DNA, 13 bp, Homo sapiens
ggcctgctctgct

SEQ ID NO: 2736524 - DNA, 18 bp, Homo sapiens
ggcctgctgcgtcagacc

SEQ ID NO: 2736525 - DNA, 15 bp, Homo sapiens
ggccttccctcccca

SEQ ID NO: 2736526 - DNA, 17 bp, Homo sapiens
ggcgacagagcaagact

SEQ ID NO: 2736527 - DNA, 18 bp, Homo sapiens
ggcgcaccctcccctccc

SEQ ID NO: 2736528 - DNA, 13 bp, Homo sapiens
ggcgcagagggaa

SEQ ID NO: 2736529 - DNA, 11 bp, Homo sapiens
ggcgccctctg

SEQ ID NO: 2736530 - DNA, 13 bp, Homo sapiens
ggcgccctctgtc

SEQ ID NO: 2736531 - DNA, 17 bp, Homo sapiens
ggcgcgtctgccccacc

SEQ ID NO: 2736532 - DNA, 21 bp, Homo sapiens
ggcggcacgccaacagccccc

SEQ ID NO: 2736533 - DNA, 14 bp, Homo sapiens
ggcggcgcagaggg

SEQ ID NO: 2736534 - DNA, 16 bp, Homo sapiens
ggcggcgcagagggaa

SEQ ID NO: 2736535 - DNA, 22 bp, Homo sapiens
ggcgggcacctatagtcccagc

SEQ ID NO: 2736536 - DNA, 20 bp, Homo sapiens
ggcgtcgctggacaacccag

SEQ ID NO: 2736537 - DNA, 16 bp, Homo sapiens
ggcgtggtggcgggca

SEQ ID NO: 2736538 - DNA, 19 bp, Homo sapiens
ggctacaaaccaggagcaa

SEQ ID NO: 2736539 - DNA, 21 bp, Homo sapiens
ggctcacgcctatgatcccag

SEQ ID NO: 2736540 - DNA, 19 bp, Homo sapiens
ggctcactgcaagctctgc

SEQ ID NO: 2736541 - DNA, 12 bp, Homo sapiens
ggctcagctgtg

SEQ ID NO: 2736542 - DNA, 17 bp, Homo sapiens
ggctcagggaccacagc

SEQ ID NO: 2736543 - DNA, 16 bp, Homo sapiens
ggctcatcagaactga

SEQ ID NO: 2736544 - DNA, 14 bp, Homo sapiens
ggctccatgctggt

SEQ ID NO: 2736545 - DNA, 15 bp, Homo sapiens
ggctccccttgccct

SEQ ID NO: 2736546 - DNA, 16 bp, Homo sapiens
ggctccctcctggagc

SEQ ID NO: 2736547 - DNA, 15 bp, Homo sapiens
ggctccgtgagccct

SEQ ID NO: 2736548 - DNA, 21 bp, Homo sapiens
ggctcctccctctgcctcatc

SEQ ID NO: 2736549 - DNA, 14 bp, Homo sapiens
ggctcctgctgcac

SEQ ID NO: 2736550 - DNA, 23 bp, Homo sapiens
ggctcctgctgcaccaacccagc

SEQ ID NO: 2736551 - DNA, 14 bp, Homo sapiens
ggctcgccccaccc

SEQ ID NO: 2736552 - DNA, 18 bp, Homo sapiens
ggctcgccccacccaggg

SEQ ID NO: 2736553 - DNA, 21 bp, Homo sapiens
ggctctgccagcgtccccggc

SEQ ID NO: 2736554 - DNA, 12 bp, Homo sapiens
ggctctgcccca

SEQ ID NO: 2736555 - DNA, 23 bp, Homo sapiens
ggctctgccccagctctggcttc

SEQ ID NO: 2736556 - DNA, 15 bp, Homo sapiens
ggctctgtgggctgc

SEQ ID NO: 2736557 - DNA, 17 bp, Homo sapiens
ggctcttaactgttgct

SEQ ID NO: 2736558 - DNA, 20 bp, Homo sapiens
ggctgaacagtgctctgcct

SEQ ID NO: 2736559 - DNA, 21 bp, Homo sapiens
ggctgacccagtgtgtgctca

SEQ ID NO: 2736560 - DNA, 12 bp, Homo sapiens
ggctgagccctg

SEQ ID NO: 2736561 - DNA, 14 bp, Homo sapiens
ggctgagccctggc

SEQ ID NO: 2736562 - DNA, 16 bp, Homo sapiens
ggctgagccctggcag

SEQ ID NO: 2736563 - DNA, 15 bp, Homo sapiens
gtgtcactggctgcc

SEQ ID NO: 2736564 - DNA, 17 bp, Homo sapiens
gtgtcactggctgcctc

SEQ ID NO: 2736565 - DNA, 18 bp, Homo sapiens
gtgtcactggctgcctcc

SEQ ID NO: 2736566 - DNA, 19 bp, Homo sapiens
gtgtcactggctgcctcca

SEQ ID NO: 2736567 - DNA, 23 bp, Homo sapiens
gtgtcactggctgcctccactcc

SEQ ID NO: 2736568 - DNA, 15 bp, Homo sapiens
gtgtcagcactcagg

SEQ ID NO: 2736569 - DNA, 23 bp, Homo sapiens
gtgtccagaccattgtcttccaa

SEQ ID NO: 2736570 - DNA, 20 bp, Homo sapiens
gtgtccctttttgcagggga

SEQ ID NO: 2736571 - DNA, 14 bp, Homo sapiens
gtgtcctgtctgct

SEQ ID NO: 2736572 - DNA, 15 bp, Homo sapiens
gtgtcgtagccaagg

SEQ ID NO: 2736573 - DNA, 19 bp, Homo sapiens
gtgtctagtagaacaatgt

SEQ ID NO: 2736574 - DNA, 12 bp, Homo sapiens
gtgtctctgcct

SEQ ID NO: 2736575 - DNA, 15 bp, Homo sapiens
gtgtctgcagctcct

SEQ ID NO: 2736576 - DNA, 18 bp, Homo sapiens
gtgtctgcagctcctgga

SEQ ID NO: 2736577 - DNA, 18 bp, Homo sapiens
gtgtgaaagtcagatgcc

SEQ ID NO: 2736578 - DNA, 17 bp, Homo sapiens
gtgtgccccccatcctg

SEQ ID NO: 2736579 - DNA, 19 bp, Homo sapiens
gtgtgccccccatcctggc

SEQ ID NO: 2736580 - DNA, 22 bp, Homo sapiens
gtgtgccccccatcctggccca

SEQ ID NO: 2736581 - DNA, 16 bp, Homo sapiens
gtgtgcctgcagcccc

SEQ ID NO: 2736582 - DNA, 18 bp, Homo sapiens
gtgtgcctgcagccccgc

SEQ ID NO: 2736583 - DNA, 16 bp, Homo sapiens
gtgtgtaccacaccct

SEQ ID NO: 2736584 - DNA, 23 bp, Homo sapiens
gtgtgtaccacaccctgcctgct

SEQ ID NO: 2736585 - DNA, 14 bp, Homo sapiens
gtgtgtagccaagg

SEQ ID NO: 2736586 - DNA, 14 bp, Homo sapiens
gtgttaggcctggc

SEQ ID NO: 2736587 - DNA, 20 bp, Homo sapiens
gtgttcagtagttccaggac

SEQ ID NO: 2736588 - DNA, 17 bp, Homo sapiens
gtgttgacgtaagctct

SEQ ID NO: 2736589 - DNA, 18 bp, Homo sapiens
gtcacagggcctggggag

SEQ ID NO: 2736590 - DNA, 20 bp, Homo sapiens
gtcacccaggctggagtaca

SEQ ID NO: 2736591 - DNA, 13 bp, Homo sapiens
gtcaccctcctga

SEQ ID NO: 2736592 - DNA, 15 bp, Homo sapiens
gtcaccctcctgagc

SEQ ID NO: 2736593 - DNA, 16 bp, Homo sapiens
gtcactggctgcctcc

SEQ ID NO: 2736594 - DNA, 20 bp, Homo sapiens
gtcactggctgcctccactc

SEQ ID NO: 2736595 - DNA, 15 bp, Homo sapiens
gtcacttatcctgac

SEQ ID NO: 2736596 - DNA, 17 bp, Homo sapiens
gtcacttatcctgacac

SEQ ID NO: 2736597 - DNA, 14 bp, Homo sapiens
gtcagactgctggg

SEQ ID NO: 2736598 - DNA, 15 bp, Homo sapiens
gtcagactgctggga

SEQ ID NO: 2736599 - DNA, 20 bp, Homo sapiens
gtcagactgctgggactggc

SEQ ID NO: 2736600 - DNA, 13 bp, Homo sapiens
gtcagcactcagg

SEQ ID NO: 2736601 - DNA, 14 bp, Homo sapiens
gtcagcctcccaca

SEQ ID NO: 2736602 - DNA, 22 bp, Homo sapiens
gtcagccttgcatcaagggctt

SEQ ID NO: 2736603 - DNA, 20 bp, Homo sapiens
gtcaggagagccctctgctg

SEQ ID NO: 2736604 - DNA, 17 bp, Homo sapiens
gtcagtgccgccgcctc

SEQ ID NO: 2736605 - DNA, 17 bp, Homo sapiens
gtcataactagaactga

SEQ ID NO: 2736606 - DNA, 20 bp, Homo sapiens
gtcatcaaaacctgcgcagt

SEQ ID NO: 2736607 - DNA, 15 bp, Homo sapiens
gtcatggtcctggct

SEQ ID NO: 2736608 - DNA, 17 bp, Homo sapiens
gtcatgtgtatgagaag

SEQ ID NO: 2736609 - DNA, 21 bp, Homo sapiens
gtcattatttgataacatttt

SEQ ID NO: 2736610 - DNA, 18 bp, Homo sapiens
gtcattcctaatgcatta

SEQ ID NO: 2736611 - DNA, 18 bp, Homo sapiens
gtcattgtaacctcgtgt

SEQ ID NO: 2736612 - DNA, 11 bp, Homo sapiens
gtcatttaaaa

SEQ ID NO: 2736613 - DNA, 22 bp, Homo sapiens
gtccaaattgtctgtctgctct

SEQ ID NO: 2736614 - DNA, 15 bp, Homo sapiens
gtccaacccctcccc

SEQ ID NO: 2736615 - DNA, 16 bp, Homo sapiens
gtccaacctgcctgtg

SEQ ID NO: 2736616 - DNA, 16 bp, Homo sapiens
gtccaaggcagttctg

SEQ ID NO: 2736617 - DNA, 21 bp, Homo sapiens
gtccacagtggaaccagccca

SEQ ID NO: 2736618 - DNA, 18 bp, Homo sapiens
gtccagccagctcctgca

SEQ ID NO: 2736619 - DNA, 17 bp, Homo sapiens
gtccagggcgggagtgg

SEQ ID NO: 2736620 - DNA, 19 bp, Homo sapiens
gtccaggggagggaaaagc

SEQ ID NO: 2736621 - DNA, 12 bp, Homo sapiens
gtccagtgccca

SEQ ID NO: 2736622 - DNA, 12 bp, Homo sapiens
gtccataaagta

SEQ ID NO: 2736623 - DNA, 14 bp, Homo sapiens
gtccatcctcctct

SEQ ID NO: 2736624 - DNA, 15 bp, Homo sapiens
gtccatttcttattt

SEQ ID NO: 2736625 - DNA, 21 bp, Homo sapiens
gtcccacttcccctcctaccc

SEQ ID NO: 2736626 - DNA, 20 bp, Homo sapiens
gtcccaggagcaaatgctgg

SEQ ID NO: 2736627 - DNA, 21 bp, Homo sapiens
gtcccaggagcaaatgctgga

SEQ ID NO: 2736628 - DNA, 12 bp, Homo sapiens
gtcccagtgaac

SEQ ID NO: 2736629 - DNA, 15 bp, Homo sapiens
gtcccctcacagact

SEQ ID NO: 2736630 - DNA, 21 bp, Homo sapiens
gtcccctcacagactcttcca

SEQ ID NO: 2736631 - DNA, 21 bp, Homo sapiens
gtcccctcttgccccaacccc

SEQ ID NO: 2736632 - DNA, 12 bp, Homo sapiens
gtcccctggggc

SEQ ID NO: 2736633 - DNA, 19 bp, Homo sapiens
gtcccctggggctggtgga

SEQ ID NO: 2736634 - DNA, 19 bp, Homo sapiens
gtcccgaggatgctgtcag

SEQ ID NO: 2736635 - DNA, 23 bp, Homo sapiens
gtccctacccactctttgctaca

SEQ ID NO: 2736636 - DNA, 18 bp, Homo sapiens
gtccctgaagtcttgcat

SEQ ID NO: 2736637 - DNA, 23 bp, Homo sapiens
gtccctgaagtcttgcattgaat

SEQ ID NO: 2736638 - DNA, 16 bp, Homo sapiens
gtcccttccatttcta

SEQ ID NO: 2736639 - DNA, 20 bp, Homo sapiens
gtccctttttgcaggggact

SEQ ID NO: 2736640 - DNA, 22 bp, Homo sapiens
gtccctttttgcaggggactgg

SEQ ID NO: 2736641 - DNA, 20 bp, Homo sapiens
gtccggagcgaccctggctc

SEQ ID NO: 2736642 - DNA, 15 bp, Homo sapiens
gtcctagagctcctg

SEQ ID NO: 2736643 - DNA, 14 bp, Homo sapiens
gtcctcaaagaagt

SEQ ID NO: 2736644 - DNA, 16 bp, Homo sapiens
gtcctcacagcctctc

SEQ ID NO: 2736645 - DNA, 22 bp, Homo sapiens
gtcctccaacaataaagagctc

SEQ ID NO: 2736646 - DNA, 14 bp, Homo sapiens
gtcctcggcccatc

SEQ ID NO: 2736647 - DNA, 20 bp, Homo sapiens
gtcctcggcccatctgtcca

SEQ ID NO: 2736648 - DNA, 19 bp, Homo sapiens
gtcctctcagagcctcagc

SEQ ID NO: 2736649 - DNA, 14 bp, Homo sapiens
gtcctctccaccta

SEQ ID NO: 2736650 - DNA, 18 bp, Homo sapiens
gtcctctccacctagtgg

SEQ ID NO: 2736651 - DNA, 18 bp, Homo sapiens
gtcctctgcttcctgagc

SEQ ID NO: 2736652 - DNA, 20 bp, Homo sapiens
gtcctgacttcaggggctgc

SEQ ID NO: 2736653 - DNA, 14 bp, Homo sapiens
gtcctgctccacag

SEQ ID NO: 2736654 - DNA, 11 bp, Homo sapiens
gtcctgctggc

SEQ ID NO: 2736655 - DNA, 12 bp, Homo sapiens
gtcctgctggcc

SEQ ID NO: 2736656 - DNA, 20 bp, Homo sapiens
gtcctggaatgaagcatgta

SEQ ID NO: 2736657 - DNA, 13 bp, Homo sapiens
gtcctggaccctg

SEQ ID NO: 2736658 - DNA, 19 bp, Homo sapiens
gtcctgggagaacctcagg

SEQ ID NO: 2736659 - DNA, 13 bp, Homo sapiens
gtcctgtcagtgc

SEQ ID NO: 2736660 - DNA, 16 bp, Homo sapiens
gtcctgtcagtgccgc

SEQ ID NO: 2736661 - DNA, 21 bp, Homo sapiens
gtcctgtcagtgccgccgcct

SEQ ID NO: 2736662 - DNA, 20 bp, Homo sapiens
gtcctgtccggagcgaccct

SEQ ID NO: 2736663 - DNA, 13 bp, Homo sapiens
gtcctgtctgctg

SEQ ID NO: 2736664 - DNA, 14 bp, Homo sapiens
gtcctgtctgctgg

SEQ ID NO: 2736665 - DNA, 16 bp, Homo sapiens
gtcctgtctgctgggc

SEQ ID NO: 2736666 - DNA, 17 bp, Homo sapiens
gtcctgtctgctgggct

SEQ ID NO: 2736667 - DNA, 14 bp, Homo sapiens
gtccttactcagag

SEQ ID NO: 2736668 - DNA, 17 bp, Homo sapiens
gtccttactcagagctg

SEQ ID NO: 2736669 - DNA, 14 bp, Homo sapiens
gtccttccaggccc

SEQ ID NO: 2736670 - DNA, 12 bp, Homo sapiens
gtccttgaaaca

SEQ ID NO: 2736671 - DNA, 14 bp, Homo sapiens
gtcctttaggcagc

SEQ ID NO: 2736672 - DNA, 15 bp, Homo sapiens
gtcctttgttgctgt

SEQ ID NO: 2736673 - DNA, 19 bp, Homo sapiens
gtcctttgttgctgttgct

SEQ ID NO: 2736674 - DNA, 22 bp, Homo sapiens
gtccttttgtaccatggtgtga

SEQ ID NO: 2736675 - DNA, 16 bp, Homo sapiens
gtcgaatttttattat

SEQ ID NO: 2736676 - DNA, 12 bp, Homo sapiens
gtcgcgctgcct

SEQ ID NO: 2736677 - DNA, 16 bp, Homo sapiens
gtcgcgctgcctgtgt

SEQ ID NO: 2736678 - DNA, 15 bp, Homo sapiens
tacaataaatgctga

SEQ ID NO: 2736679 - DNA, 17 bp, Homo sapiens
tacaataaatgctgaat

SEQ ID NO: 2736680 - DNA, 21 bp, Homo sapiens
tacacaacatgtatgtggata

SEQ ID NO: 2736681 - DNA, 16 bp, Homo sapiens
tacactccagcctgag

SEQ ID NO: 2736682 - DNA, 17 bp, Homo sapiens
tacactccagcctgagc

SEQ ID NO: 2736683 - DNA, 19 bp, Homo sapiens
tacagaacacgctttcaca

SEQ ID NO: 2736684 - DNA, 17 bp, Homo sapiens
tacagtaaataaattgt

SEQ ID NO: 2736685 - DNA, 14 bp, Homo sapiens
tacagtcaacttac

SEQ ID NO: 2736686 - DNA, 22 bp, Homo sapiens
tacagtctcaattttgtattta

SEQ ID NO: 2736687 - DNA, 16 bp, Homo sapiens
tacagtgtatttaaga

SEQ ID NO: 2736688 - DNA, 16 bp, Homo sapiens
tacagttcataattca

SEQ ID NO: 2736689 - DNA, 17 bp, Homo sapiens
tacagttcataattcac

SEQ ID NO: 2736690 - DNA, 18 bp, Homo sapiens
tacagttcataattcacc

SEQ ID NO: 2736691 - DNA, 12 bp, Homo sapiens
aaaaaaaacaaa

SEQ ID NO: 2736692 - DNA, 13 bp, Homo sapiens
aaaaagaaattgt

SEQ ID NO: 2736693 - DNA, 14 bp, Homo sapiens
aaaaagaagtttgg

SEQ ID NO: 2736694 - DNA, 17 bp, Homo sapiens
aaaaagtatatattcta

SEQ ID NO: 2736695 - DNA, 20 bp, Homo sapiens
aaaaagtcagactgctggga

SEQ ID NO: 2736696 - DNA, 11 bp, Homo sapiens
aaaaatagaag

SEQ ID NO: 2736697 - DNA, 16 bp, Homo sapiens
aaaaatatatacagat

SEQ ID NO: 2736698 - DNA, 14 bp, Homo sapiens
aaaaatcttggttt

SEQ ID NO: 2736699 - DNA, 16 bp, Homo sapiens
aaaaatgagcttgtaa

SEQ ID NO: 2736700 - DNA, 14 bp, Homo sapiens
aaaaatgatttaat

SEQ ID NO: 2736701 - DNA, 12 bp, Homo sapiens
aaaaatgtcact

SEQ ID NO: 2736702 - DNA, 13 bp, Homo sapiens
aaaaattacagat

SEQ ID NO: 2736703 - DNA, 21 bp, Homo sapiens
aaaaattacagatcatataag

SEQ ID NO: 2736704 - DNA, 22 bp, Homo sapiens
aaaacatatgtctgtctttgca

SEQ ID NO: 2736705 - DNA, 24 bp, Homo sapiens
aaaacatatgtctgtctttgcaaa

SEQ ID NO: 2736706 - DNA, 22 bp, Homo sapiens
aaaaccctaagtgtggatgttc

SEQ ID NO: 2736707 - DNA, 15 bp, Homo sapiens
aaaacctgtttttaa

SEQ ID NO: 2736708 - DNA, 22 bp, Homo sapiens
aaaacctgtttttaacatgtga

SEQ ID NO: 2736709 - DNA, 20 bp, Homo sapiens
aaaactaaggatttttcaag

SEQ ID NO: 2736710 - DNA, 13 bp, Homo sapiens
aaaactgctttat

SEQ ID NO: 2736711 - DNA, 11 bp, Homo sapiens
aaaacttattt

SEQ ID NO: 2736712 - DNA, 15 bp, Homo sapiens
aaaacttatttgagt

SEQ ID NO: 2736713 - DNA, 13 bp, Homo sapiens
aaaacttcagaga

SEQ ID NO: 2736714 - DNA, 13 bp, Homo sapiens
aaaagaaatcaat

SEQ ID NO: 2736715 - DNA, 15 bp, Homo sapiens
aaaagaaatcaattt

SEQ ID NO: 2736716 - DNA, 21 bp, Homo sapiens
aaaagacattgaaagctctat

SEQ ID NO: 2736717 - DNA, 20 bp, Homo sapiens
aaaagattatatatcataaa

SEQ ID NO: 2736718 - DNA, 17 bp, Homo sapiens
aaaagcacaagtacttt

SEQ ID NO: 2736719 - DNA, 23 bp, Homo sapiens
aaaagcaggcttgtgctttatac

SEQ ID NO: 2736720 - DNA, 11 bp, Homo sapiens
aaaagccatat

SEQ ID NO: 2736721 - DNA, 22 bp, Homo sapiens
aaaagtaagtaccactcaggcc

SEQ ID NO: 2736722 - DNA, 11 bp, Homo sapiens
aaaagtatata

SEQ ID NO: 2736723 - DNA, 16 bp, Homo sapiens
aaaagttaaactactt

SEQ ID NO: 2736724 - DNA, 18 bp, Homo sapiens
aaaatcaaatttttctgg

SEQ ID NO: 2736725 - DNA, 16 bp, Homo sapiens
aaaatcttcagctggt

SEQ ID NO: 2736726 - DNA, 13 bp, Homo sapiens
aaaatgaagcaat

SEQ ID NO: 2736727 - DNA, 15 bp, Homo sapiens
aaaatgaagcaattt

SEQ ID NO: 2736728 - DNA, 22 bp, Homo sapiens
aaaatgaagcaatttatatctt

SEQ ID NO: 2736729 - DNA, 22 bp, Homo sapiens
aaaatgagactatgcgttttta

SEQ ID NO: 2736730 - DNA, 15 bp, Homo sapiens
aaaatgcattatgtg

SEQ ID NO: 2736731 - DNA, 21 bp, Homo sapiens
aaaatgcggcactatttctga

SEQ ID NO: 2736732 - DNA, 14 bp, Homo sapiens
aaaatggtgcctga

SEQ ID NO: 2736733 - DNA, 23 bp, Homo sapiens
aaaatgtcactgaagtgattgaa

SEQ ID NO: 2736734 - DNA, 15 bp, Homo sapiens
aaaattgtaaaattg

SEQ ID NO: 2736735 - DNA, 13 bp, Homo sapiens
aaaattgtataga

SEQ ID NO: 2736736 - DNA, 17 bp, Homo sapiens
aaaatttagcttatgct

SEQ ID NO: 2736737 - DNA, 15 bp, Homo sapiens
aaacaatttaaattg

SEQ ID NO: 2736738 - DNA, 16 bp, Homo sapiens
aaacacacagactctg

SEQ ID NO: 2736739 - DNA, 23 bp, Homo sapiens
aaacactaaattagtttaaaatg

SEQ ID NO: 2736740 - DNA, 20 bp, Homo sapiens
aaacactgggctctgaggag

SEQ ID NO: 2736741 - DNA, 14 bp, Homo sapiens
aaacagaatttttc

SEQ ID NO: 2736742 - DNA, 20 bp, Homo sapiens
aaacagggacactacaaaca

SEQ ID NO: 2736743 - DNA, 18 bp, Homo sapiens
aaacagtgggagggaatt

SEQ ID NO: 2736744 - DNA, 18 bp, Homo sapiens
aaacatatgtctgtcttt

SEQ ID NO: 2736745 - DNA, 13 bp, Homo sapiens
aaacatgaaaaca

SEQ ID NO: 2736746 - DNA, 17 bp, Homo sapiens
aaacatgaaaacattga

SEQ ID NO: 2736747 - DNA, 21 bp, Homo sapiens
aaacatgtgcaactcttgtat

SEQ ID NO: 2736748 - DNA, 23 bp, Homo sapiens
aaacatgtgcaactcttgtattg

SEQ ID NO: 2736749 - DNA, 21 bp, Homo sapiens
aaacatttctggacagtacct

SEQ ID NO: 2736750 - DNA, 17 bp, Homo sapiens
aaaccaacccatgtata

SEQ ID NO: 2736751 - DNA, 12 bp, Homo sapiens
aaaccaggagca

SEQ ID NO: 2736752 - DNA, 22 bp, Homo sapiens
aaaccctaagtgtggatgttca

SEQ ID NO: 2736753 - DNA, 21 bp, Homo sapiens
aaaccctgtggggcctgatgg

SEQ ID NO: 2736754 - DNA, 18 bp, Homo sapiens
aaacctctaatttatttt

SEQ ID NO: 2736755 - DNA, 12 bp, Homo sapiens
aaacctgcattt

SEQ ID NO: 2736756 - DNA, 18 bp, Homo sapiens
aaaccttgtttctttctg

SEQ ID NO: 2736757 - DNA, 21 bp, Homo sapiens
aaacgtattttgatcagtgtt

SEQ ID NO: 2736758 - DNA, 19 bp, Homo sapiens
aaactaccagtgggcatgt

SEQ ID NO: 2736759 - DNA, 21 bp, Homo sapiens
aaactaccagtgggcatgtat

SEQ ID NO: 2736760 - DNA, 23 bp, Homo sapiens
aaactaccagtgggcatgtatta

SEQ ID NO: 2736761 - DNA, 14 bp, Homo sapiens
aaactctgccagcc

SEQ ID NO: 2736762 - DNA, 14 bp, Homo sapiens
aaactgctgttaat

SEQ ID NO: 2736763 - DNA, 17 bp, Homo sapiens
aaacttagaataaaatt

SEQ ID NO: 2736764 - DNA, 12 bp, Homo sapiens
aaacttcagaga

SEQ ID NO: 2736765 - DNA, 18 bp, Homo sapiens
aaacttcagagaaattat

SEQ ID NO: 2736766 - DNA, 13 bp, Homo sapiens
aaacttcagcacc

SEQ ID NO: 2736767 - DNA, 12 bp, Homo sapiens
aaagaaaatcaa

SEQ ID NO: 2736768 - DNA, 13 bp, Homo sapiens
aaagaaacactaa

SEQ ID NO: 2736769 - DNA, 15 bp, Homo sapiens
aaagaaacactaaat

SEQ ID NO: 2736770 - DNA, 13 bp, Homo sapiens
aaagaactgcccc

SEQ ID NO: 2736771 - DNA, 24 bp, Homo sapiens
aatgacacactgcggtgtctgcag

SEQ ID NO: 2736772 - DNA, 20 bp, Homo sapiens
aatgagaaaatgtctttatt

SEQ ID NO: 2736773 - DNA, 19 bp, Homo sapiens
aatgaggaacaatcacaaa

SEQ ID NO: 2736774 - DNA, 20 bp, Homo sapiens
aatgagtttccagctaagcc

SEQ ID NO: 2736775 - DNA, 15 bp, Homo sapiens
aatgatgataatcat

SEQ ID NO: 2736776 - DNA, 15 bp, Homo sapiens
aatgcaacaatgtgt

SEQ ID NO: 2736777 - DNA, 21 bp, Homo sapiens
aatgcacattggaagctccca

SEQ ID NO: 2736778 - DNA, 11 bp, Homo sapiens
aatgcaggaga

SEQ ID NO: 2736779 - DNA, 20 bp, Homo sapiens
aatgcatgtaaggtcttctt

SEQ ID NO: 2736780 - DNA, 23 bp, Homo sapiens
aatgccaacttgtccttttgtac

SEQ ID NO: 2736781 - DNA, 22 bp, Homo sapiens
aatgccctacctgcctgttctc

SEQ ID NO: 2736782 - DNA, 20 bp, Homo sapiens
aatgcgtggcacatctaaat

SEQ ID NO: 2736783 - DNA, 21 bp, Homo sapiens
aatgctattcagataaggcag

SEQ ID NO: 2736784 - DNA, 22 bp, Homo sapiens
aatgctattcagataaggcaga

SEQ ID NO: 2736785 - DNA, 20 bp, Homo sapiens
aatgctgtgcaaacagtgta

SEQ ID NO: 2736786 - DNA, 22 bp, Homo sapiens
aatgctgtgcaaacagtgtaag

SEQ ID NO: 2736787 - DNA, 19 bp, Homo sapiens
aatgcttctgcctcagctt

SEQ ID NO: 2736788 - DNA, 16 bp, Homo sapiens
aatgcttcttaaagtt

SEQ ID NO: 2736789 - DNA, 15 bp, Homo sapiens
aatgctttccaaaac

SEQ ID NO: 2736790 - DNA, 22 bp, Homo sapiens
aatggcacgatctcagctcacc

SEQ ID NO: 2736791 - DNA, 10 bp, Homo sapiens
aatggccatg

SEQ ID NO: 2736792 - DNA, 18 bp, Homo sapiens
aatggcttacttacaaaa

SEQ ID NO: 2736793 - DNA, 22 bp, Homo sapiens
aatggcttacttacaaaagcag

SEQ ID NO: 2736794 - DNA, 14 bp, Homo sapiens
aatgggaaagtatt

SEQ ID NO: 2736795 - DNA, 18 bp, Homo sapiens
aatggtgttactaaagtc

SEQ ID NO: 2736796 - DNA, 19 bp, Homo sapiens
aatggtgttactaaagtca

SEQ ID NO: 2736797 - DNA, 15 bp, Homo sapiens
aatgtaatgatcata

SEQ ID NO: 2736798 - DNA, 21 bp, Homo sapiens
aatgtaatgatcataagtcta

SEQ ID NO: 2736799 - DNA, 17 bp, Homo sapiens
aatgtcactgaagtgat

SEQ ID NO: 2736800 - DNA, 12 bp, Homo sapiens
aatgtcattatt

SEQ ID NO: 2736801 - DNA, 15 bp, Homo sapiens
aatgtcattatttga

SEQ ID NO: 2736802 - DNA, 14 bp, Homo sapiens
aatgtcccagaggc

SEQ ID NO: 2736803 - DNA, 14 bp, Homo sapiens
aatgtgactcaaga

SEQ ID NO: 2736804 - DNA, 13 bp, Homo sapiens
aatgtgatcatct

SEQ ID NO: 2736805 - DNA, 18 bp, Homo sapiens
aatgtgatcatctttgct

SEQ ID NO: 2736806 - DNA, 19 bp, Homo sapiens
aatgtgatcatctttgctg

SEQ ID NO: 2736807 - DNA, 12 bp, Homo sapiens
aatgtgtcattg

SEQ ID NO: 2736808 - DNA, 20 bp, Homo sapiens
aatgtgtctgcaacatggat

SEQ ID NO: 2736809 - DNA, 23 bp, Homo sapiens
aatgttggtgcaattaactctgg

SEQ ID NO: 2736810 - DNA, 12 bp, Homo sapiens
aattaatctttt

SEQ ID NO: 2736811 - DNA, 15 bp, Homo sapiens
aattaatcttttaaa

SEQ ID NO: 2736812 - DNA, 22 bp, Homo sapiens
aattaatgagttttatccaaga

SEQ ID NO: 2736813 - DNA, 16 bp, Homo sapiens
aattactggacatatg

SEQ ID NO: 2736814 - DNA, 16 bp, Homo sapiens
aattagcaatcatttt

SEQ ID NO: 2736815 - DNA, 19 bp, Homo sapiens
aattagcaatcattttata

SEQ ID NO: 2736816 - DNA, 14 bp, Homo sapiens
aattagtttaaaat

SEQ ID NO: 2736817 - DNA, 16 bp, Homo sapiens
aattagtttaaaatga

SEQ ID NO: 2736818 - DNA, 13 bp, Homo sapiens
aattattgtgatt

SEQ ID NO: 2736819 - DNA, 16 bp, Homo sapiens
aattattgtgatttcc

SEQ ID NO: 2736820 - DNA, 19 bp, Homo sapiens
aattattttccaaaatcta

SEQ ID NO: 2736821 - DNA, 20 bp, Homo sapiens
aattcaaagaaaaccctaag

SEQ ID NO: 2736822 - DNA, 14 bp, Homo sapiens
aattcaaagctcta

SEQ ID NO: 2736823 - DNA, 18 bp, Homo sapiens
aattcaaagctctattaa

SEQ ID NO: 2736824 - DNA, 16 bp, Homo sapiens
aattcaccaaaagttc

SEQ ID NO: 2736825 - DNA, 21 bp, Homo sapiens
aattcactgttgaatgcctgt

SEQ ID NO: 2736826 - DNA, 17 bp, Homo sapiens
aattcattaatctgttt

SEQ ID NO: 2736827 - DNA, 16 bp, Homo sapiens
aattcattgtgtatga

SEQ ID NO: 2736828 - DNA, 15 bp, Homo sapiens
aattccatgcactct

SEQ ID NO: 2736829 - DNA, 17 bp, Homo sapiens
aattctattttgctgga

SEQ ID NO: 2736830 - DNA, 18 bp, Homo sapiens
aattgttctgggtgattt

SEQ ID NO: 2736831 - DNA, 13 bp, Homo sapiens
aatttaaattgtt

SEQ ID NO: 2736832 - DNA, 20 bp, Homo sapiens
aatttaccattattttacag

SEQ ID NO: 2736833 - DNA, 21 bp, Homo sapiens
aatttaccattattttacagt

SEQ ID NO: 2736834 - DNA, 22 bp, Homo sapiens
aatttaccattattttacagtc

SEQ ID NO: 2736835 - DNA, 13 bp, Homo sapiens
aatttacttttta

SEQ ID NO: 2736836 - DNA, 15 bp, Homo sapiens
aatttagtcattatt

SEQ ID NO: 2736837 - DNA, 19 bp, Homo sapiens
aatttataggcagatcttt

SEQ ID NO: 2736838 - DNA, 21 bp, Homo sapiens
aatttataggcagatctttaa

SEQ ID NO: 2736839 - DNA, 22 bp, Homo sapiens
aatttataggcagatctttaaa

SEQ ID NO: 2736840 - DNA, 19 bp, Homo sapiens
aatttatatctttatgcaa

SEQ ID NO: 2736841 - DNA, 20 bp, Homo sapiens
aatttatatctttatgcaaa

SEQ ID NO: 2736842 - DNA, 21 bp, Homo sapiens
aatttccactcaggtctgttt

SEQ ID NO: 2736843 - DNA, 19 bp, Homo sapiens
aatttgtatctgaaggaga

SEQ ID NO: 2736844 - DNA, 20 bp, Homo sapiens
aatttgtatctgaaggagat

SEQ ID NO: 2736845 - DNA, 20 bp, Homo sapiens
aatttgtgcatcagaaaatg

SEQ ID NO: 2736846 - DNA, 22 bp, Homo sapiens
aattttaaggtagaacctcacc

SEQ ID NO: 2736847 - DNA, 18 bp, Homo sapiens
aattttactgacagaaat

SEQ ID NO: 2736848 - DNA, 22 bp, Homo sapiens
aattttattaaaagagtagaaa

SEQ ID NO: 2736849 - DNA, 17 bp, Homo sapiens
aattttcaaataaggaa

SEQ ID NO: 2736850 - DNA, 21 bp, Homo sapiens
aattttctgtgttctgaagtc

SEQ ID NO: 2736851 - DNA, 23 bp, Homo sapiens
aattttctttcatacattatatt

SEQ ID NO: 2736852 - DNA, 17 bp, Homo sapiens
aattttgaggtctttta

SEQ ID NO: 2736853 - DNA, 19 bp, Homo sapiens
aattttggaaaaatgtcac

SEQ ID NO: 2736854 - DNA, 20 bp, Homo sapiens
aattttggaaaaatgtcact

SEQ ID NO: 2736855 - DNA, 12 bp, Homo sapiens
aattttgtaaaa

SEQ ID NO: 2736856 - DNA, 16 bp, Homo sapiens
aattttgtatgaaaaa

SEQ ID NO: 2736857 - DNA, 11 bp, Homo sapiens
aattttgtcac

SEQ ID NO: 2736858 - DNA, 21 bp, Homo sapiens
aatttttattatttgttttcc

SEQ ID NO: 2736859 - DNA, 12 bp, Homo sapiens
aattttttgcag

SEQ ID NO: 2736860 - DNA, 17 bp, Homo sapiens
aattttttgcagtcttt

SEQ ID NO: 2736861 - DNA, 17 bp, Homo sapiens
acaaaaaaataataaaa

SEQ ID NO: 2736862 - DNA, 21 bp, Homo sapiens
acaaacagtgaatttaagcat

SEQ ID NO: 2736863 - DNA, 13 bp, Homo sapiens
acaaaccaggagc

SEQ ID NO: 2736864 - DNA, 19 bp, Homo sapiens
acaaagttactggctcttt

SEQ ID NO: 2736865 - DNA, 17 bp, Homo sapiens
acaaataaagatggcta

SEQ ID NO: 2736866 - DNA, 16 bp, Homo sapiens
acaaatacactttatt

SEQ ID NO: 2736867 - DNA, 19 bp, Homo sapiens
acaaatggctgtaaaacta

SEQ ID NO: 2736868 - DNA, 20 bp, Homo sapiens
acaaatggcttacttacaaa

SEQ ID NO: 2736869 - DNA, 18 bp, Homo sapiens
acaaatgtgtcccagtga

SEQ ID NO: 2736870 - DNA, 13 bp, Homo sapiens
acaacatgtatgt

SEQ ID NO: 2736871 - DNA, 14 bp, Homo sapiens
acaacatgtatgtg

SEQ ID NO: 2736872 - DNA, 11 bp, Homo sapiens
acaacccagaa

SEQ ID NO: 2736873 - DNA, 16 bp, Homo sapiens
acaacctttcccattt

SEQ ID NO: 2736874 - DNA, 23 bp, Homo sapiens
acaagaagggttttccaccctgg

SEQ ID NO: 2736875 - DNA, 14 bp, Homo sapiens
acaagcaagcaaaa

SEQ ID NO: 2736876 - DNA, 13 bp, Homo sapiens
acaagtacttttg

SEQ ID NO: 2736877 - DNA, 18 bp, Homo sapiens
acaagttaaggtatctgg

SEQ ID NO: 2736878 - DNA, 13 bp, Homo sapiens
acaataaagagct

SEQ ID NO: 2736879 - DNA, 12 bp, Homo sapiens
acaataaatgct

SEQ ID NO: 2736880 - DNA, 21 bp, Homo sapiens
acaataaatgctgaatgaatc

SEQ ID NO: 2736881 - DNA, 20 bp, Homo sapiens
acaataccagaagtgaatta

SEQ ID NO: 2736882 - DNA, 15 bp, Homo sapiens
acaatttaaattgtt

SEQ ID NO: 2736883 - DNA, 19 bp, Homo sapiens
acacaaaaaaataataaaa

SEQ ID NO: 2736884 - DNA, 16 bp, Homo sapiens
acacaacatgtatgtg

SEQ ID NO: 2736885 - DNA, 20 bp, Homo sapiens
acacacccccaagccacagg

SEQ ID NO: 2736886 - DNA, 15 bp, Homo sapiens
acacactcagcagcc

SEQ ID NO: 2736887 - DNA, 19 bp, Homo sapiens
acacagcccagacaagatg

SEQ ID NO: 2736888 - DNA, 14 bp, Homo sapiens
acacagtgtttcct

SEQ ID NO: 2736889 - DNA, 16 bp, Homo sapiens
acacatatatgtatat

SEQ ID NO: 2736890 - DNA, 16 bp, Homo sapiens
acacatttttaaaaca

SEQ ID NO: 2736891 - DNA, 18 bp, Homo sapiens
acacatttttaaaacaac

SEQ ID NO: 2736892 - DNA, 20 bp, Homo sapiens
acaccaagctgtgccaccct

SEQ ID NO: 2736893 - DNA, 20 bp, Homo sapiens
acaccccccgccccccacct

SEQ ID NO: 2736894 - DNA, 22 bp, Homo sapiens
actctgcaggaaatcagagctg

SEQ ID NO: 2736895 - DNA, 15 bp, Homo sapiens
actctggacctctct

SEQ ID NO: 2736896 - DNA, 12 bp, Homo sapiens
actctgtgccca

SEQ ID NO: 2736897 - DNA, 13 bp, Homo sapiens
actctgtgcccat

SEQ ID NO: 2736898 - DNA, 15 bp, Homo sapiens
actctgtgcccatgg

SEQ ID NO: 2736899 - DNA, 17 bp, Homo sapiens
actcttccaccagagca

SEQ ID NO: 2736900 - DNA, 20 bp, Homo sapiens
actcttccaccagagcaggg

SEQ ID NO: 2736901 - DNA, 23 bp, Homo sapiens
actcttccaccagagcaggggct

SEQ ID NO: 2736902 - DNA, 20 bp, Homo sapiens
actcttcccccactcctctt

SEQ ID NO: 2736903 - DNA, 13 bp, Homo sapiens
actcttggccaga

SEQ ID NO: 2736904 - DNA, 16 bp, Homo sapiens
actctttgctacaata

SEQ ID NO: 2736905 - DNA, 18 bp, Homo sapiens
actctttgctacaataaa

SEQ ID NO: 2736906 - DNA, 21 bp, Homo sapiens
actctttgctacaataaatgc

SEQ ID NO: 2736907 - DNA, 10 bp, Homo sapiens
actgaaagaa

SEQ ID NO: 2736908 - DNA, 14 bp, Homo sapiens
actgaaagtggttt

SEQ ID NO: 2736909 - DNA, 19 bp, Homo sapiens
actgaaggcttctgcagct

SEQ ID NO: 2736910 - DNA, 15 bp, Homo sapiens
actgagtctcgaggg

SEQ ID NO: 2736911 - DNA, 20 bp, Homo sapiens
actgatcttacctttatgag

SEQ ID NO: 2736912 - DNA, 18 bp, Homo sapiens
actgcaagaggctcctgt

SEQ ID NO: 2736913 - DNA, 13 bp, Homo sapiens
actgcaagctctg

SEQ ID NO: 2736914 - DNA, 14 bp, Homo sapiens
actgcaagctctgc

SEQ ID NO: 2736915 - DNA, 15 bp, Homo sapiens
actgcaagctctgcc

SEQ ID NO: 2736916 - DNA, 16 bp, Homo sapiens
actgcaagctctgcct

SEQ ID NO: 2736917 - DNA, 19 bp, Homo sapiens
actgcaagctctgcctccc

SEQ ID NO: 2736918 - DNA, 16 bp, Homo sapiens
actgcaccccctcctg

SEQ ID NO: 2736919 - DNA, 17 bp, Homo sapiens
actgcactccagcctgg

SEQ ID NO: 2736920 - DNA, 18 bp, Homo sapiens
actgcactccagcctggg

SEQ ID NO: 2736921 - DNA, 21 bp, Homo sapiens
actgcactccagcctgggcga

SEQ ID NO: 2736922 - DNA, 14 bp, Homo sapiens
actgccccatctcc

SEQ ID NO: 2736923 - DNA, 13 bp, Homo sapiens
actgccgcctcct

SEQ ID NO: 2736924 - DNA, 17 bp, Homo sapiens
actgcgaggttgtttta

SEQ ID NO: 2736925 - DNA, 21 bp, Homo sapiens
actgcgaggttgttttaaagt

SEQ ID NO: 2736926 - DNA, 21 bp, Homo sapiens
actgcgccacggcactccagc

SEQ ID NO: 2736927 - DNA, 12 bp, Homo sapiens
actgcggagcag

SEQ ID NO: 2736928 - DNA, 21 bp, Homo sapiens
actgcgggatggtcctggggc

SEQ ID NO: 2736929 - DNA, 22 bp, Homo sapiens
actgcggtgtctgcagctcctg

SEQ ID NO: 2736930 - DNA, 13 bp, Homo sapiens
actgctgggactg

SEQ ID NO: 2736931 - DNA, 18 bp, Homo sapiens
actgctgggactggccag

SEQ ID NO: 2736932 - DNA, 18 bp, Homo sapiens
actgctggggctggtgag

SEQ ID NO: 2736933 - DNA, 20 bp, Homo sapiens
actgctgggtggcccatccc

SEQ ID NO: 2736934 - DNA, 22 bp, Homo sapiens
actgctgttaattgattaaaat

SEQ ID NO: 2736935 - DNA, 15 bp, Homo sapiens
actggagagtggcaa

SEQ ID NO: 2736936 - DNA, 12 bp, Homo sapiens
actggagcccag

SEQ ID NO: 2736937 - DNA, 13 bp, Homo sapiens
actggagcccagg

SEQ ID NO: 2736938 - DNA, 23 bp, Homo sapiens
actggcatctccctgaccttctc

SEQ ID NO: 2736939 - DNA, 15 bp, Homo sapiens
actggccgtggctcc

SEQ ID NO: 2736940 - DNA, 18 bp, Homo sapiens
actggcctcgcctggcct

SEQ ID NO: 2736941 - DNA, 17 bp, Homo sapiens
actggctgcctccactc

SEQ ID NO: 2736942 - DNA, 22 bp, Homo sapiens
actggctgcctccactcccact

SEQ ID NO: 2736943 - DNA, 16 bp, Homo sapiens
actggctggctgcagt

SEQ ID NO: 2736944 - DNA, 23 bp, Homo sapiens
actgggccatgggtcctcggccc

SEQ ID NO: 2736945 - DNA, 22 bp, Homo sapiens
actgggcccctcaggggaagct

SEQ ID NO: 2736946 - DNA, 20 bp, Homo sapiens
actggtgatgggacaattct

SEQ ID NO: 2736947 - DNA, 19 bp, Homo sapiens
actgtaagcagattacaat

SEQ ID NO: 2736948 - DNA, 20 bp, Homo sapiens
actgtataaacaaattagca

SEQ ID NO: 2736949 - DNA, 16 bp, Homo sapiens
actgtcctcgcagaga

SEQ ID NO: 2736950 - DNA, 13 bp, Homo sapiens
actgtcctgctcc

SEQ ID NO: 2736951 - DNA, 16 bp, Homo sapiens
actgtcctgctccaca

SEQ ID NO: 2736952 - DNA, 20 bp, Homo sapiens
actgtcctgctccacagtgt

SEQ ID NO: 2736953 - DNA, 17 bp, Homo sapiens
actgtcctgtccggagc

SEQ ID NO: 2736954 - DNA, 17 bp, Homo sapiens
actgtgacacagctgag

SEQ ID NO: 2736955 - DNA, 17 bp, Homo sapiens
actgtgacatcagaagt

SEQ ID NO: 2736956 - DNA, 13 bp, Homo sapiens
actgtgctcccac

SEQ ID NO: 2736957 - DNA, 15 bp, Homo sapiens
actgtgctcccacgg

SEQ ID NO: 2736958 - DNA, 21 bp, Homo sapiens
actgtgtttctagttgcattt

SEQ ID NO: 2736959 - DNA, 20 bp, Homo sapiens
actgttcccagcaaagtttt

SEQ ID NO: 2736960 - DNA, 22 bp, Homo sapiens
actgttcccagcaaagttttca

SEQ ID NO: 2736961 - DNA, 22 bp, Homo sapiens
actgttctcaccttaactcagc

SEQ ID NO: 2736962 - DNA, 10 bp, Homo sapiens
acttaaacat

SEQ ID NO: 2736963 - DNA, 16 bp, Homo sapiens
acttacaaaagcagct

SEQ ID NO: 2736964 - DNA, 22 bp, Homo sapiens
acttagaataaaattgtaaaat

SEQ ID NO: 2736965 - DNA, 12 bp, Homo sapiens
acttatttgagt

SEQ ID NO: 2736966 - DNA, 22 bp, Homo sapiens
acttatttgagtgattatttgt

SEQ ID NO: 2736967 - DNA, 13 bp, Homo sapiens
acttcataaaact

SEQ ID NO: 2736968 - DNA, 13 bp, Homo sapiens
acttcatgcccac

SEQ ID NO: 2736969 - DNA, 19 bp, Homo sapiens
acttcccaattgccacatt

SEQ ID NO: 2736970 - DNA, 15 bp, Homo sapiens
acttcccccaccctg

SEQ ID NO: 2736971 - DNA, 12 bp, Homo sapiens
acttcccctcct

SEQ ID NO: 2736972 - DNA, 21 bp, Homo sapiens
acttcccctcctacccctccc

SEQ ID NO: 2736973 - DNA, 12 bp, Homo sapiens
acttccctccaa

SEQ ID NO: 2736974 - DNA, 22 bp, Homo sapiens
acttccctgcttttctcccaga

SEQ ID NO: 2736975 - DNA, 18 bp, Homo sapiens
acttcctcgcctctccca

SEQ ID NO: 2736976 - DNA, 22 bp, Homo sapiens
acttcctggtgaggcccagcct

SEQ ID NO: 2736977 - DNA, 19 bp, Homo sapiens
acttgagggtaataaactt

SEQ ID NO: 2736978 - DNA, 15 bp, Homo sapiens
acttgatatttcctt

SEQ ID NO: 2736979 - DNA, 23 bp, Homo sapiens
acttgtccttttgtaccatggtg

SEQ ID NO: 2736980 - DNA, 23 bp, Homo sapiens
acttgttcaacagtttctcaagt

SEQ ID NO: 2736981 - DNA, 15 bp, Homo sapiens
actttataagccaat

SEQ ID NO: 2736982 - DNA, 17 bp, Homo sapiens
actttgaaggtaataaa

SEQ ID NO: 2736983 - DNA, 23 bp, Homo sapiens
actttgagggtgtatattttctg

SEQ ID NO: 2736984 - DNA, 15 bp, Homo sapiens
actttgatctctgct

SEQ ID NO: 2736985 - DNA, 13 bp, Homo sapiens
actttgtcccgct

SEQ ID NO: 2736986 - DNA, 11 bp, Homo sapiens
actttgttcac

SEQ ID NO: 2736987 - DNA, 17 bp, Homo sapiens
acttttccatgtatcta

SEQ ID NO: 2736988 - DNA, 21 bp, Homo sapiens
acttttccatgtatctacctc

SEQ ID NO: 2736989 - DNA, 15 bp, Homo sapiens
acttttctaaagctc

SEQ ID NO: 2736990 - DNA, 14 bp, Homo sapiens
actttttaaacagt

SEQ ID NO: 2736991 - DNA, 14 bp, Homo sapiens
actttttgaatgtc

SEQ ID NO: 2736992 - DNA, 17 bp, Homo sapiens
actttttgttttgttct

SEQ ID NO: 2736993 - DNA, 21 bp, Homo sapiens
actttttgttttgttcttggt

SEQ ID NO: 2736994 - DNA, 14 bp, Homo sapiens
agaaaaaaagcaaa

SEQ ID NO: 2736995 - DNA, 22 bp, Homo sapiens
agaaaaccctaagtgtggatgt

SEQ ID NO: 2736996 - DNA, 19 bp, Homo sapiens
agaaaacctgtttttaaca

SEQ ID NO: 2736997 - DNA, 22 bp, Homo sapiens
agaaaacctgtttttaacatgt

SEQ ID NO: 2736998 - DNA, 18 bp, Homo sapiens
agaaaagcaatactgttt

SEQ ID NO: 2736999 - DNA, 21 bp, Homo sapiens
agaaaatgaatttgactggtt

SEQ ID NO: 2737000 - DNA, 18 bp, Homo sapiens
agaaaatgagatgggttg

SEQ ID NO: 2737001 - DNA, 14 bp, Homo sapiens
agaaaatgcaggag

SEQ ID NO: 2737002 - DNA, 12 bp, Homo sapiens
agaaacactaaa

SEQ ID NO: 2737003 - DNA, 16 bp, Homo sapiens
agaaacaggctctgag

SEQ ID NO: 2737004 - DNA, 19 bp, Homo sapiens
agaaactttgatctctgct

SEQ ID NO: 2737005 - DNA, 22 bp, Homo sapiens
agaaactttgatctctgcttac

SEQ ID NO: 2737006 - DNA, 21 bp, Homo sapiens
agaaaggatttcctttctttt

SEQ ID NO: 2737007 - DNA, 15 bp, Homo sapiens
agaaaggccactcag

SEQ ID NO: 2737008 - DNA, 15 bp, Homo sapiens
agaaatagctatgga

SEQ ID NO: 2737009 - DNA, 13 bp, Homo sapiens
agaaatcaatttt

SEQ ID NO: 2737010 - DNA, 18 bp, Homo sapiens
agaaatcgccttatgaga

SEQ ID NO: 2737011 - DNA, 17 bp, Homo sapiens
agaaatgtttttggcaa

SEQ ID NO: 2737012 - DNA, 15 bp, Homo sapiens
agaaattagccgggc

SEQ ID NO: 2737013 - DNA, 20 bp, Homo sapiens
agaaattttactgacagaaa

SEQ ID NO: 2737014 - DNA, 22 bp, Homo sapiens
agaaatttttttccagaattga

SEQ ID NO: 2737015 - DNA, 14 bp, Homo sapiens
agaacaaatacact

SEQ ID NO: 2737016 - DNA, 22 bp, Homo sapiens
agaacacagtgcctggcaaggc

SEQ ID NO: 2737017 - DNA, 15 bp, Homo sapiens
agaacacccactggc

SEQ ID NO: 2737018 - DNA, 18 bp, Homo sapiens
agcctagaccctcctcct

SEQ ID NO: 2737019 - DNA, 23 bp, Homo sapiens
agcctcacagatgctggcctctt

SEQ ID NO: 2737020 - DNA, 17 bp, Homo sapiens
agcctccagtgctggct

SEQ ID NO: 2737021 - DNA, 18 bp, Homo sapiens
agcctccagtgctggctg

SEQ ID NO: 2737022 - DNA, 14 bp, Homo sapiens
agcctccagtggga

SEQ ID NO: 2737023 - DNA, 17 bp, Homo sapiens
agcctcccaagtagctg

SEQ ID NO: 2737024 - DNA, 13 bp, Homo sapiens
agcctccctctga

SEQ ID NO: 2737025 - DNA, 14 bp, Homo sapiens
agcctccctctgac

SEQ ID NO: 2737026 - DNA, 11 bp, Homo sapiens
agcctcctgag

SEQ ID NO: 2737027 - DNA, 12 bp, Homo sapiens
agcctctgctgc

SEQ ID NO: 2737028 - DNA, 14 bp, Homo sapiens
agcctctgctgcca

SEQ ID NO: 2737029 - DNA, 18 bp, Homo sapiens
agcctctgctgccatggc

SEQ ID NO: 2737030 - DNA, 11 bp, Homo sapiens
agcctctgtgt

SEQ ID NO: 2737031 - DNA, 13 bp, Homo sapiens
agcctctgtgtca

SEQ ID NO: 2737032 - DNA, 20 bp, Homo sapiens
agcctctgtgtcactggctg

SEQ ID NO: 2737033 - DNA, 17 bp, Homo sapiens
agcctgaaccgtgtgct

SEQ ID NO: 2737034 - DNA, 11 bp, Homo sapiens
agcctgaggct

SEQ ID NO: 2737035 - DNA, 17 bp, Homo sapiens
agcctgaggctgagact

SEQ ID NO: 2737036 - DNA, 14 bp, Homo sapiens
agcctggccaacat

SEQ ID NO: 2737037 - DNA, 15 bp, Homo sapiens
agcctggccaccagc

SEQ ID NO: 2737038 - DNA, 14 bp, Homo sapiens
agcctggcccagct

SEQ ID NO: 2737039 - DNA, 17 bp, Homo sapiens
agcctggcccagctccc

SEQ ID NO: 2737040 - DNA, 18 bp, Homo sapiens
agcctggcccagctcccc

SEQ ID NO: 2737041 - DNA, 20 bp, Homo sapiens
agcctggcttctggagccct

SEQ ID NO: 2737042 - DNA, 14 bp, Homo sapiens
agcctgtcctggta

SEQ ID NO: 2737043 - DNA, 18 bp, Homo sapiens
agcctgtcgtgtccagcc

SEQ ID NO: 2737044 - DNA, 19 bp, Homo sapiens
agcctgtcgtgtccagcct

SEQ ID NO: 2737045 - DNA, 12 bp, Homo sapiens
agcgaccctggc

SEQ ID NO: 2737046 - DNA, 17 bp, Homo sapiens
agcgagctgctctgcta

SEQ ID NO: 2737047 - DNA, 19 bp, Homo sapiens
agcgaggaaaggattttac

SEQ ID NO: 2737048 - DNA, 12 bp, Homo sapiens
agcgcacctgcc

SEQ ID NO: 2737049 - DNA, 14 bp, Homo sapiens
agcgcacctgcccc

SEQ ID NO: 2737050 - DNA, 13 bp, Homo sapiens
agcgcctcctgga

SEQ ID NO: 2737051 - DNA, 14 bp, Homo sapiens
agcgcctcctggac

SEQ ID NO: 2737052 - DNA, 16 bp, Homo sapiens
agcgcctgtcccctca

SEQ ID NO: 2737053 - DNA, 19 bp, Homo sapiens
agcgcctgtcccctcacag

SEQ ID NO: 2737054 - DNA, 22 bp, Homo sapiens
agcgcctgtcccctcacagact

SEQ ID NO: 2737055 - DNA, 15 bp, Homo sapiens
agcgctggctccagg

SEQ ID NO: 2737056 - DNA, 22 bp, Homo sapiens
agcggaaaaggttttattttgt

SEQ ID NO: 2737057 - DNA, 20 bp, Homo sapiens
agcggatgctggccacagaa

SEQ ID NO: 2737058 - DNA, 13 bp, Homo sapiens
agcggccttgaag

SEQ ID NO: 2737059 - DNA, 23 bp, Homo sapiens
agcgtccatttcttatttaatta

SEQ ID NO: 2737060 - DNA, 16 bp, Homo sapiens
agctagctatttctat

SEQ ID NO: 2737061 - DNA, 18 bp, Homo sapiens
agctattagcaactgtgc

SEQ ID NO: 2737062 - DNA, 14 bp, Homo sapiens
agctattcaggagg

SEQ ID NO: 2737063 - DNA, 20 bp, Homo sapiens
agctattcaggaggctgagg

SEQ ID NO: 2737064 - DNA, 17 bp, Homo sapiens
agctattcccttctgat

SEQ ID NO: 2737065 - DNA, 19 bp, Homo sapiens
agctattcccttctgatct

SEQ ID NO: 2737066 - DNA, 18 bp, Homo sapiens
agctatttcctttgcgca

SEQ ID NO: 2737067 - DNA, 16 bp, Homo sapiens
agctatttctatgtat

SEQ ID NO: 2737068 - DNA, 20 bp, Homo sapiens
agctcataagctgtagaact

SEQ ID NO: 2737069 - DNA, 14 bp, Homo sapiens
agctccctggtgag

SEQ ID NO: 2737070 - DNA, 22 bp, Homo sapiens
agctccctggtgagggagcctc

SEQ ID NO: 2737071 - DNA, 14 bp, Homo sapiens
agctcctcccctgc

SEQ ID NO: 2737072 - DNA, 15 bp, Homo sapiens
agctcctcccctgcc

SEQ ID NO: 2737073 - DNA, 16 bp, Homo sapiens
agctcctcccctgccg

SEQ ID NO: 2737074 - DNA, 17 bp, Homo sapiens
agctcctcccctgccgc

SEQ ID NO: 2737075 - DNA, 19 bp, Homo sapiens
agctcctgtccctacccac

SEQ ID NO: 2737076 - DNA, 20 bp, Homo sapiens
agctcctgtccctacccact

SEQ ID NO: 2737077 - DNA, 13 bp, Homo sapiens
agctctatctgca

SEQ ID NO: 2737078 - DNA, 17 bp, Homo sapiens
agctctatctgcaatgt

SEQ ID NO: 2737079 - DNA, 15 bp, Homo sapiens
agctctcctgctgca

SEQ ID NO: 2737080 - DNA, 12 bp, Homo sapiens
agctctgctgga

SEQ ID NO: 2737081 - DNA, 20 bp, Homo sapiens
agctctggcttccagaaaac

SEQ ID NO: 2737082 - DNA, 14 bp, Homo sapiens
agctcttgggcctg

SEQ ID NO: 2737083 - DNA, 15 bp, Homo sapiens
agctcttgggcctga

SEQ ID NO: 2737084 - DNA, 17 bp, Homo sapiens
agctcttgggcctgacc

SEQ ID NO: 2737085 - DNA, 18 bp, Homo sapiens
agctcttgggcctgacct

SEQ ID NO: 2737086 - DNA, 24 bp, Homo sapiens
agctcttgggcctgacctccagtc

SEQ ID NO: 2737087 - DNA, 15 bp, Homo sapiens
agctgacagagccag

SEQ ID NO: 2737088 - DNA, 19 bp, Homo sapiens
agctgacagagccagaggc

SEQ ID NO: 2737089 - DNA, 13 bp, Homo sapiens
agctgacagtcct

SEQ ID NO: 2737090 - DNA, 14 bp, Homo sapiens
agctgagctggcct

SEQ ID NO: 2737091 - DNA, 16 bp, Homo sapiens
agctgaggcctccctt

SEQ ID NO: 2737092 - DNA, 16 bp, Homo sapiens
agctgcagcttcctgt

SEQ ID NO: 2737093 - DNA, 18 bp, Homo sapiens
agctgcgggctgagggca

SEQ ID NO: 2737094 - DNA, 24 bp, Homo sapiens
agctgcgggctgagggcatctctg

SEQ ID NO: 2737095 - DNA, 21 bp, Homo sapiens
agctgctaggggaaggactgg

SEQ ID NO: 2737096 - DNA, 13 bp, Homo sapiens
agctgctgccact

SEQ ID NO: 2737097 - DNA, 18 bp, Homo sapiens
agctggcagcctccagtg

SEQ ID NO: 2737098 - DNA, 23 bp, Homo sapiens
agctggcagcctccagtgggagg

SEQ ID NO: 2737099 - DNA, 18 bp, Homo sapiens
agctggcctctagaacac

SEQ ID NO: 2737100 - DNA, 23 bp, Homo sapiens
agctggcctctagaacacccact

SEQ ID NO: 2737101 - DNA, 17 bp, Homo sapiens
agctgggactacaggca

SEQ ID NO: 2737102 - DNA, 12 bp, Homo sapiens
agctgggcccac

SEQ ID NO: 2737103 - DNA, 15 bp, Homo sapiens
agctgggcccacagc

SEQ ID NO: 2737104 - DNA, 16 bp, Homo sapiens
agctgggcccacagcc

SEQ ID NO: 2737105 - DNA, 19 bp, Homo sapiens
agctgggcccacagccccc

SEQ ID NO: 2737106 - DNA, 22 bp, Homo sapiens
agctgggcccacagcccccacc

SEQ ID NO: 2737107 - DNA, 13 bp, Homo sapiens
agctggtgccaga

SEQ ID NO: 2737108 - DNA, 21 bp, Homo sapiens
agctggtggatggtgactttt

SEQ ID NO: 2737109 - DNA, 16 bp, Homo sapiens
agctgtaaatataaat

SEQ ID NO: 2737110 - DNA, 22 bp, Homo sapiens
agctgtagaactctgcaggcag

SEQ ID NO: 2737111 - DNA, 21 bp, Homo sapiens
agctgtataattaattgtcat

SEQ ID NO: 2737112 - DNA, 19 bp, Homo sapiens
agctgtcccctggagaagg

SEQ ID NO: 2737113 - DNA, 12 bp, Homo sapiens
agctgtgccacc

SEQ ID NO: 2737114 - DNA, 20 bp, Homo sapiens
agctgtgccaccctgggctc

SEQ ID NO: 2737115 - DNA, 14 bp, Homo sapiens
agctgtggtcccac

SEQ ID NO: 2737116 - DNA, 17 bp, Homo sapiens
agctgtggtcccaccca

SEQ ID NO: 2737117 - DNA, 13 bp, Homo sapiens
agctgtgtctctg

SEQ ID NO: 2737118 - DNA, 16 bp, Homo sapiens
agctgtgtctctgtat

SEQ ID NO: 2737119 - DNA, 16 bp, Homo sapiens
agcttaaagagaaaaa

SEQ ID NO: 2737120 - DNA, 18 bp, Homo sapiens
agcttagattttctgtaa

SEQ ID NO: 2737121 - DNA, 19 bp, Homo sapiens
agcttatttagcacatttt

SEQ ID NO: 2737122 - DNA, 21 bp, Homo sapiens
agcttatttagcacattttga

SEQ ID NO: 2737123 - DNA, 18 bp, Homo sapiens
agcttcatatctaattta

SEQ ID NO: 2737124 - DNA, 17 bp, Homo sapiens
agcttctcttgaaaact

SEQ ID NO: 2737125 - DNA, 15 bp, Homo sapiens
agcttctgctgggct

SEQ ID NO: 2737126 - DNA, 22 bp, Homo sapiens
agcttgactctactcccagcgc

SEQ ID NO: 2737127 - DNA, 13 bp, Homo sapiens
agcttgtaaatac

SEQ ID NO: 2737128 - DNA, 14 bp, Homo sapiens
agctttgggaaagc

SEQ ID NO: 2737129 - DNA, 14 bp, Homo sapiens
aggaaaagcctctg

SEQ ID NO: 2737130 - DNA, 15 bp, Homo sapiens
aggaaaagcctctgt

SEQ ID NO: 2737131 - DNA, 11 bp, Homo sapiens
aggaaagcacc

SEQ ID NO: 2737132 - DNA, 21 bp, Homo sapiens
aggaaagcaccgcagcatgtg

SEQ ID NO: 2737133 - DNA, 16 bp, Homo sapiens
aggaagctctctttcc

SEQ ID NO: 2737134 - DNA, 17 bp, Homo sapiens
aggaagggagggagctg

SEQ ID NO: 2737135 - DNA, 13 bp, Homo sapiens
aggaatttaattt

SEQ ID NO: 2737136 - DNA, 11 bp, Homo sapiens
aggacaaacag

SEQ ID NO: 2737137 - DNA, 16 bp, Homo sapiens
aggacaaacagtgaat

SEQ ID NO: 2737138 - DNA, 21 bp, Homo sapiens
aggacaacctgcccctcccca

SEQ ID NO: 2737139 - DNA, 15 bp, Homo sapiens
aggacagtgcttcag

SEQ ID NO: 2737140 - DNA, 16 bp, Homo sapiens
aggacagtgcttcagc

SEQ ID NO: 2737141 - DNA, 17 bp, Homo sapiens
aggacagtgcttcagcc

SEQ ID NO: 2737142 - DNA, 21 bp, Homo sapiens
aggacatgatggagcgcacct

SEQ ID NO: 2737143 - DNA, 22 bp, Homo sapiens
ataatttaaagaaacactaaat

SEQ ID NO: 2737144 - DNA, 20 bp, Homo sapiens
ataatttcagttattttgct

SEQ ID NO: 2737145 - DNA, 12 bp, Homo sapiens
ataatttgcaat

SEQ ID NO: 2737146 - DNA, 17 bp, Homo sapiens
ataatttgcaatttcag

SEQ ID NO: 2737147 - DNA, 19 bp, Homo sapiens
ataattttttgcagtcttt

SEQ ID NO: 2737148 - DNA, 23 bp, Homo sapiens
ataattttttgcagtcttttgct

SEQ ID NO: 2737149 - DNA, 12 bp, Homo sapiens
atacaaacaggt

SEQ ID NO: 2737150 - DNA, 18 bp, Homo sapiens
atacaacctatgtaattt

SEQ ID NO: 2737151 - DNA, 13 bp, Homo sapiens
atacataaacagt

SEQ ID NO: 2737152 - DNA, 15 bp, Homo sapiens
atacatgctgctaat

SEQ ID NO: 2737153 - DNA, 22 bp, Homo sapiens
atactggcctcgcctggcctga

SEQ ID NO: 2737154 - DNA, 17 bp, Homo sapiens
atacttattattttgca

SEQ ID NO: 2737155 - DNA, 23 bp, Homo sapiens
atactttaatttttataaatatg

SEQ ID NO: 2737156 - DNA, 17 bp, Homo sapiens
atagaattatattttct

SEQ ID NO: 2737157 - DNA, 22 bp, Homo sapiens
atagacgggttgaaagacatca

SEQ ID NO: 2737158 - DNA, 23 bp, Homo sapiens
atagacgggttgaaagacatcaa

SEQ ID NO: 2737159 - DNA, 14 bp, Homo sapiens
atagagatatttaa

SEQ ID NO: 2737160 - DNA, 17 bp, Homo sapiens
atagcaaggccagggca

SEQ ID NO: 2737161 - DNA, 16 bp, Homo sapiens
atagcattctctatca

SEQ ID NO: 2737162 - DNA, 22 bp, Homo sapiens
atagctagctatttctatgtat

SEQ ID NO: 2737163 - DNA, 17 bp, Homo sapiens
atagctctacacaacat

SEQ ID NO: 2737164 - DNA, 14 bp, Homo sapiens
ataggcagatcttt

SEQ ID NO: 2737165 - DNA, 23 bp, Homo sapiens
atagggaaggtatatcaggaggg

SEQ ID NO: 2737166 - DNA, 20 bp, Homo sapiens
atagggtccttgaaacagaa

SEQ ID NO: 2737167 - DNA, 17 bp, Homo sapiens
atagtcaatcaaacagg

SEQ ID NO: 2737168 - DNA, 21 bp, Homo sapiens
atagtcaatcaaacagggaca

SEQ ID NO: 2737169 - DNA, 14 bp, Homo sapiens
atagtcagagtgtc

SEQ ID NO: 2737170 - DNA, 14 bp, Homo sapiens
atataaagaaaatc

SEQ ID NO: 2737171 - DNA, 19 bp, Homo sapiens
atataataaatatatattt

SEQ ID NO: 2737172 - DNA, 14 bp, Homo sapiens
atataatgaacacg

SEQ ID NO: 2737173 - DNA, 18 bp, Homo sapiens
atatacaagcaagcaaaa

SEQ ID NO: 2737174 - DNA, 17 bp, Homo sapiens
atatagctctacacaac

SEQ ID NO: 2737175 - DNA, 21 bp, Homo sapiens
atatagctctacacaacatgt

SEQ ID NO: 2737176 - DNA, 22 bp, Homo sapiens
atatagctctacacaacatgta

SEQ ID NO: 2737177 - DNA, 17 bp, Homo sapiens
atatagttgtctttctt

SEQ ID NO: 2737178 - DNA, 14 bp, Homo sapiens
atatatatttatca

SEQ ID NO: 2737179 - DNA, 15 bp, Homo sapiens
atatatcataaagta

SEQ ID NO: 2737180 - DNA, 16 bp, Homo sapiens
atatatgtatatgtat

SEQ ID NO: 2737181 - DNA, 23 bp, Homo sapiens
atatattctacacatatatgtat

SEQ ID NO: 2737182 - DNA, 12 bp, Homo sapiens
atatattgctgc

SEQ ID NO: 2737183 - DNA, 12 bp, Homo sapiens
atatcaggaggg

SEQ ID NO: 2737184 - DNA, 12 bp, Homo sapiens
atatcataaagt

SEQ ID NO: 2737185 - DNA, 22 bp, Homo sapiens
atatcatttttataaattttaa

SEQ ID NO: 2737186 - DNA, 16 bp, Homo sapiens
atatccacaaatgcta

SEQ ID NO: 2737187 - DNA, 17 bp, Homo sapiens
atatctagtcaataact

SEQ ID NO: 2737188 - DNA, 13 bp, Homo sapiens
atatctatatctc

SEQ ID NO: 2737189 - DNA, 18 bp, Homo sapiens
atatctgagaagtgtata

SEQ ID NO: 2737190 - DNA, 19 bp, Homo sapiens
atatctgagaagtgtatat

SEQ ID NO: 2737191 - DNA, 15 bp, Homo sapiens
atatgcaatcctact

SEQ ID NO: 2737192 - DNA, 12 bp, Homo sapiens
atatggatattt

SEQ ID NO: 2737193 - DNA, 23 bp, Homo sapiens
atatggatatttttaatttatga

SEQ ID NO: 2737194 - DNA, 16 bp, Homo sapiens
atatgtatatgtatat

SEQ ID NO: 2737195 - DNA, 22 bp, Homo sapiens
atattaaatgactttttgaatg

SEQ ID NO: 2737196 - DNA, 14 bp, Homo sapiens
atattaagaaacaa

SEQ ID NO: 2737197 - DNA, 14 bp, Homo sapiens
atattattaatata

SEQ ID NO: 2737198 - DNA, 14 bp, Homo sapiens
atattcaaattcat

SEQ ID NO: 2737199 - DNA, 22 bp, Homo sapiens
atattcacacctcacgctctgg

SEQ ID NO: 2737200 - DNA, 22 bp, Homo sapiens
atattcagtgctgtggcctggg

SEQ ID NO: 2737201 - DNA, 23 bp, Homo sapiens
atattcagtgctgtggcctgggc

SEQ ID NO: 2737202 - DNA, 20 bp, Homo sapiens
atattcatcaaataaacctt

SEQ ID NO: 2737203 - DNA, 14 bp, Homo sapiens
atattcccatggta

SEQ ID NO: 2737204 - DNA, 21 bp, Homo sapiens
atattccgggtgccattccca

SEQ ID NO: 2737205 - DNA, 16 bp, Homo sapiens
atattctaaattcact

SEQ ID NO: 2737206 - DNA, 18 bp, Homo sapiens
atattctaaattcactgt

SEQ ID NO: 2737207 - DNA, 21 bp, Homo sapiens
atattctacacatatatgtat

SEQ ID NO: 2737208 - DNA, 22 bp, Homo sapiens
atattctacacatatatgtata

SEQ ID NO: 2737209 - DNA, 12 bp, Homo sapiens
atattcttttgt

SEQ ID NO: 2737210 - DNA, 17 bp, Homo sapiens
atattgaccatgtgatt

SEQ ID NO: 2737211 - DNA, 18 bp, Homo sapiens
atattgaccatgtgatta

SEQ ID NO: 2737212 - DNA, 19 bp, Homo sapiens
atattgaccatgtgattat

SEQ ID NO: 2737213 - DNA, 21 bp, Homo sapiens
atattgctcttaaaaatcttg

SEQ ID NO: 2737214 - DNA, 22 bp, Homo sapiens
atatttaataggataaattaat

SEQ ID NO: 2737215 - DNA, 21 bp, Homo sapiens
atatttacatgaattgcattt

SEQ ID NO: 2737216 - DNA, 13 bp, Homo sapiens
atatttactttaa

SEQ ID NO: 2737217 - DNA, 13 bp, Homo sapiens
atatttatttatg

SEQ ID NO: 2737218 - DNA, 16 bp, Homo sapiens
atatttcttcaagtga

SEQ ID NO: 2737219 - DNA, 14 bp, Homo sapiens
atcaaacatgaaaa

SEQ ID NO: 2737220 - DNA, 15 bp, Homo sapiens
atcaacacttttctc

SEQ ID NO: 2737221 - DNA, 23 bp, Homo sapiens
atcaacttttctgagctggtgta

SEQ ID NO: 2737222 - DNA, 19 bp, Homo sapiens
atcaagagtctctccagcc

SEQ ID NO: 2737223 - DNA, 20 bp, Homo sapiens
atcaagagtctctccagcct

SEQ ID NO: 2737224 - DNA, 14 bp, Homo sapiens
atcaagtctgtgaa

SEQ ID NO: 2737225 - DNA, 12 bp, Homo sapiens
atcaatgaagga

SEQ ID NO: 2737226 - DNA, 19 bp, Homo sapiens
atcacaaaagctgtgtctc

SEQ ID NO: 2737227 - DNA, 21 bp, Homo sapiens
atcacaaaagctgtgtctctg

SEQ ID NO: 2737228 - DNA, 23 bp, Homo sapiens
atcacaaaagctgtgtctctgta

SEQ ID NO: 2737229 - DNA, 13 bp, Homo sapiens
atcacaaacatat

SEQ ID NO: 2737230 - DNA, 19 bp, Homo sapiens
atcacagggcagagccggg

SEQ ID NO: 2737231 - DNA, 18 bp, Homo sapiens
atcaccaagtgtggaatt

SEQ ID NO: 2737232 - DNA, 12 bp, Homo sapiens
atcacctgaggt

SEQ ID NO: 2737233 - DNA, 12 bp, Homo sapiens
atcactgctccc

SEQ ID NO: 2737234 - DNA, 14 bp, Homo sapiens
atcactggagccca

SEQ ID NO: 2737235 - DNA, 16 bp, Homo sapiens
atcactggagcccagg

SEQ ID NO: 2737236 - DNA, 17 bp, Homo sapiens
atcactggagcccagga

SEQ ID NO: 2737237 - DNA, 19 bp, Homo sapiens
atcagaagtaactcccact

SEQ ID NO: 2737238 - DNA, 20 bp, Homo sapiens
atcagagctggcagcctcca

SEQ ID NO: 2737239 - DNA, 22 bp, Homo sapiens
atcagagctggcagcctccagt

SEQ ID NO: 2737240 - DNA, 22 bp, Homo sapiens
atcagctattcccttctgatct

SEQ ID NO: 2737241 - DNA, 21 bp, Homo sapiens
atcagctttttgtattaacaa

SEQ ID NO: 2737242 - DNA, 22 bp, Homo sapiens
atcagctttttgtattaacaaa

SEQ ID NO: 2737243 - DNA, 10 bp, Homo sapiens
atcaggaggg

SEQ ID NO: 2737244 - DNA, 21 bp, Homo sapiens
atcaggtcattattttttaca

SEQ ID NO: 2737245 - DNA, 22 bp, Homo sapiens
atcagtgtgccccccatcctgg

SEQ ID NO: 2737246 - DNA, 12 bp, Homo sapiens
atcataaagtat

SEQ ID NO: 2737247 - DNA, 12 bp, Homo sapiens
atcatcaggttt

SEQ ID NO: 2737248 - DNA, 20 bp, Homo sapiens
atcattggtatctgatatct

SEQ ID NO: 2737249 - DNA, 22 bp, Homo sapiens
atcattggtatctgatatctgt

SEQ ID NO: 2737250 - DNA, 14 bp, Homo sapiens
atccaaatgctgtg

SEQ ID NO: 2737251 - DNA, 19 bp, Homo sapiens
atccaaatgctgtgcaaac

SEQ ID NO: 2737252 - DNA, 18 bp, Homo sapiens
atccaaccccccacctgc

SEQ ID NO: 2737253 - DNA, 13 bp, Homo sapiens
atccaattggata

SEQ ID NO: 2737254 - DNA, 16 bp, Homo sapiens
atccacaaatgctatt

SEQ ID NO: 2737255 - DNA, 23 bp, Homo sapiens
atccaggcttctcccggacctgg

SEQ ID NO: 2737256 - DNA, 16 bp, Homo sapiens
atccagtagggaaaat

SEQ ID NO: 2737257 - DNA, 14 bp, Homo sapiens
atccagtctgcaga

SEQ ID NO: 2737258 - DNA, 19 bp, Homo sapiens
atccatgtgctgctgtggc

SEQ ID NO: 2737259 - DNA, 14 bp, Homo sapiens
atccattgtggaaa

SEQ ID NO: 2737260 - DNA, 23 bp, Homo sapiens
atccatttggcagaactgctggg

SEQ ID NO: 2737261 - DNA, 23 bp, Homo sapiens
atcccagcatctcagagtccagt

SEQ ID NO: 2737262 - DNA, 17 bp, Homo sapiens
atcccctgtcccctggg

SEQ ID NO: 2737263 - DNA, 18 bp, Homo sapiens
atcccctgtcccctgggg

SEQ ID NO: 2737264 - DNA, 19 bp, Homo sapiens
atcccctgtcccctggggc

SEQ ID NO: 2737265 - DNA, 21 bp, Homo sapiens
atcccggtgcatgcaggtctc

SEQ ID NO: 2737266 - DNA, 19 bp, Homo sapiens
attttgagggtgtaaccag

SEQ ID NO: 2737267 - DNA, 23 bp, Homo sapiens
attttgatattttcacagatgga

SEQ ID NO: 2737268 - DNA, 14 bp, Homo sapiens
attttgatcagtgt

SEQ ID NO: 2737269 - DNA, 21 bp, Homo sapiens
attttgctggagactatttaa

SEQ ID NO: 2737270 - DNA, 22 bp, Homo sapiens
attttggaaaaatgtcactgaa

SEQ ID NO: 2737271 - DNA, 16 bp, Homo sapiens
attttggacgtgtgag

SEQ ID NO: 2737272 - DNA, 16 bp, Homo sapiens
attttgtaattattgt

SEQ ID NO: 2737273 - DNA, 21 bp, Homo sapiens
attttgtcacagctcttgttt

SEQ ID NO: 2737274 - DNA, 12 bp, Homo sapiens
attttgtcttta

SEQ ID NO: 2737275 - DNA, 16 bp, Homo sapiens
attttgttttttaagt

SEQ ID NO: 2737276 - DNA, 12 bp, Homo sapiens
atttttaaaagg

SEQ ID NO: 2737277 - DNA, 21 bp, Homo sapiens
atttttaaaggacaaacagtg

SEQ ID NO: 2737278 - DNA, 18 bp, Homo sapiens
atttttacaaataaagat

SEQ ID NO: 2737279 - DNA, 15 bp, Homo sapiens
atttttattatttgt

SEQ ID NO: 2737280 - DNA, 19 bp, Homo sapiens
atttttctgggaagaaaat

SEQ ID NO: 2737281 - DNA, 21 bp, Homo sapiens
atttttgaaagaattctattt

SEQ ID NO: 2737282 - DNA, 16 bp, Homo sapiens
atttttgctcttctgt

SEQ ID NO: 2737283 - DNA, 19 bp, Homo sapiens
atttttgtacattatgtta

SEQ ID NO: 2737284 - DNA, 20 bp, Homo sapiens
atttttgtacattatgttat

SEQ ID NO: 2737285 - DNA, 16 bp, Homo sapiens
attttttaaataaaat

SEQ ID NO: 2737286 - DNA, 15 bp, Homo sapiens
attttttgcagtctt

SEQ ID NO: 2737287 - DNA, 17 bp, Homo sapiens
attttttgcagtctttt

SEQ ID NO: 2737288 - DNA, 15 bp, Homo sapiens
atttttttttgtaaa

SEQ ID NO: 2737289 - DNA, 22 bp, Homo sapiens
attttttttttaaataaaagca

SEQ ID NO: 2737290 - DNA, 15 bp, Homo sapiens
caaaaaaaatcttta

SEQ ID NO: 2737291 - DNA, 19 bp, Homo sapiens
caaaaatctcccagtgaca

SEQ ID NO: 2737292 - DNA, 12 bp, Homo sapiens
caaaacatttct

SEQ ID NO: 2737293 - DNA, 11 bp, Homo sapiens
caaaagcaaac

SEQ ID NO: 2737294 - DNA, 15 bp, Homo sapiens
caaaagctgtgtctc

SEQ ID NO: 2737295 - DNA, 17 bp, Homo sapiens
caaaagctgtgtctctg

SEQ ID NO: 2737296 - DNA, 18 bp, Homo sapiens
caaaagttcatataattt

SEQ ID NO: 2737297 - DNA, 23 bp, Homo sapiens
caaaatattatgcaaactactgt

SEQ ID NO: 2737298 - DNA, 17 bp, Homo sapiens
caaaatctaaaagctgt

SEQ ID NO: 2737299 - DNA, 19 bp, Homo sapiens
caaacacacagactctgtg

SEQ ID NO: 2737300 - DNA, 14 bp, Homo sapiens
caaacactgggctc

SEQ ID NO: 2737301 - DNA, 12 bp, Homo sapiens
caaacaggtgct

SEQ ID NO: 2737302 - DNA, 16 bp, Homo sapiens
caaacaggtgctaaca

SEQ ID NO: 2737303 - DNA, 12 bp, Homo sapiens
caaacagtgaat

SEQ ID NO: 2737304 - DNA, 15 bp, Homo sapiens
caaacatgaaaacat

SEQ ID NO: 2737305 - DNA, 16 bp, Homo sapiens
caaacatgaaaacatt

SEQ ID NO: 2737306 - DNA, 18 bp, Homo sapiens
caaacatgaaaacattga

SEQ ID NO: 2737307 - DNA, 21 bp, Homo sapiens
caaacatgtgcaactcttgta

SEQ ID NO: 2737308 - DNA, 12 bp, Homo sapiens
caaaccaggagc

SEQ ID NO: 2737309 - DNA, 13 bp, Homo sapiens
caaaccctgtggg

SEQ ID NO: 2737310 - DNA, 17 bp, Homo sapiens
caaactggggcctccct

SEQ ID NO: 2737311 - DNA, 15 bp, Homo sapiens
caaagaaaaccctaa

SEQ ID NO: 2737312 - DNA, 18 bp, Homo sapiens
caaagaaatttccactca

SEQ ID NO: 2737313 - DNA, 22 bp, Homo sapiens
caaagagtctctggctcagctg

SEQ ID NO: 2737314 - DNA, 15 bp, Homo sapiens
caaagatctcagcag

SEQ ID NO: 2737315 - DNA, 17 bp, Homo sapiens
caaagccaaactctgcc

SEQ ID NO: 2737316 - DNA, 22 bp, Homo sapiens
caaagccaaactctgccagcca

SEQ ID NO: 2737317 - DNA, 16 bp, Homo sapiens
caaagccatattctaa

SEQ ID NO: 2737318 - DNA, 19 bp, Homo sapiens
caaagccatattctaaatt

SEQ ID NO: 2737319 - DNA, 18 bp, Homo sapiens
caaagccttggtcccgtg

SEQ ID NO: 2737320 - DNA, 20 bp, Homo sapiens
caaaggactgtaagcagatt

SEQ ID NO: 2737321 - DNA, 16 bp, Homo sapiens
caaaggccagcagcag

SEQ ID NO: 2737322 - DNA, 18 bp, Homo sapiens
caaagggcagtaaagttt

SEQ ID NO: 2737323 - DNA, 15 bp, Homo sapiens
caaagtctaaagttt

SEQ ID NO: 2737324 - DNA, 20 bp, Homo sapiens
caaagtctaaagtttacagt

SEQ ID NO: 2737325 - DNA, 17 bp, Homo sapiens
caaagttatatttactt

SEQ ID NO: 2737326 - DNA, 13 bp, Homo sapiens
caaagttccagtt

SEQ ID NO: 2737327 - DNA, 14 bp, Homo sapiens
caaagttttcagat

SEQ ID NO: 2737328 - DNA, 18 bp, Homo sapiens
caaataaaccttgtttct

SEQ ID NO: 2737329 - DNA, 22 bp, Homo sapiens
caaataattttttgcagtcttt

SEQ ID NO: 2737330 - DNA, 13 bp, Homo sapiens
caaatacatacaa

SEQ ID NO: 2737331 - DNA, 23 bp, Homo sapiens
caaatacatacaacctatgtaat

SEQ ID NO: 2737332 - DNA, 15 bp, Homo sapiens
caaatagcaaggcca

SEQ ID NO: 2737333 - DNA, 20 bp, Homo sapiens
caaatgagcattagctactt

SEQ ID NO: 2737334 - DNA, 16 bp, Homo sapiens
caaatgcattcatgtt

SEQ ID NO: 2737335 - DNA, 17 bp, Homo sapiens
caaatgcattcatgttt

SEQ ID NO: 2737336 - DNA, 15 bp, Homo sapiens
caaatgctgtgcaaa

SEQ ID NO: 2737337 - DNA, 22 bp, Homo sapiens
caaatgctgtgcaaacagtgta

SEQ ID NO: 2737338 - DNA, 17 bp, Homo sapiens
caaatggcttacttaca

SEQ ID NO: 2737339 - DNA, 19 bp, Homo sapiens
caaatggcttacttacaaa

SEQ ID NO: 2737340 - DNA, 19 bp, Homo sapiens
caaatgtgtcccagtgaac

SEQ ID NO: 2737341 - DNA, 12 bp, Homo sapiens
caaattaatctt

SEQ ID NO: 2737342 - DNA, 22 bp, Homo sapiens
caaattgtctgtctgctcttat

SEQ ID NO: 2737343 - DNA, 21 bp, Homo sapiens
caaattttattaaaagagtag

SEQ ID NO: 2737344 - DNA, 19 bp, Homo sapiens
caaattttgaggtctttta

SEQ ID NO: 2737345 - DNA, 12 bp, Homo sapiens
caacaaacactg

SEQ ID NO: 2737346 - DNA, 16 bp, Homo sapiens
caacaaggtgcacaga

SEQ ID NO: 2737347 - DNA, 13 bp, Homo sapiens
caacaagtaactt

SEQ ID NO: 2737348 - DNA, 22 bp, Homo sapiens
caacaatacatgctgctaattc

SEQ ID NO: 2737349 - DNA, 20 bp, Homo sapiens
caacacatgtgggagaggag

SEQ ID NO: 2737350 - DNA, 14 bp, Homo sapiens
caacactcttcttg

SEQ ID NO: 2737351 - DNA, 21 bp, Homo sapiens
caacagtgaacagcttcactt

SEQ ID NO: 2737352 - DNA, 22 bp, Homo sapiens
caacagtgttaggcctggcaca

SEQ ID NO: 2737353 - DNA, 23 bp, Homo sapiens
caacagtgttaggcctggcacag

SEQ ID NO: 2737354 - DNA, 12 bp, Homo sapiens
caacagtttctc

SEQ ID NO: 2737355 - DNA, 21 bp, Homo sapiens
caacatggattccaaagcatt

SEQ ID NO: 2737356 - DNA, 18 bp, Homo sapiens
caacatggcgaaaccccg

SEQ ID NO: 2737357 - DNA, 15 bp, Homo sapiens
caacatgtatgtgga

SEQ ID NO: 2737358 - DNA, 13 bp, Homo sapiens
caacatgtttctg

SEQ ID NO: 2737359 - DNA, 18 bp, Homo sapiens
caacattaccttgtcttt

SEQ ID NO: 2737360 - DNA, 16 bp, Homo sapiens
caacccagccgctgcc

SEQ ID NO: 2737361 - DNA, 17 bp, Homo sapiens
caacccagccgctgccc

SEQ ID NO: 2737362 - DNA, 13 bp, Homo sapiens
caacccagcctga

SEQ ID NO: 2737363 - DNA, 13 bp, Homo sapiens
caaccccagctgg

SEQ ID NO: 2737364 - DNA, 16 bp, Homo sapiens
caaccccagctggcct

SEQ ID NO: 2737365 - DNA, 20 bp, Homo sapiens
caacccccagcacccgggct

SEQ ID NO: 2737366 - DNA, 16 bp, Homo sapiens
caaccccccacctgcc

SEQ ID NO: 2737367 - DNA, 18 bp, Homo sapiens
caacctgcctgtgcatga

SEQ ID NO: 2737368 - DNA, 14 bp, Homo sapiens
caacctgtccttac

SEQ ID NO: 2737369 - DNA, 23 bp, Homo sapiens
caacctgtccttactcagagctg

SEQ ID NO: 2737370 - DNA, 14 bp, Homo sapiens
caacctgtgtctta

SEQ ID NO: 2737371 - DNA, 18 bp, Homo sapiens
caacgctctaccctgcag

SEQ ID NO: 2737372 - DNA, 20 bp, Homo sapiens
caacgctctaccctgcagct

SEQ ID NO: 2737373 - DNA, 23 bp, Homo sapiens
caacgctctaccctgcagcttgg

SEQ ID NO: 2737374 - DNA, 23 bp, Homo sapiens
caactcccggaggtgtcaccttc

SEQ ID NO: 2737375 - DNA, 15 bp, Homo sapiens
caacttgattcttgt

SEQ ID NO: 2737376 - DNA, 19 bp, Homo sapiens
caagaaaacctgtttttaa

SEQ ID NO: 2737377 - DNA, 15 bp, Homo sapiens
caagaaggtttctgt

SEQ ID NO: 2737378 - DNA, 22 bp, Homo sapiens
caagacagtggcactaaaatgt

SEQ ID NO: 2737379 - DNA, 14 bp, Homo sapiens
caagaccagcctgg

SEQ ID NO: 2737380 - DNA, 16 bp, Homo sapiens
caagactctgtctcaa

SEQ ID NO: 2737381 - DNA, 18 bp, Homo sapiens
caagacttcactgcagcc

SEQ ID NO: 2737382 - DNA, 20 bp, Homo sapiens
caagacttcactgcagcctt

SEQ ID NO: 2737383 - DNA, 21 bp, Homo sapiens
caagacttcactgcagccttt

SEQ ID NO: 2737384 - DNA, 12 bp, Homo sapiens
caagagaacatt

SEQ ID NO: 2737385 - DNA, 18 bp, Homo sapiens
caagagaaggcttttcta

SEQ ID NO: 2737386 - DNA, 16 bp, Homo sapiens
caagaggctcctgtcc

SEQ ID NO: 2737387 - DNA, 15 bp, Homo sapiens
caagagtctctccag

SEQ ID NO: 2737388 - DNA, 16 bp, Homo sapiens
caagagtctctccagc

SEQ ID NO: 2737389 - DNA, 17 bp, Homo sapiens
caagagtctctccagcc

SEQ ID NO: 2737390 - DNA, 21 bp, Homo sapiens
cagatttactgtcccaggagc

SEQ ID NO: 2737391 - DNA, 14 bp, Homo sapiens
cagattttctcctg

SEQ ID NO: 2737392 - DNA, 12 bp, Homo sapiens
cagcaaagccat

SEQ ID NO: 2737393 - DNA, 15 bp, Homo sapiens
cagcaaagttttcag

SEQ ID NO: 2737394 - DNA, 18 bp, Homo sapiens
cagcaaggaggctggctg

SEQ ID NO: 2737395 - DNA, 15 bp, Homo sapiens
cagcaaggcacctgc

SEQ ID NO: 2737396 - DNA, 23 bp, Homo sapiens
cagcaaggcacctgcaggttggg

SEQ ID NO: 2737397 - DNA, 17 bp, Homo sapiens
cagcaatagggtgcagt

SEQ ID NO: 2737398 - DNA, 21 bp, Homo sapiens
cagcaatagggtgcagttttc

SEQ ID NO: 2737399 - DNA, 13 bp, Homo sapiens
cagcaattaatta

SEQ ID NO: 2737400 - DNA, 21 bp, Homo sapiens
cagcacagcaaggaggctggc

SEQ ID NO: 2737401 - DNA, 16 bp, Homo sapiens
cagcacagctcctccc

SEQ ID NO: 2737402 - DNA, 22 bp, Homo sapiens
cagcacagctcctcccctgccg

SEQ ID NO: 2737403 - DNA, 15 bp, Homo sapiens
cagcacgttttctgg

SEQ ID NO: 2737404 - DNA, 15 bp, Homo sapiens
cagcagccagctcct

SEQ ID NO: 2737405 - DNA, 21 bp, Homo sapiens
cagcagccccaccccaccctg

SEQ ID NO: 2737406 - DNA, 14 bp, Homo sapiens
cagcagctgcctct

SEQ ID NO: 2737407 - DNA, 17 bp, Homo sapiens
cagcagggtcttgctgt

SEQ ID NO: 2737408 - DNA, 11 bp, Homo sapiens
cagcaggtgct

SEQ ID NO: 2737409 - DNA, 14 bp, Homo sapiens
cagcaggtgctgct

SEQ ID NO: 2737410 - DNA, 21 bp, Homo sapiens
cagcatcaaacatgaaaacat

SEQ ID NO: 2737411 - DNA, 15 bp, Homo sapiens
cagcattttcacatt

SEQ ID NO: 2737412 - DNA, 19 bp, Homo sapiens
cagcattttcacattttgc

SEQ ID NO: 2737413 - DNA, 15 bp, Homo sapiens
cagccacgaacacgc

SEQ ID NO: 2737414 - DNA, 19 bp, Homo sapiens
cagccactgcagcacagga

SEQ ID NO: 2737415 - DNA, 15 bp, Homo sapiens
cagccagccctggag

SEQ ID NO: 2737416 - DNA, 19 bp, Homo sapiens
cagccagccctggaggctg

SEQ ID NO: 2737417 - DNA, 15 bp, Homo sapiens
cagccagctcctgca

SEQ ID NO: 2737418 - DNA, 15 bp, Homo sapiens
cagccaggactcctt

SEQ ID NO: 2737419 - DNA, 13 bp, Homo sapiens
cagccccacagcc

SEQ ID NO: 2737420 - DNA, 18 bp, Homo sapiens
cagcccccaccccagcac

SEQ ID NO: 2737421 - DNA, 19 bp, Homo sapiens
cagccccgtgtagccccgg

SEQ ID NO: 2737422 - DNA, 22 bp, Homo sapiens
cagccccgtgtagccccgggct

SEQ ID NO: 2737423 - DNA, 23 bp, Homo sapiens
cagccccgtgtagccccgggctg

SEQ ID NO: 2737424 - DNA, 16 bp, Homo sapiens
cagccctggaggctgg

SEQ ID NO: 2737425 - DNA, 20 bp, Homo sapiens
cagccctggaggctggatgg

SEQ ID NO: 2737426 - DNA, 17 bp, Homo sapiens
cagccctttgcaggccc

SEQ ID NO: 2737427 - DNA, 13 bp, Homo sapiens
cagccgcctccct

SEQ ID NO: 2737428 - DNA, 16 bp, Homo sapiens
cagccgctgcccggcg

SEQ ID NO: 2737429 - DNA, 22 bp, Homo sapiens
cagccgctgcccggcgccctct

SEQ ID NO: 2737430 - DNA, 13 bp, Homo sapiens
cagccgtatttta

SEQ ID NO: 2737431 - DNA, 16 bp, Homo sapiens
cagcctcacagatgct

SEQ ID NO: 2737432 - DNA, 15 bp, Homo sapiens
cagcctccagtgctg

SEQ ID NO: 2737433 - DNA, 16 bp, Homo sapiens
cagcctccagtgctgg

SEQ ID NO: 2737434 - DNA, 17 bp, Homo sapiens
cagcctcccagctttct

SEQ ID NO: 2737435 - DNA, 14 bp, Homo sapiens
cagcctccctctga

SEQ ID NO: 2737436 - DNA, 22 bp, Homo sapiens
cagcctccctctgacctgcagg

SEQ ID NO: 2737437 - DNA, 20 bp, Homo sapiens
cagcctcctgagtagctggg

SEQ ID NO: 2737438 - DNA, 18 bp, Homo sapiens
cagcctgaggctgagact

SEQ ID NO: 2737439 - DNA, 18 bp, Homo sapiens
cagcctgagtgcaccacc

SEQ ID NO: 2737440 - DNA, 14 bp, Homo sapiens
cagcctgccccagc

SEQ ID NO: 2737441 - DNA, 19 bp, Homo sapiens
cagcctgccccagcctccc

SEQ ID NO: 2737442 - DNA, 23 bp, Homo sapiens
cagcctgccccagcctcccagct

SEQ ID NO: 2737443 - DNA, 20 bp, Homo sapiens
cagcctgccgccgtctctgt

SEQ ID NO: 2737444 - DNA, 21 bp, Homo sapiens
cagcctggcttctggagccct

SEQ ID NO: 2737445 - DNA, 19 bp, Homo sapiens
cagcctgggcgacagagca

SEQ ID NO: 2737446 - DNA, 12 bp, Homo sapiens
cagcctgtcctg

SEQ ID NO: 2737447 - DNA, 19 bp, Homo sapiens
cagcctgtcgtgtccagcc

SEQ ID NO: 2737448 - DNA, 22 bp, Homo sapiens
cagcgagttgtggaaagcctct

SEQ ID NO: 2737449 - DNA, 23 bp, Homo sapiens
cagcgcctcctggacctgaaggc

SEQ ID NO: 2737450 - DNA, 12 bp, Homo sapiens
cagcgcctgtcc

SEQ ID NO: 2737451 - DNA, 22 bp, Homo sapiens
cagcgcctgtcccctcacagac

SEQ ID NO: 2737452 - DNA, 17 bp, Homo sapiens
cagcgctggctccaggc

SEQ ID NO: 2737453 - DNA, 14 bp, Homo sapiens
cagctactcagaag

SEQ ID NO: 2737454 - DNA, 19 bp, Homo sapiens
cagctactcagaagcctga

SEQ ID NO: 2737455 - DNA, 22 bp, Homo sapiens
cagctactcagaagcctgaggc

SEQ ID NO: 2737456 - DNA, 13 bp, Homo sapiens
cagctagggctgg

SEQ ID NO: 2737457 - DNA, 22 bp, Homo sapiens
cagctattcaggaggctgaggc

SEQ ID NO: 2737458 - DNA, 23 bp, Homo sapiens
cagctattcaggaggctgaggca

SEQ ID NO: 2737459 - DNA, 14 bp, Homo sapiens
cagctcctcccctg

SEQ ID NO: 2737460 - DNA, 23 bp, Homo sapiens
cagctcctcccctgccgcctccc

SEQ ID NO: 2737461 - DNA, 20 bp, Homo sapiens
cagctctgtcaccctggcca

SEQ ID NO: 2737462 - DNA, 23 bp, Homo sapiens
cagctctgtcaccctggccacca

SEQ ID NO: 2737463 - DNA, 18 bp, Homo sapiens
cagctgacagtcctctcc

SEQ ID NO: 2737464 - DNA, 17 bp, Homo sapiens
cagctgcacctgccagc

SEQ ID NO: 2737465 - DNA, 21 bp, Homo sapiens
cagctgcacctgccagcctgg

SEQ ID NO: 2737466 - DNA, 22 bp, Homo sapiens
cagctgcacctgccagcctggc

SEQ ID NO: 2737467 - DNA, 17 bp, Homo sapiens
cagctgctgccactctg

SEQ ID NO: 2737468 - DNA, 12 bp, Homo sapiens
cagctggcctct

SEQ ID NO: 2737469 - DNA, 16 bp, Homo sapiens
cagctggctctccacc

SEQ ID NO: 2737470 - DNA, 12 bp, Homo sapiens
cagctgggccca

SEQ ID NO: 2737471 - DNA, 22 bp, Homo sapiens
cagctgggcccacagcccccac

SEQ ID NO: 2737472 - DNA, 18 bp, Homo sapiens
cagctggtggatggtgac

SEQ ID NO: 2737473 - DNA, 22 bp, Homo sapiens
cagctggtggatggtgactttt

SEQ ID NO: 2737474 - DNA, 17 bp, Homo sapiens
cagctgtagctcccgag

SEQ ID NO: 2737475 - DNA, 18 bp, Homo sapiens
cagctgtgaacatggact

SEQ ID NO: 2737476 - DNA, 20 bp, Homo sapiens
cagctgtgaacatggactct

SEQ ID NO: 2737477 - DNA, 16 bp, Homo sapiens
cagctgtggtcccacc

SEQ ID NO: 2737478 - DNA, 17 bp, Homo sapiens
cagctgtggtcccaccc

SEQ ID NO: 2737479 - DNA, 23 bp, Homo sapiens
cagctgtggtcccacccaggaag

SEQ ID NO: 2737480 - DNA, 12 bp, Homo sapiens
cagcttcagttg

SEQ ID NO: 2737481 - DNA, 13 bp, Homo sapiens
cagcttcctctga

SEQ ID NO: 2737482 - DNA, 12 bp, Homo sapiens
cagcttcctgtc

SEQ ID NO: 2737483 - DNA, 14 bp, Homo sapiens
cagcttctcttgaa

SEQ ID NO: 2737484 - DNA, 11 bp, Homo sapiens
cagcttctgcc

SEQ ID NO: 2737485 - DNA, 18 bp, Homo sapiens
cagcttctgccacttccc

SEQ ID NO: 2737486 - DNA, 19 bp, Homo sapiens
cagcttctgccacttccca

SEQ ID NO: 2737487 - DNA, 14 bp, Homo sapiens
cagcttctgctggg

SEQ ID NO: 2737488 - DNA, 15 bp, Homo sapiens
cagcttctgctgggc

SEQ ID NO: 2737489 - DNA, 17 bp, Homo sapiens
cagcttctgctgggctg

SEQ ID NO: 2737490 - DNA, 13 bp, Homo sapiens
cagcttggagaac

SEQ ID NO: 2737491 - DNA, 23 bp, Homo sapiens
cagctttccctccccagagttct

SEQ ID NO: 2737492 - DNA, 14 bp, Homo sapiens
cagctttttgtatt

SEQ ID NO: 2737493 - DNA, 19 bp, Homo sapiens
caggaaaagcctctgtgtc

SEQ ID NO: 2737494 - DNA, 15 bp, Homo sapiens
caggaaaggaagatg

SEQ ID NO: 2737495 - DNA, 15 bp, Homo sapiens
caggaagggagggag

SEQ ID NO: 2737496 - DNA, 23 bp, Homo sapiens
caggaagggagggagctgaggcc

SEQ ID NO: 2737497 - DNA, 17 bp, Homo sapiens
caggaatttaatttata

SEQ ID NO: 2737498 - DNA, 23 bp, Homo sapiens
caggacggggccggccaggtggg

SEQ ID NO: 2737499 - DNA, 24 bp, Homo sapiens
caggacggggccggccaggtgggc

SEQ ID NO: 2737500 - DNA, 19 bp, Homo sapiens
caggactccttagactgat

SEQ ID NO: 2737501 - DNA, 19 bp, Homo sapiens
caggagatggaagagtcat

SEQ ID NO: 2737502 - DNA, 15 bp, Homo sapiens
caggagctgacagag

SEQ ID NO: 2737503 - DNA, 24 bp, Homo sapiens
caggagctgacagagccagaggca

SEQ ID NO: 2737504 - DNA, 19 bp, Homo sapiens
caggaggctccgtgagccc

SEQ ID NO: 2737505 - DNA, 22 bp, Homo sapiens
caggaggctccgtgagcccttg

SEQ ID NO: 2737506 - DNA, 16 bp, Homo sapiens
caggaggggaagaggc

SEQ ID NO: 2737507 - DNA, 16 bp, Homo sapiens
caggagtcaccatgca

SEQ ID NO: 2737508 - DNA, 19 bp, Homo sapiens
caggagtcaccatgcaagg

SEQ ID NO: 2737509 - DNA, 21 bp, Homo sapiens
caggagtcaccatgcaagggt

SEQ ID NO: 2737510 - DNA, 16 bp, Homo sapiens
caggatatccccaggg

SEQ ID NO: 2737511 - DNA, 18 bp, Homo sapiens
caggatatccccagggaa

SEQ ID NO: 2737512 - DNA, 15 bp, Homo sapiens
caggatgaccctgcg

SEQ ID NO: 2737513 - DNA, 14 bp, Homo sapiens
ccagggaagccctc

SEQ ID NO: 2737514 - DNA, 19 bp, Homo sapiens
ccagggccccagaacacag

SEQ ID NO: 2737515 - DNA, 15 bp, Homo sapiens
ccagggccctgcaga

SEQ ID NO: 2737516 - DNA, 16 bp, Homo sapiens
ccaggggcaggcacag

SEQ ID NO: 2737517 - DNA, 14 bp, Homo sapiens
ccaggtaactttgc

SEQ ID NO: 2737518 - DNA, 23 bp, Homo sapiens
ccaggtaagcaggaggaggtgcc

SEQ ID NO: 2737519 - DNA, 21 bp, Homo sapiens
ccaggtctcctccaccgccat

SEQ ID NO: 2737520 - DNA, 14 bp, Homo sapiens
ccaggtgcagtggc

SEQ ID NO: 2737521 - DNA, 22 bp, Homo sapiens
ccaggtgcagtggctcacgcct

SEQ ID NO: 2737522 - DNA, 23 bp, Homo sapiens
ccaggtggggtgaggcagtgggt

SEQ ID NO: 2737523 - DNA, 17 bp, Homo sapiens
ccagtactgggaaggag

SEQ ID NO: 2737524 - DNA, 23 bp, Homo sapiens
ccagtatcctgctggttcactct

SEQ ID NO: 2737525 - DNA, 20 bp, Homo sapiens
ccagtcaagttccctcctgc

SEQ ID NO: 2737526 - DNA, 18 bp, Homo sapiens
ccagtcctagagctcctg

SEQ ID NO: 2737527 - DNA, 15 bp, Homo sapiens
ccagtcctgctggcc

SEQ ID NO: 2737528 - DNA, 21 bp, Homo sapiens
ccagtcctgctggcctgctct

SEQ ID NO: 2737529 - DNA, 20 bp, Homo sapiens
ccagtcctttgttgctgttg

SEQ ID NO: 2737530 - DNA, 18 bp, Homo sapiens
ccagtcgatatctcactt

SEQ ID NO: 2737531 - DNA, 18 bp, Homo sapiens
ccagtcgcgctgcctgtg

SEQ ID NO: 2737532 - DNA, 19 bp, Homo sapiens
ccagtcgcgctgcctgtgt

SEQ ID NO: 2737533 - DNA, 13 bp, Homo sapiens
ccagtgagcctct

SEQ ID NO: 2737534 - DNA, 16 bp, Homo sapiens
ccagtgagcctctgcg

SEQ ID NO: 2737535 - DNA, 14 bp, Homo sapiens
ccagtgctcctgtg

SEQ ID NO: 2737536 - DNA, 14 bp, Homo sapiens
ccagtgctggctgc

SEQ ID NO: 2737537 - DNA, 18 bp, Homo sapiens
ccagtgctggctgctggc

SEQ ID NO: 2737538 - DNA, 19 bp, Homo sapiens
ccagtggcccccactcaca

SEQ ID NO: 2737539 - DNA, 15 bp, Homo sapiens
ccagtgggaggacag

SEQ ID NO: 2737540 - DNA, 15 bp, Homo sapiens
ccagtgtagccttgc

SEQ ID NO: 2737541 - DNA, 18 bp, Homo sapiens
ccagtgtattttctgtgt

SEQ ID NO: 2737542 - DNA, 19 bp, Homo sapiens
ccagtgtattttctgtgtt

SEQ ID NO: 2737543 - DNA, 15 bp, Homo sapiens
ccagtgtcttcctgt

SEQ ID NO: 2737544 - DNA, 15 bp, Homo sapiens
ccagtgtgatcccaa

SEQ ID NO: 2737545 - DNA, 17 bp, Homo sapiens
ccagtgtggctgtctgc

SEQ ID NO: 2737546 - DNA, 18 bp, Homo sapiens
ccagtgtgtgctcagcag

SEQ ID NO: 2737547 - DNA, 21 bp, Homo sapiens
ccatagagatatttaaaagac

SEQ ID NO: 2737548 - DNA, 16 bp, Homo sapiens
ccatatctagtcaata

SEQ ID NO: 2737549 - DNA, 23 bp, Homo sapiens
ccatatctagtcaataactctga

SEQ ID NO: 2737550 - DNA, 14 bp, Homo sapiens
ccatattgctctta

SEQ ID NO: 2737551 - DNA, 15 bp, Homo sapiens
ccatattgctcttaa

SEQ ID NO: 2737552 - DNA, 22 bp, Homo sapiens
ccatattgctcttaaaaatctt

SEQ ID NO: 2737553 - DNA, 13 bp, Homo sapiens
ccatatttttaaa

SEQ ID NO: 2737554 - DNA, 18 bp, Homo sapiens
ccatcagtgtacccccgc

SEQ ID NO: 2737555 - DNA, 23 bp, Homo sapiens
ccatcagtgtacccccgcccagg

SEQ ID NO: 2737556 - DNA, 20 bp, Homo sapiens
ccatcccccctcaccagggg

SEQ ID NO: 2737557 - DNA, 18 bp, Homo sapiens
ccatcctcctctccatgc

SEQ ID NO: 2737558 - DNA, 19 bp, Homo sapiens
ccatcctcctctccatgca

SEQ ID NO: 2737559 - DNA, 17 bp, Homo sapiens
ccatcctggcccatcag

SEQ ID NO: 2737560 - DNA, 21 bp, Homo sapiens
ccatctcctcccaccagtggc

SEQ ID NO: 2737561 - DNA, 20 bp, Homo sapiens
ccatctctctactcctacct

SEQ ID NO: 2737562 - DNA, 16 bp, Homo sapiens
ccatctgcccaggacg

SEQ ID NO: 2737563 - DNA, 15 bp, Homo sapiens
ccatctgtccatcct

SEQ ID NO: 2737564 - DNA, 16 bp, Homo sapiens
ccatcttccaggtggg

SEQ ID NO: 2737565 - DNA, 13 bp, Homo sapiens
ccatgatacttta

SEQ ID NO: 2737566 - DNA, 14 bp, Homo sapiens
ccatgcaagtgctg

SEQ ID NO: 2737567 - DNA, 15 bp, Homo sapiens
ccatgcaagtgctgt

SEQ ID NO: 2737568 - DNA, 17 bp, Homo sapiens
ccatggagacaagaagg

SEQ ID NO: 2737569 - DNA, 20 bp, Homo sapiens
ccatggattcccctggacat

SEQ ID NO: 2737570 - DNA, 23 bp, Homo sapiens
ccatggccacgaggaagcagcaa

SEQ ID NO: 2737571 - DNA, 15 bp, Homo sapiens
ccatggccttccctc

SEQ ID NO: 2737572 - DNA, 21 bp, Homo sapiens
ccatggccttccctccccaca

SEQ ID NO: 2737573 - DNA, 20 bp, Homo sapiens
ccatgggcactgctgggtgg

SEQ ID NO: 2737574 - DNA, 22 bp, Homo sapiens
ccatgggcactgctgggtggcc

SEQ ID NO: 2737575 - DNA, 12 bp, Homo sapiens
ccatgggcctgc

SEQ ID NO: 2737576 - DNA, 15 bp, Homo sapiens
ccatggtagactgtg

SEQ ID NO: 2737577 - DNA, 18 bp, Homo sapiens
ccatggtagactgtgaca

SEQ ID NO: 2737578 - DNA, 15 bp, Homo sapiens
ccatgtatctacctc

SEQ ID NO: 2737579 - DNA, 23 bp, Homo sapiens
ccatgtgcacctatggcccagcc

SEQ ID NO: 2737580 - DNA, 23 bp, Homo sapiens
ccatgtggtttgctgttaccaaa

SEQ ID NO: 2737581 - DNA, 14 bp, Homo sapiens
ccattaccatggag

SEQ ID NO: 2737582 - DNA, 21 bp, Homo sapiens
ccattccaagtcaacactctt

SEQ ID NO: 2737583 - DNA, 14 bp, Homo sapiens
ccattctcctgcct

SEQ ID NO: 2737584 - DNA, 14 bp, Homo sapiens
ccattgtcttccaa

SEQ ID NO: 2737585 - DNA, 15 bp, Homo sapiens
ccattgtcttccaac

SEQ ID NO: 2737586 - DNA, 23 bp, Homo sapiens
ccattgtcttccaaccccagctg

SEQ ID NO: 2737587 - DNA, 20 bp, Homo sapiens
ccatttgccagattgcccca

SEQ ID NO: 2737588 - DNA, 20 bp, Homo sapiens
ccatttggcagaactgctgg

SEQ ID NO: 2737589 - DNA, 14 bp, Homo sapiens
cccaaacaccctcc

SEQ ID NO: 2737590 - DNA, 13 bp, Homo sapiens
cccaacaggccct

SEQ ID NO: 2737591 - DNA, 15 bp, Homo sapiens
cccaacccccagcac

SEQ ID NO: 2737592 - DNA, 15 bp, Homo sapiens
cccaactcccggagg

SEQ ID NO: 2737593 - DNA, 12 bp, Homo sapiens
cccaagccacag

SEQ ID NO: 2737594 - DNA, 19 bp, Homo sapiens
cccaatccatttggcagaa

SEQ ID NO: 2737595 - DNA, 14 bp, Homo sapiens
cccacacacactcc

SEQ ID NO: 2737596 - DNA, 15 bp, Homo sapiens
cccacagcccacgtc

SEQ ID NO: 2737597 - DNA, 21 bp, Homo sapiens
cccacagcccccaccccagca

SEQ ID NO: 2737598 - DNA, 14 bp, Homo sapiens
cccacagctctgct

SEQ ID NO: 2737599 - DNA, 16 bp, Homo sapiens
cccacagctctgctgg

SEQ ID NO: 2737600 - DNA, 16 bp, Homo sapiens
cccacagtagagcact

SEQ ID NO: 2737601 - DNA, 23 bp, Homo sapiens
cccacagtgactcgggctcctgt

SEQ ID NO: 2737602 - DNA, 14 bp, Homo sapiens
cccacattggaccc

SEQ ID NO: 2737603 - DNA, 20 bp, Homo sapiens
cccaccaaggtctcacactc

SEQ ID NO: 2737604 - DNA, 12 bp, Homo sapiens
cccaccagagct

SEQ ID NO: 2737605 - DNA, 15 bp, Homo sapiens
cccaccagagctgcc

SEQ ID NO: 2737606 - DNA, 18 bp, Homo sapiens
cccaccagagctgcctcc

SEQ ID NO: 2737607 - DNA, 12 bp, Homo sapiens
cccacccaggaa

SEQ ID NO: 2737608 - DNA, 13 bp, Homo sapiens
cccaccccagcac

SEQ ID NO: 2737609 - DNA, 14 bp, Homo sapiens
cccacccccacttc

SEQ ID NO: 2737610 - DNA, 18 bp, Homo sapiens
cccacccccacttcatgc

SEQ ID NO: 2737611 - DNA, 19 bp, Homo sapiens
cccaccctcaaaccctgtg

SEQ ID NO: 2737612 - DNA, 14 bp, Homo sapiens
cccaccctgcccct

SEQ ID NO: 2737613 - DNA, 22 bp, Homo sapiens
cccaccttcaattcctgggccc

SEQ ID NO: 2737614 - DNA, 19 bp, Homo sapiens
cccacggggaccactgggc

SEQ ID NO: 2737615 - DNA, 20 bp, Homo sapiens
cccacggggaccactgggcc

SEQ ID NO: 2737616 - DNA, 21 bp, Homo sapiens
cccacggggaccactgggccc

SEQ ID NO: 2737617 - DNA, 20 bp, Homo sapiens
cccacgtctctctgcctgct

SEQ ID NO: 2737618 - DNA, 15 bp, Homo sapiens
cccacgtgcacagct

SEQ ID NO: 2737619 - DNA, 16 bp, Homo sapiens
cccactaagctttctc

SEQ ID NO: 2737620 - DNA, 17 bp, Homo sapiens
cccactccccaccttca

SEQ ID NO: 2737621 - DNA, 12 bp, Homo sapiens
cccactgcaccc

SEQ ID NO: 2737622 - DNA, 14 bp, Homo sapiens
cccactgcaccccc

SEQ ID NO: 2737623 - DNA, 15 bp, Homo sapiens
cccactgcaccccct

SEQ ID NO: 2737624 - DNA, 21 bp, Homo sapiens
cccactgcaccccctcctgct

SEQ ID NO: 2737625 - DNA, 23 bp, Homo sapiens
cccactgcaccccctcctgctgc

SEQ ID NO: 2737626 - DNA, 16 bp, Homo sapiens
cccactggccagtcct

SEQ ID NO: 2737627 - DNA, 19 bp, Homo sapiens
cccacttcatgcccactgc

SEQ ID NO: 2737628 - DNA, 17 bp, Homo sapiens
cccacttcccctcctac

SEQ ID NO: 2737629 - DNA, 16 bp, Homo sapiens
cccacttccctgacac

SEQ ID NO: 2737630 - DNA, 19 bp, Homo sapiens
cccacttccctgacactgc

SEQ ID NO: 2737631 - DNA, 24 bp, Homo sapiens
cccacttccctgacactgcggggc

SEQ ID NO: 2737632 - DNA, 22 bp, Homo sapiens
cccagaaggctgggtccagggg

SEQ ID NO: 2737633 - DNA, 13 bp, Homo sapiens
cccagacagctgg

SEQ ID NO: 2737634 - DNA, 20 bp, Homo sapiens
cccagagacctttgcccaca

SEQ ID NO: 2737635 - DNA, 14 bp, Homo sapiens
cccagagggcccag

SEQ ID NO: 2737636 - DNA, 23 bp, Homo sapiens
cccagagggcccaggcaggccac

SEQ ID NO: 2737637 - DNA, 21 bp, Homo sapiens
cctcccagggccagggccctg

SEQ ID NO: 2737638 - DNA, 19 bp, Homo sapiens
cctcccatggccttccctc

SEQ ID NO: 2737639 - DNA, 16 bp, Homo sapiens
cctccccaccagagct

SEQ ID NO: 2737640 - DNA, 19 bp, Homo sapiens
cctccccaccagagctgcc

SEQ ID NO: 2737641 - DNA, 19 bp, Homo sapiens
cctcccccacgtctctctg

SEQ ID NO: 2737642 - DNA, 23 bp, Homo sapiens
cctcccccacgtctctctgcctg

SEQ ID NO: 2737643 - DNA, 12 bp, Homo sapiens
cctcccctgagg

SEQ ID NO: 2737644 - DNA, 13 bp, Homo sapiens
cctcccctgagga

SEQ ID NO: 2737645 - DNA, 12 bp, Homo sapiens
cctcccctgccg

SEQ ID NO: 2737646 - DNA, 18 bp, Homo sapiens
cctcccgggaagcatcct

SEQ ID NO: 2737647 - DNA, 21 bp, Homo sapiens
cctcccgggaagcatcctccc

SEQ ID NO: 2737648 - DNA, 14 bp, Homo sapiens
cctccctagatcca

SEQ ID NO: 2737649 - DNA, 22 bp, Homo sapiens
cctccctagatccaggcttctc

SEQ ID NO: 2737650 - DNA, 13 bp, Homo sapiens
cctccctctgcct

SEQ ID NO: 2737651 - DNA, 19 bp, Homo sapiens
cctccctctgcctcatcct

SEQ ID NO: 2737652 - DNA, 12 bp, Homo sapiens
cctccctgctgt

SEQ ID NO: 2737653 - DNA, 19 bp, Homo sapiens
cctccctgctgtcccctct

SEQ ID NO: 2737654 - DNA, 22 bp, Homo sapiens
cctccctgctgtcccctcttgc

SEQ ID NO: 2737655 - DNA, 12 bp, Homo sapiens
cctccgcctaga

SEQ ID NO: 2737656 - DNA, 19 bp, Homo sapiens
cctccgccttcactccggt

SEQ ID NO: 2737657 - DNA, 13 bp, Homo sapiens
cctcctaggagta

SEQ ID NO: 2737658 - DNA, 21 bp, Homo sapiens
cctcctccagttctgatgagg

SEQ ID NO: 2737659 - DNA, 13 bp, Homo sapiens
cctcctctccatg

SEQ ID NO: 2737660 - DNA, 14 bp, Homo sapiens
cctcgaccagaatc

SEQ ID NO: 2737661 - DNA, 14 bp, Homo sapiens
cctcgcctctccca

SEQ ID NO: 2737662 - DNA, 14 bp, Homo sapiens
cctcggaggctcct

SEQ ID NO: 2737663 - DNA, 22 bp, Homo sapiens
cctcggaggctcctccctctgc

SEQ ID NO: 2737664 - DNA, 16 bp, Homo sapiens
cctcggcagatgctgt

SEQ ID NO: 2737665 - DNA, 22 bp, Homo sapiens
cctcggcccatctgtccatcct

SEQ ID NO: 2737666 - DNA, 12 bp, Homo sapiens
cctcggcctccc

SEQ ID NO: 2737667 - DNA, 22 bp, Homo sapiens
cctcggcctcccaaagtgctgg

SEQ ID NO: 2737668 - DNA, 15 bp, Homo sapiens
cctcggctcctgctg

SEQ ID NO: 2737669 - DNA, 17 bp, Homo sapiens
cctcggctcctgctgca

SEQ ID NO: 2737670 - DNA, 21 bp, Homo sapiens
cctcgggaccctcccagtgag

SEQ ID NO: 2737671 - DNA, 19 bp, Homo sapiens
cctcgggatgaaaagccat

SEQ ID NO: 2737672 - DNA, 20 bp, Homo sapiens
cctcgtttgatagtgcttct

SEQ ID NO: 2737673 - DNA, 20 bp, Homo sapiens
cctctaactccctcctcaca

SEQ ID NO: 2737674 - DNA, 16 bp, Homo sapiens
cctctagaacacccac

SEQ ID NO: 2737675 - DNA, 18 bp, Homo sapiens
cctctagaacacccactg

SEQ ID NO: 2737676 - DNA, 24 bp, Homo sapiens
cctctagaacacccactggccagt

SEQ ID NO: 2737677 - DNA, 15 bp, Homo sapiens
cctctagtgccctcc

SEQ ID NO: 2737678 - DNA, 16 bp, Homo sapiens
cctctcagagcctcag

SEQ ID NO: 2737679 - DNA, 21 bp, Homo sapiens
cctctgaatgtcccagaggct

SEQ ID NO: 2737680 - DNA, 16 bp, Homo sapiens
cctctgacctgcaggc

SEQ ID NO: 2737681 - DNA, 12 bp, Homo sapiens
cctctgcccagc

SEQ ID NO: 2737682 - DNA, 21 bp, Homo sapiens
cctctgcccagcctgccccag

SEQ ID NO: 2737683 - DNA, 17 bp, Homo sapiens
cctctgcccgcagagcc

SEQ ID NO: 2737684 - DNA, 23 bp, Homo sapiens
cctctgcctcatcctcctcctca

SEQ ID NO: 2737685 - DNA, 14 bp, Homo sapiens
cctctgctgccatg

SEQ ID NO: 2737686 - DNA, 15 bp, Homo sapiens
cctctgctgccatgg

SEQ ID NO: 2737687 - DNA, 19 bp, Homo sapiens
cctctgtccagccagctcc

SEQ ID NO: 2737688 - DNA, 15 bp, Homo sapiens
cctctgtgcagacag

SEQ ID NO: 2737689 - DNA, 14 bp, Homo sapiens
cctctgtgtcactg

SEQ ID NO: 2737690 - DNA, 22 bp, Homo sapiens
cctctgtgtcactggctgcctc

SEQ ID NO: 2737691 - DNA, 20 bp, Homo sapiens
cctcttcggttgtcttgaaa

SEQ ID NO: 2737692 - DNA, 23 bp, Homo sapiens
cctcttgccccaacccccagcac

SEQ ID NO: 2737693 - DNA, 13 bp, Homo sapiens
cctcttggcacct

SEQ ID NO: 2737694 - DNA, 15 bp, Homo sapiens
cctctttgcatggaa

SEQ ID NO: 2737695 - DNA, 16 bp, Homo sapiens
cctgaaccgtgtgctc

SEQ ID NO: 2737696 - DNA, 17 bp, Homo sapiens
cctgaatgtcctttctc

SEQ ID NO: 2737697 - DNA, 23 bp, Homo sapiens
cctgacccggattggccctgccc

SEQ ID NO: 2737698 - DNA, 14 bp, Homo sapiens
cctgacctccagtc

SEQ ID NO: 2737699 - DNA, 14 bp, Homo sapiens
cctgaccttctcca

SEQ ID NO: 2737700 - DNA, 16 bp, Homo sapiens
cctgaccttctccagg

SEQ ID NO: 2737701 - DNA, 13 bp, Homo sapiens
cctgactctctgt

SEQ ID NO: 2737702 - DNA, 15 bp, Homo sapiens
cctgactctctgtga

SEQ ID NO: 2737703 - DNA, 16 bp, Homo sapiens
cctgactctctgtgac

SEQ ID NO: 2737704 - DNA, 23 bp, Homo sapiens
cctgacttcaggggctgcccgct

SEQ ID NO: 2737705 - DNA, 21 bp, Homo sapiens
cctgagatactgaagtgcagc

SEQ ID NO: 2737706 - DNA, 11 bp, Homo sapiens
cctgagattct

SEQ ID NO: 2737707 - DNA, 18 bp, Homo sapiens
cctgagattctttaagga

SEQ ID NO: 2737708 - DNA, 20 bp, Homo sapiens
cctgagattctttaaggaga

SEQ ID NO: 2737709 - DNA, 21 bp, Homo sapiens
cctgagattctttaaggagat

SEQ ID NO: 2737710 - DNA, 23 bp, Homo sapiens
cctgagattctttaaggagatag

SEQ ID NO: 2737711 - DNA, 19 bp, Homo sapiens
cctgaggagtgtcctgtct

SEQ ID NO: 2737712 - DNA, 15 bp, Homo sapiens
cctgaggatcccctg

SEQ ID NO: 2737713 - DNA, 23 bp, Homo sapiens
cctgaggatcccctgtcccctgg

SEQ ID NO: 2737714 - DNA, 21 bp, Homo sapiens
cctgaggctgagactgcggga

SEQ ID NO: 2737715 - DNA, 13 bp, Homo sapiens
cctgaggctggca

SEQ ID NO: 2737716 - DNA, 19 bp, Homo sapiens
cctgaggctggcatcctgg

SEQ ID NO: 2737717 - DNA, 21 bp, Homo sapiens
cctgaggctggcatcctggct

SEQ ID NO: 2737718 - DNA, 20 bp, Homo sapiens
cctgaggctggtagcagaat

SEQ ID NO: 2737719 - DNA, 20 bp, Homo sapiens
cctgatcattacatggctgt

SEQ ID NO: 2737720 - DNA, 16 bp, Homo sapiens
cctgatgctcatatca

SEQ ID NO: 2737721 - DNA, 15 bp, Homo sapiens
cctgattgtattttt

SEQ ID NO: 2737722 - DNA, 13 bp, Homo sapiens
cctgcactgtcct

SEQ ID NO: 2737723 - DNA, 16 bp, Homo sapiens
cctgcactgtcctgct

SEQ ID NO: 2737724 - DNA, 19 bp, Homo sapiens
cctgcactgtcctgctcca

SEQ ID NO: 2737725 - DNA, 19 bp, Homo sapiens
cctgcagaggggaaaccag

SEQ ID NO: 2737726 - DNA, 22 bp, Homo sapiens
cctgcagccccgcgcctccttc

SEQ ID NO: 2737727 - DNA, 21 bp, Homo sapiens
cctgcaggccaagagcagagg

SEQ ID NO: 2737728 - DNA, 22 bp, Homo sapiens
cctgcaggccaagagcagaggc

SEQ ID NO: 2737729 - DNA, 17 bp, Homo sapiens
cctgcaggttgggccat

SEQ ID NO: 2737730 - DNA, 21 bp, Homo sapiens
cctgcatatctctagtccctg

SEQ ID NO: 2737731 - DNA, 19 bp, Homo sapiens
cctgcatttttaaaggaca

SEQ ID NO: 2737732 - DNA, 23 bp, Homo sapiens
cctgccactttggtacatggcca

SEQ ID NO: 2737733 - DNA, 13 bp, Homo sapiens
cctgccagcctgg

SEQ ID NO: 2737734 - DNA, 14 bp, Homo sapiens
cctgccagctctgt

SEQ ID NO: 2737735 - DNA, 17 bp, Homo sapiens
cctgccatttgcaccct

SEQ ID NO: 2737736 - DNA, 18 bp, Homo sapiens
cctgccccagcctcccag

SEQ ID NO: 2737737 - DNA, 16 bp, Homo sapiens
cctgccccgcccagct

SEQ ID NO: 2737738 - DNA, 23 bp, Homo sapiens
cctgcccctccctagatccaggc

SEQ ID NO: 2737739 - DNA, 20 bp, Homo sapiens
cctgccccttgtcctctcag

SEQ ID NO: 2737740 - DNA, 17 bp, Homo sapiens
cctgcctagctcttggg

SEQ ID NO: 2737741 - DNA, 18 bp, Homo sapiens
cctgcctagctcttgggc

SEQ ID NO: 2737742 - DNA, 19 bp, Homo sapiens
cctgcctagctcttgggcc

SEQ ID NO: 2737743 - DNA, 23 bp, Homo sapiens
cctgcctagctcttgggcctgac

SEQ ID NO: 2737744 - DNA, 19 bp, Homo sapiens
cctgcctcagcctcctgag

SEQ ID NO: 2737745 - DNA, 20 bp, Homo sapiens
cctgcctcagcctcctgagt

SEQ ID NO: 2737746 - DNA, 15 bp, Homo sapiens
cctgcctgctgtgga

SEQ ID NO: 2737747 - DNA, 13 bp, Homo sapiens
cctgcctgggcct

SEQ ID NO: 2737748 - DNA, 14 bp, Homo sapiens
cctgcctgggcctc

SEQ ID NO: 2737749 - DNA, 15 bp, Homo sapiens
cctgcctgggcctcc

SEQ ID NO: 2737750 - DNA, 16 bp, Homo sapiens
cctgcctgggcctccc

SEQ ID NO: 2737751 - DNA, 13 bp, Homo sapiens
cctgcctgtgcat

SEQ ID NO: 2737752 - DNA, 14 bp, Homo sapiens
cctgcctgtgcatg

SEQ ID NO: 2737753 - DNA, 13 bp, Homo sapiens
cctgccttgaagc

SEQ ID NO: 2737754 - DNA, 19 bp, Homo sapiens
cctgccttgaagccactga

SEQ ID NO: 2737755 - DNA, 19 bp, Homo sapiens
cctgcgagagaccctacag

SEQ ID NO: 2737756 - DNA, 18 bp, Homo sapiens
cctgctcattgtggccag

SEQ ID NO: 2737757 - DNA, 12 bp, Homo sapiens
cctgctctgctt

SEQ ID NO: 2737758 - DNA, 16 bp, Homo sapiens
cctgctctgcttttcc

SEQ ID NO: 2737759 - DNA, 23 bp, Homo sapiens
cctgctctgcttttcctgtctgt

SEQ ID NO: 2737760 - DNA, 17 bp, Homo sapiens
ctcacgtgaccagcccc

SEQ ID NO: 2737761 - DNA, 19 bp, Homo sapiens
ctcacgtgaccagccccgt

SEQ ID NO: 2737762 - DNA, 23 bp, Homo sapiens
ctcactgcaagctctgcctcccg

SEQ ID NO: 2737763 - DNA, 13 bp, Homo sapiens
ctcagaagcctga

SEQ ID NO: 2737764 - DNA, 18 bp, Homo sapiens
ctcagaagcctgaggctg

SEQ ID NO: 2737765 - DNA, 12 bp, Homo sapiens
ctcagactcctg

SEQ ID NO: 2737766 - DNA, 15 bp, Homo sapiens
ctcagactcctggct

SEQ ID NO: 2737767 - DNA, 20 bp, Homo sapiens
ctcagagagcatcttttcct

SEQ ID NO: 2737768 - DNA, 18 bp, Homo sapiens
ctcagagcagcactgggg

SEQ ID NO: 2737769 - DNA, 14 bp, Homo sapiens
ctcagagcctcagc

SEQ ID NO: 2737770 - DNA, 16 bp, Homo sapiens
ctcagagctgcgggct

SEQ ID NO: 2737771 - DNA, 17 bp, Homo sapiens
ctcagagctgcgggctg

SEQ ID NO: 2737772 - DNA, 20 bp, Homo sapiens
ctcagagctgcgggctgagg

SEQ ID NO: 2737773 - DNA, 17 bp, Homo sapiens
ctcagagctgctgagca

SEQ ID NO: 2737774 - DNA, 22 bp, Homo sapiens
ctcagagcttttcgaactgtgc

SEQ ID NO: 2737775 - DNA, 20 bp, Homo sapiens
ctcagagggaggagtttttc

SEQ ID NO: 2737776 - DNA, 17 bp, Homo sapiens
ctcagagtccagtcaag

SEQ ID NO: 2737777 - DNA, 17 bp, Homo sapiens
ctcagcagccagctcct

SEQ ID NO: 2737778 - DNA, 13 bp, Homo sapiens
ctcagcagccccc

SEQ ID NO: 2737779 - DNA, 20 bp, Homo sapiens
ctcagccagccctggaggct

SEQ ID NO: 2737780 - DNA, 23 bp, Homo sapiens
ctcagccagccctggaggctgga

SEQ ID NO: 2737781 - DNA, 12 bp, Homo sapiens
ctcagcctccag

SEQ ID NO: 2737782 - DNA, 14 bp, Homo sapiens
ctcagcctccaggc

SEQ ID NO: 2737783 - DNA, 12 bp, Homo sapiens
ctcagcctcctg

SEQ ID NO: 2737784 - DNA, 12 bp, Homo sapiens
ctcagctgcctc

SEQ ID NO: 2737785 - DNA, 13 bp, Homo sapiens
ctcagctgcctca

SEQ ID NO: 2737786 - DNA, 14 bp, Homo sapiens
ctcagctgtggtcc

SEQ ID NO: 2737787 - DNA, 18 bp, Homo sapiens
ctcagctgtggtcccacc

SEQ ID NO: 2737788 - DNA, 20 bp, Homo sapiens
ctcagcttcccaagtagctg

SEQ ID NO: 2737789 - DNA, 22 bp, Homo sapiens
ctcagcttcccaagtagctgag

SEQ ID NO: 2737790 - DNA, 18 bp, Homo sapiens
ctcaggccaggtgcagtg

SEQ ID NO: 2737791 - DNA, 12 bp, Homo sapiens
ctcagggaccac

SEQ ID NO: 2737792 - DNA, 16 bp, Homo sapiens
ctcagggaccacagca

SEQ ID NO: 2737793 - DNA, 19 bp, Homo sapiens
ctcagggaccacagcaagg

SEQ ID NO: 2737794 - DNA, 16 bp, Homo sapiens
ctcaggggaagctgct

SEQ ID NO: 2737795 - DNA, 22 bp, Homo sapiens
ctcaggggaagctgctagggga

SEQ ID NO: 2737796 - DNA, 19 bp, Homo sapiens
ctcaggtagggagctaagg

SEQ ID NO: 2737797 - DNA, 17 bp, Homo sapiens
ctcaggtagtactggga

SEQ ID NO: 2737798 - DNA, 18 bp, Homo sapiens
ctcaggtagtactgggaa

SEQ ID NO: 2737799 - DNA, 22 bp, Homo sapiens
ctcaggtgacggactcagactc

SEQ ID NO: 2737800 - DNA, 23 bp, Homo sapiens
ctcaggtgacggactcagactcc

SEQ ID NO: 2737801 - DNA, 16 bp, Homo sapiens
ctcagtctcaggagca

SEQ ID NO: 2737802 - DNA, 17 bp, Homo sapiens
ctcagtgtcagcactca

SEQ ID NO: 2737803 - DNA, 12 bp, Homo sapiens
ctcatctgtgcc

SEQ ID NO: 2737804 - DNA, 17 bp, Homo sapiens
ctcatctgtgcctgtct

SEQ ID NO: 2737805 - DNA, 18 bp, Homo sapiens
ctcatctgtgcctgtctg

SEQ ID NO: 2737806 - DNA, 22 bp, Homo sapiens
ctcatgcaagacttcactgcag

SEQ ID NO: 2737807 - DNA, 20 bp, Homo sapiens
ctcatggatttggttatgat

SEQ ID NO: 2737808 - DNA, 21 bp, Homo sapiens
ctcatgtcatttctcatggat

SEQ ID NO: 2737809 - DNA, 21 bp, Homo sapiens
ctcattccctcgggaccctcc

SEQ ID NO: 2737810 - DNA, 15 bp, Homo sapiens
ctcattgtggccagt

SEQ ID NO: 2737811 - DNA, 23 bp, Homo sapiens
ctcattgtggccagtttagagtt

SEQ ID NO: 2737812 - DNA, 22 bp, Homo sapiens
ctccaaacactgggctctgagg

SEQ ID NO: 2737813 - DNA, 23 bp, Homo sapiens
ctccaaacactgggctctgagga

SEQ ID NO: 2737814 - DNA, 20 bp, Homo sapiens
ctccaacaataaagagctca

SEQ ID NO: 2737815 - DNA, 17 bp, Homo sapiens
ctccaagaggctggaaa

SEQ ID NO: 2737816 - DNA, 23 bp, Homo sapiens
ctccacagggacacagtctggtg

SEQ ID NO: 2737817 - DNA, 14 bp, Homo sapiens
ctccacccactgtc

SEQ ID NO: 2737818 - DNA, 23 bp, Homo sapiens
ctccaccctaaagtctcaggtga

SEQ ID NO: 2737819 - DNA, 12 bp, Homo sapiens
ctccacctcctg

SEQ ID NO: 2737820 - DNA, 13 bp, Homo sapiens
ctccacctcctgg

SEQ ID NO: 2737821 - DNA, 16 bp, Homo sapiens
ctccacctcctgggtt

SEQ ID NO: 2737822 - DNA, 14 bp, Homo sapiens
ctccactcccactt

SEQ ID NO: 2737823 - DNA, 18 bp, Homo sapiens
ctccactgtttcatgagc

SEQ ID NO: 2737824 - DNA, 21 bp, Homo sapiens
ctccactgtttcatgagccca

SEQ ID NO: 2737825 - DNA, 22 bp, Homo sapiens
ctccactgtttcatgagcccaa

SEQ ID NO: 2737826 - DNA, 16 bp, Homo sapiens
ctccagactgcggagc

SEQ ID NO: 2737827 - DNA, 22 bp, Homo sapiens
ctccagcacgttttctggcttc

SEQ ID NO: 2737828 - DNA, 23 bp, Homo sapiens
ctccagcacgttttctggcttct

SEQ ID NO: 2737829 - DNA, 14 bp, Homo sapiens
ctccagcctcacag

SEQ ID NO: 2737830 - DNA, 22 bp, Homo sapiens
ctccagcctcacagatgctggc

SEQ ID NO: 2737831 - DNA, 23 bp, Homo sapiens
ctccagcctcacagatgctggcc

SEQ ID NO: 2737832 - DNA, 13 bp, Homo sapiens
ctccagcctgggc

SEQ ID NO: 2737833 - DNA, 14 bp, Homo sapiens
ctccagctgttacc

SEQ ID NO: 2737834 - DNA, 19 bp, Homo sapiens
ctccagctgttacctgaga

SEQ ID NO: 2737835 - DNA, 20 bp, Homo sapiens
ctccagctgttacctgagat

SEQ ID NO: 2737836 - DNA, 14 bp, Homo sapiens
ctccagggacagaa

SEQ ID NO: 2737837 - DNA, 14 bp, Homo sapiens
ctccaggtaacttt

SEQ ID NO: 2737838 - DNA, 13 bp, Homo sapiens
ctccagtcctgct

SEQ ID NO: 2737839 - DNA, 15 bp, Homo sapiens
ctccagtcctgctgg

SEQ ID NO: 2737840 - DNA, 18 bp, Homo sapiens
ctccagtcctgctggcct

SEQ ID NO: 2737841 - DNA, 21 bp, Homo sapiens
ctccagtcctgctggcctgct

SEQ ID NO: 2737842 - DNA, 23 bp, Homo sapiens
ctccagtcctgctggcctgctct

SEQ ID NO: 2737843 - DNA, 22 bp, Homo sapiens
ctccagtgctggctgctggccc

SEQ ID NO: 2737844 - DNA, 19 bp, Homo sapiens
ctccatgctggtgtggcca

SEQ ID NO: 2737845 - DNA, 14 bp, Homo sapiens
ctcccacagtgact

SEQ ID NO: 2737846 - DNA, 21 bp, Homo sapiens
ctcccaccaggcagctccagc

SEQ ID NO: 2737847 - DNA, 19 bp, Homo sapiens
ctcccacggggaccactgg

SEQ ID NO: 2737848 - DNA, 16 bp, Homo sapiens
ctcccactcctaatca

SEQ ID NO: 2737849 - DNA, 20 bp, Homo sapiens
ctcccactcctaatcaagag

SEQ ID NO: 2737850 - DNA, 19 bp, Homo sapiens
ctcccacttccctgacact

SEQ ID NO: 2737851 - DNA, 14 bp, Homo sapiens
ctcccagaaggctg

SEQ ID NO: 2737852 - DNA, 11 bp, Homo sapiens
ctcccagctga

SEQ ID NO: 2737853 - DNA, 21 bp, Homo sapiens
ctcccagctgacagtcctctc

SEQ ID NO: 2737854 - DNA, 23 bp, Homo sapiens
ctcccagctgacagtcctctcca

SEQ ID NO: 2737855 - DNA, 22 bp, Homo sapiens
ctcccagggccagggccctgca

SEQ ID NO: 2737856 - DNA, 17 bp, Homo sapiens
ctcccagtgtcttcctg

SEQ ID NO: 2737857 - DNA, 14 bp, Homo sapiens
ctcccatggccttc

SEQ ID NO: 2737858 - DNA, 19 bp, Homo sapiens
ctccccacagtcctcacag

SEQ ID NO: 2737859 - DNA, 16 bp, Homo sapiens
ctccccaccagagctg

SEQ ID NO: 2737860 - DNA, 20 bp, Homo sapiens
ctccccaccagagctgcctc

SEQ ID NO: 2737861 - DNA, 21 bp, Homo sapiens
ctccccaccttcaattcctgg

SEQ ID NO: 2737862 - DNA, 14 bp, Homo sapiens
ctccccagcccttt

SEQ ID NO: 2737863 - DNA, 13 bp, Homo sapiens
ctccccagggcct

SEQ ID NO: 2737864 - DNA, 12 bp, Homo sapiens
ctccccagtgct

SEQ ID NO: 2737865 - DNA, 21 bp, Homo sapiens
ctccccattagagtcagcctt

SEQ ID NO: 2737866 - DNA, 14 bp, Homo sapiens
ctcccccagagcca

SEQ ID NO: 2737867 - DNA, 19 bp, Homo sapiens
ctcccccccggggctgggt

SEQ ID NO: 2737868 - DNA, 22 bp, Homo sapiens
ctccccctaccgcatggcagct

SEQ ID NO: 2737869 - DNA, 11 bp, Homo sapiens
ctccccctggg

SEQ ID NO: 2737870 - DNA, 12 bp, Homo sapiens
ctccccctgggc

SEQ ID NO: 2737871 - DNA, 13 bp, Homo sapiens
ctccccctgggct

SEQ ID NO: 2737872 - DNA, 23 bp, Homo sapiens
ctccccctgggctctgccccagc

SEQ ID NO: 2737873 - DNA, 19 bp, Homo sapiens
ctcccctgaggatcccctg

SEQ ID NO: 2737874 - DNA, 15 bp, Homo sapiens
ctcccctgaggctgg

SEQ ID NO: 2737875 - DNA, 22 bp, Homo sapiens
ctcccctgaggctggcatcctg

SEQ ID NO: 2737876 - DNA, 12 bp, Homo sapiens
ctcccctgccgc

SEQ ID NO: 2737877 - DNA, 19 bp, Homo sapiens
ctcccggacctggactagg

SEQ ID NO: 2737878 - DNA, 22 bp, Homo sapiens
ctcccgggaagcatcctcccca

SEQ ID NO: 2737879 - DNA, 23 bp, Homo sapiens
ctcccgggaagcatcctccccac

SEQ ID NO: 2737880 - DNA, 14 bp, Homo sapiens
ctccctagatccag

SEQ ID NO: 2737881 - DNA, 16 bp, Homo sapiens
ctccctagatccaggc

SEQ ID NO: 2737882 - DNA, 17 bp, Homo sapiens
ctccctagatccaggct

SEQ ID NO: 2737883 - DNA, 16 bp, Homo sapiens
ctgctgcatggcactg

SEQ ID NO: 2737884 - DNA, 20 bp, Homo sapiens
ctgctgcatttgtgtcatct

SEQ ID NO: 2737885 - DNA, 18 bp, Homo sapiens
ctgctgccactctgctgc

SEQ ID NO: 2737886 - DNA, 20 bp, Homo sapiens
ctgctgccactctgctgcct

SEQ ID NO: 2737887 - DNA, 21 bp, Homo sapiens
ctgctgccactctgctgcctg

SEQ ID NO: 2737888 - DNA, 16 bp, Homo sapiens
ctgctgcctgtattct

SEQ ID NO: 2737889 - DNA, 15 bp, Homo sapiens
ctgctggcccacagc

SEQ ID NO: 2737890 - DNA, 22 bp, Homo sapiens
ctgctgggaccccagctagggc

SEQ ID NO: 2737891 - DNA, 17 bp, Homo sapiens
ctgctgggactggccag

SEQ ID NO: 2737892 - DNA, 12 bp, Homo sapiens
ctgctgggctct

SEQ ID NO: 2737893 - DNA, 13 bp, Homo sapiens
ctgctgggctctt

SEQ ID NO: 2737894 - DNA, 15 bp, Homo sapiens
ctgctgggctggggc

SEQ ID NO: 2737895 - DNA, 17 bp, Homo sapiens
ctgctgggctggggcct

SEQ ID NO: 2737896 - DNA, 14 bp, Homo sapiens
ctgctggggctggt

SEQ ID NO: 2737897 - DNA, 15 bp, Homo sapiens
ctgctgggggctccc

SEQ ID NO: 2737898 - DNA, 17 bp, Homo sapiens
ctgctgggggctcccct

SEQ ID NO: 2737899 - DNA, 21 bp, Homo sapiens
ctgctgggggctccccttgcc

SEQ ID NO: 2737900 - DNA, 14 bp, Homo sapiens
ctgctgggtggccc

SEQ ID NO: 2737901 - DNA, 15 bp, Homo sapiens
ctgctgggtggccca

SEQ ID NO: 2737902 - DNA, 16 bp, Homo sapiens
ctgctgggtggcccat

SEQ ID NO: 2737903 - DNA, 21 bp, Homo sapiens
ctgctgggtggcccatccccc

SEQ ID NO: 2737904 - DNA, 20 bp, Homo sapiens
ctgctggtaatttgtatctg

SEQ ID NO: 2737905 - DNA, 13 bp, Homo sapiens
ctgctgtggagcc

SEQ ID NO: 2737906 - DNA, 15 bp, Homo sapiens
ctgctgtggagccca

SEQ ID NO: 2737907 - DNA, 23 bp, Homo sapiens
ctgcttatcaataaacctgtttg

SEQ ID NO: 2737908 - DNA, 15 bp, Homo sapiens
ctgcttccctggggc

SEQ ID NO: 2737909 - DNA, 16 bp, Homo sapiens
ctgcttccctggggcc

SEQ ID NO: 2737910 - DNA, 17 bp, Homo sapiens
ctgcttccctggggccc

SEQ ID NO: 2737911 - DNA, 19 bp, Homo sapiens
ctgcttccctggggcccca

SEQ ID NO: 2737912 - DNA, 13 bp, Homo sapiens
ctgcttcctgagc

SEQ ID NO: 2737913 - DNA, 13 bp, Homo sapiens
ctgcttcctggac

SEQ ID NO: 2737914 - DNA, 14 bp, Homo sapiens
ctgcttctgcattc

SEQ ID NO: 2737915 - DNA, 9 bp, Homo sapiens
ctgctttat

SEQ ID NO: 2737916 - DNA, 20 bp, Homo sapiens
ctgcttttcctgtctgtata

SEQ ID NO: 2737917 - DNA, 20 bp, Homo sapiens
ctgctttttgctttcttctt

SEQ ID NO: 2737918 - DNA, 20 bp, Homo sapiens
ctggaaaccacacttcttga

SEQ ID NO: 2737919 - DNA, 14 bp, Homo sapiens
ctggaaaggctcag

SEQ ID NO: 2737920 - DNA, 21 bp, Homo sapiens
ctggaaaggctcagtctcagg

SEQ ID NO: 2737921 - DNA, 23 bp, Homo sapiens
ctggaaaggctcagtctcaggag

SEQ ID NO: 2737922 - DNA, 22 bp, Homo sapiens
ctggaagaactgcatggggagt

SEQ ID NO: 2737923 - DNA, 19 bp, Homo sapiens
ctggaaggtactgaaggct

SEQ ID NO: 2737924 - DNA, 13 bp, Homo sapiens
ctggaatgaagca

SEQ ID NO: 2737925 - DNA, 19 bp, Homo sapiens
ctggaatgaagcatgtagc

SEQ ID NO: 2737926 - DNA, 12 bp, Homo sapiens
ctggacaaccca

SEQ ID NO: 2737927 - DNA, 13 bp, Homo sapiens
ctggacaacccag

SEQ ID NO: 2737928 - DNA, 14 bp, Homo sapiens
ctggacaacccaga

SEQ ID NO: 2737929 - DNA, 19 bp, Homo sapiens
ctggacccatttgccagga

SEQ ID NO: 2737930 - DNA, 13 bp, Homo sapiens
ctggaccctggcc

SEQ ID NO: 2737931 - DNA, 13 bp, Homo sapiens
ctggaccggggcc

SEQ ID NO: 2737932 - DNA, 15 bp, Homo sapiens
ctggacggcattcct

SEQ ID NO: 2737933 - DNA, 14 bp, Homo sapiens
ctggactagggcct

SEQ ID NO: 2737934 - DNA, 14 bp, Homo sapiens
ctggactctggcac

SEQ ID NO: 2737935 - DNA, 15 bp, Homo sapiens
ctggactctggcacc

SEQ ID NO: 2737936 - DNA, 18 bp, Homo sapiens
ctggactctggcacccag

SEQ ID NO: 2737937 - DNA, 18 bp, Homo sapiens
ctggacttgagcttggca

SEQ ID NO: 2737938 - DNA, 14 bp, Homo sapiens
ctggagactattta

SEQ ID NO: 2737939 - DNA, 15 bp, Homo sapiens
ctggagcatcccagg

SEQ ID NO: 2737940 - DNA, 17 bp, Homo sapiens
ctggagcatcccaggcg

SEQ ID NO: 2737941 - DNA, 13 bp, Homo sapiens
ctggagcccagga

SEQ ID NO: 2737942 - DNA, 15 bp, Homo sapiens
ctggagctgccagca

SEQ ID NO: 2737943 - DNA, 20 bp, Homo sapiens
ctggaggaacattgggaagg

SEQ ID NO: 2737944 - DNA, 23 bp, Homo sapiens
ctggatgaacaggatgtataata

SEQ ID NO: 2737945 - DNA, 19 bp, Homo sapiens
ctggatgagcaactcctgt

SEQ ID NO: 2737946 - DNA, 22 bp, Homo sapiens
ctggattgatcggagcctcctc

SEQ ID NO: 2737947 - DNA, 22 bp, Homo sapiens
ctggatttttacaaataaagat

SEQ ID NO: 2737948 - DNA, 22 bp, Homo sapiens
ctggcaatgccctacctgcctg

SEQ ID NO: 2737949 - DNA, 22 bp, Homo sapiens
ctggcacaacgctctaccctgc

SEQ ID NO: 2737950 - DNA, 12 bp, Homo sapiens
ctggcacagtgt

SEQ ID NO: 2737951 - DNA, 21 bp, Homo sapiens
ctggcacagtgtctgggctga

SEQ ID NO: 2737952 - DNA, 12 bp, Homo sapiens
ctggcatcctgg

SEQ ID NO: 2737953 - DNA, 13 bp, Homo sapiens
ctggcatcctggc

SEQ ID NO: 2737954 - DNA, 15 bp, Homo sapiens
ctggcatcctggctg

SEQ ID NO: 2737955 - DNA, 16 bp, Homo sapiens
ctggcatcctggctgg

SEQ ID NO: 2737956 - DNA, 21 bp, Homo sapiens
ctggcatcctggctggctgtg

SEQ ID NO: 2737957 - DNA, 18 bp, Homo sapiens
ctggcatctccctgacct

SEQ ID NO: 2737958 - DNA, 13 bp, Homo sapiens
ctggccagcccca

SEQ ID NO: 2737959 - DNA, 14 bp, Homo sapiens
ctggccagccccac

SEQ ID NO: 2737960 - DNA, 15 bp, Homo sapiens
ctggccagccccaca

SEQ ID NO: 2737961 - DNA, 16 bp, Homo sapiens
ctggccagccccacag

SEQ ID NO: 2737962 - DNA, 17 bp, Homo sapiens
ctggccagccccacagc

SEQ ID NO: 2737963 - DNA, 18 bp, Homo sapiens
ctggccagccccacagcc

SEQ ID NO: 2737964 - DNA, 19 bp, Homo sapiens
ctggccagtcctagagctc

SEQ ID NO: 2737965 - DNA, 20 bp, Homo sapiens
ctggccagtcctagagctcc

SEQ ID NO: 2737966 - DNA, 21 bp, Homo sapiens
ctggccagtcctagagctcct

SEQ ID NO: 2737967 - DNA, 14 bp, Homo sapiens
ctggcccacagctc

SEQ ID NO: 2737968 - DNA, 15 bp, Homo sapiens
ctggcccacagctct

SEQ ID NO: 2737969 - DNA, 19 bp, Homo sapiens
ctggcccacagctctgctg

SEQ ID NO: 2737970 - DNA, 20 bp, Homo sapiens
ctggcccacagctctgctgg

SEQ ID NO: 2737971 - DNA, 22 bp, Homo sapiens
ctggcccacagctctgctggaa

SEQ ID NO: 2737972 - DNA, 13 bp, Homo sapiens
ctggcccagctcc

SEQ ID NO: 2737973 - DNA, 22 bp, Homo sapiens
ctggcccagctcccccgggagg

SEQ ID NO: 2737974 - DNA, 16 bp, Homo sapiens
ctggcccatcagtgta

SEQ ID NO: 2737975 - DNA, 18 bp, Homo sapiens
ctggccctcaaggcctcc

SEQ ID NO: 2737976 - DNA, 19 bp, Homo sapiens
ctggccctcaaggcctccc

SEQ ID NO: 2737977 - DNA, 14 bp, Homo sapiens
ctggccgtggctcc

SEQ ID NO: 2737978 - DNA, 13 bp, Homo sapiens
ctggcctaaagaa

SEQ ID NO: 2737979 - DNA, 16 bp, Homo sapiens
ctggcctcgcctggcc

SEQ ID NO: 2737980 - DNA, 20 bp, Homo sapiens
ctggcctcgcctggcctgag

SEQ ID NO: 2737981 - DNA, 21 bp, Homo sapiens
ctggcctctagaacacccact

SEQ ID NO: 2737982 - DNA, 17 bp, Homo sapiens
ctggcctcttggcacct

SEQ ID NO: 2737983 - DNA, 24 bp, Homo sapiens
ctggcctcttggcacctgcctagc

SEQ ID NO: 2737984 - DNA, 20 bp, Homo sapiens
ctggcctgaggtctcgctga

SEQ ID NO: 2737985 - DNA, 22 bp, Homo sapiens
ctggcctgctcttacttccccc

SEQ ID NO: 2737986 - DNA, 20 bp, Homo sapiens
ctggccttgtccccagctcc

SEQ ID NO: 2737987 - DNA, 15 bp, Homo sapiens
ctggcggcgcagagg

SEQ ID NO: 2737988 - DNA, 16 bp, Homo sapiens
ctggcggcgcagaggg

SEQ ID NO: 2737989 - DNA, 13 bp, Homo sapiens
ctggctcagctgt

SEQ ID NO: 2737990 - DNA, 16 bp, Homo sapiens
ctggctcagctgtggt

SEQ ID NO: 2737991 - DNA, 19 bp, Homo sapiens
ctggctcagctgtggtccc

SEQ ID NO: 2737992 - DNA, 23 bp, Homo sapiens
ctggctccaggctcctcatgagg

SEQ ID NO: 2737993 - DNA, 22 bp, Homo sapiens
ctggctctgccagcgtccccgg

SEQ ID NO: 2737994 - DNA, 21 bp, Homo sapiens
ctggctctttgtgtgtctcca

SEQ ID NO: 2737995 - DNA, 17 bp, Homo sapiens
ctggctgaacagtgctc

SEQ ID NO: 2737996 - DNA, 21 bp, Homo sapiens
ctggctgcctccactcccact

SEQ ID NO: 2737997 - DNA, 13 bp, Homo sapiens
ctggctgctggcc

SEQ ID NO: 2737998 - DNA, 17 bp, Homo sapiens
ctggctggctgcagtga

SEQ ID NO: 2737999 - DNA, 15 bp, Homo sapiens
ctggctggctgtgtc

SEQ ID NO: 2738000 - DNA, 13 bp, Homo sapiens
ctggctgtgtcct

SEQ ID NO: 2738001 - DNA, 15 bp, Homo sapiens
ctggctgtgtcctct

SEQ ID NO: 2738002 - DNA, 16 bp, Homo sapiens
ctggcttctgcttcat

SEQ ID NO: 2738003 - DNA, 13 bp, Homo sapiens
ctgggaaggagga

SEQ ID NO: 2738004 - DNA, 13 bp, Homo sapiens
ctgggaagggaag

SEQ ID NO: 2738005 - DNA, 16 bp, Homo sapiens
ctgggaagggaaggaa

SEQ ID NO: 2738006 - DNA, 21 bp, Homo sapiens
ctgggaatggaaggctttgcc

SEQ ID NO: 2738007 - DNA, 19 bp, Homo sapiens
gaattttctttcatacatt

SEQ ID NO: 2738008 - DNA, 22 bp, Homo sapiens
gaattttctttcatacattata

SEQ ID NO: 2738009 - DNA, 19 bp, Homo sapiens
gaattttggaaaaatgtca

SEQ ID NO: 2738010 - DNA, 20 bp, Homo sapiens
gacaaagccaaactctgcca

SEQ ID NO: 2738011 - DNA, 23 bp, Homo sapiens
gacaacatcgcaatagtttttta

SEQ ID NO: 2738012 - DNA, 15 bp, Homo sapiens
gacaacatttttgta

SEQ ID NO: 2738013 - DNA, 20 bp, Homo sapiens
gacaacatttttgtacatta

SEQ ID NO: 2738014 - DNA, 20 bp, Homo sapiens
gacaaccacgtaccaagcca

SEQ ID NO: 2738015 - DNA, 15 bp, Homo sapiens
gacaattgtcttttt

SEQ ID NO: 2738016 - DNA, 23 bp, Homo sapiens
gacacaatgttgcactgaaaacc

SEQ ID NO: 2738017 - DNA, 22 bp, Homo sapiens
gacacactgcggtgtctgcagc

SEQ ID NO: 2738018 - DNA, 23 bp, Homo sapiens
gacacactgcggtgtctgcagct

SEQ ID NO: 2738019 - DNA, 19 bp, Homo sapiens
gacacagctgagctggcct

SEQ ID NO: 2738020 - DNA, 21 bp, Homo sapiens
gacacccaccccctctttgtg

SEQ ID NO: 2738021 - DNA, 14 bp, Homo sapiens
gacactacaaacat

SEQ ID NO: 2738022 - DNA, 19 bp, Homo sapiens
gacactgcggggcttggct

SEQ ID NO: 2738023 - DNA, 20 bp, Homo sapiens
gacactgcggggcttggctg

SEQ ID NO: 2738024 - DNA, 13 bp, Homo sapiens
gacagaagcagga

SEQ ID NO: 2738025 - DNA, 14 bp, Homo sapiens
gacagagccagagg

SEQ ID NO: 2738026 - DNA, 17 bp, Homo sapiens
gacagtacctgattgta

SEQ ID NO: 2738027 - DNA, 22 bp, Homo sapiens
gacagtgacgtgactcagagct

SEQ ID NO: 2738028 - DNA, 15 bp, Homo sapiens
gacagtgtcagagtc

SEQ ID NO: 2738029 - DNA, 15 bp, Homo sapiens
gacatattcccatgg

SEQ ID NO: 2738030 - DNA, 14 bp, Homo sapiens
gacatcaatgaaac

SEQ ID NO: 2738031 - DNA, 20 bp, Homo sapiens
gacatcagaagtaactccca

SEQ ID NO: 2738032 - DNA, 23 bp, Homo sapiens
gacatgatttagggaagcaggga

SEQ ID NO: 2738033 - DNA, 22 bp, Homo sapiens
gacatgctctccccacaggggg

SEQ ID NO: 2738034 - DNA, 13 bp, Homo sapiens
gacattgtaaacg

SEQ ID NO: 2738035 - DNA, 12 bp, Homo sapiens
gaccactgggcc

SEQ ID NO: 2738036 - DNA, 18 bp, Homo sapiens
gaccactgggcccctcag

SEQ ID NO: 2738037 - DNA, 19 bp, Homo sapiens
gaccactgggcccctcagg

SEQ ID NO: 2738038 - DNA, 14 bp, Homo sapiens
gaccagtactggga

SEQ ID NO: 2738039 - DNA, 20 bp, Homo sapiens
gaccagtactgggaaggagg

SEQ ID NO: 2738040 - DNA, 14 bp, Homo sapiens
gaccatgtgattat

SEQ ID NO: 2738041 - DNA, 14 bp, Homo sapiens
gaccattgtcttcc

SEQ ID NO: 2738042 - DNA, 16 bp, Homo sapiens
gaccattgtcttccaa

SEQ ID NO: 2738043 - DNA, 19 bp, Homo sapiens
gaccattgtcttccaaccc

SEQ ID NO: 2738044 - DNA, 20 bp, Homo sapiens
gaccattgtcttccaacccc

SEQ ID NO: 2738045 - DNA, 23 bp, Homo sapiens
gaccattgtcttccaaccccagc

SEQ ID NO: 2738046 - DNA, 12 bp, Homo sapiens
gacccagtgtgt

SEQ ID NO: 2738047 - DNA, 16 bp, Homo sapiens
gacccatttcaggagg

SEQ ID NO: 2738048 - DNA, 16 bp, Homo sapiens
gaccccatctgcccag

SEQ ID NO: 2738049 - DNA, 17 bp, Homo sapiens
gaccccatctgcccagg

SEQ ID NO: 2738050 - DNA, 17 bp, Homo sapiens
gaccccttttcagcttc

SEQ ID NO: 2738051 - DNA, 21 bp, Homo sapiens
gacccggattggccctgcccc

SEQ ID NO: 2738052 - DNA, 23 bp, Homo sapiens
gacccggattggccctgcccctc

SEQ ID NO: 2738053 - DNA, 18 bp, Homo sapiens
gaccctcctccactccac

SEQ ID NO: 2738054 - DNA, 22 bp, Homo sapiens
gaccctcctcctcccccagagg

SEQ ID NO: 2738055 - DNA, 17 bp, Homo sapiens
gaccctcgtttgatagt

SEQ ID NO: 2738056 - DNA, 22 bp, Homo sapiens
gaccctgcgaaggggccctggt

SEQ ID NO: 2738057 - DNA, 15 bp, Homo sapiens
gaccctggctctgcc

SEQ ID NO: 2738058 - DNA, 12 bp, Homo sapiens
gaccctgtctct

SEQ ID NO: 2738059 - DNA, 18 bp, Homo sapiens
gaccgggtctgcttctgc

SEQ ID NO: 2738060 - DNA, 13 bp, Homo sapiens
gacctcagatgtg

SEQ ID NO: 2738061 - DNA, 20 bp, Homo sapiens
gacctccagtcctgctggcc

SEQ ID NO: 2738062 - DNA, 13 bp, Homo sapiens
gacctctcttgtg

SEQ ID NO: 2738063 - DNA, 14 bp, Homo sapiens
gacctgaactctgc

SEQ ID NO: 2738064 - DNA, 22 bp, Homo sapiens
gacctgaactctgcaactgaat

SEQ ID NO: 2738065 - DNA, 16 bp, Homo sapiens
gacctggagctgccag

SEQ ID NO: 2738066 - DNA, 19 bp, Homo sapiens
gacctggagctgccagcac

SEQ ID NO: 2738067 - DNA, 22 bp, Homo sapiens
gaccttacaaccacatttctgg

SEQ ID NO: 2738068 - DNA, 16 bp, Homo sapiens
gaccttctccagggac

SEQ ID NO: 2738069 - DNA, 17 bp, Homo sapiens
gacctttcagctgtgaa

SEQ ID NO: 2738070 - DNA, 13 bp, Homo sapiens
gacctttgcccac

SEQ ID NO: 2738071 - DNA, 20 bp, Homo sapiens
gacgctgtgattggcaggag

SEQ ID NO: 2738072 - DNA, 14 bp, Homo sapiens
gacggactcagact

SEQ ID NO: 2738073 - DNA, 17 bp, Homo sapiens
gacggggtttccccatg

SEQ ID NO: 2738074 - DNA, 15 bp, Homo sapiens
gacgggttgaaagac

SEQ ID NO: 2738075 - DNA, 21 bp, Homo sapiens
gacgggttgaaagacatcaat

SEQ ID NO: 2738076 - DNA, 21 bp, Homo sapiens
gacggtcctttaggcagcctg

SEQ ID NO: 2738077 - DNA, 23 bp, Homo sapiens
gacggtcctttaggcagcctgcc

SEQ ID NO: 2738078 - DNA, 23 bp, Homo sapiens
gacgtcctggaatgaagcatgta

SEQ ID NO: 2738079 - DNA, 17 bp, Homo sapiens
gacgtgactcagagctt

SEQ ID NO: 2738080 - DNA, 22 bp, Homo sapiens
gactagggcctcggaggctcct

SEQ ID NO: 2738081 - DNA, 19 bp, Homo sapiens
gactatgcgtttttataaa

SEQ ID NO: 2738082 - DNA, 18 bp, Homo sapiens
gactcagactcctggctt

SEQ ID NO: 2738083 - DNA, 12 bp, Homo sapiens
gactcagagctt

SEQ ID NO: 2738084 - DNA, 19 bp, Homo sapiens
gactccagcacgttttctg

SEQ ID NO: 2738085 - DNA, 12 bp, Homo sapiens
gactcctggctt

SEQ ID NO: 2738086 - DNA, 17 bp, Homo sapiens
gactcctggcttcatgt

SEQ ID NO: 2738087 - DNA, 19 bp, Homo sapiens
gactcgggctcctgtgccc

SEQ ID NO: 2738088 - DNA, 20 bp, Homo sapiens
gactcgggctcctgtgccct

SEQ ID NO: 2738089 - DNA, 21 bp, Homo sapiens
gactctacctgcaagatttca

SEQ ID NO: 2738090 - DNA, 13 bp, Homo sapiens
gactctctgcctg

SEQ ID NO: 2738091 - DNA, 16 bp, Homo sapiens
gactctctgcctgctt

SEQ ID NO: 2738092 - DNA, 15 bp, Homo sapiens
gactctctgtgacct

SEQ ID NO: 2738093 - DNA, 22 bp, Homo sapiens
gactctgaggctctttctgggc

SEQ ID NO: 2738094 - DNA, 22 bp, Homo sapiens
gactctgcagatagtgcctctg

SEQ ID NO: 2738095 - DNA, 14 bp, Homo sapiens
gactctgtgagatt

SEQ ID NO: 2738096 - DNA, 17 bp, Homo sapiens
gactcttccaccagagc

SEQ ID NO: 2738097 - DNA, 12 bp, Homo sapiens
gactcttcctgc

SEQ ID NO: 2738098 - DNA, 13 bp, Homo sapiens
gactcttcctgca

SEQ ID NO: 2738099 - DNA, 21 bp, Homo sapiens
gactctttttgtacctggtga

SEQ ID NO: 2738100 - DNA, 23 bp, Homo sapiens
gactgcgccacggcactccagcc

SEQ ID NO: 2738101 - DNA, 24 bp, Homo sapiens
gactgcgccacggcactccagcct

SEQ ID NO: 2738102 - DNA, 15 bp, Homo sapiens
gactgcggagcagcc

SEQ ID NO: 2738103 - DNA, 16 bp, Homo sapiens
gactggctggctgcag

SEQ ID NO: 2738104 - DNA, 14 bp, Homo sapiens
gacttcactgcagc

SEQ ID NO: 2738105 - DNA, 16 bp, Homo sapiens
gacttcactgcagcct

SEQ ID NO: 2738106 - DNA, 19 bp, Homo sapiens
gacttcactgcagcctttc

SEQ ID NO: 2738107 - DNA, 15 bp, Homo sapiens
gacttcaggagctga

SEQ ID NO: 2738108 - DNA, 20 bp, Homo sapiens
gacttcaggggctgcccgct

SEQ ID NO: 2738109 - DNA, 23 bp, Homo sapiens
gacttcaggggctgcccgctccc

SEQ ID NO: 2738110 - DNA, 19 bp, Homo sapiens
gacttcctcgcctctccca

SEQ ID NO: 2738111 - DNA, 23 bp, Homo sapiens
gacttcctggtgaggcccagcct

SEQ ID NO: 2738112 - DNA, 20 bp, Homo sapiens
gacttgaattttcccactgc

SEQ ID NO: 2738113 - DNA, 21 bp, Homo sapiens
gacttgaattttcccactgca

SEQ ID NO: 2738114 - DNA, 11 bp, Homo sapiens
gacttgcctgg

SEQ ID NO: 2738115 - DNA, 14 bp, Homo sapiens
gacttgcctggggc

SEQ ID NO: 2738116 - DNA, 22 bp, Homo sapiens
gacttgctttaaatagatttca

SEQ ID NO: 2738117 - DNA, 13 bp, Homo sapiens
gactttgtgatcc

SEQ ID NO: 2738118 - DNA, 18 bp, Homo sapiens
gacttttccatgtatcta

SEQ ID NO: 2738119 - DNA, 15 bp, Homo sapiens
gacttttttctaaac

SEQ ID NO: 2738120 - DNA, 17 bp, Homo sapiens
gagaaaaatggcctgca

SEQ ID NO: 2738121 - DNA, 13 bp, Homo sapiens
gagaaaactgaga

SEQ ID NO: 2738122 - DNA, 16 bp, Homo sapiens
gagaaaacttatttga

SEQ ID NO: 2738123 - DNA, 16 bp, Homo sapiens
gagaaaatgcaggaga

SEQ ID NO: 2738124 - DNA, 17 bp, Homo sapiens
gagaaacaggctctgag

SEQ ID NO: 2738125 - DNA, 18 bp, Homo sapiens
gagaaatttttttccaga

SEQ ID NO: 2738126 - DNA, 14 bp, Homo sapiens
gagaaggcctcccc

SEQ ID NO: 2738127 - DNA, 15 bp, Homo sapiens
gagaaggcctcccct

SEQ ID NO: 2738128 - DNA, 16 bp, Homo sapiens
gagaagggcctgctct

SEQ ID NO: 2738129 - DNA, 15 bp, Homo sapiens
gagacctttgcccac

SEQ ID NO: 2738130 - DNA, 13 bp, Homo sapiens
gcaggaggcagga

SEQ ID NO: 2738131 - DNA, 19 bp, Homo sapiens
gcaggatgcgctgggacgg

SEQ ID NO: 2738132 - DNA, 13 bp, Homo sapiens
gcaggcacagcac

SEQ ID NO: 2738133 - DNA, 18 bp, Homo sapiens
gcaggcacagcacaggga

SEQ ID NO: 2738134 - DNA, 18 bp, Homo sapiens
gcaggcagcgcctgtccc

SEQ ID NO: 2738135 - DNA, 20 bp, Homo sapiens
gcaggccaagagcagaggca

SEQ ID NO: 2738136 - DNA, 24 bp, Homo sapiens
gcaggccaagagcagaggcagcga

SEQ ID NO: 2738137 - DNA, 15 bp, Homo sapiens
gcaggccctgcactg

SEQ ID NO: 2738138 - DNA, 20 bp, Homo sapiens
gcaggccctgcactgtcctg

SEQ ID NO: 2738139 - DNA, 21 bp, Homo sapiens
gcaggccctgcactgtcctgc

SEQ ID NO: 2738140 - DNA, 14 bp, Homo sapiens
gcagggacaccccc

SEQ ID NO: 2738141 - DNA, 18 bp, Homo sapiens
gcagggagcaactctcca

SEQ ID NO: 2738142 - DNA, 22 bp, Homo sapiens
gcagggagccgagatcacgcca

SEQ ID NO: 2738143 - DNA, 14 bp, Homo sapiens
gcagggatttgagg

SEQ ID NO: 2738144 - DNA, 14 bp, Homo sapiens
gcagggcctgctac

SEQ ID NO: 2738145 - DNA, 12 bp, Homo sapiens
gcaggggactgg

SEQ ID NO: 2738146 - DNA, 15 bp, Homo sapiens
gcaggggctgctggg

SEQ ID NO: 2738147 - DNA, 13 bp, Homo sapiens
gcagggtcttgct

SEQ ID NO: 2738148 - DNA, 15 bp, Homo sapiens
gcaggtgctgctacc

SEQ ID NO: 2738149 - DNA, 22 bp, Homo sapiens
gcaggtgctgctaccctccctg

SEQ ID NO: 2738150 - DNA, 23 bp, Homo sapiens
gcaggtgctgctaccctccctgc

SEQ ID NO: 2738151 - DNA, 22 bp, Homo sapiens
gcaggttgaggggctcctggaa

SEQ ID NO: 2738152 - DNA, 18 bp, Homo sapiens
gcagtaaactttctctgc

SEQ ID NO: 2738153 - DNA, 18 bp, Homo sapiens
gcagtaagtcttttttga

SEQ ID NO: 2738154 - DNA, 13 bp, Homo sapiens
gcagtctgaagga

SEQ ID NO: 2738155 - DNA, 18 bp, Homo sapiens
gcagtcttttgctgtgct

SEQ ID NO: 2738156 - DNA, 21 bp, Homo sapiens
gcagtgaacacactcagcagc

SEQ ID NO: 2738157 - DNA, 23 bp, Homo sapiens
gcagtgaacacactcagcagccc

SEQ ID NO: 2738158 - DNA, 15 bp, Homo sapiens
gcagtgaactgagac

SEQ ID NO: 2738159 - DNA, 16 bp, Homo sapiens
gcagtgaactgagact

SEQ ID NO: 2738160 - DNA, 22 bp, Homo sapiens
gcagtgattgttatgccttgct

SEQ ID NO: 2738161 - DNA, 21 bp, Homo sapiens
gcagtgccctctggacagctt

SEQ ID NO: 2738162 - DNA, 13 bp, Homo sapiens
gcagtgtttgtat

SEQ ID NO: 2738163 - DNA, 14 bp, Homo sapiens
gcagttctgtgtcc

SEQ ID NO: 2738164 - DNA, 17 bp, Homo sapiens
gcatagtcactgtctca

SEQ ID NO: 2738165 - DNA, 17 bp, Homo sapiens
gcatatccattgtggaa

SEQ ID NO: 2738166 - DNA, 18 bp, Homo sapiens
gcatatccattgtggaaa

SEQ ID NO: 2738167 - DNA, 18 bp, Homo sapiens
gcatatctctagtccctg

SEQ ID NO: 2738168 - DNA, 15 bp, Homo sapiens
gcatcaaacatgaaa

SEQ ID NO: 2738169 - DNA, 16 bp, Homo sapiens
gcatcaaacatgaaaa

SEQ ID NO: 2738170 - DNA, 13 bp, Homo sapiens
gcatcaatacaac

SEQ ID NO: 2738171 - DNA, 19 bp, Homo sapiens
gcatcaatacaaccagccc

SEQ ID NO: 2738172 - DNA, 17 bp, Homo sapiens
gcatcacagggcagagc

SEQ ID NO: 2738173 - DNA, 18 bp, Homo sapiens
gcatcctccccaccagag

SEQ ID NO: 2738174 - DNA, 19 bp, Homo sapiens
gcatcctccccaccagagc

SEQ ID NO: 2738175 - DNA, 21 bp, Homo sapiens
gcatcctggctggctgtgtcc

SEQ ID NO: 2738176 - DNA, 22 bp, Homo sapiens
gcatctccctgaccttctccag

SEQ ID NO: 2738177 - DNA, 20 bp, Homo sapiens
gcatctctgagtgtctctgc

SEQ ID NO: 2738178 - DNA, 22 bp, Homo sapiens
gcatctctgagtgtctctgcct

SEQ ID NO: 2738179 - DNA, 24 bp, Homo sapiens
gcatctctgagtgtctctgcctgg

SEQ ID NO: 2738180 - DNA, 17 bp, Homo sapiens
gcatgaattcacaaaca

SEQ ID NO: 2738181 - DNA, 20 bp, Homo sapiens
gcatgaattcacaaacaaat

SEQ ID NO: 2738182 - DNA, 11 bp, Homo sapiens
gcatgagtggc

SEQ ID NO: 2738183 - DNA, 20 bp, Homo sapiens
gcatgccccctcgtgccagt

SEQ ID NO: 2738184 - DNA, 12 bp, Homo sapiens
gcatgcctcagc

SEQ ID NO: 2738185 - DNA, 16 bp, Homo sapiens
gcatgcctcagccagc

SEQ ID NO: 2738186 - DNA, 20 bp, Homo sapiens
gcatgcctcagccagccctg

SEQ ID NO: 2738187 - DNA, 13 bp, Homo sapiens
gcatgctggggca

SEQ ID NO: 2738188 - DNA, 16 bp, Homo sapiens
gcatgctggggcaagt

SEQ ID NO: 2738189 - DNA, 13 bp, Homo sapiens
gcatggaatttgt

SEQ ID NO: 2738190 - DNA, 14 bp, Homo sapiens
gcatggcactgacc

SEQ ID NO: 2738191 - DNA, 18 bp, Homo sapiens
gcatggcactgaccgccg

SEQ ID NO: 2738192 - DNA, 16 bp, Homo sapiens
gcatggcagctgggcc

SEQ ID NO: 2738193 - DNA, 17 bp, Homo sapiens
gcatggcagctgggccc

SEQ ID NO: 2738194 - DNA, 23 bp, Homo sapiens
gcatggcagctgggcccacagcc

SEQ ID NO: 2738195 - DNA, 23 bp, Homo sapiens
gcatggggataaaggagaaggca

SEQ ID NO: 2738196 - DNA, 20 bp, Homo sapiens
gcatgtaaaatcttcagctg

SEQ ID NO: 2738197 - DNA, 19 bp, Homo sapiens
gcattcacagcgcctcctg

SEQ ID NO: 2738198 - DNA, 20 bp, Homo sapiens
gcattcacagcgcctcctgg

SEQ ID NO: 2738199 - DNA, 12 bp, Homo sapiens
gcattcatgttt

SEQ ID NO: 2738200 - DNA, 17 bp, Homo sapiens
gcattcccggtgcagaa

SEQ ID NO: 2738201 - DNA, 15 bp, Homo sapiens
gcattctagtgcaga

SEQ ID NO: 2738202 - DNA, 13 bp, Homo sapiens
gcattctctctgc

SEQ ID NO: 2738203 - DNA, 15 bp, Homo sapiens
gcattctctctgctc

SEQ ID NO: 2738204 - DNA, 15 bp, Homo sapiens
gcattctgagctggg

SEQ ID NO: 2738205 - DNA, 16 bp, Homo sapiens
gcattctgagctgggc

SEQ ID NO: 2738206 - DNA, 15 bp, Homo sapiens
gcattggcagcaggt

SEQ ID NO: 2738207 - DNA, 22 bp, Homo sapiens
gcattttcacattttgcctttc

SEQ ID NO: 2738208 - DNA, 15 bp, Homo sapiens
gcattttcagcatca

SEQ ID NO: 2738209 - DNA, 23 bp, Homo sapiens
gcattttgaatgtgatcatcttt

SEQ ID NO: 2738210 - DNA, 21 bp, Homo sapiens
gccaaaacaatgcccgtaaga

SEQ ID NO: 2738211 - DNA, 13 bp, Homo sapiens
gccaacagccccc

SEQ ID NO: 2738212 - DNA, 18 bp, Homo sapiens
gccaacggcaacagcatg

SEQ ID NO: 2738213 - DNA, 20 bp, Homo sapiens
gccaagagcagaggcagcga

SEQ ID NO: 2738214 - DNA, 18 bp, Homo sapiens
gccaaggctgagagctct

SEQ ID NO: 2738215 - DNA, 22 bp, Homo sapiens
gccaaggtttcccagtgagcct

SEQ ID NO: 2738216 - DNA, 23 bp, Homo sapiens
gccaaggtttcccagtgagcctc

SEQ ID NO: 2738217 - DNA, 11 bp, Homo sapiens
gccaattttgt

SEQ ID NO: 2738218 - DNA, 17 bp, Homo sapiens
gccacaccaagctgtgc

SEQ ID NO: 2738219 - DNA, 19 bp, Homo sapiens
gccacaccaagctgtgcca

SEQ ID NO: 2738220 - DNA, 12 bp, Homo sapiens
gccacactgggc

SEQ ID NO: 2738221 - DNA, 13 bp, Homo sapiens
gccacactgggct

SEQ ID NO: 2738222 - DNA, 15 bp, Homo sapiens
gccacactgggctca

SEQ ID NO: 2738223 - DNA, 19 bp, Homo sapiens
gccaccacccaacctgtcc

SEQ ID NO: 2738224 - DNA, 23 bp, Homo sapiens
gccaccatattcagtgctgtggc

SEQ ID NO: 2738225 - DNA, 13 bp, Homo sapiens
gccaccctgggct

SEQ ID NO: 2738226 - DNA, 13 bp, Homo sapiens
gccaccgcagctg

SEQ ID NO: 2738227 - DNA, 14 bp, Homo sapiens
gccaccgcagctgc

SEQ ID NO: 2738228 - DNA, 15 bp, Homo sapiens
gccaccgcagctgct

SEQ ID NO: 2738229 - DNA, 18 bp, Homo sapiens
gccaccgcagctgctgcc

SEQ ID NO: 2738230 - DNA, 21 bp, Homo sapiens
gccaccgcagctgctgccact

SEQ ID NO: 2738231 - DNA, 23 bp, Homo sapiens
gccaccgcagctgctgccactct

SEQ ID NO: 2738232 - DNA, 16 bp, Homo sapiens
gccaccgcgcccagcc

SEQ ID NO: 2738233 - DNA, 19 bp, Homo sapiens
gccactacactccagcctg

SEQ ID NO: 2738234 - DNA, 23 bp, Homo sapiens
gccactacactccagcctgagca

SEQ ID NO: 2738235 - DNA, 15 bp, Homo sapiens
gccactacctttgtc

SEQ ID NO: 2738236 - DNA, 16 bp, Homo sapiens
gccactacctttgtcc

SEQ ID NO: 2738237 - DNA, 16 bp, Homo sapiens
gccactccccagtgct

SEQ ID NO: 2738238 - DNA, 15 bp, Homo sapiens
gccactctgctgcct

SEQ ID NO: 2738239 - DNA, 19 bp, Homo sapiens
gccactgcactccagcctg

SEQ ID NO: 2738240 - DNA, 20 bp, Homo sapiens
gccactgcactccagcctgg

SEQ ID NO: 2738241 - DNA, 21 bp, Homo sapiens
gccactgcactccagcctggg

SEQ ID NO: 2738242 - DNA, 17 bp, Homo sapiens
gccagagctgagtggca

SEQ ID NO: 2738243 - DNA, 14 bp, Homo sapiens
gccagccccacagc

SEQ ID NO: 2738244 - DNA, 14 bp, Homo sapiens
gccagccctggagg

SEQ ID NO: 2738245 - DNA, 15 bp, Homo sapiens
gccagccctggaggc

SEQ ID NO: 2738246 - DNA, 12 bp, Homo sapiens
gccagcctggct

SEQ ID NO: 2738247 - DNA, 19 bp, Homo sapiens
gccagctctgtcaccctgg

SEQ ID NO: 2738248 - DNA, 17 bp, Homo sapiens
gccaggactccttagac

SEQ ID NO: 2738249 - DNA, 21 bp, Homo sapiens
gccaggctgtaagcattctga

SEQ ID NO: 2738250 - DNA, 17 bp, Homo sapiens
gccagggccctgcagag

SEQ ID NO: 2738251 - DNA, 14 bp, Homo sapiens
gccagggcttgtgg

SEQ ID NO: 2738252 - DNA, 22 bp, Homo sapiens
gccagggcttgtggactctctg

SEQ ID NO: 2738253 - DNA, 13 bp, Homo sapiens
gccaggtgcagtg

SEQ ID NO: 2738254 - DNA, 18 bp, Homo sapiens
gctgctgggggctcccct

SEQ ID NO: 2738255 - DNA, 19 bp, Homo sapiens
gctgctgggggctcccctt

SEQ ID NO: 2738256 - DNA, 15 bp, Homo sapiens
gctgctgtggcatca

SEQ ID NO: 2738257 - DNA, 23 bp, Homo sapiens
gctggaaaagggctcagagctgc

SEQ ID NO: 2738258 - DNA, 15 bp, Homo sapiens
gctggactctggcac

SEQ ID NO: 2738259 - DNA, 19 bp, Homo sapiens
gctggactctggcacccag

SEQ ID NO: 2738260 - DNA, 19 bp, Homo sapiens
gctggatgagcaactcctg

SEQ ID NO: 2738261 - DNA, 14 bp, Homo sapiens
gctggcagcctcca

SEQ ID NO: 2738262 - DNA, 15 bp, Homo sapiens
gctggcagcctccag

SEQ ID NO: 2738263 - DNA, 15 bp, Homo sapiens
gctggccagccccac

SEQ ID NO: 2738264 - DNA, 20 bp, Homo sapiens
gctggcccacagctctgctg

SEQ ID NO: 2738265 - DNA, 22 bp, Homo sapiens
gctggcccacagctctgctgga

SEQ ID NO: 2738266 - DNA, 23 bp, Homo sapiens
gctggcctctagaacacccactg

SEQ ID NO: 2738267 - DNA, 13 bp, Homo sapiens
gctggcctcttgg

SEQ ID NO: 2738268 - DNA, 18 bp, Homo sapiens
gctggcctcttggcacct

SEQ ID NO: 2738269 - DNA, 15 bp, Homo sapiens
gctggcggcgcagag

SEQ ID NO: 2738270 - DNA, 13 bp, Homo sapiens
gctggctgcagtg

SEQ ID NO: 2738271 - DNA, 16 bp, Homo sapiens
gctggctgctggccca

SEQ ID NO: 2738272 - DNA, 15 bp, Homo sapiens
gctggctgggcatgg

SEQ ID NO: 2738273 - DNA, 16 bp, Homo sapiens
gctggctgggcatgga

SEQ ID NO: 2738274 - DNA, 13 bp, Homo sapiens
gctggctgtgtcc

SEQ ID NO: 2738275 - DNA, 15 bp, Homo sapiens
gctggctgtgtcctc

SEQ ID NO: 2738276 - DNA, 13 bp, Homo sapiens
gctgggcccacag

SEQ ID NO: 2738277 - DNA, 14 bp, Homo sapiens
gctgggcccacagc

SEQ ID NO: 2738278 - DNA, 20 bp, Homo sapiens
gctgggcccacagcccccac

SEQ ID NO: 2738279 - DNA, 21 bp, Homo sapiens
gctgggcccacagcccccacc

SEQ ID NO: 2738280 - DNA, 23 bp, Homo sapiens
gctgggctacaaaccaggagcaa

SEQ ID NO: 2738281 - DNA, 20 bp, Homo sapiens
gctgggctcttaactgttgc

SEQ ID NO: 2738282 - DNA, 21 bp, Homo sapiens
gctgggctcttaactgttgct

SEQ ID NO: 2738283 - DNA, 15 bp, Homo sapiens
gctgggctggggcct

SEQ ID NO: 2738284 - DNA, 14 bp, Homo sapiens
gctgggctgggtgc

SEQ ID NO: 2738285 - DNA, 21 bp, Homo sapiens
gctggggcctatcagtgtgcc

SEQ ID NO: 2738286 - DNA, 12 bp, Homo sapiens
gctggggcctga

SEQ ID NO: 2738287 - DNA, 19 bp, Homo sapiens
gctggggcctgatggggag

SEQ ID NO: 2738288 - DNA, 17 bp, Homo sapiens
gctgggttggcgcaccc

SEQ ID NO: 2738289 - DNA, 22 bp, Homo sapiens
gctgggttggcgcaccctcccc

SEQ ID NO: 2738290 - DNA, 16 bp, Homo sapiens
gctggtggattgggca

SEQ ID NO: 2738291 - DNA, 14 bp, Homo sapiens
gctgtaaatataaa

SEQ ID NO: 2738292 - DNA, 19 bp, Homo sapiens
gctgtaagcattctgagct

SEQ ID NO: 2738293 - DNA, 19 bp, Homo sapiens
gctgtacattactgtatgt

SEQ ID NO: 2738294 - DNA, 21 bp, Homo sapiens
gctgtagaactctgcaggcag

SEQ ID NO: 2738295 - DNA, 22 bp, Homo sapiens
gctgtagaactctgcaggcaga

SEQ ID NO: 2738296 - DNA, 15 bp, Homo sapiens
gctgtagctcccgag

SEQ ID NO: 2738297 - DNA, 15 bp, Homo sapiens
gctgtatacaaacag

SEQ ID NO: 2738298 - DNA, 13 bp, Homo sapiens
gctgtcctaggcc

SEQ ID NO: 2738299 - DNA, 18 bp, Homo sapiens
gctgtcggtgtgctgtca

SEQ ID NO: 2738300 - DNA, 12 bp, Homo sapiens
gctgtgccaccc

SEQ ID NO: 2738301 - DNA, 15 bp, Homo sapiens
gctgtgccaccctgg

SEQ ID NO: 2738302 - DNA, 22 bp, Homo sapiens
gctgtggaaaggattctaaaca

SEQ ID NO: 2738303 - DNA, 21 bp, Homo sapiens
gctgttacctgagatactgaa

SEQ ID NO: 2738304 - DNA, 19 bp, Homo sapiens
gcttactaatgtgccccat

SEQ ID NO: 2738305 - DNA, 17 bp, Homo sapiens
gcttaggtgccaggctg

SEQ ID NO: 2738306 - DNA, 18 bp, Homo sapiens
gcttaggtgccaggctgt

SEQ ID NO: 2738307 - DNA, 23 bp, Homo sapiens
gcttcagcctgaggctgagactg

SEQ ID NO: 2738308 - DNA, 15 bp, Homo sapiens
gcttcagttgttttc

SEQ ID NO: 2738309 - DNA, 15 bp, Homo sapiens
gcttccaaggtggtc

SEQ ID NO: 2738310 - DNA, 19 bp, Homo sapiens
gcttccagcttcctctgag

SEQ ID NO: 2738311 - DNA, 16 bp, Homo sapiens
gcttcccaagtagctg

SEQ ID NO: 2738312 - DNA, 13 bp, Homo sapiens
gcttcccctccac

SEQ ID NO: 2738313 - DNA, 17 bp, Homo sapiens
gcttcccctccacccta

SEQ ID NO: 2738314 - DNA, 16 bp, Homo sapiens
gcttccctctgcctga

SEQ ID NO: 2738315 - DNA, 16 bp, Homo sapiens
gcttccctgggcctca

SEQ ID NO: 2738316 - DNA, 18 bp, Homo sapiens
gcttccctggggccccat

SEQ ID NO: 2738317 - DNA, 13 bp, Homo sapiens
gcttcctctgagc

SEQ ID NO: 2738318 - DNA, 22 bp, Homo sapiens
gcttccttggcatcacagggca

SEQ ID NO: 2738319 - DNA, 13 bp, Homo sapiens
gcttctgccactt

SEQ ID NO: 2738320 - DNA, 18 bp, Homo sapiens
gcttctgccacttcccag

SEQ ID NO: 2738321 - DNA, 16 bp, Homo sapiens
gcttctgctgggctgg

SEQ ID NO: 2738322 - DNA, 22 bp, Homo sapiens
gcttctgctgggctggggcctg

SEQ ID NO: 2738323 - DNA, 12 bp, Homo sapiens
gcttctggagcc

SEQ ID NO: 2738324 - DNA, 14 bp, Homo sapiens
gcttctggagccct

SEQ ID NO: 2738325 - DNA, 17 bp, Homo sapiens
gcttgaacccaggaggt

SEQ ID NO: 2738326 - DNA, 20 bp, Homo sapiens
gcttgaacccaggaggtgga

SEQ ID NO: 2738327 - DNA, 22 bp, Homo sapiens
gcttgactctactcccagcgct

SEQ ID NO: 2738328 - DNA, 15 bp, Homo sapiens
gcttgcctcggctcc

SEQ ID NO: 2738329 - DNA, 22 bp, Homo sapiens
gcttgcctcggctcctgctgca

SEQ ID NO: 2738330 - DNA, 19 bp, Homo sapiens
gcttggaaagcatcacctc

SEQ ID NO: 2738331 - DNA, 21 bp, Homo sapiens
gcttggaaagcatcacctcag

SEQ ID NO: 2738332 - DNA, 23 bp, Homo sapiens
gcttgtcaaatagcaaggccagg

SEQ ID NO: 2738333 - DNA, 21 bp, Homo sapiens
gcttgtggactctctgcctgc

SEQ ID NO: 2738334 - DNA, 22 bp, Homo sapiens
gcttgtggactctctgcctgct

SEQ ID NO: 2738335 - DNA, 12 bp, Homo sapiens
gcttgttttaaa

SEQ ID NO: 2738336 - DNA, 13 bp, Homo sapiens
gcttgttttaaaa

SEQ ID NO: 2738337 - DNA, 15 bp, Homo sapiens
gctttacaaataatt

SEQ ID NO: 2738338 - DNA, 23 bp, Homo sapiens
gctttataccccatttgatttcg

SEQ ID NO: 2738339 - DNA, 12 bp, Homo sapiens
gctttctccttt

SEQ ID NO: 2738340 - DNA, 21 bp, Homo sapiens
gctttcttctttccagacccc

SEQ ID NO: 2738341 - DNA, 19 bp, Homo sapiens
gctttgccatgggcctgct

SEQ ID NO: 2738342 - DNA, 20 bp, Homo sapiens
gctttgccatgggcctgctg

SEQ ID NO: 2738343 - DNA, 22 bp, Homo sapiens
gctttggctgcacgtcaccctc

SEQ ID NO: 2738344 - DNA, 16 bp, Homo sapiens
gctttgttcttgtcat

SEQ ID NO: 2738345 - DNA, 14 bp, Homo sapiens
gcttttctcccaga

SEQ ID NO: 2738346 - DNA, 17 bp, Homo sapiens
ggaaaaatgtcactgaa

SEQ ID NO: 2738347 - DNA, 14 bp, Homo sapiens
ggaaaagcctctgt

SEQ ID NO: 2738348 - DNA, 16 bp, Homo sapiens
ggaaagactgaaagaa

SEQ ID NO: 2738349 - DNA, 21 bp, Homo sapiens
ggaaagcaccgcagcatgtgg

SEQ ID NO: 2738350 - DNA, 18 bp, Homo sapiens
ggaaagcatcacctcagg

SEQ ID NO: 2738351 - DNA, 13 bp, Homo sapiens
ggaaagcctctgc

SEQ ID NO: 2738352 - DNA, 16 bp, Homo sapiens
ggaacacccggaaaga

SEQ ID NO: 2738353 - DNA, 18 bp, Homo sapiens
ggaacggggtccttcaag

SEQ ID NO: 2738354 - DNA, 17 bp, Homo sapiens
ggaactccccagggcct

SEQ ID NO: 2738355 - DNA, 18 bp, Homo sapiens
ggaactctaccctggtag

SEQ ID NO: 2738356 - DNA, 19 bp, Homo sapiens
ggaactgaagacctccaca

SEQ ID NO: 2738357 - DNA, 16 bp, Homo sapiens
ggaagaactgcatggg

SEQ ID NO: 2738358 - DNA, 15 bp, Homo sapiens
ggaagagaggcacct

SEQ ID NO: 2738359 - DNA, 23 bp, Homo sapiens
ggaagcaagacgtcctggaatga

SEQ ID NO: 2738360 - DNA, 20 bp, Homo sapiens
ggaagccatattcacacctc

SEQ ID NO: 2738361 - DNA, 14 bp, Homo sapiens
ggaagccctcggcc

SEQ ID NO: 2738362 - DNA, 23 bp, Homo sapiens
ggaagcgatgaatttggagactc

SEQ ID NO: 2738363 - DNA, 20 bp, Homo sapiens
ggaagcggaggttgcaggga

SEQ ID NO: 2738364 - DNA, 17 bp, Homo sapiens
ggaaggctggctgggca

SEQ ID NO: 2738365 - DNA, 15 bp, Homo sapiens
ggaagggagggagct

SEQ ID NO: 2738366 - DNA, 19 bp, Homo sapiens
ggaagggggctccatgctg

SEQ ID NO: 2738367 - DNA, 21 bp, Homo sapiens
ggaaggtactgaaggcttctg

SEQ ID NO: 2738368 - DNA, 15 bp, Homo sapiens
ggaatggaaggcttt

SEQ ID NO: 2738369 - DNA, 19 bp, Homo sapiens
ggaatttgtaagtttatgt

SEQ ID NO: 2738370 - DNA, 21 bp, Homo sapiens
ggaattttctttcatacatta

SEQ ID NO: 2738371 - DNA, 16 bp, Homo sapiens
ggacagaagcaggagt

SEQ ID NO: 2738372 - DNA, 13 bp, Homo sapiens
ggacagtcctggg

SEQ ID NO: 2738373 - DNA, 14 bp, Homo sapiens
ggacagtcctggga

SEQ ID NO: 2738374 - DNA, 16 bp, Homo sapiens
ggacagtgcttcagcc

SEQ ID NO: 2738375 - DNA, 21 bp, Homo sapiens
ggacagtgcttcagcctgagg

SEQ ID NO: 2738376 - DNA, 11 bp, Homo sapiens
ggaccctggcc

SEQ ID NO: 2738377 - DNA, 12 bp, Homo sapiens
ggaccctggcct

SEQ ID NO: 2738378 - DNA, 14 bp, Homo sapiens
ggccagcaggcagc

SEQ ID NO: 2738379 - DNA, 14 bp, Homo sapiens
ggccagccccacag

SEQ ID NO: 2738380 - DNA, 18 bp, Homo sapiens
ggccagccccacagccca

SEQ ID NO: 2738381 - DNA, 11 bp, Homo sapiens
ggccagggcct

SEQ ID NO: 2738382 - DNA, 23 bp, Homo sapiens
ggccaggtgggcgggcagcacag

SEQ ID NO: 2738383 - DNA, 21 bp, Homo sapiens
ggccaggttggaaaagaaatc

SEQ ID NO: 2738384 - DNA, 22 bp, Homo sapiens
ggccaggttggaaaagaaatca

SEQ ID NO: 2738385 - DNA, 20 bp, Homo sapiens
ggccagtcctagagctcctg

SEQ ID NO: 2738386 - DNA, 15 bp, Homo sapiens
ggccatactggcctc

SEQ ID NO: 2738387 - DNA, 19 bp, Homo sapiens
ggccatcttccaggtgggg

SEQ ID NO: 2738388 - DNA, 19 bp, Homo sapiens
ggcccacagcccccacccc

SEQ ID NO: 2738389 - DNA, 22 bp, Homo sapiens
ggcccacagcccccaccccagc

SEQ ID NO: 2738390 - DNA, 23 bp, Homo sapiens
ggcccacagcccccaccccagca

SEQ ID NO: 2738391 - DNA, 18 bp, Homo sapiens
ggcccagagcgaggaaag

SEQ ID NO: 2738392 - DNA, 15 bp, Homo sapiens
ggcccagcctgtcct

SEQ ID NO: 2738393 - DNA, 16 bp, Homo sapiens
ggcccagcctgtcctg

SEQ ID NO: 2738394 - DNA, 22 bp, Homo sapiens
ggcccatcagtgtacccccgcc

SEQ ID NO: 2738395 - DNA, 19 bp, Homo sapiens
ggcccatctgtccatcctc

SEQ ID NO: 2738396 - DNA, 22 bp, Homo sapiens
ggcccatctgtccatcctcctc

SEQ ID NO: 2738397 - DNA, 17 bp, Homo sapiens
ggccccaactacacacc

SEQ ID NO: 2738398 - DNA, 15 bp, Homo sapiens
ggccccagcctggcc

SEQ ID NO: 2738399 - DNA, 16 bp, Homo sapiens
ggccccagcctggccc

SEQ ID NO: 2738400 - DNA, 21 bp, Homo sapiens
ggccccagcctggcccagctc

SEQ ID NO: 2738401 - DNA, 22 bp, Homo sapiens
ggccccagcctggcccagctcc

SEQ ID NO: 2738402 - DNA, 20 bp, Homo sapiens
ggcccccactcacagggagc

SEQ ID NO: 2738403 - DNA, 13 bp, Homo sapiens
ggcccccagagac

SEQ ID NO: 2738404 - DNA, 18 bp, Homo sapiens
ggcccctcagggctgtcg

SEQ ID NO: 2738405 - DNA, 17 bp, Homo sapiens
ggcccctcaggggaagc

SEQ ID NO: 2738406 - DNA, 16 bp, Homo sapiens
ggccccttctccagca

SEQ ID NO: 2738407 - DNA, 14 bp, Homo sapiens
ggcccgcttgcctc

SEQ ID NO: 2738408 - DNA, 21 bp, Homo sapiens
ggcccgcttgcctcggctcct

SEQ ID NO: 2738409 - DNA, 14 bp, Homo sapiens
ggcccgggccttat

SEQ ID NO: 2738410 - DNA, 17 bp, Homo sapiens
ggcccgttgtctccctg

SEQ ID NO: 2738411 - DNA, 19 bp, Homo sapiens
ggcccgttgtctccctggc

SEQ ID NO: 2738412 - DNA, 23 bp, Homo sapiens
ggcccgttgtctccctggccctc

SEQ ID NO: 2738413 - DNA, 15 bp, Homo sapiens
ggccctgcactgtcc

SEQ ID NO: 2738414 - DNA, 23 bp, Homo sapiens
ggccctgcactgtcctgctccac

SEQ ID NO: 2738415 - DNA, 15 bp, Homo sapiens
ggccctgcccctccc

SEQ ID NO: 2738416 - DNA, 21 bp, Homo sapiens
ggccctgcccctccccctacc

SEQ ID NO: 2738417 - DNA, 12 bp, Homo sapiens
ggccctggtcct

SEQ ID NO: 2738418 - DNA, 17 bp, Homo sapiens
ggccctggtccttccag

SEQ ID NO: 2738419 - DNA, 18 bp, Homo sapiens
ggcccttggtagagctgg

SEQ ID NO: 2738420 - DNA, 13 bp, Homo sapiens
ggccgagccacct

SEQ ID NO: 2738421 - DNA, 14 bp, Homo sapiens
ggccggccaggtgg

SEQ ID NO: 2738422 - DNA, 15 bp, Homo sapiens
ggccggccaggtggg

SEQ ID NO: 2738423 - DNA, 13 bp, Homo sapiens
ggccggccctgcc

SEQ ID NO: 2738424 - DNA, 14 bp, Homo sapiens
ggccggccctgccc

SEQ ID NO: 2738425 - DNA, 15 bp, Homo sapiens
ggccggtgtgggctg

SEQ ID NO: 2738426 - DNA, 18 bp, Homo sapiens
ggcctaaagaatcccacc

SEQ ID NO: 2738427 - DNA, 20 bp, Homo sapiens
ggcctatcagtgtgcccccc

SEQ ID NO: 2738428 - DNA, 23 bp, Homo sapiens
ggcctatcagtgtgccccccatc

SEQ ID NO: 2738429 - DNA, 17 bp, Homo sapiens
ggcctcagcctccaggc

SEQ ID NO: 2738430 - DNA, 13 bp, Homo sapiens
ggcctccagactg

SEQ ID NO: 2738431 - DNA, 17 bp, Homo sapiens
ggcctccagactgcgga

SEQ ID NO: 2738432 - DNA, 23 bp, Homo sapiens
ggcctccagactgcggagcagcc

SEQ ID NO: 2738433 - DNA, 13 bp, Homo sapiens
ggcctcccctgag

SEQ ID NO: 2738434 - DNA, 15 bp, Homo sapiens
ggcctcccctgagga

SEQ ID NO: 2738435 - DNA, 22 bp, Homo sapiens
ggcctcccctgaggatcccctg

SEQ ID NO: 2738436 - DNA, 13 bp, Homo sapiens
ggcctcccttgag

SEQ ID NO: 2738437 - DNA, 14 bp, Homo sapiens
ggcctcgcctggcc

SEQ ID NO: 2738438 - DNA, 22 bp, Homo sapiens
ggcctcggaggctcctccctct

SEQ ID NO: 2738439 - DNA, 18 bp, Homo sapiens
ggcctctagaacacccac

SEQ ID NO: 2738440 - DNA, 22 bp, Homo sapiens
ggcctctagaacacccactggc

SEQ ID NO: 2738441 - DNA, 23 bp, Homo sapiens
ggcctctagaacacccactggcc

SEQ ID NO: 2738442 - DNA, 15 bp, Homo sapiens
ggcctcttggcacct

SEQ ID NO: 2738443 - DNA, 21 bp, Homo sapiens
ggcctgacctccagtcctgct

SEQ ID NO: 2738444 - DNA, 23 bp, Homo sapiens
ggcctgacctccagtcctgctgg

SEQ ID NO: 2738445 - DNA, 21 bp, Homo sapiens
ggcctgctcttacttccccca

SEQ ID NO: 2738446 - DNA, 19 bp, Homo sapiens
ggcctgctgcgtcagacca

SEQ ID NO: 2738447 - DNA, 15 bp, Homo sapiens
ggcgagaggaggggc

SEQ ID NO: 2738448 - DNA, 16 bp, Homo sapiens
ggcgcaccctcccctc

SEQ ID NO: 2738449 - DNA, 17 bp, Homo sapiens
ggcgcaccctcccctcc

SEQ ID NO: 2738450 - DNA, 14 bp, Homo sapiens
ggcgcgtctgcccc

SEQ ID NO: 2738451 - DNA, 20 bp, Homo sapiens
ggcgcgtctgccccaccctc

SEQ ID NO: 2738452 - DNA, 17 bp, Homo sapiens
ggcgggagtgggggctg

SEQ ID NO: 2738453 - DNA, 15 bp, Homo sapiens
ggcgggcagcacagc

SEQ ID NO: 2738454 - DNA, 14 bp, Homo sapiens
ggcgggggagccaa

SEQ ID NO: 2738455 - DNA, 18 bp, Homo sapiens
ggcgggggagccaacagc

SEQ ID NO: 2738456 - DNA, 22 bp, Homo sapiens
ggcgtcgctggacaacccagaa

SEQ ID NO: 2738457 - DNA, 18 bp, Homo sapiens
ggctaacatttaggagaa

SEQ ID NO: 2738458 - DNA, 19 bp, Homo sapiens
ggctaacatttaggagaag

SEQ ID NO: 2738459 - DNA, 19 bp, Homo sapiens
ggctaacgtttatttaaaa

SEQ ID NO: 2738460 - DNA, 14 bp, Homo sapiens
ggctagagtgcagt

SEQ ID NO: 2738461 - DNA, 20 bp, Homo sapiens
ggctagagtgcagtggcatg

SEQ ID NO: 2738462 - DNA, 22 bp, Homo sapiens
ggctagtctcttctcagagcag

SEQ ID NO: 2738463 - DNA, 20 bp, Homo sapiens
ggctcacgcctatgatccca

SEQ ID NO: 2738464 - DNA, 16 bp, Homo sapiens
ggctcagatcctgggc

SEQ ID NO: 2738465 - DNA, 16 bp, Homo sapiens
ggctcagctgtggtcc

SEQ ID NO: 2738466 - DNA, 19 bp, Homo sapiens
ggctcagctgtggtcccac

SEQ ID NO: 2738467 - DNA, 14 bp, Homo sapiens
ggctcagggaccac

SEQ ID NO: 2738468 - DNA, 14 bp, Homo sapiens
ggctcagtctcagg

SEQ ID NO: 2738469 - DNA, 15 bp, Homo sapiens
ggctcagtctcagga

SEQ ID NO: 2738470 - DNA, 17 bp, Homo sapiens
ggctcagtctcaggagc

SEQ ID NO: 2738471 - DNA, 13 bp, Homo sapiens
ggctcatcagaac

SEQ ID NO: 2738472 - DNA, 21 bp, Homo sapiens
ggctccagaatgtgctgcctt

SEQ ID NO: 2738473 - DNA, 16 bp, Homo sapiens
ggctccatgctggtgt

SEQ ID NO: 2738474 - DNA, 19 bp, Homo sapiens
ggctcccctgaggctggca

SEQ ID NO: 2738475 - DNA, 15 bp, Homo sapiens
ggctccctcctggag

SEQ ID NO: 2738476 - DNA, 12 bp, Homo sapiens
ggctcctccctc

SEQ ID NO: 2738477 - DNA, 16 bp, Homo sapiens
ggctcctccctctgcc

SEQ ID NO: 2738478 - DNA, 19 bp, Homo sapiens
ggctcctccctctgcctca

SEQ ID NO: 2738479 - DNA, 20 bp, Homo sapiens
ggctcctccctctgcctcat

SEQ ID NO: 2738480 - DNA, 15 bp, Homo sapiens
ggctcctgctgcacc

SEQ ID NO: 2738481 - DNA, 16 bp, Homo sapiens
ggctcctgctgcacca

SEQ ID NO: 2738482 - DNA, 21 bp, Homo sapiens
ggctcctgctgcaccaaccca

SEQ ID NO: 2738483 - DNA, 22 bp, Homo sapiens
ggctcctgctgcaccaacccag

SEQ ID NO: 2738484 - DNA, 14 bp, Homo sapiens
ggctcctgtgccct

SEQ ID NO: 2738485 - DNA, 15 bp, Homo sapiens
ggctcgccccaccca

SEQ ID NO: 2738486 - DNA, 14 bp, Homo sapiens
ggctctgccagcgt

SEQ ID NO: 2738487 - DNA, 20 bp, Homo sapiens
ggctctgccccagctctggc

SEQ ID NO: 2738488 - DNA, 21 bp, Homo sapiens
ggctctgccccagctctggct

SEQ ID NO: 2738489 - DNA, 14 bp, Homo sapiens
ggctctgtgggctg

SEQ ID NO: 2738490 - DNA, 18 bp, Homo sapiens
ggctctgtgggctgcact

SEQ ID NO: 2738491 - DNA, 18 bp, Homo sapiens
ggctcttaactgttgctc

SEQ ID NO: 2738492 - DNA, 16 bp, Homo sapiens
ggctgaacagtgctct

SEQ ID NO: 2738493 - DNA, 17 bp, Homo sapiens
ggctgaacagtgctctg

SEQ ID NO: 2738494 - DNA, 18 bp, Homo sapiens
ggctgaacagtgctctgc

SEQ ID NO: 2738495 - DNA, 15 bp, Homo sapiens
ggctgagagagtggc

SEQ ID NO: 2738496 - DNA, 17 bp, Homo sapiens
ggctgagagagtggcat

SEQ ID NO: 2738497 - DNA, 13 bp, Homo sapiens
ggctgagccctgg

SEQ ID NO: 2738498 - DNA, 15 bp, Homo sapiens
ggctgagccctggca

SEQ ID NO: 2738499 - DNA, 14 bp, Homo sapiens
ggctgagggcatct

SEQ ID NO: 2738500 - DNA, 17 bp, Homo sapiens
ggctgagggcatctctg

SEQ ID NO: 2738501 - DNA, 20 bp, Homo sapiens
ggctgcacgtcaccctcctg

SEQ ID NO: 2738502 - DNA, 13 bp, Homo sapiens
gtcctgctggcct

SEQ ID NO: 2738503 - DNA, 17 bp, Homo sapiens
gtcctgctggcctgctc

SEQ ID NO: 2738504 - DNA, 18 bp, Homo sapiens
gtcctgctggcctgctct

SEQ ID NO: 2738505 - DNA, 21 bp, Homo sapiens
gtcctgggagaacctcaggct

SEQ ID NO: 2738506 - DNA, 16 bp, Homo sapiens
gtcctggtacagcagg

SEQ ID NO: 2738507 - DNA, 14 bp, Homo sapiens
gtcctgtcagtgcc

SEQ ID NO: 2738508 - DNA, 22 bp, Homo sapiens
gtccttccaggcccccaccact

SEQ ID NO: 2738509 - DNA, 18 bp, Homo sapiens
gtccttggagtgctgcag

SEQ ID NO: 2738510 - DNA, 16 bp, Homo sapiens
gtcctttaggcagcct

SEQ ID NO: 2738511 - DNA, 17 bp, Homo sapiens
gtcctttaggcagcctg

SEQ ID NO: 2738512 - DNA, 18 bp, Homo sapiens
gtcctttaggcagcctgc

SEQ ID NO: 2738513 - DNA, 17 bp, Homo sapiens
gtcgctggacaacccag

SEQ ID NO: 2738514 - DNA, 19 bp, Homo sapiens
gtcgctggacaacccagaa

SEQ ID NO: 2738515 - DNA, 22 bp, Homo sapiens
gtcggcacgtcccatgtgcatg

SEQ ID NO: 2738516 - DNA, 14 bp, Homo sapiens
gtcgtgtctgctgt

SEQ ID NO: 2738517 - DNA, 22 bp, Homo sapiens
gtctcaaaatatttttttaaga

SEQ ID NO: 2738518 - DNA, 15 bp, Homo sapiens
gtctcacactcctcc

SEQ ID NO: 2738519 - DNA, 22 bp, Homo sapiens
gtctcacactcctcctgccagc

SEQ ID NO: 2738520 - DNA, 23 bp, Homo sapiens
gtctcacactcctcctgccagct

SEQ ID NO: 2738521 - DNA, 14 bp, Homo sapiens
gtctcctccaccgc

SEQ ID NO: 2738522 - DNA, 21 bp, Homo sapiens
gtctcctccaccgccatggct

SEQ ID NO: 2738523 - DNA, 15 bp, Homo sapiens
gtctcgaactcctga

SEQ ID NO: 2738524 - DNA, 16 bp, Homo sapiens
gtctcgctctgctgcc

SEQ ID NO: 2738525 - DNA, 21 bp, Homo sapiens
gtctcgctgatgctgggctgg

SEQ ID NO: 2738526 - DNA, 22 bp, Homo sapiens
gtctcggtggtaccaggtctcc

SEQ ID NO: 2738527 - DNA, 15 bp, Homo sapiens
gtctctctgcctgct

SEQ ID NO: 2738528 - DNA, 19 bp, Homo sapiens
gtctctctgcctgctgggc

SEQ ID NO: 2738529 - DNA, 22 bp, Homo sapiens
gtctctctgcctgctgggctct

SEQ ID NO: 2738530 - DNA, 15 bp, Homo sapiens
gtctctgaacatcct

SEQ ID NO: 2738531 - DNA, 18 bp, Homo sapiens
gtctctgcctggagcagg

SEQ ID NO: 2738532 - DNA, 23 bp, Homo sapiens
gtctctgcttggcttcccctcca

SEQ ID NO: 2738533 - DNA, 15 bp, Homo sapiens
gtctctggctcagct

SEQ ID NO: 2738534 - DNA, 18 bp, Homo sapiens
gtctctggctcagctgtg

SEQ ID NO: 2738535 - DNA, 19 bp, Homo sapiens
gtctctggctcagctgtgg

SEQ ID NO: 2738536 - DNA, 13 bp, Homo sapiens
gtctcttctcaga

SEQ ID NO: 2738537 - DNA, 17 bp, Homo sapiens
gtctcttctcagagcag

SEQ ID NO: 2738538 - DNA, 21 bp, Homo sapiens
gtctcttgactggctcaagaa

SEQ ID NO: 2738539 - DNA, 12 bp, Homo sapiens
gtctgaaggatt

SEQ ID NO: 2738540 - DNA, 22 bp, Homo sapiens
gtctgaccgacgatccctcgac

SEQ ID NO: 2738541 - DNA, 19 bp, Homo sapiens
gtctgcatcagctttttgt

SEQ ID NO: 2738542 - DNA, 13 bp, Homo sapiens
gtctgccccaccc

SEQ ID NO: 2738543 - DNA, 14 bp, Homo sapiens
gtctgccccaccct

SEQ ID NO: 2738544 - DNA, 15 bp, Homo sapiens
gtctgtctttgcaaa

SEQ ID NO: 2738545 - DNA, 17 bp, Homo sapiens
gtcttactttgtgcaaa

SEQ ID NO: 2738546 - DNA, 18 bp, Homo sapiens
gtcttataggtttccact

SEQ ID NO: 2738547 - DNA, 13 bp, Homo sapiens
gtcttccaacccc

SEQ ID NO: 2738548 - DNA, 15 bp, Homo sapiens
gtcttccaaccccag

SEQ ID NO: 2738549 - DNA, 17 bp, Homo sapiens
gtcttccaaccccagct

SEQ ID NO: 2738550 - DNA, 22 bp, Homo sapiens
gtcttccaaccccagctggcct

SEQ ID NO: 2738551 - DNA, 23 bp, Homo sapiens
gtcttccaaccccagctggcctc

SEQ ID NO: 2738552 - DNA, 12 bp, Homo sapiens
gtcttcctgtgg

SEQ ID NO: 2738553 - DNA, 17 bp, Homo sapiens
gtcttgacctgaactct

SEQ ID NO: 2738554 - DNA, 18 bp, Homo sapiens
gtcttgacctgaactctg

SEQ ID NO: 2738555 - DNA, 21 bp, Homo sapiens
gtctttctttgctgctgtgga

SEQ ID NO: 2738556 - DNA, 13 bp, Homo sapiens
gtgaaaaatgagc

SEQ ID NO: 2738557 - DNA, 16 bp, Homo sapiens
gtgaaaatatttaaag

SEQ ID NO: 2738558 - DNA, 16 bp, Homo sapiens
gtgaacaaagaaaaga

SEQ ID NO: 2738559 - DNA, 23 bp, Homo sapiens
gtgaacaaagaaaagacattgaa

SEQ ID NO: 2738560 - DNA, 20 bp, Homo sapiens
gtgaataaacttcagcacca

SEQ ID NO: 2738561 - DNA, 15 bp, Homo sapiens
gtgaattacactcaa

SEQ ID NO: 2738562 - DNA, 16 bp, Homo sapiens
gtgaatttaagcatga

SEQ ID NO: 2738563 - DNA, 22 bp, Homo sapiens
gtgaccccttttcagcttctgc

SEQ ID NO: 2738564 - DNA, 23 bp, Homo sapiens
gtgaccccttttcagcttctgct

SEQ ID NO: 2738565 - DNA, 17 bp, Homo sapiens
gtgacgtgactcagagc

SEQ ID NO: 2738566 - DNA, 14 bp, Homo sapiens
gtgactcagagctt

SEQ ID NO: 2738567 - DNA, 17 bp, Homo sapiens
gtgactcgggctcctgt

SEQ ID NO: 2738568 - DNA, 21 bp, Homo sapiens
gtgactcgggctcctgtgccc

SEQ ID NO: 2738569 - DNA, 17 bp, Homo sapiens
gtgagaagggcctgctc

SEQ ID NO: 2738570 - DNA, 18 bp, Homo sapiens
gtgagaagggcctgctct

SEQ ID NO: 2738571 - DNA, 16 bp, Homo sapiens
gtgagaggaaatgttg

SEQ ID NO: 2738572 - DNA, 16 bp, Homo sapiens
gtgaggccggccctgc

SEQ ID NO: 2738573 - DNA, 18 bp, Homo sapiens
gtgaggccggccctgccc

SEQ ID NO: 2738574 - DNA, 15 bp, Homo sapiens
gtgagtgtgactttt

SEQ ID NO: 2738575 - DNA, 18 bp, Homo sapiens
gtgagtgtgactttttga

SEQ ID NO: 2738576 - DNA, 19 bp, Homo sapiens
gtgatatccacaaatgcta

SEQ ID NO: 2738577 - DNA, 20 bp, Homo sapiens
gtgatcacgatccagtctgc

SEQ ID NO: 2738578 - DNA, 15 bp, Homo sapiens
gtgatcatctttgct

SEQ ID NO: 2738579 - DNA, 22 bp, Homo sapiens
gtgattatggacatcgatatga

SEQ ID NO: 2738580 - DNA, 19 bp, Homo sapiens
gtgattatttgttatttgt

SEQ ID NO: 2738581 - DNA, 15 bp, Homo sapiens
gtgattgactttttg

SEQ ID NO: 2738582 - DNA, 20 bp, Homo sapiens
gtgattggcaggaggcagga

SEQ ID NO: 2738583 - DNA, 20 bp, Homo sapiens
gtgatttcccgtggccccag

SEQ ID NO: 2738584 - DNA, 23 bp, Homo sapiens
gtgatttcccgtggccccagcct

SEQ ID NO: 2738585 - DNA, 14 bp, Homo sapiens
gtgatttttttgtc

SEQ ID NO: 2738586 - DNA, 13 bp, Homo sapiens
gtgcaaacagtgt

SEQ ID NO: 2738587 - DNA, 15 bp, Homo sapiens
gtgcaactcttgtat

SEQ ID NO: 2738588 - DNA, 18 bp, Homo sapiens
gtgcaactcttgtattgc

SEQ ID NO: 2738589 - DNA, 18 bp, Homo sapiens
gtgcacagcttcctgagt

SEQ ID NO: 2738590 - DNA, 16 bp, Homo sapiens
gtgcacctatggccca

SEQ ID NO: 2738591 - DNA, 17 bp, Homo sapiens
gtgcacctatggcccag

SEQ ID NO: 2738592 - DNA, 15 bp, Homo sapiens
gtgcagctcaggaga

SEQ ID NO: 2738593 - DNA, 23 bp, Homo sapiens
gtgcagggaggaggtggcagccc

SEQ ID NO: 2738594 - DNA, 15 bp, Homo sapiens
gtgcatgcaggtctc

SEQ ID NO: 2738595 - DNA, 20 bp, Homo sapiens
gtgcatgccttcataaatta

SEQ ID NO: 2738596 - DNA, 21 bp, Homo sapiens
gtgccaacagtgttaggcctg

SEQ ID NO: 2738597 - DNA, 12 bp, Homo sapiens
gtgccaattttg

SEQ ID NO: 2738598 - DNA, 22 bp, Homo sapiens
gtgccaccctgggctctgtggg

SEQ ID NO: 2738599 - DNA, 16 bp, Homo sapiens
gtgccagtcgcgctgc

SEQ ID NO: 2738600 - DNA, 17 bp, Homo sapiens
gtgccagtcgcgctgcc

SEQ ID NO: 2738601 - DNA, 19 bp, Homo sapiens
gtgccagtcgcgctgcctg

SEQ ID NO: 2738602 - DNA, 14 bp, Homo sapiens
gtgcccatgggcac

SEQ ID NO: 2738603 - DNA, 19 bp, Homo sapiens
gtgcccatgggcactgctg

SEQ ID NO: 2738604 - DNA, 21 bp, Homo sapiens
gtgcccatgggcactgctggg

SEQ ID NO: 2738605 - DNA, 16 bp, Homo sapiens
gtgcccattcctcacc

SEQ ID NO: 2738606 - DNA, 22 bp, Homo sapiens
gtgccgccgcctcgcccaccgc

SEQ ID NO: 2738607 - DNA, 23 bp, Homo sapiens
gtgccgccgcctcgcccaccgca

SEQ ID NO: 2738608 - DNA, 24 bp, Homo sapiens
gtgccgtagtcctttttgtaacta

SEQ ID NO: 2738609 - DNA, 18 bp, Homo sapiens
gtgcctcagtgctgcaat

SEQ ID NO: 2738610 - DNA, 16 bp, Homo sapiens
gtgcgaccccatctgc

SEQ ID NO: 2738611 - DNA, 21 bp, Homo sapiens
gtgctcgcctctgcccagcct

SEQ ID NO: 2738612 - DNA, 13 bp, Homo sapiens
gtgctctgcctct

SEQ ID NO: 2738613 - DNA, 18 bp, Homo sapiens
gtgctgcctctcttctgt

SEQ ID NO: 2738614 - DNA, 18 bp, Homo sapiens
gtgctgctaccctccctg

SEQ ID NO: 2738615 - DNA, 13 bp, Homo sapiens
gtgctggctgctg

SEQ ID NO: 2738616 - DNA, 15 bp, Homo sapiens
gtgctggctgctggc

SEQ ID NO: 2738617 - DNA, 16 bp, Homo sapiens
gtgctgtggcctgggc

SEQ ID NO: 2738618 - DNA, 14 bp, Homo sapiens
gtggaaagcctctg

SEQ ID NO: 2738619 - DNA, 16 bp, Homo sapiens
gtggaaaggattctaa

SEQ ID NO: 2738620 - DNA, 15 bp, Homo sapiens
gtggacagtcctggg

SEQ ID NO: 2738621 - DNA, 23 bp, Homo sapiens
gtggactgaaccgacttttctaa

SEQ ID NO: 2738622 - DNA, 17 bp, Homo sapiens
gtggaggttgcagtgaa

SEQ ID NO: 2738623 - DNA, 21 bp, Homo sapiens
gtggagttctctgttctagag

SEQ ID NO: 2738624 - DNA, 13 bp, Homo sapiens
gtggatcacctga

SEQ ID NO: 2738625 - DNA, 19 bp, Homo sapiens
tcagaattttggaaaaatg

SEQ ID NO: 2738626 - DNA, 15 bp, Homo sapiens
tcagactcctggctt

SEQ ID NO: 2738627 - DNA, 13 bp, Homo sapiens
tcagactgctggg

SEQ ID NO: 2738628 - DNA, 14 bp, Homo sapiens
tcagactgctggga

SEQ ID NO: 2738629 - DNA, 21 bp, Homo sapiens
tcagactgctgggactggcca

SEQ ID NO: 2738630 - DNA, 15 bp, Homo sapiens
tcagagcagcactgg

SEQ ID NO: 2738631 - DNA, 12 bp, Homo sapiens
tcagagcctcag

SEQ ID NO: 2738632 - DNA, 21 bp, Homo sapiens
tcagagctgcgggctgagggc

SEQ ID NO: 2738633 - DNA, 19 bp, Homo sapiens
tcagagctggcagcctcca

SEQ ID NO: 2738634 - DNA, 22 bp, Homo sapiens
tcagagcttttcgaactgtgct

SEQ ID NO: 2738635 - DNA, 23 bp, Homo sapiens
tcagagtgtccctttttgcaggg

SEQ ID NO: 2738636 - DNA, 14 bp, Homo sapiens
tcagatgcccagag

SEQ ID NO: 2738637 - DNA, 22 bp, Homo sapiens
tcagatgcccagagggcccagg

SEQ ID NO: 2738638 - DNA, 15 bp, Homo sapiens
tcagattcaggagct

SEQ ID NO: 2738639 - DNA, 22 bp, Homo sapiens
tcagattgtaaaggtaggtgca

SEQ ID NO: 2738640 - DNA, 12 bp, Homo sapiens
tcagattttctc

SEQ ID NO: 2738641 - DNA, 18 bp, Homo sapiens
tcagcaatagggtgcagt

SEQ ID NO: 2738642 - DNA, 12 bp, Homo sapiens
tcagcagcccca

SEQ ID NO: 2738643 - DNA, 16 bp, Homo sapiens
tcagcagccccacccc

SEQ ID NO: 2738644 - DNA, 15 bp, Homo sapiens
tcagcatcaaacatg

SEQ ID NO: 2738645 - DNA, 16 bp, Homo sapiens
tcagcatcaaacatga

SEQ ID NO: 2738646 - DNA, 18 bp, Homo sapiens
tcagcatcaaacatgaaa

SEQ ID NO: 2738647 - DNA, 13 bp, Homo sapiens
tcagccagccctg

SEQ ID NO: 2738648 - DNA, 16 bp, Homo sapiens
tcagccagccctggag

SEQ ID NO: 2738649 - DNA, 17 bp, Homo sapiens
tcagccagccctggagg

SEQ ID NO: 2738650 - DNA, 20 bp, Homo sapiens
tcagcctcccgagtagctgg

SEQ ID NO: 2738651 - DNA, 13 bp, Homo sapiens
tcagcctcctgag

SEQ ID NO: 2738652 - DNA, 24 bp, Homo sapiens
tcagccttccccctcccagggcca

SEQ ID NO: 2738653 - DNA, 21 bp, Homo sapiens
tcagctattcccttctgatct

SEQ ID NO: 2738654 - DNA, 18 bp, Homo sapiens
tcagctctcctgctgcag

SEQ ID NO: 2738655 - DNA, 18 bp, Homo sapiens
tcagctgtggtcccaccc

SEQ ID NO: 2738656 - DNA, 21 bp, Homo sapiens
tcagcttcccaagtagctgag

SEQ ID NO: 2738657 - DNA, 17 bp, Homo sapiens
tcagcttctgctgggct

SEQ ID NO: 2738658 - DNA, 18 bp, Homo sapiens
tcagcttctgctgggctg

SEQ ID NO: 2738659 - DNA, 21 bp, Homo sapiens
tcagcttctgctgggctgggg

SEQ ID NO: 2738660 - DNA, 20 bp, Homo sapiens
tcaggagagccctctgctgc

SEQ ID NO: 2738661 - DNA, 20 bp, Homo sapiens
tcaggagatggaagagtcat

SEQ ID NO: 2738662 - DNA, 23 bp, Homo sapiens
tcaggaggggaagaggcctttct

SEQ ID NO: 2738663 - DNA, 23 bp, Homo sapiens
tcaggctggtctcgaactcctga

SEQ ID NO: 2738664 - DNA, 17 bp, Homo sapiens
tcaggctttgtctgctc

SEQ ID NO: 2738665 - DNA, 16 bp, Homo sapiens
tcaggggaagctgcta

SEQ ID NO: 2738666 - DNA, 20 bp, Homo sapiens
tcaggggctgcccgctccca

SEQ ID NO: 2738667 - DNA, 20 bp, Homo sapiens
tcaggtgacggactcagact

SEQ ID NO: 2738668 - DNA, 21 bp, Homo sapiens
tcaggtgacggactcagactc

SEQ ID NO: 2738669 - DNA, 22 bp, Homo sapiens
tcaggtgtggcggtgcgtgcct

SEQ ID NO: 2738670 - DNA, 17 bp, Homo sapiens
tcagtaagtataacaaa

SEQ ID NO: 2738671 - DNA, 14 bp, Homo sapiens
tcagtctcaggagc

SEQ ID NO: 2738672 - DNA, 21 bp, Homo sapiens
tcagtgccgccgcctcgccca

SEQ ID NO: 2738673 - DNA, 15 bp, Homo sapiens
tcagtgctgtggcct

SEQ ID NO: 2738674 - DNA, 17 bp, Homo sapiens
tcagtgctgtggcctgg

SEQ ID NO: 2738675 - DNA, 19 bp, Homo sapiens
tcagtgctgtggcctgggc

SEQ ID NO: 2738676 - DNA, 22 bp, Homo sapiens
tcagtgctgtggcctgggcaag

SEQ ID NO: 2738677 - DNA, 17 bp, Homo sapiens
tcagtgtacccccgccc

SEQ ID NO: 2738678 - DNA, 21 bp, Homo sapiens
tcagtgtacccccgcccaggc

SEQ ID NO: 2738679 - DNA, 12 bp, Homo sapiens
tcagtgtatcta

SEQ ID NO: 2738680 - DNA, 19 bp, Homo sapiens
tcagtgtgccccccatcct

SEQ ID NO: 2738681 - DNA, 17 bp, Homo sapiens
tcagttcctctttgcat

SEQ ID NO: 2738682 - DNA, 19 bp, Homo sapiens
tcagttcctctttgcatgg

SEQ ID NO: 2738683 - DNA, 21 bp, Homo sapiens
tcagttcctctttgcatggaa

SEQ ID NO: 2738684 - DNA, 13 bp, Homo sapiens
tcataaagtatgc

SEQ ID NO: 2738685 - DNA, 18 bp, Homo sapiens
tcataaattatttctaaa

SEQ ID NO: 2738686 - DNA, 21 bp, Homo sapiens
tcataaattatttctaaaaca

SEQ ID NO: 2738687 - DNA, 19 bp, Homo sapiens
tcataaatttgttgtcatg

SEQ ID NO: 2738688 - DNA, 23 bp, Homo sapiens
tcataaatttgttgtcatgtgta

SEQ ID NO: 2738689 - DNA, 24 bp, Homo sapiens
tcataaatttgttgtcatgtgtat

SEQ ID NO: 2738690 - DNA, 13 bp, Homo sapiens
tcataattcacca

SEQ ID NO: 2738691 - DNA, 22 bp, Homo sapiens
tcataatttcagttctagttga

SEQ ID NO: 2738692 - DNA, 18 bp, Homo sapiens
tcatagtcaatcaaacag

SEQ ID NO: 2738693 - DNA, 18 bp, Homo sapiens
tcatataatttaaagaaa

SEQ ID NO: 2738694 - DNA, 16 bp, Homo sapiens
tcatatatgactttat

SEQ ID NO: 2738695 - DNA, 11 bp, Homo sapiens
tcatatgaaaa

SEQ ID NO: 2738696 - DNA, 21 bp, Homo sapiens
tcatatgaaaaaaatgcattt

SEQ ID NO: 2738697 - DNA, 21 bp, Homo sapiens
tcatattaattattttccaaa

SEQ ID NO: 2738698 - DNA, 22 bp, Homo sapiens
tcatcccatctaagctgcagct

SEQ ID NO: 2738699 - DNA, 16 bp, Homo sapiens
tcatcctcctcctcat

SEQ ID NO: 2738700 - DNA, 17 bp, Homo sapiens
tcatctggaggctgcgt

SEQ ID NO: 2738701 - DNA, 18 bp, Homo sapiens
tcatctgtgcctgtctgt

SEQ ID NO: 2738702 - DNA, 22 bp, Homo sapiens
tcatgcaagacttcactgcagc

SEQ ID NO: 2738703 - DNA, 14 bp, Homo sapiens
tcatggatttggtt

SEQ ID NO: 2738704 - DNA, 13 bp, Homo sapiens
tcatgtcatttct

SEQ ID NO: 2738705 - DNA, 16 bp, Homo sapiens
tcatgtcatttctcat

SEQ ID NO: 2738706 - DNA, 21 bp, Homo sapiens
tcatgtggcattctctctgct

SEQ ID NO: 2738707 - DNA, 17 bp, Homo sapiens
tcatgttggccaggctg

SEQ ID NO: 2738708 - DNA, 22 bp, Homo sapiens
tcatgttttaaaagtttgtcct

SEQ ID NO: 2738709 - DNA, 15 bp, Homo sapiens
tcattcagcagtcag

SEQ ID NO: 2738710 - DNA, 16 bp, Homo sapiens
tcattgatggagcctg

SEQ ID NO: 2738711 - DNA, 10 bp, Homo sapiens
tcatttctaa

SEQ ID NO: 2738712 - DNA, 21 bp, Homo sapiens
tccaaacactgggctctgagg

SEQ ID NO: 2738713 - DNA, 20 bp, Homo sapiens
tccaaagggcagtaaagttt

SEQ ID NO: 2738714 - DNA, 17 bp, Homo sapiens
tccaaatacattccagt

SEQ ID NO: 2738715 - DNA, 17 bp, Homo sapiens
tccaaatgctgtgcaaa

SEQ ID NO: 2738716 - DNA, 17 bp, Homo sapiens
tccaacaataaagagct

SEQ ID NO: 2738717 - DNA, 16 bp, Homo sapiens
tccaaccccagctggc

SEQ ID NO: 2738718 - DNA, 17 bp, Homo sapiens
tccaaccccagctggcc

SEQ ID NO: 2738719 - DNA, 19 bp, Homo sapiens
tccaaccccagctggcctc

SEQ ID NO: 2738720 - DNA, 17 bp, Homo sapiens
tccaaccccccacctgc

SEQ ID NO: 2738721 - DNA, 15 bp, Homo sapiens
tccaacccctccccc

SEQ ID NO: 2738722 - DNA, 19 bp, Homo sapiens
tccaaggcagttctgtgtc

SEQ ID NO: 2738723 - DNA, 21 bp, Homo sapiens
tccaaggcagttctgtgtcct

SEQ ID NO: 2738724 - DNA, 20 bp, Homo sapiens
tccaagtccaacctgcctgt

SEQ ID NO: 2738725 - DNA, 16 bp, Homo sapiens
tccacaaatgctattc

SEQ ID NO: 2738726 - DNA, 17 bp, Homo sapiens
tccacaacctcctcctc

SEQ ID NO: 2738727 - DNA, 14 bp, Homo sapiens
tccacagccgcagc

SEQ ID NO: 2738728 - DNA, 17 bp, Homo sapiens
tccacagccgcagcctc

SEQ ID NO: 2738729 - DNA, 23 bp, Homo sapiens
tccacagggacacagtctggtgc

SEQ ID NO: 2738730 - DNA, 20 bp, Homo sapiens
tccacagtggaaccagccca

SEQ ID NO: 2738731 - DNA, 13 bp, Homo sapiens
tccaccagagcag

SEQ ID NO: 2738732 - DNA, 21 bp, Homo sapiens
tccaccagagcaggggctgct

SEQ ID NO: 2738733 - DNA, 23 bp, Homo sapiens
tccaccagagcaggggctgctgg

SEQ ID NO: 2738734 - DNA, 15 bp, Homo sapiens
tccacctccacccac

SEQ ID NO: 2738735 - DNA, 12 bp, Homo sapiens
tccacctcctgg

SEQ ID NO: 2738736 - DNA, 13 bp, Homo sapiens
tccacctcctggg

SEQ ID NO: 2738737 - DNA, 22 bp, Homo sapiens
tccacctggccccttctccagc

SEQ ID NO: 2738738 - DNA, 18 bp, Homo sapiens
tccacgtgctcgcctctg

SEQ ID NO: 2738739 - DNA, 13 bp, Homo sapiens
tccacgtgtatgc

SEQ ID NO: 2738740 - DNA, 13 bp, Homo sapiens
tccactcccactt

SEQ ID NO: 2738741 - DNA, 12 bp, Homo sapiens
tccactgtttca

SEQ ID NO: 2738742 - DNA, 16 bp, Homo sapiens
tccagaatgtgctgcc

SEQ ID NO: 2738743 - DNA, 16 bp, Homo sapiens
tccagaccattgtctt

SEQ ID NO: 2738744 - DNA, 13 bp, Homo sapiens
tccagactgcgga

SEQ ID NO: 2738745 - DNA, 16 bp, Homo sapiens
tccagactgcggagca

SEQ ID NO: 2738746 - DNA, 17 bp, Homo sapiens
tccagcacgttttctgg

SEQ ID NO: 2738747 - DNA, 14 bp, Homo sapiens
tccagccagctcct

SEQ ID NO: 2738748 - DNA, 23 bp, Homo sapiens
tcgtttgatagtgcttcttgtaa

SEQ ID NO: 2738749 - DNA, 19 bp, Homo sapiens
tctaaaacattaattgagg

SEQ ID NO: 2738750 - DNA, 18 bp, Homo sapiens
tctaaagtttacagtaaa

SEQ ID NO: 2738751 - DNA, 13 bp, Homo sapiens
tctaaattcactg

SEQ ID NO: 2738752 - DNA, 14 bp, Homo sapiens
tctaaattcactgt

SEQ ID NO: 2738753 - DNA, 13 bp, Homo sapiens
tctaacattttct

SEQ ID NO: 2738754 - DNA, 22 bp, Homo sapiens
tctaaccaaagagtctctggct

SEQ ID NO: 2738755 - DNA, 12 bp, Homo sapiens
tctaagctgcag

SEQ ID NO: 2738756 - DNA, 18 bp, Homo sapiens
tctaagctgcagcttcct

SEQ ID NO: 2738757 - DNA, 19 bp, Homo sapiens
tctaagctgcagcttcctg

SEQ ID NO: 2738758 - DNA, 16 bp, Homo sapiens
tctaatccatgtgctg

SEQ ID NO: 2738759 - DNA, 12 bp, Homo sapiens
tctaccctgcag

SEQ ID NO: 2738760 - DNA, 18 bp, Homo sapiens
tctactcattccccgggg

SEQ ID NO: 2738761 - DNA, 13 bp, Homo sapiens
tctactcccagcg

SEQ ID NO: 2738762 - DNA, 15 bp, Homo sapiens
tctactcctcacagc

SEQ ID NO: 2738763 - DNA, 22 bp, Homo sapiens
tctagaacacccactggccagt

SEQ ID NO: 2738764 - DNA, 13 bp, Homo sapiens
tctagaagcagaa

SEQ ID NO: 2738765 - DNA, 15 bp, Homo sapiens
tctaggtcttggtta

SEQ ID NO: 2738766 - DNA, 15 bp, Homo sapiens
tctagtatctattgt

SEQ ID NO: 2738767 - DNA, 19 bp, Homo sapiens
tctagtccctgtgttctgc

SEQ ID NO: 2738768 - DNA, 14 bp, Homo sapiens
tctagtgccctcca

SEQ ID NO: 2738769 - DNA, 21 bp, Homo sapiens
tctagttgattgcgagaattt

SEQ ID NO: 2738770 - DNA, 18 bp, Homo sapiens
tctatggattatccactg

SEQ ID NO: 2738771 - DNA, 22 bp, Homo sapiens
tctatgtatgtgccaattttgt

SEQ ID NO: 2738772 - DNA, 19 bp, Homo sapiens
tctcaaagaaatttccact

SEQ ID NO: 2738773 - DNA, 14 bp, Homo sapiens
tctcaaatcaaata

SEQ ID NO: 2738774 - DNA, 15 bp, Homo sapiens
tctcaattttgtatt

SEQ ID NO: 2738775 - DNA, 17 bp, Homo sapiens
tctcacactcctcctgc

SEQ ID NO: 2738776 - DNA, 18 bp, Homo sapiens
tctcacactcctcctgcc

SEQ ID NO: 2738777 - DNA, 19 bp, Homo sapiens
tctcaccttaactcagcca

SEQ ID NO: 2738778 - DNA, 18 bp, Homo sapiens
tctcagcagccagctcct

SEQ ID NO: 2738779 - DNA, 22 bp, Homo sapiens
tctcaggtgacggactcagact

SEQ ID NO: 2738780 - DNA, 16 bp, Homo sapiens
tctccacaacctcctc

SEQ ID NO: 2738781 - DNA, 16 bp, Homo sapiens
tctccacctagtggct

SEQ ID NO: 2738782 - DNA, 22 bp, Homo sapiens
tctccactgtttcatgagccca

SEQ ID NO: 2738783 - DNA, 18 bp, Homo sapiens
tctccagatggagaaaca

SEQ ID NO: 2738784 - DNA, 16 bp, Homo sapiens
tctccaggtaactttg

SEQ ID NO: 2738785 - DNA, 20 bp, Homo sapiens
tctcccacgtgcacagcttc

SEQ ID NO: 2738786 - DNA, 21 bp, Homo sapiens
tctccctgaccttctccaggg

SEQ ID NO: 2738787 - DNA, 14 bp, Homo sapiens
tctccctggccctc

SEQ ID NO: 2738788 - DNA, 20 bp, Homo sapiens
tctcctccaccgccatggct

SEQ ID NO: 2738789 - DNA, 11 bp, Homo sapiens
tctcctcccac

SEQ ID NO: 2738790 - DNA, 16 bp, Homo sapiens
tctcctcccatggcct

SEQ ID NO: 2738791 - DNA, 13 bp, Homo sapiens
tctcctccctgtt

SEQ ID NO: 2738792 - DNA, 15 bp, Homo sapiens
tctcctgtatcattt

SEQ ID NO: 2738793 - DNA, 15 bp, Homo sapiens
tctcgaactcctgac

SEQ ID NO: 2738794 - DNA, 16 bp, Homo sapiens
tctcgacttcaggagc

SEQ ID NO: 2738795 - DNA, 15 bp, Homo sapiens
tctcgccctggccag

SEQ ID NO: 2738796 - DNA, 16 bp, Homo sapiens
tctcgccctggccagg

SEQ ID NO: 2738797 - DNA, 17 bp, Homo sapiens
tctcggaaggctggctg

SEQ ID NO: 2738798 - DNA, 23 bp, Homo sapiens
tctctattccaataaagcagagt

SEQ ID NO: 2738799 - DNA, 17 bp, Homo sapiens
tctctccagcctcacag

SEQ ID NO: 2738800 - DNA, 21 bp, Homo sapiens
tctctccagcctcacagatgc

SEQ ID NO: 2738801 - DNA, 22 bp, Homo sapiens
tctctcccacgtgcacagcttc

SEQ ID NO: 2738802 - DNA, 19 bp, Homo sapiens
tctctctactcctacctca

SEQ ID NO: 2738803 - DNA, 15 bp, Homo sapiens
tctctctgcctgctg

SEQ ID NO: 2738804 - DNA, 19 bp, Homo sapiens
tctctctgcctgctgggct

SEQ ID NO: 2738805 - DNA, 12 bp, Homo sapiens
tctctgcctgct

SEQ ID NO: 2738806 - DNA, 17 bp, Homo sapiens
tctctgcctgctgggct

SEQ ID NO: 2738807 - DNA, 17 bp, Homo sapiens
tctctgcctggagcagg

SEQ ID NO: 2738808 - DNA, 18 bp, Homo sapiens
tctctggattcctgtcat

SEQ ID NO: 2738809 - DNA, 15 bp, Homo sapiens
tctctggctcagctg

SEQ ID NO: 2738810 - DNA, 17 bp, Homo sapiens
tctctggctcagctgtg

SEQ ID NO: 2738811 - DNA, 19 bp, Homo sapiens
tctctggctcagctgtggt

SEQ ID NO: 2738812 - DNA, 21 bp, Homo sapiens
tctctgggtttacaacaaaca

SEQ ID NO: 2738813 - DNA, 15 bp, Homo sapiens
tctctgttaaagatc

SEQ ID NO: 2738814 - DNA, 23 bp, Homo sapiens
tctcttgccccaaatcacaaaca

SEQ ID NO: 2738815 - DNA, 21 bp, Homo sapiens
tctgaaagttgtcaccctgga

SEQ ID NO: 2738816 - DNA, 15 bp, Homo sapiens
tctgaacaattctct

SEQ ID NO: 2738817 - DNA, 20 bp, Homo sapiens
tctgaacaatttagggactc

SEQ ID NO: 2738818 - DNA, 17 bp, Homo sapiens
tctgaatattaagaaac

SEQ ID NO: 2738819 - DNA, 19 bp, Homo sapiens
tctgaatattaagaaacaa

SEQ ID NO: 2738820 - DNA, 15 bp, Homo sapiens
tctgaatgtcccaga

SEQ ID NO: 2738821 - DNA, 19 bp, Homo sapiens
tctgacaatgcgtggcaca

SEQ ID NO: 2738822 - DNA, 18 bp, Homo sapiens
tctgaccgggtctgcttc

SEQ ID NO: 2738823 - DNA, 17 bp, Homo sapiens
tctgacctgcaggccaa

SEQ ID NO: 2738824 - DNA, 19 bp, Homo sapiens
tctgacctgcaggccaaga

SEQ ID NO: 2738825 - DNA, 21 bp, Homo sapiens
tctgacctgcaggccaagagc

SEQ ID NO: 2738826 - DNA, 15 bp, Homo sapiens
tctgagatttcacag

SEQ ID NO: 2738827 - DNA, 17 bp, Homo sapiens
tctgaggccccaggccc

SEQ ID NO: 2738828 - DNA, 16 bp, Homo sapiens
tctgagtgtctctgcc

SEQ ID NO: 2738829 - DNA, 20 bp, Homo sapiens
tctgagtgtctctgcctgga

SEQ ID NO: 2738830 - DNA, 14 bp, Homo sapiens
tctgataatgtatt

SEQ ID NO: 2738831 - DNA, 17 bp, Homo sapiens
tctgataatgtattgca

SEQ ID NO: 2738832 - DNA, 15 bp, Homo sapiens
tctgatactgtatct

SEQ ID NO: 2738833 - DNA, 18 bp, Homo sapiens
tctgattcccagaaatac

SEQ ID NO: 2738834 - DNA, 23 bp, Homo sapiens
tctgattttgatattttcacaga

SEQ ID NO: 2738835 - DNA, 15 bp, Homo sapiens
tctgcaacatggatt

SEQ ID NO: 2738836 - DNA, 18 bp, Homo sapiens
tctgcaatgtttttgtgt

SEQ ID NO: 2738837 - DNA, 21 bp, Homo sapiens
tctgcaatgtttttgtgtaga

SEQ ID NO: 2738838 - DNA, 14 bp, Homo sapiens
tctgcactcctgga

SEQ ID NO: 2738839 - DNA, 19 bp, Homo sapiens
tctgcagatagtgcctctg

SEQ ID NO: 2738840 - DNA, 17 bp, Homo sapiens
tctgcagctttggctgc

SEQ ID NO: 2738841 - DNA, 11 bp, Homo sapiens
tctgcaggaaa

SEQ ID NO: 2738842 - DNA, 16 bp, Homo sapiens
tctgcatcagcttttt

SEQ ID NO: 2738843 - DNA, 17 bp, Homo sapiens
tctgcatgtaaaatctt

SEQ ID NO: 2738844 - DNA, 20 bp, Homo sapiens
tctgcatgtaaaatcttcag

SEQ ID NO: 2738845 - DNA, 22 bp, Homo sapiens
tctgcatgtaaaatcttcagct

SEQ ID NO: 2738846 - DNA, 17 bp, Homo sapiens
tctgccacttcccaggt

SEQ ID NO: 2738847 - DNA, 13 bp, Homo sapiens
tctgccagccaca

SEQ ID NO: 2738848 - DNA, 18 bp, Homo sapiens
tctgcccacattggaccc

SEQ ID NO: 2738849 - DNA, 14 bp, Homo sapiens
tctgcccagcctgc

SEQ ID NO: 2738850 - DNA, 12 bp, Homo sapiens
tctgccccaccc

SEQ ID NO: 2738851 - DNA, 21 bp, Homo sapiens
tctgcccccaactcccggagg

SEQ ID NO: 2738852 - DNA, 15 bp, Homo sapiens
tctgcccgcagagcc

SEQ ID NO: 2738853 - DNA, 21 bp, Homo sapiens
tctgcctcatcctcctcctca

SEQ ID NO: 2738854 - DNA, 18 bp, Homo sapiens
tctgcctctaactccctc

SEQ ID NO: 2738855 - DNA, 21 bp, Homo sapiens
tctgcctctaactccctcctc

SEQ ID NO: 2738856 - DNA, 16 bp, Homo sapiens
tctgcctgagattctt

SEQ ID NO: 2738857 - DNA, 20 bp, Homo sapiens
tctgcctgcttcctggaccg

SEQ ID NO: 2738858 - DNA, 13 bp, Homo sapiens
tctgcctttttta

SEQ ID NO: 2738859 - DNA, 18 bp, Homo sapiens
tctgctcctagcccagca

SEQ ID NO: 2738860 - DNA, 18 bp, Homo sapiens
tctgctcttatttttgta

SEQ ID NO: 2738861 - DNA, 12 bp, Homo sapiens
tctgctgggctg

SEQ ID NO: 2738862 - DNA, 15 bp, Homo sapiens
tctgctgttgtggga

SEQ ID NO: 2738863 - DNA, 14 bp, Homo sapiens
tctgcttccctggg

SEQ ID NO: 2738864 - DNA, 16 bp, Homo sapiens
tctggacctctcttgt

SEQ ID NO: 2738865 - DNA, 13 bp, Homo sapiens
tctggagcccttg

SEQ ID NO: 2738866 - DNA, 22 bp, Homo sapiens
tctggaggctgcgtcctgagga

SEQ ID NO: 2738867 - DNA, 20 bp, Homo sapiens
tctggcaccactagggtcct

SEQ ID NO: 2738868 - DNA, 22 bp, Homo sapiens
tctggctcagctgtggtcccac

SEQ ID NO: 2738869 - DNA, 23 bp, Homo sapiens
tctggcttccagaaaaccccagc

SEQ ID NO: 2738870 - DNA, 12 bp, Homo sapiens
tctggcttctgc

SEQ ID NO: 2738871 - DNA, 13 bp, Homo sapiens
tctggcttctgct

SEQ ID NO: 2738872 - DNA, 15 bp, Homo sapiens
tgcctcagccagccc

SEQ ID NO: 2738873 - DNA, 16 bp, Homo sapiens
tgcctcagccagccct

SEQ ID NO: 2738874 - DNA, 17 bp, Homo sapiens
tgcctcagccagccctg

SEQ ID NO: 2738875 - DNA, 18 bp, Homo sapiens
tgcctcagccagccctgg

SEQ ID NO: 2738876 - DNA, 17 bp, Homo sapiens
tgcctcagtgctgcaat

SEQ ID NO: 2738877 - DNA, 16 bp, Homo sapiens
tgcctcatcctcctcc

SEQ ID NO: 2738878 - DNA, 23 bp, Homo sapiens
tgcctcatcctcctcctcattca

SEQ ID NO: 2738879 - DNA, 19 bp, Homo sapiens
tgcctccactcccacttcc

SEQ ID NO: 2738880 - DNA, 13 bp, Homo sapiens
tgcctcggctcct

SEQ ID NO: 2738881 - DNA, 14 bp, Homo sapiens
tgcctcggctcctg

SEQ ID NO: 2738882 - DNA, 21 bp, Homo sapiens
tgcctcggctcctgctgcacc

SEQ ID NO: 2738883 - DNA, 22 bp, Homo sapiens
tgcctcggctcctgctgcacca

SEQ ID NO: 2738884 - DNA, 14 bp, Homo sapiens
tgcctctaactccc

SEQ ID NO: 2738885 - DNA, 16 bp, Homo sapiens
tgcctctaactccctc

SEQ ID NO: 2738886 - DNA, 17 bp, Homo sapiens
tgcctctaactccctcc

SEQ ID NO: 2738887 - DNA, 18 bp, Homo sapiens
tgcctctaactccctcct

SEQ ID NO: 2738888 - DNA, 20 bp, Homo sapiens
tgcctctaactccctcctca

SEQ ID NO: 2738889 - DNA, 14 bp, Homo sapiens
tgcctctcttctgt

SEQ ID NO: 2738890 - DNA, 14 bp, Homo sapiens
tgcctgagattctt

SEQ ID NO: 2738891 - DNA, 22 bp, Homo sapiens
tgcctgagattctttaaggaga

SEQ ID NO: 2738892 - DNA, 23 bp, Homo sapiens
tgcctgagattctttaaggagat

SEQ ID NO: 2738893 - DNA, 19 bp, Homo sapiens
tgcctgagtcacccatgaa

SEQ ID NO: 2738894 - DNA, 21 bp, Homo sapiens
tgcctgattcggctgtctcag

SEQ ID NO: 2738895 - DNA, 13 bp, Homo sapiens
tgcctgcctgggc

SEQ ID NO: 2738896 - DNA, 11 bp, Homo sapiens
tgcctgctggg

SEQ ID NO: 2738897 - DNA, 12 bp, Homo sapiens
tgcctgctgggc

SEQ ID NO: 2738898 - DNA, 14 bp, Homo sapiens
tgcctgcttcctgg

SEQ ID NO: 2738899 - DNA, 18 bp, Homo sapiens
tgcctgcttcctggaccg

SEQ ID NO: 2738900 - DNA, 14 bp, Homo sapiens
tgcctgggcctccc

SEQ ID NO: 2738901 - DNA, 14 bp, Homo sapiens
tgcctggggccaca

SEQ ID NO: 2738902 - DNA, 13 bp, Homo sapiens
tgcctgtacagaa

SEQ ID NO: 2738903 - DNA, 15 bp, Homo sapiens
tgcctgtctgtccaa

SEQ ID NO: 2738904 - DNA, 13 bp, Homo sapiens
tgccttgctattt

SEQ ID NO: 2738905 - DNA, 21 bp, Homo sapiens
tgcctttttgtttttgtaaaa

SEQ ID NO: 2738906 - DNA, 18 bp, Homo sapiens
tgcgaaggggccctggtc

SEQ ID NO: 2738907 - DNA, 18 bp, Homo sapiens
tgcgaccccatctgccca

SEQ ID NO: 2738908 - DNA, 21 bp, Homo sapiens
tgcgagagaccctacagacag

SEQ ID NO: 2738909 - DNA, 17 bp, Homo sapiens
tgcgccacggcactcca

SEQ ID NO: 2738910 - DNA, 22 bp, Homo sapiens
tgcggagcagcctccagtgctg

SEQ ID NO: 2738911 - DNA, 21 bp, Homo sapiens
tgcgggcattttgaatgtgat

SEQ ID NO: 2738912 - DNA, 23 bp, Homo sapiens
tgcgggcattttgaatgtgatca

SEQ ID NO: 2738913 - DNA, 16 bp, Homo sapiens
tgcgggctgagggcat

SEQ ID NO: 2738914 - DNA, 19 bp, Homo sapiens
tgcgggctgagggcatctc

SEQ ID NO: 2738915 - DNA, 16 bp, Homo sapiens
tgcggtgtctgcagct

SEQ ID NO: 2738916 - DNA, 19 bp, Homo sapiens
tgcgtcagaccagtactgg

SEQ ID NO: 2738917 - DNA, 22 bp, Homo sapiens
tgcgtggcacatctaaattgat

SEQ ID NO: 2738918 - DNA, 13 bp, Homo sapiens
tgcgtgtcgtggg

SEQ ID NO: 2738919 - DNA, 15 bp, Homo sapiens
tgctaccctccctgc

SEQ ID NO: 2738920 - DNA, 21 bp, Homo sapiens
tgctaccctccctgctgtccc

SEQ ID NO: 2738921 - DNA, 23 bp, Homo sapiens
tgctaccctccctgctgtcccct

SEQ ID NO: 2738922 - DNA, 20 bp, Homo sapiens
tgctagcaaacaaatggctt

SEQ ID NO: 2738923 - DNA, 22 bp, Homo sapiens
tgctagcaaacaaatggcttac

SEQ ID NO: 2738924 - DNA, 22 bp, Homo sapiens
tgctagcattaccacttccctg

SEQ ID NO: 2738925 - DNA, 20 bp, Homo sapiens
tgctaggggaaggactggcc

SEQ ID NO: 2738926 - DNA, 23 bp, Homo sapiens
tgctaggggaaggactggccgtg

SEQ ID NO: 2738927 - DNA, 15 bp, Homo sapiens
tgctcacgactcttc

SEQ ID NO: 2738928 - DNA, 19 bp, Homo sapiens
tgctcacgactcttcctgc

SEQ ID NO: 2738929 - DNA, 12 bp, Homo sapiens
tgctccacagtg

SEQ ID NO: 2738930 - DNA, 14 bp, Homo sapiens
tgctccattttctt

SEQ ID NO: 2738931 - DNA, 21 bp, Homo sapiens
tgctcccacggggaccactgg

SEQ ID NO: 2738932 - DNA, 22 bp, Homo sapiens
tgctcccacggggaccactggg

SEQ ID NO: 2738933 - DNA, 18 bp, Homo sapiens
tgctcgcctctgcccagc

SEQ ID NO: 2738934 - DNA, 14 bp, Homo sapiens
tgctcgggcccagg

SEQ ID NO: 2738935 - DNA, 12 bp, Homo sapiens
tgctctgcctct

SEQ ID NO: 2738936 - DNA, 13 bp, Homo sapiens
tgctctgcctcta

SEQ ID NO: 2738937 - DNA, 15 bp, Homo sapiens
tgctcttaaaaatct

SEQ ID NO: 2738938 - DNA, 16 bp, Homo sapiens
tgctcttacttccccc

SEQ ID NO: 2738939 - DNA, 13 bp, Homo sapiens
tgctcttctgtat

SEQ ID NO: 2738940 - DNA, 23 bp, Homo sapiens
tgctgaatgtcattatttgataa

SEQ ID NO: 2738941 - DNA, 15 bp, Homo sapiens
tgctgatcgccttat

SEQ ID NO: 2738942 - DNA, 19 bp, Homo sapiens
tgctgcaccaacccagccg

SEQ ID NO: 2738943 - DNA, 21 bp, Homo sapiens
tgctgcagaggggcaggccct

SEQ ID NO: 2738944 - DNA, 15 bp, Homo sapiens
tgctgccactctgct

SEQ ID NO: 2738945 - DNA, 19 bp, Homo sapiens
tgctgcctctcttctgtgt

SEQ ID NO: 2738946 - DNA, 14 bp, Homo sapiens
tgctgcctgagtca

SEQ ID NO: 2738947 - DNA, 18 bp, Homo sapiens
tgctgctaccctccctgc

SEQ ID NO: 2738948 - DNA, 19 bp, Homo sapiens
tgctgctaccctccctgct

SEQ ID NO: 2738949 - DNA, 20 bp, Homo sapiens
tgctgctaccctccctgctg

SEQ ID NO: 2738950 - DNA, 22 bp, Homo sapiens
tgctgctaccctccctgctgtc

SEQ ID NO: 2738951 - DNA, 17 bp, Homo sapiens
tgctggccacagaaagg

SEQ ID NO: 2738952 - DNA, 19 bp, Homo sapiens
tgctggcccacagctctgc

SEQ ID NO: 2738953 - DNA, 14 bp, Homo sapiens
tgctggcctcttgg

SEQ ID NO: 2738954 - DNA, 23 bp, Homo sapiens
tgctggcctcttggcacctgcct

SEQ ID NO: 2738955 - DNA, 16 bp, Homo sapiens
tgctggcggcgcagag

SEQ ID NO: 2738956 - DNA, 17 bp, Homo sapiens
tgctggcggcgcagagg

SEQ ID NO: 2738957 - DNA, 13 bp, Homo sapiens
tgctggctgctgg

SEQ ID NO: 2738958 - DNA, 14 bp, Homo sapiens
tgctggctgctggc

SEQ ID NO: 2738959 - DNA, 20 bp, Homo sapiens
tgctggctttcttttctcta

SEQ ID NO: 2738960 - DNA, 23 bp, Homo sapiens
tgctgggattacaggtgtgagcc

SEQ ID NO: 2738961 - DNA, 19 bp, Homo sapiens
tgctgggcattttcccaga

SEQ ID NO: 2738962 - DNA, 21 bp, Homo sapiens
tgctgggctacaaaccaggag

SEQ ID NO: 2738963 - DNA, 22 bp, Homo sapiens
tgctgggctacaaaccaggagc

SEQ ID NO: 2738964 - DNA, 13 bp, Homo sapiens
tgctggggctggt

SEQ ID NO: 2738965 - DNA, 12 bp, Homo sapiens
tgctgggggctc

SEQ ID NO: 2738966 - DNA, 15 bp, Homo sapiens
tgctgggggctcccc

SEQ ID NO: 2738967 - DNA, 22 bp, Homo sapiens
tgctgtaactcagacattccaa

SEQ ID NO: 2738968 - DNA, 18 bp, Homo sapiens
tgctgtacattactgtat

SEQ ID NO: 2738969 - DNA, 17 bp, Homo sapiens
tgctgtcccctcttgcc

SEQ ID NO: 2738970 - DNA, 22 bp, Homo sapiens
tgctgtgcaaacagtgtaagct

SEQ ID NO: 2738971 - DNA, 16 bp, Homo sapiens
tgctgtggcctgggca

SEQ ID NO: 2738972 - DNA, 15 bp, Homo sapiens
tgctgtgtttgagct

SEQ ID NO: 2738973 - DNA, 13 bp, Homo sapiens
tgcttaagaatca

SEQ ID NO: 2738974 - DNA, 12 bp, Homo sapiens
tgcttcagcctg

SEQ ID NO: 2738975 - DNA, 23 bp, Homo sapiens
tgcttcagcctgaggctgagact

SEQ ID NO: 2738976 - DNA, 20 bp, Homo sapiens
tgcttcatatattgctttat

SEQ ID NO: 2738977 - DNA, 13 bp, Homo sapiens
tgcttcctctgaa

SEQ ID NO: 2738978 - DNA, 12 bp, Homo sapiens
tgcttcctgagc

SEQ ID NO: 2738979 - DNA, 19 bp, Homo sapiens
tgcttcttgtaatatttct

SEQ ID NO: 2738980 - DNA, 21 bp, Homo sapiens
tgcttcttgtaatatttcttc

SEQ ID NO: 2738981 - DNA, 16 bp, Homo sapiens
tgcttgaacccaggag

SEQ ID NO: 2738982 - DNA, 20 bp, Homo sapiens
tgcttgaacccaggaggtgg

SEQ ID NO: 2738983 - DNA, 20 bp, Homo sapiens
tgctttataccccatttgat

SEQ ID NO: 2738984 - DNA, 17 bp, Homo sapiens
tgctttcttctttccag

SEQ ID NO: 2738985 - DNA, 17 bp, Homo sapiens
tgcttttctcccagaag

SEQ ID NO: 2738986 - DNA, 18 bp, Homo sapiens
tgcttttctcccagaagg

SEQ ID NO: 2738987 - DNA, 13 bp, Homo sapiens
tggaaaagaaatc

SEQ ID NO: 2738988 - DNA, 19 bp, Homo sapiens
tggaaaagaaatcaatttt

SEQ ID NO: 2738989 - DNA, 21 bp, Homo sapiens
tggaaaccacacttcttgaaa

SEQ ID NO: 2738990 - DNA, 23 bp, Homo sapiens
tggaaactaccagtgggcatgta

SEQ ID NO: 2738991 - DNA, 19 bp, Homo sapiens
tggaaagcatcacctcagg

SEQ ID NO: 2738992 - DNA, 14 bp, Homo sapiens
tggaaagcctctgc

SEQ ID NO: 2738993 - DNA, 20 bp, Homo sapiens
tggaaaggattctaaacaga

SEQ ID NO: 2738994 - DNA, 13 bp, Homo sapiens
tggaaaggctcag

SEQ ID NO: 2738995 - DNA, 15 bp, Homo sapiens
tgtaatgcttatgtg

SEQ ID NO: 2738996 - DNA, 11 bp, Homo sapiens
tgtaattattg

SEQ ID NO: 2738997 - DNA, 14 bp, Homo sapiens
tgtaattattgtga

SEQ ID NO: 2738998 - DNA, 23 bp, Homo sapiens
tgtaatttttaaagcaaatatat

SEQ ID NO: 2738999 - DNA, 18 bp, Homo sapiens
tgtacaaagatatgctaa

SEQ ID NO: 2739000 - DNA, 13 bp, Homo sapiens
tgtacaaggtatg

SEQ ID NO: 2739001 - DNA, 18 bp, Homo sapiens
tgtacaaggtatgtacag

SEQ ID NO: 2739002 - DNA, 17 bp, Homo sapiens
tgtacagtctcaatttt

SEQ ID NO: 2739003 - DNA, 17 bp, Homo sapiens
tgtacagttatttatgc

SEQ ID NO: 2739004 - DNA, 17 bp, Homo sapiens
tgtaccacaccctgcct

SEQ ID NO: 2739005 - DNA, 19 bp, Homo sapiens
tgtaccacaccctgcctgc

SEQ ID NO: 2739006 - DNA, 20 bp, Homo sapiens
tgtaccacaccctgcctgct

SEQ ID NO: 2739007 - DNA, 21 bp, Homo sapiens
tgtaccacaccctgcctgctg

SEQ ID NO: 2739008 - DNA, 17 bp, Homo sapiens
tgtactttttgttttgt

SEQ ID NO: 2739009 - DNA, 20 bp, Homo sapiens
tgtagcaaccttctgcattc

SEQ ID NO: 2739010 - DNA, 10 bp, Homo sapiens
tgtagccaag

SEQ ID NO: 2739011 - DNA, 22 bp, Homo sapiens
tgtagccccgggctgacccagt

SEQ ID NO: 2739012 - DNA, 17 bp, Homo sapiens
tgtagccttgcccggat

SEQ ID NO: 2739013 - DNA, 21 bp, Homo sapiens
tgtataaattatgaaggacct

SEQ ID NO: 2739014 - DNA, 19 bp, Homo sapiens
tgtatacaaacaggtgcta

SEQ ID NO: 2739015 - DNA, 22 bp, Homo sapiens
tgtataccatgatgcatggagt

SEQ ID NO: 2739016 - DNA, 21 bp, Homo sapiens
tgtatatagctctacacaaca

SEQ ID NO: 2739017 - DNA, 22 bp, Homo sapiens
tgtatatagctctacacaacat

SEQ ID NO: 2739018 - DNA, 13 bp, Homo sapiens
tgtatatagtttg

SEQ ID NO: 2739019 - DNA, 19 bp, Homo sapiens
tgtatatctatatctctaa

SEQ ID NO: 2739020 - DNA, 17 bp, Homo sapiens
tgtatatgtatatctat

SEQ ID NO: 2739021 - DNA, 22 bp, Homo sapiens
tgtatcactcactgccaaaaat

SEQ ID NO: 2739022 - DNA, 12 bp, Homo sapiens
tgtatctaattc

SEQ ID NO: 2739023 - DNA, 18 bp, Homo sapiens
tgtatctttggggaaact

SEQ ID NO: 2739024 - DNA, 16 bp, Homo sapiens
tgtatgagaagtactt

SEQ ID NO: 2739025 - DNA, 15 bp, Homo sapiens
tgtatgagactgtgt

SEQ ID NO: 2739026 - DNA, 12 bp, Homo sapiens
tgtatgctggac

SEQ ID NO: 2739027 - DNA, 14 bp, Homo sapiens
tgtatgtataaatt

SEQ ID NO: 2739028 - DNA, 17 bp, Homo sapiens
tgtatgtggatacagtc

SEQ ID NO: 2739029 - DNA, 22 bp, Homo sapiens
tgtatgtggatacagtcattat

SEQ ID NO: 2739030 - DNA, 12 bp, Homo sapiens
tgtattaacaaa

SEQ ID NO: 2739031 - DNA, 24 bp, Homo sapiens
tgtattaacaaagttactggctct

SEQ ID NO: 2739032 - DNA, 17 bp, Homo sapiens
tgtcaactttcatttga

SEQ ID NO: 2739033 - DNA, 18 bp, Homo sapiens
tgtcaactttcatttgaa

SEQ ID NO: 2739034 - DNA, 17 bp, Homo sapiens
tgtcaatggaagaaacc

SEQ ID NO: 2739035 - DNA, 13 bp, Homo sapiens
tgtcacagctctt

SEQ ID NO: 2739036 - DNA, 17 bp, Homo sapiens
tgtcaccctgcagagct

SEQ ID NO: 2739037 - DNA, 20 bp, Homo sapiens
tgtcactgaagtgattgaaa

SEQ ID NO: 2739038 - DNA, 18 bp, Homo sapiens
tgtcagcttttgcttcat

SEQ ID NO: 2739039 - DNA, 14 bp, Homo sapiens
tgtcaggagatgga

SEQ ID NO: 2739040 - DNA, 19 bp, Homo sapiens
tgtcaggagatggaagagt

SEQ ID NO: 2739041 - DNA, 23 bp, Homo sapiens
tgtcagtgccgccgcctcgccca

SEQ ID NO: 2739042 - DNA, 18 bp, Homo sapiens
tgtcatgtgtatgagaag

SEQ ID NO: 2739043 - DNA, 20 bp, Homo sapiens
tgtcatgtgtatgagaagta

SEQ ID NO: 2739044 - DNA, 23 bp, Homo sapiens
tgtcattatttttgttagcaaag

SEQ ID NO: 2739045 - DNA, 17 bp, Homo sapiens
tgtcattggaagccatc

SEQ ID NO: 2739046 - DNA, 17 bp, Homo sapiens
tgtccaacccctccccc

SEQ ID NO: 2739047 - DNA, 18 bp, Homo sapiens
tgtccaacccctccccca

SEQ ID NO: 2739048 - DNA, 16 bp, Homo sapiens
tgtccaattctcttta

SEQ ID NO: 2739049 - DNA, 18 bp, Homo sapiens
tgtccagaccattgtctt

SEQ ID NO: 2739050 - DNA, 21 bp, Homo sapiens
tgtccagaccattgtcttcca

SEQ ID NO: 2739051 - DNA, 22 bp, Homo sapiens
tgtccagaccattgtcttccaa

SEQ ID NO: 2739052 - DNA, 19 bp, Homo sapiens
tgtccagcttctcttgaaa

SEQ ID NO: 2739053 - DNA, 13 bp, Homo sapiens
tgtccagtgccca

SEQ ID NO: 2739054 - DNA, 14 bp, Homo sapiens
tgtccagtgcccat

SEQ ID NO: 2739055 - DNA, 15 bp, Homo sapiens
tgtccagtgcccatt

SEQ ID NO: 2739056 - DNA, 15 bp, Homo sapiens
tgtccatcctcctct

SEQ ID NO: 2739057 - DNA, 11 bp, Homo sapiens
tgtcccctctt

SEQ ID NO: 2739058 - DNA, 15 bp, Homo sapiens
tgtcccctcttgccc

SEQ ID NO: 2739059 - DNA, 17 bp, Homo sapiens
tgtcccctcttgcccca

SEQ ID NO: 2739060 - DNA, 20 bp, Homo sapiens
tgtcccctggggctggtgga

SEQ ID NO: 2739061 - DNA, 16 bp, Homo sapiens
tgtccctacccactct

SEQ ID NO: 2739062 - DNA, 17 bp, Homo sapiens
tgtccctggtgcagagg

SEQ ID NO: 2739063 - DNA, 22 bp, Homo sapiens
tgtccctttttgcaggggactg

SEQ ID NO: 2739064 - DNA, 22 bp, Homo sapiens
tgtcctaatcatataccagagg

SEQ ID NO: 2739065 - DNA, 22 bp, Homo sapiens
tgtcctccaacaataaagagct

SEQ ID NO: 2739066 - DNA, 21 bp, Homo sapiens
tgtcctctcagagcctcagct

SEQ ID NO: 2739067 - DNA, 14 bp, Homo sapiens
tgtcctgctccaca

SEQ ID NO: 2739068 - DNA, 15 bp, Homo sapiens
tgtcctgctccacag

SEQ ID NO: 2739069 - DNA, 16 bp, Homo sapiens
tgtcctgctccacagt

SEQ ID NO: 2739070 - DNA, 18 bp, Homo sapiens
tgtcctgctccacagtgt

SEQ ID NO: 2739071 - DNA, 16 bp, Homo sapiens
tgtcctggaccctggc

SEQ ID NO: 2739072 - DNA, 19 bp, Homo sapiens
tgtcctggaccctggccta

SEQ ID NO: 2739073 - DNA, 13 bp, Homo sapiens
tgtcctgtctgct

SEQ ID NO: 2739074 - DNA, 19 bp, Homo sapiens
tgtccttactcagagctgc

SEQ ID NO: 2739075 - DNA, 20 bp, Homo sapiens
tgtccttactcagagctgcg

SEQ ID NO: 2739076 - DNA, 16 bp, Homo sapiens
tgtcctttctccagtg

SEQ ID NO: 2739077 - DNA, 13 bp, Homo sapiens
tgtcgagtccagt

SEQ ID NO: 2739078 - DNA, 16 bp, Homo sapiens
tgtcgagtccagtcct

SEQ ID NO: 2739079 - DNA, 18 bp, Homo sapiens
tgtcggcacgtcccatgt

SEQ ID NO: 2739080 - DNA, 19 bp, Homo sapiens
tgtcggggaagatgaaacc

SEQ ID NO: 2739081 - DNA, 16 bp, Homo sapiens
tgtcgtgtccagcctg

SEQ ID NO: 2739082 - DNA, 15 bp, Homo sapiens
tgtcgtgtctgctgt

SEQ ID NO: 2739083 - DNA, 17 bp, Homo sapiens
tgtcgtgtctgctgttg

SEQ ID NO: 2739084 - DNA, 13 bp, Homo sapiens
tgtctactcctca

SEQ ID NO: 2739085 - DNA, 18 bp, Homo sapiens
tgtctactcctcacagca

SEQ ID NO: 2739086 - DNA, 19 bp, Homo sapiens
tgtctagtagaacaatgta

SEQ ID NO: 2739087 - DNA, 15 bp, Homo sapiens
tgtctccaggtaact

SEQ ID NO: 2739088 - DNA, 22 bp, Homo sapiens
tgtctccaggtaactttgcttg

SEQ ID NO: 2739089 - DNA, 17 bp, Homo sapiens
tgtctctgcctggagca

SEQ ID NO: 2739090 - DNA, 18 bp, Homo sapiens
tgtctctgcctggagcag

SEQ ID NO: 2739091 - DNA, 13 bp, Homo sapiens
tgtctgcaacatg

SEQ ID NO: 2739092 - DNA, 14 bp, Homo sapiens
tgtctgcaacatgg

SEQ ID NO: 2739093 - DNA, 22 bp, Homo sapiens
tgtctgcaacatggattccaaa

SEQ ID NO: 2739094 - DNA, 12 bp, Homo sapiens
tgtctgcagctc

SEQ ID NO: 2739095 - DNA, 18 bp, Homo sapiens
tgtctgtccaacccctcc

SEQ ID NO: 2739096 - DNA, 14 bp, Homo sapiens
tgtctgtctgctct

SEQ ID NO: 2739097 - DNA, 12 bp, Homo sapiens
tgtctgtctttg

SEQ ID NO: 2739098 - DNA, 15 bp, Homo sapiens
tgtctgtctttgcaa

SEQ ID NO: 2739099 - DNA, 16 bp, Homo sapiens
tgtctgtctttgcaaa

SEQ ID NO: 2739100 - DNA, 17 bp, Homo sapiens
tgtcttccaaccccagc

SEQ ID NO: 2739101 - DNA, 22 bp, Homo sapiens
tgtcttccaaccccagctggcc

SEQ ID NO: 2739102 - DNA, 13 bp, Homo sapiens
tgtcttcctgtgg

SEQ ID NO: 2739103 - DNA, 15 bp, Homo sapiens
tgtctttctttgctg

SEQ ID NO: 2739104 - DNA, 22 bp, Homo sapiens
tgtgaaagtcagatgcccagag

SEQ ID NO: 2739105 - DNA, 14 bp, Homo sapiens
tgtgaacatggact

SEQ ID NO: 2739106 - DNA, 23 bp, Homo sapiens
tgtgacaacatttttgtacatta

SEQ ID NO: 2739107 - DNA, 15 bp, Homo sapiens
tgtgatattgaccat

SEQ ID NO: 2739108 - DNA, 19 bp, Homo sapiens
tgtgatattgaccatgtga

SEQ ID NO: 2739109 - DNA, 18 bp, Homo sapiens
tgtgatcccaagtgccag

SEQ ID NO: 2739110 - DNA, 23 bp, Homo sapiens
tgtgatcccaagtgccagtcttg

SEQ ID NO: 2739111 - DNA, 16 bp, Homo sapiens
tgtgattggcaggagg

SEQ ID NO: 2739112 - DNA, 20 bp, Homo sapiens
tgtgatttcccgtggcccca

SEQ ID NO: 2739113 - DNA, 22 bp, Homo sapiens
tgtgatttcccgtggccccagc

SEQ ID NO: 2739114 - DNA, 13 bp, Homo sapiens
tgtgcaaacagtg

SEQ ID NO: 2739115 - DNA, 16 bp, Homo sapiens
tgtgcaactcttgtat

SEQ ID NO: 2739116 - DNA, 18 bp, Homo sapiens
tgtgcacctatggcccag

SEQ ID NO: 2739117 - DNA, 20 bp, Homo sapiens
tgtgcacctatggcccagcc

SEQ ID NO: 2739118 - DNA, 14 bp, Homo sapiens
tgtgcagacagtgt

SEQ ID NO: 2739119 - DNA, 16 bp, Homo sapiens
ttgtacagttcagttc

SEQ ID NO: 2739120 - DNA, 21 bp, Homo sapiens
ttgtacattatgttattggaa

SEQ ID NO: 2739121 - DNA, 18 bp, Homo sapiens
ttgtaccatattgctctt

SEQ ID NO: 2739122 - DNA, 17 bp, Homo sapiens
ttgtatagagatatgca

SEQ ID NO: 2739123 - DNA, 17 bp, Homo sapiens
ttgtcaatggaagaaac

SEQ ID NO: 2739124 - DNA, 18 bp, Homo sapiens
ttgtcaatggaagaaacc

SEQ ID NO: 2739125 - DNA, 14 bp, Homo sapiens
ttgtcacagctctt

SEQ ID NO: 2739126 - DNA, 12 bp, Homo sapiens
ttgtcatgtgta

SEQ ID NO: 2739127 - DNA, 13 bp, Homo sapiens
ttgtccctggggc

SEQ ID NO: 2739128 - DNA, 14 bp, Homo sapiens
ttgtccctggggca

SEQ ID NO: 2739129 - DNA, 17 bp, Homo sapiens
ttgtccctggggcactc

SEQ ID NO: 2739130 - DNA, 18 bp, Homo sapiens
ttgtccctggtgcagagg

SEQ ID NO: 2739131 - DNA, 20 bp, Homo sapiens
ttgtcctctcagagcctcag

SEQ ID NO: 2739132 - DNA, 22 bp, Homo sapiens
ttgtcctctcagagcctcagct

SEQ ID NO: 2739133 - DNA, 17 bp, Homo sapiens
ttgtcctttaactatca

SEQ ID NO: 2739134 - DNA, 12 bp, Homo sapiens
ttgtctcactgt

SEQ ID NO: 2739135 - DNA, 19 bp, Homo sapiens
ttgtctccctggccctcaa

SEQ ID NO: 2739136 - DNA, 14 bp, Homo sapiens
ttgtctgctcccaa

SEQ ID NO: 2739137 - DNA, 17 bp, Homo sapiens
ttgtcttccaaccccag

SEQ ID NO: 2739138 - DNA, 20 bp, Homo sapiens
ttgtgaaattcaacctgtgt

SEQ ID NO: 2739139 - DNA, 21 bp, Homo sapiens
ttgtgatattgaccatgtgat

SEQ ID NO: 2739140 - DNA, 19 bp, Homo sapiens
ttgtgcaatagtcagagtg

SEQ ID NO: 2739141 - DNA, 13 bp, Homo sapiens
ttgttatgatcta

SEQ ID NO: 2739142 - DNA, 13 bp, Homo sapiens
ttgttcacactcc

SEQ ID NO: 2739143 - DNA, 14 bp, Homo sapiens
ttgttcacactcct

SEQ ID NO: 2739144 - DNA, 18 bp, Homo sapiens
ttgttctgggtgatttct

SEQ ID NO: 2739145 - DNA, 20 bp, Homo sapiens
ttgttgataaattccactgg

SEQ ID NO: 2739146 - DNA, 21 bp, Homo sapiens
ttgtttctcggcaccagtgcc

SEQ ID NO: 2739147 - DNA, 16 bp, Homo sapiens
ttgttttagaaccagc

SEQ ID NO: 2739148 - DNA, 21 bp, Homo sapiens
tttaaaaaaaatagaagctat

SEQ ID NO: 2739149 - DNA, 13 bp, Homo sapiens
tttaaaactatat

SEQ ID NO: 2739150 - DNA, 12 bp, Homo sapiens
tttaaaagacaa

SEQ ID NO: 2739151 - DNA, 23 bp, Homo sapiens
tttaaaaggtaggttttaaaaat

SEQ ID NO: 2739152 - DNA, 19 bp, Homo sapiens
tttaaaagtcacataaaat

SEQ ID NO: 2739153 - DNA, 12 bp, Homo sapiens
tttaaaatgaag

SEQ ID NO: 2739154 - DNA, 17 bp, Homo sapiens
tttaaaatgttggtgca

SEQ ID NO: 2739155 - DNA, 15 bp, Homo sapiens
tttaaagaaaagttt

SEQ ID NO: 2739156 - DNA, 21 bp, Homo sapiens
tttaaagaaaagttttgtaaa

SEQ ID NO: 2739157 - DNA, 13 bp, Homo sapiens
tttaaagcaaata

SEQ ID NO: 2739158 - DNA, 17 bp, Homo sapiens
tttaaaggacaaacagt

SEQ ID NO: 2739159 - DNA, 20 bp, Homo sapiens
tttaacaggttttcttctaa

SEQ ID NO: 2739160 - DNA, 16 bp, Homo sapiens
tttaactagcacttta

SEQ ID NO: 2739161 - DNA, 11 bp, Homo sapiens
tttaactatgc

SEQ ID NO: 2739162 - DNA, 19 bp, Homo sapiens
tttaagaaaaaaagcaaaa

SEQ ID NO: 2739163 - DNA, 20 bp, Homo sapiens
tttaagaaagggaaagctgt

SEQ ID NO: 2739164 - DNA, 22 bp, Homo sapiens
tttaagcatgagtggccttaat

SEQ ID NO: 2739165 - DNA, 22 bp, Homo sapiens
tttaagtactatctttgtctaa

SEQ ID NO: 2739166 - DNA, 14 bp, Homo sapiens
tttaattgattatt

SEQ ID NO: 2739167 - DNA, 15 bp, Homo sapiens
tttacaaataaagat

SEQ ID NO: 2739168 - DNA, 22 bp, Homo sapiens
tttacaatttagcttacatttt

SEQ ID NO: 2739169 - DNA, 20 bp, Homo sapiens
tttacagtaaataaattgtt

SEQ ID NO: 2739170 - DNA, 18 bp, Homo sapiens
tttacagtctctgttgta

SEQ ID NO: 2739171 - DNA, 17 bp, Homo sapiens
tttacagtgtatttaag

SEQ ID NO: 2739172 - DNA, 19 bp, Homo sapiens
tttacagtgtatttaagaa

SEQ ID NO: 2739173 - DNA, 12 bp, Homo sapiens
tttaccaaagca

SEQ ID NO: 2739174 - DNA, 18 bp, Homo sapiens
tttactcagtgaaatcat

SEQ ID NO: 2739175 - DNA, 15 bp, Homo sapiens
tttactgacagaaat

SEQ ID NO: 2739176 - DNA, 14 bp, Homo sapiens
tttagaaaatcaga

SEQ ID NO: 2739177 - DNA, 13 bp, Homo sapiens
tttagaaccagcc

SEQ ID NO: 2739178 - DNA, 17 bp, Homo sapiens
tttagatttttaaaagg

SEQ ID NO: 2739179 - DNA, 14 bp, Homo sapiens
tttaggagaagttg

SEQ ID NO: 2739180 - DNA, 17 bp, Homo sapiens
tttaggcagcctgccgc

SEQ ID NO: 2739181 - DNA, 19 bp, Homo sapiens
tttaggcagggatttgagg

SEQ ID NO: 2739182 - DNA, 16 bp, Homo sapiens
tttagggaagcaggga

SEQ ID NO: 2739183 - DNA, 15 bp, Homo sapiens
tttataaaatgggaa

SEQ ID NO: 2739184 - DNA, 13 bp, Homo sapiens
tttatacataaac

SEQ ID NO: 2739185 - DNA, 19 bp, Homo sapiens
tttatatctttatgcaaaa

SEQ ID NO: 2739186 - DNA, 23 bp, Homo sapiens
tttatatctttatgcaaaaacat

SEQ ID NO: 2739187 - DNA, 20 bp, Homo sapiens
tttatctacccagtcatgta

SEQ ID NO: 2739188 - DNA, 22 bp, Homo sapiens
tttatgacgagacctcagatgt

SEQ ID NO: 2739189 - DNA, 14 bp, Homo sapiens
tttatgatgctatt

SEQ ID NO: 2739190 - DNA, 14 bp, Homo sapiens
tttatgtctaaaga

SEQ ID NO: 2739191 - DNA, 18 bp, Homo sapiens
tttattttgtaattattg

SEQ ID NO: 2739192 - DNA, 14 bp, Homo sapiens
tttcaaaagcaaac

SEQ ID NO: 2739193 - DNA, 14 bp, Homo sapiens
tttcaaataaggaa

SEQ ID NO: 2739194 - DNA, 18 bp, Homo sapiens
tttcaatttactttttaa

SEQ ID NO: 2739195 - DNA, 23 bp, Homo sapiens
tttcaatttactttttaaacagt

SEQ ID NO: 2739196 - DNA, 21 bp, Homo sapiens
tttcacagatggaagaagttt

SEQ ID NO: 2739197 - DNA, 17 bp, Homo sapiens
tttcacttgggtctctg

SEQ ID NO: 2739198 - DNA, 23 bp, Homo sapiens
tttcagaatgcaatgtttctaaa

SEQ ID NO: 2739199 - DNA, 19 bp, Homo sapiens
tttcagcatcaaacatgaa

SEQ ID NO: 2739200 - DNA, 16 bp, Homo sapiens
tttcagctatgcagaa

SEQ ID NO: 2739201 - DNA, 23 bp, Homo sapiens
tttcagctattagcaactgtgct

SEQ ID NO: 2739202 - DNA, 20 bp, Homo sapiens
tttcagcttctgctgggctg

SEQ ID NO: 2739203 - DNA, 21 bp, Homo sapiens
tttcatacattatattcctct

SEQ ID NO: 2739204 - DNA, 20 bp, Homo sapiens
tttccagctaagcctgatga

SEQ ID NO: 2739205 - DNA, 15 bp, Homo sapiens
tttcccactgcaccc

SEQ ID NO: 2739206 - DNA, 18 bp, Homo sapiens
tttcccactgcaccccct

SEQ ID NO: 2739207 - DNA, 13 bp, Homo sapiens
tttcccagtgagc

SEQ ID NO: 2739208 - DNA, 16 bp, Homo sapiens
tttcccagtgagcctc

SEQ ID NO: 2739209 - DNA, 17 bp, Homo sapiens
tttcccatttcgtgtaa

SEQ ID NO: 2739210 - DNA, 13 bp, Homo sapiens
tttcccgccaagc

SEQ ID NO: 2739211 - DNA, 18 bp, Homo sapiens
tttcccgtggccccagcc

SEQ ID NO: 2739212 - DNA, 20 bp, Homo sapiens
tttcctgccgtccctcctgt

SEQ ID NO: 2739213 - DNA, 18 bp, Homo sapiens
tttctaaaacattaattg

SEQ ID NO: 2739214 - DNA, 18 bp, Homo sapiens
tttctactgtataaacaa

SEQ ID NO: 2739215 - DNA, 16 bp, Homo sapiens
tttctactttttctgt

SEQ ID NO: 2739216 - DNA, 15 bp, Homo sapiens
tttctcaaagaaatt

SEQ ID NO: 2739217 - DNA, 17 bp, Homo sapiens
tttctcccagaaggctg

SEQ ID NO: 2739218 - DNA, 15 bp, Homo sapiens
tttctccccctgggc

SEQ ID NO: 2739219 - DNA, 17 bp, Homo sapiens
tttctctatgaaaagca

SEQ ID NO: 2739220 - DNA, 22 bp, Homo sapiens
tttctgagtagcatatataatt

SEQ ID NO: 2739221 - DNA, 19 bp, Homo sapiens
tttctgcccaactttcatt

SEQ ID NO: 2739222 - DNA, 13 bp, Homo sapiens
tttctgcctgaga

SEQ ID NO: 2739223 - DNA, 18 bp, Homo sapiens
tttctgcctgagattctt

SEQ ID NO: 2739224 - DNA, 14 bp, Homo sapiens
tttcttatttaatt

SEQ ID NO: 2739225 - DNA, 15 bp, Homo sapiens
tttcttatttaatta

SEQ ID NO: 2739226 - DNA, 19 bp, Homo sapiens
tttcttatttaattagaat

SEQ ID NO: 2739227 - DNA, 20 bp, Homo sapiens
tttcttcaagtgagtggcat

SEQ ID NO: 2739228 - DNA, 23 bp, Homo sapiens
tttcttcaagtgagtggcatgtg

SEQ ID NO: 2739229 - DNA, 14 bp, Homo sapiens
tttctttccaaaac

SEQ ID NO: 2739230 - DNA, 19 bp, Homo sapiens
tttgaagaacaaaaggctt

SEQ ID NO: 2739231 - DNA, 21 bp, Homo sapiens
tttgaaggtaataaatacaca

SEQ ID NO: 2739232 - DNA, 15 bp, Homo sapiens
tttgaatgtcataaa

SEQ ID NO: 2739233 - DNA, 23 bp, Homo sapiens
tttgaatgtcataaagaagagcc

SEQ ID NO: 2739234 - DNA, 13 bp, Homo sapiens
tttgacaacacat

SEQ ID NO: 2739235 - DNA, 23 bp, Homo sapiens
tttgacacaatgttgcactgaaa

SEQ ID NO: 2739236 - DNA, 22 bp, Homo sapiens
tttgaggagcagcttcagttgt

SEQ ID NO: 2739237 - DNA, 21 bp, Homo sapiens
tttgagggtgtatattttctg

SEQ ID NO: 2739238 - DNA, 16 bp, Homo sapiens
tttgagtgattatttg

SEQ ID NO: 2739239 - DNA, 15 bp, Homo sapiens
tttgatgtcagcctt

SEQ ID NO: 2739240 - DNA, 22 bp, Homo sapiens
tttgcaacaagacaaagcaaag

SEQ ID NO: 2739241 - DNA, 23 bp, Homo sapiens
tttgcaagcttatttagcacatt

SEQ ID NO: 2739242 - DNA, 19 bp, Homo sapiens
tttgcaatttcaggaattt

SEQ ID NO: 2739243 - DNA, 11 bp, Homo sapiens
aaaaaagtata

SEQ ID NO: 2739244 - DNA, 18 bp, Homo sapiens
aaaaacacggcagctgta

SEQ ID NO: 2739245 - DNA, 12 bp, Homo sapiens
aaaaagaaatcc

SEQ ID NO: 2739246 - DNA, 14 bp, Homo sapiens
aaaaagaaattgtg

SEQ ID NO: 2739247 - DNA, 16 bp, Homo sapiens
aaaaagcaaaaacaat

SEQ ID NO: 2739248 - DNA, 13 bp, Homo sapiens
aaaaataataaaa

SEQ ID NO: 2739249 - DNA, 20 bp, Homo sapiens
aaaaatcttggtttggtaca

SEQ ID NO: 2739250 - DNA, 14 bp, Homo sapiens
aaaaatgtcactga

SEQ ID NO: 2739251 - DNA, 15 bp, Homo sapiens
aaaacatatgtctgt

SEQ ID NO: 2739252 - DNA, 12 bp, Homo sapiens
aaaacccctggc

SEQ ID NO: 2739253 - DNA, 18 bp, Homo sapiens
aaaaccctaagtgtggat

SEQ ID NO: 2739254 - DNA, 20 bp, Homo sapiens
aaaaccctaagtgtggatgt

SEQ ID NO: 2739255 - DNA, 17 bp, Homo sapiens
aaaacctagaaatttat

SEQ ID NO: 2739256 - DNA, 13 bp, Homo sapiens
aaaacgagataag

SEQ ID NO: 2739257 - DNA, 18 bp, Homo sapiens
aaaactttctaaatgcat

SEQ ID NO: 2739258 - DNA, 21 bp, Homo sapiens
aaaagagagaaaacttatttg

SEQ ID NO: 2739259 - DNA, 22 bp, Homo sapiens
aaaagatcattcaactaaaaat

SEQ ID NO: 2739260 - DNA, 14 bp, Homo sapiens
aaaagccatatcta

SEQ ID NO: 2739261 - DNA, 16 bp, Homo sapiens
aaaagctgtgtctctg

SEQ ID NO: 2739262 - DNA, 16 bp, Homo sapiens
aaaaggttttattttg

SEQ ID NO: 2739263 - DNA, 23 bp, Homo sapiens
aaaaggttttattttgtaattat

SEQ ID NO: 2739264 - DNA, 16 bp, Homo sapiens
aaaagtccacttttaa

SEQ ID NO: 2739265 - DNA, 12 bp, Homo sapiens
aaaagtttgtcc

SEQ ID NO: 2739266 - DNA, 20 bp, Homo sapiens
aaaatagggtccttgaaaca

SEQ ID NO: 2739267 - DNA, 19 bp, Homo sapiens
aaaatatttttttaagaaa

SEQ ID NO: 2739268 - DNA, 15 bp, Homo sapiens
aaaatcagattttct

SEQ ID NO: 2739269 - DNA, 12 bp, Homo sapiens
aaaatctttaat

SEQ ID NO: 2739270 - DNA, 22 bp, Homo sapiens
aaaatgagcttgtaaatactcc

SEQ ID NO: 2739271 - DNA, 23 bp, Homo sapiens
aaaatgcagccttaaacagtgtc

SEQ ID NO: 2739272 - DNA, 13 bp, Homo sapiens
aaaatgtctttat

SEQ ID NO: 2739273 - DNA, 18 bp, Homo sapiens
aaaatgtgtctgcaacat

SEQ ID NO: 2739274 - DNA, 21 bp, Homo sapiens
aaaatgtgtctgcaacatgga

SEQ ID NO: 2739275 - DNA, 15 bp, Homo sapiens
aaaatgtttaattca

SEQ ID NO: 2739276 - DNA, 23 bp, Homo sapiens
aaaatgtttaattcattaatctg

SEQ ID NO: 2739277 - DNA, 17 bp, Homo sapiens
aaacaaattagcaatca

SEQ ID NO: 2739278 - DNA, 22 bp, Homo sapiens
aaacaatccaaatgcattcatg

SEQ ID NO: 2739279 - DNA, 20 bp, Homo sapiens
aaacaatttaaattgttata

SEQ ID NO: 2739280 - DNA, 14 bp, Homo sapiens
aaacagatgtccct

SEQ ID NO: 2739281 - DNA, 15 bp, Homo sapiens
aaacagatgtccctg

SEQ ID NO: 2739282 - DNA, 17 bp, Homo sapiens
aaacatatgtatctttg

SEQ ID NO: 2739283 - DNA, 23 bp, Homo sapiens
aaacatgaagggaaaattagctt

SEQ ID NO: 2739284 - DNA, 13 bp, Homo sapiens
aaacatgtgcaac

SEQ ID NO: 2739285 - DNA, 16 bp, Homo sapiens
aaacattgatgaatga

SEQ ID NO: 2739286 - DNA, 12 bp, Homo sapiens
aaacccctggct

SEQ ID NO: 2739287 - DNA, 14 bp, Homo sapiens
aaacctgcattttt

SEQ ID NO: 2739288 - DNA, 17 bp, Homo sapiens
aaacctgtgaaagctgc

SEQ ID NO: 2739289 - DNA, 16 bp, Homo sapiens
aaacctgtttttaaca

SEQ ID NO: 2739290 - DNA, 14 bp, Homo sapiens
aaaccttgtttctt

SEQ ID NO: 2739291 - DNA, 14 bp, Homo sapiens
aaactaacaatatg

SEQ ID NO: 2739292 - DNA, 15 bp, Homo sapiens
aaactaacaatatga

SEQ ID NO: 2739293 - DNA, 17 bp, Homo sapiens
aaactaaggatttttca

SEQ ID NO: 2739294 - DNA, 18 bp, Homo sapiens
aaacttagaataaaattg

SEQ ID NO: 2739295 - DNA, 13 bp, Homo sapiens
acacactcagcag

SEQ ID NO: 2739296 - DNA, 19 bp, Homo sapiens
acacactcagcagccccct

SEQ ID NO: 2739297 - DNA, 19 bp, Homo sapiens
acacactgcggtgtctgca

SEQ ID NO: 2739298 - DNA, 14 bp, Homo sapiens
acacagtctggtgc

SEQ ID NO: 2739299 - DNA, 14 bp, Homo sapiens
acacatacaaaaaa

SEQ ID NO: 2739300 - DNA, 16 bp, Homo sapiens
acacatgtgggagagg

SEQ ID NO: 2739301 - DNA, 19 bp, Homo sapiens
acacattatgttagagagg

SEQ ID NO: 2739302 - DNA, 13 bp, Homo sapiens
acacatttttaaa

SEQ ID NO: 2739303 - DNA, 15 bp, Homo sapiens
acaccaaaaattgcg

SEQ ID NO: 2739304 - DNA, 22 bp, Homo sapiens
acaccaagctgtgccaccctgg

SEQ ID NO: 2739305 - DNA, 19 bp, Homo sapiens
acaccattctcctgcctca

SEQ ID NO: 2739306 - DNA, 11 bp, Homo sapiens
acacccactgg

SEQ ID NO: 2739307 - DNA, 14 bp, Homo sapiens
acacccactggcca

SEQ ID NO: 2739308 - DNA, 16 bp, Homo sapiens
acaccctcctggcaca

SEQ ID NO: 2739309 - DNA, 19 bp, Homo sapiens
acaccctgcctgctgtgga

SEQ ID NO: 2739310 - DNA, 20 bp, Homo sapiens
acacctgggcatttggtgag

SEQ ID NO: 2739311 - DNA, 15 bp, Homo sapiens
acacgcatgcctcag

SEQ ID NO: 2739312 - DNA, 17 bp, Homo sapiens
acacggcagctgtagct

SEQ ID NO: 2739313 - DNA, 16 bp, Homo sapiens
acacggggtattttag

SEQ ID NO: 2739314 - DNA, 17 bp, Homo sapiens
acacggggtattttagg

SEQ ID NO: 2739315 - DNA, 15 bp, Homo sapiens
acactaaacagacta

SEQ ID NO: 2739316 - DNA, 21 bp, Homo sapiens
acactccagaattacccttcc

SEQ ID NO: 2739317 - DNA, 15 bp, Homo sapiens
acactccagcctgag

SEQ ID NO: 2739318 - DNA, 16 bp, Homo sapiens
acactcctcctgccag

SEQ ID NO: 2739319 - DNA, 22 bp, Homo sapiens
acactccttccccttgtccctg

SEQ ID NO: 2739320 - DNA, 13 bp, Homo sapiens
acactcttcttga

SEQ ID NO: 2739321 - DNA, 16 bp, Homo sapiens
acactgggctcacatt

SEQ ID NO: 2739322 - DNA, 22 bp, Homo sapiens
acactgggctctgaggagtgga

SEQ ID NO: 2739323 - DNA, 19 bp, Homo sapiens
acactgtcctgtccggagc

SEQ ID NO: 2739324 - DNA, 21 bp, Homo sapiens
acacttatggaatttttaagt

SEQ ID NO: 2739325 - DNA, 21 bp, Homo sapiens
acacttcttgaaacagcctgg

SEQ ID NO: 2739326 - DNA, 17 bp, Homo sapiens
acagaaaacaattgttc

SEQ ID NO: 2739327 - DNA, 12 bp, Homo sapiens
acagaagcagga

SEQ ID NO: 2739328 - DNA, 16 bp, Homo sapiens
acagacctcagagatg

SEQ ID NO: 2739329 - DNA, 19 bp, Homo sapiens
acagactctgtgagattct

SEQ ID NO: 2739330 - DNA, 21 bp, Homo sapiens
acagactcttccaccagagca

SEQ ID NO: 2739331 - DNA, 17 bp, Homo sapiens
acagagggcgctcctgt

SEQ ID NO: 2739332 - DNA, 16 bp, Homo sapiens
acagatcatggcagga

SEQ ID NO: 2739333 - DNA, 23 bp, Homo sapiens
acagatgctggcctcttggcacc

SEQ ID NO: 2739334 - DNA, 14 bp, Homo sapiens
acagatgtccctga

SEQ ID NO: 2739335 - DNA, 19 bp, Homo sapiens
acagattcctgttgtgtaa

SEQ ID NO: 2739336 - DNA, 23 bp, Homo sapiens
acagcaaagccatattctaaatt

SEQ ID NO: 2739337 - DNA, 17 bp, Homo sapiens
acagcaaggaggctggc

SEQ ID NO: 2739338 - DNA, 19 bp, Homo sapiens
acagcaaggaggctggctg

SEQ ID NO: 2739339 - DNA, 16 bp, Homo sapiens
acagcaaggcacctgc

SEQ ID NO: 2739340 - DNA, 15 bp, Homo sapiens
acagccctcccgccc

SEQ ID NO: 2739341 - DNA, 21 bp, Homo sapiens
acagccctcccgccccttccc

SEQ ID NO: 2739342 - DNA, 13 bp, Homo sapiens
acagccgcagcct

SEQ ID NO: 2739343 - DNA, 22 bp, Homo sapiens
acagccgcagcctccctctgac

SEQ ID NO: 2739344 - DNA, 13 bp, Homo sapiens
acagcgcctcctg

SEQ ID NO: 2739345 - DNA, 14 bp, Homo sapiens
acagcggggaaggt

SEQ ID NO: 2739346 - DNA, 14 bp, Homo sapiens
acagctcctcccct

SEQ ID NO: 2739347 - DNA, 19 bp, Homo sapiens
acagctcctcccctgccgc

SEQ ID NO: 2739348 - DNA, 15 bp, Homo sapiens
acagctctgctggaa

SEQ ID NO: 2739349 - DNA, 23 bp, Homo sapiens
acagctggacccatttgccagga

SEQ ID NO: 2739350 - DNA, 20 bp, Homo sapiens
acagctggagacgatcttgc

SEQ ID NO: 2739351 - DNA, 19 bp, Homo sapiens
acagcttcacttaaaatca

SEQ ID NO: 2739352 - DNA, 21 bp, Homo sapiens
acagcttcacttaaaatcaaa

SEQ ID NO: 2739353 - DNA, 14 bp, Homo sapiens
acagcttcctgagt

SEQ ID NO: 2739354 - DNA, 17 bp, Homo sapiens
acaggacagtgcttcag

SEQ ID NO: 2739355 - DNA, 20 bp, Homo sapiens
acaggacagtgcttcagcct

SEQ ID NO: 2739356 - DNA, 14 bp, Homo sapiens
acaggagagacagg

SEQ ID NO: 2739357 - DNA, 21 bp, Homo sapiens
acaggaggctccgtgagccct

SEQ ID NO: 2739358 - DNA, 17 bp, Homo sapiens
acaggcaccagatggga

SEQ ID NO: 2739359 - DNA, 13 bp, Homo sapiens
acagggagctggc

SEQ ID NO: 2739360 - DNA, 17 bp, Homo sapiens
acaggggtagtttgttt

SEQ ID NO: 2739361 - DNA, 23 bp, Homo sapiens
acaggtcctgaatgtcctttctc

SEQ ID NO: 2739362 - DNA, 18 bp, Homo sapiens
acagtacctgattgtatt

SEQ ID NO: 2739363 - DNA, 21 bp, Homo sapiens
acagtcattatttaaagcaca

SEQ ID NO: 2739364 - DNA, 21 bp, Homo sapiens
acagtcctcacagcctctccc

SEQ ID NO: 2739365 - DNA, 22 bp, Homo sapiens
acagtcctcacagcctctccct

SEQ ID NO: 2739366 - DNA, 13 bp, Homo sapiens
acagtctcaattt

SEQ ID NO: 2739367 - DNA, 16 bp, Homo sapiens
acagtctcaattttgt

SEQ ID NO: 2739368 - DNA, 20 bp, Homo sapiens
acagtctcaattttgtattt

SEQ ID NO: 2739369 - DNA, 17 bp, Homo sapiens
acagtgaatttaagcat

SEQ ID NO: 2739370 - DNA, 18 bp, Homo sapiens
acagtgactcgggctcct

SEQ ID NO: 2739371 - DNA, 17 bp, Homo sapiens
acagtgctctgcctcta

SEQ ID NO: 2739372 - DNA, 14 bp, Homo sapiens
acagtgcttcagcc

SEQ ID NO: 2739373 - DNA, 17 bp, Homo sapiens
acagtgcttcagcctga

SEQ ID NO: 2739374 - DNA, 18 bp, Homo sapiens
acagtggaaccagcccag

SEQ ID NO: 2739375 - DNA, 15 bp, Homo sapiens
acagtgtatttaaga

SEQ ID NO: 2739376 - DNA, 16 bp, Homo sapiens
acagtgtcagagtcat

SEQ ID NO: 2739377 - DNA, 17 bp, Homo sapiens
acagtgttaggcctggc

SEQ ID NO: 2739378 - DNA, 19 bp, Homo sapiens
acagtgttaggcctggcac

SEQ ID NO: 2739379 - DNA, 22 bp, Homo sapiens
acagtgttaggcctggcacagt

SEQ ID NO: 2739380 - DNA, 19 bp, Homo sapiens
acagtgtttcctgagtagc

SEQ ID NO: 2739381 - DNA, 16 bp, Homo sapiens
acagttcagttcctct

SEQ ID NO: 2739382 - DNA, 21 bp, Homo sapiens
acagttcagttcctctttgca

SEQ ID NO: 2739383 - DNA, 16 bp, Homo sapiens
acagttcataaatttg

SEQ ID NO: 2739384 - DNA, 22 bp, Homo sapiens
acagttcataaatttgttgtca

SEQ ID NO: 2739385 - DNA, 21 bp, Homo sapiens
acataacaacctttcccattt

SEQ ID NO: 2739386 - DNA, 19 bp, Homo sapiens
acataagtaagacttgatt

SEQ ID NO: 2739387 - DNA, 18 bp, Homo sapiens
acatacaaaaaaaatctt

SEQ ID NO: 2739388 - DNA, 21 bp, Homo sapiens
acatacaaaaaaaatctttaa

SEQ ID NO: 2739389 - DNA, 22 bp, Homo sapiens
acatacaaaaaaaatctttaat

SEQ ID NO: 2739390 - DNA, 12 bp, Homo sapiens
acatataaaagt

SEQ ID NO: 2739391 - DNA, 22 bp, Homo sapiens
acatataaaagttaaactactt

SEQ ID NO: 2739392 - DNA, 17 bp, Homo sapiens
acatatatgtatatgta

SEQ ID NO: 2739393 - DNA, 23 bp, Homo sapiens
acatatgtctgtctttgcaaagg

SEQ ID NO: 2739394 - DNA, 22 bp, Homo sapiens
acatattaagaatagtctctgg

SEQ ID NO: 2739395 - DNA, 12 bp, Homo sapiens
acatcaatgaaa

SEQ ID NO: 2739396 - DNA, 21 bp, Homo sapiens
acatcaccaagtgtggaattg

SEQ ID NO: 2739397 - DNA, 20 bp, Homo sapiens
acatcagaagtaactcccac

SEQ ID NO: 2739398 - DNA, 21 bp, Homo sapiens
acatcagaagtaactcccact

SEQ ID NO: 2739399 - DNA, 20 bp, Homo sapiens
acatcagtctccaacatgtt

SEQ ID NO: 2739400 - DNA, 22 bp, Homo sapiens
acatcgcaatagttttttactt

SEQ ID NO: 2739401 - DNA, 18 bp, Homo sapiens
acatctaaattgatcatt

SEQ ID NO: 2739402 - DNA, 15 bp, Homo sapiens
acatgaaaacattga

SEQ ID NO: 2739403 - DNA, 21 bp, Homo sapiens
acatgaggacatgatggagcg

SEQ ID NO: 2739404 - DNA, 19 bp, Homo sapiens
acatgatttagggaagcag

SEQ ID NO: 2739405 - DNA, 22 bp, Homo sapiens
acatgatttagggaagcaggga

SEQ ID NO: 2739406 - DNA, 13 bp, Homo sapiens
acatgattttctt

SEQ ID NO: 2739407 - DNA, 16 bp, Homo sapiens
acatgcagctctgcag

SEQ ID NO: 2739408 - DNA, 23 bp, Homo sapiens
acatgcagctctgcagcaatatt

SEQ ID NO: 2739409 - DNA, 14 bp, Homo sapiens
acatgccagggaaa

SEQ ID NO: 2739410 - DNA, 21 bp, Homo sapiens
acatgctgtactaaaatatgc

SEQ ID NO: 2739411 - DNA, 15 bp, Homo sapiens
acatggattccaaag

SEQ ID NO: 2739412 - DNA, 14 bp, Homo sapiens
acatggccagtgtg

SEQ ID NO: 2739413 - DNA, 17 bp, Homo sapiens
acatgtatcactcactg

SEQ ID NO: 2739414 - DNA, 13 bp, Homo sapiens
acatgtttctgtt

SEQ ID NO: 2739415 - DNA, 16 bp, Homo sapiens
acattaattgaggctt

SEQ ID NO: 2739416 - DNA, 16 bp, Homo sapiens
acattaccttgtcttt

SEQ ID NO: 2739417 - DNA, 14 bp, Homo sapiens
acattactgtatgt

SEQ ID NO: 2739418 - DNA, 17 bp, Homo sapiens
agaacaatgtcagaaac

SEQ ID NO: 2739419 - DNA, 16 bp, Homo sapiens
agaacacccactggcc

SEQ ID NO: 2739420 - DNA, 18 bp, Homo sapiens
agaacatggtgtgtgtct

SEQ ID NO: 2739421 - DNA, 17 bp, Homo sapiens
agaaccagccgtatttt

SEQ ID NO: 2739422 - DNA, 15 bp, Homo sapiens
agaaccgcattttga

SEQ ID NO: 2739423 - DNA, 19 bp, Homo sapiens
agaacctcaggcttccttg

SEQ ID NO: 2739424 - DNA, 14 bp, Homo sapiens
agaactccgctgga

SEQ ID NO: 2739425 - DNA, 22 bp, Homo sapiens
agaactgaaggggagttttcac

SEQ ID NO: 2739426 - DNA, 21 bp, Homo sapiens
agaactgaattttgtctttat

SEQ ID NO: 2739427 - DNA, 22 bp, Homo sapiens
agaagacttcaatattaaatga

SEQ ID NO: 2739428 - DNA, 16 bp, Homo sapiens
agaagatctgcttccc

SEQ ID NO: 2739429 - DNA, 13 bp, Homo sapiens
agaagcaggagta

SEQ ID NO: 2739430 - DNA, 17 bp, Homo sapiens
agaagcctgaggctggg

SEQ ID NO: 2739431 - DNA, 22 bp, Homo sapiens
agaagctgggactcattcacat

SEQ ID NO: 2739432 - DNA, 11 bp, Homo sapiens
agaaggcctcc

SEQ ID NO: 2739433 - DNA, 12 bp, Homo sapiens
agaaggcctccc

SEQ ID NO: 2739434 - DNA, 20 bp, Homo sapiens
agaaggcctcccctgaggat

SEQ ID NO: 2739435 - DNA, 20 bp, Homo sapiens
agaaggctgggtccagggga

SEQ ID NO: 2739436 - DNA, 21 bp, Homo sapiens
agaagggttttccaccctgga

SEQ ID NO: 2739437 - DNA, 15 bp, Homo sapiens
agaagtaactcccac

SEQ ID NO: 2739438 - DNA, 16 bp, Homo sapiens
agaagtaactcccact

SEQ ID NO: 2739439 - DNA, 21 bp, Homo sapiens
agaagtactgcccttttgtgt

SEQ ID NO: 2739440 - DNA, 18 bp, Homo sapiens
agaagtactttgtgctga

SEQ ID NO: 2739441 - DNA, 15 bp, Homo sapiens
agaagtggccagggc

SEQ ID NO: 2739442 - DNA, 16 bp, Homo sapiens
agaagtggccagggct

SEQ ID NO: 2739443 - DNA, 21 bp, Homo sapiens
agaagttggtcttactttgtg

SEQ ID NO: 2739444 - DNA, 20 bp, Homo sapiens
agaagtttgggctaacattt

SEQ ID NO: 2739445 - DNA, 13 bp, Homo sapiens
agaatcctgggcc

SEQ ID NO: 2739446 - DNA, 19 bp, Homo sapiens
agaatcctgggcccccaga

SEQ ID NO: 2739447 - DNA, 22 bp, Homo sapiens
agaatggataagatgatgttaa

SEQ ID NO: 2739448 - DNA, 15 bp, Homo sapiens
agaattacccttcct

SEQ ID NO: 2739449 - DNA, 16 bp, Homo sapiens
agaattacccttcctc

SEQ ID NO: 2739450 - DNA, 17 bp, Homo sapiens
agaattctattttgctg

SEQ ID NO: 2739451 - DNA, 20 bp, Homo sapiens
agaattctattttgctggag

SEQ ID NO: 2739452 - DNA, 22 bp, Homo sapiens
agaattctattttgctggagac

SEQ ID NO: 2739453 - DNA, 19 bp, Homo sapiens
agaattgaaggagaaaatg

SEQ ID NO: 2739454 - DNA, 21 bp, Homo sapiens
agaattgcttgaacccaggag

SEQ ID NO: 2739455 - DNA, 19 bp, Homo sapiens
agaattttcaaataaggaa

SEQ ID NO: 2739456 - DNA, 10 bp, Homo sapiens
agacaaacac

SEQ ID NO: 2739457 - DNA, 12 bp, Homo sapiens
agacaaagcaaa

SEQ ID NO: 2739458 - DNA, 17 bp, Homo sapiens
agacacatacaaaaaaa

SEQ ID NO: 2739459 - DNA, 16 bp, Homo sapiens
agacagctggacccat

SEQ ID NO: 2739460 - DNA, 16 bp, Homo sapiens
agacagtggcactaaa

SEQ ID NO: 2739461 - DNA, 17 bp, Homo sapiens
agacagtggcactaaaa

SEQ ID NO: 2739462 - DNA, 14 bp, Homo sapiens
agacatcaatgaaa

SEQ ID NO: 2739463 - DNA, 15 bp, Homo sapiens
agacatcaatgaaac

SEQ ID NO: 2739464 - DNA, 17 bp, Homo sapiens
agacattgaaagctcta

SEQ ID NO: 2739465 - DNA, 20 bp, Homo sapiens
agaccattgtcttccaaccc

SEQ ID NO: 2739466 - DNA, 21 bp, Homo sapiens
agaccattgtcttccaacccc

SEQ ID NO: 2739467 - DNA, 22 bp, Homo sapiens
agaccattgtcttccaacccca

SEQ ID NO: 2739468 - DNA, 13 bp, Homo sapiens
agaccctgtctct

SEQ ID NO: 2739469 - DNA, 13 bp, Homo sapiens
agaccctgttcta

SEQ ID NO: 2739470 - DNA, 22 bp, Homo sapiens
agacctctgaatgtcccagagg

SEQ ID NO: 2739471 - DNA, 21 bp, Homo sapiens
agacgggttgaaagacatcaa

SEQ ID NO: 2739472 - DNA, 22 bp, Homo sapiens
agacgtcctggaatgaagcatg

SEQ ID NO: 2739473 - DNA, 21 bp, Homo sapiens
agacgtgagtgtgactttttg

SEQ ID NO: 2739474 - DNA, 22 bp, Homo sapiens
agactaaaaaggcccctgtggt

SEQ ID NO: 2739475 - DNA, 18 bp, Homo sapiens
agactctgtgagattcta

SEQ ID NO: 2739476 - DNA, 16 bp, Homo sapiens
agactctgtggggcct

SEQ ID NO: 2739477 - DNA, 23 bp, Homo sapiens
agactgcgggatggtcctggggc

SEQ ID NO: 2739478 - DNA, 19 bp, Homo sapiens
agactgctgggactggcca

SEQ ID NO: 2739479 - DNA, 19 bp, Homo sapiens
agacttcaatattaaatga

SEQ ID NO: 2739480 - DNA, 18 bp, Homo sapiens
agacttcactgcagcctt

SEQ ID NO: 2739481 - DNA, 18 bp, Homo sapiens
agagaaaaatggcctgca

SEQ ID NO: 2739482 - DNA, 19 bp, Homo sapiens
agagaaaacttatttgagt

SEQ ID NO: 2739483 - DNA, 15 bp, Homo sapiens
agagaagtaagcaga

SEQ ID NO: 2739484 - DNA, 23 bp, Homo sapiens
agagacaggattgggccaacaag

SEQ ID NO: 2739485 - DNA, 21 bp, Homo sapiens
agagagaaaacttatttgagt

SEQ ID NO: 2739486 - DNA, 22 bp, Homo sapiens
agagagagttgacccctcctga

SEQ ID NO: 2739487 - DNA, 19 bp, Homo sapiens
agagagcagcttctgccac

SEQ ID NO: 2739488 - DNA, 20 bp, Homo sapiens
agagaggcgcgtctgcccca

SEQ ID NO: 2739489 - DNA, 20 bp, Homo sapiens
agagatatgcagaaggaagg

SEQ ID NO: 2739490 - DNA, 13 bp, Homo sapiens
agagatatttaaa

SEQ ID NO: 2739491 - DNA, 23 bp, Homo sapiens
agagatatttaaaagacaaacac

SEQ ID NO: 2739492 - DNA, 16 bp, Homo sapiens
agagcacagccctccc

SEQ ID NO: 2739493 - DNA, 14 bp, Homo sapiens
agagcagaggcagc

SEQ ID NO: 2739494 - DNA, 16 bp, Homo sapiens
agagcagcactggggt

SEQ ID NO: 2739495 - DNA, 13 bp, Homo sapiens
agagcagctggct

SEQ ID NO: 2739496 - DNA, 17 bp, Homo sapiens
agagcaggggctgctgg

SEQ ID NO: 2739497 - DNA, 18 bp, Homo sapiens
agagcaggggctgctggg

SEQ ID NO: 2739498 - DNA, 19 bp, Homo sapiens
agagcaggggctgctgggg

SEQ ID NO: 2739499 - DNA, 23 bp, Homo sapiens
agagcaggggctgctgggggctc

SEQ ID NO: 2739500 - DNA, 12 bp, Homo sapiens
agagccagaggc

SEQ ID NO: 2739501 - DNA, 14 bp, Homo sapiens
agagccagaggcac

SEQ ID NO: 2739502 - DNA, 14 bp, Homo sapiens
agagcccagccatt

SEQ ID NO: 2739503 - DNA, 23 bp, Homo sapiens
agagccctctgctgctttccaac

SEQ ID NO: 2739504 - DNA, 17 bp, Homo sapiens
agagcctcaaatgagaa

SEQ ID NO: 2739505 - DNA, 17 bp, Homo sapiens
agagctcctgtccctac

SEQ ID NO: 2739506 - DNA, 19 bp, Homo sapiens
agagctcctgtccctaccc

SEQ ID NO: 2739507 - DNA, 13 bp, Homo sapiens
agagctctctctt

SEQ ID NO: 2739508 - DNA, 16 bp, Homo sapiens
agagctgcctccccaa

SEQ ID NO: 2739509 - DNA, 14 bp, Homo sapiens
agagctgcgggctg

SEQ ID NO: 2739510 - DNA, 16 bp, Homo sapiens
agagctgcgggctgag

SEQ ID NO: 2739511 - DNA, 20 bp, Homo sapiens
agagctgcgggctgagggca

SEQ ID NO: 2739512 - DNA, 23 bp, Homo sapiens
agagctgcgggctgagggcatct

SEQ ID NO: 2739513 - DNA, 18 bp, Homo sapiens
agagctggcagcctccag

SEQ ID NO: 2739514 - DNA, 16 bp, Homo sapiens
agagcttcccccaagg

SEQ ID NO: 2739515 - DNA, 16 bp, Homo sapiens
agaggcacctgctgga

SEQ ID NO: 2739516 - DNA, 13 bp, Homo sapiens
agaggcctttcta

SEQ ID NO: 2739517 - DNA, 21 bp, Homo sapiens
agaggcgcgtctgccccaccc

SEQ ID NO: 2739518 - DNA, 21 bp, Homo sapiens
agagggaaggggcctacaccc

SEQ ID NO: 2739519 - DNA, 19 bp, Homo sapiens
agagggaggagtttttctt

SEQ ID NO: 2739520 - DNA, 14 bp, Homo sapiens
agagggcccaggca

SEQ ID NO: 2739521 - DNA, 14 bp, Homo sapiens
agagggcgctcctg

SEQ ID NO: 2739522 - DNA, 18 bp, Homo sapiens
agaggggctttctggaga

SEQ ID NO: 2739523 - DNA, 19 bp, Homo sapiens
agaggtagcgagctgctct

SEQ ID NO: 2739524 - DNA, 23 bp, Homo sapiens
agaggtagcgagctgctctgcta

SEQ ID NO: 2739525 - DNA, 18 bp, Homo sapiens
agaggttctgcactcctg

SEQ ID NO: 2739526 - DNA, 20 bp, Homo sapiens
agaggttctgcactcctgga

SEQ ID NO: 2739527 - DNA, 14 bp, Homo sapiens
agagtaccatgctg

SEQ ID NO: 2739528 - DNA, 13 bp, Homo sapiens
agagtcaaagctg

SEQ ID NO: 2739529 - DNA, 15 bp, Homo sapiens
agagtctctccagcc

SEQ ID NO: 2739530 - DNA, 16 bp, Homo sapiens
agagtctctccagcct

SEQ ID NO: 2739531 - DNA, 12 bp, Homo sapiens
agagtctctggc

SEQ ID NO: 2739532 - DNA, 13 bp, Homo sapiens
agagtctctggct

SEQ ID NO: 2739533 - DNA, 12 bp, Homo sapiens
agagtctgtctc

SEQ ID NO: 2739534 - DNA, 22 bp, Homo sapiens
agagtgtccctttttgcagggg

SEQ ID NO: 2739535 - DNA, 23 bp, Homo sapiens
agagttcattcaaaatgtccagc

SEQ ID NO: 2739536 - DNA, 19 bp, Homo sapiens
agagttgacccctcctgaa

SEQ ID NO: 2739537 - DNA, 23 bp, Homo sapiens
agatactgaagtgcagctcagga

SEQ ID NO: 2739538 - DNA, 18 bp, Homo sapiens
agatagacgggttgaaag

SEQ ID NO: 2739539 - DNA, 19 bp, Homo sapiens
agatagacgggttgaaaga

SEQ ID NO: 2739540 - DNA, 21 bp, Homo sapiens
agatagacgggttgaaagaca

SEQ ID NO: 2739541 - DNA, 18 bp, Homo sapiens
agggctccctcctggagc

SEQ ID NO: 2739542 - DNA, 19 bp, Homo sapiens
agggctccctcctggagca

SEQ ID NO: 2739543 - DNA, 18 bp, Homo sapiens
agggctgaataaagggaa

SEQ ID NO: 2739544 - DNA, 20 bp, Homo sapiens
aggggaaaccagtgtagcct

SEQ ID NO: 2739545 - DNA, 19 bp, Homo sapiens
aggggacctggagctgcca

SEQ ID NO: 2739546 - DNA, 22 bp, Homo sapiens
aggggacctggagctgccagca

SEQ ID NO: 2739547 - DNA, 13 bp, Homo sapiens
aggggactgggcc

SEQ ID NO: 2739548 - DNA, 19 bp, Homo sapiens
aggggaggatcactggagc

SEQ ID NO: 2739549 - DNA, 17 bp, Homo sapiens
aggggagggaaaagcta

SEQ ID NO: 2739550 - DNA, 22 bp, Homo sapiens
aggggagggaaaagctaagagg

SEQ ID NO: 2739551 - DNA, 13 bp, Homo sapiens
aggggcaggcaca

SEQ ID NO: 2739552 - DNA, 14 bp, Homo sapiens
aggggcaggcacag

SEQ ID NO: 2739553 - DNA, 23 bp, Homo sapiens
aggggcaggccctgcactgtcct

SEQ ID NO: 2739554 - DNA, 16 bp, Homo sapiens
aggggcccgcttgcct

SEQ ID NO: 2739555 - DNA, 14 bp, Homo sapiens
aggggctcctggaa

SEQ ID NO: 2739556 - DNA, 15 bp, Homo sapiens
aggggctgcccgctc

SEQ ID NO: 2739557 - DNA, 17 bp, Homo sapiens
aggggctgcccgctccc

SEQ ID NO: 2739558 - DNA, 20 bp, Homo sapiens
aggggctgcccgctcccagt

SEQ ID NO: 2739559 - DNA, 15 bp, Homo sapiens
aggggctgctggggg

SEQ ID NO: 2739560 - DNA, 22 bp, Homo sapiens
aggggctgctgggggctcccct

SEQ ID NO: 2739561 - DNA, 17 bp, Homo sapiens
aggggctttctggagag

SEQ ID NO: 2739562 - DNA, 16 bp, Homo sapiens
agggggcaacaaggtg

SEQ ID NO: 2739563 - DNA, 18 bp, Homo sapiens
aggggtaggatgtacagg

SEQ ID NO: 2739564 - DNA, 14 bp, Homo sapiens
agggtaactcttgg

SEQ ID NO: 2739565 - DNA, 20 bp, Homo sapiens
agggtgcagttttccaggaa

SEQ ID NO: 2739566 - DNA, 18 bp, Homo sapiens
agggtgggagagcccagc

SEQ ID NO: 2739567 - DNA, 16 bp, Homo sapiens
aggtaagggccgccgg

SEQ ID NO: 2739568 - DNA, 15 bp, Homo sapiens
aggtaataaatacac

SEQ ID NO: 2739569 - DNA, 19 bp, Homo sapiens
aggtaatttttttttgtaa

SEQ ID NO: 2739570 - DNA, 21 bp, Homo sapiens
aggtacggtgagactctgagg

SEQ ID NO: 2739571 - DNA, 15 bp, Homo sapiens
aggtagaacctcacc

SEQ ID NO: 2739572 - DNA, 13 bp, Homo sapiens
aggtaggttttaa

SEQ ID NO: 2739573 - DNA, 20 bp, Homo sapiens
aggtaggttttaaaaataag

SEQ ID NO: 2739574 - DNA, 21 bp, Homo sapiens
aggtataaggatcttttgtaa

SEQ ID NO: 2739575 - DNA, 18 bp, Homo sapiens
aggtatctggtatctgca

SEQ ID NO: 2739576 - DNA, 22 bp, Homo sapiens
aggtcccgaggatgctgtcagg

SEQ ID NO: 2739577 - DNA, 17 bp, Homo sapiens
aggtcgtataatttagt

SEQ ID NO: 2739578 - DNA, 17 bp, Homo sapiens
aggtctataaacatgaa

SEQ ID NO: 2739579 - DNA, 18 bp, Homo sapiens
aggtctcacactcctcct

SEQ ID NO: 2739580 - DNA, 15 bp, Homo sapiens
aggtctccatgaaga

SEQ ID NO: 2739581 - DNA, 13 bp, Homo sapiens
aggtctcctccac

SEQ ID NO: 2739582 - DNA, 23 bp, Homo sapiens
aggtctcctccaccgccatggct

SEQ ID NO: 2739583 - DNA, 17 bp, Homo sapiens
aggtctcgctgatgctg

SEQ ID NO: 2739584 - DNA, 20 bp, Homo sapiens
aggtctcgctgatgctgggc

SEQ ID NO: 2739585 - DNA, 21 bp, Homo sapiens
aggtctcgctgatgctgggct

SEQ ID NO: 2739586 - DNA, 22 bp, Homo sapiens
aggtctcgctgatgctgggctg

SEQ ID NO: 2739587 - DNA, 23 bp, Homo sapiens
aggtctcgctgatgctgggctgg

SEQ ID NO: 2739588 - DNA, 21 bp, Homo sapiens
aggtcttcttgtgtcctgatg

SEQ ID NO: 2739589 - DNA, 16 bp, Homo sapiens
aggtcttgacctgaac

SEQ ID NO: 2739590 - DNA, 23 bp, Homo sapiens
aggtcttgacctgaactctgcaa

SEQ ID NO: 2739591 - DNA, 19 bp, Homo sapiens
aggtcttgttcaagcagcg

SEQ ID NO: 2739592 - DNA, 15 bp, Homo sapiens
aggtgacggactcag

SEQ ID NO: 2739593 - DNA, 23 bp, Homo sapiens
aggtgaggtgacttgcctggggc

SEQ ID NO: 2739594 - DNA, 13 bp, Homo sapiens
aggtgccaggctg

SEQ ID NO: 2739595 - DNA, 22 bp, Homo sapiens
aggtgccggtaccagcctgact

SEQ ID NO: 2739596 - DNA, 20 bp, Homo sapiens
aggtgctgctaccctccctg

SEQ ID NO: 2739597 - DNA, 21 bp, Homo sapiens
aggtgctgctaccctccctgc

SEQ ID NO: 2739598 - DNA, 13 bp, Homo sapiens
aggtggcagccct

SEQ ID NO: 2739599 - DNA, 20 bp, Homo sapiens
aggtgggcgggcagcacagc

SEQ ID NO: 2739600 - DNA, 19 bp, Homo sapiens
aggtgggctgagccctggc

SEQ ID NO: 2739601 - DNA, 19 bp, Homo sapiens
aggtgtcaccctgcagagc

SEQ ID NO: 2739602 - DNA, 16 bp, Homo sapiens
aggtgtcatttgacaa

SEQ ID NO: 2739603 - DNA, 17 bp, Homo sapiens
aggttgaggggctcctg

SEQ ID NO: 2739604 - DNA, 12 bp, Homo sapiens
aggttgcaggga

SEQ ID NO: 2739605 - DNA, 18 bp, Homo sapiens
aggttgcagggagccgag

SEQ ID NO: 2739606 - DNA, 21 bp, Homo sapiens
aggttgctttcccaccctggg

SEQ ID NO: 2739607 - DNA, 18 bp, Homo sapiens
aggttggaaaagaaatca

SEQ ID NO: 2739608 - DNA, 16 bp, Homo sapiens
aggtttcactgttcat

SEQ ID NO: 2739609 - DNA, 19 bp, Homo sapiens
aggtttcactgttcatgaa

SEQ ID NO: 2739610 - DNA, 16 bp, Homo sapiens
aggtttcccagtgagc

SEQ ID NO: 2739611 - DNA, 16 bp, Homo sapiens
aggtttctcaaagaaa

SEQ ID NO: 2739612 - DNA, 15 bp, Homo sapiens
agtaaataaattgtt

SEQ ID NO: 2739613 - DNA, 16 bp, Homo sapiens
agtaaataaattgttt

SEQ ID NO: 2739614 - DNA, 14 bp, Homo sapiens
agtaactcccactc

SEQ ID NO: 2739615 - DNA, 22 bp, Homo sapiens
agtaagcagagttctttgcaag

SEQ ID NO: 2739616 - DNA, 20 bp, Homo sapiens
agtaagtaccactcaggcca

SEQ ID NO: 2739617 - DNA, 17 bp, Homo sapiens
agtaatatgaaagccac

SEQ ID NO: 2739618 - DNA, 20 bp, Homo sapiens
agtacaataataaatcctca

SEQ ID NO: 2739619 - DNA, 21 bp, Homo sapiens
agtacagagaaattctgtggt

SEQ ID NO: 2739620 - DNA, 18 bp, Homo sapiens
agtacattcatctggagg

SEQ ID NO: 2739621 - DNA, 20 bp, Homo sapiens
agtacattcatctggaggct

SEQ ID NO: 2739622 - DNA, 11 bp, Homo sapiens
agtactttgtg

SEQ ID NO: 2739623 - DNA, 13 bp, Homo sapiens
agtaggccctgct

SEQ ID NO: 2739624 - DNA, 22 bp, Homo sapiens
agtataggataaattacattaa

SEQ ID NO: 2739625 - DNA, 19 bp, Homo sapiens
agtatattagtttgattta

SEQ ID NO: 2739626 - DNA, 23 bp, Homo sapiens
agtatctcggacctttcagctgt

SEQ ID NO: 2739627 - DNA, 12 bp, Homo sapiens
agtatttttgaa

SEQ ID NO: 2739628 - DNA, 13 bp, Homo sapiens
agtatttttgaaa

SEQ ID NO: 2739629 - DNA, 21 bp, Homo sapiens
agtatttttgaaagaattcta

SEQ ID NO: 2739630 - DNA, 22 bp, Homo sapiens
agtatttttgaaagaattctat

SEQ ID NO: 2739631 - DNA, 15 bp, Homo sapiens
agtcaacactcttct

SEQ ID NO: 2739632 - DNA, 14 bp, Homo sapiens
agtcaacttacggt

SEQ ID NO: 2739633 - DNA, 18 bp, Homo sapiens
agtcaagttccctcctgc

SEQ ID NO: 2739634 - DNA, 17 bp, Homo sapiens
agtcaataactctgatt

SEQ ID NO: 2739635 - DNA, 18 bp, Homo sapiens
agtcaataactctgattt

SEQ ID NO: 2739636 - DNA, 21 bp, Homo sapiens
agtcaataactctgattttga

SEQ ID NO: 2739637 - DNA, 14 bp, Homo sapiens
agtcaccatgcaag

SEQ ID NO: 2739638 - DNA, 15 bp, Homo sapiens
agtcaccatgcaagg

SEQ ID NO: 2739639 - DNA, 23 bp, Homo sapiens
agtcagatgcccagagggcccag

SEQ ID NO: 2739640 - DNA, 15 bp, Homo sapiens
agtcatggtcctggc

SEQ ID NO: 2739641 - DNA, 17 bp, Homo sapiens
agtcatggtcctggctg

SEQ ID NO: 2739642 - DNA, 23 bp, Homo sapiens
agtcatgtactggagagtggcaa

SEQ ID NO: 2739643 - DNA, 15 bp, Homo sapiens
agtccaacctgcctg

SEQ ID NO: 2739644 - DNA, 14 bp, Homo sapiens
agtccagggcggga

SEQ ID NO: 2739645 - DNA, 23 bp, Homo sapiens
agtccagtcaagttccctcctgc

SEQ ID NO: 2739646 - DNA, 19 bp, Homo sapiens
agtcccttagaagatctgc

SEQ ID NO: 2739647 - DNA, 14 bp, Homo sapiens
agtcctagagctcc

SEQ ID NO: 2739648 - DNA, 19 bp, Homo sapiens
agtcctagagctcctgtcc

SEQ ID NO: 2739649 - DNA, 14 bp, Homo sapiens
agtcctcacagcct

SEQ ID NO: 2739650 - DNA, 16 bp, Homo sapiens
agtcctcacagcctct

SEQ ID NO: 2739651 - DNA, 19 bp, Homo sapiens
agtcctcacagcctctccc

SEQ ID NO: 2739652 - DNA, 21 bp, Homo sapiens
agtcctcacagcctctccctt

SEQ ID NO: 2739653 - DNA, 15 bp, Homo sapiens
agtcctcgtagccat

SEQ ID NO: 2739654 - DNA, 21 bp, Homo sapiens
agtcctctccacctagtggct

SEQ ID NO: 2739655 - DNA, 18 bp, Homo sapiens
agtcctgctggcctgctc

SEQ ID NO: 2739656 - DNA, 16 bp, Homo sapiens
agtcctttgttgctgt

SEQ ID NO: 2739657 - DNA, 18 bp, Homo sapiens
agtcctttgttgctgttg

SEQ ID NO: 2739658 - DNA, 17 bp, Homo sapiens
agtcctttttgtaacta

SEQ ID NO: 2739659 - DNA, 17 bp, Homo sapiens
agtcgcgctgcctgtgt

SEQ ID NO: 2739660 - DNA, 13 bp, Homo sapiens
agtctaaagttta

SEQ ID NO: 2739661 - DNA, 15 bp, Homo sapiens
agtctcaaatcaaat

SEQ ID NO: 2739662 - DNA, 16 bp, Homo sapiens
agtctcaattttgtat

SEQ ID NO: 2739663 - DNA, 18 bp, Homo sapiens
agtctcaattttgtattt

SEQ ID NO: 2739664 - DNA, 21 bp, Homo sapiens
atgccacaccaagctgtgcca

SEQ ID NO: 2739665 - DNA, 16 bp, Homo sapiens
atgccattgtatttct

SEQ ID NO: 2739666 - DNA, 21 bp, Homo sapiens
atgcccagagggcccaggcag

SEQ ID NO: 2739667 - DNA, 17 bp, Homo sapiens
atgccccctcgtgccag

SEQ ID NO: 2739668 - DNA, 16 bp, Homo sapiens
atgccctacctgcctg

SEQ ID NO: 2739669 - DNA, 20 bp, Homo sapiens
atgccctacctgcctgttct

SEQ ID NO: 2739670 - DNA, 11 bp, Homo sapiens
atgcctcagcc

SEQ ID NO: 2739671 - DNA, 23 bp, Homo sapiens
atgcctcagccagccctggaggc

SEQ ID NO: 2739672 - DNA, 15 bp, Homo sapiens
atgcgggcattttga

SEQ ID NO: 2739673 - DNA, 17 bp, Homo sapiens
atgcgggcattttgaat

SEQ ID NO: 2739674 - DNA, 21 bp, Homo sapiens
atgctatttttattaatataa

SEQ ID NO: 2739675 - DNA, 15 bp, Homo sapiens
atgctcacagtctca

SEQ ID NO: 2739676 - DNA, 15 bp, Homo sapiens
atgctgaatgaatcc

SEQ ID NO: 2739677 - DNA, 22 bp, Homo sapiens
atgctgcccagggtcagtgtat

SEQ ID NO: 2739678 - DNA, 13 bp, Homo sapiens
atgctgcctgagt

SEQ ID NO: 2739679 - DNA, 21 bp, Homo sapiens
atgctggacggcattcctgct

SEQ ID NO: 2739680 - DNA, 22 bp, Homo sapiens
atgctggatgagcaactcctgt

SEQ ID NO: 2739681 - DNA, 14 bp, Homo sapiens
atgctggccacaga

SEQ ID NO: 2739682 - DNA, 21 bp, Homo sapiens
atgctggcggcgcagagggaa

SEQ ID NO: 2739683 - DNA, 12 bp, Homo sapiens
atgctgtgcaaa

SEQ ID NO: 2739684 - DNA, 19 bp, Homo sapiens
atgctgtgcaaacagtgta

SEQ ID NO: 2739685 - DNA, 22 bp, Homo sapiens
atgctttcctaaagtctctgct

SEQ ID NO: 2739686 - DNA, 15 bp, Homo sapiens
atgctttctcctttt

SEQ ID NO: 2739687 - DNA, 14 bp, Homo sapiens
atggaaaggaagaa

SEQ ID NO: 2739688 - DNA, 16 bp, Homo sapiens
atggaactccccaggg

SEQ ID NO: 2739689 - DNA, 15 bp, Homo sapiens
atggaataaaccatt

SEQ ID NO: 2739690 - DNA, 17 bp, Homo sapiens
atggaatttgtaagttt

SEQ ID NO: 2739691 - DNA, 21 bp, Homo sapiens
atggaatttgtaagtttatgt

SEQ ID NO: 2739692 - DNA, 17 bp, Homo sapiens
atggactcttcccccac

SEQ ID NO: 2739693 - DNA, 21 bp, Homo sapiens
atggagccagctctgcattat

SEQ ID NO: 2739694 - DNA, 22 bp, Homo sapiens
atggatatttttaatttatgat

SEQ ID NO: 2739695 - DNA, 18 bp, Homo sapiens
atggattcccctggacat

SEQ ID NO: 2739696 - DNA, 17 bp, Homo sapiens
atggatttggttatgat

SEQ ID NO: 2739697 - DNA, 13 bp, Homo sapiens
atggcagctgggc

SEQ ID NO: 2739698 - DNA, 12 bp, Homo sapiens
atggccatggaa

SEQ ID NO: 2739699 - DNA, 20 bp, Homo sapiens
atggcgtgtccctctcggaa

SEQ ID NO: 2739700 - DNA, 14 bp, Homo sapiens
atggctcccctgag

SEQ ID NO: 2739701 - DNA, 18 bp, Homo sapiens
atggctggaaggagccag

SEQ ID NO: 2739702 - DNA, 17 bp, Homo sapiens
atggcttacttacaaaa

SEQ ID NO: 2739703 - DNA, 12 bp, Homo sapiens
atggcttttctc

SEQ ID NO: 2739704 - DNA, 16 bp, Homo sapiens
atgggccgagccacct

SEQ ID NO: 2739705 - DNA, 21 bp, Homo sapiens
atgggcgaccagggccatctc

SEQ ID NO: 2739706 - DNA, 23 bp, Homo sapiens
atggtgacttcctcgcctctccc

SEQ ID NO: 2739707 - DNA, 11 bp, Homo sapiens
atggtgcctga

SEQ ID NO: 2739708 - DNA, 22 bp, Homo sapiens
atggtggtaaacattctctcag

SEQ ID NO: 2739709 - DNA, 18 bp, Homo sapiens
atggtgtgaaagtcagat

SEQ ID NO: 2739710 - DNA, 16 bp, Homo sapiens
atgtaaaggaaacata

SEQ ID NO: 2739711 - DNA, 20 bp, Homo sapiens
atgtaaattttgtatgaaaa

SEQ ID NO: 2739712 - DNA, 17 bp, Homo sapiens
atgtaaccttaaaagca

SEQ ID NO: 2739713 - DNA, 13 bp, Homo sapiens
atgtaagctggaa

SEQ ID NO: 2739714 - DNA, 21 bp, Homo sapiens
atgtacagtctcaattttgta

SEQ ID NO: 2739715 - DNA, 15 bp, Homo sapiens
atgtactggagagtg

SEQ ID NO: 2739716 - DNA, 20 bp, Homo sapiens
atgtactggagagtggcaaa

SEQ ID NO: 2739717 - DNA, 15 bp, Homo sapiens
atgtatatctatatc

SEQ ID NO: 2739718 - DNA, 19 bp, Homo sapiens
atgtatatgtatatctata

SEQ ID NO: 2739719 - DNA, 19 bp, Homo sapiens
atgtatggcttttctcttg

SEQ ID NO: 2739720 - DNA, 18 bp, Homo sapiens
atgtattagccagtcatt

SEQ ID NO: 2739721 - DNA, 21 bp, Homo sapiens
atgtattgcagtgcggctcac

SEQ ID NO: 2739722 - DNA, 21 bp, Homo sapiens
atgtattttttagaccctcta

SEQ ID NO: 2739723 - DNA, 16 bp, Homo sapiens
atgtcagactggctgg

SEQ ID NO: 2739724 - DNA, 21 bp, Homo sapiens
atgtcagcctcatgccccagg

SEQ ID NO: 2739725 - DNA, 14 bp, Homo sapiens
atgtcagccttgca

SEQ ID NO: 2739726 - DNA, 13 bp, Homo sapiens
atgtcccagaggc

SEQ ID NO: 2739727 - DNA, 17 bp, Homo sapiens
atgtcctcaaagaagtg

SEQ ID NO: 2739728 - DNA, 15 bp, Homo sapiens
atgtctgtctttgca

SEQ ID NO: 2739729 - DNA, 18 bp, Homo sapiens
atgtgatcatctttgctg

SEQ ID NO: 2739730 - DNA, 15 bp, Homo sapiens
atgtgcaactcttgt

SEQ ID NO: 2739731 - DNA, 16 bp, Homo sapiens
atgtgcaactcttgta

SEQ ID NO: 2739732 - DNA, 18 bp, Homo sapiens
atgtgccccatgtccaag

SEQ ID NO: 2739733 - DNA, 16 bp, Homo sapiens
atgtgctcccaccagg

SEQ ID NO: 2739734 - DNA, 18 bp, Homo sapiens
atgtgctctcggcttcac

SEQ ID NO: 2739735 - DNA, 16 bp, Homo sapiens
atgtgctgctgtggca

SEQ ID NO: 2739736 - DNA, 18 bp, Homo sapiens
atgtggatggaggtgatg

SEQ ID NO: 2739737 - DNA, 13 bp, Homo sapiens
atgtgtatgagaa

SEQ ID NO: 2739738 - DNA, 20 bp, Homo sapiens
atgtgtcattggaagccatc

SEQ ID NO: 2739739 - DNA, 16 bp, Homo sapiens
atgtgtcccagtgaac

SEQ ID NO: 2739740 - DNA, 13 bp, Homo sapiens
atgtgtgtctcac

SEQ ID NO: 2739741 - DNA, 20 bp, Homo sapiens
atgtgttgacgtaagctcta

SEQ ID NO: 2739742 - DNA, 18 bp, Homo sapiens
atgtgttgcataaacaat

SEQ ID NO: 2739743 - DNA, 19 bp, Homo sapiens
atgtgttgcataaacaatc

SEQ ID NO: 2739744 - DNA, 18 bp, Homo sapiens
atgttaaatgccttggtt

SEQ ID NO: 2739745 - DNA, 17 bp, Homo sapiens
atgttattggaattttc

SEQ ID NO: 2739746 - DNA, 20 bp, Homo sapiens
atgttcatgtgtaacttcta

SEQ ID NO: 2739747 - DNA, 16 bp, Homo sapiens
atgtttaattcattaa

SEQ ID NO: 2739748 - DNA, 13 bp, Homo sapiens
atgtttgtcagta

SEQ ID NO: 2739749 - DNA, 19 bp, Homo sapiens
atgtttgtcagtaaatact

SEQ ID NO: 2739750 - DNA, 13 bp, Homo sapiens
atgtttttgtgta

SEQ ID NO: 2739751 - DNA, 17 bp, Homo sapiens
atgtttttgtgtagagt

SEQ ID NO: 2739752 - DNA, 13 bp, Homo sapiens
attaaaaaaacac

SEQ ID NO: 2739753 - DNA, 15 bp, Homo sapiens
attaaaaaaacacaa

SEQ ID NO: 2739754 - DNA, 18 bp, Homo sapiens
attaaaaaaacacaaaaa

SEQ ID NO: 2739755 - DNA, 18 bp, Homo sapiens
attaaaacagaagcaaat

SEQ ID NO: 2739756 - DNA, 19 bp, Homo sapiens
attaaacagcaaagccata

SEQ ID NO: 2739757 - DNA, 16 bp, Homo sapiens
attaactctggacctc

SEQ ID NO: 2739758 - DNA, 19 bp, Homo sapiens
attaactttcaaaagcaaa

SEQ ID NO: 2739759 - DNA, 13 bp, Homo sapiens
attaagaaacaat

SEQ ID NO: 2739760 - DNA, 14 bp, Homo sapiens
attaagaaacaatt

SEQ ID NO: 2739761 - DNA, 18 bp, Homo sapiens
attaagtggctttttaac

SEQ ID NO: 2739762 - DNA, 22 bp, Homo sapiens
attaatataaccataaatcaat

SEQ ID NO: 2739763 - DNA, 13 bp, Homo sapiens
attaatattatta

SEQ ID NO: 2739764 - DNA, 14 bp, Homo sapiens
attaatcttttaaa

SEQ ID NO: 2739765 - DNA, 23 bp, Homo sapiens
attaattaaaataaaaaacagct

SEQ ID NO: 2739766 - DNA, 18 bp, Homo sapiens
attaattagatcaacact

SEQ ID NO: 2739767 - DNA, 18 bp, Homo sapiens
attacaataaatccttta

SEQ ID NO: 2739768 - DNA, 16 bp, Homo sapiens
attacagatcatataa

SEQ ID NO: 2739769 - DNA, 13 bp, Homo sapiens
attacattaaaat

SEQ ID NO: 2739770 - DNA, 13 bp, Homo sapiens
attacccttcctc

SEQ ID NO: 2739771 - DNA, 20 bp, Homo sapiens
attactgtatgtataaatta

SEQ ID NO: 2739772 - DNA, 23 bp, Homo sapiens
attactgtatgtataaattatga

SEQ ID NO: 2739773 - DNA, 14 bp, Homo sapiens
attagatcaacact

SEQ ID NO: 2739774 - DNA, 11 bp, Homo sapiens
attagccagga

SEQ ID NO: 2739775 - DNA, 14 bp, Homo sapiens
attagccagtcatt

SEQ ID NO: 2739776 - DNA, 21 bp, Homo sapiens
attagcttttagttttaaaac

SEQ ID NO: 2739777 - DNA, 13 bp, Homo sapiens
attatatatcata

SEQ ID NO: 2739778 - DNA, 18 bp, Homo sapiens
attatatatcataaagta

SEQ ID NO: 2739779 - DNA, 21 bp, Homo sapiens
attatccctgctggctttctt

SEQ ID NO: 2739780 - DNA, 14 bp, Homo sapiens
attatgaaggacct

SEQ ID NO: 2739781 - DNA, 18 bp, Homo sapiens
attatgaaggacctgaaa

SEQ ID NO: 2739782 - DNA, 22 bp, Homo sapiens
attatggacatcgatatgaaaa

SEQ ID NO: 2739783 - DNA, 15 bp, Homo sapiens
attatgttattggaa

SEQ ID NO: 2739784 - DNA, 17 bp, Homo sapiens
attatgttattggaatt

SEQ ID NO: 2739785 - DNA, 12 bp, Homo sapiens
attatgttttca

SEQ ID NO: 2739786 - DNA, 17 bp, Homo sapiens
attatttgataacattt

SEQ ID NO: 2739787 - DNA, 18 bp, Homo sapiens
attatttgataacatttt

SEQ ID NO: 2739788 - DNA, 17 bp, Homo sapiens
caacctgcctgtgcatg

SEQ ID NO: 2739789 - DNA, 22 bp, Homo sapiens
caacctttcccatttcgtgtaa

SEQ ID NO: 2739790 - DNA, 20 bp, Homo sapiens
caactactcagctctcctgc

SEQ ID NO: 2739791 - DNA, 14 bp, Homo sapiens
caactcctgttctt

SEQ ID NO: 2739792 - DNA, 13 bp, Homo sapiens
caactctccactc

SEQ ID NO: 2739793 - DNA, 15 bp, Homo sapiens
caactctccactcca

SEQ ID NO: 2739794 - DNA, 16 bp, Homo sapiens
caactctccactccat

SEQ ID NO: 2739795 - DNA, 23 bp, Homo sapiens
caactttcatttgaaagtgggtt

SEQ ID NO: 2739796 - DNA, 21 bp, Homo sapiens
caagaaaacctgtttttaaca

SEQ ID NO: 2739797 - DNA, 21 bp, Homo sapiens
caagaaatcgccttatgagaa

SEQ ID NO: 2739798 - DNA, 15 bp, Homo sapiens
caagaatgaaatact

SEQ ID NO: 2739799 - DNA, 14 bp, Homo sapiens
caagacaaagcaaa

SEQ ID NO: 2739800 - DNA, 16 bp, Homo sapiens
caagagcagaggcagc

SEQ ID NO: 2739801 - DNA, 22 bp, Homo sapiens
caagaggctggaaaagggctca

SEQ ID NO: 2739802 - DNA, 14 bp, Homo sapiens
caagagtctctcca

SEQ ID NO: 2739803 - DNA, 22 bp, Homo sapiens
caagagtctctccagcctcaca

SEQ ID NO: 2739804 - DNA, 19 bp, Homo sapiens
caagatccaaatgctgtgc

SEQ ID NO: 2739805 - DNA, 23 bp, Homo sapiens
caagcagacgtgagtgtgacttt

SEQ ID NO: 2739806 - DNA, 18 bp, Homo sapiens
caagccaacgacaaagcc

SEQ ID NO: 2739807 - DNA, 18 bp, Homo sapiens
caagccaccgcagctgct

SEQ ID NO: 2739808 - DNA, 23 bp, Homo sapiens
caagccaccgcagctgctgccac

SEQ ID NO: 2739809 - DNA, 15 bp, Homo sapiens
caagcgtgctgcctc

SEQ ID NO: 2739810 - DNA, 23 bp, Homo sapiens
caagcgtgctgcctctcttctgt

SEQ ID NO: 2739811 - DNA, 23 bp, Homo sapiens
caagctccctggtgagggagcct

SEQ ID NO: 2739812 - DNA, 14 bp, Homo sapiens
caagctgtgccacc

SEQ ID NO: 2739813 - DNA, 17 bp, Homo sapiens
caagctgtgccaccctg

SEQ ID NO: 2739814 - DNA, 16 bp, Homo sapiens
caagcttgtgtgggcc

SEQ ID NO: 2739815 - DNA, 22 bp, Homo sapiens
caagcttgtgtgggcccaacag

SEQ ID NO: 2739816 - DNA, 15 bp, Homo sapiens
caaggactcagatga

SEQ ID NO: 2739817 - DNA, 14 bp, Homo sapiens
caaggaggctggct

SEQ ID NO: 2739818 - DNA, 22 bp, Homo sapiens
caaggaggctggctggggccta

SEQ ID NO: 2739819 - DNA, 13 bp, Homo sapiens
caaggcacctgca

SEQ ID NO: 2739820 - DNA, 19 bp, Homo sapiens
caaggcagttctgtgtcct

SEQ ID NO: 2739821 - DNA, 14 bp, Homo sapiens
caaggccagggcac

SEQ ID NO: 2739822 - DNA, 19 bp, Homo sapiens
caaggccagggcacagctg

SEQ ID NO: 2739823 - DNA, 17 bp, Homo sapiens
caaggcctcccacagtg

SEQ ID NO: 2739824 - DNA, 15 bp, Homo sapiens
caaggtctcacactc

SEQ ID NO: 2739825 - DNA, 16 bp, Homo sapiens
caaggtctcacactcc

SEQ ID NO: 2739826 - DNA, 24 bp, Homo sapiens
caaggtctcacactcctcctgcca

SEQ ID NO: 2739827 - DNA, 13 bp, Homo sapiens
caaggtgcacaga

SEQ ID NO: 2739828 - DNA, 23 bp, Homo sapiens
caaggtgggctgagccctggcag

SEQ ID NO: 2739829 - DNA, 22 bp, Homo sapiens
caaggtttcccagtgagcctct

SEQ ID NO: 2739830 - DNA, 20 bp, Homo sapiens
caagtattaggggtaatata

SEQ ID NO: 2739831 - DNA, 23 bp, Homo sapiens
caagtattaggggtaatatattg

SEQ ID NO: 2739832 - DNA, 13 bp, Homo sapiens
caagtatttttat

SEQ ID NO: 2739833 - DNA, 21 bp, Homo sapiens
caagtatttttatttaaatta

SEQ ID NO: 2739834 - DNA, 17 bp, Homo sapiens
caagtcaacactcttct

SEQ ID NO: 2739835 - DNA, 20 bp, Homo sapiens
caagtcaacactcttcttga

SEQ ID NO: 2739836 - DNA, 20 bp, Homo sapiens
caagtccaacctgcctgtgc

SEQ ID NO: 2739837 - DNA, 17 bp, Homo sapiens
caagtccacagtggaac

SEQ ID NO: 2739838 - DNA, 11 bp, Homo sapiens
caagtctgtga

SEQ ID NO: 2739839 - DNA, 10 bp, Homo sapiens
caagtgagtg

SEQ ID NO: 2739840 - DNA, 19 bp, Homo sapiens
caagtgctgtttgggcagg

SEQ ID NO: 2739841 - DNA, 19 bp, Homo sapiens
caagtgggagagcccgtgg

SEQ ID NO: 2739842 - DNA, 23 bp, Homo sapiens
caagtgggagagcccgtgggggc

SEQ ID NO: 2739843 - DNA, 18 bp, Homo sapiens
caagtgggagatgaaaac

SEQ ID NO: 2739844 - DNA, 19 bp, Homo sapiens
caagtgggagatgaaaacc

SEQ ID NO: 2739845 - DNA, 22 bp, Homo sapiens
caagtgggagatgaaaacctgc

SEQ ID NO: 2739846 - DNA, 22 bp, Homo sapiens
caagtgtctcttgactggctca

SEQ ID NO: 2739847 - DNA, 13 bp, Homo sapiens
caagttagctcag

SEQ ID NO: 2739848 - DNA, 19 bp, Homo sapiens
caagttagctcaggaggct

SEQ ID NO: 2739849 - DNA, 17 bp, Homo sapiens
caagttcaatctgtttt

SEQ ID NO: 2739850 - DNA, 16 bp, Homo sapiens
caagttccctcctgca

SEQ ID NO: 2739851 - DNA, 17 bp, Homo sapiens
caagttccctcctgcag

SEQ ID NO: 2739852 - DNA, 15 bp, Homo sapiens
caagttgagaacaaa

SEQ ID NO: 2739853 - DNA, 11 bp, Homo sapiens
caataaatgct

SEQ ID NO: 2739854 - DNA, 15 bp, Homo sapiens
caataaatgctgaat

SEQ ID NO: 2739855 - DNA, 16 bp, Homo sapiens
caataaatgctgaatg

SEQ ID NO: 2739856 - DNA, 19 bp, Homo sapiens
caataactctgattttgat

SEQ ID NO: 2739857 - DNA, 15 bp, Homo sapiens
caatacatgctgcta

SEQ ID NO: 2739858 - DNA, 15 bp, Homo sapiens
caatagggtgcagtt

SEQ ID NO: 2739859 - DNA, 21 bp, Homo sapiens
caatagttttttacttctctt

SEQ ID NO: 2739860 - DNA, 15 bp, Homo sapiens
caatcactgctcccc

SEQ ID NO: 2739861 - DNA, 16 bp, Homo sapiens
caatccatttggcaga

SEQ ID NO: 2739862 - DNA, 14 bp, Homo sapiens
caatccttgttcag

SEQ ID NO: 2739863 - DNA, 20 bp, Homo sapiens
caatgaagcaaacacacaga

SEQ ID NO: 2739864 - DNA, 22 bp, Homo sapiens
caatgaaggatttcttattttc

SEQ ID NO: 2739865 - DNA, 18 bp, Homo sapiens
caatggcacgatctcagc

SEQ ID NO: 2739866 - DNA, 15 bp, Homo sapiens
caatgtttttgtgta

SEQ ID NO: 2739867 - DNA, 20 bp, Homo sapiens
caatgtttttgtgtagagtg

SEQ ID NO: 2739868 - DNA, 17 bp, Homo sapiens
caattctctttagttct

SEQ ID NO: 2739869 - DNA, 20 bp, Homo sapiens
caattggatacgacaacttg

SEQ ID NO: 2739870 - DNA, 19 bp, Homo sapiens
caattgttctgggtgattt

SEQ ID NO: 2739871 - DNA, 17 bp, Homo sapiens
caatttaaattgttata

SEQ ID NO: 2739872 - DNA, 14 bp, Homo sapiens
caatttatatcttt

SEQ ID NO: 2739873 - DNA, 21 bp, Homo sapiens
caatttatatttaataaaatt

SEQ ID NO: 2739874 - DNA, 21 bp, Homo sapiens
cacaaatgtgtcccagtgaac

SEQ ID NO: 2739875 - DNA, 22 bp, Homo sapiens
cacaacgctctaccctgcagct

SEQ ID NO: 2739876 - DNA, 18 bp, Homo sapiens
cacaccaagctgtgccac

SEQ ID NO: 2739877 - DNA, 22 bp, Homo sapiens
cacaccaagctgtgccaccctg

SEQ ID NO: 2739878 - DNA, 17 bp, Homo sapiens
cacaccattctcctgcc

SEQ ID NO: 2739879 - DNA, 13 bp, Homo sapiens
cacaccctgcctg

SEQ ID NO: 2739880 - DNA, 16 bp, Homo sapiens
cacaccctgcctgctg

SEQ ID NO: 2739881 - DNA, 13 bp, Homo sapiens
cacactcagcagc

SEQ ID NO: 2739882 - DNA, 14 bp, Homo sapiens
cacactccagaatt

SEQ ID NO: 2739883 - DNA, 19 bp, Homo sapiens
cacactgcggtgtctgcag

SEQ ID NO: 2739884 - DNA, 13 bp, Homo sapiens
cacactgggctca

SEQ ID NO: 2739885 - DNA, 21 bp, Homo sapiens
cacacttcttgaaacagcctg

SEQ ID NO: 2739886 - DNA, 22 bp, Homo sapiens
cacacttcttgaaacagcctgg

SEQ ID NO: 2739887 - DNA, 14 bp, Homo sapiens
cacagacctcagag

SEQ ID NO: 2739888 - DNA, 15 bp, Homo sapiens
cacagacctcagaga

SEQ ID NO: 2739889 - DNA, 11 bp, Homo sapiens
cacagactctg

SEQ ID NO: 2739890 - DNA, 17 bp, Homo sapiens
cacagactcttccacca

SEQ ID NO: 2739891 - DNA, 18 bp, Homo sapiens
cacagactcttccaccag

SEQ ID NO: 2739892 - DNA, 23 bp, Homo sapiens
cacagactcttccaccagagcag

SEQ ID NO: 2739893 - DNA, 17 bp, Homo sapiens
cacagatgctggcctct

SEQ ID NO: 2739894 - DNA, 20 bp, Homo sapiens
cacagatgctggcctcttgg

SEQ ID NO: 2739895 - DNA, 16 bp, Homo sapiens
cacagcatctctatga

SEQ ID NO: 2739896 - DNA, 17 bp, Homo sapiens
cacagcatctctatgaa

SEQ ID NO: 2739897 - DNA, 14 bp, Homo sapiens
cacagcccacgtcc

SEQ ID NO: 2739898 - DNA, 22 bp, Homo sapiens
cacagcccccaccccagcacag

SEQ ID NO: 2739899 - DNA, 23 bp, Homo sapiens
cacagcccccaccccagcacagc

SEQ ID NO: 2739900 - DNA, 14 bp, Homo sapiens
cacagccgcagcct

SEQ ID NO: 2739901 - DNA, 21 bp, Homo sapiens
cacagccgcagcctccctctg

SEQ ID NO: 2739902 - DNA, 14 bp, Homo sapiens
cacagcgcctcctg

SEQ ID NO: 2739903 - DNA, 12 bp, Homo sapiens
cacagctcctcc

SEQ ID NO: 2739904 - DNA, 12 bp, Homo sapiens
cacagctctgct

SEQ ID NO: 2739905 - DNA, 16 bp, Homo sapiens
cacagctctgctggaa

SEQ ID NO: 2739906 - DNA, 16 bp, Homo sapiens
cacagctcttgtttgg

SEQ ID NO: 2739907 - DNA, 23 bp, Homo sapiens
cacagctggagacgatcttgctg

SEQ ID NO: 2739908 - DNA, 15 bp, Homo sapiens
cacagcttcctgagt

SEQ ID NO: 2739909 - DNA, 15 bp, Homo sapiens
cacagggagctggca

SEQ ID NO: 2739910 - DNA, 13 bp, Homo sapiens
cacagggcagagc

SEQ ID NO: 2739911 - DNA, 14 bp, Homo sapiens
cagtgcctggcaag

SEQ ID NO: 2739912 - DNA, 12 bp, Homo sapiens
cagtgctctgcc

SEQ ID NO: 2739913 - DNA, 16 bp, Homo sapiens
cagtgctctgcctcta

SEQ ID NO: 2739914 - DNA, 17 bp, Homo sapiens
cagtgctggctgctggc

SEQ ID NO: 2739915 - DNA, 18 bp, Homo sapiens
cagtgctggctgctggcc

SEQ ID NO: 2739916 - DNA, 23 bp, Homo sapiens
cagtgctggctgctggcccacag

SEQ ID NO: 2739917 - DNA, 18 bp, Homo sapiens
cagtgctgtggcctgggc

SEQ ID NO: 2739918 - DNA, 16 bp, Homo sapiens
cagtggaaccagccca

SEQ ID NO: 2739919 - DNA, 14 bp, Homo sapiens
cagtggcactaaaa

SEQ ID NO: 2739920 - DNA, 15 bp, Homo sapiens
cagtggcccccactc

SEQ ID NO: 2739921 - DNA, 20 bp, Homo sapiens
cagtggcccccactcacagg

SEQ ID NO: 2739922 - DNA, 20 bp, Homo sapiens
cagtggctcacgcctatgat

SEQ ID NO: 2739923 - DNA, 20 bp, Homo sapiens
cagtggcttatgcctataat

SEQ ID NO: 2739924 - DNA, 19 bp, Homo sapiens
cagtgggaggacagagccg

SEQ ID NO: 2739925 - DNA, 16 bp, Homo sapiens
cagtgggcatgtatta

SEQ ID NO: 2739926 - DNA, 18 bp, Homo sapiens
cagtgggtcccacttccc

SEQ ID NO: 2739927 - DNA, 23 bp, Homo sapiens
cagtgggtcccacttcccctcct

SEQ ID NO: 2739928 - DNA, 17 bp, Homo sapiens
cagtgtattttctgtgt

SEQ ID NO: 2739929 - DNA, 17 bp, Homo sapiens
cagtgtcagcactcagg

SEQ ID NO: 2739930 - DNA, 13 bp, Homo sapiens
cagtgtctgggct

SEQ ID NO: 2739931 - DNA, 15 bp, Homo sapiens
cagtgtctgggctga

SEQ ID NO: 2739932 - DNA, 15 bp, Homo sapiens
cagtgtcttcctgtg

SEQ ID NO: 2739933 - DNA, 16 bp, Homo sapiens
cagtgtcttcctgtgg

SEQ ID NO: 2739934 - DNA, 22 bp, Homo sapiens
cagtgtgatcccaagtgccagt

SEQ ID NO: 2739935 - DNA, 13 bp, Homo sapiens
cagtgtgcccccc

SEQ ID NO: 2739936 - DNA, 17 bp, Homo sapiens
cagtgtgccccccatcc

SEQ ID NO: 2739937 - DNA, 19 bp, Homo sapiens
cagtgtgccccccatcctg

SEQ ID NO: 2739938 - DNA, 22 bp, Homo sapiens
cagtgtgccccccatcctggcc

SEQ ID NO: 2739939 - DNA, 21 bp, Homo sapiens
cagtgtgtgctcagcagcccc

SEQ ID NO: 2739940 - DNA, 15 bp, Homo sapiens
cagtgtttcctgagt

SEQ ID NO: 2739941 - DNA, 13 bp, Homo sapiens
cagttcataaatt

SEQ ID NO: 2739942 - DNA, 18 bp, Homo sapiens
cagttcataaatttgttg

SEQ ID NO: 2739943 - DNA, 23 bp, Homo sapiens
cagttcataaatttgttgtcatg

SEQ ID NO: 2739944 - DNA, 14 bp, Homo sapiens
cagttcataattca

SEQ ID NO: 2739945 - DNA, 19 bp, Homo sapiens
cagttggcccgggtgcagg

SEQ ID NO: 2739946 - DNA, 13 bp, Homo sapiens
cagttgttttccc

SEQ ID NO: 2739947 - DNA, 19 bp, Homo sapiens
cagtttctcaagtttaaag

SEQ ID NO: 2739948 - DNA, 18 bp, Homo sapiens
cagttttatccacagaaa

SEQ ID NO: 2739949 - DNA, 22 bp, Homo sapiens
cataaaactcatgactgagtct

SEQ ID NO: 2739950 - DNA, 13 bp, Homo sapiens
cataaacagtttt

SEQ ID NO: 2739951 - DNA, 24 bp, Homo sapiens
cataaagaagagccttcacatgaa

SEQ ID NO: 2739952 - DNA, 16 bp, Homo sapiens
cataaaggtatttaga

SEQ ID NO: 2739953 - DNA, 16 bp, Homo sapiens
cataaagtatgccttc

SEQ ID NO: 2739954 - DNA, 21 bp, Homo sapiens
cataaattatttctaaaacat

SEQ ID NO: 2739955 - DNA, 21 bp, Homo sapiens
cataaatttgttgtcatgtgt

SEQ ID NO: 2739956 - DNA, 21 bp, Homo sapiens
cataagtaagacttgattggt

SEQ ID NO: 2739957 - DNA, 15 bp, Homo sapiens
cataattcaccaaaa

SEQ ID NO: 2739958 - DNA, 20 bp, Homo sapiens
cataattcaccaaaagttca

SEQ ID NO: 2739959 - DNA, 15 bp, Homo sapiens
catacacatttttaa

SEQ ID NO: 2739960 - DNA, 11 bp, Homo sapiens
catacattata

SEQ ID NO: 2739961 - DNA, 13 bp, Homo sapiens
catactggcctcg

SEQ ID NO: 2739962 - DNA, 16 bp, Homo sapiens
catactggcctcgcct

SEQ ID NO: 2739963 - DNA, 19 bp, Homo sapiens
catactggcctcgcctggc

SEQ ID NO: 2739964 - DNA, 22 bp, Homo sapiens
catactggcctcgcctggcctg

SEQ ID NO: 2739965 - DNA, 17 bp, Homo sapiens
catagagatatttaaaa

SEQ ID NO: 2739966 - DNA, 16 bp, Homo sapiens
catagctcataagctg

SEQ ID NO: 2739967 - DNA, 22 bp, Homo sapiens
cataggttcacaccattttgtt

SEQ ID NO: 2739968 - DNA, 18 bp, Homo sapiens
catagtcaatcaaacagg

SEQ ID NO: 2739969 - DNA, 13 bp, Homo sapiens
catagttgaaaaa

SEQ ID NO: 2739970 - DNA, 23 bp, Homo sapiens
catagttgaaaaaagaagtttgg

SEQ ID NO: 2739971 - DNA, 21 bp, Homo sapiens
catataatttaaagaaacact

SEQ ID NO: 2739972 - DNA, 18 bp, Homo sapiens
catatatgtatatgtata

SEQ ID NO: 2739973 - DNA, 20 bp, Homo sapiens
catatatgtatatgtatatc

SEQ ID NO: 2739974 - DNA, 14 bp, Homo sapiens
catatctagtcaat

SEQ ID NO: 2739975 - DNA, 22 bp, Homo sapiens
catatgaaaaaaatgcatttta

SEQ ID NO: 2739976 - DNA, 14 bp, Homo sapiens
catatgtatctttg

SEQ ID NO: 2739977 - DNA, 13 bp, Homo sapiens
catatgtctgtct

SEQ ID NO: 2739978 - DNA, 14 bp, Homo sapiens
catattatttttaa

SEQ ID NO: 2739979 - DNA, 13 bp, Homo sapiens
catattgctctta

SEQ ID NO: 2739980 - DNA, 22 bp, Homo sapiens
catatttaataggataaattaa

SEQ ID NO: 2739981 - DNA, 12 bp, Homo sapiens
catcaaacatga

SEQ ID NO: 2739982 - DNA, 15 bp, Homo sapiens
catcaaacatgaaaa

SEQ ID NO: 2739983 - DNA, 18 bp, Homo sapiens
catcaaacatgaaaacat

SEQ ID NO: 2739984 - DNA, 21 bp, Homo sapiens
catcaaataaaccttgtttct

SEQ ID NO: 2739985 - DNA, 12 bp, Homo sapiens
catcacctcagg

SEQ ID NO: 2739986 - DNA, 15 bp, Homo sapiens
catcacctcaggcca

SEQ ID NO: 2739987 - DNA, 23 bp, Homo sapiens
catcagaagtaactcccactcct

SEQ ID NO: 2739988 - DNA, 14 bp, Homo sapiens
catcagctttttgt

SEQ ID NO: 2739989 - DNA, 18 bp, Homo sapiens
catcagctttttgtatta

SEQ ID NO: 2739990 - DNA, 21 bp, Homo sapiens
catcagtgtacccccgcccag

SEQ ID NO: 2739991 - DNA, 23 bp, Homo sapiens
catcagtgtacccccgcccaggc

SEQ ID NO: 2739992 - DNA, 17 bp, Homo sapiens
catcatctttatctcct

SEQ ID NO: 2739993 - DNA, 19 bp, Homo sapiens
catcatctttatctcctgg

SEQ ID NO: 2739994 - DNA, 13 bp, Homo sapiens
catcatttaaaca

SEQ ID NO: 2739995 - DNA, 19 bp, Homo sapiens
catccaaccccccacctgc

SEQ ID NO: 2739996 - DNA, 15 bp, Homo sapiens
catccaactcctcta

SEQ ID NO: 2739997 - DNA, 15 bp, Homo sapiens
catccagctctatgt

SEQ ID NO: 2739998 - DNA, 22 bp, Homo sapiens
catcccaggcgggcggcacgcc

SEQ ID NO: 2739999 - DNA, 13 bp, Homo sapiens
catcccccctcac

SEQ ID NO: 2740000 - DNA, 18 bp, Homo sapiens
catcccccctcaccaggg

SEQ ID NO: 2740001 - DNA, 16 bp, Homo sapiens
catcccggtgcatgca

SEQ ID NO: 2740002 - DNA, 21 bp, Homo sapiens
catccctttttttacatttca

SEQ ID NO: 2740003 - DNA, 17 bp, Homo sapiens
catcctccccaccagag

SEQ ID NO: 2740004 - DNA, 15 bp, Homo sapiens
catcctggcccatca

SEQ ID NO: 2740005 - DNA, 13 bp, Homo sapiens
catcctggctggc

SEQ ID NO: 2740006 - DNA, 16 bp, Homo sapiens
catcctggctggctgt

SEQ ID NO: 2740007 - DNA, 15 bp, Homo sapiens
catccttctgccttt

SEQ ID NO: 2740008 - DNA, 20 bp, Homo sapiens
catcgcaatagttttttact

SEQ ID NO: 2740009 - DNA, 15 bp, Homo sapiens
catcgtggctgggaa

SEQ ID NO: 2740010 - DNA, 20 bp, Homo sapiens
catctaacttcttaaagtta

SEQ ID NO: 2740011 - DNA, 15 bp, Homo sapiens
catctccctcccaca

SEQ ID NO: 2740012 - DNA, 21 bp, Homo sapiens
catctccctgaccttctccag

SEQ ID NO: 2740013 - DNA, 11 bp, Homo sapiens
catctctgagt

SEQ ID NO: 2740014 - DNA, 19 bp, Homo sapiens
catctctgagtgtctctgc

SEQ ID NO: 2740015 - DNA, 21 bp, Homo sapiens
catctctgagtgtctctgcct

SEQ ID NO: 2740016 - DNA, 23 bp, Homo sapiens
catctctgagtgtctctgcctgg

SEQ ID NO: 2740017 - DNA, 22 bp, Homo sapiens
catctgcacccagggtcccagc

SEQ ID NO: 2740018 - DNA, 14 bp, Homo sapiens
catctgcccaggac

SEQ ID NO: 2740019 - DNA, 12 bp, Homo sapiens
catctgtccatc

SEQ ID NO: 2740020 - DNA, 20 bp, Homo sapiens
catctgtgcctgtctgtcca

SEQ ID NO: 2740021 - DNA, 17 bp, Homo sapiens
catctttatctcctggg

SEQ ID NO: 2740022 - DNA, 19 bp, Homo sapiens
catgaaaaacacggcagct

SEQ ID NO: 2740023 - DNA, 21 bp, Homo sapiens
catgaaaaacacggcagctgt

SEQ ID NO: 2740024 - DNA, 22 bp, Homo sapiens
catgaaaaacacggcagctgta

SEQ ID NO: 2740025 - DNA, 14 bp, Homo sapiens
catgaaaacattga

SEQ ID NO: 2740026 - DNA, 15 bp, Homo sapiens
catgaagacaggaca

SEQ ID NO: 2740027 - DNA, 17 bp, Homo sapiens
catgaagacaggacagt

SEQ ID NO: 2740028 - DNA, 23 bp, Homo sapiens
catgactgagtctggcaaacatg

SEQ ID NO: 2740029 - DNA, 15 bp, Homo sapiens
catgacttttccatg

SEQ ID NO: 2740030 - DNA, 21 bp, Homo sapiens
catgacttttccatgtatcta

SEQ ID NO: 2740031 - DNA, 20 bp, Homo sapiens
catgagcccaaacaccctcc

SEQ ID NO: 2740032 - DNA, 21 bp, Homo sapiens
catgaggacatgatggagcgc

SEQ ID NO: 2740033 - DNA, 20 bp, Homo sapiens
catgagtggccttaataaat

SEQ ID NO: 2740034 - DNA, 18 bp, Homo sapiens
catgatggagcgcacctg

SEQ ID NO: 2740035 - DNA, 15 bp, Homo sapiens
ccatctaagctgcag

SEQ ID NO: 2740036 - DNA, 20 bp, Homo sapiens
ccatctaagctgcagcttcc

SEQ ID NO: 2740037 - DNA, 13 bp, Homo sapiens
ccatctgcccagg

SEQ ID NO: 2740038 - DNA, 12 bp, Homo sapiens
ccatctgtccat

SEQ ID NO: 2740039 - DNA, 21 bp, Homo sapiens
ccatctgtccatcctcctctc

SEQ ID NO: 2740040 - DNA, 15 bp, Homo sapiens
ccatcttccaggtgg

SEQ ID NO: 2740041 - DNA, 22 bp, Homo sapiens
ccatcttggcaaggttcagtct

SEQ ID NO: 2740042 - DNA, 16 bp, Homo sapiens
ccatgaagacaggaca

SEQ ID NO: 2740043 - DNA, 20 bp, Homo sapiens
ccatgctggcggcgcagagg

SEQ ID NO: 2740044 - DNA, 16 bp, Homo sapiens
ccatggattcccctgg

SEQ ID NO: 2740045 - DNA, 12 bp, Homo sapiens
ccatggccttcc

SEQ ID NO: 2740046 - DNA, 19 bp, Homo sapiens
ccatggcgtgtccctctcg

SEQ ID NO: 2740047 - DNA, 21 bp, Homo sapiens
ccatggcgtgtccctctcgga

SEQ ID NO: 2740048 - DNA, 20 bp, Homo sapiens
ccatggcttccaaggtggtc

SEQ ID NO: 2740049 - DNA, 14 bp, Homo sapiens
ccatgggcactgct

SEQ ID NO: 2740050 - DNA, 13 bp, Homo sapiens
ccatgggcctgct

SEQ ID NO: 2740051 - DNA, 16 bp, Homo sapiens
ccatgggcctgctgcg

SEQ ID NO: 2740052 - DNA, 21 bp, Homo sapiens
ccatgggcctgctgcgtcaga

SEQ ID NO: 2740053 - DNA, 23 bp, Homo sapiens
ccatgggcctgctgcgtcagacc

SEQ ID NO: 2740054 - DNA, 17 bp, Homo sapiens
ccatgggcgaccagggc

SEQ ID NO: 2740055 - DNA, 23 bp, Homo sapiens
ccatgggcgaccagggccatctc

SEQ ID NO: 2740056 - DNA, 17 bp, Homo sapiens
ccatggtagactgtgac

SEQ ID NO: 2740057 - DNA, 23 bp, Homo sapiens
ccatgtatagctagctatttcta

SEQ ID NO: 2740058 - DNA, 19 bp, Homo sapiens
ccatgtccaagtccaacct

SEQ ID NO: 2740059 - DNA, 16 bp, Homo sapiens
ccattattttacagtc

SEQ ID NO: 2740060 - DNA, 18 bp, Homo sapiens
ccattattttattttata

SEQ ID NO: 2740061 - DNA, 12 bp, Homo sapiens
ccattctcctgc

SEQ ID NO: 2740062 - DNA, 23 bp, Homo sapiens
ccattctcctgcctcagcctcct

SEQ ID NO: 2740063 - DNA, 13 bp, Homo sapiens
ccattgtcttcca

SEQ ID NO: 2740064 - DNA, 22 bp, Homo sapiens
ccattgtcttccaaccccagct

SEQ ID NO: 2740065 - DNA, 12 bp, Homo sapiens
ccattgtggaaa

SEQ ID NO: 2740066 - DNA, 18 bp, Homo sapiens
ccattgtggaaactggat

SEQ ID NO: 2740067 - DNA, 19 bp, Homo sapiens
ccatttaactagcacttta

SEQ ID NO: 2740068 - DNA, 16 bp, Homo sapiens
ccatttcttatttaat

SEQ ID NO: 2740069 - DNA, 22 bp, Homo sapiens
ccatttggcagaactgctgggg

SEQ ID NO: 2740070 - DNA, 12 bp, Homo sapiens
cccaacccccag

SEQ ID NO: 2740071 - DNA, 14 bp, Homo sapiens
cccaacccccagca

SEQ ID NO: 2740072 - DNA, 23 bp, Homo sapiens
cccaacctgtccttactcagagc

SEQ ID NO: 2740073 - DNA, 23 bp, Homo sapiens
cccaatccatttggcagaactgc

SEQ ID NO: 2740074 - DNA, 15 bp, Homo sapiens
cccacacacactcct

SEQ ID NO: 2740075 - DNA, 22 bp, Homo sapiens
cccacagcccacgtcctgtcag

SEQ ID NO: 2740076 - DNA, 15 bp, Homo sapiens
cccacagcccccacc

SEQ ID NO: 2740077 - DNA, 16 bp, Homo sapiens
cccacagcccccaccc

SEQ ID NO: 2740078 - DNA, 17 bp, Homo sapiens
cccacagctctgctgga

SEQ ID NO: 2740079 - DNA, 18 bp, Homo sapiens
cccacaggggggaggcac

SEQ ID NO: 2740080 - DNA, 18 bp, Homo sapiens
cccacatgaggacatgat

SEQ ID NO: 2740081 - DNA, 21 bp, Homo sapiens
cccaccaaggtctcacactcc

SEQ ID NO: 2740082 - DNA, 13 bp, Homo sapiens
cccaccagagctg

SEQ ID NO: 2740083 - DNA, 12 bp, Homo sapiens
cccaccccagca

SEQ ID NO: 2740084 - DNA, 15 bp, Homo sapiens
cccaccccagcacag

SEQ ID NO: 2740085 - DNA, 18 bp, Homo sapiens
cccaccccagcacagctc

SEQ ID NO: 2740086 - DNA, 19 bp, Homo sapiens
cccaccccagcacagctcc

SEQ ID NO: 2740087 - DNA, 16 bp, Homo sapiens
cccaccctgccccttg

SEQ ID NO: 2740088 - DNA, 21 bp, Homo sapiens
cccaccctgggtttggcccct

SEQ ID NO: 2740089 - DNA, 22 bp, Homo sapiens
cccaccctgggtttggcccctg

SEQ ID NO: 2740090 - DNA, 23 bp, Homo sapiens
cccaccctgggtttggcccctgg

SEQ ID NO: 2740091 - DNA, 18 bp, Homo sapiens
cccaccgcatgccccctc

SEQ ID NO: 2740092 - DNA, 20 bp, Homo sapiens
cccaccttcaattcctgggc

SEQ ID NO: 2740093 - DNA, 19 bp, Homo sapiens
cccacctttgggatcagcc

SEQ ID NO: 2740094 - DNA, 13 bp, Homo sapiens
cccacgtcctgtc

SEQ ID NO: 2740095 - DNA, 15 bp, Homo sapiens
cccacgtcctgtcag

SEQ ID NO: 2740096 - DNA, 14 bp, Homo sapiens
cccacgtctctctg

SEQ ID NO: 2740097 - DNA, 21 bp, Homo sapiens
cccacgtctctctgcctgctg

SEQ ID NO: 2740098 - DNA, 23 bp, Homo sapiens
cccacgtctctctgcctgctggg

SEQ ID NO: 2740099 - DNA, 12 bp, Homo sapiens
cccactcctaat

SEQ ID NO: 2740100 - DNA, 22 bp, Homo sapiens
cccactctttgctacaataaat

SEQ ID NO: 2740101 - DNA, 13 bp, Homo sapiens
cccactgccgcct

SEQ ID NO: 2740102 - DNA, 17 bp, Homo sapiens
cccactggccagtccta

SEQ ID NO: 2740103 - DNA, 21 bp, Homo sapiens
cccactggccagtcctagagc

SEQ ID NO: 2740104 - DNA, 14 bp, Homo sapiens
cccacttcccctcc

SEQ ID NO: 2740105 - DNA, 15 bp, Homo sapiens
cccacttcccctcct

SEQ ID NO: 2740106 - DNA, 20 bp, Homo sapiens
cccacttccctgacactgcg

SEQ ID NO: 2740107 - DNA, 13 bp, Homo sapiens
cccagacctctga

SEQ ID NO: 2740108 - DNA, 18 bp, Homo sapiens
cccagagggcccaggcag

SEQ ID NO: 2740109 - DNA, 17 bp, Homo sapiens
cccagcacagctcctcc

SEQ ID NO: 2740110 - DNA, 19 bp, Homo sapiens
cccagcacagctcctcccc

SEQ ID NO: 2740111 - DNA, 22 bp, Homo sapiens
cccagcacccgggctcagggac

SEQ ID NO: 2740112 - DNA, 20 bp, Homo sapiens
cccagcatctcagagtccag

SEQ ID NO: 2740113 - DNA, 14 bp, Homo sapiens
cccagccactgcag

SEQ ID NO: 2740114 - DNA, 15 bp, Homo sapiens
cccagccactgcagc

SEQ ID NO: 2740115 - DNA, 17 bp, Homo sapiens
cccagccgctgcccggc

SEQ ID NO: 2740116 - DNA, 19 bp, Homo sapiens
cccagcctcccagctttct

SEQ ID NO: 2740117 - DNA, 13 bp, Homo sapiens
cccagcctgagtg

SEQ ID NO: 2740118 - DNA, 10 bp, Homo sapiens
cccagcctgg

SEQ ID NO: 2740119 - DNA, 12 bp, Homo sapiens
cccagcctggcc

SEQ ID NO: 2740120 - DNA, 18 bp, Homo sapiens
cccagcctggcccagctc

SEQ ID NO: 2740121 - DNA, 14 bp, Homo sapiens
cccagcctgtcctg

SEQ ID NO: 2740122 - DNA, 15 bp, Homo sapiens
cccagcctgtcctgg

SEQ ID NO: 2740123 - DNA, 18 bp, Homo sapiens
cccagcgctggctccagg

SEQ ID NO: 2740124 - DNA, 18 bp, Homo sapiens
cccagcggcagatgggcc

SEQ ID NO: 2740125 - DNA, 17 bp, Homo sapiens
cccagctactcagaagc

SEQ ID NO: 2740126 - DNA, 22 bp, Homo sapiens
cccagctactcagaagcctgag

SEQ ID NO: 2740127 - DNA, 16 bp, Homo sapiens
cccagctagggctgga

SEQ ID NO: 2740128 - DNA, 13 bp, Homo sapiens
cccagctctggct

SEQ ID NO: 2740129 - DNA, 19 bp, Homo sapiens
cccagctgacagtcctctc

SEQ ID NO: 2740130 - DNA, 21 bp, Homo sapiens
cccagctgacagtcctctcca

SEQ ID NO: 2740131 - DNA, 21 bp, Homo sapiens
cccagctgcacctgccagcct

SEQ ID NO: 2740132 - DNA, 13 bp, Homo sapiens
cccagctggcctc

SEQ ID NO: 2740133 - DNA, 16 bp, Homo sapiens
cccagctggcctctag

SEQ ID NO: 2740134 - DNA, 18 bp, Homo sapiens
cccagctggcctctagaa

SEQ ID NO: 2740135 - DNA, 20 bp, Homo sapiens
cccagctttctgtgtgcaca

SEQ ID NO: 2740136 - DNA, 20 bp, Homo sapiens
cccaggaagggagggagctg

SEQ ID NO: 2740137 - DNA, 24 bp, Homo sapiens
cccaggaagggagggagctgaggc

SEQ ID NO: 2740138 - DNA, 15 bp, Homo sapiens
cccaggacggggccg

SEQ ID NO: 2740139 - DNA, 17 bp, Homo sapiens
cccaggacggggccggc

SEQ ID NO: 2740140 - DNA, 22 bp, Homo sapiens
cccaggagtttgaggctgcagc

SEQ ID NO: 2740141 - DNA, 14 bp, Homo sapiens
cccaggattcccag

SEQ ID NO: 2740142 - DNA, 16 bp, Homo sapiens
cccaggccacagccag

SEQ ID NO: 2740143 - DNA, 18 bp, Homo sapiens
cccaggccatcttccagg

SEQ ID NO: 2740144 - DNA, 20 bp, Homo sapiens
cccaggccatcttccaggtg

SEQ ID NO: 2740145 - DNA, 22 bp, Homo sapiens
cccaggccatcttccaggtggg

SEQ ID NO: 2740146 - DNA, 19 bp, Homo sapiens
cccaggctagagtgcagtg

SEQ ID NO: 2740147 - DNA, 19 bp, Homo sapiens
cccaggctggagtgcaatg

SEQ ID NO: 2740148 - DNA, 13 bp, Homo sapiens
cccaggctggcca

SEQ ID NO: 2740149 - DNA, 19 bp, Homo sapiens
cccaggctggccagcccca

SEQ ID NO: 2740150 - DNA, 23 bp, Homo sapiens
cccaggctggccagccccacagc

SEQ ID NO: 2740151 - DNA, 16 bp, Homo sapiens
cccagggtcccagcct

SEQ ID NO: 2740152 - DNA, 17 bp, Homo sapiens
cccagtgagcctctgcg

SEQ ID NO: 2740153 - DNA, 15 bp, Homo sapiens
cccagtgctcctgtg

SEQ ID NO: 2740154 - DNA, 16 bp, Homo sapiens
cccagtgctcctgtgc

SEQ ID NO: 2740155 - DNA, 20 bp, Homo sapiens
cccagtgtcttcctgtgggg

SEQ ID NO: 2740156 - DNA, 16 bp, Homo sapiens
cccagtgtgtgctcag

SEQ ID NO: 2740157 - DNA, 21 bp, Homo sapiens
cccagtgtgtgctcagcagcc

SEQ ID NO: 2740158 - DNA, 16 bp, Homo sapiens
ccgggtgccattccca

SEQ ID NO: 2740159 - DNA, 19 bp, Homo sapiens
ccgggtggggggagggcac

SEQ ID NO: 2740160 - DNA, 15 bp, Homo sapiens
ccggtaccagcctga

SEQ ID NO: 2740161 - DNA, 19 bp, Homo sapiens
ccgtagtcctttttgtaac

SEQ ID NO: 2740162 - DNA, 15 bp, Homo sapiens
ccgtattagccagga

SEQ ID NO: 2740163 - DNA, 14 bp, Homo sapiens
ccgtccctcctgtt

SEQ ID NO: 2740164 - DNA, 10 bp, Homo sapiens
ccgtccctga

SEQ ID NO: 2740165 - DNA, 22 bp, Homo sapiens
ccgtcttggggctcgccccacc

SEQ ID NO: 2740166 - DNA, 15 bp, Homo sapiens
ccgtgagcccttggt

SEQ ID NO: 2740167 - DNA, 18 bp, Homo sapiens
ccgtgcagccacgaacac

SEQ ID NO: 2740168 - DNA, 16 bp, Homo sapiens
ccgtggccccagcctg

SEQ ID NO: 2740169 - DNA, 19 bp, Homo sapiens
ccgtggccccagcctggcc

SEQ ID NO: 2740170 - DNA, 22 bp, Homo sapiens
ccgtggctccagaatgtgctgc

SEQ ID NO: 2740171 - DNA, 12 bp, Homo sapiens
ccgtttacagtg

SEQ ID NO: 2740172 - DNA, 14 bp, Homo sapiens
cctaaagtctcagg

SEQ ID NO: 2740173 - DNA, 20 bp, Homo sapiens
cctaatcaagagtctctcca

SEQ ID NO: 2740174 - DNA, 14 bp, Homo sapiens
cctaattcctggca

SEQ ID NO: 2740175 - DNA, 13 bp, Homo sapiens
cctacccactctt

SEQ ID NO: 2740176 - DNA, 14 bp, Homo sapiens
cctacccactcttt

SEQ ID NO: 2740177 - DNA, 17 bp, Homo sapiens
cctacccctcccagctg

SEQ ID NO: 2740178 - DNA, 13 bp, Homo sapiens
cctaccgcatggc

SEQ ID NO: 2740179 - DNA, 19 bp, Homo sapiens
cctaccgcatggcagctgg

SEQ ID NO: 2740180 - DNA, 22 bp, Homo sapiens
cctaccgcatggcagctgggcc

SEQ ID NO: 2740181 - DNA, 13 bp, Homo sapiens
cctacctcagcct

SEQ ID NO: 2740182 - DNA, 16 bp, Homo sapiens
cctacctcagcctaga

SEQ ID NO: 2740183 - DNA, 18 bp, Homo sapiens
cctacctcagcctagacc

SEQ ID NO: 2740184 - DNA, 17 bp, Homo sapiens
cctactgcttcctctga

SEQ ID NO: 2740185 - DNA, 17 bp, Homo sapiens
cctagagctcctgtccc

SEQ ID NO: 2740186 - DNA, 15 bp, Homo sapiens
cctagatccaggctt

SEQ ID NO: 2740187 - DNA, 23 bp, Homo sapiens
cctagctcttgggcctgacctcc

SEQ ID NO: 2740188 - DNA, 14 bp, Homo sapiens
cctaggagtacaag

SEQ ID NO: 2740189 - DNA, 16 bp, Homo sapiens
cctaggattcctcccc

SEQ ID NO: 2740190 - DNA, 18 bp, Homo sapiens
cctagtggctgtccagtg

SEQ ID NO: 2740191 - DNA, 19 bp, Homo sapiens
cctagtggctgtccagtgc

SEQ ID NO: 2740192 - DNA, 21 bp, Homo sapiens
cctagtggctgtccagtgccc

SEQ ID NO: 2740193 - DNA, 23 bp, Homo sapiens
  misc_feature (5)..(5): n is a, c, g or t
  misc_feature (12)..(12): n is a, c, g or t
cctanccccccnacccccagtgt

SEQ ID NO: 2740194 - DNA, 14 bp, Homo sapiens
cctatagtcccagc

SEQ ID NO: 2740195 - DNA, 12 bp, Homo sapiens
cctatcagtgtg

SEQ ID NO: 2740196 - DNA, 13 bp, Homo sapiens
cctatgatcccag

SEQ ID NO: 2740197 - DNA, 15 bp, Homo sapiens
cctatgatcccagca

SEQ ID NO: 2740198 - DNA, 18 bp, Homo sapiens
cctatggcccagccactg

SEQ ID NO: 2740199 - DNA, 20 bp, Homo sapiens
cctatggcccagccactgca

SEQ ID NO: 2740200 - DNA, 14 bp, Homo sapiens
cctcaaaccctgtg

SEQ ID NO: 2740201 - DNA, 16 bp, Homo sapiens
cctcaaggcctcccac

SEQ ID NO: 2740202 - DNA, 17 bp, Homo sapiens
cctcaaggcctcccaca

SEQ ID NO: 2740203 - DNA, 19 bp, Homo sapiens
cctcaaggcctcccacagt

SEQ ID NO: 2740204 - DNA, 20 bp, Homo sapiens
cctcaaggcctcccacagtg

SEQ ID NO: 2740205 - DNA, 21 bp, Homo sapiens
cctcaaggcctcccacagtga

SEQ ID NO: 2740206 - DNA, 17 bp, Homo sapiens
cctcacagactcttcca

SEQ ID NO: 2740207 - DNA, 18 bp, Homo sapiens
cctcacagactcttccac

SEQ ID NO: 2740208 - DNA, 17 bp, Homo sapiens
cctcacagatgctggcc

SEQ ID NO: 2740209 - DNA, 21 bp, Homo sapiens
cctcacagatgctggcctctt

SEQ ID NO: 2740210 - DNA, 22 bp, Homo sapiens
cctcacagatgctggcctcttg

SEQ ID NO: 2740211 - DNA, 15 bp, Homo sapiens
cctcacagcatctct

SEQ ID NO: 2740212 - DNA, 20 bp, Homo sapiens
cctcaccaggggcaggcaca

SEQ ID NO: 2740213 - DNA, 22 bp, Homo sapiens
cctcaccaggggcaggcacagc

SEQ ID NO: 2740214 - DNA, 16 bp, Homo sapiens
cctcacctgagagcca

SEQ ID NO: 2740215 - DNA, 15 bp, Homo sapiens
cctcacgctctggac

SEQ ID NO: 2740216 - DNA, 17 bp, Homo sapiens
cctcacgtgaccagccc

SEQ ID NO: 2740217 - DNA, 17 bp, Homo sapiens
cctcagccagccctgga

SEQ ID NO: 2740218 - DNA, 19 bp, Homo sapiens
cctcagcctagaccctcct

SEQ ID NO: 2740219 - DNA, 22 bp, Homo sapiens
cctcagcctcctgagtagctgg

SEQ ID NO: 2740220 - DNA, 12 bp, Homo sapiens
cctcagctgcct

SEQ ID NO: 2740221 - DNA, 21 bp, Homo sapiens
cctcagcttcccaagtagctg

SEQ ID NO: 2740222 - DNA, 17 bp, Homo sapiens
cctcaggattgtttctc

SEQ ID NO: 2740223 - DNA, 15 bp, Homo sapiens
cctcaggggaagctg

SEQ ID NO: 2740224 - DNA, 16 bp, Homo sapiens
cctcaggggaagctgc

SEQ ID NO: 2740225 - DNA, 19 bp, Homo sapiens
cctcaggtagtactgggaa

SEQ ID NO: 2740226 - DNA, 12 bp, Homo sapiens
cctcatacagaa

SEQ ID NO: 2740227 - DNA, 13 bp, Homo sapiens
cctcatcctcctc

SEQ ID NO: 2740228 - DNA, 18 bp, Homo sapiens
cctcatcctcctcctcat

SEQ ID NO: 2740229 - DNA, 16 bp, Homo sapiens
cctcatctgtgcctgt

SEQ ID NO: 2740230 - DNA, 17 bp, Homo sapiens
cctcatctgtgcctgtc

SEQ ID NO: 2740231 - DNA, 18 bp, Homo sapiens
cctcatctgtgcctgtct

SEQ ID NO: 2740232 - DNA, 16 bp, Homo sapiens
cctccaaacactgggc

SEQ ID NO: 2740233 - DNA, 20 bp, Homo sapiens
cctccaacaataaagagctc

SEQ ID NO: 2740234 - DNA, 21 bp, Homo sapiens
cctccaccctaaagtctcagg

SEQ ID NO: 2740235 - DNA, 23 bp, Homo sapiens
cctccaccctaaagtctcaggtg

SEQ ID NO: 2740236 - DNA, 14 bp, Homo sapiens
cctccacctcctgg

SEQ ID NO: 2740237 - DNA, 14 bp, Homo sapiens
cctccactcccact

SEQ ID NO: 2740238 - DNA, 15 bp, Homo sapiens
cctccactcccactt

SEQ ID NO: 2740239 - DNA, 21 bp, Homo sapiens
cctccagactgcggagcagcc

SEQ ID NO: 2740240 - DNA, 13 bp, Homo sapiens
cctccagtcctgc

SEQ ID NO: 2740241 - DNA, 17 bp, Homo sapiens
cctccagtcctgctggc

SEQ ID NO: 2740242 - DNA, 22 bp, Homo sapiens
cctccagtcctgctggcctgct

SEQ ID NO: 2740243 - DNA, 21 bp, Homo sapiens
cctccagtgctggctgctggc

SEQ ID NO: 2740244 - DNA, 14 bp, Homo sapiens
cctcccaaagtgct

SEQ ID NO: 2740245 - DNA, 13 bp, Homo sapiens
cctcccacagtga

SEQ ID NO: 2740246 - DNA, 23 bp, Homo sapiens
cctcccacagtgactcgggctcc

SEQ ID NO: 2740247 - DNA, 15 bp, Homo sapiens
cctcccaccagtggc

SEQ ID NO: 2740248 - DNA, 12 bp, Homo sapiens
cctcccagctga

SEQ ID NO: 2740249 - DNA, 14 bp, Homo sapiens
cctcccagctttct

SEQ ID NO: 2740250 - DNA, 20 bp, Homo sapiens
cctcccagctttctgtgtgc

SEQ ID NO: 2740251 - DNA, 12 bp, Homo sapiens
cctcccatggcc

SEQ ID NO: 2740252 - DNA, 21 bp, Homo sapiens
cctcccattttagaaaatcag

SEQ ID NO: 2740253 - DNA, 13 bp, Homo sapiens
cctccccaatcca

SEQ ID NO: 2740254 - DNA, 13 bp, Homo sapiens
cctccccacagtc

SEQ ID NO: 2740255 - DNA, 17 bp, Homo sapiens
cctccccaccagagctg

SEQ ID NO: 2740256 - DNA, 20 bp, Homo sapiens
cctccccaccagagctgcct

SEQ ID NO: 2740257 - DNA, 23 bp, Homo sapiens
cctccccaccagagctgcctccc

SEQ ID NO: 2740258 - DNA, 22 bp, Homo sapiens
cctcccccacgtctctctgcct

SEQ ID NO: 2740259 - DNA, 15 bp, Homo sapiens
cctcccccagagcca

SEQ ID NO: 2740260 - DNA, 17 bp, Homo sapiens
cctcccccagagccact

SEQ ID NO: 2740261 - DNA, 21 bp, Homo sapiens
cctccccctaccgcatggcag

SEQ ID NO: 2740262 - DNA, 13 bp, Homo sapiens
cctcccctcccgt

SEQ ID NO: 2740263 - DNA, 15 bp, Homo sapiens
cctcccctcccgtct

SEQ ID NO: 2740264 - DNA, 15 bp, Homo sapiens
cctcccctgccgcct

SEQ ID NO: 2740265 - DNA, 16 bp, Homo sapiens
cctccctagatccagg

SEQ ID NO: 2740266 - DNA, 18 bp, Homo sapiens
cctccctagatccaggct

SEQ ID NO: 2740267 - DNA, 15 bp, Homo sapiens
cctccctctgcctca

SEQ ID NO: 2740268 - DNA, 18 bp, Homo sapiens
cctccctctgcctcatcc

SEQ ID NO: 2740269 - DNA, 21 bp, Homo sapiens
cctccctgctgtcccctcttg

SEQ ID NO: 2740270 - DNA, 21 bp, Homo sapiens
cctcccttgagtaggccctgc

SEQ ID NO: 2740271 - DNA, 18 bp, Homo sapiens
cctccgcctagaggtccc

SEQ ID NO: 2740272 - DNA, 16 bp, Homo sapiens
cctcctacccctccca

SEQ ID NO: 2740273 - DNA, 17 bp, Homo sapiens
cctcctacccctcccag

SEQ ID NO: 2740274 - DNA, 18 bp, Homo sapiens
cctcctacccctcccagc

SEQ ID NO: 2740275 - DNA, 20 bp, Homo sapiens
cctcctacccctcccagctg

SEQ ID NO: 2740276 - DNA, 23 bp, Homo sapiens
cctcctatccttggagagcagct

SEQ ID NO: 2740277 - DNA, 14 bp, Homo sapiens
cctcctcacactcc

SEQ ID NO: 2740278 - DNA, 16 bp, Homo sapiens
cctcctcattcagacc

SEQ ID NO: 2740279 - DNA, 12 bp, Homo sapiens
cctcctcctcat

SEQ ID NO: 2740280 - DNA, 12 bp, Homo sapiens
cctcctctccat

SEQ ID NO: 2740281 - DNA, 22 bp, Homo sapiens
cctcctctccatgcaagtgctg

SEQ ID NO: 2740282 - DNA, 22 bp, Homo sapiens
cgtgatgctatgcatgtctgac

SEQ ID NO: 2740283 - DNA, 21 bp, Homo sapiens
cgtgatttggaagagaggcac

SEQ ID NO: 2740284 - DNA, 15 bp, Homo sapiens
cgtgcacctgtactc

SEQ ID NO: 2740285 - DNA, 16 bp, Homo sapiens
cgtgctgcctctcttc

SEQ ID NO: 2740286 - DNA, 12 bp, Homo sapiens
cgtggccccagc

SEQ ID NO: 2740287 - DNA, 14 bp, Homo sapiens
cgtggccccagcct

SEQ ID NO: 2740288 - DNA, 15 bp, Homo sapiens
cgtggccccagcctg

SEQ ID NO: 2740289 - DNA, 16 bp, Homo sapiens
cgtggccccagcctgg

SEQ ID NO: 2740290 - DNA, 18 bp, Homo sapiens
cgtggccccagcctggcc

SEQ ID NO: 2740291 - DNA, 19 bp, Homo sapiens
cgtggccccagcctggccc

SEQ ID NO: 2740292 - DNA, 20 bp, Homo sapiens
cgtggccccagcctggccca

SEQ ID NO: 2740293 - DNA, 15 bp, Homo sapiens
cgtggggcagcagct

SEQ ID NO: 2740294 - DNA, 14 bp, Homo sapiens
cgtggtagaagcca

SEQ ID NO: 2740295 - DNA, 17 bp, Homo sapiens
cgtggtagaagccagta

SEQ ID NO: 2740296 - DNA, 16 bp, Homo sapiens
cgtgtaatattctctg

SEQ ID NO: 2740297 - DNA, 18 bp, Homo sapiens
cgtgtagccccgggctga

SEQ ID NO: 2740298 - DNA, 22 bp, Homo sapiens
cgtgtagccccgggctgaccca

SEQ ID NO: 2740299 - DNA, 12 bp, Homo sapiens
cgtgtgcccacc

SEQ ID NO: 2740300 - DNA, 14 bp, Homo sapiens
cgtgtgcccaccag

SEQ ID NO: 2740301 - DNA, 15 bp, Homo sapiens
cgtgtgttccccagc

SEQ ID NO: 2740302 - DNA, 23 bp, Homo sapiens
cgtgttcacaccattctcctgcc

SEQ ID NO: 2740303 - DNA, 18 bp, Homo sapiens
cgttgtctccctggccct

SEQ ID NO: 2740304 - DNA, 23 bp, Homo sapiens
cgtttttataaaaaatggtgcct

SEQ ID NO: 2740305 - DNA, 18 bp, Homo sapiens
ctaaaacattaattgagg

SEQ ID NO: 2740306 - DNA, 17 bp, Homo sapiens
ctaaaatgtttaattca

SEQ ID NO: 2740307 - DNA, 20 bp, Homo sapiens
ctaaaatgtttaattcatta

SEQ ID NO: 2740308 - DNA, 18 bp, Homo sapiens
ctaaacagatgtccctga

SEQ ID NO: 2740309 - DNA, 21 bp, Homo sapiens
ctaaagctctgaacaaaagct

SEQ ID NO: 2740310 - DNA, 14 bp, Homo sapiens
ctaaagtctcaggt

SEQ ID NO: 2740311 - DNA, 14 bp, Homo sapiens
ctaaagtttacagt

SEQ ID NO: 2740312 - DNA, 17 bp, Homo sapiens
ctaaattagtttaaaat

SEQ ID NO: 2740313 - DNA, 23 bp, Homo sapiens
ctaacaatatgattgcactaaat

SEQ ID NO: 2740314 - DNA, 16 bp, Homo sapiens
ctaacgaacgttttaa

SEQ ID NO: 2740315 - DNA, 14 bp, Homo sapiens
ctaagcctgttgct

SEQ ID NO: 2740316 - DNA, 14 bp, Homo sapiens
ctaagctgcagctt

SEQ ID NO: 2740317 - DNA, 17 bp, Homo sapiens
ctaagctgcagcttcct

SEQ ID NO: 2740318 - DNA, 19 bp, Homo sapiens
ctaagctgcagcttcctgt

SEQ ID NO: 2740319 - DNA, 14 bp, Homo sapiens
ctaagctttctcct

SEQ ID NO: 2740320 - DNA, 15 bp, Homo sapiens
ctaagctttctcctt

SEQ ID NO: 2740321 - DNA, 17 bp, Homo sapiens
ctaagctttctcctttg

SEQ ID NO: 2740322 - DNA, 19 bp, Homo sapiens
ctaaggaagacacagccca

SEQ ID NO: 2740323 - DNA, 22 bp, Homo sapiens
ctaaggaagacacagcccagac

SEQ ID NO: 2740324 - DNA, 19 bp, Homo sapiens
ctaagtcatggtcctggct

SEQ ID NO: 2740325 - DNA, 20 bp, Homo sapiens
ctaagtcatggtcctggctg

SEQ ID NO: 2740326 - DNA, 22 bp, Homo sapiens
ctaagtcatggtcctggctgga

SEQ ID NO: 2740327 - DNA, 17 bp, Homo sapiens
ctaagtgtggatgttca

SEQ ID NO: 2740328 - DNA, 19 bp, Homo sapiens
ctaagtgtggatgttcaga

SEQ ID NO: 2740329 - DNA, 21 bp, Homo sapiens
ctaatcaagagtctctccagc

SEQ ID NO: 2740330 - DNA, 18 bp, Homo sapiens
ctaatccatgtgctgctg

SEQ ID NO: 2740331 - DNA, 17 bp, Homo sapiens
ctaatgaagtgtttcct

SEQ ID NO: 2740332 - DNA, 14 bp, Homo sapiens
ctaatttattttgt

SEQ ID NO: 2740333 - DNA, 11 bp, Homo sapiens
ctacaataaat

SEQ ID NO: 2740334 - DNA, 15 bp, Homo sapiens
ctacaataaatgctg

SEQ ID NO: 2740335 - DNA, 20 bp, Homo sapiens
ctacaataaatgctgaatga

SEQ ID NO: 2740336 - DNA, 18 bp, Homo sapiens
ctacacaacatgtatgtg

SEQ ID NO: 2740337 - DNA, 21 bp, Homo sapiens
ctacacacccccaagccacag

SEQ ID NO: 2740338 - DNA, 12 bp, Homo sapiens
ctacccactctt

SEQ ID NO: 2740339 - DNA, 14 bp, Homo sapiens
ctacccactctttg

SEQ ID NO: 2740340 - DNA, 16 bp, Homo sapiens
ctacccactctttgct

SEQ ID NO: 2740341 - DNA, 21 bp, Homo sapiens
ctacccactctttgctacaat

SEQ ID NO: 2740342 - DNA, 18 bp, Homo sapiens
ctacccagtcatgtactg

SEQ ID NO: 2740343 - DNA, 13 bp, Homo sapiens
ctacccctcccag

SEQ ID NO: 2740344 - DNA, 16 bp, Homo sapiens
ctaccctccctgctgt

SEQ ID NO: 2740345 - DNA, 12 bp, Homo sapiens
ctaccctgcagc

SEQ ID NO: 2740346 - DNA, 12 bp, Homo sapiens
ctaccgcatggc

SEQ ID NO: 2740347 - DNA, 14 bp, Homo sapiens
ctaccgcatggcag

SEQ ID NO: 2740348 - DNA, 21 bp, Homo sapiens
ctaccgcatggcagctgggcc

SEQ ID NO: 2740349 - DNA, 22 bp, Homo sapiens
ctacctcactattcaagtatta

SEQ ID NO: 2740350 - DNA, 12 bp, Homo sapiens
ctacctcagcct

SEQ ID NO: 2740351 - DNA, 15 bp, Homo sapiens
ctacctcagcctaga

SEQ ID NO: 2740352 - DNA, 19 bp, Homo sapiens
ctaccttaaaatgtaaaac

SEQ ID NO: 2740353 - DNA, 19 bp, Homo sapiens
ctacctttttttctctcct

SEQ ID NO: 2740354 - DNA, 18 bp, Homo sapiens
ctactaacctgacatcac

SEQ ID NO: 2740355 - DNA, 13 bp, Homo sapiens
ctactcagaagcc

SEQ ID NO: 2740356 - DNA, 17 bp, Homo sapiens
ctactcagaagcctgag

SEQ ID NO: 2740357 - DNA, 19 bp, Homo sapiens
ctactcagaagcctgaggc

SEQ ID NO: 2740358 - DNA, 15 bp, Homo sapiens
ctactcctacctcag

SEQ ID NO: 2740359 - DNA, 17 bp, Homo sapiens
ctactcctacctcagcc

SEQ ID NO: 2740360 - DNA, 18 bp, Homo sapiens
ctactcctacctcagcct

SEQ ID NO: 2740361 - DNA, 17 bp, Homo sapiens
ctactctcttgccagca

SEQ ID NO: 2740362 - DNA, 20 bp, Homo sapiens
ctactcttaaatgagaaagg

SEQ ID NO: 2740363 - DNA, 19 bp, Homo sapiens
ctacttgatatttccttca

SEQ ID NO: 2740364 - DNA, 18 bp, Homo sapiens
ctacttttgcatgaaaat

SEQ ID NO: 2740365 - DNA, 18 bp, Homo sapiens
ctagaaatcacaagaaca

SEQ ID NO: 2740366 - DNA, 17 bp, Homo sapiens
ctagaacacccactggc

SEQ ID NO: 2740367 - DNA, 19 bp, Homo sapiens
ctagaacacccactggcca

SEQ ID NO: 2740368 - DNA, 21 bp, Homo sapiens
ctagaacacccactggccagt

SEQ ID NO: 2740369 - DNA, 20 bp, Homo sapiens
ctagaatggtttttgttgag

SEQ ID NO: 2740370 - DNA, 18 bp, Homo sapiens
ctagacattattttgtat

SEQ ID NO: 2740371 - DNA, 17 bp, Homo sapiens
ctagagctcctgtccct

SEQ ID NO: 2740372 - DNA, 19 bp, Homo sapiens
ctagagctcctgtccctac

SEQ ID NO: 2740373 - DNA, 12 bp, Homo sapiens
ctagagtgacag

SEQ ID NO: 2740374 - DNA, 21 bp, Homo sapiens
ctagagtgactctacctgcaa

SEQ ID NO: 2740375 - DNA, 15 bp, Homo sapiens
ctagagtgcagtggc

SEQ ID NO: 2740376 - DNA, 15 bp, Homo sapiens
ctagattctcacctg

SEQ ID NO: 2740377 - DNA, 23 bp, Homo sapiens
ctagcagagcaggggcagggtga

SEQ ID NO: 2740378 - DNA, 15 bp, Homo sapiens
ctagcaggcatgccg

SEQ ID NO: 2740379 - DNA, 18 bp, Homo sapiens
ctagctaaaaccaaagga

SEQ ID NO: 2740380 - DNA, 13 bp, Homo sapiens
ctagctatttcta

SEQ ID NO: 2740381 - DNA, 16 bp, Homo sapiens
ctagctcttgggcctg

SEQ ID NO: 2740382 - DNA, 21 bp, Homo sapiens
ctagctcttgggcctgacctc

SEQ ID NO: 2740383 - DNA, 14 bp, Homo sapiens
ctaggactctgagg

SEQ ID NO: 2740384 - DNA, 15 bp, Homo sapiens
ctaggactctgaggc

SEQ ID NO: 2740385 - DNA, 15 bp, Homo sapiens
ctaggattcctcccc

SEQ ID NO: 2740386 - DNA, 17 bp, Homo sapiens
ctaggattcctccccca

SEQ ID NO: 2740387 - DNA, 22 bp, Homo sapiens
ctaggattcctcccccagagcc

SEQ ID NO: 2740388 - DNA, 20 bp, Homo sapiens
ctagggcctcggaggctcct

SEQ ID NO: 2740389 - DNA, 23 bp, Homo sapiens
ctagggcctcggaggctcctccc

SEQ ID NO: 2740390 - DNA, 16 bp, Homo sapiens
ctaggggaaggactgg

SEQ ID NO: 2740391 - DNA, 23 bp, Homo sapiens
ctaggggaaggactggccgtggc

SEQ ID NO: 2740392 - DNA, 15 bp, Homo sapiens
ctagtagaacaatgt

SEQ ID NO: 2740393 - DNA, 17 bp, Homo sapiens
ctagtatctattgtgtt

SEQ ID NO: 2740394 - DNA, 21 bp, Homo sapiens
ctagtatctattgtgttggct

SEQ ID NO: 2740395 - DNA, 17 bp, Homo sapiens
ctagtcaataactctga

SEQ ID NO: 2740396 - DNA, 18 bp, Homo sapiens
ctagtctcttctcagagc

SEQ ID NO: 2740397 - DNA, 20 bp, Homo sapiens
ctagtctcttctcagagcag

SEQ ID NO: 2740398 - DNA, 21 bp, Homo sapiens
ctagtctcttctcagagcagc

SEQ ID NO: 2740399 - DNA, 18 bp, Homo sapiens
ctagtgccctccacagcc

SEQ ID NO: 2740400 - DNA, 20 bp, Homo sapiens
ctagtggctgtccagtgccc

SEQ ID NO: 2740401 - DNA, 21 bp, Homo sapiens
ctagttgattgcgagaatttt

SEQ ID NO: 2740402 - DNA, 12 bp, Homo sapiens
ctagttgcattt

SEQ ID NO: 2740403 - DNA, 14 bp, Homo sapiens
ctataaacatgaag

SEQ ID NO: 2740404 - DNA, 20 bp, Homo sapiens
ctatattccgggtgccattc

SEQ ID NO: 2740405 - DNA, 13 bp, Homo sapiens
ctatatttattta

SEQ ID NO: 2740406 - DNA, 23 bp, Homo sapiens
ctgagagctctctcttctctgtt

SEQ ID NO: 2740407 - DNA, 19 bp, Homo sapiens
ctgagatactgaagtgcag

SEQ ID NO: 2740408 - DNA, 18 bp, Homo sapiens
ctgagattctttaaggag

SEQ ID NO: 2740409 - DNA, 15 bp, Homo sapiens
ctgagatttcacagg

SEQ ID NO: 2740410 - DNA, 24 bp, Homo sapiens
ctgagcaacagagtgagaccctgt

SEQ ID NO: 2740411 - DNA, 13 bp, Homo sapiens
ctgagccctggca

SEQ ID NO: 2740412 - DNA, 18 bp, Homo sapiens
ctgaggagtgtcctgtct

SEQ ID NO: 2740413 - DNA, 20 bp, Homo sapiens
ctgaggatcccctgtcccct

SEQ ID NO: 2740414 - DNA, 22 bp, Homo sapiens
ctgaggatcccctgtcccctgg

SEQ ID NO: 2740415 - DNA, 13 bp, Homo sapiens
ctgaggcaccaga

SEQ ID NO: 2740416 - DNA, 22 bp, Homo sapiens
ctgaggctgggggcgggggagc

SEQ ID NO: 2740417 - DNA, 18 bp, Homo sapiens
ctgaggctggtagcagaa

SEQ ID NO: 2740418 - DNA, 19 bp, Homo sapiens
ctgaggctggtagcagaat

SEQ ID NO: 2740419 - DNA, 13 bp, Homo sapiens
ctgagggcatctc

SEQ ID NO: 2740420 - DNA, 21 bp, Homo sapiens
ctgaggggaggatcactggag

SEQ ID NO: 2740421 - DNA, 22 bp, Homo sapiens
ctgaggggaggatcactggagc

SEQ ID NO: 2740422 - DNA, 23 bp, Homo sapiens
ctgaggggaggatcactggagcc

SEQ ID NO: 2740423 - DNA, 19 bp, Homo sapiens
ctgaggtctcgctgatgct

SEQ ID NO: 2740424 - DNA, 20 bp, Homo sapiens
ctgagtcacccatgaagaca

SEQ ID NO: 2740425 - DNA, 22 bp, Homo sapiens
ctgagtcacccatgaagacagg

SEQ ID NO: 2740426 - DNA, 21 bp, Homo sapiens
ctgagtcacccctctgtccag

SEQ ID NO: 2740427 - DNA, 22 bp, Homo sapiens
ctgagtctgctatattttcatg

SEQ ID NO: 2740428 - DNA, 17 bp, Homo sapiens
ctgagtctggcaaacat

SEQ ID NO: 2740429 - DNA, 18 bp, Homo sapiens
ctgagtctggcaaacatg

SEQ ID NO: 2740430 - DNA, 21 bp, Homo sapiens
ctgagtctggcaaacatgtgc

SEQ ID NO: 2740431 - DNA, 19 bp, Homo sapiens
ctgagtgtctctgcctgga

SEQ ID NO: 2740432 - DNA, 22 bp, Homo sapiens
ctgagtgtctctgcctggagca

SEQ ID NO: 2740433 - DNA, 20 bp, Homo sapiens
ctgatatctgtttgcttcta

SEQ ID NO: 2740434 - DNA, 22 bp, Homo sapiens
ctgatcattacatggctgtggt

SEQ ID NO: 2740435 - DNA, 15 bp, Homo sapiens
ctgatgatggaaggg

SEQ ID NO: 2740436 - DNA, 16 bp, Homo sapiens
ctgatgcattcccggt

SEQ ID NO: 2740437 - DNA, 15 bp, Homo sapiens
ctgatgctgggctgg

SEQ ID NO: 2740438 - DNA, 16 bp, Homo sapiens
ctgatggtgctcacga

SEQ ID NO: 2740439 - DNA, 17 bp, Homo sapiens
ctgattcggctgtctca

SEQ ID NO: 2740440 - DNA, 14 bp, Homo sapiens
ctgattttttaaat

SEQ ID NO: 2740441 - DNA, 11 bp, Homo sapiens
ctgcaacatgg

SEQ ID NO: 2740442 - DNA, 12 bp, Homo sapiens
ctgcaacatgga

SEQ ID NO: 2740443 - DNA, 16 bp, Homo sapiens
ctgcaagaggctcctg

SEQ ID NO: 2740444 - DNA, 14 bp, Homo sapiens
ctgcaagatttcac

SEQ ID NO: 2740445 - DNA, 15 bp, Homo sapiens
ctgcaagatttcaca

SEQ ID NO: 2740446 - DNA, 19 bp, Homo sapiens
ctgcaagctctgcctcccg

SEQ ID NO: 2740447 - DNA, 20 bp, Homo sapiens
ctgcaagctctgcctcccgt

SEQ ID NO: 2740448 - DNA, 15 bp, Homo sapiens
ctgcaattgagggct

SEQ ID NO: 2740449 - DNA, 17 bp, Homo sapiens
ctgcaccaacccagccg

SEQ ID NO: 2740450 - DNA, 13 bp, Homo sapiens
ctgcaccccctcc

SEQ ID NO: 2740451 - DNA, 13 bp, Homo sapiens
ctgcacctgccag

SEQ ID NO: 2740452 - DNA, 19 bp, Homo sapiens
ctgcacgtcaccctcctga

SEQ ID NO: 2740453 - DNA, 20 bp, Homo sapiens
ctgcacgtcaccctcctgag

SEQ ID NO: 2740454 - DNA, 21 bp, Homo sapiens
ctgcactaaaacccatcttcc

SEQ ID NO: 2740455 - DNA, 17 bp, Homo sapiens
ctgcactccagcctggg

SEQ ID NO: 2740456 - DNA, 18 bp, Homo sapiens
ctgcactccagcctgggc

SEQ ID NO: 2740457 - DNA, 19 bp, Homo sapiens
ctgcactccagcctgggcg

SEQ ID NO: 2740458 - DNA, 15 bp, Homo sapiens
ctgcactctgtgccc

SEQ ID NO: 2740459 - DNA, 16 bp, Homo sapiens
ctgcactctgtgccca

SEQ ID NO: 2740460 - DNA, 22 bp, Homo sapiens
ctgcactctgtgcccatgggca

SEQ ID NO: 2740461 - DNA, 19 bp, Homo sapiens
ctgcactgtcctgctccac

SEQ ID NO: 2740462 - DNA, 15 bp, Homo sapiens
ctgcagaggggcagg

SEQ ID NO: 2740463 - DNA, 23 bp, Homo sapiens
ctgcagaggggcaggccctgcac

SEQ ID NO: 2740464 - DNA, 19 bp, Homo sapiens
ctgcagaggggctttctgg

SEQ ID NO: 2740465 - DNA, 18 bp, Homo sapiens
ctgcagcctccttctcct

SEQ ID NO: 2740466 - DNA, 14 bp, Homo sapiens
ctgcagctcctgga

SEQ ID NO: 2740467 - DNA, 11 bp, Homo sapiens
ctgcagcttcc

SEQ ID NO: 2740468 - DNA, 12 bp, Homo sapiens
ctgcagcttcct

SEQ ID NO: 2740469 - DNA, 13 bp, Homo sapiens
ctgcagcttcctg

SEQ ID NO: 2740470 - DNA, 15 bp, Homo sapiens
ctgcagcttcctgtc

SEQ ID NO: 2740471 - DNA, 19 bp, Homo sapiens
ctgcagcttcctgtcaaca

SEQ ID NO: 2740472 - DNA, 16 bp, Homo sapiens
ctgcagctttggctgc

SEQ ID NO: 2740473 - DNA, 19 bp, Homo sapiens
ctgcaggaaatcagagctg

SEQ ID NO: 2740474 - DNA, 20 bp, Homo sapiens
ctgcaggaaatcagagctgg

SEQ ID NO: 2740475 - DNA, 23 bp, Homo sapiens
ctgcaggccaagagcagaggcag

SEQ ID NO: 2740476 - DNA, 15 bp, Homo sapiens
ctgcagggagcaact

SEQ ID NO: 2740477 - DNA, 20 bp, Homo sapiens
ctgcagggagcaactctcca

SEQ ID NO: 2740478 - DNA, 19 bp, Homo sapiens
ctgcatcagctttttgtat

SEQ ID NO: 2740479 - DNA, 22 bp, Homo sapiens
ctgcatcagctttttgtattaa

SEQ ID NO: 2740480 - DNA, 21 bp, Homo sapiens
ctgcatggagtgagcagtaga

SEQ ID NO: 2740481 - DNA, 20 bp, Homo sapiens
ctgcatgtaaaatcttcagc

SEQ ID NO: 2740482 - DNA, 21 bp, Homo sapiens
ctgcatgtaaaatcttcagct

SEQ ID NO: 2740483 - DNA, 22 bp, Homo sapiens
ctgcatgtaaaatcttcagctg

SEQ ID NO: 2740484 - DNA, 19 bp, Homo sapiens
ctgccaaaaatagaaagtg

SEQ ID NO: 2740485 - DNA, 12 bp, Homo sapiens
ctgccaaaacaa

SEQ ID NO: 2740486 - DNA, 17 bp, Homo sapiens
ctgccactctgctgcct

SEQ ID NO: 2740487 - DNA, 13 bp, Homo sapiens
ctgccacttccca

SEQ ID NO: 2740488 - DNA, 12 bp, Homo sapiens
ctgccagccaca

SEQ ID NO: 2740489 - DNA, 12 bp, Homo sapiens
ctgccagcctgg

SEQ ID NO: 2740490 - DNA, 13 bp, Homo sapiens
ctgccagcctggc

SEQ ID NO: 2740491 - DNA, 16 bp, Homo sapiens
ctgccagcctggcttc

SEQ ID NO: 2740492 - DNA, 18 bp, Homo sapiens
ctgccagctctgtcaccc

SEQ ID NO: 2740493 - DNA, 23 bp, Homo sapiens
ctgccagctctgtcaccctggcc

SEQ ID NO: 2740494 - DNA, 17 bp, Homo sapiens
ctgcccacattggaccc

SEQ ID NO: 2740495 - DNA, 12 bp, Homo sapiens
ctgccccaccct

SEQ ID NO: 2740496 - DNA, 14 bp, Homo sapiens
ctgccccagcctcc

SEQ ID NO: 2740497 - DNA, 16 bp, Homo sapiens
ctgccccatctcctcc

SEQ ID NO: 2740498 - DNA, 12 bp, Homo sapiens
ctgccccctggt

SEQ ID NO: 2740499 - DNA, 17 bp, Homo sapiens
ctgccccgcccagctgc

SEQ ID NO: 2740500 - DNA, 13 bp, Homo sapiens
ctgcccctccccc

SEQ ID NO: 2740501 - DNA, 13 bp, Homo sapiens
ctgcccctcccta

SEQ ID NO: 2740502 - DNA, 15 bp, Homo sapiens
ctgcccctccctaga

SEQ ID NO: 2740503 - DNA, 15 bp, Homo sapiens
ctgccccttgtcctc

SEQ ID NO: 2740504 - DNA, 13 bp, Homo sapiens
ctgcccgcagagc

SEQ ID NO: 2740505 - DNA, 17 bp, Homo sapiens
ctgcccgcagagcccac

SEQ ID NO: 2740506 - DNA, 19 bp, Homo sapiens
ctgcccgcctcggcctccc

SEQ ID NO: 2740507 - DNA, 14 bp, Homo sapiens
ctgcccgctcccag

SEQ ID NO: 2740508 - DNA, 16 bp, Homo sapiens
ctgcccgctcccagtg

SEQ ID NO: 2740509 - DNA, 17 bp, Homo sapiens
ctgcccggcgccctctg

SEQ ID NO: 2740510 - DNA, 23 bp, Homo sapiens
ctgcccggcgccctctgtcctga

SEQ ID NO: 2740511 - DNA, 14 bp, Homo sapiens
ctgccgatgcccaa

SEQ ID NO: 2740512 - DNA, 15 bp, Homo sapiens
ctgccgatgcccaat

SEQ ID NO: 2740513 - DNA, 14 bp, Homo sapiens
ctgccgcctcccgg

SEQ ID NO: 2740514 - DNA, 17 bp, Homo sapiens
ctgcctagctcttgggc

SEQ ID NO: 2740515 - DNA, 17 bp, Homo sapiens
ctgcctcagcctcctga

SEQ ID NO: 2740516 - DNA, 17 bp, Homo sapiens
ctgcctcatcctcctcc

SEQ ID NO: 2740517 - DNA, 13 bp, Homo sapiens
ctgcctccactcc

SEQ ID NO: 2740518 - DNA, 14 bp, Homo sapiens
ctgcctccactccc

SEQ ID NO: 2740519 - DNA, 17 bp, Homo sapiens
ctgcctccactcccact

SEQ ID NO: 2740520 - DNA, 19 bp, Homo sapiens
ctgcctccactcccacttc

SEQ ID NO: 2740521 - DNA, 16 bp, Homo sapiens
ctgcctccccaatcca

SEQ ID NO: 2740522 - DNA, 18 bp, Homo sapiens
ctgcctccctttcataca

SEQ ID NO: 2740523 - DNA, 15 bp, Homo sapiens
ctgcctctcttctgt

SEQ ID NO: 2740524 - DNA, 16 bp, Homo sapiens
ctgcctgaaaaccatc

SEQ ID NO: 2740525 - DNA, 14 bp, Homo sapiens
ctgcctgagattct

SEQ ID NO: 2740526 - DNA, 16 bp, Homo sapiens
ctgcctgagattcttt

SEQ ID NO: 2740527 - DNA, 22 bp, Homo sapiens
ctgcctgagattctttaaggag

SEQ ID NO: 2740528 - DNA, 14 bp, Homo sapiens
ctgcctgctgggct

SEQ ID NO: 2740529 - DNA, 17 bp, Homo sapiens
ctgcctgctgggctctt

SEQ ID NO: 2740530 - DNA, 14 bp, Homo sapiens
cttgccccaacccc

SEQ ID NO: 2740531 - DNA, 18 bp, Homo sapiens
cttgccccaacccccagc

SEQ ID NO: 2740532 - DNA, 19 bp, Homo sapiens
cttgccccaacccccagca

SEQ ID NO: 2740533 - DNA, 21 bp, Homo sapiens
cttgccccaacccccagcacc

SEQ ID NO: 2740534 - DNA, 20 bp, Homo sapiens
cttgcccggattctgggagg

SEQ ID NO: 2740535 - DNA, 15 bp, Homo sapiens
cttgcccttcctgac

SEQ ID NO: 2740536 - DNA, 16 bp, Homo sapiens
cttgcccttcctgacc

SEQ ID NO: 2740537 - DNA, 23 bp, Homo sapiens
cttgccgagagaggcgcgtctgc

SEQ ID NO: 2740538 - DNA, 16 bp, Homo sapiens
cttgctgtcctaggcc

SEQ ID NO: 2740539 - DNA, 22 bp, Homo sapiens
cttgcttctggctttgttcttg

SEQ ID NO: 2740540 - DNA, 18 bp, Homo sapiens
cttggaattttgtaaaaa

SEQ ID NO: 2740541 - DNA, 13 bp, Homo sapiens
cttggacttgagg

SEQ ID NO: 2740542 - DNA, 16 bp, Homo sapiens
cttggagtgctgcagc

SEQ ID NO: 2740543 - DNA, 13 bp, Homo sapiens
cttggcacctgcc

SEQ ID NO: 2740544 - DNA, 16 bp, Homo sapiens
cttggcacctgcctag

SEQ ID NO: 2740545 - DNA, 17 bp, Homo sapiens
cttggcacctgcctagc

SEQ ID NO: 2740546 - DNA, 18 bp, Homo sapiens
cttggcatcacagggcag

SEQ ID NO: 2740547 - DNA, 22 bp, Homo sapiens
cttggcatcacagggcagagcc

SEQ ID NO: 2740548 - DNA, 13 bp, Homo sapiens
cttggccagagct

SEQ ID NO: 2740549 - DNA, 17 bp, Homo sapiens
cttggccagagctgagt

SEQ ID NO: 2740550 - DNA, 23 bp, Homo sapiens
cttggccagagctgagtggcagc

SEQ ID NO: 2740551 - DNA, 17 bp, Homo sapiens
cttgggcctcatctgct

SEQ ID NO: 2740552 - DNA, 15 bp, Homo sapiens
cttggggctcgcccc

SEQ ID NO: 2740553 - DNA, 19 bp, Homo sapiens
cttggggctcgccccaccc

SEQ ID NO: 2740554 - DNA, 20 bp, Homo sapiens
cttggggctcgccccaccca

SEQ ID NO: 2740555 - DNA, 15 bp, Homo sapiens
cttgggtctctggat

SEQ ID NO: 2740556 - DNA, 23 bp, Homo sapiens
cttggtatatctggccacactgg

SEQ ID NO: 2740557 - DNA, 13 bp, Homo sapiens
cttggtcccagac

SEQ ID NO: 2740558 - DNA, 17 bp, Homo sapiens
cttggtcccagacagct

SEQ ID NO: 2740559 - DNA, 19 bp, Homo sapiens
cttggtcccagacagctgg

SEQ ID NO: 2740560 - DNA, 20 bp, Homo sapiens
cttggtcccagacagctgga

SEQ ID NO: 2740561 - DNA, 23 bp, Homo sapiens
cttggtcccagacagctggaccc

SEQ ID NO: 2740562 - DNA, 19 bp, Homo sapiens
cttgtcaaatagcaaggcc

SEQ ID NO: 2740563 - DNA, 14 bp, Homo sapiens
cttgtcaacctctt

SEQ ID NO: 2740564 - DNA, 14 bp, Homo sapiens
cttgtccctggggc

SEQ ID NO: 2740565 - DNA, 15 bp, Homo sapiens
cttgtccctggggca

SEQ ID NO: 2740566 - DNA, 20 bp, Homo sapiens
cttgtccctggggcactccc

SEQ ID NO: 2740567 - DNA, 14 bp, Homo sapiens
cttgtcctctcaga

SEQ ID NO: 2740568 - DNA, 15 bp, Homo sapiens
cttgtcctctcagag

SEQ ID NO: 2740569 - DNA, 23 bp, Homo sapiens
cttgtcctctcagagcctcagct

SEQ ID NO: 2740570 - DNA, 14 bp, Homo sapiens
cttgtctttcaaaa

SEQ ID NO: 2740571 - DNA, 16 bp, Homo sapiens
cttgtggactctctgc

SEQ ID NO: 2740572 - DNA, 18 bp, Homo sapiens
cttgtggactctctgcct

SEQ ID NO: 2740573 - DNA, 17 bp, Homo sapiens
cttgttcaacagtttct

SEQ ID NO: 2740574 - DNA, 19 bp, Homo sapiens
cttgttcaacagtttctca

SEQ ID NO: 2740575 - DNA, 13 bp, Homo sapiens
cttgtttctttct

SEQ ID NO: 2740576 - DNA, 23 bp, Homo sapiens
cttgtttggagggatcattttct

SEQ ID NO: 2740577 - DNA, 21 bp, Homo sapiens
ctttaaaggtcgcacctcctt

SEQ ID NO: 2740578 - DNA, 24 bp, Homo sapiens
ctttaaaggtcgcacctccttgga

SEQ ID NO: 2740579 - DNA, 17 bp, Homo sapiens
ctttaatttttataaat

SEQ ID NO: 2740580 - DNA, 15 bp, Homo sapiens
ctttacaaataattt

SEQ ID NO: 2740581 - DNA, 24 bp, Homo sapiens
ctttataagccaatgaagcaaaca

SEQ ID NO: 2740582 - DNA, 17 bp, Homo sapiens
ctttatctgaaaatgat

SEQ ID NO: 2740583 - DNA, 16 bp, Homo sapiens
ctttcatacattatat

SEQ ID NO: 2740584 - DNA, 14 bp, Homo sapiens
ctttccaacacaca

SEQ ID NO: 2740585 - DNA, 16 bp, Homo sapiens
ctttccctaaattgat

SEQ ID NO: 2740586 - DNA, 16 bp, Homo sapiens
ctttccctccccagag

SEQ ID NO: 2740587 - DNA, 22 bp, Homo sapiens
ctttcctaaagtctctgctgct

SEQ ID NO: 2740588 - DNA, 14 bp, Homo sapiens
ctttctccagtgta

SEQ ID NO: 2740589 - DNA, 12 bp, Homo sapiens
ctttctcctttg

SEQ ID NO: 2740590 - DNA, 11 bp, Homo sapiens
ctttctctgca

SEQ ID NO: 2740591 - DNA, 14 bp, Homo sapiens
ctttctgggccaag

SEQ ID NO: 2740592 - DNA, 17 bp, Homo sapiens
ctttctttgcaccaaag

SEQ ID NO: 2740593 - DNA, 11 bp, Homo sapiens
ctttctttgct

SEQ ID NO: 2740594 - DNA, 14 bp, Homo sapiens
ctttctttgctgct

SEQ ID NO: 2740595 - DNA, 16 bp, Homo sapiens
ctttctttgctgctgt

SEQ ID NO: 2740596 - DNA, 17 bp, Homo sapiens
ctttgaaggtaataaat

SEQ ID NO: 2740597 - DNA, 22 bp, Homo sapiens
ctttgaaggtaataaatacaca

SEQ ID NO: 2740598 - DNA, 16 bp, Homo sapiens
ctttgaatagaggcca

SEQ ID NO: 2740599 - DNA, 21 bp, Homo sapiens
ctttgaatagaggccaaatta

SEQ ID NO: 2740600 - DNA, 13 bp, Homo sapiens
ctttgagtaccaa

SEQ ID NO: 2740601 - DNA, 20 bp, Homo sapiens
ctttgcaggcccagcagact

SEQ ID NO: 2740602 - DNA, 18 bp, Homo sapiens
ctttgccatgggcctgct

SEQ ID NO: 2740603 - DNA, 21 bp, Homo sapiens
ctttgcccacacacactcctt

SEQ ID NO: 2740604 - DNA, 20 bp, Homo sapiens
ctttgccccggcttgcctgt

SEQ ID NO: 2740605 - DNA, 18 bp, Homo sapiens
ctttgctacaataaatgc

SEQ ID NO: 2740606 - DNA, 22 bp, Homo sapiens
ctttgctacaataaatgctgaa

SEQ ID NO: 2740607 - DNA, 18 bp, Homo sapiens
ctttgctgaatgtcatta

SEQ ID NO: 2740608 - DNA, 16 bp, Homo sapiens
ctttgggagagttcat

SEQ ID NO: 2740609 - DNA, 15 bp, Homo sapiens
ctttggtgaacattg

SEQ ID NO: 2740610 - DNA, 14 bp, Homo sapiens
ctttgtgtgtctcc

SEQ ID NO: 2740611 - DNA, 18 bp, Homo sapiens
ctttgttcttgtcatcag

SEQ ID NO: 2740612 - DNA, 19 bp, Homo sapiens
cttttaaaactatatttat

SEQ ID NO: 2740613 - DNA, 16 bp, Homo sapiens
cttttataaacctcta

SEQ ID NO: 2740614 - DNA, 22 bp, Homo sapiens
cttttataaacctctaatttat

SEQ ID NO: 2740615 - DNA, 17 bp, Homo sapiens
cttttattcatttgagt

SEQ ID NO: 2740616 - DNA, 18 bp, Homo sapiens
cttttcagcttctgctgg

SEQ ID NO: 2740617 - DNA, 16 bp, Homo sapiens
cttttccagaaagaaa

SEQ ID NO: 2740618 - DNA, 22 bp, Homo sapiens
cttttccagaaagaaaatgaat

SEQ ID NO: 2740619 - DNA, 16 bp, Homo sapiens
cttttcgaactgtgct

SEQ ID NO: 2740620 - DNA, 19 bp, Homo sapiens
cttttcgaactgtgctccc

SEQ ID NO: 2740621 - DNA, 20 bp, Homo sapiens
cttttcgaactgtgctccca

SEQ ID NO: 2740622 - DNA, 16 bp, Homo sapiens
cttttctcccagaagg

SEQ ID NO: 2740623 - DNA, 17 bp, Homo sapiens
cttttctcccagaaggc

SEQ ID NO: 2740624 - DNA, 12 bp, Homo sapiens
cttttctgcaga

SEQ ID NO: 2740625 - DNA, 18 bp, Homo sapiens
cttttgcaacaagacaaa

SEQ ID NO: 2740626 - DNA, 21 bp, Homo sapiens
cttttggttcctcacatatta

SEQ ID NO: 2740627 - DNA, 15 bp, Homo sapiens
cttttgtaaatgaga

SEQ ID NO: 2740628 - DNA, 16 bp, Homo sapiens
cttttgtcctgttatt

SEQ ID NO: 2740629 - DNA, 12 bp, Homo sapiens
cttttgtgttct

SEQ ID NO: 2740630 - DNA, 20 bp, Homo sapiens
cttttgttattaaaaaaaca

SEQ ID NO: 2740631 - DNA, 16 bp, Homo sapiens
cttttgttttcttcat

SEQ ID NO: 2740632 - DNA, 20 bp, Homo sapiens
ctttttaaaatgttggtgca

SEQ ID NO: 2740633 - DNA, 14 bp, Homo sapiens
ctttttctaccttt

SEQ ID NO: 2740634 - DNA, 18 bp, Homo sapiens
ctttttgaaaaaagtata

SEQ ID NO: 2740635 - DNA, 23 bp, Homo sapiens
ctttttgcaggggactgggccat

SEQ ID NO: 2740636 - DNA, 11 bp, Homo sapiens
ctttttgtaac

SEQ ID NO: 2740637 - DNA, 16 bp, Homo sapiens
ctttttttacatttca

SEQ ID NO: 2740638 - DNA, 18 bp, Homo sapiens
ctttttttttttctgcct

SEQ ID NO: 2740639 - DNA, 21 bp, Homo sapiens
ctttttttttttctgcctgag

SEQ ID NO: 2740640 - DNA, 21 bp, Homo sapiens
ctttttttttttttttaaaga

SEQ ID NO: 2740641 - DNA, 18 bp, Homo sapiens
gaaaaacacggcagctgt

SEQ ID NO: 2740642 - DNA, 12 bp, Homo sapiens
gaaaaataaata

SEQ ID NO: 2740643 - DNA, 13 bp, Homo sapiens
gaaaaatgtcact

SEQ ID NO: 2740644 - DNA, 15 bp, Homo sapiens
gaaaaatgtcactga

SEQ ID NO: 2740645 - DNA, 16 bp, Homo sapiens
gaaaacaattgttctg

SEQ ID NO: 2740646 - DNA, 14 bp, Homo sapiens
gaaaaccccagcat

SEQ ID NO: 2740647 - DNA, 14 bp, Homo sapiens
gaaaacccccagca

SEQ ID NO: 2740648 - DNA, 17 bp, Homo sapiens
gaaaacccccagcatta

SEQ ID NO: 2740649 - DNA, 13 bp, Homo sapiens
gaaaacccctggc

SEQ ID NO: 2740650 - DNA, 15 bp, Homo sapiens
gaaaacccctggctg

SEQ ID NO: 2740651 - DNA, 13 bp, Homo sapiens
gaaaactgagagg

SEQ ID NO: 2740652 - DNA, 16 bp, Homo sapiens
gaaaacttatttgagt

SEQ ID NO: 2740653 - DNA, 18 bp, Homo sapiens
gaaaagaaatcaattttt

SEQ ID NO: 2740654 - DNA, 16 bp, Homo sapiens
gcagaagccccaactg

SEQ ID NO: 2740655 - DNA, 22 bp, Homo sapiens
gcagaaggaagggcatccttct

SEQ ID NO: 2740656 - DNA, 14 bp, Homo sapiens
gcagaatcctgggc

SEQ ID NO: 2740657 - DNA, 20 bp, Homo sapiens
gcagagcaggggcagggtga

SEQ ID NO: 2740658 - DNA, 16 bp, Homo sapiens
gcagaggggctttctg

SEQ ID NO: 2740659 - DNA, 21 bp, Homo sapiens
gcagaggggctttctggagag

SEQ ID NO: 2740660 - DNA, 18 bp, Homo sapiens
gcagaggtgagcagagga

SEQ ID NO: 2740661 - DNA, 21 bp, Homo sapiens
gcagatctttaaatacagtca

SEQ ID NO: 2740662 - DNA, 15 bp, Homo sapiens
gcagatctttttgtg

SEQ ID NO: 2740663 - DNA, 19 bp, Homo sapiens
gcagattacaataaatcct

SEQ ID NO: 2740664 - DNA, 18 bp, Homo sapiens
gcagatttactgtcccag

SEQ ID NO: 2740665 - DNA, 18 bp, Homo sapiens
gcagcacaggaggctccg

SEQ ID NO: 2740666 - DNA, 12 bp, Homo sapiens
gcagcaggtgct

SEQ ID NO: 2740667 - DNA, 13 bp, Homo sapiens
gcagcaggtgctg

SEQ ID NO: 2740668 - DNA, 18 bp, Homo sapiens
gcagcaggtgctgctacc

SEQ ID NO: 2740669 - DNA, 22 bp, Homo sapiens
gcagcaggtgctgctaccctcc

SEQ ID NO: 2740670 - DNA, 22 bp, Homo sapiens
gcagccgcctcccttatgcagg

SEQ ID NO: 2740671 - DNA, 16 bp, Homo sapiens
gcagcctccagtgctg

SEQ ID NO: 2740672 - DNA, 21 bp, Homo sapiens
gcagcctccagtgctggctgc

SEQ ID NO: 2740673 - DNA, 14 bp, Homo sapiens
gcagcctccctctg

SEQ ID NO: 2740674 - DNA, 22 bp, Homo sapiens
gcagcctccctctgacctgcag

SEQ ID NO: 2740675 - DNA, 12 bp, Homo sapiens
gcagcctgaccc

SEQ ID NO: 2740676 - DNA, 14 bp, Homo sapiens
gcagcgcctgtccc

SEQ ID NO: 2740677 - DNA, 18 bp, Homo sapiens
gcagcgcctgtcccctca

SEQ ID NO: 2740678 - DNA, 16 bp, Homo sapiens
gcagctcaggagacga

SEQ ID NO: 2740679 - DNA, 12 bp, Homo sapiens
gcagctgctgcc

SEQ ID NO: 2740680 - DNA, 17 bp, Homo sapiens
gcagctgctgccactct

SEQ ID NO: 2740681 - DNA, 21 bp, Homo sapiens
gcagctgctgccactctgctg

SEQ ID NO: 2740682 - DNA, 22 bp, Homo sapiens
gcagctgctgccactctgctgc

SEQ ID NO: 2740683 - DNA, 15 bp, Homo sapiens
gcagctggctctcca

SEQ ID NO: 2740684 - DNA, 18 bp, Homo sapiens
gcagctggctctccacct

SEQ ID NO: 2740685 - DNA, 18 bp, Homo sapiens
gcagctgggcccacagcc

SEQ ID NO: 2740686 - DNA, 14 bp, Homo sapiens
gcagcttctgccac

SEQ ID NO: 2740687 - DNA, 17 bp, Homo sapiens
gcagcttctgccacttc

SEQ ID NO: 2740688 - DNA, 22 bp, Homo sapiens
gcagctttggctgcacgtcacc

SEQ ID NO: 2740689 - DNA, 20 bp, Homo sapiens
gcaggaaccggagggtgacc

SEQ ID NO: 2740690 - DNA, 12 bp, Homo sapiens
gcaggaggcagg

SEQ ID NO: 2740691 - DNA, 20 bp, Homo sapiens
gcaggcagcgcctgtcccct

SEQ ID NO: 2740692 - DNA, 18 bp, Homo sapiens
gcaggccctgcactgtcc

SEQ ID NO: 2740693 - DNA, 15 bp, Homo sapiens
gcagggacacccccc

SEQ ID NO: 2740694 - DNA, 22 bp, Homo sapiens
gcagggacaccccccgcccccc

SEQ ID NO: 2740695 - DNA, 14 bp, Homo sapiens
gcagggcagcaggc

SEQ ID NO: 2740696 - DNA, 22 bp, Homo sapiens
gcaggggacctggagctgccag

SEQ ID NO: 2740697 - DNA, 13 bp, Homo sapiens
gcaggggactggg

SEQ ID NO: 2740698 - DNA, 15 bp, Homo sapiens
gcaggggactgggcc

SEQ ID NO: 2740699 - DNA, 17 bp, Homo sapiens
gcaggggactgggccat

SEQ ID NO: 2740700 - DNA, 18 bp, Homo sapiens
gcaggggactgggccatg

SEQ ID NO: 2740701 - DNA, 22 bp, Homo sapiens
gcaggggctgctgggggctccc

SEQ ID NO: 2740702 - DNA, 13 bp, Homo sapiens
gcaggtctgggcc

SEQ ID NO: 2740703 - DNA, 14 bp, Homo sapiens
gcaggtctgggcca

SEQ ID NO: 2740704 - DNA, 20 bp, Homo sapiens
gcaggtgctgctaccctccc

SEQ ID NO: 2740705 - DNA, 16 bp, Homo sapiens
gcaggttgaggggctc

SEQ ID NO: 2740706 - DNA, 21 bp, Homo sapiens
gcaggttgaggggctcctgga

SEQ ID NO: 2740707 - DNA, 15 bp, Homo sapiens
gcagtcttttgctgt

SEQ ID NO: 2740708 - DNA, 19 bp, Homo sapiens
gcagtgggtcccacttccc

SEQ ID NO: 2740709 - DNA, 21 bp, Homo sapiens
gcagtgggtcccacttcccct

SEQ ID NO: 2740710 - DNA, 22 bp, Homo sapiens
gcatatctctagtccctgtgtt

SEQ ID NO: 2740711 - DNA, 14 bp, Homo sapiens
gcatcaaacatgaa

SEQ ID NO: 2740712 - DNA, 18 bp, Homo sapiens
gcatcaaacatgaaaaca

SEQ ID NO: 2740713 - DNA, 19 bp, Homo sapiens
gcatcaaacatgaaaacat

SEQ ID NO: 2740714 - DNA, 16 bp, Homo sapiens
gcatcaagggctttat

SEQ ID NO: 2740715 - DNA, 16 bp, Homo sapiens
gcatcacagggcagag

SEQ ID NO: 2740716 - DNA, 21 bp, Homo sapiens
gcatcacagggcagagccggg

SEQ ID NO: 2740717 - DNA, 14 bp, Homo sapiens
gcatcacctcaggc

SEQ ID NO: 2740718 - DNA, 15 bp, Homo sapiens
gcatcacctcaggcc

SEQ ID NO: 2740719 - DNA, 17 bp, Homo sapiens
gcatcacctcaggccag

SEQ ID NO: 2740720 - DNA, 14 bp, Homo sapiens
gcatcctccccacc

SEQ ID NO: 2740721 - DNA, 21 bp, Homo sapiens
gcatcctccccaccagagctg

SEQ ID NO: 2740722 - DNA, 22 bp, Homo sapiens
gcatcctccccaccagagctgc

SEQ ID NO: 2740723 - DNA, 15 bp, Homo sapiens
gcatcctggctggct

SEQ ID NO: 2740724 - DNA, 16 bp, Homo sapiens
gcatctccctgacctt

SEQ ID NO: 2740725 - DNA, 19 bp, Homo sapiens
gcatctctgagtgtctctg

SEQ ID NO: 2740726 - DNA, 23 bp, Homo sapiens
gcatctctgagtgtctctgcctg

SEQ ID NO: 2740727 - DNA, 18 bp, Homo sapiens
gcatgccccctcgtgcca

SEQ ID NO: 2740728 - DNA, 20 bp, Homo sapiens
gcatgccctgagctctctga

SEQ ID NO: 2740729 - DNA, 13 bp, Homo sapiens
gcatgcctcagcc

SEQ ID NO: 2740730 - DNA, 22 bp, Homo sapiens
gcatgcctcagccagccctgga

SEQ ID NO: 2740731 - DNA, 17 bp, Homo sapiens
gcatggaatttgtaagt

SEQ ID NO: 2740732 - DNA, 17 bp, Homo sapiens
gcatggcactgaccgcc

SEQ ID NO: 2740733 - DNA, 15 bp, Homo sapiens
gcatggcagctgggc

SEQ ID NO: 2740734 - DNA, 22 bp, Homo sapiens
gcatggggagtacattcatctg

SEQ ID NO: 2740735 - DNA, 17 bp, Homo sapiens
gcatgtaaaatcttcag

SEQ ID NO: 2740736 - DNA, 22 bp, Homo sapiens
gcatgtaaaatcttcagctggt

SEQ ID NO: 2740737 - DNA, 23 bp, Homo sapiens
gcatgtaaaatcttcagctggtg

SEQ ID NO: 2740738 - DNA, 19 bp, Homo sapiens
gcatgtagctctatggggg

SEQ ID NO: 2740739 - DNA, 20 bp, Homo sapiens
gcattaaattttaaggtaga

SEQ ID NO: 2740740 - DNA, 18 bp, Homo sapiens
gcattctctctgctcagt

SEQ ID NO: 2740741 - DNA, 15 bp, Homo sapiens
gcatttgtgtcatct

SEQ ID NO: 2740742 - DNA, 14 bp, Homo sapiens
gcattttcccagat

SEQ ID NO: 2740743 - DNA, 14 bp, Homo sapiens
gcatttttaaagga

SEQ ID NO: 2740744 - DNA, 21 bp, Homo sapiens
gcatttttaaaggacaaacag

SEQ ID NO: 2740745 - DNA, 20 bp, Homo sapiens
gccaaattaatcttttaaaa

SEQ ID NO: 2740746 - DNA, 23 bp, Homo sapiens
gccaacgacaaagccaaactctg

SEQ ID NO: 2740747 - DNA, 14 bp, Homo sapiens
gccaaggctgagag

SEQ ID NO: 2740748 - DNA, 15 bp, Homo sapiens
gccaaggctgagagc

SEQ ID NO: 2740749 - DNA, 16 bp, Homo sapiens
gccaaggctgagagct

SEQ ID NO: 2740750 - DNA, 16 bp, Homo sapiens
gccaaggtgggctgag

SEQ ID NO: 2740751 - DNA, 21 bp, Homo sapiens
gccaaggtgggctgagccctg

SEQ ID NO: 2740752 - DNA, 22 bp, Homo sapiens
gccaaggtgggctgagccctgg

SEQ ID NO: 2740753 - DNA, 22 bp, Homo sapiens
gccaattttgtcacagctcttg

SEQ ID NO: 2740754 - DNA, 14 bp, Homo sapiens
gccacaccaagctg

SEQ ID NO: 2740755 - DNA, 18 bp, Homo sapiens
gccacaccaagctgtgcc

SEQ ID NO: 2740756 - DNA, 20 bp, Homo sapiens
gccacaccaagctgtgccac

SEQ ID NO: 2740757 - DNA, 21 bp, Homo sapiens
gccacaccaagctgtgccacc

SEQ ID NO: 2740758 - DNA, 20 bp, Homo sapiens
gccaccacccaacctgtcct

SEQ ID NO: 2740759 - DNA, 22 bp, Homo sapiens
gccaccatattcagtgctgtgg

SEQ ID NO: 2740760 - DNA, 19 bp, Homo sapiens
gccaccctgggctctgtgg

SEQ ID NO: 2740761 - DNA, 21 bp, Homo sapiens
gccaccctgggctctgtgggc

SEQ ID NO: 2740762 - DNA, 19 bp, Homo sapiens
gccaccgcagctgctgcca

SEQ ID NO: 2740763 - DNA, 15 bp, Homo sapiens
gccaccgcgcccagc

SEQ ID NO: 2740764 - DNA, 17 bp, Homo sapiens
gccacggcactccagcc

SEQ ID NO: 2740765 - DNA, 22 bp, Homo sapiens
gccactacactccagcctgagc

SEQ ID NO: 2740766 - DNA, 14 bp, Homo sapiens
gccactctgctgcc

SEQ ID NO: 2740767 - DNA, 14 bp, Homo sapiens
gccactgaagctgg

SEQ ID NO: 2740768 - DNA, 19 bp, Homo sapiens
gccactgaagctgggattc

SEQ ID NO: 2740769 - DNA, 12 bp, Homo sapiens
gccactgcagca

SEQ ID NO: 2740770 - DNA, 14 bp, Homo sapiens
gccactgcagcaca

SEQ ID NO: 2740771 - DNA, 15 bp, Homo sapiens
gccactgcagcacag

SEQ ID NO: 2740772 - DNA, 17 bp, Homo sapiens
gccagatgctgggcagg

SEQ ID NO: 2740773 - DNA, 17 bp, Homo sapiens
gccagatgtgggctcag

SEQ ID NO: 2740774 - DNA, 20 bp, Homo sapiens
gccagatgtgggctcagatc

SEQ ID NO: 2740775 - DNA, 17 bp, Homo sapiens
gccagcaggcagcgcct

SEQ ID NO: 2740776 - DNA, 21 bp, Homo sapiens
gccagcaggcagcgcctgtcc

SEQ ID NO: 2740777 - DNA, 17 bp, Homo sapiens
taaagaaaatgtgtctg

SEQ ID NO: 2740778 - DNA, 23 bp, Homo sapiens
taaagaaaatgtgtctgcaacat

SEQ ID NO: 2740779 - DNA, 17 bp, Homo sapiens
taaagaaacactaaatt

SEQ ID NO: 2740780 - DNA, 22 bp, Homo sapiens
taaagaagagccttcacatgaa

SEQ ID NO: 2740781 - DNA, 22 bp, Homo sapiens
taaagcacagtctgatgacaca

SEQ ID NO: 2740782 - DNA, 16 bp, Homo sapiens
taaaggaaaaatcata

SEQ ID NO: 2740783 - DNA, 14 bp, Homo sapiens
taaaggacaaacag

SEQ ID NO: 2740784 - DNA, 22 bp, Homo sapiens
taaaggacaaacagtgaattta

SEQ ID NO: 2740785 - DNA, 13 bp, Homo sapiens
taaagtttacagt

SEQ ID NO: 2740786 - DNA, 17 bp, Homo sapiens
taaagtttacagtaaat

SEQ ID NO: 2740787 - DNA, 14 bp, Homo sapiens
taaataaaagcaca

SEQ ID NO: 2740788 - DNA, 14 bp, Homo sapiens
taaatataaatttt

SEQ ID NO: 2740789 - DNA, 20 bp, Homo sapiens
taaatatagttgtctttctt

SEQ ID NO: 2740790 - DNA, 12 bp, Homo sapiens
taaatatgtgaa

SEQ ID NO: 2740791 - DNA, 18 bp, Homo sapiens
taaatatgtgaaaatgat

SEQ ID NO: 2740792 - DNA, 19 bp, Homo sapiens
taaatatgtgaaaatgatt

SEQ ID NO: 2740793 - DNA, 16 bp, Homo sapiens
taaatcaattcattgt

SEQ ID NO: 2740794 - DNA, 13 bp, Homo sapiens
taaatgacttttt

SEQ ID NO: 2740795 - DNA, 15 bp, Homo sapiens
taaatgactttttga

SEQ ID NO: 2740796 - DNA, 17 bp, Homo sapiens
taaatgagacacataca

SEQ ID NO: 2740797 - DNA, 16 bp, Homo sapiens
taaatgccttggtttg

SEQ ID NO: 2740798 - DNA, 20 bp, Homo sapiens
taaatgccttggtttgattt

SEQ ID NO: 2740799 - DNA, 14 bp, Homo sapiens
taaatgctgaatga

SEQ ID NO: 2740800 - DNA, 13 bp, Homo sapiens
taaattacattaa

SEQ ID NO: 2740801 - DNA, 15 bp, Homo sapiens
taaattatttctaaa

SEQ ID NO: 2740802 - DNA, 13 bp, Homo sapiens
taaattccactgg

SEQ ID NO: 2740803 - DNA, 16 bp, Homo sapiens
taaattccactggact

SEQ ID NO: 2740804 - DNA, 21 bp, Homo sapiens
taaattgttataacttcataa

SEQ ID NO: 2740805 - DNA, 21 bp, Homo sapiens
taaatttgaactccatgggat

SEQ ID NO: 2740806 - DNA, 22 bp, Homo sapiens
taaatttgttgtcatgtgtatg

SEQ ID NO: 2740807 - DNA, 17 bp, Homo sapiens
taaattttgtatgaaaa

SEQ ID NO: 2740808 - DNA, 23 bp, Homo sapiens
taacaaagttactggctctttgt

SEQ ID NO: 2740809 - DNA, 22 bp, Homo sapiens
taacaatatgattgcactaaat

SEQ ID NO: 2740810 - DNA, 15 bp, Homo sapiens
taacaggttttcttc

SEQ ID NO: 2740811 - DNA, 15 bp, Homo sapiens
taacataacaacctt

SEQ ID NO: 2740812 - DNA, 23 bp, Homo sapiens
taacatccagctctatgtgggaa

SEQ ID NO: 2740813 - DNA, 23 bp, Homo sapiens
taacatgaaaaacacggcagctg

SEQ ID NO: 2740814 - DNA, 18 bp, Homo sapiens
taaccaaagagtctctgg

SEQ ID NO: 2740815 - DNA, 15 bp, Homo sapiens
taacctcgtgtctag

SEQ ID NO: 2740816 - DNA, 15 bp, Homo sapiens
taacctgacatcacc

SEQ ID NO: 2740817 - DNA, 17 bp, Homo sapiens
taactagaactgaattt

SEQ ID NO: 2740818 - DNA, 11 bp, Homo sapiens
taactcagcca

SEQ ID NO: 2740819 - DNA, 14 bp, Homo sapiens
taactccctcctca

SEQ ID NO: 2740820 - DNA, 16 bp, Homo sapiens
taactctgcaggaaat

SEQ ID NO: 2740821 - DNA, 12 bp, Homo sapiens
taactgcaattt

SEQ ID NO: 2740822 - DNA, 22 bp, Homo sapiens
taacttgagggtaataaactta

SEQ ID NO: 2740823 - DNA, 21 bp, Homo sapiens
taactttgcttgattaaacag

SEQ ID NO: 2740824 - DNA, 17 bp, Homo sapiens
taagaaaaaaagcaaaa

SEQ ID NO: 2740825 - DNA, 17 bp, Homo sapiens
taagaaacaatttaaat

SEQ ID NO: 2740826 - DNA, 21 bp, Homo sapiens
taagaatagtctctgggttta

SEQ ID NO: 2740827 - DNA, 23 bp, Homo sapiens
taagcaagacagtggcactaaaa

SEQ ID NO: 2740828 - DNA, 16 bp, Homo sapiens
taagcagagttctttg

SEQ ID NO: 2740829 - DNA, 23 bp, Homo sapiens
taagcaggaggaggtgccaacag

SEQ ID NO: 2740830 - DNA, 20 bp, Homo sapiens
taagccaatgaagcaaacac

SEQ ID NO: 2740831 - DNA, 16 bp, Homo sapiens
taagcgggatcccagc

SEQ ID NO: 2740832 - DNA, 18 bp, Homo sapiens
taagcgggatcccagcat

SEQ ID NO: 2740833 - DNA, 13 bp, Homo sapiens
taagctgtaaaaa

SEQ ID NO: 2740834 - DNA, 16 bp, Homo sapiens
taaggaaccctggaaa

SEQ ID NO: 2740835 - DNA, 18 bp, Homo sapiens
taaggaaccctggaaact

SEQ ID NO: 2740836 - DNA, 14 bp, Homo sapiens
taaggccacactgg

SEQ ID NO: 2740837 - DNA, 18 bp, Homo sapiens
taaggtagaacctcacct

SEQ ID NO: 2740838 - DNA, 19 bp, Homo sapiens
taaggtataaggatctttt

SEQ ID NO: 2740839 - DNA, 14 bp, Homo sapiens
taagtataacaaac

SEQ ID NO: 2740840 - DNA, 15 bp, Homo sapiens
taagtataacaaact

SEQ ID NO: 2740841 - DNA, 18 bp, Homo sapiens
taagtataacaaactatg

SEQ ID NO: 2740842 - DNA, 18 bp, Homo sapiens
taagtgatttttttgtcc

SEQ ID NO: 2740843 - DNA, 17 bp, Homo sapiens
taagtttatgtctaaag

SEQ ID NO: 2740844 - DNA, 15 bp, Homo sapiens
taagtttctcatccc

SEQ ID NO: 2740845 - DNA, 16 bp, Homo sapiens
taagttttatacataa

SEQ ID NO: 2740846 - DNA, 21 bp, Homo sapiens
taagttttatacataaacagt

SEQ ID NO: 2740847 - DNA, 21 bp, Homo sapiens
taataaaaaaatatatacaga

SEQ ID NO: 2740848 - DNA, 17 bp, Homo sapiens
taataaacttagaataa

SEQ ID NO: 2740849 - DNA, 14 bp, Homo sapiens
taataaatgaggaa

SEQ ID NO: 2740850 - DNA, 19 bp, Homo sapiens
taatagcgtcataactaga

SEQ ID NO: 2740851 - DNA, 20 bp, Homo sapiens
taatatacaagcaagcaaaa

SEQ ID NO: 2740852 - DNA, 12 bp, Homo sapiens
taatatattgct

SEQ ID NO: 2740853 - DNA, 19 bp, Homo sapiens
taatatctgagaagtgtat

SEQ ID NO: 2740854 - DNA, 17 bp, Homo sapiens
taatatctgatactgta

SEQ ID NO: 2740855 - DNA, 15 bp, Homo sapiens
taatatgaaagccac

SEQ ID NO: 2740856 - DNA, 14 bp, Homo sapiens
taatattctctgat

SEQ ID NO: 2740857 - DNA, 12 bp, Homo sapiens
taatattctttt

SEQ ID NO: 2740858 - DNA, 12 bp, Homo sapiens
taatatttcttc

SEQ ID NO: 2740859 - DNA, 22 bp, Homo sapiens
taatcaagagtctctccagcct

SEQ ID NO: 2740860 - DNA, 22 bp, Homo sapiens
taatcataacatagttgaaaaa

SEQ ID NO: 2740861 - DNA, 12 bp, Homo sapiens
taatctgttgtt

SEQ ID NO: 2740862 - DNA, 16 bp, Homo sapiens
taatctgttgtttgaa

SEQ ID NO: 2740863 - DNA, 15 bp, Homo sapiens
taatcttttaaaaat

SEQ ID NO: 2740864 - DNA, 20 bp, Homo sapiens
taatgaaccgtttacagtgt

SEQ ID NO: 2740865 - DNA, 13 bp, Homo sapiens
taatgatttttgt

SEQ ID NO: 2740866 - DNA, 19 bp, Homo sapiens
taatggtgttactaaagtc

SEQ ID NO: 2740867 - DNA, 19 bp, Homo sapiens
taatgtgccccatgtccaa

SEQ ID NO: 2740868 - DNA, 15 bp, Homo sapiens
taattaattgtcatt

SEQ ID NO: 2740869 - DNA, 16 bp, Homo sapiens
taattagatcaacact

SEQ ID NO: 2740870 - DNA, 15 bp, Homo sapiens
taattattttccaaa

SEQ ID NO: 2740871 - DNA, 21 bp, Homo sapiens
taattattttccaaaatctaa

SEQ ID NO: 2740872 - DNA, 14 bp, Homo sapiens
taattcattaatct

SEQ ID NO: 2740873 - DNA, 19 bp, Homo sapiens
taattcattaatctgtttg

SEQ ID NO: 2740874 - DNA, 15 bp, Homo sapiens
taattcctggcatga

SEQ ID NO: 2740875 - DNA, 13 bp, Homo sapiens
taattctttctca

SEQ ID NO: 2740876 - DNA, 21 bp, Homo sapiens
taatttaaagaaacactaaat

SEQ ID NO: 2740877 - DNA, 16 bp, Homo sapiens
taatttaccattattt

SEQ ID NO: 2740878 - DNA, 19 bp, Homo sapiens
taatttagtcccttaaaaa

SEQ ID NO: 2740879 - DNA, 22 bp, Homo sapiens
taatttcagttctagttgattg

SEQ ID NO: 2740880 - DNA, 13 bp, Homo sapiens
taatttgtatctg

SEQ ID NO: 2740881 - DNA, 17 bp, Homo sapiens
taattttttgcagtctt

SEQ ID NO: 2740882 - DNA, 18 bp, Homo sapiens
taattttttgcagtcttt

SEQ ID NO: 2740883 - DNA, 16 bp, Homo sapiens
taatttttttttgtaa

SEQ ID NO: 2740884 - DNA, 16 bp, Homo sapiens
tacaaaaaaaatcttt

SEQ ID NO: 2740885 - DNA, 13 bp, Homo sapiens
tacaaaagcagct

SEQ ID NO: 2740886 - DNA, 15 bp, Homo sapiens
tacaaaccaggagca

SEQ ID NO: 2740887 - DNA, 14 bp, Homo sapiens
tacaaataaagatg

SEQ ID NO: 2740888 - DNA, 14 bp, Homo sapiens
tacaacaaacactg

SEQ ID NO: 2740889 - DNA, 16 bp, Homo sapiens
tacaacaaacactgtg

SEQ ID NO: 2740890 - DNA, 21 bp, Homo sapiens
tacaacagaaaccagaaaagc

SEQ ID NO: 2740891 - DNA, 19 bp, Homo sapiens
tacaacagaagttatattt

SEQ ID NO: 2740892 - DNA, 14 bp, Homo sapiens
tacaaccacatttc

SEQ ID NO: 2740893 - DNA, 14 bp, Homo sapiens
tacaaccaggtctt

SEQ ID NO: 2740894 - DNA, 15 bp, Homo sapiens
tacaaccaggtcttg

SEQ ID NO: 2740895 - DNA, 20 bp, Homo sapiens
tacaagcaagcaaaattatt

SEQ ID NO: 2740896 - DNA, 21 bp, Homo sapiens
tacaagcaagcaaaattattt

SEQ ID NO: 2740897 - DNA, 14 bp, Homo sapiens
tacaaggtatgtac

SEQ ID NO: 2740898 - DNA, 16 bp, Homo sapiens
tacaataaatgctgaa

SEQ ID NO: 2740899 - DNA, 13 bp, Homo sapiens
tacaatggccatg

SEQ ID NO: 2740900 - DNA, 18 bp, Homo sapiens
tacaattgttatgatcta

SEQ ID NO: 2740901 - DNA, 17 bp, Homo sapiens
tacacaacatgtatgtg

SEQ ID NO: 2740902 - DNA, 15 bp, Homo sapiens
tcataattcaccaaa

SEQ ID NO: 2740903 - DNA, 13 bp, Homo sapiens
tcatacattatat

SEQ ID NO: 2740904 - DNA, 22 bp, Homo sapiens
tcatcaaataaaccttgtttct

SEQ ID NO: 2740905 - DNA, 14 bp, Homo sapiens
tcatcagtaagtat

SEQ ID NO: 2740906 - DNA, 20 bp, Homo sapiens
tcatcagtaagtataacaaa

SEQ ID NO: 2740907 - DNA, 14 bp, Homo sapiens
tcatcatcagtctt

SEQ ID NO: 2740908 - DNA, 21 bp, Homo sapiens
tcatcccatctaagctgcagc

SEQ ID NO: 2740909 - DNA, 22 bp, Homo sapiens
tcatcccatgggcgaccagggc

SEQ ID NO: 2740910 - DNA, 20 bp, Homo sapiens
tcatctccagtatcctgctg

SEQ ID NO: 2740911 - DNA, 12 bp, Homo sapiens
tcatctggaggc

SEQ ID NO: 2740912 - DNA, 21 bp, Homo sapiens
tcatctgtgcctgtctgtcca

SEQ ID NO: 2740913 - DNA, 11 bp, Homo sapiens
tcatctttgct

SEQ ID NO: 2740914 - DNA, 17 bp, Homo sapiens
tcatgacttttccatgt

SEQ ID NO: 2740915 - DNA, 11 bp, Homo sapiens
tcatgagccca

SEQ ID NO: 2740916 - DNA, 21 bp, Homo sapiens
tcatgcaagacttcactgcag

SEQ ID NO: 2740917 - DNA, 15 bp, Homo sapiens
tcatggtcctggctg

SEQ ID NO: 2740918 - DNA, 23 bp, Homo sapiens
tcatgtaaattttgtatgaaaaa

SEQ ID NO: 2740919 - DNA, 12 bp, Homo sapiens
tcatgtgtatga

SEQ ID NO: 2740920 - DNA, 18 bp, Homo sapiens
tcatgttttaaaagtttg

SEQ ID NO: 2740921 - DNA, 23 bp, Homo sapiens
tcatgttttaaaagtttgtcctt

SEQ ID NO: 2740922 - DNA, 20 bp, Homo sapiens
tcattaaaacagaagcaaat

SEQ ID NO: 2740923 - DNA, 23 bp, Homo sapiens
tcattaaggtattattttttcca

SEQ ID NO: 2740924 - DNA, 15 bp, Homo sapiens
tcattaggaaaacat

SEQ ID NO: 2740925 - DNA, 18 bp, Homo sapiens
tcattaggaaaacatctt

SEQ ID NO: 2740926 - DNA, 17 bp, Homo sapiens
tcattcaaaatgtccag

SEQ ID NO: 2740927 - DNA, 19 bp, Homo sapiens
tcattcaggtgttctcttc

SEQ ID NO: 2740928 - DNA, 16 bp, Homo sapiens
tcattcatttattcat

SEQ ID NO: 2740929 - DNA, 16 bp, Homo sapiens
tcattccaggtgtgtt

SEQ ID NO: 2740930 - DNA, 23 bp, Homo sapiens
tcattggttaaaatattactgat

SEQ ID NO: 2740931 - DNA, 18 bp, Homo sapiens
tcatttaaacatgcagaa

SEQ ID NO: 2740932 - DNA, 18 bp, Homo sapiens
tcatttgacaacacatgt

SEQ ID NO: 2740933 - DNA, 17 bp, Homo sapiens
tcattttgccattaaaa

SEQ ID NO: 2740934 - DNA, 22 bp, Homo sapiens
tccaaaaagatttattaattaa

SEQ ID NO: 2740935 - DNA, 14 bp, Homo sapiens
tccaaaacatttct

SEQ ID NO: 2740936 - DNA, 22 bp, Homo sapiens
tccaaaacatttctggacagta

SEQ ID NO: 2740937 - DNA, 23 bp, Homo sapiens
tccaaatgctgtgcaaacagtgt

SEQ ID NO: 2740938 - DNA, 18 bp, Homo sapiens
tccaacaataaagagctc

SEQ ID NO: 2740939 - DNA, 19 bp, Homo sapiens
tccaacaataaagagctca

SEQ ID NO: 2740940 - DNA, 15 bp, Homo sapiens
tccaacccagcctga

SEQ ID NO: 2740941 - DNA, 16 bp, Homo sapiens
tccaacccagcctgag

SEQ ID NO: 2740942 - DNA, 12 bp, Homo sapiens
tccaaccccagc

SEQ ID NO: 2740943 - DNA, 14 bp, Homo sapiens
tccaaccccagctg

SEQ ID NO: 2740944 - DNA, 15 bp, Homo sapiens
tccaaccccagctgg

SEQ ID NO: 2740945 - DNA, 18 bp, Homo sapiens
tccaaccccagctggcct

SEQ ID NO: 2740946 - DNA, 17 bp, Homo sapiens
tccaacccctcccccac

SEQ ID NO: 2740947 - DNA, 20 bp, Homo sapiens
tccaagaccttacaaccaca

SEQ ID NO: 2740948 - DNA, 15 bp, Homo sapiens
tccaaggtggtctgc

SEQ ID NO: 2740949 - DNA, 23 bp, Homo sapiens
tccaaggtggtctgctcgggccc

SEQ ID NO: 2740950 - DNA, 16 bp, Homo sapiens
tccaagtccaacctgc

SEQ ID NO: 2740951 - DNA, 22 bp, Homo sapiens
tccaagtccaacctgcctgtgc

SEQ ID NO: 2740952 - DNA, 19 bp, Homo sapiens
tccaagtccacagtggaac

SEQ ID NO: 2740953 - DNA, 14 bp, Homo sapiens
tccacataaaggta

SEQ ID NO: 2740954 - DNA, 16 bp, Homo sapiens
tccaccagagcagggg

SEQ ID NO: 2740955 - DNA, 18 bp, Homo sapiens
tccaccagagcaggggct

SEQ ID NO: 2740956 - DNA, 20 bp, Homo sapiens
tccaccagagcaggggctgc

SEQ ID NO: 2740957 - DNA, 22 bp, Homo sapiens
tccaccagagcaggggctgctg

SEQ ID NO: 2740958 - DNA, 18 bp, Homo sapiens
tccaccctaaagtctcag

SEQ ID NO: 2740959 - DNA, 21 bp, Homo sapiens
tccacctagtggctgtccagt

SEQ ID NO: 2740960 - DNA, 14 bp, Homo sapiens
tccacctcctgggt

SEQ ID NO: 2740961 - DNA, 18 bp, Homo sapiens
tccacgtgtatgcaagtg

SEQ ID NO: 2740962 - DNA, 17 bp, Homo sapiens
tccactcaggtctgttt

SEQ ID NO: 2740963 - DNA, 17 bp, Homo sapiens
tccactccacctccacc

SEQ ID NO: 2740964 - DNA, 12 bp, Homo sapiens
tccactcccact

SEQ ID NO: 2740965 - DNA, 23 bp, Homo sapiens
tccactgcaaagttttctttcca

SEQ ID NO: 2740966 - DNA, 18 bp, Homo sapiens
tccactgccaaaacaatg

SEQ ID NO: 2740967 - DNA, 21 bp, Homo sapiens
tccagaaagaaaatgaatttg

SEQ ID NO: 2740968 - DNA, 17 bp, Homo sapiens
tccagaattacccttcc

SEQ ID NO: 2740969 - DNA, 20 bp, Homo sapiens
tccagaattacccttcctca

SEQ ID NO: 2740970 - DNA, 15 bp, Homo sapiens
tccagaccattgtct

SEQ ID NO: 2740971 - DNA, 17 bp, Homo sapiens
tccagaccattgtcttc

SEQ ID NO: 2740972 - DNA, 15 bp, Homo sapiens
tccagcctgacgcct

SEQ ID NO: 2740973 - DNA, 11 bp, Homo sapiens
tccagcctggg

SEQ ID NO: 2740974 - DNA, 17 bp, Homo sapiens
tccagcctgggcgacag

SEQ ID NO: 2740975 - DNA, 23 bp, Homo sapiens
tccagcctgggcgacagagcaag

SEQ ID NO: 2740976 - DNA, 22 bp, Homo sapiens
tccagctaagcctgatgatgga

SEQ ID NO: 2740977 - DNA, 18 bp, Homo sapiens
tccagctgttacctgaga

SEQ ID NO: 2740978 - DNA, 15 bp, Homo sapiens
tccagcttcctctga

SEQ ID NO: 2740979 - DNA, 19 bp, Homo sapiens
tccagctttccctccccag

SEQ ID NO: 2740980 - DNA, 16 bp, Homo sapiens
tccaggactcagggac

SEQ ID NO: 2740981 - DNA, 22 bp, Homo sapiens
tccaggactggggcttgccagg

SEQ ID NO: 2740982 - DNA, 19 bp, Homo sapiens
tccaggcccggtgaggcca

SEQ ID NO: 2740983 - DNA, 12 bp, Homo sapiens
tccagggacaga

SEQ ID NO: 2740984 - DNA, 20 bp, Homo sapiens
tccaggggagggaaaagcta

SEQ ID NO: 2740985 - DNA, 23 bp, Homo sapiens
tccaggggagggaaaagctaaga

SEQ ID NO: 2740986 - DNA, 22 bp, Homo sapiens
tccagtcaagttccctcctgca

SEQ ID NO: 2740987 - DNA, 16 bp, Homo sapiens
tccagtcctgctggcc

SEQ ID NO: 2740988 - DNA, 19 bp, Homo sapiens
tccagtcctgctggcctgc

SEQ ID NO: 2740989 - DNA, 20 bp, Homo sapiens
tccagtcctgctggcctgct

SEQ ID NO: 2740990 - DNA, 22 bp, Homo sapiens
tccagtcctgctggcctgctct

SEQ ID NO: 2740991 - DNA, 17 bp, Homo sapiens
tccagtcctttgttgct

SEQ ID NO: 2740992 - DNA, 20 bp, Homo sapiens
tccagtgcccattcctcacc

SEQ ID NO: 2740993 - DNA, 20 bp, Homo sapiens
tccagtgctggctgctggcc

SEQ ID NO: 2740994 - DNA, 14 bp, Homo sapiens
tccagttctgatga

SEQ ID NO: 2740995 - DNA, 15 bp, Homo sapiens
tccagttctgatgag

SEQ ID NO: 2740996 - DNA, 17 bp, Homo sapiens
tccagttctgatgaggc

SEQ ID NO: 2740997 - DNA, 12 bp, Homo sapiens
tccataaagtaa

SEQ ID NO: 2740998 - DNA, 13 bp, Homo sapiens
tccatcctcctct

SEQ ID NO: 2740999 - DNA, 14 bp, Homo sapiens
tccatcctcctctc

SEQ ID NO: 2741000 - DNA, 15 bp, Homo sapiens
tccatcctcctctcc

SEQ ID NO: 2741001 - DNA, 19 bp, Homo sapiens
tccatctgtggaaatgaca

SEQ ID NO: 2741002 - DNA, 15 bp, Homo sapiens
tccatgcaagtgctg

SEQ ID NO: 2741003 - DNA, 22 bp, Homo sapiens
tccatgctggtgtggccaaggc

SEQ ID NO: 2741004 - DNA, 13 bp, Homo sapiens
tccatttggcaga

SEQ ID NO: 2741005 - DNA, 20 bp, Homo sapiens
tccatttggcagaactgctg

SEQ ID NO: 2741006 - DNA, 15 bp, Homo sapiens
tccattttcttgtca

SEQ ID NO: 2741007 - DNA, 14 bp, Homo sapiens
tcccacccaggaag

SEQ ID NO: 2741008 - DNA, 22 bp, Homo sapiens
tcccacggggaccactgggccc

SEQ ID NO: 2741009 - DNA, 13 bp, Homo sapiens
tcccacgtgcaca

SEQ ID NO: 2741010 - DNA, 18 bp, Homo sapiens
tcccactaagctttctcc

SEQ ID NO: 2741011 - DNA, 16 bp, Homo sapiens
tcccactgcaccccct

SEQ ID NO: 2741012 - DNA, 21 bp, Homo sapiens
tcccactgcaccccctcctgc

SEQ ID NO: 2741013 - DNA, 14 bp, Homo sapiens
tcccagagagacgc

SEQ ID NO: 2741014 - DNA, 20 bp, Homo sapiens
tcccagcaaagttttcagat

SEQ ID NO: 2741015 - DNA, 16 bp, Homo sapiens
tcccagcatctcagag

SEQ ID NO: 2741016 - DNA, 23 bp, Homo sapiens
tcccagcctggccaccagcttcc

SEQ ID NO: 2741017 - DNA, 16 bp, Homo sapiens
tcccagctgacagtcc

SEQ ID NO: 2741018 - DNA, 24 bp, Homo sapiens
tcccagctgacagtcctctccacc

SEQ ID NO: 2741019 - DNA, 19 bp, Homo sapiens
tcccagctttctgtgtgca

SEQ ID NO: 2741020 - DNA, 20 bp, Homo sapiens
tcccagggccagggccctgc

SEQ ID NO: 2741021 - DNA, 14 bp, Homo sapiens
tcccagtgacaaca

SEQ ID NO: 2741022 - DNA, 22 bp, Homo sapiens
tcccagtgagaagggcctgctc

SEQ ID NO: 2741023 - DNA, 13 bp, Homo sapiens
tcccagtgagcct

SEQ ID NO: 2741024 - DNA, 15 bp, Homo sapiens
tcccagtgagcctct

SEQ ID NO: 2741025 - DNA, 20 bp, Homo sapiens
tctgtccaacccctccccca

SEQ ID NO: 2741026 - DNA, 16 bp, Homo sapiens
tctgtccagccagctc

SEQ ID NO: 2741027 - DNA, 19 bp, Homo sapiens
tctgtccatcctcctctcc

SEQ ID NO: 2741028 - DNA, 10 bp, Homo sapiens
tctgtcctga

SEQ ID NO: 2741029 - DNA, 15 bp, Homo sapiens
tctgtctgctcttat

SEQ ID NO: 2741030 - DNA, 23 bp, Homo sapiens
tctgtgaaagtctcctgtatcat

SEQ ID NO: 2741031 - DNA, 12 bp, Homo sapiens
tctgtgagattc

SEQ ID NO: 2741032 - DNA, 20 bp, Homo sapiens
tctgtgcccatgggcactgc

SEQ ID NO: 2741033 - DNA, 21 bp, Homo sapiens
tctgtgcccatgggcactgct

SEQ ID NO: 2741034 - DNA, 16 bp, Homo sapiens
tctgtgggctgcactc

SEQ ID NO: 2741035 - DNA, 13 bp, Homo sapiens
tcttaaaaatctt

SEQ ID NO: 2741036 - DNA, 14 bp, Homo sapiens
tcttacctttatga

SEQ ID NO: 2741037 - DNA, 12 bp, Homo sapiens
tcttactttgtg

SEQ ID NO: 2741038 - DNA, 11 bp, Homo sapiens
tcttcagctgg

SEQ ID NO: 2741039 - DNA, 20 bp, Homo sapiens
tcttcagctggtggatggtg

SEQ ID NO: 2741040 - DNA, 13 bp, Homo sapiens
tcttcatttctct

SEQ ID NO: 2741041 - DNA, 18 bp, Homo sapiens
tcttccaaccccagctgg

SEQ ID NO: 2741042 - DNA, 20 bp, Homo sapiens
tcttccaaccccagctggcc

SEQ ID NO: 2741043 - DNA, 14 bp, Homo sapiens
tcttccaccagagc

SEQ ID NO: 2741044 - DNA, 21 bp, Homo sapiens
tcttcttattcatgctttctc

SEQ ID NO: 2741045 - DNA, 14 bp, Homo sapiens
tcttgatctcctga

SEQ ID NO: 2741046 - DNA, 21 bp, Homo sapiens
tcttgccccaaatcacaaaca

SEQ ID NO: 2741047 - DNA, 20 bp, Homo sapiens
tcttgccccaacccccagca

SEQ ID NO: 2741048 - DNA, 22 bp, Homo sapiens
tcttgccccaacccccagcacc

SEQ ID NO: 2741049 - DNA, 17 bp, Homo sapiens
tcttggaattttgtaaa

SEQ ID NO: 2741050 - DNA, 19 bp, Homo sapiens
tcttggaattttgtaaaaa

SEQ ID NO: 2741051 - DNA, 17 bp, Homo sapiens
tcttggcacctgcctag

SEQ ID NO: 2741052 - DNA, 13 bp, Homo sapiens
tcttggccagagc

SEQ ID NO: 2741053 - DNA, 13 bp, Homo sapiens
tcttggctcactg

SEQ ID NO: 2741054 - DNA, 21 bp, Homo sapiens
tcttgggcctgacctccagtc

SEQ ID NO: 2741055 - DNA, 13 bp, Homo sapiens
tcttggggctcgc

SEQ ID NO: 2741056 - DNA, 13 bp, Homo sapiens
tcttggtctcccg

SEQ ID NO: 2741057 - DNA, 18 bp, Homo sapiens
tcttggttagagaagtaa

SEQ ID NO: 2741058 - DNA, 22 bp, Homo sapiens
tctttaatggttaataggatga

SEQ ID NO: 2741059 - DNA, 16 bp, Homo sapiens
tctttatgcaaaaaca

SEQ ID NO: 2741060 - DNA, 21 bp, Homo sapiens
tctttattaaatgtagaaagt

SEQ ID NO: 2741061 - DNA, 14 bp, Homo sapiens
tctttcatacatta

SEQ ID NO: 2741062 - DNA, 15 bp, Homo sapiens
tctttccaaaacatt

SEQ ID NO: 2741063 - DNA, 15 bp, Homo sapiens
tctttccagacccca

SEQ ID NO: 2741064 - DNA, 16 bp, Homo sapiens
tctttgcaccaaagac

SEQ ID NO: 2741065 - DNA, 17 bp, Homo sapiens
tctttgctacaataaat

SEQ ID NO: 2741066 - DNA, 22 bp, Homo sapiens
tctttgctacaataaatgctga

SEQ ID NO: 2741067 - DNA, 17 bp, Homo sapiens
tctttgctgctgtggaa

SEQ ID NO: 2741068 - DNA, 18 bp, Homo sapiens
tctttgtctaaacaaggt

SEQ ID NO: 2741069 - DNA, 15 bp, Homo sapiens
tcttttaaaaatgat

SEQ ID NO: 2741070 - DNA, 20 bp, Homo sapiens
tcttttacatacagtgatat

SEQ ID NO: 2741071 - DNA, 16 bp, Homo sapiens
tcttttgttttcttca

SEQ ID NO: 2741072 - DNA, 17 bp, Homo sapiens
tctttttaagctcagtg

SEQ ID NO: 2741073 - DNA, 15 bp, Homo sapiens
tgaaaaatatgtgct

SEQ ID NO: 2741074 - DNA, 20 bp, Homo sapiens
tgaaaaatatgtgcttgaaa

SEQ ID NO: 2741075 - DNA, 15 bp, Homo sapiens
tgaaaacattgatga

SEQ ID NO: 2741076 - DNA, 20 bp, Homo sapiens
tgaaaacattgatgaatgag

SEQ ID NO: 2741077 - DNA, 22 bp, Homo sapiens
tgaaaaccatccatctgtggaa

SEQ ID NO: 2741078 - DNA, 16 bp, Homo sapiens
tgaaaactaaggattt

SEQ ID NO: 2741079 - DNA, 13 bp, Homo sapiens
tgaaacagcctgg

SEQ ID NO: 2741080 - DNA, 17 bp, Homo sapiens
tgaaacagcctgggtga

SEQ ID NO: 2741081 - DNA, 14 bp, Homo sapiens
tgaaagaaggagca

SEQ ID NO: 2741082 - DNA, 16 bp, Homo sapiens
tgaaagaattctattt

SEQ ID NO: 2741083 - DNA, 16 bp, Homo sapiens
tgaaagacatcaatga

SEQ ID NO: 2741084 - DNA, 19 bp, Homo sapiens
tgaaagacatcaatgaaac

SEQ ID NO: 2741085 - DNA, 17 bp, Homo sapiens
tgaaagctgacattaag

SEQ ID NO: 2741086 - DNA, 20 bp, Homo sapiens
tgaaagtctcctgtatcatt

SEQ ID NO: 2741087 - DNA, 21 bp, Homo sapiens
tgaaatcaccacattctgtct

SEQ ID NO: 2741088 - DNA, 17 bp, Homo sapiens
tgaaatcatattatttt

SEQ ID NO: 2741089 - DNA, 21 bp, Homo sapiens
tgaaattcaacctgtgtctta

SEQ ID NO: 2741090 - DNA, 22 bp, Homo sapiens
tgaaattgtctagcagagcagg

SEQ ID NO: 2741091 - DNA, 17 bp, Homo sapiens
tgaacaaaagcttttct

SEQ ID NO: 2741092 - DNA, 16 bp, Homo sapiens
tgaacaatattttctc

SEQ ID NO: 2741093 - DNA, 14 bp, Homo sapiens
tgaaccgacttttc

SEQ ID NO: 2741094 - DNA, 14 bp, Homo sapiens
tgaaccgtgtgctc

SEQ ID NO: 2741095 - DNA, 14 bp, Homo sapiens
tgaagacaggacag

SEQ ID NO: 2741096 - DNA, 16 bp, Homo sapiens
tgaagccactgaagct

SEQ ID NO: 2741097 - DNA, 20 bp, Homo sapiens
tgaagccactgaagctggga

SEQ ID NO: 2741098 - DNA, 13 bp, Homo sapiens
tgaaggagaaaat

SEQ ID NO: 2741099 - DNA, 23 bp, Homo sapiens
tgaaggagaaaatgcattatgtg

SEQ ID NO: 2741100 - DNA, 16 bp, Homo sapiens
tgaagggtcatttctc

SEQ ID NO: 2741101 - DNA, 17 bp, Homo sapiens
tgaaggtaataaataca

SEQ ID NO: 2741102 - DNA, 19 bp, Homo sapiens
tgaagtgcagctcaggaga

SEQ ID NO: 2741103 - DNA, 20 bp, Homo sapiens
tgaagtgcagctcaggagac

SEQ ID NO: 2741104 - DNA, 22 bp, Homo sapiens
tgaagtgtcgagtccagtcctt

SEQ ID NO: 2741105 - DNA, 15 bp, Homo sapiens
tgaataaacttcagc

SEQ ID NO: 2741106 - DNA, 16 bp, Homo sapiens
tgaataaacttcagca

SEQ ID NO: 2741107 - DNA, 22 bp, Homo sapiens
tgaatagaggccaaattaatct

SEQ ID NO: 2741108 - DNA, 16 bp, Homo sapiens
tgaatattaagaaaca

SEQ ID NO: 2741109 - DNA, 19 bp, Homo sapiens
tgaatattaagaaacaatt

SEQ ID NO: 2741110 - DNA, 13 bp, Homo sapiens
tgaatctgcaggg

SEQ ID NO: 2741111 - DNA, 16 bp, Homo sapiens
tgaatggcatggagac

SEQ ID NO: 2741112 - DNA, 21 bp, Homo sapiens
tgaatggcctgccttgaagcc

SEQ ID NO: 2741113 - DNA, 16 bp, Homo sapiens
tgaatgggaaagtatt

SEQ ID NO: 2741114 - DNA, 19 bp, Homo sapiens
tgaatgtcattatttgata

SEQ ID NO: 2741115 - DNA, 16 bp, Homo sapiens
tgaatgtcattcacaa

SEQ ID NO: 2741116 - DNA, 12 bp, Homo sapiens
tgaatgtcccag

SEQ ID NO: 2741117 - DNA, 15 bp, Homo sapiens
tgaatgtcccagagg

SEQ ID NO: 2741118 - DNA, 16 bp, Homo sapiens
tgaatgtgttgatttg

SEQ ID NO: 2741119 - DNA, 19 bp, Homo sapiens
tgaattacactcaaggaaa

SEQ ID NO: 2741120 - DNA, 15 bp, Homo sapiens
tgaattttcccactg

SEQ ID NO: 2741121 - DNA, 17 bp, Homo sapiens
tgaattttcccactgca

SEQ ID NO: 2741122 - DNA, 16 bp, Homo sapiens
tgacaagggcacaagc

SEQ ID NO: 2741123 - DNA, 22 bp, Homo sapiens
tgacaatgcgtggcacatctaa

SEQ ID NO: 2741124 - DNA, 17 bp, Homo sapiens
tgacagtcctctccacc

SEQ ID NO: 2741125 - DNA, 12 bp, Homo sapiens
tgacccagtgtg

SEQ ID NO: 2741126 - DNA, 17 bp, Homo sapiens
tgacccagtgtgtgctc

SEQ ID NO: 2741127 - DNA, 19 bp, Homo sapiens
tgacccagtgtgtgctcag

SEQ ID NO: 2741128 - DNA, 23 bp, Homo sapiens
tgaccccaggcagctcgagcatg

SEQ ID NO: 2741129 - DNA, 22 bp, Homo sapiens
tgacccccactgccgcctcctt

SEQ ID NO: 2741130 - DNA, 22 bp, Homo sapiens
tgacccggattggccctgcccc

SEQ ID NO: 2741131 - DNA, 23 bp, Homo sapiens
tgacccggattggccctgcccct

SEQ ID NO: 2741132 - DNA, 21 bp, Homo sapiens
tgaccgcaggttgctttccca

SEQ ID NO: 2741133 - DNA, 17 bp, Homo sapiens
tgacctccagtcctgct

SEQ ID NO: 2741134 - DNA, 19 bp, Homo sapiens
tgacctccagtcctgctgg

SEQ ID NO: 2741135 - DNA, 22 bp, Homo sapiens
tgacctccagtcctgctggcct

SEQ ID NO: 2741136 - DNA, 14 bp, Homo sapiens
tgacctgaactctg

SEQ ID NO: 2741137 - DNA, 20 bp, Homo sapiens
tgacctgcaggccaagagca

SEQ ID NO: 2741138 - DNA, 13 bp, Homo sapiens
tgacctgccccgc

SEQ ID NO: 2741139 - DNA, 21 bp, Homo sapiens
tgacgcctactggggcagggc

SEQ ID NO: 2741140 - DNA, 23 bp, Homo sapiens
tgacggactcagactcctggctt

SEQ ID NO: 2741141 - DNA, 20 bp, Homo sapiens
tgacggtcctttaggcagcc

SEQ ID NO: 2741142 - DNA, 13 bp, Homo sapiens
tgacgtaagctct

SEQ ID NO: 2741143 - DNA, 23 bp, Homo sapiens
tgacgtgcacctgtactcaggag

SEQ ID NO: 2741144 - DNA, 21 bp, Homo sapiens
tgactaggtacaggcaagctt

SEQ ID NO: 2741145 - DNA, 19 bp, Homo sapiens
tgactcgggctcctgtgcc

SEQ ID NO: 2741146 - DNA, 15 bp, Homo sapiens
tgactctctgtgacc

SEQ ID NO: 2741147 - DNA, 21 bp, Homo sapiens
tgactgagtctggcaaacatg

SEQ ID NO: 2741148 - DNA, 17 bp, Homo sapiens
tgacttcaggggctgcc

SEQ ID NO: 2741149 - DNA, 19 bp, Homo sapiens
tgggctctgccccagctct

SEQ ID NO: 2741150 - DNA, 21 bp, Homo sapiens
tgggctctgtgggctgcactc

SEQ ID NO: 2741151 - DNA, 16 bp, Homo sapiens
tgggctgagccctggc

SEQ ID NO: 2741152 - DNA, 17 bp, Homo sapiens
tgggctgagccctggca

SEQ ID NO: 2741153 - DNA, 18 bp, Homo sapiens
tgggctgagccctggcag

SEQ ID NO: 2741154 - DNA, 21 bp, Homo sapiens
tgggctgcactctgtgcccat

SEQ ID NO: 2741155 - DNA, 16 bp, Homo sapiens
tggggcactcccccag

SEQ ID NO: 2741156 - DNA, 18 bp, Homo sapiens
tggggcagggcagcaggc

SEQ ID NO: 2741157 - DNA, 15 bp, Homo sapiens
tggggccacatagct

SEQ ID NO: 2741158 - DNA, 22 bp, Homo sapiens
tggggcctatcagtgtgccccc

SEQ ID NO: 2741159 - DNA, 21 bp, Homo sapiens
tggggctcgccccacccaggg

SEQ ID NO: 2741160 - DNA, 17 bp, Homo sapiens
tggggctctcacagata

SEQ ID NO: 2741161 - DNA, 17 bp, Homo sapiens
tggggctctgtgcaggg

SEQ ID NO: 2741162 - DNA, 15 bp, Homo sapiens
tggggctggtgaggc

SEQ ID NO: 2741163 - DNA, 21 bp, Homo sapiens
tgggggaagagcacagccctc

SEQ ID NO: 2741164 - DNA, 23 bp, Homo sapiens
tgggggcttccctgggcctcagc

SEQ ID NO: 2741165 - DNA, 14 bp, Homo sapiens
tggggggagggcac

SEQ ID NO: 2741166 - DNA, 17 bp, Homo sapiens
tggggtgtggttccaga

SEQ ID NO: 2741167 - DNA, 14 bp, Homo sapiens
tgggtaacgtgaga

SEQ ID NO: 2741168 - DNA, 15 bp, Homo sapiens
tgggtcctcggccca

SEQ ID NO: 2741169 - DNA, 17 bp, Homo sapiens
tgggtcctcggcccatc

SEQ ID NO: 2741170 - DNA, 23 bp, Homo sapiens
tgggtcctcggcccatctgtcca

SEQ ID NO: 2741171 - DNA, 21 bp, Homo sapiens
tgggtcctctgcttcctgagc

SEQ ID NO: 2741172 - DNA, 13 bp, Homo sapiens
tgggtgagagagg

SEQ ID NO: 2741173 - DNA, 19 bp, Homo sapiens
tgggtgcgaccccatctgc

SEQ ID NO: 2741174 - DNA, 14 bp, Homo sapiens
tgggtggcccatcc

SEQ ID NO: 2741175 - DNA, 18 bp, Homo sapiens
tgggtgtgtgtagccaag

SEQ ID NO: 2741176 - DNA, 21 bp, Homo sapiens
tgggttcctcttccccactcc

SEQ ID NO: 2741177 - DNA, 22 bp, Homo sapiens
tgggtttacaacaaacactgtg

SEQ ID NO: 2741178 - DNA, 14 bp, Homo sapiens
tgggtttcaattta

SEQ ID NO: 2741179 - DNA, 16 bp, Homo sapiens
tgggtttggcccctgg

SEQ ID NO: 2741180 - DNA, 21 bp, Homo sapiens
tggtaatttgtatctgaagga

SEQ ID NO: 2741181 - DNA, 16 bp, Homo sapiens
tggtactaaggagaat

SEQ ID NO: 2741182 - DNA, 19 bp, Homo sapiens
tggtagagctggtgccaga

SEQ ID NO: 2741183 - DNA, 21 bp, Homo sapiens
tggtatcgttcgcttgtttta

SEQ ID NO: 2741184 - DNA, 20 bp, Homo sapiens
tggtcaggctggtctcgaac

SEQ ID NO: 2741185 - DNA, 23 bp, Homo sapiens
tggtcccaagtagtagtgtcttc

SEQ ID NO: 2741186 - DNA, 19 bp, Homo sapiens
tggtcccacccaggaaggg

SEQ ID NO: 2741187 - DNA, 14 bp, Homo sapiens
tggtcctggggctc

SEQ ID NO: 2741188 - DNA, 16 bp, Homo sapiens
tggtcctggggctctg

SEQ ID NO: 2741189 - DNA, 19 bp, Homo sapiens
tggtcctggggctctgtgc

SEQ ID NO: 2741190 - DNA, 17 bp, Homo sapiens
tggtctcgaactcctga

SEQ ID NO: 2741191 - DNA, 17 bp, Homo sapiens
tggtctgcatcagcttt

SEQ ID NO: 2741192 - DNA, 19 bp, Homo sapiens
tggtctgctcgggcccagg

SEQ ID NO: 2741193 - DNA, 17 bp, Homo sapiens
tggtcttgatctcctga

SEQ ID NO: 2741194 - DNA, 18 bp, Homo sapiens
tggtcttgatctcctgag

SEQ ID NO: 2741195 - DNA, 15 bp, Homo sapiens
tggtgaacattgcaa

SEQ ID NO: 2741196 - DNA, 23 bp, Homo sapiens
tggtgacttcctcgcctctccca

SEQ ID NO: 2741197 - DNA, 15 bp, Homo sapiens
tggtgaggcccagcc

SEQ ID NO: 2741198 - DNA, 16 bp, Homo sapiens
tggtgaggccggccct

SEQ ID NO: 2741199 - DNA, 18 bp, Homo sapiens
tggtgaggccggccctgc

SEQ ID NO: 2741200 - DNA, 20 bp, Homo sapiens
tggtgaggccggccctgccc

SEQ ID NO: 2741201 - DNA, 19 bp, Homo sapiens
tggtgcagaggtgagcaga

SEQ ID NO: 2741202 - DNA, 20 bp, Homo sapiens
tggtgcagaggtgagcagag

SEQ ID NO: 2741203 - DNA, 22 bp, Homo sapiens
tggtgctcacgactcttcctgc

SEQ ID NO: 2741204 - DNA, 14 bp, Homo sapiens
tggtggatggtgac

SEQ ID NO: 2741205 - DNA, 23 bp, Homo sapiens
tggtggatggtgacttttgaaga

SEQ ID NO: 2741206 - DNA, 14 bp, Homo sapiens
tggtgtgtgtctct

SEQ ID NO: 2741207 - DNA, 15 bp, Homo sapiens
tggtgtgtgtctctg

SEQ ID NO: 2741208 - DNA, 16 bp, Homo sapiens
tggtttgcacataaaa

SEQ ID NO: 2741209 - DNA, 11 bp, Homo sapiens
tggtttgtaat

SEQ ID NO: 2741210 - DNA, 17 bp, Homo sapiens
tgtaaaaagaaattgtg

SEQ ID NO: 2741211 - DNA, 20 bp, Homo sapiens
tgtaaaaagaaattgtgaaa

SEQ ID NO: 2741212 - DNA, 22 bp, Homo sapiens
tgtaaagtgcaatgtcctgcat

SEQ ID NO: 2741213 - DNA, 22 bp, Homo sapiens
tgtaaatgaagggtcatttctc

SEQ ID NO: 2741214 - DNA, 13 bp, Homo sapiens
tgtaacctcgtgt

SEQ ID NO: 2741215 - DNA, 22 bp, Homo sapiens
tgtaagcattctgagctgggct

SEQ ID NO: 2741216 - DNA, 22 bp, Homo sapiens
tgtaagcttagattttctgtaa

SEQ ID NO: 2741217 - DNA, 14 bp, Homo sapiens
tgtaaggtcttctt

SEQ ID NO: 2741218 - DNA, 18 bp, Homo sapiens
tgtaagtaaatgctttga

SEQ ID NO: 2741219 - DNA, 20 bp, Homo sapiens
tgtaagtttatgtctaaaga

SEQ ID NO: 2741220 - DNA, 12 bp, Homo sapiens
tgtaataacaga

SEQ ID NO: 2741221 - DNA, 17 bp, Homo sapiens
tgtacagaagaaactga

SEQ ID NO: 2741222 - DNA, 18 bp, Homo sapiens
tgtacagaagaaactgaa

SEQ ID NO: 2741223 - DNA, 13 bp, Homo sapiens
tgtacattactgt

SEQ ID NO: 2741224 - DNA, 16 bp, Homo sapiens
tgtaccacaccctgcc

SEQ ID NO: 2741225 - DNA, 18 bp, Homo sapiens
tgtaccacaccctgcctg

SEQ ID NO: 2741226 - DNA, 18 bp, Homo sapiens
tgtactggagagtggcaa

SEQ ID NO: 2741227 - DNA, 16 bp, Homo sapiens
tgtagccttgcccgga

SEQ ID NO: 2741228 - DNA, 13 bp, Homo sapiens
tgtatacaaacag

SEQ ID NO: 2741229 - DNA, 17 bp, Homo sapiens
tgtataccatgatgcat

SEQ ID NO: 2741230 - DNA, 21 bp, Homo sapiens
tgtataccatgatgcatggag

SEQ ID NO: 2741231 - DNA, 16 bp, Homo sapiens
tgtatataacttattt

SEQ ID NO: 2741232 - DNA, 12 bp, Homo sapiens
tgtatatagttt

SEQ ID NO: 2741233 - DNA, 19 bp, Homo sapiens
tgtatgagactgtgtttct

SEQ ID NO: 2741234 - DNA, 15 bp, Homo sapiens
tgtatggcttttctc

SEQ ID NO: 2741235 - DNA, 14 bp, Homo sapiens
tgtattaacaaagt

SEQ ID NO: 2741236 - DNA, 18 bp, Homo sapiens
tgtattaacaaagttact

SEQ ID NO: 2741237 - DNA, 22 bp, Homo sapiens
tgtattaacaaagttactggct

SEQ ID NO: 2741238 - DNA, 14 bp, Homo sapiens
tgtattagccagtc

SEQ ID NO: 2741239 - DNA, 17 bp, Homo sapiens
tgtattagccagtcatt

SEQ ID NO: 2741240 - DNA, 22 bp, Homo sapiens
tgtatttaagaaagggaaagct

SEQ ID NO: 2741241 - DNA, 16 bp, Homo sapiens
tgtcaactttcatttg

SEQ ID NO: 2741242 - DNA, 15 bp, Homo sapiens
tgtcacagctcttgt

SEQ ID NO: 2741243 - DNA, 14 bp, Homo sapiens
tgtcaccctgcaga

SEQ ID NO: 2741244 - DNA, 18 bp, Homo sapiens
tgtcaccctgcagagcta

SEQ ID NO: 2741245 - DNA, 14 bp, Homo sapiens
tgtcaccctggcca

SEQ ID NO: 2741246 - DNA, 15 bp, Homo sapiens
tgtcaccttcctagt

SEQ ID NO: 2741247 - DNA, 21 bp, Homo sapiens
tgtcactgaagtgattgaaag

SEQ ID NO: 2741248 - DNA, 13 bp, Homo sapiens
tgtcactggctgc

SEQ ID NO: 2741249 - DNA, 14 bp, Homo sapiens
tgtcactggctgcc

SEQ ID NO: 2741250 - DNA, 16 bp, Homo sapiens
tgtcactggctgcctc

SEQ ID NO: 2741251 - DNA, 18 bp, Homo sapiens
tgtcactggctgcctcca

SEQ ID NO: 2741252 - DNA, 12 bp, Homo sapiens
tgtcagaaactc

SEQ ID NO: 2741253 - DNA, 13 bp, Homo sapiens
tgtcagtgccgcc

SEQ ID NO: 2741254 - DNA, 16 bp, Homo sapiens
tgtcagtgccgccgcc

SEQ ID NO: 2741255 - DNA, 13 bp, Homo sapiens
tgtcattggaagc

SEQ ID NO: 2741256 - DNA, 22 bp, Homo sapiens
tgtcatttgacaacacatgtgg

SEQ ID NO: 2741257 - DNA, 19 bp, Homo sapiens
tgtccaacccctcccccac

SEQ ID NO: 2741258 - DNA, 21 bp, Homo sapiens
tgtccaacccctcccccacgt

SEQ ID NO: 2741259 - DNA, 22 bp, Homo sapiens
tgtccaacccctcccccacgtc

SEQ ID NO: 2741260 - DNA, 20 bp, Homo sapiens
tgtccagaccattgtcttcc

SEQ ID NO: 2741261 - DNA, 15 bp, Homo sapiens
tgtccagccagctcc

SEQ ID NO: 2741262 - DNA, 18 bp, Homo sapiens
tgtccagtgcccattcct

SEQ ID NO: 2741263 - DNA, 13 bp, Homo sapiens
tgtccagtttcca

SEQ ID NO: 2741264 - DNA, 12 bp, Homo sapiens
tgtccataaagt

SEQ ID NO: 2741265 - DNA, 17 bp, Homo sapiens
tgtccatcctcctctcc

SEQ ID NO: 2741266 - DNA, 18 bp, Homo sapiens
tgtcccagtccaaattgt

SEQ ID NO: 2741267 - DNA, 21 bp, Homo sapiens
tgtccccacgtatgtcggcac

SEQ ID NO: 2741268 - DNA, 13 bp, Homo sapiens
tgtccccagctcc

SEQ ID NO: 2741269 - DNA, 14 bp, Homo sapiens
tgtcccctcacaga

SEQ ID NO: 2741270 - DNA, 16 bp, Homo sapiens
tgtcccctcacagact

SEQ ID NO: 2741271 - DNA, 21 bp, Homo sapiens
tgtcccctcttgccccaaccc

SEQ ID NO: 2741272 - DNA, 15 bp, Homo sapiens
tgtcccctggggctg

SEQ ID NO: 2741273 - DNA, 19 bp, Homo sapiens
ttggaaaaatgtcactgaa

SEQ ID NO: 2741274 - DNA, 21 bp, Homo sapiens
ttggaaaagaaatcaattttt

SEQ ID NO: 2741275 - DNA, 22 bp, Homo sapiens
ttggaaagcatcacctcaggcc

SEQ ID NO: 2741276 - DNA, 16 bp, Homo sapiens
ttggaagagaggcacc

SEQ ID NO: 2741277 - DNA, 23 bp, Homo sapiens
ttggaagagaggcacctgctgga

SEQ ID NO: 2741278 - DNA, 13 bp, Homo sapiens
ttggaattttctt

SEQ ID NO: 2741279 - DNA, 13 bp, Homo sapiens
ttggacttgagga

SEQ ID NO: 2741280 - DNA, 14 bp, Homo sapiens
ttggagaaaagcac

SEQ ID NO: 2741281 - DNA, 21 bp, Homo sapiens
ttggagaaggagattttaagg

SEQ ID NO: 2741282 - DNA, 13 bp, Homo sapiens
ttggagactctgt

SEQ ID NO: 2741283 - DNA, 16 bp, Homo sapiens
ttggagccgggaaagc

SEQ ID NO: 2741284 - DNA, 15 bp, Homo sapiens
ttggagggatcattt

SEQ ID NO: 2741285 - DNA, 23 bp, Homo sapiens
ttggagggtgggagagcccagcc

SEQ ID NO: 2741286 - DNA, 15 bp, Homo sapiens
ttggcacctgcctag

SEQ ID NO: 2741287 - DNA, 18 bp, Homo sapiens
ttggcagaactgctgggg

SEQ ID NO: 2741288 - DNA, 12 bp, Homo sapiens
ttggcagcaggt

SEQ ID NO: 2741289 - DNA, 18 bp, Homo sapiens
ttggcagcaggtgctgct

SEQ ID NO: 2741290 - DNA, 21 bp, Homo sapiens
ttggcagcaggtgctgctacc

SEQ ID NO: 2741291 - DNA, 14 bp, Homo sapiens
ttggccagagctga

SEQ ID NO: 2741292 - DNA, 13 bp, Homo sapiens
ttggccctgcccc

SEQ ID NO: 2741293 - DNA, 15 bp, Homo sapiens
ttggccctgcccctc

SEQ ID NO: 2741294 - DNA, 16 bp, Homo sapiens
ttggccctgcccctcc

SEQ ID NO: 2741295 - DNA, 17 bp, Homo sapiens
ttggccctgcccctccc

SEQ ID NO: 2741296 - DNA, 19 bp, Homo sapiens
ttggccctgcccctccccc

SEQ ID NO: 2741297 - DNA, 23 bp, Homo sapiens
ttggccctgcccctccccctacc

SEQ ID NO: 2741298 - DNA, 17 bp, Homo sapiens
ttggcgcaccctcccct

SEQ ID NO: 2741299 - DNA, 17 bp, Homo sapiens
ttggctttacaaataat

SEQ ID NO: 2741300 - DNA, 15 bp, Homo sapiens
ttgggatcagcctcc

SEQ ID NO: 2741301 - DNA, 17 bp, Homo sapiens
ttgggccatactggcct

SEQ ID NO: 2741302 - DNA, 19 bp, Homo sapiens
ttgggccatactggcctcg

SEQ ID NO: 2741303 - DNA, 13 bp, Homo sapiens
ttgggcctgacct

SEQ ID NO: 2741304 - DNA, 18 bp, Homo sapiens
ttggggcatttgtgggac

SEQ ID NO: 2741305 - DNA, 21 bp, Homo sapiens
ttggtacagttcataattcac

SEQ ID NO: 2741306 - DNA, 21 bp, Homo sapiens
ttggtgaacattgcaatagaa

SEQ ID NO: 2741307 - DNA, 21 bp, Homo sapiens
ttggttatgatggaaaggaag

SEQ ID NO: 2741308 - DNA, 16 bp, Homo sapiens
ttggtttgcacataaa

SEQ ID NO: 2741309 - DNA, 17 bp, Homo sapiens
ttggtttggtacagttc

SEQ ID NO: 2741310 - DNA, 22 bp, Homo sapiens
ttgtaaaaaaggaacacccgga

SEQ ID NO: 2741311 - DNA, 13 bp, Homo sapiens
ttgtaaaaagaaa

SEQ ID NO: 2741312 - DNA, 18 bp, Homo sapiens
ttgtaaaggtaggtgcat

SEQ ID NO: 2741313 - DNA, 13 bp, Homo sapiens
ttgtaaataacca

SEQ ID NO: 2741314 - DNA, 15 bp, Homo sapiens
ttgtaatatttcttc

SEQ ID NO: 2741315 - DNA, 21 bp, Homo sapiens
ttgtaatatttcttcaagtga

SEQ ID NO: 2741316 - DNA, 16 bp, Homo sapiens
ttgtacaaagatatgc

SEQ ID NO: 2741317 - DNA, 13 bp, Homo sapiens
ttgtacctggtga

SEQ ID NO: 2741318 - DNA, 15 bp, Homo sapiens
ttgtcatgtgtatga

SEQ ID NO: 2741319 - DNA, 10 bp, Homo sapiens
ttgtccctgg

SEQ ID NO: 2741320 - DNA, 13 bp, Homo sapiens
ttgtctaaacaag

SEQ ID NO: 2741321 - DNA, 15 bp, Homo sapiens
ttgtctaaacaaggt

SEQ ID NO: 2741322 - DNA, 12 bp, Homo sapiens
ttgtctccctgg

SEQ ID NO: 2741323 - DNA, 15 bp, Homo sapiens
ttgtctccctggccc

SEQ ID NO: 2741324 - DNA, 16 bp, Homo sapiens
ttgtctccctggccct

SEQ ID NO: 2741325 - DNA, 18 bp, Homo sapiens
ttgtctccctggccctca

SEQ ID NO: 2741326 - DNA, 11 bp, Homo sapiens
ttgtcttccaa

SEQ ID NO: 2741327 - DNA, 12 bp, Homo sapiens
ttgtcttccaac

SEQ ID NO: 2741328 - DNA, 13 bp, Homo sapiens
ttgtcttccaacc

SEQ ID NO: 2741329 - DNA, 19 bp, Homo sapiens
ttgtcttccaaccccagct

SEQ ID NO: 2741330 - DNA, 12 bp, Homo sapiens
ttgtctttcaaa

SEQ ID NO: 2741331 - DNA, 13 bp, Homo sapiens
ttgtctttctttg

SEQ ID NO: 2741332 - DNA, 17 bp, Homo sapiens
ttgtctttctttgctgc

SEQ ID NO: 2741333 - DNA, 20 bp, Homo sapiens
ttgtgatattgaccatgtga

SEQ ID NO: 2741334 - DNA, 18 bp, Homo sapiens
ttgtggactctctgcctg

SEQ ID NO: 2741335 - DNA, 19 bp, Homo sapiens
ttgtggactctctgcctgc

SEQ ID NO: 2741336 - DNA, 15 bp, Homo sapiens
ttgtgtacagttatt

SEQ ID NO: 2741337 - DNA, 13 bp, Homo sapiens
ttgtgttggcttt

SEQ ID NO: 2741338 - DNA, 17 bp, Homo sapiens
ttgtgttggctttacaa

SEQ ID NO: 2741339 - DNA, 22 bp, Homo sapiens
ttgttagtttcttttattttca

SEQ ID NO: 2741340 - DNA, 18 bp, Homo sapiens
ttgttatgccttgctatt

SEQ ID NO: 2741341 - DNA, 17 bp, Homo sapiens
ttgttattaaaaaaaca

SEQ ID NO: 2741342 - DNA, 15 bp, Homo sapiens
ttgttatttgtacag

SEQ ID NO: 2741343 - DNA, 19 bp, Homo sapiens
ttgttcaacagtttctcaa

SEQ ID NO: 2741344 - DNA, 22 bp, Homo sapiens
ttgttctgggtgatttctagaa

SEQ ID NO: 2741345 - DNA, 21 bp, Homo sapiens
ttgttgataaattccactgga

SEQ ID NO: 2741346 - DNA, 19 bp, Homo sapiens
ttgttgatattggttctat

SEQ ID NO: 2741347 - DNA, 14 bp, Homo sapiens
ttgttgctgttgct

SEQ ID NO: 2741348 - DNA, 19 bp, Homo sapiens
ttgttggtgtgttttgctc

SEQ ID NO: 2741349 - DNA, 16 bp, Homo sapiens
ttgttgtttttaagat

SEQ ID NO: 2741350 - DNA, 20 bp, Homo sapiens
ttgtttattctttttaaagt

SEQ ID NO: 2741351 - DNA, 16 bp, Homo sapiens
ttgtttctccccctgg

SEQ ID NO: 2741352 - DNA, 13 bp, Homo sapiens
ttgtttctttctg

SEQ ID NO: 2741353 - DNA, 17 bp, Homo sapiens
ttgtttgattcagcaaa

SEQ ID NO: 2741354 - DNA, 13 bp, Homo sapiens
ttgtttgcacaga

SEQ ID NO: 2741355 - DNA, 15 bp, Homo sapiens
ttgtttgcacagagg

SEQ ID NO: 2741356 - DNA, 20 bp, Homo sapiens
ttgtttggagggatcatttt

SEQ ID NO: 2741357 - DNA, 21 bp, Homo sapiens
ttgtttgtttctccccctggg

SEQ ID NO: 2741358 - DNA, 14 bp, Homo sapiens
ttgttttcttcatt

SEQ ID NO: 2741359 - DNA, 20 bp, Homo sapiens
tttaaaaaaaatagaagcta

SEQ ID NO: 2741360 - DNA, 18 bp, Homo sapiens
tttaaaaaaagtatatat

SEQ ID NO: 2741361 - DNA, 17 bp, Homo sapiens
tttaaaaatgatgataa

SEQ ID NO: 2741362 - DNA, 15 bp, Homo sapiens
tttaaaactctttat

SEQ ID NO: 2741363 - DNA, 13 bp, Homo sapiens
tttaaagaaaagt

SEQ ID NO: 2741364 - DNA, 21 bp, Homo sapiens
tttaaaggtcgcacctccttg

SEQ ID NO: 2741365 - DNA, 16 bp, Homo sapiens
tttaaataaaagcaca

SEQ ID NO: 2741366 - DNA, 13 bp, Homo sapiens
tttaaatgaaagt

SEQ ID NO: 2741367 - DNA, 24 bp, Homo sapiens
tttaacaggttttcttctaatcat

SEQ ID NO: 2741368 - DNA, 14 bp, Homo sapiens
tttaagcaatgctt

SEQ ID NO: 2741369 - DNA, 10 bp, Homo sapiens
tttaagtcct

SEQ ID NO: 2741370 - DNA, 21 bp, Homo sapiens
tttaatagcgtcataactaga

SEQ ID NO: 2741371 - DNA, 22 bp, Homo sapiens
tttaatagcgtcataactagaa

SEQ ID NO: 2741372 - DNA, 22 bp, Homo sapiens
tttaatgatttttgtgtatcca

SEQ ID NO: 2741373 - DNA, 14 bp, Homo sapiens
tttacaacaaacac

SEQ ID NO: 2741374 - DNA, 15 bp, Homo sapiens
tttacaacaaacact

SEQ ID NO: 2741375 - DNA, 13 bp, Homo sapiens
tttacagtctctg

SEQ ID NO: 2741376 - DNA, 16 bp, Homo sapiens
tttacagtgtatttaa

SEQ ID NO: 2741377 - DNA, 21 bp, Homo sapiens
tttacatacagtgatatggta

SEQ ID NO: 2741378 - DNA, 10 bp, Homo sapiens
tttacatttc

SEQ ID NO: 2741379 - DNA, 21 bp, Homo sapiens
tttaccctcctctatttcttt

SEQ ID NO: 2741380 - DNA, 19 bp, Homo sapiens
tttactcagtgaaatcata

SEQ ID NO: 2741381 - DNA, 14 bp, Homo sapiens
tttactgacagaaa

SEQ ID NO: 2741382 - DNA, 20 bp, Homo sapiens
tttacttccatgatacttta

SEQ ID NO: 2741383 - DNA, 14 bp, Homo sapiens
tttagaatatatta

SEQ ID NO: 2741384 - DNA, 11 bp, Homo sapiens
tttaggagaag

SEQ ID NO: 2741385 - DNA, 11 bp, Homo sapiens
tttaggcagcc

SEQ ID NO: 2741386 - DNA, 20 bp, Homo sapiens
tttaggcagcctgccgccgt

SEQ ID NO: 2741387 - DNA, 14 bp, Homo sapiens
tttataaaatggga

SEQ ID NO: 2741388 - DNA, 15 bp, Homo sapiens
tttatacataaacag

SEQ ID NO: 2741389 - DNA, 16 bp, Homo sapiens
tttatacataaacagt

SEQ ID NO: 2741390 - DNA, 16 bp, Homo sapiens
tttataccccatttga

SEQ ID NO: 2741391 - DNA, 19 bp, Homo sapiens
tttatagtctcaaatcaaa

SEQ ID NO: 2741392 - DNA, 15 bp, Homo sapiens
tttatataaagaaaa

SEQ ID NO: 2741393 - DNA, 17 bp, Homo sapiens
tttatataaagaaaatc

SEQ ID NO: 2741394 - DNA, 12 bp, Homo sapiens
tttatatcttta

SEQ ID NO: 2741395 - DNA, 17 bp, Homo sapiens
tttatgcaaaaacatat

SEQ ID NO: 2741396 - DNA, 22 bp, Homo sapiens
tttatgttacttaaacatcatt

SEQ ID NO: 2741397 - DNA, 18 bp, Homo sapiens
tttattaaaagagtagaa

SEQ ID NO: 2741398 - DNA, 16 bp, Homo sapiens
ccatgaccttacattt

SEQ ID NO: 2741399 - DNA, 23 bp, Homo sapiens
ccattgtaacttggatgtagcca

SEQ ID NO: 2741400 - DNA, 14 bp, Homo sapiens
ccctttcctcaggc

SEQ ID NO: 2741401 - DNA, 14 bp, Homo sapiens
cctcagctgcttct

SEQ ID NO: 2741402 - DNA, 20 bp, Homo sapiens
cctcaggcaaggtctggcct

SEQ ID NO: 2741403 - DNA, 16 bp, Homo sapiens
cctcggcctggctcct

SEQ ID NO: 2741404 - DNA, 17 bp, Homo sapiens
cctgatttacagtttca

SEQ ID NO: 2741405 - DNA, 16 bp, Homo sapiens
ccttctgcctgagctt

SEQ ID NO: 2741406 - DNA, 17 bp, Homo sapiens
ccttctggattcttggc

SEQ ID NO: 2741407 - DNA, 18 bp, Homo sapiens
ccttggccagaagtcaag

SEQ ID NO: 2741408 - DNA, 15 bp, Homo sapiens
cgaaccaggagctgc

SEQ ID NO: 2741409 - DNA, 22 bp, Homo sapiens
cgacttttctaaagctctgaac

SEQ ID NO: 2741410 - DNA, 18 bp, Homo sapiens
cgcaggcgggaaaagcag

SEQ ID NO: 2741411 - DNA, 23 bp, Homo sapiens
cgtcaagttgcagatctttttgt

SEQ ID NO: 2741412 - DNA, 17 bp, Homo sapiens
cgttagaggagcaacag

SEQ ID NO: 2741413 - DNA, 23 bp, Homo sapiens
ctaagactcctcggcctggctcc

SEQ ID NO: 2741414 - DNA, 14 bp, Homo sapiens
ctacacatatatgt

SEQ ID NO: 2741415 - DNA, 18 bp, Homo sapiens
ctacacatatatgtatat

SEQ ID NO: 2741416 - DNA, 14 bp, Homo sapiens
ctacctcctcaggg

SEQ ID NO: 2741417 - DNA, 12 bp, Homo sapiens
ctaggggagcag

SEQ ID NO: 2741418 - DNA, 16 bp, Homo sapiens
ctattttcattttctg

SEQ ID NO: 2741419 - DNA, 15 bp, Homo sapiens
ctcagctgcttctcc

SEQ ID NO: 2741420 - DNA, 17 bp, Homo sapiens
ctcagctgcttctccca

SEQ ID NO: 2741421 - DNA, 22 bp, Homo sapiens
ctccatcctttctgcctctcaa

SEQ ID NO: 2741422 - DNA, 22 bp, Homo sapiens
ctcccacttggccaagcaggga

SEQ ID NO: 2741423 - DNA, 19 bp, Homo sapiens
ctcccaggggctggcttca

SEQ ID NO: 2741424 - DNA, 15 bp, Homo sapiens
ctcgaagaacaatgt

SEQ ID NO: 2741425 - DNA, 23 bp, Homo sapiens
ctcgaagaacaatgtcagaaact

SEQ ID NO: 2741426 - DNA, 15 bp, Homo sapiens
ctcggcctggctcct

SEQ ID NO: 2741427 - DNA, 18 bp, Homo sapiens
ctctttcttctctgctgc

SEQ ID NO: 2741428 - DNA, 22 bp, Homo sapiens
ctgagcttcccccccaccacag

SEQ ID NO: 2741429 - DNA, 21 bp, Homo sapiens
ctgagggatggactgatgctt

SEQ ID NO: 2741430 - DNA, 18 bp, Homo sapiens
ctgatgcttttagctcaa

SEQ ID NO: 2741431 - DNA, 14 bp, Homo sapiens
ctgcaagcctgcgt

SEQ ID NO: 2741432 - DNA, 20 bp, Homo sapiens
ctgcaggattgattatgcag

SEQ ID NO: 2741433 - DNA, 12 bp, Homo sapiens
ctgccaaaacaa

SEQ ID NO: 2741434 - DNA, 12 bp, Homo sapiens
ctgcctgagctt

SEQ ID NO: 2741435 - DNA, 20 bp, Homo sapiens
ctgccttctggattcttggc

SEQ ID NO: 2741436 - DNA, 16 bp, Homo sapiens
ctgctcgaagaacaat

SEQ ID NO: 2741437 - DNA, 13 bp, Homo sapiens
ctggctgcttgcc

SEQ ID NO: 2741438 - DNA, 13 bp, Homo sapiens
ctggcttcaggag

SEQ ID NO: 2741439 - DNA, 15 bp, Homo sapiens
ctgtattgatgacag

SEQ ID NO: 2741440 - DNA, 16 bp, Homo sapiens
ctgtccagtttccaaa

SEQ ID NO: 2741441 - DNA, 22 bp, Homo sapiens
ctgtttaaaaaaagtatatatt

SEQ ID NO: 2741442 - DNA, 23 bp, Homo sapiens
ctgtttaaaaaaagtatatattc

SEQ ID NO: 2741443 - DNA, 12 bp, Homo sapiens
cttacatttcct

SEQ ID NO: 2741444 - DNA, 13 bp, Homo sapiens
cttacatttcctg

SEQ ID NO: 2741445 - DNA, 14 bp, Homo sapiens
cttataggtttcca

SEQ ID NO: 2741446 - DNA, 16 bp, Homo sapiens
cttcaggagggagcat

SEQ ID NO: 2741447 - DNA, 12 bp, Homo sapiens
cttctctgctgc

SEQ ID NO: 2741448 - DNA, 16 bp, Homo sapiens
cttggtccaggaaatg

SEQ ID NO: 2741449 - DNA, 19 bp, Homo sapiens
cttgtgacagattatacag

SEQ ID NO: 2741450 - DNA, 14 bp, Homo sapiens
ctttaaaaactatt

SEQ ID NO: 2741451 - DNA, 23 bp, Homo sapiens
ctttaaaaactatttaacttgag

SEQ ID NO: 2741452 - DNA, 15 bp, Homo sapiens
ctttaaaataaaata

SEQ ID NO: 2741453 - DNA, 13 bp, Homo sapiens
ctttccttcttgc

SEQ ID NO: 2741454 - DNA, 14 bp, Homo sapiens
ctttccttcttgcc

SEQ ID NO: 2741455 - DNA, 15 bp, Homo sapiens
ctttctgcctctcaa

SEQ ID NO: 2741456 - DNA, 22 bp, Homo sapiens
cttttagctcaaacgtggcttt

SEQ ID NO: 2741457 - DNA, 22 bp, Homo sapiens
ctttttgtgaaattcaacctgt

SEQ ID NO: 2741458 - DNA, 12 bp, Homo sapiens
gaaaaagtgatg

SEQ ID NO: 2741459 - DNA, 19 bp, Homo sapiens
gaaaagcagcccttggcca

SEQ ID NO: 2741460 - DNA, 17 bp, Homo sapiens
gaagaagcttaggcagg

SEQ ID NO: 2741461 - DNA, 20 bp, Homo sapiens
gaagtcaagcccagccacgt

SEQ ID NO: 2741462 - DNA, 17 bp, Homo sapiens
gacctcagctgcttctc

SEQ ID NO: 2741463 - DNA, 15 bp, Homo sapiens
gactcctcggcctgg

SEQ ID NO: 2741464 - DNA, 17 bp, Homo sapiens
gactcctcggcctggct

SEQ ID NO: 2741465 - DNA, 20 bp, Homo sapiens
gactcctcggcctggctcct

SEQ ID NO: 2741466 - DNA, 21 bp, Homo sapiens
gagaaattttactgacagaaa

SEQ ID NO: 2741467 - DNA, 11 bp, Homo sapiens
gagagtaactt

SEQ ID NO: 2741468 - DNA, 20 bp, Homo sapiens
gaggaagaagcttaggcagg

SEQ ID NO: 2741469 - DNA, 24 bp, Homo sapiens
gagggagcatagaaggcaggtgag

SEQ ID NO: 2741470 - DNA, 22 bp, Homo sapiens
gatggagcagagcaagtctgca

SEQ ID NO: 2741471 - DNA, 13 bp, Homo sapiens
gattatatatcat

SEQ ID NO: 2741472 - DNA, 18 bp, Homo sapiens
gattatatatcataaagt

SEQ ID NO: 2741473 - DNA, 20 bp, Homo sapiens
gattatatatcataaagtat

SEQ ID NO: 2741474 - DNA, 14 bp, Homo sapiens
gatttgagaaattt

SEQ ID NO: 2741475 - DNA, 14 bp, Homo sapiens
gcaaagttatattt

SEQ ID NO: 2741476 - DNA, 17 bp, Homo sapiens
gcagaatacttttctct

SEQ ID NO: 2741477 - DNA, 15 bp, Homo sapiens
gcagcccttggccag

SEQ ID NO: 2741478 - DNA, 19 bp, Homo sapiens
gcaggattgattatgcaga

SEQ ID NO: 2741479 - DNA, 16 bp, Homo sapiens
gcagggaggaagaagc

SEQ ID NO: 2741480 - DNA, 17 bp, Homo sapiens
gcaggtgagcaaccagt

SEQ ID NO: 2741481 - DNA, 16 bp, Homo sapiens
gccaacaacttctcca

SEQ ID NO: 2741482 - DNA, 11 bp, Homo sapiens
gccacattttg

SEQ ID NO: 2741483 - DNA, 13 bp, Homo sapiens
gcccaccagagct

SEQ ID NO: 2741484 - DNA, 12 bp, Homo sapiens
gcccttggccag

SEQ ID NO: 2741485 - DNA, 13 bp, Homo sapiens
gccctttcctcag

SEQ ID NO: 2741486 - DNA, 12 bp, Homo sapiens
gccgttggccac

SEQ ID NO: 2741487 - DNA, 16 bp, Homo sapiens
gctcactacctcctca

SEQ ID NO: 2741488 - DNA, 21 bp, Homo sapiens
gctcactacctcctcagggat

SEQ ID NO: 2741489 - DNA, 13 bp, Homo sapiens
gcttcaggaggga

SEQ ID NO: 2741490 - DNA, 20 bp, Homo sapiens
gctttatgggtgttaattga

SEQ ID NO: 2741491 - DNA, 19 bp, Homo sapiens
ggagcagagcaagtctgca

SEQ ID NO: 2741492 - DNA, 21 bp, Homo sapiens
ggagcctagagtgagggcctg

SEQ ID NO: 2741493 - DNA, 14 bp, Homo sapiens
ggccaagcagggag

SEQ ID NO: 2741494 - DNA, 13 bp, Homo sapiens
ggccgttggccac

SEQ ID NO: 2741495 - DNA, 12 bp, Homo sapiens
ggcctggctcct

SEQ ID NO: 2741496 - DNA, 11 bp, Homo sapiens
ggcctgggttt

SEQ ID NO: 2741497 - DNA, 17 bp, Homo sapiens
ggctctctttccttctt

SEQ ID NO: 2741498 - DNA, 19 bp, Homo sapiens
gggagcatagaaggcaggt

SEQ ID NO: 2741499 - DNA, 18 bp, Homo sapiens
gggatggactgatgcttt

SEQ ID NO: 2741500 - DNA, 17 bp, Homo sapiens
atttaacttgagcttta

SEQ ID NO: 2741501 - DNA, 13 bp, Homo sapiens
atttaatatctga

SEQ ID NO: 2741502 - DNA, 14 bp, Homo sapiens
atttagaatatatt

SEQ ID NO: 2741503 - DNA, 17 bp, Homo sapiens
atttccacataaaggta

SEQ ID NO: 2741504 - DNA, 21 bp, Homo sapiens
atttccacataaaggtattta

SEQ ID NO: 2741505 - DNA, 15 bp, Homo sapiens
atttgccctcctcct

SEQ ID NO: 2741506 - DNA, 19 bp, Homo sapiens
attttactgacagaaatgc

SEQ ID NO: 2741507 - DNA, 23 bp, Homo sapiens
attttcattttctgcaagcctgc

SEQ ID NO: 2741508 - DNA, 20 bp, Homo sapiens
attttgtacaaagatatgct

SEQ ID NO: 2741509 - DNA, 21 bp, Homo sapiens
attttgtacaaagatatgcta

SEQ ID NO: 2741510 - DNA, 11 bp, Homo sapiens
caaaacaatgc

SEQ ID NO: 2741511 - DNA, 20 bp, Homo sapiens
caaagatatgctaagcagta

SEQ ID NO: 2741512 - DNA, 17 bp, Homo sapiens
caaagttatatttactt

SEQ ID NO: 2741513 - DNA, 14 bp, Homo sapiens
caacctgtgtctta

SEQ ID NO: 2741514 - DNA, 23 bp, Homo sapiens
caacttctccatcctttctgcct

SEQ ID NO: 2741515 - DNA, 12 bp, Homo sapiens
caagtctgcagg

SEQ ID NO: 2741516 - DNA, 14 bp, Homo sapiens
caatgtcagaaact

SEQ ID NO: 2741517 - DNA, 20 bp, Homo sapiens
cacaaaattcgacctgattt

SEQ ID NO: 2741518 - DNA, 21 bp, Homo sapiens
cacaaaggacctcagctgctt

SEQ ID NO: 2741519 - DNA, 20 bp, Homo sapiens
cacaggcagttacttctgag

SEQ ID NO: 2741520 - DNA, 10 bp, Homo sapiens
cacataaagg

SEQ ID NO: 2741521 - DNA, 20 bp, Homo sapiens
cacatataaaagttaaacta

SEQ ID NO: 2741522 - DNA, 21 bp, Homo sapiens
caccacaggccctttcctcag

SEQ ID NO: 2741523 - DNA, 15 bp, Homo sapiens
cacgtcttccttctg

SEQ ID NO: 2741524 - DNA, 15 bp, Homo sapiens
cactacctcctcagg

SEQ ID NO: 2741525 - DNA, 18 bp, Homo sapiens
cactacctcctcagggat

SEQ ID NO: 2741526 - DNA, 20 bp, Homo sapiens
cactacctcctcagggatgg

SEQ ID NO: 2741527 - DNA, 16 bp, Homo sapiens
cagagcaagtctgcag

SEQ ID NO: 2741528 - DNA, 17 bp, Homo sapiens
cagagcaagtctgcagg

SEQ ID NO: 2741529 - DNA, 19 bp, Homo sapiens
cagatgttctctcccaggg

SEQ ID NO: 2741530 - DNA, 19 bp, Homo sapiens
cagctcctccgtgcttcct

SEQ ID NO: 2741531 - DNA, 22 bp, Homo sapiens
cagctcctccgtgcttcctcag

SEQ ID NO: 2741532 - DNA, 22 bp, Homo sapiens
caggagggagcatagaaggcag

SEQ ID NO: 2741533 - DNA, 22 bp, Homo sapiens
caggcaaggtctggcctcaggt

SEQ ID NO: 2741534 - DNA, 16 bp, Homo sapiens
caggccctttcctcag

SEQ ID NO: 2741535 - DNA, 17 bp, Homo sapiens
caggccctttcctcagg

SEQ ID NO: 2741536 - DNA, 20 bp, Homo sapiens
cagggatggccgttggccac

SEQ ID NO: 2741537 - DNA, 20 bp, Homo sapiens
cagggctctctttccttctt

SEQ ID NO: 2741538 - DNA, 21 bp, Homo sapiens
cagggctctctttccttcttg

SEQ ID NO: 2741539 - DNA, 13 bp, Homo sapiens
caggggctggctt

SEQ ID NO: 2741540 - DNA, 19 bp, Homo sapiens
caggggctggcttcaggag

SEQ ID NO: 2741541 - DNA, 20 bp, Homo sapiens
cataaagtatgccttcctgt

SEQ ID NO: 2741542 - DNA, 16 bp, Homo sapiens
catagaaggcaggtga

SEQ ID NO: 2741543 - DNA, 16 bp, Homo sapiens
catagaccctctcaag

SEQ ID NO: 2741544 - DNA, 18 bp, Homo sapiens
catcctttctgcctctca

SEQ ID NO: 2741545 - DNA, 21 bp, Homo sapiens
catgaccttacatttcctggg

SEQ ID NO: 2741546 - DNA, 19 bp, Homo sapiens
cattagctacttttcagaa

SEQ ID NO: 2741547 - DNA, 15 bp, Homo sapiens
cattgtaacttggat

SEQ ID NO: 2741548 - DNA, 19 bp, Homo sapiens
cattttgcattagacagat

SEQ ID NO: 2741549 - DNA, 23 bp, Homo sapiens
cattttgtacaaagatatgctaa

SEQ ID NO: 2741550 - DNA, 19 bp, Homo sapiens
ccagattgttctgtccagt

SEQ ID NO: 2741551 - DNA, 19 bp, Homo sapiens
ccctaagactcctcggcct

SEQ ID NO: 2741552 - DNA, 13 bp, Homo sapiens
ccgacttttctaa

SEQ ID NO: 2741553 - DNA, 21 bp, Homo sapiens
ccgcccttgccgaaccaggag

SEQ ID NO: 2741554 - DNA, 23 bp, Homo sapiens
cctcagggatggccgttggccac

SEQ ID NO: 2741555 - DNA, 12 bp, Homo sapiens
cctcctcaggga

SEQ ID NO: 2741556 - DNA, 13 bp, Homo sapiens
cctctccgagctg

SEQ ID NO: 2741557 - DNA, 21 bp, Homo sapiens
cctgaggtctggctgcttgcc

SEQ ID NO: 2741558 - DNA, 14 bp, Homo sapiens
cctgatttacagtt

SEQ ID NO: 2741559 - DNA, 20 bp, Homo sapiens
cctgatttacagtttcaaaa

SEQ ID NO: 2741560 - DNA, 18 bp, Homo sapiens
cctggctcctacccaccg

SEQ ID NO: 2741561 - DNA, 23 bp, Homo sapiens
cctgttattttttatttccacat

SEQ ID NO: 2741562 - DNA, 19 bp, Homo sapiens
ccttctggattcttggccc

SEQ ID NO: 2741563 - DNA, 23 bp, Homo sapiens
cgacctgatttacagtttcaaaa

SEQ ID NO: 2741564 - DNA, 23 bp, Homo sapiens
cgatgaatgtgttgatttgagaa

SEQ ID NO: 2741565 - DNA, 12 bp, Homo sapiens
cgcacagagctg

SEQ ID NO: 2741566 - DNA, 13 bp, Homo sapiens
cgcacagagctgg

SEQ ID NO: 2741567 - DNA, 17 bp, Homo sapiens
cgcacagagctggggct

SEQ ID NO: 2741568 - DNA, 13 bp, Homo sapiens
cggcctggctcct

SEQ ID NO: 2741569 - DNA, 22 bp, Homo sapiens
cgggaaaagcagcccttggcca

SEQ ID NO: 2741570 - DNA, 16 bp, Homo sapiens
ctaaagtcacatataa

SEQ ID NO: 2741571 - DNA, 22 bp, Homo sapiens
ctaagactcctcggcctggctc

SEQ ID NO: 2741572 - DNA, 19 bp, Homo sapiens
ctacacatatatgtatatg

SEQ ID NO: 2741573 - DNA, 17 bp, Homo sapiens
ctagagtgagggcctga

SEQ ID NO: 2741574 - DNA, 21 bp, Homo sapiens
ctagtatattagtttgattta

SEQ ID NO: 2741575 - DNA, 14 bp, Homo sapiens
ctatttaacttgag

SEQ ID NO: 2741576 - DNA, 12 bp, Homo sapiens
ctcactacctcc

SEQ ID NO: 2741577 - DNA, 15 bp, Homo sapiens
ctcactacctcctca

SEQ ID NO: 2741578 - DNA, 16 bp, Homo sapiens
ctcactacctcctcag

SEQ ID NO: 2741579 - DNA, 17 bp, Homo sapiens
ctcactacctcctcagg

SEQ ID NO: 2741580 - DNA, 20 bp, Homo sapiens
ctcactacctcctcagggat

SEQ ID NO: 2741581 - DNA, 21 bp, Homo sapiens
ctcagctgcttctcccacttg

SEQ ID NO: 2741582 - DNA, 22 bp, Homo sapiens
ctcagggatggccgttggccac

SEQ ID NO: 2741583 - DNA, 15 bp, Homo sapiens
ctcccacttggccaa

SEQ ID NO: 2741584 - DNA, 20 bp, Homo sapiens
ctcctacccaccgcccttgc

SEQ ID NO: 2741585 - DNA, 14 bp, Homo sapiens
ctcctcagggatgg

SEQ ID NO: 2741586 - DNA, 20 bp, Homo sapiens
ctcctccgtgcttcctcagt

SEQ ID NO: 2741587 - DNA, 14 bp, Homo sapiens
ctcctcggcctggc

SEQ ID NO: 2741588 - DNA, 16 bp, Homo sapiens
ctcctcggcctggctc

SEQ ID NO: 2741589 - DNA, 18 bp, Homo sapiens
ctctaaactgctgttaat

SEQ ID NO: 2741590 - DNA, 13 bp, Homo sapiens
ctctcccaggggc

SEQ ID NO: 2741591 - DNA, 15 bp, Homo sapiens
ctctctttccttctt

SEQ ID NO: 2741592 - DNA, 17 bp, Homo sapiens
ctctctttccttcttgc

SEQ ID NO: 2741593 - DNA, 17 bp, Homo sapiens
ctcttggaaaaagtgat

SEQ ID NO: 2741594 - DNA, 16 bp, Homo sapiens
ctgagaagtgtatata

SEQ ID NO: 2741595 - DNA, 20 bp, Homo sapiens
ctgagggatggactgatgct

SEQ ID NO: 2741596 - DNA, 16 bp, Homo sapiens
ctgaggtctggctgct

SEQ ID NO: 2741597 - DNA, 12 bp, Homo sapiens
ctgcaagcctgc

SEQ ID NO: 2741598 - DNA, 13 bp, Homo sapiens
ctgcaagcctgcg

SEQ ID NO: 2741599 - DNA, 16 bp, Homo sapiens
ctgctcactacctcct

SEQ ID NO: 2741600 - DNA, 20 bp, Homo sapiens
ctgctcactacctcctcagg

SEQ ID NO: 2741601 - DNA, 13 bp, Homo sapiens
aaaaagattatat

SEQ ID NO: 2741602 - DNA, 11 bp, Homo sapiens
aaaaagtatat

SEQ ID NO: 2741603 - DNA, 17 bp, Homo sapiens
aaaaagtatatattcta

SEQ ID NO: 2741604 - DNA, 20 bp, Homo sapiens
aaaagattatatatcataaa

SEQ ID NO: 2741605 - DNA, 23 bp, Homo sapiens
aaaagattatatatcataaagta

SEQ ID NO: 2741606 - DNA, 19 bp, Homo sapiens
aaaagcagcccttggccag

SEQ ID NO: 2741607 - DNA, 16 bp, Homo sapiens
aaaattctactgtatg

SEQ ID NO: 2741608 - DNA, 20 bp, Homo sapiens
aaacgtggcttttagacaga

SEQ ID NO: 2741609 - DNA, 12 bp, Homo sapiens
aaagattatata

SEQ ID NO: 2741610 - DNA, 17 bp, Homo sapiens
aaagattatatatcata

SEQ ID NO: 2741611 - DNA, 13 bp, Homo sapiens
aaaggtatttaga

SEQ ID NO: 2741612 - DNA, 16 bp, Homo sapiens
aaagtaattttgtgaa

SEQ ID NO: 2741613 - DNA, 21 bp, Homo sapiens
aaagtatgccttcctgtttaa

SEQ ID NO: 2741614 - DNA, 22 bp, Homo sapiens
aaatattctattttcattttct

SEQ ID NO: 2741615 - DNA, 17 bp, Homo sapiens
aaatctggcaaagttat

SEQ ID NO: 2741616 - DNA, 22 bp, Homo sapiens
aaatctggcaaagttatattta

SEQ ID NO: 2741617 - DNA, 19 bp, Homo sapiens
aaatgctttaaaaactatt

SEQ ID NO: 2741618 - DNA, 14 bp, Homo sapiens
aacaatgtcagaaa

SEQ ID NO: 2741619 - DNA, 16 bp, Homo sapiens
aacaatgtcagaaact

SEQ ID NO: 2741620 - DNA, 15 bp, Homo sapiens
aaccaggagctgctc

SEQ ID NO: 2741621 - DNA, 12 bp, Homo sapiens
aaccgacttttc

SEQ ID NO: 2741622 - DNA, 13 bp, Homo sapiens
aacctgtgtctta

SEQ ID NO: 2741623 - DNA, 23 bp, Homo sapiens
aactatttaacttgagctttaaa

SEQ ID NO: 2741624 - DNA, 16 bp, Homo sapiens
aagactcctcggcctg

SEQ ID NO: 2741625 - DNA, 14 bp, Homo sapiens
aagattatatatca

SEQ ID NO: 2741626 - DNA, 16 bp, Homo sapiens
aagattatatatcata

SEQ ID NO: 2741627 - DNA, 23 bp, Homo sapiens
aagattatatatcataaagtatg

SEQ ID NO: 2741628 - DNA, 18 bp, Homo sapiens
aagctctgaacaaaagct

SEQ ID NO: 2741629 - DNA, 13 bp, Homo sapiens
aagcttaggcagg

SEQ ID NO: 2741630 - DNA, 20 bp, Homo sapiens
aaggagaaaatgcattatgt

SEQ ID NO: 2741631 - DNA, 16 bp, Homo sapiens
aagggcagtaaagttt

SEQ ID NO: 2741632 - DNA, 16 bp, Homo sapiens
aaggtctggcctcagg

SEQ ID NO: 2741633 - DNA, 16 bp, Homo sapiens
aagtagtagtgtcttc

SEQ ID NO: 2741634 - DNA, 12 bp, Homo sapiens
aagttatattta

SEQ ID NO: 2741635 - DNA, 21 bp, Homo sapiens
aatatctgagaagtgtatata

SEQ ID NO: 2741636 - DNA, 23 bp, Homo sapiens
aatattctattttcattttctgc

SEQ ID NO: 2741637 - DNA, 23 bp, Homo sapiens
aatgtcagaaactcgatgaatgt

SEQ ID NO: 2741638 - DNA, 17 bp, Homo sapiens
aattgaaggagaaaatg

SEQ ID NO: 2741639 - DNA, 13 bp, Homo sapiens
aattgtgtctgca

SEQ ID NO: 2741640 - DNA, 23 bp, Homo sapiens
acagtagtaccaaatgctttaaa

SEQ ID NO: 2741641 - DNA, 19 bp, Homo sapiens
accaaatgctttaaaaact

SEQ ID NO: 2741642 - DNA, 22 bp, Homo sapiens
accacaggccctttcctcaggc

SEQ ID NO: 2741643 - DNA, 15 bp, Homo sapiens
accaggagctgctca

SEQ ID NO: 2741644 - DNA, 16 bp, Homo sapiens
accaggagctgctcac

SEQ ID NO: 2741645 - DNA, 13 bp, Homo sapiens
acctcagctgctt

SEQ ID NO: 2741646 - DNA, 15 bp, Homo sapiens
acctgatttacagtt

SEQ ID NO: 2741647 - DNA, 18 bp, Homo sapiens
acgtggcttttagacaga

SEQ ID NO: 2741648 - DNA, 17 bp, Homo sapiens
actcctcggcctggctc

SEQ ID NO: 2741649 - DNA, 18 bp, Homo sapiens
actgatgcttttagctca

SEQ ID NO: 2741650 - DNA, 16 bp, Homo sapiens
actgccaaaacaatgc

SEQ ID NO: 2741651 - DNA, 22 bp, Homo sapiens
actgctgttaattgattaaaat

SEQ ID NO: 2741652 - DNA, 15 bp, Homo sapiens
acttaagttaaacat

SEQ ID NO: 2741653 - DNA, 22 bp, Homo sapiens
acttctccatcctttctgcctc

SEQ ID NO: 2741654 - DNA, 19 bp, Homo sapiens
acttggccaagcagggagg

SEQ ID NO: 2741655 - DNA, 17 bp, Homo sapiens
agaacaatgtcagaaac

SEQ ID NO: 2741656 - DNA, 16 bp, Homo sapiens
agaagcttaggcaggg

SEQ ID NO: 2741657 - DNA, 17 bp, Homo sapiens
agaagcttaggcagggc

SEQ ID NO: 2741658 - DNA, 16 bp, Homo sapiens
agaaggagcaagagaa

SEQ ID NO: 2741659 - DNA, 13 bp, Homo sapiens
agaagtgtatata

SEQ ID NO: 2741660 - DNA, 16 bp, Homo sapiens
agaatacttttctctt

SEQ ID NO: 2741661 - DNA, 17 bp, Homo sapiens
agaattgtgtctgcagg

SEQ ID NO: 2741662 - DNA, 18 bp, Homo sapiens
agaattgtgtctgcagga

SEQ ID NO: 2741663 - DNA, 14 bp, Homo sapiens
agagcaagtctgca

SEQ ID NO: 2741664 - DNA, 16 bp, Homo sapiens
agagcaagtctgcagg

SEQ ID NO: 2741665 - DNA, 19 bp, Homo sapiens
agatatgctaagcagtagt

SEQ ID NO: 2741666 - DNA, 20 bp, Homo sapiens
agatggcttatttgtataat

SEQ ID NO: 2741667 - DNA, 15 bp, Homo sapiens
agcaagtctgcaggt

SEQ ID NO: 2741668 - DNA, 13 bp, Homo sapiens
agcagcccttggc

SEQ ID NO: 2741669 - DNA, 22 bp, Homo sapiens
agcagcccttggccagaagtca

SEQ ID NO: 2741670 - DNA, 11 bp, Homo sapiens
agcagggagga

SEQ ID NO: 2741671 - DNA, 13 bp, Homo sapiens
agcccagccacgt

SEQ ID NO: 2741672 - DNA, 15 bp, Homo sapiens
agcctagagtgaggg

SEQ ID NO: 2741673 - DNA, 20 bp, Homo sapiens
agctattagcaactgtgcta

SEQ ID NO: 2741674 - DNA, 22 bp, Homo sapiens
agctcctccgtgcttcctcagt

SEQ ID NO: 2741675 - DNA, 12 bp, Homo sapiens
agctgcttctcc

SEQ ID NO: 2741676 - DNA, 22 bp, Homo sapiens
agcttcccccccaccacaggcc

SEQ ID NO: 2741677 - DNA, 18 bp, Homo sapiens
aggaagaagcttaggcag

SEQ ID NO: 2741678 - DNA, 18 bp, Homo sapiens
aggacctcagctgcttct

SEQ ID NO: 2741679 - DNA, 13 bp, Homo sapiens
aggcaaggtctgg

SEQ ID NO: 2741680 - DNA, 13 bp, Homo sapiens
aggcattccagct

SEQ ID NO: 2741681 - DNA, 17 bp, Homo sapiens
agggagcatagaaggca

SEQ ID NO: 2741682 - DNA, 20 bp, Homo sapiens
agggagcatagaaggcaggt

SEQ ID NO: 2741683 - DNA, 22 bp, Homo sapiens
agggcatcttggtccaggaaat

SEQ ID NO: 2741684 - DNA, 22 bp, Homo sapiens
agggcctgggttttcatgtttt

SEQ ID NO: 2741685 - DNA, 19 bp, Homo sapiens
aggggctggcttcaggagg

SEQ ID NO: 2741686 - DNA, 11 bp, Homo sapiens
agtaaagtttt

SEQ ID NO: 2741687 - DNA, 15 bp, Homo sapiens
agtagtagtgtcttc

SEQ ID NO: 2741688 - DNA, 19 bp, Homo sapiens
agttatatttactttaaaa

SEQ ID NO: 2741689 - DNA, 18 bp, Homo sapiens
agttggctaggggagcag

SEQ ID NO: 2741690 - DNA, 16 bp, Homo sapiens
agtttgatttaatatc

SEQ ID NO: 2741691 - DNA, 19 bp, Homo sapiens
agtttgatttaatatctga

SEQ ID NO: 2741692 - DNA, 17 bp, Homo sapiens
agtttgtggtaaaaaga

SEQ ID NO: 2741693 - DNA, 12 bp, Homo sapiens
ataaaaagctga

SEQ ID NO: 2741694 - DNA, 14 bp, Homo sapiens
ataaaggtatttag

SEQ ID NO: 2741695 - DNA, 19 bp, Homo sapiens
ataatggtgttactaaagt

SEQ ID NO: 2741696 - DNA, 22 bp, Homo sapiens
taagatggcttatttgtataat

SEQ ID NO: 2741697 - DNA, 17 bp, Homo sapiens
taatatctgagaagtgt

SEQ ID NO: 2741698 - DNA, 14 bp, Homo sapiens
taatcattgcctgg

SEQ ID NO: 2741699 - DNA, 15 bp, Homo sapiens
tacacatatatgtat

SEQ ID NO: 2741700 - DNA, 19 bp, Homo sapiens
tacagaattgtgtctgcag

SEQ ID NO: 2741701 - DNA, 13 bp, Homo sapiens
tacctcctcaggg

SEQ ID NO: 2741702 - DNA, 13 bp, Homo sapiens
tactgcacatttt

SEQ ID NO: 2741703 - DNA, 15 bp, Homo sapiens
tactgcacattttgt

SEQ ID NO: 2741704 - DNA, 18 bp, Homo sapiens
tagctcaaacgtggcttt

SEQ ID NO: 2741705 - DNA, 13 bp, Homo sapiens
taggggagcaggg

SEQ ID NO: 2741706 - DNA, 20 bp, Homo sapiens
tagtaccaaatgctttaaaa

SEQ ID NO: 2741707 - DNA, 20 bp, Homo sapiens
tagtgtcttcctagtatatt

SEQ ID NO: 2741708 - DNA, 12 bp, Homo sapiens
tatatatcataa

SEQ ID NO: 2741709 - DNA, 17 bp, Homo sapiens
tatatatcataaagtat

SEQ ID NO: 2741710 - DNA, 14 bp, Homo sapiens
tatatcataaagta

SEQ ID NO: 2741711 - DNA, 18 bp, Homo sapiens
tatatctatatctctaaa

SEQ ID NO: 2741712 - DNA, 15 bp, Homo sapiens
tatatgtatatgtat

SEQ ID NO: 2741713 - DNA, 17 bp, Homo sapiens
tatatgtatatgtatat

SEQ ID NO: 2741714 - DNA, 23 bp, Homo sapiens
tatctatatctctaaactgctgt

SEQ ID NO: 2741715 - DNA, 16 bp, Homo sapiens
tatctctaaactgctg

SEQ ID NO: 2741716 - DNA, 16 bp, Homo sapiens
attgaaatttatacac

SEQ ID NO: 2741717 - DNA, 16 bp, Homo sapiens
attgaaggagaaaatg

SEQ ID NO: 2741718 - DNA, 17 bp, Homo sapiens
attgaaggagaaaatgc

SEQ ID NO: 2741719 - DNA, 23 bp, Homo sapiens
attgtaacttggatgtagccatg

SEQ ID NO: 2741720 - DNA, 19 bp, Homo sapiens
atttaacttgagctttaaa

SEQ ID NO: 2741721 - DNA, 15 bp, Homo sapiens
atttacagtttcaaa

SEQ ID NO: 2741722 - DNA, 24 bp, Homo sapiens
atttacagtttcaaaaactgtatt

SEQ ID NO: 2741723 - DNA, 22 bp, Homo sapiens
atttgttcatagaccctctcaa

SEQ ID NO: 2741724 - DNA, 20 bp, Homo sapiens
attttaaaccataaaaagct

SEQ ID NO: 2741725 - DNA, 21 bp, Homo sapiens
attttaaaccataaaaagctg

SEQ ID NO: 2741726 - DNA, 22 bp, Homo sapiens
attttaaaccataaaaagctga

SEQ ID NO: 2741727 - DNA, 15 bp, Homo sapiens
attttcattttctgc

SEQ ID NO: 2741728 - DNA, 12 bp, Homo sapiens
attttctgcaag

SEQ ID NO: 2741729 - DNA, 16 bp, Homo sapiens
attttttatttccaca

SEQ ID NO: 2741730 - DNA, 23 bp, Homo sapiens
caaaattcgacctgatttacagt

SEQ ID NO: 2741731 - DNA, 14 bp, Homo sapiens
caaagccacatttt

SEQ ID NO: 2741732 - DNA, 20 bp, Homo sapiens
caaagggcagtaaagttttc

SEQ ID NO: 2741733 - DNA, 16 bp, Homo sapiens
caaatgagcattagct

SEQ ID NO: 2741734 - DNA, 13 bp, Homo sapiens
caaggtctggcct

SEQ ID NO: 2741735 - DNA, 18 bp, Homo sapiens
caaggtctggcctcaggt

SEQ ID NO: 2741736 - DNA, 17 bp, Homo sapiens
caagtctgcaggtgcac

SEQ ID NO: 2741737 - DNA, 18 bp, Homo sapiens
cacaaaggacctcagctg

SEQ ID NO: 2741738 - DNA, 18 bp, Homo sapiens
cacaggccctttcctcag

SEQ ID NO: 2741739 - DNA, 18 bp, Homo sapiens
cacgtcttccttctgcct

SEQ ID NO: 2741740 - DNA, 16 bp, Homo sapiens
cactacctcctcaggg

SEQ ID NO: 2741741 - DNA, 17 bp, Homo sapiens
cactacctcctcaggga

SEQ ID NO: 2741742 - DNA, 15 bp, Homo sapiens
cacttgaatcctagg

SEQ ID NO: 2741743 - DNA, 16 bp, Homo sapiens
cagaagtcaagcccag

SEQ ID NO: 2741744 - DNA, 16 bp, Homo sapiens
cagaattgaaggagaa

SEQ ID NO: 2741745 - DNA, 18 bp, Homo sapiens
cagagcaagtctgcaggt

SEQ ID NO: 2741746 - DNA, 13 bp, Homo sapiens
cagatctttttgt

SEQ ID NO: 2741747 - DNA, 15 bp, Homo sapiens
cagatctttttgtga

SEQ ID NO: 2741748 - DNA, 16 bp, Homo sapiens
cagatctttttgtgaa

SEQ ID NO: 2741749 - DNA, 12 bp, Homo sapiens
cagcccttggcc

SEQ ID NO: 2741750 - DNA, 14 bp, Homo sapiens
cagcccttggccag

SEQ ID NO: 2741751 - DNA, 12 bp, Homo sapiens
cagctgcttctc

SEQ ID NO: 2741752 - DNA, 22 bp, Homo sapiens
cagggctctctttccttcttgc

SEQ ID NO: 2741753 - DNA, 12 bp, Homo sapiens
caggggctggct

SEQ ID NO: 2741754 - DNA, 16 bp, Homo sapiens
cagtagtcgtcaagtt

SEQ ID NO: 2741755 - DNA, 23 bp, Homo sapiens
cataaaggtatttagaatatatt

SEQ ID NO: 2741756 - DNA, 14 bp, Homo sapiens
catatatgtatatg

SEQ ID NO: 2741757 - DNA, 18 bp, Homo sapiens
catatatgtatatgtata

SEQ ID NO: 2741758 - DNA, 20 bp, Homo sapiens
catatatgtatatgtatatc

SEQ ID NO: 2741759 - DNA, 20 bp, Homo sapiens
catcacttgaatcctagggc

SEQ ID NO: 2741760 - DNA, 16 bp, Homo sapiens
catcctttctgcctct

SEQ ID NO: 2741761 - DNA, 22 bp, Homo sapiens
cattgtatggatagtaaaattc

SEQ ID NO: 2741762 - DNA, 12 bp, Homo sapiens
cattttctgcaa

SEQ ID NO: 2741763 - DNA, 17 bp, Homo sapiens
cattttctgcaagcctg

SEQ ID NO: 2741764 - DNA, 18 bp, Homo sapiens
cattttctgcaagcctgc

SEQ ID NO: 2741765 - DNA, 15 bp, Homo sapiens
ccaaatgctttaaaa

SEQ ID NO: 2741766 - DNA, 13 bp, Homo sapiens
ccaagcagggagg

SEQ ID NO: 2741767 - DNA, 23 bp, Homo sapiens
ccacaggccctttcctcaggcaa

SEQ ID NO: 2741768 - DNA, 11 bp, Homo sapiens
ccacataaagg

SEQ ID NO: 2741769 - DNA, 12 bp, Homo sapiens
ccaccagagctg

SEQ ID NO: 2741770 - DNA, 12 bp, Homo sapiens
ccacttggccaa

SEQ ID NO: 2741771 - DNA, 17 bp, Homo sapiens
ccacttggccaagcagg

SEQ ID NO: 2741772 - DNA, 20 bp, Homo sapiens
ccagaagtcaagcccagcca

SEQ ID NO: 2741773 - DNA, 20 bp, Homo sapiens
ccagctcctccgtgcttcct

SEQ ID NO: 2741774 - DNA, 16 bp, Homo sapiens
ccaggaaatgtgcaca

SEQ ID NO: 2741775 - DNA, 13 bp, Homo sapiens
ccataaaaagctg

SEQ ID NO: 2741776 - DNA, 16 bp, Homo sapiens
ccatcctttctgcctc

SEQ ID NO: 2741777 - DNA, 20 bp, Homo sapiens
ccatcctttctgcctctcaa

SEQ ID NO: 2741778 - DNA, 19 bp, Homo sapiens
cccaagtagtagtgtcttc

SEQ ID NO: 2741779 - DNA, 22 bp, Homo sapiens
cccaagtagtagtgtcttccta

SEQ ID NO: 2741780 - DNA, 19 bp, Homo sapiens
cccgcacagagctggggct

SEQ ID NO: 2741781 - DNA, 13 bp, Homo sapiens
ccctctccgagct

SEQ ID NO: 2741782 - DNA, 11 bp, Homo sapiens
cccttggccag

SEQ ID NO: 2741783 - DNA, 14 bp, Homo sapiens
ccgtgcttcctcag

SEQ ID NO: 2741784 - DNA, 11 bp, Homo sapiens
ccgttggccac

SEQ ID NO: 2741785 - DNA, 18 bp, Homo sapiens
cctcaggtgggccgcagg

SEQ ID NO: 2741786 - DNA, 13 bp, Homo sapiens
cctcctcagggat

SEQ ID NO: 2741787 - DNA, 15 bp, Homo sapiens
cctgaggtctggctg

SEQ ID NO: 2741788 - DNA, 17 bp, Homo sapiens
cctgaggtctggctgct

SEQ ID NO: 2741789 - DNA, 19 bp, Homo sapiens
cctgaggtctggctgcttg

SEQ ID NO: 2741790 - DNA, 19 bp, Homo sapiens
cctgcgttcttgtgacaga

SEQ ID NO: 2741791 - DNA, 18 bp, Homo sapiens
cctggtactgcacatttt

SEQ ID NO: 2741792 - DNA, 14 bp, Homo sapiens
cctgtccataaagt

SEQ ID NO: 2741793 - DNA, 15 bp, Homo sapiens
cctgtccataaagta

SEQ ID NO: 2741794 - DNA, 16 bp, Homo sapiens
cctgtccataaagtaa

SEQ ID NO: 2741795 - DNA, 18 bp, Homo sapiens
ccttctggattcttggcc

SEQ ID NO: 2741796 - DNA, 21 bp, Homo sapiens
ccttctggattcttggcccgc

SEQ ID NO: 2741797 - DNA, 16 bp, Homo sapiens
cctttcctcaggcaag

SEQ ID NO: 2741798 - DNA, 20 bp, Homo sapiens
cgaaacctgtccataaagta

SEQ ID NO: 2741799 - DNA, 12 bp, Homo sapiens
cgaaccaggagc

SEQ ID NO: 2741800 - DNA, 21 bp, Homo sapiens
cgaagaacaatgtcagaaact

SEQ ID NO: 2741801 - DNA, 21 bp, Homo sapiens
cgccaacaacttctccatcct

SEQ ID NO: 2741802 - DNA, 23 bp, Homo sapiens
cggttttcagctattagcaactg

SEQ ID NO: 2741803 - DNA, 17 bp, Homo sapiens
cgtaagatggcttattt

SEQ ID NO: 2741804 - DNA, 19 bp, Homo sapiens
cgtaagatggcttatttgt

SEQ ID NO: 2741805 - DNA, 21 bp, Homo sapiens
ctaaagctctgaacaaaagct

SEQ ID NO: 2741806 - DNA, 15 bp, Homo sapiens
ctacctcctcaggga

SEQ ID NO: 2741807 - DNA, 13 bp, Homo sapiens
ctacttttcagaa

SEQ ID NO: 2741808 - DNA, 15 bp, Homo sapiens
ctagggcctgggttt

SEQ ID NO: 2741809 - DNA, 14 bp, Homo sapiens
ctatatctctaaac

SEQ ID NO: 2741810 - DNA, 13 bp, Homo sapiens
ctcaaacgtggct

SEQ ID NO: 2741811 - DNA, 15 bp, Homo sapiens
ctcaaacgtggcttt

SEQ ID NO: 2741812 - DNA, 15 bp, Homo sapiens
ctcaagtgccctctc

SEQ ID NO: 2741813 - DNA, 22 bp, Homo sapiens
ctcaagtgccctctccgagctg

SEQ ID NO: 2741814 - DNA, 12 bp, Homo sapiens
ctcagctgcttc

SEQ ID NO: 2741815 - DNA, 16 bp, Homo sapiens
ctcagctgcttctccc

SEQ ID NO: 2741816 - DNA, 13 bp, Homo sapiens
tttctgcctctca

SEQ ID NO: 2741817 - DNA, 22 bp, Homo sapiens
tttgattgagagtaacttaagt

SEQ ID NO: 2741818 - DNA, 22 bp, Homo sapiens
ttttcattttctgcaagcctgc

SEQ ID NO: 2741819 - DNA, 16 bp, Homo sapiens
ttttctgcaagcctgc

SEQ ID NO: 2741820 - DNA, 15 bp, Homo sapiens
ttttgtcctgttatt

SEQ ID NO: 2741821 - DNA, 15 bp, Homo sapiens
tttttatttccacat

SEQ ID NO: 2741822 - DNA, 18 bp, Homo sapiens
aatgctttaaaaactatt

SEQ ID NO: 2741823 - DNA, 22 bp, Homo sapiens
aatgctttaaaaactatttaac

SEQ ID NO: 2741824 - DNA, 23 bp, Homo sapiens
aatgctttaaaaactatttaact

SEQ ID NO: 2741825 - DNA, 17 bp, Homo sapiens
aatggtgttactaaagt

SEQ ID NO: 2741826 - DNA, 17 bp, Homo sapiens
aatgtgttgatttgaga

SEQ ID NO: 2741827 - DNA, 22 bp, Homo sapiens
aatgtgttgatttgagaaattt

SEQ ID NO: 2741828 - DNA, 17 bp, Homo sapiens
aattcaacctgtgtctt

SEQ ID NO: 2741829 - DNA, 18 bp, Homo sapiens
aattcaacctgtgtctta

SEQ ID NO: 2741830 - DNA, 20 bp, Homo sapiens
aattgaaggagaaaatgcat

SEQ ID NO: 2741831 - DNA, 21 bp, Homo sapiens
aattttactgacagaaatgca

SEQ ID NO: 2741832 - DNA, 20 bp, Homo sapiens
acaaaattcgacctgattta

SEQ ID NO: 2741833 - DNA, 18 bp, Homo sapiens
acaggccctttcctcagg

SEQ ID NO: 2741834 - DNA, 20 bp, Homo sapiens
acaggccctttcctcaggca

SEQ ID NO: 2741835 - DNA, 15 bp, Homo sapiens
acattcctctgcagc

SEQ ID NO: 2741836 - DNA, 13 bp, Homo sapiens
accaaatgcttta

SEQ ID NO: 2741837 - DNA, 17 bp, Homo sapiens
accaattgattttaaac

SEQ ID NO: 2741838 - DNA, 15 bp, Homo sapiens
acctcagctgcttct

SEQ ID NO: 2741839 - DNA, 21 bp, Homo sapiens
acctgatttacagtttcaaaa

SEQ ID NO: 2741840 - DNA, 16 bp, Homo sapiens
acctgtccataaagta

SEQ ID NO: 2741841 - DNA, 12 bp, Homo sapiens
acctgtgtctta

SEQ ID NO: 2741842 - DNA, 15 bp, Homo sapiens
actacctcctcaggg

SEQ ID NO: 2741843 - DNA, 12 bp, Homo sapiens
actgatgctttt

SEQ ID NO: 2741844 - DNA, 11 bp, Homo sapiens
actgtatggaa

SEQ ID NO: 2741845 - DNA, 12 bp, Homo sapiens
actgtattgatg

SEQ ID NO: 2741846 - DNA, 19 bp, Homo sapiens
acttgaatcctagggcctg

SEQ ID NO: 2741847 - DNA, 21 bp, Homo sapiens
acttttcagaattgaaggaga

SEQ ID NO: 2741848 - DNA, 19 bp, Homo sapiens
agaaactcgatgaatgtgt

SEQ ID NO: 2741849 - DNA, 14 bp, Homo sapiens
agaatacttttctc

SEQ ID NO: 2741850 - DNA, 16 bp, Homo sapiens
agaattgtgtctgcag

SEQ ID NO: 2741851 - DNA, 12 bp, Homo sapiens
agaccctctcaa

SEQ ID NO: 2741852 - DNA, 18 bp, Homo sapiens
agagctggggctgaggga

SEQ ID NO: 2741853 - DNA, 18 bp, Homo sapiens
agagtgagggcctgaggt

SEQ ID NO: 2741854 - DNA, 15 bp, Homo sapiens
agatctttttgtgaa

SEQ ID NO: 2741855 - DNA, 15 bp, Homo sapiens
agattatatatcata

SEQ ID NO: 2741856 - DNA, 16 bp, Homo sapiens
agattatatatcataa

SEQ ID NO: 2741857 - DNA, 18 bp, Homo sapiens
agattatatatcataaag

SEQ ID NO: 2741858 - DNA, 20 bp, Homo sapiens
agattatatatcataaagta

SEQ ID NO: 2741859 - DNA, 22 bp, Homo sapiens
agattatatatcataaagtatg

SEQ ID NO: 2741860 - DNA, 17 bp, Homo sapiens
agcagagcaagtctgca

SEQ ID NO: 2741861 - DNA, 18 bp, Homo sapiens
agcagagcaagtctgcag

SEQ ID NO: 2741862 - DNA, 18 bp, Homo sapiens
agcatatgtgttggcttg

SEQ ID NO: 2741863 - DNA, 18 bp, Homo sapiens
agctattagcaactgtgc

SEQ ID NO: 2741864 - DNA, 16 bp, Homo sapiens
agctgaccacaggcag

SEQ ID NO: 2741865 - DNA, 17 bp, Homo sapiens
agctgaccacaggcagt

SEQ ID NO: 2741866 - DNA, 17 bp, Homo sapiens
agctggggctgagggat

SEQ ID NO: 2741867 - DNA, 20 bp, Homo sapiens
agcttcccccccaccacagg

SEQ ID NO: 2741868 - DNA, 16 bp, Homo sapiens
aggaagaagcttaggc

SEQ ID NO: 2741869 - DNA, 17 bp, Homo sapiens
aggaagaagcttaggca

SEQ ID NO: 2741870 - DNA, 22 bp, Homo sapiens
aggcagggctctctttccttct

SEQ ID NO: 2741871 - DNA, 24 bp, Homo sapiens
aggcattccagctcctccgtgctt

SEQ ID NO: 2741872 - DNA, 21 bp, Homo sapiens
aggcgggaaaagcagcccttg

SEQ ID NO: 2741873 - DNA, 19 bp, Homo sapiens
agggagcatagaaggcagg

SEQ ID NO: 2741874 - DNA, 16 bp, Homo sapiens
agggcctgaggtctgg

SEQ ID NO: 2741875 - DNA, 16 bp, Homo sapiens
aggggctggcttcagg

SEQ ID NO: 2741876 - DNA, 16 bp, Homo sapiens
aggtctggctgcttgc

SEQ ID NO: 2741877 - DNA, 21 bp, Homo sapiens
aggtgagcaaccagttggcta

SEQ ID NO: 2741878 - DNA, 23 bp, Homo sapiens
aggtgggccgcaggcgggaaaag

SEQ ID NO: 2741879 - DNA, 21 bp, Homo sapiens
agtagtaccaaatgctttaaa

SEQ ID NO: 2741880 - DNA, 21 bp, Homo sapiens
agtagtgtcttcctagtatat

SEQ ID NO: 2741881 - DNA, 22 bp, Homo sapiens
agtagtgtcttcctagtatatt

SEQ ID NO: 2741882 - DNA, 13 bp, Homo sapiens
agtatatattcta

SEQ ID NO: 2741883 - DNA, 21 bp, Homo sapiens
agtatatattctacacatata

SEQ ID NO: 2741884 - DNA, 19 bp, Homo sapiens
agtatattagtttgattta

SEQ ID NO: 2741885 - DNA, 12 bp, Homo sapiens
agtgagggcctg

SEQ ID NO: 2741886 - DNA, 18 bp, Homo sapiens
agtgatggagcagagcaa

SEQ ID NO: 2741887 - DNA, 14 bp, Homo sapiens
agttaaacataaat

SEQ ID NO: 2741888 - DNA, 22 bp, Homo sapiens
agtttccaaagggcagtaaagt

SEQ ID NO: 2741889 - DNA, 16 bp, Homo sapiens
ataaaataattttatt

SEQ ID NO: 2741890 - DNA, 21 bp, Homo sapiens
ataaaggtatttagaatatat

SEQ ID NO: 2741891 - DNA, 22 bp, Homo sapiens
atacagaattgtgtctgcagga

SEQ ID NO: 2741892 - DNA, 16 bp, Homo sapiens
atagtaaaattctact

SEQ ID NO: 2741893 - DNA, 14 bp, Homo sapiens
atatatcataaagt

SEQ ID NO: 2741894 - DNA, 16 bp, Homo sapiens
atatatcataaagtat

SEQ ID NO: 2741895 - DNA, 23 bp, Homo sapiens
atatatgtatatgtatatctata

SEQ ID NO: 2741896 - DNA, 23 bp, Homo sapiens
atatattctacacatatatgtat

SEQ ID NO: 2741897 - DNA, 15 bp, Homo sapiens
atatcataaagtatg

SEQ ID NO: 2741898 - DNA, 13 bp, Homo sapiens
atatctatatctc

SEQ ID NO: 2741899 - DNA, 19 bp, Homo sapiens
atatctgagaagtgtatat

SEQ ID NO: 2741900 - DNA, 16 bp, Homo sapiens
atatgtatatgtatat

SEQ ID NO: 2741901 - DNA, 14 bp, Homo sapiens
atatttactttaaa

SEQ ID NO: 2741902 - DNA, 12 bp, Homo sapiens
atcataaagtat

SEQ ID NO: 2741903 - DNA, 17 bp, Homo sapiens
atcctagggcctgggtt

SEQ ID NO: 2741904 - DNA, 19 bp, Homo sapiens
atctgagaagtgtatatag

SEQ ID NO: 2741905 - DNA, 19 bp, Homo sapiens
atcttggtccaggaaatgt

SEQ ID NO: 2741906 - DNA, 23 bp, Homo sapiens
atcttggtccaggaaatgtgcac

SEQ ID NO: 2741907 - DNA, 18 bp, Homo sapiens
atgagagttccagattgt

SEQ ID NO: 2741908 - DNA, 14 bp, Homo sapiens
atgcagaatacttt

SEQ ID NO: 2741909 - DNA, 19 bp, Homo sapiens
atggcttatttgtataatg

SEQ ID NO: 2741910 - DNA, 23 bp, Homo sapiens
atgtagccatgaccttacatttc

SEQ ID NO: 2741911 - DNA, 14 bp, Homo sapiens
atgtatatgtatat

SEQ ID NO: 2741912 - DNA, 21 bp, Homo sapiens
atgtcagaaactcgatgaatg

SEQ ID NO: 2741913 - DNA, 17 bp, Homo sapiens
atgtttttgaaacagaa

SEQ ID NO: 2741914 - DNA, 22 bp, Homo sapiens
attagctacttttcagaattga

SEQ ID NO: 2741915 - DNA, 20 bp, Homo sapiens
attagtttgatttaatatct

SEQ ID NO: 2741916 - DNA, 22 bp, Homo sapiens
attagtttgatttaatatctga

SEQ ID NO: 2741917 - DNA, 19 bp, Homo sapiens
attatatatcataaagtat

SEQ ID NO: 2741918 - DNA, 16 bp, Homo sapiens
attcgacctgatttac

SEQ ID NO: 2741919 - DNA, 21 bp, Homo sapiens
attcttggcccgcacagagct

SEQ ID NO: 2741920 - DNA, 14 bp, Homo sapiens
attgaaatttatac

SEQ ID NO: 2741921 - DNA, 20 bp, Homo sapiens
attgagagtaacttaagtta

SEQ ID NO: 2741922 - DNA, 15 bp, Homo sapiens
attgtaacttggatg

SEQ ID NO: 2741923 - DNA, 22 bp, Homo sapiens
taaaggtatttagaatatatta

SEQ ID NO: 2741924 - DNA, 15 bp, Homo sapiens
taaagtaattttgtg

SEQ ID NO: 2741925 - DNA, 19 bp, Homo sapiens
taaatattctattttcatt

SEQ ID NO: 2741926 - DNA, 13 bp, Homo sapiens
taagactcctcgg

SEQ ID NO: 2741927 - DNA, 19 bp, Homo sapiens
taatatctgagaagtgtat

SEQ ID NO: 2741928 - DNA, 17 bp, Homo sapiens
tacacatatatgtatat

SEQ ID NO: 2741929 - DNA, 21 bp, Homo sapiens
tacttctgagggcatcttggt

SEQ ID NO: 2741930 - DNA, 19 bp, Homo sapiens
tagagtgagggcctgaggt

SEQ ID NO: 2741931 - DNA, 12 bp, Homo sapiens
tagcaactgtgc

SEQ ID NO: 2741932 - DNA, 20 bp, Homo sapiens
tagtatattagtttgattta

SEQ ID NO: 2741933 - DNA, 15 bp, Homo sapiens
tatatatcataaagt

SEQ ID NO: 2741934 - DNA, 21 bp, Homo sapiens
tatatattctacacatatatg

SEQ ID NO: 2741935 - DNA, 13 bp, Homo sapiens
tatatgtatatct

SEQ ID NO: 2741936 - DNA, 19 bp, Homo sapiens
tatatgtatatctatatct

SEQ ID NO: 2741937 - DNA, 13 bp, Homo sapiens
tatcataaagtat

SEQ ID NO: 2741938 - DNA, 15 bp, Homo sapiens
tatctatatctctaa

SEQ ID NO: 2741939 - DNA, 17 bp, Homo sapiens
tatctatatctctaaac

SEQ ID NO: 2741940 - DNA, 22 bp, Homo sapiens
tatctgagaagtgtatatagtt

SEQ ID NO: 2741941 - DNA, 17 bp, Homo sapiens
tatgccttcctgtttaa

SEQ ID NO: 2741942 - DNA, 17 bp, Homo sapiens
tatgtatatgtatatct

SEQ ID NO: 2741943 - DNA, 22 bp, Homo sapiens
tattctacacatatatgtatat

SEQ ID NO: 2741944 - DNA, 20 bp, Homo sapiens
tatttagaatatattaaatc

SEQ ID NO: 2741945 - DNA, 18 bp, Homo sapiens
tatttccacataaaggta

SEQ ID NO: 2741946 - DNA, 19 bp, Homo sapiens
tatttccacataaaggtat

SEQ ID NO: 2741947 - DNA, 18 bp, Homo sapiens
tattttttatttccacat

SEQ ID NO: 2741948 - DNA, 22 bp, Homo sapiens
tcaagcccagccacgtggagcc

SEQ ID NO: 2741949 - DNA, 23 bp, Homo sapiens
tcaagtgccctctccgagctggt

SEQ ID NO: 2741950 - DNA, 21 bp, Homo sapiens
tcacttgaatcctagggcctg

SEQ ID NO: 2741951 - DNA, 15 bp, Homo sapiens
tcagctgcttctccc

SEQ ID NO: 2741952 - DNA, 17 bp, Homo sapiens
tcaggcaaggtctggcc

SEQ ID NO: 2741953 - DNA, 13 bp, Homo sapiens
tcataaagtatgc

SEQ ID NO: 2741954 - DNA, 21 bp, Homo sapiens
tcatgtttttgaaacagaacc

SEQ ID NO: 2741955 - DNA, 12 bp, Homo sapiens
tccacataaagg

SEQ ID NO: 2741956 - DNA, 18 bp, Homo sapiens
tccactgccaaaacaatg

SEQ ID NO: 2741957 - DNA, 21 bp, Homo sapiens
tccataaagtaattttgtgaa

SEQ ID NO: 2741958 - DNA, 17 bp, Homo sapiens
tccatcctttctgcctc

SEQ ID NO: 2741959 - DNA, 13 bp, Homo sapiens
tcccacttggcca

SEQ ID NO: 2741960 - DNA, 18 bp, Homo sapiens
tcccaggggctggcttca

SEQ ID NO: 2741961 - DNA, 14 bp, Homo sapiens
tcctcggcctggct

SEQ ID NO: 2741962 - DNA, 13 bp, Homo sapiens
tcctgctctgccc

SEQ ID NO: 2741963 - DNA, 18 bp, Homo sapiens
tccttctgcctgagcttc

SEQ ID NO: 2741964 - DNA, 17 bp, Homo sapiens
tccttcttgccttcaga

SEQ ID NO: 2741965 - DNA, 19 bp, Homo sapiens
tccttttgcaacaagacaa

SEQ ID NO: 2741966 - DNA, 23 bp, Homo sapiens
tcgatgaatgtgttgatttgaga

SEQ ID NO: 2741967 - DNA, 18 bp, Homo sapiens
tcgttagaggagcaacag

SEQ ID NO: 2741968 - DNA, 21 bp, Homo sapiens
tctacacatatatgtatatgt

SEQ ID NO: 2741969 - DNA, 22 bp, Homo sapiens
tctccatcctttctgcctctca

SEQ ID NO: 2741970 - DNA, 12 bp, Homo sapiens
tctcccaggggc

SEQ ID NO: 2741971 - DNA, 18 bp, Homo sapiens
tctcccaggggctggctt

SEQ ID NO: 2741972 - DNA, 20 bp, Homo sapiens
tctctaaactgctgttaatt

SEQ ID NO: 2741973 - DNA, 20 bp, Homo sapiens
tctctcccaggggctggctt

SEQ ID NO: 2741974 - DNA, 19 bp, Homo sapiens
tctctttccttcttgcctt

SEQ ID NO: 2741975 - DNA, 15 bp, Homo sapiens
tctgaacaaaagctt

SEQ ID NO: 2741976 - DNA, 16 bp, Homo sapiens
tctgagaagtgtatat

SEQ ID NO: 2741977 - DNA, 15 bp, Homo sapiens
tctggattcttggcc

SEQ ID NO: 2741978 - DNA, 13 bp, Homo sapiens
tcttccttctgcc

SEQ ID NO: 2741979 - DNA, 15 bp, Homo sapiens
tctttccttcttgcc

SEQ ID NO: 2741980 - DNA, 23 bp, Homo sapiens
tgaaatttatacaccaattgatt

SEQ ID NO: 2741981 - DNA, 15 bp, Homo sapiens
tgaaccgacttttct

SEQ ID NO: 2741982 - DNA, 13 bp, Homo sapiens
tgaccttacattt

SEQ ID NO: 2741983 - DNA, 14 bp, Homo sapiens
tgagaagtgtatat

SEQ ID NO: 2741984 - DNA, 18 bp, Homo sapiens
tgagagtaacttaagtta

SEQ ID NO: 2741985 - DNA, 17 bp, Homo sapiens
tgattgagagtaactta

SEQ ID NO: 2741986 - DNA, 17 bp, Homo sapiens
tgatttacagtttcaaa

SEQ ID NO: 2741987 - DNA, 22 bp, Homo sapiens
tgattttaaaccataaaaagct

SEQ ID NO: 2741988 - DNA, 19 bp, Homo sapiens
tgcacattttgtacaaaga

SEQ ID NO: 2741989 - DNA, 19 bp, Homo sapiens
tgcactggtcccaagtagt

SEQ ID NO: 2741990 - DNA, 21 bp, Homo sapiens
tgcagatctttttgtgaaatt

SEQ ID NO: 2741991 - DNA, 18 bp, Homo sapiens
tgctcactacctcctcag

SEQ ID NO: 2741992 - DNA, 20 bp, Homo sapiens
tgctcactacctcctcaggg

SEQ ID NO: 2741993 - DNA, 14 bp, Homo sapiens
tgctcgaagaacaa

SEQ ID NO: 2741994 - DNA, 18 bp, Homo sapiens
tgcttgcccccatgctgg

SEQ ID NO: 2741995 - DNA, 19 bp, Homo sapiens
tgcttgctgccttctggat

SEQ ID NO: 2741996 - DNA, 12 bp, Homo sapiens
tggaaaaagtga

SEQ ID NO: 2741997 - DNA, 12 bp, Homo sapiens
tggagcagagca

SEQ ID NO: 2741998 - DNA, 20 bp, Homo sapiens
tggagcagagcaagtctgca

SEQ ID NO: 2741999 - DNA, 21 bp, Homo sapiens
tggagcagagcaagtctgcag

SEQ ID NO: 2742000 - DNA, 15 bp, Homo sapiens
tggcttttagacaga

SEQ ID NO: 2742001 - DNA, 21 bp, Homo sapiens
tgggcctcttggaaaaagtga

SEQ ID NO: 2742002 - DNA, 23 bp, Homo sapiens
tggtaaaaagattatatatcata

SEQ ID NO: 2742003 - DNA, 18 bp, Homo sapiens
tggtactgcacattttgt

SEQ ID NO: 2742004 - DNA, 23 bp, Homo sapiens
tggtcccaagtagtagtgtcttc

SEQ ID NO: 2742005 - DNA, 16 bp, Homo sapiens
tggtgttactaaagtc

SEQ ID NO: 2742006 - DNA, 18 bp, Homo sapiens
tgtacaaagatatgctaa

SEQ ID NO: 2742007 - DNA, 14 bp, Homo sapiens
tgtccagtttccaa

SEQ ID NO: 2742008 - DNA, 13 bp, Homo sapiens
tgtccataaagta

SEQ ID NO: 2742009 - DNA, 20 bp, Homo sapiens
tgtcttcctagtatattagt

SEQ ID NO: 2742010 - DNA, 22 bp, Homo sapiens
tgttactaaagtcacatataaa

SEQ ID NO: 2742011 - DNA, 18 bp, Homo sapiens
tgttcatagaccctctca

SEQ ID NO: 2742012 - DNA, 15 bp, Homo sapiens
tgttctctcccaggg

SEQ ID NO: 2742013 - DNA, 22 bp, Homo sapiens
ttaaaaaaagtatatattctac

SEQ ID NO: 2742014 - DNA, 13 bp, Homo sapiens
ttaaacataaata

SEQ ID NO: 2742015 - DNA, 17 bp, Homo sapiens
ttaacttgagctttaaa

SEQ ID NO: 2742016 - DNA, 17 bp, Homo sapiens
ttaatatctgagaagtg

SEQ ID NO: 2742017 - DNA, 18 bp, Homo sapiens
ttactgacagaaatgcaa

SEQ ID NO: 2742018 - DNA, 12 bp, Homo sapiens
ttatatatcata

SEQ ID NO: 2742019 - DNA, 17 bp, Homo sapiens
ttatttccacataaagg

SEQ ID NO: 2742020 - DNA, 21 bp, Homo sapiens
ttccaaagggcagtaaagttt

SEQ ID NO: 2742021 - DNA, 13 bp, Homo sapiens
ttccacataaagg

SEQ ID NO: 2742022 - DNA, 19 bp, Homo sapiens
ttccactgccaaaacaatg

SEQ ID NO: 2742023 - DNA, 14 bp, Homo sapiens
ttccagattgttct

SEQ ID NO: 2742024 - DNA, 11 bp, Homo sapiens
aaaaaagtata

SEQ ID NO: 2742025 - DNA, 12 bp, Homo sapiens
aaaaactgtatt

SEQ ID NO: 2742026 - DNA, 18 bp, Homo sapiens
aaaaagattatatatcat

SEQ ID NO: 2742027 - DNA, 14 bp, Homo sapiens
aaaaagtatatatt

SEQ ID NO: 2742028 - DNA, 15 bp, Homo sapiens
aaaagattatatatc

SEQ ID NO: 2742029 - DNA, 16 bp, Homo sapiens
aaaagttaaactactt

SEQ ID NO: 2742030 - DNA, 21 bp, Homo sapiens
aaaattcgacctgatttacag

SEQ ID NO: 2742031 - DNA, 17 bp, Homo sapiens
aaactatttaacttgag

SEQ ID NO: 2742032 - DNA, 14 bp, Homo sapiens
aaactgtattgatg

SEQ ID NO: 2742033 - DNA, 22 bp, Homo sapiens
aaactgtattgatgacagtagt

SEQ ID NO: 2742034 - DNA, 15 bp, Homo sapiens
aaagccacattttgc

SEQ ID NO: 2742035 - DNA, 15 bp, Homo sapiens
aaagggcagtaaagt

SEQ ID NO: 2742036 - DNA, 14 bp, Homo sapiens
aaagtatatattct

SEQ ID NO: 2742037 - DNA, 12 bp, Homo sapiens
aaataaaataat

SEQ ID NO: 2742038 - DNA, 20 bp, Homo sapiens
aaattcaacctgtgtcttat

SEQ ID NO: 2742039 - DNA, 18 bp, Homo sapiens
aaattcgacctgatttac

SEQ ID NO: 2742040 - DNA, 20 bp, Homo sapiens
aaatttatacaccaattgat

SEQ ID NO: 2742041 - DNA, 13 bp, Homo sapiens
aaccagttggcta

SEQ ID NO: 2742042 - DNA, 21 bp, Homo sapiens
aacctgtccataaagtaattt

SEQ ID NO: 2742043 - DNA, 23 bp, Homo sapiens
aactcgatgaatgtgttgatttg

SEQ ID NO: 2742044 - DNA, 22 bp, Homo sapiens
aacttgagctttaaaaatcatt

SEQ ID NO: 2742045 - DNA, 16 bp, Homo sapiens
aagaagcttaggcagg

SEQ ID NO: 2742046 - DNA, 21 bp, Homo sapiens
aagatggcttatttgtataat

SEQ ID NO: 2742047 - DNA, 21 bp, Homo sapiens
aagattatatatcataaagta

SEQ ID NO: 2742048 - DNA, 13 bp, Homo sapiens
aagcagcccttgg

SEQ ID NO: 2742049 - DNA, 16 bp, Homo sapiens
aagcagcccttggcca

SEQ ID NO: 2742050 - DNA, 20 bp, Homo sapiens
aaggtatttagaatatatta

SEQ ID NO: 2742051 - DNA, 17 bp, Homo sapiens
aagtcacatataaaagt

SEQ ID NO: 2742052 - DNA, 18 bp, Homo sapiens
aatatctgagaagtgtat

SEQ ID NO: 2742053 - DNA, 18 bp, Homo sapiens
aatggtgttactaaagtc

SEQ ID NO: 2742054 - DNA, 19 bp, Homo sapiens
aatggtgttactaaagtca

SEQ ID NO: 2742055 - DNA, 14 bp, Homo sapiens
aatgtcagaaactc

SEQ ID NO: 2742056 - DNA, 14 bp, Homo sapiens
aattcgacctgatt

SEQ ID NO: 2742057 - DNA, 18 bp, Homo sapiens
aattttactgacagaaat

SEQ ID NO: 2742058 - DNA, 19 bp, Homo sapiens
aattttactgacagaaatg

SEQ ID NO: 2742059 - DNA, 12 bp, Homo sapiens
acataaaggtat

SEQ ID NO: 2742060 - DNA, 12 bp, Homo sapiens
acatataaaagt

SEQ ID NO: 2742061 - DNA, 23 bp, Homo sapiens
acatatatgtatatgtatatcta

SEQ ID NO: 2742062 - DNA, 11 bp, Homo sapiens
accaaatgctt

SEQ ID NO: 2742063 - DNA, 14 bp, Homo sapiens
accaggagctgctc

SEQ ID NO: 2742064 - DNA, 15 bp, Homo sapiens
acccaccgcccttgc

SEQ ID NO: 2742065 - DNA, 13 bp, Homo sapiens
acctcctcaggga

SEQ ID NO: 2742066 - DNA, 23 bp, Homo sapiens
acctcctcagggatggccgttgg

SEQ ID NO: 2742067 - DNA, 15 bp, Homo sapiens
acctgtccataaagt

SEQ ID NO: 2742068 - DNA, 23 bp, Homo sapiens
acgtcttccttctgcctgagctt

SEQ ID NO: 2742069 - DNA, 17 bp, Homo sapiens
actacctcctcagggat

SEQ ID NO: 2742070 - DNA, 22 bp, Homo sapiens
actatttaacttgagctttaaa

SEQ ID NO: 2742071 - DNA, 16 bp, Homo sapiens
actcctcggcctggct

SEQ ID NO: 2742072 - DNA, 19 bp, Homo sapiens
actcctcggcctggctcct

SEQ ID NO: 2742073 - DNA, 23 bp, Homo sapiens
actcctcggcctggctcctaccc

SEQ ID NO: 2742074 - DNA, 15 bp, Homo sapiens
actcgatgaatgtgt

SEQ ID NO: 2742075 - DNA, 15 bp, Homo sapiens
actgccaaaacaatg

SEQ ID NO: 2742076 - DNA, 16 bp, Homo sapiens
acttcactaccaaatg

SEQ ID NO: 2742077 - DNA, 23 bp, Homo sapiens
acttgagctttaaaaatcattgt

SEQ ID NO: 2742078 - DNA, 15 bp, Homo sapiens
actttaaaataaaat

SEQ ID NO: 2742079 - DNA, 22 bp, Homo sapiens
agaaattttactgacagaaatg

SEQ ID NO: 2742080 - DNA, 13 bp, Homo sapiens
agaagcttaggca

SEQ ID NO: 2742081 - DNA, 15 bp, Homo sapiens
agaattgtgtctgca

SEQ ID NO: 2742082 - DNA, 12 bp, Homo sapiens
agacaaagcaaa

SEQ ID NO: 2742083 - DNA, 21 bp, Homo sapiens
agagctggggctgagggatgg

SEQ ID NO: 2742084 - DNA, 20 bp, Homo sapiens
agatgttctctcccaggggc

SEQ ID NO: 2742085 - DNA, 14 bp, Homo sapiens
agattatacagaat

SEQ ID NO: 2742086 - DNA, 17 bp, Homo sapiens
agattatacagaattgt

SEQ ID NO: 2742087 - DNA, 15 bp, Homo sapiens
agcaaccagttggct

SEQ ID NO: 2742088 - DNA, 13 bp, Homo sapiens
agcaagtctgcag

SEQ ID NO: 2742089 - DNA, 19 bp, Homo sapiens
agcagagcaagtctgcagg

SEQ ID NO: 2742090 - DNA, 16 bp, Homo sapiens
agcatatgtgttggct

SEQ ID NO: 2742091 - DNA, 18 bp, Homo sapiens
agccatgaccttacattt

SEQ ID NO: 2742092 - DNA, 11 bp, Homo sapiens
agcccttggcc

SEQ ID NO: 2742093 - DNA, 12 bp, Homo sapiens
agcccttggcca

SEQ ID NO: 2742094 - DNA, 15 bp, Homo sapiens
aggacctcagctgct

SEQ ID NO: 2742095 - DNA, 14 bp, Homo sapiens
aggagaaaatgcat

SEQ ID NO: 2742096 - DNA, 17 bp, Homo sapiens
aggattgattatgcaga

SEQ ID NO: 2742097 - DNA, 16 bp, Homo sapiens
aggccctttcctcagg

SEQ ID NO: 2742098 - DNA, 21 bp, Homo sapiens
agggagcatagaaggcaggtg

SEQ ID NO: 2742099 - DNA, 15 bp, Homo sapiens
agggaggaagaagct

SEQ ID NO: 2742100 - DNA, 13 bp, Homo sapiens
agggatggactga

SEQ ID NO: 2742101 - DNA, 18 bp, Homo sapiens
agggatggactgatgctt

SEQ ID NO: 2742102 - DNA, 19 bp, Homo sapiens
agggctctctttccttctt

SEQ ID NO: 2742103 - DNA, 22 bp, Homo sapiens
aggtgagcaaccagttggctag

SEQ ID NO: 2742104 - DNA, 14 bp, Homo sapiens
agtaacttaagtta

SEQ ID NO: 2742105 - DNA, 17 bp, Homo sapiens
agtagtaccaaatgctt

SEQ ID NO: 2742106 - DNA, 18 bp, Homo sapiens
agtagtaccaaatgcttt

SEQ ID NO: 2742107 - DNA, 19 bp, Homo sapiens
agtagtaccaaatgcttta

SEQ ID NO: 2742108 - DNA, 22 bp, Homo sapiens
agtagtaccaaatgctttaaaa

SEQ ID NO: 2742109 - DNA, 12 bp, Homo sapiens
tgtccataaagt

SEQ ID NO: 2742110 - DNA, 19 bp, Homo sapiens
tgtcttataggtttccact

SEQ ID NO: 2742111 - DNA, 22 bp, Homo sapiens
tgtcttcctagtatattagttt

SEQ ID NO: 2742112 - DNA, 14 bp, Homo sapiens
tgttaattgattaa

SEQ ID NO: 2742113 - DNA, 21 bp, Homo sapiens
tgttattttttatttccacat

SEQ ID NO: 2742114 - DNA, 18 bp, Homo sapiens
tgttctgtccagtttcca

SEQ ID NO: 2742115 - DNA, 20 bp, Homo sapiens
tgttctgtccagtttccaaa

SEQ ID NO: 2742116 - DNA, 21 bp, Homo sapiens
tgttctgtccagtttccaaag

SEQ ID NO: 2742117 - DNA, 17 bp, Homo sapiens
tgttgatttgagaaatt

SEQ ID NO: 2742118 - DNA, 16 bp, Homo sapiens
ttaaaataaaataatt

SEQ ID NO: 2742119 - DNA, 19 bp, Homo sapiens
ttaaaccataaaaagctga

SEQ ID NO: 2742120 - DNA, 13 bp, Homo sapiens
ttaaatcgttaga

SEQ ID NO: 2742121 - DNA, 14 bp, Homo sapiens
ttaatatctgagaa

SEQ ID NO: 2742122 - DNA, 13 bp, Homo sapiens
ttaattgaaattt

SEQ ID NO: 2742123 - DNA, 15 bp, Homo sapiens
ttactgacagaaatg

SEQ ID NO: 2742124 - DNA, 19 bp, Homo sapiens
ttagtttgatttaatatct

SEQ ID NO: 2742125 - DNA, 22 bp, Homo sapiens
ttatacagaattgtgtctgcag

SEQ ID NO: 2742126 - DNA, 13 bp, Homo sapiens
ttatttgtataat

SEQ ID NO: 2742127 - DNA, 16 bp, Homo sapiens
ttcaacctgtgtctta

SEQ ID NO: 2742128 - DNA, 18 bp, Homo sapiens
ttcattttctgcaagcct

SEQ ID NO: 2742129 - DNA, 22 bp, Homo sapiens
ttcctcaggcaaggtctggcct

SEQ ID NO: 2742130 - DNA, 17 bp, Homo sapiens
ttcctcagttacacaaa

SEQ ID NO: 2742131 - DNA, 17 bp, Homo sapiens
ttccttctgcctgagct

SEQ ID NO: 2742132 - DNA, 22 bp, Homo sapiens
ttcgaaacctgtccataaagta

SEQ ID NO: 2742133 - DNA, 17 bp, Homo sapiens
ttctacacatatatgta

SEQ ID NO: 2742134 - DNA, 18 bp, Homo sapiens
ttctacacatatatgtat

SEQ ID NO: 2742135 - DNA, 17 bp, Homo sapiens
ttctattttcattttct

SEQ ID NO: 2742136 - DNA, 20 bp, Homo sapiens
ttctattttcattttctgca

SEQ ID NO: 2742137 - DNA, 21 bp, Homo sapiens
ttctccatcctttctgcctct

SEQ ID NO: 2742138 - DNA, 16 bp, Homo sapiens
ttctgtccagtttcca

SEQ ID NO: 2742139 - DNA, 14 bp, Homo sapiens
ttcttctctgctgc

SEQ ID NO: 2742140 - DNA, 12 bp, Homo sapiens
ttcttgccttca

SEQ ID NO: 2742141 - DNA, 22 bp, Homo sapiens
ttcttgtgacagattatacaga

SEQ ID NO: 2742142 - DNA, 13 bp, Homo sapiens
ttgaaacagaacc

SEQ ID NO: 2742143 - DNA, 15 bp, Homo sapiens
ttgatttgagaaatt

SEQ ID NO: 2742144 - DNA, 17 bp, Homo sapiens
ttggaaaaagtgatgga

SEQ ID NO: 2742145 - DNA, 15 bp, Homo sapiens
ttggtccaggaaatg

SEQ ID NO: 2742146 - DNA, 15 bp, Homo sapiens
ttgtacaaagatatg

SEQ ID NO: 2742147 - DNA, 18 bp, Homo sapiens
ttgtacaaagatatgcta

SEQ ID NO: 2742148 - DNA, 13 bp, Homo sapiens
ttgtgaaagaagg

SEQ ID NO: 2742149 - DNA, 18 bp, Homo sapiens
tttaaaaaaagtatatat

SEQ ID NO: 2742150 - DNA, 20 bp, Homo sapiens
tttaaaaatcattgtatgga

SEQ ID NO: 2742151 - DNA, 23 bp, Homo sapiens
tttaatatctgagaagtgtatat

SEQ ID NO: 2742152 - DNA, 15 bp, Homo sapiens
tttactgacagaaat

SEQ ID NO: 2742153 - DNA, 15 bp, Homo sapiens
tttcattttctgcaa

SEQ ID NO: 2742154 - DNA, 18 bp, Homo sapiens
tttcattttctgcaagcc

SEQ ID NO: 2742155 - DNA, 15 bp, Homo sapiens
tttccactgccaaaa

SEQ ID NO: 2742156 - DNA, 16 bp, Homo sapiens
tttccttcttgccttc

SEQ ID NO: 2742157 - DNA, 19 bp, Homo sapiens
tttctaaagctctgaacaa

SEQ ID NO: 2742158 - DNA, 22 bp, Homo sapiens
tttgcaacaagacaaagcaaag

SEQ ID NO: 2742159 - DNA, 16 bp, Homo sapiens
tttgcattagacagat

SEQ ID NO: 2742160 - DNA, 21 bp, Homo sapiens
ttttaaaccataaaaagctga

SEQ ID NO: 2742161 - DNA, 14 bp, Homo sapiens
ttttactgacagaa

SEQ ID NO: 2742162 - DNA, 15 bp, Homo sapiens
ttttactgacagaaa

SEQ ID NO: 2742163 - DNA, 17 bp, Homo sapiens
ttttatttccacataaa

SEQ ID NO: 2742164 - DNA, 24 bp, Homo sapiens
ttttcagaattgaaggagaaaatg

SEQ ID NO: 2742165 - DNA, 12 bp, Homo sapiens
ttttcatgtttt

SEQ ID NO: 2742166 - DNA, 17 bp, Homo sapiens
aggggctggcttcagga

SEQ ID NO: 2742167 - DNA, 16 bp, Homo sapiens
aggtctggcctcaggt

SEQ ID NO: 2742168 - DNA, 14 bp, Homo sapiens
agtaccaaatgctt

SEQ ID NO: 2742169 - DNA, 14 bp, Homo sapiens
agtgatggagcaga

SEQ ID NO: 2742170 - DNA, 14 bp, Homo sapiens
ataaaataatttta

SEQ ID NO: 2742171 - DNA, 21 bp, Homo sapiens
ataatggtgttactaaagtca

SEQ ID NO: 2742172 - DNA, 21 bp, Homo sapiens
atacagaattgtgtctgcagg

SEQ ID NO: 2742173 - DNA, 20 bp, Homo sapiens
atataaaagttaaactactt

SEQ ID NO: 2742174 - DNA, 24 bp, Homo sapiens
atatagtttgtggtaaaaagatta

SEQ ID NO: 2742175 - DNA, 15 bp, Homo sapiens
atatatgtatatgta

SEQ ID NO: 2742176 - DNA, 19 bp, Homo sapiens
atatattctacacatatat

SEQ ID NO: 2742177 - DNA, 12 bp, Homo sapiens
atatcataaagt

SEQ ID NO: 2742178 - DNA, 13 bp, Homo sapiens
atatcataaagta

SEQ ID NO: 2742179 - DNA, 18 bp, Homo sapiens
atatctatatctctaaac

SEQ ID NO: 2742180 - DNA, 17 bp, Homo sapiens
atatctgagaagtgtat

SEQ ID NO: 2742181 - DNA, 18 bp, Homo sapiens
atatctgagaagtgtata

SEQ ID NO: 2742182 - DNA, 13 bp, Homo sapiens
atatgtatatcta

SEQ ID NO: 2742183 - DNA, 12 bp, Homo sapiens
atatgtatatgt

SEQ ID NO: 2742184 - DNA, 22 bp, Homo sapiens
atattagtttgatttaatatct

SEQ ID NO: 2742185 - DNA, 14 bp, Homo sapiens
atcattgtatggat

SEQ ID NO: 2742186 - DNA, 18 bp, Homo sapiens
atctatatctctaaactg

SEQ ID NO: 2742187 - DNA, 18 bp, Homo sapiens
atgaatgtgttgatttga

SEQ ID NO: 2742188 - DNA, 23 bp, Homo sapiens
atgacagtagtaccaaatgcttt

SEQ ID NO: 2742189 - DNA, 14 bp, Homo sapiens
atgaccttacattt

SEQ ID NO: 2742190 - DNA, 16 bp, Homo sapiens
atgaccttacatttcc

SEQ ID NO: 2742191 - DNA, 16 bp, Homo sapiens
atggactgatgctttt

SEQ ID NO: 2742192 - DNA, 19 bp, Homo sapiens
atgtatatctatatctcta

SEQ ID NO: 2742193 - DNA, 13 bp, Homo sapiens
atgtatatgtata

SEQ ID NO: 2742194 - DNA, 19 bp, Homo sapiens
atgtatatgtatatctata

SEQ ID NO: 2742195 - DNA, 13 bp, Homo sapiens
atgtcagaaactc

SEQ ID NO: 2742196 - DNA, 21 bp, Homo sapiens
attaaaatctggcaaagttat

SEQ ID NO: 2742197 - DNA, 21 bp, Homo sapiens
attcgacctgatttacagttt

SEQ ID NO: 2742198 - DNA, 19 bp, Homo sapiens
attctacacatatatgtat

SEQ ID NO: 2742199 - DNA, 18 bp, Homo sapiens
attctattttcattttct

SEQ ID NO: 2742200 - DNA, 22 bp, Homo sapiens
attcttggcccgcacagagctg

SEQ ID NO: 2742201 - DNA, 14 bp, Homo sapiens
attgattaaaatct

SEQ ID NO: 2742202 - DNA, 13 bp, Homo sapiens
atttaacttgagc

SEQ ID NO: 2742203 - DNA, 16 bp, Homo sapiens
atttaatatctgagaa

SEQ ID NO: 2742204 - DNA, 20 bp, Homo sapiens
atttagaatatattaaatcg

SEQ ID NO: 2742205 - DNA, 15 bp, Homo sapiens
atttccacataaagg

SEQ ID NO: 2742206 - DNA, 15 bp, Homo sapiens
attttactgacagaa

SEQ ID NO: 2742207 - DNA, 21 bp, Homo sapiens
attttactgacagaaatgcaa

SEQ ID NO: 2742208 - DNA, 17 bp, Homo sapiens
attttcattttctgcaa

SEQ ID NO: 2742209 - DNA, 16 bp, Homo sapiens
attttctgcaagcctg

SEQ ID NO: 2742210 - DNA, 17 bp, Homo sapiens
attttgtacaaagatat

SEQ ID NO: 2742211 - DNA, 13 bp, Homo sapiens
caaagttatattt

SEQ ID NO: 2742212 - DNA, 20 bp, Homo sapiens
caaatgagcattagctactt

SEQ ID NO: 2742213 - DNA, 12 bp, Homo sapiens
caagcagggagg

SEQ ID NO: 2742214 - DNA, 20 bp, Homo sapiens
cacataaaggtatttagaat

SEQ ID NO: 2742215 - DNA, 12 bp, Homo sapiens
cacatatatgta

SEQ ID NO: 2742216 - DNA, 19 bp, Homo sapiens
cacattttgtacaaagata

SEQ ID NO: 2742217 - DNA, 20 bp, Homo sapiens
cacattttgtacaaagatat

SEQ ID NO: 2742218 - DNA, 11 bp, Homo sapiens
caccagagctg

SEQ ID NO: 2742219 - DNA, 16 bp, Homo sapiens
cacgtcttccttctgc

SEQ ID NO: 2742220 - DNA, 18 bp, Homo sapiens
cacttggccaagcaggga

SEQ ID NO: 2742221 - DNA, 17 bp, Homo sapiens
cagaattgtgtctgcag

SEQ ID NO: 2742222 - DNA, 13 bp, Homo sapiens
cagagctggggct

SEQ ID NO: 2742223 - DNA, 20 bp, Homo sapiens
cagagctggggctgagggat

SEQ ID NO: 2742224 - DNA, 15 bp, Homo sapiens
cagctgcttctccca

SEQ ID NO: 2742225 - DNA, 19 bp, Homo sapiens
cagggatggccgttggcca

SEQ ID NO: 2742226 - DNA, 17 bp, Homo sapiens
caggggctggcttcagg

SEQ ID NO: 2742227 - DNA, 21 bp, Homo sapiens
caggtgagcaaccagttggct

SEQ ID NO: 2742228 - DNA, 14 bp, Homo sapiens
cagtagtaccaaat

SEQ ID NO: 2742229 - DNA, 16 bp, Homo sapiens
cataaaggtatttaga

SEQ ID NO: 2742230 - DNA, 15 bp, Homo sapiens
catagaccctctcaa

SEQ ID NO: 2742231 - DNA, 23 bp, Homo sapiens
catcacttgaatcctagggcctg

SEQ ID NO: 2742232 - DNA, 19 bp, Homo sapiens
catcctttctgcctctcaa

SEQ ID NO: 2742233 - DNA, 15 bp, Homo sapiens
catggctaagcttta

SEQ ID NO: 2742234 - DNA, 16 bp, Homo sapiens
catggctaagctttat

SEQ ID NO: 2742235 - DNA, 11 bp, Homo sapiens
cattttctgca

SEQ ID NO: 2742236 - DNA, 14 bp, Homo sapiens
ccaggggctggctt

SEQ ID NO: 2742237 - DNA, 19 bp, Homo sapiens
ccagtttaatcattgcctg

SEQ ID NO: 2742238 - DNA, 21 bp, Homo sapiens
cccaggggctggcttcaggag

SEQ ID NO: 2742239 - DNA, 15 bp, Homo sapiens
ccctcctttttatgt

SEQ ID NO: 2742240 - DNA, 15 bp, Homo sapiens
ccgtgcttcctcagt

SEQ ID NO: 2742241 - DNA, 23 bp, Homo sapiens
cctagagtgagggcctgaggtct

SEQ ID NO: 2742242 - DNA, 15 bp, Homo sapiens
cctcaggtgggccgc

SEQ ID NO: 2742243 - DNA, 14 bp, Homo sapiens
cctccgtgcttcct

SEQ ID NO: 2742244 - DNA, 18 bp, Homo sapiens
cctcctttttatgttgcc

SEQ ID NO: 2742245 - DNA, 12 bp, Homo sapiens
cctgaggtctgg

SEQ ID NO: 2742246 - DNA, 13 bp, Homo sapiens
cctgcctctgccc

SEQ ID NO: 2742247 - DNA, 11 bp, Homo sapiens
cctgtgtctta

SEQ ID NO: 2742248 - DNA, 17 bp, Homo sapiens
cctgtttaaaaaaagta

SEQ ID NO: 2742249 - DNA, 15 bp, Homo sapiens
ccttacatttcctgg

SEQ ID NO: 2742250 - DNA, 22 bp, Homo sapiens
ccttcagatgttctctcccagg

SEQ ID NO: 2742251 - DNA, 23 bp, Homo sapiens
ccttcagatgttctctcccaggg

SEQ ID NO: 2742252 - DNA, 16 bp, Homo sapiens
ccttcttgccttcaga

SEQ ID NO: 2742253 - DNA, 22 bp, Homo sapiens
ccttgcttgctgccttctggat

SEQ ID NO: 2742254 - DNA, 19 bp, Homo sapiens
cgaaacctgtccataaagt

SEQ ID NO: 2742255 - DNA, 18 bp, Homo sapiens
cgacctgatttacagttt

SEQ ID NO: 2742256 - DNA, 23 bp, Homo sapiens
cgggaaaagcagcccttggccag

SEQ ID NO: 2742257 - DNA, 14 bp, Homo sapiens
cgtgcttcctcagt

SEQ ID NO: 2742258 - DNA, 22 bp, Homo sapiens
ctaaagctctgaacaaaagctt

SEQ ID NO: 2742259 - DNA, 12 bp, Homo sapiens
ctacacatatat

SEQ ID NO: 2742260 - DNA, 16 bp, Homo sapiens
ctagagtgagggcctg

SEQ ID NO: 2742261 - DNA, 18 bp, Homo sapiens
ctagagtgagggcctgag

SEQ ID NO: 2742262 - DNA, 17 bp, Homo sapiens
ctaggggagcagggggc

SEQ ID NO: 2742263 - DNA, 11 bp, Homo sapiens
ctagtatatta

SEQ ID NO: 2742264 - DNA, 15 bp, Homo sapiens
ctatatctctaaact

SEQ ID NO: 2742265 - DNA, 14 bp, Homo sapiens
ctattagcaactgt

SEQ ID NO: 2742266 - DNA, 18 bp, Homo sapiens
ctcactacctcctcaggg

SEQ ID NO: 2742267 - DNA, 13 bp, Homo sapiens
ctcagctgcttct

SEQ ID NO: 2742268 - DNA, 14 bp, Homo sapiens
ctttctgcctctca

SEQ ID NO: 2742269 - DNA, 17 bp, Homo sapiens
cttttgtcctgttattt

SEQ ID NO: 2742270 - DNA, 22 bp, Homo sapiens
ctttttatgttgccagtttaat

SEQ ID NO: 2742271 - DNA, 18 bp, Homo sapiens
gaaacctgtccataaagt

SEQ ID NO: 2742272 - DNA, 20 bp, Homo sapiens
gaaacctgtccataaagtaa

SEQ ID NO: 2742273 - DNA, 20 bp, Homo sapiens
gaaattcaacctgtgtctta

SEQ ID NO: 2742274 - DNA, 22 bp, Homo sapiens
gaaattttactgacagaaatgc

SEQ ID NO: 2742275 - DNA, 15 bp, Homo sapiens
gaacaatgtcagaaa

SEQ ID NO: 2742276 - DNA, 13 bp, Homo sapiens
gaaccaggagctg

SEQ ID NO: 2742277 - DNA, 22 bp, Homo sapiens
gaaccgacttttctaaagctct

SEQ ID NO: 2742278 - DNA, 13 bp, Homo sapiens
gaagtgtatatag

SEQ ID NO: 2742279 - DNA, 15 bp, Homo sapiens
gaatcctagggcctg

SEQ ID NO: 2742280 - DNA, 19 bp, Homo sapiens
gaattgaaggagaaaatgc

SEQ ID NO: 2742281 - DNA, 20 bp, Homo sapiens
gaattgaaggagaaaatgca

SEQ ID NO: 2742282 - DNA, 16 bp, Homo sapiens
gaattgtgtctgcagg

SEQ ID NO: 2742283 - DNA, 14 bp, Homo sapiens
gacctcagctgctt

SEQ ID NO: 2742284 - DNA, 16 bp, Homo sapiens
gacctcagctgcttct

SEQ ID NO: 2742285 - DNA, 18 bp, Homo sapiens
gactcctcggcctggctc

SEQ ID NO: 2742286 - DNA, 16 bp, Homo sapiens
gagcaagtctgcaggt

SEQ ID NO: 2742287 - DNA, 13 bp, Homo sapiens
gagctgctcacta

SEQ ID NO: 2742288 - DNA, 14 bp, Homo sapiens
gagggatggactga

SEQ ID NO: 2742289 - DNA, 13 bp, Homo sapiens
gagtgagggcctg

SEQ ID NO: 2742290 - DNA, 19 bp, Homo sapiens
gatctttttgtgaaattca

SEQ ID NO: 2742291 - DNA, 17 bp, Homo sapiens
gatgcttttagctcaaa

SEQ ID NO: 2742292 - DNA, 18 bp, Homo sapiens
gatgtagccatgacctta

SEQ ID NO: 2742293 - DNA, 13 bp, Homo sapiens
gattatacagaat

SEQ ID NO: 2742294 - DNA, 15 bp, Homo sapiens
gattatatatcataa

SEQ ID NO: 2742295 - DNA, 19 bp, Homo sapiens
gattatatatcataaagta

SEQ ID NO: 2742296 - DNA, 21 bp, Homo sapiens
gattatatatcataaagtatg

SEQ ID NO: 2742297 - DNA, 23 bp, Homo sapiens
gattcttggcccgcacagagctg

SEQ ID NO: 2742298 - DNA, 21 bp, Homo sapiens
gattgttctgtccagtttcca

SEQ ID NO: 2742299 - DNA, 22 bp, Homo sapiens
gatttacagtttcaaaaactgt

SEQ ID NO: 2742300 - DNA, 13 bp, Homo sapiens
gcaaagttatatt

SEQ ID NO: 2742301 - DNA, 12 bp, Homo sapiens
gcaagtctgcag

SEQ ID NO: 2742302 - DNA, 20 bp, Homo sapiens
gcaagtctgcaggtgcacca

SEQ ID NO: 2742303 - DNA, 22 bp, Homo sapiens
gcacaaaattcgacctgattta

SEQ ID NO: 2742304 - DNA, 17 bp, Homo sapiens
gcagagcaagtctgcag

SEQ ID NO: 2742305 - DNA, 23 bp, Homo sapiens
gcagatctttttgtgaaattcaa

SEQ ID NO: 2742306 - DNA, 23 bp, Homo sapiens
gcagggaggaagaagcttaggca

SEQ ID NO: 2742307 - DNA, 23 bp, Homo sapiens
gcagggctctctttccttcttgc

SEQ ID NO: 2742308 - DNA, 21 bp, Homo sapiens
gccaaaacaatgcccgtaaga

SEQ ID NO: 2742309 - DNA, 14 bp, Homo sapiens
gccaagcagggagg

SEQ ID NO: 2742310 - DNA, 14 bp, Homo sapiens
gcccaccagagctg

SEQ ID NO: 2742311 - DNA, 14 bp, Homo sapiens
gccctctccgagct

SEQ ID NO: 2742312 - DNA, 12 bp, Homo sapiens
gccgaaccagga

SEQ ID NO: 2742313 - DNA, 19 bp, Homo sapiens
gccgaaccaggagctgctc

SEQ ID NO: 2742314 - DNA, 18 bp, Homo sapiens
gcctgaggtctggctgct

SEQ ID NO: 2742315 - DNA, 20 bp, Homo sapiens
gcctgcgttcttgtgacaga

SEQ ID NO: 2742316 - DNA, 19 bp, Homo sapiens
gccttctggattcttggcc

SEQ ID NO: 2742317 - DNA, 21 bp, Homo sapiens
gccttctggattcttggcccg

SEQ ID NO: 2742318 - DNA, 14 bp, Homo sapiens
gctaggggagcagg

SEQ ID NO: 2742319 - DNA, 18 bp, Homo sapiens
gctcactacctcctcagg

SEQ ID NO: 2742320 - DNA, 21 bp, Homo sapiens
gctcctacccaccgcccttgc

SEQ ID NO: 2742321 - DNA, 14 bp, Homo sapiens
gctcctccgtgctt

SEQ ID NO: 2742322 - DNA, 21 bp, Homo sapiens
gctgaccacaggcagttactt

SEQ ID NO: 2742323 - DNA, 21 bp, Homo sapiens
gctgagggatggactgatgct

SEQ ID NO: 2742324 - DNA, 22 bp, Homo sapiens
gctgagggatggactgatgctt

SEQ ID NO: 2742325 - DNA, 23 bp, Homo sapiens
gctgagggatggactgatgcttt

SEQ ID NO: 2742326 - DNA, 19 bp, Homo sapiens
gctgccttctggattcttg

SEQ ID NO: 2742327 - DNA, 21 bp, Homo sapiens
gctgctcactacctcctcagg

SEQ ID NO: 2742328 - DNA, 21 bp, Homo sapiens
gctgcttctcccacttggcca

SEQ ID NO: 2742329 - DNA, 19 bp, Homo sapiens
gctggtaggcattccagct

SEQ ID NO: 2742330 - DNA, 18 bp, Homo sapiens
gcttaggcagggctctct

SEQ ID NO: 2742331 - DNA, 19 bp, Homo sapiens
gcttctcccacttggccaa

SEQ ID NO: 2742332 - DNA, 20 bp, Homo sapiens
gctttaaaaactatttaact

SEQ ID NO: 2742333 - DNA, 23 bp, Homo sapiens
gctttaaaaactatttaacttga

SEQ ID NO: 2742334 - DNA, 18 bp, Homo sapiens
ggagcatagaaggcaggt

SEQ ID NO: 2742335 - DNA, 21 bp, Homo sapiens
ggaggaagaagcttaggcagg

SEQ ID NO: 2742336 - DNA, 13 bp, Homo sapiens
ggattcttggccc

SEQ ID NO: 2742337 - DNA, 18 bp, Homo sapiens
ggattgattatgcagaat

SEQ ID NO: 2742338 - DNA, 23 bp, Homo sapiens
ggcattccagctcctccgtgctt

SEQ ID NO: 2742339 - DNA, 15 bp, Homo sapiens
ggcccaccagagctg

SEQ ID NO: 2742340 - DNA, 16 bp, Homo sapiens
ggccctttcctcaggc

SEQ ID NO: 2742341 - DNA, 19 bp, Homo sapiens
ggcctgaggtctggctgct

SEQ ID NO: 2742342 - DNA, 16 bp, Homo sapiens
tatctgagaagtgtat

SEQ ID NO: 2742343 - DNA, 18 bp, Homo sapiens
tatctgagaagtgtatat

SEQ ID NO: 2742344 - DNA, 19 bp, Homo sapiens
tatctgagaagtgtatata

SEQ ID NO: 2742345 - DNA, 19 bp, Homo sapiens
tatgtatatgtatatctat

SEQ ID NO: 2742346 - DNA, 18 bp, Homo sapiens
tattctacacatatatgt

SEQ ID NO: 2742347 - DNA, 14 bp, Homo sapiens
tattctattttcat

SEQ ID NO: 2742348 - DNA, 13 bp, Homo sapiens
tatttagaatata

SEQ ID NO: 2742349 - DNA, 21 bp, Homo sapiens
tcaagcccagccacgtggagc

SEQ ID NO: 2742350 - DNA, 15 bp, Homo sapiens
tcactacctcctcag

SEQ ID NO: 2742351 - DNA, 12 bp, Homo sapiens
tcagctgcttct

SEQ ID NO: 2742352 - DNA, 21 bp, Homo sapiens
tcagggatggccgttggccac

SEQ ID NO: 2742353 - DNA, 14 bp, Homo sapiens
tcattttctgcaag

SEQ ID NO: 2742354 - DNA, 18 bp, Homo sapiens
tcattttctgcaagcctg

SEQ ID NO: 2742355 - DNA, 20 bp, Homo sapiens
tccaaagggcagtaaagttt

SEQ ID NO: 2742356 - DNA, 14 bp, Homo sapiens
tcccacttggccaa

SEQ ID NO: 2742357 - DNA, 16 bp, Homo sapiens
tccgtgcttcctcagt

SEQ ID NO: 2742358 - DNA, 17 bp, Homo sapiens
tcctagggcctgggttt

SEQ ID NO: 2742359 - DNA, 13 bp, Homo sapiens
tcctagtatatta

SEQ ID NO: 2742360 - DNA, 21 bp, Homo sapiens
tccttttgcaacaagacaaag

SEQ ID NO: 2742361 - DNA, 21 bp, Homo sapiens
tcgaaacctgtccataaagta

SEQ ID NO: 2742362 - DNA, 23 bp, Homo sapiens
tcgaagaacaatgtcagaaactc

SEQ ID NO: 2742363 - DNA, 19 bp, Homo sapiens
tcgacctgatttacagttt

SEQ ID NO: 2742364 - DNA, 19 bp, Homo sapiens
tctacacatatatgtatat

SEQ ID NO: 2742365 - DNA, 21 bp, Homo sapiens
tctactgtatggaatacaatg

SEQ ID NO: 2742366 - DNA, 19 bp, Homo sapiens
tctccatcctttctgcctc

SEQ ID NO: 2742367 - DNA, 14 bp, Homo sapiens
tctctcccaggggc

SEQ ID NO: 2742368 - DNA, 16 bp, Homo sapiens
tctctttccttcttgc

SEQ ID NO: 2742369 - DNA, 19 bp, Homo sapiens
tctctttcttctctgctgc

SEQ ID NO: 2742370 - DNA, 18 bp, Homo sapiens
tctggcaaagttatattt

SEQ ID NO: 2742371 - DNA, 15 bp, Homo sapiens
tctgtccagtttcca

SEQ ID NO: 2742372 - DNA, 17 bp, Homo sapiens
tcttataggtttccact

SEQ ID NO: 2742373 - DNA, 21 bp, Homo sapiens
tgaaattcaacctgtgtctta

SEQ ID NO: 2742374 - DNA, 16 bp, Homo sapiens
tgaaatttatacacca

SEQ ID NO: 2742375 - DNA, 14 bp, Homo sapiens
tgaaccgacttttc

SEQ ID NO: 2742376 - DNA, 22 bp, Homo sapiens
tgaaccgacttttctaaagctc

SEQ ID NO: 2742377 - DNA, 23 bp, Homo sapiens
tgaaggagaaaatgcattatgtg

SEQ ID NO: 2742378 - DNA, 16 bp, Homo sapiens
tgaatcctagggcctg

SEQ ID NO: 2742379 - DNA, 18 bp, Homo sapiens
tgaccacaggcagttact

SEQ ID NO: 2742380 - DNA, 18 bp, Homo sapiens
tgagaagtgtatatagtt

SEQ ID NO: 2742381 - DNA, 15 bp, Homo sapiens
tgatggagcagagca

SEQ ID NO: 2742382 - DNA, 15 bp, Homo sapiens
tgatttacagtttca

SEQ ID NO: 2742383 - DNA, 23 bp, Homo sapiens
tgcacattttgtacaaagatatg

SEQ ID NO: 2742384 - DNA, 16 bp, Homo sapiens
tgcattagacagatga

SEQ ID NO: 2742385 - DNA, 13 bp, Homo sapiens
tgccgaaccagga

SEQ ID NO: 2742386 - DNA, 14 bp, Homo sapiens
tgcctggttttgat

SEQ ID NO: 2742387 - DNA, 13 bp, Homo sapiens
tgctcactacctc

SEQ ID NO: 2742388 - DNA, 17 bp, Homo sapiens
tgctcactacctcctca

SEQ ID NO: 2742389 - DNA, 17 bp, Homo sapiens
tgctgccttctggattc

SEQ ID NO: 2742390 - DNA, 20 bp, Homo sapiens
tgctgccttctggattcttg

SEQ ID NO: 2742391 - DNA, 23 bp, Homo sapiens
tgctttaaaaactatttaacttg

SEQ ID NO: 2742392 - DNA, 15 bp, Homo sapiens
tggactgatgctttt

SEQ ID NO: 2742393 - DNA, 17 bp, Homo sapiens
tggctaggggagcaggg

SEQ ID NO: 2742394 - DNA, 16 bp, Homo sapiens
tggcttatttgtataa

SEQ ID NO: 2742395 - DNA, 16 bp, Homo sapiens
tggcttttagacagat

SEQ ID NO: 2742396 - DNA, 16 bp, Homo sapiens
tgtatatgtatatcta

SEQ ID NO: 2742397 - DNA, 12 bp, Homo sapiens
tgtcagaaactc

SEQ ID NO: 2742398 - DNA, 23 bp, Homo sapiens
tgtccataaagtaattttgtgaa

SEQ ID NO: 2742399 - DNA, 19 bp, Homo sapiens
tgtgaaattcaacctgtgt

SEQ ID NO: 2742400 - DNA, 18 bp, Homo sapiens
tgtgacagattatacaga

SEQ ID NO: 2742401 - DNA, 16 bp, Homo sapiens
ttaaaaactatttaac

SEQ ID NO: 2742402 - DNA, 14 bp, Homo sapiens
ttagaatatattaa

SEQ ID NO: 2742403 - DNA, 13 bp, Homo sapiens
ttatatatcataa

SEQ ID NO: 2742404 - DNA, 14 bp, Homo sapiens
ttatatatcataaa

SEQ ID NO: 2742405 - DNA, 20 bp, Homo sapiens
ttatatatcataaagtatgc

SEQ ID NO: 2742406 - DNA, 22 bp, Homo sapiens
ttcagaattgaaggagaaaatg

SEQ ID NO: 2742407 - DNA, 14 bp, Homo sapiens
ttcattttctgcaa

SEQ ID NO: 2742408 - DNA, 18 bp, Homo sapiens
ttccactgccaaaacaat

SEQ ID NO: 2742409 - DNA, 17 bp, Homo sapiens
ttccttcttgccttcag

SEQ ID NO: 2742410 - DNA, 21 bp, Homo sapiens
ttcgaaacctgtccataaagt

SEQ ID NO: 2742411 - DNA, 21 bp, Homo sapiens
ttctattttcattttctgcaa

SEQ ID NO: 2742412 - DNA, 23 bp, Homo sapiens
ttctattttcattttctgcaagc

SEQ ID NO: 2742413 - DNA, 17 bp, Homo sapiens
ttctcccacttggccaa

SEQ ID NO: 2742414 - DNA, 21 bp, Homo sapiens
ttctctcccaggggctggctt

SEQ ID NO: 2742415 - DNA, 13 bp, Homo sapiens
ttctgcaagcctg

SEQ ID NO: 2742416 - DNA, 18 bp, Homo sapiens
ttgaaggagaaaatgcat

SEQ ID NO: 2742417 - DNA, 21 bp, Homo sapiens
ttgattgagagtaacttaagt

SEQ ID NO: 2742418 - DNA, 14 bp, Homo sapiens
ttgatttaatatct

SEQ ID NO: 2742419 - DNA, 21 bp, Homo sapiens
tttaaaaactatttaacttga

SEQ ID NO: 2742420 - DNA, 21 bp, Homo sapiens
tttaatatctgagaagtgtat

SEQ ID NO: 2742421 - DNA, 14 bp, Homo sapiens
tttaatcattgcct

SEQ ID NO: 2742422 - DNA, 23 bp, Homo sapiens
tttcagaattgaaggagaaaatg

SEQ ID NO: 2742423 - DNA, 14 bp, Homo sapiens
tttcattttctgca

SEQ ID NO: 2742424 - DNA, 16 bp, Homo sapiens
atacaccaattgattt

SEQ ID NO: 2742425 - DNA, 15 bp, Homo sapiens
atatatcataaagta

SEQ ID NO: 2742426 - DNA, 12 bp, Homo sapiens
atatatgtatat

SEQ ID NO: 2742427 - DNA, 14 bp, Homo sapiens
atatatgtatatgt

SEQ ID NO: 2742428 - DNA, 21 bp, Homo sapiens
atatatgtatatgtatatcta

SEQ ID NO: 2742429 - DNA, 17 bp, Homo sapiens
atatctctaaactgctg

SEQ ID NO: 2742430 - DNA, 14 bp, Homo sapiens
atatgtatatctat

SEQ ID NO: 2742431 - DNA, 17 bp, Homo sapiens
atcacttgaatcctagg

SEQ ID NO: 2742432 - DNA, 19 bp, Homo sapiens
atcctttctgcctctcaac

SEQ ID NO: 2742433 - DNA, 21 bp, Homo sapiens
atctatatctctaaactgctg

SEQ ID NO: 2742434 - DNA, 16 bp, Homo sapiens
atctctaaactgctgt

SEQ ID NO: 2742435 - DNA, 17 bp, Homo sapiens
atctgagaagtgtatat

SEQ ID NO: 2742436 - DNA, 15 bp, Homo sapiens
atggccgttggccac

SEQ ID NO: 2742437 - DNA, 20 bp, Homo sapiens
atgtatatctatatctctaa

SEQ ID NO: 2742438 - DNA, 17 bp, Homo sapiens
atgtatatgtatatcta

SEQ ID NO: 2742439 - DNA, 18 bp, Homo sapiens
atgtatatgtatatctat

SEQ ID NO: 2742440 - DNA, 17 bp, Homo sapiens
attagcaactgtgctac

SEQ ID NO: 2742441 - DNA, 21 bp, Homo sapiens
attagtttgatttaatatctg

SEQ ID NO: 2742442 - DNA, 18 bp, Homo sapiens
attcaacctgtgtcttat

SEQ ID NO: 2742443 - DNA, 18 bp, Homo sapiens
attcgacctgatttacag

SEQ ID NO: 2742444 - DNA, 20 bp, Homo sapiens
attcgacctgatttacagtt

SEQ ID NO: 2742445 - DNA, 20 bp, Homo sapiens
attctacacatatatgtata

SEQ ID NO: 2742446 - DNA, 24 bp, Homo sapiens
attctacacatatatgtatatgta

SEQ ID NO: 2742447 - DNA, 21 bp, Homo sapiens
attctattttcattttctgca

SEQ ID NO: 2742448 - DNA, 23 bp, Homo sapiens
ctcagttacacaaaggacctcag

SEQ ID NO: 2742449 - DNA, 19 bp, Homo sapiens
ctccatcctttctgcctct

SEQ ID NO: 2742450 - DNA, 13 bp, Homo sapiens
ctcccacttggcc

SEQ ID NO: 2742451 - DNA, 16 bp, Homo sapiens
ctccgtgcttcctcag

SEQ ID NO: 2742452 - DNA, 22 bp, Homo sapiens
ctcctcagggatggccgttggc

SEQ ID NO: 2742453 - DNA, 15 bp, Homo sapiens
ctcctcggcctggct

SEQ ID NO: 2742454 - DNA, 18 bp, Homo sapiens
ctcctcggcctggctcct

SEQ ID NO: 2742455 - DNA, 20 bp, Homo sapiens
ctctctttccttcttgcctt

SEQ ID NO: 2742456 - DNA, 16 bp, Homo sapiens
ctctttccttcttgcc

SEQ ID NO: 2742457 - DNA, 13 bp, Homo sapiens
ctgacagaaatgc

SEQ ID NO: 2742458 - DNA, 17 bp, Homo sapiens
ctgagaagtgtatatag

SEQ ID NO: 2742459 - DNA, 13 bp, Homo sapiens
ctgaggtctggct

SEQ ID NO: 2742460 - DNA, 14 bp, Homo sapiens
ctgaggtctggctg

SEQ ID NO: 2742461 - DNA, 19 bp, Homo sapiens
ctgctcactacctcctcag

SEQ ID NO: 2742462 - DNA, 23 bp, Homo sapiens
ctgctgttaattgattaaaatct

SEQ ID NO: 2742463 - DNA, 18 bp, Homo sapiens
ctgcttctcccacttggc

SEQ ID NO: 2742464 - DNA, 19 bp, Homo sapiens
ctggcaaagttatatttac

SEQ ID NO: 2742465 - DNA, 22 bp, Homo sapiens
ctggcctcaggtgggccgcagg

SEQ ID NO: 2742466 - DNA, 22 bp, Homo sapiens
ctggcgccaacaacttctccat

SEQ ID NO: 2742467 - DNA, 14 bp, Homo sapiens
ctggctgcttgccc

SEQ ID NO: 2742468 - DNA, 14 bp, Homo sapiens
ctgtccagtttcca

SEQ ID NO: 2742469 - DNA, 13 bp, Homo sapiens
ctgtccataaagt

SEQ ID NO: 2742470 - DNA, 18 bp, Homo sapiens
cttctcccacttggccaa

SEQ ID NO: 2742471 - DNA, 14 bp, Homo sapiens
cttctgcctgagct

SEQ ID NO: 2742472 - DNA, 14 bp, Homo sapiens
cttgaatcctaggg

SEQ ID NO: 2742473 - DNA, 16 bp, Homo sapiens
cttggaaaaagtgatg

SEQ ID NO: 2742474 - DNA, 15 bp, Homo sapiens
cttggccaagcaggg

SEQ ID NO: 2742475 - DNA, 18 bp, Homo sapiens
cttggcccgcacagagct

SEQ ID NO: 2742476 - DNA, 20 bp, Homo sapiens
cttgtgacagattatacaga

SEQ ID NO: 2742477 - DNA, 14 bp, Homo sapiens
ctttcttctctgct

SEQ ID NO: 2742478 - DNA, 18 bp, Homo sapiens
cttttgcaacaagacaaa

SEQ ID NO: 2742479 - DNA, 20 bp, Homo sapiens
gaaaagcagcccttggccag

SEQ ID NO: 2742480 - DNA, 15 bp, Homo sapiens
gaaaatgcattatgt

SEQ ID NO: 2742481 - DNA, 18 bp, Homo sapiens
gacagaaatgcaatctcc

SEQ ID NO: 2742482 - DNA, 11 bp, Homo sapiens
gaccctctcaa

SEQ ID NO: 2742483 - DNA, 19 bp, Homo sapiens
gacctgatttacagtttca

SEQ ID NO: 2742484 - DNA, 15 bp, Homo sapiens
gagcaagagaacatt

SEQ ID NO: 2742485 - DNA, 13 bp, Homo sapiens
gagcaagtctgca

SEQ ID NO: 2742486 - DNA, 21 bp, Homo sapiens
gagcaagtctgcaggtgcacc

SEQ ID NO: 2742487 - DNA, 17 bp, Homo sapiens
gaggaagaagcttaggc

SEQ ID NO: 2742488 - DNA, 22 bp, Homo sapiens
gagggcctgaggtctggctgct

SEQ ID NO: 2742489 - DNA, 19 bp, Homo sapiens
gatggcttatttgtataat

SEQ ID NO: 2742490 - DNA, 22 bp, Homo sapiens
gattatatatcataaagtatgc

SEQ ID NO: 2742491 - DNA, 16 bp, Homo sapiens
gcaaccagttggctag

SEQ ID NO: 2742492 - DNA, 11 bp, Homo sapiens
gcaagcctgcg

SEQ ID NO: 2742493 - DNA, 19 bp, Homo sapiens
gcaaggtctggcctcaggt

SEQ ID NO: 2742494 - DNA, 22 bp, Homo sapiens
gcaaggtctggcctcaggtggg

SEQ ID NO: 2742495 - DNA, 13 bp, Homo sapiens
gcaagtctgcagg

SEQ ID NO: 2742496 - DNA, 23 bp, Homo sapiens
gcacaaaattcgacctgatttac

SEQ ID NO: 2742497 - DNA, 18 bp, Homo sapiens
gcagagcaagtctgcagg

SEQ ID NO: 2742498 - DNA, 21 bp, Homo sapiens
gcaggattgattatgcagaat

SEQ ID NO: 2742499 - DNA, 15 bp, Homo sapiens
gcatagaaggcaggt

SEQ ID NO: 2742500 - DNA, 15 bp, Homo sapiens
gcatatgtgttggct

SEQ ID NO: 2742501 - DNA, 18 bp, Homo sapiens
gccatgaccttacatttc

SEQ ID NO: 2742502 - DNA, 20 bp, Homo sapiens
gcctgaggtctggctgcttg

SEQ ID NO: 2742503 - DNA, 16 bp, Homo sapiens
gccttcagatgttctc

SEQ ID NO: 2742504 - DNA, 20 bp, Homo sapiens
gctcctccgtgcttcctcag

SEQ ID NO: 2742505 - DNA, 23 bp, Homo sapiens
gctgctcactacctcctcaggga

SEQ ID NO: 2742506 - DNA, 18 bp, Homo sapiens
ggaagaagcttaggcagg

SEQ ID NO: 2742507 - DNA, 15 bp, Homo sapiens
ggaatacaatgtaat

SEQ ID NO: 2742508 - DNA, 16 bp, Homo sapiens
ggcccgcacagagctg

SEQ ID NO: 2742509 - DNA, 23 bp, Homo sapiens
ggctctctttccttcttgccttc

SEQ ID NO: 2742510 - DNA, 16 bp, Homo sapiens
ggctggcttcaggagg

SEQ ID NO: 2742511 - DNA, 23 bp, Homo sapiens
gggaggaagaagcttaggcaggg

SEQ ID NO: 2742512 - DNA, 21 bp, Homo sapiens
gggcctcttggaaaaagtgat

SEQ ID NO: 2742513 - DNA, 16 bp, Homo sapiens
ggtactgcacattttg

SEQ ID NO: 2742514 - DNA, 14 bp, Homo sapiens
ggtgagcaaccagt

SEQ ID NO: 2742515 - DNA, 18 bp, Homo sapiens
gtaacttggatgtagcca

SEQ ID NO: 2742516 - DNA, 18 bp, Homo sapiens
gtaccaaatgctttaaaa

SEQ ID NO: 2742517 - DNA, 17 bp, Homo sapiens
gtagtcgtcaagttgca

SEQ ID NO: 2742518 - DNA, 19 bp, Homo sapiens
gtatggaatacaatgtaat

SEQ ID NO: 2742519 - DNA, 22 bp, Homo sapiens
gtctgcaggattgattatgcag

SEQ ID NO: 2742520 - DNA, 23 bp, Homo sapiens
gtggactgaaccgacttttctaa

SEQ ID NO: 2742521 - DNA, 18 bp, Homo sapiens
gtttaaaaaaagtatata

SEQ ID NO: 2742522 - DNA, 19 bp, Homo sapiens
gtttcaaaaactgtattga

SEQ ID NO: 2742523 - DNA, 14 bp, Homo sapiens
gtttttgaaacaga

SEQ ID NO: 2742524 - DNA, 13 bp, Homo sapiens
taaaaagctgacc

SEQ ID NO: 2742525 - DNA, 19 bp, Homo sapiens
taaaatctggcaaagttat

SEQ ID NO: 2742526 - DNA, 18 bp, Homo sapiens
taaaccataaaaagctga

SEQ ID NO: 2742527 - DNA, 19 bp, Homo sapiens
taaaccataaaaagctgac

SEQ ID NO: 2742528 - DNA, 13 bp, Homo sapiens
aaaaagtatatat

SEQ ID NO: 2742529 - DNA, 13 bp, Homo sapiens
aaaagattatata

SEQ ID NO: 2742530 - DNA, 17 bp, Homo sapiens
aaaagattatatatcat

SEQ ID NO: 2742531 - DNA, 22 bp, Homo sapiens
aaaagattatatatcataaagt

SEQ ID NO: 2742532 - DNA, 15 bp, Homo sapiens
aaaatgcattatgtg

SEQ ID NO: 2742533 - DNA, 18 bp, Homo sapiens
aaacctgtccataaagta

SEQ ID NO: 2742534 - DNA, 21 bp, Homo sapiens
aaagattatatatcataaagt

SEQ ID NO: 2742535 - DNA, 13 bp, Homo sapiens
aaagccacatttt

SEQ ID NO: 2742536 - DNA, 15 bp, Homo sapiens
aaagtatatattcta

SEQ ID NO: 2742537 - DNA, 18 bp, Homo sapiens
aaatattctattttcatt

SEQ ID NO: 2742538 - DNA, 15 bp, Homo sapiens
aaatgagcattagct

SEQ ID NO: 2742539 - DNA, 17 bp, Homo sapiens
aaattcgacctgattta

SEQ ID NO: 2742540 - DNA, 23 bp, Homo sapiens
aaattcgacctgatttacagttt

SEQ ID NO: 2742541 - DNA, 18 bp, Homo sapiens
aaattttactgacagaaa

SEQ ID NO: 2742542 - DNA, 17 bp, Homo sapiens
aaccaggagctgctcac

SEQ ID NO: 2742543 - DNA, 16 bp, Homo sapiens
aactatttaacttgag

SEQ ID NO: 2742544 - DNA, 20 bp, Homo sapiens
aactgctgttaattgattaa

SEQ ID NO: 2742545 - DNA, 17 bp, Homo sapiens
aacttaagttaaacata

SEQ ID NO: 2742546 - DNA, 15 bp, Homo sapiens
aagattatatatcat

SEQ ID NO: 2742547 - DNA, 20 bp, Homo sapiens
aagattatatatcataaagt

SEQ ID NO: 2742548 - DNA, 17 bp, Homo sapiens
aagcagcccttggccag

SEQ ID NO: 2742549 - DNA, 12 bp, Homo sapiens
aagcagggagga

SEQ ID NO: 2742550 - DNA, 19 bp, Homo sapiens
aagctctgaacaaaagctt

SEQ ID NO: 2742551 - DNA, 17 bp, Homo sapiens
aagctgaccacaggcag

SEQ ID NO: 2742552 - DNA, 18 bp, Homo sapiens
aagtgatggagcagagca

SEQ ID NO: 2742553 - DNA, 23 bp, Homo sapiens
aatatctgagaagtgtatatagt

SEQ ID NO: 2742554 - DNA, 14 bp, Homo sapiens
aatgagcattagct

SEQ ID NO: 2742555 - DNA, 14 bp, Homo sapiens
ttcctagtatatta

SEQ ID NO: 2742556 - DNA, 20 bp, Homo sapiens
ttccttttgcaacaagacaa

SEQ ID NO: 2742557 - DNA, 17 bp, Homo sapiens
ttcgacctgatttacag

SEQ ID NO: 2742558 - DNA, 19 bp, Homo sapiens
ttctacacatatatgtata

SEQ ID NO: 2742559 - DNA, 23 bp, Homo sapiens
ttctctcccaggggctggcttca

SEQ ID NO: 2742560 - DNA, 18 bp, Homo sapiens
ttctgtccagtttccaaa

SEQ ID NO: 2742561 - DNA, 16 bp, Homo sapiens
ttggccaagcagggag

SEQ ID NO: 2742562 - DNA, 16 bp, Homo sapiens
ttgtacaaagatatgc

SEQ ID NO: 2742563 - DNA, 14 bp, Homo sapiens
ttgtggtaaaaaga

SEQ ID NO: 2742564 - DNA, 17 bp, Homo sapiens
ttgtgtctgcaggattg

SEQ ID NO: 2742565 - DNA, 22 bp, Homo sapiens
tttaaaaaaagtatatattcta

SEQ ID NO: 2742566 - DNA, 23 bp, Homo sapiens
tttaaaaactatttaacttgagc

SEQ ID NO: 2742567 - DNA, 15 bp, Homo sapiens
tttaatcattgcctg

SEQ ID NO: 2742568 - DNA, 14 bp, Homo sapiens
tttactgacagaaa

SEQ ID NO: 2742569 - DNA, 19 bp, Homo sapiens
tttatacaccaattgattt

SEQ ID NO: 2742570 - DNA, 18 bp, Homo sapiens
tttatttccacataaagg

SEQ ID NO: 2742571 - DNA, 21 bp, Homo sapiens
tttcagctattagcaactgtg

SEQ ID NO: 2742572 - DNA, 21 bp, Homo sapiens
tttccttttgcaacaagacaa

SEQ ID NO: 2742573 - DNA, 22 bp, Homo sapiens
tttctaaagctctgaacaaaag

SEQ ID NO: 2742574 - DNA, 14 bp, Homo sapiens
tttctgcctctcaa

SEQ ID NO: 2742575 - DNA, 19 bp, Homo sapiens
tttgtggtaaaaagattat

SEQ ID NO: 2742576 - DNA, 18 bp, Homo sapiens
ttttactgacagaaatgc

SEQ ID NO: 2742577 - DNA, 20 bp, Homo sapiens
ttttatttccacataaaggt

SEQ ID NO: 2742578 - DNA, 14 bp, Homo sapiens
tttttgtgaaattc

SEQ ID NO: 2742579 - DNA, 15 bp, Homo sapiens
agtatatattctaca

SEQ ID NO: 2742580 - DNA, 21 bp, Homo sapiens
agtatgccttcctgtttaaaa

SEQ ID NO: 2742581 - DNA, 13 bp, Homo sapiens
agtcgtcaagttg

SEQ ID NO: 2742582 - DNA, 19 bp, Homo sapiens
agtgtcttcctagtatatt

SEQ ID NO: 2742583 - DNA, 15 bp, Homo sapiens
agtttcaaaaactgt

SEQ ID NO: 2742584 - DNA, 19 bp, Homo sapiens
agtttgtggtaaaaagatt

SEQ ID NO: 2742585 - DNA, 13 bp, Homo sapiens
ataaaggtattta

SEQ ID NO: 2742586 - DNA, 15 bp, Homo sapiens
ataaagtatgccttc

SEQ ID NO: 2742587 - DNA, 20 bp, Homo sapiens
atacagaattgtgtctgcag

SEQ ID NO: 2742588 - DNA, 13 bp, Homo sapiens
atagaaggcaggt

SEQ ID NO: 2742589 - DNA, 15 bp, Homo sapiens
atagaccctctcaag

SEQ ID NO: 2742590 - DNA, 12 bp, Homo sapiens
ataggtttccac

SEQ ID NO: 2742591 - DNA, 13 bp, Homo sapiens
atatatcataaag

SEQ ID NO: 2742592 - DNA, 16 bp, Homo sapiens
atatatgtatatgtat

SEQ ID NO: 2742593 - DNA, 20 bp, Homo sapiens
atatatgtatatgtatatct

SEQ ID NO: 2742594 - DNA, 22 bp, Homo sapiens
atatgtatatctatatctctaa

SEQ ID NO: 2742595 - DNA, 21 bp, Homo sapiens
atattctacacatatatgtat

SEQ ID NO: 2742596 - DNA, 22 bp, Homo sapiens
atattctacacatatatgtata

SEQ ID NO: 2742597 - DNA, 23 bp, Homo sapiens
atattctattttcattttctgca

SEQ ID NO: 2742598 - DNA, 13 bp, Homo sapiens
atatttactttaa

SEQ ID NO: 2742599 - DNA, 11 bp, Homo sapiens
atcataaagta

SEQ ID NO: 2742600 - DNA, 13 bp, Homo sapiens
atcattgcctggt

SEQ ID NO: 2742601 - DNA, 13 bp, Homo sapiens
atcctagggcctg

SEQ ID NO: 2742602 - DNA, 17 bp, Homo sapiens
atcctttctgcctctca

SEQ ID NO: 2742603 - DNA, 15 bp, Homo sapiens
atctctaaactgctg

SEQ ID NO: 2742604 - DNA, 18 bp, Homo sapiens
atctgagaagtgtatata

SEQ ID NO: 2742605 - DNA, 13 bp, Homo sapiens
atgaccttacatt

SEQ ID NO: 2742606 - DNA, 13 bp, Homo sapiens
atgtatatctata

SEQ ID NO: 2742607 - DNA, 15 bp, Homo sapiens
atgtatatctatatc

SEQ ID NO: 2742608 - DNA, 22 bp, Homo sapiens
atgttgccagtttaatcattgc

SEQ ID NO: 2742609 - DNA, 23 bp, Homo sapiens
attaaaatctggcaaagttatat

SEQ ID NO: 2742610 - DNA, 12 bp, Homo sapiens
attatatatcat

SEQ ID NO: 2742611 - DNA, 13 bp, Homo sapiens
attatatatcata

SEQ ID NO: 2742612 - DNA, 17 bp, Homo sapiens
attatatatcataaagt

SEQ ID NO: 2742613 - DNA, 18 bp, Homo sapiens
attatatatcataaagta

SEQ ID NO: 2742614 - DNA, 16 bp, Homo sapiens
attatgcagaatactt

SEQ ID NO: 2742615 - DNA, 17 bp, Homo sapiens
attatgcagaatacttt

SEQ ID NO: 2742616 - DNA, 14 bp, Homo sapiens
attcaacctgtgtc

SEQ ID NO: 2742617 - DNA, 15 bp, Homo sapiens
attccagctcctccg

SEQ ID NO: 2742618 - DNA, 15 bp, Homo sapiens
attctacacatatat

SEQ ID NO: 2742619 - DNA, 19 bp, Homo sapiens
attgaaggagaaaatgcat

SEQ ID NO: 2742620 - DNA, 14 bp, Homo sapiens
attgtgtctgcagg

SEQ ID NO: 2742621 - DNA, 22 bp, Homo sapiens
atttaatatctgagaagtgtat

SEQ ID NO: 2742622 - DNA, 13 bp, Homo sapiens
atttacagtttca

SEQ ID NO: 2742623 - DNA, 13 bp, Homo sapiens
atttagaatatat

SEQ ID NO: 2742624 - DNA, 21 bp, Homo sapiens
atttgttcatagaccctctca

SEQ ID NO: 2742625 - DNA, 16 bp, Homo sapiens
attttactgacagaaa

SEQ ID NO: 2742626 - DNA, 18 bp, Homo sapiens
attttactgacagaaatg

SEQ ID NO: 2742627 - DNA, 18 bp, Homo sapiens
attttgcattagacagat

SEQ ID NO: 2742628 - DNA, 19 bp, Homo sapiens
attttgtgaaagaaggagc

SEQ ID NO: 2742629 - DNA, 22 bp, Homo sapiens
caaaaactgtattgatgacagt

SEQ ID NO: 2742630 - DNA, 21 bp, Homo sapiens
caaaattcgacctgatttaca

SEQ ID NO: 2742631 - DNA, 16 bp, Homo sapiens
caaagggcagtaaagt

SEQ ID NO: 2742632 - DNA, 18 bp, Homo sapiens
caaagggcagtaaagttt

SEQ ID NO: 2742633 - DNA, 14 bp, Homo sapiens
caaagttatattta

SEQ ID NO: 2742634 - DNA, 14 bp, Homo sapiens
caagacaaagcaaa

SEQ ID NO: 2742635 - DNA, 17 bp, Homo sapiens
caagacaaagcaaagcc

SEQ ID NO: 2742636 - DNA, 12 bp, Homo sapiens
caagagaacatt

SEQ ID NO: 2742637 - DNA, 13 bp, Homo sapiens
caagcagggagga

SEQ ID NO: 2742638 - DNA, 17 bp, Homo sapiens
caagtagtagtgtcttc

SEQ ID NO: 2742639 - DNA, 21 bp, Homo sapiens
caatgcccgtaagatggctta

SEQ ID NO: 2742640 - DNA, 15 bp, Homo sapiens
caatgtcagaaactc

SEQ ID NO: 2742641 - DNA, 19 bp, Homo sapiens
caattgattttaaaccata

SEQ ID NO: 2742642 - DNA, 19 bp, Homo sapiens
cacaggccctttcctcagg

SEQ ID NO: 2742643 - DNA, 20 bp, Homo sapiens
cacaggccctttcctcaggc

SEQ ID NO: 2742644 - DNA, 23 bp, Homo sapiens
cacaggccctttcctcaggcaag

SEQ ID NO: 2742645 - DNA, 13 bp, Homo sapiens
cacataaaggtat

SEQ ID NO: 2742646 - DNA, 15 bp, Homo sapiens
cacatatatgtatat

SEQ ID NO: 2742647 - DNA, 18 bp, Homo sapiens
caccaattgattttaaac

SEQ ID NO: 2742648 - DNA, 23 bp, Homo sapiens
caccacaggccctttcctcaggc

SEQ ID NO: 2742649 - DNA, 20 bp, Homo sapiens
cacctggtactgcacatttt

SEQ ID NO: 2742650 - DNA, 23 bp, Homo sapiens
cacgtcttccttctgcctgagct

SEQ ID NO: 2742651 - DNA, 11 bp, Homo sapiens
cacttggccaa

SEQ ID NO: 2742652 - DNA, 20 bp, Homo sapiens
cacttggccaagcagggagg

SEQ ID NO: 2742653 - DNA, 20 bp, Homo sapiens
cagaaactcgatgaatgtgt

SEQ ID NO: 2742654 - DNA, 16 bp, Homo sapiens
cagaatacttttctct

SEQ ID NO: 2742655 - DNA, 16 bp, Homo sapiens
cagaattgtgtctgca

SEQ ID NO: 2742656 - DNA, 18 bp, Homo sapiens
cagaattgtgtctgcagg

SEQ ID NO: 2742657 - DNA, 15 bp, Homo sapiens
cagagcaagtctgca

SEQ ID NO: 2742658 - DNA, 13 bp, Homo sapiens
cagcccttggcca

SEQ ID NO: 2742659 - DNA, 19 bp, Homo sapiens
cagctattagcaactgtgc

SEQ ID NO: 2742660 - DNA, 17 bp, Homo sapiens
caggcaaggtctggcct

SEQ ID NO: 2742661 - DNA, 17 bp, Homo sapiens
cagggaggaagaagctt

SEQ ID NO: 2742662 - DNA, 24 bp, Homo sapiens
cagggctctctttccttcttgcct

SEQ ID NO: 2742663 - DNA, 15 bp, Homo sapiens
caggggctggcttca

SEQ ID NO: 2742664 - DNA, 20 bp, Homo sapiens
cagggggcccaccagagctg

SEQ ID NO: 2742665 - DNA, 21 bp, Homo sapiens
cagggggcccaccagagctgt

SEQ ID NO: 2742666 - DNA, 13 bp, Homo sapiens
cataaaaagctga

SEQ ID NO: 2742667 - DNA, 16 bp, Homo sapiens
cataaagtatgccttc

SEQ ID NO: 2742668 - DNA, 14 bp, Homo sapiens
catagaaggcaggt

SEQ ID NO: 2742669 - DNA, 21 bp, Homo sapiens
catatatgtatatgtatatct

SEQ ID NO: 2742670 - DNA, 14 bp, Homo sapiens
cattttctgcaagc

SEQ ID NO: 2742671 - DNA, 15 bp, Homo sapiens
cattttctgcaagcc

SEQ ID NO: 2742672 - DNA, 22 bp, Homo sapiens
ccaaatgctttaaaaactattt

SEQ ID NO: 2742673 - DNA, 19 bp, Homo sapiens
ccacaggccctttcctcag

SEQ ID NO: 2742674 - DNA, 21 bp, Homo sapiens
ccacaggccctttcctcaggc

SEQ ID NO: 2742675 - DNA, 22 bp, Homo sapiens
ccacaggccctttcctcaggca

SEQ ID NO: 2742676 - DNA, 14 bp, Homo sapiens
ccagccacgtggag

SEQ ID NO: 2742677 - DNA, 17 bp, Homo sapiens
ccaggagctgctcacta

SEQ ID NO: 2742678 - DNA, 19 bp, Homo sapiens
ccaggggctggcttcagga

SEQ ID NO: 2742679 - DNA, 21 bp, Homo sapiens
ccaggggctggcttcaggagg

SEQ ID NO: 2742680 - DNA, 14 bp, Homo sapiens
ccataaaaagctga

SEQ ID NO: 2742681 - DNA, 23 bp, Homo sapiens
ggctgagggatggactgatgctt

SEQ ID NO: 2742682 - DNA, 13 bp, Homo sapiens
ggctggcttcagg

SEQ ID NO: 2742683 - DNA, 23 bp, Homo sapiens
gggcctgaggtctggctgcttgc

SEQ ID NO: 2742684 - DNA, 17 bp, Homo sapiens
gggctggcttcaggagg

SEQ ID NO: 2742685 - DNA, 23 bp, Homo sapiens
ggtaaaaagattatatatcataa

SEQ ID NO: 2742686 - DNA, 14 bp, Homo sapiens
ggtctggcctcagg

SEQ ID NO: 2742687 - DNA, 15 bp, Homo sapiens
gtaaaaagattatat

SEQ ID NO: 2742688 - DNA, 19 bp, Homo sapiens
gtaagatggcttatttgta

SEQ ID NO: 2742689 - DNA, 16 bp, Homo sapiens
gtaattttgtgaaaga

SEQ ID NO: 2742690 - DNA, 16 bp, Homo sapiens
gtaccaaatgctttaa

SEQ ID NO: 2742691 - DNA, 11 bp, Homo sapiens
gtagtgtcttc

SEQ ID NO: 2742692 - DNA, 22 bp, Homo sapiens
gtagtgtcttcctagtatatta

SEQ ID NO: 2742693 - DNA, 16 bp, Homo sapiens
gtatatctatatctct

SEQ ID NO: 2742694 - DNA, 17 bp, Homo sapiens
gtatatgtatatctata

SEQ ID NO: 2742695 - DNA, 18 bp, Homo sapiens
gtatgccttcctgtttaa

SEQ ID NO: 2742696 - DNA, 11 bp, Homo sapiens
gtccataaagt

SEQ ID NO: 2742697 - DNA, 21 bp, Homo sapiens
gtcccaagtagtagtgtcttc

SEQ ID NO: 2742698 - DNA, 16 bp, Homo sapiens
gtctgcaggtgcacca

SEQ ID NO: 2742699 - DNA, 18 bp, Homo sapiens
gtcttataggtttccact

SEQ ID NO: 2742700 - DNA, 16 bp, Homo sapiens
gtgttactaaagtcac

SEQ ID NO: 2742701 - DNA, 20 bp, Homo sapiens
gttggccacgtcttccttct

SEQ ID NO: 2742702 - DNA, 17 bp, Homo sapiens
gtttaaaaaaagtatat

SEQ ID NO: 2742703 - DNA, 23 bp, Homo sapiens
gtttaaaaaaagtatatattcta

SEQ ID NO: 2742704 - DNA, 21 bp, Homo sapiens
gtttccaaagggcagtaaagt

SEQ ID NO: 2742705 - DNA, 19 bp, Homo sapiens
gttttgattgagagtaact

SEQ ID NO: 2742706 - DNA, 18 bp, Homo sapiens
taaaaaaagtatatattc

SEQ ID NO: 2742707 - DNA, 14 bp, Homo sapiens
taaaaagattatat

SEQ ID NO: 2742708 - DNA, 20 bp, Homo sapiens
taaaatctggcaaagttata

SEQ ID NO: 2742709 - DNA, 21 bp, Homo sapiens
taaaatctggcaaagttatat

SEQ ID NO: 2742710 - DNA, 19 bp, Homo sapiens
taacttggatgtagccatg

SEQ ID NO: 2742711 - DNA, 22 bp, Homo sapiens
taagactcctcggcctggctcc

SEQ ID NO: 2742712 - DNA, 23 bp, Homo sapiens
taagactcctcggcctggctcct

SEQ ID NO: 2742713 - DNA, 21 bp, Homo sapiens
taatatctgagaagtgtatat

SEQ ID NO: 2742714 - DNA, 22 bp, Homo sapiens
taatatctgagaagtgtatata

SEQ ID NO: 2742715 - DNA, 15 bp, Homo sapiens
taatcattgcctggt

SEQ ID NO: 2742716 - DNA, 21 bp, Homo sapiens
tacagaattgtgtctgcagga

SEQ ID NO: 2742717 - DNA, 12 bp, Homo sapiens
tacagtttcaaa

SEQ ID NO: 2742718 - DNA, 17 bp, Homo sapiens
taccaaatgctttaaaa

SEQ ID NO: 2742719 - DNA, 20 bp, Homo sapiens
taccaaatgctttaaaaact

SEQ ID NO: 2742720 - DNA, 15 bp, Homo sapiens
tacctcctcagggat

SEQ ID NO: 2742721 - DNA, 23 bp, Homo sapiens
tacctcctcagggatggccgttg

SEQ ID NO: 2742722 - DNA, 14 bp, Homo sapiens
tactgacagaaatg

SEQ ID NO: 2742723 - DNA, 15 bp, Homo sapiens
tagagtgagggcctg

SEQ ID NO: 2742724 - DNA, 15 bp, Homo sapiens
tagctacttttcaga

SEQ ID NO: 2742725 - DNA, 17 bp, Homo sapiens
tagctcaaacgtggctt

SEQ ID NO: 2742726 - DNA, 16 bp, Homo sapiens
tagtaccaaatgcttt

SEQ ID NO: 2742727 - DNA, 19 bp, Homo sapiens
tagtaccaaatgctttaaa

SEQ ID NO: 2742728 - DNA, 20 bp, Homo sapiens
tagtttgatttaatatctga

SEQ ID NO: 2742729 - DNA, 14 bp, Homo sapiens
tatatatcataaag

SEQ ID NO: 2742730 - DNA, 22 bp, Homo sapiens
tatatattctacacatatatgt

SEQ ID NO: 2742731 - DNA, 13 bp, Homo sapiens
tatatcataaagt

SEQ ID NO: 2742732 - DNA, 14 bp, Homo sapiens
tatatgtatatcta

SEQ ID NO: 2742733 - DNA, 11 bp, Homo sapiens
tatcataaagt

SEQ ID NO: 2742734 - DNA, 12 bp, Homo sapiens
tatcataaagta

SEQ ID NO: 2742735 - DNA, 21 bp, Homo sapiens
tatctctaaactgctgttaat

SEQ ID NO: 2742736 - DNA, 18 bp, Homo sapiens
tatgtatatgtatatcta

SEQ ID NO: 2742737 - DNA, 14 bp, Homo sapiens
tatgtgttggcttg

SEQ ID NO: 2742738 - DNA, 15 bp, Homo sapiens
tattagcaactgtgc

SEQ ID NO: 2742739 - DNA, 21 bp, Homo sapiens
tattagtttgatttaatatct

SEQ ID NO: 2742740 - DNA, 16 bp, Homo sapiens
tattctacacatatat

SEQ ID NO: 2742741 - DNA, 20 bp, Homo sapiens
tattctacacatatatgtat

SEQ ID NO: 2742742 - DNA, 22 bp, Homo sapiens
tattctattttcattttctgca

SEQ ID NO: 2742743 - DNA, 15 bp, Homo sapiens
tcaacctgtgtctta

SEQ ID NO: 2742744 - DNA, 22 bp, Homo sapiens
tcactaccattgtaacttggat

SEQ ID NO: 2742745 - DNA, 14 bp, Homo sapiens
tcactacctcctca

SEQ ID NO: 2742746 - DNA, 16 bp, Homo sapiens
tcactacctcctcagg

SEQ ID NO: 2742747 - DNA, 20 bp, Homo sapiens
tcactacctcctcagggatg

SEQ ID NO: 2742748 - DNA, 22 bp, Homo sapiens
tcagaaactcgatgaatgtgtt

SEQ ID NO: 2742749 - DNA, 16 bp, Homo sapiens
tccactgccaaaacaa

SEQ ID NO: 2742750 - DNA, 21 bp, Homo sapiens
tccagctcctccgtgcttcct

SEQ ID NO: 2742751 - DNA, 12 bp, Homo sapiens
tccataaagtaa

SEQ ID NO: 2742752 - DNA, 20 bp, Homo sapiens
tcccaagtagtagtgtcttc

SEQ ID NO: 2742753 - DNA, 23 bp, Homo sapiens
tcctagtatattagtttgattta

SEQ ID NO: 2742754 - DNA, 18 bp, Homo sapiens
tcctccgtgcttcctcag

SEQ ID NO: 2742755 - DNA, 24 bp, Homo sapiens
tcctgttattttttatttccacat

SEQ ID NO: 2742756 - DNA, 20 bp, Homo sapiens
tcgaaacctgtccataaagt

SEQ ID NO: 2742757 - DNA, 16 bp, Homo sapiens
tctattttcattttct

SEQ ID NO: 2742758 - DNA, 22 bp, Homo sapiens
tctctcccaggggctggcttca

SEQ ID NO: 2742759 - DNA, 14 bp, Homo sapiens
tctgagaagtgtat

SEQ ID NO: 2742760 - DNA, 14 bp, Homo sapiens
tctgcaagcctgcg

SEQ ID NO: 2742761 - DNA, 22 bp, Homo sapiens
tctgcaggattgattatgcaga

SEQ ID NO: 2742762 - DNA, 12 bp, Homo sapiens
tctgcctctcaa

SEQ ID NO: 2742763 - DNA, 12 bp, Homo sapiens
tctgcctgagct

SEQ ID NO: 2742764 - DNA, 16 bp, Homo sapiens
tctggattcttggccc

SEQ ID NO: 2742765 - DNA, 12 bp, Homo sapiens
tcttgccttcag

SEQ ID NO: 2742766 - DNA, 15 bp, Homo sapiens
tcttggaaaaagtga

SEQ ID NO: 2742767 - DNA, 21 bp, Homo sapiens
tcttggcccgcacagagctgg

SEQ ID NO: 2742768 - DNA, 17 bp, Homo sapiens
tgaaattcaacctgtgt

SEQ ID NO: 2742769 - DNA, 17 bp, Homo sapiens
tgaacaaaagcttttct

SEQ ID NO: 2742770 - DNA, 14 bp, Homo sapiens
tgacagaaatgcaa

SEQ ID NO: 2742771 - DNA, 21 bp, Homo sapiens
tgacagtagtaccaaatgctt

SEQ ID NO: 2742772 - DNA, 13 bp, Homo sapiens
tgaccacaggcag

SEQ ID NO: 2742773 - DNA, 14 bp, Homo sapiens
tgagagttccagat

SEQ ID NO: 2742774 - DNA, 19 bp, Homo sapiens
tgagcattagctacttttc

SEQ ID NO: 2742775 - DNA, 12 bp, Homo sapiens
tgagctttaaaa

SEQ ID NO: 2742776 - DNA, 13 bp, Homo sapiens
tgatttacagttt

SEQ ID NO: 2742777 - DNA, 22 bp, Homo sapiens
tgcaacaagacaaagcaaagcc

SEQ ID NO: 2742778 - DNA, 12 bp, Homo sapiens
tgcaagcctgcg

SEQ ID NO: 2742779 - DNA, 21 bp, Homo sapiens
tgcacaaaattcgacctgatt

SEQ ID NO: 2742780 - DNA, 11 bp, Homo sapiens
tgcctgagctt

SEQ ID NO: 2742781 - DNA, 16 bp, Homo sapiens
tgccttcagatgttct

SEQ ID NO: 2742782 - DNA, 21 bp, Homo sapiens
tgccttcctgtttaaaaaaag

SEQ ID NO: 2742783 - DNA, 13 bp, Homo sapiens
tgctgccttctgg

SEQ ID NO: 2742784 - DNA, 16 bp, Homo sapiens
tggccagaagtcaagc

SEQ ID NO: 2742785 - DNA, 14 bp, Homo sapiens
tggccgttggccac

SEQ ID NO: 2742786 - DNA, 13 bp, Homo sapiens
tggcttcaggagg

SEQ ID NO: 2742787 - DNA, 12 bp, Homo sapiens
tgtatatagttt

SEQ ID NO: 2742788 - DNA, 19 bp, Homo sapiens
tgtatatctatatctctaa

SEQ ID NO: 2742789 - DNA, 17 bp, Homo sapiens
tgtatatgtatatctat

SEQ ID NO: 2742790 - DNA, 16 bp, Homo sapiens
tgtatggatagtaaaa

SEQ ID NO: 2742791 - DNA, 13 bp, Homo sapiens
tgtccagtttcca

SEQ ID NO: 2742792 - DNA, 23 bp, Homo sapiens
tgtcctgttattttttatttcca

SEQ ID NO: 2742793 - DNA, 18 bp, Homo sapiens
tgtctgcaggattgatta

SEQ ID NO: 2742794 - DNA, 23 bp, Homo sapiens
tgtgaaattcaacctgtgtctta

SEQ ID NO: 2742795 - DNA, 12 bp, Homo sapiens
tgtgtctgcagg

SEQ ID NO: 2742796 - DNA, 12 bp, Homo sapiens
tgtgttggcttg

SEQ ID NO: 2742797 - DNA, 18 bp, Homo sapiens
tgttaattgattaaaatc

SEQ ID NO: 2742798 - DNA, 13 bp, Homo sapiens
tgttactaaagtc

SEQ ID NO: 2742799 - DNA, 20 bp, Homo sapiens
tgttattttttatttccaca

SEQ ID NO: 2742800 - DNA, 20 bp, Homo sapiens
tgtttaaaaaaagtatatat

SEQ ID NO: 2742801 - DNA, 18 bp, Homo sapiens
ttaaaaaaagtatatatt

SEQ ID NO: 2742802 - DNA, 22 bp, Homo sapiens
ttaatatctgagaagtgtatat

SEQ ID NO: 2742803 - DNA, 13 bp, Homo sapiens
ttaatcattgcct

SEQ ID NO: 2742804 - DNA, 18 bp, Homo sapiens
ttacagtttcaaaaactg

SEQ ID NO: 2742805 - DNA, 12 bp, Homo sapiens
ttactaaagtca

SEQ ID NO: 2742806 - DNA, 17 bp, Homo sapiens
ttactgacagaaatgca

SEQ ID NO: 2742807 - DNA, 12 bp, Homo sapiens
ttagaatatatt

SEQ ID NO: 2742808 - DNA, 23 bp, Homo sapiens
ttatacagaattgtgtctgcagg

SEQ ID NO: 2742809 - DNA, 16 bp, Homo sapiens
ttatatatcataaagt

SEQ ID NO: 2742810 - DNA, 17 bp, Homo sapiens
ttatatatcataaagta

SEQ ID NO: 2742811 - DNA, 15 bp, Homo sapiens
ttcaaaaactgtatt

SEQ ID NO: 2742812 - DNA, 14 bp, Homo sapiens
ttcactaccaaatg

SEQ ID NO: 2742813 - DNA, 18 bp, Homo sapiens
ttcagctattagcaactg

SEQ ID NO: 2742814 - DNA, 16 bp, Homo sapiens
ttcatagaccctctca

SEQ ID NO: 2742815 - DNA, 17 bp, Homo sapiens
ttcatagaccctctcaa

SEQ ID NO: 2742816 - DNA, 18 bp, Homo sapiens
ttcgacctgatttacagt

SEQ ID NO: 2742817 - DNA, 12 bp, Homo sapiens
ttctactgtatg

SEQ ID NO: 2742818 - DNA, 15 bp, Homo sapiens
ttctgcaagcctgcg

SEQ ID NO: 2742819 - DNA, 13 bp, Homo sapiens
ttctgcctctcaa

SEQ ID NO: 2742820 - DNA, 15 bp, Homo sapiens
ttctggattcttggc

SEQ ID NO: 2742821 - DNA, 13 bp, Homo sapiens
ttgattatgcaga

SEQ ID NO: 2742822 - DNA, 13 bp, Homo sapiens
ttggaaaaagtga

SEQ ID NO: 2742823 - DNA, 15 bp, Homo sapiens
ttggccaagcaggga

SEQ ID NO: 2742824 - DNA, 17 bp, Homo sapiens
ttgtaacttggatgtag

SEQ ID NO: 2742825 - DNA, 19 bp, Homo sapiens
ttgtgaaattcaacctgtg

SEQ ID NO: 2742826 - DNA, 20 bp, Homo sapiens
ttgtgaaattcaacctgtgt

SEQ ID NO: 2742827 - DNA, 19 bp, Homo sapiens
ttgtgacagattatacaga

SEQ ID NO: 2742828 - DNA, 13 bp, Homo sapiens
ttgtgtctgcagg

SEQ ID NO: 2742829 - DNA, 14 bp, Homo sapiens
tttaaaaactattt

SEQ ID NO: 2742830 - DNA, 12 bp, Homo sapiens
tttaacttgagc

SEQ ID NO: 2742831 - DNA, 21 bp, Homo sapiens
tttacagtttcaaaaactgta

SEQ ID NO: 2742832 - DNA, 14 bp, Homo sapiens
tttagaatatatta

SEQ ID NO: 2742833 - DNA, 20 bp, Homo sapiens
tttagctcaaacgtggcttt

SEQ ID NO: 2742834 - DNA, 23 bp, Homo sapiens
tttcagctattagcaactgtgct

SEQ ID NO: 2742835 - DNA, 14 bp, Homo sapiens
tttccacataaagg

SEQ ID NO: 2742836 - DNA, 13 bp, Homo sapiens
tttcttctctgct

SEQ ID NO: 2742837 - DNA, 21 bp, Homo sapiens
tttgattgagagtaacttaag

SEQ ID NO: 2742838 - DNA, 20 bp, Homo sapiens
ttttcagctattagcaactg

SEQ ID NO: 2742839 - DNA, 16 bp, Homo sapiens
ttttcattttctgcaa

SEQ ID NO: 2742840 - DNA, 18 bp, Homo sapiens
ttttcattttctgcaagc

SEQ ID NO: 2742841 - DNA, 13 bp, Homo sapiens
ttttttatttcca

SEQ ID NO: 2742842 - DNA, 11 bp, Homo sapiens
aaaagtatata

SEQ ID NO: 2742843 - DNA, 23 bp, Homo sapiens
aaaattcgacctgatttacagtt

SEQ ID NO: 2742844 - DNA, 17 bp, Homo sapiens
aaacctgtccataaagt

SEQ ID NO: 2742845 - DNA, 13 bp, Homo sapiens
aaactatttaact

SEQ ID NO: 2742846 - DNA, 14 bp, Homo sapiens
aaactgctgttaat

SEQ ID NO: 2742847 - DNA, 15 bp, Homo sapiens
aaagattatatatca

SEQ ID NO: 2742848 - DNA, 22 bp, Homo sapiens
aaagattatatatcataaagta

SEQ ID NO: 2742849 - DNA, 18 bp, Homo sapiens
aaagcagcccttggccag

SEQ ID NO: 2742850 - DNA, 18 bp, Homo sapiens
aaagctctgaacaaaagc

SEQ ID NO: 2742851 - DNA, 20 bp, Homo sapiens
aaagtcacatataaaagtta

SEQ ID NO: 2742852 - DNA, 20 bp, Homo sapiens
aaagttaaactacttgtaaa

SEQ ID NO: 2742853 - DNA, 22 bp, Homo sapiens
aaatgagcattagctacttttc

SEQ ID NO: 2742854 - DNA, 13 bp, Homo sapiens
aaatgcattatgt

SEQ ID NO: 2742855 - DNA, 21 bp, Homo sapiens
aaatgctttaaaaactattta

SEQ ID NO: 2742856 - DNA, 22 bp, Homo sapiens
aaatgctttaaaaactatttaa

SEQ ID NO: 2742857 - DNA, 19 bp, Homo sapiens
aaattcaacctgtgtctta

SEQ ID NO: 2742858 - DNA, 19 bp, Homo sapiens
aaattttactgacagaaat

SEQ ID NO: 2742859 - DNA, 18 bp, Homo sapiens
aaccaggagctgctcact

SEQ ID NO: 2742860 - DNA, 22 bp, Homo sapiens
aaccaggagctgctcactacct

SEQ ID NO: 2742861 - DNA, 23 bp, Homo sapiens
aaccagttggctaggggagcagg

SEQ ID NO: 2742862 - DNA, 15 bp, Homo sapiens
aaccataaaaagctg

SEQ ID NO: 2742863 - DNA, 16 bp, Homo sapiens
aacctgtccataaagt

SEQ ID NO: 2742864 - DNA, 17 bp, Homo sapiens
aacctgtccataaagta

SEQ ID NO: 2742865 - DNA, 17 bp, Homo sapiens
aagcaaagccacatttt

SEQ ID NO: 2742866 - DNA, 19 bp, Homo sapiens
aagcatatgtgttggcttg

SEQ ID NO: 2742867 - DNA, 14 bp, Homo sapiens
aagtagtagtgtct

SEQ ID NO: 2742868 - DNA, 14 bp, Homo sapiens
aagtatatattcta

SEQ ID NO: 2742869 - DNA, 23 bp, Homo sapiens
aagtatatattctacacatatat

SEQ ID NO: 2742870 - DNA, 19 bp, Homo sapiens
aagtgatggagcagagcaa

SEQ ID NO: 2742871 - DNA, 20 bp, Homo sapiens
aatatctgagaagtgtatat

SEQ ID NO: 2742872 - DNA, 16 bp, Homo sapiens
aatctggcaaagttat

SEQ ID NO: 2742873 - DNA, 18 bp, Homo sapiens
aatctggcaaagttatat

SEQ ID NO: 2742874 - DNA, 19 bp, Homo sapiens
aatctggcaaagttatatt

SEQ ID NO: 2742875 - DNA, 14 bp, Homo sapiens
aattgtgtctgcag

SEQ ID NO: 2742876 - DNA, 16 bp, Homo sapiens
acacatatatgtatat

SEQ ID NO: 2742877 - DNA, 18 bp, Homo sapiens
acagaattgtgtctgcag

SEQ ID NO: 2742878 - DNA, 19 bp, Homo sapiens
acaggcagttacttctgag

SEQ ID NO: 2742879 - DNA, 19 bp, Homo sapiens
acaggccctttcctcaggc

SEQ ID NO: 2742880 - DNA, 21 bp, Homo sapiens
acaggccctttcctcaggcaa

SEQ ID NO: 2742881 - DNA, 21 bp, Homo sapiens
acagtagtaccaaatgcttta

SEQ ID NO: 2742882 - DNA, 14 bp, Homo sapiens
acatataaaagtta

SEQ ID NO: 2742883 - DNA, 22 bp, Homo sapiens
acatataaaagttaaactactt

SEQ ID NO: 2742884 - DNA, 13 bp, Homo sapiens
acatatatgtata

SEQ ID NO: 2742885 - DNA, 14 bp, Homo sapiens
acatatatgtatat

SEQ ID NO: 2742886 - DNA, 17 bp, Homo sapiens
acatatatgtatatgta

SEQ ID NO: 2742887 - DNA, 20 bp, Homo sapiens
acattttgtacaaagatatg

SEQ ID NO: 2742888 - DNA, 21 bp, Homo sapiens
accaaatgagcattagctact

SEQ ID NO: 2742889 - DNA, 22 bp, Homo sapiens
accaaatgctttaaaaactatt

SEQ ID NO: 2742890 - DNA, 21 bp, Homo sapiens
accacaggccctttcctcagg

SEQ ID NO: 2742891 - DNA, 17 bp, Homo sapiens
accagagctgtggagag

SEQ ID NO: 2742892 - DNA, 15 bp, Homo sapiens
accataaaaagctga

SEQ ID NO: 2742893 - DNA, 16 bp, Homo sapiens
accctaagactcctcg

SEQ ID NO: 2742894 - DNA, 14 bp, Homo sapiens
acctcctcagggat

SEQ ID NO: 2742895 - DNA, 19 bp, Homo sapiens
acctggtactgcacatttt

SEQ ID NO: 2742896 - DNA, 14 bp, Homo sapiens
actacctcctcagg

SEQ ID NO: 2742897 - DNA, 19 bp, Homo sapiens
actacctcctcagggatgg

SEQ ID NO: 2742898 - DNA, 21 bp, Homo sapiens
actgaaccgacttttctaaag

SEQ ID NO: 2742899 - DNA, 15 bp, Homo sapiens
acttgagctttaaaa

SEQ ID NO: 2742900 - DNA, 10 bp, Homo sapiens
acttggccaa

SEQ ID NO: 2742901 - DNA, 15 bp, Homo sapiens
acttttctaaagctc

SEQ ID NO: 2742902 - DNA, 22 bp, Homo sapiens
acttttctaaagctctgaacaa

SEQ ID NO: 2742903 - DNA, 20 bp, Homo sapiens
agaaattttactgacagaaa

SEQ ID NO: 2742904 - DNA, 23 bp, Homo sapiens
agaaattttactgacagaaatgc

SEQ ID NO: 2742905 - DNA, 15 bp, Homo sapiens
agaagcttaggcagg

SEQ ID NO: 2742906 - DNA, 12 bp, Homo sapiens
agaagtgtatat

SEQ ID NO: 2742907 - DNA, 19 bp, Homo sapiens
agaattgaaggagaaaatg

SEQ ID NO: 2742908 - DNA, 16 bp, Homo sapiens
agagctgtggagaggg

SEQ ID NO: 2742909 - DNA, 20 bp, Homo sapiens
agatctttttgtgaaattca

SEQ ID NO: 2742910 - DNA, 19 bp, Homo sapiens
agattatatatcataaagt

SEQ ID NO: 2742911 - DNA, 19 bp, Homo sapiens
agcaaagccacattttgca

SEQ ID NO: 2742912 - DNA, 14 bp, Homo sapiens
agcaagtctgcagg

SEQ ID NO: 2742913 - DNA, 20 bp, Homo sapiens
agcagagcaagtctgcaggt

SEQ ID NO: 2742914 - DNA, 16 bp, Homo sapiens
agcagcccttggccag

SEQ ID NO: 2742915 - DNA, 16 bp, Homo sapiens
agcatagaaggcaggt

SEQ ID NO: 2742916 - DNA, 22 bp, Homo sapiens
agcattagctacttttcagaat

SEQ ID NO: 2742917 - DNA, 17 bp, Homo sapiens
agccatgaccttacatt

SEQ ID NO: 2742918 - DNA, 15 bp, Homo sapiens
agctattagcaactg

SEQ ID NO: 2742919 - DNA, 20 bp, Homo sapiens
agctcctccgtgcttcctca

SEQ ID NO: 2742920 - DNA, 23 bp, Homo sapiens
agctgctcactacctcctcaggg

SEQ ID NO: 2742921 - DNA, 22 bp, Homo sapiens
agctgcttctcccacttggcca

SEQ ID NO: 2742922 - DNA, 23 bp, Homo sapiens
agctgcttctcccacttggccaa

SEQ ID NO: 2742923 - DNA, 13 bp, Homo sapiens
agcttaggcaggg

SEQ ID NO: 2742924 - DNA, 20 bp, Homo sapiens
aggaagaagcttaggcaggg

SEQ ID NO: 2742925 - DNA, 17 bp, Homo sapiens
aggccctttcctcaggc

SEQ ID NO: 2742926 - DNA, 21 bp, Homo sapiens
agggaggaagaagcttaggca

SEQ ID NO: 2742927 - DNA, 23 bp, Homo sapiens
agggaggaagaagcttaggcagg

SEQ ID NO: 2742928 - DNA, 17 bp, Homo sapiens
agggatggactgatgct

SEQ ID NO: 2742929 - DNA, 15 bp, Homo sapiens
agggatggccgttgg

SEQ ID NO: 2742930 - DNA, 19 bp, Homo sapiens
agggatggccgttggccac

SEQ ID NO: 2742931 - DNA, 21 bp, Homo sapiens
agggcctgaggtctggctgct

SEQ ID NO: 2742932 - DNA, 22 bp, Homo sapiens
agggcctgaggtctggctgctt

SEQ ID NO: 2742933 - DNA, 21 bp, Homo sapiens
agggctctctttccttcttgc

SEQ ID NO: 2742934 - DNA, 21 bp, Homo sapiens
ctcaggcaaggtctggcctca

SEQ ID NO: 2742935 - DNA, 21 bp, Homo sapiens
ctccatcctttctgcctctca

SEQ ID NO: 2742936 - DNA, 18 bp, Homo sapiens
ctcctttttatgttgcca

SEQ ID NO: 2742937 - DNA, 16 bp, Homo sapiens
ctcttggaaaaagtga

SEQ ID NO: 2742938 - DNA, 13 bp, Homo sapiens
ctgaacaaaagct

SEQ ID NO: 2742939 - DNA, 16 bp, Homo sapiens
ctgagggatggactga

SEQ ID NO: 2742940 - DNA, 12 bp, Homo sapiens
ctgatttacagt

SEQ ID NO: 2742941 - DNA, 21 bp, Homo sapiens
ctgcaggattgattatgcaga

SEQ ID NO: 2742942 - DNA, 18 bp, Homo sapiens
ctgcgttcttgtgacaga

SEQ ID NO: 2742943 - DNA, 21 bp, Homo sapiens
ctgctcactacctcctcaggg

SEQ ID NO: 2742944 - DNA, 17 bp, Homo sapiens
ctgctcgaagaacaatg

SEQ ID NO: 2742945 - DNA, 21 bp, Homo sapiens
ctgcttctcccacttggccaa

SEQ ID NO: 2742946 - DNA, 23 bp, Homo sapiens
ctgtccataaagtaattttgtga

SEQ ID NO: 2742947 - DNA, 19 bp, Homo sapiens
ctgttattttttatttcca

SEQ ID NO: 2742948 - DNA, 21 bp, Homo sapiens
ctgttattttttatttccaca

SEQ ID NO: 2742949 - DNA, 11 bp, Homo sapiens
cttccttctgc

SEQ ID NO: 2742950 - DNA, 16 bp, Homo sapiens
cttctggattcttggc

SEQ ID NO: 2742951 - DNA, 17 bp, Homo sapiens
cttctggattcttggcc

SEQ ID NO: 2742952 - DNA, 18 bp, Homo sapiens
cttctggattcttggccc

SEQ ID NO: 2742953 - DNA, 23 bp, Homo sapiens
cttgccgaaccaggagctgctca

SEQ ID NO: 2742954 - DNA, 19 bp, Homo sapiens
cttgctgccttctggattc

SEQ ID NO: 2742955 - DNA, 14 bp, Homo sapiens
cttggaaaaagtga

SEQ ID NO: 2742956 - DNA, 17 bp, Homo sapiens
cttggccaagcagggag

SEQ ID NO: 2742957 - DNA, 19 bp, Homo sapiens
ctttaaaaactatttaact

SEQ ID NO: 2742958 - DNA, 12 bp, Homo sapiens
gggctggcttca

SEQ ID NO: 2742959 - DNA, 13 bp, Homo sapiens
ggtctggctgctt

SEQ ID NO: 2742960 - DNA, 20 bp, Homo sapiens
gtaaaaagattatatatcat

SEQ ID NO: 2742961 - DNA, 21 bp, Homo sapiens
gtaaaaagattatatatcata

SEQ ID NO: 2742962 - DNA, 16 bp, Homo sapiens
gtacaaagatatgcta

SEQ ID NO: 2742963 - DNA, 16 bp, Homo sapiens
gtagtaccaaatgctt

SEQ ID NO: 2742964 - DNA, 14 bp, Homo sapiens
gtatatattctaca

SEQ ID NO: 2742965 - DNA, 21 bp, Homo sapiens
gtatatattctacacatatat

SEQ ID NO: 2742966 - DNA, 18 bp, Homo sapiens
gtatatctatatctctaa

SEQ ID NO: 2742967 - DNA, 15 bp, Homo sapiens
gtatatgtatatcta

SEQ ID NO: 2742968 - DNA, 18 bp, Homo sapiens
gtccaggaaatgtgcaca

SEQ ID NO: 2742969 - DNA, 15 bp, Homo sapiens
gtcttccttctgcct

SEQ ID NO: 2742970 - DNA, 19 bp, Homo sapiens
gttaattgattaaaatctg

SEQ ID NO: 2742971 - DNA, 17 bp, Homo sapiens
gttacacaaaggacctc

SEQ ID NO: 2742972 - DNA, 21 bp, Homo sapiens
gttacacaaaggacctcagct

SEQ ID NO: 2742973 - DNA, 21 bp, Homo sapiens
gttctctcccaggggctggct

SEQ ID NO: 2742974 - DNA, 20 bp, Homo sapiens
gtttaaaaaaagtatatatt

SEQ ID NO: 2742975 - DNA, 17 bp, Homo sapiens
gtttcaaaaactgtatt

SEQ ID NO: 2742976 - DNA, 14 bp, Homo sapiens
taaaaaaagtatat

SEQ ID NO: 2742977 - DNA, 17 bp, Homo sapiens
taaaaactatttaactt

SEQ ID NO: 2742978 - DNA, 12 bp, Homo sapiens
taaaaagattat

SEQ ID NO: 2742979 - DNA, 19 bp, Homo sapiens
taaaaagattatatatcat

SEQ ID NO: 2742980 - DNA, 22 bp, Homo sapiens
taaaagttaaactacttgtaaa

SEQ ID NO: 2742981 - DNA, 17 bp, Homo sapiens
taaacataaataaatat

SEQ ID NO: 2742982 - DNA, 17 bp, Homo sapiens
taaaccataaaaagctg

SEQ ID NO: 2742983 - DNA, 19 bp, Homo sapiens
taatggtgttactaaagtc

SEQ ID NO: 2742984 - DNA, 18 bp, Homo sapiens
tacagaattgtgtctgca

SEQ ID NO: 2742985 - DNA, 20 bp, Homo sapiens
tacagaattgtgtctgcagg

SEQ ID NO: 2742986 - DNA, 13 bp, Homo sapiens
tacagtttcaaaa

SEQ ID NO: 2742987 - DNA, 17 bp, Homo sapiens
tacctcctcagggatgg

SEQ ID NO: 2742988 - DNA, 14 bp, Homo sapiens
tagaccctctcaag

SEQ ID NO: 2742989 - DNA, 16 bp, Homo sapiens
tagagtgagggcctga

SEQ ID NO: 2742990 - DNA, 13 bp, Homo sapiens
tagccatgacctt

SEQ ID NO: 2742991 - DNA, 22 bp, Homo sapiens
tagtaaaattctactgtatgga

SEQ ID NO: 2742992 - DNA, 13 bp, Homo sapiens
tagtagtgtcttc

SEQ ID NO: 2742993 - DNA, 22 bp, Homo sapiens
tatacagaattgtgtctgcagg

SEQ ID NO: 2742994 - DNA, 17 bp, Homo sapiens
tatatctatatctctaa

SEQ ID NO: 2742995 - DNA, 14 bp, Homo sapiens
tatcataaagtatg

SEQ ID NO: 2742996 - DNA, 14 bp, Homo sapiens
tatctatatctcta

SEQ ID NO: 2742997 - DNA, 15 bp, Homo sapiens
tatgcagaatacttt

SEQ ID NO: 2742998 - DNA, 16 bp, Homo sapiens
tatgtatatgtatatc

SEQ ID NO: 2742999 - DNA, 22 bp, Homo sapiens
tattagtttgatttaatatctg

SEQ ID NO: 2743000 - DNA, 13 bp, Homo sapiens
tatttaacttgag

SEQ ID NO: 2743001 - DNA, 20 bp, Homo sapiens
tatttaacttgagctttaaa

SEQ ID NO: 2743002 - DNA, 16 bp, Homo sapiens
tatttccacataaagg

SEQ ID NO: 2743003 - DNA, 15 bp, Homo sapiens
tattttttatttcca

SEQ ID NO: 2743004 - DNA, 13 bp, Homo sapiens
tcaaaaactgtat

SEQ ID NO: 2743005 - DNA, 21 bp, Homo sapiens
tcacatataaaagttaaacta

SEQ ID NO: 2743006 - DNA, 22 bp, Homo sapiens
tcacatataaaagttaaactac

SEQ ID NO: 2743007 - DNA, 18 bp, Homo sapiens
tcactacctcctcaggga

SEQ ID NO: 2743008 - DNA, 19 bp, Homo sapiens
tcactacctcctcagggat

SEQ ID NO: 2743009 - DNA, 17 bp, Homo sapiens
tcagaattgaaggagaa

SEQ ID NO: 2743010 - DNA, 18 bp, Homo sapiens
tcaggcaaggtctggcct

SEQ ID NO: 2743011 - DNA, 16 bp, Homo sapiens
tcatagaccctctcaa

SEQ ID NO: 2743012 - DNA, 13 bp, Homo sapiens
tcattttctgcaa

SEQ ID NO: 2743013 - DNA, 16 bp, Homo sapiens
tcattttctgcaagcc

SEQ ID NO: 2743014 - DNA, 14 bp, Homo sapiens
tccacataaaggta

SEQ ID NO: 2743015 - DNA, 17 bp, Homo sapiens
tccaggaaatgtgcaca

SEQ ID NO: 2743016 - DNA, 13 bp, Homo sapiens
tccagtttccaaa

SEQ ID NO: 2743017 - DNA, 14 bp, Homo sapiens
tccagtttccaaag

SEQ ID NO: 2743018 - DNA, 23 bp, Homo sapiens
tcccacttggccaagcagggagg

SEQ ID NO: 2743019 - DNA, 18 bp, Homo sapiens
tccctagcctgcttttgt

SEQ ID NO: 2743020 - DNA, 19 bp, Homo sapiens
tcctccgtgcttcctcagt

SEQ ID NO: 2743021 - DNA, 15 bp, Homo sapiens
tcctcggcctggctc

SEQ ID NO: 2743022 - DNA, 18 bp, Homo sapiens
tcgacctgatttacagtt

SEQ ID NO: 2743023 - DNA, 20 bp, Homo sapiens
tcgatgaatgtgttgatttg

SEQ ID NO: 2743024 - DNA, 17 bp, Homo sapiens
tctacacatatatgtat

SEQ ID NO: 2743025 - DNA, 17 bp, Homo sapiens
tctccatcctttctgcc

SEQ ID NO: 2743026 - DNA, 23 bp, Homo sapiens
tctcccaggggctggcttcagga

SEQ ID NO: 2743027 - DNA, 18 bp, Homo sapiens
tctctttccttcttgcct

SEQ ID NO: 2743028 - DNA, 15 bp, Homo sapiens
tctgcaagcctgcgt

SEQ ID NO: 2743029 - DNA, 13 bp, Homo sapiens
tctggcctcaggt

SEQ ID NO: 2743030 - DNA, 18 bp, Homo sapiens
tctggcctcaggtgggcc

SEQ ID NO: 2743031 - DNA, 19 bp, Homo sapiens
tcttcctagtatattagtt

SEQ ID NO: 2743032 - DNA, 16 bp, Homo sapiens
tcttggaaaaagtgat

SEQ ID NO: 2743033 - DNA, 18 bp, Homo sapiens
tcttggcccgcacagagc

SEQ ID NO: 2743034 - DNA, 14 bp, Homo sapiens
tgaaagaaggagca

SEQ ID NO: 2743035 - DNA, 12 bp, Homo sapiens
tgaacaaaagct

SEQ ID NO: 2743036 - DNA, 13 bp, Homo sapiens
tgaaggagaaaat

SEQ ID NO: 2743037 - DNA, 16 bp, Homo sapiens
tgaatgtgttgatttg

SEQ ID NO: 2743038 - DNA, 14 bp, Homo sapiens
tgacagtagtacca

SEQ ID NO: 2743039 - DNA, 21 bp, Homo sapiens
tgagggcatcttggtccagga

SEQ ID NO: 2743040 - DNA, 15 bp, Homo sapiens
tgaggtctggctgct

SEQ ID NO: 2743041 - DNA, 17 bp, Homo sapiens
tgatgacagtagtacca

SEQ ID NO: 2743042 - DNA, 13 bp, Homo sapiens
tgatttaatatct

SEQ ID NO: 2743043 - DNA, 14 bp, Homo sapiens
tgcaagcctgcgtt

SEQ ID NO: 2743044 - DNA, 13 bp, Homo sapiens
tgcaggtgcacca

SEQ ID NO: 2743045 - DNA, 23 bp, Homo sapiens
tgccagtttaatcattgcctggt

SEQ ID NO: 2743046 - DNA, 16 bp, Homo sapiens
tgccttcctgtttaaa

SEQ ID NO: 2743047 - DNA, 21 bp, Homo sapiens
tgctcactacctcctcaggga

SEQ ID NO: 2743048 - DNA, 13 bp, Homo sapiens
tgctttaaaaact

SEQ ID NO: 2743049 - DNA, 16 bp, Homo sapiens
tgctttaaaaactatt

SEQ ID NO: 2743050 - DNA, 17 bp, Homo sapiens
tggaaaaagtgatggag

SEQ ID NO: 2743051 - DNA, 22 bp, Homo sapiens
tggagcagagcaagtctgcagg

SEQ ID NO: 2743052 - DNA, 22 bp, Homo sapiens
tggagcctagagtgagggcctg

SEQ ID NO: 2743053 - DNA, 23 bp, Homo sapiens
tggccaagcagggaggaagaagc

SEQ ID NO: 2743054 - DNA, 12 bp, Homo sapiens
tggcttcaggag

SEQ ID NO: 2743055 - DNA, 18 bp, Homo sapiens
tggtaaaaagattatata

SEQ ID NO: 2743056 - DNA, 22 bp, Homo sapiens
tgtagccatgaccttacatttc

SEQ ID NO: 2743057 - DNA, 13 bp, Homo sapiens
tgtatatagtttg

SEQ ID NO: 2743058 - DNA, 21 bp, Homo sapiens
tgtatggatagtaaaattcta

SEQ ID NO: 2743059 - DNA, 23 bp, Homo sapiens
tgtattgatgacagtagtaccaa

SEQ ID NO: 2743060 - DNA, 14 bp, Homo sapiens
ctgctcgaagaaca

SEQ ID NO: 2743061 - DNA, 20 bp, Homo sapiens
ctgcttctcccacttggcca

SEQ ID NO: 2743062 - DNA, 21 bp, Homo sapiens
ctggcgccaacaacttctcca

SEQ ID NO: 2743063 - DNA, 21 bp, Homo sapiens
ctgtatggaatacaatgtaat

SEQ ID NO: 2743064 - DNA, 14 bp, Homo sapiens
ctgtccataaagta

SEQ ID NO: 2743065 - DNA, 18 bp, Homo sapiens
ctgtttaaaaaaagtata

SEQ ID NO: 2743066 - DNA, 19 bp, Homo sapiens
ctgtttaaaaaaagtatat

SEQ ID NO: 2743067 - DNA, 21 bp, Homo sapiens
ctgtttaaaaaaagtatatat

SEQ ID NO: 2743068 - DNA, 14 bp, Homo sapiens
cttatttgtataat

SEQ ID NO: 2743069 - DNA, 17 bp, Homo sapiens
cttcctcagttacacaa

SEQ ID NO: 2743070 - DNA, 18 bp, Homo sapiens
cttccttctgcctgagct

SEQ ID NO: 2743071 - DNA, 20 bp, Homo sapiens
cttctccatcctttctgcct

SEQ ID NO: 2743072 - DNA, 22 bp, Homo sapiens
cttctccatcctttctgcctct

SEQ ID NO: 2743073 - DNA, 15 bp, Homo sapiens
cttctgcctgagctt

SEQ ID NO: 2743074 - DNA, 15 bp, Homo sapiens
cttctggattcttgg

SEQ ID NO: 2743075 - DNA, 18 bp, Homo sapiens
cttgaatcctagggcctg

SEQ ID NO: 2743076 - DNA, 15 bp, Homo sapiens
cttgctgccttctgg

SEQ ID NO: 2743077 - DNA, 20 bp, Homo sapiens
cttgctgccttctggattct

SEQ ID NO: 2743078 - DNA, 21 bp, Homo sapiens
ctttcctcaggcaaggtctgg

SEQ ID NO: 2743079 - DNA, 16 bp, Homo sapiens
cttttgtcctgttatt

SEQ ID NO: 2743080 - DNA, 23 bp, Homo sapiens
gaaaaagtgatggagcagagcaa

SEQ ID NO: 2743081 - DNA, 19 bp, Homo sapiens
gaaacctgtccataaagta

SEQ ID NO: 2743082 - DNA, 21 bp, Homo sapiens
gaaattcaacctgtgtcttat

SEQ ID NO: 2743083 - DNA, 18 bp, Homo sapiens
gaaattttactgacagaa

SEQ ID NO: 2743084 - DNA, 19 bp, Homo sapiens
gaaattttactgacagaaa

SEQ ID NO: 2743085 - DNA, 16 bp, Homo sapiens
gaagaagcttaggcag

SEQ ID NO: 2743086 - DNA, 18 bp, Homo sapiens
gaagaagcttaggcaggg

SEQ ID NO: 2743087 - DNA, 16 bp, Homo sapiens
gacttttctaaagctc

SEQ ID NO: 2743088 - DNA, 15 bp, Homo sapiens
gagcaagtctgcagg

SEQ ID NO: 2743089 - DNA, 18 bp, Homo sapiens
gagcagagcaagtctgca

SEQ ID NO: 2743090 - DNA, 14 bp, Homo sapiens
gagcatagaaggca

SEQ ID NO: 2743091 - DNA, 16 bp, Homo sapiens
gagcatagaaggcagg

SEQ ID NO: 2743092 - DNA, 20 bp, Homo sapiens
gagggagcatagaaggcagg

SEQ ID NO: 2743093 - DNA, 15 bp, Homo sapiens
gagggcctgaggtct

SEQ ID NO: 2743094 - DNA, 17 bp, Homo sapiens
gaggtctggctgcttgc

SEQ ID NO: 2743095 - DNA, 14 bp, Homo sapiens
gagtgagggcctga

SEQ ID NO: 2743096 - DNA, 22 bp, Homo sapiens
gattgttctgtccagtttccaa

SEQ ID NO: 2743097 - DNA, 16 bp, Homo sapiens
gatttacagtttcaaa

SEQ ID NO: 2743098 - DNA, 23 bp, Homo sapiens
gattttaaaccataaaaagctga

SEQ ID NO: 2743099 - DNA, 14 bp, Homo sapiens
gcaaccagttggct

SEQ ID NO: 2743100 - DNA, 18 bp, Homo sapiens
gcaaccagttggctaggg

SEQ ID NO: 2743101 - DNA, 13 bp, Homo sapiens
gcaagagaacatt

SEQ ID NO: 2743102 - DNA, 24 bp, Homo sapiens
gcaagcctgcgttcttgtgacaga

SEQ ID NO: 2743103 - DNA, 16 bp, Homo sapiens
gcagagcaagtctgca

SEQ ID NO: 2743104 - DNA, 15 bp, Homo sapiens
gcagatctttttgtg

SEQ ID NO: 2743105 - DNA, 14 bp, Homo sapiens
gcatagaaggcagg

SEQ ID NO: 2743106 - DNA, 18 bp, Homo sapiens
gcatatgtgttggcttgt

SEQ ID NO: 2743107 - DNA, 22 bp, Homo sapiens
gcatcttggtccaggaaatgtg

SEQ ID NO: 2743108 - DNA, 14 bp, Homo sapiens
gcccgcacagagct

SEQ ID NO: 2743109 - DNA, 14 bp, Homo sapiens
gccctttcctcagg

SEQ ID NO: 2743110 - DNA, 14 bp, Homo sapiens
gccgttggccacgt

SEQ ID NO: 2743111 - DNA, 16 bp, Homo sapiens
gcctcaggtgggccgc

SEQ ID NO: 2743112 - DNA, 18 bp, Homo sapiens
gcctcttggaaaaagtga

SEQ ID NO: 2743113 - DNA, 16 bp, Homo sapiens
gcctgaggtctggctg

SEQ ID NO: 2743114 - DNA, 19 bp, Homo sapiens
gcctgaggtctggctgctt

SEQ ID NO: 2743115 - DNA, 14 bp, Homo sapiens
gcgggaaaagcagc

SEQ ID NO: 2743116 - DNA, 23 bp, Homo sapiens
gcgggaaaagcagcccttggcca

SEQ ID NO: 2743117 - DNA, 16 bp, Homo sapiens
gctgccttctggattc

SEQ ID NO: 2743118 - DNA, 17 bp, Homo sapiens
gctgccttctggattct

SEQ ID NO: 2743119 - DNA, 12 bp, Homo sapiens
gctgcttgcccc

SEQ ID NO: 2743120 - DNA, 22 bp, Homo sapiens
gctgcttgcccccatgctggcg

SEQ ID NO: 2743121 - DNA, 13 bp, Homo sapiens
gcttaggcagggc

SEQ ID NO: 2743122 - DNA, 18 bp, Homo sapiens
gcttctcccacttggcca

SEQ ID NO: 2743123 - DNA, 15 bp, Homo sapiens
gctttaaaaactatt

SEQ ID NO: 2743124 - DNA, 13 bp, Homo sapiens
gcttttagacaga

SEQ ID NO: 2743125 - DNA, 19 bp, Homo sapiens
ggaagaagcttaggcaggg

SEQ ID NO: 2743126 - DNA, 16 bp, Homo sapiens
ggacctcagctgcttc

SEQ ID NO: 2743127 - DNA, 24 bp, Homo sapiens
ggagctgctcactacctcctcagg

SEQ ID NO: 2743128 - DNA, 19 bp, Homo sapiens
ggccacgtcttccttctgc

SEQ ID NO: 2743129 - DNA, 18 bp, Homo sapiens
ggccctttcctcaggcaa

SEQ ID NO: 2743130 - DNA, 21 bp, Homo sapiens
ggcctgaggtctggctgcttg

SEQ ID NO: 2743131 - DNA, 18 bp, Homo sapiens
ggctctctttccttcttg

SEQ ID NO: 2743132 - DNA, 22 bp, Homo sapiens
ggctgagggatggactgatgct

SEQ ID NO: 2743133 - DNA, 20 bp, Homo sapiens
gggaccctaagactcctcgg

SEQ ID NO: 2743134 - DNA, 18 bp, Homo sapiens
gggagcatagaaggcagg

SEQ ID NO: 2743135 - DNA, 13 bp, Homo sapiens
gggccgcaggcgg

SEQ ID NO: 2743136 - DNA, 23 bp, Homo sapiens
gggccgcaggcgggaaaagcagc

SEQ ID NO: 2743137 - DNA, 11 bp, Homo sapiens
ggggagcaggg

SEQ ID NO: 2743138 - DNA, 22 bp, Homo sapiens
ggtcccaagtagtagtgtcttc

SEQ ID NO: 2743139 - DNA, 16 bp, Homo sapiens
ggtgggccgcaggcgg

SEQ ID NO: 2743140 - DNA, 17 bp, Homo sapiens
gtaaaaagattatatat

SEQ ID NO: 2743141 - DNA, 20 bp, Homo sapiens
gtacaaagatatgctaagca

SEQ ID NO: 2743142 - DNA, 19 bp, Homo sapiens
gtagtaccaaatgctttaa

SEQ ID NO: 2743143 - DNA, 14 bp, Homo sapiens
gtagtagtgtcttc

SEQ ID NO: 2743144 - DNA, 21 bp, Homo sapiens
gtagtgtcttcctagtatatt

SEQ ID NO: 2743145 - DNA, 16 bp, Homo sapiens
gtatatgtatatctat

SEQ ID NO: 2743146 - DNA, 18 bp, Homo sapiens
gtatatgtatatctatat

SEQ ID NO: 2743147 - DNA, 14 bp, Homo sapiens
gtatattagtttga

SEQ ID NO: 2743148 - DNA, 12 bp, Homo sapiens
gtccataaagta

SEQ ID NO: 2743149 - DNA, 22 bp, Homo sapiens
gtgaaattcaacctgtgtctta

SEQ ID NO: 2743150 - DNA, 16 bp, Homo sapiens
gtgacagattatacag

SEQ ID NO: 2743151 - DNA, 18 bp, Homo sapiens
gtgttgatttgagaaatt

SEQ ID NO: 2743152 - DNA, 17 bp, Homo sapiens
gttcatagaccctctca

SEQ ID NO: 2743153 - DNA, 22 bp, Homo sapiens
gttgcagatctttttgtgaaat

SEQ ID NO: 2743154 - DNA, 14 bp, Homo sapiens
gtttaaaaaaagta

SEQ ID NO: 2743155 - DNA, 19 bp, Homo sapiens
gtttaaaaaaagtatatat

SEQ ID NO: 2743156 - DNA, 22 bp, Homo sapiens
gtttaaaaaaagtatatattct

SEQ ID NO: 2743157 - DNA, 13 bp, Homo sapiens
gttttgattgaga

SEQ ID NO: 2743158 - DNA, 17 bp, Homo sapiens
gtttttgaaacagaacc

SEQ ID NO: 2743159 - DNA, 11 bp, Homo sapiens
taaaaagctga

SEQ ID NO: 2743160 - DNA, 16 bp, Homo sapiens
taaaattctactgtat

SEQ ID NO: 2743161 - DNA, 14 bp, Homo sapiens
caaataaacactgt

SEQ ID NO: 2743162 - DNA, 15 bp, Homo sapiens
caaataaacactgtg

SEQ ID NO: 2743163 - DNA, 20 bp, Homo sapiens
caaataaacactgtgtaagc

SEQ ID NO: 2743164 - DNA, 22 bp, Homo sapiens
caacctgtaataaatatgagtg

SEQ ID NO: 2743165 - DNA, 18 bp, Homo sapiens
caatacttgaatatggaa

SEQ ID NO: 2743166 - DNA, 15 bp, Homo sapiens
caatcattgtacagt

SEQ ID NO: 2743167 - DNA, 23 bp, Homo sapiens
caatgtcttaaataaaactattt

SEQ ID NO: 2743168 - DNA, 16 bp, Homo sapiens
caatttgtttgtgctt

SEQ ID NO: 2743169 - DNA, 16 bp, Homo sapiens
caattttccttgaagc

SEQ ID NO: 2743170 - DNA, 17 bp, Homo sapiens
caattttccttgaagcc

SEQ ID NO: 2743171 - DNA, 18 bp, Homo sapiens
caattttccttgaagccg

SEQ ID NO: 2743172 - DNA, 19 bp, Homo sapiens
caattttccttgaagccga

SEQ ID NO: 2743173 - DNA, 22 bp, Homo sapiens
cacacactgtgctttctattgt

SEQ ID NO: 2743174 - DNA, 12 bp, Homo sapiens
cacagaaagcct

SEQ ID NO: 2743175 - DNA, 22 bp, Homo sapiens
cacaggggaaggaaataacatt

SEQ ID NO: 2743176 - DNA, 13 bp, Homo sapiens
cacatttaaaaca

SEQ ID NO: 2743177 - DNA, 14 bp, Homo sapiens
cacatttaaaacat

SEQ ID NO: 2743178 - DNA, 18 bp, Homo sapiens
caccagcggcctggagtc

SEQ ID NO: 2743179 - DNA, 15 bp, Homo sapiens
cactggctgccagct

SEQ ID NO: 2743180 - DNA, 18 bp, Homo sapiens
cactggctgccagctatt

SEQ ID NO: 2743181 - DNA, 20 bp, Homo sapiens
cactggctgccagctatttt

SEQ ID NO: 2743182 - DNA, 22 bp, Homo sapiens
cactgtgctttctattgtacag

SEQ ID NO: 2743183 - DNA, 14 bp, Homo sapiens
cagaaagcctatca

SEQ ID NO: 2743184 - DNA, 12 bp, Homo sapiens
cagaataaagca

SEQ ID NO: 2743185 - DNA, 23 bp, Homo sapiens
cagcaaagccccatgctggagcc

SEQ ID NO: 2743186 - DNA, 14 bp, Homo sapiens
cagcataaaggcct

SEQ ID NO: 2743187 - DNA, 18 bp, Homo sapiens
cagcataaaggccttttt

SEQ ID NO: 2743188 - DNA, 12 bp, Homo sapiens
cagctccttggg

SEQ ID NO: 2743189 - DNA, 16 bp, Homo sapiens
cagctccttgggagga

SEQ ID NO: 2743190 - DNA, 17 bp, Homo sapiens
cagctccttgggaggaa

SEQ ID NO: 2743191 - DNA, 23 bp, Homo sapiens
cagctctgtccccaccccatggg

SEQ ID NO: 2743192 - DNA, 15 bp, Homo sapiens
caggcacacactgtg

SEQ ID NO: 2743193 - DNA, 12 bp, Homo sapiens
caggctgtgctt

SEQ ID NO: 2743194 - DNA, 19 bp, Homo sapiens
caggctgtgcttacctgtg

SEQ ID NO: 2743195 - DNA, 19 bp, Homo sapiens
caggggaaggaaataacat

SEQ ID NO: 2743196 - DNA, 20 bp, Homo sapiens
cagtgtcaaataaacactgt

SEQ ID NO: 2743197 - DNA, 14 bp, Homo sapiens
cagtttgtttacac

SEQ ID NO: 2743198 - DNA, 16 bp, Homo sapiens
cagtttgtttacacac

SEQ ID NO: 2743199 - DNA, 20 bp, Homo sapiens
catcaatcattgtacagttt

SEQ ID NO: 2743200 - DNA, 20 bp, Homo sapiens
catcctgccttagagccagg

SEQ ID NO: 2743201 - DNA, 22 bp, Homo sapiens
catcctgccttagagccaggca

SEQ ID NO: 2743202 - DNA, 23 bp, Homo sapiens
catctcccatgtgtgatgctgac

SEQ ID NO: 2743203 - DNA, 19 bp, Homo sapiens
catcttgatctgctcagcc

SEQ ID NO: 2743204 - DNA, 21 bp, Homo sapiens
catcttgatctgctcagccct

SEQ ID NO: 2743205 - DNA, 22 bp, Homo sapiens
catcttgatctgctcagccctg

SEQ ID NO: 2743206 - DNA, 19 bp, Homo sapiens
catgctggagcctgtgtaa

SEQ ID NO: 2743207 - DNA, 14 bp, Homo sapiens
catgttccaataaa

SEQ ID NO: 2743208 - DNA, 16 bp, Homo sapiens
catgttccaataaaca

SEQ ID NO: 2743209 - DNA, 18 bp, Homo sapiens
cattgcactttataaaca

SEQ ID NO: 2743210 - DNA, 19 bp, Homo sapiens
cattgtacagtttgtttac

SEQ ID NO: 2743211 - DNA, 12 bp, Homo sapiens
catttaaaacat

SEQ ID NO: 2743212 - DNA, 15 bp, Homo sapiens
catttaaaacatttg

SEQ ID NO: 2743213 - DNA, 22 bp, Homo sapiens
ccaacctgtaataaatatgagt

SEQ ID NO: 2743214 - DNA, 23 bp, Homo sapiens
ccaagactccctcgtcgagctgg

SEQ ID NO: 2743215 - DNA, 23 bp, Homo sapiens
ccacatcttgatctgctcagccc

SEQ ID NO: 2743216 - DNA, 16 bp, Homo sapiens
ccaggcacacactgtg

SEQ ID NO: 2743217 - DNA, 17 bp, Homo sapiens
ccatgctggagcctgtg

SEQ ID NO: 2743218 - DNA, 18 bp, Homo sapiens
ccatgctggagcctgtgt

SEQ ID NO: 2743219 - DNA, 22 bp, Homo sapiens
ccatgctggagcctgtgtaaca

SEQ ID NO: 2743220 - DNA, 18 bp, Homo sapiens
ccatgttccaataaacag

SEQ ID NO: 2743221 - DNA, 14 bp, Homo sapiens
ccatttatccacct

SEQ ID NO: 2743222 - DNA, 16 bp, Homo sapiens
ccatttatccacctcc

SEQ ID NO: 2743223 - DNA, 14 bp, Homo sapiens
cccaccccatgggc

SEQ ID NO: 2743224 - DNA, 17 bp, Homo sapiens
cccatgctggagcctgt

SEQ ID NO: 2743225 - DNA, 18 bp, Homo sapiens
cccatgctggagcctgtg

SEQ ID NO: 2743226 - DNA, 20 bp, Homo sapiens
cccatgctggagcctgtgta

SEQ ID NO: 2743227 - DNA, 20 bp, Homo sapiens
cccatgggcctcatgaataa

SEQ ID NO: 2743228 - DNA, 19 bp, Homo sapiens
cccatgtgtgatgctgaca

SEQ ID NO: 2743229 - DNA, 18 bp, Homo sapiens
cccatttatccacctcca

SEQ ID NO: 2743230 - DNA, 19 bp, Homo sapiens
cccatttatccacctccat

SEQ ID NO: 2743231 - DNA, 12 bp, Homo sapiens
ccccatgctgga

SEQ ID NO: 2743232 - DNA, 21 bp, Homo sapiens
ccccatgctggagcctgtgta

SEQ ID NO: 2743233 - DNA, 22 bp, Homo sapiens
ccccatgctggagcctgtgtaa

SEQ ID NO: 2743234 - DNA, 17 bp, Homo sapiens
ccccatttatccacctc

SEQ ID NO: 2743235 - DNA, 18 bp, Homo sapiens
ccctctcaggctgtgctt

SEQ ID NO: 2743236 - DNA, 16 bp, Homo sapiens
ccctggaggtgccagc

SEQ ID NO: 2743237 - DNA, 17 bp, Homo sapiens
ccctggaggtgccagca

SEQ ID NO: 2743238 - DNA, 22 bp, Homo sapiens
ccctggaggtgccagcaaagcc

SEQ ID NO: 2743239 - DNA, 14 bp, Homo sapiens
ccgtctctggcccc

SEQ ID NO: 2743240 - DNA, 17 bp, Homo sapiens
cctcactcttgccaacc

SEQ ID NO: 2743241 - DNA, 15 bp, Homo sapiens
cctcatgaataaatg

SEQ ID NO: 2743242 - DNA, 18 bp, Homo sapiens
cctggaggtgccagcaaa

SEQ ID NO: 2743243 - DNA, 20 bp, Homo sapiens
cctggagtcgtgggaaggag

SEQ ID NO: 2743244 - DNA, 13 bp, Homo sapiens
cctgtgtaacagc

SEQ ID NO: 2743245 - DNA, 15 bp, Homo sapiens
cctgtgtaacagctc

SEQ ID NO: 2743246 - DNA, 18 bp, Homo sapiens
cctgtgtaacagctcctt

SEQ ID NO: 2743247 - DNA, 18 bp, Homo sapiens
ccttagagccaggcacac

SEQ ID NO: 2743248 - DNA, 16 bp, Homo sapiens
ccttccagtcaggatg

SEQ ID NO: 2743249 - DNA, 11 bp, Homo sapiens
ccttgaagccg

SEQ ID NO: 2743250 - DNA, 17 bp, Homo sapiens
ccttgggaggaagcaga

SEQ ID NO: 2743251 - DNA, 18 bp, Homo sapiens
ccttgggaggaagcagaa

SEQ ID NO: 2743252 - DNA, 21 bp, Homo sapiens
ccttgggaggaagcagaataa

SEQ ID NO: 2743253 - DNA, 22 bp, Homo sapiens
ccttgggaggaagcagaataaa

SEQ ID NO: 2743254 - DNA, 15 bp, Homo sapiens
cgagctggatgtccc

SEQ ID NO: 2743255 - DNA, 14 bp, Homo sapiens
cggtattatgcttc

SEQ ID NO: 2743256 - DNA, 13 bp, Homo sapiens
cgtctcatctccc

SEQ ID NO: 2743257 - DNA, 14 bp, Homo sapiens
cgtctcatctccca

SEQ ID NO: 2743258 - DNA, 20 bp, Homo sapiens
cgtgcccagccagggaaggc

SEQ ID NO: 2743259 - DNA, 21 bp, Homo sapiens
cgtgtgtgggtggatataaat

SEQ ID NO: 2743260 - DNA, 23 bp, Homo sapiens
cgtgtgtgggtggatataaatat

SEQ ID NO: 2743261 - DNA, 17 bp, Homo sapiens
aaaactatttaaaattg

SEQ ID NO: 2743262 - DNA, 12 bp, Homo sapiens
aaaagttaagct

SEQ ID NO: 2743263 - DNA, 14 bp, Homo sapiens
aaagcaattttcct

SEQ ID NO: 2743264 - DNA, 21 bp, Homo sapiens
aaagcaattttccttgaagcc

SEQ ID NO: 2743265 - DNA, 22 bp, Homo sapiens
aaagcaattttccttgaagccg

SEQ ID NO: 2743266 - DNA, 20 bp, Homo sapiens
aaagccccatgctggagcct

SEQ ID NO: 2743267 - DNA, 16 bp, Homo sapiens
aaataaaactatttaa

SEQ ID NO: 2743268 - DNA, 12 bp, Homo sapiens
aaataacattgc

SEQ ID NO: 2743269 - DNA, 15 bp, Homo sapiens
aaataacattgcact

SEQ ID NO: 2743270 - DNA, 9 bp, Homo sapiens
aaatatata

SEQ ID NO: 2743271 - DNA, 15 bp, Homo sapiens
aaatatatatatcct

SEQ ID NO: 2743272 - DNA, 15 bp, Homo sapiens
aaattcgtagcaaat

SEQ ID NO: 2743273 - DNA, 13 bp, Homo sapiens
aacagctccttgg

SEQ ID NO: 2743274 - DNA, 15 bp, Homo sapiens
aacagctccttggga

SEQ ID NO: 2743275 - DNA, 18 bp, Homo sapiens
aacagctccttgggagga

SEQ ID NO: 2743276 - DNA, 22 bp, Homo sapiens
aacattgcactttataaacact

SEQ ID NO: 2743277 - DNA, 12 bp, Homo sapiens
aacctcactctt

SEQ ID NO: 2743278 - DNA, 13 bp, Homo sapiens
aacctcactcttg

SEQ ID NO: 2743279 - DNA, 18 bp, Homo sapiens
aacctgtaataaatatga

SEQ ID NO: 2743280 - DNA, 11 bp, Homo sapiens
aagactcctgc

SEQ ID NO: 2743281 - DNA, 17 bp, Homo sapiens
aagcaattttccttgaa

SEQ ID NO: 2743282 - DNA, 22 bp, Homo sapiens
aagcaattttccttgaagccga

SEQ ID NO: 2743283 - DNA, 15 bp, Homo sapiens
aagcagaataaagca

SEQ ID NO: 2743284 - DNA, 16 bp, Homo sapiens
aagcagaataaagcaa

SEQ ID NO: 2743285 - DNA, 19 bp, Homo sapiens
aagcagaataaagcaattt

SEQ ID NO: 2743286 - DNA, 20 bp, Homo sapiens
aagcagaataaagcaatttt

SEQ ID NO: 2743287 - DNA, 21 bp, Homo sapiens
aagccccatgctggagcctgt

SEQ ID NO: 2743288 - DNA, 16 bp, Homo sapiens
aaggaaataacattgc

SEQ ID NO: 2743289 - DNA, 15 bp, Homo sapiens
aaggacctaaattcg

SEQ ID NO: 2743290 - DNA, 16 bp, Homo sapiens
aagtggaaaatgcaat

SEQ ID NO: 2743291 - DNA, 18 bp, Homo sapiens
aagtgtagatgtagcatt

SEQ ID NO: 2743292 - DNA, 19 bp, Homo sapiens
aagtgtagatgtagcattg

SEQ ID NO: 2743293 - DNA, 20 bp, Homo sapiens
aagttaagctgctatagtaa

SEQ ID NO: 2743294 - DNA, 16 bp, Homo sapiens
aagtttctttgcttca

SEQ ID NO: 2743295 - DNA, 24 bp, Homo sapiens
aataaaactatttaaaattggcac

SEQ ID NO: 2743296 - DNA, 16 bp, Homo sapiens
aataaagcaattttcc

SEQ ID NO: 2743297 - DNA, 18 bp, Homo sapiens
aataaagcaattttcctt

SEQ ID NO: 2743298 - DNA, 14 bp, Homo sapiens
aataaatatatata

SEQ ID NO: 2743299 - DNA, 15 bp, Homo sapiens
aataaatatatatat

SEQ ID NO: 2743300 - DNA, 21 bp, Homo sapiens
aataacattgcactttataaa

SEQ ID NO: 2743301 - DNA, 17 bp, Homo sapiens
aatacttgaatatggaa

SEQ ID NO: 2743302 - DNA, 16 bp, Homo sapiens
aatataagtttctttg

SEQ ID NO: 2743303 - DNA, 17 bp, Homo sapiens
aataaagcaattttcct

SEQ ID NO: 2743304 - DNA, 13 bp, Homo sapiens
aataaatatgagt

SEQ ID NO: 2743305 - DNA, 13 bp, Homo sapiens
aataacattgcac

SEQ ID NO: 2743306 - DNA, 18 bp, Homo sapiens
aatatggaacatatgcac

SEQ ID NO: 2743307 - DNA, 12 bp, Homo sapiens
aatatttattgc

SEQ ID NO: 2743308 - DNA, 17 bp, Homo sapiens
aatatttattgctttat

SEQ ID NO: 2743309 - DNA, 12 bp, Homo sapiens
aatcattgtaca

SEQ ID NO: 2743310 - DNA, 17 bp, Homo sapiens
aatcattgtacagtttg

SEQ ID NO: 2743311 - DNA, 18 bp, Homo sapiens
aatcattgtacagtttgt

SEQ ID NO: 2743312 - DNA, 14 bp, Homo sapiens
aatttgtttgtgct

SEQ ID NO: 2743313 - DNA, 16 bp, Homo sapiens
aatttgtttgtgcttc

SEQ ID NO: 2743314 - DNA, 16 bp, Homo sapiens
aattttccttgaagcc

SEQ ID NO: 2743315 - DNA, 19 bp, Homo sapiens
acacacgtgcaatttgttt

SEQ ID NO: 2743316 - DNA, 19 bp, Homo sapiens
acacactgtgctttctatt

SEQ ID NO: 2743317 - DNA, 17 bp, Homo sapiens
acacagaaagcctatca

SEQ ID NO: 2743318 - DNA, 18 bp, Homo sapiens
acacatttaaaacatttg

SEQ ID NO: 2743319 - DNA, 12 bp, Homo sapiens
acaccctgccct

SEQ ID NO: 2743320 - DNA, 23 bp, Homo sapiens
acacgtgcaatttgtttgtgctt

SEQ ID NO: 2743321 - DNA, 21 bp, Homo sapiens
acactggctgccagctatttt

SEQ ID NO: 2743322 - DNA, 22 bp, Homo sapiens
acactggctgccagctattttt

SEQ ID NO: 2743323 - DNA, 23 bp, Homo sapiens
acactgtattgtaagtggaaaat

SEQ ID NO: 2743324 - DNA, 13 bp, Homo sapiens
acagctccttggg

SEQ ID NO: 2743325 - DNA, 14 bp, Homo sapiens
acagctccttggga

SEQ ID NO: 2743326 - DNA, 19 bp, Homo sapiens
acagctccttgggaggaag

SEQ ID NO: 2743327 - DNA, 23 bp, Homo sapiens
acagctccttgggaggaagcaga

SEQ ID NO: 2743328 - DNA, 18 bp, Homo sapiens
acagttggaaatccatcc

SEQ ID NO: 2743329 - DNA, 15 bp, Homo sapiens
acagtttgtttacac

SEQ ID NO: 2743330 - DNA, 20 bp, Homo sapiens
acatcttgatctgctcagcc

SEQ ID NO: 2743331 - DNA, 21 bp, Homo sapiens
acatcttgatctgctcagccc

SEQ ID NO: 2743332 - DNA, 22 bp, Homo sapiens
acatcttgatctgctcagccct

SEQ ID NO: 2743333 - DNA, 18 bp, Homo sapiens
acctcactcttgccaacc

SEQ ID NO: 2743334 - DNA, 16 bp, Homo sapiens
acctgtaataaatatg

SEQ ID NO: 2743335 - DNA, 20 bp, Homo sapiens
acgtgcaatttgtttgtgct

SEQ ID NO: 2743336 - DNA, 11 bp, Homo sapiens
actatttaaaa

SEQ ID NO: 2743337 - DNA, 16 bp, Homo sapiens
actatttaaaattggc

SEQ ID NO: 2743338 - DNA, 16 bp, Homo sapiens
actctgcctgcttaca

SEQ ID NO: 2743339 - DNA, 19 bp, Homo sapiens
actggctgccagctatttt

SEQ ID NO: 2743340 - DNA, 20 bp, Homo sapiens
actggctgccagctattttt

SEQ ID NO: 2743341 - DNA, 11 bp, Homo sapiens
actgtgctttc

SEQ ID NO: 2743342 - DNA, 12 bp, Homo sapiens
actgtgctttct

SEQ ID NO: 2743343 - DNA, 20 bp, Homo sapiens
actgtgctttctattgtaca

SEQ ID NO: 2743344 - DNA, 10 bp, Homo sapiens
acttctccca

SEQ ID NO: 2743345 - DNA, 16 bp, Homo sapiens
acttgaatatggaaca

SEQ ID NO: 2743346 - DNA, 17 bp, Homo sapiens
acttgaatatggaacat

SEQ ID NO: 2743347 - DNA, 14 bp, Homo sapiens
actttataaacact

SEQ ID NO: 2743348 - DNA, 11 bp, Homo sapiens
agaataaagca

SEQ ID NO: 2743349 - DNA, 20 bp, Homo sapiens
agaataaagcaattttcctt

SEQ ID NO: 2743350 - DNA, 19 bp, Homo sapiens
agatgtagcattgttccac

SEQ ID NO: 2743351 - DNA, 22 bp, Homo sapiens
agcaaagccccatgctggagcc

SEQ ID NO: 2743352 - DNA, 23 bp, Homo sapiens
agcaaagccccatgctggagcct

SEQ ID NO: 2743353 - DNA, 12 bp, Homo sapiens
agcaattttcct

SEQ ID NO: 2743354 - DNA, 15 bp, Homo sapiens
agcaattttccttga

SEQ ID NO: 2743355 - DNA, 16 bp, Homo sapiens
agcaattttccttgaa

SEQ ID NO: 2743356 - DNA, 21 bp, Homo sapiens
agcaattttccttgaagccga

SEQ ID NO: 2743357 - DNA, 15 bp, Homo sapiens
agcagctctgtcccc

SEQ ID NO: 2743358 - DNA, 22 bp, Homo sapiens
agcatcctgccttagagccagg

SEQ ID NO: 2743359 - DNA, 14 bp, Homo sapiens
agcattgttccaca

SEQ ID NO: 2743360 - DNA, 23 bp, Homo sapiens
agcattgttccacacatttaaaa

SEQ ID NO: 2743361 - DNA, 13 bp, Homo sapiens
agccagggaaggc

SEQ ID NO: 2743362 - DNA, 17 bp, Homo sapiens
agccccatgctggagcc

SEQ ID NO: 2743363 - DNA, 18 bp, Homo sapiens
agccccatgctggagcct

SEQ ID NO: 2743364 - DNA, 17 bp, Homo sapiens
agccctggaggtgccag

SEQ ID NO: 2743365 - DNA, 21 bp, Homo sapiens
agccctggaggtgccagcaaa

SEQ ID NO: 2743366 - DNA, 22 bp, Homo sapiens
agccctggaggtgccagcaaag

SEQ ID NO: 2743367 - DNA, 17 bp, Homo sapiens
agcctgtgtaacagctc

SEQ ID NO: 2743368 - DNA, 21 bp, Homo sapiens
agccttaccaagactcctgca

SEQ ID NO: 2743369 - DNA, 17 bp, Homo sapiens
aggaaataacattgcac

SEQ ID NO: 2743370 - DNA, 15 bp, Homo sapiens
aggaagcagaataaa

SEQ ID NO: 2743371 - DNA, 16 bp, Homo sapiens
aggaagcagaataaag

SEQ ID NO: 2743372 - DNA, 17 bp, Homo sapiens
aggaagcagaataaagc

SEQ ID NO: 2743373 - DNA, 21 bp, Homo sapiens
aggaagcagaataaagcaatt

SEQ ID NO: 2743374 - DNA, 20 bp, Homo sapiens
aggatgacggtattatgctt

SEQ ID NO: 2743375 - DNA, 14 bp, Homo sapiens
aggcacacactgtg

SEQ ID NO: 2743376 - DNA, 18 bp, Homo sapiens
aggctgtgcttacctgtg

SEQ ID NO: 2743377 - DNA, 18 bp, Homo sapiens
aggtgccagcaaagcccc

SEQ ID NO: 2743378 - DNA, 14 bp, Homo sapiens
agtcttccaaacca

SEQ ID NO: 2743379 - DNA, 16 bp, Homo sapiens
agtggaaaatgcaatg

SEQ ID NO: 2743380 - DNA, 18 bp, Homo sapiens
agtgtagatgtagcattg

SEQ ID NO: 2743381 - DNA, 21 bp, Homo sapiens
agtgtcaaataaacactgtgt

SEQ ID NO: 2743382 - DNA, 23 bp, Homo sapiens
ataaaactatttaaaattggcac

SEQ ID NO: 2743383 - DNA, 18 bp, Homo sapiens
ataaagcaattttccttg

SEQ ID NO: 2743384 - DNA, 19 bp, Homo sapiens
ataaagcaattttccttga

SEQ ID NO: 2743385 - DNA, 21 bp, Homo sapiens
ataaagcaattttccttgaag

SEQ ID NO: 2743386 - DNA, 12 bp, Homo sapiens
ataaataaatat

SEQ ID NO: 2743387 - DNA, 22 bp, Homo sapiens
ataacattgcactttataaaca

SEQ ID NO: 2743388 - DNA, 11 bp, Homo sapiens
atataaatata

SEQ ID NO: 2743389 - DNA, 13 bp, Homo sapiens
atataaatatata

SEQ ID NO: 2743390 - DNA, 21 bp, Homo sapiens
atataaatatatataaatata

SEQ ID NO: 2743391 - DNA, 10 bp, Homo sapiens
atatataaat

SEQ ID NO: 2743392 - DNA, 12 bp, Homo sapiens
atatataaataa

SEQ ID NO: 2743393 - DNA, 17 bp, Homo sapiens
atatataaataaatata

SEQ ID NO: 2743394 - DNA, 12 bp, Homo sapiens
atatatataaat

SEQ ID NO: 2743395 - DNA, 12 bp, Homo sapiens
atatatcctctg

SEQ ID NO: 2743396 - DNA, 13 bp, Homo sapiens
atcaatcattgta

SEQ ID NO: 2743397 - DNA, 17 bp, Homo sapiens
atcaatcattgtacagt

SEQ ID NO: 2743398 - DNA, 19 bp, Homo sapiens
atcaatcattgtacagttt

SEQ ID NO: 2743399 - DNA, 16 bp, Homo sapiens
atcattgtacagtttg

SEQ ID NO: 2743400 - DNA, 12 bp, Homo sapiens
atccacctccat

SEQ ID NO: 2743401 - DNA, 19 bp, Homo sapiens
atccatagtggacattgtt

SEQ ID NO: 2743402 - DNA, 19 bp, Homo sapiens
atcctgccttagagccagg

SEQ ID NO: 2743403 - DNA, 13 bp, Homo sapiens
gtgcttacctgtg

SEQ ID NO: 2743404 - DNA, 16 bp, Homo sapiens
gtgcttacctgtgaca

SEQ ID NO: 2743405 - DNA, 19 bp, Homo sapiens
gtgctttctattgtacaga

SEQ ID NO: 2743406 - DNA, 18 bp, Homo sapiens
gtgggtggatataaatat

SEQ ID NO: 2743407 - DNA, 13 bp, Homo sapiens
gtgtaacagctcc

SEQ ID NO: 2743408 - DNA, 15 bp, Homo sapiens
gtgtaacagctcctt

SEQ ID NO: 2743409 - DNA, 14 bp, Homo sapiens
gtgtgatgctgaca

SEQ ID NO: 2743410 - DNA, 15 bp, Homo sapiens
gttccaataaacagg

SEQ ID NO: 2743411 - DNA, 21 bp, Homo sapiens
gttccacacatttaaaacatt

SEQ ID NO: 2743412 - DNA, 23 bp, Homo sapiens
gtttcagtgtcaaataaacactg

SEQ ID NO: 2743413 - DNA, 14 bp, Homo sapiens
taaaactatttaaa

SEQ ID NO: 2743414 - DNA, 20 bp, Homo sapiens
taaaactatttaaaattggc

SEQ ID NO: 2743415 - DNA, 13 bp, Homo sapiens
taaaattggcacc

SEQ ID NO: 2743416 - DNA, 11 bp, Homo sapiens
taaagcaattt

SEQ ID NO: 2743417 - DNA, 13 bp, Homo sapiens
taaagcaattttc

SEQ ID NO: 2743418 - DNA, 14 bp, Homo sapiens
taaagcaattttcc

SEQ ID NO: 2743419 - DNA, 15 bp, Homo sapiens
taaagcaattttcct

SEQ ID NO: 2743420 - DNA, 21 bp, Homo sapiens
taaagcaattttccttgaagc

SEQ ID NO: 2743421 - DNA, 19 bp, Homo sapiens
taaatatatataaatatat

SEQ ID NO: 2743422 - DNA, 14 bp, Homo sapiens
taatatttattgct

SEQ ID NO: 2743423 - DNA, 16 bp, Homo sapiens
taatatttattgcttt

SEQ ID NO: 2743424 - DNA, 18 bp, Homo sapiens
taatatttattgctttat

SEQ ID NO: 2743425 - DNA, 20 bp, Homo sapiens
taatatttattgctttataa

SEQ ID NO: 2743426 - DNA, 12 bp, Homo sapiens
taccttccagtc

SEQ ID NO: 2743427 - DNA, 12 bp, Homo sapiens
tactagaacaca

SEQ ID NO: 2743428 - DNA, 15 bp, Homo sapiens
tagagccaggcacac

SEQ ID NO: 2743429 - DNA, 15 bp, Homo sapiens
tagcattgttccaca

SEQ ID NO: 2743430 - DNA, 23 bp, Homo sapiens
tagcattgttccacacatttaaa

SEQ ID NO: 2743431 - DNA, 19 bp, Homo sapiens
tataaacactgtattgtaa

SEQ ID NO: 2743432 - DNA, 13 bp, Homo sapiens
tataaatatatat

SEQ ID NO: 2743433 - DNA, 22 bp, Homo sapiens
tatataaataaatatatatatc

SEQ ID NO: 2743434 - DNA, 13 bp, Homo sapiens
tattatgcttctt

SEQ ID NO: 2743435 - DNA, 14 bp, Homo sapiens
tatttaaaattggc

SEQ ID NO: 2743436 - DNA, 14 bp, Homo sapiens
tatttattgcttta

SEQ ID NO: 2743437 - DNA, 19 bp, Homo sapiens
tcaaagaccttgtgtgtat

SEQ ID NO: 2743438 - DNA, 17 bp, Homo sapiens
tcaatacttgaatatgg

SEQ ID NO: 2743439 - DNA, 15 bp, Homo sapiens
tcaatcattgtacag

SEQ ID NO: 2743440 - DNA, 12 bp, Homo sapiens
tcagccctggag

SEQ ID NO: 2743441 - DNA, 21 bp, Homo sapiens
tcaggctgtgcttacctgtga

SEQ ID NO: 2743442 - DNA, 15 bp, Homo sapiens
tcagtgtcaaataaa

SEQ ID NO: 2743443 - DNA, 17 bp, Homo sapiens
tcagtgtcaaataaaca

SEQ ID NO: 2743444 - DNA, 13 bp, Homo sapiens
tccaataaacagg

SEQ ID NO: 2743445 - DNA, 18 bp, Homo sapiens
tccacacatttaaaacat

SEQ ID NO: 2743446 - DNA, 19 bp, Homo sapiens
tccacacatttaaaacatt

SEQ ID NO: 2743447 - DNA, 14 bp, Homo sapiens
tccacctccatctt

SEQ ID NO: 2743448 - DNA, 15 bp, Homo sapiens
tccatcttctttgca

SEQ ID NO: 2743449 - DNA, 12 bp, Homo sapiens
tccttgaagccg

SEQ ID NO: 2743450 - DNA, 15 bp, Homo sapiens
tccttgggaggaagc

SEQ ID NO: 2743451 - DNA, 19 bp, Homo sapiens
tccttgggaggaagcagaa

SEQ ID NO: 2743452 - DNA, 23 bp, Homo sapiens
tccttgggaggaagcagaataaa

SEQ ID NO: 2743453 - DNA, 15 bp, Homo sapiens
tcgggaacctcactc

SEQ ID NO: 2743454 - DNA, 22 bp, Homo sapiens
tcgtgggaaggaggggagcctt

SEQ ID NO: 2743455 - DNA, 20 bp, Homo sapiens
tctaatatttattgctttat

SEQ ID NO: 2743456 - DNA, 22 bp, Homo sapiens
tctaatatttattgctttataa

SEQ ID NO: 2743457 - DNA, 21 bp, Homo sapiens
tctaccttccagtcaggatga

SEQ ID NO: 2743458 - DNA, 15 bp, Homo sapiens
tctcaggctgtgctt

SEQ ID NO: 2743459 - DNA, 20 bp, Homo sapiens
tctcaggctgtgcttacctg

SEQ ID NO: 2743460 - DNA, 13 bp, Homo sapiens
tctcccatgtgtg

SEQ ID NO: 2743461 - DNA, 18 bp, Homo sapiens
tctcccatgtgtgatgct

SEQ ID NO: 2743462 - DNA, 21 bp, Homo sapiens
tctcccatgtgtgatgctgac

SEQ ID NO: 2743463 - DNA, 22 bp, Homo sapiens
tctcccatgtgtgatgctgaca

SEQ ID NO: 2743464 - DNA, 15 bp, Homo sapiens
tctctctcttagcat

SEQ ID NO: 2743465 - DNA, 11 bp, Homo sapiens
tctctggcccc

SEQ ID NO: 2743466 - DNA, 16 bp, Homo sapiens
tctgctcagccctgga

SEQ ID NO: 2743467 - DNA, 17 bp, Homo sapiens
tctgctcagccctggag

SEQ ID NO: 2743468 - DNA, 19 bp, Homo sapiens
tctgctcagccctggaggt

SEQ ID NO: 2743469 - DNA, 14 bp, Homo sapiens
tcttaaataaaact

SEQ ID NO: 2743470 - DNA, 16 bp, Homo sapiens
tcttagcatcctgcct

SEQ ID NO: 2743471 - DNA, 19 bp, Homo sapiens
tcttgatctgctcagccct

SEQ ID NO: 2743472 - DNA, 22 bp, Homo sapiens
tcttgatctgctcagccctgga

SEQ ID NO: 2743473 - DNA, 21 bp, Homo sapiens
tgacagcagctctgtccccac

SEQ ID NO: 2743474 - DNA, 18 bp, Homo sapiens
tgacggtattatgcttct

SEQ ID NO: 2743475 - DNA, 22 bp, Homo sapiens
tgagctctgcatttgtctattc

SEQ ID NO: 2743476 - DNA, 16 bp, Homo sapiens
tgatctgctcagccct

SEQ ID NO: 2743477 - DNA, 23 bp, Homo sapiens
tgcacaggggaaggaaataacat

SEQ ID NO: 2743478 - DNA, 12 bp, Homo sapiens
tgcagcctgggt

SEQ ID NO: 2743479 - DNA, 20 bp, Homo sapiens
tgcatttgtctattctccag

SEQ ID NO: 2743480 - DNA, 20 bp, Homo sapiens
tgccaacctgtaataaatat

SEQ ID NO: 2743481 - DNA, 22 bp, Homo sapiens
tgccaacctgtaataaatatga

SEQ ID NO: 2743482 - DNA, 23 bp, Homo sapiens
tgccaacctgtaataaatatgag

SEQ ID NO: 2743483 - DNA, 14 bp, Homo sapiens
tgccagcaaagccc

SEQ ID NO: 2743484 - DNA, 15 bp, Homo sapiens
tgccagcaaagcccc

SEQ ID NO: 2743485 - DNA, 16 bp, Homo sapiens
tgccagcaaagcccca

SEQ ID NO: 2743486 - DNA, 15 bp, Homo sapiens
tgcccagccagggaa

SEQ ID NO: 2743487 - DNA, 18 bp, Homo sapiens
tgcctcgggaacctcact

SEQ ID NO: 2743488 - DNA, 24 bp, Homo sapiens
tgcctcgggaacctcactcttgcc

SEQ ID NO: 2743489 - DNA, 18 bp, Homo sapiens
tgccttagagccaggcac

SEQ ID NO: 2743490 - DNA, 19 bp, Homo sapiens
tgccttagagccaggcaca

SEQ ID NO: 2743491 - DNA, 11 bp, Homo sapiens
tgctcagccct

SEQ ID NO: 2743492 - DNA, 14 bp, Homo sapiens
tgctcagccctgga

SEQ ID NO: 2743493 - DNA, 16 bp, Homo sapiens
tgctcagccctggagg

SEQ ID NO: 2743494 - DNA, 17 bp, Homo sapiens
tgctgacaccagcggcc

SEQ ID NO: 2743495 - DNA, 17 bp, Homo sapiens
tgctggagcctgtgtaa

SEQ ID NO: 2743496 - DNA, 22 bp, Homo sapiens
tgcttctaatatttattgcttt

SEQ ID NO: 2743497 - DNA, 14 bp, Homo sapiens
tgcttcttggagtc

SEQ ID NO: 2743498 - DNA, 22 bp, Homo sapiens
tggacattgttggcagcataaa

SEQ ID NO: 2743499 - DNA, 12 bp, Homo sapiens
tggagcctgtgt

SEQ ID NO: 2743500 - DNA, 20 bp, Homo sapiens
tggagcctgtgtaacagctc

SEQ ID NO: 2743501 - DNA, 21 bp, Homo sapiens
tggagcctgtgtaacagctcc

SEQ ID NO: 2743502 - DNA, 14 bp, Homo sapiens
tggatataaatata

SEQ ID NO: 2743503 - DNA, 20 bp, Homo sapiens
atataaatatatataaatat

SEQ ID NO: 2743504 - DNA, 13 bp, Homo sapiens
atatataaataaa

SEQ ID NO: 2743505 - DNA, 16 bp, Homo sapiens
atatataaataaatat

SEQ ID NO: 2743506 - DNA, 18 bp, Homo sapiens
atatataaatatatataa

SEQ ID NO: 2743507 - DNA, 14 bp, Homo sapiens
atatatatcctctg

SEQ ID NO: 2743508 - DNA, 11 bp, Homo sapiens
atatcctctgt

SEQ ID NO: 2743509 - DNA, 20 bp, Homo sapiens
atatggaacatatgcacagg

SEQ ID NO: 2743510 - DNA, 13 bp, Homo sapiens
atatttattgctt

SEQ ID NO: 2743511 - DNA, 15 bp, Homo sapiens
atcaatcattgtaca

SEQ ID NO: 2743512 - DNA, 16 bp, Homo sapiens
atcaatcattgtacag

SEQ ID NO: 2743513 - DNA, 21 bp, Homo sapiens
atcaatcattgtacagtttgt

SEQ ID NO: 2743514 - DNA, 22 bp, Homo sapiens
atccacctccatcttctttgca

SEQ ID NO: 2743515 - DNA, 19 bp, Homo sapiens
atccactctgcctgcttac

SEQ ID NO: 2743516 - DNA, 14 bp, Homo sapiens
atctgctcagccct

SEQ ID NO: 2743517 - DNA, 17 bp, Homo sapiens
atctgctcagccctgga

SEQ ID NO: 2743518 - DNA, 19 bp, Homo sapiens
atctgctcagccctggagg

SEQ ID NO: 2743519 - DNA, 14 bp, Homo sapiens
atcttctttgcagc

SEQ ID NO: 2743520 - DNA, 21 bp, Homo sapiens
atcttctttgcagcctgggtg

SEQ ID NO: 2743521 - DNA, 16 bp, Homo sapiens
atcttgatctgctcag

SEQ ID NO: 2743522 - DNA, 21 bp, Homo sapiens
atcttgatctgctcagccctg

SEQ ID NO: 2743523 - DNA, 22 bp, Homo sapiens
atgcaatgtcttaaataaaact

SEQ ID NO: 2743524 - DNA, 23 bp, Homo sapiens
atgcaatgtcttaaataaaacta

SEQ ID NO: 2743525 - DNA, 12 bp, Homo sapiens
atgctggagcct

SEQ ID NO: 2743526 - DNA, 13 bp, Homo sapiens
atgctggagcctg

SEQ ID NO: 2743527 - DNA, 18 bp, Homo sapiens
atgctggagcctgtgtaa

SEQ ID NO: 2743528 - DNA, 22 bp, Homo sapiens
atgctggagcctgtgtaacagc

SEQ ID NO: 2743529 - DNA, 23 bp, Homo sapiens
atgctggagcctgtgtaacagct

SEQ ID NO: 2743530 - DNA, 15 bp, Homo sapiens
gttgccgtctctggc

SEQ ID NO: 2743531 - DNA, 21 bp, Homo sapiens
gtttacacacgtgcaatttgt

SEQ ID NO: 2743532 - DNA, 23 bp, Homo sapiens
taaaaagttaagctgctatagta

SEQ ID NO: 2743533 - DNA, 17 bp, Homo sapiens
taaagcaattttccttg

SEQ ID NO: 2743534 - DNA, 20 bp, Homo sapiens
taaagcaattttccttgaag

SEQ ID NO: 2743535 - DNA, 12 bp, Homo sapiens
taaataaatata

SEQ ID NO: 2743536 - DNA, 14 bp, Homo sapiens
taaataaatatata

SEQ ID NO: 2743537 - DNA, 15 bp, Homo sapiens
taaataaatatatat

SEQ ID NO: 2743538 - DNA, 14 bp, Homo sapiens
taaatatatataaa

SEQ ID NO: 2743539 - DNA, 17 bp, Homo sapiens
taaatatatataaatat

SEQ ID NO: 2743540 - DNA, 18 bp, Homo sapiens
taaatatatataaatata

SEQ ID NO: 2743541 - DNA, 11 bp, Homo sapiens
taacagctcct

SEQ ID NO: 2743542 - DNA, 16 bp, Homo sapiens
taacagctccttggga

SEQ ID NO: 2743543 - DNA, 17 bp, Homo sapiens
taacagctccttgggag

SEQ ID NO: 2743544 - DNA, 16 bp, Homo sapiens
tacagtttgtttacac

SEQ ID NO: 2743545 - DNA, 14 bp, Homo sapiens
taccaagactcctg

SEQ ID NO: 2743546 - DNA, 16 bp, Homo sapiens
taccaagactcctgca

SEQ ID NO: 2743547 - DNA, 18 bp, Homo sapiens
tactagaacacagaaagc

SEQ ID NO: 2743548 - DNA, 15 bp, Homo sapiens
tagaacacagaaagc

SEQ ID NO: 2743549 - DNA, 12 bp, Homo sapiens
tagagccaggca

SEQ ID NO: 2743550 - DNA, 19 bp, Homo sapiens
tagagccaggcacacactg

SEQ ID NO: 2743551 - DNA, 12 bp, Homo sapiens
tagatgtagcat

SEQ ID NO: 2743552 - DNA, 12 bp, Homo sapiens
tataaataaata

SEQ ID NO: 2743553 - DNA, 13 bp, Homo sapiens
tataaataaatat

SEQ ID NO: 2743554 - DNA, 23 bp, Homo sapiens
tataaatatatataaatatatat

SEQ ID NO: 2743555 - DNA, 17 bp, Homo sapiens
aaattctgtggcagttt

SEQ ID NO: 2743556 - DNA, 14 bp, Homo sapiens
aacactgtattgta

SEQ ID NO: 2743557 - DNA, 16 bp, Homo sapiens
aacctcactcttgcca

SEQ ID NO: 2743558 - DNA, 13 bp, Homo sapiens
aacctgtaataaa

SEQ ID NO: 2743559 - DNA, 14 bp, Homo sapiens
aacctgtaataaat

SEQ ID NO: 2743560 - DNA, 16 bp, Homo sapiens
aacctgtaataaatat

SEQ ID NO: 2743561 - DNA, 20 bp, Homo sapiens
aactatttaaaattggcacc

SEQ ID NO: 2743562 - DNA, 12 bp, Homo sapiens
aagactcctgca

SEQ ID NO: 2743563 - DNA, 13 bp, Homo sapiens
aagcaattttcct

SEQ ID NO: 2743564 - DNA, 14 bp, Homo sapiens
aagcaattttcctt

SEQ ID NO: 2743565 - DNA, 16 bp, Homo sapiens
aagcaattttccttga

SEQ ID NO: 2743566 - DNA, 18 bp, Homo sapiens
aagcaattttccttgaag

SEQ ID NO: 2743567 - DNA, 12 bp, Homo sapiens
aagcagaataaa

SEQ ID NO: 2743568 - DNA, 17 bp, Homo sapiens
aagcagaataaagcaat

SEQ ID NO: 2743569 - DNA, 21 bp, Homo sapiens
aagcagaataaagcaattttc

SEQ ID NO: 2743570 - DNA, 23 bp, Homo sapiens
aagcagaataaagcaattttcct

SEQ ID NO: 2743571 - DNA, 23 bp, Homo sapiens
aagccccatgctggagcctgtgt

SEQ ID NO: 2743572 - DNA, 21 bp, Homo sapiens
aagcctatcaaagaccttgtg

SEQ ID NO: 2743573 - DNA, 17 bp, Homo sapiens
aagtgtagatgtagcat

SEQ ID NO: 2743574 - DNA, 14 bp, Homo sapiens
aataaaactattta

SEQ ID NO: 2743575 - DNA, 15 bp, Homo sapiens
aataaaactatttaa

SEQ ID NO: 2743576 - DNA, 13 bp, Homo sapiens
aataaacactgtg

SEQ ID NO: 2743577 - DNA, 13 bp, Homo sapiens
aataaagcaattt

SEQ ID NO: 2743578 - DNA, 23 bp, Homo sapiens
aataaagcaattttccttgaagc

SEQ ID NO: 2743579 - DNA, 24 bp, Homo sapiens
aataaagcaattttccttgaagcc

SEQ ID NO: 2743580 - DNA, 11 bp, Homo sapiens
aataaatatat

SEQ ID NO: 2743581 - DNA, 11 bp, Homo sapiens
aataaatatga

SEQ ID NO: 2743582 - DNA, 12 bp, Homo sapiens
aataacattgca

SEQ ID NO: 2743583 - DNA, 14 bp, Homo sapiens
aataacattgcact

SEQ ID NO: 2743584 - DNA, 17 bp, Homo sapiens
aatataagtttctttgc

SEQ ID NO: 2743585 - DNA, 13 bp, Homo sapiens
aatatttattgct

SEQ ID NO: 2743586 - DNA, 15 bp, Homo sapiens
aatatttattgcttt

SEQ ID NO: 2743587 - DNA, 16 bp, Homo sapiens
aatatttattgcttta

SEQ ID NO: 2743588 - DNA, 14 bp, Homo sapiens
aattttccttgaag

SEQ ID NO: 2743589 - DNA, 14 bp, Homo sapiens
acactgtgctttct

SEQ ID NO: 2743590 - DNA, 21 bp, Homo sapiens
acagctccttgggaggaagca

SEQ ID NO: 2743591 - DNA, 16 bp, Homo sapiens
acagtttgtttacaca

SEQ ID NO: 2743592 - DNA, 22 bp, Homo sapiens
acagtttgtttacacacgtgca

SEQ ID NO: 2743593 - DNA, 15 bp, Homo sapiens
acatatgcacagggg

SEQ ID NO: 2743594 - DNA, 14 bp, Homo sapiens
acatcttgatctgc

SEQ ID NO: 2743595 - DNA, 14 bp, Homo sapiens
acatttaaaacatt

SEQ ID NO: 2743596 - DNA, 18 bp, Homo sapiens
acatttaaaacatttgaa

SEQ ID NO: 2743597 - DNA, 14 bp, Homo sapiens
accaagactcctgc

SEQ ID NO: 2743598 - DNA, 10 bp, Homo sapiens
acctccatct

SEQ ID NO: 2743599 - DNA, 17 bp, Homo sapiens
acctgtaataaatatga

SEQ ID NO: 2743600 - DNA, 23 bp, Homo sapiens
acctgtaataaatatgagtgcca

SEQ ID NO: 2743601 - DNA, 14 bp, Homo sapiens
acctgtgacagcag

SEQ ID NO: 2743602 - DNA, 17 bp, Homo sapiens
acctgtgacagcagctc

SEQ ID NO: 2743603 - DNA, 18 bp, Homo sapiens
accttgtgtgtatgtgta

SEQ ID NO: 2743604 - DNA, 15 bp, Homo sapiens
acgtctcatctccca

SEQ ID NO: 2743605 - DNA, 22 bp, Homo sapiens
actatccatagtggacattgtt

SEQ ID NO: 2743606 - DNA, 17 bp, Homo sapiens
actatttaaaattggca

SEQ ID NO: 2743607 - DNA, 21 bp, Homo sapiens
actgtgctttctattgtacag

SEQ ID NO: 2743608 - DNA, 23 bp, Homo sapiens
agaataaagcaattttccttgaa

SEQ ID NO: 2743609 - DNA, 20 bp, Homo sapiens
agacactggctgccagctat

SEQ ID NO: 2743610 - DNA, 18 bp, Homo sapiens
agaccttgtgtgtatgtg

SEQ ID NO: 2743611 - DNA, 19 bp, Homo sapiens
agagccaggcacacactgt

SEQ ID NO: 2743612 - DNA, 20 bp, Homo sapiens
agagccaggcacacactgtg

SEQ ID NO: 2743613 - DNA, 12 bp, Homo sapiens
agatgtagcatt

SEQ ID NO: 2743614 - DNA, 15 bp, Homo sapiens
agatgtagcattgtt

SEQ ID NO: 2743615 - DNA, 13 bp, Homo sapiens
agcaattttcctt

SEQ ID NO: 2743616 - DNA, 14 bp, Homo sapiens
agcaattttccttg

SEQ ID NO: 2743617 - DNA, 20 bp, Homo sapiens
agcaattttccttgaagccg

SEQ ID NO: 2743618 - DNA, 12 bp, Homo sapiens
agcagaataaag

SEQ ID NO: 2743619 - DNA, 22 bp, Homo sapiens
agcagaataaagcaattttcct

SEQ ID NO: 2743620 - DNA, 23 bp, Homo sapiens
agcagaataaagcaattttcctt

SEQ ID NO: 2743621 - DNA, 23 bp, Homo sapiens
agcagctctgtccccaccccatg

SEQ ID NO: 2743622 - DNA, 15 bp, Homo sapiens
agcattgttccacac

SEQ ID NO: 2743623 - DNA, 11 bp, Homo sapiens
agccaggcaca

SEQ ID NO: 2743624 - DNA, 17 bp, Homo sapiens
agccaggcacacactgt

SEQ ID NO: 2743625 - DNA, 18 bp, Homo sapiens
agccaggcacacactgtg

SEQ ID NO: 2743626 - DNA, 20 bp, Homo sapiens
agccaggcacacactgtgct

SEQ ID NO: 2743627 - DNA, 15 bp, Homo sapiens
agccagggaaggctg

SEQ ID NO: 2743628 - DNA, 19 bp, Homo sapiens
agccccatgctggagcctg

SEQ ID NO: 2743629 - DNA, 13 bp, Homo sapiens
agcctgtgtaaca

SEQ ID NO: 2743630 - DNA, 20 bp, Homo sapiens
agcctgtgtaacagctcctt

SEQ ID NO: 2743631 - DNA, 21 bp, Homo sapiens
agctatttttactagaacaca

SEQ ID NO: 2743632 - DNA, 17 bp, Homo sapiens
agctccttgggaggaag

SEQ ID NO: 2743633 - DNA, 18 bp, Homo sapiens
agctccttgggaggaagc

SEQ ID NO: 2743634 - DNA, 19 bp, Homo sapiens
agctccttgggaggaagca

SEQ ID NO: 2743635 - DNA, 20 bp, Homo sapiens
agctccttgggaggaagcag

SEQ ID NO: 2743636 - DNA, 23 bp, Homo sapiens
agctctgtccccaccccatgggc

SEQ ID NO: 2743637 - DNA, 23 bp, Homo sapiens
aggatgacggtattatgcttctt

SEQ ID NO: 2743638 - DNA, 15 bp, Homo sapiens
catcaatcattgtac

SEQ ID NO: 2743639 - DNA, 16 bp, Homo sapiens
catcaatcattgtaca

SEQ ID NO: 2743640 - DNA, 22 bp, Homo sapiens
catctcccatgtgtgatgctga

SEQ ID NO: 2743641 - DNA, 21 bp, Homo sapiens
catctttcatcaatcattgta

SEQ ID NO: 2743642 - DNA, 22 bp, Homo sapiens
catctttcatcaatcattgtac

SEQ ID NO: 2743643 - DNA, 16 bp, Homo sapiens
catgctggagcctgtg

SEQ ID NO: 2743644 - DNA, 22 bp, Homo sapiens
catgctggagcctgtgtaacag

SEQ ID NO: 2743645 - DNA, 15 bp, Homo sapiens
catgtgtgatgctga

SEQ ID NO: 2743646 - DNA, 16 bp, Homo sapiens
catgtgtgatgctgac

SEQ ID NO: 2743647 - DNA, 17 bp, Homo sapiens
catgtgtgatgctgaca

SEQ ID NO: 2743648 - DNA, 20 bp, Homo sapiens
catgtgtgatgctgacacca

SEQ ID NO: 2743649 - DNA, 12 bp, Homo sapiens
cattgttccaca

SEQ ID NO: 2743650 - DNA, 13 bp, Homo sapiens
cattgttggcagc

SEQ ID NO: 2743651 - DNA, 17 bp, Homo sapiens
ccaacctgtaataaata

SEQ ID NO: 2743652 - DNA, 19 bp, Homo sapiens
ccaacctgtaataaatatg

SEQ ID NO: 2743653 - DNA, 12 bp, Homo sapiens
ccacacatttaa

SEQ ID NO: 2743654 - DNA, 22 bp, Homo sapiens
ccagcaaagccccatgctggag

SEQ ID NO: 2743655 - DNA, 19 bp, Homo sapiens
ccagctatttttactagaa

SEQ ID NO: 2743656 - DNA, 21 bp, Homo sapiens
ccagctatttttactagaaca

SEQ ID NO: 2743657 - DNA, 22 bp, Homo sapiens
ccagctgaccctggttctctct

SEQ ID NO: 2743658 - DNA, 12 bp, Homo sapiens
ccatccagaggc

SEQ ID NO: 2743659 - DNA, 13 bp, Homo sapiens
ccatctaccttcc

SEQ ID NO: 2743660 - DNA, 14 bp, Homo sapiens
ccatctaccttcca

SEQ ID NO: 2743661 - DNA, 14 bp, Homo sapiens
ccatgctggagcct

SEQ ID NO: 2743662 - DNA, 15 bp, Homo sapiens
ccatgctggagcctg

SEQ ID NO: 2743663 - DNA, 21 bp, Homo sapiens
ccatgctggagcctgtgtaac

SEQ ID NO: 2743664 - DNA, 21 bp, Homo sapiens
ccatgtgtgatgctgacacca

SEQ ID NO: 2743665 - DNA, 22 bp, Homo sapiens
ccatgtgtgatgctgacaccag

SEQ ID NO: 2743666 - DNA, 16 bp, Homo sapiens
cccatgtgtgatgctg

SEQ ID NO: 2743667 - DNA, 21 bp, Homo sapiens
cccatgtgtgatgctgacacc

SEQ ID NO: 2743668 - DNA, 22 bp, Homo sapiens
cccatgtgtgatgctgacacca

SEQ ID NO: 2743669 - DNA, 15 bp, Homo sapiens
cccatttatccacct

SEQ ID NO: 2743670 - DNA, 16 bp, Homo sapiens
ccccatgctggagcct

SEQ ID NO: 2743671 - DNA, 18 bp, Homo sapiens
ccccatgctggagcctgt

SEQ ID NO: 2743672 - DNA, 20 bp, Homo sapiens
ccccatgctggagcctgtgt

SEQ ID NO: 2743673 - DNA, 23 bp, Homo sapiens
ccccatgctggagcctgtgtaac

SEQ ID NO: 2743674 - DNA, 23 bp, Homo sapiens
ccccatgggcctcatgaataaat

SEQ ID NO: 2743675 - DNA, 21 bp, Homo sapiens
ccccatttatccacctccatc

SEQ ID NO: 2743676 - DNA, 13 bp, Homo sapiens
ccctgccctcatc

SEQ ID NO: 2743677 - DNA, 18 bp, Homo sapiens
ccctgccctcatctctct

SEQ ID NO: 2743678 - DNA, 13 bp, Homo sapiens
ccctggaggtgcc

SEQ ID NO: 2743679 - DNA, 14 bp, Homo sapiens
ccctggaggtgcca

SEQ ID NO: 2743680 - DNA, 20 bp, Homo sapiens
ccctggaggtgccagcaaag

SEQ ID NO: 2743681 - DNA, 23 bp, Homo sapiens
ccctggaggtgccagcaaagccc

SEQ ID NO: 2743682 - DNA, 17 bp, Homo sapiens
cctcatctttcatcaat

SEQ ID NO: 2743683 - DNA, 14 bp, Homo sapiens
cctcatgaataaat

SEQ ID NO: 2743684 - DNA, 17 bp, Homo sapiens
cctcgggaacctcactc

SEQ ID NO: 2743685 - DNA, 23 bp, Homo sapiens
cctcgggaacctcactcttgcca

SEQ ID NO: 2743686 - DNA, 17 bp, Homo sapiens
cctctcaggctgtgctt

SEQ ID NO: 2743687 - DNA, 19 bp, Homo sapiens
cctgccttagagccaggca

SEQ ID NO: 2743688 - DNA, 20 bp, Homo sapiens
cctgccttagagccaggcac

SEQ ID NO: 2743689 - DNA, 21 bp, Homo sapiens
cctgccttagagccaggcaca

SEQ ID NO: 2743690 - DNA, 13 bp, Homo sapiens
cctggaggtgcca

SEQ ID NO: 2743691 - DNA, 21 bp, Homo sapiens
cctggaggtgccagcaaagcc

SEQ ID NO: 2743692 - DNA, 19 bp, Homo sapiens
cctggagtcgtgggaagga

SEQ ID NO: 2743693 - DNA, 23 bp, Homo sapiens
cctgtgacagcagctctgtcccc

SEQ ID NO: 2743694 - DNA, 17 bp, Homo sapiens
cctgtgtaacagctcct

SEQ ID NO: 2743695 - DNA, 17 bp, Homo sapiens
ccttagagccaggcaca

SEQ ID NO: 2743696 - DNA, 20 bp, Homo sapiens
ccttttttggctttagacac

SEQ ID NO: 2743697 - DNA, 21 bp, Homo sapiens
cgccctgggctcgtctttgca

SEQ ID NO: 2743698 - DNA, 14 bp, Homo sapiens
cgggaacctcactc

SEQ ID NO: 2743699 - DNA, 20 bp, Homo sapiens
cgggaacctcactcttgcca

SEQ ID NO: 2743700 - DNA, 13 bp, Homo sapiens
cgtctctggcccc

SEQ ID NO: 2743701 - DNA, 10 bp, Homo sapiens
cgtctttgca

SEQ ID NO: 2743702 - DNA, 23 bp, Homo sapiens
cgtggttgccgtctctggcccct

SEQ ID NO: 2743703 - DNA, 22 bp, Homo sapiens
cgtgtgtgggtggatataaata

SEQ ID NO: 2743704 - DNA, 18 bp, Homo sapiens
ctaatatttattgcttta

SEQ ID NO: 2743705 - DNA, 21 bp, Homo sapiens
ctacagttggaaatccatcca

SEQ ID NO: 2743706 - DNA, 16 bp, Homo sapiens
ctagaacacagaaagc

SEQ ID NO: 2743707 - DNA, 16 bp, Homo sapiens
ctatttaaaattggca

SEQ ID NO: 2743708 - DNA, 18 bp, Homo sapiens
ctatttttactagaacac

SEQ ID NO: 2743709 - DNA, 14 bp, Homo sapiens
ctcactcttgccaa

SEQ ID NO: 2743710 - DNA, 12 bp, Homo sapiens
ctcagccctgga

SEQ ID NO: 2743711 - DNA, 13 bp, Homo sapiens
ctcagccctggag

SEQ ID NO: 2743712 - DNA, 14 bp, Homo sapiens
ctcagccctggagg

SEQ ID NO: 2743713 - DNA, 15 bp, Homo sapiens
ctcagccctggaggt

SEQ ID NO: 2743714 - DNA, 19 bp, Homo sapiens
ctcagccctggaggtgcca

SEQ ID NO: 2743715 - DNA, 20 bp, Homo sapiens
ctcagccctggaggtgccag

SEQ ID NO: 2743716 - DNA, 17 bp, Homo sapiens
ctcaggctgtgcttacc

SEQ ID NO: 2743717 - DNA, 22 bp, Homo sapiens
ctcccatgtgtgatgctgacac

SEQ ID NO: 2743718 - DNA, 18 bp, Homo sapiens
ctccttgggaggaagcag

SEQ ID NO: 2743719 - DNA, 21 bp, Homo sapiens
ctcgtgcccagccagggaagg

SEQ ID NO: 2743720 - DNA, 17 bp, Homo sapiens
ctctccacgtggttgcc

SEQ ID NO: 2743721 - DNA, 22 bp, Homo sapiens
ctctgcatttgtctattctcca

SEQ ID NO: 2743722 - DNA, 20 bp, Homo sapiens
ctctggcccctctcaggctg

SEQ ID NO: 2743723 - DNA, 23 bp, Homo sapiens
ctcttgccaacctgtaataaata

SEQ ID NO: 2743724 - DNA, 21 bp, Homo sapiens
ctgccccatttatccacctcc

SEQ ID NO: 2743725 - DNA, 15 bp, Homo sapiens
ctgccttagagccag

SEQ ID NO: 2743726 - DNA, 17 bp, Homo sapiens
ctgctcagccctggagg

SEQ ID NO: 2743727 - DNA, 21 bp, Homo sapiens
ctgctcagccctggaggtgcc

SEQ ID NO: 2743728 - DNA, 17 bp, Homo sapiens
ctgctgcgccctgggct

SEQ ID NO: 2743729 - DNA, 19 bp, Homo sapiens
ctggagcctgtgtaacagc

SEQ ID NO: 2743730 - DNA, 13 bp, Homo sapiens
ctggaggtgccag

SEQ ID NO: 2743731 - DNA, 16 bp, Homo sapiens
ctggctgccagctatt

SEQ ID NO: 2743732 - DNA, 16 bp, Homo sapiens
ctgtaataaatatgag

SEQ ID NO: 2743733 - DNA, 22 bp, Homo sapiens
ctgtgacagcagctctgtcccc

SEQ ID NO: 2743734 - DNA, 12 bp, Homo sapiens
ctgtgctttcta

SEQ ID NO: 2743735 - DNA, 15 bp, Homo sapiens
ctgtgctttctattg

SEQ ID NO: 2743736 - DNA, 21 bp, Homo sapiens
gggaggaagcagaataaagca

SEQ ID NO: 2743737 - DNA, 23 bp, Homo sapiens
gggaggaagcagaataaagcaat

SEQ ID NO: 2743738 - DNA, 14 bp, Homo sapiens
gggtggatataaat

SEQ ID NO: 2743739 - DNA, 21 bp, Homo sapiens
gggtggatataaatatatata

SEQ ID NO: 2743740 - DNA, 15 bp, Homo sapiens
ggtgccagcaaagcc

SEQ ID NO: 2743741 - DNA, 17 bp, Homo sapiens
ggtgccagcaaagcccc

SEQ ID NO: 2743742 - DNA, 19 bp, Homo sapiens
ggtgccagcaaagccccat

SEQ ID NO: 2743743 - DNA, 15 bp, Homo sapiens
ggtggatataaatat

SEQ ID NO: 2743744 - DNA, 20 bp, Homo sapiens
ggttgccgtctctggcccct

SEQ ID NO: 2743745 - DNA, 13 bp, Homo sapiens
gtaacagctcctt

SEQ ID NO: 2743746 - DNA, 17 bp, Homo sapiens
gtaacagctccttggga

SEQ ID NO: 2743747 - DNA, 14 bp, Homo sapiens
gtaagttactgggc

SEQ ID NO: 2743748 - DNA, 11 bp, Homo sapiens
gtaataaatat

SEQ ID NO: 2743749 - DNA, 12 bp, Homo sapiens
gtaataaatatg

SEQ ID NO: 2743750 - DNA, 14 bp, Homo sapiens
gtaataaatatgag

SEQ ID NO: 2743751 - DNA, 19 bp, Homo sapiens
gtacagtttgtttacacac

SEQ ID NO: 2743752 - DNA, 13 bp, Homo sapiens
gtagatgtagcat

SEQ ID NO: 2743753 - DNA, 14 bp, Homo sapiens
gtagatgtagcatt

SEQ ID NO: 2743754 - DNA, 18 bp, Homo sapiens
gtagatgtagcattgttc

SEQ ID NO: 2743755 - DNA, 20 bp, Homo sapiens
gtagcattgttccacacatt

SEQ ID NO: 2743756 - DNA, 16 bp, Homo sapiens
gtccccaccccatggg

SEQ ID NO: 2743757 - DNA, 13 bp, Homo sapiens
gtctcatctccca

SEQ ID NO: 2743758 - DNA, 12 bp, Homo sapiens
gtctctggcccc

SEQ ID NO: 2743759 - DNA, 14 bp, Homo sapiens
gtgatgctgacacc

SEQ ID NO: 2743760 - DNA, 20 bp, Homo sapiens
gtgatgctgacaccagcggc

SEQ ID NO: 2743761 - DNA, 16 bp, Homo sapiens
gtgccagcaaagcccc

SEQ ID NO: 2743762 - DNA, 17 bp, Homo sapiens
gtgctttctattgtaca

SEQ ID NO: 2743763 - DNA, 20 bp, Homo sapiens
gtgctttctattgtacagaa

SEQ ID NO: 2743764 - DNA, 13 bp, Homo sapiens
gtggatataaata

SEQ ID NO: 2743765 - DNA, 16 bp, Homo sapiens
gtggatataaatatat

SEQ ID NO: 2743766 - DNA, 18 bp, Homo sapiens
gtgtagatgtagcattgt

SEQ ID NO: 2743767 - DNA, 19 bp, Homo sapiens
gtgtagatgtagcattgtt

SEQ ID NO: 2743768 - DNA, 17 bp, Homo sapiens
gtgtcaaataaacactg

SEQ ID NO: 2743769 - DNA, 19 bp, Homo sapiens
gtgtcaaataaacactgtg

SEQ ID NO: 2743770 - DNA, 21 bp, Homo sapiens
gtgtgtgggtggatataaata

SEQ ID NO: 2743771 - DNA, 14 bp, Homo sapiens
gttccaataaacag

SEQ ID NO: 2743772 - DNA, 13 bp, Homo sapiens
gtttgtgcttcta

SEQ ID NO: 2743773 - DNA, 15 bp, Homo sapiens
taaaactatttaaaa

SEQ ID NO: 2743774 - DNA, 17 bp, Homo sapiens
taaaactatttaaaatt

SEQ ID NO: 2743775 - DNA, 19 bp, Homo sapiens
taaaactatttaaaattgg

SEQ ID NO: 2743776 - DNA, 16 bp, Homo sapiens
taaacactgtattgta

SEQ ID NO: 2743777 - DNA, 12 bp, Homo sapiens
taaagcaatttt

SEQ ID NO: 2743778 - DNA, 16 bp, Homo sapiens
taaagcaattttcctt

SEQ ID NO: 2743779 - DNA, 19 bp, Homo sapiens
taaagcaattttccttgaa

SEQ ID NO: 2743780 - DNA, 23 bp, Homo sapiens
taaagcaattttccttgaagccg

SEQ ID NO: 2743781 - DNA, 12 bp, Homo sapiens
taaataaaacta

SEQ ID NO: 2743782 - DNA, 15 bp, Homo sapiens
taaataaaactattt

SEQ ID NO: 2743783 - DNA, 13 bp, Homo sapiens
taaataaatatat

SEQ ID NO: 2743784 - DNA, 11 bp, Homo sapiens
taaatatatat

SEQ ID NO: 2743785 - DNA, 15 bp, Homo sapiens
taacagctccttggg

SEQ ID NO: 2743786 - DNA, 20 bp, Homo sapiens
taacagctccttgggaggaa

SEQ ID NO: 2743787 - DNA, 22 bp, Homo sapiens
taacagctccttgggaggaagc

SEQ ID NO: 2743788 - DNA, 23 bp, Homo sapiens
taacagctccttgggaggaagca

SEQ ID NO: 2743789 - DNA, 22 bp, Homo sapiens
taatataagtttctttgcttca

SEQ ID NO: 2743790 - DNA, 15 bp, Homo sapiens
taatatttattgctt

SEQ ID NO: 2743791 - DNA, 16 bp, Homo sapiens
tacacacgtgcaattt

SEQ ID NO: 2743792 - DNA, 23 bp, Homo sapiens
tacacacgtgcaatttgtttgtg

SEQ ID NO: 2743793 - DNA, 19 bp, Homo sapiens
tacagttggaaatccatcc

SEQ ID NO: 2743794 - DNA, 22 bp, Homo sapiens
tacctgtgacagcagctctgtc

SEQ ID NO: 2743795 - DNA, 14 bp, Homo sapiens
tagaacacagaaag

SEQ ID NO: 2743796 - DNA, 17 bp, Homo sapiens
tagacactggctgccag

SEQ ID NO: 2743797 - DNA, 19 bp, Homo sapiens
tagacactggctgccagct

SEQ ID NO: 2743798 - DNA, 22 bp, Homo sapiens
tagacactggctgccagctatt

SEQ ID NO: 2743799 - DNA, 21 bp, Homo sapiens
tagagccaggcacacactgtg

SEQ ID NO: 2743800 - DNA, 15 bp, Homo sapiens
tagatgtagcattgt

SEQ ID NO: 2743801 - DNA, 16 bp, Homo sapiens
tagatgtagcattgtt

SEQ ID NO: 2743802 - DNA, 16 bp, Homo sapiens
tagcattgttccacac

SEQ ID NO: 2743803 - DNA, 18 bp, Homo sapiens
tataaacactgtattgta

SEQ ID NO: 2743804 - DNA, 16 bp, Homo sapiens
tataaataaatatata

SEQ ID NO: 2743805 - DNA, 17 bp, Homo sapiens
tataaataaatatatat

SEQ ID NO: 2743806 - DNA, 18 bp, Homo sapiens
tataaataaatatatata

SEQ ID NO: 2743807 - DNA, 14 bp, Homo sapiens
tataaatatatata

SEQ ID NO: 2743808 - DNA, 17 bp, Homo sapiens
tataaatatatataaat

SEQ ID NO: 2743809 - DNA, 19 bp, Homo sapiens
tataaatatatataaatat

SEQ ID NO: 2743810 - DNA, 22 bp, Homo sapiens
tataaatatatataaatatata

SEQ ID NO: 2743811 - DNA, 11 bp, Homo sapiens
tatataaataa

SEQ ID NO: 2743812 - DNA, 18 bp, Homo sapiens
tatataaataaatatata

SEQ ID NO: 2743813 - DNA, 20 bp, Homo sapiens
tatataaatatatataaata

SEQ ID NO: 2743814 - DNA, 14 bp, Homo sapiens
tattatgcttcttg

SEQ ID NO: 2743815 - DNA, 11 bp, Homo sapiens
tcaaataaaca

SEQ ID NO: 2743816 - DNA, 16 bp, Homo sapiens
tcaaataaacactgtg

SEQ ID NO: 2743817 - DNA, 22 bp, Homo sapiens
tcaatacttgaatatggaacat

SEQ ID NO: 2743818 - DNA, 14 bp, Homo sapiens
tcaatcattgtaca

SEQ ID NO: 2743819 - DNA, 18 bp, Homo sapiens
tcaatcattgtacagttt

SEQ ID NO: 2743820 - DNA, 16 bp, Homo sapiens
tcactcttgccaacct

SEQ ID NO: 2743821 - DNA, 19 bp, Homo sapiens
tcattgtacagtttgttta

SEQ ID NO: 2743822 - DNA, 14 bp, Homo sapiens
tccacacatttaaa

SEQ ID NO: 2743823 - DNA, 20 bp, Homo sapiens
tcccatgtgtgatgctgaca

SEQ ID NO: 2743824 - DNA, 22 bp, Homo sapiens
tcccatgtgtgatgctgacacc

SEQ ID NO: 2743825 - DNA, 17 bp, Homo sapiens
tccttgggaggaagcag

SEQ ID NO: 2743826 - DNA, 20 bp, Homo sapiens
tccttgggaggaagcagaat

SEQ ID NO: 2743827 - DNA, 15 bp, Homo sapiens
tctgcatttgtctat

SEQ ID NO: 2743828 - DNA, 13 bp, Homo sapiens
tctgctcagccct

SEQ ID NO: 2743829 - DNA, 14 bp, Homo sapiens
tctgctcagccctg

SEQ ID NO: 2743830 - DNA, 16 bp, Homo sapiens
tcttaaataaaactat

SEQ ID NO: 2743831 - DNA, 23 bp, Homo sapiens
tcttgccaacctgtaataaatat

SEQ ID NO: 2743832 - DNA, 19 bp, Homo sapiens
tgacagcagctctgtcccc

SEQ ID NO: 2743833 - DNA, 20 bp, Homo sapiens
tgatctgctcagccctggag

SEQ ID NO: 2743834 - DNA, 13 bp, Homo sapiens
tgatgctgacacc

SEQ ID NO: 2743835 - DNA, 15 bp, Homo sapiens
tgatgctgacaccag

SEQ ID NO: 2743836 - DNA, 21 bp, Homo sapiens
tgcaatgtcttaaataaaact

SEQ ID NO: 2743837 - DNA, 21 bp, Homo sapiens
tgcaatttgtttgtgcttcta

SEQ ID NO: 2743838 - DNA, 17 bp, Homo sapiens
tgcacaggggaaggaaa

SEQ ID NO: 2743839 - DNA, 16 bp, Homo sapiens
tgcatttgtctattct

SEQ ID NO: 2743840 - DNA, 19 bp, Homo sapiens
tgcatttgtctattctcca

SEQ ID NO: 2743841 - DNA, 21 bp, Homo sapiens
tgccacatcttgatctgctca

SEQ ID NO: 2743842 - DNA, 24 bp, Homo sapiens
tgccagcaaagccccatgctggag

SEQ ID NO: 2743843 - DNA, 18 bp, Homo sapiens
tgcccagccagggaaggc

SEQ ID NO: 2743844 - DNA, 23 bp, Homo sapiens
tgcctcgggaacctcactcttgc

SEQ ID NO: 2743845 - DNA, 23 bp, Homo sapiens
tgccttagagccaggcacacact

SEQ ID NO: 2743846 - DNA, 14 bp, Homo sapiens
tgcgccctgggctc

SEQ ID NO: 2743847 - DNA, 13 bp, Homo sapiens
tgctcagccctgg

SEQ ID NO: 2743848 - DNA, 15 bp, Homo sapiens
tgctcagccctggag

SEQ ID NO: 2743849 - DNA, 20 bp, Homo sapiens
tgctcagccctggaggtgcc

SEQ ID NO: 2743850 - DNA, 23 bp, Homo sapiens
tgctcagccctggaggtgccagc

SEQ ID NO: 2743851 - DNA, 17 bp, Homo sapiens
tgctgcgccctgggctc

SEQ ID NO: 2743852 - DNA, 14 bp, Homo sapiens
tgctggagcctgtg

SEQ ID NO: 2743853 - DNA, 19 bp, Homo sapiens
tgctggagcctgtgtaaca

SEQ ID NO: 2743854 - DNA, 21 bp, Homo sapiens
tgctggagcctgtgtaacagc

SEQ ID NO: 2743855 - DNA, 22 bp, Homo sapiens
tgctggagcctgtgtaacagct

SEQ ID NO: 2743856 - DNA, 15 bp, Homo sapiens
tgcttacctgtgaca

SEQ ID NO: 2743857 - DNA, 12 bp, Homo sapiens
tgctttataaat

SEQ ID NO: 2743858 - DNA, 14 bp, Homo sapiens
tgctttataaataa

SEQ ID NO: 2743859 - DNA, 13 bp, Homo sapiens
tgctttctattgt

SEQ ID NO: 2743860 - DNA, 15 bp, Homo sapiens
tggaacatatgcaca

SEQ ID NO: 2743861 - DNA, 16 bp, Homo sapiens
tggagcctgtgtaaca

SEQ ID NO: 2743862 - DNA, 19 bp, Homo sapiens
tggaggtgccagcaaagcc

SEQ ID NO: 2743863 - DNA, 20 bp, Homo sapiens
tggcagcataaaggcctttt

SEQ ID NO: 2743864 - DNA, 23 bp, Homo sapiens
tgggaggaagcagaataaagcaa

SEQ ID NO: 2743865 - DNA, 17 bp, Homo sapiens
tggtccctgccctcatc

SEQ ID NO: 2743866 - DNA, 12 bp, Homo sapiens
tgtaacagctcc

SEQ ID NO: 2743867 - DNA, 13 bp, Homo sapiens
tgtaacagctcct

SEQ ID NO: 2743868 - DNA, 14 bp, Homo sapiens
tgtaacagctcctt

SEQ ID NO: 2743869 - DNA, 16 bp, Homo sapiens
tgtaacagctccttgg

SEQ ID NO: 2743870 - DNA, 14 bp, Homo sapiens
tgtagatgtagcat

SEQ ID NO: 2743871 - DNA, 16 bp, Homo sapiens
tgtagatgtagcattg

SEQ ID NO: 2743872 - DNA, 17 bp, Homo sapiens
tgtagatgtagcattgt

SEQ ID NO: 2743873 - DNA, 22 bp, Homo sapiens
tgtagatgtagcattgttccac

SEQ ID NO: 2743874 - DNA, 14 bp, Homo sapiens
tgtctattctccag

SEQ ID NO: 2743875 - DNA, 15 bp, Homo sapiens
tgtcttaaataaaac

SEQ ID NO: 2743876 - DNA, 15 bp, Homo sapiens
tgtgatgctgacacc

SEQ ID NO: 2743877 - DNA, 14 bp, Homo sapiens
tgtgcttacctgtg

SEQ ID NO: 2743878 - DNA, 15 bp, Homo sapiens
tgtgctttctattgt

SEQ ID NO: 2743879 - DNA, 15 bp, Homo sapiens
tgtgtaacagctcct

SEQ ID NO: 2743880 - DNA, 22 bp, Homo sapiens
tgtgtatgtgtacgtgtgtgtg

SEQ ID NO: 2743881 - DNA, 15 bp, Homo sapiens
tgttccaataaacag

SEQ ID NO: 2743882 - DNA, 13 bp, Homo sapiens
tgtttgtgcttct

SEQ ID NO: 2743883 - DNA, 15 bp, Homo sapiens
tgtttgtgcttctaa

SEQ ID NO: 2743884 - DNA, 12 bp, Homo sapiens
ttaaataaaact

SEQ ID NO: 2743885 - DNA, 16 bp, Homo sapiens
ttagagccaggcacac

SEQ ID NO: 2743886 - DNA, 11 bp, Homo sapiens
ttatgcttctt

SEQ ID NO: 2743887 - DNA, 23 bp, Homo sapiens
ttcagtgtcaaataaacactgtg

SEQ ID NO: 2743888 - DNA, 23 bp, Homo sapiens
ttcatccactctgcctgcttaca

SEQ ID NO: 2743889 - DNA, 15 bp, Homo sapiens
ttccagtcaggatga

SEQ ID NO: 2743890 - DNA, 22 bp, Homo sapiens
ttctcaatacttgaatatggaa

SEQ ID NO: 2743891 - DNA, 20 bp, Homo sapiens
ttgatctgctcagccctgga

SEQ ID NO: 2743892 - DNA, 19 bp, Homo sapiens
ttgcactttataaacactg

SEQ ID NO: 2743893 - DNA, 19 bp, Homo sapiens
ttgccaacctgtaataaat

SEQ ID NO: 2743894 - DNA, 20 bp, Homo sapiens
ttgggaggaagcagaataaa

SEQ ID NO: 2743895 - DNA, 15 bp, Homo sapiens
ttgtgtgtatgtgta

SEQ ID NO: 2743896 - DNA, 14 bp, Homo sapiens
tttattgctttata

SEQ ID NO: 2743897 - DNA, 19 bp, Homo sapiens
tttcatcaatcattgtaca

SEQ ID NO: 2743898 - DNA, 21 bp, Homo sapiens
tttcatcaatcattgtacagt

SEQ ID NO: 2743899 - DNA, 12 bp, Homo sapiens
tttgtgcttcta

SEQ ID NO: 2743900 - DNA, 12 bp, Homo sapiens
tttgtttacaca

SEQ ID NO: 2743901 - DNA, 20 bp, Homo sapiens
tttttggctttagacactgg

SEQ ID NO: 2743902 - DNA, 13 bp, Homo sapiens
aatatatataaat

SEQ ID NO: 2743903 - DNA, 16 bp, Homo sapiens
aatatatataaataaa

SEQ ID NO: 2743904 - DNA, 19 bp, Homo sapiens
aatatatataaatatatat

SEQ ID NO: 2743905 - DNA, 15 bp, Homo sapiens
aatatggaacatatg

SEQ ID NO: 2743906 - DNA, 14 bp, Homo sapiens
aatatttattgctt

SEQ ID NO: 2743907 - DNA, 13 bp, Homo sapiens
aatcattgtacag

SEQ ID NO: 2743908 - DNA, 18 bp, Homo sapiens
aatgtcttaaataaaact

SEQ ID NO: 2743909 - DNA, 15 bp, Homo sapiens
aatttgtttgtgctt

SEQ ID NO: 2743910 - DNA, 17 bp, Homo sapiens
aatttgtttgtgcttct

SEQ ID NO: 2743911 - DNA, 18 bp, Homo sapiens
aatttgtttgtgcttcta

SEQ ID NO: 2743912 - DNA, 15 bp, Homo sapiens
aattttccttgaagc

SEQ ID NO: 2743913 - DNA, 17 bp, Homo sapiens
aattttccttgaagccg

SEQ ID NO: 2743914 - DNA, 22 bp, Homo sapiens
acacacgtgcaatttgtttgtg

SEQ ID NO: 2743915 - DNA, 17 bp, Homo sapiens
acacactgtgctttcta

SEQ ID NO: 2743916 - DNA, 22 bp, Homo sapiens
acacactgtgctttctattgta

SEQ ID NO: 2743917 - DNA, 23 bp, Homo sapiens
acacactgtgctttctattgtac

SEQ ID NO: 2743918 - DNA, 20 bp, Homo sapiens
acaccagcggcctggagtcg

SEQ ID NO: 2743919 - DNA, 14 bp, Homo sapiens
acactggctgccag

SEQ ID NO: 2743920 - DNA, 16 bp, Homo sapiens
acactggctgccagct

SEQ ID NO: 2743921 - DNA, 23 bp, Homo sapiens
acactgtgctttctattgtacag

SEQ ID NO: 2743922 - DNA, 17 bp, Homo sapiens
acagcagctctgtcccc

SEQ ID NO: 2743923 - DNA, 20 bp, Homo sapiens
acagctccttgggaggaagc

SEQ ID NO: 2743924 - DNA, 23 bp, Homo sapiens
acaggggaaggaaataacattgc

SEQ ID NO: 2743925 - DNA, 14 bp, Homo sapiens
acagtttgtttaca

SEQ ID NO: 2743926 - DNA, 23 bp, Homo sapiens
acatcttgatctgctcagccctg

SEQ ID NO: 2743927 - DNA, 20 bp, Homo sapiens
acattgcactttataaacac

SEQ ID NO: 2743928 - DNA, 21 bp, Homo sapiens
acattgcactttataaacact

SEQ ID NO: 2743929 - DNA, 13 bp, Homo sapiens
gacctaaattcgt

SEQ ID NO: 2743930 - DNA, 21 bp, Homo sapiens
gacggtattatgcttcttgga

SEQ ID NO: 2743931 - DNA, 13 bp, Homo sapiens
gagcctgtgtaac

SEQ ID NO: 2743932 - DNA, 21 bp, Homo sapiens
gagcctgtgtaacagctcctt

SEQ ID NO: 2743933 - DNA, 13 bp, Homo sapiens
gaggaagcagaat

SEQ ID NO: 2743934 - DNA, 17 bp, Homo sapiens
gaggaagcagaataaag

SEQ ID NO: 2743935 - DNA, 17 bp, Homo sapiens
gaggtgccagcaaagcc

SEQ ID NO: 2743936 - DNA, 15 bp, Homo sapiens
gagtcgtgggaagga

SEQ ID NO: 2743937 - DNA, 22 bp, Homo sapiens
gatataaatatatataaatata

SEQ ID NO: 2743938 - DNA, 13 bp, Homo sapiens
gatctgctcagcc

SEQ ID NO: 2743939 - DNA, 14 bp, Homo sapiens
gatctgctcagccc

SEQ ID NO: 2743940 - DNA, 17 bp, Homo sapiens
gatctgctcagccctgg

SEQ ID NO: 2743941 - DNA, 19 bp, Homo sapiens
gatctgctcagccctggag

SEQ ID NO: 2743942 - DNA, 21 bp, Homo sapiens
gatctgctcagccctggaggt

SEQ ID NO: 2743943 - DNA, 19 bp, Homo sapiens
gatgacggtattatgcttc

SEQ ID NO: 2743944 - DNA, 18 bp, Homo sapiens
gcaaagccccatgctgga

SEQ ID NO: 2743945 - DNA, 22 bp, Homo sapiens
gcaaagccccatgctggagcct

SEQ ID NO: 2743946 - DNA, 23 bp, Homo sapiens
gcaaagccccatgctggagcctg

SEQ ID NO: 2743947 - DNA, 19 bp, Homo sapiens
gcaatgtcttaaataaaac

SEQ ID NO: 2743948 - DNA, 10 bp, Homo sapiens
gcaattttcc

SEQ ID NO: 2743949 - DNA, 14 bp, Homo sapiens
gcaattttccttga

SEQ ID NO: 2743950 - DNA, 12 bp, Homo sapiens
gcacacactgtg

SEQ ID NO: 2743951 - DNA, 15 bp, Homo sapiens
gcagaataaagcaat

SEQ ID NO: 2743952 - DNA, 17 bp, Homo sapiens
gcagaataaagcaattt

SEQ ID NO: 2743953 - DNA, 22 bp, Homo sapiens
gcagaataaagcaattttcctt

SEQ ID NO: 2743954 - DNA, 23 bp, Homo sapiens
gcatcctgccttagagccaggca

SEQ ID NO: 2743955 - DNA, 23 bp, Homo sapiens
gcatttgtctattctccagctga

SEQ ID NO: 2743956 - DNA, 22 bp, Homo sapiens
gccagcaaagccccatgctgga

SEQ ID NO: 2743957 - DNA, 12 bp, Homo sapiens
gccagggaaggc

SEQ ID NO: 2743958 - DNA, 17 bp, Homo sapiens
gcccagccagggaaggc

SEQ ID NO: 2743959 - DNA, 12 bp, Homo sapiens
gccccatgctgg

SEQ ID NO: 2743960 - DNA, 18 bp, Homo sapiens
gccccatgctggagcctg

SEQ ID NO: 2743961 - DNA, 18 bp, Homo sapiens
gcctcgggaacctcactc

SEQ ID NO: 2743962 - DNA, 19 bp, Homo sapiens
gcctgtgtaacagctcctt

SEQ ID NO: 2743963 - DNA, 23 bp, Homo sapiens
gcctgtgtaacagctccttggga

SEQ ID NO: 2743964 - DNA, 13 bp, Homo sapiens
gccttagagccag

SEQ ID NO: 2743965 - DNA, 12 bp, Homo sapiens
gctcagccctgg

SEQ ID NO: 2743966 - DNA, 16 bp, Homo sapiens
gctcagccctggaggt

SEQ ID NO: 2743967 - DNA, 17 bp, Homo sapiens
gctccttgggaggaagc

SEQ ID NO: 2743968 - DNA, 18 bp, Homo sapiens
gctccttgggaggaagca

SEQ ID NO: 2743969 - DNA, 23 bp, Homo sapiens
gctccttgggaggaagcagaata

SEQ ID NO: 2743970 - DNA, 16 bp, Homo sapiens
gctgcgccctgggctc

SEQ ID NO: 2743971 - DNA, 13 bp, Homo sapiens
gctggagcctgtg

SEQ ID NO: 2743972 - DNA, 21 bp, Homo sapiens
gctggagcctgtgtaacagct

SEQ ID NO: 2743973 - DNA, 18 bp, Homo sapiens
gcttctaatatttattgc

SEQ ID NO: 2743974 - DNA, 22 bp, Homo sapiens
acattgcactttataaacactg

SEQ ID NO: 2743975 - DNA, 12 bp, Homo sapiens
acatttaaaaca

SEQ ID NO: 2743976 - DNA, 16 bp, Homo sapiens
acatttaaaacatttg

SEQ ID NO: 2743977 - DNA, 13 bp, Homo sapiens
accaagactcctg

SEQ ID NO: 2743978 - DNA, 15 bp, Homo sapiens
acctcactcttgcca

SEQ ID NO: 2743979 - DNA, 16 bp, Homo sapiens
acctcactcttgccaa

SEQ ID NO: 2743980 - DNA, 13 bp, Homo sapiens
acctgtaataaat

SEQ ID NO: 2743981 - DNA, 15 bp, Homo sapiens
acctgtaataaatat

SEQ ID NO: 2743982 - DNA, 21 bp, Homo sapiens
acctgtaataaatatgagtgc

SEQ ID NO: 2743983 - DNA, 13 bp, Homo sapiens
acctgtgacagca

SEQ ID NO: 2743984 - DNA, 21 bp, Homo sapiens
acctgtgacagcagctctgtc

SEQ ID NO: 2743985 - DNA, 17 bp, Homo sapiens
accttccagtcaggatg

SEQ ID NO: 2743986 - DNA, 14 bp, Homo sapiens
acggtattatgctt

SEQ ID NO: 2743987 - DNA, 14 bp, Homo sapiens
acgtgcaatttgtt

SEQ ID NO: 2743988 - DNA, 15 bp, Homo sapiens
actagaacacagaaa

SEQ ID NO: 2743989 - DNA, 15 bp, Homo sapiens
actatttaaaattgg

SEQ ID NO: 2743990 - DNA, 21 bp, Homo sapiens
actccctcgtcgagctggatg

SEQ ID NO: 2743991 - DNA, 22 bp, Homo sapiens
actgcctcgggaacctcactct

SEQ ID NO: 2743992 - DNA, 22 bp, Homo sapiens
actgtgctttctattgtacaga

SEQ ID NO: 2743993 - DNA, 19 bp, Homo sapiens
acttgaatatggaacatat

SEQ ID NO: 2743994 - DNA, 23 bp, Homo sapiens
acttgaatatggaacatatgcac

SEQ ID NO: 2743995 - DNA, 15 bp, Homo sapiens
agaataaagcaattt

SEQ ID NO: 2743996 - DNA, 22 bp, Homo sapiens
agaataaagcaattttccttga

SEQ ID NO: 2743997 - DNA, 15 bp, Homo sapiens
agaccttgtgtgtat

SEQ ID NO: 2743998 - DNA, 21 bp, Homo sapiens
agatgtagcattgttccacac

SEQ ID NO: 2743999 - DNA, 19 bp, Homo sapiens
agcaaagccccatgctgga

SEQ ID NO: 2744000 - DNA, 21 bp, Homo sapiens
agcaaagccccatgctggagc

SEQ ID NO: 2744001 - DNA, 18 bp, Homo sapiens
agcaattttccttgaagc

SEQ ID NO: 2744002 - DNA, 19 bp, Homo sapiens
agcaattttccttgaagcc

SEQ ID NO: 2744003 - DNA, 11 bp, Homo sapiens
agcagaataaa

SEQ ID NO: 2744004 - DNA, 13 bp, Homo sapiens
agcagaataaagc

SEQ ID NO: 2744005 - DNA, 17 bp, Homo sapiens
agcagaataaagcaatt

SEQ ID NO: 2744006 - DNA, 12 bp, Homo sapiens
agcattgttcca

SEQ ID NO: 2744007 - DNA, 12 bp, Homo sapiens
agccaggcacac

SEQ ID NO: 2744008 - DNA, 14 bp, Homo sapiens
agccccatgctgga

SEQ ID NO: 2744009 - DNA, 20 bp, Homo sapiens
agccccatgctggagcctgt

SEQ ID NO: 2744010 - DNA, 11 bp, Homo sapiens
agccctggagg

SEQ ID NO: 2744011 - DNA, 16 bp, Homo sapiens
agccctggaggtgcca

SEQ ID NO: 2744012 - DNA, 17 bp, Homo sapiens
agcctatcaaagacctt

SEQ ID NO: 2744013 - DNA, 15 bp, Homo sapiens
agcctgtgtaacagc

SEQ ID NO: 2744014 - DNA, 18 bp, Homo sapiens
agcctgtgtaacagctcc

SEQ ID NO: 2744015 - DNA, 19 bp, Homo sapiens
agcctgtgtaacagctcct

SEQ ID NO: 2744016 - DNA, 21 bp, Homo sapiens
agcctgtgtaacagctccttg

SEQ ID NO: 2744017 - DNA, 14 bp, Homo sapiens
agcggcctggagtc

SEQ ID NO: 2744018 - DNA, 16 bp, Homo sapiens
agctatttttactaga

SEQ ID NO: 2744019 - DNA, 22 bp, Homo sapiens
agctccttgggaggaagcagaa

SEQ ID NO: 2744020 - DNA, 12 bp, Homo sapiens
aggaaataacat

SEQ ID NO: 2744021 - DNA, 15 bp, Homo sapiens
aggaaataacattgc

SEQ ID NO: 2744022 - DNA, 13 bp, Homo sapiens
aggaagcagaata

SEQ ID NO: 2744023 - DNA, 14 bp, Homo sapiens
aggaagcagaataa

SEQ ID NO: 2744024 - DNA, 22 bp, Homo sapiens
aggaagcagaataaagcaattt

SEQ ID NO: 2744025 - DNA, 16 bp, Homo sapiens
aggcacacactgtgct

SEQ ID NO: 2744026 - DNA, 19 bp, Homo sapiens
aggcacacactgtgctttc

SEQ ID NO: 2744027 - DNA, 20 bp, Homo sapiens
aggcacacactgtgctttct

SEQ ID NO: 2744028 - DNA, 20 bp, Homo sapiens
aggccatgttccaataaaca

SEQ ID NO: 2744029 - DNA, 21 bp, Homo sapiens
aggccatgttccaataaacag

SEQ ID NO: 2744030 - DNA, 20 bp, Homo sapiens
aggtgccagcaaagccccat

SEQ ID NO: 2744031 - DNA, 15 bp, Homo sapiens
agtggtccctgccct

SEQ ID NO: 2744032 - DNA, 12 bp, Homo sapiens
ataaaactattt

SEQ ID NO: 2744033 - DNA, 12 bp, Homo sapiens
ataaacactgtg

SEQ ID NO: 2744034 - DNA, 14 bp, Homo sapiens
ataaacactgtgta

SEQ ID NO: 2744035 - DNA, 10 bp, Homo sapiens
ataaagcaat

SEQ ID NO: 2744036 - DNA, 14 bp, Homo sapiens
ataaagcaattttc

SEQ ID NO: 2744037 - DNA, 15 bp, Homo sapiens
ataaagcaattttcc

SEQ ID NO: 2744038 - DNA, 20 bp, Homo sapiens
ataaagcaattttccttgaa

SEQ ID NO: 2744039 - DNA, 14 bp, Homo sapiens
ataaatatgagtgc

SEQ ID NO: 2744040 - DNA, 24 bp, Homo sapiens
ataacattgcactttataaacact

SEQ ID NO: 2744041 - DNA, 17 bp, Homo sapiens
atataaataaatatata

SEQ ID NO: 2744042 - DNA, 19 bp, Homo sapiens
atataaataaatatatata

SEQ ID NO: 2744043 - DNA, 22 bp, Homo sapiens
atataaataaatatatatatcc

SEQ ID NO: 2744044 - DNA, 12 bp, Homo sapiens
atataaatatat

SEQ ID NO: 2744045 - DNA, 15 bp, Homo sapiens
atataaatatatata

SEQ ID NO: 2744046 - DNA, 17 bp, Homo sapiens
atataaatatatataaa

SEQ ID NO: 2744047 - DNA, 11 bp, Homo sapiens
atatataaata

SEQ ID NO: 2744048 - DNA, 14 bp, Homo sapiens
atatttattgcttt

SEQ ID NO: 2744049 - DNA, 14 bp, Homo sapiens
atcaatcattgtac

SEQ ID NO: 2744050 - DNA, 13 bp, Homo sapiens
atcattgtacagt

SEQ ID NO: 2744051 - DNA, 15 bp, Homo sapiens
atcattgtacagttt

SEQ ID NO: 2744052 - DNA, 22 bp, Homo sapiens
atcattgtacagtttgtttaca

SEQ ID NO: 2744053 - DNA, 14 bp, Homo sapiens
atccacctccatct

SEQ ID NO: 2744054 - DNA, 21 bp, Homo sapiens
atcctgccttagagccaggca

SEQ ID NO: 2744055 - DNA, 14 bp, Homo sapiens
atctcccatgtgtg

SEQ ID NO: 2744056 - DNA, 20 bp, Homo sapiens
atctcccatgtgtgatgctg

SEQ ID NO: 2744057 - DNA, 15 bp, Homo sapiens
atctgctcagccctg

SEQ ID NO: 2744058 - DNA, 18 bp, Homo sapiens
atctgctcagccctggag

SEQ ID NO: 2744059 - DNA, 20 bp, Homo sapiens
atctgctcagccctggaggt

SEQ ID NO: 2744060 - DNA, 22 bp, Homo sapiens
atcttgatctgctcagccctgg

SEQ ID NO: 2744061 - DNA, 17 bp, Homo sapiens
atgacggtattatgctt

SEQ ID NO: 2744062 - DNA, 18 bp, Homo sapiens
atgggcctcatgaataaa

SEQ ID NO: 2744063 - DNA, 16 bp, Homo sapiens
atgtgtgatgctgaca

SEQ ID NO: 2744064 - DNA, 16 bp, Homo sapiens
attgcactttataaac

SEQ ID NO: 2744065 - DNA, 19 bp, Homo sapiens
attgcactttataaacact

SEQ ID NO: 2744066 - DNA, 13 bp, Homo sapiens
attgctttataaa

SEQ ID NO: 2744067 - DNA, 16 bp, Homo sapiens
attgtaagtggaaaat

SEQ ID NO: 2744068 - DNA, 14 bp, Homo sapiens
attgtacagtttgt

SEQ ID NO: 2744069 - DNA, 19 bp, Homo sapiens
attgtacagtttgtttaca

SEQ ID NO: 2744070 - DNA, 21 bp, Homo sapiens
attgtacagtttgtttacaca

SEQ ID NO: 2744071 - DNA, 16 bp, Homo sapiens
atttaaaattggcacc

SEQ ID NO: 2744072 - DNA, 18 bp, Homo sapiens
atttgtttgtgcttctaa

SEQ ID NO: 2744073 - DNA, 23 bp, Homo sapiens
caaagaccttgtgtgtatgtgta

SEQ ID NO: 2744074 - DNA, 19 bp, Homo sapiens
caaagccccatgctggagc

SEQ ID NO: 2744075 - DNA, 14 bp, Homo sapiens
gctttataaataaa

SEQ ID NO: 2744076 - DNA, 18 bp, Homo sapiens
ggaagcagaataaagcaa

SEQ ID NO: 2744077 - DNA, 22 bp, Homo sapiens
ggaagcagaataaagcaatttt

SEQ ID NO: 2744078 - DNA, 17 bp, Homo sapiens
ggacgtctcatctccca

SEQ ID NO: 2744079 - DNA, 22 bp, Homo sapiens
ggagcctgtgtaacagctcctt

SEQ ID NO: 2744080 - DNA, 22 bp, Homo sapiens
ggagccttaccaagactcctgc

SEQ ID NO: 2744081 - DNA, 23 bp, Homo sapiens
ggagccttaccaagactcctgca

SEQ ID NO: 2744082 - DNA, 22 bp, Homo sapiens
ggaggaagcagaataaagcaat

SEQ ID NO: 2744083 - DNA, 13 bp, Homo sapiens
ggaggtgccagca

SEQ ID NO: 2744084 - DNA, 14 bp, Homo sapiens
ggaggtgccagcaa

SEQ ID NO: 2744085 - DNA, 14 bp, Homo sapiens
ggatataaatatat

SEQ ID NO: 2744086 - DNA, 22 bp, Homo sapiens
ggatgacggtattatgcttctt

SEQ ID NO: 2744087 - DNA, 21 bp, Homo sapiens
ggcacacactgtgctttctat

SEQ ID NO: 2744088 - DNA, 23 bp, Homo sapiens
ggccatgttccaataaacaggag

SEQ ID NO: 2744089 - DNA, 22 bp, Homo sapiens
ggcccctctcaggctgtgctta

SEQ ID NO: 2744090 - DNA, 22 bp, Homo sapiens
ggcctcatgaataaatggcttc

SEQ ID NO: 2744091 - DNA, 16 bp, Homo sapiens
gggaggaagcagaata

SEQ ID NO: 2744092 - DNA, 18 bp, Homo sapiens
gggaggaagcagaataaa

SEQ ID NO: 2744093 - DNA, 14 bp, Homo sapiens
gggctcgtctttgc

SEQ ID NO: 2744094 - DNA, 18 bp, Homo sapiens
ggtattatgcttcttgga

SEQ ID NO: 2744095 - DNA, 12 bp, Homo sapiens
ggtgccagcaaa

SEQ ID NO: 2744096 - DNA, 13 bp, Homo sapiens
ggtgccagcaaag

SEQ ID NO: 2744097 - DNA, 16 bp, Homo sapiens
ggtgccagcaaagccc

SEQ ID NO: 2744098 - DNA, 12 bp, Homo sapiens
gtaacagctcct

SEQ ID NO: 2744099 - DNA, 16 bp, Homo sapiens
gtaacagctccttggg

SEQ ID NO: 2744100 - DNA, 16 bp, Homo sapiens
gtacagtttgtttaca

SEQ ID NO: 2744101 - DNA, 18 bp, Homo sapiens
gtacagtttgtttacaca

SEQ ID NO: 2744102 - DNA, 20 bp, Homo sapiens
gtagatgtagcattgttcca

SEQ ID NO: 2744103 - DNA, 14 bp, Homo sapiens
gtagcattgttcca

SEQ ID NO: 2744104 - DNA, 18 bp, Homo sapiens
gtattgtaagtggaaaat

SEQ ID NO: 2744105 - DNA, 12 bp, Homo sapiens
gtcaggatgacg

SEQ ID NO: 2744106 - DNA, 15 bp, Homo sapiens
gtcgtgggaaggagg

SEQ ID NO: 2744107 - DNA, 12 bp, Homo sapiens
gtgatgctgaca

SEQ ID NO: 2744108 - DNA, 20 bp, Homo sapiens
gtgcaatttgtttgtgcttc

SEQ ID NO: 2744109 - DNA, 21 bp, Homo sapiens
gtgcaatttgtttgtgcttct

SEQ ID NO: 2744110 - DNA, 21 bp, Homo sapiens
gtgcttctaatatttattgct

SEQ ID NO: 2744111 - DNA, 12 bp, Homo sapiens
gtgctttctatt

SEQ ID NO: 2744112 - DNA, 13 bp, Homo sapiens
gtgctttctattg

SEQ ID NO: 2744113 - DNA, 22 bp, Homo sapiens
gtgctttctattgtacagaagc

SEQ ID NO: 2744114 - DNA, 20 bp, Homo sapiens
gtgggtggatataaatatat

SEQ ID NO: 2744115 - DNA, 15 bp, Homo sapiens
tccctgccctcatct

SEQ ID NO: 2744116 - DNA, 17 bp, Homo sapiens
tcctgccttagagccag

SEQ ID NO: 2744117 - DNA, 16 bp, Homo sapiens
tccttgggaggaagca

SEQ ID NO: 2744118 - DNA, 22 bp, Homo sapiens
tccttgggaggaagcagaataa

SEQ ID NO: 2744119 - DNA, 11 bp, Homo sapiens
tcgctgctgcg

SEQ ID NO: 2744120 - DNA, 16 bp, Homo sapiens
tcgggaacctcactct

SEQ ID NO: 2744121 - DNA, 15 bp, Homo sapiens
tctaccttccagtca

SEQ ID NO: 2744122 - DNA, 16 bp, Homo sapiens
tctattctccagctga

SEQ ID NO: 2744123 - DNA, 13 bp, Homo sapiens
tctattgtacaga

SEQ ID NO: 2744124 - DNA, 19 bp, Homo sapiens
tctcaggctgtgcttacct

SEQ ID NO: 2744125 - DNA, 13 bp, Homo sapiens
tctctggcccctc

SEQ ID NO: 2744126 - DNA, 18 bp, Homo sapiens
tctgctcagccctggagg

SEQ ID NO: 2744127 - DNA, 14 bp, Homo sapiens
tcttgatctgctca

SEQ ID NO: 2744128 - DNA, 17 bp, Homo sapiens
tcttgatctgctcagcc

SEQ ID NO: 2744129 - DNA, 20 bp, Homo sapiens
tcttgatctgctcagccctg

SEQ ID NO: 2744130 - DNA, 23 bp, Homo sapiens
tcttgatctgctcagccctggag

SEQ ID NO: 2744131 - DNA, 22 bp, Homo sapiens
tcttgccaacctgtaataaata

SEQ ID NO: 2744132 - DNA, 14 bp, Homo sapiens
tcttggagtcttcc

SEQ ID NO: 2744133 - DNA, 19 bp, Homo sapiens
tctttgcttcacttctccc

SEQ ID NO: 2744134 - DNA, 19 bp, Homo sapiens
tgacggtattatgcttctt

SEQ ID NO: 2744135 - DNA, 23 bp, Homo sapiens
tgagctctgcatttgtctattct

SEQ ID NO: 2744136 - DNA, 15 bp, Homo sapiens
tgatctgctcagccc

SEQ ID NO: 2744137 - DNA, 18 bp, Homo sapiens
tgatctgctcagccctgg

SEQ ID NO: 2744138 - DNA, 19 bp, Homo sapiens
tgatctgctcagccctgga

SEQ ID NO: 2744139 - DNA, 21 bp, Homo sapiens
tgatctgctcagccctggagg

SEQ ID NO: 2744140 - DNA, 20 bp, Homo sapiens
tgcaatgtcttaaataaaac

SEQ ID NO: 2744141 - DNA, 22 bp, Homo sapiens
tgcaatgtcttaaataaaacta

SEQ ID NO: 2744142 - DNA, 17 bp, Homo sapiens
tgcaatttgtttgtgct

SEQ ID NO: 2744143 - DNA, 17 bp, Homo sapiens
tgcactttataaacact

SEQ ID NO: 2744144 - DNA, 18 bp, Homo sapiens
tgcactttataaacactg

SEQ ID NO: 2744145 - DNA, 15 bp, Homo sapiens
tgcatttgtctattc

SEQ ID NO: 2744146 - DNA, 19 bp, Homo sapiens
tgccaacctgtaataaata

SEQ ID NO: 2744147 - DNA, 13 bp, Homo sapiens
tgccagcaaagcc

SEQ ID NO: 2744148 - DNA, 13 bp, Homo sapiens
tgccagctatttt

SEQ ID NO: 2744149 - DNA, 12 bp, Homo sapiens
tgctcagccctg

SEQ ID NO: 2744150 - DNA, 21 bp, Homo sapiens
tgctcagccctggaggtgcca

SEQ ID NO: 2744151 - DNA, 10 bp, Homo sapiens
tgctggagcc

SEQ ID NO: 2744152 - DNA, 13 bp, Homo sapiens
tgctggagcctgt

SEQ ID NO: 2744153 - DNA, 20 bp, Homo sapiens
aaaactatttaaaattggca

SEQ ID NO: 2744154 - DNA, 22 bp, Homo sapiens
aaacactgtattgtaagtggaa

SEQ ID NO: 2744155 - DNA, 21 bp, Homo sapiens
aaactatttaaaattggcacc

SEQ ID NO: 2744156 - DNA, 19 bp, Homo sapiens
aaagaccttgtgtgtatgt

SEQ ID NO: 2744157 - DNA, 20 bp, Homo sapiens
aaagaccttgtgtgtatgtg

SEQ ID NO: 2744158 - DNA, 15 bp, Homo sapiens
aaagcaattttcctt

SEQ ID NO: 2744159 - DNA, 23 bp, Homo sapiens
aaagcaattttccttgaagccga

SEQ ID NO: 2744160 - DNA, 15 bp, Homo sapiens
aaagccccatgctgg

SEQ ID NO: 2744161 - DNA, 17 bp, Homo sapiens
aaagccccatgctggag

SEQ ID NO: 2744162 - DNA, 19 bp, Homo sapiens
aaagccccatgctggagcc

SEQ ID NO: 2744163 - DNA, 12 bp, Homo sapiens
aaataaaactat

SEQ ID NO: 2744164 - DNA, 13 bp, Homo sapiens
aaataaaactatt

SEQ ID NO: 2744165 - DNA, 14 bp, Homo sapiens
aaataaaactattt

SEQ ID NO: 2744166 - DNA, 12 bp, Homo sapiens
aaataaacactg

SEQ ID NO: 2744167 - DNA, 13 bp, Homo sapiens
aaataaatatata

SEQ ID NO: 2744168 - DNA, 15 bp, Homo sapiens
aaataaatatatata

SEQ ID NO: 2744169 - DNA, 10 bp, Homo sapiens
aaatatatat

SEQ ID NO: 2744170 - DNA, 14 bp, Homo sapiens
aaatatatataaat

SEQ ID NO: 2744171 - DNA, 20 bp, Homo sapiens
aaatatatataaatatatat

SEQ ID NO: 2744172 - DNA, 10 bp, Homo sapiens
aacagctcct

SEQ ID NO: 2744173 - DNA, 22 bp, Homo sapiens
aacagctccttgggaggaagca

SEQ ID NO: 2744174 - DNA, 22 bp, Homo sapiens
aaccaagtgtagatgtagcatt

SEQ ID NO: 2744175 - DNA, 15 bp, Homo sapiens
aacctcactcttgcc

SEQ ID NO: 2744176 - DNA, 12 bp, Homo sapiens
aactatttaaaa

SEQ ID NO: 2744177 - DNA, 17 bp, Homo sapiens
aactatttaaaattggc

SEQ ID NO: 2744178 - DNA, 22 bp, Homo sapiens
aagaccttgtgtgtatgtgtac

SEQ ID NO: 2744179 - DNA, 19 bp, Homo sapiens
aagcaattttccttgaagc

SEQ ID NO: 2744180 - DNA, 13 bp, Homo sapiens
aagcagaataaag

SEQ ID NO: 2744181 - DNA, 14 bp, Homo sapiens
aagcagaataaagc

SEQ ID NO: 2744182 - DNA, 16 bp, Homo sapiens
aagccccatgctggag

SEQ ID NO: 2744183 - DNA, 18 bp, Homo sapiens
aagccccatgctggagcc

SEQ ID NO: 2744184 - DNA, 22 bp, Homo sapiens
aagccccatgctggagcctgtg

SEQ ID NO: 2744185 - DNA, 13 bp, Homo sapiens
aaggaaataacat

SEQ ID NO: 2744186 - DNA, 14 bp, Homo sapiens
aaggaaataacatt

SEQ ID NO: 2744187 - DNA, 20 bp, Homo sapiens
aagtgtagatgtagcattgt

SEQ ID NO: 2744188 - DNA, 17 bp, Homo sapiens
aagttactgggcattct

SEQ ID NO: 2744189 - DNA, 12 bp, Homo sapiens
aataaacactgt

SEQ ID NO: 2744190 - DNA, 12 bp, Homo sapiens
aataaagcaatt

SEQ ID NO: 2744191 - DNA, 22 bp, Homo sapiens
aataaagcaattttccttgaag

SEQ ID NO: 2744192 - DNA, 12 bp, Homo sapiens
aataaatatata

SEQ ID NO: 2744193 - DNA, 13 bp, Homo sapiens
aataaatatatat

SEQ ID NO: 2744194 - DNA, 16 bp, Homo sapiens
aataaatatatatatc

SEQ ID NO: 2744195 - DNA, 15 bp, Homo sapiens
aataacattgcactt

SEQ ID NO: 2744196 - DNA, 16 bp, Homo sapiens
aatacttgaatatgga

SEQ ID NO: 2744197 - DNA, 19 bp, Homo sapiens
aatacttgaatatggaaca

SEQ ID NO: 2744198 - DNA, 12 bp, Homo sapiens
aatatatataaa

SEQ ID NO: 2744199 - DNA, 15 bp, Homo sapiens
aatatatataaataa

SEQ ID NO: 2744200 - DNA, 14 bp, Homo sapiens
aatatatatatcct

SEQ ID NO: 2744201 - DNA, 21 bp, Homo sapiens
aatatttattgctttataaat

SEQ ID NO: 2744202 - DNA, 23 bp, Homo sapiens
aatatttattgctttataaataa

SEQ ID NO: 2744203 - DNA, 15 bp, Homo sapiens
aatcattgtacagtt

SEQ ID NO: 2744204 - DNA, 16 bp, Homo sapiens
aatcattgtacagttt

SEQ ID NO: 2744205 - DNA, 20 bp, Homo sapiens
aatcattgtacagtttgttt

SEQ ID NO: 2744206 - DNA, 22 bp, Homo sapiens
aatcattgtacagtttgtttac

SEQ ID NO: 2744207 - DNA, 22 bp, Homo sapiens
aatgcaatgtcttaaataaaac

SEQ ID NO: 2744208 - DNA, 23 bp, Homo sapiens
aatgtcttaaataaaactattta

SEQ ID NO: 2744209 - DNA, 13 bp, Homo sapiens
aatttgtttgtgc

SEQ ID NO: 2744210 - DNA, 11 bp, Homo sapiens
acacactgtgc

SEQ ID NO: 2744211 - DNA, 16 bp, Homo sapiens
acacactgtgctttct

SEQ ID NO: 2744212 - DNA, 21 bp, Homo sapiens
acacactgtgctttctattgt

SEQ ID NO: 2744213 - DNA, 12 bp, Homo sapiens
acacatttaaaa

SEQ ID NO: 2744214 - DNA, 15 bp, Homo sapiens
acacatttaaaacat

SEQ ID NO: 2744215 - DNA, 17 bp, Homo sapiens
acacatttaaaacattt

SEQ ID NO: 2744216 - DNA, 17 bp, Homo sapiens
acaccctgccctcatgc

SEQ ID NO: 2744217 - DNA, 15 bp, Homo sapiens
acactgtgctttcta

SEQ ID NO: 2744218 - DNA, 22 bp, Homo sapiens
acactgtgctttctattgtaca

SEQ ID NO: 2744219 - DNA, 15 bp, Homo sapiens
acagctccttgggag

SEQ ID NO: 2744220 - DNA, 17 bp, Homo sapiens
acagctccttgggagga

SEQ ID NO: 2744221 - DNA, 22 bp, Homo sapiens
acagctccttgggaggaagcag

SEQ ID NO: 2744222 - DNA, 22 bp, Homo sapiens
acaggggaaggaaataacattg

SEQ ID NO: 2744223 - DNA, 18 bp, Homo sapiens
acatttgaaggacctaaa

SEQ ID NO: 2744224 - DNA, 23 bp, Homo sapiens
acctaaattcgtagcaaattctg

SEQ ID NO: 2744225 - DNA, 18 bp, Homo sapiens
acctgtaataaatatgag

SEQ ID NO: 2744226 - DNA, 17 bp, Homo sapiens
acggtattatgcttctt

SEQ ID NO: 2744227 - DNA, 18 bp, Homo sapiens
acggtattatgcttcttg

SEQ ID NO: 2744228 - DNA, 20 bp, Homo sapiens
acggtattatgcttcttgga

SEQ ID NO: 2744229 - DNA, 12 bp, Homo sapiens
cctgtaataaat

SEQ ID NO: 2744230 - DNA, 16 bp, Homo sapiens
cctgtaataaatatga

SEQ ID NO: 2744231 - DNA, 16 bp, Homo sapiens
cctgtgtaacagctcc

SEQ ID NO: 2744232 - DNA, 20 bp, Homo sapiens
cctgtgtaacagctccttgg

SEQ ID NO: 2744233 - DNA, 22 bp, Homo sapiens
cctgtgtaacagctccttggga

SEQ ID NO: 2744234 - DNA, 15 bp, Homo sapiens
ccttagagccaggca

SEQ ID NO: 2744235 - DNA, 16 bp, Homo sapiens
ccttagagccaggcac

SEQ ID NO: 2744236 - DNA, 14 bp, Homo sapiens
ccttgggaggaagc

SEQ ID NO: 2744237 - DNA, 15 bp, Homo sapiens
ccttgggaggaagca

SEQ ID NO: 2744238 - DNA, 20 bp, Homo sapiens
ccttgggaggaagcagaata

SEQ ID NO: 2744239 - DNA, 15 bp, Homo sapiens
ccttgtgtgtatgtg

SEQ ID NO: 2744240 - DNA, 12 bp, Homo sapiens
cgccctgggctc

SEQ ID NO: 2744241 - DNA, 22 bp, Homo sapiens
cgccctgggctcgtctttgcag

SEQ ID NO: 2744242 - DNA, 23 bp, Homo sapiens
cgcgtgtgtgggtggatataaat

SEQ ID NO: 2744243 - DNA, 16 bp, Homo sapiens
cggtattatgcttctt

SEQ ID NO: 2744244 - DNA, 16 bp, Homo sapiens
ctaatatttattgctt

SEQ ID NO: 2744245 - DNA, 17 bp, Homo sapiens
ctaatatttattgcttt

SEQ ID NO: 2744246 - DNA, 20 bp, Homo sapiens
ctacagttggaaatccatcc

SEQ ID NO: 2744247 - DNA, 15 bp, Homo sapiens
ctattctccagctga

SEQ ID NO: 2744248 - DNA, 15 bp, Homo sapiens
ctatttaaaattggc

SEQ ID NO: 2744249 - DNA, 16 bp, Homo sapiens
ctcactcttgccaacc

SEQ ID NO: 2744250 - DNA, 18 bp, Homo sapiens
ctcagccctggaggtgcc

SEQ ID NO: 2744251 - DNA, 22 bp, Homo sapiens
ctcagccctggaggtgccagca

SEQ ID NO: 2744252 - DNA, 22 bp, Homo sapiens
ctcaggctgtgcttacctgtga

SEQ ID NO: 2744253 - DNA, 17 bp, Homo sapiens
ctcatctcccatgtgtg

SEQ ID NO: 2744254 - DNA, 23 bp, Homo sapiens
ctccacgtggttgccgtctctgg

SEQ ID NO: 2744255 - DNA, 17 bp, Homo sapiens
ctccatcttctttgcag

SEQ ID NO: 2744256 - DNA, 19 bp, Homo sapiens
ctcccatgtgtgatgctga

SEQ ID NO: 2744257 - DNA, 13 bp, Homo sapiens
ctccttgggagga

SEQ ID NO: 2744258 - DNA, 20 bp, Homo sapiens
ctccttgggaggaagcagaa

SEQ ID NO: 2744259 - DNA, 23 bp, Homo sapiens
ctccttgggaggaagcagaataa

SEQ ID NO: 2744260 - DNA, 19 bp, Homo sapiens
ctctcaggctgtgcttacc

SEQ ID NO: 2744261 - DNA, 22 bp, Homo sapiens
ctctgtccccaccccatgggcc

SEQ ID NO: 2744262 - DNA, 19 bp, Homo sapiens
ctgagctctgcatttgtct

SEQ ID NO: 2744263 - DNA, 17 bp, Homo sapiens
ctgccttagagccaggc

SEQ ID NO: 2744264 - DNA, 19 bp, Homo sapiens
ctgccttagagccaggcac

SEQ ID NO: 2744265 - DNA, 15 bp, Homo sapiens
ctgctcagccctgga

SEQ ID NO: 2744266 - DNA, 11 bp, Homo sapiens
ctggagcctgt

SEQ ID NO: 2744267 - DNA, 13 bp, Homo sapiens
ctggagcctgtgt

SEQ ID NO: 2744268 - DNA, 15 bp, Homo sapiens
ctggagcctgtgtaa

SEQ ID NO: 2744269 - DNA, 16 bp, Homo sapiens
ctggaggtgccagcaa

SEQ ID NO: 2744270 - DNA, 19 bp, Homo sapiens
ctggaggtgccagcaaagc

SEQ ID NO: 2744271 - DNA, 18 bp, Homo sapiens
ctggagtcgtgggaagga

SEQ ID NO: 2744272 - DNA, 20 bp, Homo sapiens
ctggagtcgtgggaaggagg

SEQ ID NO: 2744273 - DNA, 17 bp, Homo sapiens
ctgtaataaatatgagt

SEQ ID NO: 2744274 - DNA, 23 bp, Homo sapiens
ctgtattgtaagtggaaaatgca

SEQ ID NO: 2744275 - DNA, 17 bp, Homo sapiens
ctgtgacagcagctctg

SEQ ID NO: 2744276 - DNA, 16 bp, Homo sapiens
ctgtgctttctattgt

SEQ ID NO: 2744277 - DNA, 13 bp, Homo sapiens
ctgtgtaacagct

SEQ ID NO: 2744278 - DNA, 16 bp, Homo sapiens
ctgtgtaacagctcct

SEQ ID NO: 2744279 - DNA, 17 bp, Homo sapiens
ctgtgtaacagctcctt

SEQ ID NO: 2744280 - DNA, 22 bp, Homo sapiens
ctgtgtaacagctccttgggag

SEQ ID NO: 2744281 - DNA, 18 bp, Homo sapiens
cttaaataaaactattta

SEQ ID NO: 2744282 - DNA, 17 bp, Homo sapiens
cttaccaagactcctgc

SEQ ID NO: 2744283 - DNA, 12 bp, Homo sapiens
cttagagccagg

SEQ ID NO: 2744284 - DNA, 17 bp, Homo sapiens
cttagagccaggcacac

SEQ ID NO: 2744285 - DNA, 14 bp, Homo sapiens
cttcacttctccca

SEQ ID NO: 2744286 - DNA, 21 bp, Homo sapiens
cttctaatatttattgcttta

SEQ ID NO: 2744287 - DNA, 18 bp, Homo sapiens
cttgaatatggaacatat

SEQ ID NO: 2744288 - DNA, 18 bp, Homo sapiens
cttgatctgctcagccct

SEQ ID NO: 2744289 - DNA, 20 bp, Homo sapiens
cttgccaacctgtaataaat

SEQ ID NO: 2744290 - DNA, 22 bp, Homo sapiens
cttgccaacctgtaataaatat

SEQ ID NO: 2744291 - DNA, 17 bp, Homo sapiens
cttgggaggaagcagaa

SEQ ID NO: 2744292 - DNA, 13 bp, Homo sapiens
ctttataaataaa

SEQ ID NO: 2744293 - DNA, 20 bp, Homo sapiens
ctttcatcaatcattgtaca

SEQ ID NO: 2744294 - DNA, 17 bp, Homo sapiens
ctttctattgtacagaa

SEQ ID NO: 2744295 - DNA, 16 bp, Homo sapiens
gaaagcctatcaaaga

SEQ ID NO: 2744296 - DNA, 15 bp, Homo sapiens
gaaataacattgcac

SEQ ID NO: 2744297 - DNA, 23 bp, Homo sapiens
gaaataacattgcactttataaa

SEQ ID NO: 2744298 - DNA, 13 bp, Homo sapiens
gaagcagaataaa

SEQ ID NO: 2744299 - DNA, 16 bp, Homo sapiens
gaagcagaataaagca

SEQ ID NO: 2744300 - DNA, 19 bp, Homo sapiens
gaagcagaataaagcaatt

SEQ ID NO: 2744301 - DNA, 20 bp, Homo sapiens
gaagcagaataaagcaattt

SEQ ID NO: 2744302 - DNA, 22 bp, Homo sapiens
gaagcagaataaagcaattttc

SEQ ID NO: 2744303 - DNA, 13 bp, Homo sapiens
gcaattttccttg

SEQ ID NO: 2744304 - DNA, 20 bp, Homo sapiens
gcaattttccttgaagccga

SEQ ID NO: 2744305 - DNA, 19 bp, Homo sapiens
gcacacactgtgctttcta

SEQ ID NO: 2744306 - DNA, 16 bp, Homo sapiens
gcagaataaagcaatt

SEQ ID NO: 2744307 - DNA, 21 bp, Homo sapiens
gcagaataaagcaattttcct

SEQ ID NO: 2744308 - DNA, 18 bp, Homo sapiens
gcagcctgggtggctatg

SEQ ID NO: 2744309 - DNA, 11 bp, Homo sapiens
gcattgttcca

SEQ ID NO: 2744310 - DNA, 14 bp, Homo sapiens
gcattgttccacac

SEQ ID NO: 2744311 - DNA, 21 bp, Homo sapiens
gcattgttccacacatttaaa

SEQ ID NO: 2744312 - DNA, 12 bp, Homo sapiens
gcatttgtctat

SEQ ID NO: 2744313 - DNA, 18 bp, Homo sapiens
gccaacctgtaataaata

SEQ ID NO: 2744314 - DNA, 14 bp, Homo sapiens
gccagcaaagcccc

SEQ ID NO: 2744315 - DNA, 19 bp, Homo sapiens
gccagggaaggctgtgcag

SEQ ID NO: 2744316 - DNA, 14 bp, Homo sapiens
gccccatgctggag

SEQ ID NO: 2744317 - DNA, 19 bp, Homo sapiens
gccccatgctggagcctgt

SEQ ID NO: 2744318 - DNA, 20 bp, Homo sapiens
gccccatgctggagcctgtg

SEQ ID NO: 2744319 - DNA, 17 bp, Homo sapiens
gccctggaggtgccagc

SEQ ID NO: 2744320 - DNA, 20 bp, Homo sapiens
gccctggaggtgccagcaaa

SEQ ID NO: 2744321 - DNA, 14 bp, Homo sapiens
gcctcatgaataaa

SEQ ID NO: 2744322 - DNA, 15 bp, Homo sapiens
gcctcatgaataaat

SEQ ID NO: 2744323 - DNA, 21 bp, Homo sapiens
gcctggagtcgtgggaaggag

SEQ ID NO: 2744324 - DNA, 22 bp, Homo sapiens
gcctgtgtaacagctccttggg

SEQ ID NO: 2744325 - DNA, 15 bp, Homo sapiens
gccttagagccaggc

SEQ ID NO: 2744326 - DNA, 23 bp, Homo sapiens
gccttagagccaggcacacactg

SEQ ID NO: 2744327 - DNA, 23 bp, Homo sapiens
gcgtgtgtgggtggatataaata

SEQ ID NO: 2744328 - DNA, 11 bp, Homo sapiens
gctcagccctg

SEQ ID NO: 2744329 - DNA, 13 bp, Homo sapiens
gctcagccctgga

SEQ ID NO: 2744330 - DNA, 15 bp, Homo sapiens
gctcagccctggagg

SEQ ID NO: 2744331 - DNA, 20 bp, Homo sapiens
gctccttgggaggaagcaga

SEQ ID NO: 2744332 - DNA, 17 bp, Homo sapiens
gctgctgcgccctgggc

SEQ ID NO: 2744333 - DNA, 22 bp, Homo sapiens
gctggagcctgtgtaacagctc

SEQ ID NO: 2744334 - DNA, 15 bp, Homo sapiens
gcttctaatatttat

SEQ ID NO: 2744335 - DNA, 20 bp, Homo sapiens
gcttctaatatttattgctt

SEQ ID NO: 2744336 - DNA, 21 bp, Homo sapiens
gcttctaatatttattgcttt

SEQ ID NO: 2744337 - DNA, 22 bp, Homo sapiens
gcttctaatatttattgcttta

SEQ ID NO: 2744338 - DNA, 17 bp, Homo sapiens
gctttctattgtacaga

SEQ ID NO: 2744339 - DNA, 12 bp, Homo sapiens
ggaacctcactc

SEQ ID NO: 2744340 - DNA, 14 bp, Homo sapiens
ggaagcagaataaa

SEQ ID NO: 2744341 - DNA, 15 bp, Homo sapiens
ggaagcagaataaag

SEQ ID NO: 2744342 - DNA, 16 bp, Homo sapiens
ggaagcagaataaagc

SEQ ID NO: 2744343 - DNA, 17 bp, Homo sapiens
ggaagcagaataaagca

SEQ ID NO: 2744344 - DNA, 19 bp, Homo sapiens
ggaagcagaataaagcaat

SEQ ID NO: 2744345 - DNA, 20 bp, Homo sapiens
ggaagcagaataaagcaatt

SEQ ID NO: 2744346 - DNA, 15 bp, Homo sapiens
ggaaggaaataacat

SEQ ID NO: 2744347 - DNA, 18 bp, Homo sapiens
ggagcctgtgtaacagct

SEQ ID NO: 2744348 - DNA, 19 bp, Homo sapiens
ggagcctgtgtaacagctc

SEQ ID NO: 2744349 - DNA, 13 bp, Homo sapiens
ggaggaagcagaa

SEQ ID NO: 2744350 - DNA, 19 bp, Homo sapiens
ggaggtgccagcaaagccc

SEQ ID NO: 2744351 - DNA, 13 bp, Homo sapiens
ggatataaatata

SEQ ID NO: 2744352 - DNA, 13 bp, Homo sapiens
ggctttagacact

SEQ ID NO: 2744353 - DNA, 19 bp, Homo sapiens
gggaacctcactcttgcca

SEQ ID NO: 2744354 - DNA, 20 bp, Homo sapiens
gggaggaagcagaataaagc

SEQ ID NO: 2744355 - DNA, 18 bp, Homo sapiens
gggcctcatgaataaatg

SEQ ID NO: 2744356 - DNA, 18 bp, Homo sapiens
ggtgccagcaaagcccca

SEQ ID NO: 2744357 - DNA, 13 bp, Homo sapiens
ggtggatataaat

SEQ ID NO: 2744358 - DNA, 21 bp, Homo sapiens
gtaacagctccttgggaggaa

SEQ ID NO: 2744359 - DNA, 15 bp, Homo sapiens
gtagatgtagcattg

SEQ ID NO: 2744360 - DNA, 14 bp, Homo sapiens
gtattatgcttctt

SEQ ID NO: 2744361 - DNA, 15 bp, Homo sapiens
gtattatgcttcttg

SEQ ID NO: 2744362 - DNA, 17 bp, Homo sapiens
gtattatgcttcttgga

SEQ ID NO: 2744363 - DNA, 21 bp, Homo sapiens
gtattgtaagtggaaaatgca

SEQ ID NO: 2744364 - DNA, 17 bp, Homo sapiens
gtcaaataaacactgtg

SEQ ID NO: 2744365 - DNA, 23 bp, Homo sapiens
gtcgagctggatgtcccacctct

SEQ ID NO: 2744366 - DNA, 13 bp, Homo sapiens
gtctctggcccct

SEQ ID NO: 2744367 - DNA, 18 bp, Homo sapiens
gtcttaaataaaactatt

SEQ ID NO: 2744368 - DNA, 23 bp, Homo sapiens
gtcttaaataaaactatttaaaa

SEQ ID NO: 2744369 - DNA, 17 bp, Homo sapiens
gtgcaatttgtttgtgc

SEQ ID NO: 2744370 - DNA, 23 bp, Homo sapiens
gtgcaatttgtttgtgcttctaa

SEQ ID NO: 2744371 - DNA, 14 bp, Homo sapiens
gtgccagcaaagcc

SEQ ID NO: 2744372 - DNA, 15 bp, Homo sapiens
gtgccagcaaagccc

SEQ ID NO: 2744373 - DNA, 19 bp, Homo sapiens
gtgcccagccagggaaggc

SEQ ID NO: 2744374 - DNA, 14 bp, Homo sapiens
gtgcttacctgtga

SEQ ID NO: 2744375 - DNA, 15 bp, Homo sapiens
gtggatataaatata

SEQ ID NO: 2744376 - DNA, 21 bp, Homo sapiens
gtgggtggatataaatatata

SEQ ID NO: 2744377 - DNA, 13 bp, Homo sapiens
gtgtgtatgtgta

SEQ ID NO: 2744378 - DNA, 22 bp, Homo sapiens
atcctgccttagagccaggcac

SEQ ID NO: 2744379 - DNA, 23 bp, Homo sapiens
atcctgccttagagccaggcaca

SEQ ID NO: 2744380 - DNA, 16 bp, Homo sapiens
atctgctcagccctgg

SEQ ID NO: 2744381 - DNA, 20 bp, Homo sapiens
atctttcatcaatcattgta

SEQ ID NO: 2744382 - DNA, 21 bp, Homo sapiens
atgcaatgtcttaaataaaac

SEQ ID NO: 2744383 - DNA, 21 bp, Homo sapiens
atgctaatataagtttctttg

SEQ ID NO: 2744384 - DNA, 11 bp, Homo sapiens
atgctgacacc

SEQ ID NO: 2744385 - DNA, 14 bp, Homo sapiens
atgctgacaccagc

SEQ ID NO: 2744386 - DNA, 16 bp, Homo sapiens
atgctggagcctgtgt

SEQ ID NO: 2744387 - DNA, 15 bp, Homo sapiens
atggaacatatgcac

SEQ ID NO: 2744388 - DNA, 14 bp, Homo sapiens
atgtagcattgttc

SEQ ID NO: 2744389 - DNA, 23 bp, Homo sapiens
atgtagcattgttccacacattt

SEQ ID NO: 2744390 - DNA, 18 bp, Homo sapiens
atgtcccacctctctgag

SEQ ID NO: 2744391 - DNA, 17 bp, Homo sapiens
atgtcttaaataaaact

SEQ ID NO: 2744392 - DNA, 15 bp, Homo sapiens
attatgcttcttgga

SEQ ID NO: 2744393 - DNA, 20 bp, Homo sapiens
attgcactttataaacactg

SEQ ID NO: 2744394 - DNA, 17 bp, Homo sapiens
attgctttataaataaa

SEQ ID NO: 2744395 - DNA, 19 bp, Homo sapiens
attgtaagtggaaaatgca

SEQ ID NO: 2744396 - DNA, 16 bp, Homo sapiens
atttgaaggacctaaa

SEQ ID NO: 2744397 - DNA, 17 bp, Homo sapiens
atttgtctattctccag

SEQ ID NO: 2744398 - DNA, 15 bp, Homo sapiens
atttgtttgtgcttc

SEQ ID NO: 2744399 - DNA, 16 bp, Homo sapiens
atttgtttgtgcttct

SEQ ID NO: 2744400 - DNA, 14 bp, Homo sapiens
attttccttgaagc

SEQ ID NO: 2744401 - DNA, 16 bp, Homo sapiens
caaagaccttgtgtgt

SEQ ID NO: 2744402 - DNA, 21 bp, Homo sapiens
caaagccccatgctggagcct

SEQ ID NO: 2744403 - DNA, 18 bp, Homo sapiens
caacctgtaataaatatg

SEQ ID NO: 2744404 - DNA, 19 bp, Homo sapiens
caacctgtaataaatatga

SEQ ID NO: 2744405 - DNA, 22 bp, Homo sapiens
caagactccctcgtcgagctgg

SEQ ID NO: 2744406 - DNA, 20 bp, Homo sapiens
caagtgtagatgtagcattg

SEQ ID NO: 2744407 - DNA, 22 bp, Homo sapiens
caagtgtagatgtagcattgtt

SEQ ID NO: 2744408 - DNA, 21 bp, Homo sapiens
caatcattgtacagtttgttt

SEQ ID NO: 2744409 - DNA, 18 bp, Homo sapiens
caatgtcttaaataaaac

SEQ ID NO: 2744410 - DNA, 19 bp, Homo sapiens
caatgtcttaaataaaact

SEQ ID NO: 2744411 - DNA, 20 bp, Homo sapiens
caatgtcttaaataaaacta

SEQ ID NO: 2744412 - DNA, 21 bp, Homo sapiens
caatgtcttaaataaaactat

SEQ ID NO: 2744413 - DNA, 13 bp, Homo sapiens
caattttccttga

SEQ ID NO: 2744414 - DNA, 12 bp, Homo sapiens
cacacatttaaa

SEQ ID NO: 2744415 - DNA, 20 bp, Homo sapiens
cacatcttgatctgctcagc

SEQ ID NO: 2744416 - DNA, 16 bp, Homo sapiens
cacatttaaaacattt

SEQ ID NO: 2744417 - DNA, 17 bp, Homo sapiens
cacatttaaaacatttg

SEQ ID NO: 2744418 - DNA, 21 bp, Homo sapiens
cactgcctcgggaacctcact

SEQ ID NO: 2744419 - DNA, 22 bp, Homo sapiens
cactgcctcgggaacctcactc

SEQ ID NO: 2744420 - DNA, 16 bp, Homo sapiens
cagaaagcctatcaaa

SEQ ID NO: 2744421 - DNA, 22 bp, Homo sapiens
cagaaagcctatcaaagacctt

SEQ ID NO: 2744422 - DNA, 14 bp, Homo sapiens
cagaataaagcaat

SEQ ID NO: 2744423 - DNA, 15 bp, Homo sapiens
cagaataaagcaatt

SEQ ID NO: 2744424 - DNA, 17 bp, Homo sapiens
cagaataaagcaatttt

SEQ ID NO: 2744425 - DNA, 21 bp, Homo sapiens
cagaataaagcaattttcctt

SEQ ID NO: 2744426 - DNA, 22 bp, Homo sapiens
cagaataaagcaattttccttg

SEQ ID NO: 2744427 - DNA, 21 bp, Homo sapiens
cagcaaagccccatgctggag

SEQ ID NO: 2744428 - DNA, 11 bp, Homo sapiens
cagcagctctg

SEQ ID NO: 2744429 - DNA, 14 bp, Homo sapiens
cagccagggaaggc

SEQ ID NO: 2744430 - DNA, 12 bp, Homo sapiens
cagccctggagg

SEQ ID NO: 2744431 - DNA, 17 bp, Homo sapiens
cagccctggaggtgcca

SEQ ID NO: 2744432 - DNA, 19 bp, Homo sapiens
cagccctggaggtgccagc

SEQ ID NO: 2744433 - DNA, 23 bp, Homo sapiens
caggcacacactgtgctttctat

SEQ ID NO: 2744434 - DNA, 17 bp, Homo sapiens
cagggaaggctgtgcag

SEQ ID NO: 2744435 - DNA, 19 bp, Homo sapiens
cagggacgtctcatctccc

SEQ ID NO: 2744436 - DNA, 18 bp, Homo sapiens
cagtgtcaaataaacact

SEQ ID NO: 2744437 - DNA, 21 bp, Homo sapiens
cagtgtcaaataaacactgtg

SEQ ID NO: 2744438 - DNA, 18 bp, Homo sapiens
cagttggaaatccatcca

SEQ ID NO: 2744439 - DNA, 21 bp, Homo sapiens
catcttctttgcagcctgggt

SEQ ID NO: 2744440 - DNA, 22 bp, Homo sapiens
catcttctttgcagcctgggtg

SEQ ID NO: 2744441 - DNA, 23 bp, Homo sapiens
catcttgatctgctcagccctgg

SEQ ID NO: 2744442 - DNA, 17 bp, Homo sapiens
catctttcatcaatcat

SEQ ID NO: 2744443 - DNA, 22 bp, Homo sapiens
catgctaatataagtttctttg

SEQ ID NO: 2744444 - DNA, 12 bp, Homo sapiens
catgctggagcc

SEQ ID NO: 2744445 - DNA, 13 bp, Homo sapiens
catgctggagcct

SEQ ID NO: 2744446 - DNA, 14 bp, Homo sapiens
catgctggagcctg

SEQ ID NO: 2744447 - DNA, 21 bp, Homo sapiens
catgggcctcatgaataaatg

SEQ ID NO: 2744448 - DNA, 14 bp, Homo sapiens
catgtgtgatgctg

SEQ ID NO: 2744449 - DNA, 11 bp, Homo sapiens
cattgttccac

SEQ ID NO: 2744450 - DNA, 14 bp, Homo sapiens
cattgttccacaca

SEQ ID NO: 2744451 - DNA, 14 bp, Homo sapiens
ccaaaccaccttcc

SEQ ID NO: 2744452 - DNA, 18 bp, Homo sapiens
ccaacctgtaataaatat

SEQ ID NO: 2744453 - DNA, 21 bp, Homo sapiens
ccaacctgtaataaatatgag

SEQ ID NO: 2744454 - DNA, 14 bp, Homo sapiens
ccaagactcctgca

SEQ ID NO: 2744455 - DNA, 17 bp, Homo sapiens
ccaagactcctgcaaaa

SEQ ID NO: 2744456 - DNA, 19 bp, Homo sapiens
ccaagtgtagatgtagcat

SEQ ID NO: 2744457 - DNA, 22 bp, Homo sapiens
ccaagtgtagatgtagcattgt

SEQ ID NO: 2744458 - DNA, 20 bp, Homo sapiens
ccacatcttgatctgctcag

SEQ ID NO: 2744459 - DNA, 13 bp, Homo sapiens
ccagcaaagcccc

SEQ ID NO: 2744460 - DNA, 14 bp, Homo sapiens
ccagcaaagcccca

SEQ ID NO: 2744461 - DNA, 19 bp, Homo sapiens
ccagcaaagccccatgctg

SEQ ID NO: 2744462 - DNA, 17 bp, Homo sapiens
ccagctatttttactag

SEQ ID NO: 2744463 - DNA, 12 bp, Homo sapiens
ccatgctggagc

SEQ ID NO: 2744464 - DNA, 13 bp, Homo sapiens
ccatgctggagcc

SEQ ID NO: 2744465 - DNA, 16 bp, Homo sapiens
ccatgctggagcctgt

SEQ ID NO: 2744466 - DNA, 19 bp, Homo sapiens
ccatgctggagcctgtgta

SEQ ID NO: 2744467 - DNA, 24 bp, Homo sapiens
ccatgctggagcctgtgtaacagc

SEQ ID NO: 2744468 - DNA, 22 bp, Homo sapiens
ccatgggcctcatgaataaatg

SEQ ID NO: 2744469 - DNA, 17 bp, Homo sapiens
ccatgtgtgatgctgac

SEQ ID NO: 2744470 - DNA, 18 bp, Homo sapiens
ccatgtgtgatgctgaca

SEQ ID NO: 2744471 - DNA, 17 bp, Homo sapiens
ccatgttccaataaaca

SEQ ID NO: 2744472 - DNA, 19 bp, Homo sapiens
cccatgctggagcctgtgt

SEQ ID NO: 2744473 - DNA, 17 bp, Homo sapiens
cccatgtgtgatgctga

SEQ ID NO: 2744474 - DNA, 23 bp, Homo sapiens
cccatgtgtgatgctgacaccag

SEQ ID NO: 2744475 - DNA, 14 bp, Homo sapiens
ccccatgctggagc

SEQ ID NO: 2744476 - DNA, 15 bp, Homo sapiens
ccccatgctggagcc

SEQ ID NO: 2744477 - DNA, 12 bp, Homo sapiens
aaaacatttgaa

SEQ ID NO: 2744478 - DNA, 15 bp, Homo sapiens
aaacactgtgtaagc

SEQ ID NO: 2744479 - DNA, 16 bp, Homo sapiens
aaactatttaaaattg

SEQ ID NO: 2744480 - DNA, 17 bp, Homo sapiens
aaactatttaaaattgg

SEQ ID NO: 2744481 - DNA, 17 bp, Homo sapiens
aaagcaattttccttga

SEQ ID NO: 2744482 - DNA, 19 bp, Homo sapiens
aaagcaattttccttgaag

SEQ ID NO: 2744483 - DNA, 20 bp, Homo sapiens
aaagcaattttccttgaagc

SEQ ID NO: 2744484 - DNA, 18 bp, Homo sapiens
aaagccccatgctggagc

SEQ ID NO: 2744485 - DNA, 13 bp, Homo sapiens
aaataaacactgt

SEQ ID NO: 2744486 - DNA, 14 bp, Homo sapiens
aaataaatatatat

SEQ ID NO: 2744487 - DNA, 13 bp, Homo sapiens
aaataacattgca

SEQ ID NO: 2744488 - DNA, 14 bp, Homo sapiens
aaataacattgcac

SEQ ID NO: 2744489 - DNA, 16 bp, Homo sapiens
cagtgtcaaataaaca

SEQ ID NO: 2744490 - DNA, 17 bp, Homo sapiens
cagtgtcaaataaacac

SEQ ID NO: 2744491 - DNA, 13 bp, Homo sapiens
cagtttgtttaca

SEQ ID NO: 2744492 - DNA, 14 bp, Homo sapiens
catcaatcattgta

SEQ ID NO: 2744493 - DNA, 21 bp, Homo sapiens
tcgtagcaaattctgtggcag

SEQ ID NO: 2744494 - DNA, 10 bp, Homo sapiens
tcgtctttgc

SEQ ID NO: 2744495 - DNA, 21 bp, Homo sapiens
tctcaatacttgaatatggaa

SEQ ID NO: 2744496 - DNA, 23 bp, Homo sapiens
tctcaatacttgaatatggaaca

SEQ ID NO: 2744497 - DNA, 18 bp, Homo sapiens
tctcaggctgtgcttacc

SEQ ID NO: 2744498 - DNA, 22 bp, Homo sapiens
tctcaggctgtgcttacctgtg

SEQ ID NO: 2744499 - DNA, 17 bp, Homo sapiens
tctctccatctaccttc

SEQ ID NO: 2744500 - DNA, 16 bp, Homo sapiens
tctctgagctctgcat

SEQ ID NO: 2744501 - DNA, 18 bp, Homo sapiens
tctgagctctgcatttgt

SEQ ID NO: 2744502 - DNA, 14 bp, Homo sapiens
tctgcatttgtcta

SEQ ID NO: 2744503 - DNA, 13 bp, Homo sapiens
aaaactatttaaa

SEQ ID NO: 2744504 - DNA, 19 bp, Homo sapiens
aaaactatttaaaattggc

SEQ ID NO: 2744505 - DNA, 22 bp, Homo sapiens
aaaagttaagctgctatagtaa

SEQ ID NO: 2744506 - DNA, 16 bp, Homo sapiens
aaacactgtattgtaa

SEQ ID NO: 2744507 - DNA, 19 bp, Homo sapiens
aaactatttaaaattggca

SEQ ID NO: 2744508 - DNA, 20 bp, Homo sapiens
aaactatttaaaattggcac

SEQ ID NO: 2744509 - DNA, 17 bp, Homo sapiens
aaagaccttgtgtgtat

SEQ ID NO: 2744510 - DNA, 23 bp, Homo sapiens
aaagaccttgtgtgtatgtgtac

SEQ ID NO: 2744511 - DNA, 12 bp, Homo sapiens
aaagcaattttc

SEQ ID NO: 2744512 - DNA, 13 bp, Homo sapiens
aaagcaattttcc

SEQ ID NO: 2744513 - DNA, 16 bp, Homo sapiens
aaagcaattttccttg

SEQ ID NO: 2744514 - DNA, 18 bp, Homo sapiens
aaagcaattttccttgaa

SEQ ID NO: 2744515 - DNA, 21 bp, Homo sapiens
aaagccccatgctggagcctg

SEQ ID NO: 2744516 - DNA, 15 bp, Homo sapiens
aaataaaactattta

SEQ ID NO: 2744517 - DNA, 11 bp, Homo sapiens
aaataaatata

SEQ ID NO: 2744518 - DNA, 12 bp, Homo sapiens
aaataaatatat

SEQ ID NO: 2744519 - DNA, 22 bp, Homo sapiens
aaataacattgcactttataaa

SEQ ID NO: 2744520 - DNA, 17 bp, Homo sapiens
aaatatatataaatata

SEQ ID NO: 2744521 - DNA, 19 bp, Homo sapiens
aaatatatataaatatata

SEQ ID NO: 2744522 - DNA, 21 bp, Homo sapiens
aaatatatataaatatatata

SEQ ID NO: 2744523 - DNA, 12 bp, Homo sapiens
aaatatatatat

SEQ ID NO: 2744524 - DNA, 22 bp, Homo sapiens
aacacagaaagcctatcaaaga

SEQ ID NO: 2744525 - DNA, 17 bp, Homo sapiens
aacactgtattgtaagt

SEQ ID NO: 2744526 - DNA, 14 bp, Homo sapiens
aacagctccttggg

SEQ ID NO: 2744527 - DNA, 23 bp, Homo sapiens
aacagctccttgggaggaagcag

SEQ ID NO: 2744528 - DNA, 23 bp, Homo sapiens
aacattgcactttataaacactg

SEQ ID NO: 2744529 - DNA, 17 bp, Homo sapiens
aacctcactcttgccaa

SEQ ID NO: 2744530 - DNA, 18 bp, Homo sapiens
aactatttaaaattggca

SEQ ID NO: 2744531 - DNA, 19 bp, Homo sapiens
aactatttaaaattggcac

SEQ ID NO: 2744532 - DNA, 18 bp, Homo sapiens
aagaccttgtgtgtatgt

SEQ ID NO: 2744533 - DNA, 20 bp, Homo sapiens
aagcaattttccttgaagcc

SEQ ID NO: 2744534 - DNA, 21 bp, Homo sapiens
aagcaattttccttgaagccg

SEQ ID NO: 2744535 - DNA, 11 bp, Homo sapiens
aagcagaataa

SEQ ID NO: 2744536 - DNA, 18 bp, Homo sapiens
aagcagaataaagcaatt

SEQ ID NO: 2744537 - DNA, 22 bp, Homo sapiens
aagcagaataaagcaattttcc

SEQ ID NO: 2744538 - DNA, 17 bp, Homo sapiens
aagccccatgctggagc

SEQ ID NO: 2744539 - DNA, 19 bp, Homo sapiens
aagccccatgctggagcct

SEQ ID NO: 2744540 - DNA, 20 bp, Homo sapiens
aagccccatgctggagcctg

SEQ ID NO: 2744541 - DNA, 15 bp, Homo sapiens
aaggaaataacattg

SEQ ID NO: 2744542 - DNA, 13 bp, Homo sapiens
aagttactgggca

SEQ ID NO: 2744543 - DNA, 23 bp, Homo sapiens
aataaaactatttaaaattggca

SEQ ID NO: 2744544 - DNA, 10 bp, Homo sapiens
aataaacact

SEQ ID NO: 2744545 - DNA, 12 bp, Homo sapiens
aataaacaggag

SEQ ID NO: 2744546 - DNA, 15 bp, Homo sapiens
aataaagcaattttc

SEQ ID NO: 2744547 - DNA, 12 bp, Homo sapiens
gagccaggcaca

SEQ ID NO: 2744548 - DNA, 13 bp, Homo sapiens
gagccaggcacac

SEQ ID NO: 2744549 - DNA, 22 bp, Homo sapiens
gagcctgtgtaacagctccttg

SEQ ID NO: 2744550 - DNA, 20 bp, Homo sapiens
gaggaagcagaataaagcaa

SEQ ID NO: 2744551 - DNA, 21 bp, Homo sapiens
gaggaagcagaataaagcaat

SEQ ID NO: 2744552 - DNA, 19 bp, Homo sapiens
gaggtgccagcaaagcccc

SEQ ID NO: 2744553 - DNA, 13 bp, Homo sapiens
gatataaatatat

SEQ ID NO: 2744554 - DNA, 15 bp, Homo sapiens
gatctgctcagccct

SEQ ID NO: 2744555 - DNA, 13 bp, Homo sapiens
gatgctgacacca

SEQ ID NO: 2744556 - DNA, 21 bp, Homo sapiens
gcaaagccccatgctggagcc

SEQ ID NO: 2744557 - DNA, 22 bp, Homo sapiens
gcaatgtcttaaataaaactat

SEQ ID NO: 2744558 - DNA, 20 bp, Homo sapiens
gcaatttgtttgtgcttcta

SEQ ID NO: 2744559 - DNA, 15 bp, Homo sapiens
gcaattttccttgaa

SEQ ID NO: 2744560 - DNA, 19 bp, Homo sapiens
gcaattttccttgaagccg

SEQ ID NO: 2744561 - DNA, 12 bp, Homo sapiens
gcagaataaagc

SEQ ID NO: 2744562 - DNA, 13 bp, Homo sapiens
gcagaataaagca

SEQ ID NO: 2744563 - DNA, 19 bp, Homo sapiens
gcagaataaagcaattttc

SEQ ID NO: 2744564 - DNA, 12 bp, Homo sapiens
gcagcataaagg

SEQ ID NO: 2744565 - DNA, 14 bp, Homo sapiens
gcataaaggccttt

SEQ ID NO: 2744566 - DNA, 14 bp, Homo sapiens
gcatatcacttgat

SEQ ID NO: 2744567 - DNA, 21 bp, Homo sapiens
gcatcctgccttagagccagg

SEQ ID NO: 2744568 - DNA, 20 bp, Homo sapiens
gccaacctgtaataaatatg

SEQ ID NO: 2744569 - DNA, 21 bp, Homo sapiens
gccaacctgtaataaatatga

SEQ ID NO: 2744570 - DNA, 16 bp, Homo sapiens
gccagcaaagccccat

SEQ ID NO: 2744571 - DNA, 23 bp, Homo sapiens
gccagcaaagccccatgctggag

SEQ ID NO: 2744572 - DNA, 15 bp, Homo sapiens
gccaggcacacactg

SEQ ID NO: 2744573 - DNA, 22 bp, Homo sapiens
gccaggcacacactgtgctttc

SEQ ID NO: 2744574 - DNA, 23 bp, Homo sapiens
gccaggcacacactgtgctttct

SEQ ID NO: 2744575 - DNA, 22 bp, Homo sapiens
gccagggaaggctgtgcaggga

SEQ ID NO: 2744576 - DNA, 20 bp, Homo sapiens
gccatgttccaataaacagg

SEQ ID NO: 2744577 - DNA, 13 bp, Homo sapiens
gccccatgctgga

SEQ ID NO: 2744578 - DNA, 16 bp, Homo sapiens
gccccatgctggagcc

SEQ ID NO: 2744579 - DNA, 21 bp, Homo sapiens
gccccatgctggagcctgtgt

SEQ ID NO: 2744580 - DNA, 23 bp, Homo sapiens
gccccatgctggagcctgtgtaa

SEQ ID NO: 2744581 - DNA, 20 bp, Homo sapiens
gccccatttatccacctcca

SEQ ID NO: 2744582 - DNA, 18 bp, Homo sapiens
gccctggaggtgccagca

SEQ ID NO: 2744583 - DNA, 24 bp, Homo sapiens
gccctggaggtgccagcaaagccc

SEQ ID NO: 2744584 - DNA, 23 bp, Homo sapiens
gcctatcaaagaccttgtgtgta

SEQ ID NO: 2744585 - DNA, 23 bp, Homo sapiens
gcctcgggaacctcactcttgcc

SEQ ID NO: 2744586 - DNA, 14 bp, Homo sapiens
gcctgtgtaacagc

SEQ ID NO: 2744587 - DNA, 18 bp, Homo sapiens
gcctgtgtaacagctcct

SEQ ID NO: 2744588 - DNA, 23 bp, Homo sapiens
gcggcctggagtcgtgggaagga

SEQ ID NO: 2744589 - DNA, 16 bp, Homo sapiens
gcgtgtgtgggtggat

SEQ ID NO: 2744590 - DNA, 14 bp, Homo sapiens
gctcagccctggag

SEQ ID NO: 2744591 - DNA, 16 bp, Homo sapiens
gctccttgggaggaag

SEQ ID NO: 2744592 - DNA, 22 bp, Homo sapiens
gctcgctgctgcgccctgggct

SEQ ID NO: 2744593 - DNA, 15 bp, Homo sapiens
gctctgcatttgtct

SEQ ID NO: 2744594 - DNA, 21 bp, Homo sapiens
gctctgtccccaccccatggg

SEQ ID NO: 2744595 - DNA, 23 bp, Homo sapiens
gctgccccatttatccacctcca

SEQ ID NO: 2744596 - DNA, 15 bp, Homo sapiens
gctgcgccctgggct

SEQ ID NO: 2744597 - DNA, 10 bp, Homo sapiens
gctggagcct

SEQ ID NO: 2744598 - DNA, 11 bp, Homo sapiens
gctggagcctg

SEQ ID NO: 2744599 - DNA, 14 bp, Homo sapiens
gctggagcctgtgt

SEQ ID NO: 2744600 - DNA, 13 bp, Homo sapiens
gctgtgcttacct

SEQ ID NO: 2744601 - DNA, 22 bp, Homo sapiens
gctgtgcttacctgtgacagca

SEQ ID NO: 2744602 - DNA, 21 bp, Homo sapiens
gctttagacactggctgccag

SEQ ID NO: 2744603 - DNA, 15 bp, Homo sapiens
gctttctattgtaca

SEQ ID NO: 2744604 - DNA, 12 bp, Homo sapiens
ggaagcagaata

SEQ ID NO: 2744605 - DNA, 13 bp, Homo sapiens
ggaagcagaataa

SEQ ID NO: 2744606 - DNA, 15 bp, Homo sapiens
ggagcctgtgtaaca

SEQ ID NO: 2744607 - DNA, 16 bp, Homo sapiens
ggagcctgtgtaacag

SEQ ID NO: 2744608 - DNA, 17 bp, Homo sapiens
ggagcctgtgtaacagc

SEQ ID NO: 2744609 - DNA, 20 bp, Homo sapiens
ggagcctgtgtaacagctcc

SEQ ID NO: 2744610 - DNA, 21 bp, Homo sapiens
ggagcctgtgtaacagctcct

SEQ ID NO: 2744611 - DNA, 12 bp, Homo sapiens
ggaggaagcaga

SEQ ID NO: 2744612 - DNA, 17 bp, Homo sapiens
ggaggaagcagaataaa

SEQ ID NO: 2744613 - DNA, 19 bp, Homo sapiens
ggaggaagcagaataaagc

SEQ ID NO: 2744614 - DNA, 20 bp, Homo sapiens
ggaggaagcagaataaagca

SEQ ID NO: 2744615 - DNA, 17 bp, Homo sapiens
ggaggtcgtgtatttgg

SEQ ID NO: 2744616 - DNA, 13 bp, Homo sapiens
ggccatgttccaa

SEQ ID NO: 2744617 - DNA, 17 bp, Homo sapiens
ggccatgttccaataaa

SEQ ID NO: 2744618 - DNA, 23 bp, Homo sapiens
ggcccctctcaggctgtgcttac

SEQ ID NO: 2744619 - DNA, 15 bp, Homo sapiens
ggcctcatgaataaa

SEQ ID NO: 2744620 - DNA, 12 bp, Homo sapiens
gggaacctcact

SEQ ID NO: 2744621 - DNA, 16 bp, Homo sapiens
gggaaggaaataacat

SEQ ID NO: 2744622 - DNA, 18 bp, Homo sapiens
gggacgtctcatctccca

SEQ ID NO: 2744623 - DNA, 14 bp, Homo sapiens
gggaggaagcagaa

SEQ ID NO: 2744624 - DNA, 15 bp, Homo sapiens
gggaggaagcagaat

SEQ ID NO: 2744625 - DNA, 17 bp, Homo sapiens
gggctcgtctttgcaga

SEQ ID NO: 2744626 - DNA, 18 bp, Homo sapiens
gtaacagctccttgggag

SEQ ID NO: 2744627 - DNA, 23 bp, Homo sapiens
gtaacagctccttgggaggaagc

SEQ ID NO: 2744628 - DNA, 13 bp, Homo sapiens
gtaataaatatga

SEQ ID NO: 2744629 - DNA, 16 bp, Homo sapiens
gtaataaatatgagtg

SEQ ID NO: 2744630 - DNA, 15 bp, Homo sapiens
gtagcattgttccac

SEQ ID NO: 2744631 - DNA, 16 bp, Homo sapiens
gtagcattgttccaca

SEQ ID NO: 2744632 - DNA, 21 bp, Homo sapiens
gtatgtgtacgtgtgtgtgcg

SEQ ID NO: 2744633 - DNA, 12 bp, Homo sapiens
gtattatgcttc

SEQ ID NO: 2744634 - DNA, 12 bp, Homo sapiens
gtcaaataaaca

SEQ ID NO: 2744635 - DNA, 13 bp, Homo sapiens
gtcaaataaacac

SEQ ID NO: 2744636 - DNA, 14 bp, Homo sapiens
gtcaaataaacact

SEQ ID NO: 2744637 - DNA, 15 bp, Homo sapiens
gtcaaataaacactg

SEQ ID NO: 2744638 - DNA, 13 bp, Homo sapiens
gtcgtgggaagga

SEQ ID NO: 2744639 - DNA, 17 bp, Homo sapiens
gtctattctccagctga

SEQ ID NO: 2744640 - DNA, 12 bp, Homo sapiens
gtctgttagcca

SEQ ID NO: 2744641 - DNA, 14 bp, Homo sapiens
gtcttaaataaaac

SEQ ID NO: 2744642 - DNA, 16 bp, Homo sapiens
gtcttaaataaaacta

SEQ ID NO: 2744643 - DNA, 22 bp, Homo sapiens
gtcttaaataaaactatttaaa

SEQ ID NO: 2744644 - DNA, 17 bp, Homo sapiens
gtgccagcaaagcccca

SEQ ID NO: 2744645 - DNA, 18 bp, Homo sapiens
gtgccagcaaagccccat

SEQ ID NO: 2744646 - DNA, 19 bp, Homo sapiens
gtgccagcaaagccccatg

SEQ ID NO: 2744647 - DNA, 21 bp, Homo sapiens
tggcccctctcaggctgtgct

SEQ ID NO: 2744648 - DNA, 22 bp, Homo sapiens
tggctgccccatttatccacct

SEQ ID NO: 2744649 - DNA, 12 bp, Homo sapiens
tgggaggaagca

SEQ ID NO: 2744650 - DNA, 13 bp, Homo sapiens
tgggaggaagcag

SEQ ID NO: 2744651 - DNA, 18 bp, Homo sapiens
tgggaggaagcagaataa

SEQ ID NO: 2744652 - DNA, 19 bp, Homo sapiens
tgggaggaagcagaataaa

SEQ ID NO: 2744653 - DNA, 22 bp, Homo sapiens
tgggaggaagcagaataaagca

SEQ ID NO: 2744654 - DNA, 16 bp, Homo sapiens
tgggcctcatgaataa

SEQ ID NO: 2744655 - DNA, 17 bp, Homo sapiens
tgggcctcatgaataaa

SEQ ID NO: 2744656 - DNA, 20 bp, Homo sapiens
tgggtggatataaatatata

SEQ ID NO: 2744657 - DNA, 19 bp, Homo sapiens
tggttgccgtctctggccc

SEQ ID NO: 2744658 - DNA, 18 bp, Homo sapiens
tgtaacagctccttggga

SEQ ID NO: 2744659 - DNA, 12 bp, Homo sapiens
tgtaataaatat

SEQ ID NO: 2744660 - DNA, 14 bp, Homo sapiens
tgtaataaatatga

SEQ ID NO: 2744661 - DNA, 13 bp, Homo sapiens
tgtacagtttgtt

SEQ ID NO: 2744662 - DNA, 14 bp, Homo sapiens
tgtacagtttgttt

SEQ ID NO: 2744663 - DNA, 16 bp, Homo sapiens
tgtagcattgttccac

SEQ ID NO: 2744664 - DNA, 17 bp, Homo sapiens
tgtagcattgttccaca

SEQ ID NO: 2744665 - DNA, 16 bp, Homo sapiens
tgtgacagcagctctg

SEQ ID NO: 2744666 - DNA, 20 bp, Homo sapiens
tgtgcgtgcttgagtgtgtt

SEQ ID NO: 2744667 - DNA, 17 bp, Homo sapiens
tgtgctttctattgtac

SEQ ID NO: 2744668 - DNA, 20 bp, Homo sapiens
tgtgggtggatataaatata

SEQ ID NO: 2744669 - DNA, 23 bp, Homo sapiens
tgtgtgggtggatataaatatat

SEQ ID NO: 2744670 - DNA, 13 bp, Homo sapiens
ttaaaattggcac

SEQ ID NO: 2744671 - DNA, 14 bp, Homo sapiens
ttaaaattggcacc

SEQ ID NO: 2744672 - DNA, 19 bp, Homo sapiens
ttacacacgtgcaatttgt

SEQ ID NO: 2744673 - DNA, 23 bp, Homo sapiens
ttagacactggctgccagctatt

SEQ ID NO: 2744674 - DNA, 14 bp, Homo sapiens
ttcacttctcccaa

SEQ ID NO: 2744675 - DNA, 16 bp, Homo sapiens
ttcatcaatcattgta

SEQ ID NO: 2744676 - DNA, 14 bp, Homo sapiens
ttccacacatttaa

SEQ ID NO: 2744677 - DNA, 14 bp, Homo sapiens
ttccttgaagccga

SEQ ID NO: 2744678 - DNA, 19 bp, Homo sapiens
ttctaatatttattgcttt

SEQ ID NO: 2744679 - DNA, 21 bp, Homo sapiens
ttctaatatttattgctttat

SEQ ID NO: 2744680 - DNA, 14 bp, Homo sapiens
ttctattgtacaga

SEQ ID NO: 2744681 - DNA, 15 bp, Homo sapiens
ttctattgtacagaa

SEQ ID NO: 2744682 - DNA, 19 bp, Homo sapiens
ttgaaggacctaaattcgt

SEQ ID NO: 2744683 - DNA, 17 bp, Homo sapiens
ttgatctgctcagccct

SEQ ID NO: 2744684 - DNA, 18 bp, Homo sapiens
ttgatctgctcagccctg

SEQ ID NO: 2744685 - DNA, 21 bp, Homo sapiens
ttgatctgctcagccctggag

SEQ ID NO: 2744686 - DNA, 21 bp, Homo sapiens
ttgccaacctgtaataaatat

SEQ ID NO: 2744687 - DNA, 14 bp, Homo sapiens
ttgggaggaagcag

SEQ ID NO: 2744688 - DNA, 21 bp, Homo sapiens
ttgggaggaagcagaataaag

SEQ ID NO: 2744689 - DNA, 11 bp, Homo sapiens
ttgtacagttt

SEQ ID NO: 2744690 - DNA, 20 bp, Homo sapiens
ttgtacagtttgtttacaca

SEQ ID NO: 2744691 - DNA, 11 bp, Homo sapiens
ttgtgcttcta

SEQ ID NO: 2744692 - DNA, 11 bp, Homo sapiens
ttgtttgtgct

SEQ ID NO: 2744693 - DNA, 14 bp, Homo sapiens
tttgtgcttctaat

SEQ ID NO: 2744694 - DNA, 15 bp, Homo sapiens
ttttccttgaagccg

SEQ ID NO: 2744695 - DNA, 18 bp, Homo sapiens
atggaacatatgcacagg

SEQ ID NO: 2744696 - DNA, 17 bp, Homo sapiens
atgggcctcatgaataa

SEQ ID NO: 2744697 - DNA, 24 bp, Homo sapiens
atgtagcattgttccacacattta

SEQ ID NO: 2744698 - DNA, 22 bp, Homo sapiens
atgtcttaaataaaactattta

SEQ ID NO: 2744699 - DNA, 13 bp, Homo sapiens
atgtgtgatgctg

SEQ ID NO: 2744700 - DNA, 14 bp, Homo sapiens
atgtgtgatgctga

SEQ ID NO: 2744701 - DNA, 16 bp, Homo sapiens
attgctttataaataa

SEQ ID NO: 2744702 - DNA, 16 bp, Homo sapiens
attgtacagtttgttt

SEQ ID NO: 2744703 - DNA, 12 bp, Homo sapiens
atttaaaacatt

SEQ ID NO: 2744704 - DNA, 13 bp, Homo sapiens
atttaaaacattt

SEQ ID NO: 2744705 - DNA, 14 bp, Homo sapiens
atttaaaattggca

SEQ ID NO: 2744706 - DNA, 15 bp, Homo sapiens
atttaaaattggcac

SEQ ID NO: 2744707 - DNA, 12 bp, Homo sapiens
atttattgcttt

SEQ ID NO: 2744708 - DNA, 13 bp, Homo sapiens
atttattgcttta

SEQ ID NO: 2744709 - DNA, 14 bp, Homo sapiens
atttattgctttat

SEQ ID NO: 2744710 - DNA, 17 bp, Homo sapiens
atttgtttgtgcttcta

SEQ ID NO: 2744711 - DNA, 21 bp, Homo sapiens
atttttactagaacacagaaa

SEQ ID NO: 2744712 - DNA, 15 bp, Homo sapiens
caaagccccatgctg

SEQ ID NO: 2744713 - DNA, 12 bp, Homo sapiens
caaataaacact

SEQ ID NO: 2744714 - DNA, 16 bp, Homo sapiens
caacctgtaataaata

SEQ ID NO: 2744715 - DNA, 17 bp, Homo sapiens
caacctgtaataaatat

SEQ ID NO: 2744716 - DNA, 21 bp, Homo sapiens
caagtgtagatgtagcattgt

SEQ ID NO: 2744717 - DNA, 13 bp, Homo sapiens
caatcattgtaca

SEQ ID NO: 2744718 - DNA, 14 bp, Homo sapiens
caatcattgtacag

SEQ ID NO: 2744719 - DNA, 22 bp, Homo sapiens
caatcattgtacagtttgttta

SEQ ID NO: 2744720 - DNA, 18 bp, Homo sapiens
caatttgtttgtgcttct

SEQ ID NO: 2744721 - DNA, 19 bp, Homo sapiens
caatttgtttgtgcttcta

SEQ ID NO: 2744722 - DNA, 10 bp, Homo sapiens
caattttcct

SEQ ID NO: 2744723 - DNA, 14 bp, Homo sapiens
caattttccttgaa

SEQ ID NO: 2744724 - DNA, 15 bp, Homo sapiens
cacactgtgctttct

SEQ ID NO: 2744725 - DNA, 23 bp, Homo sapiens
cacagaaagcctatcaaagacct

SEQ ID NO: 2744726 - DNA, 18 bp, Homo sapiens
cacaggggaaggaaataa

SEQ ID NO: 2744727 - DNA, 14 bp, Homo sapiens
cactggctgccagc

SEQ ID NO: 2744728 - DNA, 17 bp, Homo sapiens
cactgtgctttctattg

SEQ ID NO: 2744729 - DNA, 12 bp, Homo sapiens
cactgtgtaagc

SEQ ID NO: 2744730 - DNA, 13 bp, Homo sapiens
cagaataaagcaa

SEQ ID NO: 2744731 - DNA, 18 bp, Homo sapiens
cagaataaagcaattttc

SEQ ID NO: 2744732 - DNA, 12 bp, Homo sapiens
cagcaaagcccc

SEQ ID NO: 2744733 - DNA, 18 bp, Homo sapiens
cagcagctctgtccccac

SEQ ID NO: 2744734 - DNA, 18 bp, Homo sapiens
cagccctggaggtgccag

SEQ ID NO: 2744735 - DNA, 16 bp, Homo sapiens
cagctatttttactag

SEQ ID NO: 2744736 - DNA, 20 bp, Homo sapiens
cagctccttgggaggaagca

SEQ ID NO: 2744737 - DNA, 22 bp, Homo sapiens
cagctccttgggaggaagcaga

SEQ ID NO: 2744738 - DNA, 23 bp, Homo sapiens
cagctccttgggaggaagcagaa

SEQ ID NO: 2744739 - DNA, 20 bp, Homo sapiens
caggatgacggtattatgct

SEQ ID NO: 2744740 - DNA, 21 bp, Homo sapiens
caggatgacggtattatgctt

SEQ ID NO: 2744741 - DNA, 20 bp, Homo sapiens
cagggacgtctcatctccca

SEQ ID NO: 2744742 - DNA, 19 bp, Homo sapiens
cagtgtcaaataaacactg

SEQ ID NO: 2744743 - DNA, 18 bp, Homo sapiens
cagtttgtttacacacgt

SEQ ID NO: 2744744 - DNA, 23 bp, Homo sapiens
catagtggacattgttggcagca

SEQ ID NO: 2744745 - DNA, 21 bp, Homo sapiens
catcctgccttagagccaggc

SEQ ID NO: 2744746 - DNA, 23 bp, Homo sapiens
catcctgccttagagccaggcac

SEQ ID NO: 2744747 - DNA, 14 bp, Homo sapiens
catctcccatgtgt

SEQ ID NO: 2744748 - DNA, 11 bp, Homo sapiens
catctctctcc

SEQ ID NO: 2744749 - DNA, 20 bp, Homo sapiens
catcttgatctgctcagccc

SEQ ID NO: 2744750 - DNA, 16 bp, Homo sapiens
catgaataaatggctt

SEQ ID NO: 2744751 - DNA, 15 bp, Homo sapiens
catgctggagcctgt

SEQ ID NO: 2744752 - DNA, 17 bp, Homo sapiens
catgctggagcctgtgt

SEQ ID NO: 2744753 - DNA, 17 bp, Homo sapiens
catgttccaataaacag

SEQ ID NO: 2744754 - DNA, 19 bp, Homo sapiens
catgttccaataaacagga

SEQ ID NO: 2744755 - DNA, 13 bp, Homo sapiens
cattgtacagttt

SEQ ID NO: 2744756 - DNA, 14 bp, Homo sapiens
cattgtacagtttg

SEQ ID NO: 2744757 - DNA, 20 bp, Homo sapiens
cattgtacagtttgtttaca

SEQ ID NO: 2744758 - DNA, 21 bp, Homo sapiens
cattgtacagtttgtttacac

SEQ ID NO: 2744759 - DNA, 22 bp, Homo sapiens
cattgtacagtttgtttacaca

SEQ ID NO: 2744760 - DNA, 13 bp, Homo sapiens
catttaaaacatt

SEQ ID NO: 2744761 - DNA, 20 bp, Homo sapiens
catttatccacctccatctt

SEQ ID NO: 2744762 - DNA, 22 bp, Homo sapiens
catttgtctattctccagctga

SEQ ID NO: 2744763 - DNA, 16 bp, Homo sapiens
ccaaaccaccttccct

SEQ ID NO: 2744764 - DNA, 16 bp, Homo sapiens
ccaacctgtaataaat

SEQ ID NO: 2744765 - DNA, 20 bp, Homo sapiens
ccaacctgtaataaatatga

SEQ ID NO: 2744766 - DNA, 13 bp, Homo sapiens
ccaagactcctgc

SEQ ID NO: 2744767 - DNA, 13 bp, Homo sapiens
ccaataaacagga

SEQ ID NO: 2744768 - DNA, 22 bp, Homo sapiens
ccacatcttgatctgctcagcc

SEQ ID NO: 2744769 - DNA, 13 bp, Homo sapiens
ccaccccatgggc

SEQ ID NO: 2744770 - DNA, 20 bp, Homo sapiens
ccacctccatcttctttgca

SEQ ID NO: 2744771 - DNA, 21 bp, Homo sapiens
ccagcaaagccccatgctgga

SEQ ID NO: 2744772 - DNA, 15 bp, Homo sapiens
ccagccagggaaggc

SEQ ID NO: 2744773 - DNA, 15 bp, Homo sapiens
ccaggcacacactgt

SEQ ID NO: 2744774 - DNA, 22 bp, Homo sapiens
ccaggcacacactgtgctttct

SEQ ID NO: 2744775 - DNA, 20 bp, Homo sapiens
ccatgctggagcctgtgtaa

SEQ ID NO: 2744776 - DNA, 16 bp, Homo sapiens
ccatgtgtgatgctga

SEQ ID NO: 2744777 - DNA, 13 bp, Homo sapiens
cccatgctggagc

SEQ ID NO: 2744778 - DNA, 14 bp, Homo sapiens
cccatgctggagcc

SEQ ID NO: 2744779 - DNA, 15 bp, Homo sapiens
cccatgctggagcct

SEQ ID NO: 2744780 - DNA, 16 bp, Homo sapiens
cccatgctggagcctg

SEQ ID NO: 2744781 - DNA, 21 bp, Homo sapiens
cccatgctggagcctgtgtaa

SEQ ID NO: 2744782 - DNA, 22 bp, Homo sapiens
cccatgggcctcatgaataaat

SEQ ID NO: 2744783 - DNA, 18 bp, Homo sapiens
cccatgtgtgatgctgac

SEQ ID NO: 2744784 - DNA, 22 bp, Homo sapiens
cccctctcaggctgtgcttacc

SEQ ID NO: 2744785 - DNA, 21 bp, Homo sapiens
ccctcatctttcatcaatcat

SEQ ID NO: 2744786 - DNA, 15 bp, Homo sapiens
ccctggaggtgccag

SEQ ID NO: 2744787 - DNA, 18 bp, Homo sapiens
ccctggaggtgccagcaa

SEQ ID NO: 2744788 - DNA, 15 bp, Homo sapiens
cctcactcttgccaa

SEQ ID NO: 2744789 - DNA, 16 bp, Homo sapiens
cctcactcttgccaac

SEQ ID NO: 2744790 - DNA, 13 bp, Homo sapiens
cctcatgaataaa

SEQ ID NO: 2744791 - DNA, 16 bp, Homo sapiens
cctcatgaataaatgg

SEQ ID NO: 2744792 - DNA, 19 bp, Homo sapiens
cctgccctcatctctctcc

SEQ ID NO: 2744793 - DNA, 19 bp, Homo sapiens
cctggaggtgccagcaaag

SEQ ID NO: 2744794 - DNA, 22 bp, Homo sapiens
cctggaggtgccagcaaagccc

SEQ ID NO: 2744795 - DNA, 15 bp, Homo sapiens
tatataaataaatat

SEQ ID NO: 2744796 - DNA, 16 bp, Homo sapiens
tatataaataaatata

SEQ ID NO: 2744797 - DNA, 19 bp, Homo sapiens
tatataaataaatatatat

SEQ ID NO: 2744798 - DNA, 15 bp, Homo sapiens
tatataaatatatat

SEQ ID NO: 2744799 - DNA, 16 bp, Homo sapiens
tatataaatatatata

SEQ ID NO: 2744800 - DNA, 12 bp, Homo sapiens
tatatataaata

SEQ ID NO: 2744801 - DNA, 13 bp, Homo sapiens
tatatataaataa

SEQ ID NO: 2744802 - DNA, 21 bp, Homo sapiens
tatcaaagaccttgtgtgtat

SEQ ID NO: 2744803 - DNA, 16 bp, Homo sapiens
tattgctttataaata

SEQ ID NO: 2744804 - DNA, 14 bp, Homo sapiens
tattgtaagtggaa

SEQ ID NO: 2744805 - DNA, 12 bp, Homo sapiens
tattgtacagaa

SEQ ID NO: 2744806 - DNA, 17 bp, Homo sapiens
tcaaagaccttgtgtgt

SEQ ID NO: 2744807 - DNA, 21 bp, Homo sapiens
tcaaagaccttgtgtgtatgt

SEQ ID NO: 2744808 - DNA, 15 bp, Homo sapiens
tcaaataaacactgt

SEQ ID NO: 2744809 - DNA, 16 bp, Homo sapiens
tcaatcattgtacagt

SEQ ID NO: 2744810 - DNA, 13 bp, Homo sapiens
tcaggctgtgctt

SEQ ID NO: 2744811 - DNA, 14 bp, Homo sapiens
tcagtgtcaaataa

SEQ ID NO: 2744812 - DNA, 19 bp, Homo sapiens
tcagtgtcaaataaacact

SEQ ID NO: 2744813 - DNA, 21 bp, Homo sapiens
tcagtgtcaaataaacactgt

SEQ ID NO: 2744814 - DNA, 22 bp, Homo sapiens
tcagtgtcaaataaacactgtg

SEQ ID NO: 2744815 - DNA, 19 bp, Homo sapiens
tcatcaatcattgtacagt

SEQ ID NO: 2744816 - DNA, 14 bp, Homo sapiens
tcatctcccatgtg

SEQ ID NO: 2744817 - DNA, 23 bp, Homo sapiens
tcatctcccatgtgtgatgctga

SEQ ID NO: 2744818 - DNA, 14 bp, Homo sapiens
tcattgtacagttt

SEQ ID NO: 2744819 - DNA, 14 bp, Homo sapiens
tccaataaacagga

SEQ ID NO: 2744820 - DNA, 13 bp, Homo sapiens
tccagtcaggatg

SEQ ID NO: 2744821 - DNA, 17 bp, Homo sapiens
tcccatgtgtgatgctg

SEQ ID NO: 2744822 - DNA, 23 bp, Homo sapiens
tcccatgtgtgatgctgacacca

SEQ ID NO: 2744823 - DNA, 16 bp, Homo sapiens
tccctgccctcatctc

SEQ ID NO: 2744824 - DNA, 17 bp, Homo sapiens
tccctgccctcatctct

SEQ ID NO: 2744825 - DNA, 21 bp, Homo sapiens
tcctacagttggaaatccatc

SEQ ID NO: 2744826 - DNA, 23 bp, Homo sapiens
tcctacagttggaaatccatcca

SEQ ID NO: 2744827 - DNA, 17 bp, Homo sapiens
tcctgcaaaaacccttg

SEQ ID NO: 2744828 - DNA, 18 bp, Homo sapiens
tcctgccttagagccagg

SEQ ID NO: 2744829 - DNA, 14 bp, Homo sapiens
tccttgggaggaag

SEQ ID NO: 2744830 - DNA, 18 bp, Homo sapiens
tccttgggaggaagcaga

SEQ ID NO: 2744831 - DNA, 21 bp, Homo sapiens
tccttgggaggaagcagaata

SEQ ID NO: 2744832 - DNA, 13 bp, Homo sapiens
tcgtgggaaggag

SEQ ID NO: 2744833 - DNA, 11 bp, Homo sapiens
tctcatctccc

SEQ ID NO: 2744834 - DNA, 15 bp, Homo sapiens
tctgctcagccctgg

SEQ ID NO: 2744835 - DNA, 15 bp, Homo sapiens
tcttaaataaaacta

SEQ ID NO: 2744836 - DNA, 17 bp, Homo sapiens
tcttaaataaaactatt

SEQ ID NO: 2744837 - DNA, 19 bp, Homo sapiens
tcttaaataaaactattta

SEQ ID NO: 2744838 - DNA, 21 bp, Homo sapiens
tcttgatctgctcagccctgg

SEQ ID NO: 2744839 - DNA, 20 bp, Homo sapiens
tcttgccaacctgtaataaa

SEQ ID NO: 2744840 - DNA, 23 bp, Homo sapiens
tctttcatcaatcattgtacagt

SEQ ID NO: 2744841 - DNA, 14 bp, Homo sapiens
tgatctgctcagcc

SEQ ID NO: 2744842 - DNA, 17 bp, Homo sapiens
tgatctgctcagccctg

SEQ ID NO: 2744843 - DNA, 19 bp, Homo sapiens
tgcaatttgtttgtgcttc

SEQ ID NO: 2744844 - DNA, 20 bp, Homo sapiens
tgcaatttgtttgtgcttct

SEQ ID NO: 2744845 - DNA, 16 bp, Homo sapiens
tgcactttataaacac

SEQ ID NO: 2744846 - DNA, 18 bp, Homo sapiens
tgccaacctgtaataaat

SEQ ID NO: 2744847 - DNA, 21 bp, Homo sapiens
tgccaacctgtaataaatatg

SEQ ID NO: 2744848 - DNA, 16 bp, Homo sapiens
tgccccatttatccac

SEQ ID NO: 2744849 - DNA, 15 bp, Homo sapiens
tgccttagagccagg

SEQ ID NO: 2744850 - DNA, 17 bp, Homo sapiens
tgccttagagccaggca

SEQ ID NO: 2744851 - DNA, 21 bp, Homo sapiens
tgctaatataagtttctttgc

SEQ ID NO: 2744852 - DNA, 11 bp, Homo sapiens
tgctggagcct

SEQ ID NO: 2744853 - DNA, 12 bp, Homo sapiens
tgctggagcctg

SEQ ID NO: 2744854 - DNA, 15 bp, Homo sapiens
tgctggagcctgtgt

SEQ ID NO: 2744855 - DNA, 23 bp, Homo sapiens
tgctggagcctgtgtaacagctc

SEQ ID NO: 2744856 - DNA, 16 bp, Homo sapiens
tgcttcacttctccca

SEQ ID NO: 2744857 - DNA, 12 bp, Homo sapiens
tgctttctattg

SEQ ID NO: 2744858 - DNA, 18 bp, Homo sapiens
tgctttctattgtacaga

SEQ ID NO: 2744859 - DNA, 17 bp, Homo sapiens
tggaacatatgcacagg

SEQ ID NO: 2744860 - DNA, 17 bp, Homo sapiens
tggagcctgtgtaacag

SEQ ID NO: 2744861 - DNA, 18 bp, Homo sapiens
tggagcctgtgtaacagc

SEQ ID NO: 2744862 - DNA, 22 bp, Homo sapiens
tggagcctgtgtaacagctcct

SEQ ID NO: 2744863 - DNA, 17 bp, Homo sapiens
tggaggtgccagcaaag

SEQ ID NO: 2744864 - DNA, 20 bp, Homo sapiens
tggaggtgccagcaaagccc

SEQ ID NO: 2744865 - DNA, 12 bp, Homo sapiens
tggatataaata

SEQ ID NO: 2744866 - DNA, 13 bp, Homo sapiens
tggatataaatat

SEQ ID NO: 2744867 - DNA, 14 bp, Homo sapiens
tggcagcataaagg

SEQ ID NO: 2744868 - DNA, 22 bp, Homo sapiens
tggctgccagctatttttacta

SEQ ID NO: 2744869 - DNA, 15 bp, Homo sapiens
tgggaggaagcagaa

SEQ ID NO: 2744870 - DNA, 17 bp, Homo sapiens
tgggaggaagcagaata

SEQ ID NO: 2744871 - DNA, 20 bp, Homo sapiens
tgggaggaagcagaataaag

SEQ ID NO: 2744872 - DNA, 21 bp, Homo sapiens
tgggaggaagcagaataaagc

SEQ ID NO: 2744873 - DNA, 19 bp, Homo sapiens
tgggcctcatgaataaatg

SEQ ID NO: 2744874 - DNA, 22 bp, Homo sapiens
tgtaacagctccttgggaggaa

SEQ ID NO: 2744875 - DNA, 13 bp, Homo sapiens
tgtaataaatatg

SEQ ID NO: 2744876 - DNA, 22 bp, Homo sapiens
tgtacagtttgtttacacacgt

SEQ ID NO: 2744877 - DNA, 15 bp, Homo sapiens
tgtcaaataaacact

SEQ ID NO: 2744878 - DNA, 17 bp, Homo sapiens
tgtcaaataaacactgt

SEQ ID NO: 2744879 - DNA, 18 bp, Homo sapiens
tgtcaaataaacactgtg

SEQ ID NO: 2744880 - DNA, 16 bp, Homo sapiens
tgtccccaccccatgg

SEQ ID NO: 2744881 - DNA, 17 bp, Homo sapiens
tgtcttaaataaaacta

SEQ ID NO: 2744882 - DNA, 13 bp, Homo sapiens
tgtgatgctgaca

SEQ ID NO: 2744883 - DNA, 23 bp, Homo sapiens
tgtgcttctaatatttattgctt

SEQ ID NO: 2744884 - DNA, 14 bp, Homo sapiens
tgtgtaacagctcc

SEQ ID NO: 2744885 - DNA, 14 bp, Homo sapiens
tgtgtgatgctgac

SEQ ID NO: 2744886 - DNA, 20 bp, Homo sapiens
tgtgtgggtggatataaata

SEQ ID NO: 2744887 - DNA, 21 bp, Homo sapiens
tgtgtgggtggatataaatat

SEQ ID NO: 2744888 - DNA, 14 bp, Homo sapiens
tgtgtgtatgtgta

SEQ ID NO: 2744889 - DNA, 20 bp, Homo sapiens
tgtgttcgcgtgtgtgggtg

SEQ ID NO: 2744890 - DNA, 14 bp, Homo sapiens
tgttggcagcataa

SEQ ID NO: 2744891 - DNA, 12 bp, Homo sapiens
tgtttgtgcttc

SEQ ID NO: 2744892 - DNA, 12 bp, Homo sapiens
ttacctgtgaca

SEQ ID NO: 2744893 - DNA, 20 bp, Homo sapiens
ttactagaacacagaaagcc

SEQ ID NO: 2744894 - DNA, 21 bp, Homo sapiens
ttagagccaggcacacactgt

SEQ ID NO: 2744895 - DNA, 14 bp, Homo sapiens
ctgtgtaacagctc

SEQ ID NO: 2744896 - DNA, 15 bp, Homo sapiens
ctgtgtaacagctcc

SEQ ID NO: 2744897 - DNA, 13 bp, Homo sapiens
cttaaataaaact

SEQ ID NO: 2744898 - DNA, 20 bp, Homo sapiens
cttaaataaaactatttaaa

SEQ ID NO: 2744899 - DNA, 12 bp, Homo sapiens
cttacctgtgac

SEQ ID NO: 2744900 - DNA, 19 bp, Homo sapiens
cttgatctgctcagccctg

SEQ ID NO: 2744901 - DNA, 22 bp, Homo sapiens
cttgatctgctcagccctggag

SEQ ID NO: 2744902 - DNA, 23 bp, Homo sapiens
cttgatctgctcagccctggagg

SEQ ID NO: 2744903 - DNA, 23 bp, Homo sapiens
cttgccaacctgtaataaatatg

SEQ ID NO: 2744904 - DNA, 16 bp, Homo sapiens
cttgggaggaagcaga

SEQ ID NO: 2744905 - DNA, 18 bp, Homo sapiens
cttgggaggaagcagaat

SEQ ID NO: 2744906 - DNA, 19 bp, Homo sapiens
cttgggaggaagcagaata

SEQ ID NO: 2744907 - DNA, 21 bp, Homo sapiens
cttgggaggaagcagaataaa

SEQ ID NO: 2744908 - DNA, 21 bp, Homo sapiens
ctttcatcaatcattgtacag

SEQ ID NO: 2744909 - DNA, 22 bp, Homo sapiens
ctttcatcaatcattgtacagt

SEQ ID NO: 2744910 - DNA, 23 bp, Homo sapiens
cttttttggctttagacactggc

SEQ ID NO: 2744911 - DNA, 21 bp, Homo sapiens
gaaataacattgcactttata

SEQ ID NO: 2744912 - DNA, 15 bp, Homo sapiens
gaacacagaaagcct

SEQ ID NO: 2744913 - DNA, 12 bp, Homo sapiens
gaagcagaataa

SEQ ID NO: 2744914 - DNA, 15 bp, Homo sapiens
gaagcagaataaagc

SEQ ID NO: 2744915 - DNA, 18 bp, Homo sapiens
gaagcagaataaagcaat

SEQ ID NO: 2744916 - DNA, 23 bp, Homo sapiens
gaagcagaataaagcaattttcc

SEQ ID NO: 2744917 - DNA, 12 bp, Homo sapiens
gaaggaaataac

SEQ ID NO: 2744918 - DNA, 12 bp, Homo sapiens
gaataaagcaat

SEQ ID NO: 2744919 - DNA, 13 bp, Homo sapiens
gaataaagcaatt

SEQ ID NO: 2744920 - DNA, 15 bp, Homo sapiens
gaataaagcaatttt

SEQ ID NO: 2744921 - DNA, 19 bp, Homo sapiens
gacggtattatgcttcttg

SEQ ID NO: 2744922 - DNA, 14 bp, Homo sapiens
gagcctgtgtaaca

SEQ ID NO: 2744923 - DNA, 17 bp, Homo sapiens
gagcctgtgtaacagct

SEQ ID NO: 2744924 - DNA, 18 bp, Homo sapiens
gagcctgtgtaacagctc

SEQ ID NO: 2744925 - DNA, 19 bp, Homo sapiens
gagcctgtgtaacagctcc

SEQ ID NO: 2744926 - DNA, 20 bp, Homo sapiens
gagccttaccaagactcctg

SEQ ID NO: 2744927 - DNA, 22 bp, Homo sapiens
gagccttaccaagactcctgca

SEQ ID NO: 2744928 - DNA, 12 bp, Homo sapiens
gaggaagcagaa

SEQ ID NO: 2744929 - DNA, 15 bp, Homo sapiens
gaggaagcagaataa

SEQ ID NO: 2744930 - DNA, 16 bp, Homo sapiens
gaggaagcagaataaa

SEQ ID NO: 2744931 - DNA, 22 bp, Homo sapiens
gaggaagcagaataaagcaatt

SEQ ID NO: 2744932 - DNA, 14 bp, Homo sapiens
gaggtgccagcaaa

SEQ ID NO: 2744933 - DNA, 20 bp, Homo sapiens
gaggtgccagcaaagcccca

SEQ ID NO: 2744934 - DNA, 15 bp, Homo sapiens
gatataaatatatat

SEQ ID NO: 2744935 - DNA, 16 bp, Homo sapiens
gatataaatatatata

SEQ ID NO: 2744936 - DNA, 16 bp, Homo sapiens
gatctgctcagccctg

SEQ ID NO: 2744937 - DNA, 20 bp, Homo sapiens
gatgacggtattatgcttct

SEQ ID NO: 2744938 - DNA, 13 bp, Homo sapiens
gatgtagcattgt

SEQ ID NO: 2744939 - DNA, 13 bp, Homo sapiens
gcaaaaacccttg

SEQ ID NO: 2744940 - DNA, 20 bp, Homo sapiens
gcaaagccccatgctggagc

SEQ ID NO: 2744941 - DNA, 21 bp, Homo sapiens
gcaatgtcttaaataaaacta

SEQ ID NO: 2744942 - DNA, 17 bp, Homo sapiens
gcaattttccttgaagc

SEQ ID NO: 2744943 - DNA, 17 bp, Homo sapiens
gcacacactgtgctttc

SEQ ID NO: 2744944 - DNA, 16 bp, Homo sapiens
gcactttataaacact

SEQ ID NO: 2744945 - DNA, 11 bp, Homo sapiens
gcagaataaag

SEQ ID NO: 2744946 - DNA, 14 bp, Homo sapiens
gcagaataaagcaa

SEQ ID NO: 2744947 - DNA, 18 bp, Homo sapiens
gcagaataaagcaatttt

SEQ ID NO: 2744948 - DNA, 20 bp, Homo sapiens
gcagaataaagcaattttcc

SEQ ID NO: 2744949 - DNA, 15 bp, Homo sapiens
gcagcataaaggcct

SEQ ID NO: 2744950 - DNA, 22 bp, Homo sapiens
gcattgttccacacatttaaaa

SEQ ID NO: 2744951 - DNA, 11 bp, Homo sapiens
gcatttgtcta

SEQ ID NO: 2744952 - DNA, 16 bp, Homo sapiens
gccaacctgtaataaa

SEQ ID NO: 2744953 - DNA, 22 bp, Homo sapiens
gccaacctgtaataaatatgag

SEQ ID NO: 2744954 - DNA, 23 bp, Homo sapiens
gccacatcttgatctgctcagcc

SEQ ID NO: 2744955 - DNA, 17 bp, Homo sapiens
gccaggcacacactgtg

SEQ ID NO: 2744956 - DNA, 18 bp, Homo sapiens
gccatgttccaataaaca

SEQ ID NO: 2744957 - DNA, 19 bp, Homo sapiens
gccatgttccaataaacag

SEQ ID NO: 2744958 - DNA, 14 bp, Homo sapiens
gcccagccagggaa

SEQ ID NO: 2744959 - DNA, 15 bp, Homo sapiens
gccccatgctggagc

SEQ ID NO: 2744960 - DNA, 17 bp, Homo sapiens
gccccatgctggagcct

SEQ ID NO: 2744961 - DNA, 22 bp, Homo sapiens
gccccatgctggagcctgtgta

SEQ ID NO: 2744962 - DNA, 20 bp, Homo sapiens
gcccctctcaggctgtgctt

SEQ ID NO: 2744963 - DNA, 22 bp, Homo sapiens
gccctggaggtgccagcaaagc

SEQ ID NO: 2744964 - DNA, 23 bp, Homo sapiens
gccctggaggtgccagcaaagcc

SEQ ID NO: 2744965 - DNA, 15 bp, Homo sapiens
gccgtctctggcccc

SEQ ID NO: 2744966 - DNA, 16 bp, Homo sapiens
gcctgtgtaacagctc

SEQ ID NO: 2744967 - DNA, 17 bp, Homo sapiens
gcctgtgtaacagctcc

SEQ ID NO: 2744968 - DNA, 18 bp, Homo sapiens
gccttaccaagactcctg

SEQ ID NO: 2744969 - DNA, 20 bp, Homo sapiens
gccttaccaagactcctgca

SEQ ID NO: 2744970 - DNA, 14 bp, Homo sapiens
gccttagagccagg

SEQ ID NO: 2744971 - DNA, 17 bp, Homo sapiens
gccttagagccaggcac

SEQ ID NO: 2744972 - DNA, 20 bp, Homo sapiens
gctcagccctggaggtgcca

SEQ ID NO: 2744973 - DNA, 19 bp, Homo sapiens
gctccttgggaggaagcag

SEQ ID NO: 2744974 - DNA, 21 bp, Homo sapiens
gctccttgggaggaagcagaa

SEQ ID NO: 2744975 - DNA, 22 bp, Homo sapiens
gctccttgggaggaagcagaat

SEQ ID NO: 2744976 - DNA, 23 bp, Homo sapiens
gctggagcctgtgtaacagctcc

SEQ ID NO: 2744977 - DNA, 12 bp, Homo sapiens
gcttacctgtga

SEQ ID NO: 2744978 - DNA, 10 bp, Homo sapiens
gctttataaa

SEQ ID NO: 2744979 - DNA, 17 bp, Homo sapiens
ggaacatatgcacaggg

SEQ ID NO: 2744980 - DNA, 18 bp, Homo sapiens
ggaacctcactcttgcca

SEQ ID NO: 2744981 - DNA, 21 bp, Homo sapiens
ggaacctcactcttgccaacc

SEQ ID NO: 2744982 - DNA, 21 bp, Homo sapiens
ggaagcagaataaagcaattt

SEQ ID NO: 2744983 - DNA, 20 bp, Homo sapiens
ggagccttaccaagactcct

SEQ ID NO: 2744984 - DNA, 11 bp, Homo sapiens
ggaggaagcag

SEQ ID NO: 2744985 - DNA, 14 bp, Homo sapiens
ggaggaagcagaat

SEQ ID NO: 2744986 - DNA, 15 bp, Homo sapiens
ggaggaagcagaata

SEQ ID NO: 2744987 - DNA, 23 bp, Homo sapiens
ggaggaagcagaataaagcaatt

SEQ ID NO: 2744988 - DNA, 23 bp, Homo sapiens
ggatgacggtattatgcttcttg

SEQ ID NO: 2744989 - DNA, 13 bp, Homo sapiens
ggcacacactgtg

SEQ ID NO: 2744990 - DNA, 23 bp, Homo sapiens
gggagccttaccaagactcctgc

SEQ ID NO: 2744991 - DNA, 12 bp, Homo sapiens
gggaggaagcag

SEQ ID NO: 2744992 - DNA, 13 bp, Homo sapiens
gggaggaagcaga

SEQ ID NO: 2744993 - DNA, 21 bp, Homo sapiens
aggcacacactgtgctttcta

SEQ ID NO: 2744994 - DNA, 23 bp, Homo sapiens
aggccatgttccaataaacagga

SEQ ID NO: 2744995 - DNA, 18 bp, Homo sapiens
agggacgtctcatctccc

SEQ ID NO: 2744996 - DNA, 19 bp, Homo sapiens
agggacgtctcatctccca

SEQ ID NO: 2744997 - DNA, 23 bp, Homo sapiens
agggacgtctcatctcccatgtg

SEQ ID NO: 2744998 - DNA, 15 bp, Homo sapiens
aggggagccttacca

SEQ ID NO: 2744999 - DNA, 19 bp, Homo sapiens
aggtgccagcaaagcccca

SEQ ID NO: 2745000 - DNA, 20 bp, Homo sapiens
agtggacattgttggcagca

SEQ ID NO: 2745001 - DNA, 16 bp, Homo sapiens
agtggtccctgccctc

SEQ ID NO: 2745002 - DNA, 20 bp, Homo sapiens
agtgtagatgtagcattgtt

SEQ ID NO: 2745003 - DNA, 17 bp, Homo sapiens
agtgtcaaataaacact

SEQ ID NO: 2745004 - DNA, 19 bp, Homo sapiens
agtgtcaaataaacactgt

SEQ ID NO: 2745005 - DNA, 14 bp, Homo sapiens
agtttgtttacaca

SEQ ID NO: 2745006 - DNA, 11 bp, Homo sapiens
ataaaactatt

SEQ ID NO: 2745007 - DNA, 15 bp, Homo sapiens
ataaaactatttaaa

SEQ ID NO: 2745008 - DNA, 21 bp, Homo sapiens
ataaaactatttaaaattggc

SEQ ID NO: 2745009 - DNA, 13 bp, Homo sapiens
ataaagcaatttt

SEQ ID NO: 2745010 - DNA, 15 bp, Homo sapiens
ataaataaatatata

SEQ ID NO: 2745011 - DNA, 12 bp, Homo sapiens
ataaatatatat

SEQ ID NO: 2745012 - DNA, 15 bp, Homo sapiens
ataaatatgagtgcc

SEQ ID NO: 2745013 - DNA, 18 bp, Homo sapiens
ataagtttctttgcttca

SEQ ID NO: 2745014 - DNA, 16 bp, Homo sapiens
atacttgaatatggaa

SEQ ID NO: 2745015 - DNA, 23 bp, Homo sapiens
atagtaagttactgggcattctc

SEQ ID NO: 2745016 - DNA, 14 bp, Homo sapiens
atataaataaatat

SEQ ID NO: 2745017 - DNA, 14 bp, Homo sapiens
atataaatatatat

SEQ ID NO: 2745018 - DNA, 14 bp, Homo sapiens
atatatataaataa

SEQ ID NO: 2745019 - DNA, 12 bp, Homo sapiens
atatttattgct

SEQ ID NO: 2745020 - DNA, 18 bp, Homo sapiens
atatttattgctttataa

SEQ ID NO: 2745021 - DNA, 21 bp, Homo sapiens
atatttattgctttataaata

SEQ ID NO: 2745022 - DNA, 18 bp, Homo sapiens
atcattgtacagtttgtt

SEQ ID NO: 2745023 - DNA, 14 bp, Homo sapiens
atccatccagaggc

SEQ ID NO: 2745024 - DNA, 22 bp, Homo sapiens
atctaccttccagtcaggatga

SEQ ID NO: 2745025 - DNA, 13 bp, Homo sapiens
atctgctcagccc

SEQ ID NO: 2745026 - DNA, 20 bp, Homo sapiens
atcttgatctgctcagccct

SEQ ID NO: 2745027 - DNA, 23 bp, Homo sapiens
atcttgatctgctcagccctgga

SEQ ID NO: 2745028 - DNA, 16 bp, Homo sapiens
atgacggtattatgct

SEQ ID NO: 2745029 - DNA, 20 bp, Homo sapiens
atgacggtattatgcttctt

SEQ ID NO: 2745030 - DNA, 16 bp, Homo sapiens
atgcaatgtcttaaat

SEQ ID NO: 2745031 - DNA, 12 bp, Homo sapiens
atgctgacacca

SEQ ID NO: 2745032 - DNA, 13 bp, Homo sapiens
atgctgacaccag

SEQ ID NO: 2745033 - DNA, 11 bp, Homo sapiens
atgctggagcc

SEQ ID NO: 2745034 - DNA, 14 bp, Homo sapiens
atgctggagcctgt

SEQ ID NO: 2745035 - DNA, 12 bp, Homo sapiens
atgcttcttgga

SEQ ID NO: 2745036 - DNA, 20 bp, Homo sapiens
atgggcctcatgaataaatg

SEQ ID NO: 2745037 - DNA, 21 bp, Homo sapiens
atgtcttaaataaaactattt

SEQ ID NO: 2745038 - DNA, 13 bp, Homo sapiens
atgtggctgcccc

SEQ ID NO: 2745039 - DNA, 16 bp, Homo sapiens
atgtgtacgtgtgtgt

SEQ ID NO: 2745040 - DNA, 18 bp, Homo sapiens
atgtgtgatgctgacacc

SEQ ID NO: 2745041 - DNA, 20 bp, Homo sapiens
atgtgtgatgctgacaccag

SEQ ID NO: 2745042 - DNA, 15 bp, Homo sapiens
atgttccaataaaca

SEQ ID NO: 2745043 - DNA, 16 bp, Homo sapiens
atgttccaataaacag

SEQ ID NO: 2745044 - DNA, 18 bp, Homo sapiens
atgttccaataaacagga

SEQ ID NO: 2745045 - DNA, 12 bp, Homo sapiens
attatgcttctt

SEQ ID NO: 2745046 - DNA, 15 bp, Homo sapiens
attgctttataaata

SEQ ID NO: 2745047 - DNA, 17 bp, Homo sapiens
attgtacagtttgttta

SEQ ID NO: 2745048 - DNA, 18 bp, Homo sapiens
attgtacagtttgtttac

SEQ ID NO: 2745049 - DNA, 13 bp, Homo sapiens
atttaaaattggc

SEQ ID NO: 2745050 - DNA, 12 bp, Homo sapiens
attttccttgaa

SEQ ID NO: 2745051 - DNA, 13 bp, Homo sapiens
attttccttgaag

SEQ ID NO: 2745052 - DNA, 15 bp, Homo sapiens
attttccttgaagcc

SEQ ID NO: 2745053 - DNA, 16 bp, Homo sapiens
attttccttgaagccg

SEQ ID NO: 2745054 - DNA, 18 bp, Homo sapiens
caaagaccttgtgtgtat

SEQ ID NO: 2745055 - DNA, 16 bp, Homo sapiens
caaagccccatgctgg

SEQ ID NO: 2745056 - DNA, 20 bp, Homo sapiens
caaagccccatgctggagcc

SEQ ID NO: 2745057 - DNA, 22 bp, Homo sapiens
caaagccccatgctggagcctg

SEQ ID NO: 2745058 - DNA, 11 bp, Homo sapiens
caaataaacac

SEQ ID NO: 2745059 - DNA, 13 bp, Homo sapiens
caaataaacactg

SEQ ID NO: 2745060 - DNA, 21 bp, Homo sapiens
caacctgtaataaatatgagt

SEQ ID NO: 2745061 - DNA, 13 bp, Homo sapiens
caagactcctgca

SEQ ID NO: 2745062 - DNA, 20 bp, Homo sapiens
caatacttgaatatggaaca

SEQ ID NO: 2745063 - DNA, 20 bp, Homo sapiens
caatcattgtacagtttgtt

SEQ ID NO: 2745064 - DNA, 23 bp, Homo sapiens
caatcattgtacagtttgtttac

SEQ ID NO: 2745065 - DNA, 11 bp, Homo sapiens
caattttcctt

SEQ ID NO: 2745066 - DNA, 15 bp, Homo sapiens
caattttccttgaag

SEQ ID NO: 2745067 - DNA, 23 bp, Homo sapiens
cacacactgtgctttctattgta

SEQ ID NO: 2745068 - DNA, 16 bp, Homo sapiens
cacacgtgcaatttgt

SEQ ID NO: 2745069 - DNA, 14 bp, Homo sapiens
cacactgtgctttc

SEQ ID NO: 2745070 - DNA, 16 bp, Homo sapiens
cacactgtgctttcta

SEQ ID NO: 2745071 - DNA, 20 bp, Homo sapiens
cacactgtgctttctattgt

SEQ ID NO: 2745072 - DNA, 22 bp, Homo sapiens
cacactgtgctttctattgtac

SEQ ID NO: 2745073 - DNA, 23 bp, Homo sapiens
cacactgtgctttctattgtaca

SEQ ID NO: 2745074 - DNA, 18 bp, Homo sapiens
cacagaaagcctatcaaa

SEQ ID NO: 2745075 - DNA, 15 bp, Homo sapiens
cacatttaaaacatt

SEQ ID NO: 2745076 - DNA, 23 bp, Homo sapiens
cactgcctcgggaacctcactct

SEQ ID NO: 2745077 - DNA, 23 bp, Homo sapiens
cactgtgctttctattgtacaga

SEQ ID NO: 2745078 - DNA, 11 bp, Homo sapiens
cagaataaagc

SEQ ID NO: 2745079 - DNA, 16 bp, Homo sapiens
cagaataaagcaattt

SEQ ID NO: 2745080 - DNA, 19 bp, Homo sapiens
cagaataaagcaattttcc

SEQ ID NO: 2745081 - DNA, 20 bp, Homo sapiens
cagaataaagcaattttcct

SEQ ID NO: 2745082 - DNA, 23 bp, Homo sapiens
cagaataaagcaattttccttga

SEQ ID NO: 2745083 - DNA, 13 bp, Homo sapiens
cagcaaagcccca

SEQ ID NO: 2745084 - DNA, 14 bp, Homo sapiens
cagcaaagccccat

SEQ ID NO: 2745085 - DNA, 22 bp, Homo sapiens
cagcaaagccccatgctggagc

SEQ ID NO: 2745086 - DNA, 15 bp, Homo sapiens
cagcataaaggcctt

SEQ ID NO: 2745087 - DNA, 22 bp, Homo sapiens
cagccctggaggtgccagcaaa

SEQ ID NO: 2745088 - DNA, 18 bp, Homo sapiens
cagctatttttactagaa

SEQ ID NO: 2745089 - DNA, 18 bp, Homo sapiens
cagctccttgggaggaag

SEQ ID NO: 2745090 - DNA, 21 bp, Homo sapiens
cagctccttgggaggaagcag

SEQ ID NO: 2745091 - DNA, 14 bp, Homo sapiens
caggcacacactgt

SEQ ID NO: 2745092 - DNA, 21 bp, Homo sapiens
cagggacgtctcatctcccat

SEQ ID NO: 2745093 - DNA, 12 bp, Homo sapiens
cagtcaggatga

SEQ ID NO: 2745094 - DNA, 22 bp, Homo sapiens
ctacagttggaaatccatccag

SEQ ID NO: 2745095 - DNA, 19 bp, Homo sapiens
ctaccttccagtcaggatg

SEQ ID NO: 2745096 - DNA, 21 bp, Homo sapiens
ctatttttactagaacacaga

SEQ ID NO: 2745097 - DNA, 14 bp, Homo sapiens
ctcatgaataaatg

SEQ ID NO: 2745098 - DNA, 15 bp, Homo sapiens
ctccacgtggttgcc

SEQ ID NO: 2745099 - DNA, 23 bp, Homo sapiens
ctcccatgtgtgatgctgacacc

SEQ ID NO: 2745100 - DNA, 14 bp, Homo sapiens
ctccttgggaggaa

SEQ ID NO: 2745101 - DNA, 21 bp, Homo sapiens
ctccttgggaggaagcagaat

SEQ ID NO: 2745102 - DNA, 21 bp, Homo sapiens
ctcttgccaacctgtaataaa

SEQ ID NO: 2745103 - DNA, 22 bp, Homo sapiens
ctcttgccaacctgtaataaat

SEQ ID NO: 2745104 - DNA, 17 bp, Homo sapiens
ctgaccctggttctctc

SEQ ID NO: 2745105 - DNA, 17 bp, Homo sapiens
ctgcctcgggaacctca

SEQ ID NO: 2745106 - DNA, 13 bp, Homo sapiens
ctgcgccctgggc

SEQ ID NO: 2745107 - DNA, 14 bp, Homo sapiens
ctgcgccctgggct

SEQ ID NO: 2745108 - DNA, 12 bp, Homo sapiens
ctgctcagccct

SEQ ID NO: 2745109 - DNA, 13 bp, Homo sapiens
ctgctcagccctg

SEQ ID NO: 2745110 - DNA, 16 bp, Homo sapiens
ctgctcagccctggag

SEQ ID NO: 2745111 - DNA, 18 bp, Homo sapiens
ctgctcagccctggaggt

SEQ ID NO: 2745112 - DNA, 16 bp, Homo sapiens
ctgctgcgccctgggc

SEQ ID NO: 2745113 - DNA, 18 bp, Homo sapiens
ctgctgcgccctgggctc

SEQ ID NO: 2745114 - DNA, 14 bp, Homo sapiens
ctggagcctgtgta

SEQ ID NO: 2745115 - DNA, 16 bp, Homo sapiens
ctggagcctgtgtaac

SEQ ID NO: 2745116 - DNA, 22 bp, Homo sapiens
ctggaggtgccagcaaagcccc

SEQ ID NO: 2745117 - DNA, 23 bp, Homo sapiens
ctggaggtgccagcaaagcccca

SEQ ID NO: 2745118 - DNA, 17 bp, Homo sapiens
ctggagtcgtgggaagg

SEQ ID NO: 2745119 - DNA, 15 bp, Homo sapiens
ctgtgacagcagctc

SEQ ID NO: 2745120 - DNA, 18 bp, Homo sapiens
ctgtgacagcagctctgt

SEQ ID NO: 2745121 - DNA, 20 bp, Homo sapiens
ctgtgctttctattgtacag

SEQ ID NO: 2745122 - DNA, 22 bp, Homo sapiens
ctgtgctttctattgtacagaa

SEQ ID NO: 2745123 - DNA, 18 bp, Homo sapiens
ctgtgtaacagctccttg

SEQ ID NO: 2745124 - DNA, 17 bp, Homo sapiens
ctgttagccatgtggct

SEQ ID NO: 2745125 - DNA, 14 bp, Homo sapiens
cttaaataaaacta

SEQ ID NO: 2745126 - DNA, 19 bp, Homo sapiens
cttaaataaaactatttaa

SEQ ID NO: 2745127 - DNA, 16 bp, Homo sapiens
cttaccaagactcctg

SEQ ID NO: 2745128 - DNA, 18 bp, Homo sapiens
cttaccaagactcctgca

SEQ ID NO: 2745129 - DNA, 16 bp, Homo sapiens
cttagagccaggcaca

SEQ ID NO: 2745130 - DNA, 13 bp, Homo sapiens
cttccagtcagga

SEQ ID NO: 2745131 - DNA, 20 bp, Homo sapiens
cttctaatatttattgcttt

SEQ ID NO: 2745132 - DNA, 16 bp, Homo sapiens
cttgatctgctcagcc

SEQ ID NO: 2745133 - DNA, 20 bp, Homo sapiens
cttgatctgctcagccctgg

SEQ ID NO: 2745134 - DNA, 21 bp, Homo sapiens
cttgccaacctgtaataaata

SEQ ID NO: 2745135 - DNA, 14 bp, Homo sapiens
cttgggaggaagca

SEQ ID NO: 2745136 - DNA, 20 bp, Homo sapiens
cttgggaggaagcagaataa

SEQ ID NO: 2745137 - DNA, 23 bp, Homo sapiens
cttgggaggaagcagaataaagc

SEQ ID NO: 2745138 - DNA, 15 bp, Homo sapiens
ctttctattgtacag

SEQ ID NO: 2745139 - DNA, 16 bp, Homo sapiens
ctttctattgtacaga

SEQ ID NO: 2745140 - DNA, 11 bp, Homo sapiens
gaacctcactc

SEQ ID NO: 2745141 - DNA, 16 bp, Homo sapiens
gaacctcactcttgcc

SEQ ID NO: 2745142 - DNA, 17 bp, Homo sapiens
gaacctcactcttgcca

SEQ ID NO: 2745143 - DNA, 20 bp, Homo sapiens
gaacctcactcttgccaacc

SEQ ID NO: 2745144 - DNA, 21 bp, Homo sapiens
gaacctcactcttgccaacct

SEQ ID NO: 2745145 - DNA, 17 bp, Homo sapiens
gaagcagaataaagcaa

SEQ ID NO: 2745146 - DNA, 17 bp, Homo sapiens
gaataaagcaattttcc

SEQ ID NO: 2745147 - DNA, 22 bp, Homo sapiens
gaataaagcaattttccttgaa

SEQ ID NO: 2745148 - DNA, 18 bp, Homo sapiens
gaatatggaacatatgca

SEQ ID NO: 2745149 - DNA, 14 bp, Homo sapiens
gtgtaacagctcct

SEQ ID NO: 2745150 - DNA, 23 bp, Homo sapiens
gtgtaacagctccttgggaggaa

SEQ ID NO: 2745151 - DNA, 16 bp, Homo sapiens
gtgtcaaataaacact

SEQ ID NO: 2745152 - DNA, 17 bp, Homo sapiens
gttccacacatttaaaa

SEQ ID NO: 2745153 - DNA, 21 bp, Homo sapiens
gtttcagtgtcaaataaacac

SEQ ID NO: 2745154 - DNA, 22 bp, Homo sapiens
gtttcagtgtcaaataaacact

SEQ ID NO: 2745155 - DNA, 21 bp, Homo sapiens
taaaactatttaaaattggca

SEQ ID NO: 2745156 - DNA, 23 bp, Homo sapiens
taaacactgtattgtaagtggaa

SEQ ID NO: 2745157 - DNA, 11 bp, Homo sapiens
taaacactgtg

SEQ ID NO: 2745158 - DNA, 22 bp, Homo sapiens
taaagcaattttccttgaagcc

SEQ ID NO: 2745159 - DNA, 14 bp, Homo sapiens
taaataaaactatt

SEQ ID NO: 2745160 - DNA, 16 bp, Homo sapiens
taaataaaactattta

SEQ ID NO: 2745161 - DNA, 21 bp, Homo sapiens
taaatatatataaatatatat

SEQ ID NO: 2745162 - DNA, 16 bp, Homo sapiens
taaatggcttcttgcc

SEQ ID NO: 2745163 - DNA, 12 bp, Homo sapiens
taacattgcact

SEQ ID NO: 2745164 - DNA, 23 bp, Homo sapiens
taacattgcactttataaacact

SEQ ID NO: 2745165 - DNA, 12 bp, Homo sapiens
taataaatatga

SEQ ID NO: 2745166 - DNA, 17 bp, Homo sapiens
taatatttattgcttta

SEQ ID NO: 2745167 - DNA, 17 bp, Homo sapiens
tacagtttgtttacaca

SEQ ID NO: 2745168 - DNA, 20 bp, Homo sapiens
taccttccagtcaggatgac

SEQ ID NO: 2745169 - DNA, 14 bp, Homo sapiens
tagagccaggcaca

SEQ ID NO: 2745170 - DNA, 19 bp, Homo sapiens
tagatgtagcattgttcca

SEQ ID NO: 2745171 - DNA, 22 bp, Homo sapiens
tagatgtagcattgttccacac

SEQ ID NO: 2745172 - DNA, 13 bp, Homo sapiens
tagcattgttcca

SEQ ID NO: 2745173 - DNA, 14 bp, Homo sapiens
tagcattgttccac

SEQ ID NO: 2745174 - DNA, 14 bp, Homo sapiens
tataaataaatata

SEQ ID NO: 2745175 - DNA, 15 bp, Homo sapiens
tataaataaatatat

SEQ ID NO: 2745176 - DNA, 10 bp, Homo sapiens
tataaatata

SEQ ID NO: 2745177 - DNA, 12 bp, Homo sapiens
tataaatatata

SEQ ID NO: 2745178 - DNA, 21 bp, Homo sapiens
tataaatatatataaatatat

SEQ ID NO: 2745179 - DNA, 12 bp, Homo sapiens
tataagtttctt

SEQ ID NO: 2745180 - DNA, 13 bp, Homo sapiens
tatataaatatat

SEQ ID NO: 2745181 - DNA, 14 bp, Homo sapiens
tatatataaataaa

SEQ ID NO: 2745182 - DNA, 14 bp, Homo sapiens
tatatatcctctgt

SEQ ID NO: 2745183 - DNA, 16 bp, Homo sapiens
tatatatcctctgtat

SEQ ID NO: 2745184 - DNA, 13 bp, Homo sapiens
tatgcttcttgga

SEQ ID NO: 2745185 - DNA, 11 bp, Homo sapiens
tattgtacaga

SEQ ID NO: 2745186 - DNA, 15 bp, Homo sapiens
tatttaaaattggca

SEQ ID NO: 2745187 - DNA, 16 bp, Homo sapiens
tatttaaaattggcac

SEQ ID NO: 2745188 - DNA, 13 bp, Homo sapiens
tatttattgcttt

SEQ ID NO: 2745189 - DNA, 13 bp, Homo sapiens
tcaaataaacact

SEQ ID NO: 2745190 - DNA, 14 bp, Homo sapiens
tcaaataaacactg

SEQ ID NO: 2745191 - DNA, 18 bp, Homo sapiens
tcaatacttgaatatgga

SEQ ID NO: 2745192 - DNA, 12 bp, Homo sapiens
tcacttctccca

SEQ ID NO: 2745193 - DNA, 13 bp, Homo sapiens
tcagccctggagg

SEQ ID NO: 2745194 - DNA, 14 bp, Homo sapiens
tcagccctggaggt

SEQ ID NO: 2745195 - DNA, 17 bp, Homo sapiens
tcagccctggaggtgcc

SEQ ID NO: 2745196 - DNA, 19 bp, Homo sapiens
tcagccctggaggtgccag

SEQ ID NO: 2745197 - DNA, 21 bp, Homo sapiens
tcagccctggaggtgccagca

SEQ ID NO: 2745198 - DNA, 17 bp, Homo sapiens
tcaggctgtgcttacct

SEQ ID NO: 2745199 - DNA, 14 bp, Homo sapiens
tcatcaatcattgt

SEQ ID NO: 2745200 - DNA, 15 bp, Homo sapiens
tcatcaatcattgta

SEQ ID NO: 2745201 - DNA, 16 bp, Homo sapiens
tcatcaatcattgtac

SEQ ID NO: 2745202 - DNA, 11 bp, Homo sapiens
tcatgaataaa

SEQ ID NO: 2745203 - DNA, 17 bp, Homo sapiens
tcattgtacagtttgtt

SEQ ID NO: 2745204 - DNA, 12 bp, Homo sapiens
tccaataaacag

SEQ ID NO: 2745205 - DNA, 15 bp, Homo sapiens
tccacacatttaaaa

SEQ ID NO: 2745206 - DNA, 13 bp, Homo sapiens
tccacctccatct

SEQ ID NO: 2745207 - DNA, 23 bp, Homo sapiens
tccagctgaccctggttctctct

SEQ ID NO: 2745208 - DNA, 16 bp, Homo sapiens
tccatcttctttgcag

SEQ ID NO: 2745209 - DNA, 16 bp, Homo sapiens
tcccatgtgtgatgct

SEQ ID NO: 2745210 - DNA, 16 bp, Homo sapiens
tgctggagcctgtgta

SEQ ID NO: 2745211 - DNA, 18 bp, Homo sapiens
tggaacatatgcacaggg

SEQ ID NO: 2745212 - DNA, 14 bp, Homo sapiens
tggagcctgtgtaa

SEQ ID NO: 2745213 - DNA, 18 bp, Homo sapiens
tggagtcgtgggaaggag

SEQ ID NO: 2745214 - DNA, 20 bp, Homo sapiens
tggagtcgtgggaaggaggg

SEQ ID NO: 2745215 - DNA, 17 bp, Homo sapiens
tggatataaatatatat

SEQ ID NO: 2745216 - DNA, 13 bp, Homo sapiens
tggcagcataaag

SEQ ID NO: 2745217 - DNA, 14 bp, Homo sapiens
tggctgccagctat

SEQ ID NO: 2745218 - DNA, 14 bp, Homo sapiens
tgggaggaagcaga

SEQ ID NO: 2745219 - DNA, 16 bp, Homo sapiens
tgggaggaagcagaat

SEQ ID NO: 2745220 - DNA, 15 bp, Homo sapiens
tgggctcgtctttgc

SEQ ID NO: 2745221 - DNA, 16 bp, Homo sapiens
tgggctcgtctttgca

SEQ ID NO: 2745222 - DNA, 17 bp, Homo sapiens
tgggctcgtctttgcag

SEQ ID NO: 2745223 - DNA, 17 bp, Homo sapiens
tgtaacagctccttggg

SEQ ID NO: 2745224 - DNA, 15 bp, Homo sapiens
tgtaataaatatgag

SEQ ID NO: 2745225 - DNA, 16 bp, Homo sapiens
tgtacagtttgtttac

SEQ ID NO: 2745226 - DNA, 12 bp, Homo sapiens
tgtagcattgtt

SEQ ID NO: 2745227 - DNA, 15 bp, Homo sapiens
tgtagcattgttcca

SEQ ID NO: 2745228 - DNA, 21 bp, Homo sapiens
tgtgcttctaatatttattgc

SEQ ID NO: 2745229 - DNA, 11 bp, Homo sapiens
tgtgctttcta

SEQ ID NO: 2745230 - DNA, 17 bp, Homo sapiens
tgtgggtggatataaat

SEQ ID NO: 2745231 - DNA, 22 bp, Homo sapiens
tgtgggtggatataaatatata

SEQ ID NO: 2745232 - DNA, 22 bp, Homo sapiens
tgtgtgggtggatataaatata

SEQ ID NO: 2745233 - DNA, 21 bp, Homo sapiens
tgttccacacatttaaaacat

SEQ ID NO: 2745234 - DNA, 15 bp, Homo sapiens
tgttcgcgtgtgtgg

SEQ ID NO: 2745235 - DNA, 23 bp, Homo sapiens
tgttcgcgtgtgtgggtggatat

SEQ ID NO: 2745236 - DNA, 16 bp, Homo sapiens
tgtttacacacgtgca

SEQ ID NO: 2745237 - DNA, 14 bp, Homo sapiens
tgtttgtgcttcta

SEQ ID NO: 2745238 - DNA, 19 bp, Homo sapiens
tgtttgtgcttctaatatt

SEQ ID NO: 2745239 - DNA, 11 bp, Homo sapiens
ttaaaattggc

SEQ ID NO: 2745240 - DNA, 13 bp, Homo sapiens
ttaaataaaacta

SEQ ID NO: 2745241 - DNA, 23 bp, Homo sapiens
ttacacacgtgcaatttgtttgt

SEQ ID NO: 2745242 - DNA, 16 bp, Homo sapiens
ttaccaagactcctgc

SEQ ID NO: 2745243 - DNA, 13 bp, Homo sapiens
ttactagaacaca

SEQ ID NO: 2745244 - DNA, 22 bp, Homo sapiens
ttagagccaggcacacactgtg

SEQ ID NO: 2745245 - DNA, 14 bp, Homo sapiens
ttatgcttcttgga

SEQ ID NO: 2745246 - DNA, 18 bp, Homo sapiens
ttcacttctcccaagact

SEQ ID NO: 2745247 - DNA, 13 bp, Homo sapiens
ttcatcaatcatt

SEQ ID NO: 2745248 - DNA, 18 bp, Homo sapiens
ttccacacatttaaaaca

SEQ ID NO: 2745249 - DNA, 13 bp, Homo sapiens
ttccttgaagccg

SEQ ID NO: 2745250 - DNA, 18 bp, Homo sapiens
ttcttggagtcttccaaa

SEQ ID NO: 2745251 - DNA, 23 bp, Homo sapiens
ttgccaacctgtaataaatatga

SEQ ID NO: 2745252 - DNA, 15 bp, Homo sapiens
ttgccgtctctggcc

SEQ ID NO: 2745253 - DNA, 15 bp, Homo sapiens
ttggagtcttccaaa

SEQ ID NO: 2745254 - DNA, 13 bp, Homo sapiens
ttgggaggaagca

SEQ ID NO: 2745255 - DNA, 17 bp, Homo sapiens
ttgggaggaagcagaat

SEQ ID NO: 2745256 - DNA, 22 bp, Homo sapiens
ttgggaggaagcagaataaagc

SEQ ID NO: 2745257 - DNA, 18 bp, Homo sapiens
ttgtacagtttgtttaca

SEQ ID NO: 2745258 - DNA, 15 bp, Homo sapiens
ttgtctattctccag

SEQ ID NO: 2745259 - DNA, 12 bp, Homo sapiens
ttgtttgtgctt

SEQ ID NO: 2745260 - DNA, 15 bp, Homo sapiens
tttaaaattggcacc

SEQ ID NO: 2745261 - DNA, 14 bp, Homo sapiens
tttagacactggct

SEQ ID NO: 2745262 - DNA, 23 bp, Homo sapiens
tttcagtgtcaaataaacactgt

SEQ ID NO: 2745263 - DNA, 16 bp, Homo sapiens
tttctattgtacagaa

SEQ ID NO: 2745264 - DNA, 15 bp, Homo sapiens
tttgtttgtgcttct

SEQ ID NO: 2745265 - DNA, 16 bp, Homo sapiens
tttgtttgtgcttcta

SEQ ID NO: 2745266 - DNA, 14 bp, Homo sapiens
acgtctcatctccc

SEQ ID NO: 2745267 - DNA, 16 bp, Homo sapiens
acgtctcatctcccat

SEQ ID NO: 2745268 - DNA, 19 bp, Homo sapiens
acgtgcaatttgtttgtgc

SEQ ID NO: 2745269 - DNA, 21 bp, Homo sapiens
acgtgcaatttgtttgtgctt

SEQ ID NO: 2745270 - DNA, 22 bp, Homo sapiens
acgtgcaatttgtttgtgcttc

SEQ ID NO: 2745271 - DNA, 20 bp, Homo sapiens
acgtggttgccgtctctggc

SEQ ID NO: 2745272 - DNA, 18 bp, Homo sapiens
actatttaaaattggcac

SEQ ID NO: 2745273 - DNA, 13 bp, Homo sapiens
actgtgctttcta

SEQ ID NO: 2745274 - DNA, 14 bp, Homo sapiens
actgtgctttctat

SEQ ID NO: 2745275 - DNA, 19 bp, Homo sapiens
agaacacagaaagcctatc

SEQ ID NO: 2745276 - DNA, 21 bp, Homo sapiens
agaacacagaaagcctatcaa

SEQ ID NO: 2745277 - DNA, 12 bp, Homo sapiens
agaataaagcaa

SEQ ID NO: 2745278 - DNA, 13 bp, Homo sapiens
agaataaagcaat

SEQ ID NO: 2745279 - DNA, 14 bp, Homo sapiens
agaataaagcaatt

SEQ ID NO: 2745280 - DNA, 16 bp, Homo sapiens
agaataaagcaatttt

SEQ ID NO: 2745281 - DNA, 17 bp, Homo sapiens
agaataaagcaattttc

SEQ ID NO: 2745282 - DNA, 18 bp, Homo sapiens
agaataaagcaattttcc

SEQ ID NO: 2745283 - DNA, 19 bp, Homo sapiens
agaataaagcaattttcct

SEQ ID NO: 2745284 - DNA, 18 bp, Homo sapiens
agacactggctgccagct

SEQ ID NO: 2745285 - DNA, 13 bp, Homo sapiens
agagccaggcaca

SEQ ID NO: 2745286 - DNA, 22 bp, Homo sapiens
agaggccatgttccaataaaca

SEQ ID NO: 2745287 - DNA, 17 bp, Homo sapiens
agcaattttccttgaag

SEQ ID NO: 2745288 - DNA, 14 bp, Homo sapiens
agcagaataaagca

SEQ ID NO: 2745289 - DNA, 15 bp, Homo sapiens
agcagaataaagcaa

SEQ ID NO: 2745290 - DNA, 16 bp, Homo sapiens
agcagaataaagcaat

SEQ ID NO: 2745291 - DNA, 18 bp, Homo sapiens
agcagaataaagcaattt

SEQ ID NO: 2745292 - DNA, 21 bp, Homo sapiens
agcagaataaagcaattttcc

SEQ ID NO: 2745293 - DNA, 21 bp, Homo sapiens
agcatcctgccttagagccag

SEQ ID NO: 2745294 - DNA, 23 bp, Homo sapiens
agcatcctgccttagagccaggc

SEQ ID NO: 2745295 - DNA, 23 bp, Homo sapiens
agccaggcacacactgtgctttc

SEQ ID NO: 2745296 - DNA, 16 bp, Homo sapiens
agccccatgctggagc

SEQ ID NO: 2745297 - DNA, 21 bp, Homo sapiens
agccccatgctggagcctgtg

SEQ ID NO: 2745298 - DNA, 22 bp, Homo sapiens
agccccatgctggagcctgtgt

SEQ ID NO: 2745299 - DNA, 23 bp, Homo sapiens
agccccatgctggagcctgtgta

SEQ ID NO: 2745300 - DNA, 12 bp, Homo sapiens
agccctggaggt

SEQ ID NO: 2745301 - DNA, 15 bp, Homo sapiens
agccctggaggtgcc

SEQ ID NO: 2745302 - DNA, 18 bp, Homo sapiens
agccctggaggtgccagc

SEQ ID NO: 2745303 - DNA, 16 bp, Homo sapiens
agcctgtgtaacagct

SEQ ID NO: 2745304 - DNA, 20 bp, Homo sapiens
agccttaccaagactcctgc

SEQ ID NO: 2745305 - DNA, 21 bp, Homo sapiens
agctccttgggaggaagcaga

SEQ ID NO: 2745306 - DNA, 23 bp, Homo sapiens
agctccttgggaggaagcagaat

SEQ ID NO: 2745307 - DNA, 13 bp, Homo sapiens
agctctgtcccca

SEQ ID NO: 2745308 - DNA, 14 bp, Homo sapiens
aggaaataacattg

SEQ ID NO: 2745309 - DNA, 11 bp, Homo sapiens
aggaagcagaa

SEQ ID NO: 2745310 - DNA, 12 bp, Homo sapiens
aggaagcagaat

SEQ ID NO: 2745311 - DNA, 18 bp, Homo sapiens
aggaagcagaataaagca

SEQ ID NO: 2745312 - DNA, 19 bp, Homo sapiens
aggaagcagaataaagcaa

SEQ ID NO: 2745313 - DNA, 20 bp, Homo sapiens
aggaagcagaataaagcaat

SEQ ID NO: 2745314 - DNA, 23 bp, Homo sapiens
aggaagcagaataaagcaatttt

SEQ ID NO: 2745315 - DNA, 16 bp, Homo sapiens
aggaggggagccttac

SEQ ID NO: 2745316 - DNA, 23 bp, Homo sapiens
aggcacacactgtgctttctatt

SEQ ID NO: 2745317 - DNA, 15 bp, Homo sapiens
aggctgtgcttacct

SEQ ID NO: 2745318 - DNA, 16 bp, Homo sapiens
aggtgccagcaaagcc

SEQ ID NO: 2745319 - DNA, 11 bp, Homo sapiens
agtcaggatga

SEQ ID NO: 2745320 - DNA, 15 bp, Homo sapiens
agtcgtgggaaggag

SEQ ID NO: 2745321 - DNA, 15 bp, Homo sapiens
agtgtcaaataaaca

SEQ ID NO: 2745322 - DNA, 20 bp, Homo sapiens
agtgtcaaataaacactgtg

SEQ ID NO: 2745323 - DNA, 14 bp, Homo sapiens
ataaaactatttaa

SEQ ID NO: 2745324 - DNA, 11 bp, Homo sapiens
ataaagcaatt

SEQ ID NO: 2745325 - DNA, 12 bp, Homo sapiens
ataaagcaattt

SEQ ID NO: 2745326 - DNA, 16 bp, Homo sapiens
ataaagcaattttcct

SEQ ID NO: 2745327 - DNA, 17 bp, Homo sapiens
ataaagcaattttcctt

SEQ ID NO: 2745328 - DNA, 23 bp, Homo sapiens
ataaagcaattttccttgaagcc

SEQ ID NO: 2745329 - DNA, 14 bp, Homo sapiens
ataaaggccttttt

SEQ ID NO: 2745330 - DNA, 13 bp, Homo sapiens
ataaataaatata

SEQ ID NO: 2745331 - DNA, 14 bp, Homo sapiens
ataaataaatatat

SEQ ID NO: 2745332 - DNA, 20 bp, Homo sapiens
ataaatatatataaatatat

SEQ ID NO: 2745333 - DNA, 21 bp, Homo sapiens
ataaatatatataaatatata

SEQ ID NO: 2745334 - DNA, 20 bp, Homo sapiens
ataaatatatatatcctctg

SEQ ID NO: 2745335 - DNA, 15 bp, Homo sapiens
atacttgaatatgga

SEQ ID NO: 2745336 - DNA, 22 bp, Homo sapiens
atagtggacattgttggcagca

SEQ ID NO: 2745337 - DNA, 15 bp, Homo sapiens
atataaataaatata

SEQ ID NO: 2745338 - DNA, 16 bp, Homo sapiens
atataaataaatatat

SEQ ID NO: 2745339 - DNA, 16 bp, Homo sapiens
gaaggaaataacattg

SEQ ID NO: 2745340 - DNA, 14 bp, Homo sapiens
gaataaagcaattt

SEQ ID NO: 2745341 - DNA, 19 bp, Homo sapiens
gaataaagcaattttcctt

SEQ ID NO: 2745342 - DNA, 21 bp, Homo sapiens
gaataaagcaattttccttga

SEQ ID NO: 2745343 - DNA, 17 bp, Homo sapiens
gacactggctgccagct

SEQ ID NO: 2745344 - DNA, 22 bp, Homo sapiens
gacattgttggcagcataaagg

SEQ ID NO: 2745345 - DNA, 18 bp, Homo sapiens
gagaaaatccccattgaa

SEQ ID NO: 2745346 - DNA, 15 bp, Homo sapiens
gagcctgtgtaacag

SEQ ID NO: 2745347 - DNA, 16 bp, Homo sapiens
gagcctgtgtaacagc

SEQ ID NO: 2745348 - DNA, 20 bp, Homo sapiens
gagcctgtgtaacagctcct

SEQ ID NO: 2745349 - DNA, 14 bp, Homo sapiens
gaggaagcagaata

SEQ ID NO: 2745350 - DNA, 19 bp, Homo sapiens
gaggaagcagaataaagca

SEQ ID NO: 2745351 - DNA, 23 bp, Homo sapiens
gaggccatgttccaataaacagg

SEQ ID NO: 2745352 - DNA, 15 bp, Homo sapiens
gaggtgccagcaaag

SEQ ID NO: 2745353 - DNA, 16 bp, Homo sapiens
gaggtgccagcaaagc

SEQ ID NO: 2745354 - DNA, 17 bp, Homo sapiens
gatataaatatatataa

SEQ ID NO: 2745355 - DNA, 18 bp, Homo sapiens
gatctgctcagccctgga

SEQ ID NO: 2745356 - DNA, 20 bp, Homo sapiens
gatctgctcagccctggagg

SEQ ID NO: 2745357 - DNA, 21 bp, Homo sapiens
gatgacggtattatgcttctt

SEQ ID NO: 2745358 - DNA, 12 bp, Homo sapiens
gatgctgacacc

SEQ ID NO: 2745359 - DNA, 14 bp, Homo sapiens
gatgtagcattgtt

SEQ ID NO: 2745360 - DNA, 19 bp, Homo sapiens
gcaaagccccatgctggag

SEQ ID NO: 2745361 - DNA, 17 bp, Homo sapiens
gcaatgtcttaaataaa

SEQ ID NO: 2745362 - DNA, 18 bp, Homo sapiens
gcaatttgtttgtgcttc

SEQ ID NO: 2745363 - DNA, 11 bp, Homo sapiens
gcaattttcct

SEQ ID NO: 2745364 - DNA, 16 bp, Homo sapiens
ttatccacctccatct

SEQ ID NO: 2745365 - DNA, 22 bp, Homo sapiens
ttcagtgtcaaataaacactgt

SEQ ID NO: 2745366 - DNA, 22 bp, Homo sapiens
ttcatcaatcattgtacagttt

SEQ ID NO: 2745367 - DNA, 13 bp, Homo sapiens
ttccaataaacag

SEQ ID NO: 2745368 - DNA, 18 bp, Homo sapiens
ttctaatatttattgctt

SEQ ID NO: 2745369 - DNA, 19 bp, Homo sapiens
ttgatctgctcagccctgg

SEQ ID NO: 2745370 - DNA, 22 bp, Homo sapiens
ttgatctgctcagccctggagg

SEQ ID NO: 2745371 - DNA, 18 bp, Homo sapiens
ttgccaacctgtaataaa

SEQ ID NO: 2745372 - DNA, 22 bp, Homo sapiens
ttgccaacctgtaataaatatg

SEQ ID NO: 2745373 - DNA, 16 bp, Homo sapiens
ttgctttataaataaa

SEQ ID NO: 2745374 - DNA, 15 bp, Homo sapiens
ttgggaggaagcaga

SEQ ID NO: 2745375 - DNA, 18 bp, Homo sapiens
ttgggaggaagcagaata

SEQ ID NO: 2745376 - DNA, 19 bp, Homo sapiens
ttgggaggaagcagaataa

SEQ ID NO: 2745377 - DNA, 23 bp, Homo sapiens
ttgggaggaagcagaataaagca

SEQ ID NO: 2745378 - DNA, 20 bp, Homo sapiens
ttgttggcagcataaaggcc

SEQ ID NO: 2745379 - DNA, 12 bp, Homo sapiens
tttaaaacattt

SEQ ID NO: 2745380 - DNA, 12 bp, Homo sapiens
tttaaaattggc

SEQ ID NO: 2745381 - DNA, 21 bp, Homo sapiens
tttacacacgtgcaatttgtt

SEQ ID NO: 2745382 - DNA, 20 bp, Homo sapiens
tttactagaacacagaaagc

SEQ ID NO: 2745383 - DNA, 21 bp, Homo sapiens
tttcagtgtcaaataaacact

SEQ ID NO: 2745384 - DNA, 22 bp, Homo sapiens
tttcagtgtcaaataaacactg

SEQ ID NO: 2745385 - DNA, 13 bp, Homo sapiens
tttccttgaagcc

SEQ ID NO: 2745386 - DNA, 14 bp, Homo sapiens
tttccttgaagccg

SEQ ID NO: 2745387 - DNA, 13 bp, Homo sapiens
tttctattgtaca

SEQ ID NO: 2745388 - DNA, 12 bp, Homo sapiens
tttgtttgtgct

SEQ ID NO: 2745389 - DNA, 15 bp, Homo sapiens
ttttactagaacaca

SEQ ID NO: 2745390 - DNA, 14 bp, Homo sapiens
ttttccttgaagcc

SEQ ID NO: 2745391 - DNA, 17 bp, Homo sapiens
ccccatgctggagcctg

SEQ ID NO: 2745392 - DNA, 19 bp, Homo sapiens
ccccatgctggagcctgtg

SEQ ID NO: 2745393 - DNA, 18 bp, Homo sapiens
cccttggacctctccacg

SEQ ID NO: 2745394 - DNA, 18 bp, Homo sapiens
cctccatcttctttgcag

SEQ ID NO: 2745395 - DNA, 21 bp, Homo sapiens
cctcgggaacctcactcttgc

SEQ ID NO: 2745396 - DNA, 16 bp, Homo sapiens
cctgcaaaaacccttg

SEQ ID NO: 2745397 - DNA, 14 bp, Homo sapiens
cctggaggtgccag

SEQ ID NO: 2745398 - DNA, 16 bp, Homo sapiens
cctggaggtgccagca

SEQ ID NO: 2745399 - DNA, 23 bp, Homo sapiens
cctggaggtgccagcaaagcccc

SEQ ID NO: 2745400 - DNA, 13 bp, Homo sapiens
cctgtaataaata

SEQ ID NO: 2745401 - DNA, 14 bp, Homo sapiens
cctgtaataaatat

SEQ ID NO: 2745402 - DNA, 15 bp, Homo sapiens
cctgtaataaatatg

SEQ ID NO: 2745403 - DNA, 22 bp, Homo sapiens
cctgtaataaatatgagtgcca

SEQ ID NO: 2745404 - DNA, 21 bp, Homo sapiens
cctgtgtaacagctccttggg

SEQ ID NO: 2745405 - DNA, 17 bp, Homo sapiens
ccttaccaagactcctg

SEQ ID NO: 2745406 - DNA, 16 bp, Homo sapiens
ccttgggaggaagcag

SEQ ID NO: 2745407 - DNA, 19 bp, Homo sapiens
ccttgggaggaagcagaat

SEQ ID NO: 2745408 - DNA, 23 bp, Homo sapiens
ccttgggaggaagcagaataaag

SEQ ID NO: 2745409 - DNA, 17 bp, Homo sapiens
ccttgtgtgtatgtgta

SEQ ID NO: 2745410 - DNA, 18 bp, Homo sapiens
cgctgctgcgccctgggc

SEQ ID NO: 2745411 - DNA, 19 bp, Homo sapiens
cgctgctgcgccctgggct

SEQ ID NO: 2745412 - DNA, 20 bp, Homo sapiens
cgctgctgcgccctgggctc

SEQ ID NO: 2745413 - DNA, 22 bp, Homo sapiens
cggcctggagtcgtgggaagga

SEQ ID NO: 2745414 - DNA, 17 bp, Homo sapiens
cggtattatgcttcttg

SEQ ID NO: 2745415 - DNA, 14 bp, Homo sapiens
cgtctctggcccct

SEQ ID NO: 2745416 - DNA, 20 bp, Homo sapiens
cgtgcaatttgtttgtgctt

SEQ ID NO: 2745417 - DNA, 21 bp, Homo sapiens
cgtggttgccgtctctggccc

SEQ ID NO: 2745418 - DNA, 22 bp, Homo sapiens
cgtggttgccgtctctggcccc

SEQ ID NO: 2745419 - DNA, 12 bp, Homo sapiens
cgtgtgtgtgcg

SEQ ID NO: 2745420 - DNA, 22 bp, Homo sapiens
cgtttcagtgtcaaataaacac

SEQ ID NO: 2745421 - DNA, 23 bp, Homo sapiens
cgtttcagtgtcaaataaacact

SEQ ID NO: 2745422 - DNA, 22 bp, Homo sapiens
ctaatataagtttctttgcttc

SEQ ID NO: 2745423 - DNA, 21 bp, Homo sapiens
ctatcaaagaccttgtgtgta

SEQ ID NO: 2745424 - DNA, 14 bp, Homo sapiens
ctattctccagctg

SEQ ID NO: 2745425 - DNA, 12 bp, Homo sapiens
ctattgtacaga

SEQ ID NO: 2745426 - DNA, 14 bp, Homo sapiens
ctatttaaaattgg

SEQ ID NO: 2745427 - DNA, 18 bp, Homo sapiens
ctatttaaaattggcacc

SEQ ID NO: 2745428 - DNA, 14 bp, Homo sapiens
ctcaggctgtgctt

SEQ ID NO: 2745429 - DNA, 15 bp, Homo sapiens
ctcatgctaatataa

SEQ ID NO: 2745430 - DNA, 16 bp, Homo sapiens
ctccatcttctttgca

SEQ ID NO: 2745431 - DNA, 20 bp, Homo sapiens
ctcccatgtgtgatgctgac

SEQ ID NO: 2745432 - DNA, 17 bp, Homo sapiens
ctccctcgtcgagctgg

SEQ ID NO: 2745433 - DNA, 17 bp, Homo sapiens
ctccttgggaggaagca

SEQ ID NO: 2745434 - DNA, 19 bp, Homo sapiens
ctccttgggaggaagcaga

SEQ ID NO: 2745435 - DNA, 22 bp, Homo sapiens
ctccttgggaggaagcagaata

SEQ ID NO: 2745436 - DNA, 20 bp, Homo sapiens
ctcgctgctgcgccctgggc

SEQ ID NO: 2745437 - DNA, 12 bp, Homo sapiens
ctcgggaacctc

SEQ ID NO: 2745438 - DNA, 16 bp, Homo sapiens
ctcgggaacctcactc

SEQ ID NO: 2745439 - DNA, 16 bp, Homo sapiens
ctctcaggctgtgctt

SEQ ID NO: 2745440 - DNA, 18 bp, Homo sapiens
ctctcaggctgtgcttac

SEQ ID NO: 2745441 - DNA, 14 bp, Homo sapiens
ctctgcatttgtct

SEQ ID NO: 2745442 - DNA, 19 bp, Homo sapiens
ctctgcatttgtctattct

SEQ ID NO: 2745443 - DNA, 23 bp, Homo sapiens
ctctgcatttgtctattctccag

SEQ ID NO: 2745444 - DNA, 20 bp, Homo sapiens
ctcttcgtttcagtgtcaaa

SEQ ID NO: 2745445 - DNA, 22 bp, Homo sapiens
ctgccccatttatccacctcca

SEQ ID NO: 2745446 - DNA, 14 bp, Homo sapiens
ctgctcagccctgg

SEQ ID NO: 2745447 - DNA, 12 bp, Homo sapiens
ctggagcctgtg

SEQ ID NO: 2745448 - DNA, 17 bp, Homo sapiens
ctggagcctgtgtaaca

SEQ ID NO: 2745449 - DNA, 18 bp, Homo sapiens
ctggagcctgtgtaacag

SEQ ID NO: 2745450 - DNA, 22 bp, Homo sapiens
ctggagcctgtgtaacagctcc

SEQ ID NO: 2745451 - DNA, 23 bp, Homo sapiens
ctggagcctgtgtaacagctcct

SEQ ID NO: 2745452 - DNA, 24 bp, Homo sapiens
ctggagcctgtgtaacagctcctt

SEQ ID NO: 2745453 - DNA, 19 bp, Homo sapiens
ctggagtcgtgggaaggag

SEQ ID NO: 2745454 - DNA, 23 bp, Homo sapiens
ctggcccctctcaggctgtgctt

SEQ ID NO: 2745455 - DNA, 17 bp, Homo sapiens
ctgggctcgtctttgca

SEQ ID NO: 2745456 - DNA, 12 bp, Homo sapiens
ctgtaataaata

SEQ ID NO: 2745457 - DNA, 13 bp, Homo sapiens
ctgtaataaatat

SEQ ID NO: 2745458 - DNA, 14 bp, Homo sapiens
ctgtaataaatatg

SEQ ID NO: 2745459 - DNA, 15 bp, Homo sapiens
ctgtaataaatatga

SEQ ID NO: 2745460 - DNA, 15 bp, Homo sapiens
ctgtgcttacctgtg

SEQ ID NO: 2745461 - DNA, 18 bp, Homo sapiens
ctgtgcttacctgtgaca

SEQ ID NO: 2745462 - DNA, 13 bp, Homo sapiens
ctgtgctttctat

SEQ ID NO: 2745463 - DNA, 19 bp, Homo sapiens
ctgtgtaacagctccttgg

SEQ ID NO: 2745464 - DNA, 14 bp, Homo sapiens
cttagagccaggca

SEQ ID NO: 2745465 - DNA, 15 bp, Homo sapiens
cttagagccaggcac

SEQ ID NO: 2745466 - DNA, 23 bp, Homo sapiens
cttagagccaggcacacactgtg

SEQ ID NO: 2745467 - DNA, 13 bp, Homo sapiens
cttcacttctccc

SEQ ID NO: 2745468 - DNA, 17 bp, Homo sapiens
cttctaatatttattgc

SEQ ID NO: 2745469 - DNA, 18 bp, Homo sapiens
cttctttgcagcctgggt

SEQ ID NO: 2745470 - DNA, 17 bp, Homo sapiens
cttgatctgctcagccc

SEQ ID NO: 2745471 - DNA, 21 bp, Homo sapiens
cttgatctgctcagccctgga

SEQ ID NO: 2745472 - DNA, 16 bp, Homo sapiens
cttggacctctccacg

SEQ ID NO: 2745473 - DNA, 15 bp, Homo sapiens
cttgggaggaagcag

SEQ ID NO: 2745474 - DNA, 22 bp, Homo sapiens
cttgggaggaagcagaataaag

SEQ ID NO: 2745475 - DNA, 11 bp, Homo sapiens
ctttataaata

SEQ ID NO: 2745476 - DNA, 18 bp, Homo sapiens
ctttcatcaatcattgta

SEQ ID NO: 2745477 - DNA, 17 bp, Homo sapiens
gaaatccatccagaggc

SEQ ID NO: 2745478 - DNA, 18 bp, Homo sapiens
gaacatatgcacagggga

SEQ ID NO: 2745479 - DNA, 18 bp, Homo sapiens
gaacctcactcttgccaa

SEQ ID NO: 2745480 - DNA, 19 bp, Homo sapiens
gaacctcactcttgccaac

SEQ ID NO: 2745481 - DNA, 14 bp, Homo sapiens
gaagcagaataaag

SEQ ID NO: 2745482 - DNA, 21 bp, Homo sapiens
gaagcagaataaagcaatttt

SEQ ID NO: 2745483 - DNA, 16 bp, Homo sapiens
gaataaagcaattttc

SEQ ID NO: 2745484 - DNA, 18 bp, Homo sapiens
gaataaagcaattttcct

SEQ ID NO: 2745485 - DNA, 20 bp, Homo sapiens
gaataaagcaattttccttg

SEQ ID NO: 2745486 - DNA, 13 bp, Homo sapiens
gaatatggaacat

SEQ ID NO: 2745487 - DNA, 15 bp, Homo sapiens
gaatatggaacatat

SEQ ID NO: 2745488 - DNA, 22 bp, Homo sapiens
gaatatggaacatatgcacagg

SEQ ID NO: 2745489 - DNA, 22 bp, Homo sapiens
gacactggctgccagctatttt

SEQ ID NO: 2745490 - DNA, 17 bp, Homo sapiens
gacattgttggcagcat

SEQ ID NO: 2745491 - DNA, 18 bp, Homo sapiens
aaatttcagcagctgcag

SEQ ID NO: 2745492 - DNA, 12 bp, Homo sapiens
aacaataaaaga

SEQ ID NO: 2745493 - DNA, 16 bp, Homo sapiens
aagtctttcacattta

SEQ ID NO: 2745494 - DNA, 16 bp, Homo sapiens
aatcttataatttaaa

SEQ ID NO: 2745495 - DNA, 19 bp, Homo sapiens
aatcttataatttaaaata

SEQ ID NO: 2745496 - DNA, 11 bp, Homo sapiens
aattgtaatag

SEQ ID NO: 2745497 - DNA, 22 bp, Homo sapiens
acagttcggtgagctacaaatg

SEQ ID NO: 2745498 - DNA, 23 bp, Homo sapiens
accatttcttgaggtaaaagcat

SEQ ID NO: 2745499 - DNA, 18 bp, Homo sapiens
acttgtaaaggaatttaa

SEQ ID NO: 2745500 - DNA, 20 bp, Homo sapiens
acttgtaaaggaatttaaaa

SEQ ID NO: 2745501 - DNA, 14 bp, Homo sapiens
agaaaataacaata

SEQ ID NO: 2745502 - DNA, 20 bp, Homo sapiens
agcatcacatgaacttgtaa

SEQ ID NO: 2745503 - DNA, 19 bp, Homo sapiens
agctactaattttaaaatg

SEQ ID NO: 2745504 - DNA, 20 bp, Homo sapiens
aggtaaaagcatcacatgaa

SEQ ID NO: 2745505 - DNA, 20 bp, Homo sapiens
agttattatatttacaaatg

SEQ ID NO: 2745506 - DNA, 20 bp, Homo sapiens
agttcggtgagctacaaatg

SEQ ID NO: 2745507 - DNA, 22 bp, Homo sapiens
agttgcataggtttaataattt

SEQ ID NO: 2745508 - DNA, 14 bp, Homo sapiens
ataacaatgaaagt

SEQ ID NO: 2745509 - DNA, 22 bp, Homo sapiens
ataacgataaaagacagtgaaa

SEQ ID NO: 2745510 - DNA, 18 bp, Homo sapiens
ataatcctaaacatatga

SEQ ID NO: 2745511 - DNA, 14 bp, Homo sapiens
ataatgaatacttt

SEQ ID NO: 2745512 - DNA, 21 bp, Homo sapiens
atacagttcggtgagctacaa

SEQ ID NO: 2745513 - DNA, 14 bp, Homo sapiens
atagctactaattt

SEQ ID NO: 2745514 - DNA, 17 bp, Homo sapiens
atagctactaattttaa

SEQ ID NO: 2745515 - DNA, 22 bp, Homo sapiens
atcttataatttaaaatatgct

SEQ ID NO: 2745516 - DNA, 23 bp, Homo sapiens
atgtcgtcaaagctgaaatggac

SEQ ID NO: 2745517 - DNA, 19 bp, Homo sapiens
attggacagtaaaatccac

SEQ ID NO: 2745518 - DNA, 16 bp, Homo sapiens
attgtagtcctgtaat

SEQ ID NO: 2745519 - DNA, 22 bp, Homo sapiens
atttttgtgattttgtgattga

SEQ ID NO: 2745520 - DNA, 20 bp, Homo sapiens
cagtgaaagaaaataacaat

SEQ ID NO: 2745521 - DNA, 23 bp, Homo sapiens
ctacacgagatacagaattttat

SEQ ID NO: 2745522 - DNA, 14 bp, Homo sapiens
cttataatttaaaa

SEQ ID NO: 2745523 - DNA, 17 bp, Homo sapiens
cttgccaaatataaata

SEQ ID NO: 2745524 - DNA, 18 bp, Homo sapiens
gaaattgtattacaaatc

SEQ ID NO: 2745525 - DNA, 20 bp, Homo sapiens
gaataatcctaaacatatga

SEQ ID NO: 2745526 - DNA, 16 bp, Homo sapiens
gacaaggaaaaaataa

SEQ ID NO: 2745527 - DNA, 14 bp, Homo sapiens
gagctacaaatgca

SEQ ID NO: 2745528 - DNA, 17 bp, Homo sapiens
gataggtcagtgcaaat

SEQ ID NO: 2745529 - DNA, 17 bp, Homo sapiens
gcataggtttaataatt

SEQ ID NO: 2745530 - DNA, 20 bp, Homo sapiens
gcatctagcatgtcgtcaaa

SEQ ID NO: 2745531 - DNA, 16 bp, Homo sapiens
ggaaaaaataacaatg

SEQ ID NO: 2745532 - DNA, 14 bp, Homo sapiens
ggtcagtgcaaata

SEQ ID NO: 2745533 - DNA, 20 bp, Homo sapiens
gtaataggcgtaactaattt

SEQ ID NO: 2745534 - DNA, 17 bp, Homo sapiens
gttattatatttacaaa

SEQ ID NO: 2745535 - DNA, 20 bp, Homo sapiens
gttattatatttacaaatgg

SEQ ID NO: 2745536 - DNA, 20 bp, Homo sapiens
taacgataaaagacagtgaa

SEQ ID NO: 2745537 - DNA, 13 bp, Homo sapiens
tacagaattttat

SEQ ID NO: 2745538 - DNA, 16 bp, Homo sapiens
tagctactaattttaa

SEQ ID NO: 2745539 - DNA, 13 bp, Homo sapiens
tcttataatttaa

SEQ ID NO: 2745540 - DNA, 13 bp, Homo sapiens
tgaaagaaaataa

SEQ ID NO: 2745541 - DNA, 15 bp, Homo sapiens
tgaatactttataaa

SEQ ID NO: 2745542 - DNA, 14 bp, Homo sapiens
tgagctacaaatgc

SEQ ID NO: 2745543 - DNA, 23 bp, Homo sapiens
tgatgctacaggatttgaaattg

SEQ ID NO: 2745544 - DNA, 19 bp, Homo sapiens
tgccaaatataaataaaaa

SEQ ID NO: 2745545 - DNA, 22 bp, Homo sapiens
tgccaaatataaataaaaataa

SEQ ID NO: 2745546 - DNA, 22 bp, Homo sapiens
tggtccatgggccatatgaaaa

SEQ ID NO: 2745547 - DNA, 13 bp, Homo sapiens
tgtattacaaatc

SEQ ID NO: 2745548 - DNA, 22 bp, Homo sapiens
tgtattacaaatccaatgaaat

SEQ ID NO: 2745549 - DNA, 13 bp, Homo sapiens
ttctataatttaa

SEQ ID NO: 2745550 - DNA, 14 bp, Homo sapiens
ttctataatttaaa

SEQ ID NO: 2745551 - DNA, 17 bp, Homo sapiens
ttgaagggaaatttcag

SEQ ID NO: 2745552 - DNA, 14 bp, Homo sapiens
ttgtattacaaatc

SEQ ID NO: 2745553 - DNA, 18 bp, Homo sapiens
tttaaaaaaattccaagt

SEQ ID NO: 2745554 - DNA, 15 bp, Homo sapiens
tttcagcagctgcag

SEQ ID NO: 2745555 - DNA, 18 bp, Homo sapiens
tttgaatcatcaagtctt

SEQ ID NO: 2745556 - DNA, 16 bp, Homo sapiens
ttttctataatttaaa

SEQ ID NO: 2745557 - DNA, 14 bp, Homo sapiens
actagctatggtgt

SEQ ID NO: 2745558 - DNA, 19 bp, Homo sapiens
acttgtaaaggaatttaaa

SEQ ID NO: 2745559 - DNA, 22 bp, Homo sapiens
actttattttctataatttaaa

SEQ ID NO: 2745560 - DNA, 12 bp, Homo sapiens
agctacaaatgc

SEQ ID NO: 2745561 - DNA, 13 bp, Homo sapiens
agctacaaatgca

SEQ ID NO: 2745562 - DNA, 18 bp, Homo sapiens
agcttcactgtaaaataa

SEQ ID NO: 2745563 - DNA, 18 bp, Homo sapiens
agtctttcacatttaaat

SEQ ID NO: 2745564 - DNA, 17 bp, Homo sapiens
agtgaaagaaaataaca

SEQ ID NO: 2745565 - DNA, 19 bp, Homo sapiens
agttcggtgagctacaaat

SEQ ID NO: 2745566 - DNA, 23 bp, Homo sapiens
agttgaaaatcttataatttaaa

SEQ ID NO: 2745567 - DNA, 14 bp, Homo sapiens
agtttaaattgtaa

SEQ ID NO: 2745568 - DNA, 17 bp, Homo sapiens
agtttaaattgtaatag

SEQ ID NO: 2745569 - DNA, 20 bp, Homo sapiens
agtttaaattgtaataggcg

SEQ ID NO: 2745570 - DNA, 20 bp, Homo sapiens
aaaagacaaggaaaaaataa

SEQ ID NO: 2745571 - DNA, 20 bp, Homo sapiens
aaacaagcactaaacaaaga

SEQ ID NO: 2745572 - DNA, 18 bp, Homo sapiens
aaatatatgctaagtctt

SEQ ID NO: 2745573 - DNA, 17 bp, Homo sapiens
aaatttcagcagctgca

SEQ ID NO: 2745574 - DNA, 21 bp, Homo sapiens
aacaagcctccttttaaagta

SEQ ID NO: 2745575 - DNA, 22 bp, Homo sapiens
aaccactggaaagtttatggtt

SEQ ID NO: 2745576 - DNA, 16 bp, Homo sapiens
aaggaaaaaataacaa

SEQ ID NO: 2745577 - DNA, 13 bp, Homo sapiens
aaggataatgaat

SEQ ID NO: 2745578 - DNA, 22 bp, Homo sapiens
aagtcttatatattgtagataa

SEQ ID NO: 2745579 - DNA, 18 bp, Homo sapiens
aataggcgtaactaattt

SEQ ID NO: 2745580 - DNA, 15 bp, Homo sapiens
aatcatcaagtcttt

SEQ ID NO: 2745581 - DNA, 20 bp, Homo sapiens
aatgaatactttataaagga

SEQ ID NO: 2745582 - DNA, 18 bp, Homo sapiens
aattccaagtgattgaaa

SEQ ID NO: 2745583 - DNA, 18 bp, Homo sapiens
acaaaaggataatgaata

SEQ ID NO: 2745584 - DNA, 18 bp, Homo sapiens
acaagcactaaacaaaga

SEQ ID NO: 2745585 - DNA, 20 bp, Homo sapiens
acagtgaaagaaaataacaa

SEQ ID NO: 2745586 - DNA, 15 bp, Homo sapiens
actaattttaaaatg

SEQ ID NO: 2745587 - DNA, 19 bp, Homo sapiens
agacaaggaaaaaataaca

SEQ ID NO: 2745588 - DNA, 20 bp, Homo sapiens
agatagataggtcagtgcaa

SEQ ID NO: 2745589 - DNA, 21 bp, Homo sapiens
agataggtcagtgcaaatact

SEQ ID NO: 2745590 - DNA, 19 bp, Homo sapiens
agctatggtgtcataggct

SEQ ID NO: 2745591 - DNA, 15 bp, Homo sapiens
aggtcagtgcaaata

SEQ ID NO: 2745592 - DNA, 15 bp, Homo sapiens
agtgaaagaaaataa

SEQ ID NO: 2745593 - DNA, 18 bp, Homo sapiens
ataaaggattaatgtcaa

SEQ ID NO: 2745594 - DNA, 13 bp, Homo sapiens
ataaataaaaata

SEQ ID NO: 2745595 - DNA, 18 bp, Homo sapiens
atagataggtcagtgcaa

SEQ ID NO: 2745596 - DNA, 18 bp, Homo sapiens
atagctactaattttaaa

SEQ ID NO: 2745597 - DNA, 17 bp, Homo sapiens
ataggcgtaactaattt

SEQ ID NO: 2745598 - DNA, 13 bp, Homo sapiens
atatttacaaatg

SEQ ID NO: 2745599 - DNA, 14 bp, Homo sapiens
atcttataatttaa

SEQ ID NO: 2745600 - DNA, 18 bp, Homo sapiens
atgctacaggatttgaaa

SEQ ID NO: 2745601 - DNA, 17 bp, Homo sapiens
attcttgccaaatataa

SEQ ID NO: 2745602 - DNA, 14 bp, Homo sapiens
attgtattacaaat

SEQ ID NO: 2745603 - DNA, 20 bp, Homo sapiens
atttcttgaggtaaaagcat

SEQ ID NO: 2745604 - DNA, 19 bp, Homo sapiens
attttatagctactaattt

SEQ ID NO: 2745605 - DNA, 22 bp, Homo sapiens
attttcagttattatatttaca

SEQ ID NO: 2745606 - DNA, 14 bp, Homo sapiens
attttctataattt

SEQ ID NO: 2745607 - DNA, 19 bp, Homo sapiens
attttctataatttaaata

SEQ ID NO: 2745608 - DNA, 21 bp, Homo sapiens
caaaaggataatgaatacttt

SEQ ID NO: 2745609 - DNA, 21 bp, Homo sapiens
cagttattatatttacaaatg

SEQ ID NO: 2745610 - DNA, 16 bp, Homo sapiens
ccgtaggttattttca

SEQ ID NO: 2745611 - DNA, 13 bp, Homo sapiens
cctaaacatatga

SEQ ID NO: 2745612 - DNA, 12 bp, Homo sapiens
ctataatttaaa

SEQ ID NO: 2745613 - DNA, 13 bp, Homo sapiens
ctcacatttatat

SEQ ID NO: 2745614 - DNA, 21 bp, Homo sapiens
ctttattttctataatttaaa

SEQ ID NO: 2745615 - DNA, 20 bp, Homo sapiens
gaaaatcttataatttaaaa

SEQ ID NO: 2745616 - DNA, 23 bp, Homo sapiens
gacctgatttctgagcatttaat

SEQ ID NO: 2745617 - DNA, 13 bp, Homo sapiens
gagctacaaatgc

SEQ ID NO: 2745618 - DNA, 16 bp, Homo sapiens
gagtttaaattgtaat

SEQ ID NO: 2745619 - DNA, 13 bp, Homo sapiens
gcatagaagtaaa

SEQ ID NO: 2745620 - DNA, 20 bp, Homo sapiens
ggaaaaaataacaatgaaag

SEQ ID NO: 2745621 - DNA, 18 bp, Homo sapiens
gtcgtcaaagctgaaatg

SEQ ID NO: 2745622 - DNA, 16 bp, Homo sapiens
gtctttcacatttaaa

SEQ ID NO: 2745623 - DNA, 19 bp, Homo sapiens
gtgaaagaaaataacaata

SEQ ID NO: 2745624 - DNA, 19 bp, Homo sapiens
gttattatatttacaaatg

SEQ ID NO: 2745625 - DNA, 22 bp, Homo sapiens
taaaacaagcactaaacaaaga

SEQ ID NO: 2745626 - DNA, 18 bp, Homo sapiens
taaatatatgctaagtct

SEQ ID NO: 2745627 - DNA, 14 bp, Homo sapiens
tacaggatttgaaa

SEQ ID NO: 2745628 - DNA, 22 bp, Homo sapiens
tagataggtcagtgcaaatact

SEQ ID NO: 2745629 - DNA, 17 bp, Homo sapiens
tattatatttacaaatg

SEQ ID NO: 2745630 - DNA, 19 bp, Homo sapiens
tcttgccaaatataaataa

SEQ ID NO: 2745631 - DNA, 12 bp, Homo sapiens
tctttgccaagt

SEQ ID NO: 2745632 - DNA, 20 bp, Homo sapiens
tgaaaatcttataatttaaa

SEQ ID NO: 2745633 - DNA, 19 bp, Homo sapiens
tgaaatggacttttgtaca

SEQ ID NO: 2745634 - DNA, 13 bp, Homo sapiens
tgagctacaaatg

SEQ ID NO: 2745635 - DNA, 13 bp, Homo sapiens
tgattatatgtca

SEQ ID NO: 2745636 - DNA, 18 bp, Homo sapiens
tgggaaacaaaaggataa

SEQ ID NO: 2745637 - DNA, 17 bp, Homo sapiens
tgtagataatacagttc

SEQ ID NO: 2745638 - DNA, 22 bp, Homo sapiens
ttaatgtcaattcttgccaaat

SEQ ID NO: 2745639 - DNA, 16 bp, Homo sapiens
ttatatttacaaatgg

SEQ ID NO: 2745640 - DNA, 17 bp, Homo sapiens
ttgaaattgtattacaa

SEQ ID NO: 2745641 - DNA, 21 bp, Homo sapiens
tttaaatatatgctaagtctt

SEQ ID NO: 2745642 - DNA, 19 bp, Homo sapiens
tttaactctataatgtgtt

SEQ ID NO: 2745643 - DNA, 21 bp, Homo sapiens
ttttaaagtaaccctacaaaa

SEQ ID NO: 2745644 - DNA, 22 bp, Homo sapiens
aaaagctccatttttagtgaaa

SEQ ID NO: 2745645 - DNA, 13 bp, Homo sapiens
aaaggaatttaaa

SEQ ID NO: 2745646 - DNA, 17 bp, Homo sapiens
aaatcttataatttaaa

SEQ ID NO: 2745647 - DNA, 14 bp, Homo sapiens
aaatgcatttctaa

SEQ ID NO: 2745648 - DNA, 17 bp, Homo sapiens
aaattgtattacaaatc

SEQ ID NO: 2745649 - DNA, 15 bp, Homo sapiens
aataacaataaaaga

SEQ ID NO: 2745650 - DNA, 21 bp, Homo sapiens
aataacaatgaaagttgataa

SEQ ID NO: 2745651 - DNA, 15 bp, Homo sapiens
aatccaatgaaatga

SEQ ID NO: 2745652 - DNA, 20 bp, Homo sapiens
aatcctcagtttttgtgaaa

SEQ ID NO: 2745653 - DNA, 14 bp, Homo sapiens
aatcttataattta

SEQ ID NO: 2745654 - DNA, 19 bp, Homo sapiens
acagttcggtgagctacaa

SEQ ID NO: 2745655 - DNA, 23 bp, Homo sapiens
acagttcggtgagctacaaatgc

SEQ ID NO: 2745656 - DNA, 17 bp, Homo sapiens
actgtaaaataataact

SEQ ID NO: 2745657 - DNA, 17 bp, Homo sapiens
agcatgtcgtcaaagct

SEQ ID NO: 2745658 - DNA, 20 bp, Homo sapiens
agcatgtcgtcaaagctgaa

SEQ ID NO: 2745659 - DNA, 18 bp, Homo sapiens
aggaaaaaataacaatga

SEQ ID NO: 2745660 - DNA, 11 bp, Homo sapiens
aggaatttaaa

SEQ ID NO: 2745661 - DNA, 13 bp, Homo sapiens
agggaaatttcag

SEQ ID NO: 2745662 - DNA, 13 bp, Homo sapiens
agtaaaatccaca

SEQ ID NO: 2745663 - DNA, 12 bp, Homo sapiens
agtcctgtaatg

SEQ ID NO: 2745664 - DNA, 16 bp, Homo sapiens
agtctttcacatttaa

SEQ ID NO: 2745665 - DNA, 22 bp, Homo sapiens
agttgaaaatcttataatttaa

SEQ ID NO: 2745666 - DNA, 13 bp, Homo sapiens
atagaagtaaaaa

SEQ ID NO: 2745667 - DNA, 15 bp, Homo sapiens
ataggtttaataatt

SEQ ID NO: 2745668 - DNA, 13 bp, Homo sapiens
atatatgctaagt

SEQ ID NO: 2745669 - DNA, 15 bp, Homo sapiens
atcttataatttaaa

SEQ ID NO: 2745670 - DNA, 16 bp, Homo sapiens
atcttataatttaaaa

SEQ ID NO: 2745671 - DNA, 18 bp, Homo sapiens
atgaacttgtaaaggaat

SEQ ID NO: 2745672 - DNA, 17 bp, Homo sapiens
attatatttacaaatgg

SEQ ID NO: 2745673 - DNA, 23 bp, Homo sapiens
attgtaataggcgtaactaattt

SEQ ID NO: 2745674 - DNA, 17 bp, Homo sapiens
caagcactaaacaaaga

SEQ ID NO: 2745675 - DNA, 18 bp, Homo sapiens
caaggaaaaaataacaat

SEQ ID NO: 2745676 - DNA, 20 bp, Homo sapiens
caaggaaaaaataacaatga

SEQ ID NO: 2745677 - DNA, 17 bp, Homo sapiens
cagttattatatttaca

SEQ ID NO: 2745678 - DNA, 22 bp, Homo sapiens
cagttcggtgagctacaaatgc

SEQ ID NO: 2745679 - DNA, 16 bp, Homo sapiens
cataggtttaataatt

SEQ ID NO: 2745680 - DNA, 13 bp, Homo sapiens
cattctggaataa

SEQ ID NO: 2745681 - DNA, 21 bp, Homo sapiens
ctaagcttcactgtaaaataa

SEQ ID NO: 2745682 - DNA, 13 bp, Homo sapiens
ctataatttaaat

SEQ ID NO: 2745683 - DNA, 15 bp, Homo sapiens
cttcactgtaaaata

SEQ ID NO: 2745684 - DNA, 13 bp, Homo sapiens
cttctcacattta

SEQ ID NO: 2745685 - DNA, 20 bp, Homo sapiens
cttctcacatttatattttt

SEQ ID NO: 2745686 - DNA, 19 bp, Homo sapiens
cttgagtttaaattgtaat

SEQ ID NO: 2745687 - DNA, 18 bp, Homo sapiens
cttgtaaaggaatttaaa

SEQ ID NO: 2745688 - DNA, 19 bp, Homo sapiens
gaaaataacaataaaagac

SEQ ID NO: 2745689 - DNA, 18 bp, Homo sapiens
gaaaatcttataatttaa

SEQ ID NO: 2745690 - DNA, 19 bp, Homo sapiens
gaaaatcttataatttaaa

SEQ ID NO: 2745691 - DNA, 16 bp, Homo sapiens
gaaattgtattacaaa

SEQ ID NO: 2745692 - DNA, 21 bp, Homo sapiens
gaacttgtaaaggaatttaaa

SEQ ID NO: 2745693 - DNA, 14 bp, Homo sapiens
gaatactttataaa

SEQ ID NO: 2745694 - DNA, 17 bp, Homo sapiens
gagatacagaattttat

SEQ ID NO: 2745695 - DNA, 12 bp, Homo sapiens
gagctacaaatg

SEQ ID NO: 2745696 - DNA, 20 bp, Homo sapiens
gctccatttttagtgaaata

SEQ ID NO: 2745697 - DNA, 22 bp, Homo sapiens
ggcttgagtttaaattgtaata

SEQ ID NO: 2745698 - DNA, 18 bp, Homo sapiens
tagcatgtcgtcaaagct

SEQ ID NO: 2745699 - DNA, 14 bp, Homo sapiens
aaaaataacaatga

SEQ ID NO: 2745700 - DNA, 13 bp, Homo sapiens
aaagacagtgaaa

SEQ ID NO: 2745701 - DNA, 12 bp, Homo sapiens
aaataacaatga

SEQ ID NO: 2745702 - DNA, 17 bp, Homo sapiens
aaattccaagtgattga

SEQ ID NO: 2745703 - DNA, 21 bp, Homo sapiens
aagacaaggaaaaaataacaa

SEQ ID NO: 2745704 - DNA, 23 bp, Homo sapiens
aagacagtgaaagaaaataacaa

SEQ ID NO: 2745705 - DNA, 16 bp, Homo sapiens
aagcactaaacaaaga

SEQ ID NO: 2745706 - DNA, 19 bp, Homo sapiens
aaggaaaaaataacaatga

SEQ ID NO: 2745707 - DNA, 12 bp, Homo sapiens
aataaaaataat

SEQ ID NO: 2745708 - DNA, 15 bp, Homo sapiens
aataacgataaaaga

SEQ ID NO: 2745709 - DNA, 21 bp, Homo sapiens
aataatcctaaacatatgaat

SEQ ID NO: 2745710 - DNA, 19 bp, Homo sapiens
aatggacttttgtacatag

SEQ ID NO: 2745711 - DNA, 21 bp, Homo sapiens
aattcttgccaaatataaata

SEQ ID NO: 2745712 - DNA, 14 bp, Homo sapiens
acgagaaaacaata

SEQ ID NO: 2745713 - DNA, 15 bp, Homo sapiens
ataaaagacagtgaa

SEQ ID NO: 2745714 - DNA, 16 bp, Homo sapiens
ataaaagacagtgaaa

SEQ ID NO: 2745715 - DNA, 14 bp, Homo sapiens
ataaataaaaataa

SEQ ID NO: 2745716 - DNA, 19 bp, Homo sapiens
atcctcagtttttgtgaaa

SEQ ID NO: 2745717 - DNA, 20 bp, Homo sapiens
attatatggcttgagtttaa

SEQ ID NO: 2745718 - DNA, 15 bp, Homo sapiens
attatatttacaaat

SEQ ID NO: 2745719 - DNA, 16 bp, Homo sapiens
attatatttacaaatg

SEQ ID NO: 2745720 - DNA, 17 bp, Homo sapiens
attccaagtgattgaaa

SEQ ID NO: 2745721 - DNA, 15 bp, Homo sapiens
attgtattacaaatc

SEQ ID NO: 2745722 - DNA, 16 bp, Homo sapiens
atttacaaatgggaaa

SEQ ID NO: 2745723 - DNA, 16 bp, Homo sapiens
atttcagcagctgcag

SEQ ID NO: 2745724 - DNA, 17 bp, Homo sapiens
attttatagctactaat

SEQ ID NO: 2745725 - DNA, 15 bp, Homo sapiens
attttctataattta

SEQ ID NO: 2745726 - DNA, 17 bp, Homo sapiens
attttctataatttaaa

SEQ ID NO: 2745727 - DNA, 18 bp, Homo sapiens
attttctataatttaaat

SEQ ID NO: 2745728 - DNA, 15 bp, Homo sapiens
caattcttgccaaat

SEQ ID NO: 2745729 - DNA, 13 bp, Homo sapiens
cactaaacaaaga

SEQ ID NO: 2745730 - DNA, 16 bp, Homo sapiens
cagtgaaagaaaataa

SEQ ID NO: 2745731 - DNA, 22 bp, Homo sapiens
cagttattatatttacaaatgg

SEQ ID NO: 2745732 - DNA, 22 bp, Homo sapiens
catcaagtctttcacatttaaa

SEQ ID NO: 2745733 - DNA, 17 bp, Homo sapiens
cggtgagctacaaatgc

SEQ ID NO: 2745734 - DNA, 23 bp, Homo sapiens
ctggaataatcctaaacatatga

SEQ ID NO: 2745735 - DNA, 13 bp, Homo sapiens
cttataatttaaa

SEQ ID NO: 2745736 - DNA, 20 bp, Homo sapiens
cttgcttgattgtatggtgg

SEQ ID NO: 2745737 - DNA, 19 bp, Homo sapiens
cttgtaaaggaatttaaaa

SEQ ID NO: 2745738 - DNA, 17 bp, Homo sapiens
cttgtactttattttct

SEQ ID NO: 2745739 - DNA, 22 bp, Homo sapiens
gaaaacaataacgataaaagac

SEQ ID NO: 2745740 - DNA, 19 bp, Homo sapiens
gaaaataacgataaaagac

SEQ ID NO: 2745741 - DNA, 22 bp, Homo sapiens
gaacttgtaaaggaatttaaaa

SEQ ID NO: 2745742 - DNA, 14 bp, Homo sapiens
gacagtgaaagaaa

SEQ ID NO: 2745743 - DNA, 21 bp, Homo sapiens
gagttgaaaatcttataattt

SEQ ID NO: 2745744 - DNA, 16 bp, Homo sapiens
gccatatgaaaaggct

SEQ ID NO: 2745745 - DNA, 20 bp, Homo sapiens
ggctaagcttcactgtaaaa

SEQ ID NO: 2745746 - DNA, 23 bp, Homo sapiens
gtactttattttctataatttaa

SEQ ID NO: 2745747 - DNA, 19 bp, Homo sapiens
gtcttatatattgtagata

SEQ ID NO: 2745748 - DNA, 14 bp, Homo sapiens
gtgagctacaaatg

SEQ ID NO: 2745749 - DNA, 20 bp, Homo sapiens
taaaagacagtgaaagaaaa

SEQ ID NO: 2745750 - DNA, 14 bp, Homo sapiens
taaaggaatttaaa

SEQ ID NO: 2745751 - DNA, 14 bp, Homo sapiens
taaagtgtttgaaa

SEQ ID NO: 2745752 - DNA, 17 bp, Homo sapiens
taaataaaaataatcct

SEQ ID NO: 2745753 - DNA, 22 bp, Homo sapiens
taattccgtaggttattttcag

SEQ ID NO: 2745754 - DNA, 23 bp, Homo sapiens
tacagttcggtgagctacaaatg

SEQ ID NO: 2745755 - DNA, 21 bp, Homo sapiens
tagcatgtcgtcaaagctgaa

SEQ ID NO: 2745756 - DNA, 12 bp, Homo sapiens
tatatttacaaa

SEQ ID NO: 2745757 - DNA, 15 bp, Homo sapiens
tatatttacaaatgg

SEQ ID NO: 2745758 - DNA, 15 bp, Homo sapiens
tcagtttttgtgaaa

SEQ ID NO: 2745759 - DNA, 20 bp, Homo sapiens
tctaaagccattgtagtcct

SEQ ID NO: 2745760 - DNA, 14 bp, Homo sapiens
tcttataatttaaa

SEQ ID NO: 2745761 - DNA, 17 bp, Homo sapiens
tctttcacatttaaata

SEQ ID NO: 2745762 - DNA, 20 bp, Homo sapiens
tgaaaagctccatttttagt

SEQ ID NO: 2745763 - DNA, 17 bp, Homo sapiens
tgccaaatataaataaa

SEQ ID NO: 2745764 - DNA, 18 bp, Homo sapiens
tgccaaatataaataaaa

SEQ ID NO: 2745765 - DNA, 18 bp, Homo sapiens
tggacgagaaaacaataa

SEQ ID NO: 2745766 - DNA, 16 bp, Homo sapiens
tgtaaaggaatttaaa

SEQ ID NO: 2745767 - DNA, 12 bp, Homo sapiens
ttataatttaaa

SEQ ID NO: 2745768 - DNA, 14 bp, Homo sapiens
ttattatatttaca

SEQ ID NO: 2745769 - DNA, 23 bp, Homo sapiens
ttcagttattatatttacaaatg

SEQ ID NO: 2745770 - DNA, 19 bp, Homo sapiens
ttccgtaggttattttcag

SEQ ID NO: 2745771 - DNA, 16 bp, Homo sapiens
ttgtaaaggaatttaa

SEQ ID NO: 2745772 - DNA, 18 bp, Homo sapiens
tttaaatatatgctaagt

SEQ ID NO: 2745773 - DNA, 21 bp, Homo sapiens
tttgaaattgtattacaaatc

SEQ ID NO: 2745774 - DNA, 16 bp, Homo sapiens
taggtcagtgcaaata

SEQ ID NO: 2745775 - DNA, 14 bp, Homo sapiens
tatatttacaaatg

SEQ ID NO: 2745776 - DNA, 14 bp, Homo sapiens
tcaaagctgaaatg

SEQ ID NO: 2745777 - DNA, 15 bp, Homo sapiens
tcaattcttgccaaa

SEQ ID NO: 2745778 - DNA, 16 bp, Homo sapiens
tcaattcttgccaaat

SEQ ID NO: 2745779 - DNA, 12 bp, Homo sapiens
tcacatttaaat

SEQ ID NO: 2745780 - DNA, 17 bp, Homo sapiens
tcagtttttgtgaaaag

SEQ ID NO: 2745781 - DNA, 16 bp, Homo sapiens
tcataataagttgcat

SEQ ID NO: 2745782 - DNA, 20 bp, Homo sapiens
tccatgggccatatgaaaag

SEQ ID NO: 2745783 - DNA, 13 bp, Homo sapiens
tctataatttaaa

SEQ ID NO: 2745784 - DNA, 15 bp, Homo sapiens
tgaaattgtattaca

SEQ ID NO: 2745785 - DNA, 22 bp, Homo sapiens
tgaacttgtaaaggaatttaaa

SEQ ID NO: 2745786 - DNA, 16 bp, Homo sapiens
tgagctacaaatgcat

SEQ ID NO: 2745787 - DNA, 22 bp, Homo sapiens
tgagtaactgatttgtaacaag

SEQ ID NO: 2745788 - DNA, 20 bp, Homo sapiens
tgatgctacaggatttgaaa

SEQ ID NO: 2745789 - DNA, 22 bp, Homo sapiens
tggaataatcctaaacatatga

SEQ ID NO: 2745790 - DNA, 14 bp, Homo sapiens
tggagttgaaaatc

SEQ ID NO: 2745791 - DNA, 21 bp, Homo sapiens
tggcttgagtttaaattgtaa

SEQ ID NO: 2745792 - DNA, 14 bp, Homo sapiens
tgggagtacaaaag

SEQ ID NO: 2745793 - DNA, 15 bp, Homo sapiens
ttattatatttacaa

SEQ ID NO: 2745794 - DNA, 18 bp, Homo sapiens
ttcggtgagctacaaatg

SEQ ID NO: 2745795 - DNA, 14 bp, Homo sapiens
ttctgagcatttaa

SEQ ID NO: 2745796 - DNA, 21 bp, Homo sapiens
ttgaaaatcttataatttaaa

SEQ ID NO: 2745797 - DNA, 12 bp, Homo sapiens
tttaaaatgtct

SEQ ID NO: 2745798 - DNA, 15 bp, Homo sapiens
tttttgaagctgtat

SEQ ID NO: 2745799 - DNA, 19 bp, Homo sapiens
tttttgtgaaaagctccat

SEQ ID NO: 2745800 - DNA, 19 bp, Homo sapiens
aaaaaaggttaatttttcc

SEQ ID NO: 2745801 - DNA, 13 bp, Homo sapiens
aaaaacattgaaa

SEQ ID NO: 2745802 - DNA, 17 bp, Homo sapiens
aaaaacattgaaatatt

SEQ ID NO: 2745803 - DNA, 19 bp, Homo sapiens
aaaaacctattttgaaagg

SEQ ID NO: 2745804 - DNA, 18 bp, Homo sapiens
aaaaactcctgtcttgct

SEQ ID NO: 2745805 - DNA, 17 bp, Homo sapiens
aaaaagacgatgtttat

SEQ ID NO: 2745806 - DNA, 19 bp, Homo sapiens
aaaaagacgatgtttatgt

SEQ ID NO: 2745807 - DNA, 23 bp, Homo sapiens
aaaaaggaaagatgaaataaata

SEQ ID NO: 2745808 - DNA, 13 bp, Homo sapiens
aaaaagtccttca

SEQ ID NO: 2745809 - DNA, 23 bp, Homo sapiens
aaaaatacctcaggaaagaatag

SEQ ID NO: 2745810 - DNA, 11 bp, Homo sapiens
aaaaatgtttt

SEQ ID NO: 2745811 - DNA, 23 bp, Homo sapiens
aaaaattggcattttaagtgttt

SEQ ID NO: 2745812 - DNA, 14 bp, Homo sapiens
aaaacaaggatgaa

SEQ ID NO: 2745813 - DNA, 15 bp, Homo sapiens
aaaacacagtattgt

SEQ ID NO: 2745814 - DNA, 12 bp, Homo sapiens
aaaacagctatt

SEQ ID NO: 2745815 - DNA, 14 bp, Homo sapiens
aaaaccgaataaat

SEQ ID NO: 2745816 - DNA, 15 bp, Homo sapiens
aaaaccgaataaatg

SEQ ID NO: 2745817 - DNA, 14 bp, Homo sapiens
aaaacctattttga

SEQ ID NO: 2745818 - DNA, 18 bp, Homo sapiens
aaaacctattttgaaagg

SEQ ID NO: 2745819 - DNA, 23 bp, Homo sapiens
aaaactatcctatgccttcaaat

SEQ ID NO: 2745820 - DNA, 15 bp, Homo sapiens
aaaactgcattttta

SEQ ID NO: 2745821 - DNA, 19 bp, Homo sapiens
aaaactgcatttttaatca

SEQ ID NO: 2745822 - DNA, 13 bp, Homo sapiens
aaaactgtacctt

SEQ ID NO: 2745823 - DNA, 16 bp, Homo sapiens
aaaagaaaaaagtcct

SEQ ID NO: 2745824 - DNA, 17 bp, Homo sapiens
aaaagaaaaaagtcctt

SEQ ID NO: 2745825 - DNA, 19 bp, Homo sapiens
aaaagacgatgtttatgtt

SEQ ID NO: 2745826 - DNA, 15 bp, Homo sapiens
aaaagcaaaattttt

SEQ ID NO: 2745827 - DNA, 15 bp, Homo sapiens
aaaagcacttaaagt

SEQ ID NO: 2745828 - DNA, 17 bp, Homo sapiens
aaaagcacttaaagttt

SEQ ID NO: 2745829 - DNA, 21 bp, Homo sapiens
aaaagcacttaaagtttttta

SEQ ID NO: 2745830 - DNA, 15 bp, Homo sapiens
aaaagccatatcatg

SEQ ID NO: 2745831 - DNA, 15 bp, Homo sapiens
aaaagcttgtgtatc

SEQ ID NO: 2745832 - DNA, 16 bp, Homo sapiens
aaaagcttgtgtatct

SEQ ID NO: 2745833 - DNA, 19 bp, Homo sapiens
aaaaggttaatttttcctt

SEQ ID NO: 2745834 - DNA, 20 bp, Homo sapiens
aactggttctgtgttgaaat

SEQ ID NO: 2745835 - DNA, 20 bp, Homo sapiens
aactggtttgactctgtcca

SEQ ID NO: 2745836 - DNA, 20 bp, Homo sapiens
aactgtaaaaaatgtgtgta

SEQ ID NO: 2745837 - DNA, 17 bp, Homo sapiens
aacttaaatatttgaaa

SEQ ID NO: 2745838 - DNA, 14 bp, Homo sapiens
aacttagaaatatg

SEQ ID NO: 2745839 - DNA, 18 bp, Homo sapiens
aacttccagatcctggaa

SEQ ID NO: 2745840 - DNA, 13 bp, Homo sapiens
aactttattttga

SEQ ID NO: 2745841 - DNA, 23 bp, Homo sapiens
aactttattttgaatgtacctct

SEQ ID NO: 2745842 - DNA, 13 bp, Homo sapiens
aagaaaatatcac

SEQ ID NO: 2745843 - DNA, 11 bp, Homo sapiens
aagaaacattt

SEQ ID NO: 2745844 - DNA, 23 bp, Homo sapiens
aagaaagtctatctaatgacatg

SEQ ID NO: 2745845 - DNA, 15 bp, Homo sapiens
aagaactgaaatcat

SEQ ID NO: 2745846 - DNA, 15 bp, Homo sapiens
aagaattgccaatct

SEQ ID NO: 2745847 - DNA, 18 bp, Homo sapiens
aagaattgccaatcttgt

SEQ ID NO: 2745848 - DNA, 16 bp, Homo sapiens
aagacaaactaaactt

SEQ ID NO: 2745849 - DNA, 15 bp, Homo sapiens
aagagaagggcttac

SEQ ID NO: 2745850 - DNA, 13 bp, Homo sapiens
aagagactttgtc

SEQ ID NO: 2745851 - DNA, 11 bp, Homo sapiens
aagagagtttt

SEQ ID NO: 2745852 - DNA, 22 bp, Homo sapiens
aagagtaagggtaaaaaagata

SEQ ID NO: 2745853 - DNA, 17 bp, Homo sapiens
aagagtcaaagtagtta

SEQ ID NO: 2745854 - DNA, 19 bp, Homo sapiens
aagatatcccagctttaaa

SEQ ID NO: 2745855 - DNA, 20 bp, Homo sapiens
aagatcctcttgccacatct

SEQ ID NO: 2745856 - DNA, 13 bp, Homo sapiens
aagattctttaaa

SEQ ID NO: 2745857 - DNA, 16 bp, Homo sapiens
aagattgtattgctgt

SEQ ID NO: 2745858 - DNA, 17 bp, Homo sapiens
aagattttttcatttca

SEQ ID NO: 2745859 - DNA, 13 bp, Homo sapiens
aagcaaaattttt

SEQ ID NO: 2745860 - DNA, 19 bp, Homo sapiens
aagcaaaattttttctcta

SEQ ID NO: 2745861 - DNA, 21 bp, Homo sapiens
aagcaaatactgattttcaaa

SEQ ID NO: 2745862 - DNA, 17 bp, Homo sapiens
aagcactatgaatttgt

SEQ ID NO: 2745863 - DNA, 14 bp, Homo sapiens
aagcacttaaagtt

SEQ ID NO: 2745864 - DNA, 13 bp, Homo sapiens
aagcatttaaaag

SEQ ID NO: 2745865 - DNA, 20 bp, Homo sapiens
aagctcacagacctttgaac

SEQ ID NO: 2745866 - DNA, 14 bp, Homo sapiens
aagctccaggtaga

SEQ ID NO: 2745867 - DNA, 20 bp, Homo sapiens
aagcttgtgtatcttgatta

SEQ ID NO: 2745868 - DNA, 13 bp, Homo sapiens
aaggaaaagtaag

SEQ ID NO: 2745869 - DNA, 13 bp, Homo sapiens
aaggaacaatgcc

SEQ ID NO: 2745870 - DNA, 16 bp, Homo sapiens
aaggagagagtctttt

SEQ ID NO: 2745871 - DNA, 16 bp, Homo sapiens
aaggcagcatgtatag

SEQ ID NO: 2745872 - DNA, 21 bp, Homo sapiens
aaggcagcatgtatagttgct

SEQ ID NO: 2745873 - DNA, 14 bp, Homo sapiens
aaggccagccattt

SEQ ID NO: 2745874 - DNA, 22 bp, Homo sapiens
aaggccagccatttttcagtag

SEQ ID NO: 2745875 - DNA, 23 bp, Homo sapiens
aaggctatggggatagatgtgtg

SEQ ID NO: 2745876 - DNA, 17 bp, Homo sapiens
aagggaattgtttttat

SEQ ID NO: 2745877 - DNA, 19 bp, Homo sapiens
aagggaattgtttttataa

SEQ ID NO: 2745878 - DNA, 16 bp, Homo sapiens
aaggtcccatggcctg

SEQ ID NO: 2745879 - DNA, 19 bp, Homo sapiens
aagtaatgataactggaaa

SEQ ID NO: 2745880 - DNA, 15 bp, Homo sapiens
aagtcagtttctaca

SEQ ID NO: 2745881 - DNA, 18 bp, Homo sapiens
aagtccaagcatttagat

SEQ ID NO: 2745882 - DNA, 18 bp, Homo sapiens
aagtcctgactgggctgg

SEQ ID NO: 2745883 - DNA, 20 bp, Homo sapiens
aagtcctgactgggctgggt

SEQ ID NO: 2745884 - DNA, 22 bp, Homo sapiens
aagtcctgactgggctgggttt

SEQ ID NO: 2745885 - DNA, 14 bp, Homo sapiens
aagtccttcagttt

SEQ ID NO: 2745886 - DNA, 19 bp, Homo sapiens
aagtcttcttatctaaacc

SEQ ID NO: 2745887 - DNA, 15 bp, Homo sapiens
aagtgagaaagaaag

SEQ ID NO: 2745888 - DNA, 20 bp, Homo sapiens
aagtgagaaagaaagtaaaa

SEQ ID NO: 2745889 - DNA, 13 bp, Homo sapiens
aagtgatgacata

SEQ ID NO: 2745890 - DNA, 13 bp, Homo sapiens
aagtgtataatgt

SEQ ID NO: 2745891 - DNA, 20 bp, Homo sapiens
aagtgtgggtctgtgtgtgt

SEQ ID NO: 2745892 - DNA, 12 bp, Homo sapiens
aagtgtttaaaa

SEQ ID NO: 2745893 - DNA, 23 bp, Homo sapiens
aagttacatgcataaaagggtca

SEQ ID NO: 2745894 - DNA, 14 bp, Homo sapiens
aagttgtactgcat

SEQ ID NO: 2745895 - DNA, 22 bp, Homo sapiens
aagttgtttaataagtatatct

SEQ ID NO: 2745896 - DNA, 13 bp, Homo sapiens
aagttgttttttt

SEQ ID NO: 2745897 - DNA, 15 bp, Homo sapiens
aagttttttatatat

SEQ ID NO: 2745898 - DNA, 22 bp, Homo sapiens
aataaaatccatacatttgtgt

SEQ ID NO: 2745899 - DNA, 16 bp, Homo sapiens
aataaaattatttgca

SEQ ID NO: 2745900 - DNA, 17 bp, Homo sapiens
aataaaattatttgcag

SEQ ID NO: 2745901 - DNA, 12 bp, Homo sapiens
aataaatgttga

SEQ ID NO: 2745902 - DNA, 17 bp, Homo sapiens
aataaattaatattgta

SEQ ID NO: 2745903 - DNA, 22 bp, Homo sapiens
aataagtatatcttaagaatgt

SEQ ID NO: 2745904 - DNA, 17 bp, Homo sapiens
aataatgtagttttgtt

SEQ ID NO: 2745905 - DNA, 17 bp, Homo sapiens
aataatttttatatttg

SEQ ID NO: 2745906 - DNA, 20 bp, Homo sapiens
aataatttttatatttgaaa

SEQ ID NO: 2745907 - DNA, 14 bp, Homo sapiens
aatacaaacatttc

SEQ ID NO: 2745908 - DNA, 15 bp, Homo sapiens
aatacaaacatttca

SEQ ID NO: 2745909 - DNA, 13 bp, Homo sapiens
aatacaaatctgt

SEQ ID NO: 2745910 - DNA, 15 bp, Homo sapiens
aatacaaatctgtat

SEQ ID NO: 2745911 - DNA, 18 bp, Homo sapiens
aatacaaatctgtataaa

SEQ ID NO: 2745912 - DNA, 17 bp, Homo sapiens
aatacataacttcagtg

SEQ ID NO: 2745913 - DNA, 22 bp, Homo sapiens
aatacataacttcagtgcaaga

SEQ ID NO: 2745914 - DNA, 22 bp, Homo sapiens
aataccctgtctttaaaaataa

SEQ ID NO: 2745915 - DNA, 13 bp, Homo sapiens
aatacctttctaa

SEQ ID NO: 2745916 - DNA, 19 bp, Homo sapiens
aatacctttctaagggaaa

SEQ ID NO: 2745917 - DNA, 14 bp, Homo sapiens
aatactgattttca

SEQ ID NO: 2745918 - DNA, 20 bp, Homo sapiens
aatagaaccatgttggttgc

SEQ ID NO: 2745919 - DNA, 15 bp, Homo sapiens
aatagcttatgccta

SEQ ID NO: 2745920 - DNA, 13 bp, Homo sapiens
aatagtatagaaa

SEQ ID NO: 2745921 - DNA, 14 bp, Homo sapiens
aatagtatagaaaa

SEQ ID NO: 2745922 - DNA, 16 bp, Homo sapiens
aatagtcaaattgtgt

SEQ ID NO: 2745923 - DNA, 19 bp, Homo sapiens
aatagtgtcctatgcaata

SEQ ID NO: 2745924 - DNA, 16 bp, Homo sapiens
aatatacaagtaaatt

SEQ ID NO: 2745925 - DNA, 21 bp, Homo sapiens
aatatacaagtaaattctgtt

SEQ ID NO: 2745926 - DNA, 14 bp, Homo sapiens
aatatacacatttt

SEQ ID NO: 2745927 - DNA, 20 bp, Homo sapiens
aatatacacattttgtaaat

SEQ ID NO: 2745928 - DNA, 14 bp, Homo sapiens
aatatagttgaaag

SEQ ID NO: 2745929 - DNA, 15 bp, Homo sapiens
aatatagttgaaagt

SEQ ID NO: 2745930 - DNA, 22 bp, Homo sapiens
aatatagttgaaagtaaaaaaa

SEQ ID NO: 2745931 - DNA, 20 bp, Homo sapiens
aatatatagctggcaagaat

SEQ ID NO: 2745932 - DNA, 13 bp, Homo sapiens
aatatatcctgtt

SEQ ID NO: 2745933 - DNA, 17 bp, Homo sapiens
aatatatcctgtttgta

SEQ ID NO: 2745934 - DNA, 18 bp, Homo sapiens
aatatatcctgtttgtat

SEQ ID NO: 2745935 - DNA, 19 bp, Homo sapiens
aatatatcctgtttgtatt

SEQ ID NO: 2745936 - DNA, 20 bp, Homo sapiens
aatatatcctgtttgtattt

SEQ ID NO: 2745937 - DNA, 18 bp, Homo sapiens
aatatatggcatttgcag

SEQ ID NO: 2745938 - DNA, 16 bp, Homo sapiens
aatatgaccttaagga

SEQ ID NO: 2745939 - DNA, 24 bp, Homo sapiens
aatatgccccattcaacatctagt

SEQ ID NO: 2745940 - DNA, 17 bp, Homo sapiens
aatattacatgtaaagc

SEQ ID NO: 2745941 - DNA, 18 bp, Homo sapiens
aatattacatgtaaagct

SEQ ID NO: 2745942 - DNA, 21 bp, Homo sapiens
aatattacatgtaaagctgtt

SEQ ID NO: 2745943 - DNA, 16 bp, Homo sapiens
aatattatgttaaaac

SEQ ID NO: 2745944 - DNA, 18 bp, Homo sapiens
aatattggtattaaagaa

SEQ ID NO: 2745945 - DNA, 19 bp, Homo sapiens
aatattgtattgctgctgt

SEQ ID NO: 2745946 - DNA, 15 bp, Homo sapiens
aatatttattttaat

SEQ ID NO: 2745947 - DNA, 16 bp, Homo sapiens
aatattttatctttta

SEQ ID NO: 2745948 - DNA, 11 bp, Homo sapiens
aatcaggagcc

SEQ ID NO: 2745949 - DNA, 12 bp, Homo sapiens
aatcaggagcct

SEQ ID NO: 2745950 - DNA, 12 bp, Homo sapiens
aatcatgaatta

SEQ ID NO: 2745951 - DNA, 17 bp, Homo sapiens
aatcatgaattagtttt

SEQ ID NO: 2745952 - DNA, 16 bp, Homo sapiens
aatccatacatttgtg

SEQ ID NO: 2745953 - DNA, 23 bp, Homo sapiens
aatctccaactttattttgaatg

SEQ ID NO: 2745954 - DNA, 18 bp, Homo sapiens
aatctctagcctctttgt

SEQ ID NO: 2745955 - DNA, 21 bp, Homo sapiens
aatctgaaggagagagtcttt

SEQ ID NO: 2745956 - DNA, 15 bp, Homo sapiens
aatctgtataaatgt

SEQ ID NO: 2745957 - DNA, 16 bp, Homo sapiens
aatctgtataaatgtc

SEQ ID NO: 2745958 - DNA, 17 bp, Homo sapiens
aatctgtataaatgtct

SEQ ID NO: 2745959 - DNA, 18 bp, Homo sapiens
aatctgtataaatgtcta

SEQ ID NO: 2745960 - DNA, 18 bp, Homo sapiens
aatcttaaatcagaataa

SEQ ID NO: 2745961 - DNA, 19 bp, Homo sapiens
aatcttaaatcagaataaa

SEQ ID NO: 2745962 - DNA, 18 bp, Homo sapiens
aatcttgttttaagcaaa

SEQ ID NO: 2745963 - DNA, 22 bp, Homo sapiens
aatcttgttttaagcaaatgca

SEQ ID NO: 2745964 - DNA, 15 bp, Homo sapiens
atgcaagtgtttctg

SEQ ID NO: 2745965 - DNA, 15 bp, Homo sapiens
atgcaataaaattat

SEQ ID NO: 2745966 - DNA, 20 bp, Homo sapiens
atgcaataaaattatttgca

SEQ ID NO: 2745967 - DNA, 22 bp, Homo sapiens
atgcaataaaattatttgcagg

SEQ ID NO: 2745968 - DNA, 13 bp, Homo sapiens
atgcaatatttgt

SEQ ID NO: 2745969 - DNA, 16 bp, Homo sapiens
atgcagaaaaagaaaa

SEQ ID NO: 2745970 - DNA, 17 bp, Homo sapiens
atgcagaaaaagaaaaa

SEQ ID NO: 2745971 - DNA, 17 bp, Homo sapiens
atgcagttctgaagaag

SEQ ID NO: 2745972 - DNA, 21 bp, Homo sapiens
atgcataaaagggtcaaacct

SEQ ID NO: 2745973 - DNA, 23 bp, Homo sapiens
atgcataaaagggtcaaacctgt

SEQ ID NO: 2745974 - DNA, 16 bp, Homo sapiens
atgcatgtattcacta

SEQ ID NO: 2745975 - DNA, 17 bp, Homo sapiens
atgcattacttactgtt

SEQ ID NO: 2745976 - DNA, 22 bp, Homo sapiens
atgcattctatcgttattataa

SEQ ID NO: 2745977 - DNA, 23 bp, Homo sapiens
atgcattctatcgttattataaa

SEQ ID NO: 2745978 - DNA, 15 bp, Homo sapiens
atgcatttggaatta

SEQ ID NO: 2745979 - DNA, 14 bp, Homo sapiens
atgccaccatccaa

SEQ ID NO: 2745980 - DNA, 19 bp, Homo sapiens
atgccgcctgtcaataaat

SEQ ID NO: 2745981 - DNA, 20 bp, Homo sapiens
atgccttatttttgaattct

SEQ ID NO: 2745982 - DNA, 23 bp, Homo sapiens
atgccttatttttgaattcttta

SEQ ID NO: 2745983 - DNA, 13 bp, Homo sapiens
atgccttcaaata

SEQ ID NO: 2745984 - DNA, 22 bp, Homo sapiens
atgccttcaaatagtatagaaa

SEQ ID NO: 2745985 - DNA, 14 bp, Homo sapiens
atgccttttcccaa

SEQ ID NO: 2745986 - DNA, 15 bp, Homo sapiens
atgctaaaattctat

SEQ ID NO: 2745987 - DNA, 18 bp, Homo sapiens
atgctctgatgcagtgcc

SEQ ID NO: 2745988 - DNA, 14 bp, Homo sapiens
atgctgcaactttt

SEQ ID NO: 2745989 - DNA, 22 bp, Homo sapiens
atgctgtctacactaagagaga

SEQ ID NO: 2745990 - DNA, 21 bp, Homo sapiens
atgcttctgcctattgctgat

SEQ ID NO: 2745991 - DNA, 15 bp, Homo sapiens
atgctttaattgtgt

SEQ ID NO: 2745992 - DNA, 15 bp, Homo sapiens
atggaaaatatacaa

SEQ ID NO: 2745993 - DNA, 19 bp, Homo sapiens
atggaaaattaattctaaa

SEQ ID NO: 2745994 - DNA, 23 bp, Homo sapiens
atggaaaattaattctaaactta

SEQ ID NO: 2745995 - DNA, 20 bp, Homo sapiens
atggaaataccaggaccagt

SEQ ID NO: 2745996 - DNA, 21 bp, Homo sapiens
atggaaataccaggaccagtt

SEQ ID NO: 2745997 - DNA, 21 bp, Homo sapiens
atggaatgatgggtcagttgt

SEQ ID NO: 2745998 - DNA, 14 bp, Homo sapiens
atggcaatatctac

SEQ ID NO: 2745999 - DNA, 14 bp, Homo sapiens
atggcatttgcaga

SEQ ID NO: 2746000 - DNA, 19 bp, Homo sapiens
atggcctgagactttcttt

SEQ ID NO: 2746001 - DNA, 18 bp, Homo sapiens
atgtaaagctgttaaaat

SEQ ID NO: 2746002 - DNA, 16 bp, Homo sapiens
atgtactttttattgc

SEQ ID NO: 2746003 - DNA, 19 bp, Homo sapiens
atgtactttttattgcatg

SEQ ID NO: 2746004 - DNA, 15 bp, Homo sapiens
atgtatagttgcttt

SEQ ID NO: 2746005 - DNA, 20 bp, Homo sapiens
atgtcaaattgtgcaaaata

SEQ ID NO: 2746006 - DNA, 17 bp, Homo sapiens
atgtcacaaagagctga

SEQ ID NO: 2746007 - DNA, 16 bp, Homo sapiens
atgtcagtatgtggaa

SEQ ID NO: 2746008 - DNA, 22 bp, Homo sapiens
atgtccagaagagtcaaagtag

SEQ ID NO: 2746009 - DNA, 18 bp, Homo sapiens
atgtctaaaagattcttt

SEQ ID NO: 2746010 - DNA, 19 bp, Homo sapiens
atgtctaaaagattcttta

SEQ ID NO: 2746011 - DNA, 16 bp, Homo sapiens
atgtctattattatga

SEQ ID NO: 2746012 - DNA, 20 bp, Homo sapiens
atgtctattattatgaagaa

SEQ ID NO: 2746013 - DNA, 15 bp, Homo sapiens
atgtctgcctggagt

SEQ ID NO: 2746014 - DNA, 20 bp, Homo sapiens
atgtgctagagttaaaagtt

SEQ ID NO: 2746015 - DNA, 19 bp, Homo sapiens
atgtgctagtaattggaaa

SEQ ID NO: 2746016 - DNA, 15 bp, Homo sapiens
atgtggaagtgtggg

SEQ ID NO: 2746017 - DNA, 17 bp, Homo sapiens
atgtgggggtctgtgtg

SEQ ID NO: 2746018 - DNA, 23 bp, Homo sapiens
atgtgtgtgtgttgtgtgtggga

SEQ ID NO: 2746019 - DNA, 20 bp, Homo sapiens
atgttcttatagaataaaag

SEQ ID NO: 2746020 - DNA, 19 bp, Homo sapiens
attttaagtgtttaaaagc

SEQ ID NO: 2746021 - DNA, 17 bp, Homo sapiens
attttatcaaggaagtc

SEQ ID NO: 2746022 - DNA, 14 bp, Homo sapiens
attttcctgaaaac

SEQ ID NO: 2746023 - DNA, 19 bp, Homo sapiens
attttgaaaggtcagaatt

SEQ ID NO: 2746024 - DNA, 16 bp, Homo sapiens
attttgccatttagcg

SEQ ID NO: 2746025 - DNA, 13 bp, Homo sapiens
attttgtaaatct

SEQ ID NO: 2746026 - DNA, 14 bp, Homo sapiens
attttgtaaatctg

SEQ ID NO: 2746027 - DNA, 20 bp, Homo sapiens
atttttaaaactgcattttt

SEQ ID NO: 2746028 - DNA, 20 bp, Homo sapiens
atttttatattagttgcttt

SEQ ID NO: 2746029 - DNA, 16 bp, Homo sapiens
atttttatatttgaaa

SEQ ID NO: 2746030 - DNA, 20 bp, Homo sapiens
atttttcagtagcaggacct

SEQ ID NO: 2746031 - DNA, 12 bp, Homo sapiens
atttttctcatg

SEQ ID NO: 2746032 - DNA, 16 bp, Homo sapiens
attttttaaaaattgg

SEQ ID NO: 2746033 - DNA, 15 bp, Homo sapiens
attttttaaaagaga

SEQ ID NO: 2746034 - DNA, 23 bp, Homo sapiens
attttttaaagaatccaagacaa

SEQ ID NO: 2746035 - DNA, 13 bp, Homo sapiens
attttttaattgt

SEQ ID NO: 2746036 - DNA, 13 bp, Homo sapiens
attttttgattaa

SEQ ID NO: 2746037 - DNA, 14 bp, Homo sapiens
atttttttccaagt

SEQ ID NO: 2746038 - DNA, 17 bp, Homo sapiens
atttttttccaagtgta

SEQ ID NO: 2746039 - DNA, 19 bp, Homo sapiens
atttttttccaagtgtata

SEQ ID NO: 2746040 - DNA, 22 bp, Homo sapiens
atttttttccaagtgtataatg

SEQ ID NO: 2746041 - DNA, 23 bp, Homo sapiens
atttttttccaagtgtataatgt

SEQ ID NO: 2746042 - DNA, 23 bp, Homo sapiens
attttttttttaatctcctgagt

SEQ ID NO: 2746043 - DNA, 13 bp, Homo sapiens
caaaaaaatgttt

SEQ ID NO: 2746044 - DNA, 20 bp, Homo sapiens
caaaaaaatgtttttaaaaa

SEQ ID NO: 2746045 - DNA, 19 bp, Homo sapiens
caaaaatctcaatatttca

SEQ ID NO: 2746046 - DNA, 21 bp, Homo sapiens
caaaactatcctatgccttca

SEQ ID NO: 2746047 - DNA, 20 bp, Homo sapiens
caaaagcttgtgtatcttga

SEQ ID NO: 2746048 - DNA, 22 bp, Homo sapiens
caaaatattggtattaaagaat

SEQ ID NO: 2746049 - DNA, 16 bp, Homo sapiens
caaaatattttatctt

SEQ ID NO: 2746050 - DNA, 17 bp, Homo sapiens
caaaatattttatcttt

SEQ ID NO: 2746051 - DNA, 21 bp, Homo sapiens
caaaatggaaaattaattcta

SEQ ID NO: 2746052 - DNA, 12 bp, Homo sapiens
caaacacaggca

SEQ ID NO: 2746053 - DNA, 16 bp, Homo sapiens
caaacctgtagatgca

SEQ ID NO: 2746054 - DNA, 12 bp, Homo sapiens
caaactgtaaaa

SEQ ID NO: 2746055 - DNA, 14 bp, Homo sapiens
caaagagagttttt

SEQ ID NO: 2746056 - DNA, 21 bp, Homo sapiens
caaagagagtttttaatagaa

SEQ ID NO: 2746057 - DNA, 16 bp, Homo sapiens
caaatagtatagaaaa

SEQ ID NO: 2746058 - DNA, 16 bp, Homo sapiens
caaatattgaatgcct

SEQ ID NO: 2746059 - DNA, 18 bp, Homo sapiens
caaatattgaatgcctta

SEQ ID NO: 2746060 - DNA, 19 bp, Homo sapiens
caaattctgaggtaagtgt

SEQ ID NO: 2746061 - DNA, 15 bp, Homo sapiens
caaattgtgcaaaat

SEQ ID NO: 2746062 - DNA, 15 bp, Homo sapiens
caacgactactttgc

SEQ ID NO: 2746063 - DNA, 17 bp, Homo sapiens
caacgactactttgcta

SEQ ID NO: 2746064 - DNA, 21 bp, Homo sapiens
caactatctcatttccaagca

SEQ ID NO: 2746065 - DNA, 13 bp, Homo sapiens
caactctgtattt

SEQ ID NO: 2746066 - DNA, 16 bp, Homo sapiens
caactttattttgaat

SEQ ID NO: 2746067 - DNA, 17 bp, Homo sapiens
caactttattttgaatg

SEQ ID NO: 2746068 - DNA, 20 bp, Homo sapiens
caactttattttgaatgtac

SEQ ID NO: 2746069 - DNA, 18 bp, Homo sapiens
caagacaaactaaacttt

SEQ ID NO: 2746070 - DNA, 22 bp, Homo sapiens
caagagactttgtcacttattt

SEQ ID NO: 2746071 - DNA, 18 bp, Homo sapiens
caagattttttaattgtt

SEQ ID NO: 2746072 - DNA, 15 bp, Homo sapiens
caagcaggatggctg

SEQ ID NO: 2746073 - DNA, 15 bp, Homo sapiens
caaggaagtcttcaa

SEQ ID NO: 2746074 - DNA, 13 bp, Homo sapiens
caaggttgctgtt

SEQ ID NO: 2746075 - DNA, 15 bp, Homo sapiens
caaggttgctgttgt

SEQ ID NO: 2746076 - DNA, 14 bp, Homo sapiens
caagtattagaata

SEQ ID NO: 2746077 - DNA, 18 bp, Homo sapiens
caagtcctgactgggctg

SEQ ID NO: 2746078 - DNA, 20 bp, Homo sapiens
caagtcctgactgggctggg

SEQ ID NO: 2746079 - DNA, 11 bp, Homo sapiens
caagtgtataa

SEQ ID NO: 2746080 - DNA, 12 bp, Homo sapiens
caagtgtataat

SEQ ID NO: 2746081 - DNA, 15 bp, Homo sapiens
caagtgtttctgttc

SEQ ID NO: 2746082 - DNA, 18 bp, Homo sapiens
caataaaaatcaggagcc

SEQ ID NO: 2746083 - DNA, 23 bp, Homo sapiens
caataaaatccatacatttgtgt

SEQ ID NO: 2746084 - DNA, 18 bp, Homo sapiens
caataaaattatttgcag

SEQ ID NO: 2746085 - DNA, 22 bp, Homo sapiens
caataaaattatttgcaggtct

SEQ ID NO: 2746086 - DNA, 12 bp, Homo sapiens
caataaatgttg

SEQ ID NO: 2746087 - DNA, 21 bp, Homo sapiens
caataccctgtctttaaaaat

SEQ ID NO: 2746088 - DNA, 21 bp, Homo sapiens
caatatatagttagctttatt

SEQ ID NO: 2746089 - DNA, 12 bp, Homo sapiens
caatatttcaga

SEQ ID NO: 2746090 - DNA, 14 bp, Homo sapiens
caatgcatatctgt

SEQ ID NO: 2746091 - DNA, 17 bp, Homo sapiens
caatgccgcctgtcaat

SEQ ID NO: 2746092 - DNA, 18 bp, Homo sapiens
caatgccgcctgtcaata

SEQ ID NO: 2746093 - DNA, 21 bp, Homo sapiens
caatgccgcctgtcaataaat

SEQ ID NO: 2746094 - DNA, 15 bp, Homo sapiens
caatgctgtatttta

SEQ ID NO: 2746095 - DNA, 16 bp, Homo sapiens
caatgctgtattttaa

SEQ ID NO: 2746096 - DNA, 20 bp, Homo sapiens
caattgagtaattctagaca

SEQ ID NO: 2746097 - DNA, 12 bp, Homo sapiens
cacaaagagctg

SEQ ID NO: 2746098 - DNA, 17 bp, Homo sapiens
aggtgtctggcctgagg

SEQ ID NO: 2746099 - DNA, 17 bp, Homo sapiens
aggttaatttttccttc

SEQ ID NO: 2746100 - DNA, 12 bp, Homo sapiens
aggttgctgttg

SEQ ID NO: 2746101 - DNA, 16 bp, Homo sapiens
agtaaaaataaactgt

SEQ ID NO: 2746102 - DNA, 15 bp, Homo sapiens
agtaagggtaaaaaa

SEQ ID NO: 2746103 - DNA, 19 bp, Homo sapiens
agtaagggtaaaaaagata

SEQ ID NO: 2746104 - DNA, 17 bp, Homo sapiens
agtaatgataactggaa

SEQ ID NO: 2746105 - DNA, 19 bp, Homo sapiens
agtaattaggataactaaa

SEQ ID NO: 2746106 - DNA, 20 bp, Homo sapiens
agtagcaggacctgccaaga

SEQ ID NO: 2746107 - DNA, 15 bp, Homo sapiens
agtatatcttaagaa

SEQ ID NO: 2746108 - DNA, 16 bp, Homo sapiens
agtatatcttaagaat

SEQ ID NO: 2746109 - DNA, 15 bp, Homo sapiens
agtatgtggaagtgt

SEQ ID NO: 2746110 - DNA, 21 bp, Homo sapiens
agtattagaataccacaggaa

SEQ ID NO: 2746111 - DNA, 21 bp, Homo sapiens
agtattagcaatgaattagtt

SEQ ID NO: 2746112 - DNA, 23 bp, Homo sapiens
agtattagcaatgaattagttgc

SEQ ID NO: 2746113 - DNA, 23 bp, Homo sapiens
agtattgtagaaagctaatacaa

SEQ ID NO: 2746114 - DNA, 16 bp, Homo sapiens
agtatttctatgaaat

SEQ ID NO: 2746115 - DNA, 12 bp, Homo sapiens
agtatttgctgt

SEQ ID NO: 2746116 - DNA, 23 bp, Homo sapiens
agtcaaagagagtttttaataga

SEQ ID NO: 2746117 - DNA, 13 bp, Homo sapiens
agtcaaattgtgt

SEQ ID NO: 2746118 - DNA, 15 bp, Homo sapiens
agtcaaattgtgtga

SEQ ID NO: 2746119 - DNA, 19 bp, Homo sapiens
agtcaaattgtgtgaaagg

SEQ ID NO: 2746120 - DNA, 14 bp, Homo sapiens
agtcagtttctaca

SEQ ID NO: 2746121 - DNA, 16 bp, Homo sapiens
agtccaagcatttaga

SEQ ID NO: 2746122 - DNA, 13 bp, Homo sapiens
agtcccagcactt

SEQ ID NO: 2746123 - DNA, 14 bp, Homo sapiens
agtcccagcacttt

SEQ ID NO: 2746124 - DNA, 20 bp, Homo sapiens
agtcctgactgggctgggtt

SEQ ID NO: 2746125 - DNA, 18 bp, Homo sapiens
agtctatctaatgacatg

SEQ ID NO: 2746126 - DNA, 18 bp, Homo sapiens
agtctgttatatttcctt

SEQ ID NO: 2746127 - DNA, 12 bp, Homo sapiens
agtcttcaaatt

SEQ ID NO: 2746128 - DNA, 14 bp, Homo sapiens
agtcttcaaatttg

SEQ ID NO: 2746129 - DNA, 15 bp, Homo sapiens
agtcttcaaatttga

SEQ ID NO: 2746130 - DNA, 15 bp, Homo sapiens
agtcttcttatctaa

SEQ ID NO: 2746131 - DNA, 21 bp, Homo sapiens
agtcttttaactttagaattc

SEQ ID NO: 2746132 - DNA, 21 bp, Homo sapiens
agtgcaaattgtcacaggaca

SEQ ID NO: 2746133 - DNA, 20 bp, Homo sapiens
agtgctgtgctgtgtttaat

SEQ ID NO: 2746134 - DNA, 21 bp, Homo sapiens
agtgcttctacacatttcatc

SEQ ID NO: 2746135 - DNA, 23 bp, Homo sapiens
agtgcttctacacatttcatcta

SEQ ID NO: 2746136 - DNA, 22 bp, Homo sapiens
agtgggtcatatgtttattcaa

SEQ ID NO: 2746137 - DNA, 10 bp, Homo sapiens
agtgtataat

SEQ ID NO: 2746138 - DNA, 15 bp, Homo sapiens
agtgtataatgttgg

SEQ ID NO: 2746139 - DNA, 19 bp, Homo sapiens
agtgtataatgttggtgtg

SEQ ID NO: 2746140 - DNA, 16 bp, Homo sapiens
agtgtcaagtcctgac

SEQ ID NO: 2746141 - DNA, 15 bp, Homo sapiens
agtgtgcctgtcact

SEQ ID NO: 2746142 - DNA, 20 bp, Homo sapiens
agtgtgcctgtcactactgg

SEQ ID NO: 2746143 - DNA, 15 bp, Homo sapiens
agtgtgtggccccgc

SEQ ID NO: 2746144 - DNA, 17 bp, Homo sapiens
agtgtgtggccccgccc

SEQ ID NO: 2746145 - DNA, 11 bp, Homo sapiens
agtgtttctgt

SEQ ID NO: 2746146 - DNA, 13 bp, Homo sapiens
agtgtttctgttc

SEQ ID NO: 2746147 - DNA, 20 bp, Homo sapiens
agtgtttggtgctcatttaa

SEQ ID NO: 2746148 - DNA, 12 bp, Homo sapiens
agttacatgcat

SEQ ID NO: 2746149 - DNA, 14 bp, Homo sapiens
agttacatgcataa

SEQ ID NO: 2746150 - DNA, 16 bp, Homo sapiens
agttacatgcataaaa

SEQ ID NO: 2746151 - DNA, 18 bp, Homo sapiens
agttacatgcataaaagg

SEQ ID NO: 2746152 - DNA, 23 bp, Homo sapiens
agttagttttggttatttctaaa

SEQ ID NO: 2746153 - DNA, 17 bp, Homo sapiens
agttattgctgcataaa

SEQ ID NO: 2746154 - DNA, 22 bp, Homo sapiens
agttattgctgcataaatttgt

SEQ ID NO: 2746155 - DNA, 22 bp, Homo sapiens
agttcacattaactcaggcatt

SEQ ID NO: 2746156 - DNA, 15 bp, Homo sapiens
agttcaggaattttt

SEQ ID NO: 2746157 - DNA, 21 bp, Homo sapiens
agttctagctctatttacttc

SEQ ID NO: 2746158 - DNA, 13 bp, Homo sapiens
agttctgaagaag

SEQ ID NO: 2746159 - DNA, 15 bp, Homo sapiens
agttctgttaaatat

SEQ ID NO: 2746160 - DNA, 16 bp, Homo sapiens
agttgaaagtaaaaaa

SEQ ID NO: 2746161 - DNA, 15 bp, Homo sapiens
agttggcacttctgc

SEQ ID NO: 2746162 - DNA, 17 bp, Homo sapiens
agttggcacttctgcca

SEQ ID NO: 2746163 - DNA, 17 bp, Homo sapiens
agttgggggtattttct

SEQ ID NO: 2746164 - DNA, 20 bp, Homo sapiens
agttgtataaaagttgtact

SEQ ID NO: 2746165 - DNA, 20 bp, Homo sapiens
agttgtatcagcacgtgtgg

SEQ ID NO: 2746166 - DNA, 16 bp, Homo sapiens
agttgtttaataagta

SEQ ID NO: 2746167 - DNA, 21 bp, Homo sapiens
agttgtttaataagtatatct

SEQ ID NO: 2746168 - DNA, 17 bp, Homo sapiens
agtttactggataaatt

SEQ ID NO: 2746169 - DNA, 21 bp, Homo sapiens
aaacatatataacaatgctgt

SEQ ID NO: 2746170 - DNA, 15 bp, Homo sapiens
aaacattgaaatatt

SEQ ID NO: 2746171 - DNA, 16 bp, Homo sapiens
aaacattgaaatatta

SEQ ID NO: 2746172 - DNA, 13 bp, Homo sapiens
aaacatttcactt

SEQ ID NO: 2746173 - DNA, 14 bp, Homo sapiens
aaaccacaaaagtt

SEQ ID NO: 2746174 - DNA, 14 bp, Homo sapiens
aaaccgaataaatg

SEQ ID NO: 2746175 - DNA, 11 bp, Homo sapiens
aaacctgctgg

SEQ ID NO: 2746176 - DNA, 13 bp, Homo sapiens
aaactaaacttta

SEQ ID NO: 2746177 - DNA, 16 bp, Homo sapiens
aaactataaatacaaa

SEQ ID NO: 2746178 - DNA, 23 bp, Homo sapiens
aaactataaatacaaatctgtat

SEQ ID NO: 2746179 - DNA, 15 bp, Homo sapiens
aaactcgttaatttg

SEQ ID NO: 2746180 - DNA, 16 bp, Homo sapiens
aaactgactcttaaga

SEQ ID NO: 2746181 - DNA, 20 bp, Homo sapiens
aaactgtaccttttgcgatt

SEQ ID NO: 2746182 - DNA, 12 bp, Homo sapiens
aaactgttcttc

SEQ ID NO: 2746183 - DNA, 16 bp, Homo sapiens
aaacttagaaatatgc

SEQ ID NO: 2746184 - DNA, 23 bp, Homo sapiens
aaacttcagcggtttatataagc

SEQ ID NO: 2746185 - DNA, 17 bp, Homo sapiens
aaacttggctgtatgtc

SEQ ID NO: 2746186 - DNA, 19 bp, Homo sapiens
aaactttgtgtataagttg

SEQ ID NO: 2746187 - DNA, 13 bp, Homo sapiens
aaagaacattctt

SEQ ID NO: 2746188 - DNA, 14 bp, Homo sapiens
aaagaatgaaagta

SEQ ID NO: 2746189 - DNA, 23 bp, Homo sapiens
aaagaatgctgcaacttttttat

SEQ ID NO: 2746190 - DNA, 13 bp, Homo sapiens
aaagattctttaa

SEQ ID NO: 2746191 - DNA, 21 bp, Homo sapiens
aaagcaacgactactttgcta

SEQ ID NO: 2746192 - DNA, 18 bp, Homo sapiens
aaagcactatgaatttgt

SEQ ID NO: 2746193 - DNA, 13 bp, Homo sapiens
aaagctaatacaa

SEQ ID NO: 2746194 - DNA, 19 bp, Homo sapiens
aaagctgttaaaatacata

SEQ ID NO: 2746195 - DNA, 14 bp, Homo sapiens
aaagcttcagggaa

SEQ ID NO: 2746196 - DNA, 13 bp, Homo sapiens
aaagcttgtgtat

SEQ ID NO: 2746197 - DNA, 23 bp, Homo sapiens
aaagcttgtgtatcttgattaat

SEQ ID NO: 2746198 - DNA, 24 bp, Homo sapiens
aaaggactcttccatcagagatgg

SEQ ID NO: 2746199 - DNA, 23 bp, Homo sapiens
aaaggctaacaaattttaagtgc

SEQ ID NO: 2746200 - DNA, 20 bp, Homo sapiens
aaagggctgttataatcttt

SEQ ID NO: 2746201 - DNA, 22 bp, Homo sapiens
aaagggctgttataatctttca

SEQ ID NO: 2746202 - DNA, 15 bp, Homo sapiens
aaagggtcaaacctg

SEQ ID NO: 2746203 - DNA, 16 bp, Homo sapiens
aaagtaaaaaaataat

SEQ ID NO: 2746204 - DNA, 13 bp, Homo sapiens
aaagtaaaaccat

SEQ ID NO: 2746205 - DNA, 21 bp, Homo sapiens
aaagtcctgaacctttcaaaa

SEQ ID NO: 2746206 - DNA, 21 bp, Homo sapiens
aaagtccttcagtttagaacc

SEQ ID NO: 2746207 - DNA, 22 bp, Homo sapiens
aaagtgagaaagaaagtaaaaa

SEQ ID NO: 2746208 - DNA, 15 bp, Homo sapiens
aaagtgatgacatat

SEQ ID NO: 2746209 - DNA, 17 bp, Homo sapiens
aaagtgatgacatattt

SEQ ID NO: 2746210 - DNA, 22 bp, Homo sapiens
aaataaaatttaaaaaactcct

SEQ ID NO: 2746211 - DNA, 12 bp, Homo sapiens
aaatacaaatct

SEQ ID NO: 2746212 - DNA, 19 bp, Homo sapiens
aaatacaaatctgtataaa

SEQ ID NO: 2746213 - DNA, 19 bp, Homo sapiens
aaatacataacttcagtgc

SEQ ID NO: 2746214 - DNA, 18 bp, Homo sapiens
aaataccaggaccagttt

SEQ ID NO: 2746215 - DNA, 14 bp, Homo sapiens
aaatacctcaggaa

SEQ ID NO: 2746216 - DNA, 21 bp, Homo sapiens
aaatacctcaggaaagaatag

SEQ ID NO: 2746217 - DNA, 14 bp, Homo sapiens
aaatactgattttc

SEQ ID NO: 2746218 - DNA, 17 bp, Homo sapiens
aaatactgattttcaaa

SEQ ID NO: 2746219 - DNA, 19 bp, Homo sapiens
aaatactgattttcaaaaa

SEQ ID NO: 2746220 - DNA, 14 bp, Homo sapiens
aaatagtatagaaa

SEQ ID NO: 2746221 - DNA, 16 bp, Homo sapiens
aaatatagttgaaagt

SEQ ID NO: 2746222 - DNA, 20 bp, Homo sapiens
aaatatagttgaaagtaaaa

SEQ ID NO: 2746223 - DNA, 22 bp, Homo sapiens
aaatatgtccagaagagtcaaa

SEQ ID NO: 2746224 - DNA, 16 bp, Homo sapiens
aaatattgaatgcctt

SEQ ID NO: 2746225 - DNA, 19 bp, Homo sapiens
aaatattggtattaaagaa

SEQ ID NO: 2746226 - DNA, 12 bp, Homo sapiens
aaatatttttgt

SEQ ID NO: 2746227 - DNA, 14 bp, Homo sapiens
aaatcacactcaaa

SEQ ID NO: 2746228 - DNA, 12 bp, Homo sapiens
aaatcagaataa

SEQ ID NO: 2746229 - DNA, 14 bp, Homo sapiens
aaatcagaataaat

SEQ ID NO: 2746230 - DNA, 22 bp, Homo sapiens
aaatccagcgtgcaccccgccg

SEQ ID NO: 2746231 - DNA, 14 bp, Homo sapiens
aaatccttgaagat

SEQ ID NO: 2746232 - DNA, 15 bp, Homo sapiens
aaatctgtacttttt

SEQ ID NO: 2746233 - DNA, 20 bp, Homo sapiens
aaatctgtacttttttcaaa

SEQ ID NO: 2746234 - DNA, 13 bp, Homo sapiens
aaatctgtataaa

SEQ ID NO: 2746235 - DNA, 15 bp, Homo sapiens
aaatctgtataaatg

SEQ ID NO: 2746236 - DNA, 16 bp, Homo sapiens
aaatctgtataaatgt

SEQ ID NO: 2746237 - DNA, 14 bp, Homo sapiens
aaatcttggtgtaa

SEQ ID NO: 2746238 - DNA, 15 bp, Homo sapiens
aaatgcaatatttgt

SEQ ID NO: 2746239 - DNA, 20 bp, Homo sapiens
aaatgccaccatccaataaa

SEQ ID NO: 2746240 - DNA, 19 bp, Homo sapiens
aaatgcttcactgtacgta

SEQ ID NO: 2746241 - DNA, 16 bp, Homo sapiens
aaatggaaaatataca

SEQ ID NO: 2746242 - DNA, 17 bp, Homo sapiens
aaatggaaaatatacaa

SEQ ID NO: 2746243 - DNA, 20 bp, Homo sapiens
aaatggaaaatatacaagta

SEQ ID NO: 2746244 - DNA, 17 bp, Homo sapiens
aaatgtagaaattctaa

SEQ ID NO: 2746245 - DNA, 12 bp, Homo sapiens
aaatgttagttc

SEQ ID NO: 2746246 - DNA, 11 bp, Homo sapiens
aaatgttgaaa

SEQ ID NO: 2746247 - DNA, 23 bp, Homo sapiens
aaatgttgacatgggacatttgc

SEQ ID NO: 2746248 - DNA, 12 bp, Homo sapiens
aaatgttttatg

SEQ ID NO: 2746249 - DNA, 16 bp, Homo sapiens
aaatgtttttaaaaac

SEQ ID NO: 2746250 - DNA, 15 bp, Homo sapiens
aaattaatattgtat

SEQ ID NO: 2746251 - DNA, 16 bp, Homo sapiens
aaattaattctaaact

SEQ ID NO: 2746252 - DNA, 18 bp, Homo sapiens
aaattaattctaaactta

SEQ ID NO: 2746253 - DNA, 15 bp, Homo sapiens
aaattatttgccttt

SEQ ID NO: 2746254 - DNA, 19 bp, Homo sapiens
aaattcatgccccagtatt

SEQ ID NO: 2746255 - DNA, 13 bp, Homo sapiens
aaattctgaattt

SEQ ID NO: 2746256 - DNA, 19 bp, Homo sapiens
aaattgaaagcactatgaa

SEQ ID NO: 2746257 - DNA, 17 bp, Homo sapiens
aaattggcattttaagt

SEQ ID NO: 2746258 - DNA, 15 bp, Homo sapiens
aaattgtgatgtgtc

SEQ ID NO: 2746259 - DNA, 15 bp, Homo sapiens
aaatttaaaaaactc

SEQ ID NO: 2746260 - DNA, 16 bp, Homo sapiens
aaatttaaaacacagt

SEQ ID NO: 2746261 - DNA, 12 bp, Homo sapiens
aaatttatgtga

SEQ ID NO: 2746262 - DNA, 15 bp, Homo sapiens
aaatttatgtgatgg

SEQ ID NO: 2746263 - DNA, 21 bp, Homo sapiens
aacaaaaagttttttttttgt

SEQ ID NO: 2746264 - DNA, 21 bp, Homo sapiens
aacaaccctgttgagtatttg

SEQ ID NO: 2746265 - DNA, 23 bp, Homo sapiens
aacaatgccgcctgtcaataaat

SEQ ID NO: 2746266 - DNA, 16 bp, Homo sapiens
aacacaactatattgt

SEQ ID NO: 2746267 - DNA, 18 bp, Homo sapiens
aacacagtattgtagaaa

SEQ ID NO: 2746268 - DNA, 20 bp, Homo sapiens
aacacagtattgtagaaagc

SEQ ID NO: 2746269 - DNA, 15 bp, Homo sapiens
aacagcttcatgttc

SEQ ID NO: 2746270 - DNA, 20 bp, Homo sapiens
aacagtacagtatttacagt

SEQ ID NO: 2746271 - DNA, 15 bp, Homo sapiens
aacagtccaatcagt

SEQ ID NO: 2746272 - DNA, 16 bp, Homo sapiens
aacatatataacaatg

SEQ ID NO: 2746273 - DNA, 17 bp, Homo sapiens
aacattcctaaaatgct

SEQ ID NO: 2746274 - DNA, 18 bp, Homo sapiens
acttcaaatccttgaaga

SEQ ID NO: 2746275 - DNA, 20 bp, Homo sapiens
acttcaaatccttgaagatt

SEQ ID NO: 2746276 - DNA, 19 bp, Homo sapiens
acttcaaattttttaaaag

SEQ ID NO: 2746277 - DNA, 13 bp, Homo sapiens
acttctaatctta

SEQ ID NO: 2746278 - DNA, 19 bp, Homo sapiens
acttctaatcttaaatcag

SEQ ID NO: 2746279 - DNA, 18 bp, Homo sapiens
acttcttccctaaaatgt

SEQ ID NO: 2746280 - DNA, 19 bp, Homo sapiens
acttgctataaatagattt

SEQ ID NO: 2746281 - DNA, 16 bp, Homo sapiens
acttgtcaataaaatc

SEQ ID NO: 2746282 - DNA, 14 bp, Homo sapiens
actttaaatttttt

SEQ ID NO: 2746283 - DNA, 17 bp, Homo sapiens
actttaaattttttaaa

SEQ ID NO: 2746284 - DNA, 22 bp, Homo sapiens
actttactaggtacataagctt

SEQ ID NO: 2746285 - DNA, 20 bp, Homo sapiens
actttattttgaatgtacct

SEQ ID NO: 2746286 - DNA, 24 bp, Homo sapiens
actttattttgaatgtacctctat

SEQ ID NO: 2746287 - DNA, 21 bp, Homo sapiens
actttggctgatttaaaaagt

SEQ ID NO: 2746288 - DNA, 12 bp, Homo sapiens
actttgtagtgt

SEQ ID NO: 2746289 - DNA, 19 bp, Homo sapiens
acttttctctactttaaat

SEQ ID NO: 2746290 - DNA, 13 bp, Homo sapiens
actttttattgca

SEQ ID NO: 2746291 - DNA, 20 bp, Homo sapiens
actttttattgcatggtgtg

SEQ ID NO: 2746292 - DNA, 13 bp, Homo sapiens
actttttgtttct

SEQ ID NO: 2746293 - DNA, 14 bp, Homo sapiens
acttttttatgtct

SEQ ID NO: 2746294 - DNA, 14 bp, Homo sapiens
acttttttcaaata

SEQ ID NO: 2746295 - DNA, 18 bp, Homo sapiens
acttttttcaaatattga

SEQ ID NO: 2746296 - DNA, 19 bp, Homo sapiens
acttttttcaaatattgaa

SEQ ID NO: 2746297 - DNA, 20 bp, Homo sapiens
acttttttcaaatattgaat

SEQ ID NO: 2746298 - DNA, 22 bp, Homo sapiens
acttttttctttgaaatgctaa

SEQ ID NO: 2746299 - DNA, 18 bp, Homo sapiens
agaaaaaaactataaata

SEQ ID NO: 2746300 - DNA, 16 bp, Homo sapiens
agaaaacaaggatgaa

SEQ ID NO: 2746301 - DNA, 14 bp, Homo sapiens
agaaaagcacttaa

SEQ ID NO: 2746302 - DNA, 19 bp, Homo sapiens
agaaaagcacttaaagttt

SEQ ID NO: 2746303 - DNA, 10 bp, Homo sapiens
agaaagaaag

SEQ ID NO: 2746304 - DNA, 14 bp, Homo sapiens
agaaagctaataca

SEQ ID NO: 2746305 - DNA, 18 bp, Homo sapiens
agaaaggcacatattgga

SEQ ID NO: 2746306 - DNA, 23 bp, Homo sapiens
agaaaggctaacaaattttaagt

SEQ ID NO: 2746307 - DNA, 13 bp, Homo sapiens
agaaattctaact

SEQ ID NO: 2746308 - DNA, 15 bp, Homo sapiens
agaaattctgaattt

SEQ ID NO: 2746309 - DNA, 13 bp, Homo sapiens
agaacattcttat

SEQ ID NO: 2746310 - DNA, 15 bp, Homo sapiens
agaacctacaaaagc

SEQ ID NO: 2746311 - DNA, 21 bp, Homo sapiens
agaagactgcattatatttat

SEQ ID NO: 2746312 - DNA, 14 bp, Homo sapiens
agaagattccttct

SEQ ID NO: 2746313 - DNA, 19 bp, Homo sapiens
agaagcaccaatcatgaat

SEQ ID NO: 2746314 - DNA, 11 bp, Homo sapiens
agaataaaagc

SEQ ID NO: 2746315 - DNA, 20 bp, Homo sapiens
agaataaattaatattgtat

SEQ ID NO: 2746316 - DNA, 20 bp, Homo sapiens
agaatatacacattttgtaa

SEQ ID NO: 2746317 - DNA, 21 bp, Homo sapiens
agaatccaagacaaactaaac

SEQ ID NO: 2746318 - DNA, 17 bp, Homo sapiens
agaatccacacatatat

SEQ ID NO: 2746319 - DNA, 14 bp, Homo sapiens
agaatgaaagtagc

SEQ ID NO: 2746320 - DNA, 22 bp, Homo sapiens
agaatgagagacacactgaaga

SEQ ID NO: 2746321 - DNA, 18 bp, Homo sapiens
agaatgctgcaacttttt

SEQ ID NO: 2746322 - DNA, 15 bp, Homo sapiens
ttgccacatcttgaa

SEQ ID NO: 2746323 - DNA, 12 bp, Homo sapiens
ttgcctgtagtc

SEQ ID NO: 2746324 - DNA, 16 bp, Homo sapiens
ttgctaagcattccaa

SEQ ID NO: 2746325 - DNA, 20 bp, Homo sapiens
ttgctatgagctggggatgt

SEQ ID NO: 2746326 - DNA, 11 bp, Homo sapiens
ttgctcatgga

SEQ ID NO: 2746327 - DNA, 12 bp, Homo sapiens
ttgctcatggaa

SEQ ID NO: 2746328 - DNA, 15 bp, Homo sapiens
ttgctcctagaactg

SEQ ID NO: 2746329 - DNA, 21 bp, Homo sapiens
ttgctgcataaatttgtaata

SEQ ID NO: 2746330 - DNA, 20 bp, Homo sapiens
ttgcttggtgctggtttatt

SEQ ID NO: 2746331 - DNA, 15 bp, Homo sapiens
ttgctttctgaaatt

SEQ ID NO: 2746332 - DNA, 23 bp, Homo sapiens
ttgcttttgaaggaatacaatat

SEQ ID NO: 2746333 - DNA, 15 bp, Homo sapiens
ttggagaaaagcact

SEQ ID NO: 2746334 - DNA, 23 bp, Homo sapiens
ttggagccttccaccggcactca

SEQ ID NO: 2746335 - DNA, 18 bp, Homo sapiens
ttggagggaaaaaacaag

SEQ ID NO: 2746336 - DNA, 17 bp, Homo sapiens
ttggatttgcatttttg

SEQ ID NO: 2746337 - DNA, 17 bp, Homo sapiens
ttggcaaacgggcttga

SEQ ID NO: 2746338 - DNA, 18 bp, Homo sapiens
ttggccaagagaagggct

SEQ ID NO: 2746339 - DNA, 22 bp, Homo sapiens
ttgggatcgcattgcatacctt

SEQ ID NO: 2746340 - DNA, 14 bp, Homo sapiens
ttggggaggactag

SEQ ID NO: 2746341 - DNA, 16 bp, Homo sapiens
ttgggggaaatgttgt

SEQ ID NO: 2746342 - DNA, 13 bp, Homo sapiens
ttggtgctggttt

SEQ ID NO: 2746343 - DNA, 16 bp, Homo sapiens
ttggtgtaacttaaat

SEQ ID NO: 2746344 - DNA, 20 bp, Homo sapiens
ttggtgtggagttttcatga

SEQ ID NO: 2746345 - DNA, 12 bp, Homo sapiens
ttggtttaatat

SEQ ID NO: 2746346 - DNA, 12 bp, Homo sapiens
ttgtaaaaactt

SEQ ID NO: 2746347 - DNA, 13 bp, Homo sapiens
ttgtaaagtaaaa

SEQ ID NO: 2746348 - DNA, 14 bp, Homo sapiens
ttgtaaagtaaaat

SEQ ID NO: 2746349 - DNA, 17 bp, Homo sapiens
ttgtaaatctgtacttt

SEQ ID NO: 2746350 - DNA, 19 bp, Homo sapiens
ttgtaaatttatgtgatgg

SEQ ID NO: 2746351 - DNA, 17 bp, Homo sapiens
ttgtaatatatcctgtt

SEQ ID NO: 2746352 - DNA, 21 bp, Homo sapiens
ttgtaatatatcctgtttgta

SEQ ID NO: 2746353 - DNA, 17 bp, Homo sapiens
ttgtacatttggaacag

SEQ ID NO: 2746354 - DNA, 22 bp, Homo sapiens
ttgtactgcatcttagtttact

SEQ ID NO: 2746355 - DNA, 21 bp, Homo sapiens
ttgtagaaagctaatacaaaa

SEQ ID NO: 2746356 - DNA, 22 bp, Homo sapiens
ttgtagaaagctaatacaaaac

SEQ ID NO: 2746357 - DNA, 15 bp, Homo sapiens
ttgtattgctgctgt

SEQ ID NO: 2746358 - DNA, 17 bp, Homo sapiens
ttgtattgctgctgtgc

SEQ ID NO: 2746359 - DNA, 15 bp, Homo sapiens
ttgtattgctgtcct

SEQ ID NO: 2746360 - DNA, 13 bp, Homo sapiens
ttgtattttgtac

SEQ ID NO: 2746361 - DNA, 14 bp, Homo sapiens
ttgtcacttatttc

SEQ ID NO: 2746362 - DNA, 15 bp, Homo sapiens
ttgtccatttaaaaa

SEQ ID NO: 2746363 - DNA, 15 bp, Homo sapiens
ttgtcctaagtgtca

SEQ ID NO: 2746364 - DNA, 18 bp, Homo sapiens
ttgtgaagcaaaattttt

SEQ ID NO: 2746365 - DNA, 22 bp, Homo sapiens
ttgtggagattttttttttaat

SEQ ID NO: 2746366 - DNA, 13 bp, Homo sapiens
ttgtgggaataaa

SEQ ID NO: 2746367 - DNA, 15 bp, Homo sapiens
ttgtgtataagttgt

SEQ ID NO: 2746368 - DNA, 23 bp, Homo sapiens
ttgttaaaaaaaaaaagattgta

SEQ ID NO: 2746369 - DNA, 20 bp, Homo sapiens
ttgttaccactggtaacatg

SEQ ID NO: 2746370 - DNA, 22 bp, Homo sapiens
ttgttggagtgaagcatttaaa

SEQ ID NO: 2746371 - DNA, 11 bp, Homo sapiens
ttgttgtgtat

SEQ ID NO: 2746372 - DNA, 11 bp, Homo sapiens
ttgttgttgtt

SEQ ID NO: 2746373 - DNA, 14 bp, Homo sapiens
ttgttgttgtttta

SEQ ID NO: 2746374 - DNA, 13 bp, Homo sapiens
ttgttgttttata

SEQ ID NO: 2746375 - DNA, 15 bp, Homo sapiens
ttgtttagaagaagt

SEQ ID NO: 2746376 - DNA, 19 bp, Homo sapiens
ttgtttttataaaaacatt

SEQ ID NO: 2746377 - DNA, 13 bp, Homo sapiens
ttgtttttgcttt

SEQ ID NO: 2746378 - DNA, 16 bp, Homo sapiens
ttgtttttgctttctg

SEQ ID NO: 2746379 - DNA, 19 bp, Homo sapiens
ttgtttttgctttctgaaa

SEQ ID NO: 2746380 - DNA, 20 bp, Homo sapiens
tttaaaaaagaaacatttgg

SEQ ID NO: 2746381 - DNA, 15 bp, Homo sapiens
tttaaaaacctattt

SEQ ID NO: 2746382 - DNA, 22 bp, Homo sapiens
tttaaaaacctattttgaaagg

SEQ ID NO: 2746383 - DNA, 11 bp, Homo sapiens
tttaaaaagaa

SEQ ID NO: 2746384 - DNA, 16 bp, Homo sapiens
tttaaaaagaaaaaaa

SEQ ID NO: 2746385 - DNA, 14 bp, Homo sapiens
tttaaaagaatgat

SEQ ID NO: 2746386 - DNA, 12 bp, Homo sapiens
tttaaaagcaaa

SEQ ID NO: 2746387 - DNA, 23 bp, Homo sapiens
tttaaagaatccaagacaaacta

SEQ ID NO: 2746388 - DNA, 23 bp, Homo sapiens
tttaaatatctgaacatttacta

SEQ ID NO: 2746389 - DNA, 15 bp, Homo sapiens
tttaaattggagaaa

SEQ ID NO: 2746390 - DNA, 23 bp, Homo sapiens
tttaaattggagaaaagcactta

SEQ ID NO: 2746391 - DNA, 23 bp, Homo sapiens
tttaacattgattggataaatgc

SEQ ID NO: 2746392 - DNA, 16 bp, Homo sapiens
tttaagcaaatgcatt

SEQ ID NO: 2746393 - DNA, 23 bp, Homo sapiens
tttaatctcctgagttgtataaa

SEQ ID NO: 2746394 - DNA, 15 bp, Homo sapiens
tttaattgtttaaaa

SEQ ID NO: 2746395 - DNA, 20 bp, Homo sapiens
tttacagaggacagtatttg

SEQ ID NO: 2746396 - DNA, 18 bp, Homo sapiens
tttacattgtgacaaaca

SEQ ID NO: 2746397 - DNA, 21 bp, Homo sapiens
tttaccacaaaagcaaaattt

SEQ ID NO: 2746398 - DNA, 13 bp, Homo sapiens
tttaccacttgtg

SEQ ID NO: 2746399 - DNA, 17 bp, Homo sapiens
tttactggataaattta

SEQ ID NO: 2746400 - DNA, 16 bp, Homo sapiens
tttacttctaatctta

SEQ ID NO: 2746401 - DNA, 12 bp, Homo sapiens
tttagaaacaca

SEQ ID NO: 2746402 - DNA, 15 bp, Homo sapiens
tttagctagaatcca

SEQ ID NO: 2746403 - DNA, 14 bp, Homo sapiens
tttataaaaacatt

SEQ ID NO: 2746404 - DNA, 22 bp, Homo sapiens
tttataaaaacattgaaatatt

SEQ ID NO: 2746405 - DNA, 19 bp, Homo sapiens
tttatactgtgaagttaca

SEQ ID NO: 2746406 - DNA, 21 bp, Homo sapiens
tttatataatgcatgtattca

SEQ ID NO: 2746407 - DNA, 16 bp, Homo sapiens
tttatatctggaatga

SEQ ID NO: 2746408 - DNA, 17 bp, Homo sapiens
tttatatgcttctgttt

SEQ ID NO: 2746409 - DNA, 16 bp, Homo sapiens
tttatattagttgctt

SEQ ID NO: 2746410 - DNA, 20 bp, Homo sapiens
tttatattagttgctttgtt

SEQ ID NO: 2746411 - DNA, 21 bp, Homo sapiens
tttatattagttgctttgtta

SEQ ID NO: 2746412 - DNA, 17 bp, Homo sapiens
tttatggcactagtatt

SEQ ID NO: 2746413 - DNA, 12 bp, Homo sapiens
tttatgtgatgg

SEQ ID NO: 2746414 - DNA, 13 bp, Homo sapiens
tttatgtttgtgg

SEQ ID NO: 2746415 - DNA, 19 bp, Homo sapiens
tttattactgtaagaaaat

SEQ ID NO: 2746416 - DNA, 13 bp, Homo sapiens
tttattcaaaata

SEQ ID NO: 2746417 - DNA, 20 bp, Homo sapiens
tttattgcatggtgtgaact

SEQ ID NO: 2746418 - DNA, 17 bp, Homo sapiens
tttatttagaaactggt

SEQ ID NO: 2746419 - DNA, 16 bp, Homo sapiens
tttattttaataatgt

SEQ ID NO: 2746420 - DNA, 14 bp, Homo sapiens
tttattttgaatgt

SEQ ID NO: 2746421 - DNA, 16 bp, Homo sapiens
tttattttgaatgtac

SEQ ID NO: 2746422 - DNA, 12 bp, Homo sapiens
tttcaaaactag

SEQ ID NO: 2746423 - DNA, 10 bp, Homo sapiens
tttcaaaatg

SEQ ID NO: 2746424 - DNA, 17 bp, Homo sapiens
tttcaaacatatataac

SEQ ID NO: 2746425 - DNA, 21 bp, Homo sapiens
tttcaaatattgaatgcctta

SEQ ID NO: 2746426 - DNA, 22 bp, Homo sapiens
tttcaaatattgaatgccttat

SEQ ID NO: 2746427 - DNA, 17 bp, Homo sapiens
tttcaattgagtaattc

SEQ ID NO: 2746428 - DNA, 19 bp, Homo sapiens
tttcaattgagtaattcta

SEQ ID NO: 2746429 - DNA, 22 bp, Homo sapiens
tttcacttcccgagcgctggtc

SEQ ID NO: 2746430 - DNA, 21 bp, Homo sapiens
tttcacttctccaacaagtac

SEQ ID NO: 2746431 - DNA, 19 bp, Homo sapiens
tttcatagttctgttaaat

SEQ ID NO: 2746432 - DNA, 21 bp, Homo sapiens
tttcatagttctgttaaatat

SEQ ID NO: 2746433 - DNA, 13 bp, Homo sapiens
tttcatctaattt

SEQ ID NO: 2746434 - DNA, 16 bp, Homo sapiens
tttcatctaatttaat

SEQ ID NO: 2746435 - DNA, 20 bp, Homo sapiens
tttcatttacaatttcaaaa

SEQ ID NO: 2746436 - DNA, 21 bp, Homo sapiens
tttcatttacaatttcaaaag

SEQ ID NO: 2746437 - DNA, 16 bp, Homo sapiens
tttcatttcaaaatgc

SEQ ID NO: 2746438 - DNA, 15 bp, Homo sapiens
tttccaagtgtataa

SEQ ID NO: 2746439 - DNA, 20 bp, Homo sapiens
tttccaagtgtataatgttg

SEQ ID NO: 2746440 - DNA, 12 bp, Homo sapiens
tttcctgcccag

SEQ ID NO: 2746441 - DNA, 13 bp, Homo sapiens
tttcctgcccagc

SEQ ID NO: 2746442 - DNA, 21 bp, Homo sapiens
tttcctgcccagcctggggca

SEQ ID NO: 2746443 - DNA, 16 bp, Homo sapiens
tttccttcctctgtaa

SEQ ID NO: 2746444 - DNA, 18 bp, Homo sapiens
tttcctttatactgtgaa

SEQ ID NO: 2746445 - DNA, 18 bp, Homo sapiens
tttctaagggaaaaagtt

SEQ ID NO: 2746446 - DNA, 21 bp, Homo sapiens
tttctaattttttttgtacat

SEQ ID NO: 2746447 - DNA, 13 bp, Homo sapiens
tttctatgaaata

SEQ ID NO: 2746448 - DNA, 19 bp, Homo sapiens
tttctctactttaaatttt

SEQ ID NO: 2746449 - DNA, 13 bp, Homo sapiens
tttctgaaattca

SEQ ID NO: 2746450 - DNA, 17 bp, Homo sapiens
tttctgaaattcacaga

SEQ ID NO: 2746451 - DNA, 16 bp, Homo sapiens
tttctgggggaaaaag

SEQ ID NO: 2746452 - DNA, 21 bp, Homo sapiens
tgcaggtctttaaatcatttt

SEQ ID NO: 2746453 - DNA, 17 bp, Homo sapiens
tgcagttgaattcagtg

SEQ ID NO: 2746454 - DNA, 20 bp, Homo sapiens
tgcataaaagggtcaaacct

SEQ ID NO: 2746455 - DNA, 16 bp, Homo sapiens
tgcataaatttgtaat

SEQ ID NO: 2746456 - DNA, 21 bp, Homo sapiens
tgcatccagcagtacaataaa

SEQ ID NO: 2746457 - DNA, 15 bp, Homo sapiens
tgcatcttagtttac

SEQ ID NO: 2746458 - DNA, 12 bp, Homo sapiens
tgcatgtattca

SEQ ID NO: 2746459 - DNA, 16 bp, Homo sapiens
tgcatgtattcactaa

SEQ ID NO: 2746460 - DNA, 21 bp, Homo sapiens
tgcatgtattcactaaaataa

SEQ ID NO: 2746461 - DNA, 15 bp, Homo sapiens
tgcattacttactgt

SEQ ID NO: 2746462 - DNA, 16 bp, Homo sapiens
tgcattacttactgtt

SEQ ID NO: 2746463 - DNA, 20 bp, Homo sapiens
tgcattacttactgttaaaa

SEQ ID NO: 2746464 - DNA, 22 bp, Homo sapiens
tgcattacttactgttaaaact

SEQ ID NO: 2746465 - DNA, 15 bp, Homo sapiens
tgcattatatttatt

SEQ ID NO: 2746466 - DNA, 19 bp, Homo sapiens
tgcatttttaatcagtgga

SEQ ID NO: 2746467 - DNA, 13 bp, Homo sapiens
tgccaaaaattca

SEQ ID NO: 2746468 - DNA, 15 bp, Homo sapiens
tgccaatcttgtttt

SEQ ID NO: 2746469 - DNA, 18 bp, Homo sapiens
tgccacaggttttaagga

SEQ ID NO: 2746470 - DNA, 13 bp, Homo sapiens
tgccacatcttga

SEQ ID NO: 2746471 - DNA, 16 bp, Homo sapiens
tgccacatcttgaaaa

SEQ ID NO: 2746472 - DNA, 18 bp, Homo sapiens
tgccaggatggaatgatg

SEQ ID NO: 2746473 - DNA, 18 bp, Homo sapiens
tgccattgcactccagcc

SEQ ID NO: 2746474 - DNA, 23 bp, Homo sapiens
tgcccaggaactcgcacctgtgc

SEQ ID NO: 2746475 - DNA, 21 bp, Homo sapiens
tgcctatatgagaagaatagc

SEQ ID NO: 2746476 - DNA, 16 bp, Homo sapiens
tgcctgactaaaatgt

SEQ ID NO: 2746477 - DNA, 14 bp, Homo sapiens
tgcctggagtgctg

SEQ ID NO: 2746478 - DNA, 21 bp, Homo sapiens
tgcctgtagtctcagctactt

SEQ ID NO: 2746479 - DNA, 18 bp, Homo sapiens
tgccttcaaatagtatag

SEQ ID NO: 2746480 - DNA, 20 bp, Homo sapiens
tgccttcaaatagtatagaa

SEQ ID NO: 2746481 - DNA, 21 bp, Homo sapiens
tgccttcaaatagtatagaaa

SEQ ID NO: 2746482 - DNA, 23 bp, Homo sapiens
tgccttcaaatagtatagaaaat

SEQ ID NO: 2746483 - DNA, 14 bp, Homo sapiens
tgctaaaattctat

SEQ ID NO: 2746484 - DNA, 11 bp, Homo sapiens
tgctaaacttg

SEQ ID NO: 2746485 - DNA, 12 bp, Homo sapiens
tgctaaggaaca

SEQ ID NO: 2746486 - DNA, 23 bp, Homo sapiens
tgctaaggaacaatgccgcctgt

SEQ ID NO: 2746487 - DNA, 20 bp, Homo sapiens
tgctagacaaggttgctgtt

SEQ ID NO: 2746488 - DNA, 21 bp, Homo sapiens
tgctagacaaggttgctgttg

SEQ ID NO: 2746489 - DNA, 16 bp, Homo sapiens
tgctatgagctgggga

SEQ ID NO: 2746490 - DNA, 20 bp, Homo sapiens
tgctatgagctggggatgtc

SEQ ID NO: 2746491 - DNA, 22 bp, Homo sapiens
tgctatgagctggggatgtctc

SEQ ID NO: 2746492 - DNA, 18 bp, Homo sapiens
tgctattgtagagccaga

SEQ ID NO: 2746493 - DNA, 14 bp, Homo sapiens
tgctccaaggcagt

SEQ ID NO: 2746494 - DNA, 18 bp, Homo sapiens
tgctgcttggtagcactt

SEQ ID NO: 2746495 - DNA, 15 bp, Homo sapiens
tgctgtagacatttg

SEQ ID NO: 2746496 - DNA, 23 bp, Homo sapiens
tgctgtattttaaaagaatgatt

SEQ ID NO: 2746497 - DNA, 18 bp, Homo sapiens
tgctgtgcgtggaaaaag

SEQ ID NO: 2746498 - DNA, 14 bp, Homo sapiens
tgcttctgttttat

SEQ ID NO: 2746499 - DNA, 14 bp, Homo sapiens
tgcttggtgctggt

SEQ ID NO: 2746500 - DNA, 16 bp, Homo sapiens
tgcttggtgctggttt

SEQ ID NO: 2746501 - DNA, 22 bp, Homo sapiens
tggaaaagtatgttagtgcaaa

SEQ ID NO: 2746502 - DNA, 12 bp, Homo sapiens
tggaaaatatac

SEQ ID NO: 2746503 - DNA, 16 bp, Homo sapiens
tggaaaatatacaagt

SEQ ID NO: 2746504 - DNA, 19 bp, Homo sapiens
tggaaaatatacaagtaaa

SEQ ID NO: 2746505 - DNA, 19 bp, Homo sapiens
tggaaaattaattctaaac

SEQ ID NO: 2746506 - DNA, 20 bp, Homo sapiens
tggaaaattaattctaaact

SEQ ID NO: 2746507 - DNA, 23 bp, Homo sapiens
tggaaacttcagcggtttatata

SEQ ID NO: 2746508 - DNA, 20 bp, Homo sapiens
tggaagtgtgggtctgtgtg

SEQ ID NO: 2746509 - DNA, 20 bp, Homo sapiens
tggaatgatgggtcagttgt

SEQ ID NO: 2746510 - DNA, 20 bp, Homo sapiens
tggacatgcaggttggcaaa

SEQ ID NO: 2746511 - DNA, 14 bp, Homo sapiens
tggagaaaagcact

SEQ ID NO: 2746512 - DNA, 12 bp, Homo sapiens
tggagccttcca

SEQ ID NO: 2746513 - DNA, 22 bp, Homo sapiens
tggagccttccaccggcactca

SEQ ID NO: 2746514 - DNA, 17 bp, Homo sapiens
tggagctcgtggaacag

SEQ ID NO: 2746515 - DNA, 21 bp, Homo sapiens
tggagctcgtgggacagtcac

SEQ ID NO: 2746516 - DNA, 17 bp, Homo sapiens
tggagcttcatcggggt

SEQ ID NO: 2746517 - DNA, 17 bp, Homo sapiens
tggagtgaagcatttaa

SEQ ID NO: 2746518 - DNA, 19 bp, Homo sapiens
tggagtgaagcatttaaaa

SEQ ID NO: 2746519 - DNA, 14 bp, Homo sapiens
tggagtgctgtgct

SEQ ID NO: 2746520 - DNA, 21 bp, Homo sapiens
tggatataatctgaatcctgt

SEQ ID NO: 2746521 - DNA, 19 bp, Homo sapiens
tggatctgtgaggggctct

SEQ ID NO: 2746522 - DNA, 15 bp, Homo sapiens
tggatttcctttata

SEQ ID NO: 2746523 - DNA, 22 bp, Homo sapiens
tggatttcctttatactgtgaa

SEQ ID NO: 2746524 - DNA, 21 bp, Homo sapiens
tggcaggacactgcagaacag

SEQ ID NO: 2746525 - DNA, 19 bp, Homo sapiens
tggcatttgcagattttta

SEQ ID NO: 2746526 - DNA, 11 bp, Homo sapiens
tggcattttaa

SEQ ID NO: 2746527 - DNA, 14 bp, Homo sapiens
tggccagtggctgg

SEQ ID NO: 2746528 - DNA, 23 bp, Homo sapiens
tggccccgcccgagcccctgccc

SEQ ID NO: 2746529 - DNA, 12 bp, Homo sapiens
tggcctgaggtc

SEQ ID NO: 2746530 - DNA, 17 bp, Homo sapiens
tggcctgctgggcttgg

SEQ ID NO: 2746531 - DNA, 21 bp, Homo sapiens
tggcctgttcttctatgggtt

SEQ ID NO: 2746532 - DNA, 21 bp, Homo sapiens
tggctcggcgcccccacccct

SEQ ID NO: 2746533 - DNA, 22 bp, Homo sapiens
tggctgccttgtgaaggaatta

SEQ ID NO: 2746534 - DNA, 17 bp, Homo sapiens
tgggaaatgttttaatg

SEQ ID NO: 2746535 - DNA, 19 bp, Homo sapiens
tgggagaatgtcagtatgt

SEQ ID NO: 2746536 - DNA, 20 bp, Homo sapiens
tgggagaatgtcagtatgtg

SEQ ID NO: 2746537 - DNA, 22 bp, Homo sapiens
tgggagaatgtcagtatgtgga

SEQ ID NO: 2746538 - DNA, 22 bp, Homo sapiens
tgggagtgaggatgtctgggcc

SEQ ID NO: 2746539 - DNA, 16 bp, Homo sapiens
tggggatagatgtgtg

SEQ ID NO: 2746540 - DNA, 18 bp, Homo sapiens
tggggatagatgtgtgga

SEQ ID NO: 2746541 - DNA, 19 bp, Homo sapiens
tggggcaaacctagccgga

SEQ ID NO: 2746542 - DNA, 12 bp, Homo sapiens
tgggggaaaaag

SEQ ID NO: 2746543 - DNA, 15 bp, Homo sapiens
tgggggaaaaagcca

SEQ ID NO: 2746544 - DNA, 11 bp, Homo sapiens
tgggggatgta

SEQ ID NO: 2746545 - DNA, 17 bp, Homo sapiens
tggggtaagcggaataa

SEQ ID NO: 2746546 - DNA, 15 bp, Homo sapiens
tggggtaggttggga

SEQ ID NO: 2746547 - DNA, 21 bp, Homo sapiens
tggggtaggttgggagaatgt

SEQ ID NO: 2746548 - DNA, 17 bp, Homo sapiens
tggggtcccactgctcg

SEQ ID NO: 2746549 - DNA, 16 bp, Homo sapiens
tgggtagacacacatg

SEQ ID NO: 2746550 - DNA, 13 bp, Homo sapiens
tgggtctgtgtgt

SEQ ID NO: 2746551 - DNA, 18 bp, Homo sapiens
tgggtgctgatccttgca

SEQ ID NO: 2746552 - DNA, 14 bp, Homo sapiens
tgggttcagaacca

SEQ ID NO: 2746553 - DNA, 21 bp, Homo sapiens
tgggttcagaaccaagatgcc

SEQ ID NO: 2746554 - DNA, 13 bp, Homo sapiens
tggtaggaactgc

SEQ ID NO: 2746555 - DNA, 14 bp, Homo sapiens
tggtattaaagaat

SEQ ID NO: 2746556 - DNA, 18 bp, Homo sapiens
tggtgatataaagaatga

SEQ ID NO: 2746557 - DNA, 22 bp, Homo sapiens
tggtgtgaactaagttattgct

SEQ ID NO: 2746558 - DNA, 15 bp, Homo sapiens
tggttatttctaaac

SEQ ID NO: 2746559 - DNA, 17 bp, Homo sapiens
tggttcccttgatgaag

SEQ ID NO: 2746560 - DNA, 16 bp, Homo sapiens
tggtttatttgttgtt

SEQ ID NO: 2746561 - DNA, 21 bp, Homo sapiens
tggtttcctgcccagcctggg

SEQ ID NO: 2746562 - DNA, 20 bp, Homo sapiens
ttaaaaacctattttgaaag

SEQ ID NO: 2746563 - DNA, 21 bp, Homo sapiens
ttaaaaacctattttgaaagg

SEQ ID NO: 2746564 - DNA, 16 bp, Homo sapiens
ttaaaaatgatctgta

SEQ ID NO: 2746565 - DNA, 21 bp, Homo sapiens
ttaaaacacagtattgtagaa

SEQ ID NO: 2746566 - DNA, 19 bp, Homo sapiens
ttaaaactgtaccttttgc

SEQ ID NO: 2746567 - DNA, 16 bp, Homo sapiens
ttaaaatacataactt

SEQ ID NO: 2746568 - DNA, 20 bp, Homo sapiens
ttaaaatgcaatatttgtaa

SEQ ID NO: 2746569 - DNA, 18 bp, Homo sapiens
ttaaaattgtgatgtgtc

SEQ ID NO: 2746570 - DNA, 18 bp, Homo sapiens
ttaaaattttcattctga

SEQ ID NO: 2746571 - DNA, 13 bp, Homo sapiens
ttaaagaatccaa

SEQ ID NO: 2746572 - DNA, 21 bp, Homo sapiens
ttaaatatctgaacatttact

SEQ ID NO: 2746573 - DNA, 13 bp, Homo sapiens
ttaaatatttttg

SEQ ID NO: 2746574 - DNA, 14 bp, Homo sapiens
ttaaatcagaataa

SEQ ID NO: 2746575 - DNA, 16 bp, Homo sapiens
ttaaatcagaataaat

SEQ ID NO: 2746576 - DNA, 14 bp, Homo sapiens
ttaaattggagaaa

SEQ ID NO: 2746577 - DNA, 21 bp, Homo sapiens
ttaaattggagaaaagcactt

SEQ ID NO: 2746578 - DNA, 22 bp, Homo sapiens
ttaaattttctctaaactgttt

SEQ ID NO: 2746579 - DNA, 20 bp, Homo sapiens
ttaagaagactgcattatat

SEQ ID NO: 2746580 - DNA, 17 bp, Homo sapiens
ttaaggattctgcagaa

SEQ ID NO: 2746581 - DNA, 18 bp, Homo sapiens
ttaaggattctgcagaaa

SEQ ID NO: 2746582 - DNA, 17 bp, Homo sapiens
ttaatcagagtatctga

SEQ ID NO: 2746583 - DNA, 12 bp, Homo sapiens
ttaatgtacttt

SEQ ID NO: 2746584 - DNA, 15 bp, Homo sapiens
ttaattctaaactta

SEQ ID NO: 2746585 - DNA, 22 bp, Homo sapiens
ttaattctaaacttagaaatat

SEQ ID NO: 2746586 - DNA, 20 bp, Homo sapiens
catgtctgcctggagtgctg

SEQ ID NO: 2746587 - DNA, 21 bp, Homo sapiens
catgttggttgcactttgtag

SEQ ID NO: 2746588 - DNA, 22 bp, Homo sapiens
catgttggttgcactttgtagt

SEQ ID NO: 2746589 - DNA, 15 bp, Homo sapiens
cattaactcaggcat

SEQ ID NO: 2746590 - DNA, 16 bp, Homo sapiens
cattaactcaggcatt

SEQ ID NO: 2746591 - DNA, 23 bp, Homo sapiens
cattacaatcgagactgcaatgt

SEQ ID NO: 2746592 - DNA, 19 bp, Homo sapiens
cattacttactgttaaaac

SEQ ID NO: 2746593 - DNA, 19 bp, Homo sapiens
cattatatttattactgta

SEQ ID NO: 2746594 - DNA, 14 bp, Homo sapiens
cattccagaggaag

SEQ ID NO: 2746595 - DNA, 19 bp, Homo sapiens
cattctatcgttattataa

SEQ ID NO: 2746596 - DNA, 14 bp, Homo sapiens
cattctgaatctga

SEQ ID NO: 2746597 - DNA, 15 bp, Homo sapiens
cattctgacacatat

SEQ ID NO: 2746598 - DNA, 18 bp, Homo sapiens
cattcttcttttttgtaa

SEQ ID NO: 2746599 - DNA, 12 bp, Homo sapiens
cattgaaatatt

SEQ ID NO: 2746600 - DNA, 20 bp, Homo sapiens
cattgattggataaatgctt

SEQ ID NO: 2746601 - DNA, 21 bp, Homo sapiens
cattgcctgatttgttccttc

SEQ ID NO: 2746602 - DNA, 15 bp, Homo sapiens
cattggtttgagaaa

SEQ ID NO: 2746603 - DNA, 16 bp, Homo sapiens
cattgttgtgtataat

SEQ ID NO: 2746604 - DNA, 19 bp, Homo sapiens
cattgtttggatttccttt

SEQ ID NO: 2746605 - DNA, 20 bp, Homo sapiens
catttacaatttcaaaagaa

SEQ ID NO: 2746606 - DNA, 18 bp, Homo sapiens
catttcatctaatttaat

SEQ ID NO: 2746607 - DNA, 12 bp, Homo sapiens
catttccaagca

SEQ ID NO: 2746608 - DNA, 22 bp, Homo sapiens
catttgccaaaaattcatgccc

SEQ ID NO: 2746609 - DNA, 16 bp, Homo sapiens
catttgtataaaataa

SEQ ID NO: 2746610 - DNA, 13 bp, Homo sapiens
cattttgtaaatc

SEQ ID NO: 2746611 - DNA, 14 bp, Homo sapiens
cattttgtaaatct

SEQ ID NO: 2746612 - DNA, 18 bp, Homo sapiens
cattttgtaaatctgtac

SEQ ID NO: 2746613 - DNA, 15 bp, Homo sapiens
catttttgtattttg

SEQ ID NO: 2746614 - DNA, 17 bp, Homo sapiens
ccaaactcctgcctgag

SEQ ID NO: 2746615 - DNA, 22 bp, Homo sapiens
ccaaagttcacattaactcagg

SEQ ID NO: 2746616 - DNA, 16 bp, Homo sapiens
ccaagacaaactaaac

SEQ ID NO: 2746617 - DNA, 14 bp, Homo sapiens
ccaagcaagtatta

SEQ ID NO: 2746618 - DNA, 12 bp, Homo sapiens
ccaataaaaatc

SEQ ID NO: 2746619 - DNA, 23 bp, Homo sapiens
ccaataaaaatcaggagcctgct

SEQ ID NO: 2746620 - DNA, 20 bp, Homo sapiens
ccacacagacttgggcaggg

SEQ ID NO: 2746621 - DNA, 16 bp, Homo sapiens
ccacaccctcactgct

SEQ ID NO: 2746622 - DNA, 16 bp, Homo sapiens
ccacagaagctccagg

SEQ ID NO: 2746623 - DNA, 18 bp, Homo sapiens
ccacagaagctccaggta

SEQ ID NO: 2746624 - DNA, 20 bp, Homo sapiens
ccacaggaaccacaagactg

SEQ ID NO: 2746625 - DNA, 16 bp, Homo sapiens
ccacatcttgaaaatg

SEQ ID NO: 2746626 - DNA, 24 bp, Homo sapiens
ccaccgggcatgtctgcctggagt

SEQ ID NO: 2746627 - DNA, 22 bp, Homo sapiens
gaacctacaaaagcttgtgtat

SEQ ID NO: 2746628 - DNA, 18 bp, Homo sapiens
gaacctttcaaaatggaa

SEQ ID NO: 2746629 - DNA, 17 bp, Homo sapiens
gaactaagttattgctg

SEQ ID NO: 2746630 - DNA, 22 bp, Homo sapiens
gaactaagttattgctgcataa

SEQ ID NO: 2746631 - DNA, 13 bp, Homo sapiens
gaactattagagc

SEQ ID NO: 2746632 - DNA, 14 bp, Homo sapiens
gaactgaaatcata

SEQ ID NO: 2746633 - DNA, 17 bp, Homo sapiens
gaactttgatacaaatg

SEQ ID NO: 2746634 - DNA, 12 bp, Homo sapiens
gaagaactgaaa

SEQ ID NO: 2746635 - DNA, 13 bp, Homo sapiens
gaagaagtgtgtc

SEQ ID NO: 2746636 - DNA, 16 bp, Homo sapiens
gaagaattgccaatct

SEQ ID NO: 2746637 - DNA, 19 bp, Homo sapiens
gaagactgcattatattta

SEQ ID NO: 2746638 - DNA, 17 bp, Homo sapiens
gaaggagagagtctttt

SEQ ID NO: 2746639 - DNA, 19 bp, Homo sapiens
gaaggagagagtcttttaa

SEQ ID NO: 2746640 - DNA, 15 bp, Homo sapiens
gaaggctatggggat

SEQ ID NO: 2746641 - DNA, 18 bp, Homo sapiens
gaagggaattgtttttat

SEQ ID NO: 2746642 - DNA, 18 bp, Homo sapiens
gaaggtcccatggcctgc

SEQ ID NO: 2746643 - DNA, 21 bp, Homo sapiens
gaaggtcccatggcctgctgg

SEQ ID NO: 2746644 - DNA, 17 bp, Homo sapiens
gaagtcttcttatctaa

SEQ ID NO: 2746645 - DNA, 17 bp, Homo sapiens
gaagttacatgcataaa

SEQ ID NO: 2746646 - DNA, 18 bp, Homo sapiens
gaagttacatgcataaaa

SEQ ID NO: 2746647 - DNA, 22 bp, Homo sapiens
gaagttgctggttttgaatatt

SEQ ID NO: 2746648 - DNA, 16 bp, Homo sapiens
gaataaaaataaagtt

SEQ ID NO: 2746649 - DNA, 17 bp, Homo sapiens
gaataaaaataaagttt

SEQ ID NO: 2746650 - DNA, 17 bp, Homo sapiens
gaataaaagctgtggaa

SEQ ID NO: 2746651 - DNA, 17 bp, Homo sapiens
gaataaactagagaagg

SEQ ID NO: 2746652 - DNA, 20 bp, Homo sapiens
gaataagtgccaggatggaa

SEQ ID NO: 2746653 - DNA, 15 bp, Homo sapiens
gaatacaaacatttc

SEQ ID NO: 2746654 - DNA, 24 bp, Homo sapiens
gcattctatcgttattataaatgt

SEQ ID NO: 2746655 - DNA, 12 bp, Homo sapiens
gcatttagatgt

SEQ ID NO: 2746656 - DNA, 20 bp, Homo sapiens
gcattttaagtgtttaaaag

SEQ ID NO: 2746657 - DNA, 20 bp, Homo sapiens
gccaaacaccactttgtaaa

SEQ ID NO: 2746658 - DNA, 12 bp, Homo sapiens
gccaagagaagg

SEQ ID NO: 2746659 - DNA, 13 bp, Homo sapiens
gccaagagaaggg

SEQ ID NO: 2746660 - DNA, 14 bp, Homo sapiens
gccaagagaagggc

SEQ ID NO: 2746661 - DNA, 23 bp, Homo sapiens
gccaatcttgttttaagcaaatg

SEQ ID NO: 2746662 - DNA, 17 bp, Homo sapiens
gccacatacttgcagct

SEQ ID NO: 2746663 - DNA, 12 bp, Homo sapiens
gccacatcttga

SEQ ID NO: 2746664 - DNA, 20 bp, Homo sapiens
gccacatcttgaaaatgcca

SEQ ID NO: 2746665 - DNA, 19 bp, Homo sapiens
gccaccatccaataaaaat

SEQ ID NO: 2746666 - DNA, 21 bp, Homo sapiens
gccaccgggcatgtctgcctg

SEQ ID NO: 2746667 - DNA, 14 bp, Homo sapiens
gccaggactttgag

SEQ ID NO: 2746668 - DNA, 21 bp, Homo sapiens
gccagggcctgctgagttgct

SEQ ID NO: 2746669 - DNA, 21 bp, Homo sapiens
gccatcatgtttacagaggac

SEQ ID NO: 2746670 - DNA, 22 bp, Homo sapiens
gccatgtgctagtaattggaaa

SEQ ID NO: 2746671 - DNA, 17 bp, Homo sapiens
gccatttgttacagttt

SEQ ID NO: 2746672 - DNA, 23 bp, Homo sapiens
gccatttttcagtagcaggacct

SEQ ID NO: 2746673 - DNA, 22 bp, Homo sapiens
gcccacgcccttggagccttcc

SEQ ID NO: 2746674 - DNA, 18 bp, Homo sapiens
gcccccacccctggctac

SEQ ID NO: 2746675 - DNA, 11 bp, Homo sapiens
gcccctgggtt

SEQ ID NO: 2746676 - DNA, 15 bp, Homo sapiens
gcccgagcccctgcc

SEQ ID NO: 2746677 - DNA, 13 bp, Homo sapiens
gcccgcctgcccg

SEQ ID NO: 2746678 - DNA, 23 bp, Homo sapiens
gccctgttcctccctcccacact

SEQ ID NO: 2746679 - DNA, 14 bp, Homo sapiens
gcccttggagcctt

SEQ ID NO: 2746680 - DNA, 19 bp, Homo sapiens
gcccttggagccttccacc

SEQ ID NO: 2746681 - DNA, 13 bp, Homo sapiens
gccgagctggttt

SEQ ID NO: 2746682 - DNA, 17 bp, Homo sapiens
gccggaaggccgaggtc

SEQ ID NO: 2746683 - DNA, 12 bp, Homo sapiens
gccggaggaagg

SEQ ID NO: 2746684 - DNA, 17 bp, Homo sapiens
gcctaattttttaaaga

SEQ ID NO: 2746685 - DNA, 18 bp, Homo sapiens
gcctaattttttaaagaa

SEQ ID NO: 2746686 - DNA, 19 bp, Homo sapiens
gcctctcattccagaggaa

SEQ ID NO: 2746687 - DNA, 17 bp, Homo sapiens
gcctgcaaacctgctgg

SEQ ID NO: 2746688 - DNA, 21 bp, Homo sapiens
gcctgcaaacctgctggtggg

SEQ ID NO: 2746689 - DNA, 23 bp, Homo sapiens
gcctgcaaacctgctggtggggc

SEQ ID NO: 2746690 - DNA, 14 bp, Homo sapiens
gcctgcccagacaa

SEQ ID NO: 2746691 - DNA, 19 bp, Homo sapiens
gcctgcctgcaaacctgct

SEQ ID NO: 2746692 - DNA, 21 bp, Homo sapiens
gcctgctaaggaacaatgccg

SEQ ID NO: 2746693 - DNA, 13 bp, Homo sapiens
gcctgctgggctt

SEQ ID NO: 2746694 - DNA, 16 bp, Homo sapiens
gcctggagtgctgtgc

SEQ ID NO: 2746695 - DNA, 16 bp, Homo sapiens
gccttatttttgaatt

SEQ ID NO: 2746696 - DNA, 18 bp, Homo sapiens
gccttatttttgaattct

SEQ ID NO: 2746697 - DNA, 20 bp, Homo sapiens
gccttatttttgaattcttt

SEQ ID NO: 2746698 - DNA, 18 bp, Homo sapiens
gccttcaaatagtataga

SEQ ID NO: 2746699 - DNA, 17 bp, Homo sapiens
gccttccaccggcactc

SEQ ID NO: 2746700 - DNA, 19 bp, Homo sapiens
gccttccaccggcactcat

SEQ ID NO: 2746701 - DNA, 18 bp, Homo sapiens
gccttggggctgatgcag

SEQ ID NO: 2746702 - DNA, 17 bp, Homo sapiens
gccttttaaattctttt

SEQ ID NO: 2746703 - DNA, 17 bp, Homo sapiens
gcgcccccacccctggc

SEQ ID NO: 2746704 - DNA, 19 bp, Homo sapiens
gcgcccccacccctggcta

SEQ ID NO: 2746705 - DNA, 21 bp, Homo sapiens
gcgctgaggtgtctggcctga

SEQ ID NO: 2746706 - DNA, 14 bp, Homo sapiens
gcgtggaaaaagac

SEQ ID NO: 2746707 - DNA, 10 bp, Homo sapiens
gctaaacttg

SEQ ID NO: 2746708 - DNA, 20 bp, Homo sapiens
gctaaacttggctgtatgtc

SEQ ID NO: 2746709 - DNA, 17 bp, Homo sapiens
gctaaggaacaatgccg

SEQ ID NO: 2746710 - DNA, 22 bp, Homo sapiens
gctaattctttgacctgttggg

SEQ ID NO: 2746711 - DNA, 15 bp, Homo sapiens
gctaccttgtgggaa

SEQ ID NO: 2746712 - DNA, 17 bp, Homo sapiens
gctaccttgtgggaata

SEQ ID NO: 2746713 - DNA, 19 bp, Homo sapiens
gctagacaaggttgctgtt

SEQ ID NO: 2746714 - DNA, 20 bp, Homo sapiens
gctagacaaggttgctgttg

SEQ ID NO: 2746715 - DNA, 16 bp, Homo sapiens
gctagagttaaaagtt

SEQ ID NO: 2746716 - DNA, 14 bp, Homo sapiens
gctagatgtatgta

SEQ ID NO: 2746717 - DNA, 21 bp, Homo sapiens
gctagtaattggaaaggcagc

SEQ ID NO: 2746718 - DNA, 17 bp, Homo sapiens
gctatgagctggggatg

SEQ ID NO: 2746719 - DNA, 21 bp, Homo sapiens
gctatggggatagatgtgtgg

SEQ ID NO: 2746720 - DNA, 22 bp, Homo sapiens
gctattacttggcaaattctga

SEQ ID NO: 2746721 - DNA, 13 bp, Homo sapiens
gctccaaggcagt

SEQ ID NO: 2746722 - DNA, 22 bp, Homo sapiens
gctcggcgcccccacccctggc

SEQ ID NO: 2746723 - DNA, 23 bp, Homo sapiens
gctcggcgcccccacccctggct

SEQ ID NO: 2746724 - DNA, 14 bp, Homo sapiens
gctctgatgcagtg

SEQ ID NO: 2746725 - DNA, 20 bp, Homo sapiens
gctctgatgcagtgccctag

SEQ ID NO: 2746726 - DNA, 15 bp, Homo sapiens
gctgaggtgtctggc

SEQ ID NO: 2746727 - DNA, 18 bp, Homo sapiens
gctgaggtgtctggcctg

SEQ ID NO: 2746728 - DNA, 21 bp, Homo sapiens
gctgaggtgtctggcctgagg

SEQ ID NO: 2746729 - DNA, 22 bp, Homo sapiens
gctgctgtgcgtggaaaaagac

SEQ ID NO: 2746730 - DNA, 18 bp, Homo sapiens
gctgcttggtagcacttt

SEQ ID NO: 2746731 - DNA, 22 bp, Homo sapiens
gctgcttggtagcactttaaaa

SEQ ID NO: 2746732 - DNA, 21 bp, Homo sapiens
gctggaaaagtatgttagtgc

SEQ ID NO: 2746733 - DNA, 23 bp, Homo sapiens
gctggaaaagtatgttagtgcaa

SEQ ID NO: 2746734 - DNA, 13 bp, Homo sapiens
gctggatctgtga

SEQ ID NO: 2746735 - DNA, 22 bp, Homo sapiens
gctgggcttggcagcccgggtc

SEQ ID NO: 2746736 - DNA, 13 bp, Homo sapiens
gctgggtttgctg

SEQ ID NO: 2746737 - DNA, 18 bp, Homo sapiens
gctgggtttgctgtcttg

SEQ ID NO: 2746738 - DNA, 23 bp, Homo sapiens
gctggtttatttgttgttttctg

SEQ ID NO: 2746739 - DNA, 22 bp, Homo sapiens
gctggtttcctgcccagcctgg

SEQ ID NO: 2746740 - DNA, 20 bp, Homo sapiens
gctgtagacatttgctatga

SEQ ID NO: 2746741 - DNA, 20 bp, Homo sapiens
gctgtattttaaaagaatga

SEQ ID NO: 2746742 - DNA, 22 bp, Homo sapiens
gctgtattttaaaagaatgatt

SEQ ID NO: 2746743 - DNA, 18 bp, Homo sapiens
gctgtccttgaatgccat

SEQ ID NO: 2746744 - DNA, 16 bp, Homo sapiens
gcttgtgtatcttgat

SEQ ID NO: 2746745 - DNA, 20 bp, Homo sapiens
gcttgtgtatcttgattaat

SEQ ID NO: 2746746 - DNA, 18 bp, Homo sapiens
gcttgttccaatgccaca

SEQ ID NO: 2746747 - DNA, 13 bp, Homo sapiens
gctttaaaaagaa

SEQ ID NO: 2746748 - DNA, 13 bp, Homo sapiens
gctttaattgtgt

SEQ ID NO: 2746749 - DNA, 16 bp, Homo sapiens
ggaaaatatacaagta

SEQ ID NO: 2746750 - DNA, 19 bp, Homo sapiens
ggaaaattaattctaaact

SEQ ID NO: 2746751 - DNA, 21 bp, Homo sapiens
ggaaaggatgatcaaaaataa

SEQ ID NO: 2746752 - DNA, 21 bp, Homo sapiens
ggaaataccaggaccagttta

SEQ ID NO: 2746753 - DNA, 15 bp, Homo sapiens
ggaacagtgacaata

SEQ ID NO: 2746754 - DNA, 14 bp, Homo sapiens
ggaactgctgggct

SEQ ID NO: 2746755 - DNA, 15 bp, Homo sapiens
ggaactgctgggctt

SEQ ID NO: 2746756 - DNA, 20 bp, Homo sapiens
ggaactgctgggcttggcag

SEQ ID NO: 2746757 - DNA, 14 bp, Homo sapiens
ggaaggccgaggtc

SEQ ID NO: 2746758 - DNA, 16 bp, Homo sapiens
ggaatgaagcttttta

SEQ ID NO: 2746759 - DNA, 18 bp, Homo sapiens
ggacagtatttgtgggga

SEQ ID NO: 2746760 - DNA, 19 bp, Homo sapiens
ggacagtatttgtggggag

SEQ ID NO: 2746761 - DNA, 15 bp, Homo sapiens
tctctagcctctttg

SEQ ID NO: 2746762 - DNA, 13 bp, Homo sapiens
tctctaggaaata

SEQ ID NO: 2746763 - DNA, 16 bp, Homo sapiens
tctctagtagttaaaa

SEQ ID NO: 2746764 - DNA, 21 bp, Homo sapiens
tctgaaattcacagaagccta

SEQ ID NO: 2746765 - DNA, 16 bp, Homo sapiens
tctgaatacaaacatt

SEQ ID NO: 2746766 - DNA, 13 bp, Homo sapiens
tctgaatctgaag

SEQ ID NO: 2746767 - DNA, 18 bp, Homo sapiens
tctgactttttgtttctt

SEQ ID NO: 2746768 - DNA, 14 bp, Homo sapiens
tctgaggtaagtgt

SEQ ID NO: 2746769 - DNA, 14 bp, Homo sapiens
atagtcaaattgtg

SEQ ID NO: 2746770 - DNA, 12 bp, Homo sapiens
atagttctgtta

SEQ ID NO: 2746771 - DNA, 19 bp, Homo sapiens
atagttctgttaaatattt

SEQ ID NO: 2746772 - DNA, 20 bp, Homo sapiens
atagttctgttaaatatttt

SEQ ID NO: 2746773 - DNA, 17 bp, Homo sapiens
atagttgaaagtaaaaa

SEQ ID NO: 2746774 - DNA, 15 bp, Homo sapiens
atagttgcttttgaa

SEQ ID NO: 2746775 - DNA, 20 bp, Homo sapiens
atagttgcttttgaaggaat

SEQ ID NO: 2746776 - DNA, 21 bp, Homo sapiens
atagttgcttttgaaggaata

SEQ ID NO: 2746777 - DNA, 17 bp, Homo sapiens
atataacaatgctgtat

SEQ ID NO: 2746778 - DNA, 23 bp, Homo sapiens
atataatctgaatcctgttaaat

SEQ ID NO: 2746779 - DNA, 19 bp, Homo sapiens
atatacaagtaaattctgt

SEQ ID NO: 2746780 - DNA, 13 bp, Homo sapiens
atatacacatttt

SEQ ID NO: 2746781 - DNA, 16 bp, Homo sapiens
atatacacattttgta

SEQ ID NO: 2746782 - DNA, 19 bp, Homo sapiens
atatacacattttgtaaat

SEQ ID NO: 2746783 - DNA, 23 bp, Homo sapiens
atatacacattttgtaaatctgt

SEQ ID NO: 2746784 - DNA, 16 bp, Homo sapiens
atatagctggcaagaa

SEQ ID NO: 2746785 - DNA, 14 bp, Homo sapiens
atatagttgaaagt

SEQ ID NO: 2746786 - DNA, 19 bp, Homo sapiens
atatataacaatgctgtat

SEQ ID NO: 2746787 - DNA, 14 bp, Homo sapiens
atatatcctatttg

SEQ ID NO: 2746788 - DNA, 17 bp, Homo sapiens
atatatgaatattacat

SEQ ID NO: 2746789 - DNA, 15 bp, Homo sapiens
atatatggcatttgc

SEQ ID NO: 2746790 - DNA, 23 bp, Homo sapiens
atatcatgctaaaattctataga

SEQ ID NO: 2746791 - DNA, 20 bp, Homo sapiens
atatccataaaattggatta

SEQ ID NO: 2746792 - DNA, 23 bp, Homo sapiens
atatccttctggctgtagataaa

SEQ ID NO: 2746793 - DNA, 16 bp, Homo sapiens
atatctatattctaaa

SEQ ID NO: 2746794 - DNA, 13 bp, Homo sapiens
atatgagaagaat

SEQ ID NO: 2746795 - DNA, 15 bp, Homo sapiens
atatgagaagaatag

SEQ ID NO: 2746796 - DNA, 16 bp, Homo sapiens
atatggcatttgcaga

SEQ ID NO: 2746797 - DNA, 23 bp, Homo sapiens
atatgtccagaagagtcaaagta

SEQ ID NO: 2746798 - DNA, 17 bp, Homo sapiens
atatgtttattcaaaat

SEQ ID NO: 2746799 - DNA, 13 bp, Homo sapiens
atattaagctaaa

SEQ ID NO: 2746800 - DNA, 17 bp, Homo sapiens
atattacatgtaaagct

SEQ ID NO: 2746801 - DNA, 18 bp, Homo sapiens
atattacatgtaaagctg

SEQ ID NO: 2746802 - DNA, 17 bp, Homo sapiens
atattggtattaaagaa

SEQ ID NO: 2746803 - DNA, 22 bp, Homo sapiens
atattggtattaaagaatgctg

SEQ ID NO: 2746804 - DNA, 19 bp, Homo sapiens
atattgtcctaagtgtcaa

SEQ ID NO: 2746805 - DNA, 14 bp, Homo sapiens
atattgtttgctaa

SEQ ID NO: 2746806 - DNA, 19 bp, Homo sapiens
atatttattactgtaagaa

SEQ ID NO: 2746807 - DNA, 22 bp, Homo sapiens
atatttattactgtaagaaaat

SEQ ID NO: 2746808 - DNA, 17 bp, Homo sapiens
atatttattttaataat

SEQ ID NO: 2746809 - DNA, 13 bp, Homo sapiens
atatttgaaatat

SEQ ID NO: 2746810 - DNA, 15 bp, Homo sapiens
atatttgtaaggctt

SEQ ID NO: 2746811 - DNA, 19 bp, Homo sapiens
atattttatcaaggaagtc

SEQ ID NO: 2746812 - DNA, 14 bp, Homo sapiens
atattttatctttt

SEQ ID NO: 2746813 - DNA, 17 bp, Homo sapiens
atcaaggaagtcttcaa

SEQ ID NO: 2746814 - DNA, 16 bp, Homo sapiens
atcaagggtacactgc

SEQ ID NO: 2746815 - DNA, 11 bp, Homo sapiens
atcagaataaa

SEQ ID NO: 2746816 - DNA, 14 bp, Homo sapiens
atcagagtatctga

SEQ ID NO: 2746817 - DNA, 13 bp, Homo sapiens
atcagcttattgt

SEQ ID NO: 2746818 - DNA, 17 bp, Homo sapiens
atcagggttagtattgt

SEQ ID NO: 2746819 - DNA, 23 bp, Homo sapiens
atcagtggaactcaatatatagt

SEQ ID NO: 2746820 - DNA, 17 bp, Homo sapiens
atcatgaattagtttta

SEQ ID NO: 2746821 - DNA, 15 bp, Homo sapiens
atcatgctaaaattc

SEQ ID NO: 2746822 - DNA, 17 bp, Homo sapiens
atcatgctaaaattcta

SEQ ID NO: 2746823 - DNA, 18 bp, Homo sapiens
atcatgtttacagaggac

SEQ ID NO: 2746824 - DNA, 12 bp, Homo sapiens
atcattcatctt

SEQ ID NO: 2746825 - DNA, 21 bp, Homo sapiens
atcattcatcttcttctttaa

SEQ ID NO: 2746826 - DNA, 21 bp, Homo sapiens
atccaataaaaatcaggagcc

SEQ ID NO: 2746827 - DNA, 23 bp, Homo sapiens
atccaataaaaatcaggagcctg

SEQ ID NO: 2746828 - DNA, 17 bp, Homo sapiens
atccaccaaactcctgc

SEQ ID NO: 2746829 - DNA, 18 bp, Homo sapiens
atccagcagtacaataaa

SEQ ID NO: 2746830 - DNA, 23 bp, Homo sapiens
atccataaaattggattacagta

SEQ ID NO: 2746831 - DNA, 14 bp, Homo sapiens
atccatacatttgt

SEQ ID NO: 2746832 - DNA, 19 bp, Homo sapiens
atccatagcacctccacat

SEQ ID NO: 2746833 - DNA, 23 bp, Homo sapiens
aaccattggggaggactaggacc

SEQ ID NO: 2746834 - DNA, 21 bp, Homo sapiens
aacctacaaaagcttgtgtat

SEQ ID NO: 2746835 - DNA, 17 bp, Homo sapiens
aacctattttgaaaggt

SEQ ID NO: 2746836 - DNA, 16 bp, Homo sapiens
aacgtttaacattgat

SEQ ID NO: 2746837 - DNA, 15 bp, Homo sapiens
aactaagttattgct

SEQ ID NO: 2746838 - DNA, 14 bp, Homo sapiens
aactataaatacaa

SEQ ID NO: 2746839 - DNA, 13 bp, Homo sapiens
aactatattgttt

SEQ ID NO: 2746840 - DNA, 22 bp, Homo sapiens
aactatcctatgccttcaaata

SEQ ID NO: 2746841 - DNA, 13 bp, Homo sapiens
aactcaggcattt

SEQ ID NO: 2746842 - DNA, 21 bp, Homo sapiens
aactccagaaagtgacaagct

SEQ ID NO: 2746843 - DNA, 20 bp, Homo sapiens
aactgaaatcatacttctta

SEQ ID NO: 2746844 - DNA, 16 bp, Homo sapiens
aactgaaggtgcagtt

SEQ ID NO: 2746845 - DNA, 15 bp, Homo sapiens
aactgactcttaaga

SEQ ID NO: 2746846 - DNA, 19 bp, Homo sapiens
aactgactcttaagaagac

SEQ ID NO: 2746847 - DNA, 21 bp, Homo sapiens
aactgcatttttaatcagtgg

SEQ ID NO: 2746848 - DNA, 21 bp, Homo sapiens
aactggtctgttaatcttttt

SEQ ID NO: 2746849 - DNA, 15 bp, Homo sapiens
aactggtgatataaa

SEQ ID NO: 2746850 - DNA, 19 bp, Homo sapiens
aactggtgatataaagaat

SEQ ID NO: 2746851 - DNA, 21 bp, Homo sapiens
aactgttcttcattagatgtt

SEQ ID NO: 2746852 - DNA, 15 bp, Homo sapiens
aacttaaatatttga

SEQ ID NO: 2746853 - DNA, 18 bp, Homo sapiens
aacttttttctttgaaat

SEQ ID NO: 2746854 - DNA, 22 bp, Homo sapiens
aagaaagtctatctaatgacat

SEQ ID NO: 2746855 - DNA, 13 bp, Homo sapiens
aagaactgaaatc

SEQ ID NO: 2746856 - DNA, 22 bp, Homo sapiens
aagaagcaccaatcatgaatta

SEQ ID NO: 2746857 - DNA, 20 bp, Homo sapiens
aagaatagcctagatatgaa

SEQ ID NO: 2746858 - DNA, 16 bp, Homo sapiens
aagaatccaagacaaa

SEQ ID NO: 2746859 - DNA, 12 bp, Homo sapiens
aagaatgaaagt

SEQ ID NO: 2746860 - DNA, 16 bp, Homo sapiens
aagaatgattatgaat

SEQ ID NO: 2746861 - DNA, 17 bp, Homo sapiens
aagaatgctgcaacttt

SEQ ID NO: 2746862 - DNA, 23 bp, Homo sapiens
aagaatgtgctagagttaaaagt

SEQ ID NO: 2746863 - DNA, 20 bp, Homo sapiens
aagaattaccaagagaaggg

SEQ ID NO: 2746864 - DNA, 22 bp, Homo sapiens
aagaattaccaagagaagggga

SEQ ID NO: 2746865 - DNA, 13 bp, Homo sapiens
aagacaaactaaa

SEQ ID NO: 2746866 - DNA, 15 bp, Homo sapiens
aagactcctttcctg

SEQ ID NO: 2746867 - DNA, 19 bp, Homo sapiens
aatattggtattaaagaat

SEQ ID NO: 2746868 - DNA, 18 bp, Homo sapiens
aatatttattttaataat

SEQ ID NO: 2746869 - DNA, 15 bp, Homo sapiens
aatatttcagataat

SEQ ID NO: 2746870 - DNA, 21 bp, Homo sapiens
aatatttgaaaattaccttta

SEQ ID NO: 2746871 - DNA, 13 bp, Homo sapiens
aatcacaatacat

SEQ ID NO: 2746872 - DNA, 17 bp, Homo sapiens
aatcacttaacattcct

SEQ ID NO: 2746873 - DNA, 18 bp, Homo sapiens
aatcacttaacattccta

SEQ ID NO: 2746874 - DNA, 14 bp, Homo sapiens
aatcaggagcctgc

SEQ ID NO: 2746875 - DNA, 21 bp, Homo sapiens
aatcagggttagtattgtcca

SEQ ID NO: 2746876 - DNA, 22 bp, Homo sapiens
aatcagggttagtattgtccag

SEQ ID NO: 2746877 - DNA, 22 bp, Homo sapiens
aatccaagacaaactaaacttt

SEQ ID NO: 2746878 - DNA, 16 bp, Homo sapiens
aatccacacatatata

SEQ ID NO: 2746879 - DNA, 13 bp, Homo sapiens
aatccatacattt

SEQ ID NO: 2746880 - DNA, 13 bp, Homo sapiens
aatccttgaagat

SEQ ID NO: 2746881 - DNA, 17 bp, Homo sapiens
aatcgagactgcaatgt

SEQ ID NO: 2746882 - DNA, 20 bp, Homo sapiens
aatctccaactttattttga

SEQ ID NO: 2746883 - DNA, 19 bp, Homo sapiens
aatctcctgagttgtataa

SEQ ID NO: 2746884 - DNA, 20 bp, Homo sapiens
aatctcctgagttgtataaa

SEQ ID NO: 2746885 - DNA, 20 bp, Homo sapiens
aatctctagcctctttgtgt

SEQ ID NO: 2746886 - DNA, 18 bp, Homo sapiens
aatctgtacttttttcaa

SEQ ID NO: 2746887 - DNA, 21 bp, Homo sapiens
aatctgtacttttttcaaata

SEQ ID NO: 2746888 - DNA, 14 bp, Homo sapiens
aatctgtataaatg

SEQ ID NO: 2746889 - DNA, 21 bp, Homo sapiens
aatctgtataaatgtctatta

SEQ ID NO: 2746890 - DNA, 15 bp, Homo sapiens
aatcttaaatcagaa

SEQ ID NO: 2746891 - DNA, 16 bp, Homo sapiens
aatcttaaatcagaat

SEQ ID NO: 2746892 - DNA, 21 bp, Homo sapiens
aatcttaaatcagaataaatt

SEQ ID NO: 2746893 - DNA, 15 bp, Homo sapiens
aatcttggtgtaact

SEQ ID NO: 2746894 - DNA, 17 bp, Homo sapiens
accatgcaaagcaacga

SEQ ID NO: 2746895 - DNA, 22 bp, Homo sapiens
acccagctatggttctctcgca

SEQ ID NO: 2746896 - DNA, 17 bp, Homo sapiens
accccgccggaggaagg

SEQ ID NO: 2746897 - DNA, 14 bp, Homo sapiens
acccctggctacct

SEQ ID NO: 2746898 - DNA, 13 bp, Homo sapiens
acccctttaaact

SEQ ID NO: 2746899 - DNA, 16 bp, Homo sapiens
acccctttaaactgtc

SEQ ID NO: 2746900 - DNA, 12 bp, Homo sapiens
accgaataaatg

SEQ ID NO: 2746901 - DNA, 14 bp, Homo sapiens
acctacaaaagctt

SEQ ID NO: 2746902 - DNA, 19 bp, Homo sapiens
acctacaaaagcttgtgta

SEQ ID NO: 2746903 - DNA, 21 bp, Homo sapiens
acctagggtgatattaaccag

SEQ ID NO: 2746904 - DNA, 14 bp, Homo sapiens
acctattttgaaag

SEQ ID NO: 2746905 - DNA, 19 bp, Homo sapiens
acctattttgaaaggtcag

SEQ ID NO: 2746906 - DNA, 22 bp, Homo sapiens
acctattttgaaaggtcagaat

SEQ ID NO: 2746907 - DNA, 18 bp, Homo sapiens
acctctgcctcagaaaac

SEQ ID NO: 2746908 - DNA, 13 bp, Homo sapiens
acctgctggtggg

SEQ ID NO: 2746909 - DNA, 18 bp, Homo sapiens
acctgctggtggggcaga

SEQ ID NO: 2746910 - DNA, 13 bp, Homo sapiens
acctgtgctggag

SEQ ID NO: 2746911 - DNA, 14 bp, Homo sapiens
acctgtgctggagc

SEQ ID NO: 2746912 - DNA, 23 bp, Homo sapiens
acctgtgctggagccctgttcct

SEQ ID NO: 2746913 - DNA, 16 bp, Homo sapiens
accttaaggaaaagta

SEQ ID NO: 2746914 - DNA, 13 bp, Homo sapiens
accttgtgggaat

SEQ ID NO: 2746915 - DNA, 20 bp, Homo sapiens
acctttaatgcaatgcatat

SEQ ID NO: 2746916 - DNA, 15 bp, Homo sapiens
acctttcaaaatgga

SEQ ID NO: 2746917 - DNA, 22 bp, Homo sapiens
acctttctaagggaaaaagttg

SEQ ID NO: 2746918 - DNA, 20 bp, Homo sapiens
accttttggtctggagggaa

SEQ ID NO: 2746919 - DNA, 14 bp, Homo sapiens
acgactactttgct

SEQ ID NO: 2746920 - DNA, 21 bp, Homo sapiens
acgactcttttccaaacacag

SEQ ID NO: 2746921 - DNA, 15 bp, Homo sapiens
acgcccttggagcct

SEQ ID NO: 2746922 - DNA, 15 bp, Homo sapiens
actaagttattgctg

SEQ ID NO: 2746923 - DNA, 20 bp, Homo sapiens
actaagttattgctgcataa

SEQ ID NO: 2746924 - DNA, 21 bp, Homo sapiens
actaagttattgctgcataaa

SEQ ID NO: 2746925 - DNA, 14 bp, Homo sapiens
actactgaactgtt

SEQ ID NO: 2746926 - DNA, 16 bp, Homo sapiens
actactgaactgttac

SEQ ID NO: 2746927 - DNA, 15 bp, Homo sapiens
actactggtctgtac

SEQ ID NO: 2746928 - DNA, 12 bp, Homo sapiens
actagagaaggg

SEQ ID NO: 2746929 - DNA, 18 bp, Homo sapiens
actagtatttctatgaaa

SEQ ID NO: 2746930 - DNA, 16 bp, Homo sapiens
actataaatacaaatc

SEQ ID NO: 2746931 - DNA, 19 bp, Homo sapiens
actataaatacaaatctgt

SEQ ID NO: 2746932 - DNA, 15 bp, Homo sapiens
actatctcatttcca

SEQ ID NO: 2746933 - DNA, 13 bp, Homo sapiens
actatgaatttgt

SEQ ID NO: 2746934 - DNA, 14 bp, Homo sapiens
actatgaatttgtc

SEQ ID NO: 2746935 - DNA, 15 bp, Homo sapiens
actattaattccatg

SEQ ID NO: 2746936 - DNA, 18 bp, Homo sapiens
actattatagaaattctg

SEQ ID NO: 2746937 - DNA, 15 bp, Homo sapiens
actcaatatatagtt

SEQ ID NO: 2746938 - DNA, 22 bp, Homo sapiens
actcaggctttcagctgtgctt

SEQ ID NO: 2746939 - DNA, 17 bp, Homo sapiens
actcatgacggcctgcc

SEQ ID NO: 2746940 - DNA, 14 bp, Homo sapiens
actccagaaagtga

SEQ ID NO: 2746941 - DNA, 16 bp, Homo sapiens
actcctgcctgagaat

SEQ ID NO: 2746942 - DNA, 19 bp, Homo sapiens
actccttggatttgcattt

SEQ ID NO: 2746943 - DNA, 23 bp, Homo sapiens
actccttggatttgcatttttgt

SEQ ID NO: 2746944 - DNA, 17 bp, Homo sapiens
actcctttcctgcatct

SEQ ID NO: 2746945 - DNA, 15 bp, Homo sapiens
actcgccatctcctg

SEQ ID NO: 2746946 - DNA, 19 bp, Homo sapiens
actcgccatctcctgggcc

SEQ ID NO: 2746947 - DNA, 19 bp, Homo sapiens
actcgttaatttgtagtgt

SEQ ID NO: 2746948 - DNA, 21 bp, Homo sapiens
actctctagttttatcttaaa

SEQ ID NO: 2746949 - DNA, 20 bp, Homo sapiens
actctgtatttaggccattt

SEQ ID NO: 2746950 - DNA, 20 bp, Homo sapiens
actcttaagaagactgcatt

SEQ ID NO: 2746951 - DNA, 21 bp, Homo sapiens
actcttttccaaacacaggca

SEQ ID NO: 2746952 - DNA, 14 bp, Homo sapiens
actgactcttaaga

SEQ ID NO: 2746953 - DNA, 16 bp, Homo sapiens
actgactcttaagaag

SEQ ID NO: 2746954 - DNA, 22 bp, Homo sapiens
actgatgcgacttgttttgctg

SEQ ID NO: 2746955 - DNA, 13 bp, Homo sapiens
actgattttcaaa

SEQ ID NO: 2746956 - DNA, 19 bp, Homo sapiens
actgattttcaaaaaaatg

SEQ ID NO: 2746957 - DNA, 20 bp, Homo sapiens
actgcatcttagtttactgg

SEQ ID NO: 2746958 - DNA, 14 bp, Homo sapiens
actgcattatattt

SEQ ID NO: 2746959 - DNA, 20 bp, Homo sapiens
actgccttctcaactccaaa

SEQ ID NO: 2746960 - DNA, 17 bp, Homo sapiens
actggataaatttaaaa

SEQ ID NO: 2746961 - DNA, 16 bp, Homo sapiens
actgggctgggtttgc

SEQ ID NO: 2746962 - DNA, 18 bp, Homo sapiens
actgggctgggtttgctg

SEQ ID NO: 2746963 - DNA, 13 bp, Homo sapiens
actggtctgtact

SEQ ID NO: 2746964 - DNA, 19 bp, Homo sapiens
actggtgatataaagaatg

SEQ ID NO: 2746965 - DNA, 18 bp, Homo sapiens
actggtttgactctgtcc

SEQ ID NO: 2746966 - DNA, 20 bp, Homo sapiens
actgtgaagttacatgcata

SEQ ID NO: 2746967 - DNA, 22 bp, Homo sapiens
actgtgaagttacatgcataaa

SEQ ID NO: 2746968 - DNA, 18 bp, Homo sapiens
actgtgggtagacacaca

SEQ ID NO: 2746969 - DNA, 19 bp, Homo sapiens
acttcaaatccttgaagat

SEQ ID NO: 2746970 - DNA, 20 bp, Homo sapiens
acttcaagatcctcttgcca

SEQ ID NO: 2746971 - DNA, 19 bp, Homo sapiens
acttcagcggtttatataa

SEQ ID NO: 2746972 - DNA, 12 bp, Homo sapiens
acttcccagccc

SEQ ID NO: 2746973 - DNA, 13 bp, Homo sapiens
acttctcttccag

SEQ ID NO: 2746974 - DNA, 20 bp, Homo sapiens
acttgaggccaggactttga

SEQ ID NO: 2746975 - DNA, 17 bp, Homo sapiens
acttggcaaattctgag

SEQ ID NO: 2746976 - DNA, 14 bp, Homo sapiens
acttggctgtatgt

SEQ ID NO: 2746977 - DNA, 22 bp, Homo sapiens
acttggctgtatgtcaaattgt

SEQ ID NO: 2746978 - DNA, 12 bp, Homo sapiens
actttagaattc

SEQ ID NO: 2746979 - DNA, 12 bp, Homo sapiens
actttattttga

SEQ ID NO: 2746980 - DNA, 13 bp, Homo sapiens
actttattttgaa

SEQ ID NO: 2746981 - DNA, 16 bp, Homo sapiens
actttgctacgaagaa

SEQ ID NO: 2746982 - DNA, 13 bp, Homo sapiens
actttggctgatt

SEQ ID NO: 2746983 - DNA, 16 bp, Homo sapiens
acttttctctacttta

SEQ ID NO: 2746984 - DNA, 22 bp, Homo sapiens
actttttatggcactagtattt

SEQ ID NO: 2746985 - DNA, 15 bp, Homo sapiens
acttttttcaaatat

SEQ ID NO: 2746986 - DNA, 17 bp, Homo sapiens
agaaaagcacttaaagt

SEQ ID NO: 2746987 - DNA, 22 bp, Homo sapiens
agaaaatggaaaatatacaagt

SEQ ID NO: 2746988 - DNA, 16 bp, Homo sapiens
agaaacacaactatat

SEQ ID NO: 2746989 - DNA, 11 bp, Homo sapiens
agaaagctaat

SEQ ID NO: 2746990 - DNA, 15 bp, Homo sapiens
agaaagctaatacaa

SEQ ID NO: 2746991 - DNA, 22 bp, Homo sapiens
agaaaggctaacaaattttaag

SEQ ID NO: 2746992 - DNA, 15 bp, Homo sapiens
agaaagtaaaaaagg

SEQ ID NO: 2746993 - DNA, 14 bp, Homo sapiens
agaaagtaaaacca

SEQ ID NO: 2746994 - DNA, 19 bp, Homo sapiens
agaaatttaatcagtgtga

SEQ ID NO: 2746995 - DNA, 22 bp, Homo sapiens
agaacattcttatattttatca

SEQ ID NO: 2746996 - DNA, 21 bp, Homo sapiens
agaacctacaaaagcttgtgt

SEQ ID NO: 2746997 - DNA, 22 bp, Homo sapiens
agaacctacaaaagcttgtgta

SEQ ID NO: 2746998 - DNA, 23 bp, Homo sapiens
agaacctacaaaagcttgtgtat

SEQ ID NO: 2746999 - DNA, 22 bp, Homo sapiens
agaactgatgcgacttgttttg

SEQ ID NO: 2747000 - DNA, 17 bp, Homo sapiens
agaactggtgatataaa

SEQ ID NO: 2747001 - DNA, 19 bp, Homo sapiens
agaactggtgatataaaga

SEQ ID NO: 2747002 - DNA, 21 bp, Homo sapiens
agaagaactgaaatcatactt

SEQ ID NO: 2747003 - DNA, 17 bp, Homo sapiens
agtatgtggaagtgtgg

SEQ ID NO: 2747004 - DNA, 19 bp, Homo sapiens
agtattgagctttgcattt

SEQ ID NO: 2747005 - DNA, 13 bp, Homo sapiens
agtattgtagaaa

SEQ ID NO: 2747006 - DNA, 15 bp, Homo sapiens
agtattgtagaaagc

SEQ ID NO: 2747007 - DNA, 17 bp, Homo sapiens
agtattgtagaaagcta

SEQ ID NO: 2747008 - DNA, 19 bp, Homo sapiens
agtattgtagaaagctaat

SEQ ID NO: 2747009 - DNA, 20 bp, Homo sapiens
agtattgtagaaagctaata

SEQ ID NO: 2747010 - DNA, 15 bp, Homo sapiens
agtattgtccaggtc

SEQ ID NO: 2747011 - DNA, 15 bp, Homo sapiens
agtatttctatgaaa

SEQ ID NO: 2747012 - DNA, 18 bp, Homo sapiens
agtatttctatgaaatat

SEQ ID NO: 2747013 - DNA, 13 bp, Homo sapiens
agtatttgctgtt

SEQ ID NO: 2747014 - DNA, 17 bp, Homo sapiens
agtcaaattgtgtgaaa

SEQ ID NO: 2747015 - DNA, 20 bp, Homo sapiens
agtcaccattcttctttttt

SEQ ID NO: 2747016 - DNA, 16 bp, Homo sapiens
agtcaggaaagagaac

SEQ ID NO: 2747017 - DNA, 14 bp, Homo sapiens
agtccaatcagtgg

SEQ ID NO: 2747018 - DNA, 19 bp, Homo sapiens
agtcctgaacctttcaaaa

SEQ ID NO: 2747019 - DNA, 21 bp, Homo sapiens
agtcctgactgggctgggttt

SEQ ID NO: 2747020 - DNA, 18 bp, Homo sapiens
agtccttcagtttagaac

SEQ ID NO: 2747021 - DNA, 20 bp, Homo sapiens
agtgaaactcgttaatttgt

SEQ ID NO: 2747022 - DNA, 15 bp, Homo sapiens
agtgaagcatttaaa

SEQ ID NO: 2747023 - DNA, 16 bp, Homo sapiens
agtgaagcatttaaaa

SEQ ID NO: 2747024 - DNA, 18 bp, Homo sapiens
agtgaagcatttaaaaga

SEQ ID NO: 2747025 - DNA, 21 bp, Homo sapiens
agtgagcagtcaggaaagaga

SEQ ID NO: 2747026 - DNA, 14 bp, Homo sapiens
agtgcaaattgtca

SEQ ID NO: 2747027 - DNA, 17 bp, Homo sapiens
agtgcaagagactttgt

SEQ ID NO: 2747028 - DNA, 23 bp, Homo sapiens
agtgcaagagactttgtcactta

SEQ ID NO: 2747029 - DNA, 18 bp, Homo sapiens
agtgccacaggttttaag

SEQ ID NO: 2747030 - DNA, 19 bp, Homo sapiens
agtgctgtgctgtgtttaa

SEQ ID NO: 2747031 - DNA, 18 bp, Homo sapiens
agtggaactcaatatata

SEQ ID NO: 2747032 - DNA, 22 bp, Homo sapiens
agtggaactcaatatatagtta

SEQ ID NO: 2747033 - DNA, 21 bp, Homo sapiens
agtggatttttttgtcattaa

SEQ ID NO: 2747034 - DNA, 15 bp, Homo sapiens
agtgtgggtctgtgt

SEQ ID NO: 2747035 - DNA, 17 bp, Homo sapiens
agtgtgggtctgtgtgt

SEQ ID NO: 2747036 - DNA, 19 bp, Homo sapiens
agtgtgggtctgtgtgtgt

SEQ ID NO: 2747037 - DNA, 14 bp, Homo sapiens
agtgttggagaaga

SEQ ID NO: 2747038 - DNA, 17 bp, Homo sapiens
agtgttggagaagaact

SEQ ID NO: 2747039 - DNA, 18 bp, Homo sapiens
agtgttggagaagaactg

SEQ ID NO: 2747040 - DNA, 23 bp, Homo sapiens
agtgttggtttaatattacctaa

SEQ ID NO: 2747041 - DNA, 12 bp, Homo sapiens
agtgtttaaaag

SEQ ID NO: 2747042 - DNA, 15 bp, Homo sapiens
agttaaaacagctat

SEQ ID NO: 2747043 - DNA, 22 bp, Homo sapiens
agttaaaacagctattttagta

SEQ ID NO: 2747044 - DNA, 23 bp, Homo sapiens
agttactgtgagccatattacta

SEQ ID NO: 2747045 - DNA, 18 bp, Homo sapiens
agttacttgctataaata

SEQ ID NO: 2747046 - DNA, 22 bp, Homo sapiens
agttacttgctataaatagatt

SEQ ID NO: 2747047 - DNA, 23 bp, Homo sapiens
agttacttgctataaatagattt

SEQ ID NO: 2747048 - DNA, 19 bp, Homo sapiens
agttagcattgtttctaga

SEQ ID NO: 2747049 - DNA, 13 bp, Homo sapiens
agttagctttatt

SEQ ID NO: 2747050 - DNA, 23 bp, Homo sapiens
agttattgctgcataaatttgta

SEQ ID NO: 2747051 - DNA, 16 bp, Homo sapiens
agttcaggaatttttg

SEQ ID NO: 2747052 - DNA, 14 bp, Homo sapiens
agttctgaagaaga

SEQ ID NO: 2747053 - DNA, 15 bp, Homo sapiens
agttctgaagaagat

SEQ ID NO: 2747054 - DNA, 12 bp, Homo sapiens
agttgaaagtaa

SEQ ID NO: 2747055 - DNA, 14 bp, Homo sapiens
agttgaaagtaaaa

SEQ ID NO: 2747056 - DNA, 14 bp, Homo sapiens
agttgtttaataag

SEQ ID NO: 2747057 - DNA, 23 bp, Homo sapiens
agtttagaacctacaaaagcttg

SEQ ID NO: 2747058 - DNA, 15 bp, Homo sapiens
agtttagctggaaaa

SEQ ID NO: 2747059 - DNA, 16 bp, Homo sapiens
agtttcaattgagtaa

SEQ ID NO: 2747060 - DNA, 20 bp, Homo sapiens
agtttcaattgagtaattct

SEQ ID NO: 2747061 - DNA, 17 bp, Homo sapiens
agtttcttcatgcatta

SEQ ID NO: 2747062 - DNA, 17 bp, Homo sapiens
agttttatcttaaactg

SEQ ID NO: 2747063 - DNA, 17 bp, Homo sapiens
agttttggttatttcta

SEQ ID NO: 2747064 - DNA, 21 bp, Homo sapiens
agttttggttatttctaaacc

SEQ ID NO: 2747065 - DNA, 12 bp, Homo sapiens
agttttgtttat

SEQ ID NO: 2747066 - DNA, 15 bp, Homo sapiens
agttttgtttatgca

SEQ ID NO: 2747067 - DNA, 23 bp, Homo sapiens
agtttttaactctactgtgtaat

SEQ ID NO: 2747068 - DNA, 17 bp, Homo sapiens
agttttttatatatgaa

SEQ ID NO: 2747069 - DNA, 20 bp, Homo sapiens
agtttttttggtgctataac

SEQ ID NO: 2747070 - DNA, 20 bp, Homo sapiens
agttttttttttgtttgttt

SEQ ID NO: 2747071 - DNA, 16 bp, Homo sapiens
ataaaaatcaggagcc

SEQ ID NO: 2747072 - DNA, 15 bp, Homo sapiens
ataaaagctattact

SEQ ID NO: 2747073 - DNA, 17 bp, Homo sapiens
ataaaagctattacttg

SEQ ID NO: 2747074 - DNA, 19 bp, Homo sapiens
ataaaatccatacatttgt

SEQ ID NO: 2747075 - DNA, 11 bp, Homo sapiens
ataaaattgga

SEQ ID NO: 2747076 - DNA, 18 bp, Homo sapiens
ataaaattggattacagt

SEQ ID NO: 2747077 - DNA, 19 bp, Homo sapiens
ataaaattggattacagta

SEQ ID NO: 2747078 - DNA, 16 bp, Homo sapiens
ataaactagagaaggg

SEQ ID NO: 2747079 - DNA, 16 bp, Homo sapiens
ataaagaatgaaagta

SEQ ID NO: 2747080 - DNA, 23 bp, Homo sapiens
ataaatacaaatctgtataaatg

SEQ ID NO: 2747081 - DNA, 13 bp, Homo sapiens
ataaatagattta

SEQ ID NO: 2747082 - DNA, 15 bp, Homo sapiens
ataaatagatttagt

SEQ ID NO: 2747083 - DNA, 17 bp, Homo sapiens
ataaatagatttagtct

SEQ ID NO: 2747084 - DNA, 22 bp, Homo sapiens
ataaatgagacccctttaaact

SEQ ID NO: 2747085 - DNA, 23 bp, Homo sapiens
ataaatgagacccctttaaactg

SEQ ID NO: 2747086 - DNA, 21 bp, Homo sapiens
ataaatgtctattattatgaa

SEQ ID NO: 2747087 - DNA, 23 bp, Homo sapiens
ataaatgttagttctagctctat

SEQ ID NO: 2747088 - DNA, 14 bp, Homo sapiens
ataaatgttgaaaa

SEQ ID NO: 2747089 - DNA, 16 bp, Homo sapiens
ataaattaatattgta

SEQ ID NO: 2747090 - DNA, 16 bp, Homo sapiens
ataaatttaaaacaca

SEQ ID NO: 2747091 - DNA, 22 bp, Homo sapiens
ataaatttgtaatatatcctgt

SEQ ID NO: 2747092 - DNA, 13 bp, Homo sapiens
ataaatttttgtc

SEQ ID NO: 2747093 - DNA, 15 bp, Homo sapiens
ataaatttttgtctt

SEQ ID NO: 2747094 - DNA, 17 bp, Homo sapiens
ataacaatgctgtattt

SEQ ID NO: 2747095 - DNA, 13 bp, Homo sapiens
ataacattctgac

SEQ ID NO: 2747096 - DNA, 13 bp, Homo sapiens
ataactaaaattc

SEQ ID NO: 2747097 - DNA, 12 bp, Homo sapiens
ataactggaaac

SEQ ID NO: 2747098 - DNA, 23 bp, Homo sapiens
ataacttcagtgcaagagacttt

SEQ ID NO: 2747099 - DNA, 23 bp, Homo sapiens
ataataagacttttctctacttt

SEQ ID NO: 2747100 - DNA, 14 bp, Homo sapiens
ataatctttcacag

SEQ ID NO: 2747101 - DNA, 20 bp, Homo sapiens
ataatgttggtgtggagttt

SEQ ID NO: 2747102 - DNA, 19 bp, Homo sapiens
ataattccttaaaattttc

SEQ ID NO: 2747103 - DNA, 20 bp, Homo sapiens
ataattgagactgaaagaaa

SEQ ID NO: 2747104 - DNA, 14 bp, Homo sapiens
ataattttgtgaag

SEQ ID NO: 2747105 - DNA, 23 bp, Homo sapiens
atacaaaactatcctatgccttc

SEQ ID NO: 2747106 - DNA, 14 bp, Homo sapiens
atacaaatctgtat

SEQ ID NO: 2747107 - DNA, 16 bp, Homo sapiens
atacaaatctgtataa

SEQ ID NO: 2747108 - DNA, 22 bp, Homo sapiens
atacaaatctgtataaatgtct

SEQ ID NO: 2747109 - DNA, 24 bp, Homo sapiens
atacaaatctgtataaatgtctat

SEQ ID NO: 2747110 - DNA, 19 bp, Homo sapiens
atacaaatgggaattcact

SEQ ID NO: 2747111 - DNA, 17 bp, Homo sapiens
atacaagtaaattctgt

SEQ ID NO: 2747112 - DNA, 16 bp, Homo sapiens
atacaatatatagctg

SEQ ID NO: 2747113 - DNA, 14 bp, Homo sapiens
atacacattttgta

SEQ ID NO: 2747114 - DNA, 17 bp, Homo sapiens
atacacattttgtaaat

SEQ ID NO: 2747115 - DNA, 19 bp, Homo sapiens
atacacattttgtaaatct

SEQ ID NO: 2747116 - DNA, 23 bp, Homo sapiens
atacatgaataaaaataaagttt

SEQ ID NO: 2747117 - DNA, 15 bp, Homo sapiens
ataccctgtctttaa

SEQ ID NO: 2747118 - DNA, 15 bp, Homo sapiens
atacctcaggaaaga

SEQ ID NO: 2747119 - DNA, 21 bp, Homo sapiens
atacctcaggaaagaatagaa

SEQ ID NO: 2747120 - DNA, 14 bp, Homo sapiens
atactgattttcaa

SEQ ID NO: 2747121 - DNA, 15 bp, Homo sapiens
atactgattttcaaa

SEQ ID NO: 2747122 - DNA, 22 bp, Homo sapiens
atactgattttcaaaaaaatgt

SEQ ID NO: 2747123 - DNA, 19 bp, Homo sapiens
atactgtgaagttacatgc

SEQ ID NO: 2747124 - DNA, 20 bp, Homo sapiens
atactgtgaagttacatgca

SEQ ID NO: 2747125 - DNA, 21 bp, Homo sapiens
atagaaaatggaaaatataca

SEQ ID NO: 2747126 - DNA, 22 bp, Homo sapiens
atagaaaatggaaaatatacaa

SEQ ID NO: 2747127 - DNA, 12 bp, Homo sapiens
atagaaattctg

SEQ ID NO: 2747128 - DNA, 13 bp, Homo sapiens
atagaataaaagc

SEQ ID NO: 2747129 - DNA, 14 bp, Homo sapiens
atagatgtgtggac

SEQ ID NO: 2747130 - DNA, 22 bp, Homo sapiens
atagcacatccaccaaactcct

SEQ ID NO: 2747131 - DNA, 16 bp, Homo sapiens
atagctggcaagaatg

SEQ ID NO: 2747132 - DNA, 18 bp, Homo sapiens
agaatgtgctagagttaa

SEQ ID NO: 2747133 - DNA, 17 bp, Homo sapiens
agaatgttaccagactt

SEQ ID NO: 2747134 - DNA, 18 bp, Homo sapiens
agaattaccaagagaagg

SEQ ID NO: 2747135 - DNA, 14 bp, Homo sapiens
agaattgccaatct

SEQ ID NO: 2747136 - DNA, 19 bp, Homo sapiens
agacaactggtctgttaat

SEQ ID NO: 2747137 - DNA, 21 bp, Homo sapiens
agacatttgctatgagctggg

SEQ ID NO: 2747138 - DNA, 14 bp, Homo sapiens
agactcctttcctg

SEQ ID NO: 2747139 - DNA, 21 bp, Homo sapiens
agactcctttcctgcatcttt

SEQ ID NO: 2747140 - DNA, 23 bp, Homo sapiens
agactcctttcctgcatctttca

SEQ ID NO: 2747141 - DNA, 15 bp, Homo sapiens
agactcgatgcaagt

SEQ ID NO: 2747142 - DNA, 19 bp, Homo sapiens
agactctctagttttatct

SEQ ID NO: 2747143 - DNA, 17 bp, Homo sapiens
agactttgtcacttatt

SEQ ID NO: 2747144 - DNA, 17 bp, Homo sapiens
agagaacttccagatcc

SEQ ID NO: 2747145 - DNA, 15 bp, Homo sapiens
agagaatgagagaca

SEQ ID NO: 2747146 - DNA, 20 bp, Homo sapiens
agagacacactgaagaagca

SEQ ID NO: 2747147 - DNA, 20 bp, Homo sapiens
agagactttgtcacttattt

SEQ ID NO: 2747148 - DNA, 15 bp, Homo sapiens
agagagtcttttaac

SEQ ID NO: 2747149 - DNA, 22 bp, Homo sapiens
agagagtcttttaactttagaa

SEQ ID NO: 2747150 - DNA, 13 bp, Homo sapiens
agagcagttcaag

SEQ ID NO: 2747151 - DNA, 17 bp, Homo sapiens
agagctacttctaatta

SEQ ID NO: 2747152 - DNA, 19 bp, Homo sapiens
agaggacagaatggatata

SEQ ID NO: 2747153 - DNA, 22 bp, Homo sapiens
agagggactgttcttttgtccc

SEQ ID NO: 2747154 - DNA, 18 bp, Homo sapiens
agagtatctgaagggaat

SEQ ID NO: 2747155 - DNA, 22 bp, Homo sapiens
agagtcaaagtagttagttttg

SEQ ID NO: 2747156 - DNA, 14 bp, Homo sapiens
agagttaaaagtta

SEQ ID NO: 2747157 - DNA, 21 bp, Homo sapiens
agagtttcttctcatatccat

SEQ ID NO: 2747158 - DNA, 17 bp, Homo sapiens
agagtttttaatagaac

SEQ ID NO: 2747159 - DNA, 22 bp, Homo sapiens
agatatcccagctttaaaaaga

SEQ ID NO: 2747160 - DNA, 22 bp, Homo sapiens
agatcctcttgccacatcttga

SEQ ID NO: 2747161 - DNA, 14 bp, Homo sapiens
agatgcagaaaaag

SEQ ID NO: 2747162 - DNA, 15 bp, Homo sapiens
agatgcagaaaaaga

SEQ ID NO: 2747163 - DNA, 17 bp, Homo sapiens
agatgcagttctgaaga

SEQ ID NO: 2747164 - DNA, 18 bp, Homo sapiens
agatgcagttctgaagaa

SEQ ID NO: 2747165 - DNA, 20 bp, Homo sapiens
agatgcagttctgaagaaga

SEQ ID NO: 2747166 - DNA, 21 bp, Homo sapiens
agatgcagttctgaagaagat

SEQ ID NO: 2747167 - DNA, 15 bp, Homo sapiens
agatgtttatttaga

SEQ ID NO: 2747168 - DNA, 20 bp, Homo sapiens
agatgtttatttagaaactg

SEQ ID NO: 2747169 - DNA, 16 bp, Homo sapiens
agattctttaaactac

SEQ ID NO: 2747170 - DNA, 18 bp, Homo sapiens
agattctttaaactactg

SEQ ID NO: 2747171 - DNA, 22 bp, Homo sapiens
agattctttaaactactgaact

SEQ ID NO: 2747172 - DNA, 15 bp, Homo sapiens
agattttcctgaaaa

SEQ ID NO: 2747173 - DNA, 13 bp, Homo sapiens
agatttttaaatt

SEQ ID NO: 2747174 - DNA, 17 bp, Homo sapiens
agatttttaaattggag

SEQ ID NO: 2747175 - DNA, 22 bp, Homo sapiens
agatttttatattagttgcttt

SEQ ID NO: 2747176 - DNA, 15 bp, Homo sapiens
agcaaaatttttaaa

SEQ ID NO: 2747177 - DNA, 23 bp, Homo sapiens
agcaaaattttttctctaggaaa

SEQ ID NO: 2747178 - DNA, 19 bp, Homo sapiens
agcaataccctgtctttaa

SEQ ID NO: 2747179 - DNA, 17 bp, Homo sapiens
agcacatccaccaaact

SEQ ID NO: 2747180 - DNA, 22 bp, Homo sapiens
agcacatccaccaaactcctgc

SEQ ID NO: 2747181 - DNA, 16 bp, Homo sapiens
agcaccaatcatgaat

SEQ ID NO: 2747182 - DNA, 12 bp, Homo sapiens
agcacttaaagt

SEQ ID NO: 2747183 - DNA, 20 bp, Homo sapiens
agcactttaaaaaatttttt

SEQ ID NO: 2747184 - DNA, 14 bp, Homo sapiens
agcagtacaataaa

SEQ ID NO: 2747185 - DNA, 15 bp, Homo sapiens
agcagtacaataaaa

SEQ ID NO: 2747186 - DNA, 23 bp, Homo sapiens
agcataaatgttgacatgggaca

SEQ ID NO: 2747187 - DNA, 18 bp, Homo sapiens
agcatcagagcccttttg

SEQ ID NO: 2747188 - DNA, 15 bp, Homo sapiens
agcattgtttctaga

SEQ ID NO: 2747189 - DNA, 22 bp, Homo sapiens
agcatttagatgtataggttga

SEQ ID NO: 2747190 - DNA, 20 bp, Homo sapiens
agccatatcatgctaaaatt

SEQ ID NO: 2747191 - DNA, 17 bp, Homo sapiens
agccctgttcctccctc

SEQ ID NO: 2747192 - DNA, 17 bp, Homo sapiens
agcctaggaggactggg

SEQ ID NO: 2747193 - DNA, 14 bp, Homo sapiens
agcctgctaaggaa

SEQ ID NO: 2747194 - DNA, 18 bp, Homo sapiens
agccttccaccggcactc

SEQ ID NO: 2747195 - DNA, 12 bp, Homo sapiens
agcggaataaac

SEQ ID NO: 2747196 - DNA, 21 bp, Homo sapiens
agctagaatccacacatatat

SEQ ID NO: 2747197 - DNA, 23 bp, Homo sapiens
agctattacttggcaaattctga

SEQ ID NO: 2747198 - DNA, 13 bp, Homo sapiens
agctcccattcta

SEQ ID NO: 2747199 - DNA, 17 bp, Homo sapiens
agctctccatctattga

SEQ ID NO: 2747200 - DNA, 14 bp, Homo sapiens
agctgcactgttta

SEQ ID NO: 2747201 - DNA, 23 bp, Homo sapiens
agctgcactgtttatggaaatac

SEQ ID NO: 2747202 - DNA, 14 bp, Homo sapiens
agctgtatgattcc

SEQ ID NO: 2747203 - DNA, 18 bp, Homo sapiens
agctgtatgattcccagc

SEQ ID NO: 2747204 - DNA, 18 bp, Homo sapiens
agcttcatcggggtggtg

SEQ ID NO: 2747205 - DNA, 14 bp, Homo sapiens
agctttaaaaagaa

SEQ ID NO: 2747206 - DNA, 15 bp, Homo sapiens
agctttaaaaagaaa

SEQ ID NO: 2747207 - DNA, 14 bp, Homo sapiens
agctttattgaagt

SEQ ID NO: 2747208 - DNA, 19 bp, Homo sapiens
aggaaagagaacttccaga

SEQ ID NO: 2747209 - DNA, 13 bp, Homo sapiens
aggaaatatttat

SEQ ID NO: 2747210 - DNA, 21 bp, Homo sapiens
aggaactcgcacctgtgctgg

SEQ ID NO: 2747211 - DNA, 22 bp, Homo sapiens
aggaaggtcccatggcctgctg

SEQ ID NO: 2747212 - DNA, 15 bp, Homo sapiens
aggaagtcttcaaat

SEQ ID NO: 2747213 - DNA, 14 bp, Homo sapiens
aggacactgatatg

SEQ ID NO: 2747214 - DNA, 17 bp, Homo sapiens
aggacagaatggatata

SEQ ID NO: 2747215 - DNA, 22 bp, Homo sapiens
aggactcttccatcagagatgg

SEQ ID NO: 2747216 - DNA, 12 bp, Homo sapiens
aggagcctgcta

SEQ ID NO: 2747217 - DNA, 16 bp, Homo sapiens
aggaggctgaggtggc

SEQ ID NO: 2747218 - DNA, 21 bp, Homo sapiens
aggagtccctgccatcatgtt

SEQ ID NO: 2747219 - DNA, 23 bp, Homo sapiens
aggatggttcccttgatgaagaa

SEQ ID NO: 2747220 - DNA, 18 bp, Homo sapiens
aggcaaatccgaaatcag

SEQ ID NO: 2747221 - DNA, 18 bp, Homo sapiens
aggccatttgttacagtt

SEQ ID NO: 2747222 - DNA, 23 bp, Homo sapiens
aggcgacgcggttttttcacttc

SEQ ID NO: 2747223 - DNA, 19 bp, Homo sapiens
aggcgggaggatcacttga

SEQ ID NO: 2747224 - DNA, 15 bp, Homo sapiens
aggctagatgtatgt

SEQ ID NO: 2747225 - DNA, 22 bp, Homo sapiens
aggctatggggatagatgtgtg

SEQ ID NO: 2747226 - DNA, 17 bp, Homo sapiens
aggctcccaaactcagg

SEQ ID NO: 2747227 - DNA, 14 bp, Homo sapiens
aggctgaggtggca

SEQ ID NO: 2747228 - DNA, 18 bp, Homo sapiens
agggaataaatttttgtc

SEQ ID NO: 2747229 - DNA, 19 bp, Homo sapiens
agggaataaatttttgtct

SEQ ID NO: 2747230 - DNA, 12 bp, Homo sapiens
agggctggtttg

SEQ ID NO: 2747231 - DNA, 16 bp, Homo sapiens
agggctggtttgttct

SEQ ID NO: 2747232 - DNA, 16 bp, Homo sapiens
aggggaattgaggaca

SEQ ID NO: 2747233 - DNA, 15 bp, Homo sapiens
aggtcagaattttgt

SEQ ID NO: 2747234 - DNA, 22 bp, Homo sapiens
aggtcccatggcctgctgggct

SEQ ID NO: 2747235 - DNA, 23 bp, Homo sapiens
aggtcccatggcctgctgggctt

SEQ ID NO: 2747236 - DNA, 17 bp, Homo sapiens
aggtcttacattgcctg

SEQ ID NO: 2747237 - DNA, 13 bp, Homo sapiens
aggtgtctggcct

SEQ ID NO: 2747238 - DNA, 14 bp, Homo sapiens
aggtgtctggcctg

SEQ ID NO: 2747239 - DNA, 19 bp, Homo sapiens
aggttaatcagagtatctg

SEQ ID NO: 2747240 - DNA, 16 bp, Homo sapiens
aggttaatttttcctt

SEQ ID NO: 2747241 - DNA, 16 bp, Homo sapiens
aggtttccactattat

SEQ ID NO: 2747242 - DNA, 11 bp, Homo sapiens
agtaaaatatg

SEQ ID NO: 2747243 - DNA, 13 bp, Homo sapiens
agtaatgataact

SEQ ID NO: 2747244 - DNA, 14 bp, Homo sapiens
agtacaataaaagt

SEQ ID NO: 2747245 - DNA, 19 bp, Homo sapiens
agtagataggccatgggca

SEQ ID NO: 2747246 - DNA, 13 bp, Homo sapiens
agtagcaggacct

SEQ ID NO: 2747247 - DNA, 21 bp, Homo sapiens
agtatctgaagggaattgttt

SEQ ID NO: 2747248 - DNA, 14 bp, Homo sapiens
atttgtataaaata

SEQ ID NO: 2747249 - DNA, 15 bp, Homo sapiens
atttgtccatttaaa

SEQ ID NO: 2747250 - DNA, 20 bp, Homo sapiens
atttgtccatttaaaaatga

SEQ ID NO: 2747251 - DNA, 17 bp, Homo sapiens
attttaaaagaatgatt

SEQ ID NO: 2747252 - DNA, 11 bp, Homo sapiens
attttaagtgc

SEQ ID NO: 2747253 - DNA, 16 bp, Homo sapiens
attttaagtgtttaaa

SEQ ID NO: 2747254 - DNA, 20 bp, Homo sapiens
attttaagtgtttaaaagca

SEQ ID NO: 2747255 - DNA, 14 bp, Homo sapiens
attttaataatgtt

SEQ ID NO: 2747256 - DNA, 16 bp, Homo sapiens
attttaataatgtttc

SEQ ID NO: 2747257 - DNA, 16 bp, Homo sapiens
attttcaaaaaaatgt

SEQ ID NO: 2747258 - DNA, 13 bp, Homo sapiens
attttcattctga

SEQ ID NO: 2747259 - DNA, 22 bp, Homo sapiens
cagaaatttaccacaaaagcaa

SEQ ID NO: 2747260 - DNA, 14 bp, Homo sapiens
cagaacagcttcat

SEQ ID NO: 2747261 - DNA, 22 bp, Homo sapiens
cagaataaattaatattgtatt

SEQ ID NO: 2747262 - DNA, 13 bp, Homo sapiens
cagaatatacaca

SEQ ID NO: 2747263 - DNA, 16 bp, Homo sapiens
cagaatatacacattt

SEQ ID NO: 2747264 - DNA, 23 bp, Homo sapiens
cagaatatacacattttgtaaat

SEQ ID NO: 2747265 - DNA, 24 bp, Homo sapiens
cagaatatacacattttgtaaatc

SEQ ID NO: 2747266 - DNA, 12 bp, Homo sapiens
cagaatggatat

SEQ ID NO: 2747267 - DNA, 20 bp, Homo sapiens
cagaatggatataatctgaa

SEQ ID NO: 2747268 - DNA, 23 bp, Homo sapiens
cagactcgatgcaagtgtttctg

SEQ ID NO: 2747269 - DNA, 14 bp, Homo sapiens
cagagatgggaaaa

SEQ ID NO: 2747270 - DNA, 17 bp, Homo sapiens
cagagcccttttgctat

SEQ ID NO: 2747271 - DNA, 14 bp, Homo sapiens
cagatcctggaaat

SEQ ID NO: 2747272 - DNA, 14 bp, Homo sapiens
cagcaaaacagatt

SEQ ID NO: 2747273 - DNA, 19 bp, Homo sapiens
cagcatgtatagttgcttt

SEQ ID NO: 2747274 - DNA, 22 bp, Homo sapiens
cagccatttttcagtagcagga

SEQ ID NO: 2747275 - DNA, 20 bp, Homo sapiens
cagcccttctttccacagaa

SEQ ID NO: 2747276 - DNA, 16 bp, Homo sapiens
cagcctagttgatcag

SEQ ID NO: 2747277 - DNA, 13 bp, Homo sapiens
cagctaagcaata

SEQ ID NO: 2747278 - DNA, 20 bp, Homo sapiens
cagctgtatgattcccagcc

SEQ ID NO: 2747279 - DNA, 14 bp, Homo sapiens
cagcttattgtcta

SEQ ID NO: 2747280 - DNA, 12 bp, Homo sapiens
caggaaagaata

SEQ ID NO: 2747281 - DNA, 13 bp, Homo sapiens
caggaaagaatag

SEQ ID NO: 2747282 - DNA, 16 bp, Homo sapiens
caggaaagagaacttc

SEQ ID NO: 2747283 - DNA, 22 bp, Homo sapiens
caggaactcgcacctgtgctgg

SEQ ID NO: 2747284 - DNA, 14 bp, Homo sapiens
caggacaaggggca

SEQ ID NO: 2747285 - DNA, 21 bp, Homo sapiens
caggagtccctgccatcatgt

SEQ ID NO: 2747286 - DNA, 23 bp, Homo sapiens
caggatggttcccttgatgaaga

SEQ ID NO: 2747287 - DNA, 14 bp, Homo sapiens
caggcccctgggtt

SEQ ID NO: 2747288 - DNA, 19 bp, Homo sapiens
caggctagatgtatgtact

SEQ ID NO: 2747289 - DNA, 18 bp, Homo sapiens
caggctcccaaactcagg

SEQ ID NO: 2747290 - DNA, 15 bp, Homo sapiens
caggctctgcccagg

SEQ ID NO: 2747291 - DNA, 13 bp, Homo sapiens
cagggctggtttg

SEQ ID NO: 2747292 - DNA, 13 bp, Homo sapiens
cagggctgtgcac

SEQ ID NO: 2747293 - DNA, 11 bp, Homo sapiens
caggggacagg

SEQ ID NO: 2747294 - DNA, 23 bp, Homo sapiens
caggggatacaggcccctgggtt

SEQ ID NO: 2747295 - DNA, 20 bp, Homo sapiens
cagtagccaaacaccacttt

SEQ ID NO: 2747296 - DNA, 15 bp, Homo sapiens
cagtatttgtgggga

SEQ ID NO: 2747297 - DNA, 18 bp, Homo sapiens
cagtcaggaaagagaact

SEQ ID NO: 2747298 - DNA, 22 bp, Homo sapiens
cagtctttaatctgagaggcca

SEQ ID NO: 2747299 - DNA, 19 bp, Homo sapiens
cagtgcaagagactttgtc

SEQ ID NO: 2747300 - DNA, 18 bp, Homo sapiens
cagtgccctagaagggga

SEQ ID NO: 2747301 - DNA, 17 bp, Homo sapiens
cagtggaactcaatata

SEQ ID NO: 2747302 - DNA, 20 bp, Homo sapiens
cagtggctggatctgtgagg

SEQ ID NO: 2747303 - DNA, 21 bp, Homo sapiens
cagtgtgacagaaaaaaaaat

SEQ ID NO: 2747304 - DNA, 16 bp, Homo sapiens
cagttctgaagaagat

SEQ ID NO: 2747305 - DNA, 18 bp, Homo sapiens
cagtttagaacctacaaa

SEQ ID NO: 2747306 - DNA, 21 bp, Homo sapiens
cagtttagaacctacaaaagc

SEQ ID NO: 2747307 - DNA, 13 bp, Homo sapiens
cagtttatgtttg

SEQ ID NO: 2747308 - DNA, 15 bp, Homo sapiens
cagtttcttcatgca

SEQ ID NO: 2747309 - DNA, 16 bp, Homo sapiens
cagtttcttcatgcat

SEQ ID NO: 2747310 - DNA, 19 bp, Homo sapiens
cataaaagggtcaaacctg

SEQ ID NO: 2747311 - DNA, 19 bp, Homo sapiens
cataaatttgtaatatatc

SEQ ID NO: 2747312 - DNA, 20 bp, Homo sapiens
cataactggtttgactctgt

SEQ ID NO: 2747313 - DNA, 15 bp, Homo sapiens
cataacttcagtgca

SEQ ID NO: 2747314 - DNA, 18 bp, Homo sapiens
cataatcacaacccttca

SEQ ID NO: 2747315 - DNA, 13 bp, Homo sapiens
catagttctgtta

SEQ ID NO: 2747316 - DNA, 20 bp, Homo sapiens
catatataacaatgctgtat

SEQ ID NO: 2747317 - DNA, 18 bp, Homo sapiens
catatgtttattcaaaat

SEQ ID NO: 2747318 - DNA, 19 bp, Homo sapiens
catattttttatatctgga

SEQ ID NO: 2747319 - DNA, 23 bp, Homo sapiens
catcaatagtgtcctatgcaata

SEQ ID NO: 2747320 - DNA, 15 bp, Homo sapiens
catcattgttgtgta

SEQ ID NO: 2747321 - DNA, 22 bp, Homo sapiens
catccaataaaaatcaggagcc

SEQ ID NO: 2747322 - DNA, 19 bp, Homo sapiens
catctaatttaatattcct

SEQ ID NO: 2747323 - DNA, 16 bp, Homo sapiens
catctgtgcagggctg

SEQ ID NO: 2747324 - DNA, 21 bp, Homo sapiens
catctttcatagttctgttaa

SEQ ID NO: 2747325 - DNA, 13 bp, Homo sapiens
catgaataaaaat

SEQ ID NO: 2747326 - DNA, 20 bp, Homo sapiens
catgaataaaaataaagttt

SEQ ID NO: 2747327 - DNA, 16 bp, Homo sapiens
catgaattagttttat

SEQ ID NO: 2747328 - DNA, 15 bp, Homo sapiens
catgacagaatatac

SEQ ID NO: 2747329 - DNA, 17 bp, Homo sapiens
catgacggcctgcctgc

SEQ ID NO: 2747330 - DNA, 14 bp, Homo sapiens
catgatgtttagaa

SEQ ID NO: 2747331 - DNA, 15 bp, Homo sapiens
catgctctgatgcag

SEQ ID NO: 2747332 - DNA, 24 bp, Homo sapiens
catgctctgatgcagtgccctaga

SEQ ID NO: 2747333 - DNA, 20 bp, Homo sapiens
catggaattggagctcgtgg

SEQ ID NO: 2747334 - DNA, 13 bp, Homo sapiens
catggcctgctgg

SEQ ID NO: 2747335 - DNA, 14 bp, Homo sapiens
catggcctgctggg

SEQ ID NO: 2747336 - DNA, 19 bp, Homo sapiens
catggggctgattgtattt

SEQ ID NO: 2747337 - DNA, 20 bp, Homo sapiens
catgtatagttgcttttgaa

SEQ ID NO: 2747338 - DNA, 14 bp, Homo sapiens
catgtctgcctgga

SEQ ID NO: 2747339 - DNA, 23 bp, Homo sapiens
catgtctgcctggagtgctgtgc

SEQ ID NO: 2747340 - DNA, 16 bp, Homo sapiens
catgttggttgcactt

SEQ ID NO: 2747341 - DNA, 15 bp, Homo sapiens
cattaaaattgttac

SEQ ID NO: 2747342 - DNA, 17 bp, Homo sapiens
cattaactcaggcattt

SEQ ID NO: 2747343 - DNA, 13 bp, Homo sapiens
cattagaaaggct

SEQ ID NO: 2747344 - DNA, 21 bp, Homo sapiens
cattcagctgaggttcattac

SEQ ID NO: 2747345 - DNA, 22 bp, Homo sapiens
cattctatcgttattataaatg

SEQ ID NO: 2747346 - DNA, 18 bp, Homo sapiens
cattcttatattttatca

SEQ ID NO: 2747347 - DNA, 21 bp, Homo sapiens
cattcttcttttttgtaaaaa

SEQ ID NO: 2747348 - DNA, 18 bp, Homo sapiens
cattgttggcgctgaggt

SEQ ID NO: 2747349 - DNA, 19 bp, Homo sapiens
cattgttggcgctgaggtg

SEQ ID NO: 2747350 - DNA, 14 bp, Homo sapiens
cattgttgtgtata

SEQ ID NO: 2747351 - DNA, 14 bp, Homo sapiens
catttaaaagagta

SEQ ID NO: 2747352 - DNA, 17 bp, Homo sapiens
catttacctctaaattt

SEQ ID NO: 2747353 - DNA, 19 bp, Homo sapiens
catttgaaaaaaagttatt

SEQ ID NO: 2747354 - DNA, 14 bp, Homo sapiens
catttgctcatgga

SEQ ID NO: 2747355 - DNA, 15 bp, Homo sapiens
catttgctcatggaa

SEQ ID NO: 2747356 - DNA, 20 bp, Homo sapiens
catttggaattagtggattt

SEQ ID NO: 2747357 - DNA, 17 bp, Homo sapiens
catttgtataaaataat

SEQ ID NO: 2747358 - DNA, 16 bp, Homo sapiens
cattttgtaaatctgt

SEQ ID NO: 2747359 - DNA, 19 bp, Homo sapiens
catttttcagtagcaggac

SEQ ID NO: 2747360 - DNA, 13 bp, Homo sapiens
catttttgtattt

SEQ ID NO: 2747361 - DNA, 16 bp, Homo sapiens
catttttgtattttgt

SEQ ID NO: 2747362 - DNA, 23 bp, Homo sapiens
ccaaaaagatgctttaattgtgt

SEQ ID NO: 2747363 - DNA, 14 bp, Homo sapiens
ccaaacacaggcaa

SEQ ID NO: 2747364 - DNA, 18 bp, Homo sapiens
ccaaacaccactttgtaa

SEQ ID NO: 2747365 - DNA, 23 bp, Homo sapiens
tcaagatcctcttgccacatctt

SEQ ID NO: 2747366 - DNA, 14 bp, Homo sapiens
tcaaggaagtcttc

SEQ ID NO: 2747367 - DNA, 23 bp, Homo sapiens
tcaagtcctgactgggctgggtt

SEQ ID NO: 2747368 - DNA, 21 bp, Homo sapiens
tcaatagtgtcctatgcaata

SEQ ID NO: 2747369 - DNA, 22 bp, Homo sapiens
tcaattgagtaattctagacat

SEQ ID NO: 2747370 - DNA, 17 bp, Homo sapiens
tcacagaagcctaggag

SEQ ID NO: 2747371 - DNA, 19 bp, Homo sapiens
tcacagttggcacttctgc

SEQ ID NO: 2747372 - DNA, 14 bp, Homo sapiens
tcacctcatggaat

SEQ ID NO: 2747373 - DNA, 13 bp, Homo sapiens
tcactagtctttg

SEQ ID NO: 2747374 - DNA, 20 bp, Homo sapiens
tcacttaacattcctaaaat

SEQ ID NO: 2747375 - DNA, 19 bp, Homo sapiens
tcacttcccgagcgctggt

SEQ ID NO: 2747376 - DNA, 22 bp, Homo sapiens
tcagaataaattaatattgtat

SEQ ID NO: 2747377 - DNA, 12 bp, Homo sapiens
tcaggaaagaat

SEQ ID NO: 2747378 - DNA, 20 bp, Homo sapiens
tcaggaaagaatagaaagaa

SEQ ID NO: 2747379 - DNA, 13 bp, Homo sapiens
tcaggaaagagaa

SEQ ID NO: 2747380 - DNA, 13 bp, Homo sapiens
tcaggagcctgct

SEQ ID NO: 2747381 - DNA, 17 bp, Homo sapiens
tcaggagcctgctaagg

SEQ ID NO: 2747382 - DNA, 21 bp, Homo sapiens
tcaggagcctgctaaggaaca

SEQ ID NO: 2747383 - DNA, 15 bp, Homo sapiens
tcaggccgaaggagg

SEQ ID NO: 2747384 - DNA, 13 bp, Homo sapiens
tcaggctagatgt

SEQ ID NO: 2747385 - DNA, 17 bp, Homo sapiens
tcaggctagatgtatgt

SEQ ID NO: 2747386 - DNA, 15 bp, Homo sapiens
tcagtgcaagagact

SEQ ID NO: 2747387 - DNA, 22 bp, Homo sapiens
tcagtgcaagagactttgtcac

SEQ ID NO: 2747388 - DNA, 24 bp, Homo sapiens
tcagtgcaagagactttgtcactt

SEQ ID NO: 2747389 - DNA, 16 bp, Homo sapiens
tcataaatttatggtt

SEQ ID NO: 2747390 - DNA, 13 bp, Homo sapiens
tcataatggcctg

SEQ ID NO: 2747391 - DNA, 21 bp, Homo sapiens
tcatatccataaaattggatt

SEQ ID NO: 2747392 - DNA, 20 bp, Homo sapiens
tcatatgtttattcaaaata

SEQ ID NO: 2747393 - DNA, 16 bp, Homo sapiens
tcatcttcttctttaa

SEQ ID NO: 2747394 - DNA, 16 bp, Homo sapiens
tcatgaattagtttta

SEQ ID NO: 2747395 - DNA, 21 bp, Homo sapiens
tcatgaattagttttatatgc

SEQ ID NO: 2747396 - DNA, 22 bp, Homo sapiens
tcatgaattagttttatatgct

SEQ ID NO: 2747397 - DNA, 18 bp, Homo sapiens
tcatgacggcctgcctgc

SEQ ID NO: 2747398 - DNA, 20 bp, Homo sapiens
tcatgacggcctgcctgcaa

SEQ ID NO: 2747399 - DNA, 22 bp, Homo sapiens
tcatgatagaaggctatgggga

SEQ ID NO: 2747400 - DNA, 15 bp, Homo sapiens
tcatgctaaaattct

SEQ ID NO: 2747401 - DNA, 12 bp, Homo sapiens
tcattagaaagg

SEQ ID NO: 2747402 - DNA, 15 bp, Homo sapiens
tcattagaaaggcta

SEQ ID NO: 2747403 - DNA, 12 bp, Homo sapiens
tcatttacaatt

SEQ ID NO: 2747404 - DNA, 13 bp, Homo sapiens
tcatttccaagca

SEQ ID NO: 2747405 - DNA, 12 bp, Homo sapiens
tccaagtgtata

SEQ ID NO: 2747406 - DNA, 19 bp, Homo sapiens
tccacagaagctccaggta

SEQ ID NO: 2747407 - DNA, 13 bp, Homo sapiens
tccaccaaactcc

SEQ ID NO: 2747408 - DNA, 22 bp, Homo sapiens
tccactattatagaaattctga

SEQ ID NO: 2747409 - DNA, 21 bp, Homo sapiens
tccagttcaggaatttttgtt

SEQ ID NO: 2747410 - DNA, 12 bp, Homo sapiens
tccatacatttg

SEQ ID NO: 2747411 - DNA, 17 bp, Homo sapiens
tccatatccttctggct

SEQ ID NO: 2747412 - DNA, 22 bp, Homo sapiens
tccatcagagatgggaaaacca

SEQ ID NO: 2747413 - DNA, 23 bp, Homo sapiens
tcccaaaaagatgctttaattgt

SEQ ID NO: 2747414 - DNA, 17 bp, Homo sapiens
tcccaaaatcaccgtac

SEQ ID NO: 2747415 - DNA, 19 bp, Homo sapiens
tcccaagattttttcattt

SEQ ID NO: 2747416 - DNA, 14 bp, Homo sapiens
tcccacactcgcca

SEQ ID NO: 2747417 - DNA, 18 bp, Homo sapiens
tcccattctatgtgtcat

SEQ ID NO: 2747418 - DNA, 22 bp, Homo sapiens
tcccattgttggcgctgaggtg

SEQ ID NO: 2747419 - DNA, 21 bp, Homo sapiens
tccctaaaatgtagaaattct

SEQ ID NO: 2747420 - DNA, 23 bp, Homo sapiens
tccctcccacactcgccatctcc

SEQ ID NO: 2747421 - DNA, 16 bp, Homo sapiens
tcccttgatgaagaag

SEQ ID NO: 2747422 - DNA, 18 bp, Homo sapiens
tcctaagtgtcaagtcct

SEQ ID NO: 2747423 - DNA, 13 bp, Homo sapiens
tcctatgcaataa

SEQ ID NO: 2747424 - DNA, 15 bp, Homo sapiens
tcctatgccttcaaa

SEQ ID NO: 2747425 - DNA, 16 bp, Homo sapiens
tcctatgccttcaaat

SEQ ID NO: 2747426 - DNA, 18 bp, Homo sapiens
tcctatgccttcaaatag

SEQ ID NO: 2747427 - DNA, 22 bp, Homo sapiens
tcctcttgccacatcttgaaaa

SEQ ID NO: 2747428 - DNA, 21 bp, Homo sapiens
tcctgaaaacccttgccatgt

SEQ ID NO: 2747429 - DNA, 17 bp, Homo sapiens
tcctgactgggctgggt

SEQ ID NO: 2747430 - DNA, 18 bp, Homo sapiens
tcctgactgggctgggtt

SEQ ID NO: 2747431 - DNA, 22 bp, Homo sapiens
tcctgactgggctgggtttgct

SEQ ID NO: 2747432 - DNA, 14 bp, Homo sapiens
tcctgcatctttca

SEQ ID NO: 2747433 - DNA, 17 bp, Homo sapiens
tcctgcccagcctgggg

SEQ ID NO: 2747434 - DNA, 16 bp, Homo sapiens
tcctggaaatcagggt

SEQ ID NO: 2747435 - DNA, 23 bp, Homo sapiens
tcctgttaaattttctctaaact

SEQ ID NO: 2747436 - DNA, 22 bp, Homo sapiens
tcctgtttgtatttttttccaa

SEQ ID NO: 2747437 - DNA, 23 bp, Homo sapiens
tcctgtttgtatttttttccaag

SEQ ID NO: 2747438 - DNA, 15 bp, Homo sapiens
tccttatgtgtgtag

SEQ ID NO: 2747439 - DNA, 17 bp, Homo sapiens
tccttatgtgtgtagga

SEQ ID NO: 2747440 - DNA, 14 bp, Homo sapiens
tccttggatttgca

SEQ ID NO: 2747441 - DNA, 15 bp, Homo sapiens
tccttggatttgcat

SEQ ID NO: 2747442 - DNA, 16 bp, Homo sapiens
tcctttatactgtgaa

SEQ ID NO: 2747443 - DNA, 20 bp, Homo sapiens
tcctttatactgtgaagtta

SEQ ID NO: 2747444 - DNA, 14 bp, Homo sapiens
tccttttgtaaagt

SEQ ID NO: 2747445 - DNA, 16 bp, Homo sapiens
tccttttgtaaagtaa

SEQ ID NO: 2747446 - DNA, 19 bp, Homo sapiens
tccttttgtaaagtaaaat

SEQ ID NO: 2747447 - DNA, 14 bp, Homo sapiens
tcgagactgcaatg

SEQ ID NO: 2747448 - DNA, 22 bp, Homo sapiens
tcgatgcaagtgtttctgttct

SEQ ID NO: 2747449 - DNA, 15 bp, Homo sapiens
tcgccatctcctggg

SEQ ID NO: 2747450 - DNA, 16 bp, Homo sapiens
tcgccatctcctgggc

SEQ ID NO: 2747451 - DNA, 15 bp, Homo sapiens
tcgccttgaacaaaa

SEQ ID NO: 2747452 - DNA, 18 bp, Homo sapiens
tcggccgagctggtttcc

SEQ ID NO: 2747453 - DNA, 19 bp, Homo sapiens
tcggcgcccccacccctgg

SEQ ID NO: 2747454 - DNA, 17 bp, Homo sapiens
tcggggtggtgcaggct

SEQ ID NO: 2747455 - DNA, 13 bp, Homo sapiens
tcgttattataaa

SEQ ID NO: 2747456 - DNA, 15 bp, Homo sapiens
tcgttattataaatg

SEQ ID NO: 2747457 - DNA, 17 bp, Homo sapiens
tcgttattataaatgtt

SEQ ID NO: 2747458 - DNA, 19 bp, Homo sapiens
tctaaatagcgattataat

SEQ ID NO: 2747459 - DNA, 17 bp, Homo sapiens
tctaagggaaaaagttg

SEQ ID NO: 2747460 - DNA, 17 bp, Homo sapiens
tctacacatttcatcta

SEQ ID NO: 2747461 - DNA, 19 bp, Homo sapiens
tctacacatttcatctaat

SEQ ID NO: 2747462 - DNA, 21 bp, Homo sapiens
tctacacatttcatctaattt

SEQ ID NO: 2747463 - DNA, 17 bp, Homo sapiens
tctaccaaaaatctcaa

SEQ ID NO: 2747464 - DNA, 15 bp, Homo sapiens
tctacctcttggctg

SEQ ID NO: 2747465 - DNA, 17 bp, Homo sapiens
tctaggaaatatttatt

SEQ ID NO: 2747466 - DNA, 22 bp, Homo sapiens
tctagtgagcagtcaggaaaga

SEQ ID NO: 2747467 - DNA, 22 bp, Homo sapiens
tctataattccttaaaattttc

SEQ ID NO: 2747468 - DNA, 13 bp, Homo sapiens
tctatgaaatatt

SEQ ID NO: 2747469 - DNA, 14 bp, Homo sapiens
tctattattatgaa

SEQ ID NO: 2747470 - DNA, 15 bp, Homo sapiens
tctcaactccaaact

SEQ ID NO: 2747471 - DNA, 13 bp, Homo sapiens
tctcagctactta

SEQ ID NO: 2747472 - DNA, 16 bp, Homo sapiens
tctccaactttatttt

SEQ ID NO: 2747473 - DNA, 23 bp, Homo sapiens
tctccagcttactataaatgata

SEQ ID NO: 2747474 - DNA, 15 bp, Homo sapiens
tctctaaactgtttc

SEQ ID NO: 2747475 - DNA, 17 bp, Homo sapiens
tctctagctctccatct

SEQ ID NO: 2747476 - DNA, 19 bp, Homo sapiens
tctctaggaaatatttatt

SEQ ID NO: 2747477 - DNA, 17 bp, Homo sapiens
tctctagttttatctta

SEQ ID NO: 2747478 - DNA, 12 bp, Homo sapiens
tctgaagaagat

SEQ ID NO: 2747479 - DNA, 21 bp, Homo sapiens
tctgaatacaaacatttcact

SEQ ID NO: 2747480 - DNA, 22 bp, Homo sapiens
tctgaatcctgttaaattttct

SEQ ID NO: 2747481 - DNA, 22 bp, Homo sapiens
tctgaggtaagtgtatgatctt

SEQ ID NO: 2747482 - DNA, 15 bp, Homo sapiens
tctgatgcagtgccc

SEQ ID NO: 2747483 - DNA, 12 bp, Homo sapiens
tctgcctggagt

SEQ ID NO: 2747484 - DNA, 17 bp, Homo sapiens
tctgtaagatatcccag

SEQ ID NO: 2747485 - DNA, 20 bp, Homo sapiens
tctgtacttttttcaaatat

SEQ ID NO: 2747486 - DNA, 17 bp, Homo sapiens
tctgtataaatgtctat

SEQ ID NO: 2747487 - DNA, 20 bp, Homo sapiens
tctgtgcagggctggtttgt

SEQ ID NO: 2747488 - DNA, 15 bp, Homo sapiens
tctgtgtgtgtgtat

SEQ ID NO: 2747489 - DNA, 19 bp, Homo sapiens
tctgtgtgtgtgtatgtgg

SEQ ID NO: 2747490 - DNA, 15 bp, Homo sapiens
tctgtgtgtttatgt

SEQ ID NO: 2747491 - DNA, 21 bp, Homo sapiens
tctgttaaatatttttgtaca

SEQ ID NO: 2747492 - DNA, 18 bp, Homo sapiens
tctgttttataattttgt

SEQ ID NO: 2747493 - DNA, 14 bp, Homo sapiens
tcttaaaatgcaat

SEQ ID NO: 2747494 - DNA, 15 bp, Homo sapiens
tcttaaaatgcaata

SEQ ID NO: 2747495 - DNA, 21 bp, Homo sapiens
tcttaaaatgcaatatttgta

SEQ ID NO: 2747496 - DNA, 12 bp, Homo sapiens
tcttaaactgtt

SEQ ID NO: 2747497 - DNA, 12 bp, Homo sapiens
tcttaagaatgt

SEQ ID NO: 2747498 - DNA, 16 bp, Homo sapiens
tcttagctgcactgtt

SEQ ID NO: 2747499 - DNA, 21 bp, Homo sapiens
tcttagctgcactgtttatgg

SEQ ID NO: 2747500 - DNA, 22 bp, Homo sapiens
tcttagggttatgattaagtaa

SEQ ID NO: 2747501 - DNA, 14 bp, Homo sapiens
tcttatagaataaa

SEQ ID NO: 2747502 - DNA, 18 bp, Homo sapiens
tcttatagaataaaagct

SEQ ID NO: 2747503 - DNA, 23 bp, Homo sapiens
tcttatagaataaaagctgtgga

SEQ ID NO: 2747504 - DNA, 15 bp, Homo sapiens
tcttatattttatca

SEQ ID NO: 2747505 - DNA, 16 bp, Homo sapiens
tcttatattttatcaa

SEQ ID NO: 2747506 - DNA, 16 bp, Homo sapiens
tcttcaaatttgattc

SEQ ID NO: 2747507 - DNA, 16 bp, Homo sapiens
tcttcaggctctgccc

SEQ ID NO: 2747508 - DNA, 14 bp, Homo sapiens
tcttcatgcattac

SEQ ID NO: 2747509 - DNA, 21 bp, Homo sapiens
tcttcatgcattacttactgt

SEQ ID NO: 2747510 - DNA, 17 bp, Homo sapiens
tcttccagtttctgtaa

SEQ ID NO: 2747511 - DNA, 22 bp, Homo sapiens
tcttccagtttctgtaaggtct

SEQ ID NO: 2747512 - DNA, 22 bp, Homo sapiens
tcttccctaaaatgtagaaatt

SEQ ID NO: 2747513 - DNA, 19 bp, Homo sapiens
tcttcggccgagctggttt

SEQ ID NO: 2747514 - DNA, 16 bp, Homo sapiens
tcttcttatctaaacc

SEQ ID NO: 2747515 - DNA, 13 bp, Homo sapiens
tcttgaaaatgcc

SEQ ID NO: 2747516 - DNA, 14 bp, Homo sapiens
tcttgaaaatgcca

SEQ ID NO: 2747517 - DNA, 18 bp, Homo sapiens
tcttgattaatgtacttt

SEQ ID NO: 2747518 - DNA, 13 bp, Homo sapiens
tcttgccacatct

SEQ ID NO: 2747519 - DNA, 14 bp, Homo sapiens
tcttgccacatctt

SEQ ID NO: 2747520 - DNA, 14 bp, Homo sapiens
tcttggggtcccac

SEQ ID NO: 2747521 - DNA, 21 bp, Homo sapiens
tcttgttttaagcaaatgcat

SEQ ID NO: 2747522 - DNA, 20 bp, Homo sapiens
tctttaaaaataaaagctat

SEQ ID NO: 2747523 - DNA, 15 bp, Homo sapiens
tctttaaactactga

SEQ ID NO: 2747524 - DNA, 14 bp, Homo sapiens
tctttcatagttct

SEQ ID NO: 2747525 - DNA, 20 bp, Homo sapiens
tctttcatagttctgttaaa

SEQ ID NO: 2747526 - DNA, 19 bp, Homo sapiens
tctttccacagaagctcca

SEQ ID NO: 2747527 - DNA, 16 bp, Homo sapiens
tctttgaaatgctaaa

SEQ ID NO: 2747528 - DNA, 23 bp, Homo sapiens
tctttgtgtttgcttggtgctgg

SEQ ID NO: 2747529 - DNA, 13 bp, Homo sapiens
tcttttctttgta

SEQ ID NO: 2747530 - DNA, 17 bp, Homo sapiens
tcttttctttgtatcat

SEQ ID NO: 2747531 - DNA, 17 bp, Homo sapiens
tctttttcaaaactagt

SEQ ID NO: 2747532 - DNA, 21 bp, Homo sapiens
tctttttcaaaactagttctt

SEQ ID NO: 2747533 - DNA, 20 bp, Homo sapiens
tgaaaaaaaaattatttgcc

SEQ ID NO: 2747534 - DNA, 11 bp, Homo sapiens
tgaaaatgcca

SEQ ID NO: 2747535 - DNA, 14 bp, Homo sapiens
tgaaaatgccacca

SEQ ID NO: 2747536 - DNA, 19 bp, Homo sapiens
tgaaactcgttaatttgta

SEQ ID NO: 2747537 - DNA, 15 bp, Homo sapiens
tgaaaggtacttcaa

SEQ ID NO: 2747538 - DNA, 13 bp, Homo sapiens
tgaaagtaaaaaa

SEQ ID NO: 2747539 - DNA, 11 bp, Homo sapiens
tgaaatattag

SEQ ID NO: 2747540 - DNA, 16 bp, Homo sapiens
tgaaatattgactttt

SEQ ID NO: 2747541 - DNA, 14 bp, Homo sapiens
tgaacctttcaaaa

SEQ ID NO: 2747542 - DNA, 20 bp, Homo sapiens
tgaacctttcaaaatggaaa

SEQ ID NO: 2747543 - DNA, 18 bp, Homo sapiens
tgaactaagttattgctg

SEQ ID NO: 2747544 - DNA, 20 bp, Homo sapiens
tgaactaagttattgctgca

SEQ ID NO: 2747545 - DNA, 23 bp, Homo sapiens
tgaactagagtttagctggaaaa

SEQ ID NO: 2747546 - DNA, 20 bp, Homo sapiens
tgaactgaaggcagcatgta

SEQ ID NO: 2747547 - DNA, 15 bp, Homo sapiens
tgaagaaagtaaaac

SEQ ID NO: 2747548 - DNA, 17 bp, Homo sapiens
tgaagaaagtaaaacca

SEQ ID NO: 2747549 - DNA, 18 bp, Homo sapiens
tgaagaaagtaaaaccat

SEQ ID NO: 2747550 - DNA, 18 bp, Homo sapiens
tgaagaattgccaatctt

SEQ ID NO: 2747551 - DNA, 20 bp, Homo sapiens
tgaagaattgccaatcttgt

SEQ ID NO: 2747552 - DNA, 17 bp, Homo sapiens
tgaagatttaccacttg

SEQ ID NO: 2747553 - DNA, 20 bp, Homo sapiens
tgaagatttaccacttgtgt

SEQ ID NO: 2747554 - DNA, 15 bp, Homo sapiens
tgaagcatttaaaag

SEQ ID NO: 2747555 - DNA, 11 bp, Homo sapiens
tgaagtccaag

SEQ ID NO: 2747556 - DNA, 18 bp, Homo sapiens
tgaagtcttcttatctaa

SEQ ID NO: 2747557 - DNA, 19 bp, Homo sapiens
tgaagtcttcttatctaaa

SEQ ID NO: 2747558 - DNA, 21 bp, Homo sapiens
tgaagtcttcttatctaaacc

SEQ ID NO: 2747559 - DNA, 15 bp, Homo sapiens
tgaatatatggcatt

SEQ ID NO: 2747560 - DNA, 20 bp, Homo sapiens
tgaatatatggcatttgcag

SEQ ID NO: 2747561 - DNA, 14 bp, Homo sapiens
tgaatattacatgt

SEQ ID NO: 2747562 - DNA, 19 bp, Homo sapiens
tgaatattacatgtaaagc

SEQ ID NO: 2747563 - DNA, 21 bp, Homo sapiens
tgaatattacatgtaaagctg

SEQ ID NO: 2747564 - DNA, 13 bp, Homo sapiens
tgaatcctgttaa

SEQ ID NO: 2747565 - DNA, 20 bp, Homo sapiens
tgaatcctgttaaattttct

SEQ ID NO: 2747566 - DNA, 21 bp, Homo sapiens
tgaatgccttatttttgaatt

SEQ ID NO: 2747567 - DNA, 12 bp, Homo sapiens
tgaatgtacctc

SEQ ID NO: 2747568 - DNA, 14 bp, Homo sapiens
tgaattacatttgt

SEQ ID NO: 2747569 - DNA, 16 bp, Homo sapiens
tgaattacatttgtat

SEQ ID NO: 2747570 - DNA, 18 bp, Homo sapiens
tgaattacatttgtataa

SEQ ID NO: 2747571 - DNA, 14 bp, Homo sapiens
tgaattctttagat

SEQ ID NO: 2747572 - DNA, 20 bp, Homo sapiens
tgacaagctcacagaccttt

SEQ ID NO: 2747573 - DNA, 19 bp, Homo sapiens
tgacacatatcattctgtg

SEQ ID NO: 2747574 - DNA, 12 bp, Homo sapiens
tgacagaatata

SEQ ID NO: 2747575 - DNA, 23 bp, Homo sapiens
tgacatgcctatatgagaagaat

SEQ ID NO: 2747576 - DNA, 20 bp, Homo sapiens
tgaccttaaggaaaagtaag

SEQ ID NO: 2747577 - DNA, 15 bp, Homo sapiens
tgattaagtaatgat

SEQ ID NO: 2747578 - DNA, 18 bp, Homo sapiens
tgattaagtaatgataac

SEQ ID NO: 2747579 - DNA, 11 bp, Homo sapiens
tgattaatgaa

SEQ ID NO: 2747580 - DNA, 21 bp, Homo sapiens
tgattaatgaagaaagtaaaa

SEQ ID NO: 2747581 - DNA, 14 bp, Homo sapiens
tgattaatgtactt

SEQ ID NO: 2747582 - DNA, 23 bp, Homo sapiens
tgattaatgtactttttattgca

SEQ ID NO: 2747583 - DNA, 17 bp, Homo sapiens
tgattggataaatgctt

SEQ ID NO: 2747584 - DNA, 17 bp, Homo sapiens
tgatttctccagaaatt

SEQ ID NO: 2747585 - DNA, 12 bp, Homo sapiens
tgattttcaaaa

SEQ ID NO: 2747586 - DNA, 13 bp, Homo sapiens
tgattttcaaaaa

SEQ ID NO: 2747587 - DNA, 20 bp, Homo sapiens
tgcaagagactttgtcactt

SEQ ID NO: 2747588 - DNA, 23 bp, Homo sapiens
tgcaagagactttgtcacttatt

SEQ ID NO: 2747589 - DNA, 18 bp, Homo sapiens
tgcaaggattttttaaaa

SEQ ID NO: 2747590 - DNA, 15 bp, Homo sapiens
tgcaagtgtttctgt

SEQ ID NO: 2747591 - DNA, 18 bp, Homo sapiens
tgcaagtgtttctgttct

SEQ ID NO: 2747592 - DNA, 15 bp, Homo sapiens
tgcacatcaaaatat

SEQ ID NO: 2747593 - DNA, 15 bp, Homo sapiens
tgcacccagaagaag

SEQ ID NO: 2747594 - DNA, 23 bp, Homo sapiens
tgcaccccgccggaggaaggtcc

SEQ ID NO: 2747595 - DNA, 19 bp, Homo sapiens
tgcacgcgccctttctacc

SEQ ID NO: 2747596 - DNA, 19 bp, Homo sapiens
tgcactccagcctgggtga

SEQ ID NO: 2747597 - DNA, 12 bp, Homo sapiens
tgcactttgtag

SEQ ID NO: 2747598 - DNA, 22 bp, Homo sapiens
tgcagaaaaaaaagaaaaaagt

SEQ ID NO: 2747599 - DNA, 13 bp, Homo sapiens
tgcagaaaaagaa

SEQ ID NO: 2747600 - DNA, 16 bp, Homo sapiens
tgcagaaaaagaaaaa

SEQ ID NO: 2747601 - DNA, 22 bp, Homo sapiens
tgcagaaaaagaaaaaaactat

SEQ ID NO: 2747602 - DNA, 20 bp, Homo sapiens
tgcagaagttcttagtgttg

SEQ ID NO: 2747603 - DNA, 13 bp, Homo sapiens
tgcaggctcccaa

SEQ ID NO: 2747604 - DNA, 17 bp, Homo sapiens
tgcagtgagctgtgatt

SEQ ID NO: 2747605 - DNA, 18 bp, Homo sapiens
tgcagtgtgcctgtcact

SEQ ID NO: 2747606 - DNA, 16 bp, Homo sapiens
tgcagttctgaagaag

SEQ ID NO: 2747607 - DNA, 18 bp, Homo sapiens
tgcagttctgaagaagat

SEQ ID NO: 2747608 - DNA, 22 bp, Homo sapiens
tgcagttctgaagaagatggta

SEQ ID NO: 2747609 - DNA, 23 bp, Homo sapiens
tgcataaaagggtcaaacctgta

SEQ ID NO: 2747610 - DNA, 14 bp, Homo sapiens
tgcataaatttgta

SEQ ID NO: 2747611 - DNA, 21 bp, Homo sapiens
tgcataaatttgtaatatatc

SEQ ID NO: 2747612 - DNA, 17 bp, Homo sapiens
tgcatacatgaataaaa

SEQ ID NO: 2747613 - DNA, 20 bp, Homo sapiens
tgcatacatgaataaaaata

SEQ ID NO: 2747614 - DNA, 12 bp, Homo sapiens
tgcatctttcat

SEQ ID NO: 2747615 - DNA, 20 bp, Homo sapiens
tgcatctttcatagttctgt

SEQ ID NO: 2747616 - DNA, 14 bp, Homo sapiens
tgcattatatttat

SEQ ID NO: 2747617 - DNA, 22 bp, Homo sapiens
tgcattctatcgttattataaa

SEQ ID NO: 2747618 - DNA, 20 bp, Homo sapiens
tgcattggtttgagaaaggc

SEQ ID NO: 2747619 - DNA, 17 bp, Homo sapiens
tgccaatcttgttttaa

SEQ ID NO: 2747620 - DNA, 14 bp, Homo sapiens
tgccacatcttgaa

SEQ ID NO: 2747621 - DNA, 21 bp, Homo sapiens
tgccacatcttgaaaatgcca

SEQ ID NO: 2747622 - DNA, 22 bp, Homo sapiens
tgccacatcttgaaaatgccac

SEQ ID NO: 2747623 - DNA, 23 bp, Homo sapiens
tgccacatcttgaaaatgccacc

SEQ ID NO: 2747624 - DNA, 24 bp, Homo sapiens
tgccatagtcaaagagagttttta

SEQ ID NO: 2747625 - DNA, 16 bp, Homo sapiens
tgccatcatgtttaca

SEQ ID NO: 2747626 - DNA, 22 bp, Homo sapiens
tgccatcatgtttacagaggac

SEQ ID NO: 2747627 - DNA, 13 bp, Homo sapiens
tgccattgcactc

SEQ ID NO: 2747628 - DNA, 20 bp, Homo sapiens
tgcccacgcccttggagcct

SEQ ID NO: 2747629 - DNA, 14 bp, Homo sapiens
tgcccagcctgggg

SEQ ID NO: 2747630 - DNA, 23 bp, Homo sapiens
tgcccagcctggggcaaacctag

SEQ ID NO: 2747631 - DNA, 15 bp, Homo sapiens
tgccgcctgtcaata

SEQ ID NO: 2747632 - DNA, 20 bp, Homo sapiens
tgccgcctgtcaataaatgt

SEQ ID NO: 2747633 - DNA, 21 bp, Homo sapiens
tgccgcctgtcaataaatgtt

SEQ ID NO: 2747634 - DNA, 20 bp, Homo sapiens
tgcctatatgagaagaatag

SEQ ID NO: 2747635 - DNA, 18 bp, Homo sapiens
tgcctcagaaaacaagga

SEQ ID NO: 2747636 - DNA, 16 bp, Homo sapiens
tgcctgcaaacctgct

SEQ ID NO: 2747637 - DNA, 15 bp, Homo sapiens
tgcctgtcactactg

SEQ ID NO: 2747638 - DNA, 15 bp, Homo sapiens
tgccttatttttgaa

SEQ ID NO: 2747639 - DNA, 16 bp, Homo sapiens
tgccttatttttgaat

SEQ ID NO: 2747640 - DNA, 17 bp, Homo sapiens
tgccttatttttgaatt

SEQ ID NO: 2747641 - DNA, 16 bp, Homo sapiens
tgccttggtgtgctgt

SEQ ID NO: 2747642 - DNA, 18 bp, Homo sapiens
tgccttttaaattctttt

SEQ ID NO: 2747643 - DNA, 19 bp, Homo sapiens
tgccttttcccaactccag

SEQ ID NO: 2747644 - DNA, 17 bp, Homo sapiens
tgctaaaattctataga

SEQ ID NO: 2747645 - DNA, 22 bp, Homo sapiens
tgctaaacttggctgtatgtca

SEQ ID NO: 2747646 - DNA, 19 bp, Homo sapiens
tgctaagcattccaactat

SEQ ID NO: 2747647 - DNA, 17 bp, Homo sapiens
tgctaaggaacaatgcc

SEQ ID NO: 2747648 - DNA, 14 bp, Homo sapiens
tgctacgaagaaag

SEQ ID NO: 2747649 - DNA, 14 bp, Homo sapiens
tgctagtaattgga

SEQ ID NO: 2747650 - DNA, 19 bp, Homo sapiens
tgctatgagctggggatgt

SEQ ID NO: 2747651 - DNA, 14 bp, Homo sapiens
tgctcatggaattg

SEQ ID NO: 2747652 - DNA, 18 bp, Homo sapiens
tgctgctgtgcgtggaaa

SEQ ID NO: 2747653 - DNA, 19 bp, Homo sapiens
tgctgctgtgcgtggaaaa

SEQ ID NO: 2747654 - DNA, 13 bp, Homo sapiens
tgctggtttattt

SEQ ID NO: 2747655 - DNA, 21 bp, Homo sapiens
tgctgtattttaaaagaatga

SEQ ID NO: 2747656 - DNA, 22 bp, Homo sapiens
tgctgtattttaaaagaatgat

SEQ ID NO: 2747657 - DNA, 21 bp, Homo sapiens
tgctgtgcgtggaaaaagacg

SEQ ID NO: 2747658 - DNA, 16 bp, Homo sapiens
tgctgtgctgtgttta

SEQ ID NO: 2747659 - DNA, 20 bp, Homo sapiens
tgcttctacacatttcatct

SEQ ID NO: 2747660 - DNA, 13 bp, Homo sapiens
tgcttggtgctgg

SEQ ID NO: 2747661 - DNA, 15 bp, Homo sapiens
tgcttggtgctggtt

SEQ ID NO: 2747662 - DNA, 17 bp, Homo sapiens
tgcttggtgctggttta

SEQ ID NO: 2747663 - DNA, 19 bp, Homo sapiens
tgcttggtgctggtttatt

SEQ ID NO: 2747664 - DNA, 23 bp, Homo sapiens
tgctttctgaaattcacagaagc

SEQ ID NO: 2747665 - DNA, 11 bp, Homo sapiens
tggaaaaagac

SEQ ID NO: 2747666 - DNA, 13 bp, Homo sapiens
tggaaaatataca

SEQ ID NO: 2747667 - DNA, 20 bp, Homo sapiens
tggaaaatatacaagtaaat

SEQ ID NO: 2747668 - DNA, 13 bp, Homo sapiens
tggaacagtgaca

SEQ ID NO: 2747669 - DNA, 13 bp, Homo sapiens
tggagaagaactg

SEQ ID NO: 2747670 - DNA, 14 bp, Homo sapiens
tggagaagaactga

SEQ ID NO: 2747671 - DNA, 16 bp, Homo sapiens
tggagaagaactgaaa

SEQ ID NO: 2747672 - DNA, 11 bp, Homo sapiens
tggagccttcc

SEQ ID NO: 2747673 - DNA, 15 bp, Homo sapiens
tggagccttccaccg

SEQ ID NO: 2747674 - DNA, 17 bp, Homo sapiens
tggagccttccaccggc

SEQ ID NO: 2747675 - DNA, 21 bp, Homo sapiens
tggagccttccaccggcactc

SEQ ID NO: 2747676 - DNA, 18 bp, Homo sapiens
tggagtgaagcatttaaa

SEQ ID NO: 2747677 - DNA, 23 bp, Homo sapiens
tggagtgaagcatttaaaagagt

SEQ ID NO: 2747678 - DNA, 21 bp, Homo sapiens
tggataaatttaaaacacagt

SEQ ID NO: 2747679 - DNA, 19 bp, Homo sapiens
tggcagaatagcttatgcc

SEQ ID NO: 2747680 - DNA, 15 bp, Homo sapiens
tggccaagagaaggg

SEQ ID NO: 2747681 - DNA, 16 bp, Homo sapiens
tggccagtggctggat

SEQ ID NO: 2747682 - DNA, 23 bp, Homo sapiens
tggccagtggctggatctgtgag

SEQ ID NO: 2747683 - DNA, 20 bp, Homo sapiens
tggccccgcccgagcccctg

SEQ ID NO: 2747684 - DNA, 21 bp, Homo sapiens
tggcctgaggtcaatggtgca

SEQ ID NO: 2747685 - DNA, 21 bp, Homo sapiens
tggctaccttgtgggaataaa

SEQ ID NO: 2747686 - DNA, 15 bp, Homo sapiens
tggctgtagataaat

SEQ ID NO: 2747687 - DNA, 19 bp, Homo sapiens
tggcttcttttctttgtat

SEQ ID NO: 2747688 - DNA, 21 bp, Homo sapiens
tgggacagtcacctcatggaa

SEQ ID NO: 2747689 - DNA, 21 bp, Homo sapiens
tgggagtgaggatgtctgggc

SEQ ID NO: 2747690 - DNA, 13 bp, Homo sapiens
tgggagtgtgtaa

SEQ ID NO: 2747691 - DNA, 22 bp, Homo sapiens
tgggcctaattttttaaagaat

SEQ ID NO: 2747692 - DNA, 17 bp, Homo sapiens
tgggctgggtttgctgt

SEQ ID NO: 2747693 - DNA, 16 bp, Homo sapiens
tggggaggactaggac

SEQ ID NO: 2747694 - DNA, 14 bp, Homo sapiens
tggggagggatttg

SEQ ID NO: 2747695 - DNA, 20 bp, Homo sapiens
tggggatagatgtgtggaca

SEQ ID NO: 2747696 - DNA, 20 bp, Homo sapiens
tggggcaaacctagccggaa

SEQ ID NO: 2747697 - DNA, 15 bp, Homo sapiens
tgggggtattttcta

SEQ ID NO: 2747698 - DNA, 18 bp, Homo sapiens
tgggggtattttctaatt

SEQ ID NO: 2747699 - DNA, 20 bp, Homo sapiens
tgtgtattcttaaaatgcaa

SEQ ID NO: 2747700 - DNA, 23 bp, Homo sapiens
tgtgtattcttaaaatgcaatat

SEQ ID NO: 2747701 - DNA, 21 bp, Homo sapiens
tgtgtgaaaggtacttcaaat

SEQ ID NO: 2747702 - DNA, 16 bp, Homo sapiens
tgtgtgggagtgtgta

SEQ ID NO: 2747703 - DNA, 11 bp, Homo sapiens
tgtgtgtatgt

SEQ ID NO: 2747704 - DNA, 12 bp, Homo sapiens
tgtgtgtgggag

SEQ ID NO: 2747705 - DNA, 13 bp, Homo sapiens
tgtgttgaaatat

SEQ ID NO: 2747706 - DNA, 12 bp, Homo sapiens
tgtgtttgcttg

SEQ ID NO: 2747707 - DNA, 16 bp, Homo sapiens
tgttaaaatacataac

SEQ ID NO: 2747708 - DNA, 23 bp, Homo sapiens
tgttaaaatacataacttcagtg

SEQ ID NO: 2747709 - DNA, 18 bp, Homo sapiens
tgttaaatatttttgtac

SEQ ID NO: 2747710 - DNA, 19 bp, Homo sapiens
tgttaccactggtaacatg

SEQ ID NO: 2747711 - DNA, 12 bp, Homo sapiens
tgttaccagact

SEQ ID NO: 2747712 - DNA, 16 bp, Homo sapiens
tgttaccagacttcaa

SEQ ID NO: 2747713 - DNA, 19 bp, Homo sapiens
tgttaccagacttcaagat

SEQ ID NO: 2747714 - DNA, 15 bp, Homo sapiens
tgttacctaggttaa

SEQ ID NO: 2747715 - DNA, 14 bp, Homo sapiens
tgttagtgcaaatt

SEQ ID NO: 2747716 - DNA, 18 bp, Homo sapiens
tgttagttctagctctat

SEQ ID NO: 2747717 - DNA, 20 bp, Homo sapiens
tgttagttctagctctattt

SEQ ID NO: 2747718 - DNA, 13 bp, Homo sapiens
tgttgaaatatag

SEQ ID NO: 2747719 - DNA, 14 bp, Homo sapiens
tttttcaaatattg

SEQ ID NO: 2747720 - DNA, 21 bp, Homo sapiens
tttttccaagtgtataatgtt

SEQ ID NO: 2747721 - DNA, 20 bp, Homo sapiens
tttttccttcctctgtaaga

SEQ ID NO: 2747722 - DNA, 15 bp, Homo sapiens
tttttctttgaaatg

SEQ ID NO: 2747723 - DNA, 17 bp, Homo sapiens
tttttgctttctgaaat

SEQ ID NO: 2747724 - DNA, 18 bp, Homo sapiens
tttttgctttctgaaatt

SEQ ID NO: 2747725 - DNA, 14 bp, Homo sapiens
tttttgtaaaaact

SEQ ID NO: 2747726 - DNA, 17 bp, Homo sapiens
tttttgttttgttttgt

SEQ ID NO: 2747727 - DNA, 13 bp, Homo sapiens
ttttttgattaat

SEQ ID NO: 2747728 - DNA, 13 bp, Homo sapiens
tttttttgtttgt

SEQ ID NO: 2747729 - DNA, 17 bp, Homo sapiens
ggacagtcacctcatgg

SEQ ID NO: 2747730 - DNA, 12 bp, Homo sapiens
ggaccagtttat

SEQ ID NO: 2747731 - DNA, 13 bp, Homo sapiens
ggagaaaagcact

SEQ ID NO: 2747732 - DNA, 15 bp, Homo sapiens
ggagacattgtttgg

SEQ ID NO: 2747733 - DNA, 19 bp, Homo sapiens
ggagattttttttttaatc

SEQ ID NO: 2747734 - DNA, 14 bp, Homo sapiens
ggagcctgctaagg

SEQ ID NO: 2747735 - DNA, 11 bp, Homo sapiens
ggagccttcca

SEQ ID NO: 2747736 - DNA, 11 bp, Homo sapiens
ggaggaaggtc

SEQ ID NO: 2747737 - DNA, 12 bp, Homo sapiens
ggaggatcactt

SEQ ID NO: 2747738 - DNA, 12 bp, Homo sapiens
ggagggatttgg

SEQ ID NO: 2747739 - DNA, 13 bp, Homo sapiens
ggagtgctgtgct

SEQ ID NO: 2747740 - DNA, 22 bp, Homo sapiens
ggagtgtgtaatttaaaattgt

SEQ ID NO: 2747741 - DNA, 13 bp, Homo sapiens
ggataaatttaaa

SEQ ID NO: 2747742 - DNA, 14 bp, Homo sapiens
ggatagatgtgtgg

SEQ ID NO: 2747743 - DNA, 15 bp, Homo sapiens
ggatagatgtgtgga

SEQ ID NO: 2747744 - DNA, 15 bp, Homo sapiens
ggatataatctgaat

SEQ ID NO: 2747745 - DNA, 22 bp, Homo sapiens
gtgagaaagaaagtaaaaaagg

SEQ ID NO: 2747746 - DNA, 16 bp, Homo sapiens
gtgagcagtcaggaaa

SEQ ID NO: 2747747 - DNA, 15 bp, Homo sapiens
gtgaggatgtctggg

SEQ ID NO: 2747748 - DNA, 13 bp, Homo sapiens
gtgattaaatctc

SEQ ID NO: 2747749 - DNA, 14 bp, Homo sapiens
gtgcaagagacttt

SEQ ID NO: 2747750 - DNA, 13 bp, Homo sapiens
gtgcagggctggt

SEQ ID NO: 2747751 - DNA, 21 bp, Homo sapiens
gtgccaggatggaatgatggg

SEQ ID NO: 2747752 - DNA, 17 bp, Homo sapiens
gtgcctgtcactactgg

SEQ ID NO: 2747753 - DNA, 14 bp, Homo sapiens
gtgccttttgccat

SEQ ID NO: 2747754 - DNA, 16 bp, Homo sapiens
gtgcgtggaaaaagac

SEQ ID NO: 2747755 - DNA, 16 bp, Homo sapiens
gtgctagagttaaaag

SEQ ID NO: 2747756 - DNA, 13 bp, Homo sapiens
taagagagaatga

SEQ ID NO: 2747757 - DNA, 14 bp, Homo sapiens
taagagagaatgag

SEQ ID NO: 2747758 - DNA, 13 bp, Homo sapiens
taagatttatctg

SEQ ID NO: 2747759 - DNA, 15 bp, Homo sapiens
taagatttatctgca

SEQ ID NO: 2747760 - DNA, 16 bp, Homo sapiens
taagatttatctgcaa

SEQ ID NO: 2747761 - DNA, 23 bp, Homo sapiens
taagatttatctgcaaggatttt

SEQ ID NO: 2747762 - DNA, 15 bp, Homo sapiens
taagcaaatgcattc

SEQ ID NO: 2747763 - DNA, 20 bp, Homo sapiens
taagcattccaactatctca

SEQ ID NO: 2747764 - DNA, 16 bp, Homo sapiens
taagcttgtattcctt

SEQ ID NO: 2747765 - DNA, 15 bp, Homo sapiens
taaggaacaatgccg

SEQ ID NO: 2747766 - DNA, 13 bp, Homo sapiens
taaggattctgca

SEQ ID NO: 2747767 - DNA, 17 bp, Homo sapiens
taaggattctgcagaaa

SEQ ID NO: 2747768 - DNA, 16 bp, Homo sapiens
taagggtaaaaaagat

SEQ ID NO: 2747769 - DNA, 18 bp, Homo sapiens
taagtatatcttaagaat

SEQ ID NO: 2747770 - DNA, 15 bp, Homo sapiens
taagtgtttaaaagc

SEQ ID NO: 2747771 - DNA, 12 bp, Homo sapiens
taagttattgct

SEQ ID NO: 2747772 - DNA, 13 bp, Homo sapiens
taataagactttt

SEQ ID NO: 2747773 - DNA, 15 bp, Homo sapiens
taataagtatatctt

SEQ ID NO: 2747774 - DNA, 14 bp, Homo sapiens
taataatgtttcaa

SEQ ID NO: 2747775 - DNA, 12 bp, Homo sapiens
taataattaaag

SEQ ID NO: 2747776 - DNA, 20 bp, Homo sapiens
taatacctttctaagggaaa

SEQ ID NO: 2747777 - DNA, 22 bp, Homo sapiens
taatattacctaatgaaagtga

SEQ ID NO: 2747778 - DNA, 23 bp, Homo sapiens
taatattcctggcatacctttaa

SEQ ID NO: 2747779 - DNA, 17 bp, Homo sapiens
taatcagtggaactcaa

SEQ ID NO: 2747780 - DNA, 22 bp, Homo sapiens
taatcagtggaactcaatatat

SEQ ID NO: 2747781 - DNA, 16 bp, Homo sapiens
taatctccaactttat

SEQ ID NO: 2747782 - DNA, 23 bp, Homo sapiens
taatctccaactttattttgaat

SEQ ID NO: 2747783 - DNA, 21 bp, Homo sapiens
taatctcctgagttgtataaa

SEQ ID NO: 2747784 - DNA, 16 bp, Homo sapiens
taatctgaatcctgtt

SEQ ID NO: 2747785 - DNA, 16 bp, Homo sapiens
taatcttaaatcagaa

SEQ ID NO: 2747786 - DNA, 17 bp, Homo sapiens
taatcttaaatcagaat

SEQ ID NO: 2747787 - DNA, 16 bp, Homo sapiens
taatgataactggaaa

SEQ ID NO: 2747788 - DNA, 22 bp, Homo sapiens
taatgataactggaaacttcag

SEQ ID NO: 2747789 - DNA, 15 bp, Homo sapiens
taatgcaatgcatat

SEQ ID NO: 2747790 - DNA, 14 bp, Homo sapiens
taatgtacttttta

SEQ ID NO: 2747791 - DNA, 21 bp, Homo sapiens
taatgtactttttattgcatg

SEQ ID NO: 2747792 - DNA, 17 bp, Homo sapiens
taatgttggtgtggagt

SEQ ID NO: 2747793 - DNA, 23 bp, Homo sapiens
taatgttggtgtggagttttcat

SEQ ID NO: 2747794 - DNA, 14 bp, Homo sapiens
taatgtttcaaaca

SEQ ID NO: 2747795 - DNA, 15 bp, Homo sapiens
taattgagactgaaa

SEQ ID NO: 2747796 - DNA, 13 bp, Homo sapiens
taattgtttaaaa

SEQ ID NO: 2747797 - DNA, 19 bp, Homo sapiens
taatttaaaattgtgatgt

SEQ ID NO: 2747798 - DNA, 21 bp, Homo sapiens
taatttacctctcattagaaa

SEQ ID NO: 2747799 - DNA, 16 bp, Homo sapiens
taatttttatatttga

SEQ ID NO: 2747800 - DNA, 18 bp, Homo sapiens
taatttttatatttgaaa

SEQ ID NO: 2747801 - DNA, 21 bp, Homo sapiens
taatttttatatttgaaatat

SEQ ID NO: 2747802 - DNA, 16 bp, Homo sapiens
taattttttaaagaat

SEQ ID NO: 2747803 - DNA, 17 bp, Homo sapiens
tacaaaactatcctatg

SEQ ID NO: 2747804 - DNA, 18 bp, Homo sapiens
tacaaatctgtataaatg

SEQ ID NO: 2747805 - DNA, 14 bp, Homo sapiens
tacaagtaaattct

SEQ ID NO: 2747806 - DNA, 20 bp, Homo sapiens
tacacatttcatctaattta

SEQ ID NO: 2747807 - DNA, 22 bp, Homo sapiens
tacacatttcatctaatttaat

SEQ ID NO: 2747808 - DNA, 13 bp, Homo sapiens
tacacattttgta

SEQ ID NO: 2747809 - DNA, 16 bp, Homo sapiens
tacacattttgtaaat

SEQ ID NO: 2747810 - DNA, 17 bp, Homo sapiens
tacacattttgtaaatc

SEQ ID NO: 2747811 - DNA, 20 bp, Homo sapiens
tacacattttgtaaatctgt

SEQ ID NO: 2747812 - DNA, 21 bp, Homo sapiens
tacacattttgtaaatctgta

SEQ ID NO: 2747813 - DNA, 23 bp, Homo sapiens
tacacattttgtaaatctgtact

SEQ ID NO: 2747814 - DNA, 18 bp, Homo sapiens
tacagaggacagtatttg

SEQ ID NO: 2747815 - DNA, 17 bp, Homo sapiens
tacataacttcagtgca

SEQ ID NO: 2747816 - DNA, 20 bp, Homo sapiens
tacatcccttacctgggaaa

SEQ ID NO: 2747817 - DNA, 20 bp, Homo sapiens
tacatctgtgcagggctggt

SEQ ID NO: 2747818 - DNA, 15 bp, Homo sapiens
tacatgtaaagctgt

SEQ ID NO: 2747819 - DNA, 15 bp, Homo sapiens
tacatttggaacagt

SEQ ID NO: 2747820 - DNA, 16 bp, Homo sapiens
tacatttgtataaaat

SEQ ID NO: 2747821 - DNA, 17 bp, Homo sapiens
tacatttgtataaaata

SEQ ID NO: 2747822 - DNA, 13 bp, Homo sapiens
taccaagagaagg

SEQ ID NO: 2747823 - DNA, 14 bp, Homo sapiens
taccacagtctttc

SEQ ID NO: 2747824 - DNA, 18 bp, Homo sapiens
tacctcaggaaagaatag

SEQ ID NO: 2747825 - DNA, 21 bp, Homo sapiens
tacctctaaatttccatatcc

SEQ ID NO: 2747826 - DNA, 19 bp, Homo sapiens
tacctctattagtttcaat

SEQ ID NO: 2747827 - DNA, 15 bp, Homo sapiens
tacctctcattagaa

SEQ ID NO: 2747828 - DNA, 13 bp, Homo sapiens
taccttgtgggaa

SEQ ID NO: 2747829 - DNA, 21 bp, Homo sapiens
tacgactcttttccaaacaca

SEQ ID NO: 2747830 - DNA, 14 bp, Homo sapiens
tactacagttttta

SEQ ID NO: 2747831 - DNA, 20 bp, Homo sapiens
tactaggtacataagcttct

SEQ ID NO: 2747832 - DNA, 20 bp, Homo sapiens
tactataaatgatatctata

SEQ ID NO: 2747833 - DNA, 13 bp, Homo sapiens
tactggataaatt

SEQ ID NO: 2747834 - DNA, 13 bp, Homo sapiens
tactgtaagaaaa

SEQ ID NO: 2747835 - DNA, 14 bp, Homo sapiens
tactgttaaaactg

SEQ ID NO: 2747836 - DNA, 16 bp, Homo sapiens
tactgttaaaactgta

SEQ ID NO: 2747837 - DNA, 18 bp, Homo sapiens
tacttactgttaaaactg

SEQ ID NO: 2747838 - DNA, 15 bp, Homo sapiens
tacttggcaaattct

SEQ ID NO: 2747839 - DNA, 17 bp, Homo sapiens
tacttggcaaattctga

SEQ ID NO: 2747840 - DNA, 12 bp, Homo sapiens
tactttaaattt

SEQ ID NO: 2747841 - DNA, 17 bp, Homo sapiens
tacttttttcaaatatt

SEQ ID NO: 2747842 - DNA, 20 bp, Homo sapiens
tacttttttcaaatattgaa

SEQ ID NO: 2747843 - DNA, 22 bp, Homo sapiens
tacttttttcaaatattgaatg

SEQ ID NO: 2747844 - DNA, 20 bp, Homo sapiens
tagaaaatggaaaatataca

SEQ ID NO: 2747845 - DNA, 15 bp, Homo sapiens
tagaaacacaactat

SEQ ID NO: 2747846 - DNA, 17 bp, Homo sapiens
tagaaagctaatacaaa

SEQ ID NO: 2747847 - DNA, 16 bp, Homo sapiens
tagaaaggctaacaaa

SEQ ID NO: 2747848 - DNA, 14 bp, Homo sapiens
tagaacctacaaaa

SEQ ID NO: 2747849 - DNA, 18 bp, Homo sapiens
tagaactggtgatataaa

SEQ ID NO: 2747850 - DNA, 13 bp, Homo sapiens
tagaataaaagct

SEQ ID NO: 2747851 - DNA, 16 bp, Homo sapiens
tagaataaaagctgtg

SEQ ID NO: 2747852 - DNA, 15 bp, Homo sapiens
tagaatccacacata

SEQ ID NO: 2747853 - DNA, 22 bp, Homo sapiens
tagactctctagttttatctta

SEQ ID NO: 2747854 - DNA, 23 bp, Homo sapiens
tagagaagggagacattgtttgg

SEQ ID NO: 2747855 - DNA, 14 bp, Homo sapiens
tagagttaaaagtt

SEQ ID NO: 2747856 - DNA, 17 bp, Homo sapiens
tagataggccatgggca

SEQ ID NO: 2747857 - DNA, 13 bp, Homo sapiens
tagatgcagaaaa

SEQ ID NO: 2747858 - DNA, 15 bp, Homo sapiens
tagatgcagttctga

SEQ ID NO: 2747859 - DNA, 14 bp, Homo sapiens
tagatttttaaatt

SEQ ID NO: 2747860 - DNA, 17 bp, Homo sapiens
tagatttttaaattgga

SEQ ID NO: 2747861 - DNA, 20 bp, Homo sapiens
tagatttttaaattggagaa

SEQ ID NO: 2747862 - DNA, 14 bp, Homo sapiens
tagctagaatccac

SEQ ID NO: 2747863 - DNA, 20 bp, Homo sapiens
tagctgcatttgtctggcct

SEQ ID NO: 2747864 - DNA, 18 bp, Homo sapiens
taggaaatatttatttta

SEQ ID NO: 2747865 - DNA, 18 bp, Homo sapiens
taggaactgctgggcttg

SEQ ID NO: 2747866 - DNA, 23 bp, Homo sapiens
taggacccatatgggaattatta

SEQ ID NO: 2747867 - DNA, 14 bp, Homo sapiens
tagggaactttgat

SEQ ID NO: 2747868 - DNA, 14 bp, Homo sapiens
tagtagttaaaaca

SEQ ID NO: 2747869 - DNA, 16 bp, Homo sapiens
tagtatagaaaatgga

SEQ ID NO: 2747870 - DNA, 17 bp, Homo sapiens
tagtatagaaaatggaa

SEQ ID NO: 2747871 - DNA, 18 bp, Homo sapiens
tagtatagaaaatggaaa

SEQ ID NO: 2747872 - DNA, 19 bp, Homo sapiens
tagtatttctatgaaatat

SEQ ID NO: 2747873 - DNA, 14 bp, Homo sapiens
tagtcaaattgtgt

SEQ ID NO: 2747874 - DNA, 17 bp, Homo sapiens
tagtgtcctatgcaata

SEQ ID NO: 2747875 - DNA, 23 bp, Homo sapiens
tagtgttggagaagaactgaaat

SEQ ID NO: 2747876 - DNA, 17 bp, Homo sapiens
tagttaaaacagctatt

SEQ ID NO: 2747877 - DNA, 13 bp, Homo sapiens
tagttctgttaaa

SEQ ID NO: 2747878 - DNA, 12 bp, Homo sapiens
tagttgaaagta

SEQ ID NO: 2747879 - DNA, 21 bp, Homo sapiens
tagttgcttttgaaggaatac

SEQ ID NO: 2747880 - DNA, 18 bp, Homo sapiens
aaaaacattgaaatatta

SEQ ID NO: 2747881 - DNA, 17 bp, Homo sapiens
aaaaaccgaataaatgt

SEQ ID NO: 2747882 - DNA, 20 bp, Homo sapiens
aaaaacctattttgaaaggt

SEQ ID NO: 2747883 - DNA, 21 bp, Homo sapiens
aaaaactataaatacaaatct

SEQ ID NO: 2747884 - DNA, 11 bp, Homo sapiens
aaaaagaaaaa

SEQ ID NO: 2747885 - DNA, 16 bp, Homo sapiens
aaaaagaaacatttgg

SEQ ID NO: 2747886 - DNA, 21 bp, Homo sapiens
aaaaagtccttcagtttagaa

SEQ ID NO: 2747887 - DNA, 22 bp, Homo sapiens
aaaaatgttttatggtagcttt

SEQ ID NO: 2747888 - DNA, 17 bp, Homo sapiens
aaaaattggcattttaa

SEQ ID NO: 2747889 - DNA, 17 bp, Homo sapiens
aaaacaagcaggatggc

SEQ ID NO: 2747890 - DNA, 17 bp, Homo sapiens
aaaacaaggatgaatta

SEQ ID NO: 2747891 - DNA, 15 bp, Homo sapiens
aaaacagctatttta

SEQ ID NO: 2747892 - DNA, 14 bp, Homo sapiens
aaaacattgaaata

SEQ ID NO: 2747893 - DNA, 15 bp, Homo sapiens
aaaaccattggggag

SEQ ID NO: 2747894 - DNA, 16 bp, Homo sapiens
aaaactgtaccttttg

SEQ ID NO: 2747895 - DNA, 14 bp, Homo sapiens
aaaacttttttctt

SEQ ID NO: 2747896 - DNA, 14 bp, Homo sapiens
aaaagaaaaaagtc

SEQ ID NO: 2747897 - DNA, 11 bp, Homo sapiens
aaaagaatgat

SEQ ID NO: 2747898 - DNA, 12 bp, Homo sapiens
aaaagaattacc

SEQ ID NO: 2747899 - DNA, 18 bp, Homo sapiens
aaaagcaaaatttttaaa

SEQ ID NO: 2747900 - DNA, 22 bp, Homo sapiens
aaaagcaaatactgattttcaa

SEQ ID NO: 2747901 - DNA, 18 bp, Homo sapiens
aaaagctgtggaatgaag

SEQ ID NO: 2747902 - DNA, 17 bp, Homo sapiens
aaaagggtcaaacctgt

SEQ ID NO: 2747903 - DNA, 14 bp, Homo sapiens
aaaagtccttcagt

SEQ ID NO: 2747904 - DNA, 18 bp, Homo sapiens
aaaagttgtttaataagt

SEQ ID NO: 2747905 - DNA, 12 bp, Homo sapiens
aaaataaaagct

SEQ ID NO: 2747906 - DNA, 19 bp, Homo sapiens
aaaataattgagactgaaa

SEQ ID NO: 2747907 - DNA, 16 bp, Homo sapiens
aaaataatttttatat

SEQ ID NO: 2747908 - DNA, 20 bp, Homo sapiens
aaaataatttttatatttga

SEQ ID NO: 2747909 - DNA, 18 bp, Homo sapiens
aaaatacataacttcagt

SEQ ID NO: 2747910 - DNA, 16 bp, Homo sapiens
aaaatacctcaggaaa

SEQ ID NO: 2747911 - DNA, 18 bp, Homo sapiens
aaaatacctcaggaaaga

SEQ ID NO: 2747912 - DNA, 20 bp, Homo sapiens
aaaatacctcaggaaagaat

SEQ ID NO: 2747913 - DNA, 13 bp, Homo sapiens
aaaatatacaagt

SEQ ID NO: 2747914 - DNA, 15 bp, Homo sapiens
aaaatatacaagtaa

SEQ ID NO: 2747915 - DNA, 20 bp, Homo sapiens
aaaatatacaagtaaattct

SEQ ID NO: 2747916 - DNA, 14 bp, Homo sapiens
aaaatattttatct

SEQ ID NO: 2747917 - DNA, 18 bp, Homo sapiens
aaaatcaggagcctgcta

SEQ ID NO: 2747918 - DNA, 16 bp, Homo sapiens
aaaatctcaatatttc

SEQ ID NO: 2747919 - DNA, 13 bp, Homo sapiens
aaaatgccaccat

SEQ ID NO: 2747920 - DNA, 16 bp, Homo sapiens
aaaatgtagaaattct

SEQ ID NO: 2747921 - DNA, 16 bp, Homo sapiens
aaaatgtgtgtattct

SEQ ID NO: 2747922 - DNA, 23 bp, Homo sapiens
aaaatgtgtgtattcttaaaatg

SEQ ID NO: 2747923 - DNA, 18 bp, Homo sapiens
aaaattacctttaatgca

SEQ ID NO: 2747924 - DNA, 19 bp, Homo sapiens
aaaattacctttaatgcaa

SEQ ID NO: 2747925 - DNA, 12 bp, Homo sapiens
aaaattcatgcc

SEQ ID NO: 2747926 - DNA, 21 bp, Homo sapiens
aaaattcatgccccagtatta

SEQ ID NO: 2747927 - DNA, 18 bp, Homo sapiens
aaaattggcattttaagt

SEQ ID NO: 2747928 - DNA, 20 bp, Homo sapiens
aaaatttaaaaaactcctgt

SEQ ID NO: 2747929 - DNA, 17 bp, Homo sapiens
aaaatttttaaaactgc

SEQ ID NO: 2747930 - DNA, 19 bp, Homo sapiens
aaaattttttctctaggaa

SEQ ID NO: 2747931 - DNA, 12 bp, Homo sapiens
aaacaaaaacat

SEQ ID NO: 2747932 - DNA, 14 bp, Homo sapiens
aaacacaactatat

SEQ ID NO: 2747933 - DNA, 13 bp, Homo sapiens
aaacatttgccaa

SEQ ID NO: 2747934 - DNA, 19 bp, Homo sapiens
aaacccttgccatgtgcta

SEQ ID NO: 2747935 - DNA, 12 bp, Homo sapiens
aaacctattttg

SEQ ID NO: 2747936 - DNA, 15 bp, Homo sapiens
aaacctattttgaaa

SEQ ID NO: 2747937 - DNA, 17 bp, Homo sapiens
aaacctattttgaaagg

SEQ ID NO: 2747938 - DNA, 18 bp, Homo sapiens
aaacctattttgaaaggt

SEQ ID NO: 2747939 - DNA, 19 bp, Homo sapiens
aaacctgctccaaggcagt

SEQ ID NO: 2747940 - DNA, 14 bp, Homo sapiens
aaacctgctggtgg

SEQ ID NO: 2747941 - DNA, 19 bp, Homo sapiens
aaacctgtagatgcagaaa

SEQ ID NO: 2747942 - DNA, 17 bp, Homo sapiens
aaactaagatttatctg

SEQ ID NO: 2747943 - DNA, 15 bp, Homo sapiens
aaactataaatacaa

SEQ ID NO: 2747944 - DNA, 18 bp, Homo sapiens
aaactatcctatgccttc

SEQ ID NO: 2747945 - DNA, 22 bp, Homo sapiens
aaactatcctatgccttcaaat

SEQ ID NO: 2747946 - DNA, 12 bp, Homo sapiens
aaactgtttctt

SEQ ID NO: 2747947 - DNA, 18 bp, Homo sapiens
aaacttttttctttgaaa

SEQ ID NO: 2747948 - DNA, 22 bp, Homo sapiens
aaacttttttctttgaaatgct

SEQ ID NO: 2747949 - DNA, 17 bp, Homo sapiens
aaagaaaaaaaaagaat

SEQ ID NO: 2747950 - DNA, 13 bp, Homo sapiens
aaagaaacatttg

SEQ ID NO: 2747951 - DNA, 17 bp, Homo sapiens
aaagaatccaagacaaa

SEQ ID NO: 2747952 - DNA, 21 bp, Homo sapiens
aaagaatccaagacaaactaa

SEQ ID NO: 2747953 - DNA, 22 bp, Homo sapiens
aaagaatccaagacaaactaaa

SEQ ID NO: 2747954 - DNA, 13 bp, Homo sapiens
aaagaatgaaagt

SEQ ID NO: 2747955 - DNA, 16 bp, Homo sapiens
aaagaatgattatgaa

SEQ ID NO: 2747956 - DNA, 15 bp, Homo sapiens
aaagacgatgtttat

SEQ ID NO: 2747957 - DNA, 16 bp, Homo sapiens
aaagacgatgtttatg

SEQ ID NO: 2747958 - DNA, 22 bp, Homo sapiens
aaagagacaaactgtaaaaaat

SEQ ID NO: 2747959 - DNA, 12 bp, Homo sapiens
aaagattcttta

SEQ ID NO: 2747960 - DNA, 18 bp, Homo sapiens
aaagattctttaaactac

SEQ ID NO: 2747961 - DNA, 12 bp, Homo sapiens
aaagcaaatact

SEQ ID NO: 2747962 - DNA, 13 bp, Homo sapiens
aaagcaaatactg

SEQ ID NO: 2747963 - DNA, 14 bp, Homo sapiens
aaagcaaatactga

SEQ ID NO: 2747964 - DNA, 17 bp, Homo sapiens
aaagctgttaaaataca

SEQ ID NO: 2747965 - DNA, 15 bp, Homo sapiens
aaagcttgtgtatct

SEQ ID NO: 2747966 - DNA, 19 bp, Homo sapiens
aaagcttgtgtatcttgat

SEQ ID NO: 2747967 - DNA, 20 bp, Homo sapiens
aaaggatgatcaaaaataat

SEQ ID NO: 2747968 - DNA, 14 bp, Homo sapiens
aaaggtacttcaaa

SEQ ID NO: 2747969 - DNA, 16 bp, Homo sapiens
aaaggtcagaattttg

SEQ ID NO: 2747970 - DNA, 17 bp, Homo sapiens
aaaggtcagaattttgt

SEQ ID NO: 2747971 - DNA, 19 bp, Homo sapiens
aaaggttaatttttccttc

SEQ ID NO: 2747972 - DNA, 17 bp, Homo sapiens
aaagtaaaaaaataatt

SEQ ID NO: 2747973 - DNA, 19 bp, Homo sapiens
aaagtaaaaccataaacat

SEQ ID NO: 2747974 - DNA, 12 bp, Homo sapiens
aaagtaaaatat

SEQ ID NO: 2747975 - DNA, 18 bp, Homo sapiens
aaagtatgttagtgcaaa

SEQ ID NO: 2747976 - DNA, 20 bp, Homo sapiens
aaagtcctgaacctttcaaa

SEQ ID NO: 2747977 - DNA, 16 bp, Homo sapiens
aaagtctatctaatga

SEQ ID NO: 2747978 - DNA, 19 bp, Homo sapiens
aaagtgagaaagaaagtaa

SEQ ID NO: 2747979 - DNA, 17 bp, Homo sapiens
aaagttgtactgcatct

SEQ ID NO: 2747980 - DNA, 14 bp, Homo sapiens
aaagttgtatcagt

SEQ ID NO: 2747981 - DNA, 17 bp, Homo sapiens
aaagttgtttaataagt

SEQ ID NO: 2747982 - DNA, 20 bp, Homo sapiens
aaagttgtttaataagtata

SEQ ID NO: 2747983 - DNA, 18 bp, Homo sapiens
aaagttttttatatatga

SEQ ID NO: 2747984 - DNA, 17 bp, Homo sapiens
aaataattgagactgaa

SEQ ID NO: 2747985 - DNA, 15 bp, Homo sapiens
aaataatttttatat

SEQ ID NO: 2747986 - DNA, 22 bp, Homo sapiens
aaataatttttatatttgaaat

SEQ ID NO: 2747987 - DNA, 13 bp, Homo sapiens
aaatacaaatctg

SEQ ID NO: 2747988 - DNA, 17 bp, Homo sapiens
aaatacaaatctgtata

SEQ ID NO: 2747989 - DNA, 17 bp, Homo sapiens
aaatacctcaggaaaga

SEQ ID NO: 2747990 - DNA, 12 bp, Homo sapiens
aaatagatttag

SEQ ID NO: 2747991 - DNA, 14 bp, Homo sapiens
aaatagatttagtc

SEQ ID NO: 2747992 - DNA, 15 bp, Homo sapiens
aaatagtatagaaaa

SEQ ID NO: 2747993 - DNA, 16 bp, Homo sapiens
aaatagtatagaaaat

SEQ ID NO: 2747994 - DNA, 19 bp, Homo sapiens
aaatatacaagtaaattct

SEQ ID NO: 2747995 - DNA, 11 bp, Homo sapiens
aaatatagttg

SEQ ID NO: 2747996 - DNA, 17 bp, Homo sapiens
aaatatagttgaaagta

SEQ ID NO: 2747997 - DNA, 10 bp, Homo sapiens
aaatatctga

SEQ ID NO: 2747998 - DNA, 16 bp, Homo sapiens
aaatatctgaacattt

SEQ ID NO: 2747999 - DNA, 19 bp, Homo sapiens
aaatattagttacttgcta

SEQ ID NO: 2748000 - DNA, 18 bp, Homo sapiens
aaatattggtattaaaga

SEQ ID NO: 2748001 - DNA, 14 bp, Homo sapiens
aaatatttgaaaat

SEQ ID NO: 2748002 - DNA, 14 bp, Homo sapiens
aaatattttatctt

SEQ ID NO: 2748003 - DNA, 18 bp, Homo sapiens
aaatcacactcaaacttt

SEQ ID NO: 2748004 - DNA, 13 bp, Homo sapiens
aaatcagaataaa

SEQ ID NO: 2748005 - DNA, 21 bp, Homo sapiens
aaatcagaataaattaatatt

SEQ ID NO: 2748006 - DNA, 16 bp, Homo sapiens
aaatcaggagcctgct

SEQ ID NO: 2748007 - DNA, 16 bp, Homo sapiens
aagttacatgcataaa

SEQ ID NO: 2748008 - DNA, 18 bp, Homo sapiens
aagttacatgcataaaag

SEQ ID NO: 2748009 - DNA, 17 bp, Homo sapiens
aagttagcattgtttct

SEQ ID NO: 2748010 - DNA, 13 bp, Homo sapiens
aagttattgctgc

SEQ ID NO: 2748011 - DNA, 20 bp, Homo sapiens
aagttattgctgcataaatt

SEQ ID NO: 2748012 - DNA, 22 bp, Homo sapiens
aagttattgctgcataaatttg

SEQ ID NO: 2748013 - DNA, 22 bp, Homo sapiens
aagttcacattaactcaggcat

SEQ ID NO: 2748014 - DNA, 22 bp, Homo sapiens
aagttgatatgccttttcccaa

SEQ ID NO: 2748015 - DNA, 21 bp, Homo sapiens
aagttttttatatatgaatat

SEQ ID NO: 2748016 - DNA, 13 bp, Homo sapiens
aataaaagctatt

SEQ ID NO: 2748017 - DNA, 14 bp, Homo sapiens
aataaaattatttg

SEQ ID NO: 2748018 - DNA, 16 bp, Homo sapiens
aataaactagagaagg

SEQ ID NO: 2748019 - DNA, 18 bp, Homo sapiens
aataaattaatattgtat

SEQ ID NO: 2748020 - DNA, 21 bp, Homo sapiens
aataaattaatattgtattgc

SEQ ID NO: 2748021 - DNA, 21 bp, Homo sapiens
aataagtatatcttaagaatg

SEQ ID NO: 2748022 - DNA, 17 bp, Homo sapiens
aataagtgccaggatgg

SEQ ID NO: 2748023 - DNA, 19 bp, Homo sapiens
aataatgtagttttgttta

SEQ ID NO: 2748024 - DNA, 12 bp, Homo sapiens
aataatgtttca

SEQ ID NO: 2748025 - DNA, 14 bp, Homo sapiens
aataatgtttcaaa

SEQ ID NO: 2748026 - DNA, 19 bp, Homo sapiens
aataatgtttcaaacatat

SEQ ID NO: 2748027 - DNA, 17 bp, Homo sapiens
aataattgagactgaaa

SEQ ID NO: 2748028 - DNA, 14 bp, Homo sapiens
aatacataacttca

SEQ ID NO: 2748029 - DNA, 23 bp, Homo sapiens
aatacataacttcagtgcaagag

SEQ ID NO: 2748030 - DNA, 23 bp, Homo sapiens
aatacatcccttacctgggaaag

SEQ ID NO: 2748031 - DNA, 16 bp, Homo sapiens
aatacctcaggaaaga

SEQ ID NO: 2748032 - DNA, 14 bp, Homo sapiens
aatacctttctaag

SEQ ID NO: 2748033 - DNA, 20 bp, Homo sapiens
aatactgattttcaaaaaaa

SEQ ID NO: 2748034 - DNA, 14 bp, Homo sapiens
aatagaaagaaagt

SEQ ID NO: 2748035 - DNA, 23 bp, Homo sapiens
aatagtgtcctatgcaataaaat

SEQ ID NO: 2748036 - DNA, 18 bp, Homo sapiens
aatatacaagtaaattct

SEQ ID NO: 2748037 - DNA, 22 bp, Homo sapiens
aatatacacattttgtaaatct

SEQ ID NO: 2748038 - DNA, 14 bp, Homo sapiens
aatatatcctgttt

SEQ ID NO: 2748039 - DNA, 21 bp, Homo sapiens
aatatatcctgtttgtatttt

SEQ ID NO: 2748040 - DNA, 12 bp, Homo sapiens
aatatcacttgt

SEQ ID NO: 2748041 - DNA, 18 bp, Homo sapiens
aatatgaccttaaggaaa

SEQ ID NO: 2748042 - DNA, 21 bp, Homo sapiens
aatatgccccattcaacatct

SEQ ID NO: 2748043 - DNA, 13 bp, Homo sapiens
aatattacatgta

SEQ ID NO: 2748044 - DNA, 15 bp, Homo sapiens
aatattacatgtaaa

SEQ ID NO: 2748045 - DNA, 23 bp, Homo sapiens
aatattacatgtaaagctgttaa

SEQ ID NO: 2748046 - DNA, 18 bp, Homo sapiens
aatattacctaatgaaag

SEQ ID NO: 2748047 - DNA, 19 bp, Homo sapiens
aatattacctaatgaaagt

SEQ ID NO: 2748048 - DNA, 15 bp, Homo sapiens
aatattgaatgcctt

SEQ ID NO: 2748049 - DNA, 16 bp, Homo sapiens
aatattgaatgcctta

SEQ ID NO: 2748050 - DNA, 17 bp, Homo sapiens
aatattggtattaaaga

SEQ ID NO: 2748051 - DNA, 17 bp, Homo sapiens
aatattgtattgctgct

SEQ ID NO: 2748052 - DNA, 19 bp, Homo sapiens
aatatttattttaataatg

SEQ ID NO: 2748053 - DNA, 14 bp, Homo sapiens
aatattttatcttt

SEQ ID NO: 2748054 - DNA, 13 bp, Homo sapiens
aatcacactcaaa

SEQ ID NO: 2748055 - DNA, 17 bp, Homo sapiens
aatcacactcaaacttt

SEQ ID NO: 2748056 - DNA, 19 bp, Homo sapiens
aatcacactcaaactttgt

SEQ ID NO: 2748057 - DNA, 15 bp, Homo sapiens
aatcagaataaatta

SEQ ID NO: 2748058 - DNA, 23 bp, Homo sapiens
aatcagaataaattaatattgta

SEQ ID NO: 2748059 - DNA, 16 bp, Homo sapiens
aatcagcctagttgat

SEQ ID NO: 2748060 - DNA, 18 bp, Homo sapiens
aatcaggagcctgctaag

SEQ ID NO: 2748061 - DNA, 16 bp, Homo sapiens
aatcagggttagtatt

SEQ ID NO: 2748062 - DNA, 15 bp, Homo sapiens
aatcatgaattagtt

SEQ ID NO: 2748063 - DNA, 23 bp, Homo sapiens
aatcatgaattagttttatatgc

SEQ ID NO: 2748064 - DNA, 17 bp, Homo sapiens
aatcattttaggaaagg

SEQ ID NO: 2748065 - DNA, 19 bp, Homo sapiens
aatcattttaggaaaggat

SEQ ID NO: 2748066 - DNA, 17 bp, Homo sapiens
aatccatacatttgtgt

SEQ ID NO: 2748067 - DNA, 16 bp, Homo sapiens
aatctcaatatttcag

SEQ ID NO: 2748068 - DNA, 22 bp, Homo sapiens
aatctccaactttattttgaat

SEQ ID NO: 2748069 - DNA, 14 bp, Homo sapiens
aatctgtacttttt

SEQ ID NO: 2748070 - DNA, 20 bp, Homo sapiens
aatctgtacttttttcaaat

SEQ ID NO: 2748071 - DNA, 19 bp, Homo sapiens
aatctgtataaatgtctat

SEQ ID NO: 2748072 - DNA, 13 bp, Homo sapiens
aatcttggtgtaa

SEQ ID NO: 2748073 - DNA, 22 bp, Homo sapiens
aatcttggtgtaacttaaatat

SEQ ID NO: 2748074 - DNA, 20 bp, Homo sapiens
aatcttgttttaagcaaatg

SEQ ID NO: 2748075 - DNA, 23 bp, Homo sapiens
aatcttgttttaagcaaatgcat

SEQ ID NO: 2748076 - DNA, 15 bp, Homo sapiens
aatgagaccccttta

SEQ ID NO: 2748077 - DNA, 21 bp, Homo sapiens
aatgagagacacactgaagaa

SEQ ID NO: 2748078 - DNA, 14 bp, Homo sapiens
aatgataactggaa

SEQ ID NO: 2748079 - DNA, 15 bp, Homo sapiens
aatgataactggaaa

SEQ ID NO: 2748080 - DNA, 17 bp, Homo sapiens
aatgataactggaaact

SEQ ID NO: 2748081 - DNA, 15 bp, Homo sapiens
aatgatatctatatt

SEQ ID NO: 2748082 - DNA, 18 bp, Homo sapiens
aatgatatctatattcta

SEQ ID NO: 2748083 - DNA, 15 bp, Homo sapiens
aatgattatgaatta

SEQ ID NO: 2748084 - DNA, 14 bp, Homo sapiens
aatgcaatatttgt

SEQ ID NO: 2748085 - DNA, 14 bp, Homo sapiens
aatgcatatctgtt

SEQ ID NO: 2748086 - DNA, 15 bp, Homo sapiens
aatgcatatctgttt

SEQ ID NO: 2748087 - DNA, 17 bp, Homo sapiens
aatgcatatctgtttat

SEQ ID NO: 2748088 - DNA, 19 bp, Homo sapiens
aatgccagggcctgctgag

SEQ ID NO: 2748089 - DNA, 23 bp, Homo sapiens
aatgccatagtcaaagagagttt

SEQ ID NO: 2748090 - DNA, 16 bp, Homo sapiens
aatgctgtattttaaa

SEQ ID NO: 2748091 - DNA, 17 bp, Homo sapiens
aatgcttataggctggg

SEQ ID NO: 2748092 - DNA, 18 bp, Homo sapiens
aatggaaaatatacaagt

SEQ ID NO: 2748093 - DNA, 18 bp, Homo sapiens
aatggatataatctgaat

SEQ ID NO: 2748094 - DNA, 15 bp, Homo sapiens
aatggtggcttcttt

SEQ ID NO: 2748095 - DNA, 17 bp, Homo sapiens
aatgtactttttattgc

SEQ ID NO: 2748096 - DNA, 21 bp, Homo sapiens
aatgtactttttattgcatgg

SEQ ID NO: 2748097 - DNA, 14 bp, Homo sapiens
aatgtagaaattct

SEQ ID NO: 2748098 - DNA, 22 bp, Homo sapiens
aatgtatctgagtattgaatga

SEQ ID NO: 2748099 - DNA, 15 bp, Homo sapiens
aatgtcagtatgtgg

SEQ ID NO: 2748100 - DNA, 16 bp, Homo sapiens
aatgtcagtatgtgga

SEQ ID NO: 2748101 - DNA, 16 bp, Homo sapiens
aatgtctattattatg

SEQ ID NO: 2748102 - DNA, 22 bp, Homo sapiens
aatgtgatctatgtttcatctt

SEQ ID NO: 2748103 - DNA, 23 bp, Homo sapiens
aatgtgctagagttaaaagttag

SEQ ID NO: 2748104 - DNA, 14 bp, Homo sapiens
aatgttaccagact

SEQ ID NO: 2748105 - DNA, 16 bp, Homo sapiens
aatgttaccagacttc

SEQ ID NO: 2748106 - DNA, 20 bp, Homo sapiens
aatgttaccagacttcaaga

SEQ ID NO: 2748107 - DNA, 13 bp, Homo sapiens
aattacatttgta

SEQ ID NO: 2748108 - DNA, 14 bp, Homo sapiens
aattacatttgtat

SEQ ID NO: 2748109 - DNA, 14 bp, Homo sapiens
aattaccaagagaa

SEQ ID NO: 2748110 - DNA, 18 bp, Homo sapiens
aattacctttaatgcaat

SEQ ID NO: 2748111 - DNA, 14 bp, Homo sapiens
aattaggataacta

SEQ ID NO: 2748112 - DNA, 16 bp, Homo sapiens
aattaggataactaaa

SEQ ID NO: 2748113 - DNA, 17 bp, Homo sapiens
aattagttttatatgct

SEQ ID NO: 2748114 - DNA, 18 bp, Homo sapiens
aattcatgccccagtatt

SEQ ID NO: 2748115 - DNA, 14 bp, Homo sapiens
aattccttaaaatt

SEQ ID NO: 2748116 - DNA, 15 bp, Homo sapiens
aattccttaaaattt

SEQ ID NO: 2748117 - DNA, 13 bp, Homo sapiens
aattctaaactta

SEQ ID NO: 2748118 - DNA, 16 bp, Homo sapiens
aattctaaacttagaa

SEQ ID NO: 2748119 - DNA, 18 bp, Homo sapiens
aattctagacataactgg

SEQ ID NO: 2748120 - DNA, 13 bp, Homo sapiens
aattctgaatttt

SEQ ID NO: 2748121 - DNA, 18 bp, Homo sapiens
aattctgaggtaagtgta

SEQ ID NO: 2748122 - DNA, 16 bp, Homo sapiens
aattctttagattttt

SEQ ID NO: 2748123 - DNA, 22 bp, Homo sapiens
aattctttagatttttaaattg

SEQ ID NO: 2748124 - DNA, 23 bp, Homo sapiens
aattgaaagcactatgaatttgt

SEQ ID NO: 2748125 - DNA, 16 bp, Homo sapiens
aattgagactgaaaga

SEQ ID NO: 2748126 - DNA, 15 bp, Homo sapiens
aattgtgatgtgtcc

SEQ ID NO: 2748127 - DNA, 18 bp, Homo sapiens
aattgtttttataaaaac

SEQ ID NO: 2748128 - DNA, 16 bp, Homo sapiens
aatttaaaacacagta

SEQ ID NO: 2748129 - DNA, 19 bp, Homo sapiens
aatttaaaacacagtattg

SEQ ID NO: 2748130 - DNA, 19 bp, Homo sapiens
aatttaccacaaaagcaaa

SEQ ID NO: 2748131 - DNA, 23 bp, Homo sapiens
aatttaccacaaaagcaaaattt

SEQ ID NO: 2748132 - DNA, 20 bp, Homo sapiens
aatttacctctcattagaaa

SEQ ID NO: 2748133 - DNA, 13 bp, Homo sapiens
agcacatccacca

SEQ ID NO: 2748134 - DNA, 18 bp, Homo sapiens
agcagaagccccaaagtt

SEQ ID NO: 2748135 - DNA, 19 bp, Homo sapiens
agcagtcaggaaagagaac

SEQ ID NO: 2748136 - DNA, 13 bp, Homo sapiens
agcatctcccagt

SEQ ID NO: 2748137 - DNA, 13 bp, Homo sapiens
agcatttaaaaga

SEQ ID NO: 2748138 - DNA, 19 bp, Homo sapiens
agccagattttcctgaaaa

SEQ ID NO: 2748139 - DNA, 21 bp, Homo sapiens
agccctgttcctccctcccac

SEQ ID NO: 2748140 - DNA, 14 bp, Homo sapiens
agcctctttgtgtt

SEQ ID NO: 2748141 - DNA, 13 bp, Homo sapiens
agcctgctaagga

SEQ ID NO: 2748142 - DNA, 17 bp, Homo sapiens
agcctggggcaaaccta

SEQ ID NO: 2748143 - DNA, 22 bp, Homo sapiens
agcctgttgggatcgcattgca

SEQ ID NO: 2748144 - DNA, 23 bp, Homo sapiens
agccttccaccggcactcatgac

SEQ ID NO: 2748145 - DNA, 22 bp, Homo sapiens
agcgctggtcccctccctctgt

SEQ ID NO: 2748146 - DNA, 12 bp, Homo sapiens
agctagaatcca

SEQ ID NO: 2748147 - DNA, 14 bp, Homo sapiens
agctgagcaggtgt

SEQ ID NO: 2748148 - DNA, 15 bp, Homo sapiens
agctggggatgtctc

SEQ ID NO: 2748149 - DNA, 14 bp, Homo sapiens
agctggtttcctgc

SEQ ID NO: 2748150 - DNA, 15 bp, Homo sapiens
agctggtttcctgcc

SEQ ID NO: 2748151 - DNA, 22 bp, Homo sapiens
agctggtttcctgcccagcctg

SEQ ID NO: 2748152 - DNA, 16 bp, Homo sapiens
agctgtgattatgcca

SEQ ID NO: 2748153 - DNA, 20 bp, Homo sapiens
agctgttaaaatacataact

SEQ ID NO: 2748154 - DNA, 21 bp, Homo sapiens
agcttattgtctagtgaaact

SEQ ID NO: 2748155 - DNA, 14 bp, Homo sapiens
agcttctattcatt

SEQ ID NO: 2748156 - DNA, 19 bp, Homo sapiens
agcttgtgtatcttgatta

SEQ ID NO: 2748157 - DNA, 21 bp, Homo sapiens
agcttgtgtatcttgattaat

SEQ ID NO: 2748158 - DNA, 18 bp, Homo sapiens
agctttaaaaagaaaaaa

SEQ ID NO: 2748159 - DNA, 14 bp, Homo sapiens
aggaagctgaatta

SEQ ID NO: 2748160 - DNA, 20 bp, Homo sapiens
aggaaggtcccatggcctgc

SEQ ID NO: 2748161 - DNA, 14 bp, Homo sapiens
aggaagtcttcaaa

SEQ ID NO: 2748162 - DNA, 19 bp, Homo sapiens
aggaagtcttcaaatttga

SEQ ID NO: 2748163 - DNA, 14 bp, Homo sapiens
aggaattttaaaaa

SEQ ID NO: 2748164 - DNA, 12 bp, Homo sapiens
aggacagaatgg

SEQ ID NO: 2748165 - DNA, 18 bp, Homo sapiens
aggacagaatggatataa

SEQ ID NO: 2748166 - DNA, 19 bp, Homo sapiens
aggacagtatttgtgggga

SEQ ID NO: 2748167 - DNA, 22 bp, Homo sapiens
aggaccagtttatgtttgtggt

SEQ ID NO: 2748168 - DNA, 14 bp, Homo sapiens
aggactaggaccca

SEQ ID NO: 2748169 - DNA, 21 bp, Homo sapiens
aggactcttccatcagagatg

SEQ ID NO: 2748170 - DNA, 14 bp, Homo sapiens
aggagcctgctaag

SEQ ID NO: 2748171 - DNA, 15 bp, Homo sapiens
aggagcctgctaagg

SEQ ID NO: 2748172 - DNA, 20 bp, Homo sapiens
aggagcctgctaaggaacaa

SEQ ID NO: 2748173 - DNA, 23 bp, Homo sapiens
aggagcctgctaaggaacaatgc

SEQ ID NO: 2748174 - DNA, 15 bp, Homo sapiens
aggattctgcagaaa

SEQ ID NO: 2748175 - DNA, 21 bp, Homo sapiens
aggccatttgttacagtttct

SEQ ID NO: 2748176 - DNA, 15 bp, Homo sapiens
aggcccctgggtttc

SEQ ID NO: 2748177 - DNA, 16 bp, Homo sapiens
aggctagatgtatgta

SEQ ID NO: 2748178 - DNA, 21 bp, Homo sapiens
aggcttgttccaatgccacat

SEQ ID NO: 2748179 - DNA, 14 bp, Homo sapiens
agggaaaaaacaag

SEQ ID NO: 2748180 - DNA, 18 bp, Homo sapiens
agggaaatcttggtgtaa

SEQ ID NO: 2748181 - DNA, 23 bp, Homo sapiens
agggaactttgatacaaatggga

SEQ ID NO: 2748182 - DNA, 15 bp, Homo sapiens
agggaataaattttt

SEQ ID NO: 2748183 - DNA, 22 bp, Homo sapiens
agggagacattgtttggatttc

SEQ ID NO: 2748184 - DNA, 17 bp, Homo sapiens
agggccgagaggacaga

SEQ ID NO: 2748185 - DNA, 21 bp, Homo sapiens
agggtatgtcacaaagagctg

SEQ ID NO: 2748186 - DNA, 17 bp, Homo sapiens
agggttatgattaagta

SEQ ID NO: 2748187 - DNA, 16 bp, Homo sapiens
aggtgtctggcctgag

SEQ ID NO: 2748188 - DNA, 23 bp, Homo sapiens
aggttaatttttccttcctctgt

SEQ ID NO: 2748189 - DNA, 20 bp, Homo sapiens
aggttggcaaacgggcttga

SEQ ID NO: 2748190 - DNA, 23 bp, Homo sapiens
aggtttgtttagaagaagtgtgt

SEQ ID NO: 2748191 - DNA, 20 bp, Homo sapiens
aggttttaaggattctgcag

SEQ ID NO: 2748192 - DNA, 13 bp, Homo sapiens
agtaaaatatgtc

SEQ ID NO: 2748193 - DNA, 20 bp, Homo sapiens
agtaagggtaaaaaagataa

SEQ ID NO: 2748194 - DNA, 18 bp, Homo sapiens
agtaatgataactggaaa

SEQ ID NO: 2748195 - DNA, 19 bp, Homo sapiens
agtaattctagacataact

SEQ ID NO: 2748196 - DNA, 12 bp, Homo sapiens
agtagcaggacc

SEQ ID NO: 2748197 - DNA, 20 bp, Homo sapiens
agtagccaaacaccactttg

SEQ ID NO: 2748198 - DNA, 14 bp, Homo sapiens
agtagctgtatgag

SEQ ID NO: 2748199 - DNA, 12 bp, Homo sapiens
agtagttaaaac

SEQ ID NO: 2748200 - DNA, 14 bp, Homo sapiens
agtagttaaaacag

SEQ ID NO: 2748201 - DNA, 19 bp, Homo sapiens
agtagttaaaacagctatt

SEQ ID NO: 2748202 - DNA, 15 bp, Homo sapiens
agtatagaaaatgga

SEQ ID NO: 2748203 - DNA, 20 bp, Homo sapiens
agtatctgaagggaattgtt

SEQ ID NO: 2748204 - DNA, 19 bp, Homo sapiens
agtatgtggaagtgtgggt

SEQ ID NO: 2748205 - DNA, 18 bp, Homo sapiens
agtatgttagtgcaaatt

SEQ ID NO: 2748206 - DNA, 21 bp, Homo sapiens
agtatgttagtgcaaattgtc

SEQ ID NO: 2748207 - DNA, 18 bp, Homo sapiens
agtattagaataccacag

SEQ ID NO: 2748208 - DNA, 18 bp, Homo sapiens
agtattgagctttgcatt

SEQ ID NO: 2748209 - DNA, 16 bp, Homo sapiens
agtattgtccaggtct

SEQ ID NO: 2748210 - DNA, 16 bp, Homo sapiens
agtcaaagagagtttt

SEQ ID NO: 2748211 - DNA, 23 bp, Homo sapiens
agtcaaattgtgtgaaaggtact

SEQ ID NO: 2748212 - DNA, 14 bp, Homo sapiens
agtcacctcatgga

SEQ ID NO: 2748213 - DNA, 17 bp, Homo sapiens
agtcacctcatggaatt

SEQ ID NO: 2748214 - DNA, 15 bp, Homo sapiens
agtcaggaaagagaa

SEQ ID NO: 2748215 - DNA, 16 bp, Homo sapiens
agtcttcaaatttgat

SEQ ID NO: 2748216 - DNA, 17 bp, Homo sapiens
agtcttcttatctaaac

SEQ ID NO: 2748217 - DNA, 22 bp, Homo sapiens
agtgaaaaaagtcacctgccca

SEQ ID NO: 2748218 - DNA, 13 bp, Homo sapiens
agtgaagcattta

SEQ ID NO: 2748219 - DNA, 17 bp, Homo sapiens
agtgacttcttccctaa

SEQ ID NO: 2748220 - DNA, 18 bp, Homo sapiens
agtgacttcttccctaaa

SEQ ID NO: 2748221 - DNA, 14 bp, Homo sapiens
agtgaggatgtctg

SEQ ID NO: 2748222 - DNA, 22 bp, Homo sapiens
agtgcaaattgtcacaggacag

SEQ ID NO: 2748223 - DNA, 19 bp, Homo sapiens
agtgcaagagactttgtca

SEQ ID NO: 2748224 - DNA, 20 bp, Homo sapiens
agtgcaagagactttgtcac

SEQ ID NO: 2748225 - DNA, 16 bp, Homo sapiens
agtggctggatctgtg

SEQ ID NO: 2748226 - DNA, 20 bp, Homo sapiens
agtgtataatgttggtgtgg

SEQ ID NO: 2748227 - DNA, 14 bp, Homo sapiens
agtgtcaagtcctg

SEQ ID NO: 2748228 - DNA, 16 bp, Homo sapiens
agtgtcctatgcaata

SEQ ID NO: 2748229 - DNA, 16 bp, Homo sapiens
agtgtttaaaagcaaa

SEQ ID NO: 2748230 - DNA, 15 bp, Homo sapiens
agtgtttctgttctg

SEQ ID NO: 2748231 - DNA, 13 bp, Homo sapiens
agttaaaagttag

SEQ ID NO: 2748232 - DNA, 14 bp, Homo sapiens
agttagcattgttt

SEQ ID NO: 2748233 - DNA, 16 bp, Homo sapiens
agttagcattgtttct

SEQ ID NO: 2748234 - DNA, 22 bp, Homo sapiens
agttagttttggttatttctaa

SEQ ID NO: 2748235 - DNA, 14 bp, Homo sapiens
agttattgctgcat

SEQ ID NO: 2748236 - DNA, 16 bp, Homo sapiens
agttattgctgcataa

SEQ ID NO: 2748237 - DNA, 17 bp, Homo sapiens
agttcaggaatttttgt

SEQ ID NO: 2748238 - DNA, 18 bp, Homo sapiens
agttcataaatttatggt

SEQ ID NO: 2748239 - DNA, 16 bp, Homo sapiens
agttctgaagaagatg

SEQ ID NO: 2748240 - DNA, 13 bp, Homo sapiens
agttctgttaaat

SEQ ID NO: 2748241 - DNA, 19 bp, Homo sapiens
agttctgttaaatattttt

SEQ ID NO: 2748242 - DNA, 20 bp, Homo sapiens
agttctgttaaatatttttg

SEQ ID NO: 2748243 - DNA, 21 bp, Homo sapiens
agttgatatgccttttcccaa

SEQ ID NO: 2748244 - DNA, 20 bp, Homo sapiens
agttgcattggtttgagaaa

SEQ ID NO: 2748245 - DNA, 17 bp, Homo sapiens
agttgctggttttgaat

SEQ ID NO: 2748246 - DNA, 20 bp, Homo sapiens
agttgctggttttgaatatt

SEQ ID NO: 2748247 - DNA, 13 bp, Homo sapiens
agttgtactgcat

SEQ ID NO: 2748248 - DNA, 14 bp, Homo sapiens
agtttactggataa

SEQ ID NO: 2748249 - DNA, 15 bp, Homo sapiens
agtttcaattgagta

SEQ ID NO: 2748250 - DNA, 23 bp, Homo sapiens
agtttcatttacaatttcaaaag

SEQ ID NO: 2748251 - DNA, 13 bp, Homo sapiens
agtttcttctcat

SEQ ID NO: 2748252 - DNA, 16 bp, Homo sapiens
agttttatatgcttct

SEQ ID NO: 2748253 - DNA, 18 bp, Homo sapiens
agttttttatatatgaat

SEQ ID NO: 2748254 - DNA, 21 bp, Homo sapiens
agttttttatatatgaatatt

SEQ ID NO: 2748255 - DNA, 19 bp, Homo sapiens
agttttttttttgtttgtt

SEQ ID NO: 2748256 - DNA, 19 bp, Homo sapiens
ataaaaacattgaaatatt

SEQ ID NO: 2748257 - DNA, 20 bp, Homo sapiens
ataaaaacattgaaatatta

SEQ ID NO: 2748258 - DNA, 17 bp, Homo sapiens
ataaaagggtcaaacct

SEQ ID NO: 2748259 - DNA, 11 bp, Homo sapiens
caataaatgtt

SEQ ID NO: 2748260 - DNA, 13 bp, Homo sapiens
caataaatgttga

SEQ ID NO: 2748261 - DNA, 15 bp, Homo sapiens
caataataattaaag

SEQ ID NO: 2748262 - DNA, 16 bp, Homo sapiens
caataccctgtcttta

SEQ ID NO: 2748263 - DNA, 17 bp, Homo sapiens
caatagtcaaattgtgt

SEQ ID NO: 2748264 - DNA, 20 bp, Homo sapiens
caatatatagctggcaagaa

SEQ ID NO: 2748265 - DNA, 12 bp, Homo sapiens
caatcttgtttt

SEQ ID NO: 2748266 - DNA, 15 bp, Homo sapiens
caatgccacatactt

SEQ ID NO: 2748267 - DNA, 16 bp, Homo sapiens
caatgccgcctgtcaa

SEQ ID NO: 2748268 - DNA, 22 bp, Homo sapiens
caatgtgatctatgtttcatct

SEQ ID NO: 2748269 - DNA, 15 bp, Homo sapiens
caattgagtaattct

SEQ ID NO: 2748270 - DNA, 19 bp, Homo sapiens
cacaaaagcaaaattttta

SEQ ID NO: 2748271 - DNA, 11 bp, Homo sapiens
cacaaaagttg

SEQ ID NO: 2748272 - DNA, 13 bp, Homo sapiens
cacaaagagctga

SEQ ID NO: 2748273 - DNA, 22 bp, Homo sapiens
cacacatgaagtccaagcattt

SEQ ID NO: 2748274 - DNA, 14 bp, Homo sapiens
cacactgaagaagc

SEQ ID NO: 2748275 - DNA, 14 bp, Homo sapiens
cacagtattgtaga

SEQ ID NO: 2748276 - DNA, 15 bp, Homo sapiens
cacagtattgtagaa

SEQ ID NO: 2748277 - DNA, 14 bp, Homo sapiens
cacagttggcactt

SEQ ID NO: 2748278 - DNA, 18 bp, Homo sapiens
cacatcttgaaaatgcca

SEQ ID NO: 2748279 - DNA, 16 bp, Homo sapiens
cacattttgtaaatct

SEQ ID NO: 2748280 - DNA, 22 bp, Homo sapiens
cacattttgtaaatctgtactt

SEQ ID NO: 2748281 - DNA, 19 bp, Homo sapiens
caccattcttcttttttgt

SEQ ID NO: 2748282 - DNA, 20 bp, Homo sapiens
cacccctggctaccttgtgg

SEQ ID NO: 2748283 - DNA, 23 bp, Homo sapiens
cacccctggctaccttgtgggaa

SEQ ID NO: 2748284 - DNA, 20 bp, Homo sapiens
caccgggcatgtctgcctgg

SEQ ID NO: 2748285 - DNA, 21 bp, Homo sapiens
caccgggcatgtctgcctgga

SEQ ID NO: 2748286 - DNA, 23 bp, Homo sapiens
caccgggcatgtctgcctggagt

SEQ ID NO: 2748287 - DNA, 24 bp, Homo sapiens
caccgggcatgtctgcctggagtg

SEQ ID NO: 2748288 - DNA, 19 bp, Homo sapiens
cacctcagaaattgaaagc

SEQ ID NO: 2748289 - DNA, 13 bp, Homo sapiens
cacctgtgctgga

SEQ ID NO: 2748290 - DNA, 18 bp, Homo sapiens
cacgcccttggagccttc

SEQ ID NO: 2748291 - DNA, 20 bp, Homo sapiens
cacgcccttggagccttcca

SEQ ID NO: 2748292 - DNA, 13 bp, Homo sapiens
cactcatgacggc

SEQ ID NO: 2748293 - DNA, 22 bp, Homo sapiens
cactcgccatctcctgggccgt

SEQ ID NO: 2748294 - DNA, 23 bp, Homo sapiens
cactgaagaagcaccaatcatga

SEQ ID NO: 2748295 - DNA, 21 bp, Homo sapiens
cactgcagaacagcttcatgt

SEQ ID NO: 2748296 - DNA, 21 bp, Homo sapiens
cacttgaggccaggactttga

SEQ ID NO: 2748297 - DNA, 22 bp, Homo sapiens
cactttaaaaaattttttgatt

SEQ ID NO: 2748298 - DNA, 14 bp, Homo sapiens
cagaaaaaaaagaa

SEQ ID NO: 2748299 - DNA, 20 bp, Homo sapiens
cagaaaaaaaagaaaaaagt

SEQ ID NO: 2748300 - DNA, 16 bp, Homo sapiens
cagaataaattaatat

SEQ ID NO: 2748301 - DNA, 14 bp, Homo sapiens
cagagcagttcaag

SEQ ID NO: 2748302 - DNA, 12 bp, Homo sapiens
cagatcctggaa

SEQ ID NO: 2748303 - DNA, 13 bp, Homo sapiens
cagatcctggaaa

SEQ ID NO: 2748304 - DNA, 22 bp, Homo sapiens
cagatgtctaaaagattcttta

SEQ ID NO: 2748305 - DNA, 11 bp, Homo sapiens
cagattcaaag

SEQ ID NO: 2748306 - DNA, 14 bp, Homo sapiens
cagattttcctgaa

SEQ ID NO: 2748307 - DNA, 23 bp, Homo sapiens
cagccatttttcagtagcaggac

SEQ ID NO: 2748308 - DNA, 18 bp, Homo sapiens
cagctgtatgattcccag

SEQ ID NO: 2748309 - DNA, 19 bp, Homo sapiens
cagctgtatgattcccagc

SEQ ID NO: 2748310 - DNA, 21 bp, Homo sapiens
cagctgtgctttttgcaaaag

SEQ ID NO: 2748311 - DNA, 14 bp, Homo sapiens
cagcttctattcat

SEQ ID NO: 2748312 - DNA, 24 bp, Homo sapiens
caggacagcccttctttccacaga

SEQ ID NO: 2748313 - DNA, 17 bp, Homo sapiens
caggaccagtttatgtt

SEQ ID NO: 2748314 - DNA, 20 bp, Homo sapiens
caggaccagtttatgtttgt

SEQ ID NO: 2748315 - DNA, 14 bp, Homo sapiens
caggagtccctgcc

SEQ ID NO: 2748316 - DNA, 15 bp, Homo sapiens
caggagtccctgcca

SEQ ID NO: 2748317 - DNA, 20 bp, Homo sapiens
caggatggctggaacactgt

SEQ ID NO: 2748318 - DNA, 18 bp, Homo sapiens
cagggctgaggcctctca

SEQ ID NO: 2748319 - DNA, 23 bp, Homo sapiens
cagggctggtttgttctgacttt

SEQ ID NO: 2748320 - DNA, 19 bp, Homo sapiens
caggttggcaaacgggctt

SEQ ID NO: 2748321 - DNA, 20 bp, Homo sapiens
caggttggcaaacgggcttg

SEQ ID NO: 2748322 - DNA, 21 bp, Homo sapiens
caggttggcaaacgggcttga

SEQ ID NO: 2748323 - DNA, 21 bp, Homo sapiens
cagtagccaaacaccactttg

SEQ ID NO: 2748324 - DNA, 12 bp, Homo sapiens
cagtatgtggaa

SEQ ID NO: 2748325 - DNA, 19 bp, Homo sapiens
cagtcacctcatggaattg

SEQ ID NO: 2748326 - DNA, 20 bp, Homo sapiens
cagtctgactgtttccatca

SEQ ID NO: 2748327 - DNA, 15 bp, Homo sapiens
cagtgacaataaatg

SEQ ID NO: 2748328 - DNA, 17 bp, Homo sapiens
cagtgcaagagactttg

SEQ ID NO: 2748329 - DNA, 23 bp, Homo sapiens
cagtgcaagagactttgtcactt

SEQ ID NO: 2748330 - DNA, 23 bp, Homo sapiens
cagtgcttctacacatttcatct

SEQ ID NO: 2748331 - DNA, 16 bp, Homo sapiens
cagtgggttcagaacc

SEQ ID NO: 2748332 - DNA, 17 bp, Homo sapiens
cagttcaggaatttttg

SEQ ID NO: 2748333 - DNA, 18 bp, Homo sapiens
cagttcaggaatttttgt

SEQ ID NO: 2748334 - DNA, 12 bp, Homo sapiens
cagttctgaaga

SEQ ID NO: 2748335 - DNA, 13 bp, Homo sapiens
cagttctgaagaa

SEQ ID NO: 2748336 - DNA, 14 bp, Homo sapiens
cagttctgaagaag

SEQ ID NO: 2748337 - DNA, 16 bp, Homo sapiens
cagttgaattcagtgg

SEQ ID NO: 2748338 - DNA, 15 bp, Homo sapiens
cagtttatgtttgtg

SEQ ID NO: 2748339 - DNA, 19 bp, Homo sapiens
cagtttttaactctactgt

SEQ ID NO: 2748340 - DNA, 22 bp, Homo sapiens
cagtttttaactctactgtgta

SEQ ID NO: 2748341 - DNA, 21 bp, Homo sapiens
cataaaagggtcaaacctgta

SEQ ID NO: 2748342 - DNA, 14 bp, Homo sapiens
cataaaattggatt

SEQ ID NO: 2748343 - DNA, 15 bp, Homo sapiens
cataaacatttgcca

SEQ ID NO: 2748344 - DNA, 13 bp, Homo sapiens
cataaatttgtaa

SEQ ID NO: 2748345 - DNA, 18 bp, Homo sapiens
cataaatttgtaatatat

SEQ ID NO: 2748346 - DNA, 21 bp, Homo sapiens
cataaatttgtaatatatcct

SEQ ID NO: 2748347 - DNA, 18 bp, Homo sapiens
cataactggtttgactct

SEQ ID NO: 2748348 - DNA, 23 bp, Homo sapiens
catagtggcacttgcctgtagtc

SEQ ID NO: 2748349 - DNA, 18 bp, Homo sapiens
catagttctgttaaatat

SEQ ID NO: 2748350 - DNA, 15 bp, Homo sapiens
catatataacaatgc

SEQ ID NO: 2748351 - DNA, 15 bp, Homo sapiens
catatatatcctatt

SEQ ID NO: 2748352 - DNA, 18 bp, Homo sapiens
catatccataaaattgga

SEQ ID NO: 2748353 - DNA, 17 bp, Homo sapiens
catatgtttattcaaaa

SEQ ID NO: 2748354 - DNA, 19 bp, Homo sapiens
catccccctccaaagtctt

SEQ ID NO: 2748355 - DNA, 23 bp, Homo sapiens
catcgcttctttttcaaaactag

SEQ ID NO: 2748356 - DNA, 23 bp, Homo sapiens
catcggtgtggactacaggacaa

SEQ ID NO: 2748357 - DNA, 14 bp, Homo sapiens
catctagtgagcag

SEQ ID NO: 2748358 - DNA, 18 bp, Homo sapiens
catctattgatagtttca

SEQ ID NO: 2748359 - DNA, 17 bp, Homo sapiens
catctgtacctctgcct

SEQ ID NO: 2748360 - DNA, 18 bp, Homo sapiens
catctgtgcagggctggt

SEQ ID NO: 2748361 - DNA, 13 bp, Homo sapiens
catcttagtttac

SEQ ID NO: 2748362 - DNA, 15 bp, Homo sapiens
catgaataaaaataa

SEQ ID NO: 2748363 - DNA, 17 bp, Homo sapiens
catgacagaatatacac

SEQ ID NO: 2748364 - DNA, 13 bp, Homo sapiens
catgcataaaagg

SEQ ID NO: 2748365 - DNA, 21 bp, Homo sapiens
catgcattacttactgttaaa

SEQ ID NO: 2748366 - DNA, 16 bp, Homo sapiens
catgctaaaattctat

SEQ ID NO: 2748367 - DNA, 23 bp, Homo sapiens
catgctgtctacactaagagaga

SEQ ID NO: 2748368 - DNA, 18 bp, Homo sapiens
catggacatgagtttaaa

SEQ ID NO: 2748369 - DNA, 18 bp, Homo sapiens
catggcctgctgggcttg

SEQ ID NO: 2748370 - DNA, 19 bp, Homo sapiens
catggtgtgaactaagtta

SEQ ID NO: 2748371 - DNA, 17 bp, Homo sapiens
catgtaaagctgttaaa

SEQ ID NO: 2748372 - DNA, 19 bp, Homo sapiens
catgtaaagctgttaaaat

SEQ ID NO: 2748373 - DNA, 15 bp, Homo sapiens
catgtatagttgctt

SEQ ID NO: 2748374 - DNA, 14 bp, Homo sapiens
catgtattcactaa

SEQ ID NO: 2748375 - DNA, 19 bp, Homo sapiens
catgtattcactaaaataa

SEQ ID NO: 2748376 - DNA, 16 bp, Homo sapiens
catgtctgcctggagt

SEQ ID NO: 2748377 - DNA, 20 bp, Homo sapiens
catgtgctagtaattggaaa

SEQ ID NO: 2748378 - DNA, 20 bp, Homo sapiens
catgttggttgcactttgta

SEQ ID NO: 2748379 - DNA, 11 bp, Homo sapiens
cattaaaattg

SEQ ID NO: 2748380 - DNA, 22 bp, Homo sapiens
cattacctcagtgagaagccag

SEQ ID NO: 2748381 - DNA, 18 bp, Homo sapiens
cattaggaagctgaatta

SEQ ID NO: 2748382 - DNA, 20 bp, Homo sapiens
cattatgcaacgtttaacat

SEQ ID NO: 2748383 - DNA, 13 bp, Homo sapiens
cattccagaggaa

SEQ ID NO: 2748384 - DNA, 22 bp, Homo sapiens
ctttgttggagtgaagcattta

SEQ ID NO: 2748385 - DNA, 14 bp, Homo sapiens
cttttaaattcttt

SEQ ID NO: 2748386 - DNA, 17 bp, Homo sapiens
cttttagctagaatcca

SEQ ID NO: 2748387 - DNA, 12 bp, Homo sapiens
cttttcagaaga

SEQ ID NO: 2748388 - DNA, 17 bp, Homo sapiens
cttttgcgatttcacag

SEQ ID NO: 2748389 - DNA, 20 bp, Homo sapiens
cttttgtaaagtaaaatatg

SEQ ID NO: 2748390 - DNA, 19 bp, Homo sapiens
ctttttcaaaactagttct

SEQ ID NO: 2748391 - DNA, 12 bp, Homo sapiens
ctttttgtttct

SEQ ID NO: 2748392 - DNA, 19 bp, Homo sapiens
cttttttcaaatattgaat

SEQ ID NO: 2748393 - DNA, 15 bp, Homo sapiens
cttttttctttgaaa

SEQ ID NO: 2748394 - DNA, 11 bp, Homo sapiens
gaaaaaacaag

SEQ ID NO: 2748395 - DNA, 17 bp, Homo sapiens
gaaaaattatttgtgtt

SEQ ID NO: 2748396 - DNA, 14 bp, Homo sapiens
gaaaacaaggatga

SEQ ID NO: 2748397 - DNA, 14 bp, Homo sapiens
gaaaagcacttaaa

SEQ ID NO: 2748398 - DNA, 15 bp, Homo sapiens
gaaaagtaagggaat

SEQ ID NO: 2748399 - DNA, 12 bp, Homo sapiens
gaaaatgccacc

SEQ ID NO: 2748400 - DNA, 16 bp, Homo sapiens
gaaaatggaaaatata

SEQ ID NO: 2748401 - DNA, 22 bp, Homo sapiens
gaaaattaattctaaacttaga

SEQ ID NO: 2748402 - DNA, 14 bp, Homo sapiens
gaaagaaactaaga

SEQ ID NO: 2748403 - DNA, 15 bp, Homo sapiens
gaaagaatagaaaga

SEQ ID NO: 2748404 - DNA, 14 bp, Homo sapiens
gaaagctaatacaa

SEQ ID NO: 2748405 - DNA, 14 bp, Homo sapiens
gaaaggcacatatt

SEQ ID NO: 2748406 - DNA, 13 bp, Homo sapiens
gaaagtaaaacca

SEQ ID NO: 2748407 - DNA, 21 bp, Homo sapiens
gaaagtctatctaatgacatg

SEQ ID NO: 2748408 - DNA, 14 bp, Homo sapiens
gaaagtgatgacat

SEQ ID NO: 2748409 - DNA, 14 bp, Homo sapiens
gaaataccaggacc

SEQ ID NO: 2748410 - DNA, 18 bp, Homo sapiens
gaaatatagttgaaagta

SEQ ID NO: 2748411 - DNA, 23 bp, Homo sapiens
gaaatattagttacttgctataa

SEQ ID NO: 2748412 - DNA, 22 bp, Homo sapiens
gaaatgctaaacttggctgtat

SEQ ID NO: 2748413 - DNA, 20 bp, Homo sapiens
gaacaatgccgcctgtcaat

SEQ ID NO: 2748414 - DNA, 24 bp, Homo sapiens
gaacagttacctctgcctcagaaa

SEQ ID NO: 2748415 - DNA, 15 bp, Homo sapiens
gaaccacaagactgc

SEQ ID NO: 2748416 - DNA, 13 bp, Homo sapiens
gaacctttcaaaa

SEQ ID NO: 2748417 - DNA, 14 bp, Homo sapiens
gaacctttcaaaat

SEQ ID NO: 2748418 - DNA, 21 bp, Homo sapiens
gaactagagtttagctggaaa

SEQ ID NO: 2748419 - DNA, 20 bp, Homo sapiens
gaactcaatatatagttagc

SEQ ID NO: 2748420 - DNA, 15 bp, Homo sapiens
gaactcgcacctgtg

SEQ ID NO: 2748421 - DNA, 21 bp, Homo sapiens
gaactcgcacctgtgctggag

SEQ ID NO: 2748422 - DNA, 22 bp, Homo sapiens
gaacttccagatcctggaaatc

SEQ ID NO: 2748423 - DNA, 21 bp, Homo sapiens
gaagaagcaccaatcatgaat

SEQ ID NO: 2748424 - DNA, 17 bp, Homo sapiens
gaagactgcattatatt

SEQ ID NO: 2748425 - DNA, 14 bp, Homo sapiens
gaagcaaaattttt

SEQ ID NO: 2748426 - DNA, 13 bp, Homo sapiens
gaagcatttaaaa

SEQ ID NO: 2748427 - DNA, 18 bp, Homo sapiens
gaagcctaggaggactgg

SEQ ID NO: 2748428 - DNA, 17 bp, Homo sapiens
gaagggaattgttttta

SEQ ID NO: 2748429 - DNA, 19 bp, Homo sapiens
gaagggcagggctgaggcc

SEQ ID NO: 2748430 - DNA, 20 bp, Homo sapiens
gaagggcttacaggcatgga

SEQ ID NO: 2748431 - DNA, 23 bp, Homo sapiens
gaagggtatgtcacaaagagctg

SEQ ID NO: 2748432 - DNA, 17 bp, Homo sapiens
gaaggtcccatggcctg

SEQ ID NO: 2748433 - DNA, 22 bp, Homo sapiens
gaagtccaagcatttagatgta

SEQ ID NO: 2748434 - DNA, 16 bp, Homo sapiens
gaagtcttcaaatttg

SEQ ID NO: 2748435 - DNA, 19 bp, Homo sapiens
gaagtcttcaaatttgatt

SEQ ID NO: 2748436 - DNA, 19 bp, Homo sapiens
gaagtgtgggtctgtgtgt

SEQ ID NO: 2748437 - DNA, 24 bp, Homo sapiens
gaagtgtgggtctgtgtgtgtgta

SEQ ID NO: 2748438 - DNA, 19 bp, Homo sapiens
gaagttacatgcataaaag

SEQ ID NO: 2748439 - DNA, 14 bp, Homo sapiens
gaagttgttttttt

SEQ ID NO: 2748440 - DNA, 18 bp, Homo sapiens
gaataaaaataaagtttt

SEQ ID NO: 2748441 - DNA, 21 bp, Homo sapiens
gaataaattaatattgtattg

SEQ ID NO: 2748442 - DNA, 14 bp, Homo sapiens
gaatacaaacattt

SEQ ID NO: 2748443 - DNA, 12 bp, Homo sapiens
gaatagaaagaa

SEQ ID NO: 2748444 - DNA, 15 bp, Homo sapiens
gaatagaaagaaagt

SEQ ID NO: 2748445 - DNA, 22 bp, Homo sapiens
gaatagcctagatatgaatata

SEQ ID NO: 2748446 - DNA, 18 bp, Homo sapiens
gaatatacacattttgta

SEQ ID NO: 2748447 - DNA, 21 bp, Homo sapiens
gaatatacacattttgtaaat

SEQ ID NO: 2748448 - DNA, 23 bp, Homo sapiens
gaatatacacattttgtaaatct

SEQ ID NO: 2748449 - DNA, 20 bp, Homo sapiens
gaatccaagacaaactaaac

SEQ ID NO: 2748450 - DNA, 17 bp, Homo sapiens
gaatgctgcaacttttt

SEQ ID NO: 2748451 - DNA, 18 bp, Homo sapiens
gaattctttagattttta

SEQ ID NO: 2748452 - DNA, 16 bp, Homo sapiens
gaattggagctcgtgg

SEQ ID NO: 2748453 - DNA, 21 bp, Homo sapiens
gaatttgtccatttaaaaatg

SEQ ID NO: 2748454 - DNA, 15 bp, Homo sapiens
gaatttttgttttgt

SEQ ID NO: 2748455 - DNA, 14 bp, Homo sapiens
gacaaactgtaaaa

SEQ ID NO: 2748456 - DNA, 19 bp, Homo sapiens
gacaaactgtaaaaaatgt

SEQ ID NO: 2748457 - DNA, 22 bp, Homo sapiens
gacaagcacaccacaattctcc

SEQ ID NO: 2748458 - DNA, 12 bp, Homo sapiens
gacacacatgaa

SEQ ID NO: 2748459 - DNA, 22 bp, Homo sapiens
gacagaatatacacattttgta

SEQ ID NO: 2748460 - DNA, 23 bp, Homo sapiens
gacaggatggttcccttgatgaa

SEQ ID NO: 2748461 - DNA, 22 bp, Homo sapiens
gacatgggacatttgctcatgg

SEQ ID NO: 2748462 - DNA, 20 bp, Homo sapiens
gacattgtttggatttcctt

SEQ ID NO: 2748463 - DNA, 22 bp, Homo sapiens
gacattgtttggatttccttta

SEQ ID NO: 2748464 - DNA, 16 bp, Homo sapiens
gacccctttaaactgt

SEQ ID NO: 2748465 - DNA, 18 bp, Homo sapiens
gacccctttaaactgtct

SEQ ID NO: 2748466 - DNA, 18 bp, Homo sapiens
gaccttaaggaaaagtaa

SEQ ID NO: 2748467 - DNA, 20 bp, Homo sapiens
gacgactgttttcccaacac

SEQ ID NO: 2748468 - DNA, 14 bp, Homo sapiens
gacggcctgcctgc

SEQ ID NO: 2748469 - DNA, 17 bp, Homo sapiens
gactctgtccaactctg

SEQ ID NO: 2748470 - DNA, 21 bp, Homo sapiens
gactcttaagaagactgcatt

SEQ ID NO: 2748471 - DNA, 24 bp, Homo sapiens
gactgcattatatttattactgta

SEQ ID NO: 2748472 - DNA, 19 bp, Homo sapiens
gactgggctgggtttgctg

SEQ ID NO: 2748473 - DNA, 21 bp, Homo sapiens
gacttctcttccagtttctgt

SEQ ID NO: 2748474 - DNA, 18 bp, Homo sapiens
gacttcttccctaaaatg

SEQ ID NO: 2748475 - DNA, 16 bp, Homo sapiens
gactttgtcacttatt

SEQ ID NO: 2748476 - DNA, 21 bp, Homo sapiens
gagaacctagggtgatattaa

SEQ ID NO: 2748477 - DNA, 16 bp, Homo sapiens
gagaagaactgaaatc

SEQ ID NO: 2748478 - DNA, 22 bp, Homo sapiens
gagaagccagctttcctcatca

SEQ ID NO: 2748479 - DNA, 20 bp, Homo sapiens
gagaatgagagacacactga

SEQ ID NO: 2748480 - DNA, 18 bp, Homo sapiens
gagacacactgaagaagc

SEQ ID NO: 2748481 - DNA, 20 bp, Homo sapiens
gagacccctttaaactgtct

SEQ ID NO: 2748482 - DNA, 20 bp, Homo sapiens
gagactttgtcacttatttc

SEQ ID NO: 2748483 - DNA, 19 bp, Homo sapiens
gagagacacactgaagaag

SEQ ID NO: 2748484 - DNA, 23 bp, Homo sapiens
gagagagtcttttaactttagaa

SEQ ID NO: 2748485 - DNA, 12 bp, Homo sapiens
gagcccctgccc

SEQ ID NO: 2748486 - DNA, 13 bp, Homo sapiens
gagcctgctaagg

SEQ ID NO: 2748487 - DNA, 14 bp, Homo sapiens
gagcctgctaagga

SEQ ID NO: 2748488 - DNA, 22 bp, Homo sapiens
gagcctgctaaggaacaatgcc

SEQ ID NO: 2748489 - DNA, 21 bp, Homo sapiens
gagccttccaccggcactcat

SEQ ID NO: 2748490 - DNA, 18 bp, Homo sapiens
gagcgctggtcccctccc

SEQ ID NO: 2748491 - DNA, 21 bp, Homo sapiens
gaggaaggtcccatggcctgc

SEQ ID NO: 2748492 - DNA, 23 bp, Homo sapiens
gaggaaggtcccatggcctgctg

SEQ ID NO: 2748493 - DNA, 15 bp, Homo sapiens
gaggatgtctgggcc

SEQ ID NO: 2748494 - DNA, 15 bp, Homo sapiens
gagggctttattaca

SEQ ID NO: 2748495 - DNA, 21 bp, Homo sapiens
gagtatctgaagggaattgtt

SEQ ID NO: 2748496 - DNA, 13 bp, Homo sapiens
gagtgtgtaattt

SEQ ID NO: 2748497 - DNA, 11 bp, Homo sapiens
gagttaaaagt

SEQ ID NO: 2748498 - DNA, 19 bp, Homo sapiens
gagttgggggtattttcta

SEQ ID NO: 2748499 - DNA, 13 bp, Homo sapiens
gataaagtcctga

SEQ ID NO: 2748500 - DNA, 22 bp, Homo sapiens
gataaatggcttcctggcaata

SEQ ID NO: 2748501 - DNA, 15 bp, Homo sapiens
gataaatttaaaaca

SEQ ID NO: 2748502 - DNA, 20 bp, Homo sapiens
gataaatttaaaacacagta

SEQ ID NO: 2748503 - DNA, 22 bp, Homo sapiens
gatagatgtgtggacacattgg

SEQ ID NO: 2748504 - DNA, 14 bp, Homo sapiens
gatagtttcattta

SEQ ID NO: 2748505 - DNA, 19 bp, Homo sapiens
gatataaagaatgaaagta

SEQ ID NO: 2748506 - DNA, 14 bp, Homo sapiens
gatatctatattct

SEQ ID NO: 2748507 - DNA, 17 bp, Homo sapiens
gatatctatattctaaa

SEQ ID NO: 2748508 - DNA, 17 bp, Homo sapiens
gatatgaatatatggca

SEQ ID NO: 2748509 - DNA, 15 bp, Homo sapiens
gtcctatgcaataaa

SEQ ID NO: 2748510 - DNA, 20 bp, Homo sapiens
gtcctatgcaataaaattat

SEQ ID NO: 2748511 - DNA, 19 bp, Homo sapiens
gtccttcagtttagaacct

SEQ ID NO: 2748512 - DNA, 17 bp, Homo sapiens
gtctaaaagattcttta

SEQ ID NO: 2748513 - DNA, 12 bp, Homo sapiens
gtctggcctgag

SEQ ID NO: 2748514 - DNA, 14 bp, Homo sapiens
gtctggcctgaggt

SEQ ID NO: 2748515 - DNA, 11 bp, Homo sapiens
gtctgtgtgtg

SEQ ID NO: 2748516 - DNA, 19 bp, Homo sapiens
gtctgttaatctttttcat

SEQ ID NO: 2748517 - DNA, 16 bp, Homo sapiens
gtcttcttatctaaac

SEQ ID NO: 2748518 - DNA, 20 bp, Homo sapiens
gtgaaactcgttaatttgta

SEQ ID NO: 2748519 - DNA, 22 bp, Homo sapiens
gtgaagttacatgcataaaagg

SEQ ID NO: 2748520 - DNA, 21 bp, Homo sapiens
gtgactatggagctgagcagg

SEQ ID NO: 2748521 - DNA, 13 bp, Homo sapiens
gtgagaaagaaag

SEQ ID NO: 2748522 - DNA, 23 bp, Homo sapiens
gtgagaaagaaagtaaaaaaggt

SEQ ID NO: 2748523 - DNA, 20 bp, Homo sapiens
gtgatataaagaatgaaagt

SEQ ID NO: 2748524 - DNA, 15 bp, Homo sapiens
gtgattatgccattg

SEQ ID NO: 2748525 - DNA, 15 bp, Homo sapiens
gtgcacccagaagaa

SEQ ID NO: 2748526 - DNA, 21 bp, Homo sapiens
gtgcaccccgccggaggaagg

SEQ ID NO: 2748527 - DNA, 16 bp, Homo sapiens
gtgcagggctggtttg

SEQ ID NO: 2748528 - DNA, 15 bp, Homo sapiens
gtgcgtggaaaaaga

SEQ ID NO: 2748529 - DNA, 18 bp, Homo sapiens
gtgctagtaattggaaag

SEQ ID NO: 2748530 - DNA, 23 bp, Homo sapiens
gtgctattgtagagccagaggtc

SEQ ID NO: 2748531 - DNA, 20 bp, Homo sapiens
gtgcttctacacatttcatc

SEQ ID NO: 2748532 - DNA, 21 bp, Homo sapiens
gtgcttctacacatttcatct

SEQ ID NO: 2748533 - DNA, 22 bp, Homo sapiens
gtgcttctacacatttcatcta

SEQ ID NO: 2748534 - DNA, 21 bp, Homo sapiens
gtggaaaaagacgatgtttat

SEQ ID NO: 2748535 - DNA, 19 bp, Homo sapiens
gtggaaataaaaagaagga

SEQ ID NO: 2748536 - DNA, 15 bp, Homo sapiens
gtggaagtgtgggtc

SEQ ID NO: 2748537 - DNA, 22 bp, Homo sapiens
gtggaagtgtgggtctgtgtgt

SEQ ID NO: 2748538 - DNA, 18 bp, Homo sapiens
gtggccccgcccgagccc

SEQ ID NO: 2748539 - DNA, 20 bp, Homo sapiens
gtggccccgcccgagcccct

SEQ ID NO: 2748540 - DNA, 23 bp, Homo sapiens
gtggccccgcccgagcccctgcc

SEQ ID NO: 2748541 - DNA, 20 bp, Homo sapiens
gtggcttcttttctttgtat

SEQ ID NO: 2748542 - DNA, 14 bp, Homo sapiens
gtgggagtgtgtaa

SEQ ID NO: 2748543 - DNA, 15 bp, Homo sapiens
gtggtttgcagatga

SEQ ID NO: 2748544 - DNA, 22 bp, Homo sapiens
gtggttttgggaaaaattattt

SEQ ID NO: 2748545 - DNA, 21 bp, Homo sapiens
gtgtaacttaaatatttgaaa

SEQ ID NO: 2748546 - DNA, 21 bp, Homo sapiens
gtgtataagttgtattattag

SEQ ID NO: 2748547 - DNA, 14 bp, Homo sapiens
gtgtcaagtcctga

SEQ ID NO: 2748548 - DNA, 16 bp, Homo sapiens
gtgtctggcctgaggt

SEQ ID NO: 2748549 - DNA, 19 bp, Homo sapiens
gtgtgaactaagttattgc

SEQ ID NO: 2748550 - DNA, 15 bp, Homo sapiens
gtgtgtatgtggggg

SEQ ID NO: 2748551 - DNA, 14 bp, Homo sapiens
gtgtgtattcttaa

SEQ ID NO: 2748552 - DNA, 22 bp, Homo sapiens
gtgtgtattcttaaaatgcaat

SEQ ID NO: 2748553 - DNA, 14 bp, Homo sapiens
gtgtgtggccccgc

SEQ ID NO: 2748554 - DNA, 13 bp, Homo sapiens
gtgtgtgtatgtg

SEQ ID NO: 2748555 - DNA, 14 bp, Homo sapiens
gtgtgtttatgtgt

SEQ ID NO: 2748556 - DNA, 16 bp, Homo sapiens
gtgtgtttatgtgtgt

SEQ ID NO: 2748557 - DNA, 22 bp, Homo sapiens
gtgttgaaatatagttgaaagt

SEQ ID NO: 2748558 - DNA, 15 bp, Homo sapiens
gtgttgtgtgtggga

SEQ ID NO: 2748559 - DNA, 12 bp, Homo sapiens
gtgtttatgtgt

SEQ ID NO: 2748560 - DNA, 16 bp, Homo sapiens
gtgtttatgtgtgtgt

SEQ ID NO: 2748561 - DNA, 10 bp, Homo sapiens
gtgtttgctt

SEQ ID NO: 2748562 - DNA, 20 bp, Homo sapiens
gttaaattttctctaaactg

SEQ ID NO: 2748563 - DNA, 22 bp, Homo sapiens
gttaaattttctctaaactgtt

SEQ ID NO: 2748564 - DNA, 14 bp, Homo sapiens
gttaataagtctct

SEQ ID NO: 2748565 - DNA, 19 bp, Homo sapiens
gttaatcagagtatctgaa

SEQ ID NO: 2748566 - DNA, 18 bp, Homo sapiens
gttaatttttccttcctc

SEQ ID NO: 2748567 - DNA, 19 bp, Homo sapiens
gttaatttttccttcctct

SEQ ID NO: 2748568 - DNA, 21 bp, Homo sapiens
gttaatttttccttcctctgt

SEQ ID NO: 2748569 - DNA, 15 bp, Homo sapiens
gttacatctgtgcag

SEQ ID NO: 2748570 - DNA, 16 bp, Homo sapiens
gttacatctgtgcagg

SEQ ID NO: 2748571 - DNA, 17 bp, Homo sapiens
gttagcattgtttctag

SEQ ID NO: 2748572 - DNA, 22 bp, Homo sapiens
gttagcgtttcggccttcataa

SEQ ID NO: 2748573 - DNA, 17 bp, Homo sapiens
gttagctttattgaagt

SEQ ID NO: 2748574 - DNA, 13 bp, Homo sapiens
gttattataaatg

SEQ ID NO: 2748575 - DNA, 17 bp, Homo sapiens
gttattataaatgttag

SEQ ID NO: 2748576 - DNA, 16 bp, Homo sapiens
gttattgctgcataaa

SEQ ID NO: 2748577 - DNA, 19 bp, Homo sapiens
gttattgctgcataaattt

SEQ ID NO: 2748578 - DNA, 13 bp, Homo sapiens
gttctgaagaaga

SEQ ID NO: 2748579 - DNA, 16 bp, Homo sapiens
gttctgtgttgaaata

SEQ ID NO: 2748580 - DNA, 13 bp, Homo sapiens
gttctgttaaata

SEQ ID NO: 2748581 - DNA, 20 bp, Homo sapiens
gttctgttaaatatttttgt

SEQ ID NO: 2748582 - DNA, 17 bp, Homo sapiens
gttcttcattagatgtt

SEQ ID NO: 2748583 - DNA, 19 bp, Homo sapiens
gttgaaagtaaaaaaataa

SEQ ID NO: 2748584 - DNA, 20 bp, Homo sapiens
gttgaaatatagttgaaagt

SEQ ID NO: 2748585 - DNA, 18 bp, Homo sapiens
gttgacatgggacatttg

SEQ ID NO: 2748586 - DNA, 22 bp, Homo sapiens
gttgaggctgcagtgagctgtg

SEQ ID NO: 2748587 - DNA, 15 bp, Homo sapiens
gttgagtatttgctg

SEQ ID NO: 2748588 - DNA, 22 bp, Homo sapiens
gttgagttgggggtattttcta

SEQ ID NO: 2748589 - DNA, 21 bp, Homo sapiens
gttgatggtggtatgttttca

SEQ ID NO: 2748590 - DNA, 21 bp, Homo sapiens
gttgcttttgaaggaatacaa

SEQ ID NO: 2748591 - DNA, 14 bp, Homo sapiens
gttgtattattaga

SEQ ID NO: 2748592 - DNA, 15 bp, Homo sapiens
gttgtgtataattta

SEQ ID NO: 2748593 - DNA, 12 bp, Homo sapiens
gttgtgtgtggg

SEQ ID NO: 2748594 - DNA, 22 bp, Homo sapiens
gttgtgtgtgggagtgtgtaat

SEQ ID NO: 2748595 - DNA, 21 bp, Homo sapiens
gtttaatattacctaatgaaa

SEQ ID NO: 2748596 - DNA, 20 bp, Homo sapiens
gtttatataagcttgtattc

SEQ ID NO: 2748597 - DNA, 16 bp, Homo sapiens
gtttatgtgtgtgtgt

SEQ ID NO: 2748598 - DNA, 23 bp, Homo sapiens
gtttatgtttgtggttttgggaa

SEQ ID NO: 2748599 - DNA, 17 bp, Homo sapiens
gtttattcaaaatattt

SEQ ID NO: 2748600 - DNA, 19 bp, Homo sapiens
gtttattctgggaaatgtt

SEQ ID NO: 2748601 - DNA, 23 bp, Homo sapiens
gtttattctgggaaatgttttaa

SEQ ID NO: 2748602 - DNA, 16 bp, Homo sapiens
gtttatttagaaactg

SEQ ID NO: 2748603 - DNA, 18 bp, Homo sapiens
gtttatttgttgttttct

SEQ ID NO: 2748604 - DNA, 22 bp, Homo sapiens
gtttcggccttcataatggcct

SEQ ID NO: 2748605 - DNA, 17 bp, Homo sapiens
gtttctttgtgtttgct

SEQ ID NO: 2748606 - DNA, 23 bp, Homo sapiens
gtttcttttttctttcttccttt

SEQ ID NO: 2748607 - DNA, 21 bp, Homo sapiens
gtttgcttggtgctggtttat

SEQ ID NO: 2748608 - DNA, 21 bp, Homo sapiens
gtttggatttcctttatactg

SEQ ID NO: 2748609 - DNA, 16 bp, Homo sapiens
gtttgtttttgctttc

SEQ ID NO: 2748610 - DNA, 18 bp, Homo sapiens
gttttaaggattctgcag

SEQ ID NO: 2748611 - DNA, 21 bp, Homo sapiens
gttttgaatattaagctaaaa

SEQ ID NO: 2748612 - DNA, 13 bp, Homo sapiens
gtttttaatagaa

SEQ ID NO: 2748613 - DNA, 18 bp, Homo sapiens
gtttttttggtgctataa

SEQ ID NO: 2748614 - DNA, 14 bp, Homo sapiens
gttttttttttgtt

SEQ ID NO: 2748615 - DNA, 18 bp, Homo sapiens
taaaaaaaaaaagattgt

SEQ ID NO: 2748616 - DNA, 20 bp, Homo sapiens
taaaaaatgtgtgtattctt

SEQ ID NO: 2748617 - DNA, 23 bp, Homo sapiens
taaaaaatgtgtgtattcttaaa

SEQ ID NO: 2748618 - DNA, 23 bp, Homo sapiens
taaaaacaaaaacatcccaagat

SEQ ID NO: 2748619 - DNA, 15 bp, Homo sapiens
taaaaacattgaaat

SEQ ID NO: 2748620 - DNA, 17 bp, Homo sapiens
taaaaaccgaataaatg

SEQ ID NO: 2748621 - DNA, 18 bp, Homo sapiens
taaaaaccgaataaatgt

SEQ ID NO: 2748622 - DNA, 20 bp, Homo sapiens
taaaaaggagaatttttcct

SEQ ID NO: 2748623 - DNA, 17 bp, Homo sapiens
taaaaagtgagaaagaa

SEQ ID NO: 2748624 - DNA, 16 bp, Homo sapiens
taaaaataaaagctat

SEQ ID NO: 2748625 - DNA, 22 bp, Homo sapiens
taaaaataaaagctattacttg

SEQ ID NO: 2748626 - DNA, 15 bp, Homo sapiens
taaaaataaagtttt

SEQ ID NO: 2748627 - DNA, 21 bp, Homo sapiens
taaaaatcaggagcctgctaa

SEQ ID NO: 2748628 - DNA, 18 bp, Homo sapiens
taaaacagctattttagt

SEQ ID NO: 2748629 - DNA, 20 bp, Homo sapiens
taaaacagctattttagtaa

SEQ ID NO: 2748630 - DNA, 14 bp, Homo sapiens
taaaaccataaaca

SEQ ID NO: 2748631 - DNA, 14 bp, Homo sapiens
taaaactgcatttt

SEQ ID NO: 2748632 - DNA, 12 bp, Homo sapiens
taaaagaatgat

SEQ ID NO: 2748633 - DNA, 16 bp, Homo sapiens
taaaagattctttaaa

SEQ ID NO: 2748634 - DNA, 12 bp, Homo sapiens
tccttaaaattt

SEQ ID NO: 2748635 - DNA, 21 bp, Homo sapiens
tccttggatttgcatttttgt

SEQ ID NO: 2748636 - DNA, 18 bp, Homo sapiens
tccttggccaagagaagg

SEQ ID NO: 2748637 - DNA, 19 bp, Homo sapiens
tcctttatactgtgaagtt

SEQ ID NO: 2748638 - DNA, 22 bp, Homo sapiens
tcctttatactgtgaagttaca

SEQ ID NO: 2748639 - DNA, 18 bp, Homo sapiens
tcctttcttccttggcca

SEQ ID NO: 2748640 - DNA, 17 bp, Homo sapiens
tcgatgcaagtgtttct

SEQ ID NO: 2748641 - DNA, 19 bp, Homo sapiens
tcgatgcaagtgtttctgt

SEQ ID NO: 2748642 - DNA, 14 bp, Homo sapiens
tcgcttctttttca

SEQ ID NO: 2748643 - DNA, 13 bp, Homo sapiens
tcgttaatttgta

SEQ ID NO: 2748644 - DNA, 16 bp, Homo sapiens
tcgttattataaatgt

SEQ ID NO: 2748645 - DNA, 21 bp, Homo sapiens
tcgtttccagcctttgtcact

SEQ ID NO: 2748646 - DNA, 17 bp, Homo sapiens
tctaaaagattctttaa

SEQ ID NO: 2748647 - DNA, 18 bp, Homo sapiens
tctaaacccagcaaaaca

SEQ ID NO: 2748648 - DNA, 18 bp, Homo sapiens
tctaaacttagaaatatg

SEQ ID NO: 2748649 - DNA, 20 bp, Homo sapiens
tctaagggaaaaagttgtat

SEQ ID NO: 2748650 - DNA, 23 bp, Homo sapiens
tctaatcttaaatcagaataaat

SEQ ID NO: 2748651 - DNA, 21 bp, Homo sapiens
tctaatgacatgcctatatga

SEQ ID NO: 2748652 - DNA, 19 bp, Homo sapiens
tctaattattccaatatga

SEQ ID NO: 2748653 - DNA, 21 bp, Homo sapiens
tctacagcttctattcattat

SEQ ID NO: 2748654 - DNA, 13 bp, Homo sapiens
tctactttaaatt

SEQ ID NO: 2748655 - DNA, 19 bp, Homo sapiens
tctagtgagcagtcaggaa

SEQ ID NO: 2748656 - DNA, 14 bp, Homo sapiens
tctataattcctta

SEQ ID NO: 2748657 - DNA, 20 bp, Homo sapiens
tctatatgtgcggcttttca

SEQ ID NO: 2748658 - DNA, 12 bp, Homo sapiens
tctatattctaa

SEQ ID NO: 2748659 - DNA, 14 bp, Homo sapiens
tctatattctaaag

SEQ ID NO: 2748660 - DNA, 15 bp, Homo sapiens
tctatcgttattata

SEQ ID NO: 2748661 - DNA, 19 bp, Homo sapiens
tctatcgttattataaatg

SEQ ID NO: 2748662 - DNA, 15 bp, Homo sapiens
tctattcattatgca

SEQ ID NO: 2748663 - DNA, 23 bp, Homo sapiens
tctatttacttctaatcttaaat

SEQ ID NO: 2748664 - DNA, 20 bp, Homo sapiens
tctcatatccataaaattgg

SEQ ID NO: 2748665 - DNA, 14 bp, Homo sapiens
tctcattagaaagg

SEQ ID NO: 2748666 - DNA, 15 bp, Homo sapiens
tctcattagaaaggc

SEQ ID NO: 2748667 - DNA, 20 bp, Homo sapiens
tctccaactttattttgaat

SEQ ID NO: 2748668 - DNA, 22 bp, Homo sapiens
tctccaactttattttgaatgt

SEQ ID NO: 2748669 - DNA, 18 bp, Homo sapiens
tctcctgagttgtataaa

SEQ ID NO: 2748670 - DNA, 19 bp, Homo sapiens
tctcctgagttgtataaaa

SEQ ID NO: 2748671 - DNA, 23 bp, Homo sapiens
tctcctgagttgtataaaagttg

SEQ ID NO: 2748672 - DNA, 12 bp, Homo sapiens
tctctaaactgt

SEQ ID NO: 2748673 - DNA, 14 bp, Homo sapiens
tctctaaactgttt

SEQ ID NO: 2748674 - DNA, 22 bp, Homo sapiens
tctcttagaggttaatcagagt

SEQ ID NO: 2748675 - DNA, 20 bp, Homo sapiens
tctgaaattcacagaagcct

SEQ ID NO: 2748676 - DNA, 20 bp, Homo sapiens
tctgaaggagagagtctttt

SEQ ID NO: 2748677 - DNA, 23 bp, Homo sapiens
tctgaatcctgttaaattttctc

SEQ ID NO: 2748678 - DNA, 14 bp, Homo sapiens
tctgactttttgtt

SEQ ID NO: 2748679 - DNA, 15 bp, Homo sapiens
tctgaggtaagtgta

SEQ ID NO: 2748680 - DNA, 16 bp, Homo sapiens
tctgatgcagtgccct

SEQ ID NO: 2748681 - DNA, 23 bp, Homo sapiens
tctgatgcagtgccctagaaggg

SEQ ID NO: 2748682 - DNA, 22 bp, Homo sapiens
tctgcaaggattttttaaaaat

SEQ ID NO: 2748683 - DNA, 17 bp, Homo sapiens
tctgcagaaaaaaaaga

SEQ ID NO: 2748684 - DNA, 21 bp, Homo sapiens
tctgcagaaaaaaaagaaaaa

SEQ ID NO: 2748685 - DNA, 15 bp, Homo sapiens
tctgggggaaaaagc

SEQ ID NO: 2748686 - DNA, 18 bp, Homo sapiens
tctgggggaaaaagccat

SEQ ID NO: 2748687 - DNA, 22 bp, Homo sapiens
tctgtactccttggatttgcat

SEQ ID NO: 2748688 - DNA, 16 bp, Homo sapiens
tctgtacttttttcaa

SEQ ID NO: 2748689 - DNA, 18 bp, Homo sapiens
tctgtacttttttcaaat

SEQ ID NO: 2748690 - DNA, 23 bp, Homo sapiens
tctgtacttttttcaaatattga

SEQ ID NO: 2748691 - DNA, 14 bp, Homo sapiens
tctgtataaatgtc

SEQ ID NO: 2748692 - DNA, 16 bp, Homo sapiens
tctgtataaatgtcta

SEQ ID NO: 2748693 - DNA, 22 bp, Homo sapiens
tctgtcttcaggctctgcccag

SEQ ID NO: 2748694 - DNA, 17 bp, Homo sapiens
tctgtgcagggctggtt

SEQ ID NO: 2748695 - DNA, 11 bp, Homo sapiens
tctgtgtgtgt

SEQ ID NO: 2748696 - DNA, 13 bp, Homo sapiens
tctgtgtgtgtgt

SEQ ID NO: 2748697 - DNA, 22 bp, Homo sapiens
tctgtgtgtgtgtatgtggggg

SEQ ID NO: 2748698 - DNA, 19 bp, Homo sapiens
tctgtgtgtttatgtgtgt

SEQ ID NO: 2748699 - DNA, 20 bp, Homo sapiens
tctgtgtgtttatgtgtgtg

SEQ ID NO: 2748700 - DNA, 22 bp, Homo sapiens
tctgttaaatatttttgtacat

SEQ ID NO: 2748701 - DNA, 20 bp, Homo sapiens
tctgttttataattttgtga

SEQ ID NO: 2748702 - DNA, 16 bp, Homo sapiens
tcttaaaatgcaatat

SEQ ID NO: 2748703 - DNA, 13 bp, Homo sapiens
tcttaaatcagaa

SEQ ID NO: 2748704 - DNA, 15 bp, Homo sapiens
tcttaaatcagaata

SEQ ID NO: 2748705 - DNA, 13 bp, Homo sapiens
tcttaagaatgtg

SEQ ID NO: 2748706 - DNA, 19 bp, Homo sapiens
tcttagaggttaatcagag

SEQ ID NO: 2748707 - DNA, 17 bp, Homo sapiens
tcttagctgcactgttt

SEQ ID NO: 2748708 - DNA, 15 bp, Homo sapiens
tcttatagaataaaa

SEQ ID NO: 2748709 - DNA, 19 bp, Homo sapiens
tcttatagaataaaagctg

SEQ ID NO: 2748710 - DNA, 21 bp, Homo sapiens
tcttatagaataaaagctgtg

SEQ ID NO: 2748711 - DNA, 13 bp, Homo sapiens
tcttcaaatttga

SEQ ID NO: 2748712 - DNA, 23 bp, Homo sapiens
tcttcaaatttgattctaaatag

SEQ ID NO: 2748713 - DNA, 23 bp, Homo sapiens
tcttcattagatgtttatttaga

SEQ ID NO: 2748714 - DNA, 21 bp, Homo sapiens
tcttccttggccaagagaagg

SEQ ID NO: 2748715 - DNA, 15 bp, Homo sapiens
tcttgaaaatgccac

SEQ ID NO: 2748716 - DNA, 17 bp, Homo sapiens
tcttgaaaatgccacca

SEQ ID NO: 2748717 - DNA, 14 bp, Homo sapiens
tcttgattaatgta

SEQ ID NO: 2748718 - DNA, 15 bp, Homo sapiens
tcttgattaatgtac

SEQ ID NO: 2748719 - DNA, 17 bp, Homo sapiens
tcttgattaatgtactt

SEQ ID NO: 2748720 - DNA, 22 bp, Homo sapiens
tcttgctagacaaggttgctgt

SEQ ID NO: 2748721 - DNA, 23 bp, Homo sapiens
tcttgctagacaaggttgctgtt

SEQ ID NO: 2748722 - DNA, 14 bp, Homo sapiens
tcttggtgtaactt

SEQ ID NO: 2748723 - DNA, 15 bp, Homo sapiens
tcttggtgtaactta

SEQ ID NO: 2748724 - DNA, 21 bp, Homo sapiens
tcttggtgtaacttaaatatt

SEQ ID NO: 2748725 - DNA, 18 bp, Homo sapiens
tcttgtgaagttgttttt

SEQ ID NO: 2748726 - DNA, 14 bp, Homo sapiens
tctttaaactactg

SEQ ID NO: 2748727 - DNA, 16 bp, Homo sapiens
tctttaaatcatttta

SEQ ID NO: 2748728 - DNA, 23 bp, Homo sapiens
tctttaaatcattttaggaaagg

SEQ ID NO: 2748729 - DNA, 14 bp, Homo sapiens
tctttaatcactta

SEQ ID NO: 2748730 - DNA, 23 bp, Homo sapiens
tctttaatcacttaacattccta

SEQ ID NO: 2748731 - DNA, 15 bp, Homo sapiens
tctttcatagttctg

SEQ ID NO: 2748732 - DNA, 22 bp, Homo sapiens
tctttcatagttctgttaaata

SEQ ID NO: 2748733 - DNA, 19 bp, Homo sapiens
tcttttccaaacacaggca

SEQ ID NO: 2748734 - DNA, 21 bp, Homo sapiens
tgaaaaaaaaattatttgcct

SEQ ID NO: 2748735 - DNA, 22 bp, Homo sapiens
tgaaaaaaaaattatttgcctt

SEQ ID NO: 2748736 - DNA, 13 bp, Homo sapiens
tgaaaatgccacc

SEQ ID NO: 2748737 - DNA, 18 bp, Homo sapiens
tgaaaattacctttaatg

SEQ ID NO: 2748738 - DNA, 16 bp, Homo sapiens
tgaaaggtacttcaaa

SEQ ID NO: 2748739 - DNA, 18 bp, Homo sapiens
tgaaagtaaaaaaataat

SEQ ID NO: 2748740 - DNA, 15 bp, Homo sapiens
tgaaagtgatgacat

SEQ ID NO: 2748741 - DNA, 20 bp, Homo sapiens
tgaaagtgatgacatatttt

SEQ ID NO: 2748742 - DNA, 22 bp, Homo sapiens
tgaaatatagttgaaagtaaaa

SEQ ID NO: 2748743 - DNA, 15 bp, Homo sapiens
tgaaatgctaaactt

SEQ ID NO: 2748744 - DNA, 13 bp, Homo sapiens
tgaaattcacaga

SEQ ID NO: 2748745 - DNA, 20 bp, Homo sapiens
tgaacagtacagtatttaca

SEQ ID NO: 2748746 - DNA, 15 bp, Homo sapiens
tgaacatttactaca

SEQ ID NO: 2748747 - DNA, 20 bp, Homo sapiens
tgaacatttactacagtttt

SEQ ID NO: 2748748 - DNA, 13 bp, Homo sapiens
tgaacctttcaaa

SEQ ID NO: 2748749 - DNA, 16 bp, Homo sapiens
tgaacctttcaaaatg

SEQ ID NO: 2748750 - DNA, 14 bp, Homo sapiens
tgaactaagttatt

SEQ ID NO: 2748751 - DNA, 21 bp, Homo sapiens
tgaactaagttattgctgcat

SEQ ID NO: 2748752 - DNA, 14 bp, Homo sapiens
tgaagaagatggta

SEQ ID NO: 2748753 - DNA, 20 bp, Homo sapiens
tgaagaagcaccaatcatga

SEQ ID NO: 2748754 - DNA, 19 bp, Homo sapiens
tgaagaattgccaatcttg

SEQ ID NO: 2748755 - DNA, 20 bp, Homo sapiens
tgaagagaagggcagggctg

SEQ ID NO: 2748756 - DNA, 18 bp, Homo sapiens
tgaagcatttaaaagagt

SEQ ID NO: 2748757 - DNA, 13 bp, Homo sapiens
tgaaggtgcagtt

SEQ ID NO: 2748758 - DNA, 20 bp, Homo sapiens
tgaagtcttcttatctaaac

SEQ ID NO: 2748759 - DNA, 19 bp, Homo sapiens
ttattacacctcagaaatt

SEQ ID NO: 2748760 - DNA, 21 bp, Homo sapiens
ttattataaatgttagttcta

SEQ ID NO: 2748761 - DNA, 14 bp, Homo sapiens
ttattatgaagaat

SEQ ID NO: 2748762 - DNA, 19 bp, Homo sapiens
ttattatgaagaattgcca

SEQ ID NO: 2748763 - DNA, 13 bp, Homo sapiens
ttattcaaaatat

SEQ ID NO: 2748764 - DNA, 21 bp, Homo sapiens
ttattctgggaaatgttttaa

SEQ ID NO: 2748765 - DNA, 20 bp, Homo sapiens
ttattgctgcataaatttgt

SEQ ID NO: 2748766 - DNA, 15 bp, Homo sapiens
ttattgtctagtgaa

SEQ ID NO: 2748767 - DNA, 14 bp, Homo sapiens
ttatttagaaactg

SEQ ID NO: 2748768 - DNA, 15 bp, Homo sapiens
ttatttagaaactgg

SEQ ID NO: 2748769 - DNA, 18 bp, Homo sapiens
ttatttgttgttttctgg

SEQ ID NO: 2748770 - DNA, 16 bp, Homo sapiens
ttattttaataatgtt

SEQ ID NO: 2748771 - DNA, 17 bp, Homo sapiens
ttattttaataatgttt

SEQ ID NO: 2748772 - DNA, 19 bp, Homo sapiens
ttattttaataatgtttca

SEQ ID NO: 2748773 - DNA, 12 bp, Homo sapiens
ttattttgaatg

SEQ ID NO: 2748774 - DNA, 17 bp, Homo sapiens
ttcaaaactagttctta

SEQ ID NO: 2748775 - DNA, 20 bp, Homo sapiens
ttcaaaatggaaaattaatt

SEQ ID NO: 2748776 - DNA, 14 bp, Homo sapiens
ttcaaacatatata

SEQ ID NO: 2748777 - DNA, 17 bp, Homo sapiens
ttcaaatagtatagaaa

SEQ ID NO: 2748778 - DNA, 13 bp, Homo sapiens
ttcaaatttgatt

SEQ ID NO: 2748779 - DNA, 21 bp, Homo sapiens
ttcaaattttttaaaagagac

SEQ ID NO: 2748780 - DNA, 22 bp, Homo sapiens
ttcaagatcctcttgccacatc

SEQ ID NO: 2748781 - DNA, 17 bp, Homo sapiens
ttcacagaagcctagga

SEQ ID NO: 2748782 - DNA, 20 bp, Homo sapiens
ttcacagttggcacttctgc

SEQ ID NO: 2748783 - DNA, 17 bp, Homo sapiens
ttcacattaactcaggc

SEQ ID NO: 2748784 - DNA, 20 bp, Homo sapiens
ttcagataatcacaatacat

SEQ ID NO: 2748785 - DNA, 21 bp, Homo sapiens
ttcagctgtgctttttgcaaa

SEQ ID NO: 2748786 - DNA, 23 bp, Homo sapiens
ttcagtagcaggacctgccaaga

SEQ ID NO: 2748787 - DNA, 16 bp, Homo sapiens
ttcagtgcaagagact

SEQ ID NO: 2748788 - DNA, 15 bp, Homo sapiens
ttcagtttagaacct

SEQ ID NO: 2748789 - DNA, 23 bp, Homo sapiens
ttcatagttctgttaaatatttt

SEQ ID NO: 2748790 - DNA, 19 bp, Homo sapiens
ttcatgacagaatatacac

SEQ ID NO: 2748791 - DNA, 15 bp, Homo sapiens
ttcatgcattactta

SEQ ID NO: 2748792 - DNA, 13 bp, Homo sapiens
ttcatttacaatt

SEQ ID NO: 2748793 - DNA, 20 bp, Homo sapiens
ttcatttacaatttcaaaag

SEQ ID NO: 2748794 - DNA, 16 bp, Homo sapiens
ttccaccggcactcat

SEQ ID NO: 2748795 - DNA, 15 bp, Homo sapiens
ttccagcctttgtca

SEQ ID NO: 2748796 - DNA, 18 bp, Homo sapiens
ttcccaactccagaaagt

SEQ ID NO: 2748797 - DNA, 21 bp, Homo sapiens
ttcctgaggaagagggactgt

SEQ ID NO: 2748798 - DNA, 13 bp, Homo sapiens
ttcctgcatcttt

SEQ ID NO: 2748799 - DNA, 18 bp, Homo sapiens
ttcctgcccagcctgggg

SEQ ID NO: 2748800 - DNA, 19 bp, Homo sapiens
ttcctgcccagcctggggc

SEQ ID NO: 2748801 - DNA, 18 bp, Homo sapiens
ttcctttatactgtgaag

SEQ ID NO: 2748802 - DNA, 23 bp, Homo sapiens
ttccttttgtaaagtaaaatatg

SEQ ID NO: 2748803 - DNA, 18 bp, Homo sapiens
ttctaaaccacaaaagtt

SEQ ID NO: 2748804 - DNA, 20 bp, Homo sapiens
ttctaaaccacaaaagttgt

SEQ ID NO: 2748805 - DNA, 11 bp, Homo sapiens
ttctaaactta

SEQ ID NO: 2748806 - DNA, 22 bp, Homo sapiens
ttctaaatagcgattataatct

SEQ ID NO: 2748807 - DNA, 16 bp, Homo sapiens
ttctaagggaaaaagt

SEQ ID NO: 2748808 - DNA, 19 bp, Homo sapiens
ttctaagggaaaaagttgt

SEQ ID NO: 2748809 - DNA, 23 bp, Homo sapiens
ttctaagggaaaaagttgtatca

SEQ ID NO: 2748810 - DNA, 12 bp, Homo sapiens
ttctaatcttaa

SEQ ID NO: 2748811 - DNA, 21 bp, Homo sapiens
ttctaatcttaaatcagaata

SEQ ID NO: 2748812 - DNA, 22 bp, Homo sapiens
ttctacacatttcatctaattt

SEQ ID NO: 2748813 - DNA, 14 bp, Homo sapiens
ttctagacataact

SEQ ID NO: 2748814 - DNA, 19 bp, Homo sapiens
ttctagctctatttacttc

SEQ ID NO: 2748815 - DNA, 21 bp, Homo sapiens
ttctatcgttattataaatgt

SEQ ID NO: 2748816 - DNA, 18 bp, Homo sapiens
ttctcaactccaaactga

SEQ ID NO: 2748817 - DNA, 18 bp, Homo sapiens
ttctcatatccataaaat

SEQ ID NO: 2748818 - DNA, 19 bp, Homo sapiens
ttctcatatccataaaatt

SEQ ID NO: 2748819 - DNA, 13 bp, Homo sapiens
ttctctaaactgt

SEQ ID NO: 2748820 - DNA, 15 bp, Homo sapiens
ttctctactttaaat

SEQ ID NO: 2748821 - DNA, 12 bp, Homo sapiens
ttctctaggaaa

SEQ ID NO: 2748822 - DNA, 20 bp, Homo sapiens
ttctcttccagtttctgtaa

SEQ ID NO: 2748823 - DNA, 21 bp, Homo sapiens
ttctcttccagtttctgtaag

SEQ ID NO: 2748824 - DNA, 17 bp, Homo sapiens
ttctgaggtaagtgtat

SEQ ID NO: 2748825 - DNA, 15 bp, Homo sapiens
ttctgggggaaaaag

SEQ ID NO: 2748826 - DNA, 15 bp, Homo sapiens
ttctgtgttgaaata

SEQ ID NO: 2748827 - DNA, 13 bp, Homo sapiens
ttctgttaaatat

SEQ ID NO: 2748828 - DNA, 22 bp, Homo sapiens
ttctgttaaatatttttgtaca

SEQ ID NO: 2748829 - DNA, 16 bp, Homo sapiens
ttctgttttataattt

SEQ ID NO: 2748830 - DNA, 21 bp, Homo sapiens
ttcttaaaatgcaatatttgt

SEQ ID NO: 2748831 - DNA, 23 bp, Homo sapiens
ttcttaaaatgcaatatttgtaa

SEQ ID NO: 2748832 - DNA, 18 bp, Homo sapiens
ttcttagctgcactgttt

SEQ ID NO: 2748833 - DNA, 22 bp, Homo sapiens
ttcttagtgttggtttaatatt

SEQ ID NO: 2748834 - DNA, 13 bp, Homo sapiens
ttcttatagaata

SEQ ID NO: 2748835 - DNA, 18 bp, Homo sapiens
ttcttcctttcttccttg

SEQ ID NO: 2748836 - DNA, 16 bp, Homo sapiens
ttctttaaactactga

SEQ ID NO: 2748837 - DNA, 20 bp, Homo sapiens
ttctttagatttttaaattg

SEQ ID NO: 2748838 - DNA, 21 bp, Homo sapiens
ttctttgaaatgctaaacttg

SEQ ID NO: 2748839 - DNA, 19 bp, Homo sapiens
ttgaaaggtcagaattttg

SEQ ID NO: 2748840 - DNA, 23 bp, Homo sapiens
ttgaaatatagttgaaagtaaaa

SEQ ID NO: 2748841 - DNA, 19 bp, Homo sapiens
ttgaaatattgacttttta

SEQ ID NO: 2748842 - DNA, 16 bp, Homo sapiens
ttgaaggaatacaata

SEQ ID NO: 2748843 - DNA, 22 bp, Homo sapiens
ttgaagtcttcttatctaaacc

SEQ ID NO: 2748844 - DNA, 12 bp, Homo sapiens
ttgaatgtacct

SEQ ID NO: 2748845 - DNA, 13 bp, Homo sapiens
ttgacatgggaca

SEQ ID NO: 2748846 - DNA, 16 bp, Homo sapiens
ttgagctttgcattta

SEQ ID NO: 2748847 - DNA, 16 bp, Homo sapiens
ttgagtaattctagac

SEQ ID NO: 2748848 - DNA, 13 bp, Homo sapiens
ttgagtatttgct

SEQ ID NO: 2748849 - DNA, 16 bp, Homo sapiens
ttgagtatttgctgtt

SEQ ID NO: 2748850 - DNA, 13 bp, Homo sapiens
ttgagttgggggt

SEQ ID NO: 2748851 - DNA, 19 bp, Homo sapiens
ttgatggtggtatgttttc

SEQ ID NO: 2748852 - DNA, 19 bp, Homo sapiens
ttgattaatgaagaaagta

SEQ ID NO: 2748853 - DNA, 15 bp, Homo sapiens
ttgattaatgtactt

SEQ ID NO: 2748854 - DNA, 16 bp, Homo sapiens
ttgattctaaatagcg

SEQ ID NO: 2748855 - DNA, 18 bp, Homo sapiens
ttgattggataaatgctt

SEQ ID NO: 2748856 - DNA, 22 bp, Homo sapiens
ttgcaagccagattttcctgaa

SEQ ID NO: 2748857 - DNA, 12 bp, Homo sapiens
ttgcactttgta

SEQ ID NO: 2748858 - DNA, 18 bp, Homo sapiens
ttgcattggtttgagaaa

SEQ ID NO: 2748859 - DNA, 17 bp, Homo sapiens
ttgccacatcttgaaaa

SEQ ID NO: 2748860 - DNA, 20 bp, Homo sapiens
ttgcctaaggccagccattt

SEQ ID NO: 2748861 - DNA, 18 bp, Homo sapiens
ttgcctgactaaaatgtt

SEQ ID NO: 2748862 - DNA, 23 bp, Homo sapiens
ttgcctgactaaaatgtttcatt

SEQ ID NO: 2748863 - DNA, 21 bp, Homo sapiens
ttgcctgtagtctcagctact

SEQ ID NO: 2748864 - DNA, 20 bp, Homo sapiens
ttgctagacaaggttgctgt

SEQ ID NO: 2748865 - DNA, 17 bp, Homo sapiens
ttgctgcataaatttgt

SEQ ID NO: 2748866 - DNA, 19 bp, Homo sapiens
ttgctgcataaatttgtaa

SEQ ID NO: 2748867 - DNA, 18 bp, Homo sapiens
ttgctgctgtgcgtggaa

SEQ ID NO: 2748868 - DNA, 19 bp, Homo sapiens
ttgctgctgtgcgtggaaa

SEQ ID NO: 2748869 - DNA, 19 bp, Homo sapiens
ttgctgttgtgcagtgtgc

SEQ ID NO: 2748870 - DNA, 23 bp, Homo sapiens
ttgctttgttaaaaaaaaaaaga

SEQ ID NO: 2748871 - DNA, 17 bp, Homo sapiens
ttggagaaaagcactta

SEQ ID NO: 2748872 - DNA, 17 bp, Homo sapiens
ttggagaagaactgaaa

SEQ ID NO: 2748873 - DNA, 16 bp, Homo sapiens
ttggagccttccaccg

SEQ ID NO: 2748874 - DNA, 16 bp, Homo sapiens
ttggcaaacgggcttg

SEQ ID NO: 2748875 - DNA, 14 bp, Homo sapiens
ttggcaaattctga

SEQ ID NO: 2748876 - DNA, 15 bp, Homo sapiens
ttggccaagagaagg

SEQ ID NO: 2748877 - DNA, 20 bp, Homo sapiens
ttgggaaaaattatttgtgt

SEQ ID NO: 2748878 - DNA, 20 bp, Homo sapiens
ttggtaaggggaattgagga

SEQ ID NO: 2748879 - DNA, 15 bp, Homo sapiens
ttggtattaaagaat

SEQ ID NO: 2748880 - DNA, 17 bp, Homo sapiens
ttggtattaaagaatgc

SEQ ID NO: 2748881 - DNA, 20 bp, Homo sapiens
ttggtcaggaactattaatt

SEQ ID NO: 2748882 - DNA, 17 bp, Homo sapiens
ttggtgtggagttttca

SEQ ID NO: 2748883 - DNA, 15 bp, Homo sapiens
ttggttatttctaaa

SEQ ID NO: 2748884 - DNA, 14 bp, Homo sapiens
aaaaaagtccttca

SEQ ID NO: 2748885 - DNA, 15 bp, Homo sapiens
aaaaacattgaaata

SEQ ID NO: 2748886 - DNA, 13 bp, Homo sapiens
aaaaacctatttt

SEQ ID NO: 2748887 - DNA, 16 bp, Homo sapiens
aaaaacttttttcttt

SEQ ID NO: 2748888 - DNA, 19 bp, Homo sapiens
aaaaacttttttctttgaa

SEQ ID NO: 2748889 - DNA, 20 bp, Homo sapiens
aaaaacttttttctttgaaa

SEQ ID NO: 2748890 - DNA, 16 bp, Homo sapiens
aaaaagacgatgttta

SEQ ID NO: 2748891 - DNA, 23 bp, Homo sapiens
aaaaagacgatgtttatgttctt

SEQ ID NO: 2748892 - DNA, 18 bp, Homo sapiens
aaaaagattgtattgctg

SEQ ID NO: 2748893 - DNA, 15 bp, Homo sapiens
aaaaagtccttcagt

SEQ ID NO: 2748894 - DNA, 12 bp, Homo sapiens
aaaaagttgtat

SEQ ID NO: 2748895 - DNA, 14 bp, Homo sapiens
aaaaatgaagcaga

SEQ ID NO: 2748896 - DNA, 17 bp, Homo sapiens
aaaaattatttgccttt

SEQ ID NO: 2748897 - DNA, 21 bp, Homo sapiens
aaaaattatttgccttttaaa

SEQ ID NO: 2748898 - DNA, 13 bp, Homo sapiens
aaaacacagtatt

SEQ ID NO: 2748899 - DNA, 16 bp, Homo sapiens
aaaacattgaaatatt

SEQ ID NO: 2748900 - DNA, 19 bp, Homo sapiens
aaaactatcctatgccttc

SEQ ID NO: 2748901 - DNA, 21 bp, Homo sapiens
aaaagaattaccaagagaagg

SEQ ID NO: 2748902 - DNA, 20 bp, Homo sapiens
aaaagacgatgtttatgttc

SEQ ID NO: 2748903 - DNA, 17 bp, Homo sapiens
aaaagattgtattgctg

SEQ ID NO: 2748904 - DNA, 20 bp, Homo sapiens
aaaagcacttaaagtttttt

SEQ ID NO: 2748905 - DNA, 19 bp, Homo sapiens
aaaagtaagggaataaatt

SEQ ID NO: 2748906 - DNA, 21 bp, Homo sapiens
aaaagtaagggaataaatttt

SEQ ID NO: 2748907 - DNA, 19 bp, Homo sapiens
aaaagttgtttaataagta

SEQ ID NO: 2748908 - DNA, 22 bp, Homo sapiens
aaaagttttttttttgtttgtt

SEQ ID NO: 2748909 - DNA, 15 bp, Homo sapiens
aaaataaaagctatt

SEQ ID NO: 2748910 - DNA, 19 bp, Homo sapiens
aaaataaagtttttttctt

SEQ ID NO: 2748911 - DNA, 16 bp, Homo sapiens
aaaatacataacttca

SEQ ID NO: 2748912 - DNA, 19 bp, Homo sapiens
aaaatacataacttcagtg

SEQ ID NO: 2748913 - DNA, 14 bp, Homo sapiens
aaaatatacaagta

SEQ ID NO: 2748914 - DNA, 22 bp, Homo sapiens
aaaatatacaagtaaattctgt

SEQ ID NO: 2748915 - DNA, 22 bp, Homo sapiens
aaaatatgtccagaagagtcaa

SEQ ID NO: 2748916 - DNA, 20 bp, Homo sapiens
aaaatattggtattaaagaa

SEQ ID NO: 2748917 - DNA, 22 bp, Homo sapiens
aaaatcaggagcctgctaagga

SEQ ID NO: 2748918 - DNA, 17 bp, Homo sapiens
aaaatctcaatatttca

SEQ ID NO: 2748919 - DNA, 12 bp, Homo sapiens
aaaatgcaatat

SEQ ID NO: 2748920 - DNA, 22 bp, Homo sapiens
aaaatgccaccatccaataaaa

SEQ ID NO: 2748921 - DNA, 18 bp, Homo sapiens
aaaatggaaaatatacaa

SEQ ID NO: 2748922 - DNA, 14 bp, Homo sapiens
aaaatgtagaaatt

SEQ ID NO: 2748923 - DNA, 15 bp, Homo sapiens
aaaatgtagaaattc

SEQ ID NO: 2748924 - DNA, 18 bp, Homo sapiens
aaaatgtagaaattctaa

SEQ ID NO: 2748925 - DNA, 22 bp, Homo sapiens
aaaatgttttatggtagctttt

SEQ ID NO: 2748926 - DNA, 12 bp, Homo sapiens
aaaatgttttta

SEQ ID NO: 2748927 - DNA, 17 bp, Homo sapiens
aaaattaattctaaact

SEQ ID NO: 2748928 - DNA, 19 bp, Homo sapiens
aaaattaattctaaactta

SEQ ID NO: 2748929 - DNA, 15 bp, Homo sapiens
aaaattatttgcctt

SEQ ID NO: 2748930 - DNA, 20 bp, Homo sapiens
aaaattatttgccttttaaa

SEQ ID NO: 2748931 - DNA, 17 bp, Homo sapiens
aaaattttcattctgaa

SEQ ID NO: 2748932 - DNA, 22 bp, Homo sapiens
aaaattttttctctaggaaata

SEQ ID NO: 2748933 - DNA, 12 bp, Homo sapiens
aaacaccacttt

SEQ ID NO: 2748934 - DNA, 15 bp, Homo sapiens
aaacagattcaaagc

SEQ ID NO: 2748935 - DNA, 13 bp, Homo sapiens
aaacatatataac

SEQ ID NO: 2748936 - DNA, 19 bp, Homo sapiens
aaacatatataacaatgct

SEQ ID NO: 2748937 - DNA, 13 bp, Homo sapiens
aaaccgaataaat

SEQ ID NO: 2748938 - DNA, 14 bp, Homo sapiens
aaacctagccggaa

SEQ ID NO: 2748939 - DNA, 21 bp, Homo sapiens
aaacctattttgaaaggtcag

SEQ ID NO: 2748940 - DNA, 13 bp, Homo sapiens
aaacctgctggtg

SEQ ID NO: 2748941 - DNA, 22 bp, Homo sapiens
aaacctgtagatgcagaaaaag

SEQ ID NO: 2748942 - DNA, 17 bp, Homo sapiens
aaactatcctatgcctt

SEQ ID NO: 2748943 - DNA, 19 bp, Homo sapiens
aaactatcctatgccttca

SEQ ID NO: 2748944 - DNA, 23 bp, Homo sapiens
aaactatcctatgccttcaaata

SEQ ID NO: 2748945 - DNA, 16 bp, Homo sapiens
aaactgcatttttaat

SEQ ID NO: 2748946 - DNA, 23 bp, Homo sapiens
aaactggttctgtgttgaaatat

SEQ ID NO: 2748947 - DNA, 14 bp, Homo sapiens
aaactgtaaaaaat

SEQ ID NO: 2748948 - DNA, 21 bp, Homo sapiens
aaactgtaaaaaatgtgtgta

SEQ ID NO: 2748949 - DNA, 14 bp, Homo sapiens
aaacttagaaatat

SEQ ID NO: 2748950 - DNA, 17 bp, Homo sapiens
aaacttagaaatatgct

SEQ ID NO: 2748951 - DNA, 21 bp, Homo sapiens
aaagaaaccatgcaaagcaac

SEQ ID NO: 2748952 - DNA, 17 bp, Homo sapiens
aaagaaactaagattta

SEQ ID NO: 2748953 - DNA, 12 bp, Homo sapiens
aaagaatagaaa

SEQ ID NO: 2748954 - DNA, 15 bp, Homo sapiens
aaagaatgaaagtag

SEQ ID NO: 2748955 - DNA, 22 bp, Homo sapiens
aaagacgatgtttatgttctta

SEQ ID NO: 2748956 - DNA, 22 bp, Homo sapiens
aaagactcctttcctgcatctt

SEQ ID NO: 2748957 - DNA, 18 bp, Homo sapiens
aaagagaacttccagatc

SEQ ID NO: 2748958 - DNA, 17 bp, Homo sapiens
aaagatgctttaattgt

SEQ ID NO: 2748959 - DNA, 15 bp, Homo sapiens
aaagattgtattgct

SEQ ID NO: 2748960 - DNA, 14 bp, Homo sapiens
aaagcaaaattttt

SEQ ID NO: 2748961 - DNA, 18 bp, Homo sapiens
aaagcacttaaagttttt

SEQ ID NO: 2748962 - DNA, 19 bp, Homo sapiens
aaagctaatacaaaactat

SEQ ID NO: 2748963 - DNA, 20 bp, Homo sapiens
aaagctattacttggcaaat

SEQ ID NO: 2748964 - DNA, 22 bp, Homo sapiens
aaagctgttaaaatacataact

SEQ ID NO: 2748965 - DNA, 15 bp, Homo sapiens
aaaggcacatattgg

SEQ ID NO: 2748966 - DNA, 21 bp, Homo sapiens
aaaggtttccactattataga

SEQ ID NO: 2748967 - DNA, 22 bp, Homo sapiens
aaaggtttccactattatagaa

SEQ ID NO: 2748968 - DNA, 13 bp, Homo sapiens
aaagtaaaatatg

SEQ ID NO: 2748969 - DNA, 15 bp, Homo sapiens
aaagtaaaatatgtc

SEQ ID NO: 2748970 - DNA, 21 bp, Homo sapiens
aaagtaagggaataaattttt

SEQ ID NO: 2748971 - DNA, 23 bp, Homo sapiens
aaagttagcattgtttctagatt

SEQ ID NO: 2748972 - DNA, 20 bp, Homo sapiens
aaagttcacattaactcagg

SEQ ID NO: 2748973 - DNA, 22 bp, Homo sapiens
aaagttttttttttgtttgttt

SEQ ID NO: 2748974 - DNA, 13 bp, Homo sapiens
aaataaaagctat

SEQ ID NO: 2748975 - DNA, 14 bp, Homo sapiens
aaataaaagctatt

SEQ ID NO: 2748976 - DNA, 12 bp, Homo sapiens
aaataaagtttt

SEQ ID NO: 2748977 - DNA, 21 bp, Homo sapiens
aaataattgagactgaaagaa

SEQ ID NO: 2748978 - DNA, 21 bp, Homo sapiens
acctttctaagggaaaaagtt

SEQ ID NO: 2748979 - DNA, 23 bp, Homo sapiens
acgactcttttccaaacacaggc

SEQ ID NO: 2748980 - DNA, 17 bp, Homo sapiens
acgatgtttatgttctt

SEQ ID NO: 2748981 - DNA, 20 bp, Homo sapiens
acgcccttggagccttccac

SEQ ID NO: 2748982 - DNA, 13 bp, Homo sapiens
acgcggttttttc

SEQ ID NO: 2748983 - DNA, 23 bp, Homo sapiens
actaaaattctgggcctaatttt

SEQ ID NO: 2748984 - DNA, 15 bp, Homo sapiens
actaagagagaatga

SEQ ID NO: 2748985 - DNA, 22 bp, Homo sapiens
actaagttattgctgcataaat

SEQ ID NO: 2748986 - DNA, 12 bp, Homo sapiens
actacaggacaa

SEQ ID NO: 2748987 - DNA, 16 bp, Homo sapiens
actactggtctgtact

SEQ ID NO: 2748988 - DNA, 20 bp, Homo sapiens
actagagtttagctggaaaa

SEQ ID NO: 2748989 - DNA, 19 bp, Homo sapiens
actagtatttctatgaaat

SEQ ID NO: 2748990 - DNA, 12 bp, Homo sapiens
actataaataca

SEQ ID NO: 2748991 - DNA, 14 bp, Homo sapiens
actataaatacaaa

SEQ ID NO: 2748992 - DNA, 17 bp, Homo sapiens
actataaatacaaatct

SEQ ID NO: 2748993 - DNA, 22 bp, Homo sapiens
actataaatacaaatctgtata

SEQ ID NO: 2748994 - DNA, 13 bp, Homo sapiens
actataaatgata

SEQ ID NO: 2748995 - DNA, 17 bp, Homo sapiens
actatctcatttccaag

SEQ ID NO: 2748996 - DNA, 16 bp, Homo sapiens
actattatagaaattc

SEQ ID NO: 2748997 - DNA, 20 bp, Homo sapiens
actcctttcctgcatctttc

SEQ ID NO: 2748998 - DNA, 18 bp, Homo sapiens
actcgcacctgtgctgga

SEQ ID NO: 2748999 - DNA, 18 bp, Homo sapiens
actcgccatctcctgggc

SEQ ID NO: 2749000 - DNA, 21 bp, Homo sapiens
actctggaggtttgtttagaa

SEQ ID NO: 2749001 - DNA, 14 bp, Homo sapiens
actcttaagaagac

SEQ ID NO: 2749002 - DNA, 21 bp, Homo sapiens
actcttaagaagactgcatta

SEQ ID NO: 2749003 - DNA, 21 bp, Homo sapiens
actgaaagaaactaagattta

SEQ ID NO: 2749004 - DNA, 15 bp, Homo sapiens
actgaaggtgcagtt

SEQ ID NO: 2749005 - DNA, 13 bp, Homo sapiens
actgactcttaag

SEQ ID NO: 2749006 - DNA, 18 bp, Homo sapiens
actgactcttaagaagac

SEQ ID NO: 2749007 - DNA, 15 bp, Homo sapiens
actgattttcaaaaa

SEQ ID NO: 2749008 - DNA, 12 bp, Homo sapiens
actgcagaacag

SEQ ID NO: 2749009 - DNA, 15 bp, Homo sapiens
actgcattatattta

SEQ ID NO: 2749010 - DNA, 19 bp, Homo sapiens
actgccttctcaactccaa

SEQ ID NO: 2749011 - DNA, 15 bp, Homo sapiens
actggataaatttaa

SEQ ID NO: 2749012 - DNA, 23 bp, Homo sapiens
actggccagtggctggatctgtg

SEQ ID NO: 2749013 - DNA, 13 bp, Homo sapiens
actgggctgggtt

SEQ ID NO: 2749014 - DNA, 13 bp, Homo sapiens
actgtaagaaaat

SEQ ID NO: 2749015 - DNA, 15 bp, Homo sapiens
actgtaccttttgcg

SEQ ID NO: 2749016 - DNA, 19 bp, Homo sapiens
actgtaccttttgcgattt

SEQ ID NO: 2749017 - DNA, 22 bp, Homo sapiens
actgtgtaatataaaagatctt

SEQ ID NO: 2749018 - DNA, 11 bp, Homo sapiens
acttaaagttt

SEQ ID NO: 2749019 - DNA, 14 bp, Homo sapiens
acttaaatatttga

SEQ ID NO: 2749020 - DNA, 16 bp, Homo sapiens
acttaaatatttgaaa

SEQ ID NO: 2749021 - DNA, 15 bp, Homo sapiens
acttaacattcctaa

SEQ ID NO: 2749022 - DNA, 15 bp, Homo sapiens
acttaggaggctgag

SEQ ID NO: 2749023 - DNA, 22 bp, Homo sapiens
acttcaagatcctcttgccaca

SEQ ID NO: 2749024 - DNA, 20 bp, Homo sapiens
acttccagatcctggaaatc

SEQ ID NO: 2749025 - DNA, 16 bp, Homo sapiens
acttctaatcttaaat

SEQ ID NO: 2749026 - DNA, 19 bp, Homo sapiens
acttcttccctaaaatgta

SEQ ID NO: 2749027 - DNA, 21 bp, Homo sapiens
acttcttccctaaaatgtaga

SEQ ID NO: 2749028 - DNA, 18 bp, Homo sapiens
acttgaggccaggacttt

SEQ ID NO: 2749029 - DNA, 21 bp, Homo sapiens
acttgcctgtagtctcagcta

SEQ ID NO: 2749030 - DNA, 22 bp, Homo sapiens
actttaaaaaattttttgatta

SEQ ID NO: 2749031 - DNA, 20 bp, Homo sapiens
actttactaggtacataagc

SEQ ID NO: 2749032 - DNA, 17 bp, Homo sapiens
actttctttctgtaggt

SEQ ID NO: 2749033 - DNA, 22 bp, Homo sapiens
acttttctctactttaaatttt

SEQ ID NO: 2749034 - DNA, 14 bp, Homo sapiens
actttttgtttctt

SEQ ID NO: 2749035 - DNA, 23 bp, Homo sapiens
acttttttctttgaaatgctaaa

SEQ ID NO: 2749036 - DNA, 17 bp, Homo sapiens
agaaaaaagtccttcag

SEQ ID NO: 2749037 - DNA, 18 bp, Homo sapiens
agaaaaaagtccttcagt

SEQ ID NO: 2749038 - DNA, 19 bp, Homo sapiens
agaaaacaaggatgaatta

SEQ ID NO: 2749039 - DNA, 13 bp, Homo sapiens
agaaaagcactta

SEQ ID NO: 2749040 - DNA, 15 bp, Homo sapiens
agaaaagcacttaaa

SEQ ID NO: 2749041 - DNA, 20 bp, Homo sapiens
agaaaatggaaaatatacaa

SEQ ID NO: 2749042 - DNA, 15 bp, Homo sapiens
agaaacatttggtaa

SEQ ID NO: 2749043 - DNA, 22 bp, Homo sapiens
agaaagctaatacaaaactatc

SEQ ID NO: 2749044 - DNA, 15 bp, Homo sapiens
agaaaggctaacaaa

SEQ ID NO: 2749045 - DNA, 24 bp, Homo sapiens
agaaaggcttccagatgtctaaaa

SEQ ID NO: 2749046 - DNA, 17 bp, Homo sapiens
agaaagtcacctgccca

SEQ ID NO: 2749047 - DNA, 22 bp, Homo sapiens
agaaagtctatctaatgacatg

SEQ ID NO: 2749048 - DNA, 15 bp, Homo sapiens
agaaattctaactta

SEQ ID NO: 2749049 - DNA, 17 bp, Homo sapiens
agaacctacaaaagctt

SEQ ID NO: 2749050 - DNA, 13 bp, Homo sapiens
agaagaactgaaa

SEQ ID NO: 2749051 - DNA, 18 bp, Homo sapiens
agaagatggtaccaccag

SEQ ID NO: 2749052 - DNA, 20 bp, Homo sapiens
agaagggagacattgtttgg

SEQ ID NO: 2749053 - DNA, 13 bp, Homo sapiens
agaagttgatatg

SEQ ID NO: 2749054 - DNA, 20 bp, Homo sapiens
agaatagcctagatatgaat

SEQ ID NO: 2749055 - DNA, 21 bp, Homo sapiens
agaatatacacattttgtaaa

SEQ ID NO: 2749056 - DNA, 23 bp, Homo sapiens
agaatccaagacaaactaaactt

SEQ ID NO: 2749057 - DNA, 12 bp, Homo sapiens
agaatgaaagta

SEQ ID NO: 2749058 - DNA, 17 bp, Homo sapiens
agaatgagagacacact

SEQ ID NO: 2749059 - DNA, 17 bp, Homo sapiens
agaatgattatgaatta

SEQ ID NO: 2749060 - DNA, 15 bp, Homo sapiens
agaatgttaccagac

SEQ ID NO: 2749061 - DNA, 22 bp, Homo sapiens
agaatgttaccagacttcaaga

SEQ ID NO: 2749062 - DNA, 21 bp, Homo sapiens
agaattgccaatcttgtttta

SEQ ID NO: 2749063 - DNA, 20 bp, Homo sapiens
agaattttgttggtctgaat

SEQ ID NO: 2749064 - DNA, 21 bp, Homo sapiens
agaattttgttggtctgaata

SEQ ID NO: 2749065 - DNA, 23 bp, Homo sapiens
agacaagattttttaattgttta

SEQ ID NO: 2749066 - DNA, 16 bp, Homo sapiens
agacacactgaagaag

SEQ ID NO: 2749067 - DNA, 13 bp, Homo sapiens
agacataactggt

SEQ ID NO: 2749068 - DNA, 22 bp, Homo sapiens
agacattgtttggatttccttt

SEQ ID NO: 2749069 - DNA, 23 bp, Homo sapiens
agacccgaaaatccagcgtgcac

SEQ ID NO: 2749070 - DNA, 13 bp, Homo sapiens
agacgatgtttat

SEQ ID NO: 2749071 - DNA, 19 bp, Homo sapiens
agacgatgtttatgttctt

SEQ ID NO: 2749072 - DNA, 17 bp, Homo sapiens
agactgaaagaaactaa

SEQ ID NO: 2749073 - DNA, 21 bp, Homo sapiens
agactgcattatatttattac

SEQ ID NO: 2749074 - DNA, 20 bp, Homo sapiens
agagacaaactgtaaaaaat

SEQ ID NO: 2749075 - DNA, 16 bp, Homo sapiens
agagactttgtcactt

SEQ ID NO: 2749076 - DNA, 22 bp, Homo sapiens
agagactttgtcacttatttcc

SEQ ID NO: 2749077 - DNA, 16 bp, Homo sapiens
agagatgggaaaacca

SEQ ID NO: 2749078 - DNA, 14 bp, Homo sapiens
agaggacagaatgg

SEQ ID NO: 2749079 - DNA, 14 bp, Homo sapiens
agaggttaatcaga

SEQ ID NO: 2749080 - DNA, 15 bp, Homo sapiens
agagtcttttaactt

SEQ ID NO: 2749081 - DNA, 19 bp, Homo sapiens
agagtggggtaggttggga

SEQ ID NO: 2749082 - DNA, 17 bp, Homo sapiens
agagtttagctggaaaa

SEQ ID NO: 2749083 - DNA, 23 bp, Homo sapiens
agataaagtcctgaacctttcaa

SEQ ID NO: 2749084 - DNA, 13 bp, Homo sapiens
agatcctggaaat

SEQ ID NO: 2749085 - DNA, 19 bp, Homo sapiens
agatgcagttctgaagaag

SEQ ID NO: 2749086 - DNA, 21 bp, Homo sapiens
agatgtctaaaagattcttta

SEQ ID NO: 2749087 - DNA, 14 bp, Homo sapiens
agattgtattgctg

SEQ ID NO: 2749088 - DNA, 16 bp, Homo sapiens
agattttcctgaaaac

SEQ ID NO: 2749089 - DNA, 21 bp, Homo sapiens
agatttttatattagttgctt

SEQ ID NO: 2749090 - DNA, 17 bp, Homo sapiens
agattttttaattgttt

SEQ ID NO: 2749091 - DNA, 13 bp, Homo sapiens
agcaaaattttta

SEQ ID NO: 2749092 - DNA, 24 bp, Homo sapiens
agcaaaattttttctctaggaaat

SEQ ID NO: 2749093 - DNA, 19 bp, Homo sapiens
agcaaatactgattttcaa

SEQ ID NO: 2749094 - DNA, 22 bp, Homo sapiens
agcaaatactgattttcaaaaa

SEQ ID NO: 2749095 - DNA, 21 bp, Homo sapiens
agcaaatgcattctatcgtta

SEQ ID NO: 2749096 - DNA, 16 bp, Homo sapiens
agcaagcgttattttg

SEQ ID NO: 2749097 - DNA, 17 bp, Homo sapiens
agcaatgggatataata

SEQ ID NO: 2749098 - DNA, 21 bp, Homo sapiens
agcaatgggatataatacctt

SEQ ID NO: 2749099 - DNA, 22 bp, Homo sapiens
agcagtagccaaacaccacttt

SEQ ID NO: 2749100 - DNA, 18 bp, Homo sapiens
agcagtcaggaaagagaa

SEQ ID NO: 2749101 - DNA, 18 bp, Homo sapiens
agcatgtatagttgcttt

SEQ ID NO: 2749102 - DNA, 19 bp, Homo sapiens
agccagggcaacataataa

SEQ ID NO: 2749103 - DNA, 14 bp, Homo sapiens
atgtcagtatgtgg

SEQ ID NO: 2749104 - DNA, 23 bp, Homo sapiens
atgtccagaagagtcaaagtagt

SEQ ID NO: 2749105 - DNA, 13 bp, Homo sapiens
atgtctattatta

SEQ ID NO: 2749106 - DNA, 14 bp, Homo sapiens
atgtctgcctggag

SEQ ID NO: 2749107 - DNA, 22 bp, Homo sapiens
atgtctgcctggagtgctgtgc

SEQ ID NO: 2749108 - DNA, 21 bp, Homo sapiens
atgtgatctatgtttcatctt

SEQ ID NO: 2749109 - DNA, 21 bp, Homo sapiens
atgtgctagtaattggaaagg

SEQ ID NO: 2749110 - DNA, 13 bp, Homo sapiens
atgtggaagtgtg

SEQ ID NO: 2749111 - DNA, 16 bp, Homo sapiens
atgtggaagtgtgggt

SEQ ID NO: 2749112 - DNA, 23 bp, Homo sapiens
atgtggaagtgtgggtctgtgtg

SEQ ID NO: 2749113 - DNA, 16 bp, Homo sapiens
atgtgggggtctgtgt

SEQ ID NO: 2749114 - DNA, 10 bp, Homo sapiens
atgtgtgtgt

SEQ ID NO: 2749115 - DNA, 18 bp, Homo sapiens
atgttaccagacttcaag

SEQ ID NO: 2749116 - DNA, 14 bp, Homo sapiens
atgttatagctgca

SEQ ID NO: 2749117 - DNA, 17 bp, Homo sapiens
atgttcttatagaataa

SEQ ID NO: 2749118 - DNA, 18 bp, Homo sapiens
atgttcttatagaataaa

SEQ ID NO: 2749119 - DNA, 15 bp, Homo sapiens
atgttgacatgggac

SEQ ID NO: 2749120 - DNA, 23 bp, Homo sapiens
atgttggtgtggagttttcatga

SEQ ID NO: 2749121 - DNA, 16 bp, Homo sapiens
atgttggttgcacttt

SEQ ID NO: 2749122 - DNA, 18 bp, Homo sapiens
atgttggttgcactttgt

SEQ ID NO: 2749123 - DNA, 17 bp, Homo sapiens
atgtttacagaggacag

SEQ ID NO: 2749124 - DNA, 14 bp, Homo sapiens
atgtttattcaaaa

SEQ ID NO: 2749125 - DNA, 18 bp, Homo sapiens
atgtttcaaacatatata

SEQ ID NO: 2749126 - DNA, 21 bp, Homo sapiens
atgtttcaaacatatataaca

SEQ ID NO: 2749127 - DNA, 23 bp, Homo sapiens
atgtttttaaaaacctattttga

SEQ ID NO: 2749128 - DNA, 20 bp, Homo sapiens
attaaatctccagcttacta

SEQ ID NO: 2749129 - DNA, 16 bp, Homo sapiens
attaactcaggcattt

SEQ ID NO: 2749130 - DNA, 23 bp, Homo sapiens
attaagtaatgataactggaaac

SEQ ID NO: 2749131 - DNA, 17 bp, Homo sapiens
attaatattgtattgct

SEQ ID NO: 2749132 - DNA, 13 bp, Homo sapiens
attaatgaagaaa

SEQ ID NO: 2749133 - DNA, 19 bp, Homo sapiens
attaatgtactttttattg

SEQ ID NO: 2749134 - DNA, 20 bp, Homo sapiens
attaatgtactttttattgc

SEQ ID NO: 2749135 - DNA, 15 bp, Homo sapiens
attaattctaaactt

SEQ ID NO: 2749136 - DNA, 18 bp, Homo sapiens
attacacctcagaaattg

SEQ ID NO: 2749137 - DNA, 21 bp, Homo sapiens
attacagtatggcaatatcta

SEQ ID NO: 2749138 - DNA, 15 bp, Homo sapiens
attacatgtaaagct

SEQ ID NO: 2749139 - DNA, 16 bp, Homo sapiens
attacatgtaaagctg

SEQ ID NO: 2749140 - DNA, 18 bp, Homo sapiens
attacatgtaaagctgtt

SEQ ID NO: 2749141 - DNA, 16 bp, Homo sapiens
attacatttgtataaa

SEQ ID NO: 2749142 - DNA, 18 bp, Homo sapiens
attacatttgtataaaat

SEQ ID NO: 2749143 - DNA, 15 bp, Homo sapiens
attaccaagagaagg

SEQ ID NO: 2749144 - DNA, 14 bp, Homo sapiens
attacctaatgaaa

SEQ ID NO: 2749145 - DNA, 12 bp, Homo sapiens
attacttactgt

SEQ ID NO: 2749146 - DNA, 14 bp, Homo sapiens
attacttactgtta

SEQ ID NO: 2749147 - DNA, 23 bp, Homo sapiens
attacttactgttaaaactgtac

SEQ ID NO: 2749148 - DNA, 18 bp, Homo sapiens
attagatgtttatttaga

SEQ ID NO: 2749149 - DNA, 19 bp, Homo sapiens
attagatgtttatttagaa

SEQ ID NO: 2749150 - DNA, 15 bp, Homo sapiens
attaggataactaaa

SEQ ID NO: 2749151 - DNA, 19 bp, Homo sapiens
attaggataactaaaattc

SEQ ID NO: 2749152 - DNA, 16 bp, Homo sapiens
attagggtagtaatta

SEQ ID NO: 2749153 - DNA, 23 bp, Homo sapiens
attagttgcattggtttgagaaa

SEQ ID NO: 2749154 - DNA, 12 bp, Homo sapiens
attataaatgtt

SEQ ID NO: 2749155 - DNA, 15 bp, Homo sapiens
attataaatgttagt

SEQ ID NO: 2749156 - DNA, 13 bp, Homo sapiens
attatagaaattc

SEQ ID NO: 2749157 - DNA, 13 bp, Homo sapiens
attatgaagaatt

SEQ ID NO: 2749158 - DNA, 19 bp, Homo sapiens
attatgaattacatttgta

SEQ ID NO: 2749159 - DNA, 22 bp, Homo sapiens
attatgaattacatttgtataa

SEQ ID NO: 2749160 - DNA, 21 bp, Homo sapiens
attatgcaacgtttaacattg

SEQ ID NO: 2749161 - DNA, 24 bp, Homo sapiens
attatgcaacgtttaacattgatt

SEQ ID NO: 2749162 - DNA, 22 bp, Homo sapiens
attattatgaagaattgccaat

SEQ ID NO: 2749163 - DNA, 13 bp, Homo sapiens
attatttgccttt

SEQ ID NO: 2749164 - DNA, 12 bp, Homo sapiens
attatttgtgtt

SEQ ID NO: 2749165 - DNA, 20 bp, Homo sapiens
attcaaaatattttatcttt

SEQ ID NO: 2749166 - DNA, 17 bp, Homo sapiens
attcaaagcgaacagtc

SEQ ID NO: 2749167 - DNA, 20 bp, Homo sapiens
attcagtgggttcagaacca

SEQ ID NO: 2749168 - DNA, 18 bp, Homo sapiens
attcatgccccagtatta

SEQ ID NO: 2749169 - DNA, 14 bp, Homo sapiens
attcattatgcaac

SEQ ID NO: 2749170 - DNA, 12 bp, Homo sapiens
attccagaggaa

SEQ ID NO: 2749171 - DNA, 21 bp, Homo sapiens
attctaaacttagaaatatgc

SEQ ID NO: 2749172 - DNA, 13 bp, Homo sapiens
attctatgtgtca

SEQ ID NO: 2749173 - DNA, 14 bp, Homo sapiens
attctatgtgtcat

SEQ ID NO: 2749174 - DNA, 22 bp, Homo sapiens
attctccctatcttgtgaagtt

SEQ ID NO: 2749175 - DNA, 18 bp, Homo sapiens
attctgacacatatcatt

SEQ ID NO: 2749176 - DNA, 16 bp, Homo sapiens
attctgaggtaagtgt

SEQ ID NO: 2749177 - DNA, 19 bp, Homo sapiens
attctgaggtaagtgtatg

SEQ ID NO: 2749178 - DNA, 11 bp, Homo sapiens
attctgcagaa

SEQ ID NO: 2749179 - DNA, 14 bp, Homo sapiens
attctgcagaaaaa

SEQ ID NO: 2749180 - DNA, 17 bp, Homo sapiens
attcttaaaatgcaata

SEQ ID NO: 2749181 - DNA, 18 bp, Homo sapiens
attcttaaaatgcaatat

SEQ ID NO: 2749182 - DNA, 19 bp, Homo sapiens
attcttcttttttgtaaaa

SEQ ID NO: 2749183 - DNA, 17 bp, Homo sapiens
attgaagtcttcttatc

SEQ ID NO: 2749184 - DNA, 23 bp, Homo sapiens
attgaagtcttcttatctaaacc

SEQ ID NO: 2749185 - DNA, 21 bp, Homo sapiens
attgaatgccttatttttgaa

SEQ ID NO: 2749186 - DNA, 13 bp, Homo sapiens
attgactttttat

SEQ ID NO: 2749187 - DNA, 22 bp, Homo sapiens
attgagctttgcatttatgatt

SEQ ID NO: 2749188 - DNA, 13 bp, Homo sapiens
attgcatggtgtg

SEQ ID NO: 2749189 - DNA, 18 bp, Homo sapiens
attgcatggtgtgaacta

SEQ ID NO: 2749190 - DNA, 16 bp, Homo sapiens
attgctgcataaattt

SEQ ID NO: 2749191 - DNA, 18 bp, Homo sapiens
attgctgcataaatttgt

SEQ ID NO: 2749192 - DNA, 21 bp, Homo sapiens
attgctgctgtgcgtggaaaa

SEQ ID NO: 2749193 - DNA, 18 bp, Homo sapiens
attggagaaaagcactta

SEQ ID NO: 2749194 - DNA, 22 bp, Homo sapiens
attggagaaaagcacttaaagt

SEQ ID NO: 2749195 - DNA, 16 bp, Homo sapiens
attggagctcgtggaa

SEQ ID NO: 2749196 - DNA, 17 bp, Homo sapiens
attggagctcgtgggac

SEQ ID NO: 2749197 - DNA, 19 bp, Homo sapiens
attggagctcgtgggacag

SEQ ID NO: 2749198 - DNA, 12 bp, Homo sapiens
attggcatttta

SEQ ID NO: 2749199 - DNA, 20 bp, Homo sapiens
attggcattttaagtgttta

SEQ ID NO: 2749200 - DNA, 15 bp, Homo sapiens
attggtattaaagaa

SEQ ID NO: 2749201 - DNA, 17 bp, Homo sapiens
attggtattaaagaatg

SEQ ID NO: 2749202 - DNA, 21 bp, Homo sapiens
attgtagaaagctaatacaaa

SEQ ID NO: 2749203 - DNA, 12 bp, Homo sapiens
attgtattgctg

SEQ ID NO: 2749204 - DNA, 15 bp, Homo sapiens
attgtgatgtgtcct

SEQ ID NO: 2749205 - DNA, 12 bp, Homo sapiens
attgttgtgtat

SEQ ID NO: 2749206 - DNA, 15 bp, Homo sapiens
attgtttctagatta

SEQ ID NO: 2749207 - DNA, 14 bp, Homo sapiens
attgtttggatttc

SEQ ID NO: 2749208 - DNA, 20 bp, Homo sapiens
attgtttggatttcctttat

SEQ ID NO: 2749209 - DNA, 17 bp, Homo sapiens
atttaaaaaactcctgt

SEQ ID NO: 2749210 - DNA, 18 bp, Homo sapiens
atttaaaacacagtattg

SEQ ID NO: 2749211 - DNA, 20 bp, Homo sapiens
atttaaaattgtgatgtgtc

SEQ ID NO: 2749212 - DNA, 15 bp, Homo sapiens
atttacaatttcaaa

SEQ ID NO: 2749213 - DNA, 17 bp, Homo sapiens
atttacaatttcaaaag

SEQ ID NO: 2749214 - DNA, 23 bp, Homo sapiens
atttacaatttcaaaagaacatt

SEQ ID NO: 2749215 - DNA, 21 bp, Homo sapiens
atttacctctcattagaaagg

SEQ ID NO: 2749216 - DNA, 15 bp, Homo sapiens
atttatgatttctcc

SEQ ID NO: 2749217 - DNA, 22 bp, Homo sapiens
atttatgatttctccagaaatt

SEQ ID NO: 2749218 - DNA, 20 bp, Homo sapiens
atttattttaataatgtttc

SEQ ID NO: 2749219 - DNA, 21 bp, Homo sapiens
atttattttaataatgtttca

SEQ ID NO: 2749220 - DNA, 20 bp, Homo sapiens
atttcaaaagaacattctta

SEQ ID NO: 2749221 - DNA, 24 bp, Homo sapiens
atttcaaaagaacattcttatatt

SEQ ID NO: 2749222 - DNA, 20 bp, Homo sapiens
atttcacagttggcacttct

SEQ ID NO: 2749223 - DNA, 15 bp, Homo sapiens
atttcatctaattta

SEQ ID NO: 2749224 - DNA, 17 bp, Homo sapiens
atttccttatgtgtgta

SEQ ID NO: 2749225 - DNA, 13 bp, Homo sapiens
atttcctttatac

SEQ ID NO: 2749226 - DNA, 15 bp, Homo sapiens
atttcctttatactg

SEQ ID NO: 2749227 - DNA, 16 bp, Homo sapiens
atttcctttatactgt

SEQ ID NO: 2749228 - DNA, 20 bp, Homo sapiens
atttccttttgtaaagtaaa

SEQ ID NO: 2749229 - DNA, 17 bp, Homo sapiens
ccacaaaagcaaaattt

SEQ ID NO: 2749230 - DNA, 12 bp, Homo sapiens
ccacaaaagttg

SEQ ID NO: 2749231 - DNA, 19 bp, Homo sapiens
ccacactcgccatctcctg

SEQ ID NO: 2749232 - DNA, 20 bp, Homo sapiens
ccacatcttgaaaatgccac

SEQ ID NO: 2749233 - DNA, 15 bp, Homo sapiens
ccaccaaactcctgc

SEQ ID NO: 2749234 - DNA, 19 bp, Homo sapiens
ccaccgggcatgtctgcct

SEQ ID NO: 2749235 - DNA, 17 bp, Homo sapiens
ccacgcccttggagcct

SEQ ID NO: 2749236 - DNA, 18 bp, Homo sapiens
ccacgcccttggagcctt

SEQ ID NO: 2749237 - DNA, 17 bp, Homo sapiens
ccactgctcgaaatggc

SEQ ID NO: 2749238 - DNA, 23 bp, Homo sapiens
ccactgctcgaaatggcccctgt

SEQ ID NO: 2749239 - DNA, 17 bp, Homo sapiens
ccagaagaagatggctg

SEQ ID NO: 2749240 - DNA, 13 bp, Homo sapiens
ccagacttcaaga

SEQ ID NO: 2749241 - DNA, 15 bp, Homo sapiens
ccagatcctggaaat

SEQ ID NO: 2749242 - DNA, 15 bp, Homo sapiens
ccagcagtacaataa

SEQ ID NO: 2749243 - DNA, 21 bp, Homo sapiens
ccagcagtacaataaaagtaa

SEQ ID NO: 2749244 - DNA, 17 bp, Homo sapiens
ccagctttaaaaagaaa

SEQ ID NO: 2749245 - DNA, 20 bp, Homo sapiens
ccaggtagagggtgtgtaag

SEQ ID NO: 2749246 - DNA, 22 bp, Homo sapiens
ccatcatgtttacagaggacag

SEQ ID NO: 2749247 - DNA, 13 bp, Homo sapiens
ccatccaataaaa

SEQ ID NO: 2749248 - DNA, 23 bp, Homo sapiens
ccatccaataaaaatcaggagcc

SEQ ID NO: 2749249 - DNA, 14 bp, Homo sapiens
ccatggcctgctgg

SEQ ID NO: 2749250 - DNA, 19 bp, Homo sapiens
ccatggcctgctgggcttg

SEQ ID NO: 2749251 - DNA, 12 bp, Homo sapiens
ccattctatgtg

SEQ ID NO: 2749252 - DNA, 21 bp, Homo sapiens
ccattggggaggactaggacc

SEQ ID NO: 2749253 - DNA, 20 bp, Homo sapiens
ccattgttggcgctgaggtg

SEQ ID NO: 2749254 - DNA, 13 bp, Homo sapiens
cccaacacgggta

SEQ ID NO: 2749255 - DNA, 11 bp, Homo sapiens
cccacccctgg

SEQ ID NO: 2749256 - DNA, 21 bp, Homo sapiens
cccagctatggttctctcgca

SEQ ID NO: 2749257 - DNA, 21 bp, Homo sapiens
cccagctttaaaaagaaaaaa

SEQ ID NO: 2749258 - DNA, 15 bp, Homo sapiens
cccatggcctgctgg

SEQ ID NO: 2749259 - DNA, 16 bp, Homo sapiens
cccatggcctgctggg

SEQ ID NO: 2749260 - DNA, 13 bp, Homo sapiens
ccccacccctggc

SEQ ID NO: 2749261 - DNA, 11 bp, Homo sapiens
ccccagtatta

SEQ ID NO: 2749262 - DNA, 21 bp, Homo sapiens
cccccacccctggctaccttg

SEQ ID NO: 2749263 - DNA, 17 bp, Homo sapiens
ccccgcccgagcccctg

SEQ ID NO: 2749264 - DNA, 15 bp, Homo sapiens
cccctggctaccttg

SEQ ID NO: 2749265 - DNA, 15 bp, Homo sapiens
cccctgggtttcttt

SEQ ID NO: 2749266 - DNA, 14 bp, Homo sapiens
cccgccggaggaag

SEQ ID NO: 2749267 - DNA, 15 bp, Homo sapiens
cccgccggaggaagg

SEQ ID NO: 2749268 - DNA, 19 bp, Homo sapiens
ccctgttgagtatttgctg

SEQ ID NO: 2749269 - DNA, 15 bp, Homo sapiens
cccttgatgaagaag

SEQ ID NO: 2749270 - DNA, 16 bp, Homo sapiens
cccttgatgaagaagt

SEQ ID NO: 2749271 - DNA, 13 bp, Homo sapiens
cccttggagcctt

SEQ ID NO: 2749272 - DNA, 17 bp, Homo sapiens
ccgagaggacagaatgg

SEQ ID NO: 2749273 - DNA, 15 bp, Homo sapiens
ccgccggaggaaggt

SEQ ID NO: 2749274 - DNA, 12 bp, Homo sapiens
ccgcctgtcaat

SEQ ID NO: 2749275 - DNA, 17 bp, Homo sapiens
ccgcctgtcaataaatg

SEQ ID NO: 2749276 - DNA, 22 bp, Homo sapiens
ccgcctgtcaataaatgttgaa

SEQ ID NO: 2749277 - DNA, 23 bp, Homo sapiens
ccggaggaaggtcccatggcctg

SEQ ID NO: 2749278 - DNA, 16 bp, Homo sapiens
ccggcactcatgacgg

SEQ ID NO: 2749279 - DNA, 20 bp, Homo sapiens
ccgggcatgtctgcctggag

SEQ ID NO: 2749280 - DNA, 17 bp, Homo sapiens
ccgttacatctgtgcag

SEQ ID NO: 2749281 - DNA, 15 bp, Homo sapiens
cctagatatgaatat

SEQ ID NO: 2749282 - DNA, 23 bp, Homo sapiens
cctaggaggttgaggctgcagtg

SEQ ID NO: 2749283 - DNA, 14 bp, Homo sapiens
cctatgcaataaaa

SEQ ID NO: 2749284 - DNA, 16 bp, Homo sapiens
cctatgccttcaaata

SEQ ID NO: 2749285 - DNA, 11 bp, Homo sapiens
cctattttgaa

SEQ ID NO: 2749286 - DNA, 17 bp, Homo sapiens
cctattttgaaaggtca

SEQ ID NO: 2749287 - DNA, 22 bp, Homo sapiens
cctattttgaaaggtcagaatt

SEQ ID NO: 2749288 - DNA, 20 bp, Homo sapiens
cctcagaaaacaaggatgaa

SEQ ID NO: 2749289 - DNA, 17 bp, Homo sapiens
cctcagaaattgaaagc

SEQ ID NO: 2749290 - DNA, 12 bp, Homo sapiens
cctcaggaaaga

SEQ ID NO: 2749291 - DNA, 13 bp, Homo sapiens
cctcaggaaagaa

SEQ ID NO: 2749292 - DNA, 16 bp, Homo sapiens
cctcaggaaagaatag

SEQ ID NO: 2749293 - DNA, 18 bp, Homo sapiens
cctcaggaaagaatagaa

SEQ ID NO: 2749294 - DNA, 23 bp, Homo sapiens
cctcatggaattggagctcgtgg

SEQ ID NO: 2749295 - DNA, 19 bp, Homo sapiens
cctccaaagtcttgatagc

SEQ ID NO: 2749296 - DNA, 13 bp, Homo sapiens
cctcttgccacat

SEQ ID NO: 2749297 - DNA, 15 bp, Homo sapiens
cctcttgccacatct

SEQ ID NO: 2749298 - DNA, 16 bp, Homo sapiens
cctcttgccacatctt

SEQ ID NO: 2749299 - DNA, 14 bp, Homo sapiens
cctgactgggctgg

SEQ ID NO: 2749300 - DNA, 16 bp, Homo sapiens
cctgcaaacctgctgg

SEQ ID NO: 2749301 - DNA, 18 bp, Homo sapiens
cctgcaaacctgctggtg

SEQ ID NO: 2749302 - DNA, 20 bp, Homo sapiens
cctgccatcatgtttacaga

SEQ ID NO: 2749303 - DNA, 13 bp, Homo sapiens
cctgcccagacaa

SEQ ID NO: 2749304 - DNA, 15 bp, Homo sapiens
cctgcccagcctggg

SEQ ID NO: 2749305 - DNA, 13 bp, Homo sapiens
cctgcctgagaat

SEQ ID NO: 2749306 - DNA, 19 bp, Homo sapiens
cctgcctgcaaacctgctg

SEQ ID NO: 2749307 - DNA, 11 bp, Homo sapiens
cctgctaagga

SEQ ID NO: 2749308 - DNA, 12 bp, Homo sapiens
cctgctaaggaa

SEQ ID NO: 2749309 - DNA, 21 bp, Homo sapiens
cctgctaaggaacaatgccgc

SEQ ID NO: 2749310 - DNA, 23 bp, Homo sapiens
cctgctaaggaacaatgccgcct

SEQ ID NO: 2749311 - DNA, 16 bp, Homo sapiens
cctgctggtggggcag

SEQ ID NO: 2749312 - DNA, 18 bp, Homo sapiens
cctggagtgctgtgctgt

SEQ ID NO: 2749313 - DNA, 16 bp, Homo sapiens
cctggctaccttgtgg

SEQ ID NO: 2749314 - DNA, 20 bp, Homo sapiens
cctggctaccttgtgggaat

SEQ ID NO: 2749315 - DNA, 23 bp, Homo sapiens
cctgggccgttacatctgtgcag

SEQ ID NO: 2749316 - DNA, 19 bp, Homo sapiens
cctggggcaaacctagccg

SEQ ID NO: 2749317 - DNA, 18 bp, Homo sapiens
cctgtagatgcagaaaaa

SEQ ID NO: 2749318 - DNA, 17 bp, Homo sapiens
cctgtcaataaatgttg

SEQ ID NO: 2749319 - DNA, 17 bp, Homo sapiens
cctgtcttcggccgagc

SEQ ID NO: 2749320 - DNA, 16 bp, Homo sapiens
cctgttaaattttctc

SEQ ID NO: 2749321 - DNA, 17 bp, Homo sapiens
cctgttaaattttctct

SEQ ID NO: 2749322 - DNA, 19 bp, Homo sapiens
cctgttgagtatttgctgt

SEQ ID NO: 2749323 - DNA, 16 bp, Homo sapiens
ccttatttttgaattc

SEQ ID NO: 2749324 - DNA, 17 bp, Homo sapiens
ccttatttttgaattct

SEQ ID NO: 2749325 - DNA, 20 bp, Homo sapiens
ccttccaccggcactcatga

SEQ ID NO: 2749326 - DNA, 23 bp, Homo sapiens
ccttcctctgtaagatatcccag

SEQ ID NO: 2749327 - DNA, 13 bp, Homo sapiens
ccttggagccttc

SEQ ID NO: 2749328 - DNA, 15 bp, Homo sapiens
ccttggagccttcca

SEQ ID NO: 2749329 - DNA, 16 bp, Homo sapiens
ccttggagccttccac

SEQ ID NO: 2749330 - DNA, 20 bp, Homo sapiens
ccttggatttgcatttttgt

SEQ ID NO: 2749331 - DNA, 16 bp, Homo sapiens
ccttggccaagagaag

SEQ ID NO: 2749332 - DNA, 15 bp, Homo sapiens
cctttatactgtgaa

SEQ ID NO: 2749333 - DNA, 11 bp, Homo sapiens
cctttcaaaat

SEQ ID NO: 2749334 - DNA, 17 bp, Homo sapiens
cgaacagtccaatcagt

SEQ ID NO: 2749335 - DNA, 19 bp, Homo sapiens
cgagctggtttcctgccca

SEQ ID NO: 2749336 - DNA, 19 bp, Homo sapiens
cgatgcaagtgtttctgtt

SEQ ID NO: 2749337 - DNA, 20 bp, Homo sapiens
cgatgcaagtgtttctgttc

SEQ ID NO: 2749338 - DNA, 15 bp, Homo sapiens
cgcacctgtgctgga

SEQ ID NO: 2749339 - DNA, 13 bp, Homo sapiens
cgcccgagcccct

SEQ ID NO: 2749340 - DNA, 14 bp, Homo sapiens
cgcccttggagcct

SEQ ID NO: 2749341 - DNA, 15 bp, Homo sapiens
cgcccttggagcctt

SEQ ID NO: 2749342 - DNA, 17 bp, Homo sapiens
cgcccttggagccttcc

SEQ ID NO: 2749343 - DNA, 20 bp, Homo sapiens
cgcccttggagccttccacc

SEQ ID NO: 2749344 - DNA, 21 bp, Homo sapiens
cgcctgtcaataaatgttgaa

SEQ ID NO: 2749345 - DNA, 23 bp, Homo sapiens
cgcctgtcaataaatgttgaaaa

SEQ ID NO: 2749346 - DNA, 22 bp, Homo sapiens
cgctgaggtgtctggcctgagg

SEQ ID NO: 2749347 - DNA, 12 bp, Homo sapiens
cggaaggccgag

SEQ ID NO: 2749348 - DNA, 12 bp, Homo sapiens
cggaggaaggtc

SEQ ID NO: 2749349 - DNA, 22 bp, Homo sapiens
cggaggaaggtcccatggcctg

SEQ ID NO: 2749350 - DNA, 19 bp, Homo sapiens
cggcgcccccacccctggc

SEQ ID NO: 2749351 - DNA, 18 bp, Homo sapiens
cgggcatgtctgcctgga

SEQ ID NO: 2749352 - DNA, 19 bp, Homo sapiens
cgggcttgactttggctga

SEQ ID NO: 2749353 - DNA, 18 bp, Homo sapiens
cggtgtggactacaggac

SEQ ID NO: 2749354 - DNA, 19 bp, Homo sapiens
cggtgtggactacaggaca

SEQ ID NO: 2749355 - DNA, 15 bp, Homo sapiens
cggttttttcacttc

SEQ ID NO: 2749356 - DNA, 22 bp, Homo sapiens
gaggcctctcattccagaggaa

SEQ ID NO: 2749357 - DNA, 18 bp, Homo sapiens
gaggctgaggtggcagaa

SEQ ID NO: 2749358 - DNA, 13 bp, Homo sapiens
gaggtgtctggcc

SEQ ID NO: 2749359 - DNA, 15 bp, Homo sapiens
gaggtgtctggcctg

SEQ ID NO: 2749360 - DNA, 18 bp, Homo sapiens
gaggtgtctggcctgagg

SEQ ID NO: 2749361 - DNA, 15 bp, Homo sapiens
gagtaattctagaca

SEQ ID NO: 2749362 - DNA, 18 bp, Homo sapiens
gagtgaggatgtctgggc

SEQ ID NO: 2749363 - DNA, 19 bp, Homo sapiens
gagtgctgtgctgtgttta

SEQ ID NO: 2749364 - DNA, 22 bp, Homo sapiens
gagtgtgtaatttaaaattgtg

SEQ ID NO: 2749365 - DNA, 12 bp, Homo sapiens
gagttaaaagtt

SEQ ID NO: 2749366 - DNA, 21 bp, Homo sapiens
gataaataatgtagttttgtt

SEQ ID NO: 2749367 - DNA, 17 bp, Homo sapiens
gataaatttaaaacaca

SEQ ID NO: 2749368 - DNA, 21 bp, Homo sapiens
gataaatttaaaacacagtat

SEQ ID NO: 2749369 - DNA, 23 bp, Homo sapiens
gataaatttaaaacacagtattg

SEQ ID NO: 2749370 - DNA, 11 bp, Homo sapiens
gataactaaaa

SEQ ID NO: 2749371 - DNA, 16 bp, Homo sapiens
gatagatattgtccta

SEQ ID NO: 2749372 - DNA, 17 bp, Homo sapiens
gatagtttcatttacaa

SEQ ID NO: 2749373 - DNA, 13 bp, Homo sapiens
gatatcccagctt

SEQ ID NO: 2749374 - DNA, 21 bp, Homo sapiens
gatatctatattctaaagagc

SEQ ID NO: 2749375 - DNA, 12 bp, Homo sapiens
gatgcagtgccc

SEQ ID NO: 2749376 - DNA, 16 bp, Homo sapiens
gatgcagtgccctaga

SEQ ID NO: 2749377 - DNA, 17 bp, Homo sapiens
gatgcagtgccctagaa

SEQ ID NO: 2749378 - DNA, 18 bp, Homo sapiens
gatgcagttctgaagaag

SEQ ID NO: 2749379 - DNA, 16 bp, Homo sapiens
gatgctttaattgtgt

SEQ ID NO: 2749380 - DNA, 15 bp, Homo sapiens
gatgtctaaaagatt

SEQ ID NO: 2749381 - DNA, 21 bp, Homo sapiens
gatgtgtcctgataagctgag

SEQ ID NO: 2749382 - DNA, 20 bp, Homo sapiens
gatgtttatgttcttataga

SEQ ID NO: 2749383 - DNA, 11 bp, Homo sapiens
gattaaatctc

SEQ ID NO: 2749384 - DNA, 16 bp, Homo sapiens
gattaatgtacttttt

SEQ ID NO: 2749385 - DNA, 23 bp, Homo sapiens
gattaatgtactttttattgcat

SEQ ID NO: 2749386 - DNA, 20 bp, Homo sapiens
gatttagtctgttatatttc

SEQ ID NO: 2749387 - DNA, 20 bp, Homo sapiens
gatttcctttatactgtgaa

SEQ ID NO: 2749388 - DNA, 22 bp, Homo sapiens
gatttcctttatactgtgaagt

SEQ ID NO: 2749389 - DNA, 17 bp, Homo sapiens
gatttctccagaaattt

SEQ ID NO: 2749390 - DNA, 19 bp, Homo sapiens
gatttgcatttttgtattt

SEQ ID NO: 2749391 - DNA, 18 bp, Homo sapiens
gattttcaaaaaaatgtt

SEQ ID NO: 2749392 - DNA, 15 bp, Homo sapiens
gatttttaaattgga

SEQ ID NO: 2749393 - DNA, 15 bp, Homo sapiens
gattttttaaaaatt

SEQ ID NO: 2749394 - DNA, 22 bp, Homo sapiens
gatttttttgtcattaaaattg

SEQ ID NO: 2749395 - DNA, 18 bp, Homo sapiens
gcaaaatttttaaaactg

SEQ ID NO: 2749396 - DNA, 13 bp, Homo sapiens
gcaaacctgctgg

SEQ ID NO: 2749397 - DNA, 20 bp, Homo sapiens
gcaaacctgctggtggggca

SEQ ID NO: 2749398 - DNA, 18 bp, Homo sapiens
gcaaatactgattttcaa

SEQ ID NO: 2749399 - DNA, 21 bp, Homo sapiens
gcaaatactgattttcaaaaa

SEQ ID NO: 2749400 - DNA, 22 bp, Homo sapiens
gcaaatactgattttcaaaaaa

SEQ ID NO: 2749401 - DNA, 22 bp, Homo sapiens
gcaaatgcattctatcgttatt

SEQ ID NO: 2749402 - DNA, 15 bp, Homo sapiens
gcaagagactttgtc

SEQ ID NO: 2749403 - DNA, 20 bp, Homo sapiens
gcaagtattagaataccaca

SEQ ID NO: 2749404 - DNA, 16 bp, Homo sapiens
gcaataccctgtcttt

SEQ ID NO: 2749405 - DNA, 15 bp, Homo sapiens
gcacaccacaattct

SEQ ID NO: 2749406 - DNA, 21 bp, Homo sapiens
gcacatattggagggaaatct

SEQ ID NO: 2749407 - DNA, 21 bp, Homo sapiens
gcaccccgccggaggaaggtc

SEQ ID NO: 2749408 - DNA, 20 bp, Homo sapiens
gcactcatgacggcctgcct

SEQ ID NO: 2749409 - DNA, 23 bp, Homo sapiens
gcactccagcctgggtgacagag

SEQ ID NO: 2749410 - DNA, 11 bp, Homo sapiens
gcactttgtag

SEQ ID NO: 2749411 - DNA, 18 bp, Homo sapiens
gcagaaaaaaaagaaaaa

SEQ ID NO: 2749412 - DNA, 17 bp, Homo sapiens
gcagaatagcttatgcc

SEQ ID NO: 2749413 - DNA, 13 bp, Homo sapiens
gcagcatgtatag

SEQ ID NO: 2749414 - DNA, 19 bp, Homo sapiens
gcaggacactgcagaacag

SEQ ID NO: 2749415 - DNA, 15 bp, Homo sapiens
gcaggacctgccaag

SEQ ID NO: 2749416 - DNA, 16 bp, Homo sapiens
gcagtacaataaaagt

SEQ ID NO: 2749417 - DNA, 22 bp, Homo sapiens
gcagtagccaaacaccactttg

SEQ ID NO: 2749418 - DNA, 13 bp, Homo sapiens
gcagttctgaaga

SEQ ID NO: 2749419 - DNA, 20 bp, Homo sapiens
gcatacatgaataaaaataa

SEQ ID NO: 2749420 - DNA, 16 bp, Homo sapiens
gcatatctgtttattc

SEQ ID NO: 2749421 - DNA, 21 bp, Homo sapiens
gcatcagagcccttttgctat

SEQ ID NO: 2749422 - DNA, 18 bp, Homo sapiens
gcatctttcatagttctg

SEQ ID NO: 2749423 - DNA, 19 bp, Homo sapiens
gcatgtatagttgcttttg

SEQ ID NO: 2749424 - DNA, 21 bp, Homo sapiens
gcatgtattcactaaaataaa

SEQ ID NO: 2749425 - DNA, 14 bp, Homo sapiens
gcatgtctgcctgg

SEQ ID NO: 2749426 - DNA, 16 bp, Homo sapiens
gcatgtctgcctggag

SEQ ID NO: 2749427 - DNA, 17 bp, Homo sapiens
gcatgtctgcctggagt

SEQ ID NO: 2749428 - DNA, 18 bp, Homo sapiens
gcattctatcgttattat

SEQ ID NO: 2749429 - DNA, 22 bp, Homo sapiens
gcattctatcgttattataaat

SEQ ID NO: 2749430 - DNA, 13 bp, Homo sapiens
gcatttagatgta

SEQ ID NO: 2749431 - DNA, 15 bp, Homo sapiens
gcatttttgtatttt

SEQ ID NO: 2749432 - DNA, 15 bp, Homo sapiens
gccacaggttttaag

SEQ ID NO: 2749433 - DNA, 23 bp, Homo sapiens
gccacatcttgaaaatgccacca

SEQ ID NO: 2749434 - DNA, 16 bp, Homo sapiens
gccaccatccaataaa

SEQ ID NO: 2749435 - DNA, 15 bp, Homo sapiens
gccacgattgcagga

SEQ ID NO: 2749436 - DNA, 19 bp, Homo sapiens
gccagattttcctgaaaac

SEQ ID NO: 2749437 - DNA, 23 bp, Homo sapiens
gccagtggctggatctgtgaggg

SEQ ID NO: 2749438 - DNA, 17 bp, Homo sapiens
gccatagtcaaagagag

SEQ ID NO: 2749439 - DNA, 22 bp, Homo sapiens
gccatggacatgagtttaaagc

SEQ ID NO: 2749440 - DNA, 18 bp, Homo sapiens
gcccacgcccttggagcc

SEQ ID NO: 2749441 - DNA, 20 bp, Homo sapiens
gcccacgcccttggagcctt

SEQ ID NO: 2749442 - DNA, 21 bp, Homo sapiens
gcccacgcccttggagccttc

SEQ ID NO: 2749443 - DNA, 23 bp, Homo sapiens
gcccaggaactcgcacctgtgct

SEQ ID NO: 2749444 - DNA, 16 bp, Homo sapiens
gcccccacccctggct

SEQ ID NO: 2749445 - DNA, 15 bp, Homo sapiens
gccccgcccgagccc

SEQ ID NO: 2749446 - DNA, 21 bp, Homo sapiens
gcccctgtcttcggccgagct

SEQ ID NO: 2749447 - DNA, 13 bp, Homo sapiens
gcccttggagcct

SEQ ID NO: 2749448 - DNA, 17 bp, Homo sapiens
gcccttggagccttcca

SEQ ID NO: 2749449 - DNA, 14 bp, Homo sapiens
gccgagctggtttc

SEQ ID NO: 2749450 - DNA, 13 bp, Homo sapiens
gccgaggtcccat

SEQ ID NO: 2749451 - DNA, 16 bp, Homo sapiens
gccgcctgtcaataaa

SEQ ID NO: 2749452 - DNA, 18 bp, Homo sapiens
gccgcctgtcaataaatg

SEQ ID NO: 2749453 - DNA, 23 bp, Homo sapiens
gcctaattttttaaagaatccaa

SEQ ID NO: 2749454 - DNA, 15 bp, Homo sapiens
gcctaggaggactgg

SEQ ID NO: 2749455 - DNA, 15 bp, Homo sapiens
gcctcttagatgcag

SEQ ID NO: 2749456 - DNA, 20 bp, Homo sapiens
gcctgagaatgttaccagac

SEQ ID NO: 2749457 - DNA, 20 bp, Homo sapiens
gcctgcaaacctgctggtgg

SEQ ID NO: 2749458 - DNA, 15 bp, Homo sapiens
gcctgcccagacaag

SEQ ID NO: 2749459 - DNA, 16 bp, Homo sapiens
gcctgcccagacaaga

SEQ ID NO: 2749460 - DNA, 17 bp, Homo sapiens
gcctggagtgctgtgct

SEQ ID NO: 2749461 - DNA, 21 bp, Homo sapiens
gcctggggcaaacctagccgg

SEQ ID NO: 2749462 - DNA, 15 bp, Homo sapiens
gcctgtagtctcagc

SEQ ID NO: 2749463 - DNA, 16 bp, Homo sapiens
gcctgtcaataaatgt

SEQ ID NO: 2749464 - DNA, 20 bp, Homo sapiens
gcctgtcaataaatgttgaa

SEQ ID NO: 2749465 - DNA, 23 bp, Homo sapiens
gcctgtcaataaatgttgaaaag

SEQ ID NO: 2749466 - DNA, 14 bp, Homo sapiens
gcctgtcactactg

SEQ ID NO: 2749467 - DNA, 15 bp, Homo sapiens
gcctgtcactactgg

SEQ ID NO: 2749468 - DNA, 15 bp, Homo sapiens
gccttatttttgaat

SEQ ID NO: 2749469 - DNA, 19 bp, Homo sapiens
gccttcaaatagtatagaa

SEQ ID NO: 2749470 - DNA, 15 bp, Homo sapiens
gccttccaccggcac

SEQ ID NO: 2749471 - DNA, 14 bp, Homo sapiens
gccttttaaattct

SEQ ID NO: 2749472 - DNA, 13 bp, Homo sapiens
gcgatttcacagt

SEQ ID NO: 2749473 - DNA, 16 bp, Homo sapiens
gcgtgcaccccgccgg

SEQ ID NO: 2749474 - DNA, 22 bp, Homo sapiens
gcgtgcaccccgccggaggaag

SEQ ID NO: 2749475 - DNA, 13 bp, Homo sapiens
gcgtggaaaaaga

SEQ ID NO: 2749476 - DNA, 15 bp, Homo sapiens
gctaaggaacaatgc

SEQ ID NO: 2749477 - DNA, 13 bp, Homo sapiens
gctaccttgtggg

SEQ ID NO: 2749478 - DNA, 18 bp, Homo sapiens
gctagatgtatgtacttc

SEQ ID NO: 2749479 - DNA, 21 bp, Homo sapiens
gctattacttggcaaattctg

SEQ ID NO: 2749480 - DNA, 15 bp, Homo sapiens
gctcggcgcccccac

SEQ ID NO: 2749481 - DNA, 16 bp, Homo sapiens
taaaaaagaaacattt

SEQ ID NO: 2749482 - DNA, 15 bp, Homo sapiens
taaaaaatgtgtgta

SEQ ID NO: 2749483 - DNA, 22 bp, Homo sapiens
taaaaaatgtgtgtattcttaa

SEQ ID NO: 2749484 - DNA, 11 bp, Homo sapiens
taaaaacattg

SEQ ID NO: 2749485 - DNA, 22 bp, Homo sapiens
taaaaacttttttctttgaaat

SEQ ID NO: 2749486 - DNA, 23 bp, Homo sapiens
taaaaacttttttctttgaaatg

SEQ ID NO: 2749487 - DNA, 18 bp, Homo sapiens
taaaaataaaagctatta

SEQ ID NO: 2749488 - DNA, 21 bp, Homo sapiens
taaaaataaaagctattactt

SEQ ID NO: 2749489 - DNA, 18 bp, Homo sapiens
taaaaataaactgttatg

SEQ ID NO: 2749490 - DNA, 20 bp, Homo sapiens
taaaaatcaggagcctgcta

SEQ ID NO: 2749491 - DNA, 16 bp, Homo sapiens
taaaacacagtattgt

SEQ ID NO: 2749492 - DNA, 17 bp, Homo sapiens
taaaacacagtattgta

SEQ ID NO: 2749493 - DNA, 21 bp, Homo sapiens
taaaacacagtattgtagaaa

SEQ ID NO: 2749494 - DNA, 22 bp, Homo sapiens
taaaaccataaacatttgccaa

SEQ ID NO: 2749495 - DNA, 15 bp, Homo sapiens
taaaactgcattttt

SEQ ID NO: 2749496 - DNA, 17 bp, Homo sapiens
taaaactgtaccttttg

SEQ ID NO: 2749497 - DNA, 19 bp, Homo sapiens
taaaagagacaaactgtaa

SEQ ID NO: 2749498 - DNA, 23 bp, Homo sapiens
taaaagattctttaaactactga

SEQ ID NO: 2749499 - DNA, 15 bp, Homo sapiens
taaaagcaaatactg

SEQ ID NO: 2749500 - DNA, 17 bp, Homo sapiens
taaaagcaaatactgat

SEQ ID NO: 2749501 - DNA, 14 bp, Homo sapiens
taaaagctgtggaa

SEQ ID NO: 2749502 - DNA, 16 bp, Homo sapiens
taaaagggtcaaacct

SEQ ID NO: 2749503 - DNA, 17 bp, Homo sapiens
taaaagggtcaaacctg

SEQ ID NO: 2749504 - DNA, 18 bp, Homo sapiens
taaaatccatacatttgt

SEQ ID NO: 2749505 - DNA, 20 bp, Homo sapiens
taaaattttcattctgaatc

SEQ ID NO: 2749506 - DNA, 21 bp, Homo sapiens
taaaattttcattctgaatct

SEQ ID NO: 2749507 - DNA, 21 bp, Homo sapiens
taaaccacaaaagttgtttaa

SEQ ID NO: 2749508 - DNA, 15 bp, Homo sapiens
taaactagagaaggg

SEQ ID NO: 2749509 - DNA, 16 bp, Homo sapiens
taaacttagaaatatg

SEQ ID NO: 2749510 - DNA, 18 bp, Homo sapiens
taaagaatccaagacaaa

SEQ ID NO: 2749511 - DNA, 22 bp, Homo sapiens
taaagaatccaagacaaactaa

SEQ ID NO: 2749512 - DNA, 18 bp, Homo sapiens
taaagctgttaaaataca

SEQ ID NO: 2749513 - DNA, 21 bp, Homo sapiens
taaagtcctgaacctttcaaa

SEQ ID NO: 2749514 - DNA, 20 bp, Homo sapiens
taaatacaaatctgtataaa

SEQ ID NO: 2749515 - DNA, 13 bp, Homo sapiens
taaatatttgaaa

SEQ ID NO: 2749516 - DNA, 21 bp, Homo sapiens
taaatatttgaaaattacctt

SEQ ID NO: 2749517 - DNA, 12 bp, Homo sapiens
taaatatttttg

SEQ ID NO: 2749518 - DNA, 19 bp, Homo sapiens
taaatcacactcaaacttt

SEQ ID NO: 2749519 - DNA, 14 bp, Homo sapiens
taaatcagaataaa

SEQ ID NO: 2749520 - DNA, 16 bp, Homo sapiens
taaatcagaataaatt

SEQ ID NO: 2749521 - DNA, 19 bp, Homo sapiens
taaatcattttaggaaagg

SEQ ID NO: 2749522 - DNA, 21 bp, Homo sapiens
taaatcattttaggaaaggat

SEQ ID NO: 2749523 - DNA, 16 bp, Homo sapiens
taaatctgtacttttt

SEQ ID NO: 2749524 - DNA, 19 bp, Homo sapiens
taaatctgtacttttttca

SEQ ID NO: 2749525 - DNA, 20 bp, Homo sapiens
taaatctgtacttttttcaa

SEQ ID NO: 2749526 - DNA, 22 bp, Homo sapiens
taaatgagacccctttaaactg

SEQ ID NO: 2749527 - DNA, 23 bp, Homo sapiens
taaatgagacccctttaaactgt

SEQ ID NO: 2749528 - DNA, 15 bp, Homo sapiens
taaattctgttgaac

SEQ ID NO: 2749529 - DNA, 20 bp, Homo sapiens
taaattggagaaaagcactt

SEQ ID NO: 2749530 - DNA, 22 bp, Homo sapiens
taaattggtcaggaactattaa

SEQ ID NO: 2749531 - DNA, 18 bp, Homo sapiens
taaatttccatatccttc

SEQ ID NO: 2749532 - DNA, 12 bp, Homo sapiens
taaatttgtaat

SEQ ID NO: 2749533 - DNA, 20 bp, Homo sapiens
taaatttgtaatatatcctg

SEQ ID NO: 2749534 - DNA, 22 bp, Homo sapiens
taaattttctctaaactgtttc

SEQ ID NO: 2749535 - DNA, 16 bp, Homo sapiens
taacattcctaaaatg

SEQ ID NO: 2749536 - DNA, 22 bp, Homo sapiens
taacattgattggataaatgct

SEQ ID NO: 2749537 - DNA, 23 bp, Homo sapiens
taaccccaagagtttcttctcat

SEQ ID NO: 2749538 - DNA, 13 bp, Homo sapiens
taactaaaattct

SEQ ID NO: 2749539 - DNA, 14 bp, Homo sapiens
taactaaaattctg

SEQ ID NO: 2749540 - DNA, 15 bp, Homo sapiens
taactggaaacttca

SEQ ID NO: 2749541 - DNA, 22 bp, Homo sapiens
taacttaaaagaacatgtatat

SEQ ID NO: 2749542 - DNA, 21 bp, Homo sapiens
taacttaaatatttgaaaatt

SEQ ID NO: 2749543 - DNA, 18 bp, Homo sapiens
taacttaatgtagttact

SEQ ID NO: 2749544 - DNA, 17 bp, Homo sapiens
taacttcagtgcaagag

SEQ ID NO: 2749545 - DNA, 22 bp, Homo sapiens
taacttcagtgcaagagacttt

SEQ ID NO: 2749546 - DNA, 15 bp, Homo sapiens
taactttagaattcc

SEQ ID NO: 2749547 - DNA, 22 bp, Homo sapiens
taagacttttctctactttaaa

SEQ ID NO: 2749548 - DNA, 18 bp, Homo sapiens
taagcattccaactatct

SEQ ID NO: 2749549 - DNA, 23 bp, Homo sapiens
taagcggaataaactagagaagg

SEQ ID NO: 2749550 - DNA, 18 bp, Homo sapiens
taaggccagccatttttc

SEQ ID NO: 2749551 - DNA, 23 bp, Homo sapiens
taagtgccacaggttttaaggat

SEQ ID NO: 2749552 - DNA, 16 bp, Homo sapiens
taagttattgctgcat

SEQ ID NO: 2749553 - DNA, 12 bp, Homo sapiens
taataagacttt

SEQ ID NO: 2749554 - DNA, 18 bp, Homo sapiens
taataagtatatcttaag

SEQ ID NO: 2749555 - DNA, 15 bp, Homo sapiens
taataatgtttcaaa

SEQ ID NO: 2749556 - DNA, 13 bp, Homo sapiens
taatacctttcta

SEQ ID NO: 2749557 - DNA, 13 bp, Homo sapiens
taatatatcctgt

SEQ ID NO: 2749558 - DNA, 19 bp, Homo sapiens
taatattacctaatgaaag

SEQ ID NO: 2749559 - DNA, 19 bp, Homo sapiens
taatcacttaacattccta

SEQ ID NO: 2749560 - DNA, 18 bp, Homo sapiens
taatcagagtatctgaag

SEQ ID NO: 2749561 - DNA, 12 bp, Homo sapiens
taatcagtgtga

SEQ ID NO: 2749562 - DNA, 13 bp, Homo sapiens
taatctccaactt

SEQ ID NO: 2749563 - DNA, 20 bp, Homo sapiens
taatctcctgagttgtataa

SEQ ID NO: 2749564 - DNA, 20 bp, Homo sapiens
taatcttaaatcagaataaa

SEQ ID NO: 2749565 - DNA, 19 bp, Homo sapiens
taatctttttcatcattgt

SEQ ID NO: 2749566 - DNA, 19 bp, Homo sapiens
taatgaaagtgatgacata

SEQ ID NO: 2749567 - DNA, 17 bp, Homo sapiens
taatgataactggaaac

SEQ ID NO: 2749568 - DNA, 23 bp, Homo sapiens
taatgataactggaaacttcagc

SEQ ID NO: 2749569 - DNA, 13 bp, Homo sapiens
taatgtacttttt

SEQ ID NO: 2749570 - DNA, 19 bp, Homo sapiens
taatgtactttttattgca

SEQ ID NO: 2749571 - DNA, 22 bp, Homo sapiens
taatgtactttttattgcatgg

SEQ ID NO: 2749572 - DNA, 15 bp, Homo sapiens
taatgtttcaaacat

SEQ ID NO: 2749573 - DNA, 17 bp, Homo sapiens
taattaggataactaaa

SEQ ID NO: 2749574 - DNA, 13 bp, Homo sapiens
taattccttaaaa

SEQ ID NO: 2749575 - DNA, 16 bp, Homo sapiens
taattccttaaaattt

SEQ ID NO: 2749576 - DNA, 19 bp, Homo sapiens
taattctttgacctgttgg

SEQ ID NO: 2749577 - DNA, 20 bp, Homo sapiens
taattgagactgaaagaaac

SEQ ID NO: 2749578 - DNA, 22 bp, Homo sapiens
taattgagactgaaagaaacta

SEQ ID NO: 2749579 - DNA, 17 bp, Homo sapiens
taatttttatatttgaa

SEQ ID NO: 2749580 - DNA, 19 bp, Homo sapiens
taatttttatatttgaaat

SEQ ID NO: 2749581 - DNA, 22 bp, Homo sapiens
taattttttaaagaatccaaga

SEQ ID NO: 2749582 - DNA, 12 bp, Homo sapiens
tacaaaagcttg

SEQ ID NO: 2749583 - DNA, 18 bp, Homo sapiens
tacaaaagcttgtgtatc

SEQ ID NO: 2749584 - DNA, 21 bp, Homo sapiens
tacaaaagcttgtgtatcttg

SEQ ID NO: 2749585 - DNA, 23 bp, Homo sapiens
tacaaaagcttgtgtatcttgat

SEQ ID NO: 2749586 - DNA, 16 bp, Homo sapiens
tacaaagtaaaaataa

SEQ ID NO: 2749587 - DNA, 13 bp, Homo sapiens
tacaaatctgtat

SEQ ID NO: 2749588 - DNA, 16 bp, Homo sapiens
tacaaatctgtataaa

SEQ ID NO: 2749589 - DNA, 23 bp, Homo sapiens
tacaaatctgtataaatgtctat

SEQ ID NO: 2749590 - DNA, 15 bp, Homo sapiens
tacaagtaaattctg

SEQ ID NO: 2749591 - DNA, 13 bp, Homo sapiens
tacaataaaagta

SEQ ID NO: 2749592 - DNA, 16 bp, Homo sapiens
tacacctcagaaattg

SEQ ID NO: 2749593 - DNA, 14 bp, Homo sapiens
tacagaggacagta

SEQ ID NO: 2749594 - DNA, 22 bp, Homo sapiens
tacagcttctattcattatgca

SEQ ID NO: 2749595 - DNA, 18 bp, Homo sapiens
tacatcgcttctttttca

SEQ ID NO: 2749596 - DNA, 13 bp, Homo sapiens
tacatctgtgcag

SEQ ID NO: 2749597 - DNA, 12 bp, Homo sapiens
tacatgcataaa

SEQ ID NO: 2749598 - DNA, 22 bp, Homo sapiens
tacatgtaaagctgttaaaata

SEQ ID NO: 2749599 - DNA, 17 bp, Homo sapiens
tacattgcctgactaaa

SEQ ID NO: 2749600 - DNA, 17 bp, Homo sapiens
tacatttggaacagtga

SEQ ID NO: 2749601 - DNA, 22 bp, Homo sapiens
taccaaaaatctcaatatttca

SEQ ID NO: 2749602 - DNA, 11 bp, Homo sapiens
taccaagagaa

SEQ ID NO: 2749603 - DNA, 22 bp, Homo sapiens
taccacaaaagcaaaattttta

SEQ ID NO: 2749604 - DNA, 23 bp, Homo sapiens
taccacaggaaccacaagactgc

SEQ ID NO: 2749605 - DNA, 18 bp, Homo sapiens
taccaccagtctgactgt

SEQ ID NO: 2749606 - DNA, 15 bp, Homo sapiens
tcccttgatgaagaa

SEQ ID NO: 2749607 - DNA, 20 bp, Homo sapiens
tcctagaactggtgatataa

SEQ ID NO: 2749608 - DNA, 21 bp, Homo sapiens
tcctagaactggtgatataaa

SEQ ID NO: 2749609 - DNA, 14 bp, Homo sapiens
tcctccctcccaca

SEQ ID NO: 2749610 - DNA, 17 bp, Homo sapiens
tcctcttgccacatctt

SEQ ID NO: 2749611 - DNA, 17 bp, Homo sapiens
tcctgaacctttcaaaa

SEQ ID NO: 2749612 - DNA, 16 bp, Homo sapiens
tcctgactgggctggg

SEQ ID NO: 2749613 - DNA, 19 bp, Homo sapiens
tcctgactgggctgggttt

SEQ ID NO: 2749614 - DNA, 15 bp, Homo sapiens
tcctgcatctttcat

SEQ ID NO: 2749615 - DNA, 19 bp, Homo sapiens
tcctgcatctttcatagtt

SEQ ID NO: 2749616 - DNA, 23 bp, Homo sapiens
tccttgcacgcgccctttctacc

SEQ ID NO: 2749617 - DNA, 14 bp, Homo sapiens
tcgatgcaagtgtt

SEQ ID NO: 2749618 - DNA, 21 bp, Homo sapiens
tcgatgcaagtgtttctgttc

SEQ ID NO: 2749619 - DNA, 21 bp, Homo sapiens
tcgtggaacagttacctctgc

SEQ ID NO: 2749620 - DNA, 10 bp, Homo sapiens
tctaaactta

SEQ ID NO: 2749621 - DNA, 16 bp, Homo sapiens
tctaagggaaaaagtt

SEQ ID NO: 2749622 - DNA, 15 bp, Homo sapiens
tctacacatttcatc

SEQ ID NO: 2749623 - DNA, 17 bp, Homo sapiens
tctacactaagagagaa

SEQ ID NO: 2749624 - DNA, 21 bp, Homo sapiens
tctacactgggtgctgatcct

SEQ ID NO: 2749625 - DNA, 16 bp, Homo sapiens
tctaggaaatatttat

SEQ ID NO: 2749626 - DNA, 17 bp, Homo sapiens
tctagtagttaaaacag

SEQ ID NO: 2749627 - DNA, 21 bp, Homo sapiens
tctataattccttaaaatttt

SEQ ID NO: 2749628 - DNA, 20 bp, Homo sapiens
tctatcgttattataaatgt

SEQ ID NO: 2749629 - DNA, 15 bp, Homo sapiens
tctattagtttcaat

SEQ ID NO: 2749630 - DNA, 17 bp, Homo sapiens
tctattagtttcaattg

SEQ ID NO: 2749631 - DNA, 20 bp, Homo sapiens
tctcagggccgagaggacag

SEQ ID NO: 2749632 - DNA, 15 bp, Homo sapiens
tctcatttccaagca

SEQ ID NO: 2749633 - DNA, 13 bp, Homo sapiens
tctccaactttat

SEQ ID NO: 2749634 - DNA, 21 bp, Homo sapiens
tctccaggcgacgcggttttt

SEQ ID NO: 2749635 - DNA, 17 bp, Homo sapiens
tctcctgagttgtataa

SEQ ID NO: 2749636 - DNA, 21 bp, Homo sapiens
tctgactgtttccatcaaggg

SEQ ID NO: 2749637 - DNA, 17 bp, Homo sapiens
tctgactttttgtttct

SEQ ID NO: 2749638 - DNA, 21 bp, Homo sapiens
tctgcaaggattttttaaaaa

SEQ ID NO: 2749639 - DNA, 14 bp, Homo sapiens
tctggagctgtccg

SEQ ID NO: 2749640 - DNA, 11 bp, Homo sapiens
tctggccctat

SEQ ID NO: 2749641 - DNA, 17 bp, Homo sapiens
tctggcccttctttcag

SEQ ID NO: 2749642 - DNA, 12 bp, Homo sapiens
tctggcctgagg

SEQ ID NO: 2749643 - DNA, 14 bp, Homo sapiens
tctggcctgaggtc

SEQ ID NO: 2749644 - DNA, 21 bp, Homo sapiens
tctgggaaatgttttaatgcc

SEQ ID NO: 2749645 - DNA, 14 bp, Homo sapiens
tctgggggaaaaag

SEQ ID NO: 2749646 - DNA, 13 bp, Homo sapiens
tctgtaaggtctt

SEQ ID NO: 2749647 - DNA, 21 bp, Homo sapiens
tctgtactccttggatttgca

SEQ ID NO: 2749648 - DNA, 15 bp, Homo sapiens
tctgtacttttttca

SEQ ID NO: 2749649 - DNA, 19 bp, Homo sapiens
tctgtacttttttcaaata

SEQ ID NO: 2749650 - DNA, 16 bp, Homo sapiens
tctgtccaactctgta

SEQ ID NO: 2749651 - DNA, 18 bp, Homo sapiens
tctgtgcagggctggttt

SEQ ID NO: 2749652 - DNA, 19 bp, Homo sapiens
tctgtgcagggctggtttg

SEQ ID NO: 2749653 - DNA, 21 bp, Homo sapiens
tctgtgtgtgtgtatgtgggg

SEQ ID NO: 2749654 - DNA, 12 bp, Homo sapiens
tctgttaaatat

SEQ ID NO: 2749655 - DNA, 18 bp, Homo sapiens
tctgttaaatatttttgt

SEQ ID NO: 2749656 - DNA, 22 bp, Homo sapiens
tctgttttataattttgtgaag

SEQ ID NO: 2749657 - DNA, 14 bp, Homo sapiens
tcttaaatcagaat

SEQ ID NO: 2749658 - DNA, 16 bp, Homo sapiens
tcttaaatcagaataa

SEQ ID NO: 2749659 - DNA, 19 bp, Homo sapiens
tcttaaatcagaataaatt

SEQ ID NO: 2749660 - DNA, 23 bp, Homo sapiens
tcttaaatcagaataaattaata

SEQ ID NO: 2749661 - DNA, 23 bp, Homo sapiens
tcttagatgcagttctgaagaag

SEQ ID NO: 2749662 - DNA, 23 bp, Homo sapiens
tcttagggaactttgatacaaat

SEQ ID NO: 2749663 - DNA, 12 bp, Homo sapiens
tcttatagaata

SEQ ID NO: 2749664 - DNA, 13 bp, Homo sapiens
tcttatagaataa

SEQ ID NO: 2749665 - DNA, 17 bp, Homo sapiens
tcttatagaataaaagc

SEQ ID NO: 2749666 - DNA, 22 bp, Homo sapiens
tcttatagaataaaagctgtgg

SEQ ID NO: 2749667 - DNA, 18 bp, Homo sapiens
tcttcaggctctgcccag

SEQ ID NO: 2749668 - DNA, 22 bp, Homo sapiens
tcttcattacctcagtgagaag

SEQ ID NO: 2749669 - DNA, 17 bp, Homo sapiens
tcttccatcagagatgg

SEQ ID NO: 2749670 - DNA, 9 bp, Homo sapiens
tcttccttg

SEQ ID NO: 2749671 - DNA, 14 bp, Homo sapiens
tcttcttatctaaa

SEQ ID NO: 2749672 - DNA, 16 bp, Homo sapiens
tcttgaaaatgccacc

SEQ ID NO: 2749673 - DNA, 19 bp, Homo sapiens
tcttgaaaatgccaccatc

SEQ ID NO: 2749674 - DNA, 17 bp, Homo sapiens
tcttgccacatcttgaa

SEQ ID NO: 2749675 - DNA, 18 bp, Homo sapiens
tcttgccacatcttgaaa

SEQ ID NO: 2749676 - DNA, 13 bp, Homo sapiens
tcttggtgtaact

SEQ ID NO: 2749677 - DNA, 13 bp, Homo sapiens
tcttgtgaagttg

SEQ ID NO: 2749678 - DNA, 23 bp, Homo sapiens
tcttgtggagattttttttttaa

SEQ ID NO: 2749679 - DNA, 17 bp, Homo sapiens
tcttgttttaagcaaat

SEQ ID NO: 2749680 - DNA, 13 bp, Homo sapiens
tctttaaactact

SEQ ID NO: 2749681 - DNA, 18 bp, Homo sapiens
tctttaatcacttaacat

SEQ ID NO: 2749682 - DNA, 19 bp, Homo sapiens
tctttagatttttaaattg

SEQ ID NO: 2749683 - DNA, 20 bp, Homo sapiens
tctttagatttttaaattgg

SEQ ID NO: 2749684 - DNA, 17 bp, Homo sapiens
tctttccacagaagctc

SEQ ID NO: 2749685 - DNA, 10 bp, Homo sapiens
tctttcttcc

SEQ ID NO: 2749686 - DNA, 15 bp, Homo sapiens
tctttgaaatgctaa

SEQ ID NO: 2749687 - DNA, 20 bp, Homo sapiens
tcttttctttgtatcattca

SEQ ID NO: 2749688 - DNA, 20 bp, Homo sapiens
tcttttttgtaaaaactttt

SEQ ID NO: 2749689 - DNA, 12 bp, Homo sapiens
tgaaagaaacta

SEQ ID NO: 2749690 - DNA, 21 bp, Homo sapiens
tgaaatatagttgaaagtaaa

SEQ ID NO: 2749691 - DNA, 16 bp, Homo sapiens
tgaaatgctaaacttg

SEQ ID NO: 2749692 - DNA, 17 bp, Homo sapiens
tgaacagtacagtattt

SEQ ID NO: 2749693 - DNA, 15 bp, Homo sapiens
tgaacctttcaaaat

SEQ ID NO: 2749694 - DNA, 22 bp, Homo sapiens
tgaagaagcaccaatcatgaat

SEQ ID NO: 2749695 - DNA, 22 bp, Homo sapiens
tgaagagaagggcagggctgag

SEQ ID NO: 2749696 - DNA, 16 bp, Homo sapiens
tgaaggaatacaatat

SEQ ID NO: 2749697 - DNA, 22 bp, Homo sapiens
tgaagtccaagcatttagatgt

SEQ ID NO: 2749698 - DNA, 16 bp, Homo sapiens
tgaagttacatgcata

SEQ ID NO: 2749699 - DNA, 15 bp, Homo sapiens
tgaatgccttatttt

SEQ ID NO: 2749700 - DNA, 15 bp, Homo sapiens
tgaattacatttgta

SEQ ID NO: 2749701 - DNA, 17 bp, Homo sapiens
tgaattctttagatttt

SEQ ID NO: 2749702 - DNA, 18 bp, Homo sapiens
tgaatttgtccatttaaa

SEQ ID NO: 2749703 - DNA, 19 bp, Homo sapiens
tgaatttgtccatttaaaa

SEQ ID NO: 2749704 - DNA, 22 bp, Homo sapiens
tgacagaaaaaaaaatgtttta

SEQ ID NO: 2749705 - DNA, 14 bp, Homo sapiens
tgacagaatataca

SEQ ID NO: 2749706 - DNA, 18 bp, Homo sapiens
tgacagaatatacacatt

SEQ ID NO: 2749707 - DNA, 22 bp, Homo sapiens
tgacagaatatacacattttgt

SEQ ID NO: 2749708 - DNA, 17 bp, Homo sapiens
tgacatacatccaacat

SEQ ID NO: 2749709 - DNA, 16 bp, Homo sapiens
tgacatgggacatttg

SEQ ID NO: 2749710 - DNA, 17 bp, Homo sapiens
tgacatgggacatttgc

SEQ ID NO: 2749711 - DNA, 15 bp, Homo sapiens
tgaccttaaggaaaa

SEQ ID NO: 2749712 - DNA, 14 bp, Homo sapiens
tgacggcctgcctg

SEQ ID NO: 2749713 - DNA, 19 bp, Homo sapiens
tgactctgtccaactctgt

SEQ ID NO: 2749714 - DNA, 12 bp, Homo sapiens
tgactgggctgg

SEQ ID NO: 2749715 - DNA, 13 bp, Homo sapiens
tgactgggctggg

SEQ ID NO: 2749716 - DNA, 20 bp, Homo sapiens
tgacttcttccctaaaatgt

SEQ ID NO: 2749717 - DNA, 16 bp, Homo sapiens
tgactttttgtttctt

SEQ ID NO: 2749718 - DNA, 23 bp, Homo sapiens
tgagaatgttaccagacttcaag

SEQ ID NO: 2749719 - DNA, 17 bp, Homo sapiens
tgagacccctttaaact

SEQ ID NO: 2749720 - DNA, 14 bp, Homo sapiens
tgagactttctttc

SEQ ID NO: 2749721 - DNA, 19 bp, Homo sapiens
tgagagacacactgaagaa

SEQ ID NO: 2749722 - DNA, 23 bp, Homo sapiens
tgagcagagaactgatgcgactt

SEQ ID NO: 2749723 - DNA, 20 bp, Homo sapiens
tgagcagtcaggaaagagaa

SEQ ID NO: 2749724 - DNA, 17 bp, Homo sapiens
tgaggaagagggactgt

SEQ ID NO: 2749725 - DNA, 22 bp, Homo sapiens
tgagggtgactatggagctgag

SEQ ID NO: 2749726 - DNA, 17 bp, Homo sapiens
tgagttggctgggaata

SEQ ID NO: 2749727 - DNA, 19 bp, Homo sapiens
tgagttgggggtattttct

SEQ ID NO: 2749728 - DNA, 21 bp, Homo sapiens
tgagttgggggtattttctaa

SEQ ID NO: 2749729 - DNA, 15 bp, Homo sapiens
tgatataaagaatga

SEQ ID NO: 2749730 - DNA, 17 bp, Homo sapiens
tgatcagcttattgtct

SEQ ID NO: 2749731 - DNA, 24 bp, Homo sapiens
tgatcagcttattgtctagtgaaa

SEQ ID NO: 2749732 - DNA, 19 bp, Homo sapiens
ttccactattatagaaatt

SEQ ID NO: 2749733 - DNA, 18 bp, Homo sapiens
ttccagatcctggaaatc

SEQ ID NO: 2749734 - DNA, 22 bp, Homo sapiens
ttccagatgtctaaaagattct

SEQ ID NO: 2749735 - DNA, 21 bp, Homo sapiens
ttccagtttctgtaaggtctt

SEQ ID NO: 2749736 - DNA, 14 bp, Homo sapiens
ttcccgagcgctgg

SEQ ID NO: 2749737 - DNA, 14 bp, Homo sapiens
ttccctaaaatgta

SEQ ID NO: 2749738 - DNA, 15 bp, Homo sapiens
ttccctaaaatgtag

SEQ ID NO: 2749739 - DNA, 13 bp, Homo sapiens
ttcctaaaatgct

SEQ ID NO: 2749740 - DNA, 22 bp, Homo sapiens
ttcctccctcccacactcgcca

SEQ ID NO: 2749741 - DNA, 22 bp, Homo sapiens
ttcctgcatctttcatagttct

SEQ ID NO: 2749742 - DNA, 13 bp, Homo sapiens
ttccttaaaattt

SEQ ID NO: 2749743 - DNA, 15 bp, Homo sapiens
ttccttcctctgtaa

SEQ ID NO: 2749744 - DNA, 22 bp, Homo sapiens
ttccttggccaagagaagggct

SEQ ID NO: 2749745 - DNA, 15 bp, Homo sapiens
ttcctttatactgtg

SEQ ID NO: 2749746 - DNA, 18 bp, Homo sapiens
ttccttttgtaaagtaaa

SEQ ID NO: 2749747 - DNA, 21 bp, Homo sapiens
ttccttttgtaaagtaaaata

SEQ ID NO: 2749748 - DNA, 17 bp, Homo sapiens
ttcggccgagctggttt

SEQ ID NO: 2749749 - DNA, 17 bp, Homo sapiens
ttctaagggaaaaagtt

SEQ ID NO: 2749750 - DNA, 23 bp, Homo sapiens
ttctaatcttaaatcagaataaa

SEQ ID NO: 2749751 - DNA, 20 bp, Homo sapiens
ttctaattttttttgtacat

SEQ ID NO: 2749752 - DNA, 15 bp, Homo sapiens
ttctatcgttattat

SEQ ID NO: 2749753 - DNA, 17 bp, Homo sapiens
ttctatcgttattataa

SEQ ID NO: 2749754 - DNA, 22 bp, Homo sapiens
ttctatcgttattataaatgtt

SEQ ID NO: 2749755 - DNA, 15 bp, Homo sapiens
ttctccagaaattta

SEQ ID NO: 2749756 - DNA, 23 bp, Homo sapiens
ttctctcctctccccatgatgtt

SEQ ID NO: 2749757 - DNA, 14 bp, Homo sapiens
ttctgaagaagatg

SEQ ID NO: 2749758 - DNA, 18 bp, Homo sapiens
ttctgactttttgtttct

SEQ ID NO: 2749759 - DNA, 20 bp, Homo sapiens
ttctgggaaatgttttaatg

SEQ ID NO: 2749760 - DNA, 16 bp, Homo sapiens
ttctgggggaaaaagc

SEQ ID NO: 2749761 - DNA, 20 bp, Homo sapiens
ttctgggggaaaaagccata

SEQ ID NO: 2749762 - DNA, 20 bp, Homo sapiens
ttctgtaaggtcttacattg

SEQ ID NO: 2749763 - DNA, 17 bp, Homo sapiens
ttctgtgttgaaatata

SEQ ID NO: 2749764 - DNA, 14 bp, Homo sapiens
ttctgttaaatatt

SEQ ID NO: 2749765 - DNA, 22 bp, Homo sapiens
ttcttaaaatgcaatatttgta

SEQ ID NO: 2749766 - DNA, 14 bp, Homo sapiens
ttcttatagaataa

SEQ ID NO: 2749767 - DNA, 16 bp, Homo sapiens
ttcttatagaataaaa

SEQ ID NO: 2749768 - DNA, 20 bp, Homo sapiens
ttcttatagaataaaagctg

SEQ ID NO: 2749769 - DNA, 12 bp, Homo sapiens
ttcttatctaaa

SEQ ID NO: 2749770 - DNA, 14 bp, Homo sapiens
ttcttcatgcatta

SEQ ID NO: 2749771 - DNA, 16 bp, Homo sapiens
ttcttccctaaaatgt

SEQ ID NO: 2749772 - DNA, 18 bp, Homo sapiens
ttctttgaaatgctaaac

SEQ ID NO: 2749773 - DNA, 15 bp, Homo sapiens
ttcttttctttgtat

SEQ ID NO: 2749774 - DNA, 13 bp, Homo sapiens
ttgaaaatgccac

SEQ ID NO: 2749775 - DNA, 14 bp, Homo sapiens
ttgaaaatgccacc

SEQ ID NO: 2749776 - DNA, 18 bp, Homo sapiens
ttgaaagtaaaaaaataa

SEQ ID NO: 2749777 - DNA, 15 bp, Homo sapiens
ttgaaatatagttga

SEQ ID NO: 2749778 - DNA, 18 bp, Homo sapiens
ttgaaatatagttgaaag

SEQ ID NO: 2749779 - DNA, 22 bp, Homo sapiens
ttgaaatatagttgaaagtaaa

SEQ ID NO: 2749780 - DNA, 21 bp, Homo sapiens
ttgaatgccttatttttgaat

SEQ ID NO: 2749781 - DNA, 18 bp, Homo sapiens
ttgaattctttagatttt

SEQ ID NO: 2749782 - DNA, 20 bp, Homo sapiens
ttgactctgtccaactctgt

SEQ ID NO: 2749783 - DNA, 22 bp, Homo sapiens
ttgagactgaaagaaactaaga

SEQ ID NO: 2749784 - DNA, 19 bp, Homo sapiens
ttgaggccaggactttgag

SEQ ID NO: 2749785 - DNA, 20 bp, Homo sapiens
ttgagtatttgctgtttgtc

SEQ ID NO: 2749786 - DNA, 21 bp, Homo sapiens
ttgagttgggggtattttcta

SEQ ID NO: 2749787 - DNA, 22 bp, Homo sapiens
ttgagttgggggtattttctaa

SEQ ID NO: 2749788 - DNA, 12 bp, Homo sapiens
ttgatacaaatg

SEQ ID NO: 2749789 - DNA, 16 bp, Homo sapiens
ttgatagtttcattta

SEQ ID NO: 2749790 - DNA, 18 bp, Homo sapiens
ttgatggtggtatgtttt

SEQ ID NO: 2749791 - DNA, 14 bp, Homo sapiens
ttgattaatgtact

SEQ ID NO: 2749792 - DNA, 22 bp, Homo sapiens
ttgattaatgtactttttattg

SEQ ID NO: 2749793 - DNA, 20 bp, Homo sapiens
ttgcacgcgccctttctacc

SEQ ID NO: 2749794 - DNA, 13 bp, Homo sapiens
ttgcactttgtag

SEQ ID NO: 2749795 - DNA, 19 bp, Homo sapiens
ttgcagaagttcttagtgt

SEQ ID NO: 2749796 - DNA, 17 bp, Homo sapiens
ttgcagctcccattcta

SEQ ID NO: 2749797 - DNA, 22 bp, Homo sapiens
ttgcagctcccattctatgtgt

SEQ ID NO: 2749798 - DNA, 23 bp, Homo sapiens
ttgcagctcccattctatgtgtc

SEQ ID NO: 2749799 - DNA, 16 bp, Homo sapiens
ttgcatggtgtgaact

SEQ ID NO: 2749800 - DNA, 20 bp, Homo sapiens
ttgcattggtttgagaaagg

SEQ ID NO: 2749801 - DNA, 14 bp, Homo sapiens
ttgcatttttgtat

SEQ ID NO: 2749802 - DNA, 23 bp, Homo sapiens
ttgccaatcttgttttaagcaaa

SEQ ID NO: 2749803 - DNA, 13 bp, Homo sapiens
ttgccatttagcg

SEQ ID NO: 2749804 - DNA, 18 bp, Homo sapiens
ttgcctttgaagggtatg

SEQ ID NO: 2749805 - DNA, 20 bp, Homo sapiens
ttgctataaatagatttagt

SEQ ID NO: 2749806 - DNA, 16 bp, Homo sapiens
ttgctgcataaatttg

SEQ ID NO: 2749807 - DNA, 16 bp, Homo sapiens
ttggaacagtgacaat

SEQ ID NO: 2749808 - DNA, 20 bp, Homo sapiens
ttggagaaaagcacttaaag

SEQ ID NO: 2749809 - DNA, 22 bp, Homo sapiens
ttggagaagaactgaaatcata

SEQ ID NO: 2749810 - DNA, 13 bp, Homo sapiens
ttggagccttcca

SEQ ID NO: 2749811 - DNA, 14 bp, Homo sapiens
ttggagccttccac

SEQ ID NO: 2749812 - DNA, 20 bp, Homo sapiens
ttggatttcctttatactgt

SEQ ID NO: 2749813 - DNA, 15 bp, Homo sapiens
ttggatttgcatttt

SEQ ID NO: 2749814 - DNA, 15 bp, Homo sapiens
ttggcacttctgcca

SEQ ID NO: 2749815 - DNA, 16 bp, Homo sapiens
ttggcagctctactct

SEQ ID NO: 2749816 - DNA, 16 bp, Homo sapiens
ttggccaagagaaggg

SEQ ID NO: 2749817 - DNA, 15 bp, Homo sapiens
ttgggaaaaattatt

SEQ ID NO: 2749818 - DNA, 16 bp, Homo sapiens
ttgggaaaaattattt

SEQ ID NO: 2749819 - DNA, 19 bp, Homo sapiens
ttgggaaaaattatttgtg

SEQ ID NO: 2749820 - DNA, 20 bp, Homo sapiens
ttgggggaaatgttgtgggg

SEQ ID NO: 2749821 - DNA, 22 bp, Homo sapiens
ttgggggaaatgttgtgggggt

SEQ ID NO: 2749822 - DNA, 14 bp, Homo sapiens
ttggtattaaagaa

SEQ ID NO: 2749823 - DNA, 16 bp, Homo sapiens
ttggttatttctaaac

SEQ ID NO: 2749824 - DNA, 13 bp, Homo sapiens
ttggtttgagaaa

SEQ ID NO: 2749825 - DNA, 13 bp, Homo sapiens
ttgtaaaaacttt

SEQ ID NO: 2749826 - DNA, 19 bp, Homo sapiens
ttgtaaagtaaaatatgtc

SEQ ID NO: 2749827 - DNA, 15 bp, Homo sapiens
ttgtaaatctgtact

SEQ ID NO: 2749828 - DNA, 14 bp, Homo sapiens
ttgtaatatatcct

SEQ ID NO: 2749829 - DNA, 22 bp, Homo sapiens
ttgtacatcgcttctttttcaa

SEQ ID NO: 2749830 - DNA, 18 bp, Homo sapiens
ttgtactgcatcttagtt

SEQ ID NO: 2749831 - DNA, 21 bp, Homo sapiens
ttgtactgcatcttagtttac

SEQ ID NO: 2749832 - DNA, 23 bp, Homo sapiens
ttgtagtgttggagaagaactga

SEQ ID NO: 2749833 - DNA, 13 bp, Homo sapiens
ttgtataaaataa

SEQ ID NO: 2749834 - DNA, 17 bp, Homo sapiens
ttgtataaaataatttt

SEQ ID NO: 2749835 - DNA, 20 bp, Homo sapiens
ttgtattttgtacaaagtaa

SEQ ID NO: 2749836 - DNA, 15 bp, Homo sapiens
ttgtatttttttcca

SEQ ID NO: 2749837 - DNA, 16 bp, Homo sapiens
ttgtatttttttccaa

SEQ ID NO: 2749838 - DNA, 22 bp, Homo sapiens
ttgtatttttttccaagtgtat

SEQ ID NO: 2749839 - DNA, 23 bp, Homo sapiens
ttgtccagttcaggaatttttgt

SEQ ID NO: 2749840 - DNA, 21 bp, Homo sapiens
ttgtcctaagtgtcaagtcct

SEQ ID NO: 2749841 - DNA, 12 bp, Homo sapiens
ttgtgggaataa

SEQ ID NO: 2749842 - DNA, 15 bp, Homo sapiens
ttgtgtataatttac

SEQ ID NO: 2749843 - DNA, 10 bp, Homo sapiens
ttgtgtgtgg

SEQ ID NO: 2749844 - DNA, 16 bp, Homo sapiens
ttgtgtgtgggagtgt

SEQ ID NO: 2749845 - DNA, 13 bp, Homo sapiens
ttgtgttggggga

SEQ ID NO: 2749846 - DNA, 16 bp, Homo sapiens
ttgttccaatgccaca

SEQ ID NO: 2749847 - DNA, 22 bp, Homo sapiens
ttgttgggtaaaaatgaagcag

SEQ ID NO: 2749848 - DNA, 16 bp, Homo sapiens
ttgttgtgtataattt

SEQ ID NO: 2749849 - DNA, 21 bp, Homo sapiens
ttgtttaaaaaccgaataaat

SEQ ID NO: 2749850 - DNA, 18 bp, Homo sapiens
ttgtttagaagaagtgtg

SEQ ID NO: 2749851 - DNA, 15 bp, Homo sapiens
ttgtttgtttttgct

SEQ ID NO: 2749852 - DNA, 23 bp, Homo sapiens
ttgtttttttaaatcgccttgaa

SEQ ID NO: 2749853 - DNA, 19 bp, Homo sapiens
tttaaaaaccgaataaatg

SEQ ID NO: 2749854 - DNA, 18 bp, Homo sapiens
tttaaaaataaaagctat

SEQ ID NO: 2749855 - DNA, 19 bp, Homo sapiens
tttaaaaatgatctgtagt

SEQ ID NO: 2749856 - DNA, 17 bp, Homo sapiens
tttaaaacacagtattg

SEQ ID NO: 2749857 - DNA, 11 bp, Homo sapiens
ttattcaaaat

SEQ ID NO: 2749858 - DNA, 12 bp, Homo sapiens
ttattcaaaata

SEQ ID NO: 2749859 - DNA, 14 bp, Homo sapiens
ttattcaaaatatt

SEQ ID NO: 2749860 - DNA, 23 bp, Homo sapiens
ttattgaagtcttcttatctaaa

SEQ ID NO: 2749861 - DNA, 17 bp, Homo sapiens
ttatttagaaactggtt

SEQ ID NO: 2749862 - DNA, 13 bp, Homo sapiens
ttatttctaaacc

SEQ ID NO: 2749863 - DNA, 15 bp, Homo sapiens
ttatttgccttttaa

SEQ ID NO: 2749864 - DNA, 17 bp, Homo sapiens
ttattttgaatgtacct

SEQ ID NO: 2749865 - DNA, 18 bp, Homo sapiens
ttatttttgaattcttta

SEQ ID NO: 2749866 - DNA, 13 bp, Homo sapiens
ttcaaaaaaatgt

SEQ ID NO: 2749867 - DNA, 18 bp, Homo sapiens
ttcaaaaaaatgttttta

SEQ ID NO: 2749868 - DNA, 17 bp, Homo sapiens
ttcaaaatggaaaatta

SEQ ID NO: 2749869 - DNA, 15 bp, Homo sapiens
ttcaaacatatataa

SEQ ID NO: 2749870 - DNA, 13 bp, Homo sapiens
ttcaaatattgaa

SEQ ID NO: 2749871 - DNA, 15 bp, Homo sapiens
ttgtttttgctttct

SEQ ID NO: 2749872 - DNA, 23 bp, Homo sapiens
tttaaaaaattttttgattaatg

SEQ ID NO: 2749873 - DNA, 13 bp, Homo sapiens
tttaaaaagaaaa

SEQ ID NO: 2749874 - DNA, 16 bp, Homo sapiens
tttaaaaataaaagct

SEQ ID NO: 2749875 - DNA, 20 bp, Homo sapiens
tttaaaaataaaagctatta

SEQ ID NO: 2749876 - DNA, 17 bp, Homo sapiens
tttaaaaatgatctgta

SEQ ID NO: 2749877 - DNA, 23 bp, Homo sapiens
tttaaaaatgatctgtagttttt

SEQ ID NO: 2749878 - DNA, 19 bp, Homo sapiens
tttaaaacacagtattgta

SEQ ID NO: 2749879 - DNA, 23 bp, Homo sapiens
tttaaaacacagtattgtagaaa

SEQ ID NO: 2749880 - DNA, 12 bp, Homo sapiens
tttaaaagagta

SEQ ID NO: 2749881 - DNA, 13 bp, Homo sapiens
tttaaactactga

SEQ ID NO: 2749882 - DNA, 14 bp, Homo sapiens
tttaaagaatccaa

SEQ ID NO: 2749883 - DNA, 20 bp, Homo sapiens
tttaaagaatccaagacaaa

SEQ ID NO: 2749884 - DNA, 12 bp, Homo sapiens
tttaaattggag

SEQ ID NO: 2749885 - DNA, 16 bp, Homo sapiens
tttaactatgaactga

SEQ ID NO: 2749886 - DNA, 20 bp, Homo sapiens
tttaactatgaactgaaggc

SEQ ID NO: 2749887 - DNA, 17 bp, Homo sapiens
tttaactctactgtgta

SEQ ID NO: 2749888 - DNA, 14 bp, Homo sapiens
tttaagcaaatgca

SEQ ID NO: 2749889 - DNA, 15 bp, Homo sapiens
tttaagcaaatgcat

SEQ ID NO: 2749890 - DNA, 19 bp, Homo sapiens
tttaagcaaatgcattcta

SEQ ID NO: 2749891 - DNA, 23 bp, Homo sapiens
tttaagcaaatgcattctatcgt

SEQ ID NO: 2749892 - DNA, 18 bp, Homo sapiens
tttaaggattctgcagaa

SEQ ID NO: 2749893 - DNA, 13 bp, Homo sapiens
tttaataatgttt

SEQ ID NO: 2749894 - DNA, 14 bp, Homo sapiens
tttaataatgtttc

SEQ ID NO: 2749895 - DNA, 24 bp, Homo sapiens
tttaatattacctaatgaaagtga

SEQ ID NO: 2749896 - DNA, 12 bp, Homo sapiens
tttaatcactta

SEQ ID NO: 2749897 - DNA, 21 bp, Homo sapiens
tttaatcacttaacattccta

SEQ ID NO: 2749898 - DNA, 16 bp, Homo sapiens
tttaatctcctgagtt

SEQ ID NO: 2749899 - DNA, 13 bp, Homo sapiens
tttaattgtttaa

SEQ ID NO: 2749900 - DNA, 15 bp, Homo sapiens
tttacaatttcaaaa

SEQ ID NO: 2749901 - DNA, 15 bp, Homo sapiens
tttagaacctacaaa

SEQ ID NO: 2749902 - DNA, 17 bp, Homo sapiens
tttagaagaagtgtgtc

SEQ ID NO: 2749903 - DNA, 19 bp, Homo sapiens
tttagaagaagtgtgtcac

SEQ ID NO: 2749904 - DNA, 23 bp, Homo sapiens
tttagatttttaaattggagaaa

SEQ ID NO: 2749905 - DNA, 21 bp, Homo sapiens
tttaggccatttgttacagtt

SEQ ID NO: 2749906 - DNA, 22 bp, Homo sapiens
tttatatatgaatattacatgt

SEQ ID NO: 2749907 - DNA, 14 bp, Homo sapiens
tttatatctggaat

SEQ ID NO: 2749908 - DNA, 19 bp, Homo sapiens
tttatatgcttctgtttta

SEQ ID NO: 2749909 - DNA, 21 bp, Homo sapiens
tttatatgcttctgttttata

SEQ ID NO: 2749910 - DNA, 19 bp, Homo sapiens
tttatattagttgctttgt

SEQ ID NO: 2749911 - DNA, 22 bp, Homo sapiens
tttatcaaggaagtcttcaaat

SEQ ID NO: 2749912 - DNA, 21 bp, Homo sapiens
tttatctgcaaggatttttta

SEQ ID NO: 2749913 - DNA, 15 bp, Homo sapiens
tttatcttaaactgt

SEQ ID NO: 2749914 - DNA, 22 bp, Homo sapiens
tttatcttttagctagaatcca

SEQ ID NO: 2749915 - DNA, 18 bp, Homo sapiens
tttatgttcttatagaat

SEQ ID NO: 2749916 - DNA, 21 bp, Homo sapiens
tttatgtttgtggttttggga

SEQ ID NO: 2749917 - DNA, 21 bp, Homo sapiens
tttattacacctcagaaattg

SEQ ID NO: 2749918 - DNA, 15 bp, Homo sapiens
tttattttgaatgta

SEQ ID NO: 2749919 - DNA, 18 bp, Homo sapiens
tttattttgaatgtacct

SEQ ID NO: 2749920 - DNA, 19 bp, Homo sapiens
tttcaaacatatataacaa

SEQ ID NO: 2749921 - DNA, 23 bp, Homo sapiens
tttcaattgagtaattctagaca

SEQ ID NO: 2749922 - DNA, 17 bp, Homo sapiens
tttcacagttggcactt

SEQ ID NO: 2749923 - DNA, 15 bp, Homo sapiens
tttcagataatcaca

SEQ ID NO: 2749924 - DNA, 13 bp, Homo sapiens
tttcatagttctg

SEQ ID NO: 2749925 - DNA, 22 bp, Homo sapiens
tttcatcattgttgtgtataat

SEQ ID NO: 2749926 - DNA, 13 bp, Homo sapiens
tttcatgacagaa

SEQ ID NO: 2749927 - DNA, 22 bp, Homo sapiens
tttcatttacaatttcaaaaga

SEQ ID NO: 2749928 - DNA, 19 bp, Homo sapiens
tttccaagtgtataatgtt

SEQ ID NO: 2749929 - DNA, 17 bp, Homo sapiens
tttccactattatagaa

SEQ ID NO: 2749930 - DNA, 14 bp, Homo sapiens
tttcctgcccagcc

SEQ ID NO: 2749931 - DNA, 19 bp, Homo sapiens
tttctaaaccacaaaagtt

SEQ ID NO: 2749932 - DNA, 14 bp, Homo sapiens
tttctatgaaatat

SEQ ID NO: 2749933 - DNA, 13 bp, Homo sapiens
tttctctaaactg

SEQ ID NO: 2749934 - DNA, 14 bp, Homo sapiens
tttctgtaaggtct

SEQ ID NO: 2749935 - DNA, 13 bp, Homo sapiens
tttctttgaaatg

SEQ ID NO: 2749936 - DNA, 18 bp, Homo sapiens
tttctttgaaatgctaaa

SEQ ID NO: 2749937 - DNA, 17 bp, Homo sapiens
tttctttgtgtttgctt

SEQ ID NO: 2749938 - DNA, 16 bp, Homo sapiens
tttgaaaggtcagaat

SEQ ID NO: 2749939 - DNA, 18 bp, Homo sapiens
tttgaaaggtcagaattt

SEQ ID NO: 2749940 - DNA, 19 bp, Homo sapiens
tttgaaaggtcagaatttt

SEQ ID NO: 2749941 - DNA, 15 bp, Homo sapiens
tttgaaatgctaaac

SEQ ID NO: 2749942 - DNA, 18 bp, Homo sapiens
tttgaattctttagattt

SEQ ID NO: 2749943 - DNA, 17 bp, Homo sapiens
tttgatacaaatgggaa

SEQ ID NO: 2749944 - DNA, 16 bp, Homo sapiens
tttgcaggtctttaaa

SEQ ID NO: 2749945 - DNA, 19 bp, Homo sapiens
tttgctatgagctggggat

SEQ ID NO: 2749946 - DNA, 16 bp, Homo sapiens
tttggaacagtgacaa

SEQ ID NO: 2749947 - DNA, 17 bp, Homo sapiens
tttggatttcctttata

SEQ ID NO: 2749948 - DNA, 16 bp, Homo sapiens
tttgggaaaaattatt

SEQ ID NO: 2749949 - DNA, 15 bp, Homo sapiens
tttgtaaagtaaaat

SEQ ID NO: 2749950 - DNA, 13 bp, Homo sapiens
tttgtaaatctgt

SEQ ID NO: 2749951 - DNA, 14 bp, Homo sapiens
tttgtaaatctgta

SEQ ID NO: 2749952 - DNA, 17 bp, Homo sapiens
tttgtaaatctgtactt

SEQ ID NO: 2749953 - DNA, 15 bp, Homo sapiens
tttgtaatatatcct

SEQ ID NO: 2749954 - DNA, 17 bp, Homo sapiens
tttgtagtgttggagaa

SEQ ID NO: 2749955 - DNA, 21 bp, Homo sapiens
tttgtagtgttggagaagaac

SEQ ID NO: 2749956 - DNA, 17 bp, Homo sapiens
tttgtataaaataattt

SEQ ID NO: 2749957 - DNA, 16 bp, Homo sapiens
tttgtatttttttcca

SEQ ID NO: 2749958 - DNA, 17 bp, Homo sapiens
tttgtcattaaaattgt

SEQ ID NO: 2749959 - DNA, 17 bp, Homo sapiens
tttgtgaagcaaaattt

SEQ ID NO: 2749960 - DNA, 21 bp, Homo sapiens
tttgtgttgggggaaatgttg

SEQ ID NO: 2749961 - DNA, 20 bp, Homo sapiens
ttttaaaaacctattttgaa

SEQ ID NO: 2749962 - DNA, 21 bp, Homo sapiens
ttttaaatcgccttgaacaaa

SEQ ID NO: 2749963 - DNA, 12 bp, Homo sapiens
ttttaataatgt

SEQ ID NO: 2749964 - DNA, 14 bp, Homo sapiens
ttttaataatgttt

SEQ ID NO: 2749965 - DNA, 23 bp, Homo sapiens
ttttataaaaacattgaaatatt

SEQ ID NO: 2749966 - DNA, 14 bp, Homo sapiens
ttttataattttgt

SEQ ID NO: 2749967 - DNA, 14 bp, Homo sapiens
ttttatatatgaat

SEQ ID NO: 2749968 - DNA, 13 bp, Homo sapiens
ttttatatttgaa

SEQ ID NO: 2749969 - DNA, 23 bp, Homo sapiens
ttttatcttttagctagaatcca

SEQ ID NO: 2749970 - DNA, 22 bp, Homo sapiens
ttttattgcatggtgtgaacta

SEQ ID NO: 2749971 - DNA, 21 bp, Homo sapiens
ttttatttttctcatgatgag

SEQ ID NO: 2749972 - DNA, 13 bp, Homo sapiens
ttttcaaatattg

SEQ ID NO: 2749973 - DNA, 20 bp, Homo sapiens
ttttcaggctagatgtatgt

SEQ ID NO: 2749974 - DNA, 13 bp, Homo sapiens
ttttcatcattgt

SEQ ID NO: 2749975 - DNA, 19 bp, Homo sapiens
ttttccaagtgtataatgt

SEQ ID NO: 2749976 - DNA, 20 bp, Homo sapiens
ttttctctactttaaatttt

SEQ ID NO: 2749977 - DNA, 19 bp, Homo sapiens
ttttgaaaggtcagaattt

SEQ ID NO: 2749978 - DNA, 18 bp, Homo sapiens
ttttgaatattaagctaa

SEQ ID NO: 2749979 - DNA, 20 bp, Homo sapiens
ttttgattaatgaagaaagt

SEQ ID NO: 2749980 - DNA, 21 bp, Homo sapiens
ttttgattaatgaagaaagta

SEQ ID NO: 2749981 - DNA, 11 bp, Homo sapiens
ttttgctatac

SEQ ID NO: 2749982 - DNA, 19 bp, Homo sapiens
ttttgctttctgaaattca

SEQ ID NO: 2749983 - DNA, 13 bp, Homo sapiens
ttttgtaaaaact

SEQ ID NO: 2749984 - DNA, 20 bp, Homo sapiens
ttttgtacaaagtaaaaata

SEQ ID NO: 2749985 - DNA, 18 bp, Homo sapiens
ttttgtacatcgcttctt

SEQ ID NO: 2749986 - DNA, 23 bp, Homo sapiens
tttttaaattggagaaaagcact

SEQ ID NO: 2749987 - DNA, 22 bp, Homo sapiens
tttttaactctactgtgtaata

SEQ ID NO: 2749988 - DNA, 16 bp, Homo sapiens
tttttaattgtttaaa

SEQ ID NO: 2749989 - DNA, 17 bp, Homo sapiens
tttttatatatgaatat

SEQ ID NO: 2749990 - DNA, 17 bp, Homo sapiens
tttttatattagttgct

SEQ ID NO: 2749991 - DNA, 21 bp, Homo sapiens
tttttattgcatggtgtgaac

SEQ ID NO: 2749992 - DNA, 22 bp, Homo sapiens
ggatggttcccttgatgaagaa

SEQ ID NO: 2749993 - DNA, 23 bp, Homo sapiens
ggatggttcccttgatgaagaag

SEQ ID NO: 2749994 - DNA, 13 bp, Homo sapiens
ggattttttaaaa

SEQ ID NO: 2749995 - DNA, 17 bp, Homo sapiens
ggcaaatccgaaatcag

SEQ ID NO: 2749996 - DNA, 12 bp, Homo sapiens
ggccaagagaag

SEQ ID NO: 2749997 - DNA, 18 bp, Homo sapiens
ggccagcaccatctcttt

SEQ ID NO: 2749998 - DNA, 16 bp, Homo sapiens
ggccatttgttacagt

SEQ ID NO: 2749999 - DNA, 20 bp, Homo sapiens
ggccccgcccgagcccctgc

SEQ ID NO: 2750000 - DNA, 16 bp, Homo sapiens
ggcccctgggtttctt

SEQ ID NO: 2750001 - DNA, 19 bp, Homo sapiens
ggccgagctggtttcctgc

SEQ ID NO: 2750002 - DNA, 23 bp, Homo sapiens
ggccgagctggtttcctgcccag

SEQ ID NO: 2750003 - DNA, 14 bp, Homo sapiens
ggcctaatttttta

SEQ ID NO: 2750004 - DNA, 20 bp, Homo sapiens
ggcctctcattccagaggaa

SEQ ID NO: 2750005 - DNA, 17 bp, Homo sapiens
ggcgacgcggttttttc

SEQ ID NO: 2750006 - DNA, 16 bp, Homo sapiens
ggcgcccccacccctg

SEQ ID NO: 2750007 - DNA, 22 bp, Homo sapiens
ggcgctgaggtgtctggcctga

SEQ ID NO: 2750008 - DNA, 16 bp, Homo sapiens
ggctaacaaattttaa

SEQ ID NO: 2750009 - DNA, 17 bp, Homo sapiens
ggctaccttgtgggaat

SEQ ID NO: 2750010 - DNA, 20 bp, Homo sapiens
ggctaccttgtgggaataaa

SEQ ID NO: 2750011 - DNA, 14 bp, Homo sapiens
ggctcagagtgggg

SEQ ID NO: 2750012 - DNA, 23 bp, Homo sapiens
ggctcggcgcccccacccctggc

SEQ ID NO: 2750013 - DNA, 14 bp, Homo sapiens
ggctgaggtggcag

SEQ ID NO: 2750014 - DNA, 14 bp, Homo sapiens
ggctggtttgttct

SEQ ID NO: 2750015 - DNA, 23 bp, Homo sapiens
ggcttggctcggcgcccccaccc

SEQ ID NO: 2750016 - DNA, 22 bp, Homo sapiens
gggacagtcacctcatggaatt

SEQ ID NO: 2750017 - DNA, 22 bp, Homo sapiens
gggagaatgtcagtatgtggaa

SEQ ID NO: 2750018 - DNA, 13 bp, Homo sapiens
gggagcctgtcct

SEQ ID NO: 2750019 - DNA, 22 bp, Homo sapiens
gggatacaggcccctgggtttc

SEQ ID NO: 2750020 - DNA, 14 bp, Homo sapiens
gggatagatgtgtg

SEQ ID NO: 2750021 - DNA, 14 bp, Homo sapiens
gggatgtctctcat

SEQ ID NO: 2750022 - DNA, 17 bp, Homo sapiens
gggcaaacctagccgga

SEQ ID NO: 2750023 - DNA, 15 bp, Homo sapiens
gggcatgtctgcctg

SEQ ID NO: 2750024 - DNA, 14 bp, Homo sapiens
ggggacttctcttc

SEQ ID NO: 2750025 - DNA, 23 bp, Homo sapiens
ggggtctgtgtgtttatgtgtgt

SEQ ID NO: 2750026 - DNA, 15 bp, Homo sapiens
gggtattttctaatt

SEQ ID NO: 2750027 - DNA, 13 bp, Homo sapiens
gggtcaaacctgt

SEQ ID NO: 2750028 - DNA, 18 bp, Homo sapiens
gggtcattcatggcctgg

SEQ ID NO: 2750029 - DNA, 22 bp, Homo sapiens
ggtacttcaaatccttgaagat

SEQ ID NO: 2750030 - DNA, 16 bp, Homo sapiens
ggtaggaactgctggg

SEQ ID NO: 2750031 - DNA, 14 bp, Homo sapiens
ggtattttctaatt

SEQ ID NO: 2750032 - DNA, 21 bp, Homo sapiens
ggtcatatgtttattcaaaat

SEQ ID NO: 2750033 - DNA, 15 bp, Homo sapiens
ggtcccatggcctgc

SEQ ID NO: 2750034 - DNA, 18 bp, Homo sapiens
ggtcccctccctctgtct

SEQ ID NO: 2750035 - DNA, 21 bp, Homo sapiens
ggtctgtgtgtgtgtatgtgg

SEQ ID NO: 2750036 - DNA, 15 bp, Homo sapiens
ggtgtctggcctgag

SEQ ID NO: 2750037 - DNA, 15 bp, Homo sapiens
ggttatttctaaacc

SEQ ID NO: 2750038 - DNA, 16 bp, Homo sapiens
ggttgaggctgcagtg

SEQ ID NO: 2750039 - DNA, 15 bp, Homo sapiens
ggttgcactttgtag

SEQ ID NO: 2750040 - DNA, 19 bp, Homo sapiens
ggttgggagaatgtcagta

SEQ ID NO: 2750041 - DNA, 14 bp, Homo sapiens
ggtttcctgcccag

SEQ ID NO: 2750042 - DNA, 19 bp, Homo sapiens
ggtttcctgcccagcctgg

SEQ ID NO: 2750043 - DNA, 20 bp, Homo sapiens
ggtttcctgcccagcctggg

SEQ ID NO: 2750044 - DNA, 22 bp, Homo sapiens
ggtttgtttagaagaagtgtgt

SEQ ID NO: 2750045 - DNA, 12 bp, Homo sapiens
gtaaaaactttt

SEQ ID NO: 2750046 - DNA, 18 bp, Homo sapiens
gtaaaaataaactgttat

SEQ ID NO: 2750047 - DNA, 23 bp, Homo sapiens
gtaaatctgtacttttttcaaat

SEQ ID NO: 2750048 - DNA, 12 bp, Homo sapiens
gtaaattctgtt

SEQ ID NO: 2750049 - DNA, 17 bp, Homo sapiens
gtaaatttatgtgatgg

SEQ ID NO: 2750050 - DNA, 15 bp, Homo sapiens
gtaagcggaataaac

SEQ ID NO: 2750051 - DNA, 16 bp, Homo sapiens
gtaagggaataaattt

SEQ ID NO: 2750052 - DNA, 18 bp, Homo sapiens
gtaagggtaaaaaagata

SEQ ID NO: 2750053 - DNA, 22 bp, Homo sapiens
gtaaggtcttacattgcctgac

SEQ ID NO: 2750054 - DNA, 19 bp, Homo sapiens
gtaatttaaaattgtgatg

SEQ ID NO: 2750055 - DNA, 20 bp, Homo sapiens
gtaatttaaaattgtgatgt

SEQ ID NO: 2750056 - DNA, 17 bp, Homo sapiens
gtacaagtcagtttcta

SEQ ID NO: 2750057 - DNA, 13 bp, Homo sapiens
gtacatttggaac

SEQ ID NO: 2750058 - DNA, 19 bp, Homo sapiens
gtactccttggatttgcat

SEQ ID NO: 2750059 - DNA, 15 bp, Homo sapiens
gtactgcatcttagt

SEQ ID NO: 2750060 - DNA, 15 bp, Homo sapiens
gtacttcatgctgtc

SEQ ID NO: 2750061 - DNA, 18 bp, Homo sapiens
gtactttttattgcatgg

SEQ ID NO: 2750062 - DNA, 17 bp, Homo sapiens
gtacttttttcaaatat

SEQ ID NO: 2750063 - DNA, 19 bp, Homo sapiens
gtacttttttcaaatattg

SEQ ID NO: 2750064 - DNA, 23 bp, Homo sapiens
gtacttttttcaaatattgaatg

SEQ ID NO: 2750065 - DNA, 21 bp, Homo sapiens
gtagaaagctaatacaaaact

SEQ ID NO: 2750066 - DNA, 23 bp, Homo sapiens
gtagaaagctaatacaaaactat

SEQ ID NO: 2750067 - DNA, 12 bp, Homo sapiens
gtagaaattcta

SEQ ID NO: 2750068 - DNA, 15 bp, Homo sapiens
gtagagccagaggtc

SEQ ID NO: 2750069 - DNA, 13 bp, Homo sapiens
gtagttaaaacag

SEQ ID NO: 2750070 - DNA, 13 bp, Homo sapiens
gtagttttgttta

SEQ ID NO: 2750071 - DNA, 13 bp, Homo sapiens
gtataagttgtat

SEQ ID NO: 2750072 - DNA, 17 bp, Homo sapiens
gtataatgttggtgtgg

SEQ ID NO: 2750073 - DNA, 13 bp, Homo sapiens
gtataatttacct

SEQ ID NO: 2750074 - DNA, 13 bp, Homo sapiens
gtatagttgcttt

SEQ ID NO: 2750075 - DNA, 14 bp, Homo sapiens
gtatatcttaagaa

SEQ ID NO: 2750076 - DNA, 21 bp, Homo sapiens
gtatcttgattaatgtacttt

SEQ ID NO: 2750077 - DNA, 23 bp, Homo sapiens
gtatcttgattaatgtacttttt

SEQ ID NO: 2750078 - DNA, 23 bp, Homo sapiens
gtatgatcttagggaactttgat

SEQ ID NO: 2750079 - DNA, 18 bp, Homo sapiens
gtatgtcacaaagagctg

SEQ ID NO: 2750080 - DNA, 16 bp, Homo sapiens
gtatgtggaagtgtgg

SEQ ID NO: 2750081 - DNA, 15 bp, Homo sapiens
gtattcttaaaatgc

SEQ ID NO: 2750082 - DNA, 19 bp, Homo sapiens
gtattcttaaaatgcaata

SEQ ID NO: 2750083 - DNA, 20 bp, Homo sapiens
gtattcttaaaatgcaatat

SEQ ID NO: 2750084 - DNA, 12 bp, Homo sapiens
gtatttgctgtt

SEQ ID NO: 2750085 - DNA, 12 bp, Homo sapiens
gtattttctaat

SEQ ID NO: 2750086 - DNA, 20 bp, Homo sapiens
gtatttttttccaagtgtat

SEQ ID NO: 2750087 - DNA, 17 bp, Homo sapiens
gtcagtatgtggaagtg

SEQ ID NO: 2750088 - DNA, 21 bp, Homo sapiens
gtcagtatgtggaagtgtggg

SEQ ID NO: 2750089 - DNA, 13 bp, Homo sapiens
gtcagttgtatca

SEQ ID NO: 2750090 - DNA, 21 bp, Homo sapiens
gtccaagcatttagatgtata

SEQ ID NO: 2750091 - DNA, 21 bp, Homo sapiens
gtcccatggcctgctgggctt

SEQ ID NO: 2750092 - DNA, 22 bp, Homo sapiens
gtcccattgttggcgctgaggt

SEQ ID NO: 2750093 - DNA, 16 bp, Homo sapiens
gtccctgaagagaagg

SEQ ID NO: 2750094 - DNA, 16 bp, Homo sapiens
gtcctatgcaataaaa

SEQ ID NO: 2750095 - DNA, 21 bp, Homo sapiens
gtcctatgcaataaaattatt

SEQ ID NO: 2750096 - DNA, 19 bp, Homo sapiens
gtcctgaacctttcaaaat

SEQ ID NO: 2750097 - DNA, 16 bp, Homo sapiens
gtcctgactgggctgg

SEQ ID NO: 2750098 - DNA, 23 bp, Homo sapiens
gtctacactaagagagaatgaga

SEQ ID NO: 2750099 - DNA, 12 bp, Homo sapiens
gtctgcctggag

SEQ ID NO: 2750100 - DNA, 13 bp, Homo sapiens
gtctgcctggagt

SEQ ID NO: 2750101 - DNA, 16 bp, Homo sapiens
gtctgtgtgtgtgtat

SEQ ID NO: 2750102 - DNA, 21 bp, Homo sapiens
gtctgtgtgtttatgtgtgtg

SEQ ID NO: 2750103 - DNA, 14 bp, Homo sapiens
gtcttcaaatttga

SEQ ID NO: 2750104 - DNA, 17 bp, Homo sapiens
gtcttcggccgagctgg

SEQ ID NO: 2750105 - DNA, 21 bp, Homo sapiens
gtcttggggtcccactgctcg

SEQ ID NO: 2750106 - DNA, 17 bp, Homo sapiens
taactgaaggtgcagtt

SEQ ID NO: 2750107 - DNA, 21 bp, Homo sapiens
taactggtttgactctgtcca

SEQ ID NO: 2750108 - DNA, 16 bp, Homo sapiens
taacttaaatatttga

SEQ ID NO: 2750109 - DNA, 18 bp, Homo sapiens
taacttaaatatttgaaa

SEQ ID NO: 2750110 - DNA, 21 bp, Homo sapiens
taagaatgtgctagagttaaa

SEQ ID NO: 2750111 - DNA, 14 bp, Homo sapiens
taagacttttctct

SEQ ID NO: 2750112 - DNA, 21 bp, Homo sapiens
tagttttggttatttctaaac

SEQ ID NO: 2750113 - DNA, 22 bp, Homo sapiens
tagttttggttatttctaaacc

SEQ ID NO: 2750114 - DNA, 13 bp, Homo sapiens
tataaaaacattg

SEQ ID NO: 2750115 - DNA, 22 bp, Homo sapiens
tataaaataatttttatatttg

SEQ ID NO: 2750116 - DNA, 15 bp, Homo sapiens
tataaagaatgaaag

SEQ ID NO: 2750117 - DNA, 16 bp, Homo sapiens
tataaatagatttagt

SEQ ID NO: 2750118 - DNA, 22 bp, Homo sapiens
tataaatgatatctatattcta

SEQ ID NO: 2750119 - DNA, 14 bp, Homo sapiens
tataaatgtctatt

SEQ ID NO: 2750120 - DNA, 12 bp, Homo sapiens
tataacattctg

SEQ ID NO: 2750121 - DNA, 13 bp, Homo sapiens
tataacattctga

SEQ ID NO: 2750122 - DNA, 15 bp, Homo sapiens
tataagttgtattat

SEQ ID NO: 2750123 - DNA, 19 bp, Homo sapiens
tataagttgtattattaga

SEQ ID NO: 2750124 - DNA, 15 bp, Homo sapiens
tataatacctttcta

SEQ ID NO: 2750125 - DNA, 17 bp, Homo sapiens
tataatgttggtgtgga

SEQ ID NO: 2750126 - DNA, 16 bp, Homo sapiens
tatacaagtaaattct

SEQ ID NO: 2750127 - DNA, 14 bp, Homo sapiens
tatacacattttgt

SEQ ID NO: 2750128 - DNA, 15 bp, Homo sapiens
tataccacagtcttt

SEQ ID NO: 2750129 - DNA, 22 bp, Homo sapiens
tatagaaaatggaaaatataca

SEQ ID NO: 2750130 - DNA, 12 bp, Homo sapiens
tatagaaattct

SEQ ID NO: 2750131 - DNA, 17 bp, Homo sapiens
tatagttagctttattg

SEQ ID NO: 2750132 - DNA, 19 bp, Homo sapiens
tatataacaatgctgtatt

SEQ ID NO: 2750133 - DNA, 14 bp, Homo sapiens
tatatagctggcaa

SEQ ID NO: 2750134 - DNA, 12 bp, Homo sapiens
tatatatgaata

SEQ ID NO: 2750135 - DNA, 14 bp, Homo sapiens
tatatatgaatatt

SEQ ID NO: 2750136 - DNA, 15 bp, Homo sapiens
tatatcctgtttgta

SEQ ID NO: 2750137 - DNA, 14 bp, Homo sapiens
tatatctggaatga

SEQ ID NO: 2750138 - DNA, 16 bp, Homo sapiens
tatatcttaagaatgt

SEQ ID NO: 2750139 - DNA, 20 bp, Homo sapiens
tatatcttaagaatgtgcta

SEQ ID NO: 2750140 - DNA, 17 bp, Homo sapiens
tatatgaatattacatg

SEQ ID NO: 2750141 - DNA, 19 bp, Homo sapiens
tatatgaatattacatgta

SEQ ID NO: 2750142 - DNA, 14 bp, Homo sapiens
tatatgcttctgtt

SEQ ID NO: 2750143 - DNA, 18 bp, Homo sapiens
tatatgtgcggcttttca

SEQ ID NO: 2750144 - DNA, 18 bp, Homo sapiens
tatattagttgctttgtt

SEQ ID NO: 2750145 - DNA, 15 bp, Homo sapiens
tatattctaaagagc

SEQ ID NO: 2750146 - DNA, 19 bp, Homo sapiens
tatatttattactgtaaga

SEQ ID NO: 2750147 - DNA, 23 bp, Homo sapiens
tatatttattactgtaagaaaat

SEQ ID NO: 2750148 - DNA, 20 bp, Homo sapiens
tatatttccttttgtaaagt

SEQ ID NO: 2750149 - DNA, 18 bp, Homo sapiens
tatcaaggaagtcttcaa

SEQ ID NO: 2750150 - DNA, 17 bp, Homo sapiens
tatcagtaccatttgat

SEQ ID NO: 2750151 - DNA, 13 bp, Homo sapiens
tatcatgctaaaa

SEQ ID NO: 2750152 - DNA, 18 bp, Homo sapiens
tatcatgctaaaattcta

SEQ ID NO: 2750153 - DNA, 13 bp, Homo sapiens
tatcattcatctt

SEQ ID NO: 2750154 - DNA, 19 bp, Homo sapiens
tatcattcatcttcttctt

SEQ ID NO: 2750155 - DNA, 18 bp, Homo sapiens
tatcctatgccttcaaat

SEQ ID NO: 2750156 - DNA, 15 bp, Homo sapiens
tatcctgtttgtatt

SEQ ID NO: 2750157 - DNA, 15 bp, Homo sapiens
tatccttctggctgt

SEQ ID NO: 2750158 - DNA, 14 bp, Homo sapiens
tatctaatgacatg

SEQ ID NO: 2750159 - DNA, 15 bp, Homo sapiens
tatctacagcttcta

SEQ ID NO: 2750160 - DNA, 16 bp, Homo sapiens
tatctatattctaaag

SEQ ID NO: 2750161 - DNA, 14 bp, Homo sapiens
tatctgaacattta

SEQ ID NO: 2750162 - DNA, 17 bp, Homo sapiens
tatctgaacatttacta

SEQ ID NO: 2750163 - DNA, 13 bp, Homo sapiens
tatcttaaactgt

SEQ ID NO: 2750164 - DNA, 15 bp, Homo sapiens
tatcttaaactgttc

SEQ ID NO: 2750165 - DNA, 22 bp, Homo sapiens
tatcttgattaatgtacttttt

SEQ ID NO: 2750166 - DNA, 24 bp, Homo sapiens
tatgaagaattgccaatcttgttt

SEQ ID NO: 2750167 - DNA, 23 bp, Homo sapiens
tatgaattacatttgtataaaat

SEQ ID NO: 2750168 - DNA, 14 bp, Homo sapiens
tatgagaagaatag

SEQ ID NO: 2750169 - DNA, 22 bp, Homo sapiens
tatgatcttagggaactttgat

SEQ ID NO: 2750170 - DNA, 16 bp, Homo sapiens
tatgattaagtaatga

SEQ ID NO: 2750171 - DNA, 20 bp, Homo sapiens
tatgattaagtaatgataac

SEQ ID NO: 2750172 - DNA, 21 bp, Homo sapiens
tatgattaagtaatgataact

SEQ ID NO: 2750173 - DNA, 21 bp, Homo sapiens
tatgcaataaaattatttgca

SEQ ID NO: 2750174 - DNA, 15 bp, Homo sapiens
tatgcttctgtttta

SEQ ID NO: 2750175 - DNA, 22 bp, Homo sapiens
tatggaaataccaggaccagtt

SEQ ID NO: 2750176 - DNA, 22 bp, Homo sapiens
tatgtcacaaagagctgacagt

SEQ ID NO: 2750177 - DNA, 12 bp, Homo sapiens
tatgtggaagtg

SEQ ID NO: 2750178 - DNA, 18 bp, Homo sapiens
tatgtgggggtctgtgtg

SEQ ID NO: 2750179 - DNA, 19 bp, Homo sapiens
tatgtgggggtctgtgtgt

SEQ ID NO: 2750180 - DNA, 20 bp, Homo sapiens
tatgtgggggtctgtgtgtt

SEQ ID NO: 2750181 - DNA, 12 bp, Homo sapiens
tatgttaaaact

SEQ ID NO: 2750182 - DNA, 14 bp, Homo sapiens
tatgttcttataga

SEQ ID NO: 2750183 - DNA, 13 bp, Homo sapiens
tattaaagaatgc

SEQ ID NO: 2750184 - DNA, 21 bp, Homo sapiens
tattaaagaatgctgcaactt

SEQ ID NO: 2750185 - DNA, 16 bp, Homo sapiens
tattacatgtaaagct

SEQ ID NO: 2750186 - DNA, 17 bp, Homo sapiens
tattacatgtaaagctg

SEQ ID NO: 2750187 - DNA, 14 bp, Homo sapiens
tattacttggcaaa

SEQ ID NO: 2750188 - DNA, 16 bp, Homo sapiens
tattagttacttgcta

SEQ ID NO: 2750189 - DNA, 18 bp, Homo sapiens
tattagttacttgctata

SEQ ID NO: 2750190 - DNA, 14 bp, Homo sapiens
tattataaatgtta

SEQ ID NO: 2750191 - DNA, 16 bp, Homo sapiens
tattataaatgttagt

SEQ ID NO: 2750192 - DNA, 12 bp, Homo sapiens
tattatagaaat

SEQ ID NO: 2750193 - DNA, 21 bp, Homo sapiens
tattctgggaaatgttttaat

SEQ ID NO: 2750194 - DNA, 18 bp, Homo sapiens
tattcttaaaatgcaata

SEQ ID NO: 2750195 - DNA, 21 bp, Homo sapiens
tattcttaaaatgcaatattt

SEQ ID NO: 2750196 - DNA, 14 bp, Homo sapiens
tattgaatgcctta

SEQ ID NO: 2750197 - DNA, 18 bp, Homo sapiens
tattgatagtttcattta

SEQ ID NO: 2750198 - DNA, 19 bp, Homo sapiens
tattgcatggtgtgaacta

SEQ ID NO: 2750199 - DNA, 16 bp, Homo sapiens
tattgctgcataaatt

SEQ ID NO: 2750200 - DNA, 20 bp, Homo sapiens
tattgctgcataaatttgta

SEQ ID NO: 2750201 - DNA, 20 bp, Homo sapiens
tattgctgctgtgcgtggaa

SEQ ID NO: 2750202 - DNA, 22 bp, Homo sapiens
tattgctgctgtgcgtggaaaa

SEQ ID NO: 2750203 - DNA, 20 bp, Homo sapiens
tattggagggaaatcttggt

SEQ ID NO: 2750204 - DNA, 13 bp, Homo sapiens
tattggtattaaa

SEQ ID NO: 2750205 - DNA, 14 bp, Homo sapiens
tattggtattaaag

SEQ ID NO: 2750206 - DNA, 23 bp, Homo sapiens
tattgtagaaagctaatacaaaa

SEQ ID NO: 2750207 - DNA, 16 bp, Homo sapiens
tattgtattgctgctg

SEQ ID NO: 2750208 - DNA, 18 bp, Homo sapiens
tattgtattgctgctgtg

SEQ ID NO: 2750209 - DNA, 20 bp, Homo sapiens
tatttacttctaatcttaaa

SEQ ID NO: 2750210 - DNA, 13 bp, Homo sapiens
tatttagaaactg

SEQ ID NO: 2750211 - DNA, 14 bp, Homo sapiens
tatttagaaactgg

SEQ ID NO: 2750212 - DNA, 17 bp, Homo sapiens
tatttaggccatttgtt

SEQ ID NO: 2750213 - DNA, 23 bp, Homo sapiens
tatttaggccatttgttacagtt

SEQ ID NO: 2750214 - DNA, 14 bp, Homo sapiens
tatttattactgta

SEQ ID NO: 2750215 - DNA, 16 bp, Homo sapiens
tatttattttaataat

SEQ ID NO: 2750216 - DNA, 14 bp, Homo sapiens
tatttctatgaaat

SEQ ID NO: 2750217 - DNA, 23 bp, Homo sapiens
tatttgaaaattacctttaatgc

SEQ ID NO: 2750218 - DNA, 22 bp, Homo sapiens
tatttgtaaatttatgtgatgg

SEQ ID NO: 2750219 - DNA, 22 bp, Homo sapiens
tattttaataatgtttcaaaca

SEQ ID NO: 2750220 - DNA, 15 bp, Homo sapiens
tattttgaatgtacc

SEQ ID NO: 2750221 - DNA, 16 bp, Homo sapiens
tattttgaatgtacct

SEQ ID NO: 2750222 - DNA, 14 bp, Homo sapiens
tatttttgaattct

SEQ ID NO: 2750223 - DNA, 19 bp, Homo sapiens
tattttttatatctggaat

SEQ ID NO: 2750224 - DNA, 12 bp, Homo sapiens
tcaaaatgcttc

SEQ ID NO: 2750225 - DNA, 12 bp, Homo sapiens
tcaaaatggaaa

SEQ ID NO: 2750226 - DNA, 14 bp, Homo sapiens
tcaaagtagttagt

SEQ ID NO: 2750227 - DNA, 15 bp, Homo sapiens
tcaaagtagttagtt

SEQ ID NO: 2750228 - DNA, 15 bp, Homo sapiens
tcaaatagtatagaa

SEQ ID NO: 2750229 - DNA, 16 bp, Homo sapiens
tcaaatagtatagaaa

SEQ ID NO: 2750230 - DNA, 14 bp, Homo sapiens
tcaaattgtgtgaa

SEQ ID NO: 2750231 - DNA, 15 bp, Homo sapiens
tcaaattgtgtgaaa

SEQ ID NO: 2750232 - DNA, 19 bp, Homo sapiens
tcaactccaaactgactct

SEQ ID NO: 2750233 - DNA, 20 bp, Homo sapiens
tcaagatcctcttgccacat

SEQ ID NO: 2750234 - DNA, 22 bp, Homo sapiens
tcaagatcctcttgccacatct

SEQ ID NO: 2750235 - DNA, 21 bp, Homo sapiens
tcaataaaatccatacatttg

SEQ ID NO: 2750236 - DNA, 16 bp, Homo sapiens
tcaataaatgttgaaa

SEQ ID NO: 2750237 - DNA, 19 bp, Homo sapiens
tcaataaatgttgaaaagt

SEQ ID NO: 2750238 - DNA, 20 bp, Homo sapiens
tcaatagtgtcctatgcaat

SEQ ID NO: 2750239 - DNA, 13 bp, Homo sapiens
actctgtccaact

SEQ ID NO: 2750240 - DNA, 17 bp, Homo sapiens
actctgtccaactctgt

SEQ ID NO: 2750241 - DNA, 22 bp, Homo sapiens
actctgtccaactctgtattta

SEQ ID NO: 2750242 - DNA, 15 bp, Homo sapiens
actcttaagaagact

SEQ ID NO: 2750243 - DNA, 14 bp, Homo sapiens
actgaaagaaacta

SEQ ID NO: 2750244 - DNA, 13 bp, Homo sapiens
actgaactgttac

SEQ ID NO: 2750245 - DNA, 12 bp, Homo sapiens
actgaagaagca

SEQ ID NO: 2750246 - DNA, 17 bp, Homo sapiens
actgactcttaagaaga

SEQ ID NO: 2750247 - DNA, 19 bp, Homo sapiens
actgatatgggtcttgata

SEQ ID NO: 2750248 - DNA, 15 bp, Homo sapiens
actgcaatgtgatct

SEQ ID NO: 2750249 - DNA, 15 bp, Homo sapiens
actgcatcttagttt

SEQ ID NO: 2750250 - DNA, 13 bp, Homo sapiens
actgccttctcaa

SEQ ID NO: 2750251 - DNA, 22 bp, Homo sapiens
actgccttctcaactccaaact

SEQ ID NO: 2750252 - DNA, 21 bp, Homo sapiens
actggataaatttaaaacaca

SEQ ID NO: 2750253 - DNA, 18 bp, Homo sapiens
actgggacaggggagaac

SEQ ID NO: 2750254 - DNA, 17 bp, Homo sapiens
actggtgatataaagaa

SEQ ID NO: 2750255 - DNA, 18 bp, Homo sapiens
actgtaaaaaatgtgtgt

SEQ ID NO: 2750256 - DNA, 19 bp, Homo sapiens
actgtaagaaaatatcact

SEQ ID NO: 2750257 - DNA, 22 bp, Homo sapiens
actgtaagaaaatatcacttgt

SEQ ID NO: 2750258 - DNA, 23 bp, Homo sapiens
actgtgaagttacatgcataaaa

SEQ ID NO: 2750259 - DNA, 13 bp, Homo sapiens
actgtgggtagac

SEQ ID NO: 2750260 - DNA, 15 bp, Homo sapiens
actgtgtaatataaa

SEQ ID NO: 2750261 - DNA, 17 bp, Homo sapiens
actgttaaaactgtacc

SEQ ID NO: 2750262 - DNA, 20 bp, Homo sapiens
actgttaaaactgtaccttt

SEQ ID NO: 2750263 - DNA, 21 bp, Homo sapiens
actgttaaaactgtacctttt

SEQ ID NO: 2750264 - DNA, 19 bp, Homo sapiens
actgtttatggaaatacca

SEQ ID NO: 2750265 - DNA, 19 bp, Homo sapiens
acttaaagttttttatata

SEQ ID NO: 2750266 - DNA, 22 bp, Homo sapiens
acttaaagttttttatatatga

SEQ ID NO: 2750267 - DNA, 23 bp, Homo sapiens
acttaaagttttttatatatgaa

SEQ ID NO: 2750268 - DNA, 15 bp, Homo sapiens
acttaaatatttgaa

SEQ ID NO: 2750269 - DNA, 18 bp, Homo sapiens
acttaaatatttgaaaat

SEQ ID NO: 2750270 - DNA, 21 bp, Homo sapiens
acttaacattcctaaaatgct

SEQ ID NO: 2750271 - DNA, 17 bp, Homo sapiens
acttcaaatccttgaag

SEQ ID NO: 2750272 - DNA, 17 bp, Homo sapiens
acttcagcggtttatat

SEQ ID NO: 2750273 - DNA, 18 bp, Homo sapiens
acttcagcggtttatata

SEQ ID NO: 2750274 - DNA, 22 bp, Homo sapiens
acttcagtgcaagagactttgt

SEQ ID NO: 2750275 - DNA, 21 bp, Homo sapiens
acttgaggccaggactttgag

SEQ ID NO: 2750276 - DNA, 16 bp, Homo sapiens
acttgctataaataga

SEQ ID NO: 2750277 - DNA, 15 bp, Homo sapiens
acttggcaaattctg

SEQ ID NO: 2750278 - DNA, 16 bp, Homo sapiens
acttggcaaattctga

SEQ ID NO: 2750279 - DNA, 20 bp, Homo sapiens
acttggctgtatgtcaaatt

SEQ ID NO: 2750280 - DNA, 15 bp, Homo sapiens
acttgtcaataaaat

SEQ ID NO: 2750281 - DNA, 16 bp, Homo sapiens
acttgtgttttgcaag

SEQ ID NO: 2750282 - DNA, 14 bp, Homo sapiens
actttattttgaat

SEQ ID NO: 2750283 - DNA, 15 bp, Homo sapiens
actttattttgaatg

SEQ ID NO: 2750284 - DNA, 17 bp, Homo sapiens
actttattttgaatgta

SEQ ID NO: 2750285 - DNA, 23 bp, Homo sapiens
actttattttgaatgtacctcta

SEQ ID NO: 2750286 - DNA, 16 bp, Homo sapiens
actttgagaccagcca

SEQ ID NO: 2750287 - DNA, 15 bp, Homo sapiens
actttgtagtgtttg

SEQ ID NO: 2750288 - DNA, 20 bp, Homo sapiens
actttgtagtgtttggtgct

SEQ ID NO: 2750289 - DNA, 22 bp, Homo sapiens
actttgtcacttatttccttat

SEQ ID NO: 2750290 - DNA, 14 bp, Homo sapiens
actttttattgcat

SEQ ID NO: 2750291 - DNA, 15 bp, Homo sapiens
actttttattgcatg

SEQ ID NO: 2750292 - DNA, 13 bp, Homo sapiens
acttttttcaaat

SEQ ID NO: 2750293 - DNA, 22 bp, Homo sapiens
acttttttcaaatattgaatgc

SEQ ID NO: 2750294 - DNA, 14 bp, Homo sapiens
acttttttctttga

SEQ ID NO: 2750295 - DNA, 22 bp, Homo sapiens
agaaaaaaaagaaaaaagtcct

SEQ ID NO: 2750296 - DNA, 19 bp, Homo sapiens
agaaaaaagtccttcagtt

SEQ ID NO: 2750297 - DNA, 12 bp, Homo sapiens
agaaaagcactt

SEQ ID NO: 2750298 - DNA, 18 bp, Homo sapiens
agaaaagcacttaaagtt

SEQ ID NO: 2750299 - DNA, 13 bp, Homo sapiens
agaaaatggaaaa

SEQ ID NO: 2750300 - DNA, 23 bp, Homo sapiens
agaaaatggaaaatatacaagta

SEQ ID NO: 2750301 - DNA, 19 bp, Homo sapiens
agaaaccatgcaaagcaac

SEQ ID NO: 2750302 - DNA, 14 bp, Homo sapiens
agaaactaagattt

SEQ ID NO: 2750303 - DNA, 18 bp, Homo sapiens
agaaactaagatttatct

SEQ ID NO: 2750304 - DNA, 21 bp, Homo sapiens
agaaactggttctgtgttgaa

SEQ ID NO: 2750305 - DNA, 16 bp, Homo sapiens
agaaagctaatacaaa

SEQ ID NO: 2750306 - DNA, 13 bp, Homo sapiens
agaaattgaaagc

SEQ ID NO: 2750307 - DNA, 14 bp, Homo sapiens
agaaattgaaagca

SEQ ID NO: 2750308 - DNA, 21 bp, Homo sapiens
agaaatttaccacaaaagcaa

SEQ ID NO: 2750309 - DNA, 14 bp, Homo sapiens
agaagaactgaaat

SEQ ID NO: 2750310 - DNA, 14 bp, Homo sapiens
agaagaagtgtgtc

SEQ ID NO: 2750311 - DNA, 15 bp, Homo sapiens
agaagagtcaaagta

SEQ ID NO: 2750312 - DNA, 14 bp, Homo sapiens
agaagctccaggta

SEQ ID NO: 2750313 - DNA, 16 bp, Homo sapiens
agaataaaagctgtgg

SEQ ID NO: 2750314 - DNA, 14 bp, Homo sapiens
agaatagaaagaaa

SEQ ID NO: 2750315 - DNA, 16 bp, Homo sapiens
agaatatacacatttt

SEQ ID NO: 2750316 - DNA, 18 bp, Homo sapiens
agaatccaagacaaacta

SEQ ID NO: 2750317 - DNA, 22 bp, Homo sapiens
agaatccaagacaaactaaact

SEQ ID NO: 2750318 - DNA, 13 bp, Homo sapiens
agaatgaaagtag

SEQ ID NO: 2750319 - DNA, 17 bp, Homo sapiens
agaatgctgcaactttt

SEQ ID NO: 2750320 - DNA, 13 bp, Homo sapiens
agaatgtcagtat

SEQ ID NO: 2750321 - DNA, 15 bp, Homo sapiens
agaatgtcagtatgt

SEQ ID NO: 2750322 - DNA, 16 bp, Homo sapiens
agaatgtcagtatgtg

SEQ ID NO: 2750323 - DNA, 23 bp, Homo sapiens
agaatgtgctagagttaaaagtt

SEQ ID NO: 2750324 - DNA, 20 bp, Homo sapiens
agaatgttaccagacttcaa

SEQ ID NO: 2750325 - DNA, 17 bp, Homo sapiens
agaattgccaatcttgt

SEQ ID NO: 2750326 - DNA, 14 bp, Homo sapiens
agacaaactaaact

SEQ ID NO: 2750327 - DNA, 16 bp, Homo sapiens
agacaaactaaacttt

SEQ ID NO: 2750328 - DNA, 21 bp, Homo sapiens
agacaaactgtaaaaaatgtg

SEQ ID NO: 2750329 - DNA, 20 bp, Homo sapiens
agacaagattttttaattgt

SEQ ID NO: 2750330 - DNA, 21 bp, Homo sapiens
agacaagattttttaattgtt

SEQ ID NO: 2750331 - DNA, 15 bp, Homo sapiens
agacacacatgaagt

SEQ ID NO: 2750332 - DNA, 21 bp, Homo sapiens
agacattgtttggatttcctt

SEQ ID NO: 2750333 - DNA, 13 bp, Homo sapiens
agacccagtgagc

SEQ ID NO: 2750334 - DNA, 16 bp, Homo sapiens
agactgaaagaaacta

SEQ ID NO: 2750335 - DNA, 23 bp, Homo sapiens
agactgaaagaaactaagattta

SEQ ID NO: 2750336 - DNA, 21 bp, Homo sapiens
agactgcaatgtgatctatgt

SEQ ID NO: 2750337 - DNA, 17 bp, Homo sapiens
agactgcattatattta

SEQ ID NO: 2750338 - DNA, 14 bp, Homo sapiens
agacttatcaacat

SEQ ID NO: 2750339 - DNA, 21 bp, Homo sapiens
agactttctttctgtaggtgg

SEQ ID NO: 2750340 - DNA, 18 bp, Homo sapiens
agactttgtcacttattt

SEQ ID NO: 2750341 - DNA, 18 bp, Homo sapiens
agagacaaactgtaaaaa

SEQ ID NO: 2750342 - DNA, 22 bp, Homo sapiens
agagacaaactgtaaaaaatgt

SEQ ID NO: 2750343 - DNA, 17 bp, Homo sapiens
agagacacactgaagaa

SEQ ID NO: 2750344 - DNA, 18 bp, Homo sapiens
agagagtcttttaacttt

SEQ ID NO: 2750345 - DNA, 22 bp, Homo sapiens
agagtatctgaagggaattgtt

SEQ ID NO: 2750346 - DNA, 12 bp, Homo sapiens
agagttaaaagt

SEQ ID NO: 2750347 - DNA, 16 bp, Homo sapiens
agagtttagctggaaa

SEQ ID NO: 2750348 - DNA, 20 bp, Homo sapiens
agatcctcttgccacatctt

SEQ ID NO: 2750349 - DNA, 14 bp, Homo sapiens
agatcctggaaatc

SEQ ID NO: 2750350 - DNA, 18 bp, Homo sapiens
agatcttgcagaagttct

SEQ ID NO: 2750351 - DNA, 22 bp, Homo sapiens
agatgtatgtacttcatgctgt

SEQ ID NO: 2750352 - DNA, 19 bp, Homo sapiens
agattctttaaactactga

SEQ ID NO: 2750353 - DNA, 16 bp, Homo sapiens
agatttaccacttgtg

SEQ ID NO: 2750354 - DNA, 14 bp, Homo sapiens
agattttcctgaaa

SEQ ID NO: 2750355 - DNA, 16 bp, Homo sapiens
agatttttaaattgga

SEQ ID NO: 2750356 - DNA, 19 bp, Homo sapiens
agatttttaaattggagaa

SEQ ID NO: 2750357 - DNA, 20 bp, Homo sapiens
agatttttaaattggagaaa

SEQ ID NO: 2750358 - DNA, 23 bp, Homo sapiens
agattttttaattgtttaaaaac

SEQ ID NO: 2750359 - DNA, 17 bp, Homo sapiens
agcaaaacagattcaaa

SEQ ID NO: 2750360 - DNA, 18 bp, Homo sapiens
agcaaaacagattcaaag

SEQ ID NO: 2750361 - DNA, 22 bp, Homo sapiens
agcaaatgcattctatcgttat

SEQ ID NO: 2750362 - DNA, 17 bp, Homo sapiens
agcaatgaattagttgc

SEQ ID NO: 2750363 - DNA, 16 bp, Homo sapiens
agcacaccacaattct

SEQ ID NO: 2750364 - DNA, 11 bp, Homo sapiens
agcacatccac

SEQ ID NO: 2750365 - DNA, 19 bp, Homo sapiens
ataaaagggtcaaacctgt

SEQ ID NO: 2750366 - DNA, 20 bp, Homo sapiens
ataaaagggtcaaacctgta

SEQ ID NO: 2750367 - DNA, 18 bp, Homo sapiens
ataaaatccatacatttg

SEQ ID NO: 2750368 - DNA, 17 bp, Homo sapiens
ataaaattggattacag

SEQ ID NO: 2750369 - DNA, 16 bp, Homo sapiens
ataaaatttaaaaaac

SEQ ID NO: 2750370 - DNA, 14 bp, Homo sapiens
ataaacagacaaat

SEQ ID NO: 2750371 - DNA, 13 bp, Homo sapiens
ataaatacaaatc

SEQ ID NO: 2750372 - DNA, 17 bp, Homo sapiens
ataaatacaaatctgta

SEQ ID NO: 2750373 - DNA, 18 bp, Homo sapiens
ataaatacaaatctgtat

SEQ ID NO: 2750374 - DNA, 21 bp, Homo sapiens
ataaatacaaatctgtataaa

SEQ ID NO: 2750375 - DNA, 17 bp, Homo sapiens
ataaatgtctattatta

SEQ ID NO: 2750376 - DNA, 15 bp, Homo sapiens
ataaattaatattgt

SEQ ID NO: 2750377 - DNA, 17 bp, Homo sapiens
ataaattaatattgtat

SEQ ID NO: 2750378 - DNA, 19 bp, Homo sapiens
ataaatttaaaacacagta

SEQ ID NO: 2750379 - DNA, 20 bp, Homo sapiens
ataaatttaaaacacagtat

SEQ ID NO: 2750380 - DNA, 12 bp, Homo sapiens
ataaatttgtaa

SEQ ID NO: 2750381 - DNA, 20 bp, Homo sapiens
ataaatttgtaatatatcct

SEQ ID NO: 2750382 - DNA, 14 bp, Homo sapiens
ataaatttttgtct

SEQ ID NO: 2750383 - DNA, 19 bp, Homo sapiens
ataacaatgctgtatttta

SEQ ID NO: 2750384 - DNA, 21 bp, Homo sapiens
ataacaatgctgtattttaaa

SEQ ID NO: 2750385 - DNA, 12 bp, Homo sapiens
ataacattctga

SEQ ID NO: 2750386 - DNA, 19 bp, Homo sapiens
ataactggtttgactctgt

SEQ ID NO: 2750387 - DNA, 21 bp, Homo sapiens
ataacttcagtgcaagagact

SEQ ID NO: 2750388 - DNA, 14 bp, Homo sapiens
ataagcttctcaat

SEQ ID NO: 2750389 - DNA, 15 bp, Homo sapiens
ataataagacttttc

SEQ ID NO: 2750390 - DNA, 18 bp, Homo sapiens
ataatcacaacccttcag

SEQ ID NO: 2750391 - DNA, 18 bp, Homo sapiens
ataatctccaactttatt

SEQ ID NO: 2750392 - DNA, 18 bp, Homo sapiens
ataatgtagttttgttta

SEQ ID NO: 2750393 - DNA, 16 bp, Homo sapiens
ataatgttggtgtgga

SEQ ID NO: 2750394 - DNA, 18 bp, Homo sapiens
ataatgtttcaaacatat

SEQ ID NO: 2750395 - DNA, 17 bp, Homo sapiens
ataattccttaaaattt

SEQ ID NO: 2750396 - DNA, 22 bp, Homo sapiens
ataattccttaaaattttcatt

SEQ ID NO: 2750397 - DNA, 16 bp, Homo sapiens
ataattgagactgaaa

SEQ ID NO: 2750398 - DNA, 12 bp, Homo sapiens
atacaaatctgt

SEQ ID NO: 2750399 - DNA, 21 bp, Homo sapiens
atacaaatctgtataaatgtc

SEQ ID NO: 2750400 - DNA, 16 bp, Homo sapiens
atacaagtaaattctg

SEQ ID NO: 2750401 - DNA, 15 bp, Homo sapiens
atacacattttgtaa

SEQ ID NO: 2750402 - DNA, 23 bp, Homo sapiens
atacacattttgtaaatctgtac

SEQ ID NO: 2750403 - DNA, 22 bp, Homo sapiens
ataccacaggaaccacaagact

SEQ ID NO: 2750404 - DNA, 13 bp, Homo sapiens
atactgattttca

SEQ ID NO: 2750405 - DNA, 19 bp, Homo sapiens
atagaaaatggaaaatata

SEQ ID NO: 2750406 - DNA, 13 bp, Homo sapiens
atagaaagaaagt

SEQ ID NO: 2750407 - DNA, 14 bp, Homo sapiens
atagaaattctgaa

SEQ ID NO: 2750408 - DNA, 19 bp, Homo sapiens
atagaaattctgaattttg

SEQ ID NO: 2750409 - DNA, 11 bp, Homo sapiens
atagaataaaa

SEQ ID NO: 2750410 - DNA, 16 bp, Homo sapiens
atagaataaaagctgt

SEQ ID NO: 2750411 - DNA, 11 bp, Homo sapiens
atagatgtgtg

SEQ ID NO: 2750412 - DNA, 12 bp, Homo sapiens
atagatgtgtgg

SEQ ID NO: 2750413 - DNA, 13 bp, Homo sapiens
atagatgtgtgga

SEQ ID NO: 2750414 - DNA, 20 bp, Homo sapiens
atagatttagtctgttatat

SEQ ID NO: 2750415 - DNA, 12 bp, Homo sapiens
atagtatagaaa

SEQ ID NO: 2750416 - DNA, 20 bp, Homo sapiens
atagtgtcctatgcaataaa

SEQ ID NO: 2750417 - DNA, 16 bp, Homo sapiens
atagttctgttaaata

SEQ ID NO: 2750418 - DNA, 14 bp, Homo sapiens
atagttgaaagtaa

SEQ ID NO: 2750419 - DNA, 15 bp, Homo sapiens
atagttgaaagtaaa

SEQ ID NO: 2750420 - DNA, 12 bp, Homo sapiens
atagttgctttt

SEQ ID NO: 2750421 - DNA, 15 bp, Homo sapiens
atataacaatgctgt

SEQ ID NO: 2750422 - DNA, 13 bp, Homo sapiens
atatacaagtaaa

SEQ ID NO: 2750423 - DNA, 15 bp, Homo sapiens
atatacacattttgt

SEQ ID NO: 2750424 - DNA, 18 bp, Homo sapiens
atatacacattttgtaaa

SEQ ID NO: 2750425 - DNA, 22 bp, Homo sapiens
atatacacattttgtaaatctg

SEQ ID NO: 2750426 - DNA, 16 bp, Homo sapiens
atatagttgaaagtaa

SEQ ID NO: 2750427 - DNA, 20 bp, Homo sapiens
atatagttgaaagtaaaaaa

SEQ ID NO: 2750428 - DNA, 20 bp, Homo sapiens
atatatagctggcaagaatg

SEQ ID NO: 2750429 - DNA, 18 bp, Homo sapiens
atatatagttagctttat

SEQ ID NO: 2750430 - DNA, 18 bp, Homo sapiens
atatcacttgtcaataaa

SEQ ID NO: 2750431 - DNA, 13 bp, Homo sapiens
atatcatgctaaa

SEQ ID NO: 2750432 - DNA, 19 bp, Homo sapiens
atatcattctgtgattaaa

SEQ ID NO: 2750433 - DNA, 21 bp, Homo sapiens
atatcccagctttaaaaagaa

SEQ ID NO: 2750434 - DNA, 14 bp, Homo sapiens
atatcctgtttgta

SEQ ID NO: 2750435 - DNA, 16 bp, Homo sapiens
atatcctgtttgtatt

SEQ ID NO: 2750436 - DNA, 21 bp, Homo sapiens
atatctacagcttctattcat

SEQ ID NO: 2750437 - DNA, 14 bp, Homo sapiens
atatctatattcta

SEQ ID NO: 2750438 - DNA, 22 bp, Homo sapiens
atatctatattctaaagagcta

SEQ ID NO: 2750439 - DNA, 18 bp, Homo sapiens
atatctgtttattctggg

SEQ ID NO: 2750440 - DNA, 23 bp, Homo sapiens
atatgaatattacatgtaaagct

SEQ ID NO: 2750441 - DNA, 22 bp, Homo sapiens
atatgcttctgttttataattt

SEQ ID NO: 2750442 - DNA, 23 bp, Homo sapiens
atatgcttctgttttataatttt

SEQ ID NO: 2750443 - DNA, 19 bp, Homo sapiens
atattacatgtaaagctgt

SEQ ID NO: 2750444 - DNA, 23 bp, Homo sapiens
atattacatgtaaagctgttaaa

SEQ ID NO: 2750445 - DNA, 17 bp, Homo sapiens
atattacctaatgaaag

SEQ ID NO: 2750446 - DNA, 21 bp, Homo sapiens
atattacctaatgaaagtgat

SEQ ID NO: 2750447 - DNA, 13 bp, Homo sapiens
atattatgttaaa

SEQ ID NO: 2750448 - DNA, 16 bp, Homo sapiens
atattgaatgccttat

SEQ ID NO: 2750449 - DNA, 17 bp, Homo sapiens
atattgtattgctgctg

SEQ ID NO: 2750450 - DNA, 20 bp, Homo sapiens
atattgtattgctgctgtgc

SEQ ID NO: 2750451 - DNA, 23 bp, Homo sapiens
atatttcagataatcacaataca

SEQ ID NO: 2750452 - DNA, 16 bp, Homo sapiens
atatttccttttgtaa

SEQ ID NO: 2750453 - DNA, 21 bp, Homo sapiens
atatttccttttgtaaagtaa

SEQ ID NO: 2750454 - DNA, 19 bp, Homo sapiens
atatttgaaatattgactt

SEQ ID NO: 2750455 - DNA, 12 bp, Homo sapiens
atcaaaaataat

SEQ ID NO: 2750456 - DNA, 20 bp, Homo sapiens
atcaaggaagtcttcaaatt

SEQ ID NO: 2750457 - DNA, 21 bp, Homo sapiens
atcaagggtacactgccttct

SEQ ID NO: 2750458 - DNA, 23 bp, Homo sapiens
atcaatagtgtcctatgcaataa

SEQ ID NO: 2750459 - DNA, 22 bp, Homo sapiens
atcacttgtcaataaaatccat

SEQ ID NO: 2750460 - DNA, 21 bp, Homo sapiens
atcagagtatctgaagggaat

SEQ ID NO: 2750461 - DNA, 14 bp, Homo sapiens
atcaggagcctgct

SEQ ID NO: 2750462 - DNA, 19 bp, Homo sapiens
atcaggagcctgctaagga

SEQ ID NO: 2750463 - DNA, 18 bp, Homo sapiens
atcagtggaactcaatat

SEQ ID NO: 2750464 - DNA, 21 bp, Homo sapiens
atcatgctaaaattctataga

SEQ ID NO: 2750465 - DNA, 15 bp, Homo sapiens
atcattgttgtgtat

SEQ ID NO: 2750466 - DNA, 17 bp, Homo sapiens
atccaagacaaactaaa

SEQ ID NO: 2750467 - DNA, 20 bp, Homo sapiens
atccaagacaaactaaactt

SEQ ID NO: 2750468 - DNA, 22 bp, Homo sapiens
atccaataaaaatcaggagcct

SEQ ID NO: 2750469 - DNA, 15 bp, Homo sapiens
atccaccaaactcct

SEQ ID NO: 2750470 - DNA, 20 bp, Homo sapiens
atccagcgtgcaccccgccg

SEQ ID NO: 2750471 - DNA, 13 bp, Homo sapiens
atccataaaattg

SEQ ID NO: 2750472 - DNA, 20 bp, Homo sapiens
atcccagctttaaaaagaaa

SEQ ID NO: 2750473 - DNA, 22 bp, Homo sapiens
atccccctccaaagtcttgata

SEQ ID NO: 2750474 - DNA, 15 bp, Homo sapiens
atcctcttgccacat

SEQ ID NO: 2750475 - DNA, 17 bp, Homo sapiens
atcctcttgccacatct

SEQ ID NO: 2750476 - DNA, 15 bp, Homo sapiens
atcctgtttgtattt

SEQ ID NO: 2750477 - DNA, 17 bp, Homo sapiens
atcctgtttgtattttt

SEQ ID NO: 2750478 - DNA, 22 bp, Homo sapiens
atcctgtttgtatttttttcca

SEQ ID NO: 2750479 - DNA, 19 bp, Homo sapiens
atcgccttgaacaaaaagt

SEQ ID NO: 2750480 - DNA, 13 bp, Homo sapiens
atcgcttcttttt

SEQ ID NO: 2750481 - DNA, 12 bp, Homo sapiens
atcgttattata

SEQ ID NO: 2750482 - DNA, 18 bp, Homo sapiens
atcgttattataaatgtt

SEQ ID NO: 2750483 - DNA, 15 bp, Homo sapiens
atctatattctaaag

SEQ ID NO: 2750484 - DNA, 16 bp, Homo sapiens
atctatattctaaaga

SEQ ID NO: 2750485 - DNA, 20 bp, Homo sapiens
atctatgtttcatcttgttt

SEQ ID NO: 2750486 - DNA, 14 bp, Homo sapiens
atctcatttccaag

SEQ ID NO: 2750487 - DNA, 22 bp, Homo sapiens
atctccaactttattttgaatg

SEQ ID NO: 2750488 - DNA, 19 bp, Homo sapiens
atctccagcttactataaa

SEQ ID NO: 2750489 - DNA, 17 bp, Homo sapiens
atctcctgagttgtata

SEQ ID NO: 2750490 - DNA, 16 bp, Homo sapiens
atctgaagggaattgt

SEQ ID NO: 2750491 - DNA, 23 bp, Homo sapiens
cattctatcgttattataaatgt

SEQ ID NO: 2750492 - DNA, 19 bp, Homo sapiens
cattctgacacatatcatt

SEQ ID NO: 2750493 - DNA, 20 bp, Homo sapiens
cattcttatattttatcaag

SEQ ID NO: 2750494 - DNA, 16 bp, Homo sapiens
cattgcctgactaaaa

SEQ ID NO: 2750495 - DNA, 21 bp, Homo sapiens
cattgcctgactaaaatgttt

SEQ ID NO: 2750496 - DNA, 18 bp, Homo sapiens
cattggtttgagaaaggc

SEQ ID NO: 2750497 - DNA, 16 bp, Homo sapiens
cattgttgcttgttgg

SEQ ID NO: 2750498 - DNA, 17 bp, Homo sapiens
cattgttggcgctgagg

SEQ ID NO: 2750499 - DNA, 15 bp, Homo sapiens
cattgttgtgtataa

SEQ ID NO: 2750500 - DNA, 18 bp, Homo sapiens
cattgttgtgtataattt

SEQ ID NO: 2750501 - DNA, 20 bp, Homo sapiens
cattgttgtgtataatttac

SEQ ID NO: 2750502 - DNA, 16 bp, Homo sapiens
catttaaatatctgaa

SEQ ID NO: 2750503 - DNA, 17 bp, Homo sapiens
catttacaatttcaaaa

SEQ ID NO: 2750504 - DNA, 19 bp, Homo sapiens
catttacaatttcaaaaga

SEQ ID NO: 2750505 - DNA, 23 bp, Homo sapiens
catttatgatttctccagaaatt

SEQ ID NO: 2750506 - DNA, 14 bp, Homo sapiens
catttcaaaatgct

SEQ ID NO: 2750507 - DNA, 13 bp, Homo sapiens
catttgctcatgg

SEQ ID NO: 2750508 - DNA, 16 bp, Homo sapiens
catttgctcatggaat

SEQ ID NO: 2750509 - DNA, 18 bp, Homo sapiens
catttgctcatggaattg

SEQ ID NO: 2750510 - DNA, 17 bp, Homo sapiens
catttggaacagtgaca

SEQ ID NO: 2750511 - DNA, 19 bp, Homo sapiens
catttgtataaaataattt

SEQ ID NO: 2750512 - DNA, 20 bp, Homo sapiens
catttgtataaaataatttt

SEQ ID NO: 2750513 - DNA, 21 bp, Homo sapiens
catttgttacagtttcttcat

SEQ ID NO: 2750514 - DNA, 22 bp, Homo sapiens
catttgttacagtttcttcatg

SEQ ID NO: 2750515 - DNA, 17 bp, Homo sapiens
cattttaagtgtttaaa

SEQ ID NO: 2750516 - DNA, 22 bp, Homo sapiens
cattttaagtgtttaaaagcaa

SEQ ID NO: 2750517 - DNA, 14 bp, Homo sapiens
ccaaacaccacttt

SEQ ID NO: 2750518 - DNA, 23 bp, Homo sapiens
ccaacatcggtgtggactacagg

SEQ ID NO: 2750519 - DNA, 21 bp, Homo sapiens
ccaactccagaaagtgacaag

SEQ ID NO: 2750520 - DNA, 17 bp, Homo sapiens
ccaagcatttagatgta

SEQ ID NO: 2750521 - DNA, 12 bp, Homo sapiens
ccaagtgtataa

SEQ ID NO: 2750522 - DNA, 22 bp, Homo sapiens
ccaataaaaatcaggagcctgc

SEQ ID NO: 2750523 - DNA, 14 bp, Homo sapiens
ccaatcttgtttta

SEQ ID NO: 2750524 - DNA, 14 bp, Homo sapiens
ccacatcttgaaaa

SEQ ID NO: 2750525 - DNA, 17 bp, Homo sapiens
ccacatcttgaaaatgc

SEQ ID NO: 2750526 - DNA, 15 bp, Homo sapiens
ccaccatccaataaa

SEQ ID NO: 2750527 - DNA, 19 bp, Homo sapiens
ccaccggcactcatgacgg

SEQ ID NO: 2750528 - DNA, 22 bp, Homo sapiens
ccaccgggcatgtctgcctgga

SEQ ID NO: 2750529 - DNA, 21 bp, Homo sapiens
ccacgcccttggagccttcca

SEQ ID NO: 2750530 - DNA, 18 bp, Homo sapiens
ccactggtaacatgtgac

SEQ ID NO: 2750531 - DNA, 21 bp, Homo sapiens
ccagcaaaacagattcaaagc

SEQ ID NO: 2750532 - DNA, 20 bp, Homo sapiens
ccagcgtgcaccccgccgga

SEQ ID NO: 2750533 - DNA, 21 bp, Homo sapiens
ccaggaactcgcacctgtgct

SEQ ID NO: 2750534 - DNA, 22 bp, Homo sapiens
ccaggaactcgcacctgtgctg

SEQ ID NO: 2750535 - DNA, 13 bp, Homo sapiens
ccaggaccagttt

SEQ ID NO: 2750536 - DNA, 19 bp, Homo sapiens
ccagtttctgtaaggtctt

SEQ ID NO: 2750537 - DNA, 13 bp, Homo sapiens
ccatacatttgtg

SEQ ID NO: 2750538 - DNA, 14 bp, Homo sapiens
ccatacatttgtgt

SEQ ID NO: 2750539 - DNA, 16 bp, Homo sapiens
ccatagtcaaagagag

SEQ ID NO: 2750540 - DNA, 21 bp, Homo sapiens
ccatcagagatgggaaaacca

SEQ ID NO: 2750541 - DNA, 20 bp, Homo sapiens
ccatcatgtttacagaggac

SEQ ID NO: 2750542 - DNA, 22 bp, Homo sapiens
ccatgcaaagcaacgactactt

SEQ ID NO: 2750543 - DNA, 13 bp, Homo sapiens
ccatggcctgctg

SEQ ID NO: 2750544 - DNA, 22 bp, Homo sapiens
ccatttttcagtagcaggacct

SEQ ID NO: 2750545 - DNA, 17 bp, Homo sapiens
cccaaaaagatgcttta

SEQ ID NO: 2750546 - DNA, 20 bp, Homo sapiens
cccaagagtttcttctcata

SEQ ID NO: 2750547 - DNA, 18 bp, Homo sapiens
cccacgcccttggagcct

SEQ ID NO: 2750548 - DNA, 19 bp, Homo sapiens
cccacgcccttggagcctt

SEQ ID NO: 2750549 - DNA, 18 bp, Homo sapiens
cccagaatgcctcctgca

SEQ ID NO: 2750550 - DNA, 17 bp, Homo sapiens
cccagctttaaaaagaa

SEQ ID NO: 2750551 - DNA, 19 bp, Homo sapiens
cccagctttaaaaagaaaa

SEQ ID NO: 2750552 - DNA, 22 bp, Homo sapiens
cccaggaactcgcacctgtgct

SEQ ID NO: 2750553 - DNA, 23 bp, Homo sapiens
cccaggaactcgcacctgtgctg

SEQ ID NO: 2750554 - DNA, 21 bp, Homo sapiens
cccattgttggcgctgaggtg

SEQ ID NO: 2750555 - DNA, 12 bp, Homo sapiens
cccccacccctg

SEQ ID NO: 2750556 - DNA, 13 bp, Homo sapiens
cccctccctctgt

SEQ ID NO: 2750557 - DNA, 19 bp, Homo sapiens
cccctgcccacgcccttgg

SEQ ID NO: 2750558 - DNA, 18 bp, Homo sapiens
cccctggctaccttgtgg

SEQ ID NO: 2750559 - DNA, 23 bp, Homo sapiens
ccctctgtcttcaggctctgccc

SEQ ID NO: 2750560 - DNA, 18 bp, Homo sapiens
ccctgcccacgcccttgg

SEQ ID NO: 2750561 - DNA, 20 bp, Homo sapiens
ccctgcccacgcccttggag

SEQ ID NO: 2750562 - DNA, 22 bp, Homo sapiens
ccctgttgagtatttgctgttt

SEQ ID NO: 2750563 - DNA, 17 bp, Homo sapiens
cccttctttccacagaa

SEQ ID NO: 2750564 - DNA, 15 bp, Homo sapiens
cccttggagccttcc

SEQ ID NO: 2750565 - DNA, 18 bp, Homo sapiens
cccttggagccttccacc

SEQ ID NO: 2750566 - DNA, 21 bp, Homo sapiens
ccgagcccctgcccacgccct

SEQ ID NO: 2750567 - DNA, 14 bp, Homo sapiens
ccgcccgagcccct

SEQ ID NO: 2750568 - DNA, 15 bp, Homo sapiens
ccgcccgagcccctg

SEQ ID NO: 2750569 - DNA, 17 bp, Homo sapiens
ccgccggaggaaggtcc

SEQ ID NO: 2750570 - DNA, 15 bp, Homo sapiens
ccgcctgtcaataaa

SEQ ID NO: 2750571 - DNA, 18 bp, Homo sapiens
ccgcctgtcaataaatgt

SEQ ID NO: 2750572 - DNA, 21 bp, Homo sapiens
ccggcactcatgacggcctgc

SEQ ID NO: 2750573 - DNA, 22 bp, Homo sapiens
ccgggtcatctgtacctctgcc

SEQ ID NO: 2750574 - DNA, 23 bp, Homo sapiens
ccgttacatctgtgcagggctgg

SEQ ID NO: 2750575 - DNA, 12 bp, Homo sapiens
cctaatgaaagt

SEQ ID NO: 2750576 - DNA, 16 bp, Homo sapiens
cctaattttttaaaga

SEQ ID NO: 2750577 - DNA, 21 bp, Homo sapiens
cctaattttttaaagaatcca

SEQ ID NO: 2750578 - DNA, 15 bp, Homo sapiens
cctaggaggactggg

SEQ ID NO: 2750579 - DNA, 15 bp, Homo sapiens
cctatatgagaagaa

SEQ ID NO: 2750580 - DNA, 13 bp, Homo sapiens
cctatcttgtgaa

SEQ ID NO: 2750581 - DNA, 15 bp, Homo sapiens
cctatcttgtgaagt

SEQ ID NO: 2750582 - DNA, 14 bp, Homo sapiens
cctattttgaaagg

SEQ ID NO: 2750583 - DNA, 19 bp, Homo sapiens
cctcaggaaagaatagaaa

SEQ ID NO: 2750584 - DNA, 18 bp, Homo sapiens
cctctcattccagaggaa

SEQ ID NO: 2750585 - DNA, 23 bp, Homo sapiens
cctcttagatgcagttctgaaga

SEQ ID NO: 2750586 - DNA, 20 bp, Homo sapiens
cctctttgtgtttttgttgt

SEQ ID NO: 2750587 - DNA, 22 bp, Homo sapiens
cctctttgtgtttttgttgttg

SEQ ID NO: 2750588 - DNA, 19 bp, Homo sapiens
cctgaagagaagggcaggg

SEQ ID NO: 2750589 - DNA, 15 bp, Homo sapiens
cctgagaatgttacc

SEQ ID NO: 2750590 - DNA, 22 bp, Homo sapiens
cctgagaatgttaccagacttc

SEQ ID NO: 2750591 - DNA, 15 bp, Homo sapiens
cctgagttgtataaa

SEQ ID NO: 2750592 - DNA, 17 bp, Homo sapiens
cctgcatctttcatagt

SEQ ID NO: 2750593 - DNA, 22 bp, Homo sapiens
cctgcatctttcatagttctgt

SEQ ID NO: 2750594 - DNA, 18 bp, Homo sapiens
cctgccatcatgtttaca

SEQ ID NO: 2750595 - DNA, 14 bp, Homo sapiens
cctgcccagcctgg

SEQ ID NO: 2750596 - DNA, 14 bp, Homo sapiens
cctgctaaggaaca

SEQ ID NO: 2750597 - DNA, 20 bp, Homo sapiens
cctgctaaggaacaatgccg

SEQ ID NO: 2750598 - DNA, 15 bp, Homo sapiens
cctggagtgctgtgc

SEQ ID NO: 2750599 - DNA, 16 bp, Homo sapiens
cctggagtgctgtgct

SEQ ID NO: 2750600 - DNA, 17 bp, Homo sapiens
cctggagtgctgtgctg

SEQ ID NO: 2750601 - DNA, 17 bp, Homo sapiens
cctggctaccttgtggg

SEQ ID NO: 2750602 - DNA, 22 bp, Homo sapiens
cctggctaccttgtgggaataa

SEQ ID NO: 2750603 - DNA, 21 bp, Homo sapiens
cctgggtttcttttttctttc

SEQ ID NO: 2750604 - DNA, 15 bp, Homo sapiens
cctgtagatgcagaa

SEQ ID NO: 2750605 - DNA, 19 bp, Homo sapiens
cctgtagatgcagaaaaag

SEQ ID NO: 2750606 - DNA, 23 bp, Homo sapiens
cctgtagatgcagaaaaagaaaa

SEQ ID NO: 2750607 - DNA, 18 bp, Homo sapiens
cctgtagtcccagcactt

SEQ ID NO: 2750608 - DNA, 16 bp, Homo sapiens
cctgtcaataaatgtt

SEQ ID NO: 2750609 - DNA, 21 bp, Homo sapiens
cctgtcaataaatgttgaaaa

SEQ ID NO: 2750610 - DNA, 23 bp, Homo sapiens
cctgtcaataaatgttgaaaagt

SEQ ID NO: 2750611 - DNA, 14 bp, Homo sapiens
cctgtcactactgg

SEQ ID NO: 2750612 - DNA, 22 bp, Homo sapiens
cctgtcttcggccgagctggtt

SEQ ID NO: 2750613 - DNA, 24 bp, Homo sapiens
cctgtgtagtctctctagtagtta

SEQ ID NO: 2750614 - DNA, 13 bp, Homo sapiens
cctgtttgtattt

SEQ ID NO: 2750615 - DNA, 17 bp, Homo sapiens
gctgttgtgcagtgtgc

SEQ ID NO: 2750616 - DNA, 22 bp, Homo sapiens
gcttcatcggggtggtgcaggc

SEQ ID NO: 2750617 - DNA, 17 bp, Homo sapiens
gcttccagatgtctaaa

SEQ ID NO: 2750618 - DNA, 19 bp, Homo sapiens
gcttctgttttataatttt

SEQ ID NO: 2750619 - DNA, 15 bp, Homo sapiens
gcttgactttggctg

SEQ ID NO: 2750620 - DNA, 15 bp, Homo sapiens
gcttggtagcacttt

SEQ ID NO: 2750621 - DNA, 16 bp, Homo sapiens
gcttggtgctggttta

SEQ ID NO: 2750622 - DNA, 19 bp, Homo sapiens
gctttcctcatcaggccat

SEQ ID NO: 2750623 - DNA, 13 bp, Homo sapiens
gctttctgaaatt

SEQ ID NO: 2750624 - DNA, 15 bp, Homo sapiens
gctttgttaaaaaaa

SEQ ID NO: 2750625 - DNA, 14 bp, Homo sapiens
gcttttcagaagaa

SEQ ID NO: 2750626 - DNA, 22 bp, Homo sapiens
gcttttcctcaaagggagagag

SEQ ID NO: 2750627 - DNA, 19 bp, Homo sapiens
ggaaaaagacgatgtttat

SEQ ID NO: 2750628 - DNA, 13 bp, Homo sapiens
ggaaaaagccata

SEQ ID NO: 2750629 - DNA, 22 bp, Homo sapiens
ggaaaaagccatatcatgctaa

SEQ ID NO: 2750630 - DNA, 11 bp, Homo sapiens
ggaaaaagttg

SEQ ID NO: 2750631 - DNA, 23 bp, Homo sapiens
ggaaaagtaagggaataaatttt

SEQ ID NO: 2750632 - DNA, 22 bp, Homo sapiens
ggaaaatatacaagtaaattct

SEQ ID NO: 2750633 - DNA, 20 bp, Homo sapiens
ggaaaattaattctaaactt

SEQ ID NO: 2750634 - DNA, 16 bp, Homo sapiens
ggaaataccaggacca

SEQ ID NO: 2750635 - DNA, 18 bp, Homo sapiens
ggaacagtgacaataaat

SEQ ID NO: 2750636 - DNA, 14 bp, Homo sapiens
ggaagctgaattat

SEQ ID NO: 2750637 - DNA, 20 bp, Homo sapiens
ggaaggtcccatggcctgct

SEQ ID NO: 2750638 - DNA, 21 bp, Homo sapiens
ggaaggtcccatggcctgctg

SEQ ID NO: 2750639 - DNA, 18 bp, Homo sapiens
ggaataaactagagaagg

SEQ ID NO: 2750640 - DNA, 23 bp, Homo sapiens
ggaattgtttttataaaaacatt

SEQ ID NO: 2750641 - DNA, 21 bp, Homo sapiens
ggacagtcacctcatggaatt

SEQ ID NO: 2750642 - DNA, 18 bp, Homo sapiens
ggacgtggcccctgccca

SEQ ID NO: 2750643 - DNA, 17 bp, Homo sapiens
ggactacaggacaaggg

SEQ ID NO: 2750644 - DNA, 20 bp, Homo sapiens
ggagaaaagcacttaaagtt

SEQ ID NO: 2750645 - DNA, 22 bp, Homo sapiens
ggagaatgtcagtatgtggaag

SEQ ID NO: 2750646 - DNA, 10 bp, Homo sapiens
ggagattttt

SEQ ID NO: 2750647 - DNA, 20 bp, Homo sapiens
ggaggttgaggctgcagtga

SEQ ID NO: 2750648 - DNA, 14 bp, Homo sapiens
ggataactaaaatt

SEQ ID NO: 2750649 - DNA, 16 bp, Homo sapiens
ggataactaaaattct

SEQ ID NO: 2750650 - DNA, 13 bp, Homo sapiens
ggatagatgtgtg

SEQ ID NO: 2750651 - DNA, 17 bp, Homo sapiens
ggatggaatgatgggtc

SEQ ID NO: 2750652 - DNA, 13 bp, Homo sapiens
ggattctgcagaa

SEQ ID NO: 2750653 - DNA, 12 bp, Homo sapiens
ggcaaattctga

SEQ ID NO: 2750654 - DNA, 22 bp, Homo sapiens
ggcactcatgacggcctgcctg

SEQ ID NO: 2750655 - DNA, 19 bp, Homo sapiens
ggcaggacactgcagaaca

SEQ ID NO: 2750656 - DNA, 15 bp, Homo sapiens
ggcagggctgaggcc

SEQ ID NO: 2750657 - DNA, 18 bp, Homo sapiens
ggccccgcccgagcccct

SEQ ID NO: 2750658 - DNA, 21 bp, Homo sapiens
ggccccgcccgagcccctgcc

SEQ ID NO: 2750659 - DNA, 22 bp, Homo sapiens
ggccccgcccgagcccctgccc

SEQ ID NO: 2750660 - DNA, 14 bp, Homo sapiens
ggccgagaggacag

SEQ ID NO: 2750661 - DNA, 17 bp, Homo sapiens
ggccgaggtcccattgt

SEQ ID NO: 2750662 - DNA, 23 bp, Homo sapiens
ggcctaattttttaaagaatcca

SEQ ID NO: 2750663 - DNA, 11 bp, Homo sapiens
ggcctgcctgc

SEQ ID NO: 2750664 - DNA, 23 bp, Homo sapiens
ggctggaacactgtactgaggaa

SEQ ID NO: 2750665 - DNA, 16 bp, Homo sapiens
ggcttacaggcatgga

SEQ ID NO: 2750666 - DNA, 18 bp, Homo sapiens
ggcttcttttctttgtat

SEQ ID NO: 2750667 - DNA, 15 bp, Homo sapiens
ggcttgactttggct

SEQ ID NO: 2750668 - DNA, 17 bp, Homo sapiens
ggcttgactttggctga

SEQ ID NO: 2750669 - DNA, 17 bp, Homo sapiens
ggcttggctcggcgccc

SEQ ID NO: 2750670 - DNA, 18 bp, Homo sapiens
ggctttgccattaaaatg

SEQ ID NO: 2750671 - DNA, 19 bp, Homo sapiens
gggccgttacatctgtgca

SEQ ID NO: 2750672 - DNA, 16 bp, Homo sapiens
gggcctgcccagacaa

SEQ ID NO: 2750673 - DNA, 20 bp, Homo sapiens
gggcttggctcggcgccccc

SEQ ID NO: 2750674 - DNA, 21 bp, Homo sapiens
gggtcatctgtacctctgcct

SEQ ID NO: 2750675 - DNA, 18 bp, Homo sapiens
ggtaggaactgctgggct

SEQ ID NO: 2750676 - DNA, 12 bp, Homo sapiens
ggtattaaagaa

SEQ ID NO: 2750677 - DNA, 23 bp, Homo sapiens
ggtattggagggaaaaaacaagc

SEQ ID NO: 2750678 - DNA, 22 bp, Homo sapiens
ggtcccattgttggcgctgagg

SEQ ID NO: 2750679 - DNA, 11 bp, Homo sapiens
ggtctgtgtgt

SEQ ID NO: 2750680 - DNA, 20 bp, Homo sapiens
ggtctgtgtgtgtgtatgtg

SEQ ID NO: 2750681 - DNA, 15 bp, Homo sapiens
ggtggcagaatagct

SEQ ID NO: 2750682 - DNA, 14 bp, Homo sapiens
ggtgtctggcctga

SEQ ID NO: 2750683 - DNA, 16 bp, Homo sapiens
ggttaatttttccttc

SEQ ID NO: 2750684 - DNA, 16 bp, Homo sapiens
ggttctgtgttgaaat

SEQ ID NO: 2750685 - DNA, 14 bp, Homo sapiens
ggtttatttgttgt

SEQ ID NO: 2750686 - DNA, 18 bp, Homo sapiens
ggtttcttttttctttct

SEQ ID NO: 2750687 - DNA, 23 bp, Homo sapiens
ggtttcttttttctttcttcctt

SEQ ID NO: 2750688 - DNA, 15 bp, Homo sapiens
ggtttgagaaaggca

SEQ ID NO: 2750689 - DNA, 13 bp, Homo sapiens
gtaaaaacttttt

SEQ ID NO: 2750690 - DNA, 16 bp, Homo sapiens
gtaaaaatgaagcaga

SEQ ID NO: 2750691 - DNA, 12 bp, Homo sapiens
gtaaaatatgtc

SEQ ID NO: 2750692 - DNA, 22 bp, Homo sapiens
gtaaagctgttaaaatacataa

SEQ ID NO: 2750693 - DNA, 11 bp, Homo sapiens
gtaaattctgt

SEQ ID NO: 2750694 - DNA, 16 bp, Homo sapiens
gtaaatttatgtgatg

SEQ ID NO: 2750695 - DNA, 13 bp, Homo sapiens
gtaagcggaataa

SEQ ID NO: 2750696 - DNA, 17 bp, Homo sapiens
gtaagggaataaatttt

SEQ ID NO: 2750697 - DNA, 12 bp, Homo sapiens
gtaatataaaag

SEQ ID NO: 2750698 - DNA, 19 bp, Homo sapiens
gtaatgataactggaaact

SEQ ID NO: 2750699 - DNA, 16 bp, Homo sapiens
gtacaaagtaaaaata

SEQ ID NO: 2750700 - DNA, 16 bp, Homo sapiens
gtacaataaaagtaaa

SEQ ID NO: 2750701 - DNA, 17 bp, Homo sapiens
gtacataagcttctcaa

SEQ ID NO: 2750702 - DNA, 14 bp, Homo sapiens
gtacatcgcttctt

SEQ ID NO: 2750703 - DNA, 21 bp, Homo sapiens
gtacgactcttttccaaacac

SEQ ID NO: 2750704 - DNA, 15 bp, Homo sapiens
gtactttttattgca

SEQ ID NO: 2750705 - DNA, 16 bp, Homo sapiens
gtactttttattgcat

SEQ ID NO: 2750706 - DNA, 15 bp, Homo sapiens
gtacttttttcaaat

SEQ ID NO: 2750707 - DNA, 21 bp, Homo sapiens
gtacttttttcaaatattgaa

SEQ ID NO: 2750708 - DNA, 17 bp, Homo sapiens
gtagaaagctaatacaa

SEQ ID NO: 2750709 - DNA, 22 bp, Homo sapiens
gtagaaagctaatacaaaacta

SEQ ID NO: 2750710 - DNA, 12 bp, Homo sapiens
gtagcaggacct

SEQ ID NO: 2750711 - DNA, 15 bp, Homo sapiens
gtagcaggacctgcc

SEQ ID NO: 2750712 - DNA, 22 bp, Homo sapiens
gtagtaattaggataactaaaa

SEQ ID NO: 2750713 - DNA, 15 bp, Homo sapiens
gtagtcccagcactt

SEQ ID NO: 2750714 - DNA, 17 bp, Homo sapiens
gtagtctctctagtagt

SEQ ID NO: 2750715 - DNA, 20 bp, Homo sapiens
gtagtgttggagaagaactg

SEQ ID NO: 2750716 - DNA, 12 bp, Homo sapiens
gtagttaaaaca

SEQ ID NO: 2750717 - DNA, 23 bp, Homo sapiens
gtatagaaaatggaaaatataca

SEQ ID NO: 2750718 - DNA, 13 bp, Homo sapiens
gtatcttgattaa

SEQ ID NO: 2750719 - DNA, 18 bp, Homo sapiens
gtatcttgattaatgtac

SEQ ID NO: 2750720 - DNA, 15 bp, Homo sapiens
gtatgtggaagtgtg

SEQ ID NO: 2750721 - DNA, 21 bp, Homo sapiens
gtatgtggaagtgtgggtctg

SEQ ID NO: 2750722 - DNA, 17 bp, Homo sapiens
gtatgttagtgcaaatt

SEQ ID NO: 2750723 - DNA, 15 bp, Homo sapiens
gtattaaagaatgct

SEQ ID NO: 2750724 - DNA, 11 bp, Homo sapiens
gtattgctgct

SEQ ID NO: 2750725 - DNA, 14 bp, Homo sapiens
gtattgctgctgtg

SEQ ID NO: 2750726 - DNA, 15 bp, Homo sapiens
gtattgctgctgtgc

SEQ ID NO: 2750727 - DNA, 14 bp, Homo sapiens
gtatttaggccatt

SEQ ID NO: 2750728 - DNA, 16 bp, Homo sapiens
gtattttaaaagaatg

SEQ ID NO: 2750729 - DNA, 18 bp, Homo sapiens
gtattttaaaagaatgat

SEQ ID NO: 2750730 - DNA, 22 bp, Homo sapiens
gtatttttttccaagtgtataa

SEQ ID NO: 2750731 - DNA, 15 bp, Homo sapiens
gtcaaagtagttagt

SEQ ID NO: 2750732 - DNA, 23 bp, Homo sapiens
gtcaataaaatccatacatttgt

SEQ ID NO: 2750733 - DNA, 15 bp, Homo sapiens
gtcacaaagagctga

SEQ ID NO: 2750734 - DNA, 14 bp, Homo sapiens
gtcacctcatggaa

SEQ ID NO: 2750735 - DNA, 14 bp, Homo sapiens
gtcactagtctttg

SEQ ID NO: 2750736 - DNA, 15 bp, Homo sapiens
gtcccatggcctgct

SEQ ID NO: 2750737 - DNA, 19 bp, Homo sapiens
gtcccatggcctgctgggc

SEQ ID NO: 2750738 - DNA, 21 bp, Homo sapiens
gtcccccatgctctgatgcag

SEQ ID NO: 2750739 - DNA, 20 bp, Homo sapiens
gtcctaagtgtcaagtcctg

SEQ ID NO: 2750740 - DNA, 13 bp, Homo sapiens
gtcctatgcaata

SEQ ID NO: 2750741 - DNA, 15 bp, Homo sapiens
tatgtttattcaaaa

SEQ ID NO: 2750742 - DNA, 19 bp, Homo sapiens
tatgtttattcaaaatatt

SEQ ID NO: 2750743 - DNA, 21 bp, Homo sapiens
tatgttttcaggctagatgta

SEQ ID NO: 2750744 - DNA, 13 bp, Homo sapiens
tattaagctaaaa

SEQ ID NO: 2750745 - DNA, 17 bp, Homo sapiens
tattacacctcagaaat

SEQ ID NO: 2750746 - DNA, 18 bp, Homo sapiens
tattacacctcagaaatt

SEQ ID NO: 2750747 - DNA, 20 bp, Homo sapiens
tattacacctcagaaattga

SEQ ID NO: 2750748 - DNA, 22 bp, Homo sapiens
tattacacctcagaaattgaaa

SEQ ID NO: 2750749 - DNA, 23 bp, Homo sapiens
tattacacctcagaaattgaaag

SEQ ID NO: 2750750 - DNA, 14 bp, Homo sapiens
tattactgtaagaa

SEQ ID NO: 2750751 - DNA, 15 bp, Homo sapiens
tattagaataccaca

SEQ ID NO: 2750752 - DNA, 21 bp, Homo sapiens
tattagactctctagttttat

SEQ ID NO: 2750753 - DNA, 12 bp, Homo sapiens
tattagttgctt

SEQ ID NO: 2750754 - DNA, 14 bp, Homo sapiens
tattagttgctttg

SEQ ID NO: 2750755 - DNA, 14 bp, Homo sapiens
tattatagaaattc

SEQ ID NO: 2750756 - DNA, 16 bp, Homo sapiens
tattatagaaattctg

SEQ ID NO: 2750757 - DNA, 12 bp, Homo sapiens
tattattatgaa

SEQ ID NO: 2750758 - DNA, 12 bp, Homo sapiens
tattcaaaatat

SEQ ID NO: 2750759 - DNA, 23 bp, Homo sapiens
tattctgggaaatgttttaatgc

SEQ ID NO: 2750760 - DNA, 15 bp, Homo sapiens
tattcttaaaatgca

SEQ ID NO: 2750761 - DNA, 21 bp, Homo sapiens
tattgaagtcttcttatctaa

SEQ ID NO: 2750762 - DNA, 15 bp, Homo sapiens
tattgaatgccttat

SEQ ID NO: 2750763 - DNA, 20 bp, Homo sapiens
tattgaatgccttatttttg

SEQ ID NO: 2750764 - DNA, 22 bp, Homo sapiens
tattgagctttgcatttatgat

SEQ ID NO: 2750765 - DNA, 16 bp, Homo sapiens
tattgcatggtgtgaa

SEQ ID NO: 2750766 - DNA, 17 bp, Homo sapiens
tattgctgcataaattt

SEQ ID NO: 2750767 - DNA, 18 bp, Homo sapiens
tattgctgcataaatttg

SEQ ID NO: 2750768 - DNA, 21 bp, Homo sapiens
tattgctgcataaatttgtaa

SEQ ID NO: 2750769 - DNA, 14 bp, Homo sapiens
tattgtagaaagct

SEQ ID NO: 2750770 - DNA, 17 bp, Homo sapiens
tattgtcctaagtgtca

SEQ ID NO: 2750771 - DNA, 13 bp, Homo sapiens
tatttattactgt

SEQ ID NO: 2750772 - DNA, 18 bp, Homo sapiens
tatttattttaataatgt

SEQ ID NO: 2750773 - DNA, 21 bp, Homo sapiens
tatttccttatgtgtgtagga

SEQ ID NO: 2750774 - DNA, 17 bp, Homo sapiens
tatttccttttgtaaag

SEQ ID NO: 2750775 - DNA, 15 bp, Homo sapiens
tatttctatgaaata

SEQ ID NO: 2750776 - DNA, 21 bp, Homo sapiens
tatttctatgaaatattatgt

SEQ ID NO: 2750777 - DNA, 22 bp, Homo sapiens
tatttgcaggtctttaaatcat

SEQ ID NO: 2750778 - DNA, 20 bp, Homo sapiens
tatttgccttttaaattctt

SEQ ID NO: 2750779 - DNA, 17 bp, Homo sapiens
tatttgtaaatttatgt

SEQ ID NO: 2750780 - DNA, 22 bp, Homo sapiens
tatttgttgttttctgggggaa

SEQ ID NO: 2750781 - DNA, 14 bp, Homo sapiens
tattttaaaagaat

SEQ ID NO: 2750782 - DNA, 18 bp, Homo sapiens
tattttaaaagaatgatt

SEQ ID NO: 2750783 - DNA, 13 bp, Homo sapiens
tattttgccattt

SEQ ID NO: 2750784 - DNA, 21 bp, Homo sapiens
tattttgtacaaagtaaaaat

SEQ ID NO: 2750785 - DNA, 16 bp, Homo sapiens
tatttttgaattcttt

SEQ ID NO: 2750786 - DNA, 15 bp, Homo sapiens
tatttttttccaagt

SEQ ID NO: 2750787 - DNA, 12 bp, Homo sapiens
tcaaaaaaatgt

SEQ ID NO: 2750788 - DNA, 14 bp, Homo sapiens
tcaaaaaaatgttt

SEQ ID NO: 2750789 - DNA, 11 bp, Homo sapiens
tcaaacctgta

SEQ ID NO: 2750790 - DNA, 17 bp, Homo sapiens
tcaaagcgaacagtcca

SEQ ID NO: 2750791 - DNA, 14 bp, Homo sapiens
tcaaatattgaatg

SEQ ID NO: 2750792 - DNA, 17 bp, Homo sapiens
tcaaatattgaatgcct

SEQ ID NO: 2750793 - DNA, 18 bp, Homo sapiens
tcaaattgtgcaaaatat

SEQ ID NO: 2750794 - DNA, 21 bp, Homo sapiens
tcaaattttttaaaagagaca

SEQ ID NO: 2750795 - DNA, 22 bp, Homo sapiens
tcaactccaaactgactcttaa

SEQ ID NO: 2750796 - DNA, 16 bp, Homo sapiens
tcaagtcctgactggg

SEQ ID NO: 2750797 - DNA, 15 bp, Homo sapiens
tcaataaatgttgaa

SEQ ID NO: 2750798 - DNA, 13 bp, Homo sapiens
tcaatagtgtcct

SEQ ID NO: 2750799 - DNA, 19 bp, Homo sapiens
tcaatagtgtcctatgcaa

SEQ ID NO: 2750800 - DNA, 16 bp, Homo sapiens
tcaatatatagttagc

SEQ ID NO: 2750801 - DNA, 17 bp, Homo sapiens
tcaattgagtaattcta

SEQ ID NO: 2750802 - DNA, 12 bp, Homo sapiens
tcacctcatgga

SEQ ID NO: 2750803 - DNA, 13 bp, Homo sapiens
tcactactggtct

SEQ ID NO: 2750804 - DNA, 16 bp, Homo sapiens
tcactactggtctgta

SEQ ID NO: 2750805 - DNA, 17 bp, Homo sapiens
tcacttgtcaataaaat

SEQ ID NO: 2750806 - DNA, 13 bp, Homo sapiens
tcagaagaaattt

SEQ ID NO: 2750807 - DNA, 17 bp, Homo sapiens
tcagatttgccttattg

SEQ ID NO: 2750808 - DNA, 12 bp, Homo sapiens
tcaggagcctgc

SEQ ID NO: 2750809 - DNA, 19 bp, Homo sapiens
tcaggagcctgctaaggaa

SEQ ID NO: 2750810 - DNA, 22 bp, Homo sapiens
tcaggagcctgctaaggaacaa

SEQ ID NO: 2750811 - DNA, 19 bp, Homo sapiens
tcagggccgagaggacaga

SEQ ID NO: 2750812 - DNA, 23 bp, Homo sapiens
tcagggccgagaggacagaatgg

SEQ ID NO: 2750813 - DNA, 15 bp, Homo sapiens
tcagtagcaggacct

SEQ ID NO: 2750814 - DNA, 23 bp, Homo sapiens
tcagtagcaggacctgccaagaa

SEQ ID NO: 2750815 - DNA, 12 bp, Homo sapiens
tcagtatgtgga

SEQ ID NO: 2750816 - DNA, 22 bp, Homo sapiens
tcagtctttaatctgagaggcc

SEQ ID NO: 2750817 - DNA, 23 bp, Homo sapiens
tcagtggaactcaatatatagtt

SEQ ID NO: 2750818 - DNA, 18 bp, Homo sapiens
tcagtttagaacctacaa

SEQ ID NO: 2750819 - DNA, 13 bp, Homo sapiens
tcatagttctgtt

SEQ ID NO: 2750820 - DNA, 14 bp, Homo sapiens
tcatagttctgtta

SEQ ID NO: 2750821 - DNA, 21 bp, Homo sapiens
tcatatgtttattcaaaatat

SEQ ID NO: 2750822 - DNA, 22 bp, Homo sapiens
tcatatgtttattcaaaatatt

SEQ ID NO: 2750823 - DNA, 21 bp, Homo sapiens
tcatcaatagtgtcctatgca

SEQ ID NO: 2750824 - DNA, 13 bp, Homo sapiens
tcatcattgttgt

SEQ ID NO: 2750825 - DNA, 13 bp, Homo sapiens
tcatctaatttaa

SEQ ID NO: 2750826 - DNA, 18 bp, Homo sapiens
tcatgacagaatatacac

SEQ ID NO: 2750827 - DNA, 15 bp, Homo sapiens
tcatgccccagtatt

SEQ ID NO: 2750828 - DNA, 16 bp, Homo sapiens
tcatgccccagtatta

SEQ ID NO: 2750829 - DNA, 16 bp, Homo sapiens
tcatgctaaaattcta

SEQ ID NO: 2750830 - DNA, 14 bp, Homo sapiens
tcattgttgtgtat

SEQ ID NO: 2750831 - DNA, 18 bp, Homo sapiens
tcatttacaatttcaaaa

SEQ ID NO: 2750832 - DNA, 14 bp, Homo sapiens
tccaactctgtatt

SEQ ID NO: 2750833 - DNA, 15 bp, Homo sapiens
tccaactctgtattt

SEQ ID NO: 2750834 - DNA, 16 bp, Homo sapiens
tccaactctgtattta

SEQ ID NO: 2750835 - DNA, 15 bp, Homo sapiens
tccaactttattttg

SEQ ID NO: 2750836 - DNA, 18 bp, Homo sapiens
tccaactttattttgaat

SEQ ID NO: 2750837 - DNA, 23 bp, Homo sapiens
tccaactttattttgaatgtacc

SEQ ID NO: 2750838 - DNA, 16 bp, Homo sapiens
tccaagacaaactaaa

SEQ ID NO: 2750839 - DNA, 19 bp, Homo sapiens
tccaagacaaactaaactt

SEQ ID NO: 2750840 - DNA, 20 bp, Homo sapiens
tccaagacaaactaaacttt

SEQ ID NO: 2750841 - DNA, 20 bp, Homo sapiens
tccaagcatttagatgtata

SEQ ID NO: 2750842 - DNA, 24 bp, Homo sapiens
tccaataaaaatcaggagcctgct

SEQ ID NO: 2750843 - DNA, 22 bp, Homo sapiens
tccacaagtgtgtggccccgcc

SEQ ID NO: 2750844 - DNA, 14 bp, Homo sapiens
tccaccaaactcct

SEQ ID NO: 2750845 - DNA, 16 bp, Homo sapiens
tccaccaaactcctgc

SEQ ID NO: 2750846 - DNA, 21 bp, Homo sapiens
tccactattatagaaattctg

SEQ ID NO: 2750847 - DNA, 13 bp, Homo sapiens
tccagatgtctaa

SEQ ID NO: 2750848 - DNA, 17 bp, Homo sapiens
tccagcgtgcaccccgc

SEQ ID NO: 2750849 - DNA, 20 bp, Homo sapiens
tccagcgtgcaccccgccgg

SEQ ID NO: 2750850 - DNA, 19 bp, Homo sapiens
tccaggtagagggtgtgta

SEQ ID NO: 2750851 - DNA, 22 bp, Homo sapiens
tccataaaattggattacagta

SEQ ID NO: 2750852 - DNA, 18 bp, Homo sapiens
tccatatccttctggctg

SEQ ID NO: 2750853 - DNA, 17 bp, Homo sapiens
tcccaagagggctttat

SEQ ID NO: 2750854 - DNA, 23 bp, Homo sapiens
tcccaagagggctttattacacc

SEQ ID NO: 2750855 - DNA, 18 bp, Homo sapiens
tcccacactcgccatctc

SEQ ID NO: 2750856 - DNA, 13 bp, Homo sapiens
tcccattctatgt

SEQ ID NO: 2750857 - DNA, 16 bp, Homo sapiens
tccctatcttgtgaag

SEQ ID NO: 2750858 - DNA, 14 bp, Homo sapiens
tccgaaatcagcag

SEQ ID NO: 2750859 - DNA, 12 bp, Homo sapiens
tcctatgccttc

SEQ ID NO: 2750860 - DNA, 20 bp, Homo sapiens
tcctatgccttcaaatagta

SEQ ID NO: 2750861 - DNA, 17 bp, Homo sapiens
tcctctccccatgatgt

SEQ ID NO: 2750862 - DNA, 16 bp, Homo sapiens
tcctcttgccacatct

SEQ ID NO: 2750863 - DNA, 21 bp, Homo sapiens
tcctcttgccacatcttgaaa

SEQ ID NO: 2750864 - DNA, 22 bp, Homo sapiens
tcctgaaaacccttgccatgtg

SEQ ID NO: 2750865 - DNA, 21 bp, Homo sapiens
tcctgttaaattttctctaaa

SEQ ID NO: 2750866 - DNA, 15 bp, Homo sapiens
tcctgtttgtatttt

SEQ ID NO: 2750867 - DNA, 19 bp, Homo sapiens
tgtgcagggctggtttgtt

SEQ ID NO: 2750868 - DNA, 17 bp, Homo sapiens
tgtgcgtggaaaaagac

SEQ ID NO: 2750869 - DNA, 15 bp, Homo sapiens
tgtggaagtgtgggt

SEQ ID NO: 2750870 - DNA, 23 bp, Homo sapiens
tgtggccccgcccgagcccctgc

SEQ ID NO: 2750871 - DNA, 14 bp, Homo sapiens
tgtgggtctgtgtg

SEQ ID NO: 2750872 - DNA, 20 bp, Homo sapiens
tgtgggtctgtgtgtgtgta

SEQ ID NO: 2750873 - DNA, 13 bp, Homo sapiens
tgtgtaagtagat

SEQ ID NO: 2750874 - DNA, 19 bp, Homo sapiens
tgtgtaatttaaaattgtg

SEQ ID NO: 2750875 - DNA, 20 bp, Homo sapiens
tgtgtaggaggggttaataa

SEQ ID NO: 2750876 - DNA, 17 bp, Homo sapiens
tgtgtataatttacctc

SEQ ID NO: 2750877 - DNA, 23 bp, Homo sapiens
tgtgtatcttgattaatgtactt

SEQ ID NO: 2750878 - DNA, 20 bp, Homo sapiens
tgtgtcatcaatagtgtcct

SEQ ID NO: 2750879 - DNA, 12 bp, Homo sapiens
tgtgttgaaata

SEQ ID NO: 2750880 - DNA, 23 bp, Homo sapiens
tgtgttgaaatatagttgaaagt

SEQ ID NO: 2750881 - DNA, 23 bp, Homo sapiens
tgtgttgtgtgtgggagtgtgta

SEQ ID NO: 2750882 - DNA, 19 bp, Homo sapiens
tgtgttttgcaagccagat

SEQ ID NO: 2750883 - DNA, 17 bp, Homo sapiens
tgttaaaactgtacctt

SEQ ID NO: 2750884 - DNA, 22 bp, Homo sapiens
tgttaaaatacataacttcagt

SEQ ID NO: 2750885 - DNA, 17 bp, Homo sapiens
tgttaaattttctctaa

SEQ ID NO: 2750886 - DNA, 22 bp, Homo sapiens
tgttaaattttctctaaactgt

SEQ ID NO: 2750887 - DNA, 16 bp, Homo sapiens
tgttaatctttttcat

SEQ ID NO: 2750888 - DNA, 16 bp, Homo sapiens
tgttcttatagaataa

SEQ ID NO: 2750889 - DNA, 17 bp, Homo sapiens
tgttcttatagaataaa

SEQ ID NO: 2750890 - DNA, 21 bp, Homo sapiens
tgttcttatagaataaaagct

SEQ ID NO: 2750891 - DNA, 23 bp, Homo sapiens
tgttcttatagaataaaagctgt

SEQ ID NO: 2750892 - DNA, 16 bp, Homo sapiens
tgttcttttgtcccag

SEQ ID NO: 2750893 - DNA, 16 bp, Homo sapiens
tgttgaaatatagttg

SEQ ID NO: 2750894 - DNA, 19 bp, Homo sapiens
tgttgaaatatagttgaaa

SEQ ID NO: 2750895 - DNA, 21 bp, Homo sapiens
tgttgaaatatagttgaaagt

SEQ ID NO: 2750896 - DNA, 19 bp, Homo sapiens
tgttgaaccacctgtgtag

SEQ ID NO: 2750897 - DNA, 20 bp, Homo sapiens
tgttgaaccacctgtgtagt

SEQ ID NO: 2750898 - DNA, 22 bp, Homo sapiens
tgttgcccacagctgtatgatt

SEQ ID NO: 2750899 - DNA, 19 bp, Homo sapiens
tgttggagaagaactgaaa

SEQ ID NO: 2750900 - DNA, 20 bp, Homo sapiens
tgttggagaagaactgaaat

SEQ ID NO: 2750901 - DNA, 20 bp, Homo sapiens
tgttggtgtggagttttcat

SEQ ID NO: 2750902 - DNA, 15 bp, Homo sapiens
tgttgtgcagtgtgc

SEQ ID NO: 2750903 - DNA, 12 bp, Homo sapiens
tgttgtgtataa

SEQ ID NO: 2750904 - DNA, 16 bp, Homo sapiens
tgttgtgtgtgggagt

SEQ ID NO: 2750905 - DNA, 11 bp, Homo sapiens
tgttgttgttg

SEQ ID NO: 2750906 - DNA, 15 bp, Homo sapiens
tgttgttttctgggg

SEQ ID NO: 2750907 - DNA, 21 bp, Homo sapiens
tgtttacagaggacagtattt

SEQ ID NO: 2750908 - DNA, 22 bp, Homo sapiens
tgtttatggaaataccaggacc

SEQ ID NO: 2750909 - DNA, 23 bp, Homo sapiens
tgtttatgttcttatagaataaa

SEQ ID NO: 2750910 - DNA, 13 bp, Homo sapiens
tgtttattcaaaa

SEQ ID NO: 2750911 - DNA, 21 bp, Homo sapiens
tgtttcaaacatatataacaa

SEQ ID NO: 2750912 - DNA, 18 bp, Homo sapiens
tgtttcttagctgcactg

SEQ ID NO: 2750913 - DNA, 19 bp, Homo sapiens
tgtttgtatttttttccaa

SEQ ID NO: 2750914 - DNA, 20 bp, Homo sapiens
tgttttataattttgtgaag

SEQ ID NO: 2750915 - DNA, 19 bp, Homo sapiens
tgttttctgggggaaaaag

SEQ ID NO: 2750916 - DNA, 15 bp, Homo sapiens
tgtttttaaaaacct

SEQ ID NO: 2750917 - DNA, 20 bp, Homo sapiens
tgtttttataaaaacattga

SEQ ID NO: 2750918 - DNA, 17 bp, Homo sapiens
tgtttttgctttctgaa

SEQ ID NO: 2750919 - DNA, 11 bp, Homo sapiens
ttaaaaattgg

SEQ ID NO: 2750920 - DNA, 16 bp, Homo sapiens
ttaaaaattggcattt

SEQ ID NO: 2750921 - DNA, 19 bp, Homo sapiens
ttaaaacacagtattgtag

SEQ ID NO: 2750922 - DNA, 20 bp, Homo sapiens
ttaaaacacagtattgtaga

SEQ ID NO: 2750923 - DNA, 13 bp, Homo sapiens
ttaaaatgcaata

SEQ ID NO: 2750924 - DNA, 19 bp, Homo sapiens
ttaaaattttcattctgaa

SEQ ID NO: 2750925 - DNA, 12 bp, Homo sapiens
ttaaactactga

SEQ ID NO: 2750926 - DNA, 12 bp, Homo sapiens
ttaaagaatcca

SEQ ID NO: 2750927 - DNA, 13 bp, Homo sapiens
ttaaatatttgaa

SEQ ID NO: 2750928 - DNA, 13 bp, Homo sapiens
ttaaatcatttta

SEQ ID NO: 2750929 - DNA, 19 bp, Homo sapiens
ttaaatcgccttgaacaaa

SEQ ID NO: 2750930 - DNA, 22 bp, Homo sapiens
ttaaatctccagcttactataa

SEQ ID NO: 2750931 - DNA, 17 bp, Homo sapiens
ttaaattggagaaaagc

SEQ ID NO: 2750932 - DNA, 18 bp, Homo sapiens
ttaaattggagaaaagca

SEQ ID NO: 2750933 - DNA, 17 bp, Homo sapiens
ttaactctactgtgtaa

SEQ ID NO: 2750934 - DNA, 15 bp, Homo sapiens
ttaagcaaatgcatt

SEQ ID NO: 2750935 - DNA, 18 bp, Homo sapiens
ttaagtaatgataactgg

SEQ ID NO: 2750936 - DNA, 18 bp, Homo sapiens
ttaagtgtttaaaagcaa

SEQ ID NO: 2750937 - DNA, 17 bp, Homo sapiens
ttaataagtatatctta

SEQ ID NO: 2750938 - DNA, 16 bp, Homo sapiens
ttaataatgtttcaaa

SEQ ID NO: 2750939 - DNA, 22 bp, Homo sapiens
ttaatattgtattgctgctgtg

SEQ ID NO: 2750940 - DNA, 15 bp, Homo sapiens
ttaatcacttaacat

SEQ ID NO: 2750941 - DNA, 18 bp, Homo sapiens
ttaatcagagtatctgaa

SEQ ID NO: 2750942 - DNA, 22 bp, Homo sapiens
ttaatcagtggaactcaatata

SEQ ID NO: 2750943 - DNA, 17 bp, Homo sapiens
ttaatctttttcatcat

SEQ ID NO: 2750944 - DNA, 21 bp, Homo sapiens
ttaatgtactttttattgcat

SEQ ID NO: 2750945 - DNA, 13 bp, Homo sapiens
ttaattctaaact

SEQ ID NO: 2750946 - DNA, 13 bp, Homo sapiens
ttacaatttcaaa

SEQ ID NO: 2750947 - DNA, 15 bp, Homo sapiens
ttacagtttcttcat

SEQ ID NO: 2750948 - DNA, 16 bp, Homo sapiens
ttacatgcataaaagg

SEQ ID NO: 2750949 - DNA, 20 bp, Homo sapiens
ttacatgtaaagctgttaaa

SEQ ID NO: 2750950 - DNA, 14 bp, Homo sapiens
ttacatttgtataa

SEQ ID NO: 2750951 - DNA, 15 bp, Homo sapiens
ttacatttgtataaa

SEQ ID NO: 2750952 - DNA, 19 bp, Homo sapiens
ttaccactggtaacatgtg

SEQ ID NO: 2750953 - DNA, 21 bp, Homo sapiens
ttaccactggtaacatgtgac

SEQ ID NO: 2750954 - DNA, 21 bp, Homo sapiens
ttaccacttgtgttttgcaag

SEQ ID NO: 2750955 - DNA, 12 bp, Homo sapiens
ttaccagacttc

SEQ ID NO: 2750956 - DNA, 13 bp, Homo sapiens
ttaccagacttca

SEQ ID NO: 2750957 - DNA, 14 bp, Homo sapiens
ttaccagacttcaa

SEQ ID NO: 2750958 - DNA, 17 bp, Homo sapiens
ttaccagacttcaagat

SEQ ID NO: 2750959 - DNA, 14 bp, Homo sapiens
ttacctctaaattt

SEQ ID NO: 2750960 - DNA, 16 bp, Homo sapiens
ttacctttaatgcaat

SEQ ID NO: 2750961 - DNA, 20 bp, Homo sapiens
ttacctttaatgcaatgcat

SEQ ID NO: 2750962 - DNA, 15 bp, Homo sapiens
ttactgttaaaactg

SEQ ID NO: 2750963 - DNA, 20 bp, Homo sapiens
ttacttactgttaaaactgt

SEQ ID NO: 2750964 - DNA, 14 bp, Homo sapiens
ttacttgctataaa

SEQ ID NO: 2750965 - DNA, 14 bp, Homo sapiens
ttagaagaagtgtg

SEQ ID NO: 2750966 - DNA, 16 bp, Homo sapiens
ttagaagaagtgtgtc

SEQ ID NO: 2750967 - DNA, 16 bp, Homo sapiens
ttagatttttaaattg

SEQ ID NO: 2750968 - DNA, 22 bp, Homo sapiens
ttagatttttaaattggagaaa

SEQ ID NO: 2750969 - DNA, 21 bp, Homo sapiens
ttagcaatgaattagttgcat

SEQ ID NO: 2750970 - DNA, 15 bp, Homo sapiens
ttagctagaatccac

SEQ ID NO: 2750971 - DNA, 18 bp, Homo sapiens
ttaggataactaaaattc

SEQ ID NO: 2750972 - DNA, 19 bp, Homo sapiens
ttaggataactaaaattct

SEQ ID NO: 2750973 - DNA, 19 bp, Homo sapiens
ttagtctgttatatttcct

SEQ ID NO: 2750974 - DNA, 22 bp, Homo sapiens
ttagttctagctctatttactt

SEQ ID NO: 2750975 - DNA, 14 bp, Homo sapiens
ttagtttactggat

SEQ ID NO: 2750976 - DNA, 20 bp, Homo sapiens
ttagttttggttatttctaa

SEQ ID NO: 2750977 - DNA, 19 bp, Homo sapiens
ttataaaaacattgaaata

SEQ ID NO: 2750978 - DNA, 20 bp, Homo sapiens
ttataaaaacattgaaatat

SEQ ID NO: 2750979 - DNA, 15 bp, Homo sapiens
ttataattttgtgaa

SEQ ID NO: 2750980 - DNA, 15 bp, Homo sapiens
ttatactgtgaagtt

SEQ ID NO: 2750981 - DNA, 16 bp, Homo sapiens
ttatagaaattctgaa

SEQ ID NO: 2750982 - DNA, 18 bp, Homo sapiens
ttatcaaggaagtcttca

SEQ ID NO: 2750983 - DNA, 20 bp, Homo sapiens
ttatcaaggaagtcttcaaa

SEQ ID NO: 2750984 - DNA, 21 bp, Homo sapiens
ttatgaattacatttgtataa

SEQ ID NO: 2750985 - DNA, 20 bp, Homo sapiens
ttatgatttctccagaaatt

SEQ ID NO: 2750986 - DNA, 19 bp, Homo sapiens
ttatgcaacgtttaacatt

SEQ ID NO: 2750987 - DNA, 14 bp, Homo sapiens
ttatgtgtgtgtgt

SEQ ID NO: 2750988 - DNA, 19 bp, Homo sapiens
ttatgttaaaactgggaca

SEQ ID NO: 2750989 - DNA, 17 bp, Homo sapiens
ttatgttcttatagaat

SEQ ID NO: 2750990 - DNA, 20 bp, Homo sapiens
ttatgttcttatagaataaa

SEQ ID NO: 2750991 - DNA, 23 bp, Homo sapiens
ttatgttcttatagaataaaagc

SEQ ID NO: 2750992 - DNA, 17 bp, Homo sapiens
aagaattgccaatcttg

SEQ ID NO: 2750993 - DNA, 17 bp, Homo sapiens
aagacaaactaaacttt

SEQ ID NO: 2750994 - DNA, 15 bp, Homo sapiens
aagacgatgtttatg

SEQ ID NO: 2750995 - DNA, 22 bp, Homo sapiens
aagagaaggggacttctcttcc

SEQ ID NO: 2750996 - DNA, 16 bp, Homo sapiens
aagagactttgtcact

SEQ ID NO: 2750997 - DNA, 19 bp, Homo sapiens
aagagagtttttaatagaa

SEQ ID NO: 2750998 - DNA, 18 bp, Homo sapiens
aagagtaagggtaaaaaa

SEQ ID NO: 2750999 - DNA, 21 bp, Homo sapiens
aagagtaagggtaaaaaagat

SEQ ID NO: 2751000 - DNA, 15 bp, Homo sapiens
aagagtcaaagtagt

SEQ ID NO: 2751001 - DNA, 18 bp, Homo sapiens
aagatcctcttgccacat

SEQ ID NO: 2751002 - DNA, 16 bp, Homo sapiens
aagatgccaacatcgg

SEQ ID NO: 2751003 - DNA, 18 bp, Homo sapiens
aagatgctttaattgtgt

SEQ ID NO: 2751004 - DNA, 12 bp, Homo sapiens
aagattctttaa

SEQ ID NO: 2751005 - DNA, 18 bp, Homo sapiens
aagattctttaaactact

SEQ ID NO: 2751006 - DNA, 20 bp, Homo sapiens
aagattctttaaactactga

SEQ ID NO: 2751007 - DNA, 14 bp, Homo sapiens
aagattgtattgct

SEQ ID NO: 2751008 - DNA, 21 bp, Homo sapiens
aagatttatctgcaaggattt

SEQ ID NO: 2751009 - DNA, 22 bp, Homo sapiens
aagatttatctgcaaggatttt

SEQ ID NO: 2751010 - DNA, 18 bp, Homo sapiens
aagattttttaattgttt

SEQ ID NO: 2751011 - DNA, 20 bp, Homo sapiens
aagattttttaattgtttaa

SEQ ID NO: 2751012 - DNA, 14 bp, Homo sapiens
aagattttttcatt

SEQ ID NO: 2751013 - DNA, 12 bp, Homo sapiens
aagcaaaatttt

SEQ ID NO: 2751014 - DNA, 20 bp, Homo sapiens
aagcaacgactactttgcta

SEQ ID NO: 2751015 - DNA, 17 bp, Homo sapiens
aagcacaccacaattct

SEQ ID NO: 2751016 - DNA, 16 bp, Homo sapiens
aagcagaagccccaaa

SEQ ID NO: 2751017 - DNA, 15 bp, Homo sapiens
aagcaggatggctgg

SEQ ID NO: 2751018 - DNA, 14 bp, Homo sapiens
aagcatttaaaaga

SEQ ID NO: 2751019 - DNA, 13 bp, Homo sapiens
aagccagattttc

SEQ ID NO: 2751020 - DNA, 19 bp, Homo sapiens
aagccagattttcctgaaa

SEQ ID NO: 2751021 - DNA, 22 bp, Homo sapiens
aagctattacttggcaaattct

SEQ ID NO: 2751022 - DNA, 14 bp, Homo sapiens
aagctgtggaatga

SEQ ID NO: 2751023 - DNA, 14 bp, Homo sapiens
aagcttgtgtatct

SEQ ID NO: 2751024 - DNA, 12 bp, Homo sapiens
aaggaacaatgc

SEQ ID NO: 2751025 - DNA, 19 bp, Homo sapiens
aaggaacaatgccgcctgt

SEQ ID NO: 2751026 - DNA, 18 bp, Homo sapiens
aaggaagtcttcaaattt

SEQ ID NO: 2751027 - DNA, 20 bp, Homo sapiens
aaggaatacaatatatagct

SEQ ID NO: 2751028 - DNA, 13 bp, Homo sapiens
aaggattctgcag

SEQ ID NO: 2751029 - DNA, 15 bp, Homo sapiens
aaggattctgcagaa

SEQ ID NO: 2751030 - DNA, 20 bp, Homo sapiens
aaggcagctctaaatgtcaa

SEQ ID NO: 2751031 - DNA, 23 bp, Homo sapiens
aagggagacattgtttggatttc

SEQ ID NO: 2751032 - DNA, 17 bp, Homo sapiens
aaggggaattgaggaca

SEQ ID NO: 2751033 - DNA, 13 bp, Homo sapiens
aagggtaaaaaag

SEQ ID NO: 2751034 - DNA, 17 bp, Homo sapiens
aagggtaaaaaagataa

SEQ ID NO: 2751035 - DNA, 14 bp, Homo sapiens
aaggtacttcaaat

SEQ ID NO: 2751036 - DNA, 21 bp, Homo sapiens
aaggtttccactattatagaa

SEQ ID NO: 2751037 - DNA, 12 bp, Homo sapiens
aagtaagggaat

SEQ ID NO: 2751038 - DNA, 14 bp, Homo sapiens
aagtaatgataact

SEQ ID NO: 2751039 - DNA, 17 bp, Homo sapiens
aagtacctgtgaacagt

SEQ ID NO: 2751040 - DNA, 21 bp, Homo sapiens
aagtatgttagtgcaaattgt

SEQ ID NO: 2751041 - DNA, 19 bp, Homo sapiens
aagtcctgaacctttcaaa

SEQ ID NO: 2751042 - DNA, 20 bp, Homo sapiens
aagtgtataatgttggtgtg

SEQ ID NO: 2751043 - DNA, 16 bp, Homo sapiens
aagttagcattgtttc

SEQ ID NO: 2751044 - DNA, 12 bp, Homo sapiens
aagttattgctg

SEQ ID NO: 2751045 - DNA, 19 bp, Homo sapiens
aagttattgctgcataaat

SEQ ID NO: 2751046 - DNA, 17 bp, Homo sapiens
aagttttttatatatga

SEQ ID NO: 2751047 - DNA, 14 bp, Homo sapiens
aataaaagctatta

SEQ ID NO: 2751048 - DNA, 23 bp, Homo sapiens
aataaaatttaaaaaactcctgt

SEQ ID NO: 2751049 - DNA, 20 bp, Homo sapiens
aataaactagagaagggaga

SEQ ID NO: 2751050 - DNA, 16 bp, Homo sapiens
aataaattaatattgt

SEQ ID NO: 2751051 - DNA, 23 bp, Homo sapiens
aataatgcatccagcagtacaat

SEQ ID NO: 2751052 - DNA, 22 bp, Homo sapiens
aataatgtagttttgtttatgc

SEQ ID NO: 2751053 - DNA, 19 bp, Homo sapiens
aataattgagactgaaaga

SEQ ID NO: 2751054 - DNA, 19 bp, Homo sapiens
aataatttttatatttgaa

SEQ ID NO: 2751055 - DNA, 19 bp, Homo sapiens
aatacaaatctgtataaat

SEQ ID NO: 2751056 - DNA, 21 bp, Homo sapiens
aatacaaatctgtataaatgt

SEQ ID NO: 2751057 - DNA, 22 bp, Homo sapiens
aatacaaatctgtataaatgtc

SEQ ID NO: 2751058 - DNA, 16 bp, Homo sapiens
aatacataacttcagt

SEQ ID NO: 2751059 - DNA, 18 bp, Homo sapiens
aatacataacttcagtgc

SEQ ID NO: 2751060 - DNA, 23 bp, Homo sapiens
aataccacaggaaccacaagact

SEQ ID NO: 2751061 - DNA, 20 bp, Homo sapiens
aatagtatagaaaatggaaa

SEQ ID NO: 2751062 - DNA, 21 bp, Homo sapiens
aatagtatagaaaatggaaaa

SEQ ID NO: 2751063 - DNA, 19 bp, Homo sapiens
aatagtcaaattgtgtgaa

SEQ ID NO: 2751064 - DNA, 22 bp, Homo sapiens
aatagtgtcctatgcaataaaa

SEQ ID NO: 2751065 - DNA, 20 bp, Homo sapiens
aatatacaagtaaattctgt

SEQ ID NO: 2751066 - DNA, 16 bp, Homo sapiens
aatatagttgaaagta

SEQ ID NO: 2751067 - DNA, 14 bp, Homo sapiens
aatatatggcattt

SEQ ID NO: 2751068 - DNA, 16 bp, Homo sapiens
aatatatggcatttgc

SEQ ID NO: 2751069 - DNA, 22 bp, Homo sapiens
aatatatggcatttgcagattt

SEQ ID NO: 2751070 - DNA, 20 bp, Homo sapiens
aatatcacttgtcaataaaa

SEQ ID NO: 2751071 - DNA, 15 bp, Homo sapiens
aatatctgaacattt

SEQ ID NO: 2751072 - DNA, 19 bp, Homo sapiens
aatatctgaacatttacta

SEQ ID NO: 2751073 - DNA, 17 bp, Homo sapiens
aatatgaccttaaggaa

SEQ ID NO: 2751074 - DNA, 19 bp, Homo sapiens
aatattacatgtaaagctg

SEQ ID NO: 2751075 - DNA, 22 bp, Homo sapiens
aatattacatgtaaagctgtta

SEQ ID NO: 2751076 - DNA, 14 bp, Homo sapiens
aatattacctaatg

SEQ ID NO: 2751077 - DNA, 21 bp, Homo sapiens
aatattgtattgctgctgtgc

SEQ ID NO: 2751078 - DNA, 14 bp, Homo sapiens
aatatttcagataa

SEQ ID NO: 2751079 - DNA, 23 bp, Homo sapiens
aatattttatcttttagctagaa

SEQ ID NO: 2751080 - DNA, 19 bp, Homo sapiens
aatcacttaacattcctaa

SEQ ID NO: 2751081 - DNA, 12 bp, Homo sapiens
aatcagaataaa

SEQ ID NO: 2751082 - DNA, 18 bp, Homo sapiens
aatcagaataaattaata

SEQ ID NO: 2751083 - DNA, 17 bp, Homo sapiens
aatcagagtatctgaag

SEQ ID NO: 2751084 - DNA, 13 bp, Homo sapiens
aatcaggagcctg

SEQ ID NO: 2751085 - DNA, 15 bp, Homo sapiens
aatcaggagcctgct

SEQ ID NO: 2751086 - DNA, 16 bp, Homo sapiens
aatcagtggaactcaa

SEQ ID NO: 2751087 - DNA, 19 bp, Homo sapiens
aatcatgaattagttttat

SEQ ID NO: 2751088 - DNA, 14 bp, Homo sapiens
aatccatacatttg

SEQ ID NO: 2751089 - DNA, 20 bp, Homo sapiens
aatcctgttaaattttctct

SEQ ID NO: 2751090 - DNA, 15 bp, Homo sapiens
aatctccaactttat

SEQ ID NO: 2751091 - DNA, 16 bp, Homo sapiens
aatctccaactttatt

SEQ ID NO: 2751092 - DNA, 22 bp, Homo sapiens
aatctgaatcctgttaaatttt

SEQ ID NO: 2751093 - DNA, 12 bp, Homo sapiens
aatctgtacttt

SEQ ID NO: 2751094 - DNA, 13 bp, Homo sapiens
aatctgtactttt

SEQ ID NO: 2751095 - DNA, 19 bp, Homo sapiens
aatctgtacttttttcaaa

SEQ ID NO: 2751096 - DNA, 13 bp, Homo sapiens
aatctgtataaat

SEQ ID NO: 2751097 - DNA, 20 bp, Homo sapiens
aatcttaaatcagaataaat

SEQ ID NO: 2751098 - DNA, 17 bp, Homo sapiens
aatcttgttttaagcaa

SEQ ID NO: 2751099 - DNA, 12 bp, Homo sapiens
aatgaagaaagt

SEQ ID NO: 2751100 - DNA, 16 bp, Homo sapiens
aatgaattagttgcat

SEQ ID NO: 2751101 - DNA, 22 bp, Homo sapiens
aatgagacccctttaaactgtc

SEQ ID NO: 2751102 - DNA, 18 bp, Homo sapiens
aatgagtcaccattcttc

SEQ ID NO: 2751103 - DNA, 20 bp, Homo sapiens
aatgataactggaaacttca

SEQ ID NO: 2751104 - DNA, 20 bp, Homo sapiens
aatgatatctatattctaaa

SEQ ID NO: 2751105 - DNA, 15 bp, Homo sapiens
aatgccgcctgtcaa

SEQ ID NO: 2751106 - DNA, 15 bp, Homo sapiens
aatgccttatttttg

SEQ ID NO: 2751107 - DNA, 16 bp, Homo sapiens
aatgccttatttttga

SEQ ID NO: 2751108 - DNA, 17 bp, Homo sapiens
aatgccttatttttgaa

SEQ ID NO: 2751109 - DNA, 18 bp, Homo sapiens
aatgccttatttttgaat

SEQ ID NO: 2751110 - DNA, 20 bp, Homo sapiens
aatgccttatttttgaattc

SEQ ID NO: 2751111 - DNA, 22 bp, Homo sapiens
aatgccttatttttgaattctt

SEQ ID NO: 2751112 - DNA, 20 bp, Homo sapiens
aatgctgtattttaaaagaa

SEQ ID NO: 2751113 - DNA, 21 bp, Homo sapiens
aatgcttataggctgggccag

SEQ ID NO: 2751114 - DNA, 15 bp, Homo sapiens
aatggaaaatataca

SEQ ID NO: 2751115 - DNA, 12 bp, Homo sapiens
aatggaaaatta

SEQ ID NO: 2751116 - DNA, 22 bp, Homo sapiens
aatggtggcttcttttctttgt

SEQ ID NO: 2751117 - DNA, 11 bp, Homo sapiens
atttctaaacc

SEQ ID NO: 2751118 - DNA, 23 bp, Homo sapiens
atttctaaaccacaaaagttgtt

SEQ ID NO: 2751119 - DNA, 20 bp, Homo sapiens
atttctatgaaatattatgt

SEQ ID NO: 2751120 - DNA, 18 bp, Homo sapiens
atttgaaaattaccttta

SEQ ID NO: 2751121 - DNA, 16 bp, Homo sapiens
atttgcatttttgtat

SEQ ID NO: 2751122 - DNA, 18 bp, Homo sapiens
atttgccttttaaattct

SEQ ID NO: 2751123 - DNA, 14 bp, Homo sapiens
atttgctcatggaa

SEQ ID NO: 2751124 - DNA, 17 bp, Homo sapiens
atttgctcatggaattg

SEQ ID NO: 2751125 - DNA, 19 bp, Homo sapiens
atttggaacagtgacaata

SEQ ID NO: 2751126 - DNA, 19 bp, Homo sapiens
atttgtataaaataatttt

SEQ ID NO: 2751127 - DNA, 19 bp, Homo sapiens
atttgtccatttaaaaatg

SEQ ID NO: 2751128 - DNA, 22 bp, Homo sapiens
atttgtgttgggggaaatgttg

SEQ ID NO: 2751129 - DNA, 18 bp, Homo sapiens
attttaaaagaatgatta

SEQ ID NO: 2751130 - DNA, 21 bp, Homo sapiens
attttaagtgtttaaaagcaa

SEQ ID NO: 2751131 - DNA, 22 bp, Homo sapiens
attttaagtgtttaaaagcaaa

SEQ ID NO: 2751132 - DNA, 12 bp, Homo sapiens
attttaataatg

SEQ ID NO: 2751133 - DNA, 13 bp, Homo sapiens
attttaggaaagg

SEQ ID NO: 2751134 - DNA, 15 bp, Homo sapiens
attttaggaaaggat

SEQ ID NO: 2751135 - DNA, 19 bp, Homo sapiens
attttatcaaggaagtctt

SEQ ID NO: 2751136 - DNA, 18 bp, Homo sapiens
attttctctaaactgttt

SEQ ID NO: 2751137 - DNA, 13 bp, Homo sapiens
attttgaatgtac

SEQ ID NO: 2751138 - DNA, 17 bp, Homo sapiens
attttgtaaatctgtac

SEQ ID NO: 2751139 - DNA, 18 bp, Homo sapiens
attttgtaaatctgtact

SEQ ID NO: 2751140 - DNA, 20 bp, Homo sapiens
attttgtaaatctgtacttt

SEQ ID NO: 2751141 - DNA, 13 bp, Homo sapiens
atttttaaaactg

SEQ ID NO: 2751142 - DNA, 21 bp, Homo sapiens
atttttaaattggagaaaagc

SEQ ID NO: 2751143 - DNA, 12 bp, Homo sapiens
atttttaatcag

SEQ ID NO: 2751144 - DNA, 15 bp, Homo sapiens
atttttatatttgaa

SEQ ID NO: 2751145 - DNA, 14 bp, Homo sapiens
atttttgaattctt

SEQ ID NO: 2751146 - DNA, 14 bp, Homo sapiens
attttttaattgtt

SEQ ID NO: 2751147 - DNA, 21 bp, Homo sapiens
attttttcatttcaaaatgct

SEQ ID NO: 2751148 - DNA, 20 bp, Homo sapiens
attttttctctaggaaatat

SEQ ID NO: 2751149 - DNA, 20 bp, Homo sapiens
atttttttccaagtgtataa

SEQ ID NO: 2751150 - DNA, 17 bp, Homo sapiens
attttttttttaatctc

SEQ ID NO: 2751151 - DNA, 22 bp, Homo sapiens
caaaaagatgctttaattgtgt

SEQ ID NO: 2751152 - DNA, 13 bp, Homo sapiens
caaaactatccta

SEQ ID NO: 2751153 - DNA, 19 bp, Homo sapiens
caaaactatcctatgcctt

SEQ ID NO: 2751154 - DNA, 23 bp, Homo sapiens
caaaagaaaccatgcaaagcaac

SEQ ID NO: 2751155 - DNA, 18 bp, Homo sapiens
caaaatattggtattaaa

SEQ ID NO: 2751156 - DNA, 20 bp, Homo sapiens
caaaatattggtattaaaga

SEQ ID NO: 2751157 - DNA, 21 bp, Homo sapiens
caaaatattggtattaaagaa

SEQ ID NO: 2751158 - DNA, 13 bp, Homo sapiens
caaaatattttat

SEQ ID NO: 2751159 - DNA, 16 bp, Homo sapiens
caaaatggaaaattaa

SEQ ID NO: 2751160 - DNA, 19 bp, Homo sapiens
caaaatttttaaaactgca

SEQ ID NO: 2751161 - DNA, 12 bp, Homo sapiens
caaacctgctgg

SEQ ID NO: 2751162 - DNA, 14 bp, Homo sapiens
caaacctgctggtg

SEQ ID NO: 2751163 - DNA, 19 bp, Homo sapiens
caaacctgtagatgcagaa

SEQ ID NO: 2751164 - DNA, 22 bp, Homo sapiens
caaacctgtagatgcagaaaaa

SEQ ID NO: 2751165 - DNA, 17 bp, Homo sapiens
caaactgactcttaaga

SEQ ID NO: 2751166 - DNA, 22 bp, Homo sapiens
caaagagagtttttaatagaac

SEQ ID NO: 2751167 - DNA, 20 bp, Homo sapiens
caaagggcctgcccagacaa

SEQ ID NO: 2751168 - DNA, 21 bp, Homo sapiens
caaagggcctgcccagacaag

SEQ ID NO: 2751169 - DNA, 23 bp, Homo sapiens
caaagtaaaaataaactgttatg

SEQ ID NO: 2751170 - DNA, 19 bp, Homo sapiens
caaatactgattttcaaaa

SEQ ID NO: 2751171 - DNA, 17 bp, Homo sapiens
caaatagtatagaaaat

SEQ ID NO: 2751172 - DNA, 11 bp, Homo sapiens
caaatattgaa

SEQ ID NO: 2751173 - DNA, 17 bp, Homo sapiens
caaatattgaatgcctt

SEQ ID NO: 2751174 - DNA, 15 bp, Homo sapiens
caaatccttgaagat

SEQ ID NO: 2751175 - DNA, 20 bp, Homo sapiens
caaatctgtataaatgtcta

SEQ ID NO: 2751176 - DNA, 19 bp, Homo sapiens
caaattttttaaaagagac

SEQ ID NO: 2751177 - DNA, 18 bp, Homo sapiens
caacaataataattaaag

SEQ ID NO: 2751178 - DNA, 12 bp, Homo sapiens
caactccagaaa

SEQ ID NO: 2751179 - DNA, 15 bp, Homo sapiens
caagaatggtggctt

SEQ ID NO: 2751180 - DNA, 20 bp, Homo sapiens
caagaatggtggcttctttt

SEQ ID NO: 2751181 - DNA, 16 bp, Homo sapiens
caagagactttgtcac

SEQ ID NO: 2751182 - DNA, 20 bp, Homo sapiens
caagagactttgtcacttat

SEQ ID NO: 2751183 - DNA, 18 bp, Homo sapiens
caagatgccaacatcggt

SEQ ID NO: 2751184 - DNA, 14 bp, Homo sapiens
caagcaagtattag

SEQ ID NO: 2751185 - DNA, 17 bp, Homo sapiens
caagccttggctctacc

SEQ ID NO: 2751186 - DNA, 15 bp, Homo sapiens
caagcgttattttgg

SEQ ID NO: 2751187 - DNA, 17 bp, Homo sapiens
caaggaagtcttcaaat

SEQ ID NO: 2751188 - DNA, 17 bp, Homo sapiens
caaggattttttaaaaa

SEQ ID NO: 2751189 - DNA, 16 bp, Homo sapiens
caaggttgctgttgtg

SEQ ID NO: 2751190 - DNA, 23 bp, Homo sapiens
caaggttgctgttgtgcagtgtg

SEQ ID NO: 2751191 - DNA, 20 bp, Homo sapiens
caagtattagaataccacag

SEQ ID NO: 2751192 - DNA, 19 bp, Homo sapiens
caagtcctgactgggctgg

SEQ ID NO: 2751193 - DNA, 14 bp, Homo sapiens
caagtgtataatgt

SEQ ID NO: 2751194 - DNA, 19 bp, Homo sapiens
caataaaaatcaggagcct

SEQ ID NO: 2751195 - DNA, 15 bp, Homo sapiens
caataaatgttgaaa

SEQ ID NO: 2751196 - DNA, 20 bp, Homo sapiens
caatagtgtcctatgcaata

SEQ ID NO: 2751197 - DNA, 17 bp, Homo sapiens
caatcagcctagttgat

SEQ ID NO: 2751198 - DNA, 19 bp, Homo sapiens
caatcttgttttaagcaaa

SEQ ID NO: 2751199 - DNA, 20 bp, Homo sapiens
caatgccacatacttgcagc

SEQ ID NO: 2751200 - DNA, 17 bp, Homo sapiens
caatgctgtattttaaa

SEQ ID NO: 2751201 - DNA, 23 bp, Homo sapiens
caatgctgtattttaaaagaatg

SEQ ID NO: 2751202 - DNA, 15 bp, Homo sapiens
caatgtgatctatgt

SEQ ID NO: 2751203 - DNA, 16 bp, Homo sapiens
caatgtgatctatgtt

SEQ ID NO: 2751204 - DNA, 14 bp, Homo sapiens
caatttcaaaagaa

SEQ ID NO: 2751205 - DNA, 18 bp, Homo sapiens
cacaagactgcacatcaa

SEQ ID NO: 2751206 - DNA, 17 bp, Homo sapiens
cacaagtgtgtggcccc

SEQ ID NO: 2751207 - DNA, 18 bp, Homo sapiens
cacaagtgtgtggccccg

SEQ ID NO: 2751208 - DNA, 17 bp, Homo sapiens
cacacatgaagtccaag

SEQ ID NO: 2751209 - DNA, 23 bp, Homo sapiens
cacagaagcctaggaggactggg

SEQ ID NO: 2751210 - DNA, 17 bp, Homo sapiens
cacagcctcttagatgc

SEQ ID NO: 2751211 - DNA, 19 bp, Homo sapiens
cacaggaaccacaagactg

SEQ ID NO: 2751212 - DNA, 16 bp, Homo sapiens
cacagtattgtagaaa

SEQ ID NO: 2751213 - DNA, 15 bp, Homo sapiens
cacatatatatccta

SEQ ID NO: 2751214 - DNA, 12 bp, Homo sapiens
cacatcttgaaa

SEQ ID NO: 2751215 - DNA, 20 bp, Homo sapiens
cacatcttgaaaatgccacc

SEQ ID NO: 2751216 - DNA, 21 bp, Homo sapiens
cacatcttgaaaatgccacca

SEQ ID NO: 2751217 - DNA, 17 bp, Homo sapiens
cacatgaagtccaagca

SEQ ID NO: 2751218 - DNA, 20 bp, Homo sapiens
cacatgaagtccaagcattt

SEQ ID NO: 2751219 - DNA, 19 bp, Homo sapiens
cacattaactcaggcattt

SEQ ID NO: 2751220 - DNA, 17 bp, Homo sapiens
cacatttcatctaattt

SEQ ID NO: 2751221 - DNA, 14 bp, Homo sapiens
cacattttgtaaat

SEQ ID NO: 2751222 - DNA, 20 bp, Homo sapiens
caccacaattctccctatct

SEQ ID NO: 2751223 - DNA, 19 bp, Homo sapiens
caccactttgtaaaaggac

SEQ ID NO: 2751224 - DNA, 21 bp, Homo sapiens
caccactttgtaaaaggactc

SEQ ID NO: 2751225 - DNA, 21 bp, Homo sapiens
cacccagaagaagatggctgt

SEQ ID NO: 2751226 - DNA, 14 bp, Homo sapiens
caccccgccggagg

SEQ ID NO: 2751227 - DNA, 19 bp, Homo sapiens
caccccgccggaggaaggt

SEQ ID NO: 2751228 - DNA, 22 bp, Homo sapiens
cacccctggctaccttgtggga

SEQ ID NO: 2751229 - DNA, 11 bp, Homo sapiens
cacctcatgga

SEQ ID NO: 2751230 - DNA, 14 bp, Homo sapiens
cacctcatggaatt

SEQ ID NO: 2751231 - DNA, 21 bp, Homo sapiens
cacgggtaaatctagtaccat

SEQ ID NO: 2751232 - DNA, 14 bp, Homo sapiens
cactattatagaaa

SEQ ID NO: 2751233 - DNA, 19 bp, Homo sapiens
cactattatagaaattctg

SEQ ID NO: 2751234 - DNA, 19 bp, Homo sapiens
cactcatgacggcctgcct

SEQ ID NO: 2751235 - DNA, 20 bp, Homo sapiens
cactcatgacggcctgcctg

SEQ ID NO: 2751236 - DNA, 22 bp, Homo sapiens
cactcatgacggcctgcctgca

SEQ ID NO: 2751237 - DNA, 20 bp, Homo sapiens
cactcgccatctcctgggcc

SEQ ID NO: 2751238 - DNA, 22 bp, Homo sapiens
cactgtgggtagacacacatga

SEQ ID NO: 2751239 - DNA, 23 bp, Homo sapiens
cactgtttatggaaataccagga

SEQ ID NO: 2751240 - DNA, 21 bp, Homo sapiens
cacttaacattcctaaaatgc

SEQ ID NO: 2751241 - DNA, 19 bp, Homo sapiens
cacttctgccatgagcaga

SEQ ID NO: 2751242 - DNA, 17 bp, Homo sapiens
cgttattataaatgtta

SEQ ID NO: 2751243 - DNA, 21 bp, Homo sapiens
ctaaaataaaatttaaaaaac

SEQ ID NO: 2751244 - DNA, 16 bp, Homo sapiens
ctaaaatgtagaaatt

SEQ ID NO: 2751245 - DNA, 18 bp, Homo sapiens
ctaaaatgtagaaattct

SEQ ID NO: 2751246 - DNA, 16 bp, Homo sapiens
ctaaactgtttcttag

SEQ ID NO: 2751247 - DNA, 16 bp, Homo sapiens
ctaaacttagaaatat

SEQ ID NO: 2751248 - DNA, 22 bp, Homo sapiens
ctaaagagctacttctaattat

SEQ ID NO: 2751249 - DNA, 17 bp, Homo sapiens
ctaacaaattttaagtg

SEQ ID NO: 2751250 - DNA, 18 bp, Homo sapiens
ctaactgaaggtgcagtt

SEQ ID NO: 2751251 - DNA, 14 bp, Homo sapiens
ctaagatttatctg

SEQ ID NO: 2751252 - DNA, 15 bp, Homo sapiens
ctaaggaacaatgcc

SEQ ID NO: 2751253 - DNA, 19 bp, Homo sapiens
ctaagggaaaaagttgtat

SEQ ID NO: 2751254 - DNA, 20 bp, Homo sapiens
ctaatcttaaatcagaataa

SEQ ID NO: 2751255 - DNA, 21 bp, Homo sapiens
ctaatcttaaatcagaataaa

SEQ ID NO: 2751256 - DNA, 18 bp, Homo sapiens
ctaatgaaagtgatgaca

SEQ ID NO: 2751257 - DNA, 23 bp, Homo sapiens
ctaatgacatgcctatatgagaa

SEQ ID NO: 2751258 - DNA, 22 bp, Homo sapiens
ctaattctttgacctgttggga

SEQ ID NO: 2751259 - DNA, 17 bp, Homo sapiens
ctaattttttaaagaat

SEQ ID NO: 2751260 - DNA, 15 bp, Homo sapiens
ctacaggacaagggg

SEQ ID NO: 2751261 - DNA, 18 bp, Homo sapiens
ctacaggacaaggggcat

SEQ ID NO: 2751262 - DNA, 11 bp, Homo sapiens
ctaccttgtgg

SEQ ID NO: 2751263 - DNA, 14 bp, Homo sapiens
ctaccttgtgggaa

SEQ ID NO: 2751264 - DNA, 15 bp, Homo sapiens
ctaccttgtgggaat

SEQ ID NO: 2751265 - DNA, 15 bp, Homo sapiens
ctacttctaattatt

SEQ ID NO: 2751266 - DNA, 22 bp, Homo sapiens
ctagaactggtgatataaagaa

SEQ ID NO: 2751267 - DNA, 12 bp, Homo sapiens
ctagaaggggaa

SEQ ID NO: 2751268 - DNA, 16 bp, Homo sapiens
ctagacaaggttgctg

SEQ ID NO: 2751269 - DNA, 20 bp, Homo sapiens
ctagcctctttgtgtttttg

SEQ ID NO: 2751270 - DNA, 19 bp, Homo sapiens
ctaggaaatatttatttta

SEQ ID NO: 2751271 - DNA, 13 bp, Homo sapiens
ctagttttatctt

SEQ ID NO: 2751272 - DNA, 20 bp, Homo sapiens
ctagttttatcttaaactgt

SEQ ID NO: 2751273 - DNA, 17 bp, Homo sapiens
ctataaatacaaatctg

SEQ ID NO: 2751274 - DNA, 19 bp, Homo sapiens
ctataaatacaaatctgta

SEQ ID NO: 2751275 - DNA, 16 bp, Homo sapiens
ctataacattctgaca

SEQ ID NO: 2751276 - DNA, 20 bp, Homo sapiens
ctataattccttaaaatttt

SEQ ID NO: 2751277 - DNA, 16 bp, Homo sapiens
ctatatgagaagaata

SEQ ID NO: 2751278 - DNA, 11 bp, Homo sapiens
ctatatgtgcg

SEQ ID NO: 2751279 - DNA, 20 bp, Homo sapiens
ctatcctatgccttcaaata

SEQ ID NO: 2751280 - DNA, 15 bp, Homo sapiens
ctatcgttattataa

SEQ ID NO: 2751281 - DNA, 17 bp, Homo sapiens
ctatcgttattataaat

SEQ ID NO: 2751282 - DNA, 20 bp, Homo sapiens
ctatcgttattataaatgtt

SEQ ID NO: 2751283 - DNA, 21 bp, Homo sapiens
ctatcgttattataaatgtta

SEQ ID NO: 2751284 - DNA, 18 bp, Homo sapiens
ctatgaaatattatgtta

SEQ ID NO: 2751285 - DNA, 22 bp, Homo sapiens
ctatgaatttgtccatttaaaa

SEQ ID NO: 2751286 - DNA, 16 bp, Homo sapiens
ctatgccttcaaatag

SEQ ID NO: 2751287 - DNA, 17 bp, Homo sapiens
ctatgccttcaaatagt

SEQ ID NO: 2751288 - DNA, 20 bp, Homo sapiens
ctatggggatagatgtgtgg

SEQ ID NO: 2751289 - DNA, 21 bp, Homo sapiens
ctattacttggcaaattctga

SEQ ID NO: 2751290 - DNA, 21 bp, Homo sapiens
ctattagtttcaattgagtaa

SEQ ID NO: 2751291 - DNA, 19 bp, Homo sapiens
ctattatagaaattctgaa

SEQ ID NO: 2751292 - DNA, 14 bp, Homo sapiens
ctattcattatgca

SEQ ID NO: 2751293 - DNA, 20 bp, Homo sapiens
ctattttgaaaggtcagaat

SEQ ID NO: 2751294 - DNA, 22 bp, Homo sapiens
ctattttgaaaggtcagaattt

SEQ ID NO: 2751295 - DNA, 23 bp, Homo sapiens
ctattttgaaaggtcagaatttt

SEQ ID NO: 2751296 - DNA, 23 bp, Homo sapiens
ctcaaactttgtgtataagttgt

SEQ ID NO: 2751297 - DNA, 14 bp, Homo sapiens
ctcaatatatagtt

SEQ ID NO: 2751298 - DNA, 15 bp, Homo sapiens
ctcaggaaagaatag

SEQ ID NO: 2751299 - DNA, 22 bp, Homo sapiens
ctcaggcatggatgaataaatg

SEQ ID NO: 2751300 - DNA, 23 bp, Homo sapiens
ctcaggccgaaggaggagtcagg

SEQ ID NO: 2751301 - DNA, 20 bp, Homo sapiens
ctcaggcctgactctcagca

SEQ ID NO: 2751302 - DNA, 12 bp, Homo sapiens
ctcatttccaag

SEQ ID NO: 2751303 - DNA, 16 bp, Homo sapiens
ctccaaagtcttgata

SEQ ID NO: 2751304 - DNA, 18 bp, Homo sapiens
ctccaactttattttgaa

SEQ ID NO: 2751305 - DNA, 19 bp, Homo sapiens
ctccccatgatgtttagaa

SEQ ID NO: 2751306 - DNA, 20 bp, Homo sapiens
ctcctgagttgtataaaagt

SEQ ID NO: 2751307 - DNA, 23 bp, Homo sapiens
ctcctgggccgttacatctgtgc

SEQ ID NO: 2751308 - DNA, 22 bp, Homo sapiens
ctccttggatttgcatttttgt

SEQ ID NO: 2751309 - DNA, 18 bp, Homo sapiens
ctcgatgcaagtgtttct

SEQ ID NO: 2751310 - DNA, 20 bp, Homo sapiens
ctcgatgcaagtgtttctgt

SEQ ID NO: 2751311 - DNA, 12 bp, Homo sapiens
ctcgccatctcc

SEQ ID NO: 2751312 - DNA, 14 bp, Homo sapiens
ctcggcgcccccac

SEQ ID NO: 2751313 - DNA, 19 bp, Homo sapiens
ctcggcgcccccacccctg

SEQ ID NO: 2751314 - DNA, 20 bp, Homo sapiens
ctcggcgcccccacccctgg

SEQ ID NO: 2751315 - DNA, 22 bp, Homo sapiens
ctcggcgcccccacccctggct

SEQ ID NO: 2751316 - DNA, 13 bp, Homo sapiens
ctctactgtgtaa

SEQ ID NO: 2751317 - DNA, 13 bp, Homo sapiens
ctctagcctcttt

SEQ ID NO: 2751318 - DNA, 18 bp, Homo sapiens
ctctattagtttcaattg

SEQ ID NO: 2751319 - DNA, 21 bp, Homo sapiens
ctctcagggccgagaggacag

SEQ ID NO: 2751320 - DNA, 15 bp, Homo sapiens
ctctccccatgatgt

SEQ ID NO: 2751321 - DNA, 20 bp, Homo sapiens
ctctgcccaggaactcgcac

SEQ ID NO: 2751322 - DNA, 19 bp, Homo sapiens
ctctgtaagatatcccagc

SEQ ID NO: 2751323 - DNA, 16 bp, Homo sapiens
ctctgtccaactctgt

SEQ ID NO: 2751324 - DNA, 13 bp, Homo sapiens
ctcttaagaagac

SEQ ID NO: 2751325 - DNA, 22 bp, Homo sapiens
ctcttagatgcagttctgaaga

SEQ ID NO: 2751326 - DNA, 23 bp, Homo sapiens
ctcttccatcagagatgggaaaa

SEQ ID NO: 2751327 - DNA, 15 bp, Homo sapiens
ctcttgccacatctt

SEQ ID NO: 2751328 - DNA, 16 bp, Homo sapiens
ctcttttccaaacaca

SEQ ID NO: 2751329 - DNA, 13 bp, Homo sapiens
ctgaaagaaacta

SEQ ID NO: 2751330 - DNA, 19 bp, Homo sapiens
ctgaaagaaactaagattt

SEQ ID NO: 2751331 - DNA, 16 bp, Homo sapiens
ctgaacctttcaaaat

SEQ ID NO: 2751332 - DNA, 21 bp, Homo sapiens
ctgaaggagagagtcttttaa

SEQ ID NO: 2751333 - DNA, 14 bp, Homo sapiens
ctgaaggtgcagtt

SEQ ID NO: 2751334 - DNA, 14 bp, Homo sapiens
ctgaattttggtaa

SEQ ID NO: 2751335 - DNA, 20 bp, Homo sapiens
ctgacacatatcattctgtg

SEQ ID NO: 2751336 - DNA, 14 bp, Homo sapiens
ctgactgggctggg

SEQ ID NO: 2751337 - DNA, 16 bp, Homo sapiens
ctgactgggctgggtt

SEQ ID NO: 2751338 - DNA, 18 bp, Homo sapiens
ctgactgggctgggtttg

SEQ ID NO: 2751339 - DNA, 22 bp, Homo sapiens
ctgaggtaagtgtatgatctta

SEQ ID NO: 2751340 - DNA, 17 bp, Homo sapiens
ctgagttgtataaaagt

SEQ ID NO: 2751341 - DNA, 17 bp, Homo sapiens
ctgatgcagtgccctag

SEQ ID NO: 2751342 - DNA, 23 bp, Homo sapiens
ctgatgcgacttgttttgctgct

SEQ ID NO: 2751343 - DNA, 16 bp, Homo sapiens
ctgatttaaaaagtga

SEQ ID NO: 2751344 - DNA, 24 bp, Homo sapiens
ctgatttaaaaagtgagaaagaaa

SEQ ID NO: 2751345 - DNA, 16 bp, Homo sapiens
ctgatttgttccttct

SEQ ID NO: 2751346 - DNA, 23 bp, Homo sapiens
ctgcaaacctgctggtggggcag

SEQ ID NO: 2751347 - DNA, 17 bp, Homo sapiens
ctgcaaggattttttaa

SEQ ID NO: 2751348 - DNA, 19 bp, Homo sapiens
ctgcaaggattttttaaaa

SEQ ID NO: 2751349 - DNA, 21 bp, Homo sapiens
ctgcaaggattttttaaaaat

SEQ ID NO: 2751350 - DNA, 22 bp, Homo sapiens
ctgcaaggattttttaaaaatt

SEQ ID NO: 2751351 - DNA, 18 bp, Homo sapiens
ctgcaatgtgatctatgt

SEQ ID NO: 2751352 - DNA, 16 bp, Homo sapiens
ctgcataaatttgtaa

SEQ ID NO: 2751353 - DNA, 17 bp, Homo sapiens
ctgcataaatttgtaat

SEQ ID NO: 2751354 - DNA, 17 bp, Homo sapiens
ctgcatcttagtttact

SEQ ID NO: 2751355 - DNA, 19 bp, Homo sapiens
ctgcatctttcatagttct

SEQ ID NO: 2751356 - DNA, 20 bp, Homo sapiens
ctgcatctttcatagttctg

SEQ ID NO: 2751357 - DNA, 23 bp, Homo sapiens
ctgcatctttcatagttctgtta

SEQ ID NO: 2751358 - DNA, 22 bp, Homo sapiens
ctgccatggacatgagtttaaa

SEQ ID NO: 2751359 - DNA, 18 bp, Homo sapiens
ctgcccacgcccttggag

SEQ ID NO: 2751360 - DNA, 22 bp, Homo sapiens
ctgcccacgcccttggagcctt

SEQ ID NO: 2751361 - DNA, 17 bp, Homo sapiens
ctgcccagacaagattt

SEQ ID NO: 2751362 - DNA, 14 bp, Homo sapiens
ctgcctattgctga

SEQ ID NO: 2751363 - DNA, 20 bp, Homo sapiens
ctgcctggagtgctgtgctg

SEQ ID NO: 2751364 - DNA, 15 bp, Homo sapiens
ctgctggtggggcag

SEQ ID NO: 2751365 - DNA, 17 bp, Homo sapiens
ctgctggtggggcagac

SEQ ID NO: 2751366 - DNA, 21 bp, Homo sapiens
gctctatttacttctaatctt

SEQ ID NO: 2751367 - DNA, 14 bp, Homo sapiens
gctgaggcctctca

SEQ ID NO: 2751368 - DNA, 14 bp, Homo sapiens
gctgaggtgtctgg

SEQ ID NO: 2751369 - DNA, 20 bp, Homo sapiens
gctgaggtgtctggcctgag

SEQ ID NO: 2751370 - DNA, 17 bp, Homo sapiens
gctgatttaaaaagtga

SEQ ID NO: 2751371 - DNA, 13 bp, Homo sapiens
gctgcactgttta

SEQ ID NO: 2751372 - DNA, 18 bp, Homo sapiens
gctgcataaatttgtaat

SEQ ID NO: 2751373 - DNA, 17 bp, Homo sapiens
gctgggtttgctgtctt

SEQ ID NO: 2751374 - DNA, 20 bp, Homo sapiens
gctggttctttgttctgtcc

SEQ ID NO: 2751375 - DNA, 17 bp, Homo sapiens
gctggtttcctgcccag

SEQ ID NO: 2751376 - DNA, 14 bp, Homo sapiens
gctgtagataaata

SEQ ID NO: 2751377 - DNA, 18 bp, Homo sapiens
gctgtgcgtggaaaaaga

SEQ ID NO: 2751378 - DNA, 20 bp, Homo sapiens
gctgtggaatgaagcttttt

SEQ ID NO: 2751379 - DNA, 15 bp, Homo sapiens
gcttggtgctggttt

SEQ ID NO: 2751380 - DNA, 20 bp, Homo sapiens
gcttggtgctggtttatttg

SEQ ID NO: 2751381 - DNA, 17 bp, Homo sapiens
gcttgtgtatcttgatt

SEQ ID NO: 2751382 - DNA, 19 bp, Homo sapiens
gcttgttccaatgccacat

SEQ ID NO: 2751383 - DNA, 16 bp, Homo sapiens
gctttaaaaagaaaaa

SEQ ID NO: 2751384 - DNA, 23 bp, Homo sapiens
gctttaattgtgtggtgctttta

SEQ ID NO: 2751385 - DNA, 17 bp, Homo sapiens
gctttcagctgtgcttt

SEQ ID NO: 2751386 - DNA, 20 bp, Homo sapiens
ggaaataccaggaccagttt

SEQ ID NO: 2751387 - DNA, 15 bp, Homo sapiens
ggaaatatttatttt

SEQ ID NO: 2751388 - DNA, 19 bp, Homo sapiens
ggaaatcagggttagtatt

SEQ ID NO: 2751389 - DNA, 12 bp, Homo sapiens
ggaacagactcg

SEQ ID NO: 2751390 - DNA, 19 bp, Homo sapiens
ggaactcgcacctgtgctg

SEQ ID NO: 2751391 - DNA, 17 bp, Homo sapiens
ggaactttgatacaaat

SEQ ID NO: 2751392 - DNA, 13 bp, Homo sapiens
ggaagctgaatta

SEQ ID NO: 2751393 - DNA, 23 bp, Homo sapiens
ggaagggacaccaagccttggct

SEQ ID NO: 2751394 - DNA, 21 bp, Homo sapiens
ggaagtgtgggtctgtgtgtg

SEQ ID NO: 2751395 - DNA, 22 bp, Homo sapiens
ggaattggagctcgtgggacag

SEQ ID NO: 2751396 - DNA, 17 bp, Homo sapiens
ggacatgagtttaaagc

SEQ ID NO: 2751397 - DNA, 16 bp, Homo sapiens
ggacatttgctcatgg

SEQ ID NO: 2751398 - DNA, 17 bp, Homo sapiens
ggacatttgctcatgga

SEQ ID NO: 2751399 - DNA, 20 bp, Homo sapiens
ggacatttgctcatggaatt

SEQ ID NO: 2751400 - DNA, 15 bp, Homo sapiens
ggagaaaagcactta

SEQ ID NO: 2751401 - DNA, 20 bp, Homo sapiens
ggagagagtcttttaacttt

SEQ ID NO: 2751402 - DNA, 13 bp, Homo sapiens
ggagcctgctaag

SEQ ID NO: 2751403 - DNA, 16 bp, Homo sapiens
ggagcctgctaaggaa

SEQ ID NO: 2751404 - DNA, 14 bp, Homo sapiens
ggaggactaggacc

SEQ ID NO: 2751405 - DNA, 14 bp, Homo sapiens
ggagtgctgtgctg

SEQ ID NO: 2751406 - DNA, 11 bp, Homo sapiens
ggagtgtgtaa

SEQ ID NO: 2751407 - DNA, 20 bp, Homo sapiens
ggatggccgcagggctgtgc

SEQ ID NO: 2751408 - DNA, 13 bp, Homo sapiens
ggatgtctgggcc

SEQ ID NO: 2751409 - DNA, 20 bp, Homo sapiens
ggcaaatccgaaatcagcag

SEQ ID NO: 2751410 - DNA, 22 bp, Homo sapiens
ggcaacataataagacttttct

SEQ ID NO: 2751411 - DNA, 14 bp, Homo sapiens
ggccaagagaaggg

SEQ ID NO: 2751412 - DNA, 14 bp, Homo sapiens
ggccccgcccgagc

SEQ ID NO: 2751413 - DNA, 16 bp, Homo sapiens
ggccccgcccgagccc

SEQ ID NO: 2751414 - DNA, 12 bp, Homo sapiens
ggccctgtgcct

SEQ ID NO: 2751415 - DNA, 17 bp, Homo sapiens
ggccctgtgccttggtg

SEQ ID NO: 2751416 - DNA, 16 bp, Homo sapiens
ggcctgactctcagca

SEQ ID NO: 2751417 - DNA, 14 bp, Homo sapiens
ggcctgctgggctt

SEQ ID NO: 2751418 - DNA, 15 bp, Homo sapiens
ggcgctgaggtgtct

SEQ ID NO: 2751419 - DNA, 20 bp, Homo sapiens
ggcgctgaggtgtctggcct

SEQ ID NO: 2751420 - DNA, 16 bp, Homo sapiens
ggctaccttgtgggaa

SEQ ID NO: 2751421 - DNA, 21 bp, Homo sapiens
ggctatggggatagatgtgtg

SEQ ID NO: 2751422 - DNA, 16 bp, Homo sapiens
ggctcccaaactcagg

SEQ ID NO: 2751423 - DNA, 17 bp, Homo sapiens
ggctggatctgtgaggg

SEQ ID NO: 2751424 - DNA, 22 bp, Homo sapiens
ggcttggctcggcgcccccacc

SEQ ID NO: 2751425 - DNA, 10 bp, Homo sapiens
gggaaaaagc

SEQ ID NO: 2751426 - DNA, 14 bp, Homo sapiens
gggaattgaggaca

SEQ ID NO: 2751427 - DNA, 20 bp, Homo sapiens
gggacaccaagccttggctc

SEQ ID NO: 2751428 - DNA, 19 bp, Homo sapiens
gggacatttgctcatggaa

SEQ ID NO: 2751429 - DNA, 19 bp, Homo sapiens
gggagaatgtcagtatgtg

SEQ ID NO: 2751430 - DNA, 17 bp, Homo sapiens
gggcatgtctgcctgga

SEQ ID NO: 2751431 - DNA, 17 bp, Homo sapiens
gggcttacaggcatgga

SEQ ID NO: 2751432 - DNA, 16 bp, Homo sapiens
gggcttgactttggct

SEQ ID NO: 2751433 - DNA, 19 bp, Homo sapiens
ggggaattgaggacactga

SEQ ID NO: 2751434 - DNA, 13 bp, Homo sapiens
ggggatagatgtg

SEQ ID NO: 2751435 - DNA, 12 bp, Homo sapiens
gggtcccactgc

SEQ ID NO: 2751436 - DNA, 13 bp, Homo sapiens
ggtaaattggtca

SEQ ID NO: 2751437 - DNA, 22 bp, Homo sapiens
ggtagacacacatgaagtccaa

SEQ ID NO: 2751438 - DNA, 19 bp, Homo sapiens
ggtatgtcacaaagagctg

SEQ ID NO: 2751439 - DNA, 22 bp, Homo sapiens
ggtcatatgtttattcaaaata

SEQ ID NO: 2751440 - DNA, 22 bp, Homo sapiens
ggtcccatggcctgctgggctt

SEQ ID NO: 2751441 - DNA, 21 bp, Homo sapiens
ggtcccattgttggcgctgag

SEQ ID NO: 2751442 - DNA, 13 bp, Homo sapiens
ggtcccctccctc

SEQ ID NO: 2751443 - DNA, 21 bp, Homo sapiens
ggtctataattccttaaaatt

SEQ ID NO: 2751444 - DNA, 22 bp, Homo sapiens
ggtctataattccttaaaattt

SEQ ID NO: 2751445 - DNA, 16 bp, Homo sapiens
ggtcttacattgcctg

SEQ ID NO: 2751446 - DNA, 23 bp, Homo sapiens
ggtctttaaatcattttaggaaa

SEQ ID NO: 2751447 - DNA, 12 bp, Homo sapiens
ggtgctggttta

SEQ ID NO: 2751448 - DNA, 21 bp, Homo sapiens
ggtggcttcttttctttgtat

SEQ ID NO: 2751449 - DNA, 20 bp, Homo sapiens
ggtgtctggcctgaggtcaa

SEQ ID NO: 2751450 - DNA, 22 bp, Homo sapiens
ggtgtcttcattttacattgtg

SEQ ID NO: 2751451 - DNA, 20 bp, Homo sapiens
ggtgtgaactaagttattgc

SEQ ID NO: 2751452 - DNA, 15 bp, Homo sapiens
ggtgtggagttttca

SEQ ID NO: 2751453 - DNA, 23 bp, Homo sapiens
ggtttgactctgtccaactctgt

SEQ ID NO: 2751454 - DNA, 16 bp, Homo sapiens
ggtttgctgtcttggg

SEQ ID NO: 2751455 - DNA, 15 bp, Homo sapiens
gtaaaaccataaaca

SEQ ID NO: 2751456 - DNA, 14 bp, Homo sapiens
gtaaagctgttaaa

SEQ ID NO: 2751457 - DNA, 15 bp, Homo sapiens
gtaaagtaaaatatg

SEQ ID NO: 2751458 - DNA, 19 bp, Homo sapiens
gtaaatcacactcaaactt

SEQ ID NO: 2751459 - DNA, 15 bp, Homo sapiens
gtaaatctgtacttt

SEQ ID NO: 2751460 - DNA, 15 bp, Homo sapiens
gtaaattctgttgaa

SEQ ID NO: 2751461 - DNA, 16 bp, Homo sapiens
gtaacttaaatatttg

SEQ ID NO: 2751462 - DNA, 14 bp, Homo sapiens
gtaatataaaagat

SEQ ID NO: 2751463 - DNA, 19 bp, Homo sapiens
gtaatatatcctgtttgta

SEQ ID NO: 2751464 - DNA, 20 bp, Homo sapiens
gtaatatatcctgtttgtat

SEQ ID NO: 2751465 - DNA, 21 bp, Homo sapiens
gtaattaggataactaaaatt

SEQ ID NO: 2751466 - DNA, 17 bp, Homo sapiens
gtacaaagtaaaaataa

SEQ ID NO: 2751467 - DNA, 23 bp, Homo sapiens
gtacactgccttctcaactccaa

SEQ ID NO: 2751468 - DNA, 20 bp, Homo sapiens
gtacatttggaacagtgaca

SEQ ID NO: 2751469 - DNA, 21 bp, Homo sapiens
gtacatttggaacagtgacaa

SEQ ID NO: 2751470 - DNA, 22 bp, Homo sapiens
gtacctctattagtttcaattg

SEQ ID NO: 2751471 - DNA, 23 bp, Homo sapiens
gtactttttattgcatggtgtga

SEQ ID NO: 2751472 - DNA, 16 bp, Homo sapiens
gtagaaagctaataca

SEQ ID NO: 2751473 - DNA, 18 bp, Homo sapiens
gtagaaagctaatacaaa

SEQ ID NO: 2751474 - DNA, 13 bp, Homo sapiens
gtagaaattctaa

SEQ ID NO: 2751475 - DNA, 15 bp, Homo sapiens
gtagataaataatgt

SEQ ID NO: 2751476 - DNA, 14 bp, Homo sapiens
gtagatgcagaaaa

SEQ ID NO: 2751477 - DNA, 21 bp, Homo sapiens
gtagcaggacctgccaagaag

SEQ ID NO: 2751478 - DNA, 16 bp, Homo sapiens
gtaggaactgctgggc

SEQ ID NO: 2751479 - DNA, 14 bp, Homo sapiens
gtaggttgggagaa

SEQ ID NO: 2751480 - DNA, 16 bp, Homo sapiens
gtagtcccagcacttt

SEQ ID NO: 2751481 - DNA, 17 bp, Homo sapiens
gtagtgttggagaagaa

SEQ ID NO: 2751482 - DNA, 15 bp, Homo sapiens
gtataaaataatttt

SEQ ID NO: 2751483 - DNA, 11 bp, Homo sapiens
gtataaatgtc

SEQ ID NO: 2751484 - DNA, 20 bp, Homo sapiens
gtataatttacctctcatta

SEQ ID NO: 2751485 - DNA, 14 bp, Homo sapiens
gtatagaaaatgga

SEQ ID NO: 2751486 - DNA, 16 bp, Homo sapiens
gtatagaaaatggaaa

SEQ ID NO: 2751487 - DNA, 17 bp, Homo sapiens
gtatcttgattaatgta

SEQ ID NO: 2751488 - DNA, 14 bp, Homo sapiens
gtatgattcccagc

SEQ ID NO: 2751489 - DNA, 18 bp, Homo sapiens
gtatgtggaagtgtgggt

SEQ ID NO: 2751490 - DNA, 19 bp, Homo sapiens
gtatgtgggggtctgtgtg

SEQ ID NO: 2751491 - DNA, 18 bp, Homo sapiens
gtattattagactctcta

SEQ ID NO: 2751492 - DNA, 21 bp, Homo sapiens
tatgaccttaaggaaaagtaa

SEQ ID NO: 2751493 - DNA, 23 bp, Homo sapiens
tatgagctggggatgtctctcat

SEQ ID NO: 2751494 - DNA, 19 bp, Homo sapiens
tatgatcttagggaacttt

SEQ ID NO: 2751495 - DNA, 18 bp, Homo sapiens
tatgcaacgtttaacatt

SEQ ID NO: 2751496 - DNA, 12 bp, Homo sapiens
tatgcaataaaa

SEQ ID NO: 2751497 - DNA, 16 bp, Homo sapiens
tatgccattgcactcc

SEQ ID NO: 2751498 - DNA, 15 bp, Homo sapiens
tatgccccattcaac

SEQ ID NO: 2751499 - DNA, 15 bp, Homo sapiens
tatgccttcaaatag

SEQ ID NO: 2751500 - DNA, 16 bp, Homo sapiens
tatgcttctgttttat

SEQ ID NO: 2751501 - DNA, 17 bp, Homo sapiens
tatggggatagatgtgt

SEQ ID NO: 2751502 - DNA, 17 bp, Homo sapiens
tatgtacttcatgctgt

SEQ ID NO: 2751503 - DNA, 13 bp, Homo sapiens
tatgtcaaattgt

SEQ ID NO: 2751504 - DNA, 21 bp, Homo sapiens
tatgtcaaattgtgcaaaata

SEQ ID NO: 2751505 - DNA, 22 bp, Homo sapiens
tatgtgtgtgtgttgtgtgtgg

SEQ ID NO: 2751506 - DNA, 19 bp, Homo sapiens
tattacacctcagaaattg

SEQ ID NO: 2751507 - DNA, 19 bp, Homo sapiens
tattacatgtaaagctgtt

SEQ ID NO: 2751508 - DNA, 17 bp, Homo sapiens
tattacctaatgaaagt

SEQ ID NO: 2751509 - DNA, 20 bp, Homo sapiens
tattacttggcaaattctga

SEQ ID NO: 2751510 - DNA, 13 bp, Homo sapiens
tattagttgcttt

SEQ ID NO: 2751511 - DNA, 12 bp, Homo sapiens
tattataaatgt

SEQ ID NO: 2751512 - DNA, 13 bp, Homo sapiens
tattataaatgtt

SEQ ID NO: 2751513 - DNA, 13 bp, Homo sapiens
tattatagaaatt

SEQ ID NO: 2751514 - DNA, 15 bp, Homo sapiens
tattatagaaattct

SEQ ID NO: 2751515 - DNA, 20 bp, Homo sapiens
tattatagaaattctgaatt

SEQ ID NO: 2751516 - DNA, 15 bp, Homo sapiens
tattcaaaatatttt

SEQ ID NO: 2751517 - DNA, 12 bp, Homo sapiens
tattcccatgag

SEQ ID NO: 2751518 - DNA, 13 bp, Homo sapiens
tattcttaaaatg

SEQ ID NO: 2751519 - DNA, 20 bp, Homo sapiens
tattgaagtcttcttatcta

SEQ ID NO: 2751520 - DNA, 20 bp, Homo sapiens
tattgatagtttcatttaca

SEQ ID NO: 2751521 - DNA, 15 bp, Homo sapiens
tattgctgcataaat

SEQ ID NO: 2751522 - DNA, 22 bp, Homo sapiens
tattgctgcataaatttgtaat

SEQ ID NO: 2751523 - DNA, 19 bp, Homo sapiens
tattgctgtccttgaatgc

SEQ ID NO: 2751524 - DNA, 16 bp, Homo sapiens
tattggagggaaatct

SEQ ID NO: 2751525 - DNA, 13 bp, Homo sapiens
tattgtagaaagc

SEQ ID NO: 2751526 - DNA, 22 bp, Homo sapiens
tattgtagaaagctaatacaaa

SEQ ID NO: 2751527 - DNA, 17 bp, Homo sapiens
tattgtctagtgaaact

SEQ ID NO: 2751528 - DNA, 18 bp, Homo sapiens
tatttacttctaatctta

SEQ ID NO: 2751529 - DNA, 19 bp, Homo sapiens
tatttacttctaatcttaa

SEQ ID NO: 2751530 - DNA, 14 bp, Homo sapiens
tatttattttaata

SEQ ID NO: 2751531 - DNA, 15 bp, Homo sapiens
tatttccttatgtgt

SEQ ID NO: 2751532 - DNA, 15 bp, Homo sapiens
tatttccttttgtaa

SEQ ID NO: 2751533 - DNA, 21 bp, Homo sapiens
tatttccttttgtaaagtaaa

SEQ ID NO: 2751534 - DNA, 13 bp, Homo sapiens
tatttctatgaaa

SEQ ID NO: 2751535 - DNA, 14 bp, Homo sapiens
tatttgaaaattac

SEQ ID NO: 2751536 - DNA, 19 bp, Homo sapiens
tatttgaaaattaccttta

SEQ ID NO: 2751537 - DNA, 21 bp, Homo sapiens
tatttgattagggtagtaatt

SEQ ID NO: 2751538 - DNA, 23 bp, Homo sapiens
tatttgtaaggcttgttccaatg

SEQ ID NO: 2751539 - DNA, 14 bp, Homo sapiens
tattttgaatgtac

SEQ ID NO: 2751540 - DNA, 18 bp, Homo sapiens
tattttggtggtagaaac

SEQ ID NO: 2751541 - DNA, 21 bp, Homo sapiens
tcaaaatatgccccattcaac

SEQ ID NO: 2751542 - DNA, 19 bp, Homo sapiens
tcaaaatggaaaattaatt

SEQ ID NO: 2751543 - DNA, 20 bp, Homo sapiens
tcaaacctgtagatgcagaa

SEQ ID NO: 2751544 - DNA, 14 bp, Homo sapiens
tcaaatagtataga

SEQ ID NO: 2751545 - DNA, 13 bp, Homo sapiens
tcaaatattgaat

SEQ ID NO: 2751546 - DNA, 15 bp, Homo sapiens
tcaaatattgaatgc

SEQ ID NO: 2751547 - DNA, 18 bp, Homo sapiens
tcaaatattgaatgcctt

SEQ ID NO: 2751548 - DNA, 13 bp, Homo sapiens
tcaaattgtgcaa

SEQ ID NO: 2751549 - DNA, 17 bp, Homo sapiens
tcaaattgtgcaaaata

SEQ ID NO: 2751550 - DNA, 19 bp, Homo sapiens
tcaaattgtgcaaaatatt

SEQ ID NO: 2751551 - DNA, 14 bp, Homo sapiens
tcaaatttgattct

SEQ ID NO: 2751552 - DNA, 18 bp, Homo sapiens
tcaaatttgattctaaat

SEQ ID NO: 2751553 - DNA, 20 bp, Homo sapiens
tcaaattttttaaaagagac

SEQ ID NO: 2751554 - DNA, 22 bp, Homo sapiens
tcaaggaagtcttcaaatttga

SEQ ID NO: 2751555 - DNA, 21 bp, Homo sapiens
tcaagtcctgactgggctggg

SEQ ID NO: 2751556 - DNA, 14 bp, Homo sapiens
tcaataaaatccat

SEQ ID NO: 2751557 - DNA, 16 bp, Homo sapiens
tcaattgagtaattct

SEQ ID NO: 2751558 - DNA, 14 bp, Homo sapiens
tcacaaagagctga

SEQ ID NO: 2751559 - DNA, 23 bp, Homo sapiens
tcacagcaagtcactggccagtg

SEQ ID NO: 2751560 - DNA, 23 bp, Homo sapiens
tcacaggacagcccttctttcca

SEQ ID NO: 2751561 - DNA, 19 bp, Homo sapiens
tcacattaactcaggcatt

SEQ ID NO: 2751562 - DNA, 13 bp, Homo sapiens
tcacctcatggaa

SEQ ID NO: 2751563 - DNA, 14 bp, Homo sapiens
tcactactggtctg

SEQ ID NO: 2751564 - DNA, 15 bp, Homo sapiens
tcactactggtctgt

SEQ ID NO: 2751565 - DNA, 12 bp, Homo sapiens
tcactagtcttt

SEQ ID NO: 2751566 - DNA, 18 bp, Homo sapiens
tcacttcccgagcgctgg

SEQ ID NO: 2751567 - DNA, 23 bp, Homo sapiens
tcacttgaggccaggactttgag

SEQ ID NO: 2751568 - DNA, 13 bp, Homo sapiens
tcagaaattgaaa

SEQ ID NO: 2751569 - DNA, 20 bp, Homo sapiens
tcagaagaaatttaatcagt

SEQ ID NO: 2751570 - DNA, 12 bp, Homo sapiens
tcagaataaatt

SEQ ID NO: 2751571 - DNA, 20 bp, Homo sapiens
tcagagtatctgaagggaat

SEQ ID NO: 2751572 - DNA, 20 bp, Homo sapiens
tcagatcattatcagcctgt

SEQ ID NO: 2751573 - DNA, 22 bp, Homo sapiens
tcagatttgccttattggcagc

SEQ ID NO: 2751574 - DNA, 14 bp, Homo sapiens
tcaggaaagaatag

SEQ ID NO: 2751575 - DNA, 23 bp, Homo sapiens
tcaggaaagaatagaaagaaagt

SEQ ID NO: 2751576 - DNA, 11 bp, Homo sapiens
tcaggagcctg

SEQ ID NO: 2751577 - DNA, 14 bp, Homo sapiens
tcaggagcctgcta

SEQ ID NO: 2751578 - DNA, 16 bp, Homo sapiens
tcaggagcctgctaag

SEQ ID NO: 2751579 - DNA, 23 bp, Homo sapiens
tcaggcatttcatttattttttc

SEQ ID NO: 2751580 - DNA, 18 bp, Homo sapiens
tcagggccgagaggacag

SEQ ID NO: 2751581 - DNA, 22 bp, Homo sapiens
tcagtagcaggacctgccaaga

SEQ ID NO: 2751582 - DNA, 16 bp, Homo sapiens
tcagtatgtggaagtg

SEQ ID NO: 2751583 - DNA, 17 bp, Homo sapiens
tcagtgcaagagacttt

SEQ ID NO: 2751584 - DNA, 19 bp, Homo sapiens
tcagtgcaagagactttgt

SEQ ID NO: 2751585 - DNA, 19 bp, Homo sapiens
tcatatgtttattcaaaat

SEQ ID NO: 2751586 - DNA, 19 bp, Homo sapiens
tcatcattgttgtgtataa

SEQ ID NO: 2751587 - DNA, 20 bp, Homo sapiens
tcatcattgttgtgtataat

SEQ ID NO: 2751588 - DNA, 17 bp, Homo sapiens
tcatgacagaatataca

SEQ ID NO: 2751589 - DNA, 21 bp, Homo sapiens
tcatgacagaatatacacatt

SEQ ID NO: 2751590 - DNA, 22 bp, Homo sapiens
tcatgcattacttactgttaaa

SEQ ID NO: 2751591 - DNA, 12 bp, Homo sapiens
tcattaaaattg

SEQ ID NO: 2751592 - DNA, 22 bp, Homo sapiens
tcattatgcaacgtttaacatt

SEQ ID NO: 2751593 - DNA, 14 bp, Homo sapiens
tcattccagaggaa

SEQ ID NO: 2751594 - DNA, 16 bp, Homo sapiens
tcattgttgtgtataa

SEQ ID NO: 2751595 - DNA, 18 bp, Homo sapiens
tcatttcaaaatgcttca

SEQ ID NO: 2751596 - DNA, 16 bp, Homo sapiens
tcatttccaagcaagt

SEQ ID NO: 2751597 - DNA, 15 bp, Homo sapiens
tcattttaggaaagg

SEQ ID NO: 2751598 - DNA, 23 bp, Homo sapiens
tccaaactgactcttaagaagac

SEQ ID NO: 2751599 - DNA, 20 bp, Homo sapiens
tccaactttattttgaatgt

SEQ ID NO: 2751600 - DNA, 21 bp, Homo sapiens
tccaactttattttgaatgta

SEQ ID NO: 2751601 - DNA, 17 bp, Homo sapiens
tccaagacaaactaaac

SEQ ID NO: 2751602 - DNA, 17 bp, Homo sapiens
tccaagcatttagatgt

SEQ ID NO: 2751603 - DNA, 14 bp, Homo sapiens
tccaaggcagtgga

SEQ ID NO: 2751604 - DNA, 14 bp, Homo sapiens
tccaagtgtataat

SEQ ID NO: 2751605 - DNA, 22 bp, Homo sapiens
tccaataaaaatcaggagcctg

SEQ ID NO: 2751606 - DNA, 13 bp, Homo sapiens
tccaatcagtggg

SEQ ID NO: 2751607 - DNA, 20 bp, Homo sapiens
tccaatgccacatacttgca

SEQ ID NO: 2751608 - DNA, 20 bp, Homo sapiens
tccacaagtgtgtggccccg

SEQ ID NO: 2751609 - DNA, 16 bp, Homo sapiens
tccaccggcactcatg

SEQ ID NO: 2751610 - DNA, 20 bp, Homo sapiens
tccagttcaggaatttttgt

SEQ ID NO: 2751611 - DNA, 15 bp, Homo sapiens
tccatacatttgtgt

SEQ ID NO: 2751612 - DNA, 21 bp, Homo sapiens
tccatttaaaaatgatctgta

SEQ ID NO: 2751613 - DNA, 18 bp, Homo sapiens
tcccagctttaaaaagaa

SEQ ID NO: 2751614 - DNA, 20 bp, Homo sapiens
tcccatggcctgctgggctt

SEQ ID NO: 2751615 - DNA, 14 bp, Homo sapiens
tcccattctatgtg

SEQ ID NO: 2751616 - DNA, 15 bp, Homo sapiens
tcccctccctctgtc

SEQ ID NO: 2751617 - DNA, 13 bp, Homo sapiens
tccctaaaatgta

SEQ ID NO: 2751618 - DNA, 23 bp, Homo sapiens
tgttttaagcaaatgcattctat

SEQ ID NO: 2751619 - DNA, 11 bp, Homo sapiens
tgttttatata

SEQ ID NO: 2751620 - DNA, 13 bp, Homo sapiens
tgttttgtctata

SEQ ID NO: 2751621 - DNA, 18 bp, Homo sapiens
tgtttttgctttctgaaa

SEQ ID NO: 2751622 - DNA, 15 bp, Homo sapiens
ttaaaaaagaaacat

SEQ ID NO: 2751623 - DNA, 19 bp, Homo sapiens
ttaaaaaagaaacatttgg

SEQ ID NO: 2751624 - DNA, 18 bp, Homo sapiens
ttaaaaaccgaataaatg

SEQ ID NO: 2751625 - DNA, 15 bp, Homo sapiens
ttaaaaagtgagaaa

SEQ ID NO: 2751626 - DNA, 16 bp, Homo sapiens
ttaaaaataaaagcta

SEQ ID NO: 2751627 - DNA, 18 bp, Homo sapiens
ttaaaaataaaagctatt

SEQ ID NO: 2751628 - DNA, 17 bp, Homo sapiens
ttaaaacacagtattgt

SEQ ID NO: 2751629 - DNA, 22 bp, Homo sapiens
ttaaaacacagtattgtagaaa

SEQ ID NO: 2751630 - DNA, 15 bp, Homo sapiens
ttaaaactgtacctt

SEQ ID NO: 2751631 - DNA, 15 bp, Homo sapiens
ttaaaatacataact

SEQ ID NO: 2751632 - DNA, 20 bp, Homo sapiens
ttaaaatacataacttcagt

SEQ ID NO: 2751633 - DNA, 23 bp, Homo sapiens
ttaaaatgcaatatttgtaaggc

SEQ ID NO: 2751634 - DNA, 13 bp, Homo sapiens
ttaaaattgtgat

SEQ ID NO: 2751635 - DNA, 16 bp, Homo sapiens
ttaaaattgttaccac

SEQ ID NO: 2751636 - DNA, 20 bp, Homo sapiens
ttaaagttttttatatatga

SEQ ID NO: 2751637 - DNA, 17 bp, Homo sapiens
ttaaatatctgaacatt

SEQ ID NO: 2751638 - DNA, 15 bp, Homo sapiens
ttaaatcagaataaa

SEQ ID NO: 2751639 - DNA, 20 bp, Homo sapiens
ttaaatcattttaggaaagg

SEQ ID NO: 2751640 - DNA, 22 bp, Homo sapiens
ttaaattggagaaaagcactta

SEQ ID NO: 2751641 - DNA, 23 bp, Homo sapiens
ttaaattggagaaaagcacttaa

SEQ ID NO: 2751642 - DNA, 14 bp, Homo sapiens
ttaaattttctcta

SEQ ID NO: 2751643 - DNA, 18 bp, Homo sapiens
ttaacaaccctgttgagt

SEQ ID NO: 2751644 - DNA, 22 bp, Homo sapiens
ttaacattcctaaaatgcttca

SEQ ID NO: 2751645 - DNA, 15 bp, Homo sapiens
ttaactcaggcattt

SEQ ID NO: 2751646 - DNA, 12 bp, Homo sapiens
ttaactcagtct

SEQ ID NO: 2751647 - DNA, 13 bp, Homo sapiens
ttaactctactgt

SEQ ID NO: 2751648 - DNA, 22 bp, Homo sapiens
ttaagaagactgcattatattt

SEQ ID NO: 2751649 - DNA, 19 bp, Homo sapiens
ttaagaatgtgctagagtt

SEQ ID NO: 2751650 - DNA, 20 bp, Homo sapiens
ttaaggaaaagtaagggaat

SEQ ID NO: 2751651 - DNA, 15 bp, Homo sapiens
ttaaggattctgcag

SEQ ID NO: 2751652 - DNA, 13 bp, Homo sapiens
ttaataagtatat

SEQ ID NO: 2751653 - DNA, 21 bp, Homo sapiens
ttaatctcctgagttgtataa

SEQ ID NO: 2751654 - DNA, 13 bp, Homo sapiens
ttaatctttttca

SEQ ID NO: 2751655 - DNA, 14 bp, Homo sapiens
ttaatgaagaaagt

SEQ ID NO: 2751656 - DNA, 20 bp, Homo sapiens
ttaatgtactttttattgca

SEQ ID NO: 2751657 - DNA, 22 bp, Homo sapiens
ttaatgtactttttattgcatg

SEQ ID NO: 2751658 - DNA, 14 bp, Homo sapiens
ttaattctaaactt

SEQ ID NO: 2751659 - DNA, 16 bp, Homo sapiens
ttacacctcagaaatt

SEQ ID NO: 2751660 - DNA, 20 bp, Homo sapiens
ttacaggcatggacatgcag

SEQ ID NO: 2751661 - DNA, 19 bp, Homo sapiens
ttacagtttcttcatgcat

SEQ ID NO: 2751662 - DNA, 21 bp, Homo sapiens
ttacatctgtgcagggctggt

SEQ ID NO: 2751663 - DNA, 13 bp, Homo sapiens
ttacatgcataaa

SEQ ID NO: 2751664 - DNA, 14 bp, Homo sapiens
ttacatgcataaaa

SEQ ID NO: 2751665 - DNA, 14 bp, Homo sapiens
ttacatgtaaagct

SEQ ID NO: 2751666 - DNA, 15 bp, Homo sapiens
ttacatgtaaagctg

SEQ ID NO: 2751667 - DNA, 17 bp, Homo sapiens
ttacatgtaaagctgtt

SEQ ID NO: 2751668 - DNA, 13 bp, Homo sapiens
ttaccactggtaa

SEQ ID NO: 2751669 - DNA, 13 bp, Homo sapiens
ttacctttaatgc

SEQ ID NO: 2751670 - DNA, 14 bp, Homo sapiens
ttacctttaatgca

SEQ ID NO: 2751671 - DNA, 15 bp, Homo sapiens
ttactacagttttta

SEQ ID NO: 2751672 - DNA, 18 bp, Homo sapiens
ttactggataaatttaaa

SEQ ID NO: 2751673 - DNA, 16 bp, Homo sapiens
ttactgttaaaactgt

SEQ ID NO: 2751674 - DNA, 18 bp, Homo sapiens
ttactgttaaaactgtac

SEQ ID NO: 2751675 - DNA, 23 bp, Homo sapiens
ttactgttaaaactgtacctttt

SEQ ID NO: 2751676 - DNA, 16 bp, Homo sapiens
ttacttctaatcttaa

SEQ ID NO: 2751677 - DNA, 18 bp, Homo sapiens
ttacttctaatcttaaat

SEQ ID NO: 2751678 - DNA, 19 bp, Homo sapiens
ttagaaacacaactatatt

SEQ ID NO: 2751679 - DNA, 19 bp, Homo sapiens
ttagaaactggttctgtgt

SEQ ID NO: 2751680 - DNA, 18 bp, Homo sapiens
ttagactctctagtttta

SEQ ID NO: 2751681 - DNA, 16 bp, Homo sapiens
ttagaggttaatcaga

SEQ ID NO: 2751682 - DNA, 21 bp, Homo sapiens
ttagctagaatccacacatat

SEQ ID NO: 2751683 - DNA, 15 bp, Homo sapiens
ttagctgcactgttt

SEQ ID NO: 2751684 - DNA, 13 bp, Homo sapiens
ttagctggaaaag

SEQ ID NO: 2751685 - DNA, 21 bp, Homo sapiens
ttagctggtgtcttcatttta

SEQ ID NO: 2751686 - DNA, 18 bp, Homo sapiens
ttaggaaaggatgatcaa

SEQ ID NO: 2751687 - DNA, 14 bp, Homo sapiens
ttagggttatgatt

SEQ ID NO: 2751688 - DNA, 22 bp, Homo sapiens
ttagttacttgctataaataga

SEQ ID NO: 2751689 - DNA, 12 bp, Homo sapiens
ttagttgcattg

SEQ ID NO: 2751690 - DNA, 14 bp, Homo sapiens
ttataaaaacattg

SEQ ID NO: 2751691 - DNA, 17 bp, Homo sapiens
ttataaatgttagttct

SEQ ID NO: 2751692 - DNA, 18 bp, Homo sapiens
ttataaatgttagttcta

SEQ ID NO: 2751693 - DNA, 12 bp, Homo sapiens
ttatactgtgaa

SEQ ID NO: 2751694 - DNA, 19 bp, Homo sapiens
ttatactgtgaagttacat

SEQ ID NO: 2751695 - DNA, 15 bp, Homo sapiens
ttatagaaattctga

SEQ ID NO: 2751696 - DNA, 22 bp, Homo sapiens
ttatagaataaaagctgtggaa

SEQ ID NO: 2751697 - DNA, 23 bp, Homo sapiens
ttatagaataaaagctgtggaat

SEQ ID NO: 2751698 - DNA, 22 bp, Homo sapiens
ttatatatgaatattacatgta

SEQ ID NO: 2751699 - DNA, 15 bp, Homo sapiens
ttatatttgaaatat

SEQ ID NO: 2751700 - DNA, 19 bp, Homo sapiens
ttatatttgaaatattgac

SEQ ID NO: 2751701 - DNA, 14 bp, Homo sapiens
ttatcaacatttgt

SEQ ID NO: 2751702 - DNA, 22 bp, Homo sapiens
ttatcaaggaagtcttcaaatt

SEQ ID NO: 2751703 - DNA, 22 bp, Homo sapiens
ttatcttttagctagaatccac

SEQ ID NO: 2751704 - DNA, 14 bp, Homo sapiens
ttatgaattacatt

SEQ ID NO: 2751705 - DNA, 16 bp, Homo sapiens
ttatgaattacatttg

SEQ ID NO: 2751706 - DNA, 17 bp, Homo sapiens
ttatgaattacatttgt

SEQ ID NO: 2751707 - DNA, 22 bp, Homo sapiens
ttatgattaagtaatgataact

SEQ ID NO: 2751708 - DNA, 14 bp, Homo sapiens
ttatggaaatacca

SEQ ID NO: 2751709 - DNA, 15 bp, Homo sapiens
ttattacctctcagg

SEQ ID NO: 2751710 - DNA, 16 bp, Homo sapiens
ttattactgtaagaaa

SEQ ID NO: 2751711 - DNA, 18 bp, Homo sapiens
ttattactgtaagaaaat

SEQ ID NO: 2751712 - DNA, 13 bp, Homo sapiens
ttattataaatgt

SEQ ID NO: 2751713 - DNA, 14 bp, Homo sapiens
ttattataaatgtt

SEQ ID NO: 2751714 - DNA, 13 bp, Homo sapiens
ttattatgaagaa

SEQ ID NO: 2751715 - DNA, 15 bp, Homo sapiens
ttattatgaagaatt

SEQ ID NO: 2751716 - DNA, 18 bp, Homo sapiens
ttattctgggaaatgttt

SEQ ID NO: 2751717 - DNA, 22 bp, Homo sapiens
ttattgaagtcttcttatctaa

SEQ ID NO: 2751718 - DNA, 15 bp, Homo sapiens
ttattgctgcataaa

SEQ ID NO: 2751719 - DNA, 22 bp, Homo sapiens
ttattgctgcataaatttgtaa

SEQ ID NO: 2751720 - DNA, 23 bp, Homo sapiens
ttatttctaaaccacaaaagttg

SEQ ID NO: 2751721 - DNA, 16 bp, Homo sapiens
ttatttgttgttttct

SEQ ID NO: 2751722 - DNA, 14 bp, Homo sapiens
ttattttgaatgta

SEQ ID NO: 2751723 - DNA, 16 bp, Homo sapiens
ttattttgaatgtacc

SEQ ID NO: 2751724 - DNA, 14 bp, Homo sapiens
ttcaaaatatttta

SEQ ID NO: 2751725 - DNA, 23 bp, Homo sapiens
ttcaaaatggaaaattaattcta

SEQ ID NO: 2751726 - DNA, 13 bp, Homo sapiens
ttcaaatagtata

SEQ ID NO: 2751727 - DNA, 12 bp, Homo sapiens
ttcaaatattga

SEQ ID NO: 2751728 - DNA, 18 bp, Homo sapiens
ttcaaatattgaatgcct

SEQ ID NO: 2751729 - DNA, 20 bp, Homo sapiens
ttcaagatcctcttgccaca

SEQ ID NO: 2751730 - DNA, 18 bp, Homo sapiens
ttcaattgagtaattcta

SEQ ID NO: 2751731 - DNA, 16 bp, Homo sapiens
ttcagatttgccttat

SEQ ID NO: 2751732 - DNA, 17 bp, Homo sapiens
ttcagcggtttatataa

SEQ ID NO: 2751733 - DNA, 23 bp, Homo sapiens
ttcagctgtgctttttgcaaaag

SEQ ID NO: 2751734 - DNA, 20 bp, Homo sapiens
ttcagtgacttcttccctaa

SEQ ID NO: 2751735 - DNA, 19 bp, Homo sapiens
ttcagtgcaagagactttg

SEQ ID NO: 2751736 - DNA, 19 bp, Homo sapiens
ttcagtgggttcagaacca

SEQ ID NO: 2751737 - DNA, 14 bp, Homo sapiens
ttcatagttctgtt

SEQ ID NO: 2751738 - DNA, 14 bp, Homo sapiens
ttcatgacagaata

SEQ ID NO: 2751739 - DNA, 22 bp, Homo sapiens
ttcatgacagaatatacacatt

SEQ ID NO: 2751740 - DNA, 19 bp, Homo sapiens
ttcattatgcaacgtttaa

SEQ ID NO: 2751741 - DNA, 23 bp, Homo sapiens
ttcattatgcaacgtttaacatt

SEQ ID NO: 2751742 - DNA, 19 bp, Homo sapiens
ttcatttacaatttcaaaa

SEQ ID NO: 2751743 - DNA, 15 bp, Homo sapiens
ttccaccggcactca

SEQ ID NO: 2751744 - DNA, 13 bp, Homo sapiens
cacaactatattg

SEQ ID NO: 2751745 - DNA, 15 bp, Homo sapiens
cacagaagcctagga

SEQ ID NO: 2751746 - DNA, 21 bp, Homo sapiens
cacagcctcttagatgcagtt

SEQ ID NO: 2751747 - DNA, 20 bp, Homo sapiens
cacaggaaccacaagactgc

SEQ ID NO: 2751748 - DNA, 18 bp, Homo sapiens
cacagtattgtagaaagc

SEQ ID NO: 2751749 - DNA, 19 bp, Homo sapiens
cacagttggcacttctgcc

SEQ ID NO: 2751750 - DNA, 21 bp, Homo sapiens
cacatccaccaaactcctgcc

SEQ ID NO: 2751751 - DNA, 16 bp, Homo sapiens
cacatcttgaaaatgc

SEQ ID NO: 2751752 - DNA, 17 bp, Homo sapiens
cacatcttgaaaatgcc

SEQ ID NO: 2751753 - DNA, 16 bp, Homo sapiens
cacatgaagtccaagc

SEQ ID NO: 2751754 - DNA, 20 bp, Homo sapiens
cacatttcatctaatttaat

SEQ ID NO: 2751755 - DNA, 13 bp, Homo sapiens
cacattttgtaaa

SEQ ID NO: 2751756 - DNA, 15 bp, Homo sapiens
cacattttgtaaatc

SEQ ID NO: 2751757 - DNA, 20 bp, Homo sapiens
cacattttgtaaatctgtac

SEQ ID NO: 2751758 - DNA, 15 bp, Homo sapiens
caccatccaataaaa

SEQ ID NO: 2751759 - DNA, 15 bp, Homo sapiens
cacccctggctacct

SEQ ID NO: 2751760 - DNA, 15 bp, Homo sapiens
caccggcactcatga

SEQ ID NO: 2751761 - DNA, 16 bp, Homo sapiens
caccggcactcatgac

SEQ ID NO: 2751762 - DNA, 22 bp, Homo sapiens
caccgggcatgtctgcctggag

SEQ ID NO: 2751763 - DNA, 20 bp, Homo sapiens
cacctgtgctggagccctgt

SEQ ID NO: 2751764 - DNA, 19 bp, Homo sapiens
cacgtgtggcctgttcttc

SEQ ID NO: 2751765 - DNA, 17 bp, Homo sapiens
cactaagagagaatgag

SEQ ID NO: 2751766 - DNA, 19 bp, Homo sapiens
cactagtatttctatgaaa

SEQ ID NO: 2751767 - DNA, 20 bp, Homo sapiens
cactgccttctcaactccaa

SEQ ID NO: 2751768 - DNA, 19 bp, Homo sapiens
cactgtgggtagacacaca

SEQ ID NO: 2751769 - DNA, 24 bp, Homo sapiens
cactgtgggtagacacacatgaag

SEQ ID NO: 2751770 - DNA, 12 bp, Homo sapiens
cacttaaagttt

SEQ ID NO: 2751771 - DNA, 17 bp, Homo sapiens
cacttgtgttttgcaag

SEQ ID NO: 2751772 - DNA, 19 bp, Homo sapiens
cacttgtgttttgcaagcc

SEQ ID NO: 2751773 - DNA, 13 bp, Homo sapiens
cagaaaaaaaaga

SEQ ID NO: 2751774 - DNA, 13 bp, Homo sapiens
cagaaaaagaaaa

SEQ ID NO: 2751775 - DNA, 16 bp, Homo sapiens
cagaagagtcaaagta

SEQ ID NO: 2751776 - DNA, 17 bp, Homo sapiens
cagaagagtcaaagtag

SEQ ID NO: 2751777 - DNA, 21 bp, Homo sapiens
cagaagcctaggaggactggg

SEQ ID NO: 2751778 - DNA, 15 bp, Homo sapiens
cagaatatacacatt

SEQ ID NO: 2751779 - DNA, 21 bp, Homo sapiens
cagaatatacacattttgtaa

SEQ ID NO: 2751780 - DNA, 14 bp, Homo sapiens
cagaatggatataa

SEQ ID NO: 2751781 - DNA, 19 bp, Homo sapiens
cagactcgatgcaagtgtt

SEQ ID NO: 2751782 - DNA, 12 bp, Homo sapiens
cagacttcaaga

SEQ ID NO: 2751783 - DNA, 14 bp, Homo sapiens
cagacttcaagatc

SEQ ID NO: 2751784 - DNA, 22 bp, Homo sapiens
cagaggacagtatttgtgggga

SEQ ID NO: 2751785 - DNA, 14 bp, Homo sapiens
cagataatcacaat

SEQ ID NO: 2751786 - DNA, 23 bp, Homo sapiens
cagatcattatcagcctgtgcca

SEQ ID NO: 2751787 - DNA, 16 bp, Homo sapiens
cagatgtctaaaagat

SEQ ID NO: 2751788 - DNA, 15 bp, Homo sapiens
cagattcaaagcgaa

SEQ ID NO: 2751789 - DNA, 22 bp, Homo sapiens
cagatttttatattagttgctt

SEQ ID NO: 2751790 - DNA, 22 bp, Homo sapiens
ccacgcccttggagccttccac

SEQ ID NO: 2751791 - DNA, 17 bp, Homo sapiens
ccagcagtacaataaaa

SEQ ID NO: 2751792 - DNA, 16 bp, Homo sapiens
ccagctttaaaaagaa

SEQ ID NO: 2751793 - DNA, 19 bp, Homo sapiens
ccagctttaaaaagaaaaa

SEQ ID NO: 2751794 - DNA, 20 bp, Homo sapiens
ccagctttaaaaagaaaaaa

SEQ ID NO: 2751795 - DNA, 20 bp, Homo sapiens
ccaggaactcgcacctgtgc

SEQ ID NO: 2751796 - DNA, 10 bp, Homo sapiens
ccaggaccag

SEQ ID NO: 2751797 - DNA, 15 bp, Homo sapiens
ccaggggccatgaat

SEQ ID NO: 2751798 - DNA, 19 bp, Homo sapiens
ccagttcaggaatttttgt

SEQ ID NO: 2751799 - DNA, 15 bp, Homo sapiens
ccagtttatgtttgt

SEQ ID NO: 2751800 - DNA, 17 bp, Homo sapiens
ccatatgggaattatta

SEQ ID NO: 2751801 - DNA, 17 bp, Homo sapiens
ccatgagcagagaactg

SEQ ID NO: 2751802 - DNA, 16 bp, Homo sapiens
ccatgatgtttagaaa

SEQ ID NO: 2751803 - DNA, 22 bp, Homo sapiens
ccatgttggttgcactttgtag

SEQ ID NO: 2751804 - DNA, 14 bp, Homo sapiens
ccattcttcttttt

SEQ ID NO: 2751805 - DNA, 13 bp, Homo sapiens
cccaactccagaa

SEQ ID NO: 2751806 - DNA, 18 bp, Homo sapiens
cccagctttaaaaagaaa

SEQ ID NO: 2751807 - DNA, 19 bp, Homo sapiens
cccatgctctgatgcagtg

SEQ ID NO: 2751808 - DNA, 14 bp, Homo sapiens
cccccacccctggc

SEQ ID NO: 2751809 - DNA, 14 bp, Homo sapiens
ccccgccggaggaa

SEQ ID NO: 2751810 - DNA, 14 bp, Homo sapiens
cccgagcccctgcc

SEQ ID NO: 2751811 - DNA, 18 bp, Homo sapiens
cccgcccgagcccctgcc

SEQ ID NO: 2751812 - DNA, 19 bp, Homo sapiens
ccctgcccacgcccttgga

SEQ ID NO: 2751813 - DNA, 21 bp, Homo sapiens
ccctgcccacgcccttggagc

SEQ ID NO: 2751814 - DNA, 12 bp, Homo sapiens
ccgagaggacag

SEQ ID NO: 2751815 - DNA, 12 bp, Homo sapiens
ccgagcgctggt

SEQ ID NO: 2751816 - DNA, 12 bp, Homo sapiens
ccgaggtcccat

SEQ ID NO: 2751817 - DNA, 13 bp, Homo sapiens
ccgccggaggaag

SEQ ID NO: 2751818 - DNA, 14 bp, Homo sapiens
ccgcctgtcaataa

SEQ ID NO: 2751819 - DNA, 17 bp, Homo sapiens
ccgggcatgtctgcctg

SEQ ID NO: 2751820 - DNA, 16 bp, Homo sapiens
cctaaggccagccatt

SEQ ID NO: 2751821 - DNA, 13 bp, Homo sapiens
cctacaaaagctt

SEQ ID NO: 2751822 - DNA, 22 bp, Homo sapiens
cctacaaaagcttgtgtatctt

SEQ ID NO: 2751823 - DNA, 16 bp, Homo sapiens
cctagatatgaatata

SEQ ID NO: 2751824 - DNA, 21 bp, Homo sapiens
cctcaggaaagaatagaaaga

SEQ ID NO: 2751825 - DNA, 14 bp, Homo sapiens
cctcccacactcgc

SEQ ID NO: 2751826 - DNA, 15 bp, Homo sapiens
cctgaacctttcaaa

SEQ ID NO: 2751827 - DNA, 14 bp, Homo sapiens
cctgactctcagca

SEQ ID NO: 2751828 - DNA, 15 bp, Homo sapiens
cctgactgggctggg

SEQ ID NO: 2751829 - DNA, 19 bp, Homo sapiens
cctgaggaagagggactgt

SEQ ID NO: 2751830 - DNA, 19 bp, Homo sapiens
cctgcaaacctgctggtgg

SEQ ID NO: 2751831 - DNA, 20 bp, Homo sapiens
cctgcccacgcccttggagc

SEQ ID NO: 2751832 - DNA, 15 bp, Homo sapiens
cctgcccagacaaga

SEQ ID NO: 2751833 - DNA, 17 bp, Homo sapiens
cctgcctgagaatgtta

SEQ ID NO: 2751834 - DNA, 20 bp, Homo sapiens
cctgcctgcaaacctgctgg

SEQ ID NO: 2751835 - DNA, 22 bp, Homo sapiens
cctgctaaggaacaatgccgcc

SEQ ID NO: 2751836 - DNA, 23 bp, Homo sapiens
cctggaaatcagggttagtattg

SEQ ID NO: 2751837 - DNA, 21 bp, Homo sapiens
cctggagtgctgtgctgtgtt

SEQ ID NO: 2751838 - DNA, 15 bp, Homo sapiens
cctggctaccttgtg

SEQ ID NO: 2751839 - DNA, 18 bp, Homo sapiens
cctggctaccttgtggga

SEQ ID NO: 2751840 - DNA, 20 bp, Homo sapiens
cctgtagatgcagaaaaaga

SEQ ID NO: 2751841 - DNA, 22 bp, Homo sapiens
cctgtagatgcagaaaaagaaa

SEQ ID NO: 2751842 - DNA, 18 bp, Homo sapiens
cctgtcaataaatgttga

SEQ ID NO: 2751843 - DNA, 15 bp, Homo sapiens
cctgtctttaaaaat

SEQ ID NO: 2751844 - DNA, 13 bp, Homo sapiens
cctgttaaatttt

SEQ ID NO: 2751845 - DNA, 15 bp, Homo sapiens
cctgttaaattttct

SEQ ID NO: 2751846 - DNA, 22 bp, Homo sapiens
cctgttaaattttctctaaact

SEQ ID NO: 2751847 - DNA, 18 bp, Homo sapiens
cctgttcctccctcccac

SEQ ID NO: 2751848 - DNA, 18 bp, Homo sapiens
cctgttgagtatttgctg

SEQ ID NO: 2751849 - DNA, 21 bp, Homo sapiens
cctgttgagtatttgctgttt

SEQ ID NO: 2751850 - DNA, 24 bp, Homo sapiens
cctgttgagtatttgctgtttgtc

SEQ ID NO: 2751851 - DNA, 13 bp, Homo sapiens
ccttaaaattttc

SEQ ID NO: 2751852 - DNA, 13 bp, Homo sapiens
ccttatttttgaa

SEQ ID NO: 2751853 - DNA, 14 bp, Homo sapiens
ccttcaaatagtat

SEQ ID NO: 2751854 - DNA, 14 bp, Homo sapiens
ccttcagtttagaa

SEQ ID NO: 2751855 - DNA, 15 bp, Homo sapiens
ccttccaccggcact

SEQ ID NO: 2751856 - DNA, 17 bp, Homo sapiens
ccttccaccggcactca

SEQ ID NO: 2751857 - DNA, 18 bp, Homo sapiens
ccttccaccggcactcat

SEQ ID NO: 2751858 - DNA, 14 bp, Homo sapiens
ccttggagccttcc

SEQ ID NO: 2751859 - DNA, 16 bp, Homo sapiens
ccttgtgggaataaac

SEQ ID NO: 2751860 - DNA, 12 bp, Homo sapiens
cctttaaactgt

SEQ ID NO: 2751861 - DNA, 10 bp, Homo sapiens
cctttcttcc

SEQ ID NO: 2751862 - DNA, 10 bp, Homo sapiens
cgaataaatg

SEQ ID NO: 2751863 - DNA, 16 bp, Homo sapiens
cgacttgttttgctgc

SEQ ID NO: 2751864 - DNA, 15 bp, Homo sapiens
cgcccccacccctgg

SEQ ID NO: 2751865 - DNA, 15 bp, Homo sapiens
cgcccgagcccctgc

SEQ ID NO: 2751866 - DNA, 16 bp, Homo sapiens
cgcccttggagccttc

SEQ ID NO: 2751867 - DNA, 14 bp, Homo sapiens
cgcctgtcaataaa

SEQ ID NO: 2751868 - DNA, 17 bp, Homo sapiens
cgctgaggtgtctggcc

SEQ ID NO: 2751869 - DNA, 22 bp, Homo sapiens
cgctggtcccctccctctgtct

SEQ ID NO: 2751870 - DNA, 11 bp, Homo sapiens
cgcttcttttt

SEQ ID NO: 2751871 - DNA, 11 bp, Homo sapiens
cggcactcatg

SEQ ID NO: 2751872 - DNA, 15 bp, Homo sapiens
cggccgagctggttt

SEQ ID NO: 2751873 - DNA, 12 bp, Homo sapiens
cggcctgcctgc

SEQ ID NO: 2751874 - DNA, 20 bp, Homo sapiens
cggcgcccccacccctggct

SEQ ID NO: 2751875 - DNA, 22 bp, Homo sapiens
cggcgcccccacccctggctac

SEQ ID NO: 2751876 - DNA, 18 bp, Homo sapiens
cggcttttcagaagaaat

SEQ ID NO: 2751877 - DNA, 23 bp, Homo sapiens
cgtggaaaaagacgatgtttatg

SEQ ID NO: 2751878 - DNA, 15 bp, Homo sapiens
cgttattataaatgt

SEQ ID NO: 2751879 - DNA, 22 bp, Homo sapiens
atgttcttatagaataaaagct

SEQ ID NO: 2751880 - DNA, 19 bp, Homo sapiens
atgtttacagaggacagta

SEQ ID NO: 2751881 - DNA, 15 bp, Homo sapiens
atgtttatgttctta

SEQ ID NO: 2751882 - DNA, 18 bp, Homo sapiens
atgtttatttagaaactg

SEQ ID NO: 2751883 - DNA, 15 bp, Homo sapiens
atgttttcaggctag

SEQ ID NO: 2751884 - DNA, 15 bp, Homo sapiens
attaatattgtattg

SEQ ID NO: 2751885 - DNA, 12 bp, Homo sapiens
attaatgtactt

SEQ ID NO: 2751886 - DNA, 13 bp, Homo sapiens
attaatgtacttt

SEQ ID NO: 2751887 - DNA, 15 bp, Homo sapiens
attaatgtacttttt

SEQ ID NO: 2751888 - DNA, 16 bp, Homo sapiens
attaatgtacttttta

SEQ ID NO: 2751889 - DNA, 12 bp, Homo sapiens
attaattctaaa

SEQ ID NO: 2751890 - DNA, 16 bp, Homo sapiens
attaattctaaactta

SEQ ID NO: 2751891 - DNA, 23 bp, Homo sapiens
attacacctcagaaattgaaagc

SEQ ID NO: 2751892 - DNA, 22 bp, Homo sapiens
attacatgtaaagctgttaaaa

SEQ ID NO: 2751893 - DNA, 20 bp, Homo sapiens
attacatttgtataaaataa

SEQ ID NO: 2751894 - DNA, 22 bp, Homo sapiens
attacctctcagggccgagagg

SEQ ID NO: 2751895 - DNA, 18 bp, Homo sapiens
attacttggcaaattctg

SEQ ID NO: 2751896 - DNA, 19 bp, Homo sapiens
attacttggcaaattctga

SEQ ID NO: 2751897 - DNA, 23 bp, Homo sapiens
attagatgtttatttagaaactg

SEQ ID NO: 2751898 - DNA, 14 bp, Homo sapiens
attagcaatgaatt

SEQ ID NO: 2751899 - DNA, 22 bp, Homo sapiens
attagcaatgaattagttgcat

SEQ ID NO: 2751900 - DNA, 21 bp, Homo sapiens
attaggataactaaaattctg

SEQ ID NO: 2751901 - DNA, 17 bp, Homo sapiens
attagttacttgctata

SEQ ID NO: 2751902 - DNA, 20 bp, Homo sapiens
attagttacttgctataaat

SEQ ID NO: 2751903 - DNA, 13 bp, Homo sapiens
attagttgcattg

SEQ ID NO: 2751904 - DNA, 14 bp, Homo sapiens
attagttgctttgt

SEQ ID NO: 2751905 - DNA, 15 bp, Homo sapiens
attagttgctttgtt

SEQ ID NO: 2751906 - DNA, 23 bp, Homo sapiens
attagtttcaattgagtaattct

SEQ ID NO: 2751907 - DNA, 13 bp, Homo sapiens
attataaatgtta

SEQ ID NO: 2751908 - DNA, 16 bp, Homo sapiens
attataaatgttagtt

SEQ ID NO: 2751909 - DNA, 16 bp, Homo sapiens
attatagaaattctga

SEQ ID NO: 2751910 - DNA, 17 bp, Homo sapiens
attatagaaattctgaa

SEQ ID NO: 2751911 - DNA, 20 bp, Homo sapiens
attatagaaattctgaattt

SEQ ID NO: 2751912 - DNA, 21 bp, Homo sapiens
attatgttaaaactgggacag

SEQ ID NO: 2751913 - DNA, 14 bp, Homo sapiens
attattatgaagaa

SEQ ID NO: 2751914 - DNA, 14 bp, Homo sapiens
attcactcactgga

SEQ ID NO: 2751915 - DNA, 17 bp, Homo sapiens
attcagctgaggttcat

SEQ ID NO: 2751916 - DNA, 18 bp, Homo sapiens
attccttctaactgaagg

SEQ ID NO: 2751917 - DNA, 21 bp, Homo sapiens
attctatcgttattataaatg

SEQ ID NO: 2751918 - DNA, 22 bp, Homo sapiens
attctatcgttattataaatgt

SEQ ID NO: 2751919 - DNA, 23 bp, Homo sapiens
attctatgtgtcatcaatagtgt

SEQ ID NO: 2751920 - DNA, 18 bp, Homo sapiens
attctgaggtaagtgtat

SEQ ID NO: 2751921 - DNA, 20 bp, Homo sapiens
attctgaggtaagtgtatga

SEQ ID NO: 2751922 - DNA, 19 bp, Homo sapiens
attctgcagaaaaaaaaga

SEQ ID NO: 2751923 - DNA, 16 bp, Homo sapiens
attctgggaaatgttt

SEQ ID NO: 2751924 - DNA, 20 bp, Homo sapiens
attctgggaaatgttttaat

SEQ ID NO: 2751925 - DNA, 22 bp, Homo sapiens
attctgggaaatgttttaatgc

SEQ ID NO: 2751926 - DNA, 20 bp, Homo sapiens
attcttaaaatgcaatattt

SEQ ID NO: 2751927 - DNA, 22 bp, Homo sapiens
attcttaaaatgcaatatttgt

SEQ ID NO: 2751928 - DNA, 14 bp, Homo sapiens
attcttatatttta

SEQ ID NO: 2751929 - DNA, 18 bp, Homo sapiens
attctttagatttttaaa

SEQ ID NO: 2751930 - DNA, 19 bp, Homo sapiens
attctttgacctgttggga

SEQ ID NO: 2751931 - DNA, 13 bp, Homo sapiens
attgaaatattag

SEQ ID NO: 2751932 - DNA, 12 bp, Homo sapiens
attgaagtcttc

SEQ ID NO: 2751933 - DNA, 19 bp, Homo sapiens
attgaagtcttcttatcta

SEQ ID NO: 2751934 - DNA, 20 bp, Homo sapiens
attgaagtcttcttatctaa

SEQ ID NO: 2751935 - DNA, 21 bp, Homo sapiens
attgaagtcttcttatctaaa

SEQ ID NO: 2751936 - DNA, 13 bp, Homo sapiens
attgaatgcctta

SEQ ID NO: 2751937 - DNA, 20 bp, Homo sapiens
attgaatgccttatttttga

SEQ ID NO: 2751938 - DNA, 23 bp, Homo sapiens
attgaatgccttatttttgaatt

SEQ ID NO: 2751939 - DNA, 18 bp, Homo sapiens
attgattggataaatgct

SEQ ID NO: 2751940 - DNA, 21 bp, Homo sapiens
attgattggataaatgcttat

SEQ ID NO: 2751941 - DNA, 22 bp, Homo sapiens
attgctgtccttgaatgccata

SEQ ID NO: 2751942 - DNA, 16 bp, Homo sapiens
attggagaaaagcact

SEQ ID NO: 2751943 - DNA, 17 bp, Homo sapiens
attggagaaaagcactt

SEQ ID NO: 2751944 - DNA, 19 bp, Homo sapiens
attggagaaaagcacttaa

SEQ ID NO: 2751945 - DNA, 18 bp, Homo sapiens
attggtattaaagaatgc

SEQ ID NO: 2751946 - DNA, 12 bp, Homo sapiens
attggtgttgac

SEQ ID NO: 2751947 - DNA, 17 bp, Homo sapiens
attgtagagccagaggt

SEQ ID NO: 2751948 - DNA, 18 bp, Homo sapiens
attgtagagccagaggtc

SEQ ID NO: 2751949 - DNA, 14 bp, Homo sapiens
attgtattgctgct

SEQ ID NO: 2751950 - DNA, 14 bp, Homo sapiens
attgtattgctgtc

SEQ ID NO: 2751951 - DNA, 19 bp, Homo sapiens
atcccagctttaaaaagaa

SEQ ID NO: 2751952 - DNA, 21 bp, Homo sapiens
atcccagctttaaaaagaaaa

SEQ ID NO: 2751953 - DNA, 21 bp, Homo sapiens
atcctatgccttcaaatagta

SEQ ID NO: 2751954 - DNA, 18 bp, Homo sapiens
atcctcttgccacatctt

SEQ ID NO: 2751955 - DNA, 18 bp, Homo sapiens
atcctgttaaattttctc

SEQ ID NO: 2751956 - DNA, 12 bp, Homo sapiens
atcctgtttgta

SEQ ID NO: 2751957 - DNA, 23 bp, Homo sapiens
atcctgtttgtatttttttccaa

SEQ ID NO: 2751958 - DNA, 19 bp, Homo sapiens
atccttctggctgtagata

SEQ ID NO: 2751959 - DNA, 17 bp, Homo sapiens
atcgttattataaatgt

SEQ ID NO: 2751960 - DNA, 22 bp, Homo sapiens
atcgttattataaatgttagtt

SEQ ID NO: 2751961 - DNA, 16 bp, Homo sapiens
atctatgtttcatctt

SEQ ID NO: 2751962 - DNA, 18 bp, Homo sapiens
atctattgatagtttcat

SEQ ID NO: 2751963 - DNA, 21 bp, Homo sapiens
atctcatttccaagcaagtat

SEQ ID NO: 2751964 - DNA, 15 bp, Homo sapiens
atctccaactttatt

SEQ ID NO: 2751965 - DNA, 17 bp, Homo sapiens
atctccagcttactata

SEQ ID NO: 2751966 - DNA, 16 bp, Homo sapiens
atctcctgagttgtat

SEQ ID NO: 2751967 - DNA, 18 bp, Homo sapiens
atctcctgagttgtataa

SEQ ID NO: 2751968 - DNA, 17 bp, Homo sapiens
atctctagcctctttgt

SEQ ID NO: 2751969 - DNA, 14 bp, Homo sapiens
atctgcaaggattt

SEQ ID NO: 2751970 - DNA, 19 bp, Homo sapiens
atctgcaaggattttttaa

SEQ ID NO: 2751971 - DNA, 16 bp, Homo sapiens
atctgtacctctgcct

SEQ ID NO: 2751972 - DNA, 13 bp, Homo sapiens
atctgtacttttt

SEQ ID NO: 2751973 - DNA, 18 bp, Homo sapiens
atctgtacttttttcaaa

SEQ ID NO: 2751974 - DNA, 20 bp, Homo sapiens
atctgtacttttttcaaata

SEQ ID NO: 2751975 - DNA, 12 bp, Homo sapiens
atctgtataaat

SEQ ID NO: 2751976 - DNA, 13 bp, Homo sapiens
atctgtataaatg

SEQ ID NO: 2751977 - DNA, 17 bp, Homo sapiens
atctgtataaatgtcta

SEQ ID NO: 2751978 - DNA, 22 bp, Homo sapiens
atctgtataaatgtctattatt

SEQ ID NO: 2751979 - DNA, 21 bp, Homo sapiens
atctgtgaggggctctctcat

SEQ ID NO: 2751980 - DNA, 14 bp, Homo sapiens
atctgtttattctg

SEQ ID NO: 2751981 - DNA, 19 bp, Homo sapiens
atctgtttattctgggaaa

SEQ ID NO: 2751982 - DNA, 14 bp, Homo sapiens
atcttaaatcagaa

SEQ ID NO: 2751983 - DNA, 17 bp, Homo sapiens
atcttaaatcagaataa

SEQ ID NO: 2751984 - DNA, 18 bp, Homo sapiens
atcttaaatcagaataaa

SEQ ID NO: 2751985 - DNA, 14 bp, Homo sapiens
atcttaagaatgtg

SEQ ID NO: 2751986 - DNA, 18 bp, Homo sapiens
atcttagggaactttgat

SEQ ID NO: 2751987 - DNA, 21 bp, Homo sapiens
atcttagggaactttgataca

SEQ ID NO: 2751988 - DNA, 18 bp, Homo sapiens
atcttagtttactggata

SEQ ID NO: 2751989 - DNA, 14 bp, Homo sapiens
atcttggtgtaact

SEQ ID NO: 2751990 - DNA, 15 bp, Homo sapiens
atcttggtgtaactt

SEQ ID NO: 2751991 - DNA, 16 bp, Homo sapiens
atcttggtgtaactta

SEQ ID NO: 2751992 - DNA, 22 bp, Homo sapiens
atcttgttttaagcaaatgcat

SEQ ID NO: 2751993 - DNA, 19 bp, Homo sapiens
atcttttagctagaatcca

SEQ ID NO: 2751994 - DNA, 13 bp, Homo sapiens
atgaaatattatg

SEQ ID NO: 2751995 - DNA, 20 bp, Homo sapiens
atgaataaaaataaagtttt

SEQ ID NO: 2751996 - DNA, 13 bp, Homo sapiens
atgaatatatggc

SEQ ID NO: 2751997 - DNA, 20 bp, Homo sapiens
atgaatatatggcatttgca

SEQ ID NO: 2751998 - DNA, 14 bp, Homo sapiens
atgaatattacatg

SEQ ID NO: 2751999 - DNA, 23 bp, Homo sapiens
atgaatattacatgtaaagctgt

SEQ ID NO: 2752000 - DNA, 15 bp, Homo sapiens
atgaattaagttttt

SEQ ID NO: 2752001 - DNA, 16 bp, Homo sapiens
atgaattacatttgta

SEQ ID NO: 2752002 - DNA, 15 bp, Homo sapiens
atgaatttgtccatt

SEQ ID NO: 2752003 - DNA, 21 bp, Homo sapiens
atgaatttgtccatttaaaaa

SEQ ID NO: 2752004 - DNA, 22 bp, Homo sapiens
atgaatttgtccatttaaaaat

SEQ ID NO: 2752005 - DNA, 12 bp, Homo sapiens
atgacagaatat

SEQ ID NO: 2752006 - DNA, 21 bp, Homo sapiens
atgaccttaaggaaaagtaag

SEQ ID NO: 2752007 - DNA, 13 bp, Homo sapiens
atgagaagaatag

SEQ ID NO: 2752008 - DNA, 20 bp, Homo sapiens
atgagacccctttaaactgt

SEQ ID NO: 2752009 - DNA, 13 bp, Homo sapiens
atgagagacacac

SEQ ID NO: 2752010 - DNA, 19 bp, Homo sapiens
atgagagacacactgaaga

SEQ ID NO: 2752011 - DNA, 21 bp, Homo sapiens
atgagagacacactgaagaag

SEQ ID NO: 2752012 - DNA, 18 bp, Homo sapiens
atgagttggctgggaata

SEQ ID NO: 2752013 - DNA, 14 bp, Homo sapiens
atgattaagtaatg

SEQ ID NO: 2752014 - DNA, 12 bp, Homo sapiens
atgattcccagc

SEQ ID NO: 2752015 - DNA, 18 bp, Homo sapiens
atgatttctccagaaatt

SEQ ID NO: 2752016 - DNA, 20 bp, Homo sapiens
tctgatgcagtgccctagaa

SEQ ID NO: 2752017 - DNA, 14 bp, Homo sapiens
tctgcaaggatttt

SEQ ID NO: 2752018 - DNA, 14 bp, Homo sapiens
tctggaatgagcct

SEQ ID NO: 2752019 - DNA, 21 bp, Homo sapiens
tctggcctgaggtcaatggtg

SEQ ID NO: 2752020 - DNA, 17 bp, Homo sapiens
tctgtacttttttcaaa

SEQ ID NO: 2752021 - DNA, 21 bp, Homo sapiens
tctgtacttttttcaaatatt

SEQ ID NO: 2752022 - DNA, 22 bp, Homo sapiens
tctgtacttttttcaaatattg

SEQ ID NO: 2752023 - DNA, 13 bp, Homo sapiens
tctgtataaatgt

SEQ ID NO: 2752024 - DNA, 15 bp, Homo sapiens
tctgtataaatgtct

SEQ ID NO: 2752025 - DNA, 21 bp, Homo sapiens
tctgtgattaaatctccagct

SEQ ID NO: 2752026 - DNA, 14 bp, Homo sapiens
tctgtgcagggctg

SEQ ID NO: 2752027 - DNA, 16 bp, Homo sapiens
tctgtgcagggctggt

SEQ ID NO: 2752028 - DNA, 18 bp, Homo sapiens
tctgtgtgtgtgtatgtg

SEQ ID NO: 2752029 - DNA, 16 bp, Homo sapiens
tctgtgtgtttatgtg

SEQ ID NO: 2752030 - DNA, 17 bp, Homo sapiens
tctgttaatctttttca

SEQ ID NO: 2752031 - DNA, 21 bp, Homo sapiens
tctgttaatctttttcatcat

SEQ ID NO: 2752032 - DNA, 22 bp, Homo sapiens
tcttaaactgttcttcattaga

SEQ ID NO: 2752033 - DNA, 17 bp, Homo sapiens
tcttaaatcagaataaa

SEQ ID NO: 2752034 - DNA, 22 bp, Homo sapiens
tcttaaatcagaataaattaat

SEQ ID NO: 2752035 - DNA, 12 bp, Homo sapiens
tcttaagaagac

SEQ ID NO: 2752036 - DNA, 18 bp, Homo sapiens
tcttaagaagactgcatt

SEQ ID NO: 2752037 - DNA, 22 bp, Homo sapiens
tcttagatgcagttctgaagaa

SEQ ID NO: 2752038 - DNA, 17 bp, Homo sapiens
tcttagggaactttgat

SEQ ID NO: 2752039 - DNA, 19 bp, Homo sapiens
tcttagggaactttgatac

SEQ ID NO: 2752040 - DNA, 15 bp, Homo sapiens
tcttagtttactgga

SEQ ID NO: 2752041 - DNA, 17 bp, Homo sapiens
tcttcaggctctgccca

SEQ ID NO: 2752042 - DNA, 15 bp, Homo sapiens
tcttccctaaaatgt

SEQ ID NO: 2752043 - DNA, 20 bp, Homo sapiens
tcttcggccgagctggtttc

SEQ ID NO: 2752044 - DNA, 22 bp, Homo sapiens
tcttctcatatccataaaattg

SEQ ID NO: 2752045 - DNA, 18 bp, Homo sapiens
tcttcttgtggagatttt

SEQ ID NO: 2752046 - DNA, 16 bp, Homo sapiens
tcttgattaatgtact

SEQ ID NO: 2752047 - DNA, 22 bp, Homo sapiens
tcttgattaatgtactttttat

SEQ ID NO: 2752048 - DNA, 15 bp, Homo sapiens
tcttgccacatcttg

SEQ ID NO: 2752049 - DNA, 22 bp, Homo sapiens
tcttgttttaagcaaatgcatt

SEQ ID NO: 2752050 - DNA, 16 bp, Homo sapiens
tctttaaactactgaa

SEQ ID NO: 2752051 - DNA, 16 bp, Homo sapiens
tctttcatagttctgt

SEQ ID NO: 2752052 - DNA, 19 bp, Homo sapiens
tctttcatagttctgttaa

SEQ ID NO: 2752053 - DNA, 17 bp, Homo sapiens
tctttgaaatgctaaac

SEQ ID NO: 2752054 - DNA, 20 bp, Homo sapiens
tctttgaaatgctaaacttg

SEQ ID NO: 2752055 - DNA, 17 bp, Homo sapiens
tctttgtatcattcatc

SEQ ID NO: 2752056 - DNA, 13 bp, Homo sapiens
tcttttagctaga

SEQ ID NO: 2752057 - DNA, 14 bp, Homo sapiens
tcttttctttgtat

SEQ ID NO: 2752058 - DNA, 20 bp, Homo sapiens
tctttttcaaaactagttct

SEQ ID NO: 2752059 - DNA, 12 bp, Homo sapiens
tgaaaatgccac

SEQ ID NO: 2752060 - DNA, 17 bp, Homo sapiens
tgaaagaaactaagatt

SEQ ID NO: 2752061 - DNA, 16 bp, Homo sapiens
tgaaaggtcagaattt

SEQ ID NO: 2752062 - DNA, 16 bp, Homo sapiens
tgaaagtgatgacata

SEQ ID NO: 2752063 - DNA, 15 bp, Homo sapiens
tgaaatatagttgaa

SEQ ID NO: 2752064 - DNA, 16 bp, Homo sapiens
tgaaatatagttgaaa

SEQ ID NO: 2752065 - DNA, 17 bp, Homo sapiens
tgaaatatagttgaaag

SEQ ID NO: 2752066 - DNA, 18 bp, Homo sapiens
tgaaatatagttgaaagt

SEQ ID NO: 2752067 - DNA, 20 bp, Homo sapiens
tgaaatatagttgaaagtaa

SEQ ID NO: 2752068 - DNA, 21 bp, Homo sapiens
tgaaatattagttacttgcta

SEQ ID NO: 2752069 - DNA, 18 bp, Homo sapiens
tgaaatattatgttaaaa

SEQ ID NO: 2752070 - DNA, 14 bp, Homo sapiens
tgaaatgctaaact

SEQ ID NO: 2752071 - DNA, 21 bp, Homo sapiens
tgaaattcacagaagcctagg

SEQ ID NO: 2752072 - DNA, 15 bp, Homo sapiens
tgaacagtacagtat

SEQ ID NO: 2752073 - DNA, 22 bp, Homo sapiens
tgaacatttactacagttttta

SEQ ID NO: 2752074 - DNA, 16 bp, Homo sapiens
tgaactaagttattgc

SEQ ID NO: 2752075 - DNA, 17 bp, Homo sapiens
tgaactaagttattgct

SEQ ID NO: 2752076 - DNA, 14 bp, Homo sapiens
tgaagcagaagccc

SEQ ID NO: 2752077 - DNA, 19 bp, Homo sapiens
tgaagcagaagccccaaag

SEQ ID NO: 2752078 - DNA, 13 bp, Homo sapiens
tgaagtccaagca

SEQ ID NO: 2752079 - DNA, 21 bp, Homo sapiens
tgaagtccaagcatttagatg

SEQ ID NO: 2752080 - DNA, 17 bp, Homo sapiens
tgaagttacatgcataa

SEQ ID NO: 2752081 - DNA, 18 bp, Homo sapiens
tgaagttacatgcataaa

SEQ ID NO: 2752082 - DNA, 22 bp, Homo sapiens
tgaagttacatgcataaaaggg

SEQ ID NO: 2752083 - DNA, 15 bp, Homo sapiens
tgaagttgttttttt

SEQ ID NO: 2752084 - DNA, 20 bp, Homo sapiens
tgaataaaaataaagttttt

SEQ ID NO: 2752085 - DNA, 15 bp, Homo sapiens
tgaatacaaacattt

SEQ ID NO: 2752086 - DNA, 17 bp, Homo sapiens
tgaatacaaacatttca

SEQ ID NO: 2752087 - DNA, 16 bp, Homo sapiens
tgaatattaagctaaa

SEQ ID NO: 2752088 - DNA, 20 bp, Homo sapiens
tgaatattacatgtaaagct

SEQ ID NO: 2752089 - DNA, 12 bp, Homo sapiens
tgaatcctgtta

SEQ ID NO: 2752090 - DNA, 14 bp, Homo sapiens
tgaatgccttattt

SEQ ID NO: 2752091 - DNA, 23 bp, Homo sapiens
tgaatgccttatttttgaattct

SEQ ID NO: 2752092 - DNA, 14 bp, Homo sapiens
tgaattaagttttt

SEQ ID NO: 2752093 - DNA, 15 bp, Homo sapiens
tgaattctttagatt

SEQ ID NO: 2752094 - DNA, 15 bp, Homo sapiens
tgacaagctcacaga

SEQ ID NO: 2752095 - DNA, 23 bp, Homo sapiens
tgacagaaaaaaaaatgttttat

SEQ ID NO: 2752096 - DNA, 19 bp, Homo sapiens
tgacagaatatacacattt

SEQ ID NO: 2752097 - DNA, 23 bp, Homo sapiens
tgacagaatatacacattttgta

SEQ ID NO: 2752098 - DNA, 15 bp, Homo sapiens
tgactcttaagaaga

SEQ ID NO: 2752099 - DNA, 15 bp, Homo sapiens
tgactgtttccatca

SEQ ID NO: 2752100 - DNA, 18 bp, Homo sapiens
tgacttcttccctaaaat

SEQ ID NO: 2752101 - DNA, 13 bp, Homo sapiens
tgactttggctga

SEQ ID NO: 2752102 - DNA, 15 bp, Homo sapiens
tgactttttgtttct

SEQ ID NO: 2752103 - DNA, 12 bp, Homo sapiens
tgagaagaatag

SEQ ID NO: 2752104 - DNA, 18 bp, Homo sapiens
tgagaatgttaccagact

SEQ ID NO: 2752105 - DNA, 19 bp, Homo sapiens
tgagaatgttaccagactt

SEQ ID NO: 2752106 - DNA, 22 bp, Homo sapiens
tgagaatgttaccagacttcaa

SEQ ID NO: 2752107 - DNA, 18 bp, Homo sapiens
tgagactgaaagaaacta

SEQ ID NO: 2752108 - DNA, 21 bp, Homo sapiens
tgagactgaaagaaactaaga

SEQ ID NO: 2752109 - DNA, 17 bp, Homo sapiens
tgagagacacactgaag

SEQ ID NO: 2752110 - DNA, 21 bp, Homo sapiens
tgagagacacactgaagaagc

SEQ ID NO: 2752111 - DNA, 22 bp, Homo sapiens
tgagagacacactgaagaagca

SEQ ID NO: 2752112 - DNA, 17 bp, Homo sapiens
tgagcagtcaggaaaga

SEQ ID NO: 2752113 - DNA, 20 bp, Homo sapiens
tgagctggggatgtctctca

SEQ ID NO: 2752114 - DNA, 15 bp, Homo sapiens
tgaggacactgatat

SEQ ID NO: 2752115 - DNA, 18 bp, Homo sapiens
tgaggccaggactttgag

SEQ ID NO: 2752116 - DNA, 17 bp, Homo sapiens
tgaggtgtctggcctga

SEQ ID NO: 2752117 - DNA, 13 bp, Homo sapiens
tgagtatttgctg

SEQ ID NO: 2752118 - DNA, 18 bp, Homo sapiens
tgagttcataaatttatg

SEQ ID NO: 2752119 - DNA, 10 bp, Homo sapiens
tgagttgctt

SEQ ID NO: 2752120 - DNA, 20 bp, Homo sapiens
tgagttgggggtattttcta

SEQ ID NO: 2752121 - DNA, 20 bp, Homo sapiens
tgagttgtataaaagttgta

SEQ ID NO: 2752122 - DNA, 16 bp, Homo sapiens
tgataactggaaactt

SEQ ID NO: 2752123 - DNA, 20 bp, Homo sapiens
tgatagcaagcgttattttg

SEQ ID NO: 2752124 - DNA, 21 bp, Homo sapiens
tgatataaagaatgaaagtag

SEQ ID NO: 2752125 - DNA, 22 bp, Homo sapiens
tgatataaagaatgaaagtagc

SEQ ID NO: 2752126 - DNA, 19 bp, Homo sapiens
tgatatctatattctaaag

SEQ ID NO: 2752127 - DNA, 21 bp, Homo sapiens
tgatgcagtgccctagaaggg

SEQ ID NO: 2752128 - DNA, 23 bp, Homo sapiens
tgattaagtaatgataactggaa

SEQ ID NO: 2752129 - DNA, 15 bp, Homo sapiens
tgattaatgtacttt

SEQ ID NO: 2752130 - DNA, 21 bp, Homo sapiens
tgattatgaattacatttgta

SEQ ID NO: 2752131 - DNA, 22 bp, Homo sapiens
tgattatgaattacatttgtat

SEQ ID NO: 2752132 - DNA, 17 bp, Homo sapiens
tgtaaaaaatgtgtgta

SEQ ID NO: 2752133 - DNA, 13 bp, Homo sapiens
tgtaaaaactttt

SEQ ID NO: 2752134 - DNA, 14 bp, Homo sapiens
tgtaaaaacttttt

SEQ ID NO: 2752135 - DNA, 14 bp, Homo sapiens
tgtaaagctgttaa

SEQ ID NO: 2752136 - DNA, 17 bp, Homo sapiens
tgtaaatctgtactttt

SEQ ID NO: 2752137 - DNA, 17 bp, Homo sapiens
tgtaaatttatgtgatg

SEQ ID NO: 2752138 - DNA, 15 bp, Homo sapiens
tgtaatatatcctgt

SEQ ID NO: 2752139 - DNA, 17 bp, Homo sapiens
tgtaatttaaaattgtg

SEQ ID NO: 2752140 - DNA, 22 bp, Homo sapiens
tgtaatttaaaattgtgatgtg

SEQ ID NO: 2752141 - DNA, 14 bp, Homo sapiens
tgtacaaagtaaaa

SEQ ID NO: 2752142 - DNA, 14 bp, Homo sapiens
tgtacatttggaac

SEQ ID NO: 2752143 - DNA, 17 bp, Homo sapiens
tgtacctctattagttt

SEQ ID NO: 2752144 - DNA, 14 bp, Homo sapiens
tgtacctctgcctc

SEQ ID NO: 2752145 - DNA, 18 bp, Homo sapiens
tgtactgcatcttagttt

SEQ ID NO: 2752146 - DNA, 13 bp, Homo sapiens
tgtacttttttca

SEQ ID NO: 2752147 - DNA, 11 bp, Homo sapiens
tgtagaaattc

SEQ ID NO: 2752148 - DNA, 19 bp, Homo sapiens
tgtagatgcagaaaaagaa

SEQ ID NO: 2752149 - DNA, 23 bp, Homo sapiens
tgtaggtggtctggagctgtccg

SEQ ID NO: 2752150 - DNA, 16 bp, Homo sapiens
tgtagtcccagcactt

SEQ ID NO: 2752151 - DNA, 23 bp, Homo sapiens
tcaatatttcagataatcacaat

SEQ ID NO: 2752152 - DNA, 13 bp, Homo sapiens
tcacaaagagctg

SEQ ID NO: 2752153 - DNA, 15 bp, Homo sapiens
tcacactcaaacttt

SEQ ID NO: 2752154 - DNA, 16 bp, Homo sapiens
tcacagacctttgaac

SEQ ID NO: 2752155 - DNA, 22 bp, Homo sapiens
tcacttaacattcctaaaatgc

SEQ ID NO: 2752156 - DNA, 20 bp, Homo sapiens
tcacttatttccttatgtgt

SEQ ID NO: 2752157 - DNA, 15 bp, Homo sapiens
tcagaaattgaaagc

SEQ ID NO: 2752158 - DNA, 19 bp, Homo sapiens
tcagagcccttttgctata

SEQ ID NO: 2752159 - DNA, 13 bp, Homo sapiens
tcagagtatctga

SEQ ID NO: 2752160 - DNA, 14 bp, Homo sapiens
tcagagtatctgaa

SEQ ID NO: 2752161 - DNA, 19 bp, Homo sapiens
tcaggaaagagaacttcca

SEQ ID NO: 2752162 - DNA, 18 bp, Homo sapiens
tcaggagcctgctaagga

SEQ ID NO: 2752163 - DNA, 14 bp, Homo sapiens
tcagtatgtggaag

SEQ ID NO: 2752164 - DNA, 21 bp, Homo sapiens
tcagtgcaagagactttgtca

SEQ ID NO: 2752165 - DNA, 22 bp, Homo sapiens
tcagtttagaacctacaaaagc

SEQ ID NO: 2752166 - DNA, 12 bp, Homo sapiens
tcagtttctaca

SEQ ID NO: 2752167 - DNA, 15 bp, Homo sapiens
tcatagttctgttaa

SEQ ID NO: 2752168 - DNA, 16 bp, Homo sapiens
tcatagttctgttaaa

SEQ ID NO: 2752169 - DNA, 18 bp, Homo sapiens
tcatcattgttgtgtata

SEQ ID NO: 2752170 - DNA, 22 bp, Homo sapiens
tcatgacagaatatacacattt

SEQ ID NO: 2752171 - DNA, 16 bp, Homo sapiens
tcatgacggcctgcct

SEQ ID NO: 2752172 - DNA, 19 bp, Homo sapiens
tcatggaattggagctcgt

SEQ ID NO: 2752173 - DNA, 21 bp, Homo sapiens
tcatggaattggagctcgtgg

SEQ ID NO: 2752174 - DNA, 17 bp, Homo sapiens
tcatgtttacagaggac

SEQ ID NO: 2752175 - DNA, 20 bp, Homo sapiens
tcattatgcaacgtttaaca

SEQ ID NO: 2752176 - DNA, 21 bp, Homo sapiens
tcattatgcaacgtttaacat

SEQ ID NO: 2752177 - DNA, 16 bp, Homo sapiens
tcattctgaatctgaa

SEQ ID NO: 2752178 - DNA, 15 bp, Homo sapiens
tcattgttgtgtata

SEQ ID NO: 2752179 - DNA, 12 bp, Homo sapiens
tcattttacatt

SEQ ID NO: 2752180 - DNA, 14 bp, Homo sapiens
tccaaacacaggca

SEQ ID NO: 2752181 - DNA, 21 bp, Homo sapiens
tccaactatctcatttccaag

SEQ ID NO: 2752182 - DNA, 18 bp, Homo sapiens
tccaagacaaactaaact

SEQ ID NO: 2752183 - DNA, 13 bp, Homo sapiens
tccaagtgtataa

SEQ ID NO: 2752184 - DNA, 16 bp, Homo sapiens
tccaagtgtataatgt

SEQ ID NO: 2752185 - DNA, 18 bp, Homo sapiens
tccaagtgtataatgttg

SEQ ID NO: 2752186 - DNA, 20 bp, Homo sapiens
tccaagtgtataatgttggt

SEQ ID NO: 2752187 - DNA, 20 bp, Homo sapiens
tccaataaaaatcaggagcc

SEQ ID NO: 2752188 - DNA, 23 bp, Homo sapiens
tccaataaaaatcaggagcctgc

SEQ ID NO: 2752189 - DNA, 22 bp, Homo sapiens
tccaatgccacatacttgcagc

SEQ ID NO: 2752190 - DNA, 14 bp, Homo sapiens
tccaccggcactca

SEQ ID NO: 2752191 - DNA, 15 bp, Homo sapiens
tccaccggcactcat

SEQ ID NO: 2752192 - DNA, 17 bp, Homo sapiens
tccaccggcactcatga

SEQ ID NO: 2752193 - DNA, 14 bp, Homo sapiens
tccagaaatttacc

SEQ ID NO: 2752194 - DNA, 14 bp, Homo sapiens
tccagatcctggaa

SEQ ID NO: 2752195 - DNA, 16 bp, Homo sapiens
tccagatcctggaaat

SEQ ID NO: 2752196 - DNA, 17 bp, Homo sapiens
tccagatcctggaaatc

SEQ ID NO: 2752197 - DNA, 16 bp, Homo sapiens
tccagcgtgcaccccg

SEQ ID NO: 2752198 - DNA, 14 bp, Homo sapiens
tccagtttctgtaa

SEQ ID NO: 2752199 - DNA, 22 bp, Homo sapiens
tccatatccttctggctgtaga

SEQ ID NO: 2752200 - DNA, 13 bp, Homo sapiens
tcccaaaaagatg

SEQ ID NO: 2752201 - DNA, 21 bp, Homo sapiens
tcccaaaaagatgctttaatt

SEQ ID NO: 2752202 - DNA, 14 bp, Homo sapiens
tcccaagatttttt

SEQ ID NO: 2752203 - DNA, 22 bp, Homo sapiens
tcccagctttaaaaagaaaaaa

SEQ ID NO: 2752204 - DNA, 13 bp, Homo sapiens
tcccatggcctgc

SEQ ID NO: 2752205 - DNA, 15 bp, Homo sapiens
tcccattctatgtgt

SEQ ID NO: 2752206 - DNA, 22 bp, Homo sapiens
tccctaaaatgtagaaattcta

SEQ ID NO: 2752207 - DNA, 12 bp, Homo sapiens
tcctatgcaata

SEQ ID NO: 2752208 - DNA, 16 bp, Homo sapiens
tcctatgcaataaaat

SEQ ID NO: 2752209 - DNA, 20 bp, Homo sapiens
tcctcttgccacatcttgaa

SEQ ID NO: 2752210 - DNA, 18 bp, Homo sapiens
tcctgaacctttcaaaat

SEQ ID NO: 2752211 - DNA, 23 bp, Homo sapiens
tcctgaacctttcaaaatggaaa

SEQ ID NO: 2752212 - DNA, 23 bp, Homo sapiens
tcctgactgggctgggtttgctg

SEQ ID NO: 2752213 - DNA, 19 bp, Homo sapiens
tcctgagttgtataaaagt

SEQ ID NO: 2752214 - DNA, 15 bp, Homo sapiens
tcctgcccagcctgg

SEQ ID NO: 2752215 - DNA, 17 bp, Homo sapiens
tcctggcaatagtcaaa

SEQ ID NO: 2752216 - DNA, 23 bp, Homo sapiens
tcctgggccgttacatctgtgca

SEQ ID NO: 2752217 - DNA, 19 bp, Homo sapiens
tcctgtccctcatccatag

SEQ ID NO: 2752218 - DNA, 17 bp, Homo sapiens
tcctgttaaattttctc

SEQ ID NO: 2752219 - DNA, 12 bp, Homo sapiens
tcctgtttgtat

SEQ ID NO: 2752220 - DNA, 13 bp, Homo sapiens
tcctgtttgtatt

SEQ ID NO: 2752221 - DNA, 21 bp, Homo sapiens
tcctgtttgtatttttttcca

SEQ ID NO: 2752222 - DNA, 22 bp, Homo sapiens
tccttctggctgtagataaata

SEQ ID NO: 2752223 - DNA, 14 bp, Homo sapiens
tcctttatactgtg

SEQ ID NO: 2752224 - DNA, 15 bp, Homo sapiens
tcctttatactgtga

SEQ ID NO: 2752225 - DNA, 16 bp, Homo sapiens
tcctttcctgcatctt

SEQ ID NO: 2752226 - DNA, 16 bp, Homo sapiens
tcgcacctgtgctgga

SEQ ID NO: 2752227 - DNA, 17 bp, Homo sapiens
tcgcacctgtgctggag

SEQ ID NO: 2752228 - DNA, 18 bp, Homo sapiens
tcgcacctgtgctggagc

SEQ ID NO: 2752229 - DNA, 15 bp, Homo sapiens
tcgcttctttttcaa

SEQ ID NO: 2752230 - DNA, 15 bp, Homo sapiens
tcggccgagctggtt

SEQ ID NO: 2752231 - DNA, 17 bp, Homo sapiens
tcggccgagctggtttc

SEQ ID NO: 2752232 - DNA, 15 bp, Homo sapiens
tcggggtggtgcagg

SEQ ID NO: 2752233 - DNA, 16 bp, Homo sapiens
tcggggtggtgcaggc

SEQ ID NO: 2752234 - DNA, 22 bp, Homo sapiens
tcgtgggacagtcacctcatgg

SEQ ID NO: 2752235 - DNA, 13 bp, Homo sapiens
tctaaaagattct

SEQ ID NO: 2752236 - DNA, 18 bp, Homo sapiens
tctaaaagattctttaaa

SEQ ID NO: 2752237 - DNA, 18 bp, Homo sapiens
tctaaaccacaaaagttg

SEQ ID NO: 2752238 - DNA, 21 bp, Homo sapiens
tctaaacccagcaaaacagat

SEQ ID NO: 2752239 - DNA, 24 bp, Homo sapiens
tctaaacccagcaaaacagattca

SEQ ID NO: 2752240 - DNA, 14 bp, Homo sapiens
tctaaactgtttct

SEQ ID NO: 2752241 - DNA, 15 bp, Homo sapiens
tctaaactgtttctt

SEQ ID NO: 2752242 - DNA, 17 bp, Homo sapiens
tctaaacttagaaatat

SEQ ID NO: 2752243 - DNA, 18 bp, Homo sapiens
tctaaatagcgattataa

SEQ ID NO: 2752244 - DNA, 18 bp, Homo sapiens
tctaaatttccatatcct

SEQ ID NO: 2752245 - DNA, 19 bp, Homo sapiens
tctaactgaaggtgcagtt

SEQ ID NO: 2752246 - DNA, 17 bp, Homo sapiens
tctaacttaatgtagtt

SEQ ID NO: 2752247 - DNA, 16 bp, Homo sapiens
tctacacatttcatct

SEQ ID NO: 2752248 - DNA, 21 bp, Homo sapiens
tctacactaagagagaatgag

SEQ ID NO: 2752249 - DNA, 23 bp, Homo sapiens
tctactgtgtaatataaaagatc

SEQ ID NO: 2752250 - DNA, 22 bp, Homo sapiens
tctagacataactggtttgact

SEQ ID NO: 2752251 - DNA, 15 bp, Homo sapiens
tctagcctctttgtg

SEQ ID NO: 2752252 - DNA, 18 bp, Homo sapiens
tctagctctatttacttc

SEQ ID NO: 2752253 - DNA, 16 bp, Homo sapiens
tctagtagttaaaaca

SEQ ID NO: 2752254 - DNA, 14 bp, Homo sapiens
tctagttttatctt

SEQ ID NO: 2752255 - DNA, 16 bp, Homo sapiens
tctatcgttattataa

SEQ ID NO: 2752256 - DNA, 18 bp, Homo sapiens
tctatcgttattataaat

SEQ ID NO: 2752257 - DNA, 12 bp, Homo sapiens
tctatctaatga

SEQ ID NO: 2752258 - DNA, 14 bp, Homo sapiens
tctatctaatgaca

SEQ ID NO: 2752259 - DNA, 16 bp, Homo sapiens
tctatctaatgacatg

SEQ ID NO: 2752260 - DNA, 14 bp, Homo sapiens
tctatgaaatatta

SEQ ID NO: 2752261 - DNA, 17 bp, Homo sapiens
tctatgaaatattatgt

SEQ ID NO: 2752262 - DNA, 18 bp, Homo sapiens
tctatgaaatattatgtt

SEQ ID NO: 2752263 - DNA, 14 bp, Homo sapiens
tctattagtttcaa

SEQ ID NO: 2752264 - DNA, 12 bp, Homo sapiens
tctattattatg

SEQ ID NO: 2752265 - DNA, 23 bp, Homo sapiens
tctattattatgaagaattgcca

SEQ ID NO: 2752266 - DNA, 18 bp, Homo sapiens
tctcagggccgagaggac

SEQ ID NO: 2752267 - DNA, 16 bp, Homo sapiens
tctcattccagaggaa

SEQ ID NO: 2752268 - DNA, 22 bp, Homo sapiens
tctcctgagttgtataaaagtt

SEQ ID NO: 2752269 - DNA, 18 bp, Homo sapiens
tctcctgggccgttacat

SEQ ID NO: 2752270 - DNA, 17 bp, Homo sapiens
tctctaaactgtttctt

SEQ ID NO: 2752271 - DNA, 21 bp, Homo sapiens
tctctactttaaattttttaa

SEQ ID NO: 2752272 - DNA, 16 bp, Homo sapiens
cttaaactgttcttca

SEQ ID NO: 2752273 - DNA, 18 bp, Homo sapiens
cttaaactgttcttcatt

SEQ ID NO: 2752274 - DNA, 15 bp, Homo sapiens
cttaaatatttgaaa

SEQ ID NO: 2752275 - DNA, 18 bp, Homo sapiens
cttaaatcagaataaatt

SEQ ID NO: 2752276 - DNA, 15 bp, Homo sapiens
cttaaggaaaagtaa

SEQ ID NO: 2752277 - DNA, 22 bp, Homo sapiens
cttagatgcagttctgaagaag

SEQ ID NO: 2752278 - DNA, 15 bp, Homo sapiens
cttaggccagcacca

SEQ ID NO: 2752279 - DNA, 12 bp, Homo sapiens
cttatagaataa

SEQ ID NO: 2752280 - DNA, 20 bp, Homo sapiens
cttatagaataaaagctgtg

SEQ ID NO: 2752281 - DNA, 23 bp, Homo sapiens
cttatagaataaaagctgtggaa

SEQ ID NO: 2752282 - DNA, 16 bp, Homo sapiens
cttatgtgtgtaggag

SEQ ID NO: 2752283 - DNA, 18 bp, Homo sapiens
cttattggcagctctact

SEQ ID NO: 2752284 - DNA, 16 bp, Homo sapiens
cttatttttgaattct

SEQ ID NO: 2752285 - DNA, 17 bp, Homo sapiens
cttatttttgaattctt

SEQ ID NO: 2752286 - DNA, 23 bp, Homo sapiens
cttcaaatagtatagaaaatgga

SEQ ID NO: 2752287 - DNA, 16 bp, Homo sapiens
cttcagcggtttatat

SEQ ID NO: 2752288 - DNA, 18 bp, Homo sapiens
cttcagcggtttatataa

SEQ ID NO: 2752289 - DNA, 17 bp, Homo sapiens
cttcaggctctgcccag

SEQ ID NO: 2752290 - DNA, 13 bp, Homo sapiens
cttcagtttagaa

SEQ ID NO: 2752291 - DNA, 16 bp, Homo sapiens
cttcattagatgttta

SEQ ID NO: 2752292 - DNA, 17 bp, Homo sapiens
cttccaccggcactcat

SEQ ID NO: 2752293 - DNA, 19 bp, Homo sapiens
cttccagatcctggaaatc

SEQ ID NO: 2752294 - DNA, 19 bp, Homo sapiens
cttccagatgtctaaaaga

SEQ ID NO: 2752295 - DNA, 19 bp, Homo sapiens
cttccagtttctgtaaggt

SEQ ID NO: 2752296 - DNA, 20 bp, Homo sapiens
cttccttggccaagagaagg

SEQ ID NO: 2752297 - DNA, 13 bp, Homo sapiens
cttcttcttgtgg

SEQ ID NO: 2752298 - DNA, 13 bp, Homo sapiens
cttcttgtggaga

SEQ ID NO: 2752299 - DNA, 20 bp, Homo sapiens
cttctttaatcacttaacat

SEQ ID NO: 2752300 - DNA, 21 bp, Homo sapiens
cttcttttttgtaaaaacttt

SEQ ID NO: 2752301 - DNA, 14 bp, Homo sapiens
cttgaaaatgccac

SEQ ID NO: 2752302 - DNA, 22 bp, Homo sapiens
cttgactttggctgatttaaaa

SEQ ID NO: 2752303 - DNA, 22 bp, Homo sapiens
cttgatagcaagcgttattttg

SEQ ID NO: 2752304 - DNA, 13 bp, Homo sapiens
cttgatgaagaag

SEQ ID NO: 2752305 - DNA, 16 bp, Homo sapiens
cttgattaatgtactt

SEQ ID NO: 2752306 - DNA, 18 bp, Homo sapiens
cttgattaatgtactttt

SEQ ID NO: 2752307 - DNA, 19 bp, Homo sapiens
cttgattaatgtacttttt

SEQ ID NO: 2752308 - DNA, 17 bp, Homo sapiens
cttgctataaatagatt

SEQ ID NO: 2752309 - DNA, 14 bp, Homo sapiens
cttggagccttcca

SEQ ID NO: 2752310 - DNA, 16 bp, Homo sapiens
cttggagccttccacc

SEQ ID NO: 2752311 - DNA, 13 bp, Homo sapiens
cttggatttgcat

SEQ ID NO: 2752312 - DNA, 14 bp, Homo sapiens
cttggccaagagaa

SEQ ID NO: 2752313 - DNA, 16 bp, Homo sapiens
cttggccaagagaagg

SEQ ID NO: 2752314 - DNA, 15 bp, Homo sapiens
cttggctggttcttt

SEQ ID NO: 2752315 - DNA, 21 bp, Homo sapiens
cttggctgtatgtcaaattgt

SEQ ID NO: 2752316 - DNA, 18 bp, Homo sapiens
cttggggctgatgcagtt

SEQ ID NO: 2752317 - DNA, 13 bp, Homo sapiens
cttggggtcccac

SEQ ID NO: 2752318 - DNA, 17 bp, Homo sapiens
cttggtgctggtttatt

SEQ ID NO: 2752319 - DNA, 12 bp, Homo sapiens
cttgtgtatctt

SEQ ID NO: 2752320 - DNA, 21 bp, Homo sapiens
cttgtgtatcttgattaatgt

SEQ ID NO: 2752321 - DNA, 15 bp, Homo sapiens
ctttaaaaagaaaaa

SEQ ID NO: 2752322 - DNA, 18 bp, Homo sapiens
ctttaaaaataaaagcta

SEQ ID NO: 2752323 - DNA, 12 bp, Homo sapiens
ctttaaactgtc

SEQ ID NO: 2752324 - DNA, 13 bp, Homo sapiens
ctttaattgtgtg

SEQ ID NO: 2752325 - DNA, 18 bp, Homo sapiens
ctttagatttttaaattg

SEQ ID NO: 2752326 - DNA, 15 bp, Homo sapiens
ctttatactgtgaag

SEQ ID NO: 2752327 - DNA, 23 bp, Homo sapiens
ctttattacacctcagaaattga

SEQ ID NO: 2752328 - DNA, 14 bp, Homo sapiens
ctttcagctgtgct

SEQ ID NO: 2752329 - DNA, 14 bp, Homo sapiens
ctttcatagttctg

SEQ ID NO: 2752330 - DNA, 15 bp, Homo sapiens
ctttcctgcatcttt

SEQ ID NO: 2752331 - DNA, 21 bp, Homo sapiens
ctttctaagggaaaaagttgt

SEQ ID NO: 2752332 - DNA, 18 bp, Homo sapiens
ctttgaaatgctaaactt

SEQ ID NO: 2752333 - DNA, 14 bp, Homo sapiens
ctttgacctgttgg

SEQ ID NO: 2752334 - DNA, 20 bp, Homo sapiens
ctttgagaccagccagggca

SEQ ID NO: 2752335 - DNA, 14 bp, Homo sapiens
ctttgctacgaaga

SEQ ID NO: 2752336 - DNA, 20 bp, Homo sapiens
ctttgtagtgtttggtgctc

SEQ ID NO: 2752337 - DNA, 17 bp, Homo sapiens
ctttgtgtttgcttggt

SEQ ID NO: 2752338 - DNA, 14 bp, Homo sapiens
ctttgttaaaaaaa

SEQ ID NO: 2752339 - DNA, 18 bp, Homo sapiens
cttttagctagaatccac

SEQ ID NO: 2752340 - DNA, 10 bp, Homo sapiens
cttttcttct

SEQ ID NO: 2752341 - DNA, 13 bp, Homo sapiens
cttttctttgtat

SEQ ID NO: 2752342 - DNA, 19 bp, Homo sapiens
cttttgtaaagtaaaatat

SEQ ID NO: 2752343 - DNA, 12 bp, Homo sapiens
ctttttattgca

SEQ ID NO: 2752344 - DNA, 22 bp, Homo sapiens
cttttttctttgaaatgctaaa

SEQ ID NO: 2752345 - DNA, 13 bp, Homo sapiens
cttttttgtaaaa

SEQ ID NO: 2752346 - DNA, 16 bp, Homo sapiens
gaaaaaaaaagaatta

SEQ ID NO: 2752347 - DNA, 21 bp, Homo sapiens
gaaaaaaaagaaaaaagtcct

SEQ ID NO: 2752348 - DNA, 17 bp, Homo sapiens
gaaaaaaactataaata

SEQ ID NO: 2752349 - DNA, 12 bp, Homo sapiens
gaaaaaagtcct

SEQ ID NO: 2752350 - DNA, 18 bp, Homo sapiens
gaaaagcacttaaagttt

SEQ ID NO: 2752351 - DNA, 19 bp, Homo sapiens
gaaaatatacaagtaaatt

SEQ ID NO: 2752352 - DNA, 12 bp, Homo sapiens
gaaaatatcact

SEQ ID NO: 2752353 - DNA, 15 bp, Homo sapiens
gaaaatggaaaatat

SEQ ID NO: 2752354 - DNA, 17 bp, Homo sapiens
gaaaattaattctaaac

SEQ ID NO: 2752355 - DNA, 23 bp, Homo sapiens
gaaactcgttaatttgtagtgtt

SEQ ID NO: 2752356 - DNA, 22 bp, Homo sapiens
gaaactggttctgtgttgaaat

SEQ ID NO: 2752357 - DNA, 11 bp, Homo sapiens
gaaagaaacta

SEQ ID NO: 2752358 - DNA, 12 bp, Homo sapiens
gaaagaatagaa

SEQ ID NO: 2752359 - DNA, 14 bp, Homo sapiens
gaaagaatagaaag

SEQ ID NO: 2752360 - DNA, 17 bp, Homo sapiens
gaaagagaacttccaga

SEQ ID NO: 2752361 - DNA, 15 bp, Homo sapiens
gaaagctaatacaaa

SEQ ID NO: 2752362 - DNA, 16 bp, Homo sapiens
gaaaggtcagaatttt

SEQ ID NO: 2752363 - DNA, 18 bp, Homo sapiens
gaaagtaaaaaaataatt

SEQ ID NO: 2752364 - DNA, 19 bp, Homo sapiens
gaaataccaggaccagttt

SEQ ID NO: 2752365 - DNA, 20 bp, Homo sapiens
gaaataccaggaccagttta

SEQ ID NO: 2752366 - DNA, 13 bp, Homo sapiens
gaaatatttattt

SEQ ID NO: 2752367 - DNA, 17 bp, Homo sapiens
gaaatgttttaatgcca

SEQ ID NO: 2752368 - DNA, 12 bp, Homo sapiens
gaaattgaaagc

SEQ ID NO: 2752369 - DNA, 22 bp, Homo sapiens
gaacaatgccgcctgtcaataa

SEQ ID NO: 2752370 - DNA, 16 bp, Homo sapiens
gaatagaaagaaagtc

SEQ ID NO: 2752371 - DNA, 17 bp, Homo sapiens
gaatagcctagatatga

SEQ ID NO: 2752372 - DNA, 14 bp, Homo sapiens
gaatatatggcatt

SEQ ID NO: 2752373 - DNA, 23 bp, Homo sapiens
gaatatatggcatttgcagattt

SEQ ID NO: 2752374 - DNA, 15 bp, Homo sapiens
gaatattaagctaaa

SEQ ID NO: 2752375 - DNA, 19 bp, Homo sapiens
gaatattaagctaaaaggt

SEQ ID NO: 2752376 - DNA, 20 bp, Homo sapiens
gaatgagagacacactgaag

SEQ ID NO: 2752377 - DNA, 14 bp, Homo sapiens
gaatgccttatttt

SEQ ID NO: 2752378 - DNA, 19 bp, Homo sapiens
gaatgccttatttttgaat

SEQ ID NO: 2752379 - DNA, 22 bp, Homo sapiens
gaatgccttatttttgaattct

SEQ ID NO: 2752380 - DNA, 15 bp, Homo sapiens
gaatggatataatct

SEQ ID NO: 2752381 - DNA, 18 bp, Homo sapiens
gaatgtcagtatgtggaa

SEQ ID NO: 2752382 - DNA, 19 bp, Homo sapiens
gaatgtcagtatgtggaag

SEQ ID NO: 2752383 - DNA, 18 bp, Homo sapiens
gaatgtgctagagttaaa

SEQ ID NO: 2752384 - DNA, 23 bp, Homo sapiens
gaattctttagatttttaaattg

SEQ ID NO: 2752385 - DNA, 15 bp, Homo sapiens
gaattgtttttataa

SEQ ID NO: 2752386 - DNA, 17 bp, Homo sapiens
gaattgtttttataaaa

SEQ ID NO: 2752387 - DNA, 19 bp, Homo sapiens
gaattgtttttataaaaac

SEQ ID NO: 2752388 - DNA, 14 bp, Homo sapiens
gacaaggttgctgt

SEQ ID NO: 2752389 - DNA, 16 bp, Homo sapiens
gacaaggttgctgttg

SEQ ID NO: 2752390 - DNA, 22 bp, Homo sapiens
gacaataaatgagaccccttta

SEQ ID NO: 2752391 - DNA, 15 bp, Homo sapiens
gacacactgaagaag

SEQ ID NO: 2752392 - DNA, 20 bp, Homo sapiens
gacagaaaaaaaaatgtttt

SEQ ID NO: 2752393 - DNA, 15 bp, Homo sapiens
gacagaatggatata

SEQ ID NO: 2752394 - DNA, 15 bp, Homo sapiens
gacagtatttgtggg

SEQ ID NO: 2752395 - DNA, 17 bp, Homo sapiens
gacagtcacctcatgga

SEQ ID NO: 2752396 - DNA, 22 bp, Homo sapiens
gacatgcctatatgagaagaat

SEQ ID NO: 2752397 - DNA, 21 bp, Homo sapiens
gacattgtttggatttccttt

SEQ ID NO: 2752398 - DNA, 23 bp, Homo sapiens
gacccgaaaatccagcgtgcacc

SEQ ID NO: 2752399 - DNA, 17 bp, Homo sapiens
gacctttcctgaggaag

SEQ ID NO: 2752400 - DNA, 11 bp, Homo sapiens
gactaaaatgt

SEQ ID NO: 2752401 - DNA, 18 bp, Homo sapiens
gactaaaatgtttcattt

SEQ ID NO: 2752402 - DNA, 23 bp, Homo sapiens
gactcctttcctgcatctttcat

SEQ ID NO: 2752403 - DNA, 16 bp, Homo sapiens
gactgaaagaaactaa

SEQ ID NO: 2752404 - DNA, 23 bp, Homo sapiens
gactgaaagaaactaagatttat

SEQ ID NO: 2752405 - DNA, 14 bp, Homo sapiens
gactgcattatatt

SEQ ID NO: 2752406 - DNA, 16 bp, Homo sapiens
gactgcattatattta

SEQ ID NO: 2752407 - DNA, 12 bp, Homo sapiens
gactgggctggg

SEQ ID NO: 2752408 - DNA, 13 bp, Homo sapiens
gactgggctgggt

SEQ ID NO: 2752409 - DNA, 16 bp, Homo sapiens
gacttcaagatcctct

SEQ ID NO: 2752410 - DNA, 16 bp, Homo sapiens
gactttggctgattta

SEQ ID NO: 2752411 - DNA, 22 bp, Homo sapiens
gactttttatggcactagtatt

SEQ ID NO: 2752412 - DNA, 13 bp, Homo sapiens
gagaaaagcactt

SEQ ID NO: 2752413 - DNA, 18 bp, Homo sapiens
gagaaaagcacttaaagt

SEQ ID NO: 2752414 - DNA, 19 bp, Homo sapiens
gagaaaggcacatattgga

SEQ ID NO: 2752415 - DNA, 14 bp, Homo sapiens
gagaagaactgaaa

SEQ ID NO: 2752416 - DNA, 14 bp, Homo sapiens
gagaagaatagcct

SEQ ID NO: 2752417 - DNA, 23 bp, Homo sapiens
gagaagaatagcctagatatgaa

SEQ ID NO: 2752418 - DNA, 17 bp, Homo sapiens
gagaaggggacttctct

SEQ ID NO: 2752419 - DNA, 15 bp, Homo sapiens
gagaatgttaccaga

SEQ ID NO: 2752420 - DNA, 16 bp, Homo sapiens
gagaatgttaccagac

SEQ ID NO: 2752421 - DNA, 19 bp, Homo sapiens
gagacccctttaaactgtc

SEQ ID NO: 2752422 - DNA, 22 bp, Homo sapiens
gagagagtcttttaactttaga

SEQ ID NO: 2752423 - DNA, 16 bp, Homo sapiens
gagaggacagaatgga

SEQ ID NO: 2752424 - DNA, 17 bp, Homo sapiens
gagcaataccctgtctt

SEQ ID NO: 2752425 - DNA, 15 bp, Homo sapiens
gagcctgctaaggaa

SEQ ID NO: 2752426 - DNA, 23 bp, Homo sapiens
gagcctgctaaggaacaatgccg

SEQ ID NO: 2752427 - DNA, 19 bp, Homo sapiens
gagccttccaccggcactc

SEQ ID NO: 2752428 - DNA, 23 bp, Homo sapiens
gagccttccaccggcactcatga

SEQ ID NO: 2752429 - DNA, 16 bp, Homo sapiens
gagctcgtgggacagt

SEQ ID NO: 2752430 - DNA, 11 bp, Homo sapiens
gagctggtttc

SEQ ID NO: 2752431 - DNA, 18 bp, Homo sapiens
gagctgtccggctggtgg

SEQ ID NO: 2752432 - DNA, 20 bp, Homo sapiens
gaggtgtctggcctgaggtc

SEQ ID NO: 2752433 - DNA, 17 bp, Homo sapiens
gagtatctgaagggaat

SEQ ID NO: 2752434 - DNA, 14 bp, Homo sapiens
gagtatttgctgtt

SEQ ID NO: 2752435 - DNA, 18 bp, Homo sapiens
gagtcagggagagctgaa

SEQ ID NO: 2752436 - DNA, 13 bp, Homo sapiens
gagttaaaagtta

SEQ ID NO: 2752437 - DNA, 18 bp, Homo sapiens
gagttgggggtattttct

SEQ ID NO: 2752438 - DNA, 12 bp, Homo sapiens
gagttgtataaa

SEQ ID NO: 2752439 - DNA, 22 bp, Homo sapiens
gataaacctgctccaaggcagt

SEQ ID NO: 2752440 - DNA, 20 bp, Homo sapiens
gataaagtcctgaacctttc

SEQ ID NO: 2752441 - DNA, 16 bp, Homo sapiens
gataactaaaattctg

SEQ ID NO: 2752442 - DNA, 19 bp, Homo sapiens
gatacaggcccctgggttt

SEQ ID NO: 2752443 - DNA, 21 bp, Homo sapiens
gatacaggcccctgggtttct

SEQ ID NO: 2752444 - DNA, 23 bp, Homo sapiens
gatactccgctgtcggcacattc

SEQ ID NO: 2752445 - DNA, 15 bp, Homo sapiens
gatatctatattcta

SEQ ID NO: 2752446 - DNA, 18 bp, Homo sapiens
gatatctatattctaaag

SEQ ID NO: 2752447 - DNA, 14 bp, Homo sapiens
gatatgaatatatg

SEQ ID NO: 2752448 - DNA, 19 bp, Homo sapiens
gatattgtcctaagtgtca

SEQ ID NO: 2752449 - DNA, 23 bp, Homo sapiens
gatcctcttgccacatcttgaaa

SEQ ID NO: 2752450 - DNA, 22 bp, Homo sapiens
gatgaataaatgttatagctgc

SEQ ID NO: 2752451 - DNA, 22 bp, Homo sapiens
gatggttcccttgatgaagaag

SEQ ID NO: 2752452 - DNA, 22 bp, Homo sapiens
gattaagtaatgataactggaa

SEQ ID NO: 2752453 - DNA, 14 bp, Homo sapiens
gattaatgtacttt

SEQ ID NO: 2752454 - DNA, 18 bp, Homo sapiens
gattctttaaactactga

SEQ ID NO: 2752455 - DNA, 23 bp, Homo sapiens
gattgcaggagtccctgccatca

SEQ ID NO: 2752456 - DNA, 15 bp, Homo sapiens
gattgtattgctgtc

SEQ ID NO: 2752457 - DNA, 23 bp, Homo sapiens
gatttaaaaagtgagaaagaaag

SEQ ID NO: 2752458 - DNA, 23 bp, Homo sapiens
gatttagtctgttatatttcctt

SEQ ID NO: 2752459 - DNA, 20 bp, Homo sapiens
gatttggggctcagagtggg

SEQ ID NO: 2752460 - DNA, 19 bp, Homo sapiens
gatttttaaattggagaaa

SEQ ID NO: 2752461 - DNA, 22 bp, Homo sapiens
gatttttaaattggagaaaagc

SEQ ID NO: 2752462 - DNA, 21 bp, Homo sapiens
gcaaacctgctggtggggcag

SEQ ID NO: 2752463 - DNA, 12 bp, Homo sapiens
gcaaaggagccg

SEQ ID NO: 2752464 - DNA, 19 bp, Homo sapiens
gcaaatactgattttcaaa

SEQ ID NO: 2752465 - DNA, 16 bp, Homo sapiens
gcaaatccgaaatcag

SEQ ID NO: 2752466 - DNA, 21 bp, Homo sapiens
gcaaatgcattctatcgttat

SEQ ID NO: 2752467 - DNA, 14 bp, Homo sapiens
gcaagagactttgt

SEQ ID NO: 2752468 - DNA, 17 bp, Homo sapiens
gcaaggattttttaaaa

SEQ ID NO: 2752469 - DNA, 18 bp, Homo sapiens
gcaatagtcaaattgtgt

SEQ ID NO: 2752470 - DNA, 20 bp, Homo sapiens
gcacaccacaattctcccta

SEQ ID NO: 2752471 - DNA, 20 bp, Homo sapiens
tttgaaaattacctttaatg

SEQ ID NO: 2752472 - DNA, 22 bp, Homo sapiens
tttgaaaattacctttaatgca

SEQ ID NO: 2752473 - DNA, 19 bp, Homo sapiens
tttgaattctttagatttt

SEQ ID NO: 2752474 - DNA, 22 bp, Homo sapiens
tttgactctgtccaactctgta

SEQ ID NO: 2752475 - DNA, 17 bp, Homo sapiens
tttgattctaaatagcg

SEQ ID NO: 2752476 - DNA, 14 bp, Homo sapiens
tttgcaagccagat

SEQ ID NO: 2752477 - DNA, 21 bp, Homo sapiens
tttgcatacatgaataaaaat

SEQ ID NO: 2752478 - DNA, 22 bp, Homo sapiens
tttgcatacatgaataaaaata

SEQ ID NO: 2752479 - DNA, 13 bp, Homo sapiens
tttgcatttttgt

SEQ ID NO: 2752480 - DNA, 19 bp, Homo sapiens
tttgctaagcattccaact

SEQ ID NO: 2752481 - DNA, 11 bp, Homo sapiens
tttgctcatgg

SEQ ID NO: 2752482 - DNA, 12 bp, Homo sapiens
tttgctcatgga

SEQ ID NO: 2752483 - DNA, 16 bp, Homo sapiens
tttgctcctagaactg

SEQ ID NO: 2752484 - DNA, 20 bp, Homo sapiens
tttgcttggtgctggtttat

SEQ ID NO: 2752485 - DNA, 20 bp, Homo sapiens
tttggtgctcatttaaatat

SEQ ID NO: 2752486 - DNA, 14 bp, Homo sapiens
tttgtaaaaacttt

SEQ ID NO: 2752487 - DNA, 15 bp, Homo sapiens
tttgtaaatctgtac

SEQ ID NO: 2752488 - DNA, 19 bp, Homo sapiens
tttgtaaatctgtactttt

SEQ ID NO: 2752489 - DNA, 17 bp, Homo sapiens
tttgtaatatatcctgt

SEQ ID NO: 2752490 - DNA, 19 bp, Homo sapiens
tttgtagtgttggagaaga

SEQ ID NO: 2752491 - DNA, 16 bp, Homo sapiens
tttgtataaaataatt

SEQ ID NO: 2752492 - DNA, 19 bp, Homo sapiens
tttgtataaaataattttt

SEQ ID NO: 2752493 - DNA, 17 bp, Homo sapiens
tttgtcacttatttcct

SEQ ID NO: 2752494 - DNA, 16 bp, Homo sapiens
tttgtggttttgggaa

SEQ ID NO: 2752495 - DNA, 14 bp, Homo sapiens
tttgtgttggggga

SEQ ID NO: 2752496 - DNA, 15 bp, Homo sapiens
tttgttggtctgaat

SEQ ID NO: 2752497 - DNA, 18 bp, Homo sapiens
tttgtttttgctttctga

SEQ ID NO: 2752498 - DNA, 14 bp, Homo sapiens
ttttaaaagaatga

SEQ ID NO: 2752499 - DNA, 15 bp, Homo sapiens
ttttaaaagaatgat

SEQ ID NO: 2752500 - DNA, 21 bp, Homo sapiens
ttttaaaagaatgattatgaa

SEQ ID NO: 2752501 - DNA, 14 bp, Homo sapiens
ttttaaagaatcca

SEQ ID NO: 2752502 - DNA, 20 bp, Homo sapiens
ttttaaattggagaaaagca

SEQ ID NO: 2752503 - DNA, 24 bp, Homo sapiens
ttttaaattggagaaaagcactta

SEQ ID NO: 2752504 - DNA, 23 bp, Homo sapiens
ttttaactttagaattcccaaga

SEQ ID NO: 2752505 - DNA, 17 bp, Homo sapiens
ttttaaggattctgcag

SEQ ID NO: 2752506 - DNA, 21 bp, Homo sapiens
ttttatatctggaatgagcct

SEQ ID NO: 2752507 - DNA, 18 bp, Homo sapiens
ttttatatttgaaatatt

SEQ ID NO: 2752508 - DNA, 22 bp, Homo sapiens
ttttatggcactagtatttcta

SEQ ID NO: 2752509 - DNA, 16 bp, Homo sapiens
ttttatggtagctttt

SEQ ID NO: 2752510 - DNA, 16 bp, Homo sapiens
ttttcaaatattgaat

SEQ ID NO: 2752511 - DNA, 14 bp, Homo sapiens
ttttcatcattgtt

SEQ ID NO: 2752512 - DNA, 22 bp, Homo sapiens
ttttcatcattgttgtgtataa

SEQ ID NO: 2752513 - DNA, 15 bp, Homo sapiens
ttttcatgacagaat

SEQ ID NO: 2752514 - DNA, 12 bp, Homo sapiens
ttttcattctga

SEQ ID NO: 2752515 - DNA, 14 bp, Homo sapiens
ttttcctgaaaacc

SEQ ID NO: 2752516 - DNA, 22 bp, Homo sapiens
ttttctaattttttttgtacat

SEQ ID NO: 2752517 - DNA, 16 bp, Homo sapiens
ttttctctaggaaata

SEQ ID NO: 2752518 - DNA, 14 bp, Homo sapiens
ttttctttgaaatg

SEQ ID NO: 2752519 - DNA, 12 bp, Homo sapiens
ttttctttgtat

SEQ ID NO: 2752520 - DNA, 15 bp, Homo sapiens
ttttctttgtatcat

SEQ ID NO: 2752521 - DNA, 14 bp, Homo sapiens
ttttgaaggaatac

SEQ ID NO: 2752522 - DNA, 14 bp, Homo sapiens
ttttgaatgtacct

SEQ ID NO: 2752523 - DNA, 17 bp, Homo sapiens
ttttgctttctgaaatt

SEQ ID NO: 2752524 - DNA, 16 bp, Homo sapiens
ttttggttatttctaa

SEQ ID NO: 2752525 - DNA, 16 bp, Homo sapiens
ttttgtaaagtaaaat

SEQ ID NO: 2752526 - DNA, 18 bp, Homo sapiens
ttttgtaaagtaaaatat

SEQ ID NO: 2752527 - DNA, 19 bp, Homo sapiens
ttttgtaaagtaaaatatg

SEQ ID NO: 2752528 - DNA, 19 bp, Homo sapiens
ttttgtaaatctgtacttt

SEQ ID NO: 2752529 - DNA, 14 bp, Homo sapiens
ttttgtgaagcaaa

SEQ ID NO: 2752530 - DNA, 18 bp, Homo sapiens
tttttaaaaaagaaacat

SEQ ID NO: 2752531 - DNA, 15 bp, Homo sapiens
tttttaaaagagaca

SEQ ID NO: 2752532 - DNA, 12 bp, Homo sapiens
tttttaatagaa

SEQ ID NO: 2752533 - DNA, 13 bp, Homo sapiens
tttttatatatga

SEQ ID NO: 2752534 - DNA, 19 bp, Homo sapiens
tttttatatttgaaatatt

SEQ ID NO: 2752535 - DNA, 17 bp, Homo sapiens
tttttccaagtgtataa

SEQ ID NO: 2752536 - DNA, 23 bp, Homo sapiens
tttttctttgaaatgctaaactt

SEQ ID NO: 2752537 - DNA, 15 bp, Homo sapiens
tttttgtaaaaactt

SEQ ID NO: 2752538 - DNA, 21 bp, Homo sapiens
tttttgtacatttggaacagt

SEQ ID NO: 2752539 - DNA, 12 bp, Homo sapiens
tttttgtatttt

SEQ ID NO: 2752540 - DNA, 11 bp, Homo sapiens
tttttgtttgt

SEQ ID NO: 2752541 - DNA, 18 bp, Homo sapiens
tttttgtttgtttttgct

SEQ ID NO: 2752542 - DNA, 12 bp, Homo sapiens
ttttttaaagaa

SEQ ID NO: 2752543 - DNA, 21 bp, Homo sapiens
ttttttctttgaaatgctaaa

SEQ ID NO: 2752544 - DNA, 23 bp, Homo sapiens
ttaattgtgtggtgcttttatag

SEQ ID NO: 2752545 - DNA, 12 bp, Homo sapiens
ttaattgtttaa

SEQ ID NO: 2752546 - DNA, 12 bp, Homo sapiens
ttacatctgtgc

SEQ ID NO: 2752547 - DNA, 14 bp, Homo sapiens
ttacatctgtgcag

SEQ ID NO: 2752548 - DNA, 16 bp, Homo sapiens
ttacatgtaaagctgt

SEQ ID NO: 2752549 - DNA, 18 bp, Homo sapiens
ttacatgtaaagctgtta

SEQ ID NO: 2752550 - DNA, 20 bp, Homo sapiens
ttacatttgtataaaataat

SEQ ID NO: 2752551 - DNA, 18 bp, Homo sapiens
ttaccagacttcaagatc

SEQ ID NO: 2752552 - DNA, 22 bp, Homo sapiens
ttacctctaaatttccatatcc

SEQ ID NO: 2752553 - DNA, 21 bp, Homo sapiens
ttacctctcattagaaaggct

SEQ ID NO: 2752554 - DNA, 12 bp, Homo sapiens
ttacctgggaaa

SEQ ID NO: 2752555 - DNA, 14 bp, Homo sapiens
ttactacagttttt

SEQ ID NO: 2752556 - DNA, 22 bp, Homo sapiens
ttactacagtttttaactctac

SEQ ID NO: 2752557 - DNA, 22 bp, Homo sapiens
ttactgttaaaactgtaccttt

SEQ ID NO: 2752558 - DNA, 20 bp, Homo sapiens
ttacttctaatcttaaatca

SEQ ID NO: 2752559 - DNA, 16 bp, Homo sapiens
ttagaacctacaaaag

SEQ ID NO: 2752560 - DNA, 15 bp, Homo sapiens
ttagaggttaatcag

SEQ ID NO: 2752561 - DNA, 20 bp, Homo sapiens
ttagatgcagttctgaagaa

SEQ ID NO: 2752562 - DNA, 23 bp, Homo sapiens
ttagatgcagttctgaagaagat

SEQ ID NO: 2752563 - DNA, 20 bp, Homo sapiens
ttagcaatgaattagttgca

SEQ ID NO: 2752564 - DNA, 14 bp, Homo sapiens
ttagctagaatcca

SEQ ID NO: 2752565 - DNA, 14 bp, Homo sapiens
ttaggataactaaa

SEQ ID NO: 2752566 - DNA, 17 bp, Homo sapiens
ttaggataactaaaatt

SEQ ID NO: 2752567 - DNA, 22 bp, Homo sapiens
ttagttttggttatttctaaac

SEQ ID NO: 2752568 - DNA, 13 bp, Homo sapiens
ttataaaaacatt

SEQ ID NO: 2752569 - DNA, 18 bp, Homo sapiens
ttataaaaacattgaaat

SEQ ID NO: 2752570 - DNA, 14 bp, Homo sapiens
ttataattttgtga

SEQ ID NO: 2752571 - DNA, 17 bp, Homo sapiens
ttataattttgtgaagc

SEQ ID NO: 2752572 - DNA, 16 bp, Homo sapiens
ttatactgtgaagtta

SEQ ID NO: 2752573 - DNA, 20 bp, Homo sapiens
ttatagaataaaagctgtgg

SEQ ID NO: 2752574 - DNA, 20 bp, Homo sapiens
ttatatatgaatattacatg

SEQ ID NO: 2752575 - DNA, 20 bp, Homo sapiens
ttatattagttgctttgtta

SEQ ID NO: 2752576 - DNA, 20 bp, Homo sapiens
ttatatttattactgtaaga

SEQ ID NO: 2752577 - DNA, 12 bp, Homo sapiens
ttatatttgaaa

SEQ ID NO: 2752578 - DNA, 13 bp, Homo sapiens
ttatatttgaaat

SEQ ID NO: 2752579 - DNA, 19 bp, Homo sapiens
ttatcaaggaagtcttcaa

SEQ ID NO: 2752580 - DNA, 23 bp, Homo sapiens
ttatctaaacccagcaaaacaga

SEQ ID NO: 2752581 - DNA, 16 bp, Homo sapiens
ttatcttttagctaga

SEQ ID NO: 2752582 - DNA, 19 bp, Homo sapiens
ttatgattaagtaatgata

SEQ ID NO: 2752583 - DNA, 21 bp, Homo sapiens
ttatgatttctccagaaattt

SEQ ID NO: 2752584 - DNA, 21 bp, Homo sapiens
ttatggcactagtatttctat

SEQ ID NO: 2752585 - DNA, 13 bp, Homo sapiens
ttatgttcttata

SEQ ID NO: 2752586 - DNA, 19 bp, Homo sapiens
ttatgttcttatagaataa

SEQ ID NO: 2752587 - DNA, 21 bp, Homo sapiens
ttattacacctcagaaattga

SEQ ID NO: 2752588 - DNA, 12 bp, Homo sapiens
ttattataaatg

SEQ ID NO: 2752589 - DNA, 23 bp, Homo sapiens
ttattctgggaaatgttttaatg

SEQ ID NO: 2752590 - DNA, 15 bp, Homo sapiens
ttattttaataatgt

SEQ ID NO: 2752591 - DNA, 20 bp, Homo sapiens
ttattttaataatgtttcaa

SEQ ID NO: 2752592 - DNA, 16 bp, Homo sapiens
ttcaaaactagttctt

SEQ ID NO: 2752593 - DNA, 14 bp, Homo sapiens
ttcaaaagaacatt

SEQ ID NO: 2752594 - DNA, 18 bp, Homo sapiens
ttcaaaagaacattctta

SEQ ID NO: 2752595 - DNA, 14 bp, Homo sapiens
ttcaaatagtatag

SEQ ID NO: 2752596 - DNA, 16 bp, Homo sapiens
ttcaaatagtatagaa

SEQ ID NO: 2752597 - DNA, 15 bp, Homo sapiens
ttcaaatattgaatg

SEQ ID NO: 2752598 - DNA, 16 bp, Homo sapiens
ttcactaaaataaaat

SEQ ID NO: 2752599 - DNA, 18 bp, Homo sapiens
ttcagtgcaagagacttt

SEQ ID NO: 2752600 - DNA, 20 bp, Homo sapiens
ttcagtgcaagagactttgt

SEQ ID NO: 2752601 - DNA, 16 bp, Homo sapiens
ttcagtttagaaccta

SEQ ID NO: 2752602 - DNA, 20 bp, Homo sapiens
ttcataatggcctgagactt

SEQ ID NO: 2752603 - DNA, 12 bp, Homo sapiens
ttcatagttctg

SEQ ID NO: 2752604 - DNA, 13 bp, Homo sapiens
ttcatagttctgt

SEQ ID NO: 2752605 - DNA, 15 bp, Homo sapiens
ttcatagttctgtta

SEQ ID NO: 2752606 - DNA, 16 bp, Homo sapiens
ttcatagttctgttaa

SEQ ID NO: 2752607 - DNA, 16 bp, Homo sapiens
ttcatcattgttgtgt

SEQ ID NO: 2752608 - DNA, 12 bp, Homo sapiens
ttcatgacagaa

SEQ ID NO: 2752609 - DNA, 15 bp, Homo sapiens
ttcatgacagaatat

SEQ ID NO: 2752610 - DNA, 18 bp, Homo sapiens
ttcatgacagaatataca

SEQ ID NO: 2752611 - DNA, 18 bp, Homo sapiens
ttcatttacaatttcaaa

SEQ ID NO: 2752612 - DNA, 19 bp, Homo sapiens
ttccagatcctggaaatca

SEQ ID NO: 2752613 - DNA, 19 bp, Homo sapiens
ttccagatgtctaaaagat

SEQ ID NO: 2752614 - DNA, 20 bp, Homo sapiens
ttccatatccttctggctgt

SEQ ID NO: 2752615 - DNA, 17 bp, Homo sapiens
ttcccttgatgaagaag

SEQ ID NO: 2752616 - DNA, 16 bp, Homo sapiens
ttcctttatactgtga

SEQ ID NO: 2752617 - DNA, 17 bp, Homo sapiens
ttccttttgtaaagtaa

SEQ ID NO: 2752618 - DNA, 20 bp, Homo sapiens
ttcggccgagctggtttcct

SEQ ID NO: 2752619 - DNA, 18 bp, Homo sapiens
ttctaaacttagaaatat

SEQ ID NO: 2752620 - DNA, 17 bp, Homo sapiens
ttctaacttaatgtagt

SEQ ID NO: 2752621 - DNA, 16 bp, Homo sapiens
ttctaatcttaaatca

SEQ ID NO: 2752622 - DNA, 18 bp, Homo sapiens
ttctacacatttcatcta

SEQ ID NO: 2752623 - DNA, 19 bp, Homo sapiens
ttctacacatttcatctaa

SEQ ID NO: 2752624 - DNA, 20 bp, Homo sapiens
ttctacacatttcatctaat

SEQ ID NO: 2752625 - DNA, 21 bp, Homo sapiens
ttctacacatttcatctaatt

SEQ ID NO: 2752626 - DNA, 23 bp, Homo sapiens
ttctacactgggtgctgatcctt

SEQ ID NO: 2752627 - DNA, 19 bp, Homo sapiens
ttctatagagatagatatt

SEQ ID NO: 2752628 - DNA, 21 bp, Homo sapiens
ttctatgaaatattatgttaa

SEQ ID NO: 2752629 - DNA, 20 bp, Homo sapiens
ttctcatatccataaaattg

SEQ ID NO: 2752630 - DNA, 22 bp, Homo sapiens
ttctcatatccataaaattgga

SEQ ID NO: 2752631 - DNA, 12 bp, Homo sapiens
ttctctaaactg

SEQ ID NO: 2752632 - DNA, 18 bp, Homo sapiens
ttctctaaactgtttctt

SEQ ID NO: 2752633 - DNA, 19 bp, Homo sapiens
ttctctaaactgtttctta

SEQ ID NO: 2752634 - DNA, 16 bp, Homo sapiens
ttctctactttaaatt

SEQ ID NO: 2752635 - DNA, 23 bp, Homo sapiens
ttctgaggtaagtgtatgatctt

SEQ ID NO: 2752636 - DNA, 19 bp, Homo sapiens
ttctgggaaatgttttaat

SEQ ID NO: 2752637 - DNA, 21 bp, Homo sapiens
ttctgggaaatgttttaatgc

SEQ ID NO: 2752638 - DNA, 23 bp, Homo sapiens
ttctgggcctaattttttaaaga

SEQ ID NO: 2752639 - DNA, 19 bp, Homo sapiens
ttctgtgttgaaatatagt

SEQ ID NO: 2752640 - DNA, 16 bp, Homo sapiens
ttcttaaaatgcaata

SEQ ID NO: 2752641 - DNA, 15 bp, Homo sapiens
ttcttagctgcactg

SEQ ID NO: 2752642 - DNA, 19 bp, Homo sapiens
ttcttagggttatgattaa

SEQ ID NO: 2752643 - DNA, 21 bp, Homo sapiens
ctagtgagcagtcaggaaaga

SEQ ID NO: 2752644 - DNA, 12 bp, Homo sapiens
ctataaatacaa

SEQ ID NO: 2752645 - DNA, 16 bp, Homo sapiens
ctataaatacaaatct

SEQ ID NO: 2752646 - DNA, 21 bp, Homo sapiens
ctataaatacaaatctgtata

SEQ ID NO: 2752647 - DNA, 13 bp, Homo sapiens
ctataaatagatt

SEQ ID NO: 2752648 - DNA, 22 bp, Homo sapiens
ctataaatgatatctatattct

SEQ ID NO: 2752649 - DNA, 14 bp, Homo sapiens
ctataacattctga

SEQ ID NO: 2752650 - DNA, 20 bp, Homo sapiens
ctataacattctgacacata

SEQ ID NO: 2752651 - DNA, 18 bp, Homo sapiens
ctataattccttaaaatt

SEQ ID NO: 2752652 - DNA, 18 bp, Homo sapiens
ctatattgtttgctaagc

SEQ ID NO: 2752653 - DNA, 14 bp, Homo sapiens
ctatcgttattata

SEQ ID NO: 2752654 - DNA, 18 bp, Homo sapiens
ctatcgttattataaatg

SEQ ID NO: 2752655 - DNA, 15 bp, Homo sapiens
ctatctaatgacatg

SEQ ID NO: 2752656 - DNA, 19 bp, Homo sapiens
ctatggggatagatgtgtg

SEQ ID NO: 2752657 - DNA, 14 bp, Homo sapiens
ctattaattccatg

SEQ ID NO: 2752658 - DNA, 22 bp, Homo sapiens
ctattcattatgcaacgtttaa

SEQ ID NO: 2752659 - DNA, 14 bp, Homo sapiens
ctattgtagagcca

SEQ ID NO: 2752660 - DNA, 18 bp, Homo sapiens
ctatttacttctaatctt

SEQ ID NO: 2752661 - DNA, 22 bp, Homo sapiens
ctatttgattagggtagtaatt

SEQ ID NO: 2752662 - DNA, 13 bp, Homo sapiens
ctattttgaaagg

SEQ ID NO: 2752663 - DNA, 19 bp, Homo sapiens
ctcagggccgagaggacag

SEQ ID NO: 2752664 - DNA, 18 bp, Homo sapiens
ctcatgacggcctgcctg

SEQ ID NO: 2752665 - DNA, 19 bp, Homo sapiens
ctcatgacggcctgcctgc

SEQ ID NO: 2752666 - DNA, 13 bp, Homo sapiens
ctcattagaaagg

SEQ ID NO: 2752667 - DNA, 17 bp, Homo sapiens
ctcattccagaggaagg

SEQ ID NO: 2752668 - DNA, 14 bp, Homo sapiens
ctcatttaaatatc

SEQ ID NO: 2752669 - DNA, 13 bp, Homo sapiens
ctcatttccaagc

SEQ ID NO: 2752670 - DNA, 22 bp, Homo sapiens
ctccaggcgacgcggttttttc

SEQ ID NO: 2752671 - DNA, 13 bp, Homo sapiens
ctcccaaaaagat

SEQ ID NO: 2752672 - DNA, 16 bp, Homo sapiens
ctccttggatttgcat

SEQ ID NO: 2752673 - DNA, 21 bp, Homo sapiens
ctcctttcctgcatctttcat

SEQ ID NO: 2752674 - DNA, 15 bp, Homo sapiens
ctcgcacctgtgctg

SEQ ID NO: 2752675 - DNA, 18 bp, Homo sapiens
ctcgccatctcctgggcc

SEQ ID NO: 2752676 - DNA, 18 bp, Homo sapiens
ctcggcgcccccacccct

SEQ ID NO: 2752677 - DNA, 14 bp, Homo sapiens
ctctagcctctttg

SEQ ID NO: 2752678 - DNA, 17 bp, Homo sapiens
ctctattagtttcaatt

SEQ ID NO: 2752679 - DNA, 12 bp, Homo sapiens
ctctatttactt

SEQ ID NO: 2752680 - DNA, 24 bp, Homo sapiens
ctctatttacttctaatcttaaat

SEQ ID NO: 2752681 - DNA, 11 bp, Homo sapiens
ctctccatcta

SEQ ID NO: 2752682 - DNA, 16 bp, Homo sapiens
ctctccccatgatgtt

SEQ ID NO: 2752683 - DNA, 22 bp, Homo sapiens
ctctgtcttcaggctctgccca

SEQ ID NO: 2752684 - DNA, 23 bp, Homo sapiens
ctctgtcttcaggctctgcccag

SEQ ID NO: 2752685 - DNA, 20 bp, Homo sapiens
ctcttagatgcagttctgaa

SEQ ID NO: 2752686 - DNA, 21 bp, Homo sapiens
ctcttagatgcagttctgaag

SEQ ID NO: 2752687 - DNA, 18 bp, Homo sapiens
ctcttgccacatcttgaa

SEQ ID NO: 2752688 - DNA, 19 bp, Homo sapiens
ctcttgccacatcttgaaa

SEQ ID NO: 2752689 - DNA, 15 bp, Homo sapiens
ctctttgtgtttttg

SEQ ID NO: 2752690 - DNA, 20 bp, Homo sapiens
ctctttgtgtttttgttgtt

SEQ ID NO: 2752691 - DNA, 20 bp, Homo sapiens
ctgaaagaaactaagattta

SEQ ID NO: 2752692 - DNA, 22 bp, Homo sapiens
ctgaaggagagagtcttttaac

SEQ ID NO: 2752693 - DNA, 22 bp, Homo sapiens
ctgaagggaattgtttttataa

SEQ ID NO: 2752694 - DNA, 21 bp, Homo sapiens
ctgacacatatcattctgtga

SEQ ID NO: 2752695 - DNA, 13 bp, Homo sapiens
ctgactgggctgg

SEQ ID NO: 2752696 - DNA, 23 bp, Homo sapiens
ctgagttgcttcttcttgtggag

SEQ ID NO: 2752697 - DNA, 14 bp, Homo sapiens
ctgagttgtataaa

SEQ ID NO: 2752698 - DNA, 14 bp, Homo sapiens
ctgattttcaaaaa

SEQ ID NO: 2752699 - DNA, 23 bp, Homo sapiens
ctgcaaggattttttaaaaattg

SEQ ID NO: 2752700 - DNA, 18 bp, Homo sapiens
ctgcactgtttatggaaa

SEQ ID NO: 2752701 - DNA, 21 bp, Homo sapiens
ctgcactgtttatggaaatac

SEQ ID NO: 2752702 - DNA, 17 bp, Homo sapiens
ctgcatttgtctggcct

SEQ ID NO: 2752703 - DNA, 12 bp, Homo sapiens
ctgcccacgccc

SEQ ID NO: 2752704 - DNA, 23 bp, Homo sapiens
ctgcccacgcccttggagccttc

SEQ ID NO: 2752705 - DNA, 18 bp, Homo sapiens
ctgcctggagtgctgtgc

SEQ ID NO: 2752706 - DNA, 19 bp, Homo sapiens
ctgcctggagtgctgtgct

SEQ ID NO: 2752707 - DNA, 13 bp, Homo sapiens
ctgctaaggaaca

SEQ ID NO: 2752708 - DNA, 19 bp, Homo sapiens
ctgctaaggaacaatgccg

SEQ ID NO: 2752709 - DNA, 11 bp, Homo sapiens
ctgctgggctt

SEQ ID NO: 2752710 - DNA, 16 bp, Homo sapiens
ctgctgggcttggctc

SEQ ID NO: 2752711 - DNA, 12 bp, Homo sapiens
ctgctggtgggg

SEQ ID NO: 2752712 - DNA, 21 bp, Homo sapiens
ctgctgtgcgtggaaaaagac

SEQ ID NO: 2752713 - DNA, 16 bp, Homo sapiens
ctggaacactgtactg

SEQ ID NO: 2752714 - DNA, 15 bp, Homo sapiens
ctggagtgctgtgct

SEQ ID NO: 2752715 - DNA, 20 bp, Homo sapiens
ctggagtgctgtgctgtgtt

SEQ ID NO: 2752716 - DNA, 16 bp, Homo sapiens
ctggataaatttaaaa

SEQ ID NO: 2752717 - DNA, 13 bp, Homo sapiens
ctggcaagaatgg

SEQ ID NO: 2752718 - DNA, 17 bp, Homo sapiens
ctggctaccttgtggga

SEQ ID NO: 2752719 - DNA, 21 bp, Homo sapiens
ctggctaccttgtgggaataa

SEQ ID NO: 2752720 - DNA, 16 bp, Homo sapiens
ctggggatgtctctca

SEQ ID NO: 2752721 - DNA, 22 bp, Homo sapiens
ctggggatgtctctcatgacca

SEQ ID NO: 2752722 - DNA, 13 bp, Homo sapiens
ctgggggaaaaag

SEQ ID NO: 2752723 - DNA, 13 bp, Homo sapiens
ctggtctgtactc

SEQ ID NO: 2752724 - DNA, 22 bp, Homo sapiens
ctggtttcctgcccagcctggg

SEQ ID NO: 2752725 - DNA, 18 bp, Homo sapiens
ctggtttgactctgtcca

SEQ ID NO: 2752726 - DNA, 20 bp, Homo sapiens
ctgtaagaaaatatcacttg

SEQ ID NO: 2752727 - DNA, 14 bp, Homo sapiens
ctgtacctctgcct

SEQ ID NO: 2752728 - DNA, 22 bp, Homo sapiens
ctgtaccttttgcgatttcaca

SEQ ID NO: 2752729 - DNA, 19 bp, Homo sapiens
ctgtacttttttcaaatat

SEQ ID NO: 2752730 - DNA, 20 bp, Homo sapiens
ctgtacttttttcaaatatt

SEQ ID NO: 2752731 - DNA, 22 bp, Homo sapiens
ctgtacttttttcaaatattga

SEQ ID NO: 2752732 - DNA, 15 bp, Homo sapiens
ctgtagatgcagaaa

SEQ ID NO: 2752733 - DNA, 17 bp, Homo sapiens
ctgtagatgcagaaaaa

SEQ ID NO: 2752734 - DNA, 19 bp, Homo sapiens
ctgtagtcccagcactttg

SEQ ID NO: 2752735 - DNA, 18 bp, Homo sapiens
gcattatatttgtaaatt

SEQ ID NO: 2752736 - DNA, 21 bp, Homo sapiens
gcattctatcgttattataaa

SEQ ID NO: 2752737 - DNA, 20 bp, Homo sapiens
gcatttaaaagagtaagggt

SEQ ID NO: 2752738 - DNA, 23 bp, Homo sapiens
gcattttaagtgtttaaaagcaa

SEQ ID NO: 2752739 - DNA, 15 bp, Homo sapiens
gccaaacaccacttt

SEQ ID NO: 2752740 - DNA, 15 bp, Homo sapiens
gccaatcttgtttta

SEQ ID NO: 2752741 - DNA, 16 bp, Homo sapiens
gccacatacttgcagc

SEQ ID NO: 2752742 - DNA, 13 bp, Homo sapiens
gccacatcttgaa

SEQ ID NO: 2752743 - DNA, 16 bp, Homo sapiens
gccacatcttgaaaat

SEQ ID NO: 2752744 - DNA, 18 bp, Homo sapiens
gccacatcttgaaaatgc

SEQ ID NO: 2752745 - DNA, 21 bp, Homo sapiens
gccacatcttgaaaatgccac

SEQ ID NO: 2752746 - DNA, 22 bp, Homo sapiens
gccaccgggcatgtctgcctgg

SEQ ID NO: 2752747 - DNA, 20 bp, Homo sapiens
gccagccatttttcagtagc

SEQ ID NO: 2752748 - DNA, 22 bp, Homo sapiens
gccagccatttttcagtagcag

SEQ ID NO: 2752749 - DNA, 19 bp, Homo sapiens
gccatgggcactgtgggta

SEQ ID NO: 2752750 - DNA, 19 bp, Homo sapiens
gccatttttcagtagcagg

SEQ ID NO: 2752751 - DNA, 19 bp, Homo sapiens
gcccacgcccttggagcct

SEQ ID NO: 2752752 - DNA, 23 bp, Homo sapiens
gcccacgcccttggagccttcca

SEQ ID NO: 2752753 - DNA, 13 bp, Homo sapiens
gcccagcctgggg

SEQ ID NO: 2752754 - DNA, 13 bp, Homo sapiens
gccccgcccgagc

SEQ ID NO: 2752755 - DNA, 15 bp, Homo sapiens
gcccctgcccacgcc

SEQ ID NO: 2752756 - DNA, 14 bp, Homo sapiens
gcccgagcccctgc

SEQ ID NO: 2752757 - DNA, 19 bp, Homo sapiens
gcccttctttccacagaag

SEQ ID NO: 2752758 - DNA, 15 bp, Homo sapiens
gcccttggagccttc

SEQ ID NO: 2752759 - DNA, 16 bp, Homo sapiens
gcccttggagccttcc

SEQ ID NO: 2752760 - DNA, 18 bp, Homo sapiens
gcccttggagccttccac

SEQ ID NO: 2752761 - DNA, 20 bp, Homo sapiens
gcccttggagccttccaccg

SEQ ID NO: 2752762 - DNA, 19 bp, Homo sapiens
gccgagctggtttcctgcc

SEQ ID NO: 2752763 - DNA, 15 bp, Homo sapiens
gcctaattttttaaa

SEQ ID NO: 2752764 - DNA, 18 bp, Homo sapiens
gcctaggaggactggggt

SEQ ID NO: 2752765 - DNA, 19 bp, Homo sapiens
gcctatatgagaagaatag

SEQ ID NO: 2752766 - DNA, 22 bp, Homo sapiens
gcctctttgtgtttttgttgtt

SEQ ID NO: 2752767 - DNA, 21 bp, Homo sapiens
gcctgagaatgttaccagact

SEQ ID NO: 2752768 - DNA, 16 bp, Homo sapiens
gcctgaggtcaatggt

SEQ ID NO: 2752769 - DNA, 13 bp, Homo sapiens
gcctgctaaggaa

SEQ ID NO: 2752770 - DNA, 16 bp, Homo sapiens
gcctgctaaggaacaa

SEQ ID NO: 2752771 - DNA, 17 bp, Homo sapiens
gcctgctaaggaacaat

SEQ ID NO: 2752772 - DNA, 19 bp, Homo sapiens
gcctggagtgctgtgctgt

SEQ ID NO: 2752773 - DNA, 20 bp, Homo sapiens
gccttccaccggcactcatg

SEQ ID NO: 2752774 - DNA, 18 bp, Homo sapiens
gccttttaaattcttttc

SEQ ID NO: 2752775 - DNA, 21 bp, Homo sapiens
gcgctggtcccctccctctgt

SEQ ID NO: 2752776 - DNA, 20 bp, Homo sapiens
gcggaataaactagagaagg

SEQ ID NO: 2752777 - DNA, 21 bp, Homo sapiens
gctaacaaattttaagtgcca

SEQ ID NO: 2752778 - DNA, 13 bp, Homo sapiens
gctagatgtatgt

SEQ ID NO: 2752779 - DNA, 16 bp, Homo sapiens
gctagatgtatgtact

SEQ ID NO: 2752780 - DNA, 15 bp, Homo sapiens
gctataacattctga

SEQ ID NO: 2752781 - DNA, 14 bp, Homo sapiens
gctccaaggcagtg

SEQ ID NO: 2752782 - DNA, 22 bp, Homo sapiens
gctctaacgtgataaacctgct

SEQ ID NO: 2752783 - DNA, 15 bp, Homo sapiens
gctctgatgcagtgc

SEQ ID NO: 2752784 - DNA, 14 bp, Homo sapiens
gctgattgtattta

SEQ ID NO: 2752785 - DNA, 14 bp, Homo sapiens
gctgcataaatttg

SEQ ID NO: 2752786 - DNA, 15 bp, Homo sapiens
gctgcataaatttgt

SEQ ID NO: 2752787 - DNA, 13 bp, Homo sapiens
cgcccccacccct

SEQ ID NO: 2752788 - DNA, 15 bp, Homo sapiens
cgcctgtcaataaat

SEQ ID NO: 2752789 - DNA, 17 bp, Homo sapiens
cgcctgtcaataaatgt

SEQ ID NO: 2752790 - DNA, 15 bp, Homo sapiens
cgctgaggtgtctgg

SEQ ID NO: 2752791 - DNA, 19 bp, Homo sapiens
cgctgaggtgtctggcctg

SEQ ID NO: 2752792 - DNA, 21 bp, Homo sapiens
cgctgaggtgtctggcctgag

SEQ ID NO: 2752793 - DNA, 20 bp, Homo sapiens
cggaataaactagagaaggg

SEQ ID NO: 2752794 - DNA, 21 bp, Homo sapiens
cggaataaactagagaaggga

SEQ ID NO: 2752795 - DNA, 18 bp, Homo sapiens
cggcgcccccacccctgg

SEQ ID NO: 2752796 - DNA, 16 bp, Homo sapiens
cgggcatgtctgcctg

SEQ ID NO: 2752797 - DNA, 15 bp, Homo sapiens
cggtttatataagct

SEQ ID NO: 2752798 - DNA, 17 bp, Homo sapiens
cgtgataaacctgctcc

SEQ ID NO: 2752799 - DNA, 18 bp, Homo sapiens
cgtgcaccccgccggagg

SEQ ID NO: 2752800 - DNA, 23 bp, Homo sapiens
cgttacatctgtgcagggctggt

SEQ ID NO: 2752801 - DNA, 14 bp, Homo sapiens
cgttattataaatg

SEQ ID NO: 2752802 - DNA, 16 bp, Homo sapiens
cgttattataaatgtt

SEQ ID NO: 2752803 - DNA, 20 bp, Homo sapiens
ctaaaatgtagaaattctaa

SEQ ID NO: 2752804 - DNA, 22 bp, Homo sapiens
ctaaaattctgggcctaatttt

SEQ ID NO: 2752805 - DNA, 19 bp, Homo sapiens
ctaaacttagaaatatgct

SEQ ID NO: 2752806 - DNA, 19 bp, Homo sapiens
ctaaatagcgattataatc

SEQ ID NO: 2752807 - DNA, 21 bp, Homo sapiens
ctaacaaattttaagtgccac

SEQ ID NO: 2752808 - DNA, 14 bp, Homo sapiens
ctaagagagaatga

SEQ ID NO: 2752809 - DNA, 15 bp, Homo sapiens
ctaagagagaatgag

SEQ ID NO: 2752810 - DNA, 17 bp, Homo sapiens
ctaagatttatctgcaa

SEQ ID NO: 2752811 - DNA, 17 bp, Homo sapiens
ctaagggaaaaagttgt

SEQ ID NO: 2752812 - DNA, 22 bp, Homo sapiens
ctaagttattgctgcataaatt

SEQ ID NO: 2752813 - DNA, 15 bp, Homo sapiens
ctaatacaaaactat

SEQ ID NO: 2752814 - DNA, 13 bp, Homo sapiens
ctaatgaaagtga

SEQ ID NO: 2752815 - DNA, 16 bp, Homo sapiens
ctaattttttaaagaa

SEQ ID NO: 2752816 - DNA, 18 bp, Homo sapiens
ctacaaaagcttgtgtat

SEQ ID NO: 2752817 - DNA, 23 bp, Homo sapiens
ctacacatttcatctaatttaat

SEQ ID NO: 2752818 - DNA, 14 bp, Homo sapiens
ctacactgggtgct

SEQ ID NO: 2752819 - DNA, 16 bp, Homo sapiens
ctacaggacaaggggc

SEQ ID NO: 2752820 - DNA, 14 bp, Homo sapiens
ctacagtttttcct

SEQ ID NO: 2752821 - DNA, 22 bp, Homo sapiens
ctactctggaggtttgtttaga

SEQ ID NO: 2752822 - DNA, 24 bp, Homo sapiens
ctactgaactgttacctaggttaa

SEQ ID NO: 2752823 - DNA, 13 bp, Homo sapiens
ctactggtctgta

SEQ ID NO: 2752824 - DNA, 14 bp, Homo sapiens
ctactggtctgtac

SEQ ID NO: 2752825 - DNA, 19 bp, Homo sapiens
ctactggtctgtactcctt

SEQ ID NO: 2752826 - DNA, 17 bp, Homo sapiens
ctagaatccacacatat

SEQ ID NO: 2752827 - DNA, 18 bp, Homo sapiens
ctagacaaggttgctgtt

SEQ ID NO: 2752828 - DNA, 21 bp, Homo sapiens
ctagagaagggagacattgtt

SEQ ID NO: 2752829 - DNA, 22 bp, Homo sapiens
ctagagaagggagacattgttt

SEQ ID NO: 2752830 - DNA, 15 bp, Homo sapiens
ctagagttaaaagtt

SEQ ID NO: 2752831 - DNA, 17 bp, Homo sapiens
ctagagttaaaagttag

SEQ ID NO: 2752832 - DNA, 24 bp, Homo sapiens
ctagatatgaatatatggcatttg

SEQ ID NO: 2752833 - DNA, 18 bp, Homo sapiens
ctagccggaaggccgagg

SEQ ID NO: 2752834 - DNA, 15 bp, Homo sapiens
ctagtagttaaaaca

SEQ ID NO: 2752835 - DNA, 23 bp, Homo sapiens
ctagtagttaaaacagctatttt

SEQ ID NO: 2752836 - DNA, 19 bp, Homo sapiens
ctagtatttctatgaaata

SEQ ID NO: 2752837 - DNA, 23 bp, Homo sapiens
ctagttgatcagcttattgtcta

SEQ ID NO: 2752838 - DNA, 9 bp, Homo sapiens
ctataaata

SEQ ID NO: 2752839 - DNA, 14 bp, Homo sapiens
ctataaatacaaat

SEQ ID NO: 2752840 - DNA, 22 bp, Homo sapiens
ctataaatacaaatctgtataa

SEQ ID NO: 2752841 - DNA, 19 bp, Homo sapiens
ctataattccttaaaattt

SEQ ID NO: 2752842 - DNA, 23 bp, Homo sapiens
ctataattccttaaaattttcat

SEQ ID NO: 2752843 - DNA, 17 bp, Homo sapiens
ctatatgagaagaatag

SEQ ID NO: 2752844 - DNA, 17 bp, Homo sapiens
ctatattctaaagagct

SEQ ID NO: 2752845 - DNA, 19 bp, Homo sapiens
ctatcctatgccttcaaat

SEQ ID NO: 2752846 - DNA, 18 bp, Homo sapiens
ctatctcatttccaagca

SEQ ID NO: 2752847 - DNA, 13 bp, Homo sapiens
ctatgaaatatta

SEQ ID NO: 2752848 - DNA, 16 bp, Homo sapiens
ctatgaactgaaggca

SEQ ID NO: 2752849 - DNA, 14 bp, Homo sapiens
ctatgtttcatctt

SEQ ID NO: 2752850 - DNA, 15 bp, Homo sapiens
ctatgtttcatcttg

SEQ ID NO: 2752851 - DNA, 13 bp, Homo sapiens
ctattagtttcaa

SEQ ID NO: 2752852 - DNA, 14 bp, Homo sapiens
ctattatagaaatt

SEQ ID NO: 2752853 - DNA, 23 bp, Homo sapiens
ctattatagaaattctgaatttt

SEQ ID NO: 2752854 - DNA, 15 bp, Homo sapiens
ctcaatatatagtta

SEQ ID NO: 2752855 - DNA, 19 bp, Homo sapiens
ctcagaaaacaaggatgaa

SEQ ID NO: 2752856 - DNA, 23 bp, Homo sapiens
ctcagaaaacaaggatgaattaa

SEQ ID NO: 2752857 - DNA, 11 bp, Homo sapiens
ctcaggaaaga

SEQ ID NO: 2752858 - DNA, 20 bp, Homo sapiens
ctcaggaaagaatagaaaga

SEQ ID NO: 2752859 - DNA, 21 bp, Homo sapiens
ctcaggaaagaatagaaagaa

SEQ ID NO: 2752860 - DNA, 15 bp, Homo sapiens
ctcaggcatttcatt

SEQ ID NO: 2752861 - DNA, 16 bp, Homo sapiens
ctcatatccataaaat

SEQ ID NO: 2752862 - DNA, 20 bp, Homo sapiens
ctcatatccataaaattgga

SEQ ID NO: 2752863 - DNA, 16 bp, Homo sapiens
ctcatgacggcctgcc

SEQ ID NO: 2752864 - DNA, 23 bp, Homo sapiens
ctcatgatagaaggctatgggga

SEQ ID NO: 2752865 - DNA, 15 bp, Homo sapiens
ctcattccagaggaa

SEQ ID NO: 2752866 - DNA, 14 bp, Homo sapiens
ctcatttccaagca

SEQ ID NO: 2752867 - DNA, 21 bp, Homo sapiens
ctccaaactgactcttaagaa

SEQ ID NO: 2752868 - DNA, 15 bp, Homo sapiens
ctcccaaactcaggc

SEQ ID NO: 2752869 - DNA, 21 bp, Homo sapiens
ctccttggatttgcatttttg

SEQ ID NO: 2752870 - DNA, 14 bp, Homo sapiens
ctcgcacctgtgct

SEQ ID NO: 2752871 - DNA, 17 bp, Homo sapiens
ctcgcacctgtgctgga

SEQ ID NO: 2752872 - DNA, 11 bp, Homo sapiens
ctctaaactgt

SEQ ID NO: 2752873 - DNA, 13 bp, Homo sapiens
ctctaaactgttt

SEQ ID NO: 2752874 - DNA, 14 bp, Homo sapiens
ctctactgtgtaat

SEQ ID NO: 2752875 - DNA, 15 bp, Homo sapiens
ctctaggaaatattt

SEQ ID NO: 2752876 - DNA, 16 bp, Homo sapiens
ctctagttttatctta

SEQ ID NO: 2752877 - DNA, 24 bp, Homo sapiens
ctctccatctattgatagtttcat

SEQ ID NO: 2752878 - DNA, 18 bp, Homo sapiens
ctctgtcttcaggctctg

SEQ ID NO: 2752879 - DNA, 15 bp, Homo sapiens
ctcttccagtttctg

SEQ ID NO: 2752880 - DNA, 20 bp, Homo sapiens
ctcttttccaaacacaggca

SEQ ID NO: 2752881 - DNA, 20 bp, Homo sapiens
ctgaaattcacagaagccta

SEQ ID NO: 2752882 - DNA, 21 bp, Homo sapiens
ctgaacatttactacagtttt

SEQ ID NO: 2752883 - DNA, 17 bp, Homo sapiens
ctgaacctttcaaaatg

SEQ ID NO: 2752884 - DNA, 14 bp, Homo sapiens
ctgaagaagatggt

SEQ ID NO: 2752885 - DNA, 21 bp, Homo sapiens
ctgaagagaagggcagggctg

SEQ ID NO: 2752886 - DNA, 18 bp, Homo sapiens
ctgaaggcagcatgtata

SEQ ID NO: 2752887 - DNA, 16 bp, Homo sapiens
ctgaagggaattgttt

SEQ ID NO: 2752888 - DNA, 13 bp, Homo sapiens
ctgaatcctgtta

SEQ ID NO: 2752889 - DNA, 22 bp, Homo sapiens
ctgaatcctgttaaattttctc

SEQ ID NO: 2752890 - DNA, 13 bp, Homo sapiens
ctgactaaaatgt

SEQ ID NO: 2752891 - DNA, 15 bp, Homo sapiens
ctgactaaaatgttt

SEQ ID NO: 2752892 - DNA, 23 bp, Homo sapiens
ctgactgggctgggtttgctgtc

SEQ ID NO: 2752893 - DNA, 15 bp, Homo sapiens
ctgactttttgtttc

SEQ ID NO: 2752894 - DNA, 17 bp, Homo sapiens
ctgactttttgtttctt

SEQ ID NO: 2752895 - DNA, 19 bp, Homo sapiens
ctgactttttgtttctttg

SEQ ID NO: 2752896 - DNA, 19 bp, Homo sapiens
ctgagaatgttaccagact

SEQ ID NO: 2752897 - DNA, 21 bp, Homo sapiens
ctgagaatgttaccagacttc

SEQ ID NO: 2752898 - DNA, 23 bp, Homo sapiens
ctgagaatgttaccagacttcaa

SEQ ID NO: 2752899 - DNA, 12 bp, Homo sapiens
ctgagaggccac

SEQ ID NO: 2752900 - DNA, 23 bp, Homo sapiens
ctgaggaagagggactgttcttt

SEQ ID NO: 2752901 - DNA, 23 bp, Homo sapiens
ctgaggaatgaatagaaaggctt

SEQ ID NO: 2752902 - DNA, 15 bp, Homo sapiens
ctgaggtgtctggcc

SEQ ID NO: 2752903 - DNA, 16 bp, Homo sapiens
ctgaggtgtctggcct

SEQ ID NO: 2752904 - DNA, 18 bp, Homo sapiens
ctgaggtgtctggcctga

SEQ ID NO: 2752905 - DNA, 22 bp, Homo sapiens
ctgaggtgtctggcctgaggtc

SEQ ID NO: 2752906 - DNA, 19 bp, Homo sapiens
ctgagttgcttcttcttgt

SEQ ID NO: 2752907 - DNA, 13 bp, Homo sapiens
ctgattgtattta

SEQ ID NO: 2752908 - DNA, 22 bp, Homo sapiens
ctgatttaaaaagtgagaaaga

SEQ ID NO: 2752909 - DNA, 18 bp, Homo sapiens
ctgcaaacctgctggtgg

SEQ ID NO: 2752910 - DNA, 19 bp, Homo sapiens
ctgcaaacctgctggtggg

SEQ ID NO: 2752911 - DNA, 13 bp, Homo sapiens
ctgcaactttttt

SEQ ID NO: 2752912 - DNA, 15 bp, Homo sapiens
gactatggagctgag

SEQ ID NO: 2752913 - DNA, 14 bp, Homo sapiens
gactcttaagaaga

SEQ ID NO: 2752914 - DNA, 18 bp, Homo sapiens
gactcttaagaagactgc

SEQ ID NO: 2752915 - DNA, 20 bp, Homo sapiens
gactcttccatcagagatgg

SEQ ID NO: 2752916 - DNA, 22 bp, Homo sapiens
gactcttttccaaacacaggca

SEQ ID NO: 2752917 - DNA, 15 bp, Homo sapiens
gactgaaagaaacta

SEQ ID NO: 2752918 - DNA, 17 bp, Homo sapiens
gactgaaagaaactaag

SEQ ID NO: 2752919 - DNA, 21 bp, Homo sapiens
gactgggctgggtttgctgtc

SEQ ID NO: 2752920 - DNA, 19 bp, Homo sapiens
gacttcttccctaaaatgt

SEQ ID NO: 2752921 - DNA, 20 bp, Homo sapiens
gactttttgtttctttgtgt

SEQ ID NO: 2752922 - DNA, 22 bp, Homo sapiens
gagaacctagggtgatattaac

SEQ ID NO: 2752923 - DNA, 23 bp, Homo sapiens
gagaacttccagatcctggaaat

SEQ ID NO: 2752924 - DNA, 11 bp, Homo sapiens
gagaagaatag

SEQ ID NO: 2752925 - DNA, 18 bp, Homo sapiens
gagaaggggacttctctt

SEQ ID NO: 2752926 - DNA, 17 bp, Homo sapiens
gagaatgagagacacac

SEQ ID NO: 2752927 - DNA, 17 bp, Homo sapiens
gagaatgtcagtatgtg

SEQ ID NO: 2752928 - DNA, 15 bp, Homo sapiens
gagactttgtcactt

SEQ ID NO: 2752929 - DNA, 19 bp, Homo sapiens
gagactttgtcacttattt

SEQ ID NO: 2752930 - DNA, 17 bp, Homo sapiens
gagagtttttaatagaa

SEQ ID NO: 2752931 - DNA, 18 bp, Homo sapiens
gagagtttttaatagaac

SEQ ID NO: 2752932 - DNA, 14 bp, Homo sapiens
gagcagtcaggaaa

SEQ ID NO: 2752933 - DNA, 18 bp, Homo sapiens
gagccctgttcctccctc

SEQ ID NO: 2752934 - DNA, 20 bp, Homo sapiens
gagccctgttcctccctccc

SEQ ID NO: 2752935 - DNA, 14 bp, Homo sapiens
gagccgccaccggg

SEQ ID NO: 2752936 - DNA, 22 bp, Homo sapiens
gagccgccaccgggcatgtctg

SEQ ID NO: 2752937 - DNA, 12 bp, Homo sapiens
gagcctgctaag

SEQ ID NO: 2752938 - DNA, 12 bp, Homo sapiens
gagccttccacc

SEQ ID NO: 2752939 - DNA, 13 bp, Homo sapiens
gagccttccaccg

SEQ ID NO: 2752940 - DNA, 18 bp, Homo sapiens
gagccttccaccggcact

SEQ ID NO: 2752941 - DNA, 16 bp, Homo sapiens
gagctggtttcctgcc

SEQ ID NO: 2752942 - DNA, 19 bp, Homo sapiens
gaggaaggtcccatggcct

SEQ ID NO: 2752943 - DNA, 16 bp, Homo sapiens
gaggtgtctggcctga

SEQ ID NO: 2752944 - DNA, 22 bp, Homo sapiens
gaggtttgtttagaagaagtgt

SEQ ID NO: 2752945 - DNA, 21 bp, Homo sapiens
gagtaagggtaaaaaagataa

SEQ ID NO: 2752946 - DNA, 13 bp, Homo sapiens
gagtatttgctgt

SEQ ID NO: 2752947 - DNA, 14 bp, Homo sapiens
gagtccctgccatc

SEQ ID NO: 2752948 - DNA, 16 bp, Homo sapiens
gagtgaagcatttaaa

SEQ ID NO: 2752949 - DNA, 21 bp, Homo sapiens
gagtgaagcatttaaaagagt

SEQ ID NO: 2752950 - DNA, 14 bp, Homo sapiens
gagtgctgtgctgt

SEQ ID NO: 2752951 - DNA, 21 bp, Homo sapiens
gagtgtgtaatttaaaattgt

SEQ ID NO: 2752952 - DNA, 13 bp, Homo sapiens
gagttggctggga

SEQ ID NO: 2752953 - DNA, 12 bp, Homo sapiens
gagttgggggta

SEQ ID NO: 2752954 - DNA, 16 bp, Homo sapiens
gagtttagctggaaaa

SEQ ID NO: 2752955 - DNA, 17 bp, Homo sapiens
gagttttcatgacagaa

SEQ ID NO: 2752956 - DNA, 16 bp, Homo sapiens
gagtttttaatagaac

SEQ ID NO: 2752957 - DNA, 23 bp, Homo sapiens
gataaagtcctgaacctttcaaa

SEQ ID NO: 2752958 - DNA, 18 bp, Homo sapiens
gtatgtacttcatgctgt

SEQ ID NO: 2752959 - DNA, 17 bp, Homo sapiens
gtatgtggaagtgtggg

SEQ ID NO: 2752960 - DNA, 20 bp, Homo sapiens
gtatgtgggggtctgtgtgt

SEQ ID NO: 2752961 - DNA, 18 bp, Homo sapiens
gtattaaagaatgctgca

SEQ ID NO: 2752962 - DNA, 17 bp, Homo sapiens
gtattgctgctgtgcgt

SEQ ID NO: 2752963 - DNA, 18 bp, Homo sapiens
gtattgctgctgtgcgtg

SEQ ID NO: 2752964 - DNA, 15 bp, Homo sapiens
gtattgtagaaagct

SEQ ID NO: 2752965 - DNA, 17 bp, Homo sapiens
gtatttctatgaaatat

SEQ ID NO: 2752966 - DNA, 22 bp, Homo sapiens
gtatttctatgaaatattatgt

SEQ ID NO: 2752967 - DNA, 17 bp, Homo sapiens
gtattttaaaagaatga

SEQ ID NO: 2752968 - DNA, 20 bp, Homo sapiens
gtattttaaaagaatgatta

SEQ ID NO: 2752969 - DNA, 19 bp, Homo sapiens
gtattttgtacaaagtaaa

SEQ ID NO: 2752970 - DNA, 15 bp, Homo sapiens
gtatttttttccaag

SEQ ID NO: 2752971 - DNA, 20 bp, Homo sapiens
gtcaaattgtgcaaaatatt

SEQ ID NO: 2752972 - DNA, 20 bp, Homo sapiens
gtcaagtcctgactgggctg

SEQ ID NO: 2752973 - DNA, 21 bp, Homo sapiens
gtcaataaaatccatacattt

SEQ ID NO: 2752974 - DNA, 17 bp, Homo sapiens
gtcaataaatgttgaaa

SEQ ID NO: 2752975 - DNA, 15 bp, Homo sapiens
gtcactactggtctg

SEQ ID NO: 2752976 - DNA, 13 bp, Homo sapiens
gtcaggaaagaga

SEQ ID NO: 2752977 - DNA, 19 bp, Homo sapiens
gtcatatgtttattcaaaa

SEQ ID NO: 2752978 - DNA, 23 bp, Homo sapiens
gtcatcaatagtgtcctatgcaa

SEQ ID NO: 2752979 - DNA, 13 bp, Homo sapiens
gtcattaaaattg

SEQ ID NO: 2752980 - DNA, 15 bp, Homo sapiens
gtccaactctgtatt

SEQ ID NO: 2752981 - DNA, 16 bp, Homo sapiens
gtccaactctgtattt

SEQ ID NO: 2752982 - DNA, 18 bp, Homo sapiens
gtccagttcaggaatttt

SEQ ID NO: 2752983 - DNA, 20 bp, Homo sapiens
gtcccagaatgcctcctgca

SEQ ID NO: 2752984 - DNA, 14 bp, Homo sapiens
gtcccatggcctgc

SEQ ID NO: 2752985 - DNA, 16 bp, Homo sapiens
gtcccatggcctgctg

SEQ ID NO: 2752986 - DNA, 21 bp, Homo sapiens
gtcccattgttggcgctgagg

SEQ ID NO: 2752987 - DNA, 23 bp, Homo sapiens
gtcccattgttggcgctgaggtg

SEQ ID NO: 2752988 - DNA, 17 bp, Homo sapiens
gtcctgactgggctggg

SEQ ID NO: 2752989 - DNA, 11 bp, Homo sapiens
gtccttcagtt

SEQ ID NO: 2752990 - DNA, 16 bp, Homo sapiens
gtccttgaatgccata

SEQ ID NO: 2752991 - DNA, 21 bp, Homo sapiens
gtctataattccttaaaattt

SEQ ID NO: 2752992 - DNA, 22 bp, Homo sapiens
gtctataattccttaaaatttt

SEQ ID NO: 2752993 - DNA, 23 bp, Homo sapiens
gtctataattccttaaaattttc

SEQ ID NO: 2752994 - DNA, 17 bp, Homo sapiens
gtctatctaatgacatg

SEQ ID NO: 2752995 - DNA, 13 bp, Homo sapiens
gtctgactgtttc

SEQ ID NO: 2752996 - DNA, 20 bp, Homo sapiens
gtctgcctggagtgctgtgc

SEQ ID NO: 2752997 - DNA, 21 bp, Homo sapiens
gtctgcctggagtgctgtgct

SEQ ID NO: 2752998 - DNA, 15 bp, Homo sapiens
gtctggcctgaggtc

SEQ ID NO: 2752999 - DNA, 12 bp, Homo sapiens
gtctgtgtgtgt

SEQ ID NO: 2753000 - DNA, 20 bp, Homo sapiens
gtctgtgtgtgtgtatgtgg

SEQ ID NO: 2753001 - DNA, 11 bp, Homo sapiens
gtctgtgtgtt

SEQ ID NO: 2753002 - DNA, 22 bp, Homo sapiens
gtctgtgtgtttatgtgtgtgt

SEQ ID NO: 2753003 - DNA, 15 bp, Homo sapiens
gtctgttaatctttt

SEQ ID NO: 2753004 - DNA, 17 bp, Homo sapiens
gtcttacattgcctgac

SEQ ID NO: 2753005 - DNA, 11 bp, Homo sapiens
gtcttcaaatt

SEQ ID NO: 2753006 - DNA, 24 bp, Homo sapiens
gtcttcaaatttgattctaaatag

SEQ ID NO: 2753007 - DNA, 21 bp, Homo sapiens
gtcttcggccgagctggtttc

SEQ ID NO: 2753008 - DNA, 18 bp, Homo sapiens
gtcttggggtcccactgc

SEQ ID NO: 2753009 - DNA, 17 bp, Homo sapiens
gtcttttaactttagaa

SEQ ID NO: 2753010 - DNA, 17 bp, Homo sapiens
gtgaactaagttattgc

SEQ ID NO: 2753011 - DNA, 13 bp, Homo sapiens
gtgatgacatatt

SEQ ID NO: 2753012 - DNA, 10 bp, Homo sapiens
gtgatgtgtc

SEQ ID NO: 2753013 - DNA, 12 bp, Homo sapiens
gtgcaaaatatt

SEQ ID NO: 2753014 - DNA, 18 bp, Homo sapiens
gtgcaaattgtcacagga

SEQ ID NO: 2753015 - DNA, 20 bp, Homo sapiens
gtgcaagagactttgtcact

SEQ ID NO: 2753016 - DNA, 17 bp, Homo sapiens
gtgctataacattctga

SEQ ID NO: 2753017 - DNA, 15 bp, Homo sapiens
gtgctgatccttgca

SEQ ID NO: 2753018 - DNA, 15 bp, Homo sapiens
gtgctggagccctgt

SEQ ID NO: 2753019 - DNA, 23 bp, Homo sapiens
gtgcttctacacatttcatctaa

SEQ ID NO: 2753020 - DNA, 14 bp, Homo sapiens
gtggaagtgtgggt

SEQ ID NO: 2753021 - DNA, 21 bp, Homo sapiens
gtggaagtgtgggtctgtgtg

SEQ ID NO: 2753022 - DNA, 14 bp, Homo sapiens
gtgggggtctgtgt

SEQ ID NO: 2753023 - DNA, 17 bp, Homo sapiens
gtggttttgggaaaaat

SEQ ID NO: 2753024 - DNA, 21 bp, Homo sapiens
gtgtaagtagataggccatgg

SEQ ID NO: 2753025 - DNA, 20 bp, Homo sapiens
gtgtataagttgtattatta

SEQ ID NO: 2753026 - DNA, 13 bp, Homo sapiens
gtgtataatgttg

SEQ ID NO: 2753027 - DNA, 17 bp, Homo sapiens
gtgtataatgttggtgt

SEQ ID NO: 2753028 - DNA, 14 bp, Homo sapiens
gtgtataatttacc

SEQ ID NO: 2753029 - DNA, 20 bp, Homo sapiens
gtgtatcttgattaatgtac

SEQ ID NO: 2753030 - DNA, 21 bp, Homo sapiens
gtgtatcttgattaatgtact

SEQ ID NO: 2753031 - DNA, 22 bp, Homo sapiens
gtgtatcttgattaatgtactt

SEQ ID NO: 2753032 - DNA, 22 bp, Homo sapiens
gtgtcaagtcctgactgggctg

SEQ ID NO: 2753033 - DNA, 23 bp, Homo sapiens
gtgtgaactaagttattgctgca

SEQ ID NO: 2753034 - DNA, 16 bp, Homo sapiens
gtgtgacagaaaaaaa

SEQ ID NO: 2753035 - DNA, 19 bp, Homo sapiens
gtgtgcctgtcactactgg

SEQ ID NO: 2753036 - DNA, 15 bp, Homo sapiens
gtgtggagttttcat

SEQ ID NO: 2753037 - DNA, 20 bp, Homo sapiens
gtgtggccccgcccgagccc

SEQ ID NO: 2753038 - DNA, 17 bp, Homo sapiens
gtgtgggagtgtgtaat

SEQ ID NO: 2753039 - DNA, 17 bp, Homo sapiens
gtgtgtgttgtgtgtgg

SEQ ID NO: 2753040 - DNA, 17 bp, Homo sapiens
gtgtgttgtgtgtggga

SEQ ID NO: 2753041 - DNA, 15 bp, Homo sapiens
gtgtgtttatgtgtg

SEQ ID NO: 2753042 - DNA, 12 bp, Homo sapiens
gtgttgaaatat

SEQ ID NO: 2753043 - DNA, 23 bp, Homo sapiens
gttaaattttctctaaactgttt

SEQ ID NO: 2753044 - DNA, 19 bp, Homo sapiens
gttacagtttcttcatgca

SEQ ID NO: 2753045 - DNA, 14 bp, Homo sapiens
gttaccagacttca

SEQ ID NO: 2753046 - DNA, 18 bp, Homo sapiens
gttagctttattgaagtc

SEQ ID NO: 2753047 - DNA, 21 bp, Homo sapiens
gttatatttccttttgtaaag

SEQ ID NO: 2753048 - DNA, 14 bp, Homo sapiens
gttattataaatgt

SEQ ID NO: 2753049 - DNA, 15 bp, Homo sapiens
gttattataaatgtt

SEQ ID NO: 2753050 - DNA, 21 bp, Homo sapiens
gttattataaatgttagttct

SEQ ID NO: 2753051 - DNA, 20 bp, Homo sapiens
gttattgctgcataaatttg

SEQ ID NO: 2753052 - DNA, 13 bp, Homo sapiens
gttatttctaaac

SEQ ID NO: 2753053 - DNA, 14 bp, Homo sapiens
gttatttctaaacc

SEQ ID NO: 2753054 - DNA, 17 bp, Homo sapiens
gttcacattaactcagg

SEQ ID NO: 2753055 - DNA, 18 bp, Homo sapiens
gttcacattaactcaggc

SEQ ID NO: 2753056 - DNA, 11 bp, Homo sapiens
gttcagaacca

SEQ ID NO: 2753057 - DNA, 15 bp, Homo sapiens
gttctgaagaagatg

SEQ ID NO: 2753058 - DNA, 14 bp, Homo sapiens
gttcttatagaata

SEQ ID NO: 2753059 - DNA, 17 bp, Homo sapiens
gttcttatagaataaaa

SEQ ID NO: 2753060 - DNA, 21 bp, Homo sapiens
gttcttatagaataaaagctg

SEQ ID NO: 2753061 - DNA, 23 bp, Homo sapiens
gttcttatagaataaaagctgtg

SEQ ID NO: 2753062 - DNA, 18 bp, Homo sapiens
gttgaaagtaaaaaaata

SEQ ID NO: 2753063 - DNA, 13 bp, Homo sapiens
gttgacatgggac

SEQ ID NO: 2753064 - DNA, 14 bp, Homo sapiens
gttgacatgggaca

SEQ ID NO: 2753065 - DNA, 14 bp, Homo sapiens
gttgcactttgtag

SEQ ID NO: 2753066 - DNA, 21 bp, Homo sapiens
gttgcattggtttgagaaagg

SEQ ID NO: 2753067 - DNA, 22 bp, Homo sapiens
gttgcattggtttgagaaaggc

SEQ ID NO: 2753068 - DNA, 21 bp, Homo sapiens
gttgggagaatgtcagtatgt

SEQ ID NO: 2753069 - DNA, 18 bp, Homo sapiens
gttggttgcactttgtag

SEQ ID NO: 2753070 - DNA, 13 bp, Homo sapiens
gttgtattattag

SEQ ID NO: 2753071 - DNA, 19 bp, Homo sapiens
gttgtgcagtgtgcctgtc

SEQ ID NO: 2753072 - DNA, 12 bp, Homo sapiens
gttgttgttgtt

SEQ ID NO: 2753073 - DNA, 16 bp, Homo sapiens
gttgttttctggggga

SEQ ID NO: 2753074 - DNA, 13 bp, Homo sapiens
gtttaacattgat

SEQ ID NO: 2753075 - DNA, 16 bp, Homo sapiens
gtttagaagaagtgtg

SEQ ID NO: 2753076 - DNA, 15 bp, Homo sapiens
gtttatgttcttata

SEQ ID NO: 2753077 - DNA, 20 bp, Homo sapiens
gtttcctgcccagcctgggg

SEQ ID NO: 2753078 - DNA, 12 bp, Homo sapiens
gtttctgttctg

SEQ ID NO: 2753079 - DNA, 14 bp, Homo sapiens
gtttcttagctgca

SEQ ID NO: 2753080 - DNA, 14 bp, Homo sapiens
gtttgtttttgctt

SEQ ID NO: 2753081 - DNA, 17 bp, Homo sapiens
gttttaaggattctgca

SEQ ID NO: 2753082 - DNA, 15 bp, Homo sapiens
gttttataattttgt

SEQ ID NO: 2753083 - DNA, 22 bp, Homo sapiens
gttttataattttgtgaagcaa

SEQ ID NO: 2753084 - DNA, 18 bp, Homo sapiens
gttttatataatgcatgt

SEQ ID NO: 2753085 - DNA, 21 bp, Homo sapiens
gttttcatgacagaatataca

SEQ ID NO: 2753086 - DNA, 18 bp, Homo sapiens
gttttctgggggaaaaag

SEQ ID NO: 2753087 - DNA, 17 bp, Homo sapiens
atagtcaaattgtgtga

SEQ ID NO: 2753088 - DNA, 14 bp, Homo sapiens
atagttagctttat

SEQ ID NO: 2753089 - DNA, 14 bp, Homo sapiens
atagttctgttaaa

SEQ ID NO: 2753090 - DNA, 22 bp, Homo sapiens
atagttctgttaaatatttttg

SEQ ID NO: 2753091 - DNA, 20 bp, Homo sapiens
atagttgaaagtaaaaaaat

SEQ ID NO: 2753092 - DNA, 22 bp, Homo sapiens
atagttgaaagtaaaaaaataa

SEQ ID NO: 2753093 - DNA, 19 bp, Homo sapiens
atataagcttgtattcctt

SEQ ID NO: 2753094 - DNA, 17 bp, Homo sapiens
atataatacctttctaa

SEQ ID NO: 2753095 - DNA, 20 bp, Homo sapiens
atataatctgaatcctgtta

SEQ ID NO: 2753096 - DNA, 20 bp, Homo sapiens
atatacaagtaaattctgtt

SEQ ID NO: 2753097 - DNA, 13 bp, Homo sapiens
atatagctggcaa

SEQ ID NO: 2753098 - DNA, 19 bp, Homo sapiens
atatagctggcaagaatgg

SEQ ID NO: 2753099 - DNA, 15 bp, Homo sapiens
atatagttagcttta

SEQ ID NO: 2753100 - DNA, 17 bp, Homo sapiens
atatagttgaaagtaaa

SEQ ID NO: 2753101 - DNA, 14 bp, Homo sapiens
atatataacaatgc

SEQ ID NO: 2753102 - DNA, 22 bp, Homo sapiens
atatatagttagctttattgaa

SEQ ID NO: 2753103 - DNA, 13 bp, Homo sapiens
atatatcctgttt

SEQ ID NO: 2753104 - DNA, 13 bp, Homo sapiens
atatatgaatatt

SEQ ID NO: 2753105 - DNA, 17 bp, Homo sapiens
atatatggcatttgcag

SEQ ID NO: 2753106 - DNA, 14 bp, Homo sapiens
atatcatgctaaaa

SEQ ID NO: 2753107 - DNA, 15 bp, Homo sapiens
atatccataaaattg

SEQ ID NO: 2753108 - DNA, 17 bp, Homo sapiens
atatcctgtttgtattt

SEQ ID NO: 2753109 - DNA, 18 bp, Homo sapiens
atatcctgtttgtatttt

SEQ ID NO: 2753110 - DNA, 18 bp, Homo sapiens
atatctgaacatttacta

SEQ ID NO: 2753111 - DNA, 14 bp, Homo sapiens
atatctgtttattc

SEQ ID NO: 2753112 - DNA, 16 bp, Homo sapiens
atatctgtttattctg

SEQ ID NO: 2753113 - DNA, 20 bp, Homo sapiens
atatgaatattacatgtaaa

SEQ ID NO: 2753114 - DNA, 16 bp, Homo sapiens
atatgaccttaaggaa

SEQ ID NO: 2753115 - DNA, 22 bp, Homo sapiens
atatgaccttaaggaaaagtaa

SEQ ID NO: 2753116 - DNA, 23 bp, Homo sapiens
atatgaccttaaggaaaagtaag

SEQ ID NO: 2753117 - DNA, 20 bp, Homo sapiens
atatgcttctgttttataat

SEQ ID NO: 2753118 - DNA, 18 bp, Homo sapiens
atatgtccagaagagtca

SEQ ID NO: 2753119 - DNA, 16 bp, Homo sapiens
atatgtgcggcttttc

SEQ ID NO: 2753120 - DNA, 15 bp, Homo sapiens
atatgtttattcaaa

SEQ ID NO: 2753121 - DNA, 16 bp, Homo sapiens
atatgtttattcaaaa

SEQ ID NO: 2753122 - DNA, 19 bp, Homo sapiens
atattagttacttgctata

SEQ ID NO: 2753123 - DNA, 18 bp, Homo sapiens
atattagttgctttgtta

SEQ ID NO: 2753124 - DNA, 16 bp, Homo sapiens
atattatgttaaaact

SEQ ID NO: 2753125 - DNA, 15 bp, Homo sapiens
atattgaatgcctta

SEQ ID NO: 2753126 - DNA, 22 bp, Homo sapiens
atattgaatgccttatttttga

SEQ ID NO: 2753127 - DNA, 23 bp, Homo sapiens
atattgaatgccttatttttgaa

SEQ ID NO: 2753128 - DNA, 16 bp, Homo sapiens
atattggtattaaaga

SEQ ID NO: 2753129 - DNA, 18 bp, Homo sapiens
atattggtattaaagaat

SEQ ID NO: 2753130 - DNA, 20 bp, Homo sapiens
atattggtattaaagaatgc

SEQ ID NO: 2753131 - DNA, 14 bp, Homo sapiens
atatttattactgt

SEQ ID NO: 2753132 - DNA, 18 bp, Homo sapiens
atatttattttaataatg

SEQ ID NO: 2753133 - DNA, 19 bp, Homo sapiens
atatttccttttgtaaagt

SEQ ID NO: 2753134 - DNA, 22 bp, Homo sapiens
atatttccttttgtaaagtaaa

SEQ ID NO: 2753135 - DNA, 17 bp, Homo sapiens
atatttgaaaattacct

SEQ ID NO: 2753136 - DNA, 20 bp, Homo sapiens
atatttgtaaatttatgtga

SEQ ID NO: 2753137 - DNA, 21 bp, Homo sapiens
atatttgtaaggcttgttcca

SEQ ID NO: 2753138 - DNA, 12 bp, Homo sapiens
atattttatctt

SEQ ID NO: 2753139 - DNA, 22 bp, Homo sapiens
atattttttatatctggaatga

SEQ ID NO: 2753140 - DNA, 14 bp, Homo sapiens
atcaaggaagtctt

SEQ ID NO: 2753141 - DNA, 19 bp, Homo sapiens
atcaaggaagtcttcaaat

SEQ ID NO: 2753142 - DNA, 15 bp, Homo sapiens
atcacttaacattcc

SEQ ID NO: 2753143 - DNA, 12 bp, Homo sapiens
atcagaataaat

SEQ ID NO: 2753144 - DNA, 14 bp, Homo sapiens
atcagcctgtgcca

SEQ ID NO: 2753145 - DNA, 12 bp, Homo sapiens
atcaggagcctg

SEQ ID NO: 2753146 - DNA, 13 bp, Homo sapiens
atcaggagcctgc

SEQ ID NO: 2753147 - DNA, 17 bp, Homo sapiens
atcaggagcctgctaag

SEQ ID NO: 2753148 - DNA, 22 bp, Homo sapiens
atcaggagcctgctaaggaaca

SEQ ID NO: 2753149 - DNA, 13 bp, Homo sapiens
atcaggccattgt

SEQ ID NO: 2753150 - DNA, 15 bp, Homo sapiens
atcagtaccatttga

SEQ ID NO: 2753151 - DNA, 17 bp, Homo sapiens
atcagtgggtcatatgt

SEQ ID NO: 2753152 - DNA, 16 bp, Homo sapiens
atcatgctaaaattct

SEQ ID NO: 2753153 - DNA, 16 bp, Homo sapiens
atcattctgtgattaa

SEQ ID NO: 2753154 - DNA, 20 bp, Homo sapiens
atcattctgtgattaaatct

SEQ ID NO: 2753155 - DNA, 16 bp, Homo sapiens
atcattgttgtgtata

SEQ ID NO: 2753156 - DNA, 17 bp, Homo sapiens
atcattgttgtgtataa

SEQ ID NO: 2753157 - DNA, 18 bp, Homo sapiens
atcattgttgtgtataat

SEQ ID NO: 2753158 - DNA, 19 bp, Homo sapiens
atccagcgtgcaccccgcc

SEQ ID NO: 2753159 - DNA, 13 bp, Homo sapiens
atcctatgccttc

SEQ ID NO: 2753160 - DNA, 18 bp, Homo sapiens
atcctatgccttcaaata

SEQ ID NO: 2753161 - DNA, 19 bp, Homo sapiens
atcctatgccttcaaatag

SEQ ID NO: 2753162 - DNA, 23 bp, Homo sapiens
atcctcttgccacatcttgaaaa

SEQ ID NO: 2753163 - DNA, 16 bp, Homo sapiens
atcctgttaaattttc

SEQ ID NO: 2753164 - DNA, 16 bp, Homo sapiens
atcctgtttgtatttt

SEQ ID NO: 2753165 - DNA, 14 bp, Homo sapiens
atcgcattgcatac

SEQ ID NO: 2753166 - DNA, 16 bp, Homo sapiens
atcgttattataaatg

SEQ ID NO: 2753167 - DNA, 19 bp, Homo sapiens
atcgttattataaatgtta

SEQ ID NO: 2753168 - DNA, 12 bp, Homo sapiens
atctaatttaat

SEQ ID NO: 2753169 - DNA, 19 bp, Homo sapiens
atctacagcttctattcat

SEQ ID NO: 2753170 - DNA, 13 bp, Homo sapiens
atctcaatatttc

SEQ ID NO: 2753171 - DNA, 21 bp, Homo sapiens
atctccaactttattttgaat

SEQ ID NO: 2753172 - DNA, 20 bp, Homo sapiens
atctcctgagttgtataaaa

SEQ ID NO: 2753173 - DNA, 23 bp, Homo sapiens
atctgaaggagagagtcttttaa

SEQ ID NO: 2753174 - DNA, 20 bp, Homo sapiens
atctgagaggccacagtgca

SEQ ID NO: 2753175 - DNA, 17 bp, Homo sapiens
atctgtacttttttcaa

SEQ ID NO: 2753176 - DNA, 19 bp, Homo sapiens
atctgtacttttttcaaat

SEQ ID NO: 2753177 - DNA, 15 bp, Homo sapiens
atctgtataaatgtc

SEQ ID NO: 2753178 - DNA, 15 bp, Homo sapiens
atctgtgcagggctg

SEQ ID NO: 2753179 - DNA, 17 bp, Homo sapiens
atctgtgcagggctggt

SEQ ID NO: 2753180 - DNA, 20 bp, Homo sapiens
atctgtgcagggctggtttg

SEQ ID NO: 2753181 - DNA, 13 bp, Homo sapiens
atcttaagaatgt

SEQ ID NO: 2753182 - DNA, 16 bp, Homo sapiens
atcttagtttactgga

SEQ ID NO: 2753183 - DNA, 17 bp, Homo sapiens
atcttgaaaatgccacc

SEQ ID NO: 2753184 - DNA, 11 bp, Homo sapiens
atcttgattaa

SEQ ID NO: 2753185 - DNA, 22 bp, Homo sapiens
atcttgattaatgtacttttta

SEQ ID NO: 2753186 - DNA, 19 bp, Homo sapiens
atcttgttttaagcaaatg

SEQ ID NO: 2753187 - DNA, 21 bp, Homo sapiens
atcttgttttaagcaaatgca

SEQ ID NO: 2753188 - DNA, 19 bp, Homo sapiens
atctttcatagttctgtta

SEQ ID NO: 2753189 - DNA, 20 bp, Homo sapiens
atctttcatagttctgttaa

SEQ ID NO: 2753190 - DNA, 17 bp, Homo sapiens
atgaaatattatgttaa

SEQ ID NO: 2753191 - DNA, 18 bp, Homo sapiens
atgaaatattatgttaaa

SEQ ID NO: 2753192 - DNA, 14 bp, Homo sapiens
atgaagaaagtaaa

SEQ ID NO: 2753193 - DNA, 19 bp, Homo sapiens
atgaagaattgccaatctt

SEQ ID NO: 2753194 - DNA, 23 bp, Homo sapiens
atgaagtccaagcatttagatgt

SEQ ID NO: 2753195 - DNA, 14 bp, Homo sapiens
atgaataaaaataa

SEQ ID NO: 2753196 - DNA, 22 bp, Homo sapiens
atgaatatatggcatttgcaga

SEQ ID NO: 2753197 - DNA, 20 bp, Homo sapiens
atgaatattacatgtaaagc

SEQ ID NO: 2753198 - DNA, 18 bp, Homo sapiens
atgaattacatttgtata

SEQ ID NO: 2753199 - DNA, 14 bp, Homo sapiens
atgacggcctgcct

SEQ ID NO: 2753200 - DNA, 14 bp, Homo sapiens
atgagagacacact

SEQ ID NO: 2753201 - DNA, 14 bp, Homo sapiens
atgataactggaaa

SEQ ID NO: 2753202 - DNA, 15 bp, Homo sapiens
atgataactggaaac

SEQ ID NO: 2753203 - DNA, 15 bp, Homo sapiens
atgatatctatattc

SEQ ID NO: 2753204 - DNA, 15 bp, Homo sapiens
atgatcaaaaataat

SEQ ID NO: 2753205 - DNA, 18 bp, Homo sapiens
atgcaataaaattatttg

SEQ ID NO: 2753206 - DNA, 13 bp, Homo sapiens
atgcagaaaaaga

SEQ ID NO: 2753207 - DNA, 16 bp, Homo sapiens
atgcagtgccctagaa

SEQ ID NO: 2753208 - DNA, 20 bp, Homo sapiens
atgcataaaagggtcaaacc

SEQ ID NO: 2753209 - DNA, 19 bp, Homo sapiens
atgccaccatccaataaaa

SEQ ID NO: 2753210 - DNA, 14 bp, Homo sapiens
atgccccagtatta

SEQ ID NO: 2753211 - DNA, 13 bp, Homo sapiens
atgccttattttt

SEQ ID NO: 2753212 - DNA, 19 bp, Homo sapiens
atggaaaatatacaagtaa

SEQ ID NO: 2753213 - DNA, 22 bp, Homo sapiens
atggaaaatatacaagtaaatt

SEQ ID NO: 2753214 - DNA, 12 bp, Homo sapiens
atggaaatacca

SEQ ID NO: 2753215 - DNA, 23 bp, Homo sapiens
atggaaataccaggaccagttta

SEQ ID NO: 2753216 - DNA, 20 bp, Homo sapiens
atggccgcagggctgtgcac

SEQ ID NO: 2753217 - DNA, 21 bp, Homo sapiens
atgggacatttgctcatggaa

SEQ ID NO: 2753218 - DNA, 20 bp, Homo sapiens
atggggatagatgtgtggac

SEQ ID NO: 2753219 - DNA, 23 bp, Homo sapiens
atggtggcttcttttctttgtat

SEQ ID NO: 2753220 - DNA, 21 bp, Homo sapiens
atggttcccttgatgaagaag

SEQ ID NO: 2753221 - DNA, 21 bp, Homo sapiens
atgtacctctattagtttcaa

SEQ ID NO: 2753222 - DNA, 18 bp, Homo sapiens
atgtactttttattgcat

SEQ ID NO: 2753223 - DNA, 21 bp, Homo sapiens
atgtactttttattgcatggt

SEQ ID NO: 2753224 - DNA, 23 bp, Homo sapiens
atgtagaaattctaacttaatgt

SEQ ID NO: 2753225 - DNA, 22 bp, Homo sapiens
atgtcaaattgtgcaaaatatt

SEQ ID NO: 2753226 - DNA, 14 bp, Homo sapiens
atgtctattattat

SEQ ID NO: 2753227 - DNA, 13 bp, Homo sapiens
atgtctgcctgga

SEQ ID NO: 2753228 - DNA, 17 bp, Homo sapiens
atgtctgcctggagtgc

SEQ ID NO: 2753229 - DNA, 20 bp, Homo sapiens
atgtgatacattaggaagct

SEQ ID NO: 2753230 - DNA, 19 bp, Homo sapiens
atgtgctagagttaaaagt

SEQ ID NO: 2753231 - DNA, 21 bp, Homo sapiens
atgtgctagagttaaaagtta

SEQ ID NO: 2753232 - DNA, 13 bp, Homo sapiens
atgttaccagact

SEQ ID NO: 2753233 - DNA, 19 bp, Homo sapiens
atgttaccagacttcaaga

SEQ ID NO: 2753234 - DNA, 20 bp, Homo sapiens
atgttaccagacttcaagat

SEQ ID NO: 2753235 - DNA, 21 bp, Homo sapiens
atgttagttctagctctattt

SEQ ID NO: 2753236 - DNA, 16 bp, Homo sapiens
atgttcttatagaata

SEQ ID NO: 2753237 - DNA, 19 bp, Homo sapiens
atgttcttatagaataaaa

SEQ ID NO: 2753238 - DNA, 15 bp, Homo sapiens
atgttggttgcactt

SEQ ID NO: 2753239 - DNA, 19 bp, Homo sapiens
atgttggttgcactttgta

SEQ ID NO: 2753240 - DNA, 20 bp, Homo sapiens
atgttggttgcactttgtag

SEQ ID NO: 2753241 - DNA, 15 bp, Homo sapiens
atgtttacagaggac

SEQ ID NO: 2753242 - DNA, 14 bp, Homo sapiens
atgtttatgttctt

SEQ ID NO: 2753243 - DNA, 17 bp, Homo sapiens
atgtttatttagaaact

SEQ ID NO: 2753244 - DNA, 21 bp, Homo sapiens
atgtttcatttacctctaaat

SEQ ID NO: 2753245 - DNA, 17 bp, Homo sapiens
atgttttcaggctagat

SEQ ID NO: 2753246 - DNA, 21 bp, Homo sapiens
atgttttcaggctagatgtat

SEQ ID NO: 2753247 - DNA, 22 bp, Homo sapiens
atgtttttaaaaacctattttg

SEQ ID NO: 2753248 - DNA, 13 bp, Homo sapiens
attaagtaatgat

SEQ ID NO: 2753249 - DNA, 15 bp, Homo sapiens
attaagtaatgataa

SEQ ID NO: 2753250 - DNA, 21 bp, Homo sapiens
attaagtaatgataactggaa

SEQ ID NO: 2753251 - DNA, 13 bp, Homo sapiens
attaatattgtat

SEQ ID NO: 2753252 - DNA, 18 bp, Homo sapiens
attaatattgtattgctg

SEQ ID NO: 2753253 - DNA, 17 bp, Homo sapiens
attaatgaagaaagtaa

SEQ ID NO: 2753254 - DNA, 14 bp, Homo sapiens
attaatgtactttt

SEQ ID NO: 2753255 - DNA, 21 bp, Homo sapiens
attaatgtactttttattgca

SEQ ID NO: 2753256 - DNA, 22 bp, Homo sapiens
attaatgtactttttattgcat

SEQ ID NO: 2753257 - DNA, 14 bp, Homo sapiens
attaattctaaact

SEQ ID NO: 2753258 - DNA, 19 bp, Homo sapiens
attacacctcagaaattga

SEQ ID NO: 2753259 - DNA, 20 bp, Homo sapiens
attacagtatggcaatatct

SEQ ID NO: 2753260 - DNA, 13 bp, Homo sapiens
attacatttgtat

SEQ ID NO: 2753261 - DNA, 20 bp, Homo sapiens
attacttactgttaaaactg

SEQ ID NO: 2753262 - DNA, 18 bp, Homo sapiens
attagaaaggctaacaaa

SEQ ID NO: 2753263 - DNA, 19 bp, Homo sapiens
attagactctctagtttta

SEQ ID NO: 2753264 - DNA, 16 bp, Homo sapiens
attaggataactaaaa

SEQ ID NO: 2753265 - DNA, 20 bp, Homo sapiens
attataaatgttagttctag

SEQ ID NO: 2753266 - DNA, 16 bp, Homo sapiens
attataatctccaact

SEQ ID NO: 2753267 - DNA, 14 bp, Homo sapiens
attatagaaattct

SEQ ID NO: 2753268 - DNA, 18 bp, Homo sapiens
attatagaaattctgaat

SEQ ID NO: 2753269 - DNA, 17 bp, Homo sapiens
attatgaattacatttg

SEQ ID NO: 2753270 - DNA, 22 bp, Homo sapiens
attattagactctctagtttta

SEQ ID NO: 2753271 - DNA, 11 bp, Homo sapiens
attcaaaatat

SEQ ID NO: 2753272 - DNA, 16 bp, Homo sapiens
attcatcttcttcttt

SEQ ID NO: 2753273 - DNA, 17 bp, Homo sapiens
attcatggcctggggga

SEQ ID NO: 2753274 - DNA, 23 bp, Homo sapiens
attccttaaaattttcattctga

SEQ ID NO: 2753275 - DNA, 12 bp, Homo sapiens
attctaaactta

SEQ ID NO: 2753276 - DNA, 12 bp, Homo sapiens
attctgaatttt

SEQ ID NO: 2753277 - DNA, 21 bp, Homo sapiens
attctgggcctaattttttaa

SEQ ID NO: 2753278 - DNA, 13 bp, Homo sapiens
attcttaaaatgc

SEQ ID NO: 2753279 - DNA, 15 bp, Homo sapiens
attcttatattttat

SEQ ID NO: 2753280 - DNA, 17 bp, Homo sapiens
attcttatattttatca

SEQ ID NO: 2753281 - DNA, 19 bp, Homo sapiens
attcttatattttatcaag

SEQ ID NO: 2753282 - DNA, 14 bp, Homo sapiens
attctttaaactac

SEQ ID NO: 2753283 - DNA, 16 bp, Homo sapiens
attctttaaactactg

SEQ ID NO: 2753284 - DNA, 15 bp, Homo sapiens
attgagactgaaaga

SEQ ID NO: 2753285 - DNA, 19 bp, Homo sapiens
attgagctttgcatttatg

SEQ ID NO: 2753286 - DNA, 22 bp, Homo sapiens
attgaggacactgatatgggtc

SEQ ID NO: 2753287 - DNA, 16 bp, Homo sapiens
attgatagtttcattt

SEQ ID NO: 2753288 - DNA, 19 bp, Homo sapiens
attgatagtttcatttaca

SEQ ID NO: 2753289 - DNA, 21 bp, Homo sapiens
attgatagtttcatttacaat

SEQ ID NO: 2753290 - DNA, 23 bp, Homo sapiens
attgcaggagtccctgccatcat

SEQ ID NO: 2753291 - DNA, 15 bp, Homo sapiens
attgcatggtgtgaa

SEQ ID NO: 2753292 - DNA, 19 bp, Homo sapiens
attgccaatcttgttttaa

SEQ ID NO: 2753293 - DNA, 18 bp, Homo sapiens
attgcctgactaaaatgt

SEQ ID NO: 2753294 - DNA, 20 bp, Homo sapiens
attgcctgactaaaatgttt

SEQ ID NO: 2753295 - DNA, 14 bp, Homo sapiens
attgctgcataaat

SEQ ID NO: 2753296 - DNA, 17 bp, Homo sapiens
attgctgcataaatttg

SEQ ID NO: 2753297 - DNA, 19 bp, Homo sapiens
attgctgcataaatttgta

SEQ ID NO: 2753298 - DNA, 23 bp, Homo sapiens
attggagaaaagcacttaaagtt

SEQ ID NO: 2753299 - DNA, 16 bp, Homo sapiens
attggtattaaagaat

SEQ ID NO: 2753300 - DNA, 17 bp, Homo sapiens
attggtttgagaaaggc

SEQ ID NO: 2753301 - DNA, 13 bp, Homo sapiens
attgtagaaagct

SEQ ID NO: 2753302 - DNA, 16 bp, Homo sapiens
attgtagaaagctaat

SEQ ID NO: 2753303 - DNA, 20 bp, Homo sapiens
attgtagaaagctaatacaa

SEQ ID NO: 2753304 - DNA, 14 bp, Homo sapiens
attgtcctaagtgt

SEQ ID NO: 2753305 - DNA, 13 bp, Homo sapiens
attgtgatgtgtc

SEQ ID NO: 2753306 - DNA, 15 bp, Homo sapiens
attgtgcaaaatatt

SEQ ID NO: 2753307 - DNA, 16 bp, Homo sapiens
attgtgcaaaatattg

SEQ ID NO: 2753308 - DNA, 21 bp, Homo sapiens
attgtttttataaaaacattg

SEQ ID NO: 2753309 - DNA, 15 bp, Homo sapiens
atttaaaattgtgat

SEQ ID NO: 2753310 - DNA, 23 bp, Homo sapiens
atttaaatatctgaacatttact

SEQ ID NO: 2753311 - DNA, 13 bp, Homo sapiens
atttacaatttca

SEQ ID NO: 2753312 - DNA, 15 bp, Homo sapiens
atttacctctaaatt

SEQ ID NO: 2753313 - DNA, 19 bp, Homo sapiens
atttacttctaatcttaaa

SEQ ID NO: 2753314 - DNA, 13 bp, Homo sapiens
atttagatgtata

SEQ ID NO: 2753315 - DNA, 19 bp, Homo sapiens
atttatctgcaaggatttt

SEQ ID NO: 2753316 - DNA, 23 bp, Homo sapiens
atttatgatttctccagaaattt

SEQ ID NO: 2753317 - DNA, 19 bp, Homo sapiens
atttattactgtaagaaaa

SEQ ID NO: 2753318 - DNA, 19 bp, Homo sapiens
atttcaaaagaacattctt

SEQ ID NO: 2753319 - DNA, 14 bp, Homo sapiens
atttcatctaattt

SEQ ID NO: 2753320 - DNA, 12 bp, Homo sapiens
atttccatatcc

SEQ ID NO: 2753321 - DNA, 19 bp, Homo sapiens
atttcctttatactgtgaa

SEQ ID NO: 2753322 - DNA, 23 bp, Homo sapiens
atttccttttgtaaagtaaaata

SEQ ID NO: 2753323 - DNA, 14 bp, Homo sapiens
atttctatgaaata

SEQ ID NO: 2753324 - DNA, 18 bp, Homo sapiens
atttgccaaaaattcatg

SEQ ID NO: 2753325 - DNA, 18 bp, Homo sapiens
atttgtaaatttatgtga

SEQ ID NO: 2753326 - DNA, 19 bp, Homo sapiens
atttgtaaatttatgtgat

SEQ ID NO: 2753327 - DNA, 17 bp, Homo sapiens
atttgtaatatatcctg

SEQ ID NO: 2753328 - DNA, 18 bp, Homo sapiens
atttgtagtgttggagaa

SEQ ID NO: 2753329 - DNA, 22 bp, Homo sapiens
atttgtagtgttggagaagaac

SEQ ID NO: 2753330 - DNA, 14 bp, Homo sapiens
attttcattctgaa

SEQ ID NO: 2753331 - DNA, 15 bp, Homo sapiens
attttcattctgaat

SEQ ID NO: 2753332 - DNA, 18 bp, Homo sapiens
attttcattctgaatctg

SEQ ID NO: 2753333 - DNA, 13 bp, Homo sapiens
attttcctgaaaa

SEQ ID NO: 2753334 - DNA, 16 bp, Homo sapiens
attttctctaaactgt

SEQ ID NO: 2753335 - DNA, 20 bp, Homo sapiens
attttgaaaggtcagaattt

SEQ ID NO: 2753336 - DNA, 23 bp, Homo sapiens
attttgaaaggtcagaattttgt

SEQ ID NO: 2753337 - DNA, 16 bp, Homo sapiens
attttgaatgtacctc

SEQ ID NO: 2753338 - DNA, 15 bp, Homo sapiens
attttgtaaatctgt

SEQ ID NO: 2753339 - DNA, 16 bp, Homo sapiens
attttgtaaatctgta

SEQ ID NO: 2753340 - DNA, 19 bp, Homo sapiens
attttgtaaatctgtactt

SEQ ID NO: 2753341 - DNA, 18 bp, Homo sapiens
atttttatattagttgct

SEQ ID NO: 2753342 - DNA, 16 bp, Homo sapiens
atttttcagtagcagg

SEQ ID NO: 2753343 - DNA, 12 bp, Homo sapiens
atttttgaattc

SEQ ID NO: 2753344 - DNA, 15 bp, Homo sapiens
atttttgaattcttt

SEQ ID NO: 2753345 - DNA, 16 bp, Homo sapiens
atttttgaattcttta

SEQ ID NO: 2753346 - DNA, 18 bp, Homo sapiens
atttttgtattttgtaca

SEQ ID NO: 2753347 - DNA, 14 bp, Homo sapiens
attttttaaaaatt

SEQ ID NO: 2753348 - DNA, 15 bp, Homo sapiens
attttttaaaaattg

SEQ ID NO: 2753349 - DNA, 21 bp, Homo sapiens
attttttaaaagagacaaact

SEQ ID NO: 2753350 - DNA, 13 bp, Homo sapiens
attttttaaagaa

SEQ ID NO: 2753351 - DNA, 14 bp, Homo sapiens
attttttaaagaat

SEQ ID NO: 2753352 - DNA, 16 bp, Homo sapiens
attttttaaagaatcc

SEQ ID NO: 2753353 - DNA, 17 bp, Homo sapiens
attttttaaagaatcca

SEQ ID NO: 2753354 - DNA, 18 bp, Homo sapiens
attttttaaagaatccaa

SEQ ID NO: 2753355 - DNA, 13 bp, Homo sapiens
attttttcatttc

SEQ ID NO: 2753356 - DNA, 14 bp, Homo sapiens
attttttcatttca

SEQ ID NO: 2753357 - DNA, 14 bp, Homo sapiens
attttttgattaat

SEQ ID NO: 2753358 - DNA, 21 bp, Homo sapiens
atttttttccaagtgtataat

SEQ ID NO: 2753359 - DNA, 17 bp, Homo sapiens
atttttttgtcattaaa

SEQ ID NO: 2753360 - DNA, 19 bp, Homo sapiens
atttttttgtcattaaaat

SEQ ID NO: 2753361 - DNA, 23 bp, Homo sapiens
attttttttgtacatttggaaca

SEQ ID NO: 2753362 - DNA, 15 bp, Homo sapiens
caaaaagatgcttta

SEQ ID NO: 2753363 - DNA, 20 bp, Homo sapiens
caaaactatcctatgccttc

SEQ ID NO: 2753364 - DNA, 14 bp, Homo sapiens
caaaagcaaaattt

SEQ ID NO: 2753365 - DNA, 17 bp, Homo sapiens
caaaagcaaaattttta

SEQ ID NO: 2753366 - DNA, 18 bp, Homo sapiens
caaaagcaaaatttttaa

SEQ ID NO: 2753367 - DNA, 15 bp, Homo sapiens
caaaagcttgtgtat

SEQ ID NO: 2753368 - DNA, 16 bp, Homo sapiens
caaaagttgtttaata

SEQ ID NO: 2753369 - DNA, 21 bp, Homo sapiens
caaaagttgtttaataagtat

SEQ ID NO: 2753370 - DNA, 12 bp, Homo sapiens
caaaatttttaa

SEQ ID NO: 2753371 - DNA, 21 bp, Homo sapiens
caaaattttttctctaggaaa

SEQ ID NO: 2753372 - DNA, 22 bp, Homo sapiens
caaaattttttctctaggaaat

SEQ ID NO: 2753373 - DNA, 20 bp, Homo sapiens
caaacctgctggtggggcag

SEQ ID NO: 2753374 - DNA, 13 bp, Homo sapiens
caaactaaacttt

SEQ ID NO: 2753375 - DNA, 21 bp, Homo sapiens
caaactgactcttaagaagac

SEQ ID NO: 2753376 - DNA, 21 bp, Homo sapiens
caaactgtaaaaaatgtgtgt

SEQ ID NO: 2753377 - DNA, 13 bp, Homo sapiens
caaactttgtgta

SEQ ID NO: 2753378 - DNA, 14 bp, Homo sapiens
caaagtaaaaataa

SEQ ID NO: 2753379 - DNA, 19 bp, Homo sapiens
caaagtcttgatagcaagc

SEQ ID NO: 2753380 - DNA, 20 bp, Homo sapiens
caaagttcacattaactcag

SEQ ID NO: 2753381 - DNA, 12 bp, Homo sapiens
caaatactgatt

SEQ ID NO: 2753382 - DNA, 17 bp, Homo sapiens
caaatactgattttcaa

SEQ ID NO: 2753383 - DNA, 20 bp, Homo sapiens
caaatactgattttcaaaaa

SEQ ID NO: 2753384 - DNA, 15 bp, Homo sapiens
caaatagtatagaaa

SEQ ID NO: 2753385 - DNA, 15 bp, Homo sapiens
caaatccgaaatcag

SEQ ID NO: 2753386 - DNA, 18 bp, Homo sapiens
caaattgtgcaaaatatt

SEQ ID NO: 2753387 - DNA, 15 bp, Homo sapiens
caaattgtgtgaaag

SEQ ID NO: 2753388 - DNA, 17 bp, Homo sapiens
caaattttttaaaagag

SEQ ID NO: 2753389 - DNA, 13 bp, Homo sapiens
caacataataaga

SEQ ID NO: 2753390 - DNA, 22 bp, Homo sapiens
caaccctgttgagtatttgctg

SEQ ID NO: 2753391 - DNA, 18 bp, Homo sapiens
caacgactactttgctac

SEQ ID NO: 2753392 - DNA, 19 bp, Homo sapiens
caactatattgtttgctaa

SEQ ID NO: 2753393 - DNA, 11 bp, Homo sapiens
caagagaaggg

SEQ ID NO: 2753394 - DNA, 12 bp, Homo sapiens
caagagaagggc

SEQ ID NO: 2753395 - DNA, 15 bp, Homo sapiens
caagagaagggctta

SEQ ID NO: 2753396 - DNA, 22 bp, Homo sapiens
caagagaaggggacttctcttc

SEQ ID NO: 2753397 - DNA, 17 bp, Homo sapiens
caagagactttgtcact

SEQ ID NO: 2753398 - DNA, 19 bp, Homo sapiens
caagattttttaattgttt

SEQ ID NO: 2753399 - DNA, 16 bp, Homo sapiens
caagcatttagatgta

SEQ ID NO: 2753400 - DNA, 19 bp, Homo sapiens
caagcatttagatgtatag

SEQ ID NO: 2753401 - DNA, 21 bp, Homo sapiens
caagccagattttcctgaaaa

SEQ ID NO: 2753402 - DNA, 18 bp, Homo sapiens
caaggaagtcttcaaatt

SEQ ID NO: 2753403 - DNA, 18 bp, Homo sapiens
caaggattttttaaaaat

SEQ ID NO: 2753404 - DNA, 14 bp, Homo sapiens
caagtaaattctgt

SEQ ID NO: 2753405 - DNA, 16 bp, Homo sapiens
caagtaaattctgttg

SEQ ID NO: 2753406 - DNA, 18 bp, Homo sapiens
caagtaaattctgttgaa

SEQ ID NO: 2753407 - DNA, 13 bp, Homo sapiens
caagtcagtttct

SEQ ID NO: 2753408 - DNA, 16 bp, Homo sapiens
caagtcagtttctaca

SEQ ID NO: 2753409 - DNA, 16 bp, Homo sapiens
caagtgtataatgttg

SEQ ID NO: 2753410 - DNA, 12 bp, Homo sapiens
caagtgtgtggc

SEQ ID NO: 2753411 - DNA, 21 bp, Homo sapiens
caataaaaatcaggagcctgc

SEQ ID NO: 2753412 - DNA, 20 bp, Homo sapiens
caataaaatccatacatttg

SEQ ID NO: 2753413 - DNA, 17 bp, Homo sapiens
caataaaattatttgca

SEQ ID NO: 2753414 - DNA, 19 bp, Homo sapiens
caataaaattatttgcagg

SEQ ID NO: 2753415 - DNA, 14 bp, Homo sapiens
caataaatgttgaa

SEQ ID NO: 2753416 - DNA, 19 bp, Homo sapiens
caataaatgttgaaaagtc

SEQ ID NO: 2753417 - DNA, 16 bp, Homo sapiens
caataataattaaaga

SEQ ID NO: 2753418 - DNA, 23 bp, Homo sapiens
caatacatcccttacctgggaaa

SEQ ID NO: 2753419 - DNA, 22 bp, Homo sapiens
caataccctgtctttaaaaata

SEQ ID NO: 2753420 - DNA, 19 bp, Homo sapiens
caatagtcaaattgtgtga

SEQ ID NO: 2753421 - DNA, 21 bp, Homo sapiens
caatagtgtcctatgcaataa

SEQ ID NO: 2753422 - DNA, 22 bp, Homo sapiens
caatagtgtcctatgcaataaa

SEQ ID NO: 2753423 - DNA, 20 bp, Homo sapiens
caatatttcagataatcaca

SEQ ID NO: 2753424 - DNA, 21 bp, Homo sapiens
caatatttcagataatcacaa

SEQ ID NO: 2753425 - DNA, 18 bp, Homo sapiens
caatgcatatctgtttat

SEQ ID NO: 2753426 - DNA, 20 bp, Homo sapiens
caatgccgcctgtcaataaa

SEQ ID NO: 2753427 - DNA, 22 bp, Homo sapiens
caatgccgcctgtcaataaatg

SEQ ID NO: 2753428 - DNA, 23 bp, Homo sapiens
caatgccgcctgtcaataaatgt

SEQ ID NO: 2753429 - DNA, 14 bp, Homo sapiens
caatgctgtatttt

SEQ ID NO: 2753430 - DNA, 22 bp, Homo sapiens
caatttcaaaagaacattctta

SEQ ID NO: 2753431 - DNA, 22 bp, Homo sapiens
cacaaaatagcacatccaccaa

SEQ ID NO: 2753432 - DNA, 21 bp, Homo sapiens
cacaagtgtgtggccccgccc

SEQ ID NO: 2753433 - DNA, 16 bp, Homo sapiens
cacaccacaattctcc

SEQ ID NO: 2753434 - DNA, 18 bp, Homo sapiens
cacaccacaattctccct

SEQ ID NO: 2753435 - DNA, 13 bp, Homo sapiens
cacactgaagaag

SEQ ID NO: 2753436 - DNA, 22 bp, Homo sapiens
cacaggttttaaggattctgca

SEQ ID NO: 2753437 - DNA, 23 bp, Homo sapiens
cacaggttttaaggattctgcag

SEQ ID NO: 2753438 - DNA, 23 bp, Homo sapiens
cacagtattgtagaaagctaata

SEQ ID NO: 2753439 - DNA, 20 bp, Homo sapiens
cacagttggcacttctgcca

SEQ ID NO: 2753440 - DNA, 19 bp, Homo sapiens
cacatccaccaaactcctg

SEQ ID NO: 2753441 - DNA, 20 bp, Homo sapiens
cacatccaccaaactcctgc

SEQ ID NO: 2753442 - DNA, 12 bp, Homo sapiens
ccaaactcctgc

SEQ ID NO: 2753443 - DNA, 22 bp, Homo sapiens
ccaaactgactcttaagaagac

SEQ ID NO: 2753444 - DNA, 13 bp, Homo sapiens
ccaaagtcttgat

SEQ ID NO: 2753445 - DNA, 18 bp, Homo sapiens
ccaactttattttgaatg

SEQ ID NO: 2753446 - DNA, 19 bp, Homo sapiens
ccaagacaaactaaacttt

SEQ ID NO: 2753447 - DNA, 19 bp, Homo sapiens
ccaagccttggctctaccc

SEQ ID NO: 2753448 - DNA, 16 bp, Homo sapiens
ccaataaaaatcagga

SEQ ID NO: 2753449 - DNA, 19 bp, Homo sapiens
ccaataaaaatcaggagcc

SEQ ID NO: 2753450 - DNA, 20 bp, Homo sapiens
ccaataaaaatcaggagcct

SEQ ID NO: 2753451 - DNA, 20 bp, Homo sapiens
ccaatcttgttttaagcaaa

SEQ ID NO: 2753452 - DNA, 21 bp, Homo sapiens
ccaatcttgttttaagcaaat

SEQ ID NO: 2753453 - DNA, 21 bp, Homo sapiens
ccacaaaagcaaaatttttaa

SEQ ID NO: 2753454 - DNA, 15 bp, Homo sapiens
ccacatcttgaaaat

SEQ ID NO: 2753455 - DNA, 19 bp, Homo sapiens
ccacatcttgaaaatgcca

SEQ ID NO: 2753456 - DNA, 15 bp, Homo sapiens
ccaccggcactcatg

SEQ ID NO: 2753457 - DNA, 16 bp, Homo sapiens
ccaccggcactcatga

SEQ ID NO: 2753458 - DNA, 18 bp, Homo sapiens
ccaccggcactcatgacg

SEQ ID NO: 2753459 - DNA, 23 bp, Homo sapiens
ccaccggcactcatgacggcctg

SEQ ID NO: 2753460 - DNA, 20 bp, Homo sapiens
ccaccgggcatgtctgcctg

SEQ ID NO: 2753461 - DNA, 16 bp, Homo sapiens
ccactggtaacatgtg

SEQ ID NO: 2753462 - DNA, 17 bp, Homo sapiens
ccagaagagtcaaagta

SEQ ID NO: 2753463 - DNA, 14 bp, Homo sapiens
ccagacttcaagat

SEQ ID NO: 2753464 - DNA, 17 bp, Homo sapiens
ccagacttcaagatcct

SEQ ID NO: 2753465 - DNA, 14 bp, Homo sapiens
gttttgggaaaaat

SEQ ID NO: 2753466 - DNA, 21 bp, Homo sapiens
gtttttaaaaacctattttga

SEQ ID NO: 2753467 - DNA, 21 bp, Homo sapiens
gtttttaactctactgtgtaa

SEQ ID NO: 2753468 - DNA, 16 bp, Homo sapiens
gtttttataaaaacat

SEQ ID NO: 2753469 - DNA, 23 bp, Homo sapiens
gtttttataaaaacattgaaata

SEQ ID NO: 2753470 - DNA, 23 bp, Homo sapiens
gtttttttttaaaaaagaaacat

SEQ ID NO: 2753471 - DNA, 17 bp, Homo sapiens
gttttttttttgtttgt

SEQ ID NO: 2753472 - DNA, 21 bp, Homo sapiens
taaaaaaataattgagactga

SEQ ID NO: 2753473 - DNA, 11 bp, Homo sapiens
taaaaaagata

SEQ ID NO: 2753474 - DNA, 13 bp, Homo sapiens
taaaaaagataaa

SEQ ID NO: 2753475 - DNA, 17 bp, Homo sapiens
taaaaacattgaaatat

SEQ ID NO: 2753476 - DNA, 16 bp, Homo sapiens
taaaaaccgaataaat

SEQ ID NO: 2753477 - DNA, 20 bp, Homo sapiens
taaaaaccgaataaatgttt

SEQ ID NO: 2753478 - DNA, 19 bp, Homo sapiens
taaaaacctattttgaaag

SEQ ID NO: 2753479 - DNA, 21 bp, Homo sapiens
taaaaacctattttgaaaggt

SEQ ID NO: 2753480 - DNA, 21 bp, Homo sapiens
taaaaacttttttctttgaaa

SEQ ID NO: 2753481 - DNA, 23 bp, Homo sapiens
taaaaagaaaaaaaaagaattac

SEQ ID NO: 2753482 - DNA, 19 bp, Homo sapiens
taaaaagtgagaaagaaag

SEQ ID NO: 2753483 - DNA, 14 bp, Homo sapiens
taaaaataaaagct

SEQ ID NO: 2753484 - DNA, 15 bp, Homo sapiens
taaaaataaaagcta

SEQ ID NO: 2753485 - DNA, 15 bp, Homo sapiens
taaaaatcaggagcc

SEQ ID NO: 2753486 - DNA, 17 bp, Homo sapiens
taaaaatcaggagcctg

SEQ ID NO: 2753487 - DNA, 16 bp, Homo sapiens
taaaaattggcatttt

SEQ ID NO: 2753488 - DNA, 17 bp, Homo sapiens
taaaaattggcatttta

SEQ ID NO: 2753489 - DNA, 12 bp, Homo sapiens
taaaacagctat

SEQ ID NO: 2753490 - DNA, 19 bp, Homo sapiens
taaaacagctattttagta

SEQ ID NO: 2753491 - DNA, 19 bp, Homo sapiens
taaaactgcatttttaatc

SEQ ID NO: 2753492 - DNA, 22 bp, Homo sapiens
taaaactgcatttttaatcagt

SEQ ID NO: 2753493 - DNA, 13 bp, Homo sapiens
taaaactgtacct

SEQ ID NO: 2753494 - DNA, 14 bp, Homo sapiens
taaaactgtacctt

SEQ ID NO: 2753495 - DNA, 16 bp, Homo sapiens
taaaagatcttgcaga

SEQ ID NO: 2753496 - DNA, 15 bp, Homo sapiens
taaaagattctttaa

SEQ ID NO: 2753497 - DNA, 19 bp, Homo sapiens
taaaagattctttaaacta

SEQ ID NO: 2753498 - DNA, 21 bp, Homo sapiens
taaaagctattacttggcaaa

SEQ ID NO: 2753499 - DNA, 18 bp, Homo sapiens
taaaagggtcaaacctgt

SEQ ID NO: 2753500 - DNA, 20 bp, Homo sapiens
taaaagggtcaaacctgtag

SEQ ID NO: 2753501 - DNA, 18 bp, Homo sapiens
taaaatgcaatatttgta

SEQ ID NO: 2753502 - DNA, 14 bp, Homo sapiens
taaaattatttgca

SEQ ID NO: 2753503 - DNA, 15 bp, Homo sapiens
taaaatttaaaaaac

SEQ ID NO: 2753504 - DNA, 17 bp, Homo sapiens
taaaattttcattctga

SEQ ID NO: 2753505 - DNA, 16 bp, Homo sapiens
taaaccacaaaagttg

SEQ ID NO: 2753506 - DNA, 14 bp, Homo sapiens
taaagaatgaaagt

SEQ ID NO: 2753507 - DNA, 17 bp, Homo sapiens
taaagaatgctgcaact

SEQ ID NO: 2753508 - DNA, 16 bp, Homo sapiens
taaagctgttaaaata

SEQ ID NO: 2753509 - DNA, 17 bp, Homo sapiens
taaagctgttaaaatac

SEQ ID NO: 2753510 - DNA, 13 bp, Homo sapiens
taaagtaaaatat

SEQ ID NO: 2753511 - DNA, 23 bp, Homo sapiens
taaagtcctgaacctttcaaaat

SEQ ID NO: 2753512 - DNA, 13 bp, Homo sapiens
taaatacaaatct

SEQ ID NO: 2753513 - DNA, 17 bp, Homo sapiens
taaatcacactcaaact

SEQ ID NO: 2753514 - DNA, 17 bp, Homo sapiens
taaatcagaataaatta

SEQ ID NO: 2753515 - DNA, 17 bp, Homo sapiens
taaatcattttaggaaa

SEQ ID NO: 2753516 - DNA, 20 bp, Homo sapiens
taaatcattttaggaaagga

SEQ ID NO: 2753517 - DNA, 22 bp, Homo sapiens
taaatctccagcttactataaa

SEQ ID NO: 2753518 - DNA, 13 bp, Homo sapiens
taaatctgtactt

SEQ ID NO: 2753519 - DNA, 22 bp, Homo sapiens
taaatgatatctatattctaaa

SEQ ID NO: 2753520 - DNA, 20 bp, Homo sapiens
taaatggcttcctggcaata

SEQ ID NO: 2753521 - DNA, 18 bp, Homo sapiens
taaatgtctattattatg

SEQ ID NO: 2753522 - DNA, 17 bp, Homo sapiens
taaatgttagttctagc

SEQ ID NO: 2753523 - DNA, 12 bp, Homo sapiens
taaatgttgaaa

SEQ ID NO: 2753524 - DNA, 11 bp, Homo sapiens
taaattctttt

SEQ ID NO: 2753525 - DNA, 19 bp, Homo sapiens
taaattggagaaaagcact

SEQ ID NO: 2753526 - DNA, 21 bp, Homo sapiens
taaatttaaaacacagtattg

SEQ ID NO: 2753527 - DNA, 13 bp, Homo sapiens
taaatttatgtga

SEQ ID NO: 2753528 - DNA, 14 bp, Homo sapiens
taaatttgtaatat

SEQ ID NO: 2753529 - DNA, 17 bp, Homo sapiens
taaattttctctaaact

SEQ ID NO: 2753530 - DNA, 15 bp, Homo sapiens
taaatttttgtcttt

SEQ ID NO: 2753531 - DNA, 15 bp, Homo sapiens
taacaatgctgtatt

SEQ ID NO: 2753532 - DNA, 17 bp, Homo sapiens
taacaatgctgtatttt

SEQ ID NO: 2753533 - DNA, 19 bp, Homo sapiens
taacaatgctgtattttaa

SEQ ID NO: 2753534 - DNA, 20 bp, Homo sapiens
taacattcctaaaatgcttc

SEQ ID NO: 2753535 - DNA, 14 bp, Homo sapiens
taactcaggcattt

SEQ ID NO: 2753536 - DNA, 16 bp, Homo sapiens
taacttcagtgcaaga

SEQ ID NO: 2753537 - DNA, 21 bp, Homo sapiens
taagaaaatatcacttgtcaa

SEQ ID NO: 2753538 - DNA, 18 bp, Homo sapiens
taagacttttctctactt

SEQ ID NO: 2753539 - DNA, 23 bp, Homo sapiens
taagagagaatgagagacacact

SEQ ID NO: 2753540 - DNA, 12 bp, Homo sapiens
taagcaaatgca

SEQ ID NO: 2753541 - DNA, 13 bp, Homo sapiens
taagcggaataaa

SEQ ID NO: 2753542 - DNA, 13 bp, Homo sapiens
taaggaaaagtaa

SEQ ID NO: 2753543 - DNA, 14 bp, Homo sapiens
taaggaacaatgcc

SEQ ID NO: 2753544 - DNA, 17 bp, Homo sapiens
taaggaacaatgccgcc

SEQ ID NO: 2753545 - DNA, 22 bp, Homo sapiens
taaggaacaatgccgcctgtca

SEQ ID NO: 2753546 - DNA, 15 bp, Homo sapiens
taaggccagccattt

SEQ ID NO: 2753547 - DNA, 15 bp, Homo sapiens
taagggaaaaagttg

SEQ ID NO: 2753548 - DNA, 20 bp, Homo sapiens
taagtaatgataactggaaa

SEQ ID NO: 2753549 - DNA, 15 bp, Homo sapiens
taagtatatcttaag

SEQ ID NO: 2753550 - DNA, 22 bp, Homo sapiens
taagtgccaggatggaatgatg

SEQ ID NO: 2753551 - DNA, 16 bp, Homo sapiens
taagtgtcaagtcctg

SEQ ID NO: 2753552 - DNA, 17 bp, Homo sapiens
taagtgtcaagtcctga

SEQ ID NO: 2753553 - DNA, 13 bp, Homo sapiens
taagtgtttaaaa

SEQ ID NO: 2753554 - DNA, 13 bp, Homo sapiens
taagttattgctg

SEQ ID NO: 2753555 - DNA, 21 bp, Homo sapiens
taagttgtattattagactct

SEQ ID NO: 2753556 - DNA, 18 bp, Homo sapiens
taagtttttttttaaaaa

SEQ ID NO: 2753557 - DNA, 23 bp, Homo sapiens
taataagtatatcttaagaatgt

SEQ ID NO: 2753558 - DNA, 13 bp, Homo sapiens
taatacaaaacta

SEQ ID NO: 2753559 - DNA, 12 bp, Homo sapiens
taatatatcctg

SEQ ID NO: 2753560 - DNA, 14 bp, Homo sapiens
taatatatcctgtt

SEQ ID NO: 2753561 - DNA, 21 bp, Homo sapiens
taatatatcctgtttgtattt

SEQ ID NO: 2753562 - DNA, 18 bp, Homo sapiens
taatattgtattgctgct

SEQ ID NO: 2753563 - DNA, 17 bp, Homo sapiens
taatcagagtatctgaa

SEQ ID NO: 2753564 - DNA, 15 bp, Homo sapiens
taatctccaacttta

SEQ ID NO: 2753565 - DNA, 18 bp, Homo sapiens
taatctccaactttattt

SEQ ID NO: 2753566 - DNA, 22 bp, Homo sapiens
taatctccaactttattttgaa

SEQ ID NO: 2753567 - DNA, 14 bp, Homo sapiens
taatctcctgagtt

SEQ ID NO: 2753568 - DNA, 23 bp, Homo sapiens
taatctttttcatcattgttgtg

SEQ ID NO: 2753569 - DNA, 19 bp, Homo sapiens
taatgcaatgcatatctgt

SEQ ID NO: 2753570 - DNA, 13 bp, Homo sapiens
taatgccagggcc

SEQ ID NO: 2753571 - DNA, 18 bp, Homo sapiens
taatgtactttttattgc

SEQ ID NO: 2753572 - DNA, 15 bp, Homo sapiens
taatgtagttactgt

SEQ ID NO: 2753573 - DNA, 16 bp, Homo sapiens
taatgttggtgtggag

SEQ ID NO: 2753574 - DNA, 22 bp, Homo sapiens
taatgttggtgtggagttttca

SEQ ID NO: 2753575 - DNA, 18 bp, Homo sapiens
taattaggataactaaaa

SEQ ID NO: 2753576 - DNA, 20 bp, Homo sapiens
taattaggataactaaaatt

SEQ ID NO: 2753577 - DNA, 21 bp, Homo sapiens
taattaggataactaaaattc

SEQ ID NO: 2753578 - DNA, 15 bp, Homo sapiens
taattccttaaaatt

SEQ ID NO: 2753579 - DNA, 17 bp, Homo sapiens
taattctaaacttagaa

SEQ ID NO: 2753580 - DNA, 18 bp, Homo sapiens
taattctaaacttagaaa

SEQ ID NO: 2753581 - DNA, 22 bp, Homo sapiens
taattggaaaggcagctctaaa

SEQ ID NO: 2753582 - DNA, 23 bp, Homo sapiens
taatttgtagtgttggagaagaa

SEQ ID NO: 2753583 - DNA, 13 bp, Homo sapiens
taattttgtgaag

SEQ ID NO: 2753584 - DNA, 13 bp, Homo sapiens
taatttttccttc

SEQ ID NO: 2753585 - DNA, 15 bp, Homo sapiens
taattttttaaagaa

SEQ ID NO: 2753586 - DNA, 19 bp, Homo sapiens
taattttttaaagaatcca

SEQ ID NO: 2753587 - DNA, 22 bp, Homo sapiens
taattttttttgtacatttgga

SEQ ID NO: 2753588 - DNA, 17 bp, Homo sapiens
tacaaaagcttgtgtat

SEQ ID NO: 2753589 - DNA, 19 bp, Homo sapiens
tacaaaagcttgtgtatct

SEQ ID NO: 2753590 - DNA, 14 bp, Homo sapiens
tacaaacatttcac

SEQ ID NO: 2753591 - DNA, 12 bp, Homo sapiens
tacaaatctgta

SEQ ID NO: 2753592 - DNA, 20 bp, Homo sapiens
tacaagtaaattctgttgaa

SEQ ID NO: 2753593 - DNA, 18 bp, Homo sapiens
tacaagtcagtttctaca

SEQ ID NO: 2753594 - DNA, 23 bp, Homo sapiens
tacaatatatagctggcaagaat

SEQ ID NO: 2753595 - DNA, 20 bp, Homo sapiens
tacaatttcaaaagaacatt

SEQ ID NO: 2753596 - DNA, 13 bp, Homo sapiens
tacacatttcatc

SEQ ID NO: 2753597 - DNA, 15 bp, Homo sapiens
tacacatttcatcta

SEQ ID NO: 2753598 - DNA, 18 bp, Homo sapiens
tacacatttcatctaatt

SEQ ID NO: 2753599 - DNA, 14 bp, Homo sapiens
tacacattttgtaa

SEQ ID NO: 2753600 - DNA, 22 bp, Homo sapiens
tacacattttgtaaatctgtac

SEQ ID NO: 2753601 - DNA, 20 bp, Homo sapiens
tacacctcagaaattgaaag

SEQ ID NO: 2753602 - DNA, 19 bp, Homo sapiens
tacactaagagagaatgag

SEQ ID NO: 2753603 - DNA, 15 bp, Homo sapiens
tacagtatttacagt

SEQ ID NO: 2753604 - DNA, 23 bp, Homo sapiens
tacagtttcttcatgcattactt

SEQ ID NO: 2753605 - DNA, 22 bp, Homo sapiens
tacatctgtgcagggctggttt

SEQ ID NO: 2753606 - DNA, 14 bp, Homo sapiens
tacatgtaaagctg

SEQ ID NO: 2753607 - DNA, 19 bp, Homo sapiens
tacatgtaaagctgttaaa

SEQ ID NO: 2753608 - DNA, 23 bp, Homo sapiens
tacatgtaaagctgttaaaatac

SEQ ID NO: 2753609 - DNA, 20 bp, Homo sapiens
tacattaggaagctgaatta

SEQ ID NO: 2753610 - DNA, 12 bp, Homo sapiens
tacatttggaac

SEQ ID NO: 2753611 - DNA, 14 bp, Homo sapiens
taccaagagaaggg

SEQ ID NO: 2753612 - DNA, 18 bp, Homo sapiens
taccacaaaagcaaaatt

SEQ ID NO: 2753613 - DNA, 14 bp, Homo sapiens
taccagacttcaag

SEQ ID NO: 2753614 - DNA, 15 bp, Homo sapiens
taccagacttcaaga

SEQ ID NO: 2753615 - DNA, 18 bp, Homo sapiens
taccaggaccagtttatg

SEQ ID NO: 2753616 - DNA, 14 bp, Homo sapiens
taccatttgatctg

SEQ ID NO: 2753617 - DNA, 14 bp, Homo sapiens
taccttgtgggaat

SEQ ID NO: 2753618 - DNA, 15 bp, Homo sapiens
taccttgtgggaata

SEQ ID NO: 2753619 - DNA, 15 bp, Homo sapiens
tactgattttcaaaa

SEQ ID NO: 2753620 - DNA, 16 bp, Homo sapiens
tactgattttcaaaaa

SEQ ID NO: 2753621 - DNA, 18 bp, Homo sapiens
tactgcatcttagtttac

SEQ ID NO: 2753622 - DNA, 19 bp, Homo sapiens
tactgcatcttagtttact

SEQ ID NO: 2753623 - DNA, 18 bp, Homo sapiens
tactggataaatttaaaa

SEQ ID NO: 2753624 - DNA, 14 bp, Homo sapiens
tactggtctgtact

SEQ ID NO: 2753625 - DNA, 19 bp, Homo sapiens
tacttcaaatccttgaaga

SEQ ID NO: 2753626 - DNA, 22 bp, Homo sapiens
tacttgcagctcccattctatg

SEQ ID NO: 2753627 - DNA, 16 bp, Homo sapiens
tacttggcaaattctg

SEQ ID NO: 2753628 - DNA, 13 bp, Homo sapiens
tacttttttcaaa

SEQ ID NO: 2753629 - DNA, 19 bp, Homo sapiens
tacttttttcaaatattga

SEQ ID NO: 2753630 - DNA, 13 bp, Homo sapiens
tagaaaatggaaa

SEQ ID NO: 2753631 - DNA, 22 bp, Homo sapiens
tagaaaatggaaaatatacaag

SEQ ID NO: 2753632 - DNA, 12 bp, Homo sapiens
tagaaattctaa

SEQ ID NO: 2753633 - DNA, 17 bp, Homo sapiens
tagaaattctgaatttt

SEQ ID NO: 2753634 - DNA, 18 bp, Homo sapiens
tagaataaaagctgtgga

SEQ ID NO: 2753635 - DNA, 18 bp, Homo sapiens
tagacaaggttgctgttg

SEQ ID NO: 2753636 - DNA, 13 bp, Homo sapiens
tagacacacatga

SEQ ID NO: 2753637 - DNA, 21 bp, Homo sapiens
tagacatttgctatgagctgg

SEQ ID NO: 2753638 - DNA, 16 bp, Homo sapiens
tagactctctagtttt

SEQ ID NO: 2753639 - DNA, 15 bp, Homo sapiens
tagaggttaatcaga

SEQ ID NO: 2753640 - DNA, 13 bp, Homo sapiens
tagagttaaaagt

SEQ ID NO: 2753641 - DNA, 15 bp, Homo sapiens
tagagttaaaagtta

SEQ ID NO: 2753642 - DNA, 17 bp, Homo sapiens
tagagtttagctggaaa

SEQ ID NO: 2753643 - DNA, 14 bp, Homo sapiens
tagataggccatgg

SEQ ID NO: 2753644 - DNA, 21 bp, Homo sapiens
tagatattgtcctaagtgtca

SEQ ID NO: 2753645 - DNA, 19 bp, Homo sapiens
tagatgcagaaaaagaaaa

SEQ ID NO: 2753646 - DNA, 19 bp, Homo sapiens
tagatgcagttctgaagaa

SEQ ID NO: 2753647 - DNA, 21 bp, Homo sapiens
tagatgcagttctgaagaaga

SEQ ID NO: 2753648 - DNA, 17 bp, Homo sapiens
tagatgtttatttagaa

SEQ ID NO: 2753649 - DNA, 16 bp, Homo sapiens
tagatttttaaattgg

SEQ ID NO: 2753650 - DNA, 19 bp, Homo sapiens
tagatttttaaattggaga

SEQ ID NO: 2753651 - DNA, 19 bp, Homo sapiens
tagcaatgggatataatac

SEQ ID NO: 2753652 - DNA, 18 bp, Homo sapiens
tagcctagatatgaatat

SEQ ID NO: 2753653 - DNA, 19 bp, Homo sapiens
tagcctctttgtgtttttg

SEQ ID NO: 2753654 - DNA, 13 bp, Homo sapiens
tagctagaatcca

SEQ ID NO: 2753655 - DNA, 23 bp, Homo sapiens
tagctgcactgtttatggaaata

SEQ ID NO: 2753656 - DNA, 17 bp, Homo sapiens
taggataactaaaattc

SEQ ID NO: 2753657 - DNA, 13 bp, Homo sapiens
tagtcaaattgtg

SEQ ID NO: 2753658 - DNA, 18 bp, Homo sapiens
tagtcaaattgtgtgaaa

SEQ ID NO: 2753659 - DNA, 22 bp, Homo sapiens
tagtgagcagtcaggaaagaga

SEQ ID NO: 2753660 - DNA, 15 bp, Homo sapiens
tagtgcaaattgtca

SEQ ID NO: 2753661 - DNA, 14 bp, Homo sapiens
tagtgtcctatgca

SEQ ID NO: 2753662 - DNA, 16 bp, Homo sapiens
tagtgttggagaagaa

SEQ ID NO: 2753663 - DNA, 17 bp, Homo sapiens
tagtgttggagaagaac

SEQ ID NO: 2753664 - DNA, 12 bp, Homo sapiens
tagttagttttg

SEQ ID NO: 2753665 - DNA, 19 bp, Homo sapiens
tagttctgttaaatatttt

SEQ ID NO: 2753666 - DNA, 13 bp, Homo sapiens
tagttgaaagtaa

SEQ ID NO: 2753667 - DNA, 17 bp, Homo sapiens
tagttgaaagtaaaaaa

SEQ ID NO: 2753668 - DNA, 21 bp, Homo sapiens
tagttgcattggtttgagaaa

SEQ ID NO: 2753669 - DNA, 14 bp, Homo sapiens
tagttgctttgtta

SEQ ID NO: 2753670 - DNA, 15 bp, Homo sapiens
tagttttatcttaaa

SEQ ID NO: 2753671 - DNA, 22 bp, Homo sapiens
tataaaaacattgaaatattag

SEQ ID NO: 2753672 - DNA, 23 bp, Homo sapiens
tataaagaatgaaagtagctgta

SEQ ID NO: 2753673 - DNA, 18 bp, Homo sapiens
tataaatacaaatctgta

SEQ ID NO: 2753674 - DNA, 20 bp, Homo sapiens
tataaatacaaatctgtata

SEQ ID NO: 2753675 - DNA, 22 bp, Homo sapiens
tataaatgtctattattatgaa

SEQ ID NO: 2753676 - DNA, 18 bp, Homo sapiens
tataacaatgctgtattt

SEQ ID NO: 2753677 - DNA, 14 bp, Homo sapiens
tataacattctgac

SEQ ID NO: 2753678 - DNA, 16 bp, Homo sapiens
tataacttcaaatttt

SEQ ID NO: 2753679 - DNA, 21 bp, Homo sapiens
tataagttgtattattagact

SEQ ID NO: 2753680 - DNA, 19 bp, Homo sapiens
tataattccttaaaatttt

SEQ ID NO: 2753681 - DNA, 23 bp, Homo sapiens
tataatttacctctcattagaaa

SEQ ID NO: 2753682 - DNA, 18 bp, Homo sapiens
tatacaagtaaattctgt

SEQ ID NO: 2753683 - DNA, 18 bp, Homo sapiens
tatacacattttgtaaat

SEQ ID NO: 2753684 - DNA, 21 bp, Homo sapiens
tatatagttagctttattgaa

SEQ ID NO: 2753685 - DNA, 17 bp, Homo sapiens
tatatatcctatttgat

SEQ ID NO: 2753686 - DNA, 15 bp, Homo sapiens
tatatcctatttgat

SEQ ID NO: 2753687 - DNA, 23 bp, Homo sapiens
tatatcttaagaatgtgctagag

SEQ ID NO: 2753688 - DNA, 15 bp, Homo sapiens
tatattgtttgctaa

SEQ ID NO: 2753689 - DNA, 13 bp, Homo sapiens
tatatttgaaata

SEQ ID NO: 2753690 - DNA, 14 bp, Homo sapiens
tatatttgaaatat

SEQ ID NO: 2753691 - DNA, 20 bp, Homo sapiens
tatatttgtaaatttatgtg

SEQ ID NO: 2753692 - DNA, 20 bp, Homo sapiens
tatcaaggaagtcttcaaat

SEQ ID NO: 2753693 - DNA, 15 bp, Homo sapiens
tatcagcacgtgtgg

SEQ ID NO: 2753694 - DNA, 15 bp, Homo sapiens
tatcatgctaaaatt

SEQ ID NO: 2753695 - DNA, 20 bp, Homo sapiens
tatcatgctaaaattctata

SEQ ID NO: 2753696 - DNA, 12 bp, Homo sapiens
tatcattctgtg

SEQ ID NO: 2753697 - DNA, 21 bp, Homo sapiens
tatcattctgtgattaaatct

SEQ ID NO: 2753698 - DNA, 13 bp, Homo sapiens
tatccataaaatt

SEQ ID NO: 2753699 - DNA, 16 bp, Homo sapiens
tatccataaaattgga

SEQ ID NO: 2753700 - DNA, 17 bp, Homo sapiens
tatccataaaattggat

SEQ ID NO: 2753701 - DNA, 21 bp, Homo sapiens
tatcccagctttaaaaagaaa

SEQ ID NO: 2753702 - DNA, 19 bp, Homo sapiens
tatcctatgccttcaaata

SEQ ID NO: 2753703 - DNA, 20 bp, Homo sapiens
tatcctatgccttcaaatag

SEQ ID NO: 2753704 - DNA, 17 bp, Homo sapiens
tatcgttattataaatg

SEQ ID NO: 2753705 - DNA, 19 bp, Homo sapiens
tatctaaacccagcaaaac

SEQ ID NO: 2753706 - DNA, 14 bp, Homo sapiens
tatctgaagggaat

SEQ ID NO: 2753707 - DNA, 16 bp, Homo sapiens
tatctggaatgagcct

SEQ ID NO: 2753708 - DNA, 14 bp, Homo sapiens
tatcttaagaatgt

SEQ ID NO: 2753709 - DNA, 19 bp, Homo sapiens
tatcttgattaatgtactt

SEQ ID NO: 2753710 - DNA, 14 bp, Homo sapiens
tatcttgtgaagtt

SEQ ID NO: 2753711 - DNA, 16 bp, Homo sapiens
tatgaaaaaaaaatta

SEQ ID NO: 2753712 - DNA, 22 bp, Homo sapiens
tatgaaaaaaaaattatttgcc

SEQ ID NO: 2753713 - DNA, 21 bp, Homo sapiens
tatgaagaattgccaatcttg

SEQ ID NO: 2753714 - DNA, 17 bp, Homo sapiens
tatgaattacatttgta

SEQ ID NO: 2753715 - DNA, 16 bp, Homo sapiens
tatgattcccagccag

SEQ ID NO: 2753716 - DNA, 13 bp, Homo sapiens
tatgccttcaaat

SEQ ID NO: 2753717 - DNA, 13 bp, Homo sapiens
tatggcatttgca

SEQ ID NO: 2753718 - DNA, 18 bp, Homo sapiens
tatggggatagatgtgtg

SEQ ID NO: 2753719 - DNA, 19 bp, Homo sapiens
tatggggatagatgtgtgg

SEQ ID NO: 2753720 - DNA, 21 bp, Homo sapiens
tatgtccagaagagtcaaagt

SEQ ID NO: 2753721 - DNA, 16 bp, Homo sapiens
tatgtggaagtgtggg

SEQ ID NO: 2753722 - DNA, 13 bp, Homo sapiens
tatgttcttatag

SEQ ID NO: 2753723 - DNA, 18 bp, Homo sapiens
ggctgggtttgctgtctt

SEQ ID NO: 2753724 - DNA, 15 bp, Homo sapiens
gggaactttgataca

SEQ ID NO: 2753725 - DNA, 20 bp, Homo sapiens
gggacagtcacctcatggaa

SEQ ID NO: 2753726 - DNA, 21 bp, Homo sapiens
gggacagtcacctcatggaat

SEQ ID NO: 2753727 - DNA, 20 bp, Homo sapiens
gggacatttgctcatggaat

SEQ ID NO: 2753728 - DNA, 21 bp, Homo sapiens
gggacatttgctcatggaatt

SEQ ID NO: 2753729 - DNA, 11 bp, Homo sapiens
gggagtgtgta

SEQ ID NO: 2753730 - DNA, 20 bp, Homo sapiens
gggatacaggcccctgggtt

SEQ ID NO: 2753731 - DNA, 13 bp, Homo sapiens
gggatagatgtgt

SEQ ID NO: 2753732 - DNA, 18 bp, Homo sapiens
gggctcagagtggggtag

SEQ ID NO: 2753733 - DNA, 15 bp, Homo sapiens
gggctgggtttgctg

SEQ ID NO: 2753734 - DNA, 16 bp, Homo sapiens
gggctgggtttgctgt

SEQ ID NO: 2753735 - DNA, 22 bp, Homo sapiens
gggctgtgcacccagaagaaga

SEQ ID NO: 2753736 - DNA, 22 bp, Homo sapiens
ggggcaaacctagccggaaggc

SEQ ID NO: 2753737 - DNA, 19 bp, Homo sapiens
ggggtattttctaattttt

SEQ ID NO: 2753738 - DNA, 21 bp, Homo sapiens
ggtaaatcacactcaaacttt

SEQ ID NO: 2753739 - DNA, 15 bp, Homo sapiens
ggtaagcggaataaa

SEQ ID NO: 2753740 - DNA, 16 bp, Homo sapiens
ggtaagcggaataaac

SEQ ID NO: 2753741 - DNA, 15 bp, Homo sapiens
ggtagacacacatga

SEQ ID NO: 2753742 - DNA, 17 bp, Homo sapiens
ggtctgtgtgtgtgtat

SEQ ID NO: 2753743 - DNA, 21 bp, Homo sapiens
ggtgatataaagaatgaaagt

SEQ ID NO: 2753744 - DNA, 19 bp, Homo sapiens
ggtgtaacttaaatatttg

SEQ ID NO: 2753745 - DNA, 13 bp, Homo sapiens
ggtgtctggcctg

SEQ ID NO: 2753746 - DNA, 16 bp, Homo sapiens
ggtgtctggcctgagg

SEQ ID NO: 2753747 - DNA, 13 bp, Homo sapiens
ggtttaatattac

SEQ ID NO: 2753748 - DNA, 18 bp, Homo sapiens
ggtttatttgttgttttc

SEQ ID NO: 2753749 - DNA, 22 bp, Homo sapiens
ggtttatttgttgttttctggg

SEQ ID NO: 2753750 - DNA, 13 bp, Homo sapiens
gtaaaaggactct

SEQ ID NO: 2753751 - DNA, 17 bp, Homo sapiens
gtaaagctgttaaaata

SEQ ID NO: 2753752 - DNA, 11 bp, Homo sapiens
gtaaagtaaaa

SEQ ID NO: 2753753 - DNA, 17 bp, Homo sapiens
gtaaatctgtacttttt

SEQ ID NO: 2753754 - DNA, 18 bp, Homo sapiens
gtaaatctgtactttttt

SEQ ID NO: 2753755 - DNA, 14 bp, Homo sapiens
gtaaccccaagagt

SEQ ID NO: 2753756 - DNA, 12 bp, Homo sapiens
gtaacttaaata

SEQ ID NO: 2753757 - DNA, 15 bp, Homo sapiens
gtaacttaaatattt

SEQ ID NO: 2753758 - DNA, 13 bp, Homo sapiens
gtaagggaataaa

SEQ ID NO: 2753759 - DNA, 12 bp, Homo sapiens
gtaagggtaaaa

SEQ ID NO: 2753760 - DNA, 19 bp, Homo sapiens
gtaattaggataactaaaa

SEQ ID NO: 2753761 - DNA, 20 bp, Homo sapiens
gtaattaggataactaaaat

SEQ ID NO: 2753762 - DNA, 15 bp, Homo sapiens
gtaattggaaaggca

SEQ ID NO: 2753763 - DNA, 23 bp, Homo sapiens
gtaatttaaaattgtgatgtgtc

SEQ ID NO: 2753764 - DNA, 16 bp, Homo sapiens
gtacatttggaacagt

SEQ ID NO: 2753765 - DNA, 17 bp, Homo sapiens
gtactccttggatttgc

SEQ ID NO: 2753766 - DNA, 19 bp, Homo sapiens
gtactgcatcttagtttac

SEQ ID NO: 2753767 - DNA, 22 bp, Homo sapiens
gtactgcatcttagtttactgg

SEQ ID NO: 2753768 - DNA, 21 bp, Homo sapiens
gtacttcaaatccttgaagat

SEQ ID NO: 2753769 - DNA, 22 bp, Homo sapiens
gtacttcaaatccttgaagatt

SEQ ID NO: 2753770 - DNA, 16 bp, Homo sapiens
gtacttttttcaaata

SEQ ID NO: 2753771 - DNA, 22 bp, Homo sapiens
gtacttttttcaaatattgaat

SEQ ID NO: 2753772 - DNA, 17 bp, Homo sapiens
gtagatgcagaaaaaga

SEQ ID NO: 2753773 - DNA, 19 bp, Homo sapiens
gtagatgcagaaaaagaaa

SEQ ID NO: 2753774 - DNA, 20 bp, Homo sapiens
gtagcaggacctgccaagaa

SEQ ID NO: 2753775 - DNA, 22 bp, Homo sapiens
gtagcttttactttttatgaaa

SEQ ID NO: 2753776 - DNA, 14 bp, Homo sapiens
gtagtgttggagaa

SEQ ID NO: 2753777 - DNA, 15 bp, Homo sapiens
gtagtgttggagaag

SEQ ID NO: 2753778 - DNA, 13 bp, Homo sapiens
gtataaaagttgt

SEQ ID NO: 2753779 - DNA, 21 bp, Homo sapiens
gtataaaataatttttatatt

SEQ ID NO: 2753780 - DNA, 15 bp, Homo sapiens
gtataaatgtctatt

SEQ ID NO: 2753781 - DNA, 19 bp, Homo sapiens
gtatcttgattaatgtact

SEQ ID NO: 2753782 - DNA, 19 bp, Homo sapiens
tatgttcttatagaataaa

SEQ ID NO: 2753783 - DNA, 16 bp, Homo sapiens
tatgtttattcaaaat

SEQ ID NO: 2753784 - DNA, 17 bp, Homo sapiens
tatgtttattcaaaata

SEQ ID NO: 2753785 - DNA, 22 bp, Homo sapiens
tattaaagaatgctgcaacttt

SEQ ID NO: 2753786 - DNA, 23 bp, Homo sapiens
tattaaagaatgctgcaactttt

SEQ ID NO: 2753787 - DNA, 18 bp, Homo sapiens
tattaattccatgtgata

SEQ ID NO: 2753788 - DNA, 14 bp, Homo sapiens
tattagactctcta

SEQ ID NO: 2753789 - DNA, 18 bp, Homo sapiens
tattataaatgttagttc

SEQ ID NO: 2753790 - DNA, 22 bp, Homo sapiens
tattatgaagaattgccaatct

SEQ ID NO: 2753791 - DNA, 16 bp, Homo sapiens
tattatgttaaaactg

SEQ ID NO: 2753792 - DNA, 23 bp, Homo sapiens
tattcattatgcaacgtttaaca

SEQ ID NO: 2753793 - DNA, 13 bp, Homo sapiens
tattcctggcata

SEQ ID NO: 2753794 - DNA, 21 bp, Homo sapiens
tattctaaagagctacttcta

SEQ ID NO: 2753795 - DNA, 17 bp, Homo sapiens
tattcttaaaatgcaat

SEQ ID NO: 2753796 - DNA, 19 bp, Homo sapiens
tattcttaaaatgcaatat

SEQ ID NO: 2753797 - DNA, 17 bp, Homo sapiens
tattgaatgccttattt

SEQ ID NO: 2753798 - DNA, 18 bp, Homo sapiens
tattgaatgccttatttt

SEQ ID NO: 2753799 - DNA, 22 bp, Homo sapiens
tattgatagtttcatttacaat

SEQ ID NO: 2753800 - DNA, 20 bp, Homo sapiens
tattggtattaaagaatgct

SEQ ID NO: 2753801 - DNA, 15 bp, Homo sapiens
tattgtattgctgct

SEQ ID NO: 2753802 - DNA, 16 bp, Homo sapiens
tatttagaaactggtt

SEQ ID NO: 2753803 - DNA, 19 bp, Homo sapiens
tatttccttatgtgtgtag

SEQ ID NO: 2753804 - DNA, 22 bp, Homo sapiens
tatttccttttgtaaagtaaaa

SEQ ID NO: 2753805 - DNA, 12 bp, Homo sapiens
tatttctaaacc

SEQ ID NO: 2753806 - DNA, 22 bp, Homo sapiens
tatttctatgaaatattatgtt

SEQ ID NO: 2753807 - DNA, 21 bp, Homo sapiens
tatttgccttttaaattcttt

SEQ ID NO: 2753808 - DNA, 12 bp, Homo sapiens
tatttgctgttt

SEQ ID NO: 2753809 - DNA, 16 bp, Homo sapiens
tatttgtaaatttatg

SEQ ID NO: 2753810 - DNA, 16 bp, Homo sapiens
tatttgtgttggggga

SEQ ID NO: 2753811 - DNA, 22 bp, Homo sapiens
tatttgtgttgggggaaatgtt

SEQ ID NO: 2753812 - DNA, 15 bp, Homo sapiens
tatttgttgttttct

SEQ ID NO: 2753813 - DNA, 19 bp, Homo sapiens
tattttaataatgtttcaa

SEQ ID NO: 2753814 - DNA, 12 bp, Homo sapiens
tattttgaaagg

SEQ ID NO: 2753815 - DNA, 16 bp, Homo sapiens
tattttgccatttagc

SEQ ID NO: 2753816 - DNA, 15 bp, Homo sapiens
tatttttgaattctt

SEQ ID NO: 2753817 - DNA, 20 bp, Homo sapiens
tatttttgaattctttagat

SEQ ID NO: 2753818 - DNA, 13 bp, Homo sapiens
tatttttttccaa

SEQ ID NO: 2753819 - DNA, 14 bp, Homo sapiens
tatttttttccaag

SEQ ID NO: 2753820 - DNA, 17 bp, Homo sapiens
tcaaacatatataacaa

SEQ ID NO: 2753821 - DNA, 21 bp, Homo sapiens
tcaaacctgtagatgcagaaa

SEQ ID NO: 2753822 - DNA, 16 bp, Homo sapiens
tcaaagagagttttta

SEQ ID NO: 2753823 - DNA, 19 bp, Homo sapiens
tcaaatattgaatgcctta

SEQ ID NO: 2753824 - DNA, 15 bp, Homo sapiens
tcaaatccttgaaga

SEQ ID NO: 2753825 - DNA, 16 bp, Homo sapiens
tcaaatccttgaagat

SEQ ID NO: 2753826 - DNA, 20 bp, Homo sapiens
tcaaattgtgcaaaatattg

SEQ ID NO: 2753827 - DNA, 18 bp, Homo sapiens
tcaaattgtgtgaaaggt

SEQ ID NO: 2753828 - DNA, 15 bp, Homo sapiens
tgacggcctgcctgc

SEQ ID NO: 2753829 - DNA, 22 bp, Homo sapiens
tgactctgtccaactctgtatt

SEQ ID NO: 2753830 - DNA, 13 bp, Homo sapiens
tgactcttaagaa

SEQ ID NO: 2753831 - DNA, 14 bp, Homo sapiens
tgactcttaagaag

SEQ ID NO: 2753832 - DNA, 16 bp, Homo sapiens
tgactcttaagaagac

SEQ ID NO: 2753833 - DNA, 22 bp, Homo sapiens
tgactgggctgggtttgctgtc

SEQ ID NO: 2753834 - DNA, 12 bp, Homo sapiens
tgagaaagaaag

SEQ ID NO: 2753835 - DNA, 20 bp, Homo sapiens
tgagaatgttaccagacttc

SEQ ID NO: 2753836 - DNA, 21 bp, Homo sapiens
tgagaatgttaccagacttca

SEQ ID NO: 2753837 - DNA, 19 bp, Homo sapiens
tgagacccctttaaactgt

SEQ ID NO: 2753838 - DNA, 20 bp, Homo sapiens
tgagacccctttaaactgtc

SEQ ID NO: 2753839 - DNA, 16 bp, Homo sapiens
tgagagacacactgaa

SEQ ID NO: 2753840 - DNA, 20 bp, Homo sapiens
tgagagacacactgaagaag

SEQ ID NO: 2753841 - DNA, 15 bp, Homo sapiens
tgagcagtcaggaaa

SEQ ID NO: 2753842 - DNA, 15 bp, Homo sapiens
tgaggtaagtgtatg

SEQ ID NO: 2753843 - DNA, 16 bp, Homo sapiens
tgaggtgtctggcctg

SEQ ID NO: 2753844 - DNA, 21 bp, Homo sapiens
tgaggtgtctggcctgaggtc

SEQ ID NO: 2753845 - DNA, 14 bp, Homo sapiens
tgagtatttgctgt

SEQ ID NO: 2753846 - DNA, 15 bp, Homo sapiens
tgagtatttgctgtt

SEQ ID NO: 2753847 - DNA, 13 bp, Homo sapiens
tgagttgggggta

SEQ ID NO: 2753848 - DNA, 24 bp, Homo sapiens
tgataagcagtcatcctcagatca

SEQ ID NO: 2753849 - DNA, 21 bp, Homo sapiens
tgatacaaatgggaattcact

SEQ ID NO: 2753850 - DNA, 14 bp, Homo sapiens
tgatagtttcattt

SEQ ID NO: 2753851 - DNA, 17 bp, Homo sapiens
tgatagtttcatttaca

SEQ ID NO: 2753852 - DNA, 13 bp, Homo sapiens
tgatataaagaat

SEQ ID NO: 2753853 - DNA, 12 bp, Homo sapiens
tgatatgggtct

SEQ ID NO: 2753854 - DNA, 17 bp, Homo sapiens
tgatcaaaaataatgca

SEQ ID NO: 2753855 - DNA, 18 bp, Homo sapiens
tgatcaaaaataatgcat

SEQ ID NO: 2753856 - DNA, 11 bp, Homo sapiens
tgatgaagaag

SEQ ID NO: 2753857 - DNA, 17 bp, Homo sapiens
tgatgaagaagttgata

SEQ ID NO: 2753858 - DNA, 15 bp, Homo sapiens
tgatgggtcagttgt

SEQ ID NO: 2753859 - DNA, 15 bp, Homo sapiens
tgatggtggtatgtt

SEQ ID NO: 2753860 - DNA, 22 bp, Homo sapiens
tgatgtttagaaacacaactat

SEQ ID NO: 2753861 - DNA, 19 bp, Homo sapiens
tggggtaagcggaataaac

SEQ ID NO: 2753862 - DNA, 21 bp, Homo sapiens
tggggtaagcggaataaacta

SEQ ID NO: 2753863 - DNA, 17 bp, Homo sapiens
tgggtagacacacatga

SEQ ID NO: 2753864 - DNA, 13 bp, Homo sapiens
tggtagcacttta

SEQ ID NO: 2753865 - DNA, 16 bp, Homo sapiens
tggtagcactttaaaa

SEQ ID NO: 2753866 - DNA, 16 bp, Homo sapiens
tggtagcttttacttt

SEQ ID NO: 2753867 - DNA, 20 bp, Homo sapiens
tggtagcttttactttttat

SEQ ID NO: 2753868 - DNA, 21 bp, Homo sapiens
tggtatgttttcaggctagat

SEQ ID NO: 2753869 - DNA, 13 bp, Homo sapiens
tggtattaaagaa

SEQ ID NO: 2753870 - DNA, 23 bp, Homo sapiens
tggtctgtactccttggatttgc

SEQ ID NO: 2753871 - DNA, 18 bp, Homo sapiens
tggtctgttaatcttttt

SEQ ID NO: 2753872 - DNA, 19 bp, Homo sapiens
tggtgcaaaggagccgcca

SEQ ID NO: 2753873 - DNA, 18 bp, Homo sapiens
tggtgctcatttaaatat

SEQ ID NO: 2753874 - DNA, 14 bp, Homo sapiens
tggtgctggtttat

SEQ ID NO: 2753875 - DNA, 16 bp, Homo sapiens
tggtgcttttatagtt

SEQ ID NO: 2753876 - DNA, 17 bp, Homo sapiens
tggtgtcttcattttac

SEQ ID NO: 2753877 - DNA, 16 bp, Homo sapiens
tggtgtggagttttca

SEQ ID NO: 2753878 - DNA, 14 bp, Homo sapiens
tggttatttctaaa

SEQ ID NO: 2753879 - DNA, 17 bp, Homo sapiens
tggttttgaatattaag

SEQ ID NO: 2753880 - DNA, 18 bp, Homo sapiens
tgtaaagctgttaaaata

SEQ ID NO: 2753881 - DNA, 20 bp, Homo sapiens
tgtaaagctgttaaaataca

SEQ ID NO: 2753882 - DNA, 12 bp, Homo sapiens
tgtaaatctgta

SEQ ID NO: 2753883 - DNA, 15 bp, Homo sapiens
tgtaaatctgtactt

SEQ ID NO: 2753884 - DNA, 15 bp, Homo sapiens
tgtaaatttatgtga

SEQ ID NO: 2753885 - DNA, 16 bp, Homo sapiens
tgtaaatttatgtgat

SEQ ID NO: 2753886 - DNA, 18 bp, Homo sapiens
tgtaacttaaatatttga

SEQ ID NO: 2753887 - DNA, 16 bp, Homo sapiens
tgtaatatatcctgtt

SEQ ID NO: 2753888 - DNA, 20 bp, Homo sapiens
tgtaatttaaaattgtgatg

SEQ ID NO: 2753889 - DNA, 15 bp, Homo sapiens
tgtacatttggaaca

SEQ ID NO: 2753890 - DNA, 22 bp, Homo sapiens
tgtacctctattagtttcaatt

SEQ ID NO: 2753891 - DNA, 21 bp, Homo sapiens
tgtaccttttgcgatttcaca

SEQ ID NO: 2753892 - DNA, 15 bp, Homo sapiens
tgtacttttttcaaa

SEQ ID NO: 2753893 - DNA, 16 bp, Homo sapiens
tgtacttttttcaaat

SEQ ID NO: 2753894 - DNA, 17 bp, Homo sapiens
tgtacttttttcaaata

SEQ ID NO: 2753895 - DNA, 18 bp, Homo sapiens
tgtacttttttcaaatat

SEQ ID NO: 2753896 - DNA, 21 bp, Homo sapiens
tgtacttttttcaaatattga

SEQ ID NO: 2753897 - DNA, 23 bp, Homo sapiens
tgtacttttttcaaatattgaat

SEQ ID NO: 2753898 - DNA, 13 bp, Homo sapiens
tgtagatgcagaa

SEQ ID NO: 2753899 - DNA, 18 bp, Homo sapiens
tgtagatgcagaaaaaga

SEQ ID NO: 2753900 - DNA, 19 bp, Homo sapiens
tgtaggaggggttaataag

SEQ ID NO: 2753901 - DNA, 14 bp, Homo sapiens
tgtagtgttggaga

SEQ ID NO: 2753902 - DNA, 18 bp, Homo sapiens
tgtataaaagttgtactg

SEQ ID NO: 2753903 - DNA, 13 bp, Homo sapiens
tgtataaatgtct

SEQ ID NO: 2753904 - DNA, 22 bp, Homo sapiens
tgtataaatgtctattattatg

SEQ ID NO: 2753905 - DNA, 15 bp, Homo sapiens
tgtataagttgtatt

SEQ ID NO: 2753906 - DNA, 17 bp, Homo sapiens
tgtatagttgcttttga

SEQ ID NO: 2753907 - DNA, 21 bp, Homo sapiens
tgtatcttgattaatgtactt

SEQ ID NO: 2753908 - DNA, 22 bp, Homo sapiens
tgtatgtcaaattgtgcaaaat

SEQ ID NO: 2753909 - DNA, 20 bp, Homo sapiens
tgtatgtgggggtctgtgtg

SEQ ID NO: 2753910 - DNA, 21 bp, Homo sapiens
tgtatgtgggggtctgtgtgt

SEQ ID NO: 2753911 - DNA, 22 bp, Homo sapiens
tgtattcttaaaatgcaatatt

SEQ ID NO: 2753912 - DNA, 18 bp, Homo sapiens
tgtattgctgctgtgcgt

SEQ ID NO: 2753913 - DNA, 22 bp, Homo sapiens
tgtattgctgctgtgcgtggaa

SEQ ID NO: 2753914 - DNA, 12 bp, Homo sapiens
tgtattgctgtc

SEQ ID NO: 2753915 - DNA, 15 bp, Homo sapiens
tgtatttaggccatt

SEQ ID NO: 2753916 - DNA, 18 bp, Homo sapiens
tgtattttaaaagaatga

SEQ ID NO: 2753917 - DNA, 19 bp, Homo sapiens
tgtattttaaaagaatgat

SEQ ID NO: 2753918 - DNA, 22 bp, Homo sapiens
tgtatttttttccaagtgtata

SEQ ID NO: 2753919 - DNA, 23 bp, Homo sapiens
tgtatttttttccaagtgtataa

SEQ ID NO: 2753920 - DNA, 15 bp, Homo sapiens
tgtcaataaatgttg

SEQ ID NO: 2753921 - DNA, 17 bp, Homo sapiens
tgtcaataaatgttgaa

SEQ ID NO: 2753922 - DNA, 20 bp, Homo sapiens
tgtcaatcagcctagttgat

SEQ ID NO: 2753923 - DNA, 12 bp, Homo sapiens
tgtcactactgg

SEQ ID NO: 2753924 - DNA, 13 bp, Homo sapiens
tgtccaactctgt

SEQ ID NO: 2753925 - DNA, 23 bp, Homo sapiens
tgtccagaagagtcaaagtagtt

SEQ ID NO: 2753926 - DNA, 21 bp, Homo sapiens
tgtcctaagtgtcaagtcctg

SEQ ID NO: 2753927 - DNA, 22 bp, Homo sapiens
tgtcctaagtgtcaagtcctga

SEQ ID NO: 2753928 - DNA, 14 bp, Homo sapiens
tgtcctatgcaata

SEQ ID NO: 2753929 - DNA, 15 bp, Homo sapiens
tgtcctatgcaataa

SEQ ID NO: 2753930 - DNA, 14 bp, Homo sapiens
tgtcggcacattca

SEQ ID NO: 2753931 - DNA, 16 bp, Homo sapiens
tgtctaaaagattctt

SEQ ID NO: 2753932 - DNA, 18 bp, Homo sapiens
tgtctaaaagattcttta

SEQ ID NO: 2753933 - DNA, 13 bp, Homo sapiens
tgtctgcctggag

SEQ ID NO: 2753934 - DNA, 13 bp, Homo sapiens
tgtctggcctgag

SEQ ID NO: 2753935 - DNA, 18 bp, Homo sapiens
tgtctggcctgaggtcaa

SEQ ID NO: 2753936 - DNA, 19 bp, Homo sapiens
tgtgaacagtacagtattt

SEQ ID NO: 2753937 - DNA, 18 bp, Homo sapiens
tgtgaactaagttattgc

SEQ ID NO: 2753938 - DNA, 14 bp, Homo sapiens
tgtgaagttacatg

SEQ ID NO: 2753939 - DNA, 20 bp, Homo sapiens
tgtgaagttacatgcataaa

SEQ ID NO: 2753940 - DNA, 14 bp, Homo sapiens
tgtgattaaatctc

SEQ ID NO: 2753941 - DNA, 14 bp, Homo sapiens
tgtgcagggctggt

SEQ ID NO: 2753942 - DNA, 17 bp, Homo sapiens
tgtgcagggctggtttg

SEQ ID NO: 2753943 - DNA, 18 bp, Homo sapiens
tgtgcctgtcactactgg

SEQ ID NO: 2753944 - DNA, 17 bp, Homo sapiens
tgtgccttggtgtgctg

SEQ ID NO: 2753945 - DNA, 16 bp, Homo sapiens
tgtgccttttgccatc

SEQ ID NO: 2753946 - DNA, 15 bp, Homo sapiens
tgtgcgtggaaaaag

SEQ ID NO: 2753947 - DNA, 16 bp, Homo sapiens
tgtgcgtggaaaaaga

SEQ ID NO: 2753948 - DNA, 22 bp, Homo sapiens
tgtgctgtgtttaatcagggga

SEQ ID NO: 2753949 - DNA, 21 bp, Homo sapiens
tgtggactacaggacaagggg

SEQ ID NO: 2753950 - DNA, 13 bp, Homo sapiens
tgtggagttttca

SEQ ID NO: 2753951 - DNA, 15 bp, Homo sapiens
tgtggagttttcatg

SEQ ID NO: 2753952 - DNA, 18 bp, Homo sapiens
tgtggagttttcatgaca

SEQ ID NO: 2753953 - DNA, 12 bp, Homo sapiens
tgtgggaataaa

SEQ ID NO: 2753954 - DNA, 15 bp, Homo sapiens
tgtgggagtgtgtaa

SEQ ID NO: 2753955 - DNA, 16 bp, Homo sapiens
tgtgggggtctgtgtg

SEQ ID NO: 2753956 - DNA, 16 bp, Homo sapiens
tgtgggtctgtgtgtg

SEQ ID NO: 2753957 - DNA, 18 bp, Homo sapiens
tgtgtaatttaaaattgt

SEQ ID NO: 2753958 - DNA, 22 bp, Homo sapiens
tgtgtaatttaaaattgtgatg

SEQ ID NO: 2753959 - DNA, 13 bp, Homo sapiens
tgtgtatcttgat

SEQ ID NO: 2753960 - DNA, 16 bp, Homo sapiens
tgtgtatcttgattaa

SEQ ID NO: 2753961 - DNA, 22 bp, Homo sapiens
tgtgtatcttgattaatgtact

SEQ ID NO: 2753962 - DNA, 13 bp, Homo sapiens
tgtgtatgtgggg

SEQ ID NO: 2753963 - DNA, 23 bp, Homo sapiens
tgtgtatgtgggggtctgtgtgt

SEQ ID NO: 2753964 - DNA, 16 bp, Homo sapiens
ttcaaatattgaatgc

SEQ ID NO: 2753965 - DNA, 17 bp, Homo sapiens
ttcaaatccttgaagat

SEQ ID NO: 2753966 - DNA, 15 bp, Homo sapiens
ttcaaatttgattct

SEQ ID NO: 2753967 - DNA, 19 bp, Homo sapiens
ttcaaatttgattctaaat

SEQ ID NO: 2753968 - DNA, 19 bp, Homo sapiens
ttcaattgagtaattctag

SEQ ID NO: 2753969 - DNA, 21 bp, Homo sapiens
ttcacattaactcaggcattt

SEQ ID NO: 2753970 - DNA, 14 bp, Homo sapiens
ttcactaaaataaa

SEQ ID NO: 2753971 - DNA, 12 bp, Homo sapiens
ttcactgtacgt

SEQ ID NO: 2753972 - DNA, 14 bp, Homo sapiens
ttcaggctctgccc

SEQ ID NO: 2753973 - DNA, 22 bp, Homo sapiens
ttcagtagcaggacctgccaag

SEQ ID NO: 2753974 - DNA, 16 bp, Homo sapiens
ttcagtgggttcagaa

SEQ ID NO: 2753975 - DNA, 11 bp, Homo sapiens
ttcataatggc

SEQ ID NO: 2753976 - DNA, 17 bp, Homo sapiens
ttcatagttctgttaaa

SEQ ID NO: 2753977 - DNA, 19 bp, Homo sapiens
ttcatcattgttgtgtata

SEQ ID NO: 2753978 - DNA, 15 bp, Homo sapiens
ttcatctaatttaat

SEQ ID NO: 2753979 - DNA, 13 bp, Homo sapiens
ttccaagtgtata

SEQ ID NO: 2753980 - DNA, 16 bp, Homo sapiens
ttccaagtgtataatg

SEQ ID NO: 2753981 - DNA, 18 bp, Homo sapiens
ttccaagtgtataatgtt

SEQ ID NO: 2753982 - DNA, 23 bp, Homo sapiens
ttccaatatgaccttaaggaaaa

SEQ ID NO: 2753983 - DNA, 17 bp, Homo sapiens
ttccaccggcactcatg

SEQ ID NO: 2753984 - DNA, 19 bp, Homo sapiens
ttccaccggcactcatgac

SEQ ID NO: 2753985 - DNA, 18 bp, Homo sapiens
ttcccttgatgaagaagt

SEQ ID NO: 2753986 - DNA, 17 bp, Homo sapiens
ttcctgcatctttcata

SEQ ID NO: 2753987 - DNA, 18 bp, Homo sapiens
ttcctgcatctttcatag

SEQ ID NO: 2753988 - DNA, 20 bp, Homo sapiens
ttcctgcatctttcatagtt

SEQ ID NO: 2753989 - DNA, 16 bp, Homo sapiens
ttcctgcccagcctgg

SEQ ID NO: 2753990 - DNA, 19 bp, Homo sapiens
ttcctttatactgtgaagt

SEQ ID NO: 2753991 - DNA, 14 bp, Homo sapiens
ttccttttgtaaag

SEQ ID NO: 2753992 - DNA, 23 bp, Homo sapiens
ttctaaatagcgattataatctc

SEQ ID NO: 2753993 - DNA, 14 bp, Homo sapiens
ttctatgaaatatt

SEQ ID NO: 2753994 - DNA, 13 bp, Homo sapiens
ttctattcattat

SEQ ID NO: 2753995 - DNA, 14 bp, Homo sapiens
ttctcaactccaaa

SEQ ID NO: 2753996 - DNA, 14 bp, Homo sapiens
ttctctaaactgtt

SEQ ID NO: 2753997 - DNA, 18 bp, Homo sapiens
ttctcttccagtttctgt

SEQ ID NO: 2753998 - DNA, 22 bp, Homo sapiens
ttctgaaattcacagaagccta

SEQ ID NO: 2753999 - DNA, 12 bp, Homo sapiens
ttctgaagaaga

SEQ ID NO: 2754000 - DNA, 13 bp, Homo sapiens
ttctgaagaagat

SEQ ID NO: 2754001 - DNA, 20 bp, Homo sapiens
ttctggctgtagataaataa

SEQ ID NO: 2754002 - DNA, 23 bp, Homo sapiens
ttctgggggaaaaagccatatca

SEQ ID NO: 2754003 - DNA, 16 bp, Homo sapiens
ttctgtgattaaatct

SEQ ID NO: 2754004 - DNA, 17 bp, Homo sapiens
ttctgttttataatttt

SEQ ID NO: 2754005 - DNA, 18 bp, Homo sapiens
ttcttaaaatgcaatatt

SEQ ID NO: 2754006 - DNA, 15 bp, Homo sapiens
ttcttatagaataaa

SEQ ID NO: 2754007 - DNA, 14 bp, Homo sapiens
ttcttatctaaacc

SEQ ID NO: 2754008 - DNA, 22 bp, Homo sapiens
ttcttcatgcattacttactgt

SEQ ID NO: 2754009 - DNA, 16 bp, Homo sapiens
ttcttctcatatccat

SEQ ID NO: 2754010 - DNA, 21 bp, Homo sapiens
ttctttagatttttaaattgg

SEQ ID NO: 2754011 - DNA, 14 bp, Homo sapiens
ttcttttctttgta

SEQ ID NO: 2754012 - DNA, 15 bp, Homo sapiens
ttgaaaatgccacca

SEQ ID NO: 2754013 - DNA, 17 bp, Homo sapiens
ttgaaaggtcagaattt

SEQ ID NO: 2754014 - DNA, 11 bp, Homo sapiens
ttgaaatatag

SEQ ID NO: 2754015 - DNA, 13 bp, Homo sapiens
ttgaaatatagtt

SEQ ID NO: 2754016 - DNA, 17 bp, Homo sapiens
ttgaaatatagttgaaa

SEQ ID NO: 2754017 - DNA, 19 bp, Homo sapiens
ttgaaatatagttgaaagt

SEQ ID NO: 2754018 - DNA, 19 bp, Homo sapiens
ttgaagtcttcttatctaa

SEQ ID NO: 2754019 - DNA, 21 bp, Homo sapiens
ttgaagtcttcttatctaaac

SEQ ID NO: 2754020 - DNA, 16 bp, Homo sapiens
ttgaatattaagctaa

SEQ ID NO: 2754021 - DNA, 21 bp, Homo sapiens
ttgaatattaagctaaaaggt

SEQ ID NO: 2754022 - DNA, 22 bp, Homo sapiens
ttgaatgccttatttttgaatt

SEQ ID NO: 2754023 - DNA, 16 bp, Homo sapiens
ttgagactgaaagaaa

SEQ ID NO: 2754024 - DNA, 19 bp, Homo sapiens
ttgagactgaaagaaacta

SEQ ID NO: 2754025 - DNA, 15 bp, Homo sapiens
ttgaggacactgata

SEQ ID NO: 2754026 - DNA, 16 bp, Homo sapiens
ttgaggccaggacttt

SEQ ID NO: 2754027 - DNA, 14 bp, Homo sapiens
ttgagtatttgctg

SEQ ID NO: 2754028 - DNA, 19 bp, Homo sapiens
ttgagtatttgctgtttgt

SEQ ID NO: 2754029 - DNA, 20 bp, Homo sapiens
ttgagttgggggtattttct

SEQ ID NO: 2754030 - DNA, 19 bp, Homo sapiens
ttgatagtttcatttacaa

SEQ ID NO: 2754031 - DNA, 13 bp, Homo sapiens
ttgatgaagaagt

SEQ ID NO: 2754032 - DNA, 20 bp, Homo sapiens
ttgattaatgaagaaagtaa

SEQ ID NO: 2754033 - DNA, 21 bp, Homo sapiens
ttgattaatgaagaaagtaaa

SEQ ID NO: 2754034 - DNA, 17 bp, Homo sapiens
ttgattaatgtactttt

SEQ ID NO: 2754035 - DNA, 14 bp, Homo sapiens
ttgcactttgtagt

SEQ ID NO: 2754036 - DNA, 13 bp, Homo sapiens
ttgcatggtgtga

SEQ ID NO: 2754037 - DNA, 12 bp, Homo sapiens
ttgccacatctt

SEQ ID NO: 2754038 - DNA, 16 bp, Homo sapiens
ttgccacatcttgaaa

SEQ ID NO: 2754039 - DNA, 22 bp, Homo sapiens
ttgccacatcttgaaaatgcca

SEQ ID NO: 2754040 - DNA, 23 bp, Homo sapiens
ttgccacatcttgaaaatgccac

SEQ ID NO: 2754041 - DNA, 13 bp, Homo sapiens
ttgcgatttcaca

SEQ ID NO: 2754042 - DNA, 18 bp, Homo sapiens
ttgctaagcattccaact

SEQ ID NO: 2754043 - DNA, 21 bp, Homo sapiens
ttgctagacaaggttgctgtt

SEQ ID NO: 2754044 - DNA, 22 bp, Homo sapiens
ttgctgctgtgcgtggaaaaag

SEQ ID NO: 2754045 - DNA, 20 bp, Homo sapiens
ttgctgtcttggggtcccac

SEQ ID NO: 2754046 - DNA, 16 bp, Homo sapiens
ttgctttctgaaattc

SEQ ID NO: 2754047 - DNA, 18 bp, Homo sapiens
ttgcttttgaaggaatac

SEQ ID NO: 2754048 - DNA, 21 bp, Homo sapiens
ttgcttttgaaggaatacaat

SEQ ID NO: 2754049 - DNA, 23 bp, Homo sapiens
ttggagaaaagcacttaaagttt

SEQ ID NO: 2754050 - DNA, 15 bp, Homo sapiens
ttggagaagaactga

SEQ ID NO: 2754051 - DNA, 12 bp, Homo sapiens
ttggagccttcc

SEQ ID NO: 2754052 - DNA, 22 bp, Homo sapiens
ttggagggaaatcttggtgtaa

SEQ ID NO: 2754053 - DNA, 16 bp, Homo sapiens
ttggcacttctgccat

SEQ ID NO: 2754054 - DNA, 13 bp, Homo sapiens
ttggcgctgaggt

SEQ ID NO: 2754055 - DNA, 19 bp, Homo sapiens
ttggctgatttaaaaagtg

SEQ ID NO: 2754056 - DNA, 19 bp, Homo sapiens
ttggtgctcatttaaatat

SEQ ID NO: 2754057 - DNA, 16 bp, Homo sapiens
ttggtttgagaaaggc

SEQ ID NO: 2754058 - DNA, 14 bp, Homo sapiens
ttgtaaatctgtac

SEQ ID NO: 2754059 - DNA, 18 bp, Homo sapiens
ttgtacaaagtaaaaata

SEQ ID NO: 2754060 - DNA, 20 bp, Homo sapiens
ttgtacaaagtaaaaataaa

SEQ ID NO: 2754061 - DNA, 18 bp, Homo sapiens
ttgtacatcgcttctttt

SEQ ID NO: 2754062 - DNA, 14 bp, Homo sapiens
ttgtacatttggaa

SEQ ID NO: 2754063 - DNA, 11 bp, Homo sapiens
ttgtagaaagc

SEQ ID NO: 2754064 - DNA, 14 bp, Homo sapiens
ttgtagaaagctaa

SEQ ID NO: 2754065 - DNA, 20 bp, Homo sapiens
ttgtagaaagctaatacaaa

SEQ ID NO: 2754066 - DNA, 18 bp, Homo sapiens
ttgtataaaagttgtact

SEQ ID NO: 2754067 - DNA, 16 bp, Homo sapiens
ttgtataaaataattt

SEQ ID NO: 2754068 - DNA, 16 bp, Homo sapiens
ttgtatcagtaccatt

SEQ ID NO: 2754069 - DNA, 16 bp, Homo sapiens
ttgtattgctgctgtg

SEQ ID NO: 2754070 - DNA, 23 bp, Homo sapiens
ttgtatttttttccaagtgtata

SEQ ID NO: 2754071 - DNA, 20 bp, Homo sapiens
ttgtcaataaaatccataca

SEQ ID NO: 2754072 - DNA, 15 bp, Homo sapiens
ttgtcattaaaattg

SEQ ID NO: 2754073 - DNA, 18 bp, Homo sapiens
ttgtccctgaagagaagg

SEQ ID NO: 2754074 - DNA, 12 bp, Homo sapiens
ttgtgatgtgtc

SEQ ID NO: 2754075 - DNA, 13 bp, Homo sapiens
ttgtgcaaaatat

SEQ ID NO: 2754076 - DNA, 14 bp, Homo sapiens
ttgtgcaaaatatt

SEQ ID NO: 2754077 - DNA, 15 bp, Homo sapiens
ttgtgcaaaatattg

SEQ ID NO: 2754078 - DNA, 10 bp, Homo sapiens
ttgtgggaat

SEQ ID NO: 2754079 - DNA, 14 bp, Homo sapiens
ttgtgtataattta

SEQ ID NO: 2754080 - DNA, 13 bp, Homo sapiens
ttgtgtgtgggag

SEQ ID NO: 2754081 - DNA, 16 bp, Homo sapiens
ttgtgtttgcttggtg

SEQ ID NO: 2754082 - DNA, 18 bp, Homo sapiens
ttgtgttttgcaagccag

SEQ ID NO: 2754083 - DNA, 22 bp, Homo sapiens
ttgttctgactttttgtttctt

SEQ ID NO: 2754084 - DNA, 9 bp, Homo sapiens
ttgttgttg

SEQ ID NO: 2754085 - DNA, 15 bp, Homo sapiens
ttgttgttgttttat

SEQ ID NO: 2754086 - DNA, 12 bp, Homo sapiens
ttgttgttttct

SEQ ID NO: 2754087 - DNA, 13 bp, Homo sapiens
ttgttttgctgct

SEQ ID NO: 2754088 - DNA, 13 bp, Homo sapiens
tttttcaaatatt

SEQ ID NO: 2754089 - DNA, 16 bp, Homo sapiens
tgttgagtatttgctg

SEQ ID NO: 2754090 - DNA, 15 bp, Homo sapiens
tgttggcgctgaggt

SEQ ID NO: 2754091 - DNA, 18 bp, Homo sapiens
tgttgggagtgaggatgt

SEQ ID NO: 2754092 - DNA, 14 bp, Homo sapiens
tgttggtttaatat

SEQ ID NO: 2754093 - DNA, 18 bp, Homo sapiens
tgttgtgtataatttacc

SEQ ID NO: 2754094 - DNA, 19 bp, Homo sapiens
tgttgtgtataatttacct

SEQ ID NO: 2754095 - DNA, 12 bp, Homo sapiens
tgttgttgttgt

SEQ ID NO: 2754096 - DNA, 22 bp, Homo sapiens
tgttgttttctgggggaaaaag

SEQ ID NO: 2754097 - DNA, 18 bp, Homo sapiens
tgtttaaaagcaaatact

SEQ ID NO: 2754098 - DNA, 15 bp, Homo sapiens
tgtttaataagtata

SEQ ID NO: 2754099 - DNA, 14 bp, Homo sapiens
tgtttacagaggac

SEQ ID NO: 2754100 - DNA, 23 bp, Homo sapiens
tgtttatggaaataccaggacca

SEQ ID NO: 2754101 - DNA, 18 bp, Homo sapiens
tgtttatgttcttataga

SEQ ID NO: 2754102 - DNA, 22 bp, Homo sapiens
tgtttatgttcttatagaataa

SEQ ID NO: 2754103 - DNA, 15 bp, Homo sapiens
tgtttattcaaaata

SEQ ID NO: 2754104 - DNA, 23 bp, Homo sapiens
tgtttattcaaaatattttatct

SEQ ID NO: 2754105 - DNA, 13 bp, Homo sapiens
tgtttatttagaa

SEQ ID NO: 2754106 - DNA, 13 bp, Homo sapiens
tgtttcaaacata

SEQ ID NO: 2754107 - DNA, 14 bp, Homo sapiens
tgtttctgttctgg

SEQ ID NO: 2754108 - DNA, 18 bp, Homo sapiens
tgtttctttgtgtttgct

SEQ ID NO: 2754109 - DNA, 15 bp, Homo sapiens
tgtttgctaagcatt

SEQ ID NO: 2754110 - DNA, 21 bp, Homo sapiens
tgtttggatttcctttatact

SEQ ID NO: 2754111 - DNA, 18 bp, Homo sapiens
tgtttgtggttttgggaa

SEQ ID NO: 2754112 - DNA, 13 bp, Homo sapiens
tgttttataattt

SEQ ID NO: 2754113 - DNA, 13 bp, Homo sapiens
tgtttttataaaa

SEQ ID NO: 2754114 - DNA, 12 bp, Homo sapiens
tgtttttgcttt

SEQ ID NO: 2754115 - DNA, 14 bp, Homo sapiens
tgtttttgctttct

SEQ ID NO: 2754116 - DNA, 15 bp, Homo sapiens
ttaaaacagctattt

SEQ ID NO: 2754117 - DNA, 14 bp, Homo sapiens
ttaaaactgcattt

SEQ ID NO: 2754118 - DNA, 16 bp, Homo sapiens
ttaaaactgtaccttt

SEQ ID NO: 2754119 - DNA, 13 bp, Homo sapiens
ttaaaagaatgat

SEQ ID NO: 2754120 - DNA, 19 bp, Homo sapiens
ttaaaagaatgattatgaa

SEQ ID NO: 2754121 - DNA, 22 bp, Homo sapiens
ttaaaagttagcattgtttcta

SEQ ID NO: 2754122 - DNA, 23 bp, Homo sapiens
ttaaaatacataacttcagtgca

SEQ ID NO: 2754123 - DNA, 12 bp, Homo sapiens
ttaaaatgcaat

SEQ ID NO: 2754124 - DNA, 21 bp, Homo sapiens
ttaaagttttttatatatgaa

SEQ ID NO: 2754125 - DNA, 22 bp, Homo sapiens
ttaaatatctgaacatttacta

SEQ ID NO: 2754126 - DNA, 16 bp, Homo sapiens
ttaaatatttgaaaat

SEQ ID NO: 2754127 - DNA, 18 bp, Homo sapiens
ttaaatcattttaggaaa

SEQ ID NO: 2754128 - DNA, 21 bp, Homo sapiens
ttaaatcattttaggaaagga

SEQ ID NO: 2754129 - DNA, 19 bp, Homo sapiens
ttaaattttctctaaactg

SEQ ID NO: 2754130 - DNA, 20 bp, Homo sapiens
ttaaattttctctaaactgt

SEQ ID NO: 2754131 - DNA, 13 bp, Homo sapiens
ttaacattgattg

SEQ ID NO: 2754132 - DNA, 13 bp, Homo sapiens
ttaagcaaatgca

SEQ ID NO: 2754133 - DNA, 14 bp, Homo sapiens
ttaagcaaatgcat

SEQ ID NO: 2754134 - DNA, 13 bp, Homo sapiens
ttaaggaaaagta

SEQ ID NO: 2754135 - DNA, 14 bp, Homo sapiens
ttaaggaaaagtaa

SEQ ID NO: 2754136 - DNA, 14 bp, Homo sapiens
ttaaggattctgca

SEQ ID NO: 2754137 - DNA, 22 bp, Homo sapiens
ttaagtgccacaggttttaagg

SEQ ID NO: 2754138 - DNA, 13 bp, Homo sapiens
ttaataagtctct

SEQ ID NO: 2754139 - DNA, 18 bp, Homo sapiens
ttaataatgtttcaaaca

SEQ ID NO: 2754140 - DNA, 21 bp, Homo sapiens
ttaatattacctaatgaaagt

SEQ ID NO: 2754141 - DNA, 16 bp, Homo sapiens
ttaatattgtattgct

SEQ ID NO: 2754142 - DNA, 20 bp, Homo sapiens
ttaatcacttaacattccta

SEQ ID NO: 2754143 - DNA, 18 bp, Homo sapiens
ttaatcagtggaactcaa

SEQ ID NO: 2754144 - DNA, 12 bp, Homo sapiens
ttaatcagtgtg

SEQ ID NO: 2754145 - DNA, 12 bp, Homo sapiens
ttaattctaaac

SEQ ID NO: 2754146 - DNA, 12 bp, Homo sapiens
ttaattgtgtgg

SEQ ID NO: 2754147 - DNA, 13 bp, Homo sapiens
ttaattgtttaaa

SEQ ID NO: 2754148 - DNA, 15 bp, Homo sapiens
ttacaatttcaaaag

SEQ ID NO: 2754149 - DNA, 22 bp, Homo sapiens
ttacacctcagaaattgaaagc

SEQ ID NO: 2754150 - DNA, 15 bp, Homo sapiens
ttacagaggacagta

SEQ ID NO: 2754151 - DNA, 14 bp, Homo sapiens
ttacagtttcttca

SEQ ID NO: 2754152 - DNA, 20 bp, Homo sapiens
ttacatgcataaaagggtca

SEQ ID NO: 2754153 - DNA, 20 bp, Homo sapiens
ttacattgcctgactaaaat

SEQ ID NO: 2754154 - DNA, 21 bp, Homo sapiens
ttacattgcctgactaaaatg

SEQ ID NO: 2754155 - DNA, 14 bp, Homo sapiens
ttaccaagagaagg

SEQ ID NO: 2754156 - DNA, 16 bp, Homo sapiens
ttaccacaaaagcaaa

SEQ ID NO: 2754157 - DNA, 18 bp, Homo sapiens
ttaccactggtaacatgt

SEQ ID NO: 2754158 - DNA, 15 bp, Homo sapiens
ttaccagacttcaag

SEQ ID NO: 2754159 - DNA, 16 bp, Homo sapiens
ttaccagacttcaaga

SEQ ID NO: 2754160 - DNA, 15 bp, Homo sapiens
ttactgtaagaaaat

SEQ ID NO: 2754161 - DNA, 14 bp, Homo sapiens
ttacttactgttaa

SEQ ID NO: 2754162 - DNA, 17 bp, Homo sapiens
ttacttctaatcttaaa

SEQ ID NO: 2754163 - DNA, 20 bp, Homo sapiens
ttacttgctataaatagatt

SEQ ID NO: 2754164 - DNA, 18 bp, Homo sapiens
ttacttggcaaattctga

SEQ ID NO: 2754165 - DNA, 13 bp, Homo sapiens
ttactttttatga

SEQ ID NO: 2754166 - DNA, 15 bp, Homo sapiens
ttagaagaagtgtgt

SEQ ID NO: 2754167 - DNA, 21 bp, Homo sapiens
ttagatgcagttctgaagaag

SEQ ID NO: 2754168 - DNA, 22 bp, Homo sapiens
ttagatgcagttctgaagaaga

SEQ ID NO: 2754169 - DNA, 16 bp, Homo sapiens
ttagatgtttatttag

SEQ ID NO: 2754170 - DNA, 15 bp, Homo sapiens
ttagatttttaaatt

SEQ ID NO: 2754171 - DNA, 16 bp, Homo sapiens
ttagcctttgtcccag

SEQ ID NO: 2754172 - DNA, 12 bp, Homo sapiens
ttagctggaaaa

SEQ ID NO: 2754173 - DNA, 19 bp, Homo sapiens
ttagggaactttgatacaa

SEQ ID NO: 2754174 - DNA, 16 bp, Homo sapiens
ttagggttatgattaa

SEQ ID NO: 2754175 - DNA, 23 bp, Homo sapiens
ttagtggatttttttgtcattaa

SEQ ID NO: 2754176 - DNA, 21 bp, Homo sapiens
ttagttttggttatttctaaa

SEQ ID NO: 2754177 - DNA, 11 bp, Homo sapiens
ttataaaaaca

SEQ ID NO: 2754178 - DNA, 13 bp, Homo sapiens
ttataatctccaa

SEQ ID NO: 2754179 - DNA, 16 bp, Homo sapiens
ttataatctccaactt

SEQ ID NO: 2754180 - DNA, 11 bp, Homo sapiens
ttataatcttt

SEQ ID NO: 2754181 - DNA, 16 bp, Homo sapiens
ttataattttgtgaag

SEQ ID NO: 2754182 - DNA, 18 bp, Homo sapiens
ttataattttgtgaagca

SEQ ID NO: 2754183 - DNA, 21 bp, Homo sapiens
ttatactgtgaagttacatgc

SEQ ID NO: 2754184 - DNA, 12 bp, Homo sapiens
ttatagaataaa

SEQ ID NO: 2754185 - DNA, 19 bp, Homo sapiens
ttatagaataaaagctgtg

SEQ ID NO: 2754186 - DNA, 11 bp, Homo sapiens
ttatagtttag

SEQ ID NO: 2754187 - DNA, 18 bp, Homo sapiens
ttatataagcttgtattc

SEQ ID NO: 2754188 - DNA, 14 bp, Homo sapiens
ttatattttatcaa

SEQ ID NO: 2754189 - DNA, 15 bp, Homo sapiens
ttatcttaaactgtt

SEQ ID NO: 2754190 - DNA, 21 bp, Homo sapiens
ttatgaagaattgccaatctt

SEQ ID NO: 2754191 - DNA, 23 bp, Homo sapiens
ttatgaagaattgccaatcttgt

SEQ ID NO: 2754192 - DNA, 17 bp, Homo sapiens
ttatgcatttggaatta

SEQ ID NO: 2754193 - DNA, 21 bp, Homo sapiens
ttatggaaataccaggaccag

SEQ ID NO: 2754194 - DNA, 23 bp, Homo sapiens
ttatggaaataccaggaccagtt

SEQ ID NO: 2754195 - DNA, 10 bp, Homo sapiens
ttatgtgtgt

SEQ ID NO: 2754196 - DNA, 12 bp, Homo sapiens
ttatgtgtgtgt

SEQ ID NO: 2754197 - DNA, 15 bp, Homo sapiens
ttatgttcttataga

SEQ ID NO: 2754198 - DNA, 18 bp, Homo sapiens
ttatgttcttatagaata

SEQ ID NO: 2754199 - DNA, 17 bp, Homo sapiens
ttattactgtaagaaaa

SEQ ID NO: 2754200 - DNA, 19 bp, Homo sapiens
aatgtacctctattagttt

SEQ ID NO: 2754201 - DNA, 12 bp, Homo sapiens
aatgtacttttt

SEQ ID NO: 2754202 - DNA, 18 bp, Homo sapiens
aatgtactttttattgca

SEQ ID NO: 2754203 - DNA, 19 bp, Homo sapiens
aatgtagaaattctaactt

SEQ ID NO: 2754204 - DNA, 18 bp, Homo sapiens
aatgtagttttgtttatg

SEQ ID NO: 2754205 - DNA, 14 bp, Homo sapiens
aatgtgatctatgt

SEQ ID NO: 2754206 - DNA, 17 bp, Homo sapiens
aatgttaccagacttca

SEQ ID NO: 2754207 - DNA, 20 bp, Homo sapiens
aattaggataactaaaattc

SEQ ID NO: 2754208 - DNA, 20 bp, Homo sapiens
aattagttttatatgcttct

SEQ ID NO: 2754209 - DNA, 18 bp, Homo sapiens
aattatttgccttttaaa

SEQ ID NO: 2754210 - DNA, 20 bp, Homo sapiens
aattcagtgggttcagaacc

SEQ ID NO: 2754211 - DNA, 16 bp, Homo sapiens
aattccttaaaatttt

SEQ ID NO: 2754212 - DNA, 17 bp, Homo sapiens
aattccttaaaattttc

SEQ ID NO: 2754213 - DNA, 23 bp, Homo sapiens
aattctaaacttagaaatatgct

SEQ ID NO: 2754214 - DNA, 21 bp, Homo sapiens
aattctatagagatagatatt

SEQ ID NO: 2754215 - DNA, 20 bp, Homo sapiens
aattctccctatcttgtgaa

SEQ ID NO: 2754216 - DNA, 23 bp, Homo sapiens
aattctgttgaaccacctgtgta

SEQ ID NO: 2754217 - DNA, 12 bp, Homo sapiens
aattctttagat

SEQ ID NO: 2754218 - DNA, 14 bp, Homo sapiens
aattctttagattt

SEQ ID NO: 2754219 - DNA, 15 bp, Homo sapiens
aattctttagatttt

SEQ ID NO: 2754220 - DNA, 17 bp, Homo sapiens
aattctttagattttta

SEQ ID NO: 2754221 - DNA, 21 bp, Homo sapiens
aattgaaagcactatgaattt

SEQ ID NO: 2754222 - DNA, 17 bp, Homo sapiens
aattgagactgaaagaa

SEQ ID NO: 2754223 - DNA, 18 bp, Homo sapiens
aattgagactgaaagaaa

SEQ ID NO: 2754224 - DNA, 16 bp, Homo sapiens
aattgagtaattctag

SEQ ID NO: 2754225 - DNA, 16 bp, Homo sapiens
aattggagaaaagcac

SEQ ID NO: 2754226 - DNA, 19 bp, Homo sapiens
aattggagaaaagcactta

SEQ ID NO: 2754227 - DNA, 20 bp, Homo sapiens
aattggagaaaagcacttaa

SEQ ID NO: 2754228 - DNA, 15 bp, Homo sapiens
aattggagctcgtgg

SEQ ID NO: 2754229 - DNA, 14 bp, Homo sapiens
aattggcattttaa

SEQ ID NO: 2754230 - DNA, 11 bp, Homo sapiens
aattgtgatgt

SEQ ID NO: 2754231 - DNA, 13 bp, Homo sapiens
aattgtgcaaaat

SEQ ID NO: 2754232 - DNA, 17 bp, Homo sapiens
aattgtgcaaaatattg

SEQ ID NO: 2754233 - DNA, 23 bp, Homo sapiens
aattgtgtgaaaggtacttcaaa

SEQ ID NO: 2754234 - DNA, 24 bp, Homo sapiens
aattgttaccactggtaacatgtg

SEQ ID NO: 2754235 - DNA, 12 bp, Homo sapiens
aatttaaaaaac

SEQ ID NO: 2754236 - DNA, 20 bp, Homo sapiens
aatttaaaacacagtattgt

SEQ ID NO: 2754237 - DNA, 21 bp, Homo sapiens
aatttaaaacacagtattgta

SEQ ID NO: 2754238 - DNA, 23 bp, Homo sapiens
aatttacctctcattagaaaggc

SEQ ID NO: 2754239 - DNA, 14 bp, Homo sapiens
aatttatgtgatgg

SEQ ID NO: 2754240 - DNA, 17 bp, Homo sapiens
aatttcaaaagaacatt

SEQ ID NO: 2754241 - DNA, 13 bp, Homo sapiens
aatttccatatcc

SEQ ID NO: 2754242 - DNA, 13 bp, Homo sapiens
aatttgtaatata

SEQ ID NO: 2754243 - DNA, 23 bp, Homo sapiens
aatttgtaatatatcctgtttgt

SEQ ID NO: 2754244 - DNA, 13 bp, Homo sapiens
aatttgtccattt

SEQ ID NO: 2754245 - DNA, 20 bp, Homo sapiens
aatttgtccatttaaaaatg

SEQ ID NO: 2754246 - DNA, 21 bp, Homo sapiens
aatttgtccatttaaaaatga

SEQ ID NO: 2754247 - DNA, 12 bp, Homo sapiens
aattttaagtgc

SEQ ID NO: 2754248 - DNA, 17 bp, Homo sapiens
aattttctctaaactgt

SEQ ID NO: 2754249 - DNA, 19 bp, Homo sapiens
aatttttaaaactgcattt

SEQ ID NO: 2754250 - DNA, 19 bp, Homo sapiens
aatttttatatttgaaata

SEQ ID NO: 2754251 - DNA, 22 bp, Homo sapiens
aattttttctctaggaaatatt

SEQ ID NO: 2754252 - DNA, 13 bp, Homo sapiens
aattttttgatta

SEQ ID NO: 2754253 - DNA, 15 bp, Homo sapiens
aattttttttgtaca

SEQ ID NO: 2754254 - DNA, 15 bp, Homo sapiens
acaaaaagttttttt

SEQ ID NO: 2754255 - DNA, 21 bp, Homo sapiens
acaaaactatcctatgccttc

SEQ ID NO: 2754256 - DNA, 18 bp, Homo sapiens
acaaaagcttgtgtatct

SEQ ID NO: 2754257 - DNA, 18 bp, Homo sapiens
acaaactgtaaaaaatgt

SEQ ID NO: 2754258 - DNA, 11 bp, Homo sapiens
acaaagagctg

SEQ ID NO: 2754259 - DNA, 12 bp, Homo sapiens
acaaagagctga

SEQ ID NO: 2754260 - DNA, 15 bp, Homo sapiens
acaaatctgtataaa

SEQ ID NO: 2754261 - DNA, 19 bp, Homo sapiens
acaaatctgtataaatgtc

SEQ ID NO: 2754262 - DNA, 22 bp, Homo sapiens
acaaccctgttgagtatttgct

SEQ ID NO: 2754263 - DNA, 13 bp, Homo sapiens
acaactatattgt

SEQ ID NO: 2754264 - DNA, 22 bp, Homo sapiens
acaagattttttaattgtttaa

SEQ ID NO: 2754265 - DNA, 16 bp, Homo sapiens
acaagcaggatggctg

SEQ ID NO: 2754266 - DNA, 22 bp, Homo sapiens
acaagctcacagacctttgaac

SEQ ID NO: 2754267 - DNA, 14 bp, Homo sapiens
acaaggttgctgtt

SEQ ID NO: 2754268 - DNA, 23 bp, Homo sapiens
acaatacatcccttacctgggaa

SEQ ID NO: 2754269 - DNA, 20 bp, Homo sapiens
acaatgccgcctgtcaataa

SEQ ID NO: 2754270 - DNA, 20 bp, Homo sapiens
acaattctccctatcttgtg

SEQ ID NO: 2754271 - DNA, 20 bp, Homo sapiens
acacagtattgtagaaagct

SEQ ID NO: 2754272 - DNA, 14 bp, Homo sapiens
acacattttgtaaa

SEQ ID NO: 2754273 - DNA, 19 bp, Homo sapiens
acacattttgtaaatctgt

SEQ ID NO: 2754274 - DNA, 16 bp, Homo sapiens
acacctcagaaattga

SEQ ID NO: 2754275 - DNA, 14 bp, Homo sapiens
acactaagagagaa

SEQ ID NO: 2754276 - DNA, 14 bp, Homo sapiens
acactgaagaagca

SEQ ID NO: 2754277 - DNA, 16 bp, Homo sapiens
acagaagctccaggta

SEQ ID NO: 2754278 - DNA, 19 bp, Homo sapiens
acagctgtatgattcccag

SEQ ID NO: 2754279 - DNA, 22 bp, Homo sapiens
acaggatggttcccttgatgaa

SEQ ID NO: 2754280 - DNA, 23 bp, Homo sapiens
acagtgcttctacacatttcatc

SEQ ID NO: 2754281 - DNA, 17 bp, Homo sapiens
acagttggcacttctgc

SEQ ID NO: 2754282 - DNA, 14 bp, Homo sapiens
acataacttcagtg

SEQ ID NO: 2754283 - DNA, 15 bp, Homo sapiens
acataacttcagtgc

SEQ ID NO: 2754284 - DNA, 21 bp, Homo sapiens
acatatcattctgtgattaaa

SEQ ID NO: 2754285 - DNA, 19 bp, Homo sapiens
acatattttttatatctgg

SEQ ID NO: 2754286 - DNA, 17 bp, Homo sapiens
acatcgcttctttttca

SEQ ID NO: 2754287 - DNA, 19 bp, Homo sapiens
acatctgtgcagggctggt

SEQ ID NO: 2754288 - DNA, 22 bp, Homo sapiens
acatctgtgcagggctggtttg

SEQ ID NO: 2754289 - DNA, 13 bp, Homo sapiens
acatcttgaaaat

SEQ ID NO: 2754290 - DNA, 18 bp, Homo sapiens
acatcttgaaaatgccac

SEQ ID NO: 2754291 - DNA, 19 bp, Homo sapiens
acatgcataaaagggtcaa

SEQ ID NO: 2754292 - DNA, 22 bp, Homo sapiens
acatgcctatatgagaagaata

SEQ ID NO: 2754293 - DNA, 14 bp, Homo sapiens
acatgggacatttg

SEQ ID NO: 2754294 - DNA, 21 bp, Homo sapiens
acattaggaagctgaattatt

SEQ ID NO: 2754295 - DNA, 15 bp, Homo sapiens
acattcagctgaggt

SEQ ID NO: 2754296 - DNA, 14 bp, Homo sapiens
acattcctaaaatg

SEQ ID NO: 2754297 - DNA, 15 bp, Homo sapiens
acattcttatatttt

SEQ ID NO: 2754298 - DNA, 18 bp, Homo sapiens
acatttcatctaatttaa

SEQ ID NO: 2754299 - DNA, 16 bp, Homo sapiens
acatttggaacagtga

SEQ ID NO: 2754300 - DNA, 19 bp, Homo sapiens
acatttgtataaaataatt

SEQ ID NO: 2754301 - DNA, 16 bp, Homo sapiens
acattttgtaaatctg

SEQ ID NO: 2754302 - DNA, 18 bp, Homo sapiens
acattttgtaaatctgta

SEQ ID NO: 2754303 - DNA, 21 bp, Homo sapiens
accaaactcctgcctgagaat

SEQ ID NO: 2754304 - DNA, 13 bp, Homo sapiens
accaatcatgaat

SEQ ID NO: 2754305 - DNA, 12 bp, Homo sapiens
accagacttcaa

SEQ ID NO: 2754306 - DNA, 19 bp, Homo sapiens
accatgtcgtagttactct

SEQ ID NO: 2754307 - DNA, 23 bp, Homo sapiens
accatgttggttgcactttgtag

SEQ ID NO: 2754308 - DNA, 14 bp, Homo sapiens
accattggggagga

SEQ ID NO: 2754309 - DNA, 22 bp, Homo sapiens
acccctggctaccttgtgggaa

SEQ ID NO: 2754310 - DNA, 15 bp, Homo sapiens
acccctttaaactgt

SEQ ID NO: 2754311 - DNA, 11 bp, Homo sapiens
accctgttgag

SEQ ID NO: 2754312 - DNA, 15 bp, Homo sapiens
accgaataaatgttt

SEQ ID NO: 2754313 - DNA, 14 bp, Homo sapiens
accggcactcatga

SEQ ID NO: 2754314 - DNA, 21 bp, Homo sapiens
accgggcatgtctgcctggag

SEQ ID NO: 2754315 - DNA, 21 bp, Homo sapiens
acctaatgaaagtgatgacat

SEQ ID NO: 2754316 - DNA, 22 bp, Homo sapiens
acctaatgaaagtgatgacata

SEQ ID NO: 2754317 - DNA, 20 bp, Homo sapiens
acctacaaaagcttgtgtat

SEQ ID NO: 2754318 - DNA, 23 bp, Homo sapiens
acctacaaaagcttgtgtatctt

SEQ ID NO: 2754319 - DNA, 12 bp, Homo sapiens
acctagccggaa

SEQ ID NO: 2754320 - DNA, 20 bp, Homo sapiens
acctctcattagaaaggcta

SEQ ID NO: 2754321 - DNA, 14 bp, Homo sapiens
acctgccaagaaga

SEQ ID NO: 2754322 - DNA, 19 bp, Homo sapiens
acctgtagatgcagaaaaa

SEQ ID NO: 2754323 - DNA, 21 bp, Homo sapiens
acctgtagatgcagaaaaaga

SEQ ID NO: 2754324 - DNA, 15 bp, Homo sapiens
acctgtagtcccagc

SEQ ID NO: 2754325 - DNA, 12 bp, Homo sapiens
accttgtgggaa

SEQ ID NO: 2754326 - DNA, 23 bp, Homo sapiens
atatttgaaatattgacttttta

SEQ ID NO: 2754327 - DNA, 13 bp, Homo sapiens
atcaaaaataatg

SEQ ID NO: 2754328 - DNA, 22 bp, Homo sapiens
atcaatagtgtcctatgcaata

SEQ ID NO: 2754329 - DNA, 17 bp, Homo sapiens
atcacactcaaactttg

SEQ ID NO: 2754330 - DNA, 23 bp, Homo sapiens
atcacttaacattcctaaaatgc

SEQ ID NO: 2754331 - DNA, 20 bp, Homo sapiens
atcacttgaggccaggactt

SEQ ID NO: 2754332 - DNA, 19 bp, Homo sapiens
atcagagatgggaaaacca

SEQ ID NO: 2754333 - DNA, 15 bp, Homo sapiens
atcaggagcctgcta

SEQ ID NO: 2754334 - DNA, 20 bp, Homo sapiens
atcaggagcctgctaaggaa

SEQ ID NO: 2754335 - DNA, 16 bp, Homo sapiens
atcaggccattgtccc

SEQ ID NO: 2754336 - DNA, 21 bp, Homo sapiens
atcatgaattagttttatatg

SEQ ID NO: 2754337 - DNA, 23 bp, Homo sapiens
atcatgtttacagaggacagtat

SEQ ID NO: 2754338 - DNA, 20 bp, Homo sapiens
atcattatcagcctgtgcca

SEQ ID NO: 2754339 - DNA, 15 bp, Homo sapiens
atcattttaggaaag

SEQ ID NO: 2754340 - DNA, 16 bp, Homo sapiens
atcattttaggaaagg

SEQ ID NO: 2754341 - DNA, 21 bp, Homo sapiens
atccaagacaaactaaacttt

SEQ ID NO: 2754342 - DNA, 21 bp, Homo sapiens
atccataaaattggattacag

SEQ ID NO: 2754343 - DNA, 20 bp, Homo sapiens
atccatggggctgattgtat

SEQ ID NO: 2754344 - DNA, 22 bp, Homo sapiens
atcccagctttaaaaagaaaaa

SEQ ID NO: 2754345 - DNA, 15 bp, Homo sapiens
atccgaaatcagcag

SEQ ID NO: 2754346 - DNA, 21 bp, Homo sapiens
atcctcttgccacatcttgaa

SEQ ID NO: 2754347 - DNA, 22 bp, Homo sapiens
atcctcttgccacatcttgaaa

SEQ ID NO: 2754348 - DNA, 21 bp, Homo sapiens
atcctgttaaattttctctaa

SEQ ID NO: 2754349 - DNA, 13 bp, Homo sapiens
atcctgtttgtat

SEQ ID NO: 2754350 - DNA, 13 bp, Homo sapiens
atccttctggctg

SEQ ID NO: 2754351 - DNA, 14 bp, Homo sapiens
atccttctggctgt

SEQ ID NO: 2754352 - DNA, 12 bp, Homo sapiens
atccttgaagat

SEQ ID NO: 2754353 - DNA, 16 bp, Homo sapiens
atcgcttctttttcaa

SEQ ID NO: 2754354 - DNA, 15 bp, Homo sapiens
atcgttattataaat

SEQ ID NO: 2754355 - DNA, 23 bp, Homo sapiens
atctaaacccagcaaaacagatt

SEQ ID NO: 2754356 - DNA, 24 bp, Homo sapiens
atctaaacccagcaaaacagattc

SEQ ID NO: 2754357 - DNA, 14 bp, Homo sapiens
atctatattctaaa

SEQ ID NO: 2754358 - DNA, 16 bp, Homo sapiens
atctcaggacccgccc

SEQ ID NO: 2754359 - DNA, 23 bp, Homo sapiens
atctcatttccaagcaagtatta

SEQ ID NO: 2754360 - DNA, 11 bp, Homo sapiens
atctccaactt

SEQ ID NO: 2754361 - DNA, 16 bp, Homo sapiens
atctccaactttattt

SEQ ID NO: 2754362 - DNA, 19 bp, Homo sapiens
atctcctgagttgtataaa

SEQ ID NO: 2754363 - DNA, 17 bp, Homo sapiens
atctgagtattgaatga

SEQ ID NO: 2754364 - DNA, 21 bp, Homo sapiens
atctgtacttttttcaaatat

SEQ ID NO: 2754365 - DNA, 22 bp, Homo sapiens
atctgtgaggggctctctcatg

SEQ ID NO: 2754366 - DNA, 12 bp, Homo sapiens
atctgtgcaggg

SEQ ID NO: 2754367 - DNA, 13 bp, Homo sapiens
atctgtttattct

SEQ ID NO: 2754368 - DNA, 15 bp, Homo sapiens
atctgtttattctgg

SEQ ID NO: 2754369 - DNA, 19 bp, Homo sapiens
atcttaaatcagaataaat

SEQ ID NO: 2754370 - DNA, 20 bp, Homo sapiens
atcttaaatcagaataaatt

SEQ ID NO: 2754371 - DNA, 22 bp, Homo sapiens
atcttaaatcagaataaattaa

SEQ ID NO: 2754372 - DNA, 17 bp, Homo sapiens
atcttagggaactttga

SEQ ID NO: 2754373 - DNA, 11 bp, Homo sapiens
atcttgaaaat

SEQ ID NO: 2754374 - DNA, 16 bp, Homo sapiens
atcttgattaatgtac

SEQ ID NO: 2754375 - DNA, 18 bp, Homo sapiens
atcttgattaatgtactt

SEQ ID NO: 2754376 - DNA, 19 bp, Homo sapiens
atcttgattaatgtacttt

SEQ ID NO: 2754377 - DNA, 23 bp, Homo sapiens
atcttgattaatgtactttttat

SEQ ID NO: 2754378 - DNA, 22 bp, Homo sapiens
atcttgcagaagttcttagtgt

SEQ ID NO: 2754379 - DNA, 15 bp, Homo sapiens
atcttgttttaagca

SEQ ID NO: 2754380 - DNA, 17 bp, Homo sapiens
atcttgttttaagcaaa

SEQ ID NO: 2754381 - DNA, 17 bp, Homo sapiens
atctttcatagttctgt

SEQ ID NO: 2754382 - DNA, 18 bp, Homo sapiens
atctttcatagttctgtt

SEQ ID NO: 2754383 - DNA, 17 bp, Homo sapiens
atcttttagctagaatc

SEQ ID NO: 2754384 - DNA, 15 bp, Homo sapiens
atgaaagtagctgta

SEQ ID NO: 2754385 - DNA, 20 bp, Homo sapiens
atgaaatattatgttaaaac

SEQ ID NO: 2754386 - DNA, 21 bp, Homo sapiens
atgaaatattatgttaaaact

SEQ ID NO: 2754387 - DNA, 21 bp, Homo sapiens
atgaataaaaataaagttttt

SEQ ID NO: 2754388 - DNA, 12 bp, Homo sapiens
atgaatattaca

SEQ ID NO: 2754389 - DNA, 17 bp, Homo sapiens
atgaattacatttgtat

SEQ ID NO: 2754390 - DNA, 17 bp, Homo sapiens
atgaattagttgcattg

SEQ ID NO: 2754391 - DNA, 21 bp, Homo sapiens
atgaattagttttatatgctt

SEQ ID NO: 2754392 - DNA, 23 bp, Homo sapiens
atgaattagttttatatgcttct

SEQ ID NO: 2754393 - DNA, 16 bp, Homo sapiens
atgacagaatatacac

SEQ ID NO: 2754394 - DNA, 18 bp, Homo sapiens
atgacagaatatacacat

SEQ ID NO: 2754395 - DNA, 19 bp, Homo sapiens
atgacagaatatacacatt

SEQ ID NO: 2754396 - DNA, 20 bp, Homo sapiens
atgaccttaaggaaaagtaa

SEQ ID NO: 2754397 - DNA, 15 bp, Homo sapiens
atgacggcctgcctg

SEQ ID NO: 2754398 - DNA, 18 bp, Homo sapiens
atgacggcctgcctgcaa

SEQ ID NO: 2754399 - DNA, 20 bp, Homo sapiens
atgagagacacactgaagaa

SEQ ID NO: 2754400 - DNA, 23 bp, Homo sapiens
atgagagacacactgaagaagca

SEQ ID NO: 2754401 - DNA, 13 bp, Homo sapiens
atgatcaaaaata

SEQ ID NO: 2754402 - DNA, 18 bp, Homo sapiens
atgattaagtaatgataa

SEQ ID NO: 2754403 - DNA, 19 bp, Homo sapiens
atgatttctccagaaattt

SEQ ID NO: 2754404 - DNA, 20 bp, Homo sapiens
atgatttctccagaaattta

SEQ ID NO: 2754405 - DNA, 18 bp, Homo sapiens
atgcaagtgtttctgttc

SEQ ID NO: 2754406 - DNA, 21 bp, Homo sapiens
atgcaataaaattatttgcag

SEQ ID NO: 2754407 - DNA, 14 bp, Homo sapiens
atgcaatatttgta

SEQ ID NO: 2754408 - DNA, 15 bp, Homo sapiens
atgcagaaaaagaaa

SEQ ID NO: 2754409 - DNA, 15 bp, Homo sapiens
atgcagtgccctaga

SEQ ID NO: 2754410 - DNA, 13 bp, Homo sapiens
atgcagttctgaa

SEQ ID NO: 2754411 - DNA, 15 bp, Homo sapiens
atgcagttctgaaga

SEQ ID NO: 2754412 - DNA, 18 bp, Homo sapiens
atgcagttctgaagaaga

SEQ ID NO: 2754413 - DNA, 22 bp, Homo sapiens
atgcataaaagggtcaaacctg

SEQ ID NO: 2754414 - DNA, 21 bp, Homo sapiens
atgcattctatcgttattata

SEQ ID NO: 2754415 - DNA, 14 bp, Homo sapiens
atgccgcctgtcaa

SEQ ID NO: 2754416 - DNA, 20 bp, Homo sapiens
atgccgcctgtcaataaatg

SEQ ID NO: 2754417 - DNA, 19 bp, Homo sapiens
atgccttcaaatagtatag

SEQ ID NO: 2754418 - DNA, 19 bp, Homo sapiens
atgcgacttgttttgctgc

SEQ ID NO: 2754419 - DNA, 12 bp, Homo sapiens
atgctaaacttg

SEQ ID NO: 2754420 - DNA, 14 bp, Homo sapiens
atgctctgatgcag

SEQ ID NO: 2754421 - DNA, 14 bp, Homo sapiens
atgctgtattttaa

SEQ ID NO: 2754422 - DNA, 19 bp, Homo sapiens
atgctgtattttaaaagaa

SEQ ID NO: 2754423 - DNA, 20 bp, Homo sapiens
atgcttcaaagtccacatta

SEQ ID NO: 2754424 - DNA, 20 bp, Homo sapiens
atgcttctgcctattgctga

SEQ ID NO: 2754425 - DNA, 21 bp, Homo sapiens
atgcttctgttttataatttt

SEQ ID NO: 2754426 - DNA, 14 bp, Homo sapiens
atggaaaatataca

SEQ ID NO: 2754427 - DNA, 22 bp, Homo sapiens
atggaaaattaattctaaactt

SEQ ID NO: 2754428 - DNA, 23 bp, Homo sapiens
atggaattggagctcgtgggaca

SEQ ID NO: 2754429 - DNA, 19 bp, Homo sapiens
atggacatgagtttaaagc

SEQ ID NO: 2754430 - DNA, 14 bp, Homo sapiens
atggcactagtatt

SEQ ID NO: 2754431 - DNA, 16 bp, Homo sapiens
atggcactagtatttc

SEQ ID NO: 2754432 - DNA, 13 bp, Homo sapiens
atggcatttgcag

SEQ ID NO: 2754433 - DNA, 16 bp, Homo sapiens
atggcctgggggatgt

SEQ ID NO: 2754434 - DNA, 20 bp, Homo sapiens
atggctggaacactgtactg

SEQ ID NO: 2754435 - DNA, 23 bp, Homo sapiens
atggcttcctggcaatagtcaaa

SEQ ID NO: 2754436 - DNA, 20 bp, Homo sapiens
atgggacatttgctcatgga

SEQ ID NO: 2754437 - DNA, 16 bp, Homo sapiens
atggtgtgaactaagt

SEQ ID NO: 2754438 - DNA, 20 bp, Homo sapiens
atggtgtgaactaagttatt

SEQ ID NO: 2754439 - DNA, 16 bp, Homo sapiens
atggttctcaggcctg

SEQ ID NO: 2754440 - DNA, 15 bp, Homo sapiens
atgtaaagctgttaa

SEQ ID NO: 2754441 - DNA, 16 bp, Homo sapiens
atgtaaagctgttaaa

SEQ ID NO: 2754442 - DNA, 19 bp, Homo sapiens
atgtaaagctgttaaaata

SEQ ID NO: 2754443 - DNA, 22 bp, Homo sapiens
atgtaaagctgttaaaatacat

SEQ ID NO: 2754444 - DNA, 23 bp, Homo sapiens
atgtaaagctgttaaaatacata

SEQ ID NO: 2754445 - DNA, 17 bp, Homo sapiens
atgtactttttattgca

SEQ ID NO: 2754446 - DNA, 20 bp, Homo sapiens
atgtactttttattgcatgg

SEQ ID NO: 2754447 - DNA, 12 bp, Homo sapiens
atgtagaaattc

SEQ ID NO: 2754448 - DNA, 15 bp, Homo sapiens
atgtagaaattctaa

SEQ ID NO: 2754449 - DNA, 17 bp, Homo sapiens
atgtagttttgtttatg

SEQ ID NO: 2754450 - DNA, 19 bp, Homo sapiens
atgtcaaattgtgcaaaat

SEQ ID NO: 2754451 - DNA, 21 bp, Homo sapiens
ctggaaatcagggttagtatt

SEQ ID NO: 2754452 - DNA, 16 bp, Homo sapiens
ctggagccctgttcct

SEQ ID NO: 2754453 - DNA, 21 bp, Homo sapiens
ctggagccctgttcctccctc

SEQ ID NO: 2754454 - DNA, 12 bp, Homo sapiens
ctggaggtttgt

SEQ ID NO: 2754455 - DNA, 14 bp, Homo sapiens
ctggataaatttaa

SEQ ID NO: 2754456 - DNA, 19 bp, Homo sapiens
ctggataaatttaaaacac

SEQ ID NO: 2754457 - DNA, 22 bp, Homo sapiens
ctggataaatttaaaacacagt

SEQ ID NO: 2754458 - DNA, 14 bp, Homo sapiens
ctggatctgtgagg

SEQ ID NO: 2754459 - DNA, 21 bp, Homo sapiens
ctggccagtggctggatctgt

SEQ ID NO: 2754460 - DNA, 13 bp, Homo sapiens
ctggccctgtgcc

SEQ ID NO: 2754461 - DNA, 13 bp, Homo sapiens
ctggcctgaggtc

SEQ ID NO: 2754462 - DNA, 15 bp, Homo sapiens
ctggctaccttgtgg

SEQ ID NO: 2754463 - DNA, 18 bp, Homo sapiens
ctggctaccttgtgggaa

SEQ ID NO: 2754464 - DNA, 16 bp, Homo sapiens
ctgggaaatgttttaa

SEQ ID NO: 2754465 - DNA, 13 bp, Homo sapiens
ctgggctgggttt

SEQ ID NO: 2754466 - DNA, 22 bp, Homo sapiens
ctgggctgggtttgctgtcttg

SEQ ID NO: 2754467 - DNA, 13 bp, Homo sapiens
ctgggcttggctc

SEQ ID NO: 2754468 - DNA, 17 bp, Homo sapiens
ctggggatgtctctcat

SEQ ID NO: 2754469 - DNA, 14 bp, Homo sapiens
ctgggggaaaaagc

SEQ ID NO: 2754470 - DNA, 20 bp, Homo sapiens
ctggggtaagcggaataaac

SEQ ID NO: 2754471 - DNA, 13 bp, Homo sapiens
ctgggtttgctgt

SEQ ID NO: 2754472 - DNA, 21 bp, Homo sapiens
ctggtcccctccctctgtctt

SEQ ID NO: 2754473 - DNA, 19 bp, Homo sapiens
ctggtctgttaatcttttt

SEQ ID NO: 2754474 - DNA, 17 bp, Homo sapiens
ctggttctgtgttgaaa

SEQ ID NO: 2754475 - DNA, 19 bp, Homo sapiens
ctggttctgtgttgaaata

SEQ ID NO: 2754476 - DNA, 16 bp, Homo sapiens
ctggtttcctgcccag

SEQ ID NO: 2754477 - DNA, 17 bp, Homo sapiens
ctggtttcctgcccagc

SEQ ID NO: 2754478 - DNA, 21 bp, Homo sapiens
ctggtttcctgcccagcctgg

SEQ ID NO: 2754479 - DNA, 13 bp, Homo sapiens
ctggtttgttctg

SEQ ID NO: 2754480 - DNA, 17 bp, Homo sapiens
ctggtttgttctgactt

SEQ ID NO: 2754481 - DNA, 20 bp, Homo sapiens
ctgtactccttggatttgca

SEQ ID NO: 2754482 - DNA, 21 bp, Homo sapiens
ctgtactccttggatttgcat

SEQ ID NO: 2754483 - DNA, 17 bp, Homo sapiens
ctgtacttttttcaaat

SEQ ID NO: 2754484 - DNA, 19 bp, Homo sapiens
ctgtagatgcagaaaaaga

SEQ ID NO: 2754485 - DNA, 19 bp, Homo sapiens
ctgtataaatgtctattat

SEQ ID NO: 2754486 - DNA, 15 bp, Homo sapiens
ctgtatgattcccag

SEQ ID NO: 2754487 - DNA, 16 bp, Homo sapiens
ctgtattttaaaagaa

SEQ ID NO: 2754488 - DNA, 20 bp, Homo sapiens
ctgtattttaaaagaatgat

SEQ ID NO: 2754489 - DNA, 22 bp, Homo sapiens
ctgtcttcggccgagctggttt

SEQ ID NO: 2754490 - DNA, 21 bp, Homo sapiens
ctgtgaacagtacagtattta

SEQ ID NO: 2754491 - DNA, 23 bp, Homo sapiens
ctgtgaagttacatgcataaaag

SEQ ID NO: 2754492 - DNA, 19 bp, Homo sapiens
ctgtgaggggctctctcat

SEQ ID NO: 2754493 - DNA, 17 bp, Homo sapiens
ctgtgcgtggaaaaaga

SEQ ID NO: 2754494 - DNA, 18 bp, Homo sapiens
ctgtgcgtggaaaaagac

SEQ ID NO: 2754495 - DNA, 13 bp, Homo sapiens
ctgtgctggagcc

SEQ ID NO: 2754496 - DNA, 13 bp, Homo sapiens
ctgtgctgtgttt

SEQ ID NO: 2754497 - DNA, 20 bp, Homo sapiens
ctgtggaatgaagcttttta

SEQ ID NO: 2754498 - DNA, 15 bp, Homo sapiens
ctgtgtgtgtgtatg

SEQ ID NO: 2754499 - DNA, 16 bp, Homo sapiens
ctgtgtgtgtgtatgt

SEQ ID NO: 2754500 - DNA, 15 bp, Homo sapiens
ctgttaaaactgtac

SEQ ID NO: 2754501 - DNA, 17 bp, Homo sapiens
ctgttaaaactgtacct

SEQ ID NO: 2754502 - DNA, 17 bp, Homo sapiens
ctgttaaatatttttgt

SEQ ID NO: 2754503 - DNA, 19 bp, Homo sapiens
ctgttaaatatttttgtac

SEQ ID NO: 2754504 - DNA, 15 bp, Homo sapiens
ctgttaaattttctc

SEQ ID NO: 2754505 - DNA, 19 bp, Homo sapiens
ctgttataatctttcacag

SEQ ID NO: 2754506 - DNA, 16 bp, Homo sapiens
ctgttgagtatttgct

SEQ ID NO: 2754507 - DNA, 17 bp, Homo sapiens
ctgttgagtatttgctg

SEQ ID NO: 2754508 - DNA, 18 bp, Homo sapiens
ctgttgagtatttgctgt

SEQ ID NO: 2754509 - DNA, 15 bp, Homo sapiens
ctgttgtgcagtgtg

SEQ ID NO: 2754510 - DNA, 22 bp, Homo sapiens
ctgttgtgcagtgtgcctgtca

SEQ ID NO: 2754511 - DNA, 13 bp, Homo sapiens
ctgtttatggaaa

SEQ ID NO: 2754512 - DNA, 20 bp, Homo sapiens
ctgtttgtatttttttccaa

SEQ ID NO: 2754513 - DNA, 21 bp, Homo sapiens
ctgtttgtatttttttccaag

SEQ ID NO: 2754514 - DNA, 14 bp, Homo sapiens
cttaaaatgcaata

SEQ ID NO: 2754515 - DNA, 19 bp, Homo sapiens
cttaaaatgcaatatttgt

SEQ ID NO: 2754516 - DNA, 20 bp, Homo sapiens
cttaaaatgcaatatttgta

SEQ ID NO: 2754517 - DNA, 22 bp, Homo sapiens
cttaaaatgcaatatttgtaag

SEQ ID NO: 2754518 - DNA, 19 bp, Homo sapiens
cttaaaattttcattctga

SEQ ID NO: 2754519 - DNA, 14 bp, Homo sapiens
cttaaatatttgaa

SEQ ID NO: 2754520 - DNA, 13 bp, Homo sapiens
cttaaatcagaat

SEQ ID NO: 2754521 - DNA, 16 bp, Homo sapiens
cttaaatcagaataaa

SEQ ID NO: 2754522 - DNA, 17 bp, Homo sapiens
cttaaatcagaataaat

SEQ ID NO: 2754523 - DNA, 19 bp, Homo sapiens
cttaaatcagaataaatta

SEQ ID NO: 2754524 - DNA, 19 bp, Homo sapiens
cttaacattcctaaaatgc

SEQ ID NO: 2754525 - DNA, 21 bp, Homo sapiens
cttaagaagactgcattatat

SEQ ID NO: 2754526 - DNA, 21 bp, Homo sapiens
cttacaggcatggacatgcag

SEQ ID NO: 2754527 - DNA, 16 bp, Homo sapiens
cttacattgcctgact

SEQ ID NO: 2754528 - DNA, 23 bp, Homo sapiens
cttacattgcctgactaaaatgt

SEQ ID NO: 2754529 - DNA, 20 bp, Homo sapiens
cttagatgcagttctgaaga

SEQ ID NO: 2754530 - DNA, 16 bp, Homo sapiens
cttagctgcactgttt

SEQ ID NO: 2754531 - DNA, 23 bp, Homo sapiens
cttagctgcactgtttatggaaa

SEQ ID NO: 2754532 - DNA, 21 bp, Homo sapiens
cttatagaataaaagctgtgg

SEQ ID NO: 2754533 - DNA, 13 bp, Homo sapiens
cttatttttgaat

SEQ ID NO: 2754534 - DNA, 15 bp, Homo sapiens
cttatttttgaattc

SEQ ID NO: 2754535 - DNA, 18 bp, Homo sapiens
cttcaaatagtatagaaa

SEQ ID NO: 2754536 - DNA, 12 bp, Homo sapiens
cttcaaatttga

SEQ ID NO: 2754537 - DNA, 21 bp, Homo sapiens
cttcaaattttttaaaagaga

SEQ ID NO: 2754538 - DNA, 23 bp, Homo sapiens
cttcaagatcctcttgccacatc

SEQ ID NO: 2754539 - DNA, 15 bp, Homo sapiens
cttcaggctctgccc

SEQ ID NO: 2754540 - DNA, 14 bp, Homo sapiens
cttcagtgcaagag

SEQ ID NO: 2754541 - DNA, 15 bp, Homo sapiens
cttccaccggcactc

SEQ ID NO: 2754542 - DNA, 16 bp, Homo sapiens
cttccaccggcactca

SEQ ID NO: 2754543 - DNA, 20 bp, Homo sapiens
cttccaccggcactcatgac

SEQ ID NO: 2754544 - DNA, 21 bp, Homo sapiens
cttccaccggcactcatgacg

SEQ ID NO: 2754545 - DNA, 19 bp, Homo sapiens
cttcccgagcgctggtccc

SEQ ID NO: 2754546 - DNA, 18 bp, Homo sapiens
cttcggccgagctggttt

SEQ ID NO: 2754547 - DNA, 14 bp, Homo sapiens
cttctaatcttaaa

SEQ ID NO: 2754548 - DNA, 15 bp, Homo sapiens
cttcttatctaaacc

SEQ ID NO: 2754549 - DNA, 14 bp, Homo sapiens
cttcttggctggtt

SEQ ID NO: 2754550 - DNA, 15 bp, Homo sapiens
cttcttttctttgta

SEQ ID NO: 2754551 - DNA, 16 bp, Homo sapiens
cttcttttctttgtat

SEQ ID NO: 2754552 - DNA, 22 bp, Homo sapiens
cttcttttttgtaaaaactttt

SEQ ID NO: 2754553 - DNA, 13 bp, Homo sapiens
cttgaaaatgcca

SEQ ID NO: 2754554 - DNA, 12 bp, Homo sapiens
cttgatgaagaa

SEQ ID NO: 2754555 - DNA, 23 bp, Homo sapiens
cttgccacatcttgaaaatgcca

SEQ ID NO: 2754556 - DNA, 12 bp, Homo sapiens
cttggagccttc

SEQ ID NO: 2754557 - DNA, 15 bp, Homo sapiens
cttggagccttccac

SEQ ID NO: 2754558 - DNA, 19 bp, Homo sapiens
cttggagccttccaccggc

SEQ ID NO: 2754559 - DNA, 16 bp, Homo sapiens
cttggatttgcatttt

SEQ ID NO: 2754560 - DNA, 14 bp, Homo sapiens
cttggtagcacttt

SEQ ID NO: 2754561 - DNA, 14 bp, Homo sapiens
cttggtgctggttt

SEQ ID NO: 2754562 - DNA, 12 bp, Homo sapiens
cttgtgaagttg

SEQ ID NO: 2754563 - DNA, 15 bp, Homo sapiens
cttgtgaagttgttt

SEQ ID NO: 2754564 - DNA, 14 bp, Homo sapiens
cttgtgggaataaa

SEQ ID NO: 2754565 - DNA, 17 bp, Homo sapiens
cttgtgggaataaacag

SEQ ID NO: 2754566 - DNA, 18 bp, Homo sapiens
cttgttccaatgccacat

SEQ ID NO: 2754567 - DNA, 19 bp, Homo sapiens
cttgttttaagcaaatgca

SEQ ID NO: 2754568 - DNA, 21 bp, Homo sapiens
cttgttttaagcaaatgcatt

SEQ ID NO: 2754569 - DNA, 13 bp, Homo sapiens
ctttaaaaagaaa

SEQ ID NO: 2754570 - DNA, 17 bp, Homo sapiens
ctttaaaaataaaagct

SEQ ID NO: 2754571 - DNA, 20 bp, Homo sapiens
ctttaaaaataaaagctatt

SEQ ID NO: 2754572 - DNA, 14 bp, Homo sapiens
ctttaaactactga

SEQ ID NO: 2754573 - DNA, 11 bp, Homo sapiens
ctttaaactgt

SEQ ID NO: 2754574 - DNA, 22 bp, Homo sapiens
ctttaatcacttaacattccta

SEQ ID NO: 2754575 - DNA, 17 bp, Homo sapiens
ctttagatttttaaatt

SEQ ID NO: 2754576 - DNA, 18 bp, Homo sapiens
ctttatactgtgaagtta

SEQ ID NO: 2754577 - DNA, 20 bp, Homo sapiens
gtattgctgctgtgcgtgga

SEQ ID NO: 2754578 - DNA, 20 bp, Homo sapiens
gtattgctgtccttgaatgc

SEQ ID NO: 2754579 - DNA, 12 bp, Homo sapiens
gtattgtagaaa

SEQ ID NO: 2754580 - DNA, 14 bp, Homo sapiens
gtattgtagaaagc

SEQ ID NO: 2754581 - DNA, 14 bp, Homo sapiens
gtatttgctgtttg

SEQ ID NO: 2754582 - DNA, 14 bp, Homo sapiens
gtatttttttccaa

SEQ ID NO: 2754583 - DNA, 17 bp, Homo sapiens
gtcaaattgtgcaaaat

SEQ ID NO: 2754584 - DNA, 16 bp, Homo sapiens
gtcaaattgtgtgaaa

SEQ ID NO: 2754585 - DNA, 15 bp, Homo sapiens
gtcaataaaatccat

SEQ ID NO: 2754586 - DNA, 22 bp, Homo sapiens
gtcaataaaatccatacatttg

SEQ ID NO: 2754587 - DNA, 14 bp, Homo sapiens
gtcaggaaagagaa

SEQ ID NO: 2754588 - DNA, 13 bp, Homo sapiens
gtcagtttctaca

SEQ ID NO: 2754589 - DNA, 15 bp, Homo sapiens
gtcatatgtttattc

SEQ ID NO: 2754590 - DNA, 18 bp, Homo sapiens
gtcatatgtttattcaaa

SEQ ID NO: 2754591 - DNA, 23 bp, Homo sapiens
gtcatatgtttattcaaaatatt

SEQ ID NO: 2754592 - DNA, 13 bp, Homo sapiens
gtcccatggcctg

SEQ ID NO: 2754593 - DNA, 17 bp, Homo sapiens
gtcccatggcctgctgg

SEQ ID NO: 2754594 - DNA, 15 bp, Homo sapiens
gtcctaagtgtcaag

SEQ ID NO: 2754595 - DNA, 14 bp, Homo sapiens
gtcctatgcaataa

SEQ ID NO: 2754596 - DNA, 15 bp, Homo sapiens
gtcctgactgggctg

SEQ ID NO: 2754597 - DNA, 12 bp, Homo sapiens
gtccttcagttt

SEQ ID NO: 2754598 - DNA, 15 bp, Homo sapiens
gtccttcagtttaga

SEQ ID NO: 2754599 - DNA, 16 bp, Homo sapiens
gtccttcagtttagaa

SEQ ID NO: 2754600 - DNA, 15 bp, Homo sapiens
gtcgtagttactctc

SEQ ID NO: 2754601 - DNA, 17 bp, Homo sapiens
gtctacactaagagaga

SEQ ID NO: 2754602 - DNA, 15 bp, Homo sapiens
gtctattattatgaa

SEQ ID NO: 2754603 - DNA, 23 bp, Homo sapiens
gtctgtactccttggatttgcat

SEQ ID NO: 2754604 - DNA, 19 bp, Homo sapiens
gtcttcaaatttgattcta

SEQ ID NO: 2754605 - DNA, 22 bp, Homo sapiens
gtcttcggccgagctggtttcc

SEQ ID NO: 2754606 - DNA, 17 bp, Homo sapiens
gtcttcttatctaaacc

SEQ ID NO: 2754607 - DNA, 15 bp, Homo sapiens
gtcttggggtcccac

SEQ ID NO: 2754608 - DNA, 13 bp, Homo sapiens
gtctttaaatcat

SEQ ID NO: 2754609 - DNA, 19 bp, Homo sapiens
gtgaactaagttattgctg

SEQ ID NO: 2754610 - DNA, 14 bp, Homo sapiens
gtgaagttacatgc

SEQ ID NO: 2754611 - DNA, 16 bp, Homo sapiens
gtgacaagctcacaga

SEQ ID NO: 2754612 - DNA, 17 bp, Homo sapiens
gtgacagagcaataccc

SEQ ID NO: 2754613 - DNA, 12 bp, Homo sapiens
gtgagaaagaaa

SEQ ID NO: 2754614 - DNA, 17 bp, Homo sapiens
gtgagccatattactag

SEQ ID NO: 2754615 - DNA, 17 bp, Homo sapiens
gtgattatgccattgca

SEQ ID NO: 2754616 - DNA, 22 bp, Homo sapiens
gtgcaggctcccaaactcaggc

SEQ ID NO: 2754617 - DNA, 12 bp, Homo sapiens
gtgcagggctgg

SEQ ID NO: 2754618 - DNA, 21 bp, Homo sapiens
gtgcagggctggtttgttctg

SEQ ID NO: 2754619 - DNA, 15 bp, Homo sapiens
gtgcagtgtgcctgt

SEQ ID NO: 2754620 - DNA, 16 bp, Homo sapiens
gtgccctagaagggga

SEQ ID NO: 2754621 - DNA, 20 bp, Homo sapiens
gtgcggcttttcagaagaaa

SEQ ID NO: 2754622 - DNA, 14 bp, Homo sapiens
gtgctggtttattt

SEQ ID NO: 2754623 - DNA, 19 bp, Homo sapiens
gtggaagtgtgggtctgtg

SEQ ID NO: 2754624 - DNA, 15 bp, Homo sapiens
gtggatttttttgtc

SEQ ID NO: 2754625 - DNA, 21 bp, Homo sapiens
gtggccccgcccgagcccctg

SEQ ID NO: 2754626 - DNA, 23 bp, Homo sapiens
gtggctcccaaaaagatgcttta

SEQ ID NO: 2754627 - DNA, 17 bp, Homo sapiens
gtggctggatctgtgag

SEQ ID NO: 2754628 - DNA, 19 bp, Homo sapiens
gtggggtaggttgggagaa

SEQ ID NO: 2754629 - DNA, 13 bp, Homo sapiens
gtgggtctgtgtg

SEQ ID NO: 2754630 - DNA, 16 bp, Homo sapiens
gtgggtctgtgtgtgt

SEQ ID NO: 2754631 - DNA, 15 bp, Homo sapiens
gtgggttcagaacca

SEQ ID NO: 2754632 - DNA, 22 bp, Homo sapiens
gtgggttcagaaccaagatgcc

SEQ ID NO: 2754633 - DNA, 20 bp, Homo sapiens
gtgtaatttaaaattgtgat

SEQ ID NO: 2754634 - DNA, 22 bp, Homo sapiens
gtgtaatttaaaattgtgatgt

SEQ ID NO: 2754635 - DNA, 23 bp, Homo sapiens
gtgtaatttaaaattgtgatgtg

SEQ ID NO: 2754636 - DNA, 21 bp, Homo sapiens
gtgtatgtgggggtctgtgtg

SEQ ID NO: 2754637 - DNA, 21 bp, Homo sapiens
gtgtattcttaaaatgcaata

SEQ ID NO: 2754638 - DNA, 12 bp, Homo sapiens
gtgtctggcctg

SEQ ID NO: 2754639 - DNA, 14 bp, Homo sapiens
gtgtctggcctgag

SEQ ID NO: 2754640 - DNA, 18 bp, Homo sapiens
gtgtctggcctgaggtca

SEQ ID NO: 2754641 - DNA, 22 bp, Homo sapiens
gtgtggactacaggacaagggg

SEQ ID NO: 2754642 - DNA, 13 bp, Homo sapiens
gtgtggccccgcc

SEQ ID NO: 2754643 - DNA, 14 bp, Homo sapiens
gtgtgtaatttaaa

SEQ ID NO: 2754644 - DNA, 13 bp, Homo sapiens
gtgtgtatgtggg

SEQ ID NO: 2754645 - DNA, 20 bp, Homo sapiens
gtgtgtcacccttaggccag

SEQ ID NO: 2754646 - DNA, 12 bp, Homo sapiens
gtgtgttgtgtg

SEQ ID NO: 2754647 - DNA, 14 bp, Homo sapiens
gtgttgaaatatag

SEQ ID NO: 2754648 - DNA, 18 bp, Homo sapiens
gtgttgggggaaatgttg

SEQ ID NO: 2754649 - DNA, 19 bp, Homo sapiens
gtgttgggggaaatgttgt

SEQ ID NO: 2754650 - DNA, 12 bp, Homo sapiens
gtgtttctgttc

SEQ ID NO: 2754651 - DNA, 11 bp, Homo sapiens
gtgtttgcttg

SEQ ID NO: 2754652 - DNA, 14 bp, Homo sapiens
gtgtttgcttggtg

SEQ ID NO: 2754653 - DNA, 13 bp, Homo sapiens
gtgtttttgttgt

SEQ ID NO: 2754654 - DNA, 12 bp, Homo sapiens
gttaaaatacat

SEQ ID NO: 2754655 - DNA, 16 bp, Homo sapiens
gttaaaatacataact

SEQ ID NO: 2754656 - DNA, 15 bp, Homo sapiens
gttaaatatttttgt

SEQ ID NO: 2754657 - DNA, 21 bp, Homo sapiens
gttaaattttctctaaactgt

SEQ ID NO: 2754658 - DNA, 18 bp, Homo sapiens
gttaatcagagtatctga

SEQ ID NO: 2754659 - DNA, 17 bp, Homo sapiens
gttacctaggttaacaa

SEQ ID NO: 2754660 - DNA, 14 bp, Homo sapiens
gttacttgctataa

SEQ ID NO: 2754661 - DNA, 22 bp, Homo sapiens
gttatatttccttttgtaaagt

SEQ ID NO: 2754662 - DNA, 21 bp, Homo sapiens
gttattgctgcataaatttgt

SEQ ID NO: 2754663 - DNA, 22 bp, Homo sapiens
gttctgactttttgtttctttg

SEQ ID NO: 2754664 - DNA, 13 bp, Homo sapiens
gttgagtatttgc

SEQ ID NO: 2754665 - DNA, 17 bp, Homo sapiens
gttgagtatttgctgtt

SEQ ID NO: 2754666 - DNA, 20 bp, Homo sapiens
gttgatggtggtatgttttc

SEQ ID NO: 2754667 - DNA, 15 bp, Homo sapiens
gttggcgctgaggtg

SEQ ID NO: 2754668 - DNA, 18 bp, Homo sapiens
gttgggatcgcattgcat

SEQ ID NO: 2754669 - DNA, 21 bp, Homo sapiens
gttgggtaaaaatgaagcaga

SEQ ID NO: 2754670 - DNA, 18 bp, Homo sapiens
gttgtatcagcacgtgtg

SEQ ID NO: 2754671 - DNA, 14 bp, Homo sapiens
gttgtgtataattt

SEQ ID NO: 2754672 - DNA, 16 bp, Homo sapiens
gttgtgtgtgggagtg

SEQ ID NO: 2754673 - DNA, 22 bp, Homo sapiens
gttgttttatataatgcatgta

SEQ ID NO: 2754674 - DNA, 19 bp, Homo sapiens
gtttaaaaaccgaataaat

SEQ ID NO: 2754675 - DNA, 20 bp, Homo sapiens
gtttaacattgattggataa

SEQ ID NO: 2754676 - DNA, 18 bp, Homo sapiens
gtttactggataaattta

SEQ ID NO: 2754677 - DNA, 19 bp, Homo sapiens
gtttagaacctacaaaagc

SEQ ID NO: 2754678 - DNA, 21 bp, Homo sapiens
gtttagaacctacaaaagctt

SEQ ID NO: 2754679 - DNA, 20 bp, Homo sapiens
gtttagctggaaaagtatgt

SEQ ID NO: 2754680 - DNA, 22 bp, Homo sapiens
gtttatgttcttatagaataaa

SEQ ID NO: 2754681 - DNA, 13 bp, Homo sapiens
gtttattcaaaat

SEQ ID NO: 2754682 - DNA, 16 bp, Homo sapiens
gtttattcaaaatatt

SEQ ID NO: 2754683 - DNA, 21 bp, Homo sapiens
gtttcaaacatatataacaat

SEQ ID NO: 2754684 - DNA, 20 bp, Homo sapiens
gtttcaattgagtaattcta

SEQ ID NO: 2754685 - DNA, 15 bp, Homo sapiens
gtttcttagctgcac

SEQ ID NO: 2754686 - DNA, 22 bp, Homo sapiens
gtttcttttttctttcttcctt

SEQ ID NO: 2754687 - DNA, 23 bp, Homo sapiens
gtttgagaaaggcacatattgga

SEQ ID NO: 2754688 - DNA, 17 bp, Homo sapiens
gtttgtatttttttcca

SEQ ID NO: 2754689 - DNA, 18 bp, Homo sapiens
gtttgtatttttttccaa

SEQ ID NO: 2754690 - DNA, 20 bp, Homo sapiens
gttttaagcaaatgcattct

SEQ ID NO: 2754691 - DNA, 17 bp, Homo sapiens
gttttatcttaaactgt

SEQ ID NO: 2754692 - DNA, 18 bp, Homo sapiens
gttttcaggctagatgta

SEQ ID NO: 2754693 - DNA, 17 bp, Homo sapiens
gttttcatgacagaata

SEQ ID NO: 2754694 - DNA, 19 bp, Homo sapiens
gttttctgggggaaaaagc

SEQ ID NO: 2754695 - DNA, 16 bp, Homo sapiens
gttttcttaacttaaa

SEQ ID NO: 2754696 - DNA, 14 bp, Homo sapiens
gttttgaatattaa

SEQ ID NO: 2754697 - DNA, 14 bp, Homo sapiens
gtttttaactctac

SEQ ID NO: 2754698 - DNA, 15 bp, Homo sapiens
gtttttataataaaa

SEQ ID NO: 2754699 - DNA, 11 bp, Homo sapiens
gtttttgcttt

SEQ ID NO: 2754700 - DNA, 15 bp, Homo sapiens
gtttttgctttctga

SEQ ID NO: 2754701 - DNA, 17 bp, Homo sapiens
gtttttgctttctgaaa

SEQ ID NO: 2754702 - DNA, 19 bp, Homo sapiens
taaaaaaaaaaagattgta

SEQ ID NO: 2754703 - DNA, 21 bp, Homo sapiens
taaaaaactcctgtcttgcta

SEQ ID NO: 2754704 - DNA, 16 bp, Homo sapiens
tgattaagtaatgata

SEQ ID NO: 2754705 - DNA, 21 bp, Homo sapiens
tgcaaaatattggtattaaag

SEQ ID NO: 2754706 - DNA, 13 bp, Homo sapiens
tgcaaacctgctg

SEQ ID NO: 2754707 - DNA, 11 bp, Homo sapiens
tgcaacttttt

SEQ ID NO: 2754708 - DNA, 21 bp, Homo sapiens
tgcaagccagattttcctgaa

SEQ ID NO: 2754709 - DNA, 16 bp, Homo sapiens
tgcaagtgtttctgtt

SEQ ID NO: 2754710 - DNA, 20 bp, Homo sapiens
tgcaataaaattatttgcag

SEQ ID NO: 2754711 - DNA, 22 bp, Homo sapiens
tgcaataaaattatttgcaggt

SEQ ID NO: 2754712 - DNA, 13 bp, Homo sapiens
tgcaatatttgta

SEQ ID NO: 2754713 - DNA, 20 bp, Homo sapiens
tgcaatatttgtaaggcttg

SEQ ID NO: 2754714 - DNA, 20 bp, Homo sapiens
tgcacgcgccctttctacca

SEQ ID NO: 2754715 - DNA, 14 bp, Homo sapiens
tgcagaaaaagaaa

SEQ ID NO: 2754716 - DNA, 17 bp, Homo sapiens
tgcagaaaaagaaaaaa

SEQ ID NO: 2754717 - DNA, 14 bp, Homo sapiens
tgcagggctggttt

SEQ ID NO: 2754718 - DNA, 19 bp, Homo sapiens
tgcagggctggtttgttct

SEQ ID NO: 2754719 - DNA, 22 bp, Homo sapiens
tgcaggtctttaaatcatttta

SEQ ID NO: 2754720 - DNA, 16 bp, Homo sapiens
tgcagtgccctagaag

SEQ ID NO: 2754721 - DNA, 21 bp, Homo sapiens
tgcagtgccctagaaggggaa

SEQ ID NO: 2754722 - DNA, 13 bp, Homo sapiens
tgcagtgtgcctg

SEQ ID NO: 2754723 - DNA, 14 bp, Homo sapiens
tgcagttctgaaga

SEQ ID NO: 2754724 - DNA, 19 bp, Homo sapiens
tgcagttctgaagaagatg

SEQ ID NO: 2754725 - DNA, 15 bp, Homo sapiens
tgcataaatttgtaa

SEQ ID NO: 2754726 - DNA, 22 bp, Homo sapiens
tgcatacatgaataaaaataaa

SEQ ID NO: 2754727 - DNA, 21 bp, Homo sapiens
tgcatctttcatagttctgtt

SEQ ID NO: 2754728 - DNA, 22 bp, Homo sapiens
tgcatctttcatagttctgtta

SEQ ID NO: 2754729 - DNA, 12 bp, Homo sapiens
tgcatggtgtga

SEQ ID NO: 2754730 - DNA, 20 bp, Homo sapiens
tgcatggtgtgaactaagtt

SEQ ID NO: 2754731 - DNA, 21 bp, Homo sapiens
tgcattatatttattactgta

SEQ ID NO: 2754732 - DNA, 21 bp, Homo sapiens
tgcattatatttgtaaattta

SEQ ID NO: 2754733 - DNA, 13 bp, Homo sapiens
tgcattctatcgt

SEQ ID NO: 2754734 - DNA, 23 bp, Homo sapiens
tgcattctatcgttattataaat

SEQ ID NO: 2754735 - DNA, 13 bp, Homo sapiens
tgcatttttgtat

SEQ ID NO: 2754736 - DNA, 17 bp, Homo sapiens
tgccacaggttttaagg

SEQ ID NO: 2754737 - DNA, 17 bp, Homo sapiens
tgccatagtcaaagaga

SEQ ID NO: 2754738 - DNA, 23 bp, Homo sapiens
tgcccacgcccttggagccttcc

SEQ ID NO: 2754739 - DNA, 16 bp, Homo sapiens
tgccccattcaacatc

SEQ ID NO: 2754740 - DNA, 15 bp, Homo sapiens
tgcctggagtgctgt

SEQ ID NO: 2754741 - DNA, 17 bp, Homo sapiens
tgcctggagtgctgtgc

SEQ ID NO: 2754742 - DNA, 19 bp, Homo sapiens
tgccttatttttgaattct

SEQ ID NO: 2754743 - DNA, 13 bp, Homo sapiens
tgccttcaaatag

SEQ ID NO: 2754744 - DNA, 16 bp, Homo sapiens
tgccttcaaatagtat

SEQ ID NO: 2754745 - DNA, 22 bp, Homo sapiens
tgccttcaaatagtatagaaaa

SEQ ID NO: 2754746 - DNA, 17 bp, Homo sapiens
tgccttctcaactccaa

SEQ ID NO: 2754747 - DNA, 22 bp, Homo sapiens
tgccttctcaactccaaactga

SEQ ID NO: 2754748 - DNA, 19 bp, Homo sapiens
tgctagacaaggttgctgt

SEQ ID NO: 2754749 - DNA, 16 bp, Homo sapiens
tgctagagttaaaagt

SEQ ID NO: 2754750 - DNA, 22 bp, Homo sapiens
tgctataaatagatttagtctg

SEQ ID NO: 2754751 - DNA, 16 bp, Homo sapiens
tgctataacattctga

SEQ ID NO: 2754752 - DNA, 22 bp, Homo sapiens
tgctattgtagagccagaggtc

SEQ ID NO: 2754753 - DNA, 11 bp, Homo sapiens
tgctcatggaa

SEQ ID NO: 2754754 - DNA, 17 bp, Homo sapiens
tgctctgatgcagtgcc

SEQ ID NO: 2754755 - DNA, 14 bp, Homo sapiens
tgctgatccttgca

SEQ ID NO: 2754756 - DNA, 14 bp, Homo sapiens
tgctgcaacttttt

SEQ ID NO: 2754757 - DNA, 13 bp, Homo sapiens
tgctgcataaatt

SEQ ID NO: 2754758 - DNA, 16 bp, Homo sapiens
tgctgcataaatttgt

SEQ ID NO: 2754759 - DNA, 17 bp, Homo sapiens
tgctgcataaatttgta

SEQ ID NO: 2754760 - DNA, 18 bp, Homo sapiens
tgctgcataaatttgtaa

SEQ ID NO: 2754761 - DNA, 19 bp, Homo sapiens
tgctgcataaatttgtaat

SEQ ID NO: 2754762 - DNA, 21 bp, Homo sapiens
tgctgcataaatttgtaatat

SEQ ID NO: 2754763 - DNA, 14 bp, Homo sapiens
tgctggagccctgt

SEQ ID NO: 2754764 - DNA, 22 bp, Homo sapiens
tgctggtttatttgttgttttc

SEQ ID NO: 2754765 - DNA, 13 bp, Homo sapiens
tgctgtattttaa

SEQ ID NO: 2754766 - DNA, 14 bp, Homo sapiens
tgctgtccttgaat

SEQ ID NO: 2754767 - DNA, 18 bp, Homo sapiens
tgctgttgtgcagtgtgc

SEQ ID NO: 2754768 - DNA, 22 bp, Homo sapiens
tgcttctacacatttcatctaa

SEQ ID NO: 2754769 - DNA, 17 bp, Homo sapiens
tgcttctgttttataat

SEQ ID NO: 2754770 - DNA, 22 bp, Homo sapiens
tgcttctgttttataattttgt

SEQ ID NO: 2754771 - DNA, 13 bp, Homo sapiens
tgctttctgaaat

SEQ ID NO: 2754772 - DNA, 20 bp, Homo sapiens
tgcttttgaaggaatacaat

SEQ ID NO: 2754773 - DNA, 14 bp, Homo sapiens
tggaaaatatacaa

SEQ ID NO: 2754774 - DNA, 13 bp, Homo sapiens
tggaaaggcagct

SEQ ID NO: 2754775 - DNA, 17 bp, Homo sapiens
tggaaataccaggacca

SEQ ID NO: 2754776 - DNA, 19 bp, Homo sapiens
tggaaataccaggaccagt

SEQ ID NO: 2754777 - DNA, 23 bp, Homo sapiens
tggaaataccaggaccagtttat

SEQ ID NO: 2754778 - DNA, 13 bp, Homo sapiens
tggaactcaatat

SEQ ID NO: 2754779 - DNA, 19 bp, Homo sapiens
tggaactcaatatatagtt

SEQ ID NO: 2754780 - DNA, 14 bp, Homo sapiens
tggaagtgtgggtc

SEQ ID NO: 2754781 - DNA, 21 bp, Homo sapiens
tggaagtgtgggtctgtgtgt

SEQ ID NO: 2754782 - DNA, 23 bp, Homo sapiens
tggaagtgtgggtctgtgtgtgt

SEQ ID NO: 2754783 - DNA, 17 bp, Homo sapiens
tggacatgagtttaaag

SEQ ID NO: 2754784 - DNA, 16 bp, Homo sapiens
tggagaaaagcactta

SEQ ID NO: 2754785 - DNA, 21 bp, Homo sapiens
tggagaaaagcacttaaagtt

SEQ ID NO: 2754786 - DNA, 13 bp, Homo sapiens
tggagccttccac

SEQ ID NO: 2754787 - DNA, 14 bp, Homo sapiens
tggagccttccacc

SEQ ID NO: 2754788 - DNA, 14 bp, Homo sapiens
tggagctcgtggaa

SEQ ID NO: 2754789 - DNA, 21 bp, Homo sapiens
tggagctcgtggaacagttac

SEQ ID NO: 2754790 - DNA, 11 bp, Homo sapiens
tggagggaagc

SEQ ID NO: 2754791 - DNA, 14 bp, Homo sapiens
tggagttttcatga

SEQ ID NO: 2754792 - DNA, 15 bp, Homo sapiens
tggatctgtgagggg

SEQ ID NO: 2754793 - DNA, 21 bp, Homo sapiens
tggatttgcatttttgtattt

SEQ ID NO: 2754794 - DNA, 22 bp, Homo sapiens
tggatttttttgtcattaaaat

SEQ ID NO: 2754795 - DNA, 20 bp, Homo sapiens
tggcaatagtcaaattgtgt

SEQ ID NO: 2754796 - DNA, 15 bp, Homo sapiens
tggcactagtatttc

SEQ ID NO: 2754797 - DNA, 18 bp, Homo sapiens
tggcattttaagtgttta

SEQ ID NO: 2754798 - DNA, 22 bp, Homo sapiens
tggcattttaagtgtttaaaag

SEQ ID NO: 2754799 - DNA, 23 bp, Homo sapiens
tggcattttaagtgtttaaaagc

SEQ ID NO: 2754800 - DNA, 15 bp, Homo sapiens
tggccagtggctgga

SEQ ID NO: 2754801 - DNA, 17 bp, Homo sapiens
tggccccgcccgagccc

SEQ ID NO: 2754802 - DNA, 16 bp, Homo sapiens
tggctaccttgtggga

SEQ ID NO: 2754803 - DNA, 17 bp, Homo sapiens
tggctaccttgtgggaa

SEQ ID NO: 2754804 - DNA, 18 bp, Homo sapiens
tggctaccttgtgggaat

SEQ ID NO: 2754805 - DNA, 19 bp, Homo sapiens
tggctaccttgtgggaata

SEQ ID NO: 2754806 - DNA, 20 bp, Homo sapiens
tggctccattggtgttgaca

SEQ ID NO: 2754807 - DNA, 18 bp, Homo sapiens
tggctcccacctgtagtc

SEQ ID NO: 2754808 - DNA, 18 bp, Homo sapiens
tggctggaacactgtact

SEQ ID NO: 2754809 - DNA, 18 bp, Homo sapiens
tggctgtagataaataat

SEQ ID NO: 2754810 - DNA, 22 bp, Homo sapiens
tggcttcttttctttgtatcat

SEQ ID NO: 2754811 - DNA, 14 bp, Homo sapiens
tgggaaaaattatt

SEQ ID NO: 2754812 - DNA, 15 bp, Homo sapiens
tgggaaatgttttaa

SEQ ID NO: 2754813 - DNA, 23 bp, Homo sapiens
tgggaataagtgccaggatggaa

SEQ ID NO: 2754814 - DNA, 19 bp, Homo sapiens
tgggacatttgctcatgga

SEQ ID NO: 2754815 - DNA, 20 bp, Homo sapiens
tgggacatttgctcatggaa

SEQ ID NO: 2754816 - DNA, 22 bp, Homo sapiens
tgggatataatacctttctaag

SEQ ID NO: 2754817 - DNA, 13 bp, Homo sapiens
tggggaggactag

SEQ ID NO: 2754818 - DNA, 17 bp, Homo sapiens
tggggatagatgtgtgg

SEQ ID NO: 2754819 - DNA, 15 bp, Homo sapiens
tggggctcagagtgg

SEQ ID NO: 2754820 - DNA, 13 bp, Homo sapiens
tgggggaaaaagc

SEQ ID NO: 2754821 - DNA, 14 bp, Homo sapiens
tgggggtctgtgtg

SEQ ID NO: 2754822 - DNA, 18 bp, Homo sapiens
tgggggtctgtgtgttta

SEQ ID NO: 2754823 - DNA, 14 bp, Homo sapiens
tgggtagacacaca

SEQ ID NO: 2754824 - DNA, 19 bp, Homo sapiens
tgggtcatatgtttattca

SEQ ID NO: 2754825 - DNA, 12 bp, Homo sapiens
tgggtctgtgtg

SEQ ID NO: 2754826 - DNA, 20 bp, Homo sapiens
tggtaaggggaattgaggac

SEQ ID NO: 2754827 - DNA, 20 bp, Homo sapiens
tggtaggaactgctgggctt

SEQ ID NO: 2754828 - DNA, 19 bp, Homo sapiens
tggtattaaagaatgctgc

SEQ ID NO: 2754829 - DNA, 12 bp, Homo sapiens
tggtctgtactc

SEQ ID NO: 2754830 - DNA, 17 bp, Homo sapiens
tttttgtaaaaactttt

SEQ ID NO: 2754831 - DNA, 23 bp, Homo sapiens
ttttttaaaaaagaaacatttgg

SEQ ID NO: 2754832 - DNA, 21 bp, Homo sapiens
aaatcaggagcctgctaagga

SEQ ID NO: 2754833 - DNA, 19 bp, Homo sapiens
aaatcattttaggaaagga

SEQ ID NO: 2754834 - DNA, 15 bp, Homo sapiens
aaatccatacatttg

SEQ ID NO: 2754835 - DNA, 21 bp, Homo sapiens
aaatctgtacttttttcaaat

SEQ ID NO: 2754836 - DNA, 15 bp, Homo sapiens
aaatcttggtgtaac

SEQ ID NO: 2754837 - DNA, 21 bp, Homo sapiens
aaatcttggtgtaacttaaat

SEQ ID NO: 2754838 - DNA, 20 bp, Homo sapiens
aaatgcattctatcgttatt

SEQ ID NO: 2754839 - DNA, 13 bp, Homo sapiens
aaatgctaaactt

SEQ ID NO: 2754840 - DNA, 15 bp, Homo sapiens
aaatgctaaacttgg

SEQ ID NO: 2754841 - DNA, 13 bp, Homo sapiens
aaatggaaaatat

SEQ ID NO: 2754842 - DNA, 13 bp, Homo sapiens
aaatggaaaatta

SEQ ID NO: 2754843 - DNA, 19 bp, Homo sapiens
aaatggcttcctggcaata

SEQ ID NO: 2754844 - DNA, 18 bp, Homo sapiens
aaatgtgtgtattcttaa

SEQ ID NO: 2754845 - DNA, 22 bp, Homo sapiens
aaatgttgacatgggacatttg

SEQ ID NO: 2754846 - DNA, 13 bp, Homo sapiens
aaatgttttaatg

SEQ ID NO: 2754847 - DNA, 14 bp, Homo sapiens
aaatgttttaatgc

SEQ ID NO: 2754848 - DNA, 19 bp, Homo sapiens
aaattatttgccttttaaa

SEQ ID NO: 2754849 - DNA, 17 bp, Homo sapiens
aaattctgaattttggt

SEQ ID NO: 2754850 - DNA, 20 bp, Homo sapiens
aaattctgggcctaattttt

SEQ ID NO: 2754851 - DNA, 22 bp, Homo sapiens
aaattgaaagcactatgaattt

SEQ ID NO: 2754852 - DNA, 10 bp, Homo sapiens
aaattggaga

SEQ ID NO: 2754853 - DNA, 18 bp, Homo sapiens
aaattggagaaaagcact

SEQ ID NO: 2754854 - DNA, 22 bp, Homo sapiens
aaattggagaaaagcacttaaa

SEQ ID NO: 2754855 - DNA, 23 bp, Homo sapiens
aaattggcattttaagtgtttaa

SEQ ID NO: 2754856 - DNA, 19 bp, Homo sapiens
aaatttaaaaaactcctgt

SEQ ID NO: 2754857 - DNA, 20 bp, Homo sapiens
aaatttaccacaaaagcaaa

SEQ ID NO: 2754858 - DNA, 15 bp, Homo sapiens
aaatttgtaatatat

SEQ ID NO: 2754859 - DNA, 19 bp, Homo sapiens
aaatttgtaatatatcctg

SEQ ID NO: 2754860 - DNA, 20 bp, Homo sapiens
aaatttgtaatatatcctgt

SEQ ID NO: 2754861 - DNA, 15 bp, Homo sapiens
aaattttcattctga

SEQ ID NO: 2754862 - DNA, 17 bp, Homo sapiens
aaattttctctaaactg

SEQ ID NO: 2754863 - DNA, 19 bp, Homo sapiens
aaattttctctaaactgtt

SEQ ID NO: 2754864 - DNA, 17 bp, Homo sapiens
aaatttttaaaactgca

SEQ ID NO: 2754865 - DNA, 16 bp, Homo sapiens
aaatttttgtctttgt

SEQ ID NO: 2754866 - DNA, 16 bp, Homo sapiens
aaattttttgattaat

SEQ ID NO: 2754867 - DNA, 15 bp, Homo sapiens
aacaaccacaggaat

SEQ ID NO: 2754868 - DNA, 18 bp, Homo sapiens
aacaatgccgcctgtcaa

SEQ ID NO: 2754869 - DNA, 22 bp, Homo sapiens
aacaatgccgcctgtcaataaa

SEQ ID NO: 2754870 - DNA, 15 bp, Homo sapiens
aacaatgctgtattt

SEQ ID NO: 2754871 - DNA, 17 bp, Homo sapiens
aacaatgctgtatttta

SEQ ID NO: 2754872 - DNA, 22 bp, Homo sapiens
aacaatgctgtattttaaaaga

SEQ ID NO: 2754873 - DNA, 14 bp, Homo sapiens
aacagattcaaagc

SEQ ID NO: 2754874 - DNA, 21 bp, Homo sapiens
aacagattcaaagcgaacagt

SEQ ID NO: 2754875 - DNA, 19 bp, Homo sapiens
aacagctattttagtaacc

SEQ ID NO: 2754876 - DNA, 16 bp, Homo sapiens
aacagtccaatcagtg

SEQ ID NO: 2754877 - DNA, 21 bp, Homo sapiens
aacattgaaatattagttact

SEQ ID NO: 2754878 - DNA, 20 bp, Homo sapiens
aacatttgccaaaaattcat

SEQ ID NO: 2754879 - DNA, 15 bp, Homo sapiens
aaccacaaaagttgt

SEQ ID NO: 2754880 - DNA, 14 bp, Homo sapiens
aacccagcaaaaca

SEQ ID NO: 2754881 - DNA, 22 bp, Homo sapiens
aaccctgttgagtatttgctgt

SEQ ID NO: 2754882 - DNA, 23 bp, Homo sapiens
aaccctgttgagtatttgctgtt

SEQ ID NO: 2754883 - DNA, 15 bp, Homo sapiens
aacctacaaaagctt

SEQ ID NO: 2754884 - DNA, 16 bp, Homo sapiens
aacctattttgaaagg

SEQ ID NO: 2754885 - DNA, 19 bp, Homo sapiens
aacctgtagatgcagaaaa

SEQ ID NO: 2754886 - DNA, 21 bp, Homo sapiens
aacgggcttgactttggctga

SEQ ID NO: 2754887 - DNA, 14 bp, Homo sapiens
aactaagttattgc

SEQ ID NO: 2754888 - DNA, 18 bp, Homo sapiens
aactaagttattgctgca

SEQ ID NO: 2754889 - DNA, 19 bp, Homo sapiens
aactaagttattgctgcat

SEQ ID NO: 2754890 - DNA, 21 bp, Homo sapiens
aactaagttattgctgcataa

SEQ ID NO: 2754891 - DNA, 12 bp, Homo sapiens
aactagttctta

SEQ ID NO: 2754892 - DNA, 23 bp, Homo sapiens
aactatctcatttccaagcaagt

SEQ ID NO: 2754893 - DNA, 15 bp, Homo sapiens
aactcaatatatagt

SEQ ID NO: 2754894 - DNA, 17 bp, Homo sapiens
aactcaatatatagtta

SEQ ID NO: 2754895 - DNA, 16 bp, Homo sapiens
aactcctgtcttgcta

SEQ ID NO: 2754896 - DNA, 13 bp, Homo sapiens
aactgaaatcata

SEQ ID NO: 2754897 - DNA, 20 bp, Homo sapiens
aactgactcttaagaagact

SEQ ID NO: 2754898 - DNA, 14 bp, Homo sapiens
aactgcatttttaa

SEQ ID NO: 2754899 - DNA, 18 bp, Homo sapiens
aactggtgatataaagaa

SEQ ID NO: 2754900 - DNA, 13 bp, Homo sapiens
aactgtacctttt

SEQ ID NO: 2754901 - DNA, 18 bp, Homo sapiens
aacttcagcggtttatat

SEQ ID NO: 2754902 - DNA, 21 bp, Homo sapiens
aacttcagtgcaagagacttt

SEQ ID NO: 2754903 - DNA, 14 bp, Homo sapiens
aactttattttgaa

SEQ ID NO: 2754904 - DNA, 15 bp, Homo sapiens
aactttattttgaat

SEQ ID NO: 2754905 - DNA, 18 bp, Homo sapiens
aactttattttgaatgta

SEQ ID NO: 2754906 - DNA, 22 bp, Homo sapiens
aactttattttgaatgtacctc

SEQ ID NO: 2754907 - DNA, 14 bp, Homo sapiens
aacttttttatgtc

SEQ ID NO: 2754908 - DNA, 12 bp, Homo sapiens
aagaactgaaat

SEQ ID NO: 2754909 - DNA, 15 bp, Homo sapiens
aagaagactgcatta

SEQ ID NO: 2754910 - DNA, 19 bp, Homo sapiens
aagaagtgtgtcaccctta

SEQ ID NO: 2754911 - DNA, 19 bp, Homo sapiens
aagaatggtggcttctttt

SEQ ID NO: 2754912 - DNA, 23 bp, Homo sapiens
aagaattgccaatcttgttttaa

SEQ ID NO: 2754913 - DNA, 13 bp, Homo sapiens
aagagacaaactg

SEQ ID NO: 2754914 - DNA, 21 bp, Homo sapiens
aagagctacttctaattattc

SEQ ID NO: 2754915 - DNA, 17 bp, Homo sapiens
aagatcctcttgccaca

SEQ ID NO: 2754916 - DNA, 23 bp, Homo sapiens
aagatcctcttgccacatcttga

SEQ ID NO: 2754917 - DNA, 13 bp, Homo sapiens
aagatcttgcaga

SEQ ID NO: 2754918 - DNA, 19 bp, Homo sapiens
aagatcttgcagaagttct

SEQ ID NO: 2754919 - DNA, 14 bp, Homo sapiens
aagatgctttaatt

SEQ ID NO: 2754920 - DNA, 16 bp, Homo sapiens
aagatttaccacttgt

SEQ ID NO: 2754921 - DNA, 15 bp, Homo sapiens
aagatttatctgcaa

SEQ ID NO: 2754922 - DNA, 18 bp, Homo sapiens
aagcaaaatttttaaaac

SEQ ID NO: 2754923 - DNA, 19 bp, Homo sapiens
aagcaaaatttttaaaact

SEQ ID NO: 2754924 - DNA, 17 bp, Homo sapiens
aagcaaatgcattctat

SEQ ID NO: 2754925 - DNA, 16 bp, Homo sapiens
aagcaacgactacttt

SEQ ID NO: 2754926 - DNA, 17 bp, Homo sapiens
aagcatttaaaagagta

SEQ ID NO: 2754927 - DNA, 21 bp, Homo sapiens
aagccttggggctgatgcagt

SEQ ID NO: 2754928 - DNA, 22 bp, Homo sapiens
aagcggaataaactagagaagg

SEQ ID NO: 2754929 - DNA, 15 bp, Homo sapiens
aagctaaaaggtttc

SEQ ID NO: 2754930 - DNA, 16 bp, Homo sapiens
aagctgttaaaataca

SEQ ID NO: 2754931 - DNA, 22 bp, Homo sapiens
aagctgttaaaatacataactt

SEQ ID NO: 2754932 - DNA, 23 bp, Homo sapiens
aagcttgtattcctttttctctc

SEQ ID NO: 2754933 - DNA, 14 bp, Homo sapiens
aaggaacaatgccg

SEQ ID NO: 2754934 - DNA, 14 bp, Homo sapiens
aaggaagtcttcaa

SEQ ID NO: 2754935 - DNA, 23 bp, Homo sapiens
aaggaagtcttcaaatttgattc

SEQ ID NO: 2754936 - DNA, 15 bp, Homo sapiens
aaggccagccatttt

SEQ ID NO: 2754937 - DNA, 19 bp, Homo sapiens
aaggctaacaaattttaag

SEQ ID NO: 2754938 - DNA, 14 bp, Homo sapiens
aagggaaaaagttg

SEQ ID NO: 2754939 - DNA, 15 bp, Homo sapiens
aagggaaaaagttgt

SEQ ID NO: 2754940 - DNA, 22 bp, Homo sapiens
aagggtatgtcacaaagagctg

SEQ ID NO: 2754941 - DNA, 15 bp, Homo sapiens
aagggtcaaacctgt

SEQ ID NO: 2754942 - DNA, 16 bp, Homo sapiens
aagggtcaaacctgta

SEQ ID NO: 2754943 - DNA, 19 bp, Homo sapiens
aaggtcccatggcctgctg

SEQ ID NO: 2754944 - DNA, 17 bp, Homo sapiens
aagtaaaaataaactgt

SEQ ID NO: 2754945 - DNA, 19 bp, Homo sapiens
aagtaaaaccataaacatt

SEQ ID NO: 2754946 - DNA, 12 bp, Homo sapiens
aagtaaaatatg

SEQ ID NO: 2754947 - DNA, 13 bp, Homo sapiens
aagtaaaatatgt

SEQ ID NO: 2754948 - DNA, 14 bp, Homo sapiens
aagtaaattctgtt

SEQ ID NO: 2754949 - DNA, 19 bp, Homo sapiens
aagtaagggaataaatttt

SEQ ID NO: 2754950 - DNA, 20 bp, Homo sapiens
aagtaagggaataaattttt

SEQ ID NO: 2754951 - DNA, 19 bp, Homo sapiens
aagtatatcttaagaatgt

SEQ ID NO: 2754952 - DNA, 19 bp, Homo sapiens
aagtcctgactgggctggg

SEQ ID NO: 2754953 - DNA, 13 bp, Homo sapiens
aagtcttcaaatt

SEQ ID NO: 2754954 - DNA, 14 bp, Homo sapiens
aagtgatgacatat

SEQ ID NO: 2754955 - DNA, 17 bp, Homo sapiens
aagtgtatgatcttagg

SEQ ID NO: 2754956 - DNA, 18 bp, Homo sapiens
aagtgtttaaaagcaaat

SEQ ID NO: 2754957 - DNA, 15 bp, Homo sapiens
aagttacatgcataa

SEQ ID NO: 2754958 - DNA, 15 bp, Homo sapiens
atctgaatcctgtta

SEQ ID NO: 2754959 - DNA, 16 bp, Homo sapiens
atctgaatcctgttaa

SEQ ID NO: 2754960 - DNA, 16 bp, Homo sapiens
atctgtacttttttca

SEQ ID NO: 2754961 - DNA, 14 bp, Homo sapiens
atctgtataaatgt

SEQ ID NO: 2754962 - DNA, 21 bp, Homo sapiens
atctgtataaatgtctattat

SEQ ID NO: 2754963 - DNA, 18 bp, Homo sapiens
atctgtgcagggctggtt

SEQ ID NO: 2754964 - DNA, 23 bp, Homo sapiens
atcttaaactgttcttcattaga

SEQ ID NO: 2754965 - DNA, 15 bp, Homo sapiens
atcttaaatcagaat

SEQ ID NO: 2754966 - DNA, 15 bp, Homo sapiens
atcttagggaacttt

SEQ ID NO: 2754967 - DNA, 13 bp, Homo sapiens
atcttagtttact

SEQ ID NO: 2754968 - DNA, 15 bp, Homo sapiens
atcttgaaaatgcca

SEQ ID NO: 2754969 - DNA, 16 bp, Homo sapiens
atcttgaaaatgccac

SEQ ID NO: 2754970 - DNA, 18 bp, Homo sapiens
atcttgaaaatgccacca

SEQ ID NO: 2754971 - DNA, 15 bp, Homo sapiens
atcttgattaatgta

SEQ ID NO: 2754972 - DNA, 19 bp, Homo sapiens
atcttggtgtaacttaaat

SEQ ID NO: 2754973 - DNA, 18 bp, Homo sapiens
atcttgttttaagcaaat

SEQ ID NO: 2754974 - DNA, 16 bp, Homo sapiens
atctttcatagttctg

SEQ ID NO: 2754975 - DNA, 13 bp, Homo sapiens
atctttttcatca

SEQ ID NO: 2754976 - DNA, 20 bp, Homo sapiens
atgaaagtgatgacatattt

SEQ ID NO: 2754977 - DNA, 20 bp, Homo sapiens
atgaagtccaagcatttaga

SEQ ID NO: 2754978 - DNA, 15 bp, Homo sapiens
atgaataaaaataaa

SEQ ID NO: 2754979 - DNA, 15 bp, Homo sapiens
atgaattacatttgt

SEQ ID NO: 2754980 - DNA, 19 bp, Homo sapiens
atgaattacatttgtataa

SEQ ID NO: 2754981 - DNA, 22 bp, Homo sapiens
atgaattacatttgtataaaat

SEQ ID NO: 2754982 - DNA, 15 bp, Homo sapiens
atgacagaatataca

SEQ ID NO: 2754983 - DNA, 21 bp, Homo sapiens
atgacagaatatacacatttt

SEQ ID NO: 2754984 - DNA, 13 bp, Homo sapiens
atgacatattttt

SEQ ID NO: 2754985 - DNA, 16 bp, Homo sapiens
atgacggcctgcctgc

SEQ ID NO: 2754986 - DNA, 13 bp, Homo sapiens
atgagaccccttt

SEQ ID NO: 2754987 - DNA, 14 bp, Homo sapiens
atgagaccccttta

SEQ ID NO: 2754988 - DNA, 21 bp, Homo sapiens
atgagacccctttaaactgtc

SEQ ID NO: 2754989 - DNA, 17 bp, Homo sapiens
atgagagacacactgaa

SEQ ID NO: 2754990 - DNA, 18 bp, Homo sapiens
atgatatctatattctaa

SEQ ID NO: 2754991 - DNA, 19 bp, Homo sapiens
atgatatctatattctaaa

SEQ ID NO: 2754992 - DNA, 23 bp, Homo sapiens
atgatatctatattctaaagagc

SEQ ID NO: 2754993 - DNA, 17 bp, Homo sapiens
atgatctgtagtttttt

SEQ ID NO: 2754994 - DNA, 16 bp, Homo sapiens
atgatgggtcagttgt

SEQ ID NO: 2754995 - DNA, 22 bp, Homo sapiens
atgattatgaattacatttgta

SEQ ID NO: 2754996 - DNA, 16 bp, Homo sapiens
atgcaataaaattatt

SEQ ID NO: 2754997 - DNA, 19 bp, Homo sapiens
atgcaataaaattatttgc

SEQ ID NO: 2754998 - DNA, 15 bp, Homo sapiens
atgcaatatttgtaa

SEQ ID NO: 2754999 - DNA, 17 bp, Homo sapiens
atgcaatgcatatctgt

SEQ ID NO: 2755000 - DNA, 14 bp, Homo sapiens
atgcagaaaaagaa

SEQ ID NO: 2755001 - DNA, 14 bp, Homo sapiens
atgcagtgccctag

SEQ ID NO: 2755002 - DNA, 19 bp, Homo sapiens
atgcagttctgaagaagat

SEQ ID NO: 2755003 - DNA, 13 bp, Homo sapiens
atgcatatctgtt

SEQ ID NO: 2755004 - DNA, 23 bp, Homo sapiens
atgcatgtattcactaaaataaa

SEQ ID NO: 2755005 - DNA, 14 bp, Homo sapiens
atgcattctatcgt

SEQ ID NO: 2755006 - DNA, 15 bp, Homo sapiens
atgcattctatcgtt

SEQ ID NO: 2755007 - DNA, 15 bp, Homo sapiens
atgccgcctgtcaat

SEQ ID NO: 2755008 - DNA, 19 bp, Homo sapiens
atgccttatttttgaattc

SEQ ID NO: 2755009 - DNA, 20 bp, Homo sapiens
atgccttcaaatagtataga

SEQ ID NO: 2755010 - DNA, 20 bp, Homo sapiens
atgccttttcccaactccag

SEQ ID NO: 2755011 - DNA, 22 bp, Homo sapiens
atgccttttcccaactccagaa

SEQ ID NO: 2755012 - DNA, 18 bp, Homo sapiens
atgcgacttgttttgctg

SEQ ID NO: 2755013 - DNA, 14 bp, Homo sapiens
atgctaaaattcta

SEQ ID NO: 2755014 - DNA, 21 bp, Homo sapiens
atgctaaacttggctgtatgt

SEQ ID NO: 2755015 - DNA, 16 bp, Homo sapiens
atgctctgatgcagtg

SEQ ID NO: 2755016 - DNA, 22 bp, Homo sapiens
atgctgtattttaaaagaatga

SEQ ID NO: 2755017 - DNA, 23 bp, Homo sapiens
atgctgtctacactaagagagaa

SEQ ID NO: 2755018 - DNA, 16 bp, Homo sapiens
atgctttaattgtgtg

SEQ ID NO: 2755019 - DNA, 21 bp, Homo sapiens
atggaaaattaattctaaact

SEQ ID NO: 2755020 - DNA, 22 bp, Homo sapiens
atggaaataccaggaccagttt

SEQ ID NO: 2755021 - DNA, 17 bp, Homo sapiens
atggcatttgcagattt

SEQ ID NO: 2755022 - DNA, 19 bp, Homo sapiens
atggctggaacactgtact

SEQ ID NO: 2755023 - DNA, 22 bp, Homo sapiens
atgggacatttgctcatggaat

SEQ ID NO: 2755024 - DNA, 22 bp, Homo sapiens
atggtggcttcttttctttgta

SEQ ID NO: 2755025 - DNA, 14 bp, Homo sapiens
atgtaaagctgtta

SEQ ID NO: 2755026 - DNA, 20 bp, Homo sapiens
atgtaaagctgttaaaatac

SEQ ID NO: 2755027 - DNA, 16 bp, Homo sapiens
atgtacttcatgctgt

SEQ ID NO: 2755028 - DNA, 14 bp, Homo sapiens
atgtagaaattcta

SEQ ID NO: 2755029 - DNA, 17 bp, Homo sapiens
atgtatataaacatgct

SEQ ID NO: 2755030 - DNA, 18 bp, Homo sapiens
atgtcaaattgtgcaaaa

SEQ ID NO: 2755031 - DNA, 16 bp, Homo sapiens
atgtcaatcagcctag

SEQ ID NO: 2755032 - DNA, 21 bp, Homo sapiens
atgtcaatcagcctagttgat

SEQ ID NO: 2755033 - DNA, 13 bp, Homo sapiens
atgtcagtatgtg

SEQ ID NO: 2755034 - DNA, 17 bp, Homo sapiens
atgtccagaagagtcaa

SEQ ID NO: 2755035 - DNA, 19 bp, Homo sapiens
atgtcgtagttactctcag

SEQ ID NO: 2755036 - DNA, 22 bp, Homo sapiens
atgtcgtagttactctcaggca

SEQ ID NO: 2755037 - DNA, 20 bp, Homo sapiens
atgtctaaaagattctttaa

SEQ ID NO: 2755038 - DNA, 21 bp, Homo sapiens
atgtctaaaagattctttaaa

SEQ ID NO: 2755039 - DNA, 15 bp, Homo sapiens
atgtctattattatg

SEQ ID NO: 2755040 - DNA, 22 bp, Homo sapiens
atgtgatacattaggaagctga

SEQ ID NO: 2755041 - DNA, 14 bp, Homo sapiens
atgtgctagagtta

SEQ ID NO: 2755042 - DNA, 17 bp, Homo sapiens
atgtgctagagttaaaa

SEQ ID NO: 2755043 - DNA, 18 bp, Homo sapiens
atgtgctagagttaaaag

SEQ ID NO: 2755044 - DNA, 20 bp, Homo sapiens
atgtgctagtaattggaaag

SEQ ID NO: 2755045 - DNA, 22 bp, Homo sapiens
atgtggaagtgtgggtctgtgt

SEQ ID NO: 2755046 - DNA, 18 bp, Homo sapiens
atgtgggggtctgtgtgt

SEQ ID NO: 2755047 - DNA, 18 bp, Homo sapiens
atgtgtgtgtgttgtgtg

SEQ ID NO: 2755048 - DNA, 22 bp, Homo sapiens
atgtgtgtgtgttgtgtgtggg

SEQ ID NO: 2755049 - DNA, 17 bp, Homo sapiens
atgttaccagacttcaa

SEQ ID NO: 2755050 - DNA, 11 bp, Homo sapiens
atgttagttct

SEQ ID NO: 2755051 - DNA, 12 bp, Homo sapiens
atgttagttcta

SEQ ID NO: 2755052 - DNA, 15 bp, Homo sapiens
atgttcttatagaat

SEQ ID NO: 2755053 - DNA, 17 bp, Homo sapiens
atgtttattcaaaatat

SEQ ID NO: 2755054 - DNA, 19 bp, Homo sapiens
atgtttgtggttttgggaa

SEQ ID NO: 2755055 - DNA, 20 bp, Homo sapiens
atgtttgtggttttgggaaa

SEQ ID NO: 2755056 - DNA, 13 bp, Homo sapiens
attaaagaatgct

SEQ ID NO: 2755057 - DNA, 23 bp, Homo sapiens
attaaagaatgctgcaacttttt

SEQ ID NO: 2755058 - DNA, 13 bp, Homo sapiens
attaagctaaaag

SEQ ID NO: 2755059 - DNA, 15 bp, Homo sapiens
attaagctaaaaggt

SEQ ID NO: 2755060 - DNA, 16 bp, Homo sapiens
attaatgaagaaagta

SEQ ID NO: 2755061 - DNA, 13 bp, Homo sapiens
attaattctaaac

SEQ ID NO: 2755062 - DNA, 17 bp, Homo sapiens
attacatgtaaagctgt

SEQ ID NO: 2755063 - DNA, 19 bp, Homo sapiens
attacatgtaaagctgtta

SEQ ID NO: 2755064 - DNA, 23 bp, Homo sapiens
attacatgtaaagctgttaaaat

SEQ ID NO: 2755065 - DNA, 15 bp, Homo sapiens
attacatttgtataa

SEQ ID NO: 2755066 - DNA, 17 bp, Homo sapiens
attacatttgtataaaa

SEQ ID NO: 2755067 - DNA, 15 bp, Homo sapiens
attacctaatgaaag

SEQ ID NO: 2755068 - DNA, 14 bp, Homo sapiens
attacctttaatgc

SEQ ID NO: 2755069 - DNA, 15 bp, Homo sapiens
attactgtaagaaaa

SEQ ID NO: 2755070 - DNA, 16 bp, Homo sapiens
attactgtaagaaaat

SEQ ID NO: 2755071 - DNA, 13 bp, Homo sapiens
attacttactgtt

SEQ ID NO: 2755072 - DNA, 21 bp, Homo sapiens
attacttactgttaaaactgt

SEQ ID NO: 2755073 - DNA, 19 bp, Homo sapiens
attagaaaggctaacaaat

SEQ ID NO: 2755074 - DNA, 14 bp, Homo sapiens
attaggataactaa

SEQ ID NO: 2755075 - DNA, 13 bp, Homo sapiens
attagtggatttt

SEQ ID NO: 2755076 - DNA, 22 bp, Homo sapiens
attagttacttgctataaatag

SEQ ID NO: 2755077 - DNA, 21 bp, Homo sapiens
attagttgcattggtttgaga

SEQ ID NO: 2755078 - DNA, 13 bp, Homo sapiens
attagttgctttg

SEQ ID NO: 2755079 - DNA, 19 bp, Homo sapiens
attataaatgttagttcta

SEQ ID NO: 2755080 - DNA, 15 bp, Homo sapiens
attatagaaattctg

SEQ ID NO: 2755081 - DNA, 15 bp, Homo sapiens
attatatttattact

SEQ ID NO: 2755082 - DNA, 18 bp, Homo sapiens
attatatttattactgta

SEQ ID NO: 2755083 - DNA, 14 bp, Homo sapiens
attatgaattacat

SEQ ID NO: 2755084 - DNA, 14 bp, Homo sapiens
cctgtttgtatttt

SEQ ID NO: 2755085 - DNA, 15 bp, Homo sapiens
cctgtttgtattttt

SEQ ID NO: 2755086 - DNA, 21 bp, Homo sapiens
cctgtttgtatttttttccaa

SEQ ID NO: 2755087 - DNA, 15 bp, Homo sapiens
ccttcaaatagtata

SEQ ID NO: 2755088 - DNA, 19 bp, Homo sapiens
ccttccaccggcactcatg

SEQ ID NO: 2755089 - DNA, 21 bp, Homo sapiens
ccttccaccggcactcatgac

SEQ ID NO: 2755090 - DNA, 22 bp, Homo sapiens
ccttccaccggcactcatgacg

SEQ ID NO: 2755091 - DNA, 11 bp, Homo sapiens
ccttctggctg

SEQ ID NO: 2755092 - DNA, 20 bp, Homo sapiens
ccttgaacaaaaagtttttt

SEQ ID NO: 2755093 - DNA, 21 bp, Homo sapiens
ccttggatttgcatttttgta

SEQ ID NO: 2755094 - DNA, 17 bp, Homo sapiens
ccttggccaagagaagg

SEQ ID NO: 2755095 - DNA, 21 bp, Homo sapiens
ccttggccaagagaagggctt

SEQ ID NO: 2755096 - DNA, 19 bp, Homo sapiens
ccttggggctgatgcagtt

SEQ ID NO: 2755097 - DNA, 15 bp, Homo sapiens
ccttgtgggaataaa

SEQ ID NO: 2755098 - DNA, 13 bp, Homo sapiens
cctttaaactgtc

SEQ ID NO: 2755099 - DNA, 14 bp, Homo sapiens
cctttaaactgtct

SEQ ID NO: 2755100 - DNA, 12 bp, Homo sapiens
ccttttcccaac

SEQ ID NO: 2755101 - DNA, 15 bp, Homo sapiens
ccttttgtaaagtaa

SEQ ID NO: 2755102 - DNA, 18 bp, Homo sapiens
cgaaaatccagcgtgcac

SEQ ID NO: 2755103 - DNA, 15 bp, Homo sapiens
cgaagaaagactcct

SEQ ID NO: 2755104 - DNA, 14 bp, Homo sapiens
cgagactgcaatgt

SEQ ID NO: 2755105 - DNA, 16 bp, Homo sapiens
cgagaggacagaatgg

SEQ ID NO: 2755106 - DNA, 20 bp, Homo sapiens
cgagcccctgcccacgccct

SEQ ID NO: 2755107 - DNA, 16 bp, Homo sapiens
cgatgtttatgttctt

SEQ ID NO: 2755108 - DNA, 23 bp, Homo sapiens
cgattgcaggagtccctgccatc

SEQ ID NO: 2755109 - DNA, 19 bp, Homo sapiens
cgcccgagcccctgcccac

SEQ ID NO: 2755110 - DNA, 23 bp, Homo sapiens
cgctgaggtgtctggcctgaggt

SEQ ID NO: 2755111 - DNA, 19 bp, Homo sapiens
cggaataaactagagaagg

SEQ ID NO: 2755112 - DNA, 23 bp, Homo sapiens
cggaggaaggtcccatggcctgc

SEQ ID NO: 2755113 - DNA, 22 bp, Homo sapiens
cggctttctggcccttctttca

SEQ ID NO: 2755114 - DNA, 20 bp, Homo sapiens
cgggcatgtctgcctggagt

SEQ ID NO: 2755115 - DNA, 15 bp, Homo sapiens
cgggtcatctgtacc

SEQ ID NO: 2755116 - DNA, 22 bp, Homo sapiens
cgggtcatctgtacctctgcct

SEQ ID NO: 2755117 - DNA, 20 bp, Homo sapiens
cgttattataaatgttagtt

SEQ ID NO: 2755118 - DNA, 21 bp, Homo sapiens
ctaaaagattctttaaactac

SEQ ID NO: 2755119 - DNA, 21 bp, Homo sapiens
ctaaaattctgggcctaattt

SEQ ID NO: 2755120 - DNA, 19 bp, Homo sapiens
ctaaaccacaaaagttgtt

SEQ ID NO: 2755121 - DNA, 24 bp, Homo sapiens
ctaacgtgataaacctgctccaag

SEQ ID NO: 2755122 - DNA, 16 bp, Homo sapiens
ctaaggaacaatgccg

SEQ ID NO: 2755123 - DNA, 17 bp, Homo sapiens
ctaaggaacaatgccgc

SEQ ID NO: 2755124 - DNA, 15 bp, Homo sapiens
ctaaggccagccatt

SEQ ID NO: 2755125 - DNA, 15 bp, Homo sapiens
ctaagttattgctgc

SEQ ID NO: 2755126 - DNA, 17 bp, Homo sapiens
ctaatcttaaatcagaa

SEQ ID NO: 2755127 - DNA, 22 bp, Homo sapiens
ctaatcttaaatcagaataaat

SEQ ID NO: 2755128 - DNA, 21 bp, Homo sapiens
ctaattctttgacctgttggg

SEQ ID NO: 2755129 - DNA, 19 bp, Homo sapiens
ctacaaaagcttgtgtatc

SEQ ID NO: 2755130 - DNA, 20 bp, Homo sapiens
ctacaaaagcttgtgtatct

SEQ ID NO: 2755131 - DNA, 17 bp, Homo sapiens
ctaccttgtgggaataa

SEQ ID NO: 2755132 - DNA, 17 bp, Homo sapiens
ctactgaactgttacct

SEQ ID NO: 2755133 - DNA, 11 bp, Homo sapiens
ctactgtgtaa

SEQ ID NO: 2755134 - DNA, 12 bp, Homo sapiens
ctactttaaatt

SEQ ID NO: 2755135 - DNA, 23 bp, Homo sapiens
ctagaactggtgatataaagaat

SEQ ID NO: 2755136 - DNA, 10 bp, Homo sapiens
ctagagaagg

SEQ ID NO: 2755137 - DNA, 14 bp, Homo sapiens
ctagagttaaaagt

SEQ ID NO: 2755138 - DNA, 19 bp, Homo sapiens
ctagagtttagctggaaaa

SEQ ID NO: 2755139 - DNA, 22 bp, Homo sapiens
ctagatatgaatatatggcatt

SEQ ID NO: 2755140 - DNA, 20 bp, Homo sapiens
ctagctctccatctattgat

SEQ ID NO: 2755141 - DNA, 22 bp, Homo sapiens
ctaggaaatatttattttaata

SEQ ID NO: 2755142 - DNA, 16 bp, Homo sapiens
ctagtaattggaaagg

SEQ ID NO: 2755143 - DNA, 20 bp, Homo sapiens
ctagtatttctatgaaatat

SEQ ID NO: 2755144 - DNA, 22 bp, Homo sapiens
ctagtatttctatgaaatatta

SEQ ID NO: 2755145 - DNA, 22 bp, Homo sapiens
ctagttttatcttaaactgttc

SEQ ID NO: 2755146 - DNA, 15 bp, Homo sapiens
ctataaatacaaatc

SEQ ID NO: 2755147 - DNA, 18 bp, Homo sapiens
ctataaatacaaatctgt

SEQ ID NO: 2755148 - DNA, 15 bp, Homo sapiens
ctataaatagattta

SEQ ID NO: 2755149 - DNA, 18 bp, Homo sapiens
ctatatgagaagaatagc

SEQ ID NO: 2755150 - DNA, 19 bp, Homo sapiens
ctatattgtttgctaagca

SEQ ID NO: 2755151 - DNA, 15 bp, Homo sapiens
ctatcctatgccttc

SEQ ID NO: 2755152 - DNA, 19 bp, Homo sapiens
ctatcgttattataaatgt

SEQ ID NO: 2755153 - DNA, 13 bp, Homo sapiens
ctatctaatgaca

SEQ ID NO: 2755154 - DNA, 19 bp, Homo sapiens
ctatgaaatattatgttaa

SEQ ID NO: 2755155 - DNA, 15 bp, Homo sapiens
ctatgccttcaaata

SEQ ID NO: 2755156 - DNA, 21 bp, Homo sapiens
ctatggggatagatgtgtgga

SEQ ID NO: 2755157 - DNA, 13 bp, Homo sapiens
ctattattatgaa

SEQ ID NO: 2755158 - DNA, 16 bp, Homo sapiens
ctcaatatatagttag

SEQ ID NO: 2755159 - DNA, 16 bp, Homo sapiens
ctcagaaattgaaagc

SEQ ID NO: 2755160 - DNA, 15 bp, Homo sapiens
ctcatgacggcctgc

SEQ ID NO: 2755161 - DNA, 17 bp, Homo sapiens
ctcatgacggcctgcct

SEQ ID NO: 2755162 - DNA, 17 bp, Homo sapiens
ctcatttccaagcaagt

SEQ ID NO: 2755163 - DNA, 21 bp, Homo sapiens
ctcatttccaagcaagtatta

SEQ ID NO: 2755164 - DNA, 17 bp, Homo sapiens
ctccattggtgttgaca

SEQ ID NO: 2755165 - DNA, 15 bp, Homo sapiens
ctcccacactcgcca

SEQ ID NO: 2755166 - DNA, 16 bp, Homo sapiens
ctccctatcttgtgaa

SEQ ID NO: 2755167 - DNA, 18 bp, Homo sapiens
ctccctcccacactcgcc

SEQ ID NO: 2755168 - DNA, 15 bp, Homo sapiens
ctcctgagttgtata

SEQ ID NO: 2755169 - DNA, 19 bp, Homo sapiens
ctcgatgcaagtgtttctg

SEQ ID NO: 2755170 - DNA, 21 bp, Homo sapiens
ctcgatgcaagtgtttctgtt

SEQ ID NO: 2755171 - DNA, 22 bp, Homo sapiens
ctcgatgcaagtgtttctgttc

SEQ ID NO: 2755172 - DNA, 14 bp, Homo sapiens
ctcgttaatttgta

SEQ ID NO: 2755173 - DNA, 12 bp, Homo sapiens
ctctaaactgtt

SEQ ID NO: 2755174 - DNA, 17 bp, Homo sapiens
ctctaggaaatatttat

SEQ ID NO: 2755175 - DNA, 24 bp, Homo sapiens
ctctagtagttaaaacagctattt

SEQ ID NO: 2755176 - DNA, 22 bp, Homo sapiens
ctctagttttatcttaaactgt

SEQ ID NO: 2755177 - DNA, 23 bp, Homo sapiens
ctctagttttatcttaaactgtt

SEQ ID NO: 2755178 - DNA, 16 bp, Homo sapiens
ctctattagtttcaat

SEQ ID NO: 2755179 - DNA, 14 bp, Homo sapiens
ctctgatgcagtgc

SEQ ID NO: 2755180 - DNA, 23 bp, Homo sapiens
ctctgtatttaggccatttgtta

SEQ ID NO: 2755181 - DNA, 20 bp, Homo sapiens
ctctgtccaactctgtattt

SEQ ID NO: 2755182 - DNA, 15 bp, Homo sapiens
ctcttagatgcagtt

SEQ ID NO: 2755183 - DNA, 14 bp, Homo sapiens
ctcttgccacatct

SEQ ID NO: 2755184 - DNA, 17 bp, Homo sapiens
ctcttgccacatcttga

SEQ ID NO: 2755185 - DNA, 21 bp, Homo sapiens
ctctttgtgtttttgttgttg

SEQ ID NO: 2755186 - DNA, 22 bp, Homo sapiens
ctgaaattcacagaagcctagg

SEQ ID NO: 2755187 - DNA, 23 bp, Homo sapiens
ctgaagaagcaccaatcatgaat

SEQ ID NO: 2755188 - DNA, 16 bp, Homo sapiens
ctgaatacaaacattt

SEQ ID NO: 2755189 - DNA, 20 bp, Homo sapiens
ctgaatcctgttaaattttc

SEQ ID NO: 2755190 - DNA, 14 bp, Homo sapiens
ctgactaaaatgtt

SEQ ID NO: 2755191 - DNA, 17 bp, Homo sapiens
ctgactcttaagaagac

SEQ ID NO: 2755192 - DNA, 18 bp, Homo sapiens
ctgactttttgtttcttt

SEQ ID NO: 2755193 - DNA, 20 bp, Homo sapiens
ctgagaatgttaccagactt

SEQ ID NO: 2755194 - DNA, 22 bp, Homo sapiens
ctgagaatgttaccagacttca

SEQ ID NO: 2755195 - DNA, 19 bp, Homo sapiens
ctgagactttctttctgta

SEQ ID NO: 2755196 - DNA, 12 bp, Homo sapiens
ctgagcaggtgt

SEQ ID NO: 2755197 - DNA, 18 bp, Homo sapiens
ctgaggaagagggactgt

SEQ ID NO: 2755198 - DNA, 18 bp, Homo sapiens
ctgaggaatgaatagaaa

SEQ ID NO: 2755199 - DNA, 17 bp, Homo sapiens
ctgaggtggcagaatag

SEQ ID NO: 2755200 - DNA, 17 bp, Homo sapiens
ctgaggtgtctggcctg

SEQ ID NO: 2755201 - DNA, 20 bp, Homo sapiens
ctgaggtgtctggcctgagg

SEQ ID NO: 2755202 - DNA, 21 bp, Homo sapiens
ctgaggtgtctggcctgaggt

SEQ ID NO: 2755203 - DNA, 13 bp, Homo sapiens
ctgagttgtataa

SEQ ID NO: 2755204 - DNA, 15 bp, Homo sapiens
ctgagttgtataaaa

SEQ ID NO: 2755205 - DNA, 19 bp, Homo sapiens
ctgagttgtataaaagttg

SEQ ID NO: 2755206 - DNA, 15 bp, Homo sapiens
ctgcagaaaaaaaag

SEQ ID NO: 2755207 - DNA, 17 bp, Homo sapiens
ctgcagaacagcttcat

SEQ ID NO: 2755208 - DNA, 20 bp, Homo sapiens
ctgcagaacagcttcatgtt

SEQ ID NO: 2755209 - DNA, 23 bp, Homo sapiens
gatatgaatatatggcatttgca

SEQ ID NO: 2755210 - DNA, 23 bp, Homo sapiens
gatcagcttattgtctagtgaaa

SEQ ID NO: 2755211 - DNA, 13 bp, Homo sapiens
gatcctggaaatc

SEQ ID NO: 2755212 - DNA, 14 bp, Homo sapiens
gatcctggaaatca

SEQ ID NO: 2755213 - DNA, 15 bp, Homo sapiens
gatctatgtttcatc

SEQ ID NO: 2755214 - DNA, 18 bp, Homo sapiens
gatcttagggaactttga

SEQ ID NO: 2755215 - DNA, 19 bp, Homo sapiens
gatcttagggaactttgat

SEQ ID NO: 2755216 - DNA, 15 bp, Homo sapiens
gatcttgcagaagtt

SEQ ID NO: 2755217 - DNA, 15 bp, Homo sapiens
gatgcaagtgtttct

SEQ ID NO: 2755218 - DNA, 13 bp, Homo sapiens
gatggaatgatgg

SEQ ID NO: 2755219 - DNA, 21 bp, Homo sapiens
gatgggtcagttgtatcagca

SEQ ID NO: 2755220 - DNA, 21 bp, Homo sapiens
gatgtctaaaagattctttaa

SEQ ID NO: 2755221 - DNA, 14 bp, Homo sapiens
gattaagtaatgat

SEQ ID NO: 2755222 - DNA, 17 bp, Homo sapiens
gattaatgtacttttta

SEQ ID NO: 2755223 - DNA, 21 bp, Homo sapiens
gattaatgtactttttattgc

SEQ ID NO: 2755224 - DNA, 21 bp, Homo sapiens
gattacagtatggcaatatct

SEQ ID NO: 2755225 - DNA, 19 bp, Homo sapiens
gatttagtctgttatattt

SEQ ID NO: 2755226 - DNA, 19 bp, Homo sapiens
gatttcctttatactgtga

SEQ ID NO: 2755227 - DNA, 15 bp, Homo sapiens
gattttcctgaaaac

SEQ ID NO: 2755228 - DNA, 16 bp, Homo sapiens
gcaaaacagattcaaa

SEQ ID NO: 2755229 - DNA, 23 bp, Homo sapiens
gcaaaatattggtattaaagaat

SEQ ID NO: 2755230 - DNA, 15 bp, Homo sapiens
gcaaaatttttaaaa

SEQ ID NO: 2755231 - DNA, 15 bp, Homo sapiens
gcaaacctgctggtg

SEQ ID NO: 2755232 - DNA, 17 bp, Homo sapiens
gcaaacctgctggtggg

SEQ ID NO: 2755233 - DNA, 22 bp, Homo sapiens
gcaaagggcctgcccagacaag

SEQ ID NO: 2755234 - DNA, 22 bp, Homo sapiens
gcaaattctgaggtaagtgtat

SEQ ID NO: 2755235 - DNA, 21 bp, Homo sapiens
gcaacttttttatgtctctta

SEQ ID NO: 2755236 - DNA, 21 bp, Homo sapiens
gcaagaatggtggcttctttt

SEQ ID NO: 2755237 - DNA, 10 bp, Homo sapiens
gcaagccaga

SEQ ID NO: 2755238 - DNA, 15 bp, Homo sapiens
gcaaggattttttaa

SEQ ID NO: 2755239 - DNA, 12 bp, Homo sapiens
gcaagtgtttct

SEQ ID NO: 2755240 - DNA, 16 bp, Homo sapiens
gcaagtgtttctgttc

SEQ ID NO: 2755241 - DNA, 17 bp, Homo sapiens
gcaagtgtttctgttct

SEQ ID NO: 2755242 - DNA, 19 bp, Homo sapiens
gcaataaaattatttgcag

SEQ ID NO: 2755243 - DNA, 22 bp, Homo sapiens
gcaatagtcaaattgtgtgaaa

SEQ ID NO: 2755244 - DNA, 23 bp, Homo sapiens
gcaatgcatatctgtttattctg

SEQ ID NO: 2755245 - DNA, 22 bp, Homo sapiens
gcacatattggagggaaatctt

SEQ ID NO: 2755246 - DNA, 22 bp, Homo sapiens
gcacatccaccaaactcctgcc

SEQ ID NO: 2755247 - DNA, 18 bp, Homo sapiens
gcaccccgccggaggaag

SEQ ID NO: 2755248 - DNA, 19 bp, Homo sapiens
gcactcatgacggcctgcc

SEQ ID NO: 2755249 - DNA, 22 bp, Homo sapiens
gcactcatgacggcctgcctgc

SEQ ID NO: 2755250 - DNA, 23 bp, Homo sapiens
gcactcatgacggcctgcctgca

SEQ ID NO: 2755251 - DNA, 13 bp, Homo sapiens
gcactgtttatgg

SEQ ID NO: 2755252 - DNA, 17 bp, Homo sapiens
gcactttgtagtgtttg

SEQ ID NO: 2755253 - DNA, 14 bp, Homo sapiens
gcagaaaaagaaaa

SEQ ID NO: 2755254 - DNA, 15 bp, Homo sapiens
gcagaagccccaaag

SEQ ID NO: 2755255 - DNA, 18 bp, Homo sapiens
gcagacccgaaaatccag

SEQ ID NO: 2755256 - DNA, 13 bp, Homo sapiens
gcaggacgactgt

SEQ ID NO: 2755257 - DNA, 11 bp, Homo sapiens
gcagggctggt

SEQ ID NO: 2755258 - DNA, 14 bp, Homo sapiens
gcagggctggtttg

SEQ ID NO: 2755259 - DNA, 14 bp, Homo sapiens
gcagggctgtgcac

SEQ ID NO: 2755260 - DNA, 21 bp, Homo sapiens
gcagtagccaaacaccacttt

SEQ ID NO: 2755261 - DNA, 22 bp, Homo sapiens
gcagttgttgcccacagctgta

SEQ ID NO: 2755262 - DNA, 21 bp, Homo sapiens
gcataaaagggtcaaacctgt

SEQ ID NO: 2755263 - DNA, 14 bp, Homo sapiens
gcatagtggcactt

SEQ ID NO: 2755264 - DNA, 18 bp, Homo sapiens
gcatgtatagttgctttt

SEQ ID NO: 2755265 - DNA, 23 bp, Homo sapiens
gcattctatcgttattataaatg

SEQ ID NO: 2755266 - DNA, 14 bp, Homo sapiens
gcatttaaaagagt

SEQ ID NO: 2755267 - DNA, 17 bp, Homo sapiens
gcatttgcagattttta

SEQ ID NO: 2755268 - DNA, 21 bp, Homo sapiens
gccaatcttgttttaagcaaa

SEQ ID NO: 2755269 - DNA, 14 bp, Homo sapiens
gccacatcttgaaa

SEQ ID NO: 2755270 - DNA, 17 bp, Homo sapiens
gccaccatccaataaaa

SEQ ID NO: 2755271 - DNA, 14 bp, Homo sapiens
gccaggatggaatg

SEQ ID NO: 2755272 - DNA, 14 bp, Homo sapiens
gccagtggctggat

SEQ ID NO: 2755273 - DNA, 23 bp, Homo sapiens
gccatagtcaaagagagttttta

SEQ ID NO: 2755274 - DNA, 21 bp, Homo sapiens
gccatatcatgctaaaattct

SEQ ID NO: 2755275 - DNA, 17 bp, Homo sapiens
gccatcatgtttacaga

SEQ ID NO: 2755276 - DNA, 16 bp, Homo sapiens
gcccacagctgtatga

SEQ ID NO: 2755277 - DNA, 14 bp, Homo sapiens
gcccccacccctgg

SEQ ID NO: 2755278 - DNA, 16 bp, Homo sapiens
gccccgcccgagcccc

SEQ ID NO: 2755279 - DNA, 15 bp, Homo sapiens
gcccctgggtttctt

SEQ ID NO: 2755280 - DNA, 13 bp, Homo sapiens
gccgagaggacag

SEQ ID NO: 2755281 - DNA, 21 bp, Homo sapiens
gccgagaggacagaatggata

SEQ ID NO: 2755282 - DNA, 15 bp, Homo sapiens
gccggaggaaggtcc

SEQ ID NO: 2755283 - DNA, 18 bp, Homo sapiens
gcctaaggccagccattt

SEQ ID NO: 2755284 - DNA, 20 bp, Homo sapiens
gcctctcattccagaggaag

SEQ ID NO: 2755285 - DNA, 13 bp, Homo sapiens
gcctgaggtcaat

SEQ ID NO: 2755286 - DNA, 16 bp, Homo sapiens
gcctgatttgttcctt

SEQ ID NO: 2755287 - DNA, 16 bp, Homo sapiens
gcctgcaaacctgctg

SEQ ID NO: 2755288 - DNA, 21 bp, Homo sapiens
gcctgcctgcaaacctgctgg

SEQ ID NO: 2755289 - DNA, 17 bp, Homo sapiens
gcctgctgggcttggct

SEQ ID NO: 2755290 - DNA, 22 bp, Homo sapiens
gcctgctgggcttggctcggcg

SEQ ID NO: 2755291 - DNA, 17 bp, Homo sapiens
gcctgtcaataaatgtt

SEQ ID NO: 2755292 - DNA, 21 bp, Homo sapiens
gcctgtcaataaatgttgaaa

SEQ ID NO: 2755293 - DNA, 19 bp, Homo sapiens
gcctgtcactactggtctg

SEQ ID NO: 2755294 - DNA, 14 bp, Homo sapiens
gccttatttttgaa

SEQ ID NO: 2755295 - DNA, 19 bp, Homo sapiens
gccttatttttgaattctt

SEQ ID NO: 2755296 - DNA, 18 bp, Homo sapiens
gccttccaccggcactca

SEQ ID NO: 2755297 - DNA, 18 bp, Homo sapiens
gcgacttgttttgctgct

SEQ ID NO: 2755298 - DNA, 20 bp, Homo sapiens
gcgctgaggtgtctggcctg

SEQ ID NO: 2755299 - DNA, 21 bp, Homo sapiens
gcggaataaactagagaaggg

SEQ ID NO: 2755300 - DNA, 19 bp, Homo sapiens
gcggcttttcagaagaaat

SEQ ID NO: 2755301 - DNA, 14 bp, Homo sapiens
gcgtgcaccccgcc

SEQ ID NO: 2755302 - DNA, 23 bp, Homo sapiens
gcgtgcaccccgccggaggaagg

SEQ ID NO: 2755303 - DNA, 12 bp, Homo sapiens
gcgtggaaaaag

SEQ ID NO: 2755304 - DNA, 14 bp, Homo sapiens
gctaagcattccaa

SEQ ID NO: 2755305 - DNA, 13 bp, Homo sapiens
gctaaggaacaat

SEQ ID NO: 2755306 - DNA, 14 bp, Homo sapiens
gctaatacaaaact

SEQ ID NO: 2755307 - DNA, 12 bp, Homo sapiens
gctagaatccac

SEQ ID NO: 2755308 - DNA, 15 bp, Homo sapiens
gctagagttaaaagt

SEQ ID NO: 2755309 - DNA, 16 bp, Homo sapiens
gctataacattctgac

SEQ ID NO: 2755310 - DNA, 19 bp, Homo sapiens
gctatggggatagatgtgt

SEQ ID NO: 2755311 - DNA, 20 bp, Homo sapiens
gctcccaaaaagatgcttta

SEQ ID NO: 2755312 - DNA, 18 bp, Homo sapiens
gctcgaaatggcccctgt

SEQ ID NO: 2755313 - DNA, 13 bp, Homo sapiens
gctctatttactt

SEQ ID NO: 2755314 - DNA, 23 bp, Homo sapiens
gctctgcccaggaactcgcacct

SEQ ID NO: 2755315 - DNA, 19 bp, Homo sapiens
gctgaggtggcagaatagc

SEQ ID NO: 2755316 - DNA, 19 bp, Homo sapiens
gctgcaacttttttatgtc

SEQ ID NO: 2755317 - DNA, 14 bp, Homo sapiens
gctgcactgtttat

SEQ ID NO: 2755318 - DNA, 19 bp, Homo sapiens
gctgcactgtttatggaaa

SEQ ID NO: 2755319 - DNA, 16 bp, Homo sapiens
gctgcataaatttgta

SEQ ID NO: 2755320 - DNA, 17 bp, Homo sapiens
gctgcataaatttgtaa

SEQ ID NO: 2755321 - DNA, 21 bp, Homo sapiens
gctgctgtgcgtggaaaaaga

SEQ ID NO: 2755322 - DNA, 16 bp, Homo sapiens
gctggaacactgtact

SEQ ID NO: 2755323 - DNA, 22 bp, Homo sapiens
gctggagccctgttcctccctc

SEQ ID NO: 2755324 - DNA, 20 bp, Homo sapiens
gctgggaataagtgccagga

SEQ ID NO: 2755325 - DNA, 22 bp, Homo sapiens
gctggtcccctccctctgtctt

SEQ ID NO: 2755326 - DNA, 12 bp, Homo sapiens
gctggtggggca

SEQ ID NO: 2755327 - DNA, 23 bp, Homo sapiens
gctggtttcctgcccagcctggg

SEQ ID NO: 2755328 - DNA, 18 bp, Homo sapiens
gctgtattttaaaagaat

SEQ ID NO: 2755329 - DNA, 20 bp, Homo sapiens
gctgtctacactaagagaga

SEQ ID NO: 2755330 - DNA, 20 bp, Homo sapiens
gctgtcttggggtcccactg

SEQ ID NO: 2755331 - DNA, 14 bp, Homo sapiens
gctgtgctgtgttt

SEQ ID NO: 2755332 - DNA, 14 bp, Homo sapiens
gctgttaaaataca

SEQ ID NO: 2755333 - DNA, 14 bp, Homo sapiens
gctgttgtgcagtg

SEQ ID NO: 2755334 - DNA, 23 bp, Homo sapiens
tacctttctaagggaaaaagttg

SEQ ID NO: 2755335 - DNA, 14 bp, Homo sapiens
tactgcatcttagt

SEQ ID NO: 2755336 - DNA, 21 bp, Homo sapiens
tactggataaatttaaaacac

SEQ ID NO: 2755337 - DNA, 17 bp, Homo sapiens
tactgttaaaactgtac

SEQ ID NO: 2755338 - DNA, 22 bp, Homo sapiens
tactgttaaaactgtacctttt

SEQ ID NO: 2755339 - DNA, 13 bp, Homo sapiens
tacttactgttaa

SEQ ID NO: 2755340 - DNA, 21 bp, Homo sapiens
tacttcaaatccttgaagatt

SEQ ID NO: 2755341 - DNA, 23 bp, Homo sapiens
tacttctaatcttaaatcagaat

SEQ ID NO: 2755342 - DNA, 19 bp, Homo sapiens
tacttcttagggttatgat

SEQ ID NO: 2755343 - DNA, 21 bp, Homo sapiens
tacttgctataaatagattta

SEQ ID NO: 2755344 - DNA, 14 bp, Homo sapiens
tactttttattgca

SEQ ID NO: 2755345 - DNA, 14 bp, Homo sapiens
tacttttttcaaat

SEQ ID NO: 2755346 - DNA, 12 bp, Homo sapiens
tagaaagaaagt

SEQ ID NO: 2755347 - DNA, 12 bp, Homo sapiens
tagaaagctaat

SEQ ID NO: 2755348 - DNA, 14 bp, Homo sapiens
tagaaattctaact

SEQ ID NO: 2755349 - DNA, 14 bp, Homo sapiens
tagaaattctgaat

SEQ ID NO: 2755350 - DNA, 23 bp, Homo sapiens
tagaaccatgttggttgcacttt

SEQ ID NO: 2755351 - DNA, 12 bp, Homo sapiens
tagaataaaagc

SEQ ID NO: 2755352 - DNA, 15 bp, Homo sapiens
tagaataaaagctgt

SEQ ID NO: 2755353 - DNA, 22 bp, Homo sapiens
tagaataaaagctgtggaatga

SEQ ID NO: 2755354 - DNA, 23 bp, Homo sapiens
tagaataccacaggaaccacaag

SEQ ID NO: 2755355 - DNA, 17 bp, Homo sapiens
tagacaaggttgctgtt

SEQ ID NO: 2755356 - DNA, 21 bp, Homo sapiens
tagactctctagttttatctt

SEQ ID NO: 2755357 - DNA, 22 bp, Homo sapiens
tagagttaaaagttagcattgt

SEQ ID NO: 2755358 - DNA, 12 bp, Homo sapiens
tagatgcagaaa

SEQ ID NO: 2755359 - DNA, 16 bp, Homo sapiens
tagatgcagttctgaa

SEQ ID NO: 2755360 - DNA, 20 bp, Homo sapiens
tagatgtatgtacttcatgc

SEQ ID NO: 2755361 - DNA, 11 bp, Homo sapiens
tagatgtgtgg

SEQ ID NO: 2755362 - DNA, 21 bp, Homo sapiens
tagatgtttatttagaaactg

SEQ ID NO: 2755363 - DNA, 23 bp, Homo sapiens
tagcacatccaccaaactcctgc

SEQ ID NO: 2755364 - DNA, 17 bp, Homo sapiens
tagcaggacctgccaag

SEQ ID NO: 2755365 - DNA, 17 bp, Homo sapiens
tagccggaaggccgagg

SEQ ID NO: 2755366 - DNA, 22 bp, Homo sapiens
tagcctagatatgaatatatgg

SEQ ID NO: 2755367 - DNA, 15 bp, Homo sapiens
tagctctatttactt

SEQ ID NO: 2755368 - DNA, 14 bp, Homo sapiens
tagctgcactgttt

SEQ ID NO: 2755369 - DNA, 11 bp, Homo sapiens
taggaaaggat

SEQ ID NO: 2755370 - DNA, 19 bp, Homo sapiens
taggaaatatttattttaa

SEQ ID NO: 2755371 - DNA, 15 bp, Homo sapiens
taggaactgctgggc

SEQ ID NO: 2755372 - DNA, 18 bp, Homo sapiens
taggaggggttaataagt

SEQ ID NO: 2755373 - DNA, 20 bp, Homo sapiens
taggaggttgaggctgcagt

SEQ ID NO: 2755374 - DNA, 19 bp, Homo sapiens
taggccatttgttacagtt

SEQ ID NO: 2755375 - DNA, 21 bp, Homo sapiens
tagtaattaggataactaaaa

SEQ ID NO: 2755376 - DNA, 17 bp, Homo sapiens
tagtattgtccaggtct

SEQ ID NO: 2755377 - DNA, 18 bp, Homo sapiens
tagtatttctatgaaata

SEQ ID NO: 2755378 - DNA, 15 bp, Homo sapiens
tagtcccagcacttt

SEQ ID NO: 2755379 - DNA, 16 bp, Homo sapiens
tagtctctctagtagt

SEQ ID NO: 2755380 - DNA, 16 bp, Homo sapiens
tagtgtcctatgcaat

SEQ ID NO: 2755381 - DNA, 12 bp, Homo sapiens
tagtgttggaga

SEQ ID NO: 2755382 - DNA, 17 bp, Homo sapiens
tagttgcttttgaagga

SEQ ID NO: 2755383 - DNA, 15 bp, Homo sapiens
tagtttcatttacaa

SEQ ID NO: 2755384 - DNA, 15 bp, Homo sapiens
tagttttatatgctt

SEQ ID NO: 2755385 - DNA, 16 bp, Homo sapiens
tagttttatatgcttc

SEQ ID NO: 2755386 - DNA, 13 bp, Homo sapiens
tagttttgtttat

SEQ ID NO: 2755387 - DNA, 21 bp, Homo sapiens
tataaaaacattgaaatatta

SEQ ID NO: 2755388 - DNA, 13 bp, Homo sapiens
tataaaagttgta

SEQ ID NO: 2755389 - DNA, 21 bp, Homo sapiens
tataaaataatttttatattt

SEQ ID NO: 2755390 - DNA, 23 bp, Homo sapiens
tataaaataatttttatatttga

SEQ ID NO: 2755391 - DNA, 16 bp, Homo sapiens
tataaagaatgaaagt

SEQ ID NO: 2755392 - DNA, 15 bp, Homo sapiens
tataaatacaaatct

SEQ ID NO: 2755393 - DNA, 22 bp, Homo sapiens
tataaatacaaatctgtataaa

SEQ ID NO: 2755394 - DNA, 18 bp, Homo sapiens
tataaatgtctattatta

SEQ ID NO: 2755395 - DNA, 14 bp, Homo sapiens
tataaatgttagtt

SEQ ID NO: 2755396 - DNA, 17 bp, Homo sapiens
tataaatgttagttcta

SEQ ID NO: 2755397 - DNA, 14 bp, Homo sapiens
tataatgttggtgt

SEQ ID NO: 2755398 - DNA, 16 bp, Homo sapiens
tataattccttaaaat

SEQ ID NO: 2755399 - DNA, 19 bp, Homo sapiens
tatacaagtaaattctgtt

SEQ ID NO: 2755400 - DNA, 15 bp, Homo sapiens
tatacacattttgta

SEQ ID NO: 2755401 - DNA, 16 bp, Homo sapiens
tatacacattttgtaa

SEQ ID NO: 2755402 - DNA, 17 bp, Homo sapiens
tatacacattttgtaaa

SEQ ID NO: 2755403 - DNA, 22 bp, Homo sapiens
tatacacattttgtaaatctgt

SEQ ID NO: 2755404 - DNA, 14 bp, Homo sapiens
tataccacagtctt

SEQ ID NO: 2755405 - DNA, 13 bp, Homo sapiens
tatagttagcttt

SEQ ID NO: 2755406 - DNA, 13 bp, Homo sapiens
tatagttgctttt

SEQ ID NO: 2755407 - DNA, 18 bp, Homo sapiens
tatatagctggcaagaat

SEQ ID NO: 2755408 - DNA, 20 bp, Homo sapiens
tatatagctggcaagaatgg

SEQ ID NO: 2755409 - DNA, 16 bp, Homo sapiens
tatatatgaatattac

SEQ ID NO: 2755410 - DNA, 14 bp, Homo sapiens
tatatgagaagaat

SEQ ID NO: 2755411 - DNA, 15 bp, Homo sapiens
tatatgagaagaata

SEQ ID NO: 2755412 - DNA, 13 bp, Homo sapiens
tatatgcttctgt

SEQ ID NO: 2755413 - DNA, 16 bp, Homo sapiens
tatatgcttctgtttt

SEQ ID NO: 2755414 - DNA, 15 bp, Homo sapiens
tatatggcatttgca

SEQ ID NO: 2755415 - DNA, 16 bp, Homo sapiens
tatatttccttttgta

SEQ ID NO: 2755416 - DNA, 18 bp, Homo sapiens
tatatttccttttgtaaa

SEQ ID NO: 2755417 - DNA, 22 bp, Homo sapiens
tatatttccttttgtaaagtaa

SEQ ID NO: 2755418 - DNA, 22 bp, Homo sapiens
tatattttatcaaggaagtctt

SEQ ID NO: 2755419 - DNA, 19 bp, Homo sapiens
tatcaaggaagtcttcaaa

SEQ ID NO: 2755420 - DNA, 14 bp, Homo sapiens
tatcagcacgtgtg

SEQ ID NO: 2755421 - DNA, 22 bp, Homo sapiens
tatcatgctaaaattctataga

SEQ ID NO: 2755422 - DNA, 14 bp, Homo sapiens
tatccataaaattg

SEQ ID NO: 2755423 - DNA, 23 bp, Homo sapiens
tatcccagctttaaaaagaaaaa

SEQ ID NO: 2755424 - DNA, 16 bp, Homo sapiens
tatcctgtttgtattt

SEQ ID NO: 2755425 - DNA, 18 bp, Homo sapiens
tatcctgtttgtattttt

SEQ ID NO: 2755426 - DNA, 23 bp, Homo sapiens
tatctaaacccagcaaaacagat

SEQ ID NO: 2755427 - DNA, 15 bp, Homo sapiens
tatctagttacatgg

SEQ ID NO: 2755428 - DNA, 19 bp, Homo sapiens
tatctgaacatttactaca

SEQ ID NO: 2755429 - DNA, 23 bp, Homo sapiens
tatctgcaaggattttttaaaaa

SEQ ID NO: 2755430 - DNA, 16 bp, Homo sapiens
tatctgtttattctgg

SEQ ID NO: 2755431 - DNA, 24 bp, Homo sapiens
tatcttaaactgttcttcattaga

SEQ ID NO: 2755432 - DNA, 17 bp, Homo sapiens
tatcttaagaatgtgct

SEQ ID NO: 2755433 - DNA, 18 bp, Homo sapiens
tatcttgattaatgtact

SEQ ID NO: 2755434 - DNA, 21 bp, Homo sapiens
tatgaaatattatgttaaaac

SEQ ID NO: 2755435 - DNA, 18 bp, Homo sapiens
tatgaagaattgccaatc

SEQ ID NO: 2755436 - DNA, 23 bp, Homo sapiens
tatgaagaattgccaatcttgtt

SEQ ID NO: 2755437 - DNA, 21 bp, Homo sapiens
tatgaatatatggcatttgca

SEQ ID NO: 2755438 - DNA, 24 bp, Homo sapiens
tatgaatattacatgtaaagctgt

SEQ ID NO: 2755439 - DNA, 22 bp, Homo sapiens
tatgaccttaaggaaaagtaag

SEQ ID NO: 2755440 - DNA, 21 bp, Homo sapiens
tatgatcttagggaactttga

SEQ ID NO: 2755441 - DNA, 14 bp, Homo sapiens
tatgccttcaaata

SEQ ID NO: 2755442 - DNA, 18 bp, Homo sapiens
tatgccttcaaatagtat

SEQ ID NO: 2755443 - DNA, 20 bp, Homo sapiens
tatggaaataccaggaccag

SEQ ID NO: 2755444 - DNA, 19 bp, Homo sapiens
tatggcatttgcagatttt

SEQ ID NO: 2755445 - DNA, 20 bp, Homo sapiens
tatggggatagatgtgtgga

SEQ ID NO: 2755446 - DNA, 22 bp, Homo sapiens
tatggtagcttttactttttat

SEQ ID NO: 2755447 - DNA, 21 bp, Homo sapiens
tatggtaggaactgctgggct

SEQ ID NO: 2755448 - DNA, 13 bp, Homo sapiens
tatgtacttcatg

SEQ ID NO: 2755449 - DNA, 11 bp, Homo sapiens
tatgtcaaatt

SEQ ID NO: 2755450 - DNA, 22 bp, Homo sapiens
tatgtcaaattgtgcaaaatat

SEQ ID NO: 2755451 - DNA, 17 bp, Homo sapiens
tatgtcacaaagagctg

SEQ ID NO: 2755452 - DNA, 19 bp, Homo sapiens
tatgtccagaagagtcaaa

SEQ ID NO: 2755453 - DNA, 20 bp, Homo sapiens
tatgtccagaagagtcaaag

SEQ ID NO: 2755454 - DNA, 23 bp, Homo sapiens
tatgtccagaagagtcaaagtag

SEQ ID NO: 2755455 - DNA, 11 bp, Homo sapiens
tatgtgtgtgt

SEQ ID NO: 2755456 - DNA, 14 bp, Homo sapiens
tatgtgtgtgtgtt

SEQ ID NO: 2755457 - DNA, 23 bp, Homo sapiens
tatgtgtgtgtgttgtgtgtggg

SEQ ID NO: 2755458 - DNA, 19 bp, Homo sapiens
tatgttagtgcaaattgtc

SEQ ID NO: 2755459 - DNA, 21 bp, Homo sapiens
tgctgcaacttttttatgtct

SEQ ID NO: 2755460 - DNA, 15 bp, Homo sapiens
tgctgcataaatttg

SEQ ID NO: 2755461 - DNA, 20 bp, Homo sapiens
tgctgcataaatttgtaata

SEQ ID NO: 2755462 - DNA, 13 bp, Homo sapiens
tgctgctgtgcgt

SEQ ID NO: 2755463 - DNA, 13 bp, Homo sapiens
tgctggtggggca

SEQ ID NO: 2755464 - DNA, 23 bp, Homo sapiens
tgctgtatccatccatggggctg

SEQ ID NO: 2755465 - DNA, 14 bp, Homo sapiens
tgctgtgcgtggaa

SEQ ID NO: 2755466 - DNA, 13 bp, Homo sapiens
tgcttataggctg

SEQ ID NO: 2755467 - DNA, 18 bp, Homo sapiens
tgcttggtgctggtttat

SEQ ID NO: 2755468 - DNA, 14 bp, Homo sapiens
tgctttctgaaatt

SEQ ID NO: 2755469 - DNA, 22 bp, Homo sapiens
tgctttgttaaaaaaaaaaaga

SEQ ID NO: 2755470 - DNA, 17 bp, Homo sapiens
tggaaaattaattctaa

SEQ ID NO: 2755471 - DNA, 21 bp, Homo sapiens
tggaaaattaattctaaactt

SEQ ID NO: 2755472 - DNA, 15 bp, Homo sapiens
tggaaataccaggac

SEQ ID NO: 2755473 - DNA, 20 bp, Homo sapiens
tggaaataccaggaccagtt

SEQ ID NO: 2755474 - DNA, 15 bp, Homo sapiens
tggaacactgtactg

SEQ ID NO: 2755475 - DNA, 13 bp, Homo sapiens
tggaagtgtgggt

SEQ ID NO: 2755476 - DNA, 18 bp, Homo sapiens
tggaattggagctcgtgg

SEQ ID NO: 2755477 - DNA, 22 bp, Homo sapiens
tggacctttcctgaggaagagg

SEQ ID NO: 2755478 - DNA, 14 bp, Homo sapiens
tggactacaggaca

SEQ ID NO: 2755479 - DNA, 17 bp, Homo sapiens
tggagaaaagcacttaa

SEQ ID NO: 2755480 - DNA, 20 bp, Homo sapiens
tggagattttttttttaatc

SEQ ID NO: 2755481 - DNA, 15 bp, Homo sapiens
tggagccctgttcct

SEQ ID NO: 2755482 - DNA, 19 bp, Homo sapiens
tggagccttccaccggcac

SEQ ID NO: 2755483 - DNA, 23 bp, Homo sapiens
tggagccttccaccggcactcat

SEQ ID NO: 2755484 - DNA, 16 bp, Homo sapiens
tggagcttcatcgggg

SEQ ID NO: 2755485 - DNA, 23 bp, Homo sapiens
tggagggaaatcttggtgtaact

SEQ ID NO: 2755486 - DNA, 21 bp, Homo sapiens
tggagtgaagcatttaaaaga

SEQ ID NO: 2755487 - DNA, 17 bp, Homo sapiens
tggagtgctgtgctgtg

SEQ ID NO: 2755488 - DNA, 18 bp, Homo sapiens
tggataaatttaaaacac

SEQ ID NO: 2755489 - DNA, 17 bp, Homo sapiens
tggatataatctgaatc

SEQ ID NO: 2755490 - DNA, 18 bp, Homo sapiens
tggatttcctttatactg

SEQ ID NO: 2755491 - DNA, 17 bp, Homo sapiens
tggatttgcatttttgt

SEQ ID NO: 2755492 - DNA, 16 bp, Homo sapiens
tggcaaacgggcttga

SEQ ID NO: 2755493 - DNA, 19 bp, Homo sapiens
tggcacttgcctgtagtct

SEQ ID NO: 2755494 - DNA, 17 bp, Homo sapiens
tggcatttgcagatttt

SEQ ID NO: 2755495 - DNA, 14 bp, Homo sapiens
tggccaagagaagg

SEQ ID NO: 2755496 - DNA, 18 bp, Homo sapiens
tggccccgcccgagcccc

SEQ ID NO: 2755497 - DNA, 19 bp, Homo sapiens
tggccccgcccgagcccct

SEQ ID NO: 2755498 - DNA, 18 bp, Homo sapiens
tggctcggcgcccccacc

SEQ ID NO: 2755499 - DNA, 23 bp, Homo sapiens
tggctcggcgcccccacccctgg

SEQ ID NO: 2755500 - DNA, 14 bp, Homo sapiens
tggctgtagataaa

SEQ ID NO: 2755501 - DNA, 16 bp, Homo sapiens
tggcttcctggcaata

SEQ ID NO: 2755502 - DNA, 18 bp, Homo sapiens
tgggacagtcacctcatg

SEQ ID NO: 2755503 - DNA, 20 bp, Homo sapiens
tgggacagtcacctcatgga

SEQ ID NO: 2755504 - DNA, 11 bp, Homo sapiens
tgggagtgtgt

SEQ ID NO: 2755505 - DNA, 17 bp, Homo sapiens
tgggcatagtggcactt

SEQ ID NO: 2755506 - DNA, 20 bp, Homo sapiens
tgggcatagtggcacttgcc

SEQ ID NO: 2755507 - DNA, 22 bp, Homo sapiens
tggggagggatttggggctcag

SEQ ID NO: 2755508 - DNA, 14 bp, Homo sapiens
tggggctgattgta

SEQ ID NO: 2755509 - DNA, 15 bp, Homo sapiens
tgggggtctgtgtgt

SEQ ID NO: 2755510 - DNA, 23 bp, Homo sapiens
tgggtcatatgtttattcaaaat

SEQ ID NO: 2755511 - DNA, 15 bp, Homo sapiens
tgggtctgtgtgtgt

SEQ ID NO: 2755512 - DNA, 16 bp, Homo sapiens
tgggtgacagagcaat

SEQ ID NO: 2755513 - DNA, 11 bp, Homo sapiens
tgggtttcttt

SEQ ID NO: 2755514 - DNA, 13 bp, Homo sapiens
tggtatgttttca

SEQ ID NO: 2755515 - DNA, 19 bp, Homo sapiens
tggtctgaatacaaacatt

SEQ ID NO: 2755516 - DNA, 16 bp, Homo sapiens
tggtgatataaagaat

SEQ ID NO: 2755517 - DNA, 21 bp, Homo sapiens
tggtgatataaagaatgaaag

SEQ ID NO: 2755518 - DNA, 13 bp, Homo sapiens
tggtgctataaca

SEQ ID NO: 2755519 - DNA, 19 bp, Homo sapiens
tggtgctataacattctga

SEQ ID NO: 2755520 - DNA, 16 bp, Homo sapiens
tggtgtgaactaagtt

SEQ ID NO: 2755521 - DNA, 23 bp, Homo sapiens
tggtgtggagttttcatgacaga

SEQ ID NO: 2755522 - DNA, 16 bp, Homo sapiens
tggttcccttgatgaa

SEQ ID NO: 2755523 - DNA, 20 bp, Homo sapiens
tggttcccttgatgaagaag

SEQ ID NO: 2755524 - DNA, 12 bp, Homo sapiens
tggtttcctgcc

SEQ ID NO: 2755525 - DNA, 13 bp, Homo sapiens
tggtttgttctga

SEQ ID NO: 2755526 - DNA, 17 bp, Homo sapiens
tggtttgttctgacttt

SEQ ID NO: 2755527 - DNA, 23 bp, Homo sapiens
tggttttgaatattaagctaaaa

SEQ ID NO: 2755528 - DNA, 13 bp, Homo sapiens
tggttttgggaaa

SEQ ID NO: 2755529 - DNA, 22 bp, Homo sapiens
tgtaaagctgttaaaatacata

SEQ ID NO: 2755530 - DNA, 16 bp, Homo sapiens
tgtaaagtaaaatatg

SEQ ID NO: 2755531 - DNA, 16 bp, Homo sapiens
tgtaaatctgtacttt

SEQ ID NO: 2755532 - DNA, 18 bp, Homo sapiens
tgtaagaaaatatcactt

SEQ ID NO: 2755533 - DNA, 20 bp, Homo sapiens
tgtaatatatcctgtttgta

SEQ ID NO: 2755534 - DNA, 21 bp, Homo sapiens
tgtaatttaaaattgtgatgt

SEQ ID NO: 2755535 - DNA, 17 bp, Homo sapiens
tgtacatttggaacagt

SEQ ID NO: 2755536 - DNA, 12 bp, Homo sapiens
tgtaccttttgc

SEQ ID NO: 2755537 - DNA, 22 bp, Homo sapiens
tgtaccttttgcgatttcacag

SEQ ID NO: 2755538 - DNA, 23 bp, Homo sapiens
tgtactgcatcttagtttactgg

SEQ ID NO: 2755539 - DNA, 14 bp, Homo sapiens
tgtacttttttcaa

SEQ ID NO: 2755540 - DNA, 22 bp, Homo sapiens
tgtacttttttcaaatattgaa

SEQ ID NO: 2755541 - DNA, 17 bp, Homo sapiens
tgtagaaagctaataca

SEQ ID NO: 2755542 - DNA, 18 bp, Homo sapiens
tgtagaaagctaatacaa

SEQ ID NO: 2755543 - DNA, 14 bp, Homo sapiens
tgtagatgcagaaa

SEQ ID NO: 2755544 - DNA, 15 bp, Homo sapiens
tgtagtgttggagaa

SEQ ID NO: 2755545 - DNA, 17 bp, Homo sapiens
tgtagtgttggagaaga

SEQ ID NO: 2755546 - DNA, 18 bp, Homo sapiens
tgtagtgttggagaagaa

SEQ ID NO: 2755547 - DNA, 20 bp, Homo sapiens
tgtagtgttggagaagaact

SEQ ID NO: 2755548 - DNA, 21 bp, Homo sapiens
tgtagtgttggagaagaactg

SEQ ID NO: 2755549 - DNA, 15 bp, Homo sapiens
tgtataaaagttgta

SEQ ID NO: 2755550 - DNA, 14 bp, Homo sapiens
tgtataaaataatt

SEQ ID NO: 2755551 - DNA, 15 bp, Homo sapiens
tgtatagttgctttt

SEQ ID NO: 2755552 - DNA, 19 bp, Homo sapiens
tgtatcagtaccatttgat

SEQ ID NO: 2755553 - DNA, 14 bp, Homo sapiens
tgtatcttgattaa

SEQ ID NO: 2755554 - DNA, 16 bp, Homo sapiens
tgtatgattcccagcc

SEQ ID NO: 2755555 - DNA, 16 bp, Homo sapiens
tgtattcactaaaata

SEQ ID NO: 2755556 - DNA, 20 bp, Homo sapiens
tgtattcttaaaatgcaata

SEQ ID NO: 2755557 - DNA, 14 bp, Homo sapiens
tgtattgctgtcct

SEQ ID NO: 2755558 - DNA, 20 bp, Homo sapiens
tgtatttaggccatttgtta

SEQ ID NO: 2755559 - DNA, 21 bp, Homo sapiens
tgtcaaattgtgcaaaatatt

SEQ ID NO: 2755560 - DNA, 13 bp, Homo sapiens
tgtcaagtcctga

SEQ ID NO: 2755561 - DNA, 21 bp, Homo sapiens
tgtcaataaaatccatacatt

SEQ ID NO: 2755562 - DNA, 13 bp, Homo sapiens
tgtcactactggt

SEQ ID NO: 2755563 - DNA, 17 bp, Homo sapiens
tgtcactactggtctgt

SEQ ID NO: 2755564 - DNA, 12 bp, Homo sapiens
tgtcacttattt

SEQ ID NO: 2755565 - DNA, 15 bp, Homo sapiens
tgtcacttatttcct

SEQ ID NO: 2755566 - DNA, 19 bp, Homo sapiens
tgtcagtatgtggaagtgt

SEQ ID NO: 2755567 - DNA, 20 bp, Homo sapiens
tgtcagtatgtggaagtgtg

SEQ ID NO: 2755568 - DNA, 17 bp, Homo sapiens
tgtccaactctgtattt

SEQ ID NO: 2755569 - DNA, 22 bp, Homo sapiens
tgtcgtagttactctcaggcat

SEQ ID NO: 2755570 - DNA, 22 bp, Homo sapiens
tgtctaaaagattctttaaact

SEQ ID NO: 2755571 - DNA, 23 bp, Homo sapiens
tgtctaaaagattctttaaacta

SEQ ID NO: 2755572 - DNA, 13 bp, Homo sapiens
tgtctattattat

SEQ ID NO: 2755573 - DNA, 16 bp, Homo sapiens
tgtctattattatgaa

SEQ ID NO: 2755574 - DNA, 19 bp, Homo sapiens
tgtcttcggccgagctggt

SEQ ID NO: 2755575 - DNA, 22 bp, Homo sapiens
tgtcttcggccgagctggtttc

SEQ ID NO: 2755576 - DNA, 23 bp, Homo sapiens
tgtcttcggccgagctggtttcc

SEQ ID NO: 2755577 - DNA, 22 bp, Homo sapiens
tgtctttaaaaataaaagctat

SEQ ID NO: 2755578 - DNA, 14 bp, Homo sapiens
tgtctttgcataca

SEQ ID NO: 2755579 - DNA, 20 bp, Homo sapiens
tgtgaactaagttattgctg

SEQ ID NO: 2755580 - DNA, 22 bp, Homo sapiens
tgtgaactaagttattgctgca

SEQ ID NO: 2755581 - DNA, 23 bp, Homo sapiens
tgtgaactaagttattgctgcat

SEQ ID NO: 2755582 - DNA, 11 bp, Homo sapiens
tgtgatgtgtc

SEQ ID NO: 2755583 - DNA, 16 bp, Homo sapiens
tgtgcagggctggttt

SEQ ID NO: 2755584 - DNA, 19 bp, Homo sapiens
ttttatggcactagtattt

SEQ ID NO: 2755585 - DNA, 15 bp, Homo sapiens
ttttcaaaaaaatgt

SEQ ID NO: 2755586 - DNA, 17 bp, Homo sapiens
ttttcaaaactagttct

SEQ ID NO: 2755587 - DNA, 19 bp, Homo sapiens
ttttcaaatattgaatgcc

SEQ ID NO: 2755588 - DNA, 22 bp, Homo sapiens
ttttcaaatattgaatgcctta

SEQ ID NO: 2755589 - DNA, 15 bp, Homo sapiens
ttttcagaagaaatt

SEQ ID NO: 2755590 - DNA, 23 bp, Homo sapiens
ttttcatcattgttgtgtataat

SEQ ID NO: 2755591 - DNA, 13 bp, Homo sapiens
ttttcattctgaa

SEQ ID NO: 2755592 - DNA, 13 bp, Homo sapiens
ttttcctgaaaac

SEQ ID NO: 2755593 - DNA, 24 bp, Homo sapiens
ttttccttcctctgtaagatatcc

SEQ ID NO: 2755594 - DNA, 14 bp, Homo sapiens
ttttctctaaactg

SEQ ID NO: 2755595 - DNA, 14 bp, Homo sapiens
ttttctctaggaaa

SEQ ID NO: 2755596 - DNA, 18 bp, Homo sapiens
ttttctgggggaaaaagc

SEQ ID NO: 2755597 - DNA, 20 bp, Homo sapiens
ttttctttgtatcattcatc

SEQ ID NO: 2755598 - DNA, 22 bp, Homo sapiens
ttttgattaatgaagaaagtaa

SEQ ID NO: 2755599 - DNA, 15 bp, Homo sapiens
ttttgcgatttcaca

SEQ ID NO: 2755600 - DNA, 17 bp, Homo sapiens
ttttgcgatttcacagt

SEQ ID NO: 2755601 - DNA, 22 bp, Homo sapiens
ttttgggaaaaattatttgtgt

SEQ ID NO: 2755602 - DNA, 18 bp, Homo sapiens
ttttggtctggagggaag

SEQ ID NO: 2755603 - DNA, 12 bp, Homo sapiens
tttttaaaactg

SEQ ID NO: 2755604 - DNA, 20 bp, Homo sapiens
tttttaaaagagacaaactg

SEQ ID NO: 2755605 - DNA, 24 bp, Homo sapiens
tttttaaagaatccaagacaaact

SEQ ID NO: 2755606 - DNA, 24 bp, Homo sapiens
tttttaaattggagaaaagcactt

SEQ ID NO: 2755607 - DNA, 22 bp, Homo sapiens
tttttatatatgaatattacat

SEQ ID NO: 2755608 - DNA, 23 bp, Homo sapiens
tttttatatctggaatgagcctg

SEQ ID NO: 2755609 - DNA, 18 bp, Homo sapiens
tttttatattagttgctt

SEQ ID NO: 2755610 - DNA, 24 bp, Homo sapiens
tttttattgcatggtgtgaactaa

SEQ ID NO: 2755611 - DNA, 12 bp, Homo sapiens
tttttcaaatat

SEQ ID NO: 2755612 - DNA, 21 bp, Homo sapiens
tttttcaaatattgaatgcct

SEQ ID NO: 2755613 - DNA, 22 bp, Homo sapiens
tttttcaaatattgaatgcctt

SEQ ID NO: 2755614 - DNA, 18 bp, Homo sapiens
tttttccaagtgtataat

SEQ ID NO: 2755615 - DNA, 20 bp, Homo sapiens
tttttccaagtgtataatgt

SEQ ID NO: 2755616 - DNA, 12 bp, Homo sapiens
tttttgaattct

SEQ ID NO: 2755617 - DNA, 22 bp, Homo sapiens
tttttgtttctttgtgtttgct

SEQ ID NO: 2755618 - DNA, 16 bp, Homo sapiens
ttttttaaagaatcca

SEQ ID NO: 2755619 - DNA, 12 bp, Homo sapiens
ttttttcaaata

SEQ ID NO: 2755620 - DNA, 12 bp, Homo sapiens
ttttttcacttc

SEQ ID NO: 2755621 - DNA, 23 bp, Homo sapiens
ttttttgattaatgaagaaagta

SEQ ID NO: 2755622 - DNA, 13 bp, Homo sapiens
ttttttgtttgtt

SEQ ID NO: 2755623 - DNA, 18 bp, Homo sapiens
aacatttggtaaggggaa

SEQ ID NO: 2755624 - DNA, 22 bp, Homo sapiens
aaccacaaaaaaatacctcagg

SEQ ID NO: 2755625 - DNA, 13 bp, Homo sapiens
aaccataaacatt

SEQ ID NO: 2755626 - DNA, 21 bp, Homo sapiens
aaccctgttgagtatttgctg

SEQ ID NO: 2755627 - DNA, 13 bp, Homo sapiens
aaccgaataaatg

SEQ ID NO: 2755628 - DNA, 14 bp, Homo sapiens
aacctgctggtggg

SEQ ID NO: 2755629 - DNA, 18 bp, Homo sapiens
aacctgctggtggggcag

SEQ ID NO: 2755630 - DNA, 14 bp, Homo sapiens
aacctgtagatgca

SEQ ID NO: 2755631 - DNA, 22 bp, Homo sapiens
aacctgtagatgcagaaaaaga

SEQ ID NO: 2755632 - DNA, 23 bp, Homo sapiens
aacctgtagatgcagaaaaagaa

SEQ ID NO: 2755633 - DNA, 12 bp, Homo sapiens
aactaaacttta

SEQ ID NO: 2755634 - DNA, 12 bp, Homo sapiens
aactagagaagg

SEQ ID NO: 2755635 - DNA, 21 bp, Homo sapiens
aactagagtttagctggaaaa

SEQ ID NO: 2755636 - DNA, 20 bp, Homo sapiens
aactatctcatttccaagca

SEQ ID NO: 2755637 - DNA, 13 bp, Homo sapiens
aactcaatatata

SEQ ID NO: 2755638 - DNA, 14 bp, Homo sapiens
aactccagaaagtg

SEQ ID NO: 2755639 - DNA, 22 bp, Homo sapiens
aactcctgcctgagaatgttac

SEQ ID NO: 2755640 - DNA, 19 bp, Homo sapiens
aactcgcacctgtgctgga

SEQ ID NO: 2755641 - DNA, 18 bp, Homo sapiens
aactcgttaatttgtagt

SEQ ID NO: 2755642 - DNA, 15 bp, Homo sapiens
aactctactgtgtaa

SEQ ID NO: 2755643 - DNA, 18 bp, Homo sapiens
aactgactcttaagaaga

SEQ ID NO: 2755644 - DNA, 22 bp, Homo sapiens
aactgatgcgacttgttttgct

SEQ ID NO: 2755645 - DNA, 20 bp, Homo sapiens
aactgcatttttaatcagtg

SEQ ID NO: 2755646 - DNA, 16 bp, Homo sapiens
aactggtgatataaag

SEQ ID NO: 2755647 - DNA, 21 bp, Homo sapiens
aactggtgatataaagaatga

SEQ ID NO: 2755648 - DNA, 19 bp, Homo sapiens
aaaagtatgttagtgcaaa

SEQ ID NO: 2755649 - DNA, 23 bp, Homo sapiens
aaaagtccttcagtttagaacct

SEQ ID NO: 2755650 - DNA, 21 bp, Homo sapiens
aaaagttttttttttgtttgt

SEQ ID NO: 2755651 - DNA, 13 bp, Homo sapiens
aaaataaaagcta

SEQ ID NO: 2755652 - DNA, 23 bp, Homo sapiens
aaaataatttttatatttgaaat

SEQ ID NO: 2755653 - DNA, 22 bp, Homo sapiens
aaaatagcacatccaccaaact

SEQ ID NO: 2755654 - DNA, 19 bp, Homo sapiens
aaaatccatacatttgtgt

SEQ ID NO: 2755655 - DNA, 17 bp, Homo sapiens
aaaatgcaatatttgta

SEQ ID NO: 2755656 - DNA, 14 bp, Homo sapiens
aaaatgcttcaaag

SEQ ID NO: 2755657 - DNA, 17 bp, Homo sapiens
aaaatggaaaatataca

SEQ ID NO: 2755658 - DNA, 21 bp, Homo sapiens
aaaatggaaaatatacaagta

SEQ ID NO: 2755659 - DNA, 19 bp, Homo sapiens
aaaatggaaaattaattct

SEQ ID NO: 2755660 - DNA, 13 bp, Homo sapiens
aaaatgtttttaa

SEQ ID NO: 2755661 - DNA, 13 bp, Homo sapiens
aaaattaccttta

SEQ ID NO: 2755662 - DNA, 16 bp, Homo sapiens
aaaattagttgggcat

SEQ ID NO: 2755663 - DNA, 17 bp, Homo sapiens
aaaattatttgcctttt

SEQ ID NO: 2755664 - DNA, 16 bp, Homo sapiens
aaaattcatgccccag

SEQ ID NO: 2755665 - DNA, 18 bp, Homo sapiens
aaaattttcattctgaat

SEQ ID NO: 2755666 - DNA, 20 bp, Homo sapiens
aaaattttcattctgaatct

SEQ ID NO: 2755667 - DNA, 21 bp, Homo sapiens
aaacacagtattgtagaaagc

SEQ ID NO: 2755668 - DNA, 17 bp, Homo sapiens
aatgaaagtgatgacat

SEQ ID NO: 2755669 - DNA, 15 bp, Homo sapiens
aatgaagctttttaa

SEQ ID NO: 2755670 - DNA, 18 bp, Homo sapiens
aatgaattagttgcattg

SEQ ID NO: 2755671 - DNA, 22 bp, Homo sapiens
aatgatatctatattctaaaga

SEQ ID NO: 2755672 - DNA, 21 bp, Homo sapiens
aatgattatgaattacatttg

SEQ ID NO: 2755673 - DNA, 23 bp, Homo sapiens
aatgattatgaattacatttgta

SEQ ID NO: 2755674 - DNA, 13 bp, Homo sapiens
aatgcatatctgt

SEQ ID NO: 2755675 - DNA, 18 bp, Homo sapiens
aatgccgcctgtcaataa

SEQ ID NO: 2755676 - DNA, 23 bp, Homo sapiens
aatgccttatttttgaattcttt

SEQ ID NO: 2755677 - DNA, 13 bp, Homo sapiens
aatgctaaacttg

SEQ ID NO: 2755678 - DNA, 18 bp, Homo sapiens
aatgcttcactgtacgta

SEQ ID NO: 2755679 - DNA, 17 bp, Homo sapiens
aatggaaaatatacaag

SEQ ID NO: 2755680 - DNA, 19 bp, Homo sapiens
aatggaaaatatacaagta

SEQ ID NO: 2755681 - DNA, 19 bp, Homo sapiens
aatggaaaattaattctaa

SEQ ID NO: 2755682 - DNA, 19 bp, Homo sapiens
aatgggatataataccttt

SEQ ID NO: 2755683 - DNA, 22 bp, Homo sapiens
aatggtgcaaaggagccgccac

SEQ ID NO: 2755684 - DNA, 19 bp, Homo sapiens
aatgtactttttattgcat

SEQ ID NO: 2755685 - DNA, 16 bp, Homo sapiens
aatgtagaaattctaa

SEQ ID NO: 2755686 - DNA, 22 bp, Homo sapiens
aatgtcagtatgtggaagtgtg

SEQ ID NO: 2755687 - DNA, 19 bp, Homo sapiens
aatgtgatctatgtttcat

SEQ ID NO: 2755688 - DNA, 15 bp, Homo sapiens
aatgtgctagagtta

SEQ ID NO: 2755689 - DNA, 20 bp, Homo sapiens
aatgtgctagagttaaaagt

SEQ ID NO: 2755690 - DNA, 22 bp, Homo sapiens
aatgtgctagagttaaaagtta

SEQ ID NO: 2755691 - DNA, 23 bp, Homo sapiens
aatgtgtgtattcttaaaatgca

SEQ ID NO: 2755692 - DNA, 15 bp, Homo sapiens
aatgttaccagactt

SEQ ID NO: 2755693 - DNA, 19 bp, Homo sapiens
aatgttaccagacttcaag

SEQ ID NO: 2755694 - DNA, 18 bp, Homo sapiens
aatgttgacatgggacat

SEQ ID NO: 2755695 - DNA, 23 bp, Homo sapiens
aatgttggtgtggagttttcatg

SEQ ID NO: 2755696 - DNA, 23 bp, Homo sapiens
aatgtttcaaacatatataacaa

SEQ ID NO: 2755697 - DNA, 13 bp, Homo sapiens
aatgttttaatgc

SEQ ID NO: 2755698 - DNA, 14 bp, Homo sapiens
aatgttttaatgcc

SEQ ID NO: 2755699 - DNA, 16 bp, Homo sapiens
aattaattctaaactt

SEQ ID NO: 2755700 - DNA, 17 bp, Homo sapiens
aattaattctaaactta

SEQ ID NO: 2755701 - DNA, 16 bp, Homo sapiens
aattaccaagagaagg

SEQ ID NO: 2755702 - DNA, 22 bp, Homo sapiens
aattaggataactaaaattctg

SEQ ID NO: 2755703 - DNA, 23 bp, Homo sapiens
aattagtggatttttttgtcatt

SEQ ID NO: 2755704 - DNA, 19 bp, Homo sapiens
aattatttgcaggtcttta

SEQ ID NO: 2755705 - DNA, 16 bp, Homo sapiens
aattatttgcctttta

SEQ ID NO: 2755706 - DNA, 21 bp, Homo sapiens
aattatttgtgttgggggaaa

SEQ ID NO: 2755707 - DNA, 19 bp, Homo sapiens
aattcatgccccagtatta

SEQ ID NO: 2755708 - DNA, 16 bp, Homo sapiens
aattccacaccctcac

SEQ ID NO: 2755709 - DNA, 17 bp, Homo sapiens
aattctaacttaatgta

SEQ ID NO: 2755710 - DNA, 21 bp, Homo sapiens
aattctgaggtaagtgtatga

SEQ ID NO: 2755711 - DNA, 18 bp, Homo sapiens
aattctgggcctaatttt

SEQ ID NO: 2755712 - DNA, 13 bp, Homo sapiens
aattctttagatt

SEQ ID NO: 2755713 - DNA, 18 bp, Homo sapiens
aattctttgacctgttgg

SEQ ID NO: 2755714 - DNA, 22 bp, Homo sapiens
aattctttgacctgttgggagt

SEQ ID NO: 2755715 - DNA, 21 bp, Homo sapiens
aattgagactgaaagaaacta

SEQ ID NO: 2755716 - DNA, 18 bp, Homo sapiens
aattgaggacactgatat

SEQ ID NO: 2755717 - DNA, 13 bp, Homo sapiens
aattgccaatctt

SEQ ID NO: 2755718 - DNA, 16 bp, Homo sapiens
aattgccaatcttgtt

SEQ ID NO: 2755719 - DNA, 17 bp, Homo sapiens
aattggagaaaagcact

SEQ ID NO: 2755720 - DNA, 15 bp, Homo sapiens
aattggattacagta

SEQ ID NO: 2755721 - DNA, 15 bp, Homo sapiens
aattgtgcaaaatat

SEQ ID NO: 2755722 - DNA, 16 bp, Homo sapiens
aattgtgcaaaatatt

SEQ ID NO: 2755723 - DNA, 16 bp, Homo sapiens
aattgtttttataaaa

SEQ ID NO: 2755724 - DNA, 16 bp, Homo sapiens
aatttaccacaaaagc

SEQ ID NO: 2755725 - DNA, 18 bp, Homo sapiens
aatttaccacaaaagcaa

SEQ ID NO: 2755726 - DNA, 18 bp, Homo sapiens
aattttgttggtctgaat

SEQ ID NO: 2755727 - DNA, 13 bp, Homo sapiens
aatttttgttttg

SEQ ID NO: 2755728 - DNA, 17 bp, Homo sapiens
aattttttaaaagagac

SEQ ID NO: 2755729 - DNA, 13 bp, Homo sapiens
aattttttaaaga

SEQ ID NO: 2755730 - DNA, 15 bp, Homo sapiens
aattttttaaagaat

SEQ ID NO: 2755731 - DNA, 19 bp, Homo sapiens
aattttttctctaggaaat

SEQ ID NO: 2755732 - DNA, 21 bp, Homo sapiens
acaaaaagttttttttttgtt

SEQ ID NO: 2755733 - DNA, 22 bp, Homo sapiens
acaaaactatcctatgccttca

SEQ ID NO: 2755734 - DNA, 15 bp, Homo sapiens
acaaaagcaaaattt

SEQ ID NO: 2755735 - DNA, 20 bp, Homo sapiens
acaaaagttgtttaataagt

SEQ ID NO: 2755736 - DNA, 21 bp, Homo sapiens
acaaaagttgtttaataagta

SEQ ID NO: 2755737 - DNA, 19 bp, Homo sapiens
acaaaatagcacatccacc

SEQ ID NO: 2755738 - DNA, 17 bp, Homo sapiens
acaactggtctgttaat

SEQ ID NO: 2755739 - DNA, 15 bp, Homo sapiens
acaagattttttaat

SEQ ID NO: 2755740 - DNA, 20 bp, Homo sapiens
acaagattttttaattgttt

SEQ ID NO: 2755741 - DNA, 13 bp, Homo sapiens
acaagtaaattct

SEQ ID NO: 2755742 - DNA, 19 bp, Homo sapiens
acaatgccgcctgtcaata

SEQ ID NO: 2755743 - DNA, 21 bp, Homo sapiens
acaatgccgcctgtcaataaa

SEQ ID NO: 2755744 - DNA, 17 bp, Homo sapiens
acaatgctgtattttaa

SEQ ID NO: 2755745 - DNA, 22 bp, Homo sapiens
acaatttcaaaagaacattctt

SEQ ID NO: 2755746 - DNA, 13 bp, Homo sapiens
acacaactatatt

SEQ ID NO: 2755747 - DNA, 13 bp, Homo sapiens
acacactgaagaa

SEQ ID NO: 2755748 - DNA, 11 bp, Homo sapiens
acacagtattg

SEQ ID NO: 2755749 - DNA, 17 bp, Homo sapiens
acacagtattgtagaaa

SEQ ID NO: 2755750 - DNA, 14 bp, Homo sapiens
acacatttcatcta

SEQ ID NO: 2755751 - DNA, 20 bp, Homo sapiens
acacatttcatctaatttaa

SEQ ID NO: 2755752 - DNA, 15 bp, Homo sapiens
acacattttgtaaat

SEQ ID NO: 2755753 - DNA, 20 bp, Homo sapiens
acacattttgtaaatctgta

SEQ ID NO: 2755754 - DNA, 20 bp, Homo sapiens
acacctcagaaattgaaagc

SEQ ID NO: 2755755 - DNA, 18 bp, Homo sapiens
acactaagagagaatgag

SEQ ID NO: 2755756 - DNA, 17 bp, Homo sapiens
acactcgccatctcctg

SEQ ID NO: 2755757 - DNA, 20 bp, Homo sapiens
acagaaaaaaaaatgtttta

SEQ ID NO: 2755758 - DNA, 21 bp, Homo sapiens
acagaatatacacattttgta

SEQ ID NO: 2755759 - DNA, 22 bp, Homo sapiens
acagaatatacacattttgtaa

SEQ ID NO: 2755760 - DNA, 23 bp, Homo sapiens
acagaatatacacattttgtaaa

SEQ ID NO: 2755761 - DNA, 14 bp, Homo sapiens
acagacctttgaac

SEQ ID NO: 2755762 - DNA, 19 bp, Homo sapiens
acagcccttctttccacag

SEQ ID NO: 2755763 - DNA, 14 bp, Homo sapiens
acagctgtatgatt

SEQ ID NO: 2755764 - DNA, 23 bp, Homo sapiens
acaggcaaatccgaaatcagcag

SEQ ID NO: 2755765 - DNA, 12 bp, Homo sapiens
acaggttttaag

SEQ ID NO: 2755766 - DNA, 14 bp, Homo sapiens
acaggttttaagga

SEQ ID NO: 2755767 - DNA, 17 bp, Homo sapiens
acagtattgtagaaagc

SEQ ID NO: 2755768 - DNA, 16 bp, Homo sapiens
acagtcacctcatgga

SEQ ID NO: 2755769 - DNA, 18 bp, Homo sapiens
acagtcacctcatggaat

SEQ ID NO: 2755770 - DNA, 21 bp, Homo sapiens
acagttacctctgcctcagaa

SEQ ID NO: 2755771 - DNA, 14 bp, Homo sapiens
acagtttcttcatg

SEQ ID NO: 2755772 - DNA, 21 bp, Homo sapiens
acagtttcttcatgcattact

SEQ ID NO: 2755773 - DNA, 15 bp, Homo sapiens
acataagcttctcaa

SEQ ID NO: 2755774 - DNA, 18 bp, Homo sapiens
acatatatatcctatttg

SEQ ID NO: 2755775 - DNA, 15 bp, Homo sapiens
acatatcattctgtg

SEQ ID NO: 2755776 - DNA, 20 bp, Homo sapiens
acatattggagggaaatctt

SEQ ID NO: 2755777 - DNA, 14 bp, Homo sapiens
acatcttgaaaatg

SEQ ID NO: 2755778 - DNA, 20 bp, Homo sapiens
acattaggaagctgaattat

SEQ ID NO: 2755779 - DNA, 22 bp, Homo sapiens
acattcagctgaggttcattac

SEQ ID NO: 2755780 - DNA, 16 bp, Homo sapiens
acattgaaatattagt

SEQ ID NO: 2755781 - DNA, 16 bp, Homo sapiens
acatttcatctaattt

SEQ ID NO: 2755782 - DNA, 15 bp, Homo sapiens
acatttgctcatgga

SEQ ID NO: 2755783 - DNA, 16 bp, Homo sapiens
acatttgctcatggaa

SEQ ID NO: 2755784 - DNA, 18 bp, Homo sapiens
acatttgctcatggaatt

SEQ ID NO: 2755785 - DNA, 14 bp, Homo sapiens
acatttgtataaaa

SEQ ID NO: 2755786 - DNA, 15 bp, Homo sapiens
acattttgtaaatct

SEQ ID NO: 2755787 - DNA, 13 bp, Homo sapiens
accaaactcctgc

SEQ ID NO: 2755788 - DNA, 12 bp, Homo sapiens
accaagagaagg

SEQ ID NO: 2755789 - DNA, 18 bp, Homo sapiens
accaagatgccaacatcg

SEQ ID NO: 2755790 - DNA, 15 bp, Homo sapiens
accaatcatgaatta

SEQ ID NO: 2755791 - DNA, 13 bp, Homo sapiens
accacaaaagttg

SEQ ID NO: 2755792 - DNA, 16 bp, Homo sapiens
accactggtaacatgt

SEQ ID NO: 2755793 - DNA, 15 bp, Homo sapiens
accagacttcaagat

SEQ ID NO: 2755794 - DNA, 14 bp, Homo sapiens
accagtctgactgt

SEQ ID NO: 2755795 - DNA, 18 bp, Homo sapiens
accataaacatttgccaa

SEQ ID NO: 2755796 - DNA, 14 bp, Homo sapiens
accatctctttacc

SEQ ID NO: 2755797 - DNA, 17 bp, Homo sapiens
tgtagtctcagctactt

SEQ ID NO: 2755798 - DNA, 16 bp, Homo sapiens
tgtagtgttggagaag

SEQ ID NO: 2755799 - DNA, 19 bp, Homo sapiens
tgtagtgttggagaagaac

SEQ ID NO: 2755800 - DNA, 14 bp, Homo sapiens
tgtagttttgttta

SEQ ID NO: 2755801 - DNA, 13 bp, Homo sapiens
tgtataaaagttg

SEQ ID NO: 2755802 - DNA, 19 bp, Homo sapiens
tgtataaaagttgtactgc

SEQ ID NO: 2755803 - DNA, 13 bp, Homo sapiens
tgtataaaataat

SEQ ID NO: 2755804 - DNA, 21 bp, Homo sapiens
tgtataagttgtattattaga

SEQ ID NO: 2755805 - DNA, 18 bp, Homo sapiens
tgtataatgttggtgtgg

SEQ ID NO: 2755806 - DNA, 21 bp, Homo sapiens
tgtataatgttggtgtggagt

SEQ ID NO: 2755807 - DNA, 13 bp, Homo sapiens
tgtatagttgctt

SEQ ID NO: 2755808 - DNA, 14 bp, Homo sapiens
tgtatagttgcttt

SEQ ID NO: 2755809 - DNA, 17 bp, Homo sapiens
tgtatcttgattaatgt

SEQ ID NO: 2755810 - DNA, 18 bp, Homo sapiens
tgtatcttgattaatgta

SEQ ID NO: 2755811 - DNA, 20 bp, Homo sapiens
tgtatcttgattaatgtact

SEQ ID NO: 2755812 - DNA, 22 bp, Homo sapiens
tgtatcttgattaatgtacttt

SEQ ID NO: 2755813 - DNA, 15 bp, Homo sapiens
tgtatgattcccagc

SEQ ID NO: 2755814 - DNA, 12 bp, Homo sapiens
tgtatgtggggg

SEQ ID NO: 2755815 - DNA, 22 bp, Homo sapiens
tgtatgtgggggtctgtgtgtt

SEQ ID NO: 2755816 - DNA, 14 bp, Homo sapiens
tgtattcttaaaat

SEQ ID NO: 2755817 - DNA, 17 bp, Homo sapiens
tgtattgctgctgtgcg

SEQ ID NO: 2755818 - DNA, 14 bp, Homo sapiens
tgtatttttttcca

SEQ ID NO: 2755819 - DNA, 14 bp, Homo sapiens
tgtcaataaatgtt

SEQ ID NO: 2755820 - DNA, 18 bp, Homo sapiens
tgtcaataaatgttgaaa

SEQ ID NO: 2755821 - DNA, 19 bp, Homo sapiens
tgtcaataaatgttgaaaa

SEQ ID NO: 2755822 - DNA, 15 bp, Homo sapiens
tgtcacaaagagctg

SEQ ID NO: 2755823 - DNA, 22 bp, Homo sapiens
tgtcacccttaggccagcacca

SEQ ID NO: 2755824 - DNA, 16 bp, Homo sapiens
tgtcactactggtctg

SEQ ID NO: 2755825 - DNA, 18 bp, Homo sapiens
tgtcagtatgtggaagtg

SEQ ID NO: 2755826 - DNA, 22 bp, Homo sapiens
tgtcagtatgtggaagtgtggg

SEQ ID NO: 2755827 - DNA, 21 bp, Homo sapiens
tgtccagaagagtcaaagtag

SEQ ID NO: 2755828 - DNA, 22 bp, Homo sapiens
tgtccagttcaggaatttttgt

SEQ ID NO: 2755829 - DNA, 16 bp, Homo sapiens
tgtcctatgcaataaa

SEQ ID NO: 2755830 - DNA, 17 bp, Homo sapiens
tgtctaaaagattcttt

SEQ ID NO: 2755831 - DNA, 17 bp, Homo sapiens
tgtctacactaagagag

SEQ ID NO: 2755832 - DNA, 22 bp, Homo sapiens
tgtctacactaagagagaatga

SEQ ID NO: 2755833 - DNA, 17 bp, Homo sapiens
tgtctattattatgaag

SEQ ID NO: 2755834 - DNA, 21 bp, Homo sapiens
tgtctgcctggagtgctgtgc

SEQ ID NO: 2755835 - DNA, 22 bp, Homo sapiens
tgtctgcctggagtgctgtgct

SEQ ID NO: 2755836 - DNA, 14 bp, Homo sapiens
tgtctggcctgagg

SEQ ID NO: 2755837 - DNA, 23 bp, Homo sapiens
tgtcttgctagacaaggttgctg

SEQ ID NO: 2755838 - DNA, 18 bp, Homo sapiens
tgtcttggggtcccactg

SEQ ID NO: 2755839 - DNA, 22 bp, Homo sapiens
tgtcttggggtcccactgctcg

SEQ ID NO: 2755840 - DNA, 17 bp, Homo sapiens
tgtgaacagtacagtat

SEQ ID NO: 2755841 - DNA, 19 bp, Homo sapiens
tgtgaactaagttattgct

SEQ ID NO: 2755842 - DNA, 14 bp, Homo sapiens
tgtgaagcaaaatt

SEQ ID NO: 2755843 - DNA, 21 bp, Homo sapiens
tgtgaagttacatgcataaaa

SEQ ID NO: 2755844 - DNA, 18 bp, Homo sapiens
tgtgaggggctctctcat

SEQ ID NO: 2755845 - DNA, 19 bp, Homo sapiens
tgtgctagtaattggaaag

SEQ ID NO: 2755846 - DNA, 18 bp, Homo sapiens
tgtgctttttgcaaaagg

SEQ ID NO: 2755847 - DNA, 20 bp, Homo sapiens
tgtgctttttgcaaaagggc

SEQ ID NO: 2755848 - DNA, 16 bp, Homo sapiens
tgtggagttttcatga

SEQ ID NO: 2755849 - DNA, 22 bp, Homo sapiens
tgtggccccgcccgagcccctg

SEQ ID NO: 2755850 - DNA, 14 bp, Homo sapiens
tgtgggagtgtgta

SEQ ID NO: 2755851 - DNA, 21 bp, Homo sapiens
tgtgtagtctctctagtagtt

SEQ ID NO: 2755852 - DNA, 10 bp, Homo sapiens
tgtgtataat

SEQ ID NO: 2755853 - DNA, 22 bp, Homo sapiens
tgtgtgaaaggtacttcaaatc

SEQ ID NO: 2755854 - DNA, 13 bp, Homo sapiens
tgtgtgtgtgtat

SEQ ID NO: 2755855 - DNA, 18 bp, Homo sapiens
tgtgtgttgtgtgtggga

SEQ ID NO: 2755856 - DNA, 14 bp, Homo sapiens
tgtgttgtgtgtgg

SEQ ID NO: 2755857 - DNA, 13 bp, Homo sapiens
tgtgtttatgtgt

SEQ ID NO: 2755858 - DNA, 15 bp, Homo sapiens
tgtgtttatgtgtgt

SEQ ID NO: 2755859 - DNA, 16 bp, Homo sapiens
tgttaaaactgtacct

SEQ ID NO: 2755860 - DNA, 19 bp, Homo sapiens
tgttaaaactgtacctttt

SEQ ID NO: 2755861 - DNA, 13 bp, Homo sapiens
tgttaaaatacat

SEQ ID NO: 2755862 - DNA, 15 bp, Homo sapiens
tgttaaaatacataa

SEQ ID NO: 2755863 - DNA, 19 bp, Homo sapiens
tgttaaaatacataacttc

SEQ ID NO: 2755864 - DNA, 13 bp, Homo sapiens
tgttaaattttct

SEQ ID NO: 2755865 - DNA, 23 bp, Homo sapiens
tgttaaattttctctaaactgtt

SEQ ID NO: 2755866 - DNA, 23 bp, Homo sapiens
tgttacagtttcttcatgcatta

SEQ ID NO: 2755867 - DNA, 14 bp, Homo sapiens
tgttaccagacttc

SEQ ID NO: 2755868 - DNA, 12 bp, Homo sapiens
tgttataatctt

SEQ ID NO: 2755869 - DNA, 15 bp, Homo sapiens
tgttccaatgccaca

SEQ ID NO: 2755870 - DNA, 14 bp, Homo sapiens
tgttcttatagaat

SEQ ID NO: 2755871 - DNA, 18 bp, Homo sapiens
tgttcttatagaataaaa

SEQ ID NO: 2755872 - DNA, 18 bp, Homo sapiens
tgttgagtatttgctgtt

SEQ ID NO: 2755873 - DNA, 14 bp, Homo sapiens
tgttggagaagaac

SEQ ID NO: 2755874 - DNA, 18 bp, Homo sapiens
tgttgggatcgcattgca

SEQ ID NO: 2755875 - DNA, 23 bp, Homo sapiens
tgttgtgcagtgtgcctgtcact

SEQ ID NO: 2755876 - DNA, 14 bp, Homo sapiens
tgttgtgtgtggga

SEQ ID NO: 2755877 - DNA, 15 bp, Homo sapiens
tgttgtgtgtgggag

SEQ ID NO: 2755878 - DNA, 14 bp, Homo sapiens
tgttgttgttttat

SEQ ID NO: 2755879 - DNA, 16 bp, Homo sapiens
tgttgttttctggggg

SEQ ID NO: 2755880 - DNA, 14 bp, Homo sapiens
tgtttaataagtat

SEQ ID NO: 2755881 - DNA, 16 bp, Homo sapiens
tgtttagaagaagtgt

SEQ ID NO: 2755882 - DNA, 19 bp, Homo sapiens
tgtttagaagaagtgtgtc

SEQ ID NO: 2755883 - DNA, 13 bp, Homo sapiens
tgtttatgtgtgt

SEQ ID NO: 2755884 - DNA, 13 bp, Homo sapiens
tgtttatgttctt

SEQ ID NO: 2755885 - DNA, 17 bp, Homo sapiens
tgtttatttagaaactg

SEQ ID NO: 2755886 - DNA, 22 bp, Homo sapiens
tgtttcaaacatatataacaat

SEQ ID NO: 2755887 - DNA, 11 bp, Homo sapiens
tgtttctgttc

SEQ ID NO: 2755888 - DNA, 19 bp, Homo sapiens
tgtttgctaagcattccaa

SEQ ID NO: 2755889 - DNA, 22 bp, Homo sapiens
tgtttggatttcctttatactg

SEQ ID NO: 2755890 - DNA, 20 bp, Homo sapiens
tgtttgtatttttttccaag

SEQ ID NO: 2755891 - DNA, 17 bp, Homo sapiens
tgtttgtccagttcagg

SEQ ID NO: 2755892 - DNA, 18 bp, Homo sapiens
tgtttgtttttgctttct

SEQ ID NO: 2755893 - DNA, 18 bp, Homo sapiens
tgttttaagcaaatgcat

SEQ ID NO: 2755894 - DNA, 14 bp, Homo sapiens
tgttttgcaagcca

SEQ ID NO: 2755895 - DNA, 14 bp, Homo sapiens
tgtttttaaaaacc

SEQ ID NO: 2755896 - DNA, 16 bp, Homo sapiens
tgtttttataaaaaca

SEQ ID NO: 2755897 - DNA, 17 bp, Homo sapiens
tgtttttataaaaacat

SEQ ID NO: 2755898 - DNA, 18 bp, Homo sapiens
tgtttttataaaaacatt

SEQ ID NO: 2755899 - DNA, 18 bp, Homo sapiens
ttaaaaaagaaacatttg

SEQ ID NO: 2755900 - DNA, 20 bp, Homo sapiens
ttaaaaaattttttgattaa

SEQ ID NO: 2755901 - DNA, 18 bp, Homo sapiens
ttaaaaacctattttgaa

SEQ ID NO: 2755902 - DNA, 9 bp, Homo sapiens
ttcttcctt

SEQ ID NO: 2755903 - DNA, 12 bp, Homo sapiens
ttcttctttaat

SEQ ID NO: 2755904 - DNA, 15 bp, Homo sapiens
ttctttaaactactg

SEQ ID NO: 2755905 - DNA, 22 bp, Homo sapiens
ttctttagatttttaaattgga

SEQ ID NO: 2755906 - DNA, 18 bp, Homo sapiens
ttctttccacagaagctc

SEQ ID NO: 2755907 - DNA, 15 bp, Homo sapiens
ttctttgaaatgcta

SEQ ID NO: 2755908 - DNA, 20 bp, Homo sapiens
ttctttgaaatgctaaactt

SEQ ID NO: 2755909 - DNA, 12 bp, Homo sapiens
ttctttgtatca

SEQ ID NO: 2755910 - DNA, 18 bp, Homo sapiens
ttcttttttgtaaaaact

SEQ ID NO: 2755911 - DNA, 14 bp, Homo sapiens
ttgaaaattacctt

SEQ ID NO: 2755912 - DNA, 16 bp, Homo sapiens
ttgaaaattaccttta

SEQ ID NO: 2755913 - DNA, 23 bp, Homo sapiens
ttgaaaattacctttaatgcaat

SEQ ID NO: 2755914 - DNA, 18 bp, Homo sapiens
ttgaaatgctaaacttgg

SEQ ID NO: 2755915 - DNA, 18 bp, Homo sapiens
ttgaaggaatacaatata

SEQ ID NO: 2755916 - DNA, 23 bp, Homo sapiens
ttgaaggaatacaatatatagct

SEQ ID NO: 2755917 - DNA, 23 bp, Homo sapiens
ttgaatgccatagtcaaagagag

SEQ ID NO: 2755918 - DNA, 21 bp, Homo sapiens
ttgaattctttagatttttaa

SEQ ID NO: 2755919 - DNA, 12 bp, Homo sapiens
ttgactttttat

SEQ ID NO: 2755920 - DNA, 14 bp, Homo sapiens
ttgaggacactgat

SEQ ID NO: 2755921 - DNA, 14 bp, Homo sapiens
ttgaggctgcagtg

SEQ ID NO: 2755922 - DNA, 15 bp, Homo sapiens
ttgagtatttgctgt

SEQ ID NO: 2755923 - DNA, 15 bp, Homo sapiens
ttgatagtttcattt

SEQ ID NO: 2755924 - DNA, 20 bp, Homo sapiens
ttgatatgccttttcccaac

SEQ ID NO: 2755925 - DNA, 12 bp, Homo sapiens
ttgatgaagaag

SEQ ID NO: 2755926 - DNA, 14 bp, Homo sapiens
ttgatgaagaagtt

SEQ ID NO: 2755927 - DNA, 23 bp, Homo sapiens
ttgatgaagaagttgatatgcct

SEQ ID NO: 2755928 - DNA, 16 bp, Homo sapiens
ttgattaatgtacttt

SEQ ID NO: 2755929 - DNA, 18 bp, Homo sapiens
ttgcacgcgccctttcta

SEQ ID NO: 2755930 - DNA, 13 bp, Homo sapiens
ttgcagaagttct

SEQ ID NO: 2755931 - DNA, 17 bp, Homo sapiens
ttgcatggtgtgaacta

SEQ ID NO: 2755932 - DNA, 16 bp, Homo sapiens
ctaaaagattctttaa

SEQ ID NO: 2755933 - DNA, 17 bp, Homo sapiens
ctaaaaggtttccacta

SEQ ID NO: 2755934 - DNA, 14 bp, Homo sapiens
ctaaaataaaattt

SEQ ID NO: 2755935 - DNA, 17 bp, Homo sapiens
ctaaaatgtagaaattc

SEQ ID NO: 2755936 - DNA, 16 bp, Homo sapiens
ctaaaccacaaaagtt

SEQ ID NO: 2755937 - DNA, 17 bp, Homo sapiens
ctaaaccacaaaagttg

SEQ ID NO: 2755938 - DNA, 18 bp, Homo sapiens
ctaaaccacaaaagttgt

SEQ ID NO: 2755939 - DNA, 13 bp, Homo sapiens
ctaaacttagaaa

SEQ ID NO: 2755940 - DNA, 20 bp, Homo sapiens
ctaaagagctacttctaatt

SEQ ID NO: 2755941 - DNA, 16 bp, Homo sapiens
ctaagggaaaaagttg

SEQ ID NO: 2755942 - DNA, 13 bp, Homo sapiens
ctaagttattgct

SEQ ID NO: 2755943 - DNA, 16 bp, Homo sapiens
ctaagttattgctgca

SEQ ID NO: 2755944 - DNA, 23 bp, Homo sapiens
ctaatcttaaatcagaataaatt

SEQ ID NO: 2755945 - DNA, 20 bp, Homo sapiens
ctaatgaaagtgatgacata

SEQ ID NO: 2755946 - DNA, 17 bp, Homo sapiens
ctaattttttttgtaca

SEQ ID NO: 2755947 - DNA, 12 bp, Homo sapiens
ctacaaaagctt

SEQ ID NO: 2755948 - DNA, 14 bp, Homo sapiens
ctacacatttcatc

SEQ ID NO: 2755949 - DNA, 16 bp, Homo sapiens
ctacacatttcatcta

SEQ ID NO: 2755950 - DNA, 19 bp, Homo sapiens
ctacacatttcatctaatt

SEQ ID NO: 2755951 - DNA, 14 bp, Homo sapiens
ctacactaagagag

SEQ ID NO: 2755952 - DNA, 11 bp, Homo sapiens
ctacaggacaa

SEQ ID NO: 2755953 - DNA, 13 bp, Homo sapiens
ctaccttgtggga

SEQ ID NO: 2755954 - DNA, 16 bp, Homo sapiens
ctaccttgtgggaata

SEQ ID NO: 2755955 - DNA, 12 bp, Homo sapiens
ctactggtctgt

SEQ ID NO: 2755956 - DNA, 13 bp, Homo sapiens
ctactttaaattt

SEQ ID NO: 2755957 - DNA, 18 bp, Homo sapiens
ctactttaaattttttaa

SEQ ID NO: 2755958 - DNA, 14 bp, Homo sapiens
ctagaatccacaca

SEQ ID NO: 2755959 - DNA, 12 bp, Homo sapiens
ctagagttaaaa

SEQ ID NO: 2755960 - DNA, 16 bp, Homo sapiens
ctagagttaaaagtta

SEQ ID NO: 2755961 - DNA, 18 bp, Homo sapiens
ctagagtttagctggaaa

SEQ ID NO: 2755962 - DNA, 14 bp, Homo sapiens
ctagatatgaatat

SEQ ID NO: 2755963 - DNA, 20 bp, Homo sapiens
ctagctctatttacttctaa

SEQ ID NO: 2755964 - DNA, 14 bp, Homo sapiens
ctaggaaatattta

SEQ ID NO: 2755965 - DNA, 15 bp, Homo sapiens
ctaggaaatatttat

SEQ ID NO: 2755966 - DNA, 20 bp, Homo sapiens
ctaggaaatatttattttaa

SEQ ID NO: 2755967 - DNA, 18 bp, Homo sapiens
ctagggtctataattcct

SEQ ID NO: 2755968 - DNA, 23 bp, Homo sapiens
ctaggttaacaaccctgttgagt

SEQ ID NO: 2755969 - DNA, 20 bp, Homo sapiens
ctagtgaaactcgttaattt

SEQ ID NO: 2755970 - DNA, 20 bp, Homo sapiens
agtttagaacctacaaaagc

SEQ ID NO: 2755971 - DNA, 13 bp, Homo sapiens
agtttatgtttgt

SEQ ID NO: 2755972 - DNA, 22 bp, Homo sapiens
agtttcatttacaatttcaaaa

SEQ ID NO: 2755973 - DNA, 14 bp, Homo sapiens
agtttcttcatgca

SEQ ID NO: 2755974 - DNA, 15 bp, Homo sapiens
agtttcttcatgcat

SEQ ID NO: 2755975 - DNA, 14 bp, Homo sapiens
agttttatcttaaa

SEQ ID NO: 2755976 - DNA, 18 bp, Homo sapiens
agttttatcttaaactgt

SEQ ID NO: 2755977 - DNA, 17 bp, Homo sapiens
agttttcatgacagaat

SEQ ID NO: 2755978 - DNA, 18 bp, Homo sapiens
agttttggttatttctaa

SEQ ID NO: 2755979 - DNA, 20 bp, Homo sapiens
agttttggttatttctaaac

SEQ ID NO: 2755980 - DNA, 12 bp, Homo sapiens
ataaaagctgtg

SEQ ID NO: 2755981 - DNA, 13 bp, Homo sapiens
ataaaagttgtac

SEQ ID NO: 2755982 - DNA, 14 bp, Homo sapiens
ataaaagttgtact

SEQ ID NO: 2755983 - DNA, 12 bp, Homo sapiens
ataaaataattt

SEQ ID NO: 2755984 - DNA, 15 bp, Homo sapiens
ataaaataattttta

SEQ ID NO: 2755985 - DNA, 21 bp, Homo sapiens
ataaaataatttttatatttg

SEQ ID NO: 2755986 - DNA, 20 bp, Homo sapiens
ataaaattggattacagtat

SEQ ID NO: 2755987 - DNA, 22 bp, Homo sapiens
ataaaatttaaaaaactcctgt

SEQ ID NO: 2755988 - DNA, 19 bp, Homo sapiens
ataaactgttatgagtagt

SEQ ID NO: 2755989 - DNA, 15 bp, Homo sapiens
ataaagaatgaaagt

SEQ ID NO: 2755990 - DNA, 22 bp, Homo sapiens
ataaagaatgaaagtagctgta

SEQ ID NO: 2755991 - DNA, 17 bp, Homo sapiens
ataaagtcctgaacctt

SEQ ID NO: 2755992 - DNA, 16 bp, Homo sapiens
ataaatagatttagtc

SEQ ID NO: 2755993 - DNA, 15 bp, Homo sapiens
ataaatgatatctat

SEQ ID NO: 2755994 - DNA, 15 bp, Homo sapiens
ataaatgttgaaaag

SEQ ID NO: 2755995 - DNA, 14 bp, Homo sapiens
ataacattctgaca

SEQ ID NO: 2755996 - DNA, 19 bp, Homo sapiens
ataacattctgacacatat

SEQ ID NO: 2755997 - DNA, 14 bp, Homo sapiens
ataactaaaattct

SEQ ID NO: 2755998 - DNA, 16 bp, Homo sapiens
ataacttcaaattttt

SEQ ID NO: 2755999 - DNA, 17 bp, Homo sapiens
ataagtatatcttaaga

SEQ ID NO: 2756000 - DNA, 15 bp, Homo sapiens
ataatacctttctaa

SEQ ID NO: 2756001 - DNA, 21 bp, Homo sapiens
ataatctttcacaggggacag

SEQ ID NO: 2756002 - DNA, 18 bp, Homo sapiens
ataatgcatccagcagta

SEQ ID NO: 2756003 - DNA, 21 bp, Homo sapiens
ataatgttggtgtggagtttt

SEQ ID NO: 2756004 - DNA, 22 bp, Homo sapiens
ataatgttggtgtggagttttc

SEQ ID NO: 2756005 - DNA, 20 bp, Homo sapiens
ataattccttaaaattttca

SEQ ID NO: 2756006 - DNA, 21 bp, Homo sapiens
ataattccttaaaattttcat

SEQ ID NO: 2756007 - DNA, 22 bp, Homo sapiens
ataattgagactgaaagaaact

SEQ ID NO: 2756008 - DNA, 13 bp, Homo sapiens
ataattttgtgaa

SEQ ID NO: 2756009 - DNA, 15 bp, Homo sapiens
ataattttgtgaagc

SEQ ID NO: 2756010 - DNA, 20 bp, Homo sapiens
ataattttgtgaagcaaaat

SEQ ID NO: 2756011 - DNA, 16 bp, Homo sapiens
ataatttttatatttg

SEQ ID NO: 2756012 - DNA, 19 bp, Homo sapiens
ataatttttatatttgaaa

SEQ ID NO: 2756013 - DNA, 21 bp, Homo sapiens
ataatttttatatttgaaata

SEQ ID NO: 2756014 - DNA, 22 bp, Homo sapiens
ataatttttatatttgaaatat

SEQ ID NO: 2756015 - DNA, 17 bp, Homo sapiens
atacaaatctgtataaa

SEQ ID NO: 2756016 - DNA, 15 bp, Homo sapiens
atacataacttcagt

SEQ ID NO: 2756017 - DNA, 17 bp, Homo sapiens
atacataacttcagtgc

SEQ ID NO: 2756018 - DNA, 12 bp, Homo sapiens
atacatgaataa

SEQ ID NO: 2756019 - DNA, 19 bp, Homo sapiens
atacctcaggaaagaatag

SEQ ID NO: 2756020 - DNA, 20 bp, Homo sapiens
ataccttcggggtacaagtc

SEQ ID NO: 2756021 - DNA, 13 bp, Homo sapiens
atacctttctaag

SEQ ID NO: 2756022 - DNA, 23 bp, Homo sapiens
atacctttctaagggaaaaagtt

SEQ ID NO: 2756023 - DNA, 17 bp, Homo sapiens
atactgattttcaaaaa

SEQ ID NO: 2756024 - DNA, 20 bp, Homo sapiens
atactgattttcaaaaaaat

SEQ ID NO: 2756025 - DNA, 16 bp, Homo sapiens
atagaaattctgaatt

SEQ ID NO: 2756026 - DNA, 12 bp, Homo sapiens
atagaataaaag

SEQ ID NO: 2756027 - DNA, 14 bp, Homo sapiens
atagtcaaagagag

SEQ ID NO: 2756028 - DNA, 20 bp, Homo sapiens
atagtcaaagagagttttta

SEQ ID NO: 2756029 - DNA, 17 bp, Homo sapiens
agaatggtggcttcttt

SEQ ID NO: 2756030 - DNA, 19 bp, Homo sapiens
agaatgtgctagagttaaa

SEQ ID NO: 2756031 - DNA, 14 bp, Homo sapiens
agaatgttaccaga

SEQ ID NO: 2756032 - DNA, 16 bp, Homo sapiens
agaatgttaccagact

SEQ ID NO: 2756033 - DNA, 18 bp, Homo sapiens
agaatgttaccagacttc

SEQ ID NO: 2756034 - DNA, 21 bp, Homo sapiens
agaatgttaccagacttcaag

SEQ ID NO: 2756035 - DNA, 19 bp, Homo sapiens
agaattaccaagagaaggg

SEQ ID NO: 2756036 - DNA, 24 bp, Homo sapiens
agaattcccaagagggctttatta

SEQ ID NO: 2756037 - DNA, 15 bp, Homo sapiens
agaattgccaatctt

SEQ ID NO: 2756038 - DNA, 19 bp, Homo sapiens
agaattttgttggtctgaa

SEQ ID NO: 2756039 - DNA, 18 bp, Homo sapiens
agacaaactgtaaaaaat

SEQ ID NO: 2756040 - DNA, 22 bp, Homo sapiens
agacaagattttttaattgttt

SEQ ID NO: 2756041 - DNA, 16 bp, Homo sapiens
agacaaggttgctgtt

SEQ ID NO: 2756042 - DNA, 17 bp, Homo sapiens
agacaaggttgctgttg

SEQ ID NO: 2756043 - DNA, 12 bp, Homo sapiens
agacacacatga

SEQ ID NO: 2756044 - DNA, 17 bp, Homo sapiens
agacacactgaagaagc

SEQ ID NO: 2756045 - DNA, 17 bp, Homo sapiens
agacgatgtttatgttc

SEQ ID NO: 2756046 - DNA, 22 bp, Homo sapiens
agactcctttcctgcatctttc

SEQ ID NO: 2756047 - DNA, 22 bp, Homo sapiens
agactcgatgcaagtgtttctg

SEQ ID NO: 2756048 - DNA, 16 bp, Homo sapiens
agactctctagtttta

SEQ ID NO: 2756049 - DNA, 22 bp, Homo sapiens
agactgaaagaaactaagattt

SEQ ID NO: 2756050 - DNA, 16 bp, Homo sapiens
agagacacactgaaga

SEQ ID NO: 2756051 - DNA, 18 bp, Homo sapiens
agagacacactgaagaag

SEQ ID NO: 2756052 - DNA, 15 bp, Homo sapiens
agagactttgtcact

SEQ ID NO: 2756053 - DNA, 18 bp, Homo sapiens
agagactttgtcacttat

SEQ ID NO: 2756054 - DNA, 14 bp, Homo sapiens
agagagtcttttaa

SEQ ID NO: 2756055 - DNA, 17 bp, Homo sapiens
agagagtcttttaactt

SEQ ID NO: 2756056 - DNA, 17 bp, Homo sapiens
agagcccttttgctata

SEQ ID NO: 2756057 - DNA, 20 bp, Homo sapiens
agaggacagtatttgtgggg

SEQ ID NO: 2756058 - DNA, 23 bp, Homo sapiens
agagtatctgaagggaattgttt

SEQ ID NO: 2756059 - DNA, 17 bp, Homo sapiens
agagtcttttaacttta

SEQ ID NO: 2756060 - DNA, 20 bp, Homo sapiens
agagtcttttaactttagaa

SEQ ID NO: 2756061 - DNA, 22 bp, Homo sapiens
agagttaaaagttagcattgtt

SEQ ID NO: 2756062 - DNA, 22 bp, Homo sapiens
agataaagtcctgaacctttca

SEQ ID NO: 2756063 - DNA, 14 bp, Homo sapiens
agataaataatgta

SEQ ID NO: 2756064 - DNA, 14 bp, Homo sapiens
agatatgaatatat

SEQ ID NO: 2756065 - DNA, 21 bp, Homo sapiens
agatcctcttgccacatcttg

SEQ ID NO: 2756066 - DNA, 16 bp, Homo sapiens
agatgcagaaaaagaa

SEQ ID NO: 2756067 - DNA, 16 bp, Homo sapiens
agatgcagttctgaag

SEQ ID NO: 2756068 - DNA, 17 bp, Homo sapiens
agatgctttaattgtgt

SEQ ID NO: 2756069 - DNA, 14 bp, Homo sapiens
agatgggaaaacca

SEQ ID NO: 2756070 - DNA, 22 bp, Homo sapiens
agatgtttatttagaaactggt

SEQ ID NO: 2756071 - DNA, 15 bp, Homo sapiens
agattgtattgctgt

SEQ ID NO: 2756072 - DNA, 23 bp, Homo sapiens
agatttttaaattggagaaaagc

SEQ ID NO: 2756073 - DNA, 16 bp, Homo sapiens
agattttttttttaat

SEQ ID NO: 2756074 - DNA, 18 bp, Homo sapiens
agcaaatactgattttca

SEQ ID NO: 2756075 - DNA, 21 bp, Homo sapiens
agcaaatactgattttcaaaa

SEQ ID NO: 2756076 - DNA, 16 bp, Homo sapiens
agcaaatgcattctat

SEQ ID NO: 2756077 - DNA, 17 bp, Homo sapiens
agcaataccctgtcttt

SEQ ID NO: 2756078 - DNA, 22 bp, Homo sapiens
agcaataccctgtctttaaaaa

SEQ ID NO: 2756079 - DNA, 17 bp, Homo sapiens
agcacaccacaattctc

SEQ ID NO: 2756080 - DNA, 22 bp, Homo sapiens
agcacagcctcttagatgcagt

SEQ ID NO: 2756081 - DNA, 20 bp, Homo sapiens
agcacatccaccaaactcct

SEQ ID NO: 2756082 - DNA, 21 bp, Homo sapiens
agcacatccaccaaactcctg

SEQ ID NO: 2756083 - DNA, 13 bp, Homo sapiens
agcacttaaagtt

SEQ ID NO: 2756084 - DNA, 15 bp, Homo sapiens
agcacttaaagtttt

SEQ ID NO: 2756085 - DNA, 16 bp, Homo sapiens
agcacttaaagttttt

SEQ ID NO: 2756086 - DNA, 17 bp, Homo sapiens
agcagtcaggaaagaga

SEQ ID NO: 2756087 - DNA, 23 bp, Homo sapiens
agcatcagagcccttttgctata

SEQ ID NO: 2756088 - DNA, 17 bp, Homo sapiens
agcatgtatagttgctt

SEQ ID NO: 2756089 - DNA, 16 bp, Homo sapiens
agccaaacaccacttt

SEQ ID NO: 2756090 - DNA, 13 bp, Homo sapiens
agccagaggtctg

SEQ ID NO: 2756091 - DNA, 15 bp, Homo sapiens
agccagattttcctg

SEQ ID NO: 2756092 - DNA, 22 bp, Homo sapiens
agccatatcatgctaaaattct

SEQ ID NO: 2756093 - DNA, 17 bp, Homo sapiens
agcccttctttccacag

SEQ ID NO: 2756094 - DNA, 19 bp, Homo sapiens
agcccttctttccacagaa

SEQ ID NO: 2756095 - DNA, 15 bp, Homo sapiens
agccggaaggccgag

SEQ ID NO: 2756096 - DNA, 16 bp, Homo sapiens
agccggaaggccgagg

SEQ ID NO: 2756097 - DNA, 19 bp, Homo sapiens
agcctaggaggactggggt

SEQ ID NO: 2756098 - DNA, 18 bp, Homo sapiens
agcctgctaaggaacaat

SEQ ID NO: 2756099 - DNA, 20 bp, Homo sapiens
agcctgctaaggaacaatgc

SEQ ID NO: 2756100 - DNA, 21 bp, Homo sapiens
agcctgctaaggaacaatgcc

SEQ ID NO: 2756101 - DNA, 22 bp, Homo sapiens
agcctgctaaggaacaatgccg

SEQ ID NO: 2756102 - DNA, 16 bp, Homo sapiens
agccttccaccggcac

SEQ ID NO: 2756103 - DNA, 20 bp, Homo sapiens
agccttggggctgatgcagt

SEQ ID NO: 2756104 - DNA, 22 bp, Homo sapiens
agcctttgtcactagtctttga

SEQ ID NO: 2756105 - DNA, 19 bp, Homo sapiens
agcgctggtcccctccctc

SEQ ID NO: 2756106 - DNA, 21 bp, Homo sapiens
agcggaataaactagagaagg

SEQ ID NO: 2756107 - DNA, 15 bp, Homo sapiens
agcgtgcaccccgcc

SEQ ID NO: 2756108 - DNA, 23 bp, Homo sapiens
agcgtgcaccccgccggaggaag

SEQ ID NO: 2756109 - DNA, 19 bp, Homo sapiens
agctaattctttgacctgt

SEQ ID NO: 2756110 - DNA, 13 bp, Homo sapiens
agctagaatccac

SEQ ID NO: 2756111 - DNA, 20 bp, Homo sapiens
agctcccattctatgtgtca

SEQ ID NO: 2756112 - DNA, 14 bp, Homo sapiens
agctgcctgtgcct

SEQ ID NO: 2756113 - DNA, 13 bp, Homo sapiens
agctggaaaagta

SEQ ID NO: 2756114 - DNA, 10 bp, Homo sapiens
agctggtttc

SEQ ID NO: 2756115 - DNA, 13 bp, Homo sapiens
agctggtttcctg

SEQ ID NO: 2756116 - DNA, 16 bp, Homo sapiens
agctggtttcctgccc

SEQ ID NO: 2756117 - DNA, 17 bp, Homo sapiens
agctgttaaaatacata

SEQ ID NO: 2756118 - DNA, 12 bp, Homo sapiens
agcttgtgtatc

SEQ ID NO: 2756119 - DNA, 14 bp, Homo sapiens
agcttgtgtatctt

SEQ ID NO: 2756120 - DNA, 15 bp, Homo sapiens
agcttgtgtatcttg

SEQ ID NO: 2756121 - DNA, 17 bp, Homo sapiens
agcttgtgtatcttgat

SEQ ID NO: 2756122 - DNA, 17 bp, Homo sapiens
aggaaaagtaagggaat

SEQ ID NO: 2756123 - DNA, 20 bp, Homo sapiens
aggaaaagtaagggaataaa

SEQ ID NO: 2756124 - DNA, 12 bp, Homo sapiens
aggaaagaatag

SEQ ID NO: 2756125 - DNA, 13 bp, Homo sapiens
aggaaagagaact

SEQ ID NO: 2756126 - DNA, 18 bp, Homo sapiens
aggaaatatttattttaa

SEQ ID NO: 2756127 - DNA, 21 bp, Homo sapiens
aggaacaatgccgcctgtcaa

SEQ ID NO: 2756128 - DNA, 23 bp, Homo sapiens
aggaacaatgccgcctgtcaata

SEQ ID NO: 2756129 - DNA, 22 bp, Homo sapiens
aggaactcgcacctgtgctgga

SEQ ID NO: 2756130 - DNA, 16 bp, Homo sapiens
aggaactgctgggctt

SEQ ID NO: 2756131 - DNA, 15 bp, Homo sapiens
aggaatacaatatat

SEQ ID NO: 2756132 - DNA, 17 bp, Homo sapiens
aggacactgcagaacag

SEQ ID NO: 2756133 - DNA, 23 bp, Homo sapiens
aggacagcccttctttccacaga

SEQ ID NO: 2756134 - DNA, 13 bp, Homo sapiens
aggagcctgctaa

SEQ ID NO: 2756135 - DNA, 20 bp, Homo sapiens
aggaggttgaggctgcagtg

SEQ ID NO: 2756136 - DNA, 13 bp, Homo sapiens
aggatgtctgggc

SEQ ID NO: 2756137 - DNA, 17 bp, Homo sapiens
aggattttttaaaaatt

SEQ ID NO: 2756138 - DNA, 16 bp, Homo sapiens
aggcagcatgtatagt

SEQ ID NO: 2756139 - DNA, 19 bp, Homo sapiens
aggcatggatgaataaatg

SEQ ID NO: 2756140 - DNA, 22 bp, Homo sapiens
aggccaggactttgagaccagc

SEQ ID NO: 2756141 - DNA, 16 bp, Homo sapiens
aggcccctgggtttct

SEQ ID NO: 2756142 - DNA, 15 bp, Homo sapiens
aggccgaggtcccat

SEQ ID NO: 2756143 - DNA, 21 bp, Homo sapiens
aggcctctcattccagaggaa

SEQ ID NO: 2756144 - DNA, 16 bp, Homo sapiens
aggcctgactctcagc

SEQ ID NO: 2756145 - DNA, 18 bp, Homo sapiens
aggcgacgcggttttttc

SEQ ID NO: 2756146 - DNA, 17 bp, Homo sapiens
aggctagatgtatgtac

SEQ ID NO: 2756147 - DNA, 16 bp, Homo sapiens
aggctcccaaactcag

SEQ ID NO: 2756148 - DNA, 13 bp, Homo sapiens
aggctctgcccag

SEQ ID NO: 2756149 - DNA, 14 bp, Homo sapiens
agggaaatcttggt

SEQ ID NO: 2756150 - DNA, 21 bp, Homo sapiens
agggaaatcttggtgtaactt

SEQ ID NO: 2756151 - DNA, 20 bp, Homo sapiens
agggaattgtttttataaaa

SEQ ID NO: 2756152 - DNA, 20 bp, Homo sapiens
agggcaacataataagactt

SEQ ID NO: 2756153 - DNA, 21 bp, Homo sapiens
agggcaacataataagacttt

SEQ ID NO: 2756154 - DNA, 15 bp, Homo sapiens
agggccgagaggaca

SEQ ID NO: 2756155 - DNA, 22 bp, Homo sapiens
agggctgttataatctttcaca

SEQ ID NO: 2756156 - DNA, 15 bp, Homo sapiens
aggtgtctggcctga

SEQ ID NO: 2756157 - DNA, 20 bp, Homo sapiens
accccgccggaggaaggtcc

SEQ ID NO: 2756158 - DNA, 16 bp, Homo sapiens
acccctggctaccttg

SEQ ID NO: 2756159 - DNA, 19 bp, Homo sapiens
acccctggctaccttgtgg

SEQ ID NO: 2756160 - DNA, 13 bp, Homo sapiens
accctgtctttaa

SEQ ID NO: 2756161 - DNA, 21 bp, Homo sapiens
accctgttgagtatttgctgt

SEQ ID NO: 2756162 - DNA, 22 bp, Homo sapiens
accctgttgagtatttgctgtt

SEQ ID NO: 2756163 - DNA, 13 bp, Homo sapiens
accgaataaatgt

SEQ ID NO: 2756164 - DNA, 12 bp, Homo sapiens
accggcactcat

SEQ ID NO: 2756165 - DNA, 23 bp, Homo sapiens
accggcactcatgacggcctgcc

SEQ ID NO: 2756166 - DNA, 18 bp, Homo sapiens
accgggcatgtctgcctg

SEQ ID NO: 2756167 - DNA, 22 bp, Homo sapiens
accgggcatgtctgcctggagt

SEQ ID NO: 2756168 - DNA, 13 bp, Homo sapiens
acctaatgaaagt

SEQ ID NO: 2756169 - DNA, 16 bp, Homo sapiens
acctagggtgatatta

SEQ ID NO: 2756170 - DNA, 18 bp, Homo sapiens
acctcagaaattgaaagc

SEQ ID NO: 2756171 - DNA, 17 bp, Homo sapiens
acctcaggaaagaatag

SEQ ID NO: 2756172 - DNA, 20 bp, Homo sapiens
acctctaaatttccatatcc

SEQ ID NO: 2756173 - DNA, 17 bp, Homo sapiens
acctctattagtttcaa

SEQ ID NO: 2756174 - DNA, 17 bp, Homo sapiens
acctctgcctcagaaaa

SEQ ID NO: 2756175 - DNA, 20 bp, Homo sapiens
acctctgcctcagaaaacaa

SEQ ID NO: 2756176 - DNA, 12 bp, Homo sapiens
acctgctccaag

SEQ ID NO: 2756177 - DNA, 15 bp, Homo sapiens
acctgtagatgcaga

SEQ ID NO: 2756178 - DNA, 13 bp, Homo sapiens
acctgtgtagtct

SEQ ID NO: 2756179 - DNA, 12 bp, Homo sapiens
acctttcaaaat

SEQ ID NO: 2756180 - DNA, 12 bp, Homo sapiens
acgatgtttatg

SEQ ID NO: 2756181 - DNA, 16 bp, Homo sapiens
acgatgtttatgttct

SEQ ID NO: 2756182 - DNA, 19 bp, Homo sapiens
acgcccttggagccttcca

SEQ ID NO: 2756183 - DNA, 14 bp, Homo sapiens
acggcctgcctgca

SEQ ID NO: 2756184 - DNA, 22 bp, Homo sapiens
actaaaattctgggcctaattt

SEQ ID NO: 2756185 - DNA, 13 bp, Homo sapiens
actaagagagaat

SEQ ID NO: 2756186 - DNA, 13 bp, Homo sapiens
actactttgctac

SEQ ID NO: 2756187 - DNA, 11 bp, Homo sapiens
actagttctta

SEQ ID NO: 2756188 - DNA, 15 bp, Homo sapiens
actataaatacaaat

SEQ ID NO: 2756189 - DNA, 18 bp, Homo sapiens
actataaatacaaatctg

SEQ ID NO: 2756190 - DNA, 16 bp, Homo sapiens
actataaatgatatct

SEQ ID NO: 2756191 - DNA, 17 bp, Homo sapiens
actataaatgatatcta

SEQ ID NO: 2756192 - DNA, 17 bp, Homo sapiens
actatattgtttgctaa

SEQ ID NO: 2756193 - DNA, 22 bp, Homo sapiens
actatattgtttgctaagcatt

SEQ ID NO: 2756194 - DNA, 20 bp, Homo sapiens
actatcctatgccttcaaat

SEQ ID NO: 2756195 - DNA, 22 bp, Homo sapiens
actatcctatgccttcaaatag

SEQ ID NO: 2756196 - DNA, 16 bp, Homo sapiens
actatctcatttccaa

SEQ ID NO: 2756197 - DNA, 22 bp, Homo sapiens
actatgaactgaaggcagcatg

SEQ ID NO: 2756198 - DNA, 16 bp, Homo sapiens
actcaatatatagtta

SEQ ID NO: 2756199 - DNA, 23 bp, Homo sapiens
actcaatatatagttagctttat

SEQ ID NO: 2756200 - DNA, 12 bp, Homo sapiens
actcactggaat

SEQ ID NO: 2756201 - DNA, 13 bp, Homo sapiens
actcagtctttaa

SEQ ID NO: 2756202 - DNA, 19 bp, Homo sapiens
actcatgacggcctgcctg

SEQ ID NO: 2756203 - DNA, 20 bp, Homo sapiens
actcatgacggcctgcctgc

SEQ ID NO: 2756204 - DNA, 21 bp, Homo sapiens
actcatgacggcctgcctgca

SEQ ID NO: 2756205 - DNA, 21 bp, Homo sapiens
actccagcctgggtgacagag

SEQ ID NO: 2756206 - DNA, 22 bp, Homo sapiens
actccttggatttgcatttttg

SEQ ID NO: 2756207 - DNA, 23 bp, Homo sapiens
actcgatgcaagtgtttctgttc

SEQ ID NO: 2756208 - DNA, 14 bp, Homo sapiens
actctactgtgtaa

SEQ ID NO: 2756209 - DNA, 15 bp, Homo sapiens
actctactgtgtaat

SEQ ID NO: 2756210 - DNA, 14 bp, Homo sapiens
actctgtccaactc

SEQ ID NO: 2756211 - DNA, 18 bp, Homo sapiens
actctgtccaactctgta

SEQ ID NO: 2756212 - DNA, 21 bp, Homo sapiens
actctgtccaactctgtattt

SEQ ID NO: 2756213 - DNA, 12 bp, Homo sapiens
actgaaagaaac

SEQ ID NO: 2756214 - DNA, 19 bp, Homo sapiens
actgaaagaaactaagatt

SEQ ID NO: 2756215 - DNA, 22 bp, Homo sapiens
actgaagaagcaccaatcatga

SEQ ID NO: 2756216 - DNA, 23 bp, Homo sapiens
actgaaggcagcatgtatagttg

SEQ ID NO: 2756217 - DNA, 13 bp, Homo sapiens
actgaaggtgcag

SEQ ID NO: 2756218 - DNA, 15 bp, Homo sapiens
actgactcttaagaa

SEQ ID NO: 2756219 - DNA, 20 bp, Homo sapiens
actgactcttaagaagactg

SEQ ID NO: 2756220 - DNA, 21 bp, Homo sapiens
actggggtaagcggaataaac

SEQ ID NO: 2756221 - DNA, 13 bp, Homo sapiens
actggtaacatgt

SEQ ID NO: 2756222 - DNA, 18 bp, Homo sapiens
actggtctgttaatcttt

SEQ ID NO: 2756223 - DNA, 14 bp, Homo sapiens
actgtactgaggaa

SEQ ID NO: 2756224 - DNA, 21 bp, Homo sapiens
actgtgaagttacatgcataa

SEQ ID NO: 2756225 - DNA, 21 bp, Homo sapiens
actgtgtaatataaaagatct

SEQ ID NO: 2756226 - DNA, 12 bp, Homo sapiens
actgttaaaact

SEQ ID NO: 2756227 - DNA, 14 bp, Homo sapiens
actgttaaaactgt

SEQ ID NO: 2756228 - DNA, 15 bp, Homo sapiens
actgttaaaactgta

SEQ ID NO: 2756229 - DNA, 19 bp, Homo sapiens
actgttaaaactgtacctt

SEQ ID NO: 2756230 - DNA, 19 bp, Homo sapiens
actgtttcttagctgcact

SEQ ID NO: 2756231 - DNA, 23 bp, Homo sapiens
actgtttcttagctgcactgttt

SEQ ID NO: 2756232 - DNA, 12 bp, Homo sapiens
acttaaagtttt

SEQ ID NO: 2756233 - DNA, 17 bp, Homo sapiens
acttaaagttttttata

SEQ ID NO: 2756234 - DNA, 14 bp, Homo sapiens
acttactgttaaaa

SEQ ID NO: 2756235 - DNA, 17 bp, Homo sapiens
acttactgttaaaactg

SEQ ID NO: 2756236 - DNA, 19 bp, Homo sapiens
acttactgttaaaactgta

SEQ ID NO: 2756237 - DNA, 14 bp, Homo sapiens
acttatttccttat

SEQ ID NO: 2756238 - DNA, 16 bp, Homo sapiens
attgtcctaagtgtca

SEQ ID NO: 2756239 - DNA, 13 bp, Homo sapiens
attgtctagtgaa

SEQ ID NO: 2756240 - DNA, 16 bp, Homo sapiens
attgtgacaaacagct

SEQ ID NO: 2756241 - DNA, 14 bp, Homo sapiens
attgtgatgtgtcc

SEQ ID NO: 2756242 - DNA, 15 bp, Homo sapiens
attgtgtggtgcttt

SEQ ID NO: 2756243 - DNA, 18 bp, Homo sapiens
attgttggcgctgaggtg

SEQ ID NO: 2756244 - DNA, 14 bp, Homo sapiens
attgttgtgtataa

SEQ ID NO: 2756245 - DNA, 14 bp, Homo sapiens
attgtttaaaaacc

SEQ ID NO: 2756246 - DNA, 20 bp, Homo sapiens
attgtttttataaaaacatt

SEQ ID NO: 2756247 - DNA, 20 bp, Homo sapiens
atttaaaaaactcctgtctt

SEQ ID NO: 2756248 - DNA, 23 bp, Homo sapiens
atttaaaacacagtattgtagaa

SEQ ID NO: 2756249 - DNA, 24 bp, Homo sapiens
atttaaaacacagtattgtagaaa

SEQ ID NO: 2756250 - DNA, 19 bp, Homo sapiens
atttaaaattgtgatgtgt

SEQ ID NO: 2756251 - DNA, 18 bp, Homo sapiens
atttaatcagtgtgacag

SEQ ID NO: 2756252 - DNA, 17 bp, Homo sapiens
atttaccacaaaagcaa

SEQ ID NO: 2756253 - DNA, 18 bp, Homo sapiens
atttaccacaaaagcaaa

SEQ ID NO: 2756254 - DNA, 22 bp, Homo sapiens
atttaccacaaaagcaaaattt

SEQ ID NO: 2756255 - DNA, 15 bp, Homo sapiens
atttaccacttgtgt

SEQ ID NO: 2756256 - DNA, 22 bp, Homo sapiens
atttaccacttgtgttttgcaa

SEQ ID NO: 2756257 - DNA, 17 bp, Homo sapiens
atttacctctaaatttc

SEQ ID NO: 2756258 - DNA, 22 bp, Homo sapiens
atttacctctcattagaaaggc

SEQ ID NO: 2756259 - DNA, 14 bp, Homo sapiens
atttactacagttt

SEQ ID NO: 2756260 - DNA, 18 bp, Homo sapiens
atttacttctaatcttaa

SEQ ID NO: 2756261 - DNA, 18 bp, Homo sapiens
atttatctgcaaggattt

SEQ ID NO: 2756262 - DNA, 22 bp, Homo sapiens
atttattactgtaagaaaatat

SEQ ID NO: 2756263 - DNA, 14 bp, Homo sapiens
atttattttaataa

SEQ ID NO: 2756264 - DNA, 19 bp, Homo sapiens
atttattttaataatgttt

SEQ ID NO: 2756265 - DNA, 16 bp, Homo sapiens
atttcaaaagaacatt

SEQ ID NO: 2756266 - DNA, 17 bp, Homo sapiens
atttcatctaatttaat

SEQ ID NO: 2756267 - DNA, 14 bp, Homo sapiens
atttccttatgtgt

SEQ ID NO: 2756268 - DNA, 17 bp, Homo sapiens
atttcctttatactgtg

SEQ ID NO: 2756269 - DNA, 18 bp, Homo sapiens
atttccttttgtaaagta

SEQ ID NO: 2756270 - DNA, 19 bp, Homo sapiens
atttctaaaccacaaaagt

SEQ ID NO: 2756271 - DNA, 21 bp, Homo sapiens
atttctaaaccacaaaagttg

SEQ ID NO: 2756272 - DNA, 22 bp, Homo sapiens
atttctaaaccacaaaagttgt

SEQ ID NO: 2756273 - DNA, 15 bp, Homo sapiens
atttctatgaaatat

SEQ ID NO: 2756274 - DNA, 16 bp, Homo sapiens
atttctccagaaattt

SEQ ID NO: 2756275 - DNA, 20 bp, Homo sapiens
atttgccttttaaattcttt

SEQ ID NO: 2756276 - DNA, 16 bp, Homo sapiens
atttgctatgagctgg

SEQ ID NO: 2756277 - DNA, 13 bp, Homo sapiens
atttggaacagtg

SEQ ID NO: 2756278 - DNA, 16 bp, Homo sapiens
atttgtaaggcttgtt

SEQ ID NO: 2756279 - DNA, 18 bp, Homo sapiens
atttgtaatatatcctgt

SEQ ID NO: 2756280 - DNA, 21 bp, Homo sapiens
atttgtataaaataattttta

SEQ ID NO: 2756281 - DNA, 21 bp, Homo sapiens
atttgtccatttaaaaatgat

SEQ ID NO: 2756282 - DNA, 22 bp, Homo sapiens
atttgtggggagggatttgggg

SEQ ID NO: 2756283 - DNA, 19 bp, Homo sapiens
atttgttacagtttcttca

SEQ ID NO: 2756284 - DNA, 23 bp, Homo sapiens
atttgttacagtttcttcatgca

SEQ ID NO: 2756285 - DNA, 15 bp, Homo sapiens
atttgttgttttctg

SEQ ID NO: 2756286 - DNA, 16 bp, Homo sapiens
attttaaaagaatgat

SEQ ID NO: 2756287 - DNA, 22 bp, Homo sapiens
attttaaaagaatgattatgaa

SEQ ID NO: 2756288 - DNA, 23 bp, Homo sapiens
attttaaaagaatgattatgaat

SEQ ID NO: 2756289 - DNA, 22 bp, Homo sapiens
cagcacagcctcttagatgcag

SEQ ID NO: 2756290 - DNA, 17 bp, Homo sapiens
cagcacgtgtggcctgt

SEQ ID NO: 2756291 - DNA, 18 bp, Homo sapiens
cagcatgtatagttgctt

SEQ ID NO: 2756292 - DNA, 18 bp, Homo sapiens
cagccatttttcagtagc

SEQ ID NO: 2756293 - DNA, 15 bp, Homo sapiens
cagcccttctttcca

SEQ ID NO: 2756294 - DNA, 19 bp, Homo sapiens
cagcccttctttccacaga

SEQ ID NO: 2756295 - DNA, 16 bp, Homo sapiens
cagctattttagtaac

SEQ ID NO: 2756296 - DNA, 17 bp, Homo sapiens
cagctttaaaaagaaaa

SEQ ID NO: 2756297 - DNA, 18 bp, Homo sapiens
caggaaccacaagactgc

SEQ ID NO: 2756298 - DNA, 23 bp, Homo sapiens
caggaactcgcacctgtgctgga

SEQ ID NO: 2756299 - DNA, 14 bp, Homo sapiens
caggaccagtttat

SEQ ID NO: 2756300 - DNA, 14 bp, Homo sapiens
caggacctgccaag

SEQ ID NO: 2756301 - DNA, 15 bp, Homo sapiens
caggacctgccaaga

SEQ ID NO: 2756302 - DNA, 11 bp, Homo sapiens
caggagcctgc

SEQ ID NO: 2756303 - DNA, 12 bp, Homo sapiens
caggagcctgct

SEQ ID NO: 2756304 - DNA, 15 bp, Homo sapiens
caggagcctgctaag

SEQ ID NO: 2756305 - DNA, 16 bp, Homo sapiens
caggagcctgctaagg

SEQ ID NO: 2756306 - DNA, 17 bp, Homo sapiens
caggagcctgctaagga

SEQ ID NO: 2756307 - DNA, 23 bp, Homo sapiens
caggagcctgctaaggaacaatg

SEQ ID NO: 2756308 - DNA, 21 bp, Homo sapiens
caggatggttcccttgatgaa

SEQ ID NO: 2756309 - DNA, 17 bp, Homo sapiens
caggcatggacatgcag

SEQ ID NO: 2756310 - DNA, 15 bp, Homo sapiens
caggcccctgggttt

SEQ ID NO: 2756311 - DNA, 16 bp, Homo sapiens
caggctcccaaactca

SEQ ID NO: 2756312 - DNA, 18 bp, Homo sapiens
caggctttcagctgtgct

SEQ ID NO: 2756313 - DNA, 22 bp, Homo sapiens
cagggcaacataataagacttt

SEQ ID NO: 2756314 - DNA, 15 bp, Homo sapiens
cagggccgagaggac

SEQ ID NO: 2756315 - DNA, 12 bp, Homo sapiens
cagggctggttt

SEQ ID NO: 2756316 - DNA, 12 bp, Homo sapiens
caggtgttcttc

SEQ ID NO: 2756317 - DNA, 20 bp, Homo sapiens
caggttttaaggattctgca

SEQ ID NO: 2756318 - DNA, 14 bp, Homo sapiens
cagtagcaggacct

SEQ ID NO: 2756319 - DNA, 14 bp, Homo sapiens
cagtattgtagaaa

SEQ ID NO: 2756320 - DNA, 19 bp, Homo sapiens
cagtattgtagaaagctaa

SEQ ID NO: 2756321 - DNA, 15 bp, Homo sapiens
cagtatttacagtat

SEQ ID NO: 2756322 - DNA, 15 bp, Homo sapiens
cagtcaggaaagaga

SEQ ID NO: 2756323 - DNA, 22 bp, Homo sapiens
cagtcaggaaagagaacttcca

SEQ ID NO: 2756324 - DNA, 23 bp, Homo sapiens
cagtgacttcttccctaaaatgt

SEQ ID NO: 2756325 - DNA, 15 bp, Homo sapiens
cagtgagctgtgatt

SEQ ID NO: 2756326 - DNA, 20 bp, Homo sapiens
cagtgcaagagactttgtca

SEQ ID NO: 2756327 - DNA, 21 bp, Homo sapiens
cagtgtgcctgtcactactgg

SEQ ID NO: 2756328 - DNA, 21 bp, Homo sapiens
cagttacctctgcctcagaaa

SEQ ID NO: 2756329 - DNA, 22 bp, Homo sapiens
cagttctgaagaagatggtacc

SEQ ID NO: 2756330 - DNA, 18 bp, Homo sapiens
cagttggcacttctgcca

SEQ ID NO: 2756331 - DNA, 19 bp, Homo sapiens
cagttggcacttctgccat

SEQ ID NO: 2756332 - DNA, 20 bp, Homo sapiens
cataaaagggtcaaacctgt

SEQ ID NO: 2756333 - DNA, 22 bp, Homo sapiens
cataaaagggtcaaacctgtag

SEQ ID NO: 2756334 - DNA, 16 bp, Homo sapiens
cataaaattggattac

SEQ ID NO: 2756335 - DNA, 22 bp, Homo sapiens
cataaacatttgccaaaaattc

SEQ ID NO: 2756336 - DNA, 14 bp, Homo sapiens
cataaatttgtaat

SEQ ID NO: 2756337 - DNA, 13 bp, Homo sapiens
cataacttcagtg

SEQ ID NO: 2756338 - DNA, 17 bp, Homo sapiens
cataacttcagtgcaag

SEQ ID NO: 2756339 - DNA, 14 bp, Homo sapiens
cataagcttctcaa

SEQ ID NO: 2756340 - DNA, 14 bp, Homo sapiens
catagttctgttaa

SEQ ID NO: 2756341 - DNA, 20 bp, Homo sapiens
catatcatgctaaaattcta

SEQ ID NO: 2756342 - DNA, 21 bp, Homo sapiens
catatccataaaattggatta

SEQ ID NO: 2756343 - DNA, 17 bp, Homo sapiens
catatccttctggctgt

SEQ ID NO: 2756344 - DNA, 13 bp, Homo sapiens
catatctgtttat

SEQ ID NO: 2756345 - DNA, 19 bp, Homo sapiens
catatgtttattcaaaata

SEQ ID NO: 2756346 - DNA, 22 bp, Homo sapiens
catcaatagtgtcctatgcaat

SEQ ID NO: 2756347 - DNA, 23 bp, Homo sapiens
catcagagatgggaaaaccattg

SEQ ID NO: 2756348 - DNA, 13 bp, Homo sapiens
catcatgtttaca

SEQ ID NO: 2756349 - DNA, 19 bp, Homo sapiens
catcatgtttacagaggac

SEQ ID NO: 2756350 - DNA, 19 bp, Homo sapiens
catcattgttgtgtataat

SEQ ID NO: 2756351 - DNA, 22 bp, Homo sapiens
catcattgttgtgtataattta

SEQ ID NO: 2756352 - DNA, 23 bp, Homo sapiens
catccaataaaaatcaggagcct

SEQ ID NO: 2756353 - DNA, 16 bp, Homo sapiens
catccaccaaactcct

SEQ ID NO: 2756354 - DNA, 18 bp, Homo sapiens
catccaccaaactcctgc

SEQ ID NO: 2756355 - DNA, 19 bp, Homo sapiens
catccatggggctgattgt

SEQ ID NO: 2756356 - DNA, 18 bp, Homo sapiens
catcccttacctgggaaa

SEQ ID NO: 2756357 - DNA, 18 bp, Homo sapiens
catcggggtggtgcaggc

SEQ ID NO: 2756358 - DNA, 22 bp, Homo sapiens
catcggtgtggactacaggaca

SEQ ID NO: 2756359 - DNA, 22 bp, Homo sapiens
catctagtgagcagtcaggaaa

SEQ ID NO: 2756360 - DNA, 17 bp, Homo sapiens
catctgtgcagggctgg

SEQ ID NO: 2756361 - DNA, 16 bp, Homo sapiens
catcttgaaaatgcca

SEQ ID NO: 2756362 - DNA, 17 bp, Homo sapiens
catcttgaaaatgccac

SEQ ID NO: 2756363 - DNA, 18 bp, Homo sapiens
catcttgaaaatgccacc

SEQ ID NO: 2756364 - DNA, 18 bp, Homo sapiens
catctttcatagttctgt

SEQ ID NO: 2756365 - DNA, 13 bp, Homo sapiens
catgacggcctgc

SEQ ID NO: 2756366 - DNA, 19 bp, Homo sapiens
catgacggcctgcctgcaa

SEQ ID NO: 2756367 - DNA, 13 bp, Homo sapiens
catgagtttaaag

SEQ ID NO: 2756368 - DNA, 17 bp, Homo sapiens
catggcctgctgggctt

SEQ ID NO: 2756369 - DNA, 20 bp, Homo sapiens
catgtaaagctgttaaaata

SEQ ID NO: 2756370 - DNA, 17 bp, Homo sapiens
catgtatagttgctttt

SEQ ID NO: 2756371 - DNA, 12 bp, Homo sapiens
catgtctgcctg

SEQ ID NO: 2756372 - DNA, 14 bp, Homo sapiens
tgcaaacctgctgg

SEQ ID NO: 2756373 - DNA, 13 bp, Homo sapiens
tgcaagagacttt

SEQ ID NO: 2756374 - DNA, 21 bp, Homo sapiens
tgcaagagactttgtcactta

SEQ ID NO: 2756375 - DNA, 21 bp, Homo sapiens
tgcaaggattttttaaaaatt

SEQ ID NO: 2756376 - DNA, 13 bp, Homo sapiens
tgcaagtgtttct

SEQ ID NO: 2756377 - DNA, 14 bp, Homo sapiens
tgcaatatttgtaa

SEQ ID NO: 2756378 - DNA, 16 bp, Homo sapiens
tgcaatgcatatctgt

SEQ ID NO: 2756379 - DNA, 20 bp, Homo sapiens
tgcacaaaatagcacatcca

SEQ ID NO: 2756380 - DNA, 22 bp, Homo sapiens
tgcactgtttatggaaatacca

SEQ ID NO: 2756381 - DNA, 15 bp, Homo sapiens
tgcactttgtagtgt

SEQ ID NO: 2756382 - DNA, 17 bp, Homo sapiens
tgcagaaaaaaaagaaa

SEQ ID NO: 2756383 - DNA, 15 bp, Homo sapiens
tgcagaaaaagaaaa

SEQ ID NO: 2756384 - DNA, 18 bp, Homo sapiens
tgcagggctggtttgttc

SEQ ID NO: 2756385 - DNA, 15 bp, Homo sapiens
gcacagcctcttaga

SEQ ID NO: 2756386 - DNA, 18 bp, Homo sapiens
gcacagcctcttagatgc

SEQ ID NO: 2756387 - DNA, 16 bp, Homo sapiens
gcaccccgccggagga

SEQ ID NO: 2756388 - DNA, 23 bp, Homo sapiens
gcaccccgccggaggaaggtccc

SEQ ID NO: 2756389 - DNA, 20 bp, Homo sapiens
gcacgcgccctttctaccat

SEQ ID NO: 2756390 - DNA, 17 bp, Homo sapiens
gcactcatgacggcctg

SEQ ID NO: 2756391 - DNA, 18 bp, Homo sapiens
gcactgtttatggaaata

SEQ ID NO: 2756392 - DNA, 17 bp, Homo sapiens
gcacttgcctgtagtct

SEQ ID NO: 2756393 - DNA, 23 bp, Homo sapiens
gcactttaaaaaattttttgatt

SEQ ID NO: 2756394 - DNA, 20 bp, Homo sapiens
gcactttgggaggcaaaggc

SEQ ID NO: 2756395 - DNA, 21 bp, Homo sapiens
gcagaaaaaaaagaaaaaagt

SEQ ID NO: 2756396 - DNA, 15 bp, Homo sapiens
gcagctcccattcta

SEQ ID NO: 2756397 - DNA, 21 bp, Homo sapiens
gcaggtctttaaatcatttta

SEQ ID NO: 2756398 - DNA, 21 bp, Homo sapiens
gcaggttggcaaacgggcttg

SEQ ID NO: 2756399 - DNA, 14 bp, Homo sapiens
gcataaatttgtaa

SEQ ID NO: 2756400 - DNA, 15 bp, Homo sapiens
gcataaatttgtaat

SEQ ID NO: 2756401 - DNA, 16 bp, Homo sapiens
gcatgtatagttgctt

SEQ ID NO: 2756402 - DNA, 15 bp, Homo sapiens
gcatgtctgcctgga

SEQ ID NO: 2756403 - DNA, 18 bp, Homo sapiens
gcatgtctgcctggagtg

SEQ ID NO: 2756404 - DNA, 16 bp, Homo sapiens
gcattacttactgtta

SEQ ID NO: 2756405 - DNA, 21 bp, Homo sapiens
gcattacttactgttaaaact

SEQ ID NO: 2756406 - DNA, 13 bp, Homo sapiens
tcaatatatagtt

SEQ ID NO: 2756407 - DNA, 15 bp, Homo sapiens
tcaatatttcagata

SEQ ID NO: 2756408 - DNA, 19 bp, Homo sapiens
tcaatatttcagataatca

SEQ ID NO: 2756409 - DNA, 12 bp, Homo sapiens
ctgtataaatgt

SEQ ID NO: 2756410 - DNA, 13 bp, Homo sapiens
ctgtataaatgtc

SEQ ID NO: 2756411 - DNA, 19 bp, Homo sapiens
ctgtattttaaaagaatga

SEQ ID NO: 2756412 - DNA, 22 bp, Homo sapiens
ctgtattttaaaagaatgatta

SEQ ID NO: 2756413 - DNA, 15 bp, Homo sapiens
ctgtcaataaatgtt

SEQ ID NO: 2756414 - DNA, 18 bp, Homo sapiens
ctgtcaataaatgttgaa

SEQ ID NO: 2756415 - DNA, 22 bp, Homo sapiens
ctgtcaataaatgttgaaaagt

SEQ ID NO: 2756416 - DNA, 15 bp, Homo sapiens
ctgtcactactggtc

SEQ ID NO: 2756417 - DNA, 18 bp, Homo sapiens
ctgtcttcaggctctgcc

SEQ ID NO: 2756418 - DNA, 23 bp, Homo sapiens
ctgtcttcggccgagctggtttc

SEQ ID NO: 2756419 - DNA, 13 bp, Homo sapiens
ctgtgaagttaca

SEQ ID NO: 2756420 - DNA, 17 bp, Homo sapiens
ctgtgaagttacatgca

SEQ ID NO: 2756421 - DNA, 18 bp, Homo sapiens
ctgtgaagttacatgcat

SEQ ID NO: 2756422 - DNA, 22 bp, Homo sapiens
ctgtgaagttacatgcataaaa

SEQ ID NO: 2756423 - DNA, 17 bp, Homo sapiens
ctgtgcagggctggttt

SEQ ID NO: 2756424 - DNA, 18 bp, Homo sapiens
ctgtgcagggctggtttg

SEQ ID NO: 2756425 - DNA, 16 bp, Homo sapiens
ctgtgccttttgccat

SEQ ID NO: 2756426 - DNA, 16 bp, Homo sapiens
ctgtgcgtggaaaaag

SEQ ID NO: 2756427 - DNA, 17 bp, Homo sapiens
ctgtgctgtgtttaatc

SEQ ID NO: 2756428 - DNA, 20 bp, Homo sapiens
ctgtgctttttgcaaaaggg

SEQ ID NO: 2756429 - DNA, 13 bp, Homo sapiens
ctgtggaatgaag

SEQ ID NO: 2756430 - DNA, 18 bp, Homo sapiens
ctgtgttgaaatatagtt

SEQ ID NO: 2756431 - DNA, 13 bp, Homo sapiens
ctgtgtttaatca

SEQ ID NO: 2756432 - DNA, 19 bp, Homo sapiens
ctgttacctaggttaacaa

SEQ ID NO: 2756433 - DNA, 13 bp, Homo sapiens
ctgttataatctt

SEQ ID NO: 2756434 - DNA, 15 bp, Homo sapiens
ctgttgagtatttgc

SEQ ID NO: 2756435 - DNA, 23 bp, Homo sapiens
ctgtttatggaaataccaggacc

SEQ ID NO: 2756436 - DNA, 20 bp, Homo sapiens
ctgtttattctgggaaatgt

SEQ ID NO: 2756437 - DNA, 12 bp, Homo sapiens
ctgtttgtattt

SEQ ID NO: 2756438 - DNA, 13 bp, Homo sapiens
ctgtttgtatttt

SEQ ID NO: 2756439 - DNA, 15 bp, Homo sapiens
ctgttttataatttt

SEQ ID NO: 2756440 - DNA, 13 bp, Homo sapiens
cttaaaatgcaat

SEQ ID NO: 2756441 - DNA, 15 bp, Homo sapiens
cttaaaatgcaatat

SEQ ID NO: 2756442 - DNA, 10 bp, Homo sapiens
aaaaaacaag

SEQ ID NO: 2756443 - DNA, 20 bp, Homo sapiens
aaaaacattgaaatattagt

SEQ ID NO: 2756444 - DNA, 16 bp, Homo sapiens
aaaaaccgaataaatg

SEQ ID NO: 2756445 - DNA, 17 bp, Homo sapiens
aaaaacctattttgaaa

SEQ ID NO: 2756446 - DNA, 16 bp, Homo sapiens
aaaaaggttaattttt

SEQ ID NO: 2756447 - DNA, 14 bp, Homo sapiens
aaaaatcaggagcc

SEQ ID NO: 2756448 - DNA, 22 bp, Homo sapiens
aaaaatgtgtgtattcttaaaa

SEQ ID NO: 2756449 - DNA, 24 bp, Homo sapiens
aaaaattggcattttaagtgttta

SEQ ID NO: 2756450 - DNA, 23 bp, Homo sapiens
aaaaattttttgattaatgaaga

SEQ ID NO: 2756451 - DNA, 21 bp, Homo sapiens
aaaactataaatacaaatctg

SEQ ID NO: 2756452 - DNA, 22 bp, Homo sapiens
aaaacttttttctttgaaatgc

SEQ ID NO: 2756453 - DNA, 15 bp, Homo sapiens
aaaagacgatgttta

SEQ ID NO: 2756454 - DNA, 21 bp, Homo sapiens
aaaagacgatgtttatgttct

SEQ ID NO: 2756455 - DNA, 13 bp, Homo sapiens
aaaagatgcttta

SEQ ID NO: 2756456 - DNA, 22 bp, Homo sapiens
aaaagattctttaaactactga

SEQ ID NO: 2756457 - DNA, 15 bp, Homo sapiens
aaaagattgtattgc

SEQ ID NO: 2756458 - DNA, 13 bp, Homo sapiens
aaaagcaaaattt

SEQ ID NO: 2756459 - DNA, 14 bp, Homo sapiens
aaaagcaaaatttt

SEQ ID NO: 2756460 - DNA, 13 bp, Homo sapiens
aaaagcaaatact

SEQ ID NO: 2756461 - DNA, 18 bp, Homo sapiens
aaaagcttgtgtatcttg

SEQ ID NO: 2756462 - DNA, 15 bp, Homo sapiens
aaaagggtcaaacct

SEQ ID NO: 2756463 - DNA, 18 bp, Homo sapiens
aaaagggtcaaacctgta

SEQ ID NO: 2756464 - DNA, 15 bp, Homo sapiens
aaaagtaagggaata

SEQ ID NO: 2756465 - DNA, 20 bp, Homo sapiens
aaaagtccttcagtttagaa

SEQ ID NO: 2756466 - DNA, 16 bp, Homo sapiens
aaaagttgtttaataa

SEQ ID NO: 2756467 - DNA, 21 bp, Homo sapiens
aaaataattgagactgaaaga

SEQ ID NO: 2756468 - DNA, 22 bp, Homo sapiens
aaaataattgagactgaaagaa

SEQ ID NO: 2756469 - DNA, 11 bp, Homo sapiens
aaaataatttt

SEQ ID NO: 2756470 - DNA, 17 bp, Homo sapiens
aaaataatttttatatt

SEQ ID NO: 2756471 - DNA, 21 bp, Homo sapiens
aaaataatttttatatttgaa

SEQ ID NO: 2756472 - DNA, 24 bp, Homo sapiens
aaaatacctcaggaaagaatagaa

SEQ ID NO: 2756473 - DNA, 21 bp, Homo sapiens
aaaatatacaagtaaattctg

SEQ ID NO: 2756474 - DNA, 19 bp, Homo sapiens
aaaatattggtattaaaga

SEQ ID NO: 2756475 - DNA, 17 bp, Homo sapiens
aaaatcaggagcctgct

SEQ ID NO: 2756476 - DNA, 21 bp, Homo sapiens
aaaatcaggagcctgctaagg

SEQ ID NO: 2756477 - DNA, 11 bp, Homo sapiens
aaaatgcaata

SEQ ID NO: 2756478 - DNA, 15 bp, Homo sapiens
aaaatgcaatatttg

SEQ ID NO: 2756479 - DNA, 17 bp, Homo sapiens
aaaatgtagaaattcta

SEQ ID NO: 2756480 - DNA, 20 bp, Homo sapiens
aaaatgtagaaattctaact

SEQ ID NO: 2756481 - DNA, 16 bp, Homo sapiens
aaaatgtttcatttac

SEQ ID NO: 2756482 - DNA, 14 bp, Homo sapiens
aaaattaattctaa

SEQ ID NO: 2756483 - DNA, 16 bp, Homo sapiens
aaaattaattctaaac

SEQ ID NO: 2756484 - DNA, 16 bp, Homo sapiens
aaaattacctttaatg

SEQ ID NO: 2756485 - DNA, 13 bp, Homo sapiens
aaaattatttgca

SEQ ID NO: 2756486 - DNA, 14 bp, Homo sapiens
aaaattatttgcag

SEQ ID NO: 2756487 - DNA, 15 bp, Homo sapiens
aaaattggcatttta

SEQ ID NO: 2756488 - DNA, 16 bp, Homo sapiens
aaaattgtgatgtgtc

SEQ ID NO: 2756489 - DNA, 12 bp, Homo sapiens
aaaattttcatt

SEQ ID NO: 2756490 - DNA, 14 bp, Homo sapiens
aaaattttttgatt

SEQ ID NO: 2756491 - DNA, 17 bp, Homo sapiens
aaacaaggatgaattaa

SEQ ID NO: 2756492 - DNA, 17 bp, Homo sapiens
aaacacagtattgtaga

SEQ ID NO: 2756493 - DNA, 18 bp, Homo sapiens
aaacacagtattgtagaa

SEQ ID NO: 2756494 - DNA, 19 bp, Homo sapiens
aaacacagtattgtagaaa

SEQ ID NO: 2756495 - DNA, 23 bp, Homo sapiens
aaacacagtattgtagaaagcta

SEQ ID NO: 2756496 - DNA, 16 bp, Homo sapiens
aaacaccactttgtaa

SEQ ID NO: 2756497 - DNA, 16 bp, Homo sapiens
aaacatatataacaat

SEQ ID NO: 2756498 - DNA, 13 bp, Homo sapiens
aaacattgaaata

SEQ ID NO: 2756499 - DNA, 14 bp, Homo sapiens
aaacattgaaatat

SEQ ID NO: 2756500 - DNA, 22 bp, Homo sapiens
aaacatttgccaaaaattcatg

SEQ ID NO: 2756501 - DNA, 15 bp, Homo sapiens
aaaccacaaaaaaat

SEQ ID NO: 2756502 - DNA, 16 bp, Homo sapiens
aaaccacaaaagttgt

SEQ ID NO: 2756503 - DNA, 15 bp, Homo sapiens
aaaccataaacattt

SEQ ID NO: 2756504 - DNA, 19 bp, Homo sapiens
aaaccattggggaggacta

SEQ ID NO: 2756505 - DNA, 15 bp, Homo sapiens
aaacccagcaaaaca

SEQ ID NO: 2756506 - DNA, 23 bp, Homo sapiens
aaacccagcaaaacagattcaaa

SEQ ID NO: 2756507 - DNA, 16 bp, Homo sapiens
aaaccgaataaatgtt

SEQ ID NO: 2756508 - DNA, 11 bp, Homo sapiens
aaacctatttt

SEQ ID NO: 2756509 - DNA, 16 bp, Homo sapiens
aaacctgctggtgggg

SEQ ID NO: 2756510 - DNA, 15 bp, Homo sapiens
aaactaagatttatc

SEQ ID NO: 2756511 - DNA, 14 bp, Homo sapiens
aaactataaataca

SEQ ID NO: 2756512 - DNA, 17 bp, Homo sapiens
aaactgactcttaagaa

SEQ ID NO: 2756513 - DNA, 20 bp, Homo sapiens
aaactgcatttttaatcagt

SEQ ID NO: 2756514 - DNA, 20 bp, Homo sapiens
aaactggttctgtgttgaaa

SEQ ID NO: 2756515 - DNA, 21 bp, Homo sapiens
aaactggttctgtgttgaaat

SEQ ID NO: 2756516 - DNA, 22 bp, Homo sapiens
aaactggttctgtgttgaaata

SEQ ID NO: 2756517 - DNA, 22 bp, Homo sapiens
aaactttgtgtataagttgtat

SEQ ID NO: 2756518 - DNA, 19 bp, Homo sapiens
aaagaaaaaagtccttcag

SEQ ID NO: 2756519 - DNA, 10 bp, Homo sapiens
aaagaaacta

SEQ ID NO: 2756520 - DNA, 16 bp, Homo sapiens
aaagaaactaagattt

SEQ ID NO: 2756521 - DNA, 14 bp, Homo sapiens
aaagaatagaaaga

SEQ ID NO: 2756522 - DNA, 11 bp, Homo sapiens
aaagaatccaa

SEQ ID NO: 2756523 - DNA, 17 bp, Homo sapiens
aaagactcctttcctgc

SEQ ID NO: 2756524 - DNA, 23 bp, Homo sapiens
aaagagagtttttaatagaacca

SEQ ID NO: 2756525 - DNA, 20 bp, Homo sapiens
aaagatgctttaattgtgtg

SEQ ID NO: 2756526 - DNA, 14 bp, Homo sapiens
aaagattctttaaa

SEQ ID NO: 2756527 - DNA, 21 bp, Homo sapiens
aaagattctttaaactactga

SEQ ID NO: 2756528 - DNA, 16 bp, Homo sapiens
aaagcactatgaattt

SEQ ID NO: 2756529 - DNA, 23 bp, Homo sapiens
aaagccatatcatgctaaaattc

SEQ ID NO: 2756530 - DNA, 23 bp, Homo sapiens
aaagctattacttggcaaattct

SEQ ID NO: 2756531 - DNA, 18 bp, Homo sapiens
aaagctgttaaaatacat

SEQ ID NO: 2756532 - DNA, 14 bp, Homo sapiens
aaagcttgtgtatc

SEQ ID NO: 2756533 - DNA, 18 bp, Homo sapiens
aaaggcacatattggagg

SEQ ID NO: 2756534 - DNA, 18 bp, Homo sapiens
aaaggctaacaaatttta

SEQ ID NO: 2756535 - DNA, 14 bp, Homo sapiens
aaagtaaaatatgt

SEQ ID NO: 2756536 - DNA, 14 bp, Homo sapiens
aaagtaaaccacaa

SEQ ID NO: 2756537 - DNA, 21 bp, Homo sapiens
aaagtaaaccacaaaaaaata

SEQ ID NO: 2756538 - DNA, 20 bp, Homo sapiens
aaagtaagggaataaatttt

SEQ ID NO: 2756539 - DNA, 13 bp, Homo sapiens
aaagtagttagtt

SEQ ID NO: 2756540 - DNA, 17 bp, Homo sapiens
aaagtatgttagtgcaa

SEQ ID NO: 2756541 - DNA, 16 bp, Homo sapiens
aaagtgatgacatatt

SEQ ID NO: 2756542 - DNA, 20 bp, Homo sapiens
aaagttagcattgtttctag

SEQ ID NO: 2756543 - DNA, 13 bp, Homo sapiens
aaagttgtactgc

SEQ ID NO: 2756544 - DNA, 21 bp, Homo sapiens
aaagttgtactgcatcttagt

SEQ ID NO: 2756545 - DNA, 17 bp, Homo sapiens
aaataatgtagttttgt

SEQ ID NO: 2756546 - DNA, 22 bp, Homo sapiens
aaataatgtagttttgtttatg

SEQ ID NO: 2756547 - DNA, 20 bp, Homo sapiens
aaataattgagactgaaaga

SEQ ID NO: 2756548 - DNA, 23 bp, Homo sapiens
aaataatttttatatttgaaata

SEQ ID NO: 2756549 - DNA, 15 bp, Homo sapiens
aaatacaaatctgta

SEQ ID NO: 2756550 - DNA, 18 bp, Homo sapiens
aaatacaaatctgtataa

SEQ ID NO: 2756551 - DNA, 13 bp, Homo sapiens
aaataccaggacc

SEQ ID NO: 2756552 - DNA, 17 bp, Homo sapiens
aaatagcacatccacca

SEQ ID NO: 2756553 - DNA, 13 bp, Homo sapiens
aaatatagttgaa

SEQ ID NO: 2756554 - DNA, 14 bp, Homo sapiens
aaatatagttgaaa

SEQ ID NO: 2756555 - DNA, 15 bp, Homo sapiens
aaatattagttactt

SEQ ID NO: 2756556 - DNA, 13 bp, Homo sapiens
aaatattgaatgc

SEQ ID NO: 2756557 - DNA, 17 bp, Homo sapiens
aaatattgaatgcctta

SEQ ID NO: 2756558 - DNA, 18 bp, Homo sapiens
aaatattgaatgccttat

SEQ ID NO: 2756559 - DNA, 23 bp, Homo sapiens
aaatattggtattaaagaatgct

SEQ ID NO: 2756560 - DNA, 13 bp, Homo sapiens
aaatatttatttt

SEQ ID NO: 2756561 - DNA, 15 bp, Homo sapiens
aaatatttattttaa

SEQ ID NO: 2756562 - DNA, 20 bp, Homo sapiens
aaatatttattttaataatg

SEQ ID NO: 2756563 - DNA, 21 bp, Homo sapiens
aaatatttattttaataatgt

SEQ ID NO: 2756564 - DNA, 12 bp, Homo sapiens
aaatatttgaaa

SEQ ID NO: 2756565 - DNA, 16 bp, Homo sapiens
aaatcacactcaaact

SEQ ID NO: 2756566 - DNA, 17 bp, Homo sapiens
aaatcacactcaaactt

SEQ ID NO: 2756567 - DNA, 23 bp, Homo sapiens
aaatcagaataaattaatattgt

SEQ ID NO: 2756568 - DNA, 12 bp, Homo sapiens
aaatcaggagcc

SEQ ID NO: 2756569 - DNA, 16 bp, Homo sapiens
aaatcattttaggaaa

SEQ ID NO: 2756570 - DNA, 18 bp, Homo sapiens
aaatcattttaggaaagg

SEQ ID NO: 2756571 - DNA, 20 bp, Homo sapiens
aaatctccagcttactataa

SEQ ID NO: 2756572 - DNA, 15 bp, Homo sapiens
aaatctctagcctct

SEQ ID NO: 2756573 - DNA, 17 bp, Homo sapiens
aaatctctagcctcttt

SEQ ID NO: 2756574 - DNA, 13 bp, Homo sapiens
aaatctgtacttt

SEQ ID NO: 2756575 - DNA, 17 bp, Homo sapiens
aaatctgtataaatgtc

SEQ ID NO: 2756576 - DNA, 18 bp, Homo sapiens
aaatctgtataaatgtct

SEQ ID NO: 2756577 - DNA, 19 bp, Homo sapiens
aaatctgtataaatgtcta

SEQ ID NO: 2756578 - DNA, 17 bp, Homo sapiens
aaatcttggtgtaactt

SEQ ID NO: 2756579 - DNA, 18 bp, Homo sapiens
aaatcttggtgtaactta

SEQ ID NO: 2756580 - DNA, 22 bp, Homo sapiens
aaatcttggtgtaacttaaata

SEQ ID NO: 2756581 - DNA, 23 bp, Homo sapiens
aaatgagacccctttaaactgtc

SEQ ID NO: 2756582 - DNA, 20 bp, Homo sapiens
aaatgatatctatattctaa

SEQ ID NO: 2756583 - DNA, 21 bp, Homo sapiens
aaatgatatctatattctaaa

SEQ ID NO: 2756584 - DNA, 11 bp, Homo sapiens
aaatgcaatat

SEQ ID NO: 2756585 - DNA, 19 bp, Homo sapiens
aaatgcattctatcgttat

SEQ ID NO: 2756586 - DNA, 22 bp, Homo sapiens
aaatgcattctatcgttattat

SEQ ID NO: 2756587 - DNA, 18 bp, Homo sapiens
aaatggcttcctggcaat

SEQ ID NO: 2756588 - DNA, 12 bp, Homo sapiens
aaatgttttaat

SEQ ID NO: 2756589 - DNA, 17 bp, Homo sapiens
aaattaattctaaactt

SEQ ID NO: 2756590 - DNA, 16 bp, Homo sapiens
aaattacctttaatgc

SEQ ID NO: 2756591 - DNA, 18 bp, Homo sapiens
aaattatttgccttttaa

SEQ ID NO: 2756592 - DNA, 22 bp, Homo sapiens
aaattatttgtgttgggggaaa

SEQ ID NO: 2756593 - DNA, 17 bp, Homo sapiens
aaattcacagaagccta

SEQ ID NO: 2756594 - DNA, 15 bp, Homo sapiens
aaattctgaattttg

SEQ ID NO: 2756595 - DNA, 16 bp, Homo sapiens
aaattctgaattttgg

SEQ ID NO: 2756596 - DNA, 11 bp, Homo sapiens
aaattcttttc

SEQ ID NO: 2756597 - DNA, 12 bp, Homo sapiens
aaattggagaaa

SEQ ID NO: 2756598 - DNA, 21 bp, Homo sapiens
aaattggcattttaagtgttt

SEQ ID NO: 2756599 - DNA, 12 bp, Homo sapiens
aaattgtgatgt

SEQ ID NO: 2756600 - DNA, 12 bp, Homo sapiens
aaatttaaaaca

SEQ ID NO: 2756601 - DNA, 14 bp, Homo sapiens
aaatttaaaacaca

SEQ ID NO: 2756602 - DNA, 14 bp, Homo sapiens
aaatttccatatcc

SEQ ID NO: 2756603 - DNA, 20 bp, Homo sapiens
aaatttgattctaaatagcg

SEQ ID NO: 2756604 - DNA, 13 bp, Homo sapiens
aaatttgtaatat

SEQ ID NO: 2756605 - DNA, 18 bp, Homo sapiens
aaattttaagtgccacag

SEQ ID NO: 2756606 - DNA, 16 bp, Homo sapiens
aaattttctctaaact

SEQ ID NO: 2756607 - DNA, 20 bp, Homo sapiens
aaattttctctaaactgttt

SEQ ID NO: 2756608 - DNA, 13 bp, Homo sapiens
aaatttttaaaac

SEQ ID NO: 2756609 - DNA, 15 bp, Homo sapiens
aaattttttaaaaaa

SEQ ID NO: 2756610 - DNA, 18 bp, Homo sapiens
aaattttttaaaagagac

SEQ ID NO: 2756611 - DNA, 15 bp, Homo sapiens
aacaaaaagtttttt

SEQ ID NO: 2756612 - DNA, 20 bp, Homo sapiens
aacaaccctgttgagtattt

SEQ ID NO: 2756613 - DNA, 22 bp, Homo sapiens
aacaaccctgttgagtatttgc

SEQ ID NO: 2756614 - DNA, 15 bp, Homo sapiens
aacacaactatattg

SEQ ID NO: 2756615 - DNA, 21 bp, Homo sapiens
aacacaatgtgaaaatgtatc

SEQ ID NO: 2756616 - DNA, 15 bp, Homo sapiens
aacacagtattgtag

SEQ ID NO: 2756617 - DNA, 17 bp, Homo sapiens
aacacagtattgtagaa

SEQ ID NO: 2756618 - DNA, 13 bp, Homo sapiens
aacactgtactga

SEQ ID NO: 2756619 - DNA, 22 bp, Homo sapiens
aacagactcgatgcaagtgttt

SEQ ID NO: 2756620 - DNA, 17 bp, Homo sapiens
aacagtgacaataaatg

SEQ ID NO: 2756621 - DNA, 15 bp, Homo sapiens
aacatcccaagattt

SEQ ID NO: 2756622 - DNA, 16 bp, Homo sapiens
aacattgattggataa

SEQ ID NO: 2756623 - DNA, 17 bp, Homo sapiens
aacattgattggataaa

SEQ ID NO: 2756624 - DNA, 13 bp, Homo sapiens
aacatttactaca

SEQ ID NO: 2756625 - DNA, 17 bp, Homo sapiens
aacatttactacagttt

SEQ ID NO: 2756626 - DNA, 19 bp, Homo sapiens
aacatttactacagttttt

SEQ ID NO: 2756627 - DNA, 21 bp, Homo sapiens
aacatttgccaaaaattcatg

SEQ ID NO: 2756628 - DNA, 17 bp, Homo sapiens
aaccattggggaggact

SEQ ID NO: 2756629 - DNA, 16 bp, Homo sapiens
aatcttggtgtaactt

SEQ ID NO: 2756630 - DNA, 13 bp, Homo sapiens
aatcttgttttaa

SEQ ID NO: 2756631 - DNA, 14 bp, Homo sapiens
aatctttttcatca

SEQ ID NO: 2756632 - DNA, 13 bp, Homo sapiens
aatgaagaaagta

SEQ ID NO: 2756633 - DNA, 20 bp, Homo sapiens
aatgaagaaagtaaaaccat

SEQ ID NO: 2756634 - DNA, 14 bp, Homo sapiens
aatgagaccccttt

SEQ ID NO: 2756635 - DNA, 22 bp, Homo sapiens
aatgagagacacactgaagaag

SEQ ID NO: 2756636 - DNA, 16 bp, Homo sapiens
aatgataactggaaac

SEQ ID NO: 2756637 - DNA, 21 bp, Homo sapiens
aatgcatccagcagtacaata

SEQ ID NO: 2756638 - DNA, 23 bp, Homo sapiens
aatgccgcctgtcaataaatgtt

SEQ ID NO: 2756639 - DNA, 19 bp, Homo sapiens
aatgccttatttttgaatt

SEQ ID NO: 2756640 - DNA, 21 bp, Homo sapiens
aatgctgtattttaaaagaat

SEQ ID NO: 2756641 - DNA, 22 bp, Homo sapiens
aatgctgtattttaaaagaatg

SEQ ID NO: 2756642 - DNA, 16 bp, Homo sapiens
aatggaaaatatacaa

SEQ ID NO: 2756643 - DNA, 15 bp, Homo sapiens
aatggaaaattaatt

SEQ ID NO: 2756644 - DNA, 23 bp, Homo sapiens
aatggtggcttcttttctttgta

SEQ ID NO: 2756645 - DNA, 10 bp, Homo sapiens
aatgtacttt

SEQ ID NO: 2756646 - DNA, 20 bp, Homo sapiens
aatgtactttttattgcatg

SEQ ID NO: 2756647 - DNA, 15 bp, Homo sapiens
aatgtagaaattcta

SEQ ID NO: 2756648 - DNA, 13 bp, Homo sapiens
aatgtcagtatgt

SEQ ID NO: 2756649 - DNA, 18 bp, Homo sapiens
aatgtctattattatgaa

SEQ ID NO: 2756650 - DNA, 18 bp, Homo sapiens
aatgttaccagacttcaa

SEQ ID NO: 2756651 - DNA, 13 bp, Homo sapiens
aatgttagttcta

SEQ ID NO: 2756652 - DNA, 12 bp, Homo sapiens
aatgttgaaaag

SEQ ID NO: 2756653 - DNA, 24 bp, Homo sapiens
aatgttggtgtggagttttcatga

SEQ ID NO: 2756654 - DNA, 13 bp, Homo sapiens
aattaatattgta

SEQ ID NO: 2756655 - DNA, 13 bp, Homo sapiens
aattaattctaaa

SEQ ID NO: 2756656 - DNA, 14 bp, Homo sapiens
aattaattctaaac

SEQ ID NO: 2756657 - DNA, 15 bp, Homo sapiens
aattaattctaaact

SEQ ID NO: 2756658 - DNA, 15 bp, Homo sapiens
aattacctttaatgc

SEQ ID NO: 2756659 - DNA, 18 bp, Homo sapiens
aattaggataactaaaat

SEQ ID NO: 2756660 - DNA, 14 bp, Homo sapiens
aattagtggatttt

SEQ ID NO: 2756661 - DNA, 19 bp, Homo sapiens
aattagtggatttttttgt

SEQ ID NO: 2756662 - DNA, 14 bp, Homo sapiens
aattagttgcattg

SEQ ID NO: 2756663 - DNA, 14 bp, Homo sapiens
aattagttttatat

SEQ ID NO: 2756664 - DNA, 18 bp, Homo sapiens
aattctccctatcttgtg

SEQ ID NO: 2756665 - DNA, 20 bp, Homo sapiens
aattgagtaattctagacat

SEQ ID NO: 2756666 - DNA, 15 bp, Homo sapiens
aattgccaatcttgt

SEQ ID NO: 2756667 - DNA, 14 bp, Homo sapiens
aattgtgatgtgtc

SEQ ID NO: 2756668 - DNA, 13 bp, Homo sapiens
aattgtttaaaaa

SEQ ID NO: 2756669 - DNA, 19 bp, Homo sapiens
aattgtttttataaaaaca

SEQ ID NO: 2756670 - DNA, 20 bp, Homo sapiens
aattgtttttataaaaacat

SEQ ID NO: 2756671 - DNA, 18 bp, Homo sapiens
aatttaaaaaactcctgt

SEQ ID NO: 2756672 - DNA, 11 bp, Homo sapiens
aatttaaaaca

SEQ ID NO: 2756673 - DNA, 23 bp, Homo sapiens
aatttaaaacacagtattgtaga

SEQ ID NO: 2756674 - DNA, 21 bp, Homo sapiens
aatttaccacaaaagcaaaat

SEQ ID NO: 2756675 - DNA, 22 bp, Homo sapiens
aatttaccacaaaagcaaaatt

SEQ ID NO: 2756676 - DNA, 22 bp, Homo sapiens
aatttacctctcattagaaagg

SEQ ID NO: 2756677 - DNA, 15 bp, Homo sapiens
aatttgattctaaat

SEQ ID NO: 2756678 - DNA, 21 bp, Homo sapiens
aatttgtaatatatcctgttt

SEQ ID NO: 2756679 - DNA, 18 bp, Homo sapiens
aatttgtccatttaaaaa

SEQ ID NO: 2756680 - DNA, 18 bp, Homo sapiens
aattttctctaaactgtt

SEQ ID NO: 2756681 - DNA, 22 bp, Homo sapiens
aattttctctaaactgtttctt

SEQ ID NO: 2756682 - DNA, 18 bp, Homo sapiens
aattttgtgaagcaaaat

SEQ ID NO: 2756683 - DNA, 18 bp, Homo sapiens
aattttttaaagaatcca

SEQ ID NO: 2756684 - DNA, 16 bp, Homo sapiens
acaaaagcaaaatttt

SEQ ID NO: 2756685 - DNA, 16 bp, Homo sapiens
acaaaagcttgtgtat

SEQ ID NO: 2756686 - DNA, 22 bp, Homo sapiens
acaaaagcttgtgtatcttgat

SEQ ID NO: 2756687 - DNA, 15 bp, Homo sapiens
acaaactaaacttta

SEQ ID NO: 2756688 - DNA, 18 bp, Homo sapiens
acaaatctgtataaatgt

SEQ ID NO: 2756689 - DNA, 22 bp, Homo sapiens
acaaatctgtataaatgtctat

SEQ ID NO: 2756690 - DNA, 13 bp, Homo sapiens
acaagactgcaca

SEQ ID NO: 2756691 - DNA, 21 bp, Homo sapiens
acaagattttttaattgttta

SEQ ID NO: 2756692 - DNA, 19 bp, Homo sapiens
acaaggggcattgttgctt

SEQ ID NO: 2756693 - DNA, 15 bp, Homo sapiens
acaagtaaattctgt

SEQ ID NO: 2756694 - DNA, 23 bp, Homo sapiens
acaatgccgcctgtcaataaatg

SEQ ID NO: 2756695 - DNA, 14 bp, Homo sapiens
acaatgctgtattt

SEQ ID NO: 2756696 - DNA, 18 bp, Homo sapiens
acaatgctgtattttaaa

SEQ ID NO: 2756697 - DNA, 22 bp, Homo sapiens
acaatgctgtattttaaaagaa

SEQ ID NO: 2756698 - DNA, 13 bp, Homo sapiens
acaatttcaaaag

SEQ ID NO: 2756699 - DNA, 17 bp, Homo sapiens
acacaactatattgttt

SEQ ID NO: 2756700 - DNA, 14 bp, Homo sapiens
acacactgaagaag

SEQ ID NO: 2756701 - DNA, 13 bp, Homo sapiens
acacatttcatct

SEQ ID NO: 2756702 - DNA, 17 bp, Homo sapiens
acacattttgtaaatct

SEQ ID NO: 2756703 - DNA, 18 bp, Homo sapiens
acacattttgtaaatctg

SEQ ID NO: 2756704 - DNA, 23 bp, Homo sapiens
acacattttgtaaatctgtactt

SEQ ID NO: 2756705 - DNA, 15 bp, Homo sapiens
acacctcagaaattg

SEQ ID NO: 2756706 - DNA, 13 bp, Homo sapiens
acactaagagaga

SEQ ID NO: 2756707 - DNA, 19 bp, Homo sapiens
acactaagagagaatgaga

SEQ ID NO: 2756708 - DNA, 12 bp, Homo sapiens
acactgaagaag

SEQ ID NO: 2756709 - DNA, 15 bp, Homo sapiens
acagaatatacacat

SEQ ID NO: 2756710 - DNA, 14 bp, Homo sapiens
acagaatggatata

SEQ ID NO: 2756711 - DNA, 21 bp, Homo sapiens
acagacactcccacttggcat

SEQ ID NO: 2756712 - DNA, 23 bp, Homo sapiens
acagaggacagtatttgtgggga

SEQ ID NO: 2756713 - DNA, 13 bp, Homo sapiens
acagattcaaagc

SEQ ID NO: 2756714 - DNA, 20 bp, Homo sapiens
acagcccttctttccacaga

SEQ ID NO: 2756715 - DNA, 22 bp, Homo sapiens
acaggaaccacaagactgcaca

SEQ ID NO: 2756716 - DNA, 15 bp, Homo sapiens
acaggaattttaaaa

SEQ ID NO: 2756717 - DNA, 14 bp, Homo sapiens
acagtattgtagaa

SEQ ID NO: 2756718 - DNA, 18 bp, Homo sapiens
acagtattgtagaaagct

SEQ ID NO: 2756719 - DNA, 17 bp, Homo sapiens
acagtcacctcatggaa

SEQ ID NO: 2756720 - DNA, 20 bp, Homo sapiens
acagttggcacttctgccat

SEQ ID NO: 2756721 - DNA, 16 bp, Homo sapiens
acagtttcttcatgca

SEQ ID NO: 2756722 - DNA, 19 bp, Homo sapiens
acagtttttaactctactg

SEQ ID NO: 2756723 - DNA, 20 bp, Homo sapiens
acatcccttacctgggaaag

SEQ ID NO: 2756724 - DNA, 12 bp, Homo sapiens
acatctgtgcag

SEQ ID NO: 2756725 - DNA, 17 bp, Homo sapiens
acatcttgaaaatgcca

SEQ ID NO: 2756726 - DNA, 21 bp, Homo sapiens
acatcttgaaaatgccaccat

SEQ ID NO: 2756727 - DNA, 16 bp, Homo sapiens
acatgaagtccaagca

SEQ ID NO: 2756728 - DNA, 21 bp, Homo sapiens
acatgaataaaaataaagttt

SEQ ID NO: 2756729 - DNA, 16 bp, Homo sapiens
acatgagtttaaagcg

SEQ ID NO: 2756730 - DNA, 14 bp, Homo sapiens
acatgcataaaagg

SEQ ID NO: 2756731 - DNA, 15 bp, Homo sapiens
acatgggacatttgc

SEQ ID NO: 2756732 - DNA, 21 bp, Homo sapiens
acatgggacatttgctcatgg

SEQ ID NO: 2756733 - DNA, 14 bp, Homo sapiens
acatgtaaagctgt

SEQ ID NO: 2756734 - DNA, 15 bp, Homo sapiens
acatgtaaagctgtt

SEQ ID NO: 2756735 - DNA, 20 bp, Homo sapiens
acatgtaaagctgttaaaat

SEQ ID NO: 2756736 - DNA, 13 bp, Homo sapiens
acattaactcagg

SEQ ID NO: 2756737 - DNA, 18 bp, Homo sapiens
acattaactcaggcattt

SEQ ID NO: 2756738 - DNA, 21 bp, Homo sapiens
acattcagctgaggttcatta

SEQ ID NO: 2756739 - DNA, 22 bp, Homo sapiens
acattgattggataaatgctta

SEQ ID NO: 2756740 - DNA, 19 bp, Homo sapiens
acattgcctgactaaaatg

SEQ ID NO: 2756741 - DNA, 19 bp, Homo sapiens
acattgtttggatttcctt

SEQ ID NO: 2756742 - DNA, 17 bp, Homo sapiens
acatttcacttctccaa

SEQ ID NO: 2756743 - DNA, 15 bp, Homo sapiens
acatttggaacagtg

SEQ ID NO: 2756744 - DNA, 21 bp, Homo sapiens
acatttgtataaaataatttt

SEQ ID NO: 2756745 - DNA, 22 bp, Homo sapiens
acattttgtaaatctgtacttt

SEQ ID NO: 2756746 - DNA, 12 bp, Homo sapiens
accaaactcctg

SEQ ID NO: 2756747 - DNA, 13 bp, Homo sapiens
accaagagaaggg

SEQ ID NO: 2756748 - DNA, 16 bp, Homo sapiens
accacaagactgcaca

SEQ ID NO: 2756749 - DNA, 21 bp, Homo sapiens
accacaattctccctatcttg

SEQ ID NO: 2756750 - DNA, 23 bp, Homo sapiens
accacttgtgttttgcaagccag

SEQ ID NO: 2756751 - DNA, 18 bp, Homo sapiens
agaagactgcattatatt

SEQ ID NO: 2756752 - DNA, 22 bp, Homo sapiens
agaagggcttacaggcatggac

SEQ ID NO: 2756753 - DNA, 19 bp, Homo sapiens
agaaggggacttctcttcc

SEQ ID NO: 2756754 - DNA, 15 bp, Homo sapiens
agaataaaagctgtg

SEQ ID NO: 2756755 - DNA, 13 bp, Homo sapiens
agaatagaaagaa

SEQ ID NO: 2756756 - DNA, 15 bp, Homo sapiens
agaatatacacattt

SEQ ID NO: 2756757 - DNA, 22 bp, Homo sapiens
agaatatacacattttgtaaat

SEQ ID NO: 2756758 - DNA, 23 bp, Homo sapiens
agaatatacacattttgtaaatc

SEQ ID NO: 2756759 - DNA, 19 bp, Homo sapiens
agaatccaagacaaactaa

SEQ ID NO: 2756760 - DNA, 23 bp, Homo sapiens
agaatccacacatatatatccta

SEQ ID NO: 2756761 - DNA, 13 bp, Homo sapiens
agaatggtggctt

SEQ ID NO: 2756762 - DNA, 17 bp, Homo sapiens
agaatgtcagtatgtgg

SEQ ID NO: 2756763 - DNA, 19 bp, Homo sapiens
agaatgtcagtatgtggaa

SEQ ID NO: 2756764 - DNA, 21 bp, Homo sapiens
atgccttatttttgaattctt

SEQ ID NO: 2756765 - DNA, 23 bp, Homo sapiens
atgctctgatgcagtgccctaga

SEQ ID NO: 2756766 - DNA, 23 bp, Homo sapiens
atgctgtattttaaaagaatgat

SEQ ID NO: 2756767 - DNA, 16 bp, Homo sapiens
atggaaaatatacaag

SEQ ID NO: 2756768 - DNA, 16 bp, Homo sapiens
ccagcgtgcaccccgc

SEQ ID NO: 2756769 - DNA, 22 bp, Homo sapiens
ccaggaccagtttatgtttgtg

SEQ ID NO: 2756770 - DNA, 17 bp, Homo sapiens
ccatatccttctggctg

SEQ ID NO: 2756771 - DNA, 16 bp, Homo sapiens
ccatatgggaattatt

SEQ ID NO: 2756772 - DNA, 18 bp, Homo sapiens
ccatcaagggtacactgc

SEQ ID NO: 2756773 - DNA, 18 bp, Homo sapiens
ccatgctctgatgcagtg

SEQ ID NO: 2756774 - DNA, 18 bp, Homo sapiens
ccatggcctgctgggctt

SEQ ID NO: 2756775 - DNA, 18 bp, Homo sapiens
ccatgggcactgtgggta

SEQ ID NO: 2756776 - DNA, 20 bp, Homo sapiens
ccattggggaggactaggac

SEQ ID NO: 2756777 - DNA, 13 bp, Homo sapiens
ccattggtgttga

SEQ ID NO: 2756778 - DNA, 14 bp, Homo sapiens
ccatttaaaaatga

SEQ ID NO: 2756779 - DNA, 19 bp, Homo sapiens
ccatttgttacagtttctt

SEQ ID NO: 2756780 - DNA, 13 bp, Homo sapiens
cccacactcgcca

SEQ ID NO: 2756781 - DNA, 13 bp, Homo sapiens
cccatggcctgct

SEQ ID NO: 2756782 - DNA, 20 bp, Homo sapiens
cccatggcctgctgggcttg

SEQ ID NO: 2756783 - DNA, 16 bp, Homo sapiens
ccccagtattagcaat

SEQ ID NO: 2756784 - DNA, 13 bp, Homo sapiens
cccccacccctgg

SEQ ID NO: 2756785 - DNA, 18 bp, Homo sapiens
cccgaaaatccagcgtgc

SEQ ID NO: 2756786 - DNA, 14 bp, Homo sapiens
ccctatcttgtgaa

SEQ ID NO: 2756787 - DNA, 14 bp, Homo sapiens
ccctattttgccat

SEQ ID NO: 2756788 - DNA, 18 bp, Homo sapiens
ccctcccacactcgccat

SEQ ID NO: 2756789 - DNA, 20 bp, Homo sapiens
ccctgccatcatgtttacag

SEQ ID NO: 2756790 - DNA, 23 bp, Homo sapiens
ccctgcccacgcccttggagcct

SEQ ID NO: 2756791 - DNA, 17 bp, Homo sapiens
ccctggctaccttgtgg

SEQ ID NO: 2756792 - DNA, 24 bp, Homo sapiens
ccctgtgccttggtgtgctgtatc

SEQ ID NO: 2756793 - DNA, 23 bp, Homo sapiens
ccctgttgagtatttgctgtttg

SEQ ID NO: 2756794 - DNA, 17 bp, Homo sapiens
cccttggagccttccac

SEQ ID NO: 2756795 - DNA, 14 bp, Homo sapiens
ccctttaaactgtc

SEQ ID NO: 2756796 - DNA, 11 bp, Homo sapiens
ccgaataaatg

SEQ ID NO: 2756797 - DNA, 13 bp, Homo sapiens
ccgagaggacaga

SEQ ID NO: 2756798 - DNA, 11 bp, Homo sapiens
ccgagcccctg

SEQ ID NO: 2756799 - DNA, 22 bp, Homo sapiens
ccgagcgctggtcccctccctc

SEQ ID NO: 2756800 - DNA, 15 bp, Homo sapiens
ccgagctggtttcct

SEQ ID NO: 2756801 - DNA, 16 bp, Homo sapiens
ccgagctggtttcctg

SEQ ID NO: 2756802 - DNA, 16 bp, Homo sapiens
ccgcccgagcccctgc

SEQ ID NO: 2756803 - DNA, 13 bp, Homo sapiens
ccgcctgtcaata

SEQ ID NO: 2756804 - DNA, 14 bp, Homo sapiens
ccggaggaaggtcc

SEQ ID NO: 2756805 - DNA, 20 bp, Homo sapiens
ccggcactcatgacggcctg

SEQ ID NO: 2756806 - DNA, 23 bp, Homo sapiens
ccgtacgactcttttccaaacac

SEQ ID NO: 2756807 - DNA, 21 bp, Homo sapiens
cctaatgaaagtgatgacata

SEQ ID NO: 2756808 - DNA, 22 bp, Homo sapiens
cctaatgaaagtgatgacatat

SEQ ID NO: 2756809 - DNA, 20 bp, Homo sapiens
cctacaaaagcttgtgtatc

SEQ ID NO: 2756810 - DNA, 21 bp, Homo sapiens
cctacaaaagcttgtgtatct

SEQ ID NO: 2756811 - DNA, 14 bp, Homo sapiens
cctagatatgaata

SEQ ID NO: 2756812 - DNA, 21 bp, Homo sapiens
cctagatatgaatatatggca

SEQ ID NO: 2756813 - DNA, 22 bp, Homo sapiens
cctaggttaacaaccctgttga

SEQ ID NO: 2756814 - DNA, 22 bp, Homo sapiens
cctatatgagaagaatagccta

SEQ ID NO: 2756815 - DNA, 12 bp, Homo sapiens
cctatgcaataa

SEQ ID NO: 2756816 - DNA, 17 bp, Homo sapiens
cctatgccttcaaatag

SEQ ID NO: 2756817 - DNA, 17 bp, Homo sapiens
cctccaaagtcttgata

SEQ ID NO: 2756818 - DNA, 13 bp, Homo sapiens
cctccctcccaca

SEQ ID NO: 2756819 - DNA, 18 bp, Homo sapiens
cctctcagggccgagagg

SEQ ID NO: 2756820 - DNA, 17 bp, Homo sapiens
cctctgtcttcaggctc

SEQ ID NO: 2756821 - DNA, 14 bp, Homo sapiens
cctcttgccacatc

SEQ ID NO: 2756822 - DNA, 19 bp, Homo sapiens
cctcttgccacatcttgaa

SEQ ID NO: 2756823 - DNA, 20 bp, Homo sapiens
cctcttgccacatcttgaaa

SEQ ID NO: 2756824 - DNA, 15 bp, Homo sapiens
cctcttggctgcctt

SEQ ID NO: 2756825 - DNA, 23 bp, Homo sapiens
cctctttgtgtttttgttgttgt

SEQ ID NO: 2756826 - DNA, 16 bp, Homo sapiens
cctgactgggctgggt

SEQ ID NO: 2756827 - DNA, 15 bp, Homo sapiens
cctgcaaacctgctg

SEQ ID NO: 2756828 - DNA, 13 bp, Homo sapiens
cctgcccacgccc

SEQ ID NO: 2756829 - DNA, 17 bp, Homo sapiens
cctgcccacgcccttgg

SEQ ID NO: 2756830 - DNA, 18 bp, Homo sapiens
cctgcccacgcccttgga

SEQ ID NO: 2756831 - DNA, 21 bp, Homo sapiens
cctgcccacgcccttggagcc

SEQ ID NO: 2756832 - DNA, 19 bp, Homo sapiens
cctgcccactaaaagaatt

SEQ ID NO: 2756833 - DNA, 12 bp, Homo sapiens
cctgcccagcct

SEQ ID NO: 2756834 - DNA, 16 bp, Homo sapiens
cctgcccagcctgggg

SEQ ID NO: 2756835 - DNA, 13 bp, Homo sapiens
cctgctaaggaac

SEQ ID NO: 2756836 - DNA, 18 bp, Homo sapiens
cctgctaaggaacaatgc

SEQ ID NO: 2756837 - DNA, 19 bp, Homo sapiens
cctgctaaggaacaatgcc

SEQ ID NO: 2756838 - DNA, 16 bp, Homo sapiens
cctgctgagttgcttc

SEQ ID NO: 2756839 - DNA, 19 bp, Homo sapiens
cctggctaccttgtgggaa

SEQ ID NO: 2756840 - DNA, 13 bp, Homo sapiens
cctgggtttcttt

SEQ ID NO: 2756841 - DNA, 21 bp, Homo sapiens
cctgtagatgcagaaaaagaa

SEQ ID NO: 2756842 - DNA, 17 bp, Homo sapiens
cctgtagtcccagcact

SEQ ID NO: 2756843 - DNA, 18 bp, Homo sapiens
cctgtagtctcagctact

SEQ ID NO: 2756844 - DNA, 11 bp, Homo sapiens
cctgtcaataa

SEQ ID NO: 2756845 - DNA, 14 bp, Homo sapiens
cctgtcaataaatg

SEQ ID NO: 2756846 - DNA, 18 bp, Homo sapiens
cctgtcttcggccgagct

SEQ ID NO: 2756847 - DNA, 19 bp, Homo sapiens
cctgtcttcggccgagctg

SEQ ID NO: 2756848 - DNA, 17 bp, Homo sapiens
cctgtgccttttgccat

SEQ ID NO: 2756849 - DNA, 15 bp, Homo sapiens
ccttatttttgaatt

SEQ ID NO: 2756850 - DNA, 22 bp, Homo sapiens
ccttctaactgaaggtgcagtt

SEQ ID NO: 2756851 - DNA, 21 bp, Homo sapiens
ccttctggctgtagataaata

SEQ ID NO: 2756852 - DNA, 14 bp, Homo sapiens
ccttgatgaagaag

SEQ ID NO: 2756853 - DNA, 13 bp, Homo sapiens
cctttatactgtg

SEQ ID NO: 2756854 - DNA, 17 bp, Homo sapiens
cctttatactgtgaagt

SEQ ID NO: 2756855 - DNA, 14 bp, Homo sapiens
cctttgtcccagaa

SEQ ID NO: 2756856 - DNA, 15 bp, Homo sapiens
cgaacagtccaatca

SEQ ID NO: 2756857 - DNA, 14 bp, Homo sapiens
cgactactttgcta

SEQ ID NO: 2756858 - DNA, 13 bp, Homo sapiens
cgagaggacagaa

SEQ ID NO: 2756859 - DNA, 15 bp, Homo sapiens
cgagaggacagaatg

SEQ ID NO: 2756860 - DNA, 11 bp, Homo sapiens
cgagcccctgc

SEQ ID NO: 2756861 - DNA, 13 bp, Homo sapiens
cgagcccctgccc

SEQ ID NO: 2756862 - DNA, 18 bp, Homo sapiens
cgagcccctgcccacgcc

SEQ ID NO: 2756863 - DNA, 12 bp, Homo sapiens
cgagctggtttc

SEQ ID NO: 2756864 - DNA, 19 bp, Homo sapiens
cgattataatctccaactt

SEQ ID NO: 2756865 - DNA, 21 bp, Homo sapiens
cgattgcaggagtccctgcca

SEQ ID NO: 2756866 - DNA, 22 bp, Homo sapiens
cgccaccgggcatgtctgcctg

SEQ ID NO: 2756867 - DNA, 15 bp, Homo sapiens
cgccatctcctgggc

SEQ ID NO: 2756868 - DNA, 20 bp, Homo sapiens
ctgcactgtttatggaaata

SEQ ID NO: 2756869 - DNA, 16 bp, Homo sapiens
ctgcagaaaaaaaaga

SEQ ID NO: 2756870 - DNA, 14 bp, Homo sapiens
ctgcataaatttgt

SEQ ID NO: 2756871 - DNA, 15 bp, Homo sapiens
ctgcataaatttgta

SEQ ID NO: 2756872 - DNA, 18 bp, Homo sapiens
ctgcataaatttgtaata

SEQ ID NO: 2756873 - DNA, 21 bp, Homo sapiens
ctgcataaatttgtaatatat

SEQ ID NO: 2756874 - DNA, 22 bp, Homo sapiens
ctgcataaatttgtaatatatc

SEQ ID NO: 2756875 - DNA, 13 bp, Homo sapiens
ctgcatctttcat

SEQ ID NO: 2756876 - DNA, 14 bp, Homo sapiens
ctgcatctttcata

SEQ ID NO: 2756877 - DNA, 21 bp, Homo sapiens
ctgcatctttcatagttctgt

SEQ ID NO: 2756878 - DNA, 15 bp, Homo sapiens
ctgcatttttaatca

SEQ ID NO: 2756879 - DNA, 22 bp, Homo sapiens
ctgccatcatgtttacagagga

SEQ ID NO: 2756880 - DNA, 15 bp, Homo sapiens
ctgcccacgcccttg

SEQ ID NO: 2756881 - DNA, 19 bp, Homo sapiens
ctgcccacgcccttggagc

SEQ ID NO: 2756882 - DNA, 13 bp, Homo sapiens
ctgcccagcctgg

SEQ ID NO: 2756883 - DNA, 14 bp, Homo sapiens
ctgcccagcctggg

SEQ ID NO: 2756884 - DNA, 23 bp, Homo sapiens
ctgcccagcctggggcaaaccta

SEQ ID NO: 2756885 - DNA, 16 bp, Homo sapiens
ctgcccaggaactcgc

SEQ ID NO: 2756886 - DNA, 21 bp, Homo sapiens
ctgcctgagaatgttaccaga

SEQ ID NO: 2756887 - DNA, 22 bp, Homo sapiens
ctgcctgcaaacctgctggtgg

SEQ ID NO: 2756888 - DNA, 15 bp, Homo sapiens
ctgctccaaggcagt

SEQ ID NO: 2756889 - DNA, 23 bp, Homo sapiens
ctgctcgaaatggcccctgtctt

SEQ ID NO: 2756890 - DNA, 17 bp, Homo sapiens
ctgctgagttgcttctt

SEQ ID NO: 2756891 - DNA, 13 bp, Homo sapiens
ctgctggtggggc

SEQ ID NO: 2756892 - DNA, 14 bp, Homo sapiens
ctgctggtggggca

SEQ ID NO: 2756893 - DNA, 14 bp, Homo sapiens
ctgctgtgcgtgga

SEQ ID NO: 2756894 - DNA, 17 bp, Homo sapiens
ctgctgtgcgtggaaaa

SEQ ID NO: 2756895 - DNA, 19 bp, Homo sapiens
ctgctgtgcgtggaaaaag

SEQ ID NO: 2756896 - DNA, 20 bp, Homo sapiens
ctgctgtgcgtggaaaaaga

SEQ ID NO: 2756897 - DNA, 19 bp, Homo sapiens
ctgcttggtagcactttaa

SEQ ID NO: 2756898 - DNA, 23 bp, Homo sapiens
ctggaaaagtatgttagtgcaaa

SEQ ID NO: 2756899 - DNA, 20 bp, Homo sapiens
ctggataaatttaaaacaca

SEQ ID NO: 2756900 - DNA, 11 bp, Homo sapiens
ctggcctgagg

SEQ ID NO: 2756901 - DNA, 19 bp, Homo sapiens
ctggctaccttgtgggaat

SEQ ID NO: 2756902 - DNA, 21 bp, Homo sapiens
ctgggccgttacatctgtgca

SEQ ID NO: 2756903 - DNA, 22 bp, Homo sapiens
ctgggccgttacatctgtgcag

SEQ ID NO: 2756904 - DNA, 22 bp, Homo sapiens
ctgggcttggctcggcgccccc

SEQ ID NO: 2756905 - DNA, 18 bp, Homo sapiens
ctggggtaagcggaataa

SEQ ID NO: 2756906 - DNA, 16 bp, Homo sapiens
ctgggtgctgatcctt

SEQ ID NO: 2756907 - DNA, 20 bp, Homo sapiens
ctgggtgctgatccttgcac

SEQ ID NO: 2756908 - DNA, 12 bp, Homo sapiens
ctgggtttcttt

SEQ ID NO: 2756909 - DNA, 19 bp, Homo sapiens
ctggtcccctccctctgtc

SEQ ID NO: 2756910 - DNA, 12 bp, Homo sapiens
ctggtggggcag

SEQ ID NO: 2756911 - DNA, 15 bp, Homo sapiens
ctgtacttttttcaa

SEQ ID NO: 2756912 - DNA, 16 bp, Homo sapiens
ctgtacttttttcaaa

SEQ ID NO: 2756913 - DNA, 23 bp, Homo sapiens
ctgtacttttttcaaatattgaa

SEQ ID NO: 2756914 - DNA, 14 bp, Homo sapiens
ctgtagataaataa

SEQ ID NO: 2756915 - DNA, 18 bp, Homo sapiens
ctgtagatgcagaaaaag

SEQ ID NO: 2756916 - DNA, 15 bp, Homo sapiens
ctgtataaatgtcta

SEQ ID NO: 2756917 - DNA, 17 bp, Homo sapiens
ctgtataaatgtctatt

SEQ ID NO: 2756918 - DNA, 20 bp, Homo sapiens
ctgtataaatgtctattatt

SEQ ID NO: 2756919 - DNA, 21 bp, Homo sapiens
ctgtataaatgtctattatta

SEQ ID NO: 2756920 - DNA, 23 bp, Homo sapiens
ctgtatttaggccatttgttaca

SEQ ID NO: 2756921 - DNA, 13 bp, Homo sapiens
ctgtatttgctcc

SEQ ID NO: 2756922 - DNA, 13 bp, Homo sapiens
ctgtcaataaatg

SEQ ID NO: 2756923 - DNA, 14 bp, Homo sapiens
ctgtcaataaatgt

SEQ ID NO: 2756924 - DNA, 20 bp, Homo sapiens
ctgtcaataaatgttgaaaa

SEQ ID NO: 2756925 - DNA, 12 bp, Homo sapiens
ctgtcactactg

SEQ ID NO: 2756926 - DNA, 13 bp, Homo sapiens
ctgtcactactgg

SEQ ID NO: 2756927 - DNA, 17 bp, Homo sapiens
ctgtccaactctgtatt

SEQ ID NO: 2756928 - DNA, 19 bp, Homo sapiens
ctgtcccccatgctctgat

SEQ ID NO: 2756929 - DNA, 19 bp, Homo sapiens
ctgtccttgaatgccatag

SEQ ID NO: 2756930 - DNA, 20 bp, Homo sapiens
ctgtctttgcatacatgaat

SEQ ID NO: 2756931 - DNA, 21 bp, Homo sapiens
ctgtgaagttacatgcataaa

SEQ ID NO: 2756932 - DNA, 21 bp, Homo sapiens
ctgtgattatgccattgcact

SEQ ID NO: 2756933 - DNA, 19 bp, Homo sapiens
ctgtgcacccagaagaaga

SEQ ID NO: 2756934 - DNA, 16 bp, Homo sapiens
ctgtgcagggctggtt

SEQ ID NO: 2756935 - DNA, 18 bp, Homo sapiens
ctgtgctgtgtttaatca

SEQ ID NO: 2756936 - DNA, 20 bp, Homo sapiens
ctgtgtgtgtgtatgtgggg

SEQ ID NO: 2756937 - DNA, 17 bp, Homo sapiens
ctgtgtgtttatgtgtg

SEQ ID NO: 2756938 - DNA, 18 bp, Homo sapiens
ctgttaaaactgtacctt

SEQ ID NO: 2756939 - DNA, 17 bp, Homo sapiens
ctgttaaattttctcta

SEQ ID NO: 2756940 - DNA, 18 bp, Homo sapiens
ctgttacctaggttaaca

SEQ ID NO: 2756941 - DNA, 17 bp, Homo sapiens
ctgttcctccctcccac

SEQ ID NO: 2756942 - DNA, 19 bp, Homo sapiens
ctgttgagtatttgctgtt

SEQ ID NO: 2756943 - DNA, 23 bp, Homo sapiens
ctgttgtgcagtgtgcctgtcac

SEQ ID NO: 2756944 - DNA, 14 bp, Homo sapiens
ctgtttatggaaat

SEQ ID NO: 2756945 - DNA, 14 bp, Homo sapiens
ctgttttataattt

SEQ ID NO: 2756946 - DNA, 19 bp, Homo sapiens
ctgttttataattttgtga

SEQ ID NO: 2756947 - DNA, 21 bp, Homo sapiens
cttaaaatgcaatatttgtaa

SEQ ID NO: 2756948 - DNA, 18 bp, Homo sapiens
cttaaagttttttatata

SEQ ID NO: 2756949 - DNA, 21 bp, Homo sapiens
cttaaatcagaataaattaat

SEQ ID NO: 2756950 - DNA, 16 bp, Homo sapiens
cttaacattcctaaaa

SEQ ID NO: 2756951 - DNA, 23 bp, Homo sapiens
cttaagaagactgcattatattt

SEQ ID NO: 2756952 - DNA, 19 bp, Homo sapiens
cttagatgcagttctgaag

SEQ ID NO: 2756953 - DNA, 15 bp, Homo sapiens
cttagctgcactgtt

SEQ ID NO: 2756954 - DNA, 21 bp, Homo sapiens
cttagggttatgattaagtaa

SEQ ID NO: 2756955 - DNA, 13 bp, Homo sapiens
cttatagaataaa

SEQ ID NO: 2756956 - DNA, 17 bp, Homo sapiens
cttatagaataaaagct

SEQ ID NO: 2756957 - DNA, 19 bp, Homo sapiens
cttatagaataaaagctgt

SEQ ID NO: 2756958 - DNA, 14 bp, Homo sapiens
cttatctagttaca

SEQ ID NO: 2756959 - DNA, 14 bp, Homo sapiens
cttatttttgaatt

SEQ ID NO: 2756960 - DNA, 22 bp, Homo sapiens
cttatttttgaattctttagat

SEQ ID NO: 2756961 - DNA, 17 bp, Homo sapiens
cttcaaatccttgaaga

SEQ ID NO: 2756962 - DNA, 15 bp, Homo sapiens
cttcaaatttgattc

SEQ ID NO: 2756963 - DNA, 16 bp, Homo sapiens
cttcaggctctgccca

SEQ ID NO: 2756964 - DNA, 17 bp, Homo sapiens
cttcagtgcaagagact

SEQ ID NO: 2756965 - DNA, 19 bp, Homo sapiens
cttcagtgcaagagacttt

SEQ ID NO: 2756966 - DNA, 15 bp, Homo sapiens
cttcataatggcctg

SEQ ID NO: 2756967 - DNA, 19 bp, Homo sapiens
cttcatcggggtggtgcag

SEQ ID NO: 2756968 - DNA, 18 bp, Homo sapiens
cttccaccggcactcatg

SEQ ID NO: 2756969 - DNA, 15 bp, Homo sapiens
cttccatcagagatg

SEQ ID NO: 2756970 - DNA, 22 bp, Homo sapiens
cttcctctgtaagatatcccag

SEQ ID NO: 2756971 - DNA, 16 bp, Homo sapiens
cttcggccgagctggt

SEQ ID NO: 2756972 - DNA, 17 bp, Homo sapiens
cttctacacatttcatc

SEQ ID NO: 2756973 - DNA, 17 bp, Homo sapiens
cttctacctcttggctg

SEQ ID NO: 2756974 - DNA, 15 bp, Homo sapiens
cttctgttttataat

SEQ ID NO: 2756975 - DNA, 15 bp, Homo sapiens
cttcttcttgtggag

SEQ ID NO: 2756976 - DNA, 19 bp, Homo sapiens
cttctttcagtgacttctt

SEQ ID NO: 2756977 - DNA, 19 bp, Homo sapiens
cttctttccacagaagctc

SEQ ID NO: 2756978 - DNA, 22 bp, Homo sapiens
cttcttttttaagcgaatgatt

SEQ ID NO: 2756979 - DNA, 16 bp, Homo sapiens
cttgaaaatgccacca

SEQ ID NO: 2756980 - DNA, 15 bp, Homo sapiens
cttgaacaaaaagtt

SEQ ID NO: 2756981 - DNA, 23 bp, Homo sapiens
cttgaatgccatagtcaaagaga

SEQ ID NO: 2756982 - DNA, 12 bp, Homo sapiens
cttgccacatct

SEQ ID NO: 2756983 - DNA, 18 bp, Homo sapiens
cttgccacatcttgaaaa

SEQ ID NO: 2756984 - DNA, 19 bp, Homo sapiens
cttgccacatcttgaaaat

SEQ ID NO: 2756985 - DNA, 13 bp, Homo sapiens
cttggagccttcc

SEQ ID NO: 2756986 - DNA, 19 bp, Homo sapiens
cttggatttgcatttttgt

SEQ ID NO: 2756987 - DNA, 15 bp, Homo sapiens
cttggcaaattctga

SEQ ID NO: 2756988 - DNA, 17 bp, Homo sapiens
cttggccaagagaaggg

SEQ ID NO: 2756989 - DNA, 15 bp, Homo sapiens
cttggtgctggttta

SEQ ID NO: 2756990 - DNA, 23 bp, Homo sapiens
cttgtcaataaaatccatacatt

SEQ ID NO: 2756991 - DNA, 18 bp, Homo sapiens
cttgtgaagttgtttttt

SEQ ID NO: 2756992 - DNA, 22 bp, Homo sapiens
cttgtgtatcttgattaatgta

SEQ ID NO: 2756993 - DNA, 13 bp, Homo sapiens
cttgttttaagca

SEQ ID NO: 2756994 - DNA, 14 bp, Homo sapiens
ctttaaaaagaaaa

SEQ ID NO: 2756995 - DNA, 21 bp, Homo sapiens
ctttaaaaagaaaaaaaaaga

SEQ ID NO: 2756996 - DNA, 22 bp, Homo sapiens
ctttaaactactgaactgttac

SEQ ID NO: 2756997 - DNA, 15 bp, Homo sapiens
ctttaaattttttaa

SEQ ID NO: 2756998 - DNA, 22 bp, Homo sapiens
ctttaatgcaatgcatatctgt

SEQ ID NO: 2756999 - DNA, 22 bp, Homo sapiens
ctttaattgtgtggtgctttta

SEQ ID NO: 2757000 - DNA, 14 bp, Homo sapiens
ctttatactgtgaa

SEQ ID NO: 2757001 - DNA, 22 bp, Homo sapiens
ctttattacacctcagaaattg

SEQ ID NO: 2757002 - DNA, 22 bp, Homo sapiens
ctttcaaaatggaaaattaatt

SEQ ID NO: 2757003 - DNA, 15 bp, Homo sapiens
ctttcatagttctgt

SEQ ID NO: 2757004 - DNA, 17 bp, Homo sapiens
ctttcatagttctgtta

SEQ ID NO: 2757005 - DNA, 20 bp, Homo sapiens
ctttcatagttctgttaaat

SEQ ID NO: 2757006 - DNA, 23 bp, Homo sapiens
ctttcatagttctgttaaatatt

SEQ ID NO: 2757007 - DNA, 13 bp, Homo sapiens
ctttccacagaag

SEQ ID NO: 2757008 - DNA, 21 bp, Homo sapiens
ctttcctgcatctttcatagt

SEQ ID NO: 2757009 - DNA, 19 bp, Homo sapiens
ctttctaagggaaaaagtt

SEQ ID NO: 2757010 - DNA, 14 bp, Homo sapiens
ctttctgaaattca

SEQ ID NO: 2757011 - DNA, 15 bp, Homo sapiens
ctttcttccttggcc

SEQ ID NO: 2757012 - DNA, 19 bp, Homo sapiens
ctttcttcctttcttcctt

SEQ ID NO: 2757013 - DNA, 19 bp, Homo sapiens
ctttgaaatgctaaacttg

SEQ ID NO: 2757014 - DNA, 18 bp, Homo sapiens
ctttgtatcattcatctt

SEQ ID NO: 2757015 - DNA, 19 bp, Homo sapiens
ctttgtatcattcatcttc

SEQ ID NO: 2757016 - DNA, 15 bp, Homo sapiens
cttttaaattctttt

SEQ ID NO: 2757017 - DNA, 21 bp, Homo sapiens
cttttagctagaatccacaca

SEQ ID NO: 2757018 - DNA, 15 bp, Homo sapiens
cttttctctacttta

SEQ ID NO: 2757019 - DNA, 14 bp, Homo sapiens
cttttctttgtatc

SEQ ID NO: 2757020 - DNA, 18 bp, Homo sapiens
cttttgtaaagtaaaata

SEQ ID NO: 2757021 - DNA, 14 bp, Homo sapiens
cttttgtcccagaa

SEQ ID NO: 2757022 - DNA, 16 bp, Homo sapiens
ctttttattgcatggt

SEQ ID NO: 2757023 - DNA, 13 bp, Homo sapiens
cttttttcaaata

SEQ ID NO: 2757024 - DNA, 16 bp, Homo sapiens
cttttttcaaatattg

SEQ ID NO: 2757025 - DNA, 20 bp, Homo sapiens
cttttttcaaatattgaatg

SEQ ID NO: 2757026 - DNA, 16 bp, Homo sapiens
gaaaaaagtccttcag

SEQ ID NO: 2757027 - DNA, 20 bp, Homo sapiens
gaaaaattatttgtgttggg

SEQ ID NO: 2757028 - DNA, 16 bp, Homo sapiens
gaaaagcacttaaagt

SEQ ID NO: 2757029 - DNA, 13 bp, Homo sapiens
cacattaactcag

SEQ ID NO: 2757030 - DNA, 13 bp, Homo sapiens
cacatttcatcta

SEQ ID NO: 2757031 - DNA, 18 bp, Homo sapiens
cacattttgtaaatctgt

SEQ ID NO: 2757032 - DNA, 14 bp, Homo sapiens
caccacaattctcc

SEQ ID NO: 2757033 - DNA, 12 bp, Homo sapiens
cacctcatggaa

SEQ ID NO: 2757034 - DNA, 21 bp, Homo sapiens
cacctgtagtcccagcacttt

SEQ ID NO: 2757035 - DNA, 16 bp, Homo sapiens
cacgcccttggagcct

SEQ ID NO: 2757036 - DNA, 19 bp, Homo sapiens
cacgcccttggagccttcc

SEQ ID NO: 2757037 - DNA, 17 bp, Homo sapiens
cacgcgccctttctacc

SEQ ID NO: 2757038 - DNA, 21 bp, Homo sapiens
cactaaaataaaatttaaaaa

SEQ ID NO: 2757039 - DNA, 14 bp, Homo sapiens
cactagtatttcta

SEQ ID NO: 2757040 - DNA, 21 bp, Homo sapiens
cactcatgacggcctgcctgc

SEQ ID NO: 2757041 - DNA, 21 bp, Homo sapiens
cactccagcctgggtgacaga

SEQ ID NO: 2757042 - DNA, 11 bp, Homo sapiens
cactgaagaag

SEQ ID NO: 2757043 - DNA, 22 bp, Homo sapiens
cactgctcgaaatggcccctgt

SEQ ID NO: 2757044 - DNA, 17 bp, Homo sapiens
cactggtaacatgtgac

SEQ ID NO: 2757045 - DNA, 21 bp, Homo sapiens
cactgtttatggaaataccag

SEQ ID NO: 2757046 - DNA, 21 bp, Homo sapiens
gaaaagtaagggaataaattt

SEQ ID NO: 2757047 - DNA, 23 bp, Homo sapiens
gaaaagtaagggaataaattttt

SEQ ID NO: 2757048 - DNA, 20 bp, Homo sapiens
gaaaagtatgttagtgcaaa

SEQ ID NO: 2757049 - DNA, 17 bp, Homo sapiens
gaaaatccagcgtgcac

SEQ ID NO: 2757050 - DNA, 18 bp, Homo sapiens
gaaaatccagcgtgcacc

SEQ ID NO: 2757051 - DNA, 23 bp, Homo sapiens
gaaaatgccaccatccaataaaa

SEQ ID NO: 2757052 - DNA, 19 bp, Homo sapiens
gaaaatggaaaatatacaa

SEQ ID NO: 2757053 - DNA, 22 bp, Homo sapiens
gaaaatggaaaatatacaagta

SEQ ID NO: 2757054 - DNA, 15 bp, Homo sapiens
gaaaattaattctaa

SEQ ID NO: 2757055 - DNA, 19 bp, Homo sapiens
gaaaattaattctaaactt

SEQ ID NO: 2757056 - DNA, 23 bp, Homo sapiens
gaaacttcagcggtttatataag

SEQ ID NO: 2757057 - DNA, 13 bp, Homo sapiens
gaaagaatagaaa

SEQ ID NO: 2757058 - DNA, 19 bp, Homo sapiens
gaaagaatagaaagaaagt

SEQ ID NO: 2757059 - DNA, 17 bp, Homo sapiens
gaaagcactatgaattt

SEQ ID NO: 2757060 - DNA, 21 bp, Homo sapiens
gaaagctaatacaaaactatc

SEQ ID NO: 2757061 - DNA, 17 bp, Homo sapiens
gaaagtaaaaaaataat

SEQ ID NO: 2757062 - DNA, 15 bp, Homo sapiens
gaaataccaggacca

SEQ ID NO: 2757063 - DNA, 17 bp, Homo sapiens
gaaatatagttgaaagt

SEQ ID NO: 2757064 - DNA, 19 bp, Homo sapiens
gaaatatagttgaaagtaa

SEQ ID NO: 2757065 - DNA, 20 bp, Homo sapiens
gaaatatagttgaaagtaaa

SEQ ID NO: 2757066 - DNA, 13 bp, Homo sapiens
gaaatattatgtt

SEQ ID NO: 2757067 - DNA, 15 bp, Homo sapiens
gaaatatttatttta

SEQ ID NO: 2757068 - DNA, 16 bp, Homo sapiens
gaaatatttattttaa

SEQ ID NO: 2757069 - DNA, 17 bp, Homo sapiens
gaaatatttattttaat

SEQ ID NO: 2757070 - DNA, 15 bp, Homo sapiens
gaaatgctaaacttg

SEQ ID NO: 2757071 - DNA, 14 bp, Homo sapiens
gaaattctgaattt

SEQ ID NO: 2757072 - DNA, 17 bp, Homo sapiens
gaacaaaaagttttttt

SEQ ID NO: 2757073 - DNA, 19 bp, Homo sapiens
gaacaatgccgcctgtcaa

SEQ ID NO: 2757074 - DNA, 19 bp, Homo sapiens
gaacctttcaaaatggaaa

SEQ ID NO: 2757075 - DNA, 15 bp, Homo sapiens
gaactaagttattgc

SEQ ID NO: 2757076 - DNA, 16 bp, Homo sapiens
gaactaagttattgct

SEQ ID NO: 2757077 - DNA, 18 bp, Homo sapiens
gaactaagttattgctgc

SEQ ID NO: 2757078 - DNA, 22 bp, Homo sapiens
gaactagagtttagctggaaaa

SEQ ID NO: 2757079 - DNA, 18 bp, Homo sapiens
gaactcgcacctgtgctg

SEQ ID NO: 2757080 - DNA, 20 bp, Homo sapiens
gaactcgcacctgtgctgga

SEQ ID NO: 2757081 - DNA, 13 bp, Homo sapiens
gaactgaaatcat

SEQ ID NO: 2757082 - DNA, 17 bp, Homo sapiens
gaagaaagtaaaaccat

SEQ ID NO: 2757083 - DNA, 19 bp, Homo sapiens
gaagaattgccaatcttgt

SEQ ID NO: 2757084 - DNA, 17 bp, Homo sapiens
gaagagaagggcagggc

SEQ ID NO: 2757085 - DNA, 14 bp, Homo sapiens
gaagagtcaaagta

SEQ ID NO: 2757086 - DNA, 13 bp, Homo sapiens
gaagatggctgtt

SEQ ID NO: 2757087 - DNA, 16 bp, Homo sapiens
gaagatggctgttagc

SEQ ID NO: 2757088 - DNA, 21 bp, Homo sapiens
gaagccttggggctgatgcag

SEQ ID NO: 2757089 - DNA, 13 bp, Homo sapiens
gaagctgaattat

SEQ ID NO: 2757090 - DNA, 17 bp, Homo sapiens
gaaggccgaggtcccat

SEQ ID NO: 2757091 - DNA, 12 bp, Homo sapiens
gaagtccaagca

SEQ ID NO: 2757092 - DNA, 23 bp, Homo sapiens
gaagtccaagcatttagatgtat

SEQ ID NO: 2757093 - DNA, 20 bp, Homo sapiens
gaagtcttcttatctaaacc

SEQ ID NO: 2757094 - DNA, 17 bp, Homo sapiens
gaagtgtgggtctgtgt

SEQ ID NO: 2757095 - DNA, 18 bp, Homo sapiens
gaagtgtgggtctgtgtg

SEQ ID NO: 2757096 - DNA, 20 bp, Homo sapiens
gaagttacatgcataaaagg

SEQ ID NO: 2757097 - DNA, 19 bp, Homo sapiens
gaataaaaataaagttttt

SEQ ID NO: 2757098 - DNA, 22 bp, Homo sapiens
gaatacaatatatagctggcaa

SEQ ID NO: 2757099 - DNA, 13 bp, Homo sapiens
gaatagaaagaaa

SEQ ID NO: 2757100 - DNA, 19 bp, Homo sapiens
gaatatatggcatttgcag

SEQ ID NO: 2757101 - DNA, 14 bp, Homo sapiens
gaatattacatgta

SEQ ID NO: 2757102 - DNA, 18 bp, Homo sapiens
gaatattacatgtaaagc

SEQ ID NO: 2757103 - DNA, 19 bp, Homo sapiens
gaatccaagacaaactaaa

SEQ ID NO: 2757104 - DNA, 22 bp, Homo sapiens
gaatccaagacaaactaaactt

SEQ ID NO: 2757105 - DNA, 23 bp, Homo sapiens
gaatgagagacacactgaagaag

SEQ ID NO: 2757106 - DNA, 14 bp, Homo sapiens
gaatgattatgaat

SEQ ID NO: 2757107 - DNA, 22 bp, Homo sapiens
gaatgattatgaattacatttg

SEQ ID NO: 2757108 - DNA, 20 bp, Homo sapiens
gaatgccttatttttgaatt

SEQ ID NO: 2757109 - DNA, 21 bp, Homo sapiens
gaatgtgctagagttaaaagt

SEQ ID NO: 2757110 - DNA, 16 bp, Homo sapiens
gaatgttaccagactt

SEQ ID NO: 2757111 - DNA, 19 bp, Homo sapiens
gaatgttaccagacttcaa

SEQ ID NO: 2757112 - DNA, 13 bp, Homo sapiens
gaattacatttgt

SEQ ID NO: 2757113 - DNA, 20 bp, Homo sapiens
gaattacatttgtataaaat

SEQ ID NO: 2757114 - DNA, 17 bp, Homo sapiens
gaattaccaagagaagg

SEQ ID NO: 2757115 - DNA, 18 bp, Homo sapiens
gaattaccaagagaaggg

SEQ ID NO: 2757116 - DNA, 11 bp, Homo sapiens
gaattagtttt

SEQ ID NO: 2757117 - DNA, 11 bp, Homo sapiens
gaattcagtgg

SEQ ID NO: 2757118 - DNA, 13 bp, Homo sapiens
gaattctttagat

SEQ ID NO: 2757119 - DNA, 12 bp, Homo sapiens
gacaaactaaac

SEQ ID NO: 2757120 - DNA, 15 bp, Homo sapiens
gacaaactaaacttt

SEQ ID NO: 2757121 - DNA, 13 bp, Homo sapiens
gacacactgaaga

SEQ ID NO: 2757122 - DNA, 14 bp, Homo sapiens
gacacactgaagaa

SEQ ID NO: 2757123 - DNA, 22 bp, Homo sapiens
gacagaaaaaaaaatgttttat

SEQ ID NO: 2757124 - DNA, 18 bp, Homo sapiens
gacagtcacctcatggaa

SEQ ID NO: 2757125 - DNA, 16 bp, Homo sapiens
gacatgggacatttgc

SEQ ID NO: 2757126 - DNA, 16 bp, Homo sapiens
gaccagtttatgtttg

SEQ ID NO: 2757127 - DNA, 21 bp, Homo sapiens
gaccagtttatgtttgtggtt

SEQ ID NO: 2757128 - DNA, 18 bp, Homo sapiens
gacgatgtttatgttctt

SEQ ID NO: 2757129 - DNA, 16 bp, Homo sapiens
aagactgcacatcaaa

SEQ ID NO: 2757130 - DNA, 17 bp, Homo sapiens
aagactgcattatattt

SEQ ID NO: 2757131 - DNA, 15 bp, Homo sapiens
aagagaacttccaga

SEQ ID NO: 2757132 - DNA, 18 bp, Homo sapiens
aagagaagggcagggctg

SEQ ID NO: 2757133 - DNA, 19 bp, Homo sapiens
aagagactttgtcacttat

SEQ ID NO: 2757134 - DNA, 20 bp, Homo sapiens
aagagactttgtcacttatt

SEQ ID NO: 2757135 - DNA, 19 bp, Homo sapiens
aagattttttaattgttta

SEQ ID NO: 2757136 - DNA, 16 bp, Homo sapiens
aagcaaaatttttaaa

SEQ ID NO: 2757137 - DNA, 23 bp, Homo sapiens
aagcaaatactgattttcaaaaa

SEQ ID NO: 2757138 - DNA, 15 bp, Homo sapiens
aagcaaatgcattct

SEQ ID NO: 2757139 - DNA, 16 bp, Homo sapiens
aagcaaatgcattcta

SEQ ID NO: 2757140 - DNA, 16 bp, Homo sapiens
aagcaagtattagaat

SEQ ID NO: 2757141 - DNA, 16 bp, Homo sapiens
aagcatttagatgtat

SEQ ID NO: 2757142 - DNA, 13 bp, Homo sapiens
aagctccaggtag

SEQ ID NO: 2757143 - DNA, 20 bp, Homo sapiens
aagctgtggaatgaagcttt

SEQ ID NO: 2757144 - DNA, 17 bp, Homo sapiens
aagctgttaaaatacat

SEQ ID NO: 2757145 - DNA, 17 bp, Homo sapiens
aagcttgtgtatcttga

SEQ ID NO: 2757146 - DNA, 18 bp, Homo sapiens
aagcttgtgtatcttgat

SEQ ID NO: 2757147 - DNA, 12 bp, Homo sapiens
aaggaaaagtaa

SEQ ID NO: 2757148 - DNA, 17 bp, Homo sapiens
aaggaagtcttcaaatt

SEQ ID NO: 2757149 - DNA, 14 bp, Homo sapiens
aaggattttttaaa

SEQ ID NO: 2757150 - DNA, 15 bp, Homo sapiens
aaggattttttaaaa

SEQ ID NO: 2757151 - DNA, 22 bp, Homo sapiens
aaggattttttaaaaattggca

SEQ ID NO: 2757152 - DNA, 13 bp, Homo sapiens
aaggccagccatt

SEQ ID NO: 2757153 - DNA, 15 bp, Homo sapiens
aagggctgttataat

SEQ ID NO: 2757154 - DNA, 17 bp, Homo sapiens
aagggctgttataatct

SEQ ID NO: 2757155 - DNA, 21 bp, Homo sapiens
aagggtatgtcacaaagagct

SEQ ID NO: 2757156 - DNA, 23 bp, Homo sapiens
aagggtatgtcacaaagagctga

SEQ ID NO: 2757157 - DNA, 13 bp, Homo sapiens
aaggtacttcaaa

SEQ ID NO: 2757158 - DNA, 14 bp, Homo sapiens
aaggtcagaatttt

SEQ ID NO: 2757159 - DNA, 20 bp, Homo sapiens
aaggtcccatggcctgctgg

SEQ ID NO: 2757160 - DNA, 18 bp, Homo sapiens
aaggtcttacattgcctg

SEQ ID NO: 2757161 - DNA, 22 bp, Homo sapiens
aaggttaatttttccttcctct

SEQ ID NO: 2757162 - DNA, 14 bp, Homo sapiens
aaggttgctgttgt

SEQ ID NO: 2757163 - DNA, 22 bp, Homo sapiens
aaggtttccactattatagaaa

SEQ ID NO: 2757164 - DNA, 16 bp, Homo sapiens
aagtaaaatatgtcca

SEQ ID NO: 2757165 - DNA, 13 bp, Homo sapiens
aagtaaattctgt

SEQ ID NO: 2757166 - DNA, 18 bp, Homo sapiens
aagtatgttagtgcaaat

SEQ ID NO: 2757167 - DNA, 19 bp, Homo sapiens
aagtatgttagtgcaaatt

SEQ ID NO: 2757168 - DNA, 23 bp, Homo sapiens
aagtatgttagtgcaaattgtca

SEQ ID NO: 2757169 - DNA, 13 bp, Homo sapiens
aagtattagaata

SEQ ID NO: 2757170 - DNA, 21 bp, Homo sapiens
aagtcactggccagtggctgg

SEQ ID NO: 2757171 - DNA, 16 bp, Homo sapiens
aagtcctgaacctttc

SEQ ID NO: 2757172 - DNA, 21 bp, Homo sapiens
aagtcctgaacctttcaaaat

SEQ ID NO: 2757173 - DNA, 17 bp, Homo sapiens
aagtcctgactgggctg

SEQ ID NO: 2757174 - DNA, 13 bp, Homo sapiens
aagtccttcagtt

SEQ ID NO: 2757175 - DNA, 22 bp, Homo sapiens
aagtctatctaatgacatgcct

SEQ ID NO: 2757176 - DNA, 17 bp, Homo sapiens
aagtcttcaaatttgat

SEQ ID NO: 2757177 - DNA, 10 bp, Homo sapiens
aagtgtataa

SEQ ID NO: 2757178 - DNA, 15 bp, Homo sapiens
aagtgtataatgttg

SEQ ID NO: 2757179 - DNA, 17 bp, Homo sapiens
aagtgtataatgttggt

SEQ ID NO: 2757180 - DNA, 17 bp, Homo sapiens
aagtgtcccttgagtga

SEQ ID NO: 2757181 - DNA, 10 bp, Homo sapiens
aagtgtgggt

SEQ ID NO: 2757182 - DNA, 17 bp, Homo sapiens
aagtgtgggtctgtgtg

SEQ ID NO: 2757183 - DNA, 18 bp, Homo sapiens
aagtgtgggtctgtgtgt

SEQ ID NO: 2757184 - DNA, 19 bp, Homo sapiens
aagtgtggtttgcagatga

SEQ ID NO: 2757185 - DNA, 14 bp, Homo sapiens
aagtgtttaaaagc

SEQ ID NO: 2757186 - DNA, 14 bp, Homo sapiens
aagtgtttctgttc

SEQ ID NO: 2757187 - DNA, 15 bp, Homo sapiens
aagttattgctgcat

SEQ ID NO: 2757188 - DNA, 17 bp, Homo sapiens
aagttgtactgcatctt

SEQ ID NO: 2757189 - DNA, 14 bp, Homo sapiens
aagttgtttaataa

SEQ ID NO: 2757190 - DNA, 13 bp, Homo sapiens
aagttttttatat

SEQ ID NO: 2757191 - DNA, 17 bp, Homo sapiens
aataaaaatcaggagcc

SEQ ID NO: 2757192 - DNA, 20 bp, Homo sapiens
aataaaaatcaggagcctgc

SEQ ID NO: 2757193 - DNA, 12 bp, Homo sapiens
aataaaagctat

SEQ ID NO: 2757194 - DNA, 23 bp, Homo sapiens
aataaaagctattacttggcaaa

SEQ ID NO: 2757195 - DNA, 13 bp, Homo sapiens
aataaaagctgtg

SEQ ID NO: 2757196 - DNA, 19 bp, Homo sapiens
aataaaattatttgcaggt

SEQ ID NO: 2757197 - DNA, 14 bp, Homo sapiens
aataaatgttgaaa

SEQ ID NO: 2757198 - DNA, 18 bp, Homo sapiens
aataaatgttttatttct

SEQ ID NO: 2757199 - DNA, 18 bp, Homo sapiens
aataagtatatcttaaga

SEQ ID NO: 2757200 - DNA, 20 bp, Homo sapiens
aataagtatatcttaagaat

SEQ ID NO: 2757201 - DNA, 15 bp, Homo sapiens
aataataattaaaga

SEQ ID NO: 2757202 - DNA, 16 bp, Homo sapiens
aataatttttatattt

SEQ ID NO: 2757203 - DNA, 14 bp, Homo sapiens
aatacaaatctgta

SEQ ID NO: 2757204 - DNA, 20 bp, Homo sapiens
aataccctgtctttaaaaat

SEQ ID NO: 2757205 - DNA, 16 bp, Homo sapiens
aatactgattttcaaa

SEQ ID NO: 2757206 - DNA, 17 bp, Homo sapiens
aatactgattttcaaaa

SEQ ID NO: 2757207 - DNA, 15 bp, Homo sapiens
aatagtatagaaaat

SEQ ID NO: 2757208 - DNA, 14 bp, Homo sapiens
aatagtgtcctatg

SEQ ID NO: 2757209 - DNA, 20 bp, Homo sapiens
aatagtgtcctatgcaataa

SEQ ID NO: 2757210 - DNA, 21 bp, Homo sapiens
aatagtgtcctatgcaataaa

SEQ ID NO: 2757211 - DNA, 19 bp, Homo sapiens
aatatacaagtaaattctg

SEQ ID NO: 2757212 - DNA, 16 bp, Homo sapiens
aatatacacattttgt

SEQ ID NO: 2757213 - DNA, 17 bp, Homo sapiens
aatatacacattttgta

SEQ ID NO: 2757214 - DNA, 16 bp, Homo sapiens
aatatatcctgtttgt

SEQ ID NO: 2757215 - DNA, 13 bp, Homo sapiens
aatatatggcatt

SEQ ID NO: 2757216 - DNA, 17 bp, Homo sapiens
aatatatggcatttgca

SEQ ID NO: 2757217 - DNA, 15 bp, Homo sapiens
aatatcacttgtcaa

SEQ ID NO: 2757218 - DNA, 22 bp, Homo sapiens
aatatcacttgtcaataaaatc

SEQ ID NO: 2757219 - DNA, 21 bp, Homo sapiens
aatatctgaacatttactaca

SEQ ID NO: 2757220 - DNA, 22 bp, Homo sapiens
aatatgaccttaaggaaaagta

SEQ ID NO: 2757221 - DNA, 18 bp, Homo sapiens
aatatgcttctgcctatt

SEQ ID NO: 2757222 - DNA, 20 bp, Homo sapiens
aatattacatgtaaagctgt

SEQ ID NO: 2757223 - DNA, 16 bp, Homo sapiens
aatattggtattaaag

SEQ ID NO: 2757224 - DNA, 22 bp, Homo sapiens
gatacattaggaagctgaatta

SEQ ID NO: 2757225 - DNA, 13 bp, Homo sapiens
gatagatgtgtgg

SEQ ID NO: 2757226 - DNA, 14 bp, Homo sapiens
gatagatgtgtgga

SEQ ID NO: 2757227 - DNA, 18 bp, Homo sapiens
gatataaagaatgaaagt

SEQ ID NO: 2757228 - DNA, 19 bp, Homo sapiens
gatataatacctttctaag

SEQ ID NO: 2757229 - DNA, 14 bp, Homo sapiens
gatcattatcagcc

SEQ ID NO: 2757230 - DNA, 17 bp, Homo sapiens
gatcctcttgccacatc

SEQ ID NO: 2757231 - DNA, 18 bp, Homo sapiens
gatcctcttgccacatct

SEQ ID NO: 2757232 - DNA, 20 bp, Homo sapiens
gatcctcttgccacatcttg

SEQ ID NO: 2757233 - DNA, 14 bp, Homo sapiens
gatctgtagttttt

SEQ ID NO: 2757234 - DNA, 19 bp, Homo sapiens
gatgcaagtgtttctgttc

SEQ ID NO: 2757235 - DNA, 21 bp, Homo sapiens
gatgcaagtgtttctgttctg

SEQ ID NO: 2757236 - DNA, 18 bp, Homo sapiens
gatgcagtgccctagaag

SEQ ID NO: 2757237 - DNA, 20 bp, Homo sapiens
gatggcaaagaaggagagca

SEQ ID NO: 2757238 - DNA, 21 bp, Homo sapiens
gatggccgcagggctgtgcac

SEQ ID NO: 2757239 - DNA, 15 bp, Homo sapiens
gatgggtcagttgta

SEQ ID NO: 2757240 - DNA, 20 bp, Homo sapiens
gatgtctaaaagattcttta

SEQ ID NO: 2757241 - DNA, 14 bp, Homo sapiens
gatgtttatgttct

SEQ ID NO: 2757242 - DNA, 19 bp, Homo sapiens
gatgtttatttagaaactg

SEQ ID NO: 2757243 - DNA, 19 bp, Homo sapiens
gattaatgtactttttatt

SEQ ID NO: 2757244 - DNA, 22 bp, Homo sapiens
gattaatgtactttttattgca

SEQ ID NO: 2757245 - DNA, 17 bp, Homo sapiens
gattagggtagtaatta

SEQ ID NO: 2757246 - DNA, 13 bp, Homo sapiens
gattgtattgctg

SEQ ID NO: 2757247 - DNA, 13 bp, Homo sapiens
gatttaaaaagtg

SEQ ID NO: 2757248 - DNA, 15 bp, Homo sapiens
gatttaccacttgtg

SEQ ID NO: 2757249 - DNA, 16 bp, Homo sapiens
gatttaccacttgtgt

SEQ ID NO: 2757250 - DNA, 19 bp, Homo sapiens
gatttcacagttggcactt

SEQ ID NO: 2757251 - DNA, 22 bp, Homo sapiens
gatttcacagttggcacttctg

SEQ ID NO: 2757252 - DNA, 18 bp, Homo sapiens
gatttcctttatactgtg

SEQ ID NO: 2757253 - DNA, 18 bp, Homo sapiens
gatttctccagaaattta

SEQ ID NO: 2757254 - DNA, 18 bp, Homo sapiens
gatttttaaattggagaa

SEQ ID NO: 2757255 - DNA, 20 bp, Homo sapiens
gatttttatattagttgctt

SEQ ID NO: 2757256 - DNA, 22 bp, Homo sapiens
gatttttatattagttgctttg

SEQ ID NO: 2757257 - DNA, 18 bp, Homo sapiens
gattttttaattgtttaa

SEQ ID NO: 2757258 - DNA, 17 bp, Homo sapiens
gcaaaacagattcaaag

SEQ ID NO: 2757259 - DNA, 21 bp, Homo sapiens
gcaaaatattggtattaaaga

SEQ ID NO: 2757260 - DNA, 14 bp, Homo sapiens
gcaaaatttttaaa

SEQ ID NO: 2757261 - DNA, 21 bp, Homo sapiens
gcaaacctagccggaaggccg

SEQ ID NO: 2757262 - DNA, 22 bp, Homo sapiens
gcaaacgggcttgactttggct

SEQ ID NO: 2757263 - DNA, 15 bp, Homo sapiens
gcaaatgcattctat

SEQ ID NO: 2757264 - DNA, 11 bp, Homo sapiens
gcaaattctga

SEQ ID NO: 2757265 - DNA, 16 bp, Homo sapiens
gcaaattgtcacagga

SEQ ID NO: 2757266 - DNA, 22 bp, Homo sapiens
gcaacataataagacttttctc

SEQ ID NO: 2757267 - DNA, 16 bp, Homo sapiens
gcaacttttttatgtc

SEQ ID NO: 2757268 - DNA, 20 bp, Homo sapiens
gcaagaatggtggcttcttt

SEQ ID NO: 2757269 - DNA, 20 bp, Homo sapiens
gcaaggattttttaaaaatt

SEQ ID NO: 2757270 - DNA, 15 bp, Homo sapiens
gcaagtgtttctgtt

SEQ ID NO: 2757271 - DNA, 16 bp, Homo sapiens
gcaataaaattatttg

SEQ ID NO: 2757272 - DNA, 18 bp, Homo sapiens
gcaataaaattatttgca

SEQ ID NO: 2757273 - DNA, 20 bp, Homo sapiens
gcacagcctcttagatgcag

SEQ ID NO: 2757274 - DNA, 20 bp, Homo sapiens
gcacatccaccaaactcctg

SEQ ID NO: 2757275 - DNA, 14 bp, Homo sapiens
gcacctgtgctgga

SEQ ID NO: 2757276 - DNA, 18 bp, Homo sapiens
gcacgcgccctttctacc

SEQ ID NO: 2757277 - DNA, 18 bp, Homo sapiens
gcactcatgacggcctgc

SEQ ID NO: 2757278 - DNA, 21 bp, Homo sapiens
gcactcatgacggcctgcctg

SEQ ID NO: 2757279 - DNA, 19 bp, Homo sapiens
gcactgtgggtagacacac

SEQ ID NO: 2757280 - DNA, 14 bp, Homo sapiens
gcacttaaagtttt

SEQ ID NO: 2757281 - DNA, 21 bp, Homo sapiens
gcacttctgccatgagcagag

SEQ ID NO: 2757282 - DNA, 21 bp, Homo sapiens
gcactttgggaggcaaaggcg

SEQ ID NO: 2757283 - DNA, 13 bp, Homo sapiens
gcagaaaaagaaa

SEQ ID NO: 2757284 - DNA, 23 bp, Homo sapiens
gcagatttttatattagttgctt

SEQ ID NO: 2757285 - DNA, 14 bp, Homo sapiens
gcaggacactgcag

SEQ ID NO: 2757286 - DNA, 16 bp, Homo sapiens
gcagggctggtttgtt

SEQ ID NO: 2757287 - DNA, 14 bp, Homo sapiens
gcaggtctttaaat

SEQ ID NO: 2757288 - DNA, 22 bp, Homo sapiens
gcaggttggcaaacgggcttga

SEQ ID NO: 2757289 - DNA, 17 bp, Homo sapiens
gcagtacaataaaagta

SEQ ID NO: 2757290 - DNA, 17 bp, Homo sapiens
gcagtgccctagaaggg

SEQ ID NO: 2757291 - DNA, 18 bp, Homo sapiens
gcagtgccctagaagggg

SEQ ID NO: 2757292 - DNA, 14 bp, Homo sapiens
gcagttctgaagaa

SEQ ID NO: 2757293 - DNA, 15 bp, Homo sapiens
gcagttctgaagaag

SEQ ID NO: 2757294 - DNA, 17 bp, Homo sapiens
gcagttctgaagaagat

SEQ ID NO: 2757295 - DNA, 17 bp, Homo sapiens
gcataaatttgtaatat

SEQ ID NO: 2757296 - DNA, 20 bp, Homo sapiens
gcataaatttgtaatatatc

SEQ ID NO: 2757297 - DNA, 21 bp, Homo sapiens
gcatctttcatagttctgtta

SEQ ID NO: 2757298 - DNA, 22 bp, Homo sapiens
gcatggtgtgaactaagttatt

SEQ ID NO: 2757299 - DNA, 13 bp, Homo sapiens
gcattatatttat

SEQ ID NO: 2757300 - DNA, 13 bp, Homo sapiens
gctggagccctgt

SEQ ID NO: 2757301 - DNA, 14 bp, Homo sapiens
gctggggatgtctc

SEQ ID NO: 2757302 - DNA, 20 bp, Homo sapiens
gctgggtttgctgtcttggg

SEQ ID NO: 2757303 - DNA, 12 bp, Homo sapiens
gctggtcccctc

SEQ ID NO: 2757304 - DNA, 14 bp, Homo sapiens
gctggtttgttctg

SEQ ID NO: 2757305 - DNA, 12 bp, Homo sapiens
gctgtattttaa

SEQ ID NO: 2757306 - DNA, 13 bp, Homo sapiens
gctgtattttaaa

SEQ ID NO: 2757307 - DNA, 21 bp, Homo sapiens
gctgtattttaaaagaatgat

SEQ ID NO: 2757308 - DNA, 18 bp, Homo sapiens
gctgtcttggggtcccac

SEQ ID NO: 2757309 - DNA, 21 bp, Homo sapiens
gctgtgcacccagaagaagat

SEQ ID NO: 2757310 - DNA, 22 bp, Homo sapiens
gcttcatgttcccaaaatcacc

SEQ ID NO: 2757311 - DNA, 19 bp, Homo sapiens
gcttcctggcaatagtcaa

SEQ ID NO: 2757312 - DNA, 14 bp, Homo sapiens
gcttctattcatta

SEQ ID NO: 2757313 - DNA, 21 bp, Homo sapiens
gcttcttcttgtggagatttt

SEQ ID NO: 2757314 - DNA, 17 bp, Homo sapiens
gcttcttttctttgtat

SEQ ID NO: 2757315 - DNA, 20 bp, Homo sapiens
gcttcttttctttgtatcat

SEQ ID NO: 2757316 - DNA, 20 bp, Homo sapiens
gcttctttttcaaaactagt

SEQ ID NO: 2757317 - DNA, 12 bp, Homo sapiens
gcttggtgctgg

SEQ ID NO: 2757318 - DNA, 14 bp, Homo sapiens
gctttaaaaagaaa

SEQ ID NO: 2757319 - DNA, 15 bp, Homo sapiens
gctttaaaaagaaaa

SEQ ID NO: 2757320 - DNA, 14 bp, Homo sapiens
gctttattgaagtc

SEQ ID NO: 2757321 - DNA, 13 bp, Homo sapiens
gctttcagctgtg

SEQ ID NO: 2757322 - DNA, 23 bp, Homo sapiens
gctttgttaaaaaaaaaaagatt

SEQ ID NO: 2757323 - DNA, 21 bp, Homo sapiens
ggaaaattaattctaaactta

SEQ ID NO: 2757324 - DNA, 12 bp, Homo sapiens
ggaaatatttat

SEQ ID NO: 2757325 - DNA, 13 bp, Homo sapiens
ggaaatatttatt

SEQ ID NO: 2757326 - DNA, 17 bp, Homo sapiens
ggaaatatttattttaa

SEQ ID NO: 2757327 - DNA, 18 bp, Homo sapiens
ggaaatatttattttaat

SEQ ID NO: 2757328 - DNA, 18 bp, Homo sapiens
ggaaatgttgtgggggtg

SEQ ID NO: 2757329 - DNA, 14 bp, Homo sapiens
ggaaatgttttaat

SEQ ID NO: 2757330 - DNA, 15 bp, Homo sapiens
ggaacaatgccgcct

SEQ ID NO: 2757331 - DNA, 13 bp, Homo sapiens
ggaacagtgacaa

SEQ ID NO: 2757332 - DNA, 11 bp, Homo sapiens
ggaaggtccca

SEQ ID NO: 2757333 - DNA, 17 bp, Homo sapiens
ggaaggtcccatggcct

SEQ ID NO: 2757334 - DNA, 12 bp, Homo sapiens
ggaagtgtgggt

SEQ ID NO: 2757335 - DNA, 22 bp, Homo sapiens
ggaagtgtgggtctgtgtgtgt

SEQ ID NO: 2757336 - DNA, 20 bp, Homo sapiens
ggaataaactagagaaggga

SEQ ID NO: 2757337 - DNA, 13 bp, Homo sapiens
ggaataaattttt

SEQ ID NO: 2757338 - DNA, 16 bp, Homo sapiens
ggaattggagctcgtg

SEQ ID NO: 2757339 - DNA, 13 bp, Homo sapiens
ggaattgttttta

SEQ ID NO: 2757340 - DNA, 18 bp, Homo sapiens
ggacagtcacctcatgga

SEQ ID NO: 2757341 - DNA, 11 bp, Homo sapiens
ggagaagaact

SEQ ID NO: 2757342 - DNA, 14 bp, Homo sapiens
ggagaagaactgaa

SEQ ID NO: 2757343 - DNA, 19 bp, Homo sapiens
ggagccttccaccggcact

SEQ ID NO: 2757344 - DNA, 21 bp, Homo sapiens
ggagccttccaccggcactca

SEQ ID NO: 2757345 - DNA, 14 bp, Homo sapiens
ggaggaaggtccca

SEQ ID NO: 2757346 - DNA, 20 bp, Homo sapiens
ggagtgaagcatttaaaaga

SEQ ID NO: 2757347 - DNA, 21 bp, Homo sapiens
ggataaatttaaaacacagta

SEQ ID NO: 2757348 - DNA, 15 bp, Homo sapiens
ggataactaaaattc

SEQ ID NO: 2757349 - DNA, 16 bp, Homo sapiens
ggatataatctgaatc

SEQ ID NO: 2757350 - DNA, 15 bp, Homo sapiens
ggcaaacgggcttga

SEQ ID NO: 2757351 - DNA, 17 bp, Homo sapiens
ggcaacataataagact

SEQ ID NO: 2757352 - DNA, 17 bp, Homo sapiens
ggcaatatctacagctt

SEQ ID NO: 2757353 - DNA, 23 bp, Homo sapiens
ggcactcatgacggcctgcctgc

SEQ ID NO: 2757354 - DNA, 12 bp, Homo sapiens
ggcatagtggca

SEQ ID NO: 2757355 - DNA, 14 bp, Homo sapiens
ggcatagtggcact

SEQ ID NO: 2757356 - DNA, 13 bp, Homo sapiens
ggcatgtctgcct

SEQ ID NO: 2757357 - DNA, 16 bp, Homo sapiens
ggcatgtctgcctgga

SEQ ID NO: 2757358 - DNA, 22 bp, Homo sapiens
ggcattttaagtgtttaaaagc

SEQ ID NO: 2757359 - DNA, 13 bp, Homo sapiens
ggccaagagaagg

SEQ ID NO: 2757360 - DNA, 19 bp, Homo sapiens
ggccagtggctggatctgt

SEQ ID NO: 2757361 - DNA, 23 bp, Homo sapiens
ggccccgcccgagcccctgccca

SEQ ID NO: 2757362 - DNA, 15 bp, Homo sapiens
ggccgagctggtttc

SEQ ID NO: 2757363 - DNA, 13 bp, Homo sapiens
ggcctaatttttt

SEQ ID NO: 2757364 - DNA, 14 bp, Homo sapiens
ggcctgaggtcaat

SEQ ID NO: 2757365 - DNA, 15 bp, Homo sapiens
ggcctgctgggcttg

SEQ ID NO: 2757366 - DNA, 19 bp, Homo sapiens
ggcctgctgggcttggctc

SEQ ID NO: 2757367 - DNA, 14 bp, Homo sapiens
ggccttcataatgg

SEQ ID NO: 2757368 - DNA, 19 bp, Homo sapiens
ggcgcccccacccctggct

SEQ ID NO: 2757369 - DNA, 21 bp, Homo sapiens
ggcgctgaggtgtctggcctg

SEQ ID NO: 2757370 - DNA, 19 bp, Homo sapiens
ggctaccttgtgggaataa

SEQ ID NO: 2757371 - DNA, 19 bp, Homo sapiens
gtgctagagttaaaagtta

SEQ ID NO: 2757372 - DNA, 20 bp, Homo sapiens
gtggaagtgtgggtctgtgt

SEQ ID NO: 2757373 - DNA, 22 bp, Homo sapiens
gtggactacaggacaaggggca

SEQ ID NO: 2757374 - DNA, 17 bp, Homo sapiens
gtggagttttcatgaca

SEQ ID NO: 2757375 - DNA, 17 bp, Homo sapiens
gtggcaggacactgcag

SEQ ID NO: 2757376 - DNA, 21 bp, Homo sapiens
gtgggacagtcacctcatgga

SEQ ID NO: 2757377 - DNA, 13 bp, Homo sapiens
gtgggagtgtgta

SEQ ID NO: 2757378 - DNA, 15 bp, Homo sapiens
gtgggggtctgtgtg

SEQ ID NO: 2757379 - DNA, 16 bp, Homo sapiens
gtgggggtctgtgtgt

SEQ ID NO: 2757380 - DNA, 14 bp, Homo sapiens
gtgggtagacacac

SEQ ID NO: 2757381 - DNA, 14 bp, Homo sapiens
gtgtataatgttgg

SEQ ID NO: 2757382 - DNA, 16 bp, Homo sapiens
gtgtataatgttggtg

SEQ ID NO: 2757383 - DNA, 13 bp, Homo sapiens
gtgtatgtggggg

SEQ ID NO: 2757384 - DNA, 15 bp, Homo sapiens
gtgtctggcctgagg

SEQ ID NO: 2757385 - DNA, 16 bp, Homo sapiens
gtgtgaactaagttat

SEQ ID NO: 2757386 - DNA, 17 bp, Homo sapiens
gtgtggactacaggaca

SEQ ID NO: 2757387 - DNA, 19 bp, Homo sapiens
gtgtggccccgcccgagcc

SEQ ID NO: 2757388 - DNA, 14 bp, Homo sapiens
gtgtgggtctgtgt

SEQ ID NO: 2757389 - DNA, 12 bp, Homo sapiens
gtgtgtatgtgg

SEQ ID NO: 2757390 - DNA, 16 bp, Homo sapiens
gtgtgtgggagtgtgt

SEQ ID NO: 2757391 - DNA, 14 bp, Homo sapiens
gtgtgtgtatgtgg

SEQ ID NO: 2757392 - DNA, 14 bp, Homo sapiens
gtgtgttgtgtgtg

SEQ ID NO: 2757393 - DNA, 17 bp, Homo sapiens
gttaaattttctctaaa

SEQ ID NO: 2757394 - DNA, 17 bp, Homo sapiens
gttacatgcataaaagg

SEQ ID NO: 2757395 - DNA, 23 bp, Homo sapiens
gttacctctgcctcagaaaacaa

SEQ ID NO: 2757396 - DNA, 20 bp, Homo sapiens
gttagttttggttatttcta

SEQ ID NO: 2757397 - DNA, 16 bp, Homo sapiens
gttattataaatgtta

SEQ ID NO: 2757398 - DNA, 17 bp, Homo sapiens
gttattgctgcataaat

SEQ ID NO: 2757399 - DNA, 18 bp, Homo sapiens
gttcccttgatgaagaag

SEQ ID NO: 2757400 - DNA, 12 bp, Homo sapiens
gttctgaagaag

SEQ ID NO: 2757401 - DNA, 14 bp, Homo sapiens
gttctgaagaagat

SEQ ID NO: 2757402 - DNA, 15 bp, Homo sapiens
gttcttatagaataa

SEQ ID NO: 2757403 - DNA, 16 bp, Homo sapiens
gttcttatagaataaa

SEQ ID NO: 2757404 - DNA, 13 bp, Homo sapiens
gttgaaagtaaaa

SEQ ID NO: 2757405 - DNA, 11 bp, Homo sapiens
gttgctttgtt

SEQ ID NO: 2757406 - DNA, 14 bp, Homo sapiens
gttgggagaatgtc

SEQ ID NO: 2757407 - DNA, 17 bp, Homo sapiens
gttgggggtattttcta

SEQ ID NO: 2757408 - DNA, 14 bp, Homo sapiens
gttgtgcagtgtgc

SEQ ID NO: 2757409 - DNA, 13 bp, Homo sapiens
gttgtgtgtggga

SEQ ID NO: 2757410 - DNA, 14 bp, Homo sapiens
gttgtgtgtgggag

SEQ ID NO: 2757411 - DNA, 20 bp, Homo sapiens
gtttaaaaaccgaataaatg

SEQ ID NO: 2757412 - DNA, 15 bp, Homo sapiens
gtttaaaagcaaata

SEQ ID NO: 2757413 - DNA, 21 bp, Homo sapiens
gtttagctggaaaagtatgtt

SEQ ID NO: 2757414 - DNA, 20 bp, Homo sapiens
gtttatggaaataccaggac

SEQ ID NO: 2757415 - DNA, 13 bp, Homo sapiens
gtttatgtgtgtg

SEQ ID NO: 2757416 - DNA, 21 bp, Homo sapiens
gtttatgttcttatagaataa

SEQ ID NO: 2757417 - DNA, 14 bp, Homo sapiens
gtttatttagaaac

SEQ ID NO: 2757418 - DNA, 14 bp, Homo sapiens
gtttcttcatgcat

SEQ ID NO: 2757419 - DNA, 16 bp, Homo sapiens
gtttcttcatgcatta

SEQ ID NO: 2757420 - DNA, 16 bp, Homo sapiens
gtttctttgtgtttgc

SEQ ID NO: 2757421 - DNA, 23 bp, Homo sapiens
gtttgactctgtccaactctgta

SEQ ID NO: 2757422 - DNA, 17 bp, Homo sapiens
gtttgtttttgctttct

SEQ ID NO: 2757423 - DNA, 17 bp, Homo sapiens
gttttaagcaaatgcat

SEQ ID NO: 2757424 - DNA, 22 bp, Homo sapiens
gttttaagcaaatgcattctat

SEQ ID NO: 2757425 - DNA, 21 bp, Homo sapiens
gttttaaggattctgcagaaa

SEQ ID NO: 2757426 - DNA, 12 bp, Homo sapiens
gttttgaatatt

SEQ ID NO: 2757427 - DNA, 15 bp, Homo sapiens
gttttggttatttct

SEQ ID NO: 2757428 - DNA, 17 bp, Homo sapiens
gtttttataaaaacatt

SEQ ID NO: 2757429 - DNA, 23 bp, Homo sapiens
gtttttgctttctgaaattcaca

SEQ ID NO: 2757430 - DNA, 16 bp, Homo sapiens
gttttttatatatgaa

SEQ ID NO: 2757431 - DNA, 21 bp, Homo sapiens
gttttttatatatgaatatta

SEQ ID NO: 2757432 - DNA, 22 bp, Homo sapiens
gttttttatatatgaatattac

SEQ ID NO: 2757433 - DNA, 21 bp, Homo sapiens
gtttttttggtgctataacat

SEQ ID NO: 2757434 - DNA, 22 bp, Homo sapiens
taaaaacaaaaacatcccaaga

SEQ ID NO: 2757435 - DNA, 18 bp, Homo sapiens
taaaaacattgaaatatt

SEQ ID NO: 2757436 - DNA, 18 bp, Homo sapiens
taaaaacctattttgaaa

SEQ ID NO: 2757437 - DNA, 17 bp, Homo sapiens
taaaaataaactgttat

SEQ ID NO: 2757438 - DNA, 16 bp, Homo sapiens
taaaaatcaggagcct

SEQ ID NO: 2757439 - DNA, 19 bp, Homo sapiens
taaaaattggcattttaag

SEQ ID NO: 2757440 - DNA, 20 bp, Homo sapiens
taaaacacagtattgtagaa

SEQ ID NO: 2757441 - DNA, 22 bp, Homo sapiens
taaaacacagtattgtagaaag

SEQ ID NO: 2757442 - DNA, 15 bp, Homo sapiens
taaaactgtaccttt

SEQ ID NO: 2757443 - DNA, 13 bp, Homo sapiens
taaaagattcttt

SEQ ID NO: 2757444 - DNA, 14 bp, Homo sapiens
taaaagattcttta

SEQ ID NO: 2757445 - DNA, 23 bp, Homo sapiens
taaaagcaaatactgattttcaa

SEQ ID NO: 2757446 - DNA, 19 bp, Homo sapiens
taaaagggtcaaacctgta

SEQ ID NO: 2757447 - DNA, 17 bp, Homo sapiens
taaaagttgtactgcat

SEQ ID NO: 2757448 - DNA, 22 bp, Homo sapiens
taaaataatttttatatttgaa

SEQ ID NO: 2757449 - DNA, 20 bp, Homo sapiens
taaaatatgtccagaagagt

SEQ ID NO: 2757450 - DNA, 16 bp, Homo sapiens
taaaatgcaatatttg

SEQ ID NO: 2757451 - DNA, 17 bp, Homo sapiens
taaaatgtagaaattct

SEQ ID NO: 2757452 - DNA, 18 bp, Homo sapiens
taaaattttcattctgaa

SEQ ID NO: 2757453 - DNA, 19 bp, Homo sapiens
taaaattttcattctgaat

SEQ ID NO: 2757454 - DNA, 23 bp, Homo sapiens
taaaattttcattctgaatctga

SEQ ID NO: 2757455 - DNA, 17 bp, Homo sapiens
taaacccagcaaaacag

SEQ ID NO: 2757456 - DNA, 11 bp, Homo sapiens
taaactactga

SEQ ID NO: 2757457 - DNA, 14 bp, Homo sapiens
taaactactgaact

SEQ ID NO: 2757458 - DNA, 16 bp, Homo sapiens
taaactagagaaggga

SEQ ID NO: 2757459 - DNA, 18 bp, Homo sapiens
taaactgttatgagtagt

SEQ ID NO: 2757460 - DNA, 15 bp, Homo sapiens
taaagaatgctgcaa

SEQ ID NO: 2757461 - DNA, 16 bp, Homo sapiens
taaagagctacttcta

SEQ ID NO: 2757462 - DNA, 14 bp, Homo sapiens
taaagctgttaaaa

SEQ ID NO: 2757463 - DNA, 21 bp, Homo sapiens
taaagctgttaaaatacataa

SEQ ID NO: 2757464 - DNA, 14 bp, Homo sapiens
taaagtaaaatatg

SEQ ID NO: 2757465 - DNA, 18 bp, Homo sapiens
taaagtaaaatatgtcca

SEQ ID NO: 2757466 - DNA, 15 bp, Homo sapiens
taaagtcctgaacct

SEQ ID NO: 2757467 - DNA, 16 bp, Homo sapiens
taaagttttttatata

SEQ ID NO: 2757468 - DNA, 20 bp, Homo sapiens
taaagttttttatatatgaa

SEQ ID NO: 2757469 - DNA, 15 bp, Homo sapiens
taaatacaaatctgt

SEQ ID NO: 2757470 - DNA, 16 bp, Homo sapiens
taaatacaaatctgta

SEQ ID NO: 2757471 - DNA, 18 bp, Homo sapiens
taaatagatttagtctgt

SEQ ID NO: 2757472 - DNA, 21 bp, Homo sapiens
taaatatctgaacatttacta

SEQ ID NO: 2757473 - DNA, 18 bp, Homo sapiens
taaatcacactcaaactt

SEQ ID NO: 2757474 - DNA, 13 bp, Homo sapiens
taaatcagaataa

SEQ ID NO: 2757475 - DNA, 12 bp, Homo sapiens
taaatcatttta

SEQ ID NO: 2757476 - DNA, 12 bp, Homo sapiens
taaatctgtact

SEQ ID NO: 2757477 - DNA, 19 bp, Homo sapiens
taaatgagacccctttaaa

SEQ ID NO: 2757478 - DNA, 23 bp, Homo sapiens
taaatgatatctatattctaaag

SEQ ID NO: 2757479 - DNA, 14 bp, Homo sapiens
taaatgttgaaaag

SEQ ID NO: 2757480 - DNA, 18 bp, Homo sapiens
taaattggagaaaagcac

SEQ ID NO: 2757481 - DNA, 13 bp, Homo sapiens
taaatttaaaaca

SEQ ID NO: 2757482 - DNA, 13 bp, Homo sapiens
taaatttgtaata

SEQ ID NO: 2757483 - DNA, 15 bp, Homo sapiens
taaatttgtaatata

SEQ ID NO: 2757484 - DNA, 20 bp, Homo sapiens
taaattttctctaaactgtt

SEQ ID NO: 2757485 - DNA, 17 bp, Homo sapiens
taacaaattttaagtgc

SEQ ID NO: 2757486 - DNA, 17 bp, Homo sapiens
taacaacaataataatt

SEQ ID NO: 2757487 - DNA, 16 bp, Homo sapiens
taacaaccctgttgag

SEQ ID NO: 2757488 - DNA, 17 bp, Homo sapiens
taaccaggggccatgaa

SEQ ID NO: 2757489 - DNA, 13 bp, Homo sapiens
taactcaggcatt

SEQ ID NO: 2757490 - DNA, 19 bp, Homo sapiens
aaaaaagattgtattgctg

SEQ ID NO: 2757491 - DNA, 16 bp, Homo sapiens
aaaaaatgtttttaaa

SEQ ID NO: 2757492 - DNA, 17 bp, Homo sapiens
aatttccatatccttct

SEQ ID NO: 2757493 - DNA, 19 bp, Homo sapiens
aatttgtaatatatcctgt

SEQ ID NO: 2757494 - DNA, 13 bp, Homo sapiens
aattttggtaaat

SEQ ID NO: 2757495 - DNA, 13 bp, Homo sapiens
aattttgtgaagc

SEQ ID NO: 2757496 - DNA, 17 bp, Homo sapiens
aattttgtgaagcaaaa

SEQ ID NO: 2757497 - DNA, 17 bp, Homo sapiens
aatttttaaaactgcat

SEQ ID NO: 2757498 - DNA, 14 bp, Homo sapiens
aatttttccttcct

SEQ ID NO: 2757499 - DNA, 14 bp, Homo sapiens
aattttttaaagaa

SEQ ID NO: 2757500 - DNA, 19 bp, Homo sapiens
aattttttaaagaatccaa

SEQ ID NO: 2757501 - DNA, 21 bp, Homo sapiens
acaaaaaaatacctcaggaaa

SEQ ID NO: 2757502 - DNA, 23 bp, Homo sapiens
acaaaaaaatacctcaggaaaga

SEQ ID NO: 2757503 - DNA, 23 bp, Homo sapiens
acaaaactatcctatgccttcaa

SEQ ID NO: 2757504 - DNA, 19 bp, Homo sapiens
acaaaagcaaaatttttaa

SEQ ID NO: 2757505 - DNA, 23 bp, Homo sapiens
acaaaagcaaaatttttaaaact

SEQ ID NO: 2757506 - DNA, 21 bp, Homo sapiens
acaaacatttcacttctccaa

SEQ ID NO: 2757507 - DNA, 13 bp, Homo sapiens
acaaactaaactt

SEQ ID NO: 2757508 - DNA, 14 bp, Homo sapiens
acaaactaaacttt

SEQ ID NO: 2757509 - DNA, 20 bp, Homo sapiens
acaaagagctgacagtgctt

SEQ ID NO: 2757510 - DNA, 23 bp, Homo sapiens
acaaatctgtataaatgtctatt

SEQ ID NO: 2757511 - DNA, 23 bp, Homo sapiens
acaaccctgttgagtatttgctg

SEQ ID NO: 2757512 - DNA, 14 bp, Homo sapiens
acaagactgcacat

SEQ ID NO: 2757513 - DNA, 20 bp, Homo sapiens
acaagcacaccacaattctc

SEQ ID NO: 2757514 - DNA, 21 bp, Homo sapiens
acaaggatgaattaagttttt

SEQ ID NO: 2757515 - DNA, 20 bp, Homo sapiens
acaagtgtgtggccccgccc

SEQ ID NO: 2757516 - DNA, 14 bp, Homo sapiens
acaataataattaa

SEQ ID NO: 2757517 - DNA, 23 bp, Homo sapiens
acaatatatagctggcaagaatg

SEQ ID NO: 2757518 - DNA, 19 bp, Homo sapiens
acaattctccctatcttgt

SEQ ID NO: 2757519 - DNA, 14 bp, Homo sapiens
acacaactatattg

SEQ ID NO: 2757520 - DNA, 15 bp, Homo sapiens
acacatgaagtccaa

SEQ ID NO: 2757521 - DNA, 13 bp, Homo sapiens
acacattttgtaa

SEQ ID NO: 2757522 - DNA, 21 bp, Homo sapiens
acacattttgtaaatctgtac

SEQ ID NO: 2757523 - DNA, 18 bp, Homo sapiens
acaccacaattctcccta

SEQ ID NO: 2757524 - DNA, 14 bp, Homo sapiens
acacctcagaaatt

SEQ ID NO: 2757525 - DNA, 17 bp, Homo sapiens
acactaagagagaatga

SEQ ID NO: 2757526 - DNA, 14 bp, Homo sapiens
acactcaaactttg

SEQ ID NO: 2757527 - DNA, 13 bp, Homo sapiens
acagaatatacac

SEQ ID NO: 2757528 - DNA, 14 bp, Homo sapiens
acagaatatacaca

SEQ ID NO: 2757529 - DNA, 19 bp, Homo sapiens
acagaatatacacattttg

SEQ ID NO: 2757530 - DNA, 21 bp, Homo sapiens
acagcccttctttccacagaa

SEQ ID NO: 2757531 - DNA, 16 bp, Homo sapiens
acagcctcttagatgc

SEQ ID NO: 2757532 - DNA, 20 bp, Homo sapiens
acagctgtatgattcccagc

SEQ ID NO: 2757533 - DNA, 23 bp, Homo sapiens
acagctgtatgattcccagccag

SEQ ID NO: 2757534 - DNA, 17 bp, Homo sapiens
acagcttctattcatta

SEQ ID NO: 2757535 - DNA, 24 bp, Homo sapiens
acaggatggttcccttgatgaaga

SEQ ID NO: 2757536 - DNA, 17 bp, Homo sapiens
acaggcccctgggtttc

SEQ ID NO: 2757537 - DNA, 15 bp, Homo sapiens
acagtatggcaatat

SEQ ID NO: 2757538 - DNA, 15 bp, Homo sapiens
acagtattgtagaaa

SEQ ID NO: 2757539 - DNA, 13 bp, Homo sapiens
acataacttcagt

SEQ ID NO: 2757540 - DNA, 16 bp, Homo sapiens
acataacttcagtgca

SEQ ID NO: 2757541 - DNA, 16 bp, Homo sapiens
acataagcttctcaat

SEQ ID NO: 2757542 - DNA, 19 bp, Homo sapiens
acatatataacaatgctgt

SEQ ID NO: 2757543 - DNA, 15 bp, Homo sapiens
acatattttttatat

SEQ ID NO: 2757544 - DNA, 21 bp, Homo sapiens
acatattttttatatctggaa

SEQ ID NO: 2757545 - DNA, 22 bp, Homo sapiens
acatattttttatatctggaat

SEQ ID NO: 2757546 - DNA, 19 bp, Homo sapiens
acatccaccaaactcctgc

SEQ ID NO: 2757547 - DNA, 19 bp, Homo sapiens
acatcttgaaaatgccacc

SEQ ID NO: 2757548 - DNA, 20 bp, Homo sapiens
acatgaataaaaataaagtt

SEQ ID NO: 2757549 - DNA, 11 bp, Homo sapiens
acatgggacat

SEQ ID NO: 2757550 - DNA, 13 bp, Homo sapiens
acatgtaaagctg

SEQ ID NO: 2757551 - DNA, 21 bp, Homo sapiens
acatgtaaagctgttaaaata

SEQ ID NO: 2757552 - DNA, 20 bp, Homo sapiens
acattcagctgaggttcatt

SEQ ID NO: 2757553 - DNA, 16 bp, Homo sapiens
acattgattggataaa

SEQ ID NO: 2757554 - DNA, 20 bp, Homo sapiens
acattgattggataaatgct

SEQ ID NO: 2757555 - DNA, 17 bp, Homo sapiens
acattgtgacaaacagc

SEQ ID NO: 2757556 - DNA, 16 bp, Homo sapiens
acattgtttggatttc

SEQ ID NO: 2757557 - DNA, 21 bp, Homo sapiens
acatttactacagtttttaac

SEQ ID NO: 2757558 - DNA, 17 bp, Homo sapiens
acatttcatctaattta

SEQ ID NO: 2757559 - DNA, 14 bp, Homo sapiens
acatttggaacagt

SEQ ID NO: 2757560 - DNA, 18 bp, Homo sapiens
acatttggaacagtgaca

SEQ ID NO: 2757561 - DNA, 23 bp, Homo sapiens
acatttggaacagtgacaataaa

SEQ ID NO: 2757562 - DNA, 16 bp, Homo sapiens
acatttgtataaaata

SEQ ID NO: 2757563 - DNA, 17 bp, Homo sapiens
acattttgtaaatctgt

SEQ ID NO: 2757564 - DNA, 21 bp, Homo sapiens
acattttgtaaatctgtactt

SEQ ID NO: 2757565 - DNA, 23 bp, Homo sapiens
accaaaaatctcaatatttcaga

SEQ ID NO: 2757566 - DNA, 18 bp, Homo sapiens
accacaaaaaaatacctc

SEQ ID NO: 2757567 - DNA, 17 bp, Homo sapiens
accacaaaagcaaaatt

SEQ ID NO: 2757568 - DNA, 20 bp, Homo sapiens
accacaaaagcaaaattttt

SEQ ID NO: 2757569 - DNA, 22 bp, Homo sapiens
accacaggaattttaaaaacaa

SEQ ID NO: 2757570 - DNA, 18 bp, Homo sapiens
accacttgtgttttgcaa

SEQ ID NO: 2757571 - DNA, 19 bp, Homo sapiens
accacttgtgttttgcaag

SEQ ID NO: 2757572 - DNA, 14 bp, Homo sapiens
accagacttcaaga

SEQ ID NO: 2757573 - DNA, 12 bp, Homo sapiens
accagtttatgt

SEQ ID NO: 2757574 - DNA, 19 bp, Homo sapiens
accccaagagtttcttctc

SEQ ID NO: 2757575 - DNA, 19 bp, Homo sapiens
accctgttgagtatttgct

SEQ ID NO: 2757576 - DNA, 20 bp, Homo sapiens
accctgttgagtatttgctg

SEQ ID NO: 2757577 - DNA, 15 bp, Homo sapiens
accggcactcatgac

SEQ ID NO: 2757578 - DNA, 15 bp, Homo sapiens
acctattttgaaagg

SEQ ID NO: 2757579 - DNA, 12 bp, Homo sapiens
acctcaggaaag

SEQ ID NO: 2757580 - DNA, 16 bp, Homo sapiens
acctcaggaaagaata

SEQ ID NO: 2757581 - DNA, 23 bp, Homo sapiens
acctcaggaaagaatagaaagaa

SEQ ID NO: 2757582 - DNA, 17 bp, Homo sapiens
acctctcattagaaagg

SEQ ID NO: 2757583 - DNA, 17 bp, Homo sapiens
acctgtagatgcagaaa

SEQ ID NO: 2757584 - DNA, 20 bp, Homo sapiens
acctgtagatgcagaaaaag

SEQ ID NO: 2757585 - DNA, 19 bp, Homo sapiens
acctgtagtcccagcactt

SEQ ID NO: 2757586 - DNA, 17 bp, Homo sapiens
accttaaggaaaagtaa

SEQ ID NO: 2757587 - DNA, 16 bp, Homo sapiens
acctttcaaaatggaa

SEQ ID NO: 2757588 - DNA, 20 bp, Homo sapiens
acctttcaaaatggaaaatt

SEQ ID NO: 2757589 - DNA, 16 bp, Homo sapiens
acgcccttggagcctt

SEQ ID NO: 2757590 - DNA, 18 bp, Homo sapiens
acgcccttggagccttcc

SEQ ID NO: 2757591 - DNA, 22 bp, Homo sapiens
acgcccttggagccttccaccg

SEQ ID NO: 2757592 - DNA, 19 bp, Homo sapiens
acgcggttttttcacttcc

SEQ ID NO: 2757593 - DNA, 15 bp, Homo sapiens
acgtttaacattgat

SEQ ID NO: 2757594 - DNA, 18 bp, Homo sapiens
acgtttaacattgattgg

SEQ ID NO: 2757595 - DNA, 16 bp, Homo sapiens
actaagagagaatgag

SEQ ID NO: 2757596 - DNA, 18 bp, Homo sapiens
actaagatttatctgcaa

SEQ ID NO: 2757597 - DNA, 14 bp, Homo sapiens
actaagttattgct

SEQ ID NO: 2757598 - DNA, 17 bp, Homo sapiens
actaagttattgctgca

SEQ ID NO: 2757599 - DNA, 23 bp, Homo sapiens
actaagttattgctgcataaatt

SEQ ID NO: 2757600 - DNA, 18 bp, Homo sapiens
actactgaactgttacct

SEQ ID NO: 2757601 - DNA, 14 bp, Homo sapiens
actactggtctgta

SEQ ID NO: 2757602 - DNA, 17 bp, Homo sapiens
actactggtctgtactc

SEQ ID NO: 2757603 - DNA, 12 bp, Homo sapiens
actactttgcta

SEQ ID NO: 2757604 - DNA, 18 bp, Homo sapiens
actaggtacataagcttc

SEQ ID NO: 2757605 - DNA, 20 bp, Homo sapiens
actagtatttctatgaaata

SEQ ID NO: 2757606 - DNA, 20 bp, Homo sapiens
actattatagaaattctgaa

SEQ ID NO: 2757607 - DNA, 21 bp, Homo sapiens
actccaaactgactcttaaga

SEQ ID NO: 2757608 - DNA, 18 bp, Homo sapiens
actccagaaagtgacaag

SEQ ID NO: 2757609 - DNA, 16 bp, Homo sapiens
actccttggatttgca

SEQ ID NO: 2757610 - DNA, 17 bp, Homo sapiens
actccttggatttgcat

SEQ ID NO: 2757611 - DNA, 14 bp, Homo sapiens
actcgcacctgtgc

SEQ ID NO: 2757612 - DNA, 20 bp, Homo sapiens
actcgcacctgtgctggagc

SEQ ID NO: 2757613 - DNA, 14 bp, Homo sapiens
actcgttaatttgt

SEQ ID NO: 2757614 - DNA, 17 bp, Homo sapiens
actctctagttttatct

SEQ ID NO: 2757615 - DNA, 19 bp, Homo sapiens
actctgtatttaggccatt

SEQ ID NO: 2757616 - DNA, 23 bp, Homo sapiens
actctgtatttaggccatttgtt

SEQ ID NO: 2757617 - DNA, 18 bp, Homo sapiens
attatgaattacatttgt

SEQ ID NO: 2757618 - DNA, 20 bp, Homo sapiens
attatgaattacatttgtat

SEQ ID NO: 2757619 - DNA, 12 bp, Homo sapiens
attcaaaatatt

SEQ ID NO: 2757620 - DNA, 13 bp, Homo sapiens
attcactaaaata

SEQ ID NO: 2757621 - DNA, 21 bp, Homo sapiens
attcagctgaggttcattaca

SEQ ID NO: 2757622 - DNA, 19 bp, Homo sapiens
attctaacttaatgtagtt

SEQ ID NO: 2757623 - DNA, 15 bp, Homo sapiens
attctatcgttatta

SEQ ID NO: 2757624 - DNA, 18 bp, Homo sapiens
attctatcgttattataa

SEQ ID NO: 2757625 - DNA, 19 bp, Homo sapiens
attctatcgttattataaa

SEQ ID NO: 2757626 - DNA, 23 bp, Homo sapiens
attctatcgttattataaatgtt

SEQ ID NO: 2757627 - DNA, 17 bp, Homo sapiens
attctgaattttggtaa

SEQ ID NO: 2757628 - DNA, 22 bp, Homo sapiens
attctgaattttggtaaatcac

SEQ ID NO: 2757629 - DNA, 23 bp, Homo sapiens
attctgggcctaattttttaaag

SEQ ID NO: 2757630 - DNA, 13 bp, Homo sapiens
attctttaaacta

SEQ ID NO: 2757631 - DNA, 17 bp, Homo sapiens
attctttaaactactga

SEQ ID NO: 2757632 - DNA, 19 bp, Homo sapiens
attctttagatttttaaat

SEQ ID NO: 2757633 - DNA, 23 bp, Homo sapiens
attctttagatttttaaattgga

SEQ ID NO: 2757634 - DNA, 20 bp, Homo sapiens
attgaaagcactatgaattt

SEQ ID NO: 2757635 - DNA, 21 bp, Homo sapiens
attgaaagcactatgaatttg

SEQ ID NO: 2757636 - DNA, 18 bp, Homo sapiens
attgactttttatggcac

SEQ ID NO: 2757637 - DNA, 13 bp, Homo sapiens
attgagactgaaa

SEQ ID NO: 2757638 - DNA, 19 bp, Homo sapiens
attgagactgaaagaaact

SEQ ID NO: 2757639 - DNA, 20 bp, Homo sapiens
attgagactgaaagaaacta

SEQ ID NO: 2757640 - DNA, 17 bp, Homo sapiens
attgattggataaatgc

SEQ ID NO: 2757641 - DNA, 14 bp, Homo sapiens
attgcatggtgtga

SEQ ID NO: 2757642 - DNA, 17 bp, Homo sapiens
attgcatggtgtgaact

SEQ ID NO: 2757643 - DNA, 17 bp, Homo sapiens
attgccaatcttgtttt

SEQ ID NO: 2757644 - DNA, 21 bp, Homo sapiens
attgctgcataaatttgtaat

SEQ ID NO: 2757645 - DNA, 16 bp, Homo sapiens
attggagggaaatctt

SEQ ID NO: 2757646 - DNA, 12 bp, Homo sapiens
attgtagaaagc

SEQ ID NO: 2757647 - DNA, 16 bp, Homo sapiens
attgtattgctgctgt

SEQ ID NO: 2757648 - DNA, 14 bp, Homo sapiens
attgtgcaaaatat

SEQ ID NO: 2757649 - DNA, 15 bp, Homo sapiens
attgttgtgtataat

SEQ ID NO: 2757650 - DNA, 22 bp, Homo sapiens
attgtttaaaaaccgaataaat

SEQ ID NO: 2757651 - DNA, 16 bp, Homo sapiens
attgtttttataaaaa

SEQ ID NO: 2757652 - DNA, 22 bp, Homo sapiens
attgtttttataaaaacattga

SEQ ID NO: 2757653 - DNA, 17 bp, Homo sapiens
atttaaaaagtgagaaa

SEQ ID NO: 2757654 - DNA, 23 bp, Homo sapiens
atttaaaaagtgagaaagaaagt

SEQ ID NO: 2757655 - DNA, 14 bp, Homo sapiens
atttaaaaatgatc

SEQ ID NO: 2757656 - DNA, 13 bp, Homo sapiens
atttaaaacacag

SEQ ID NO: 2757657 - DNA, 17 bp, Homo sapiens
atttaaaacacagtatt

SEQ ID NO: 2757658 - DNA, 14 bp, Homo sapiens
atttaaaagagtaa

SEQ ID NO: 2757659 - DNA, 20 bp, Homo sapiens
atttaaatatctgaacattt

SEQ ID NO: 2757660 - DNA, 19 bp, Homo sapiens
atttacagtattgagcttt

SEQ ID NO: 2757661 - DNA, 17 bp, Homo sapiens
atttagtctgttatatt

SEQ ID NO: 2757662 - DNA, 20 bp, Homo sapiens
atttattactgtaagaaaat

SEQ ID NO: 2757663 - DNA, 17 bp, Homo sapiens
atttattttaataatgt

SEQ ID NO: 2757664 - DNA, 14 bp, Homo sapiens
atttcaaaatgctt

SEQ ID NO: 2757665 - DNA, 22 bp, Homo sapiens
atttcctttatactgtgaagtt

SEQ ID NO: 2757666 - DNA, 18 bp, Homo sapiens
atttctatgaaatattat

SEQ ID NO: 2757667 - DNA, 20 bp, Homo sapiens
atttgaaaattacctttaat

SEQ ID NO: 2757668 - DNA, 14 bp, Homo sapiens
atttgaaatattga

SEQ ID NO: 2757669 - DNA, 14 bp, Homo sapiens
atttgattctaaat

SEQ ID NO: 2757670 - DNA, 13 bp, Homo sapiens
atttgccttttaa

SEQ ID NO: 2757671 - DNA, 20 bp, Homo sapiens
atttgctatgagctggggat

SEQ ID NO: 2757672 - DNA, 17 bp, Homo sapiens
atttgctgtttgtccag

SEQ ID NO: 2757673 - DNA, 23 bp, Homo sapiens
atttggtaaggggaattgaggac

SEQ ID NO: 2757674 - DNA, 19 bp, Homo sapiens
atttgtagtgttggagaag

SEQ ID NO: 2757675 - DNA, 15 bp, Homo sapiens
atttgtataaaataa

SEQ ID NO: 2757676 - DNA, 18 bp, Homo sapiens
atttgtataaaataattt

SEQ ID NO: 2757677 - DNA, 16 bp, Homo sapiens
atttgttacagtttct

SEQ ID NO: 2757678 - DNA, 15 bp, Homo sapiens
attttaataatgttt

SEQ ID NO: 2757679 - DNA, 18 bp, Homo sapiens
attttaataatgtttcaa

SEQ ID NO: 2757680 - DNA, 19 bp, Homo sapiens
attttaataatgtttcaaa

SEQ ID NO: 2757681 - DNA, 12 bp, Homo sapiens
attttcaaaaaa

SEQ ID NO: 2757682 - DNA, 15 bp, Homo sapiens
attttctctaaactg

SEQ ID NO: 2757683 - DNA, 21 bp, Homo sapiens
attttctctaaactgtttctt

SEQ ID NO: 2757684 - DNA, 21 bp, Homo sapiens
attttgtaaatctgtactttt

SEQ ID NO: 2757685 - DNA, 12 bp, Homo sapiens
atttttaaattg

SEQ ID NO: 2757686 - DNA, 19 bp, Homo sapiens
atttttatattagttgctt

SEQ ID NO: 2757687 - DNA, 19 bp, Homo sapiens
atttttatatttgaaatat

SEQ ID NO: 2757688 - DNA, 22 bp, Homo sapiens
atttttccttcctctgtaagat

SEQ ID NO: 2757689 - DNA, 23 bp, Homo sapiens
attttttctctaggaaatattta

SEQ ID NO: 2757690 - DNA, 13 bp, Homo sapiens
atttttttccaag

SEQ ID NO: 2757691 - DNA, 22 bp, Homo sapiens
atttttttgtcattaaaattgt

SEQ ID NO: 2757692 - DNA, 16 bp, Homo sapiens
caaaacagattcaaag

SEQ ID NO: 2757693 - DNA, 14 bp, Homo sapiens
caaaactagttctt

SEQ ID NO: 2757694 - DNA, 20 bp, Homo sapiens
caaaagaaaccatgcaaagc

SEQ ID NO: 2757695 - DNA, 15 bp, Homo sapiens
caaaagcaaaatttt

SEQ ID NO: 2757696 - DNA, 16 bp, Homo sapiens
caaaagcaaaattttt

SEQ ID NO: 2757697 - DNA, 16 bp, Homo sapiens
caaaagcttgtgtatc

SEQ ID NO: 2757698 - DNA, 23 bp, Homo sapiens
caaaatagcacatccaccaaact

SEQ ID NO: 2757699 - DNA, 19 bp, Homo sapiens
caaaatattggtattaaag

SEQ ID NO: 2757700 - DNA, 20 bp, Homo sapiens
caaaatggaaaattaattct

SEQ ID NO: 2757701 - DNA, 14 bp, Homo sapiens
caaaatttttaaaa

SEQ ID NO: 2757702 - DNA, 18 bp, Homo sapiens
caaaatttttaaaactgc

SEQ ID NO: 2757703 - DNA, 16 bp, Homo sapiens
caaaattttttctcta

SEQ ID NO: 2757704 - DNA, 13 bp, Homo sapiens
caaacaccacttt

SEQ ID NO: 2757705 - DNA, 17 bp, Homo sapiens
caaacatatataacaat

SEQ ID NO: 2757706 - DNA, 14 bp, Homo sapiens
caaactcaggcttt

SEQ ID NO: 2757707 - DNA, 16 bp, Homo sapiens
caaactgactcttaag

SEQ ID NO: 2757708 - DNA, 23 bp, Homo sapiens
caaactttgtgtataagttgtat

SEQ ID NO: 2757709 - DNA, 17 bp, Homo sapiens
caaagcaacgactactt

SEQ ID NO: 2757710 - DNA, 23 bp, Homo sapiens
caaaggcgggaggatcacttgag

SEQ ID NO: 2757711 - DNA, 18 bp, Homo sapiens
caaatagtatagaaaatg

SEQ ID NO: 2757712 - DNA, 14 bp, Homo sapiens
caaatattgaatgc

SEQ ID NO: 2757713 - DNA, 21 bp, Homo sapiens
caaatattgaatgccttattt

SEQ ID NO: 2757714 - DNA, 22 bp, Homo sapiens
caaatattgaatgccttatttt

SEQ ID NO: 2757715 - DNA, 15 bp, Homo sapiens
caaatctgtataaat

SEQ ID NO: 2757716 - DNA, 16 bp, Homo sapiens
caaatctgtataaatg

SEQ ID NO: 2757717 - DNA, 17 bp, Homo sapiens
caaatctgtataaatgt

SEQ ID NO: 2757718 - DNA, 18 bp, Homo sapiens
caaatctgtataaatgtc

SEQ ID NO: 2757719 - DNA, 19 bp, Homo sapiens
caaatctgtataaatgtct

SEQ ID NO: 2757720 - DNA, 14 bp, Homo sapiens
caaatgcattctat

SEQ ID NO: 2757721 - DNA, 17 bp, Homo sapiens
caaattgtgcaaaatat

SEQ ID NO: 2757722 - DNA, 15 bp, Homo sapiens
caaatttgattctaa

SEQ ID NO: 2757723 - DNA, 13 bp, Homo sapiens
caaccctgttgag

SEQ ID NO: 2757724 - DNA, 19 bp, Homo sapiens
caactatctcatttccaag

SEQ ID NO: 2757725 - DNA, 22 bp, Homo sapiens
caactttattttgaatgtacct

SEQ ID NO: 2757726 - DNA, 12 bp, Homo sapiens
caacttttttat

SEQ ID NO: 2757727 - DNA, 15 bp, Homo sapiens
caacttttttatgtc

SEQ ID NO: 2757728 - DNA, 15 bp, Homo sapiens
caagacaaactaaac

SEQ ID NO: 2757729 - DNA, 19 bp, Homo sapiens
caagactgcacatcaaaat

SEQ ID NO: 2757730 - DNA, 12 bp, Homo sapiens
caagagaagggg

SEQ ID NO: 2757731 - DNA, 18 bp, Homo sapiens
caagagactttgtcactt

SEQ ID NO: 2757732 - DNA, 22 bp, Homo sapiens
caagagtttcttctcatatcca

SEQ ID NO: 2757733 - DNA, 22 bp, Homo sapiens
caagatcctcttgccacatctt

SEQ ID NO: 2757734 - DNA, 16 bp, Homo sapiens
caagatgccaacatcg

SEQ ID NO: 2757735 - DNA, 16 bp, Homo sapiens
caagattttttaattg

SEQ ID NO: 2757736 - DNA, 21 bp, Homo sapiens
caagattttttaattgtttaa

SEQ ID NO: 2757737 - DNA, 14 bp, Homo sapiens
caaggattttttaa

SEQ ID NO: 2757738 - DNA, 12 bp, Homo sapiens
caaggttgctgt

SEQ ID NO: 2757739 - DNA, 19 bp, Homo sapiens
caagtacctgtgaacagta

SEQ ID NO: 2757740 - DNA, 22 bp, Homo sapiens
caagtgtataatgttggtgtgg

SEQ ID NO: 2757741 - DNA, 18 bp, Homo sapiens
caagtgtttctgttctgg

SEQ ID NO: 2757742 - DNA, 22 bp, Homo sapiens
caataaaaatcaggagcctgct

SEQ ID NO: 2757743 - DNA, 18 bp, Homo sapiens
ctgcagtgagctgtgatt

SEQ ID NO: 2757744 - DNA, 20 bp, Homo sapiens
ctgcataaatttgtaatata

SEQ ID NO: 2757745 - DNA, 15 bp, Homo sapiens
ctgcatcttagttta

SEQ ID NO: 2757746 - DNA, 12 bp, Homo sapiens
ctgcatttttaa

SEQ ID NO: 2757747 - DNA, 23 bp, Homo sapiens
ctgccatcatgtttacagaggac

SEQ ID NO: 2757748 - DNA, 16 bp, Homo sapiens
ctgcccacgcccttgg

SEQ ID NO: 2757749 - DNA, 21 bp, Homo sapiens
ctgcccacgcccttggagcct

SEQ ID NO: 2757750 - DNA, 18 bp, Homo sapiens
ctgcctgcaaacctgctg

SEQ ID NO: 2757751 - DNA, 17 bp, Homo sapiens
ctgctaaggaacaatgc

SEQ ID NO: 2757752 - DNA, 18 bp, Homo sapiens
ctggataaatttaaaaca

SEQ ID NO: 2757753 - DNA, 23 bp, Homo sapiens
ctggccctatgcttccggcctcc

SEQ ID NO: 2757754 - DNA, 20 bp, Homo sapiens
ctggctaccttgtgggaata

SEQ ID NO: 2757755 - DNA, 18 bp, Homo sapiens
ctgggaataagtgccagg

SEQ ID NO: 2757756 - DNA, 10 bp, Homo sapiens
ctgggacagg

SEQ ID NO: 2757757 - DNA, 18 bp, Homo sapiens
ctgggaggtattggaggg

SEQ ID NO: 2757758 - DNA, 16 bp, Homo sapiens
ctgggctgggtttgct

SEQ ID NO: 2757759 - DNA, 19 bp, Homo sapiens
ctgggctgggtttgctgtc

SEQ ID NO: 2757760 - DNA, 16 bp, Homo sapiens
ctgggtttcttttttc

SEQ ID NO: 2757761 - DNA, 16 bp, Homo sapiens
ctgggtttgctgtctt

SEQ ID NO: 2757762 - DNA, 16 bp, Homo sapiens
ctggtctgttaatctt

SEQ ID NO: 2757763 - DNA, 22 bp, Homo sapiens
ctggtttatttgttgttttctg

SEQ ID NO: 2757764 - DNA, 13 bp, Homo sapiens
ctggtttcctgcc

SEQ ID NO: 2757765 - DNA, 18 bp, Homo sapiens
ctgtacttttttcaaata

SEQ ID NO: 2757766 - DNA, 16 bp, Homo sapiens
ctgtagataaataatg

SEQ ID NO: 2757767 - DNA, 14 bp, Homo sapiens
ctgtagatgcagaa

SEQ ID NO: 2757768 - DNA, 16 bp, Homo sapiens
ctgtagatgcagaaaa

SEQ ID NO: 2757769 - DNA, 22 bp, Homo sapiens
ctgtagatgcagaaaaagaaaa

SEQ ID NO: 2757770 - DNA, 18 bp, Homo sapiens
ctgtagtcccagcacttt

SEQ ID NO: 2757771 - DNA, 14 bp, Homo sapiens
ctgtataaatgtct

SEQ ID NO: 2757772 - DNA, 13 bp, Homo sapiens
ctgtatgtcaaat

SEQ ID NO: 2757773 - DNA, 13 bp, Homo sapiens
ctgtattttaaaa

SEQ ID NO: 2757774 - DNA, 19 bp, Homo sapiens
ctgtcaataaatgttgaaa

SEQ ID NO: 2757775 - DNA, 20 bp, Homo sapiens
ctgtctacactaagagagaa

SEQ ID NO: 2757776 - DNA, 20 bp, Homo sapiens
ctgtcttcaggctctgccca

SEQ ID NO: 2757777 - DNA, 21 bp, Homo sapiens
ctgtcttcaggctctgcccag

SEQ ID NO: 2757778 - DNA, 17 bp, Homo sapiens
ctgtcttcggccgagct

SEQ ID NO: 2757779 - DNA, 18 bp, Homo sapiens
ctgtcttcggccgagctg

SEQ ID NO: 2757780 - DNA, 12 bp, Homo sapiens
ctgtctttaaaa

SEQ ID NO: 2757781 - DNA, 20 bp, Homo sapiens
ctgtgaacagtacagtattt

SEQ ID NO: 2757782 - DNA, 19 bp, Homo sapiens
ctgtgattatgccattgca

SEQ ID NO: 2757783 - DNA, 15 bp, Homo sapiens
ctgtgcagggctggt

SEQ ID NO: 2757784 - DNA, 14 bp, Homo sapiens
ctgtgtgtgtgtat

SEQ ID NO: 2757785 - DNA, 18 bp, Homo sapiens
ctgtgtgtgtgtatgtgg

SEQ ID NO: 2757786 - DNA, 21 bp, Homo sapiens
ctgtgtgtgtgtatgtggggg

SEQ ID NO: 2757787 - DNA, 16 bp, Homo sapiens
ctgtgtgtttatgtgt

SEQ ID NO: 2757788 - DNA, 18 bp, Homo sapiens
ctgtgtgtttatgtgtgt

SEQ ID NO: 2757789 - DNA, 20 bp, Homo sapiens
ctgtgtgtttatgtgtgtgt

SEQ ID NO: 2757790 - DNA, 17 bp, Homo sapiens
ctgtgttgaaatatagt

SEQ ID NO: 2757791 - DNA, 22 bp, Homo sapiens
ctgtgttgaaatatagttgaaa

SEQ ID NO: 2757792 - DNA, 15 bp, Homo sapiens
ctgttaaaatacata

SEQ ID NO: 2757793 - DNA, 21 bp, Homo sapiens
ctgttatatttccttttgtaa

SEQ ID NO: 2757794 - DNA, 18 bp, Homo sapiens
ctgttcctccctcccaca

SEQ ID NO: 2757795 - DNA, 13 bp, Homo sapiens
ctgtttcttagct

SEQ ID NO: 2757796 - DNA, 20 bp, Homo sapiens
ctgtttcttagctgcactgt

SEQ ID NO: 2757797 - DNA, 19 bp, Homo sapiens
ctgtttgtatttttttcca

SEQ ID NO: 2757798 - DNA, 15 bp, Homo sapiens
cttaaatcagaataa

SEQ ID NO: 2757799 - DNA, 19 bp, Homo sapiens
cttaatgtagttactgtga

SEQ ID NO: 2757800 - DNA, 21 bp, Homo sapiens
cttacattgcctgactaaaat

SEQ ID NO: 2757801 - DNA, 24 bp, Homo sapiens
cttactataaatgatatctatatt

SEQ ID NO: 2757802 - DNA, 21 bp, Homo sapiens
cttactgttaaaactgtacct

SEQ ID NO: 2757803 - DNA, 14 bp, Homo sapiens
cttatagaataaaa

SEQ ID NO: 2757804 - DNA, 16 bp, Homo sapiens
cttatagaataaaagc

SEQ ID NO: 2757805 - DNA, 20 bp, Homo sapiens
cttcaaatttgattctaaat

SEQ ID NO: 2757806 - DNA, 22 bp, Homo sapiens
cttcaagatcctcttgccacat

SEQ ID NO: 2757807 - DNA, 18 bp, Homo sapiens
cttcaggctctgcccagg

SEQ ID NO: 2757808 - DNA, 18 bp, Homo sapiens
cttcagtgcaagagactt

SEQ ID NO: 2757809 - DNA, 17 bp, Homo sapiens
cttcagtttagaaccta

SEQ ID NO: 2757810 - DNA, 22 bp, Homo sapiens
cttcatgcattacttactgtta

SEQ ID NO: 2757811 - DNA, 23 bp, Homo sapiens
cttcatgctgtctacactaagag

SEQ ID NO: 2757812 - DNA, 19 bp, Homo sapiens
cttccaccggcactcatga

SEQ ID NO: 2757813 - DNA, 16 bp, Homo sapiens
cttccatcagagatgg

SEQ ID NO: 2757814 - DNA, 15 bp, Homo sapiens
cttcctctgtaagat

SEQ ID NO: 2757815 - DNA, 11 bp, Homo sapiens
cttccttggcc

SEQ ID NO: 2757816 - DNA, 12 bp, Homo sapiens
cttctaatctta

SEQ ID NO: 2757817 - DNA, 17 bp, Homo sapiens
cttctaatcttaaatca

SEQ ID NO: 2757818 - DNA, 15 bp, Homo sapiens
cttctggctgtagat

SEQ ID NO: 2757819 - DNA, 20 bp, Homo sapiens
cttctgttttataattttgt

SEQ ID NO: 2757820 - DNA, 13 bp, Homo sapiens
cttcttatctaaa

SEQ ID NO: 2757821 - DNA, 17 bp, Homo sapiens
cttcttccctaaaatgt

SEQ ID NO: 2757822 - DNA, 13 bp, Homo sapiens
cttctttccacag

SEQ ID NO: 2757823 - DNA, 15 bp, Homo sapiens
cttgaaaatgccacc

SEQ ID NO: 2757824 - DNA, 14 bp, Homo sapiens
cttgaacaaaaagt

SEQ ID NO: 2757825 - DNA, 17 bp, Homo sapiens
cttgactttggctgatt

SEQ ID NO: 2757826 - DNA, 17 bp, Homo sapiens
cttgagtgaggcagtga

SEQ ID NO: 2757827 - DNA, 12 bp, Homo sapiens
cttgattaatgt

SEQ ID NO: 2757828 - DNA, 15 bp, Homo sapiens
cttgattaatgtact

SEQ ID NO: 2757829 - DNA, 17 bp, Homo sapiens
cttgattaatgtacttt

SEQ ID NO: 2757830 - DNA, 21 bp, Homo sapiens
cttgcacgcgccctttctacc

SEQ ID NO: 2757831 - DNA, 22 bp, Homo sapiens
cttgcacgcgccctttctacca

SEQ ID NO: 2757832 - DNA, 14 bp, Homo sapiens
cttgccacatcttg

SEQ ID NO: 2757833 - DNA, 16 bp, Homo sapiens
cttgccacatcttgaa

SEQ ID NO: 2757834 - DNA, 21 bp, Homo sapiens
cttgctagacaaggttgctgt

SEQ ID NO: 2757835 - DNA, 22 bp, Homo sapiens
cttgctagacaaggttgctgtt

SEQ ID NO: 2757836 - DNA, 20 bp, Homo sapiens
cttggatttgcatttttgta

SEQ ID NO: 2757837 - DNA, 19 bp, Homo sapiens
cttggctgtatgtcaaatt

SEQ ID NO: 2757838 - DNA, 16 bp, Homo sapiens
cttggggctgatgcag

SEQ ID NO: 2757839 - DNA, 13 bp, Homo sapiens
cttggtgtaactt

SEQ ID NO: 2757840 - DNA, 20 bp, Homo sapiens
cttggtgtaacttaaatatt

SEQ ID NO: 2757841 - DNA, 13 bp, Homo sapiens
cttgtgtatcttg

SEQ ID NO: 2757842 - DNA, 14 bp, Homo sapiens
cttgtgtatcttga

SEQ ID NO: 2757843 - DNA, 21 bp, Homo sapiens
cttgttccaatgccacatact

SEQ ID NO: 2757844 - DNA, 23 bp, Homo sapiens
cttgttttaagcaaatgcattct

SEQ ID NO: 2757845 - DNA, 15 bp, Homo sapiens
cttgtttttataata

SEQ ID NO: 2757846 - DNA, 23 bp, Homo sapiens
cttgtttttataataaaaagctt

SEQ ID NO: 2757847 - DNA, 18 bp, Homo sapiens
ctttaaaaaattttttga

SEQ ID NO: 2757848 - DNA, 16 bp, Homo sapiens
ctttaaaaataaaagc

SEQ ID NO: 2757849 - DNA, 18 bp, Homo sapiens
ctttaaactactgaactg

SEQ ID NO: 2757850 - DNA, 15 bp, Homo sapiens
ctttaaatcatttta

SEQ ID NO: 2757851 - DNA, 17 bp, Homo sapiens
ctttaaattttttaaaa

SEQ ID NO: 2757852 - DNA, 12 bp, Homo sapiens
ctttaatgcaat

SEQ ID NO: 2757853 - DNA, 16 bp, Homo sapiens
ctttagatttttaaat

SEQ ID NO: 2757854 - DNA, 19 bp, Homo sapiens
ctttagatttttaaattgg

SEQ ID NO: 2757855 - DNA, 17 bp, Homo sapiens
ctttatactgtgaagtt

SEQ ID NO: 2757856 - DNA, 14 bp, Homo sapiens
ctttattttgaatg

SEQ ID NO: 2757857 - DNA, 12 bp, Homo sapiens
ctttcaaaatgg

SEQ ID NO: 2757858 - DNA, 16 bp, Homo sapiens
ctttcatagttctgtt

SEQ ID NO: 2757859 - DNA, 18 bp, Homo sapiens
ctttcatagttctgttaa

SEQ ID NO: 2757860 - DNA, 22 bp, Homo sapiens
ctttcatagttctgttaaatat

SEQ ID NO: 2757861 - DNA, 22 bp, Homo sapiens
ctttcgtttccagcctttgtca

SEQ ID NO: 2757862 - DNA, 15 bp, Homo sapiens
ctttctgaaattcac

SEQ ID NO: 2757863 - DNA, 16 bp, Homo sapiens
ctttctgaaattcaca

SEQ ID NO: 2757864 - DNA, 19 bp, Homo sapiens
ctttctggcccttctttca

SEQ ID NO: 2757865 - DNA, 23 bp, Homo sapiens
ctttctggcccttctttcagtga

SEQ ID NO: 2757866 - DNA, 15 bp, Homo sapiens
ctttgctacgaagaa

SEQ ID NO: 2757867 - DNA, 14 bp, Homo sapiens
ctttgtgtttgctt

SEQ ID NO: 2757868 - DNA, 21 bp, Homo sapiens
ctttgtgtttgcttggtgctg

SEQ ID NO: 2757869 - DNA, 15 bp, Homo sapiens
taaaagctattactt

SEQ ID NO: 2757870 - DNA, 12 bp, Homo sapiens
taaaagctgtgg

SEQ ID NO: 2757871 - DNA, 15 bp, Homo sapiens
taaaagctgtggaat

SEQ ID NO: 2757872 - DNA, 16 bp, Homo sapiens
taaaagttagcattgt

SEQ ID NO: 2757873 - DNA, 20 bp, Homo sapiens
taaaagttgtactgcatctt

SEQ ID NO: 2757874 - DNA, 21 bp, Homo sapiens
taaaagttgtactgcatctta

SEQ ID NO: 2757875 - DNA, 20 bp, Homo sapiens
taaaataatttttatatttg

SEQ ID NO: 2757876 - DNA, 15 bp, Homo sapiens
taaaatacataactt

SEQ ID NO: 2757877 - DNA, 23 bp, Homo sapiens
taaaatatgtccagaagagtcaa

SEQ ID NO: 2757878 - DNA, 15 bp, Homo sapiens
taaaatccatacatt

SEQ ID NO: 2757879 - DNA, 17 bp, Homo sapiens
taaaatccatacatttg

SEQ ID NO: 2757880 - DNA, 19 bp, Homo sapiens
taaaatccatacatttgtg

SEQ ID NO: 2757881 - DNA, 12 bp, Homo sapiens
taaaatgcaata

SEQ ID NO: 2757882 - DNA, 21 bp, Homo sapiens
taaaatgcttcactgtacgta

SEQ ID NO: 2757883 - DNA, 16 bp, Homo sapiens
taaaatgtagaaattc

SEQ ID NO: 2757884 - DNA, 18 bp, Homo sapiens
taaaatgtagaaattcta

SEQ ID NO: 2757885 - DNA, 16 bp, Homo sapiens
taaaattggattacag

SEQ ID NO: 2757886 - DNA, 18 bp, Homo sapiens
taaaattggattacagta

SEQ ID NO: 2757887 - DNA, 15 bp, Homo sapiens
taaaattgtgatgtg

SEQ ID NO: 2757888 - DNA, 16 bp, Homo sapiens
taaaattgtgatgtgt

SEQ ID NO: 2757889 - DNA, 14 bp, Homo sapiens
taaacatttgccaa

SEQ ID NO: 2757890 - DNA, 24 bp, Homo sapiens
taaacatttgccaaaaattcatgc

SEQ ID NO: 2757891 - DNA, 15 bp, Homo sapiens
taaaccacaaaagtt

SEQ ID NO: 2757892 - DNA, 14 bp, Homo sapiens
taaactagagaagg

SEQ ID NO: 2757893 - DNA, 11 bp, Homo sapiens
taaagaatcca

SEQ ID NO: 2757894 - DNA, 17 bp, Homo sapiens
taaagaatccaagacaa

SEQ ID NO: 2757895 - DNA, 15 bp, Homo sapiens
taaagaatgaaagta

SEQ ID NO: 2757896 - DNA, 19 bp, Homo sapiens
taaagaatgctgcaacttt

SEQ ID NO: 2757897 - DNA, 20 bp, Homo sapiens
taaagaatgctgcaactttt

SEQ ID NO: 2757898 - DNA, 13 bp, Homo sapiens
taaagctgttaaa

SEQ ID NO: 2757899 - DNA, 19 bp, Homo sapiens
taaagttttttatatatga

SEQ ID NO: 2757900 - DNA, 13 bp, Homo sapiens
taaataatgtagt

SEQ ID NO: 2757901 - DNA, 14 bp, Homo sapiens
taaatacaaatctg

SEQ ID NO: 2757902 - DNA, 17 bp, Homo sapiens
taaatacaaatctgtat

SEQ ID NO: 2757903 - DNA, 18 bp, Homo sapiens
taaatctccagcttacta

SEQ ID NO: 2757904 - DNA, 14 bp, Homo sapiens
taaatctgtacttt

SEQ ID NO: 2757905 - DNA, 17 bp, Homo sapiens
taaatctgtactttttt

SEQ ID NO: 2757906 - DNA, 21 bp, Homo sapiens
taaatctgtacttttttcaaa

SEQ ID NO: 2757907 - DNA, 23 bp, Homo sapiens
taaatctgtacttttttcaaata

SEQ ID NO: 2757908 - DNA, 15 bp, Homo sapiens
taaatgtctattatt

SEQ ID NO: 2757909 - DNA, 16 bp, Homo sapiens
taaatgttagttctag

SEQ ID NO: 2757910 - DNA, 18 bp, Homo sapiens
taaatgttagttctagct

SEQ ID NO: 2757911 - DNA, 18 bp, Homo sapiens
taaatgttatagctgcat

SEQ ID NO: 2757912 - DNA, 15 bp, Homo sapiens
taaatgttgacatgg

SEQ ID NO: 2757913 - DNA, 22 bp, Homo sapiens
taaattaatattgtattgctgc

SEQ ID NO: 2757914 - DNA, 14 bp, Homo sapiens
taaattctgttgaa

SEQ ID NO: 2757915 - DNA, 13 bp, Homo sapiens
taaattggagaaa

SEQ ID NO: 2757916 - DNA, 17 bp, Homo sapiens
taaattggagaaaagca

SEQ ID NO: 2757917 - DNA, 18 bp, Homo sapiens
taaatttaaaacacagta

SEQ ID NO: 2757918 - DNA, 21 bp, Homo sapiens
taaatttccatatccttctgg

SEQ ID NO: 2757919 - DNA, 14 bp, Homo sapiens
taaattttctctaa

SEQ ID NO: 2757920 - DNA, 19 bp, Homo sapiens
taaattttctctaaactgt

SEQ ID NO: 2757921 - DNA, 21 bp, Homo sapiens
taaattttctctaaactgttt

SEQ ID NO: 2757922 - DNA, 20 bp, Homo sapiens
taacaaccctgttgagtatt

SEQ ID NO: 2757923 - DNA, 13 bp, Homo sapiens
taacaatgctgta

SEQ ID NO: 2757924 - DNA, 13 bp, Homo sapiens
taacattcctaaa

SEQ ID NO: 2757925 - DNA, 17 bp, Homo sapiens
taacattcctaaaatgc

SEQ ID NO: 2757926 - DNA, 12 bp, Homo sapiens
taacattctgac

SEQ ID NO: 2757927 - DNA, 20 bp, Homo sapiens
taacttcagtgcaagagact

SEQ ID NO: 2757928 - DNA, 13 bp, Homo sapiens
taagaatgtgcta

SEQ ID NO: 2757929 - DNA, 20 bp, Homo sapiens
taagatatcccagctttaaa

SEQ ID NO: 2757930 - DNA, 14 bp, Homo sapiens
taagcaaatgcatt

SEQ ID NO: 2757931 - DNA, 16 bp, Homo sapiens
taagcattccaactat

SEQ ID NO: 2757932 - DNA, 16 bp, Homo sapiens
taaggattctgcagaa

SEQ ID NO: 2757933 - DNA, 16 bp, Homo sapiens
taagggaataaatttt

SEQ ID NO: 2757934 - DNA, 13 bp, Homo sapiens
taagggtaaaaaa

SEQ ID NO: 2757935 - DNA, 19 bp, Homo sapiens
taagtaatgataactggaa

SEQ ID NO: 2757936 - DNA, 17 bp, Homo sapiens
taagtgtttaaaagcaa

SEQ ID NO: 2757937 - DNA, 15 bp, Homo sapiens
taagttattgctgca

SEQ ID NO: 2757938 - DNA, 18 bp, Homo sapiens
taagttattgctgcataa

SEQ ID NO: 2757939 - DNA, 19 bp, Homo sapiens
taagttattgctgcataaa

SEQ ID NO: 2757940 - DNA, 22 bp, Homo sapiens
taataagacttttctctacttt

SEQ ID NO: 2757941 - DNA, 16 bp, Homo sapiens
taatataaaagatctt

SEQ ID NO: 2757942 - DNA, 20 bp, Homo sapiens
taatataaaagatcttgcag

SEQ ID NO: 2757943 - DNA, 14 bp, Homo sapiens
taatattgtattgc

SEQ ID NO: 2757944 - DNA, 21 bp, Homo sapiens
taatattgtattgctgctgtg

SEQ ID NO: 2757945 - DNA, 23 bp, Homo sapiens
taatattgtattgctgctgtgcg

SEQ ID NO: 2757946 - DNA, 19 bp, Homo sapiens
taatctcctgagttgtata

SEQ ID NO: 2757947 - DNA, 13 bp, Homo sapiens
taatctttcacag

SEQ ID NO: 2757948 - DNA, 12 bp, Homo sapiens
taatctttttca

SEQ ID NO: 2757949 - DNA, 22 bp, Homo sapiens
taatgaaagtgatgacatattt

SEQ ID NO: 2757950 - DNA, 16 bp, Homo sapiens
taatgacatgcctata

SEQ ID NO: 2757951 - DNA, 22 bp, Homo sapiens
taatgccagggcctgctgagtt

SEQ ID NO: 2757952 - DNA, 20 bp, Homo sapiens
taatgtactttttattgcat

SEQ ID NO: 2757953 - DNA, 14 bp, Homo sapiens
taatgttggtgtgg

SEQ ID NO: 2757954 - DNA, 22 bp, Homo sapiens
taatgtttcaaacatatataac

SEQ ID NO: 2757955 - DNA, 12 bp, Homo sapiens
taattctaaact

SEQ ID NO: 2757956 - DNA, 14 bp, Homo sapiens
taattctaaactta

SEQ ID NO: 2757957 - DNA, 22 bp, Homo sapiens
taattctaaacttagaaatatg

SEQ ID NO: 2757958 - DNA, 12 bp, Homo sapiens
taattgtttaaa

SEQ ID NO: 2757959 - DNA, 15 bp, Homo sapiens
taatttaaaattgtg

SEQ ID NO: 2757960 - DNA, 16 bp, Homo sapiens
taatttaaaattgtga

SEQ ID NO: 2757961 - DNA, 20 bp, Homo sapiens
taatttaaaattgtgatgtg

SEQ ID NO: 2757962 - DNA, 20 bp, Homo sapiens
taatttaatattcctggcat

SEQ ID NO: 2757963 - DNA, 20 bp, Homo sapiens
taatttgtagtgttggagaa

SEQ ID NO: 2757964 - DNA, 18 bp, Homo sapiens
taattttgtgaagcaaaa

SEQ ID NO: 2757965 - DNA, 12 bp, Homo sapiens
taatttttatat

SEQ ID NO: 2757966 - DNA, 20 bp, Homo sapiens
tacaaaagcttgtgtatctt

SEQ ID NO: 2757967 - DNA, 22 bp, Homo sapiens
tacaaacatttcacttctccaa

SEQ ID NO: 2757968 - DNA, 11 bp, Homo sapiens
tacaaatctgt

SEQ ID NO: 2757969 - DNA, 15 bp, Homo sapiens
tacaaatctgtataa

SEQ ID NO: 2757970 - DNA, 19 bp, Homo sapiens
tacaaatctgtataaatgt

SEQ ID NO: 2757971 - DNA, 20 bp, Homo sapiens
tacaaatctgtataaatgtc

SEQ ID NO: 2757972 - DNA, 22 bp, Homo sapiens
tacaaatctgtataaatgtcta

SEQ ID NO: 2757973 - DNA, 13 bp, Homo sapiens
tacaagtaaattc

SEQ ID NO: 2757974 - DNA, 16 bp, Homo sapiens
tacaagtaaattctgt

SEQ ID NO: 2757975 - DNA, 16 bp, Homo sapiens
tacaagtcagtttcta

SEQ ID NO: 2757976 - DNA, 22 bp, Homo sapiens
tacaatcgagactgcaatgtga

SEQ ID NO: 2757977 - DNA, 15 bp, Homo sapiens
tacacattttgtaaa

SEQ ID NO: 2757978 - DNA, 19 bp, Homo sapiens
tacacattttgtaaatctg

SEQ ID NO: 2757979 - DNA, 14 bp, Homo sapiens
tacactaagagaga

SEQ ID NO: 2757980 - DNA, 18 bp, Homo sapiens
tacactaagagagaatga

SEQ ID NO: 2757981 - DNA, 15 bp, Homo sapiens
tacagcttctattca

SEQ ID NO: 2757982 - DNA, 22 bp, Homo sapiens
tacagtattgagctttgcattt

SEQ ID NO: 2757983 - DNA, 24 bp, Homo sapiens
tacagtattgagctttgcatttat

SEQ ID NO: 2757984 - DNA, 17 bp, Homo sapiens
tacagtttcttcatgca

SEQ ID NO: 2757985 - DNA, 16 bp, Homo sapiens
tacataagcttctcaa

SEQ ID NO: 2757986 - DNA, 14 bp, Homo sapiens
tacatgggaagttg

SEQ ID NO: 2757987 - DNA, 16 bp, Homo sapiens
tacatgtaaagctgtt

SEQ ID NO: 2757988 - DNA, 18 bp, Homo sapiens
tacatgtaaagctgttaa

SEQ ID NO: 2757989 - DNA, 16 bp, Homo sapiens
tacatttggaacagtg

SEQ ID NO: 2757990 - DNA, 11 bp, Homo sapiens
tacatttgtgt

SEQ ID NO: 2757991 - DNA, 19 bp, Homo sapiens
taccacaaaagcaaaattt

SEQ ID NO: 2757992 - DNA, 12 bp, Homo sapiens
tacctcaggaaa

SEQ ID NO: 2757993 - DNA, 14 bp, Homo sapiens
tacctcaggaaaga

SEQ ID NO: 2757994 - DNA, 13 bp, Homo sapiens
tacctcttggctg

SEQ ID NO: 2757995 - DNA, 10 bp, Homo sapiens
taccttgtgg

SEQ ID NO: 2757996 - DNA, 15 bp, Homo sapiens
tgaagttacatgcat

SEQ ID NO: 2757997 - DNA, 23 bp, Homo sapiens
tgaagttacatgcataaaagggt

SEQ ID NO: 2757998 - DNA, 13 bp, Homo sapiens
tgaataaaaataa

SEQ ID NO: 2757999 - DNA, 16 bp, Homo sapiens
tgaatatatggcattt

SEQ ID NO: 2758000 - DNA, 21 bp, Homo sapiens
tgaatatatggcatttgcaga

SEQ ID NO: 2758001 - DNA, 22 bp, Homo sapiens
tgaatattacatgtaaagctgt

SEQ ID NO: 2758002 - DNA, 21 bp, Homo sapiens
tgaatgccatagtcaaagaga

SEQ ID NO: 2758003 - DNA, 20 bp, Homo sapiens
tgaatgccttatttttgaat

SEQ ID NO: 2758004 - DNA, 21 bp, Homo sapiens
tgaatgtacctctattagttt

SEQ ID NO: 2758005 - DNA, 13 bp, Homo sapiens
tgaattacatttg

SEQ ID NO: 2758006 - DNA, 13 bp, Homo sapiens
tgacaaacagcta

SEQ ID NO: 2758007 - DNA, 12 bp, Homo sapiens
tgacaagctcac

SEQ ID NO: 2758008 - DNA, 13 bp, Homo sapiens
tgacagaaaaaaa

SEQ ID NO: 2758009 - DNA, 15 bp, Homo sapiens
tgacagaatatacac

SEQ ID NO: 2758010 - DNA, 17 bp, Homo sapiens
tgacagagcaataccct

SEQ ID NO: 2758011 - DNA, 17 bp, Homo sapiens
tgacatgcctatatgag

SEQ ID NO: 2758012 - DNA, 18 bp, Homo sapiens
tgacatgggacatttgct

SEQ ID NO: 2758013 - DNA, 19 bp, Homo sapiens
tgaccttaaggaaaagtaa

SEQ ID NO: 2758014 - DNA, 23 bp, Homo sapiens
tgaccttaaggaaaagtaaggga

SEQ ID NO: 2758015 - DNA, 12 bp, Homo sapiens
tgacggcctgcc

SEQ ID NO: 2758016 - DNA, 16 bp, Homo sapiens
tgactctgtccaactc

SEQ ID NO: 2758017 - DNA, 12 bp, Homo sapiens
tgactcttaaga

SEQ ID NO: 2758018 - DNA, 15 bp, Homo sapiens
tgactgggctgggtt

SEQ ID NO: 2758019 - DNA, 17 bp, Homo sapiens
tgactgggctgggtttg

SEQ ID NO: 2758020 - DNA, 20 bp, Homo sapiens
tgactgggctgggtttgctg

SEQ ID NO: 2758021 - DNA, 14 bp, Homo sapiens
tgagaaagaaagta

SEQ ID NO: 2758022 - DNA, 17 bp, Homo sapiens
tgagaaagaaagtaaaa

SEQ ID NO: 2758023 - DNA, 17 bp, Homo sapiens
tgagaatgttaccagac

SEQ ID NO: 2758024 - DNA, 16 bp, Homo sapiens
tgagacccctttaaac

SEQ ID NO: 2758025 - DNA, 18 bp, Homo sapiens
tgagacccctttaaactg

SEQ ID NO: 2758026 - DNA, 15 bp, Homo sapiens
tgaggccaggacttt

SEQ ID NO: 2758027 - DNA, 16 bp, Homo sapiens
tgagtatttgctgttt

SEQ ID NO: 2758028 - DNA, 21 bp, Homo sapiens
tgagttgcttcttcttgtgga

SEQ ID NO: 2758029 - DNA, 14 bp, Homo sapiens
tgagttggctggga

SEQ ID NO: 2758030 - DNA, 16 bp, Homo sapiens
tgagttggctgggaat

SEQ ID NO: 2758031 - DNA, 22 bp, Homo sapiens
tgagttgggggtattttctaat

SEQ ID NO: 2758032 - DNA, 13 bp, Homo sapiens
tgatactgtcttt

SEQ ID NO: 2758033 - DNA, 18 bp, Homo sapiens
tgatactgtctttgcata

SEQ ID NO: 2758034 - DNA, 21 bp, Homo sapiens
tgatagaaggctatggggata

SEQ ID NO: 2758035 - DNA, 17 bp, Homo sapiens
tgatataaagaatgaaa

SEQ ID NO: 2758036 - DNA, 19 bp, Homo sapiens
tgatataaagaatgaaagt

SEQ ID NO: 2758037 - DNA, 16 bp, Homo sapiens
tgatcaaaaataatgc

SEQ ID NO: 2758038 - DNA, 14 bp, Homo sapiens
tgatctgtagtttt

SEQ ID NO: 2758039 - DNA, 21 bp, Homo sapiens
tgatcttagggaactttgata

SEQ ID NO: 2758040 - DNA, 12 bp, Homo sapiens
tgatgaagaagt

SEQ ID NO: 2758041 - DNA, 13 bp, Homo sapiens
tgatgcagtgccc

SEQ ID NO: 2758042 - DNA, 17 bp, Homo sapiens
tgatgcagtgccctaga

SEQ ID NO: 2758043 - DNA, 12 bp, Homo sapiens
tgattaaatctc

SEQ ID NO: 2758044 - DNA, 15 bp, Homo sapiens
tgattaatgaagaaa

SEQ ID NO: 2758045 - DNA, 12 bp, Homo sapiens
tgattaatgtac

SEQ ID NO: 2758046 - DNA, 13 bp, Homo sapiens
tgattaatgtact

SEQ ID NO: 2758047 - DNA, 17 bp, Homo sapiens
tgattatgaattacatt

SEQ ID NO: 2758048 - DNA, 19 bp, Homo sapiens
tgattatgaattacatttg

SEQ ID NO: 2758049 - DNA, 19 bp, Homo sapiens
tgatttaaaaagtgagaaa

SEQ ID NO: 2758050 - DNA, 18 bp, Homo sapiens
tgatttctccagaaattt

SEQ ID NO: 2758051 - DNA, 18 bp, Homo sapiens
tgattttcaaaaaaatgt

SEQ ID NO: 2758052 - DNA, 13 bp, Homo sapiens
tgcaaaatattgg

SEQ ID NO: 2758053 - DNA, 19 bp, Homo sapiens
tgcaaaatattggtattaa

SEQ ID NO: 2758054 - DNA, 20 bp, Homo sapiens
tgcaaacctgctggtggggc

SEQ ID NO: 2758055 - DNA, 15 bp, Homo sapiens
tgcaagagactttgt

SEQ ID NO: 2758056 - DNA, 16 bp, Homo sapiens
tgcaagagactttgtc

SEQ ID NO: 2758057 - DNA, 17 bp, Homo sapiens
tgcaagagactttgtca

SEQ ID NO: 2758058 - DNA, 15 bp, Homo sapiens
tgcaagccagatttt

SEQ ID NO: 2758059 - DNA, 22 bp, Homo sapiens
tgcaaggattttttaaaaattg

SEQ ID NO: 2758060 - DNA, 14 bp, Homo sapiens
tgcaagtgtttctg

SEQ ID NO: 2758061 - DNA, 18 bp, Homo sapiens
tgcaatgtgatctatgtt

SEQ ID NO: 2758062 - DNA, 21 bp, Homo sapiens
tgcaccccgccggaggaaggt

SEQ ID NO: 2758063 - DNA, 13 bp, Homo sapiens
tgcactttgtagt

SEQ ID NO: 2758064 - DNA, 18 bp, Homo sapiens
tgcactttgtagtgtttg

SEQ ID NO: 2758065 - DNA, 18 bp, Homo sapiens
tgcaggctcccaaactca

SEQ ID NO: 2758066 - DNA, 12 bp, Homo sapiens
tgcagggctggt

SEQ ID NO: 2758067 - DNA, 15 bp, Homo sapiens
tgcaggtctttaaat

SEQ ID NO: 2758068 - DNA, 23 bp, Homo sapiens
tgcaggttggcaaacgggcttga

SEQ ID NO: 2758069 - DNA, 19 bp, Homo sapiens
tgcagtgccctagaagggg

SEQ ID NO: 2758070 - DNA, 12 bp, Homo sapiens
tgcagttctgaa

SEQ ID NO: 2758071 - DNA, 15 bp, Homo sapiens
tgcagttctgaagaa

SEQ ID NO: 2758072 - DNA, 17 bp, Homo sapiens
tgcagttctgaagaaga

SEQ ID NO: 2758073 - DNA, 20 bp, Homo sapiens
tgcagttgaattcagtgggt

SEQ ID NO: 2758074 - DNA, 21 bp, Homo sapiens
tgcataaaagggtcaaacctg

SEQ ID NO: 2758075 - DNA, 22 bp, Homo sapiens
tgcataaaagggtcaaacctgt

SEQ ID NO: 2758076 - DNA, 17 bp, Homo sapiens
tgcataaatttgtaata

SEQ ID NO: 2758077 - DNA, 18 bp, Homo sapiens
tgcataaatttgtaatat

SEQ ID NO: 2758078 - DNA, 23 bp, Homo sapiens
tgcataaatttgtaatatatcct

SEQ ID NO: 2758079 - DNA, 14 bp, Homo sapiens
tgcatatctgttta

SEQ ID NO: 2758080 - DNA, 18 bp, Homo sapiens
tgcatatctgtttattct

SEQ ID NO: 2758081 - DNA, 13 bp, Homo sapiens
tgcatcttagttt

SEQ ID NO: 2758082 - DNA, 23 bp, Homo sapiens
tgcatctttcatagttctgttaa

SEQ ID NO: 2758083 - DNA, 16 bp, Homo sapiens
tgcatggtgtgaacta

SEQ ID NO: 2758084 - DNA, 17 bp, Homo sapiens
tgcattacttactgtta

SEQ ID NO: 2758085 - DNA, 20 bp, Homo sapiens
tgcattatatttattactgt

SEQ ID NO: 2758086 - DNA, 14 bp, Homo sapiens
tgcattctatcgtt

SEQ ID NO: 2758087 - DNA, 15 bp, Homo sapiens
tgccaaaaattcatg

SEQ ID NO: 2758088 - DNA, 15 bp, Homo sapiens
tgccacatcttgaaa

SEQ ID NO: 2758089 - DNA, 20 bp, Homo sapiens
tgccacatcttgaaaatgcc

SEQ ID NO: 2758090 - DNA, 18 bp, Homo sapiens
tgccaccatccaataaaa

SEQ ID NO: 2758091 - DNA, 18 bp, Homo sapiens
tgccatagtcaaagagag

SEQ ID NO: 2758092 - DNA, 16 bp, Homo sapiens
tgcccacgcccttgga

SEQ ID NO: 2758093 - DNA, 22 bp, Homo sapiens
tgcccacgcccttggagccttc

SEQ ID NO: 2758094 - DNA, 24 bp, Homo sapiens
tgcccacgcccttggagccttcca

SEQ ID NO: 2758095 - DNA, 13 bp, Homo sapiens
tgccgcctgtcaa

SEQ ID NO: 2758096 - DNA, 14 bp, Homo sapiens
tgccgcctgtcaat

SEQ ID NO: 2758097 - DNA, 17 bp, Homo sapiens
tgcctaaggccagccat

SEQ ID NO: 2758098 - DNA, 18 bp, Homo sapiens
tgcctgagaatgttacca

SEQ ID NO: 2758099 - DNA, 23 bp, Homo sapiens
tgcctgcaaacctgctggtgggg

SEQ ID NO: 2758100 - DNA, 16 bp, Homo sapiens
tgcctggagtgctgtg

SEQ ID NO: 2758101 - DNA, 17 bp, Homo sapiens
tgcctgtagtctcagct

SEQ ID NO: 2758102 - DNA, 16 bp, Homo sapiens
tgcctgtcactactgg

SEQ ID NO: 2758103 - DNA, 15 bp, Homo sapiens
tgccttctcaactcc

SEQ ID NO: 2758104 - DNA, 19 bp, Homo sapiens
tgccttgtgaaggaattat

SEQ ID NO: 2758105 - DNA, 17 bp, Homo sapiens
tgccttttcccaactcc

SEQ ID NO: 2758106 - DNA, 22 bp, Homo sapiens
tgcgatttcacagttggcactt

SEQ ID NO: 2758107 - DNA, 13 bp, Homo sapiens
tgcgtggaaaaag

SEQ ID NO: 2758108 - DNA, 15 bp, Homo sapiens
tgcgtggaaaaagac

SEQ ID NO: 2758109 - DNA, 11 bp, Homo sapiens
tgctaaaattc

SEQ ID NO: 2758110 - DNA, 21 bp, Homo sapiens
tgctaaaattctatagagata

SEQ ID NO: 2758111 - DNA, 23 bp, Homo sapiens
tgctaaaattctatagagataga

SEQ ID NO: 2758112 - DNA, 12 bp, Homo sapiens
tgctaaacttgg

SEQ ID NO: 2758113 - DNA, 15 bp, Homo sapiens
tgctaagcattccaa

SEQ ID NO: 2758114 - DNA, 14 bp, Homo sapiens
tgctaaggaacaat

SEQ ID NO: 2758115 - DNA, 12 bp, Homo sapiens
tgctacgaagaa

SEQ ID NO: 2758116 - DNA, 13 bp, Homo sapiens
tgctagagttaaa

SEQ ID NO: 2758117 - DNA, 19 bp, Homo sapiens
tgctagagttaaaagttag

SEQ ID NO: 2758118 - DNA, 16 bp, Homo sapiens
tgctagtaattggaaa

SEQ ID NO: 2758119 - DNA, 14 bp, Homo sapiens
tgctctgatgcagt

SEQ ID NO: 2758120 - DNA, 18 bp, Homo sapiens
tgctctgatgcagtgccc

SEQ ID NO: 2758121 - DNA, 22 bp, Homo sapiens
tgctctgatgcagtgccctaga

SEQ ID NO: 2758122 - DNA, 15 bp, Homo sapiens
tgctgagttgcttct

SEQ ID NO: 2758123 - DNA, 14 bp, Homo sapiens
ttgtaaaaactttt

SEQ ID NO: 2758124 - DNA, 22 bp, Homo sapiens
ttgtaaaaacttttttctttga

SEQ ID NO: 2758125 - DNA, 12 bp, Homo sapiens
ttgtaaagtaaa

SEQ ID NO: 2758126 - DNA, 16 bp, Homo sapiens
ttgtaaagtaaaatat

SEQ ID NO: 2758127 - DNA, 11 bp, Homo sapiens
ttgtaaatctg

SEQ ID NO: 2758128 - DNA, 12 bp, Homo sapiens
ttgtaaatctgt

SEQ ID NO: 2758129 - DNA, 16 bp, Homo sapiens
ttgtaatatatcctgt

SEQ ID NO: 2758130 - DNA, 16 bp, Homo sapiens
ttgtacatcgcttctt

SEQ ID NO: 2758131 - DNA, 12 bp, Homo sapiens
ttgtagaaagct

SEQ ID NO: 2758132 - DNA, 19 bp, Homo sapiens
ttgtagaaagctaatacaa

SEQ ID NO: 2758133 - DNA, 17 bp, Homo sapiens
ttgtataaaagttgtac

SEQ ID NO: 2758134 - DNA, 19 bp, Homo sapiens
ttgtataaaagttgtactg

SEQ ID NO: 2758135 - DNA, 15 bp, Homo sapiens
ttgtataaaataatt

SEQ ID NO: 2758136 - DNA, 19 bp, Homo sapiens
ttgtataaaataattttta

SEQ ID NO: 2758137 - DNA, 16 bp, Homo sapiens
ttgtccatttaaaaat

SEQ ID NO: 2758138 - DNA, 15 bp, Homo sapiens
ttgtctagtgaaact

SEQ ID NO: 2758139 - DNA, 11 bp, Homo sapiens
ttgtgggaata

SEQ ID NO: 2758140 - DNA, 15 bp, Homo sapiens
ttgtggttttgggaa

SEQ ID NO: 2758141 - DNA, 13 bp, Homo sapiens
ttgtgtataagtt

SEQ ID NO: 2758142 - DNA, 13 bp, Homo sapiens
ttgtgtataattt

SEQ ID NO: 2758143 - DNA, 19 bp, Homo sapiens
ttgtgtatcttgattaatg

SEQ ID NO: 2758144 - DNA, 23 bp, Homo sapiens
ttgtgtgaaaggtacttcaaatc

SEQ ID NO: 2758145 - DNA, 19 bp, Homo sapiens
ttgtgttgggggaaatgtt

SEQ ID NO: 2758146 - DNA, 21 bp, Homo sapiens
ttgtgttgggggaaatgttgt

SEQ ID NO: 2758147 - DNA, 22 bp, Homo sapiens
ttgttaaaaaaaaaaagattgt

SEQ ID NO: 2758148 - DNA, 16 bp, Homo sapiens
ttgttctgactttttg

SEQ ID NO: 2758149 - DNA, 12 bp, Homo sapiens
ttgttctgtccc

SEQ ID NO: 2758150 - DNA, 15 bp, Homo sapiens
ttgttgttttatata

SEQ ID NO: 2758151 - DNA, 17 bp, Homo sapiens
ttgtttaataagtatat

SEQ ID NO: 2758152 - DNA, 22 bp, Homo sapiens
ttgtttaataagtatatcttaa

SEQ ID NO: 2758153 - DNA, 15 bp, Homo sapiens
ttgtttggatttcct

SEQ ID NO: 2758154 - DNA, 10 bp, Homo sapiens
ttgtttgttt

SEQ ID NO: 2758155 - DNA, 13 bp, Homo sapiens
ttgtttgtttttg

SEQ ID NO: 2758156 - DNA, 15 bp, Homo sapiens
ttgttttaagcaaat

SEQ ID NO: 2758157 - DNA, 16 bp, Homo sapiens
ttgttttaagcaaatg

SEQ ID NO: 2758158 - DNA, 13 bp, Homo sapiens
tttaaaaattggc

SEQ ID NO: 2758159 - DNA, 19 bp, Homo sapiens
tttaaaaattggcatttta

SEQ ID NO: 2758160 - DNA, 16 bp, Homo sapiens
tttaaaagagacaaac

SEQ ID NO: 2758161 - DNA, 14 bp, Homo sapiens
tttaaaagcaaata

SEQ ID NO: 2758162 - DNA, 16 bp, Homo sapiens
tttaaaattgtgatgt

SEQ ID NO: 2758163 - DNA, 15 bp, Homo sapiens
tttaaagaatccaag

SEQ ID NO: 2758164 - DNA, 21 bp, Homo sapiens
tttaactctactgtgtaatat

SEQ ID NO: 2758165 - DNA, 15 bp, Homo sapiens
tttaaggattctgca

SEQ ID NO: 2758166 - DNA, 17 bp, Homo sapiens
tttaatagaaccatgtt

SEQ ID NO: 2758167 - DNA, 15 bp, Homo sapiens
tttaatattacctaa

SEQ ID NO: 2758168 - DNA, 21 bp, Homo sapiens
tttaatgcaatgcatatctgt

SEQ ID NO: 2758169 - DNA, 20 bp, Homo sapiens
tttacctctcattagaaagg

SEQ ID NO: 2758170 - DNA, 13 bp, Homo sapiens
tttactacagttt

SEQ ID NO: 2758171 - DNA, 20 bp, Homo sapiens
tttagaaacacaactatatt

SEQ ID NO: 2758172 - DNA, 20 bp, Homo sapiens
tttagaacctacaaaagctt

SEQ ID NO: 2758173 - DNA, 18 bp, Homo sapiens
tttagatttttaaattgg

SEQ ID NO: 2758174 - DNA, 17 bp, Homo sapiens
tttagctagaatccaca

SEQ ID NO: 2758175 - DNA, 20 bp, Homo sapiens
tttataaaaacattgaaata

SEQ ID NO: 2758176 - DNA, 22 bp, Homo sapiens
tttataattttgtgaagcaaaa

SEQ ID NO: 2758177 - DNA, 21 bp, Homo sapiens
tttatactgtgaagttacatg

SEQ ID NO: 2758178 - DNA, 20 bp, Homo sapiens
tttatatatgaatattacat

SEQ ID NO: 2758179 - DNA, 21 bp, Homo sapiens
tttatcaaggaagtcttcaaa

SEQ ID NO: 2758180 - DNA, 23 bp, Homo sapiens
tttatcaaggaagtcttcaaatt

SEQ ID NO: 2758181 - DNA, 21 bp, Homo sapiens
tttatgatttctccagaaatt

SEQ ID NO: 2758182 - DNA, 11 bp, Homo sapiens
tttatgtgtgt

SEQ ID NO: 2758183 - DNA, 14 bp, Homo sapiens
tttatgttcttata

SEQ ID NO: 2758184 - DNA, 14 bp, Homo sapiens
tttattcaaaatat

SEQ ID NO: 2758185 - DNA, 19 bp, Homo sapiens
tttattctgggaaatgttt

SEQ ID NO: 2758186 - DNA, 12 bp, Homo sapiens
tttattgcatgg

SEQ ID NO: 2758187 - DNA, 14 bp, Homo sapiens
tttatttagaaact

SEQ ID NO: 2758188 - DNA, 19 bp, Homo sapiens
tttattttgaatgtacctc

SEQ ID NO: 2758189 - DNA, 14 bp, Homo sapiens
tttcaaatattgaa

SEQ ID NO: 2758190 - DNA, 17 bp, Homo sapiens
tttcaaatattgaatgc

SEQ ID NO: 2758191 - DNA, 15 bp, Homo sapiens
tttcaattgagtaat

SEQ ID NO: 2758192 - DNA, 24 bp, Homo sapiens
tttcaattgagtaattctagacat

SEQ ID NO: 2758193 - DNA, 19 bp, Homo sapiens
tttcacagttggcacttct

SEQ ID NO: 2758194 - DNA, 16 bp, Homo sapiens
tttcatagttctgtta

SEQ ID NO: 2758195 - DNA, 17 bp, Homo sapiens
tttcatagttctgttaa

SEQ ID NO: 2758196 - DNA, 15 bp, Homo sapiens
tttcatgacagaata

SEQ ID NO: 2758197 - DNA, 21 bp, Homo sapiens
tttcatgacagaatatacaca

SEQ ID NO: 2758198 - DNA, 18 bp, Homo sapiens
tttccaagtgtataatgt

SEQ ID NO: 2758199 - DNA, 20 bp, Homo sapiens
tttccactattatagaaatt

SEQ ID NO: 2758200 - DNA, 19 bp, Homo sapiens
tttccagcctttgtcacta

SEQ ID NO: 2758201 - DNA, 12 bp, Homo sapiens
tttctaattttt

SEQ ID NO: 2758202 - DNA, 20 bp, Homo sapiens
tttctatgaaatattatgtt

SEQ ID NO: 2758203 - DNA, 14 bp, Homo sapiens
tttctccagaaatt

SEQ ID NO: 2758204 - DNA, 21 bp, Homo sapiens
tttgaaggaatacaatatata

SEQ ID NO: 2758205 - DNA, 12 bp, Homo sapiens
tttgaatgtacc

SEQ ID NO: 2758206 - DNA, 23 bp, Homo sapiens
tttgacctgttgggagtgaggat

SEQ ID NO: 2758207 - DNA, 15 bp, Homo sapiens
tttgactctgtccaa

SEQ ID NO: 2758208 - DNA, 12 bp, Homo sapiens
tttgatacaaat

SEQ ID NO: 2758209 - DNA, 22 bp, Homo sapiens
tttgcaggtctttaaatcattt

SEQ ID NO: 2758210 - DNA, 19 bp, Homo sapiens
tttgcatacatgaataaaa

SEQ ID NO: 2758211 - DNA, 23 bp, Homo sapiens
tttgcatttttgtattttgtaca

SEQ ID NO: 2758212 - DNA, 20 bp, Homo sapiens
tttgccttttaaattctttt

SEQ ID NO: 2758213 - DNA, 13 bp, Homo sapiens
tttgcttggtgct

SEQ ID NO: 2758214 - DNA, 18 bp, Homo sapiens
tttgcttggtgctggttt

SEQ ID NO: 2758215 - DNA, 17 bp, Homo sapiens
tttgctttctgaaattc

SEQ ID NO: 2758216 - DNA, 22 bp, Homo sapiens
tttggatttcctttatactgtg

SEQ ID NO: 2758217 - DNA, 18 bp, Homo sapiens
tttggtaaggggaattga

SEQ ID NO: 2758218 - DNA, 16 bp, Homo sapiens
tttgtaaagtaaaata

SEQ ID NO: 2758219 - DNA, 23 bp, Homo sapiens
tttgtaaatctgtacttttttca

SEQ ID NO: 2758220 - DNA, 17 bp, Homo sapiens
tttgtaaatttatgtga

SEQ ID NO: 2758221 - DNA, 17 bp, Homo sapiens
tttgtaaggcttgttcc

SEQ ID NO: 2758222 - DNA, 12 bp, Homo sapiens
tttgtacatttg

SEQ ID NO: 2758223 - DNA, 21 bp, Homo sapiens
tttgtataaaataatttttat

SEQ ID NO: 2758224 - DNA, 18 bp, Homo sapiens
tttgtatttttttccaag

SEQ ID NO: 2758225 - DNA, 13 bp, Homo sapiens
tttgtcacttatt

SEQ ID NO: 2758226 - DNA, 13 bp, Homo sapiens
tttgtgtttgctt

SEQ ID NO: 2758227 - DNA, 18 bp, Homo sapiens
tttgttgttttctggggg

SEQ ID NO: 2758228 - DNA, 20 bp, Homo sapiens
tttgtttttgctttctgaaa

SEQ ID NO: 2758229 - DNA, 13 bp, Homo sapiens
ttttaaaaaagaa

SEQ ID NO: 2758230 - DNA, 16 bp, Homo sapiens
ttttaaaactgcattt

SEQ ID NO: 2758231 - DNA, 14 bp, Homo sapiens
ttttaaaagagaca

SEQ ID NO: 2758232 - DNA, 23 bp, Homo sapiens
ttttaaaagagacaaactgtaaa

SEQ ID NO: 2758233 - DNA, 23 bp, Homo sapiens
ttttaaagaatccaagacaaact

SEQ ID NO: 2758234 - DNA, 13 bp, Homo sapiens
ttttaaattcttt

SEQ ID NO: 2758235 - DNA, 16 bp, Homo sapiens
ttttaagcaaatgcat

SEQ ID NO: 2758236 - DNA, 21 bp, Homo sapiens
ttttaagcaaatgcattctat

SEQ ID NO: 2758237 - DNA, 16 bp, Homo sapiens
ttttaataatgtttca

SEQ ID NO: 2758238 - DNA, 12 bp, Homo sapiens
ttttaatagaac

SEQ ID NO: 2758239 - DNA, 14 bp, Homo sapiens
ttttaattgtttaa

SEQ ID NO: 2758240 - DNA, 21 bp, Homo sapiens
ttttataattttgtgaagcaa

SEQ ID NO: 2758241 - DNA, 23 bp, Homo sapiens
ttttataattttgtgaagcaaaa

SEQ ID NO: 2758242 - DNA, 15 bp, Homo sapiens
ttttatatatgaata

SEQ ID NO: 2758243 - DNA, 16 bp, Homo sapiens
ttttatatatgaatat

SEQ ID NO: 2758244 - DNA, 21 bp, Homo sapiens
ttttatatatgaatattacat

SEQ ID NO: 2758245 - DNA, 22 bp, Homo sapiens
ttttatatatgaatattacatg

SEQ ID NO: 2758246 - DNA, 15 bp, Homo sapiens
ttttatatgcttctg

SEQ ID NO: 2758247 - DNA, 10 bp, Homo sapiens
ttttatattt

SEQ ID NO: 2758248 - DNA, 12 bp, Homo sapiens
ttttatcttaaa

SEQ ID NO: 2758249 - DNA, 16 bp, Homo sapiens
ttttatcttaaactgt

SEQ ID NO: 2758250 - DNA, 18 bp, Homo sapiens
aaataatttttatatttg

SEQ ID NO: 2758251 - DNA, 20 bp, Homo sapiens
aaataatttttatatttgaa

SEQ ID NO: 2758252 - DNA, 21 bp, Homo sapiens
aaataatttttatatttgaaa

SEQ ID NO: 2758253 - DNA, 14 bp, Homo sapiens
aaatacaaatctgt

SEQ ID NO: 2758254 - DNA, 16 bp, Homo sapiens
aaatacaaatctgtat

SEQ ID NO: 2758255 - DNA, 17 bp, Homo sapiens
aaatacataacttcagt

SEQ ID NO: 2758256 - DNA, 17 bp, Homo sapiens
aaataccaggaccagtt

SEQ ID NO: 2758257 - DNA, 15 bp, Homo sapiens
aaatacctcaggaaa

SEQ ID NO: 2758258 - DNA, 18 bp, Homo sapiens
aaatacctcaggaaagaa

SEQ ID NO: 2758259 - DNA, 12 bp, Homo sapiens
aaatactgattt

SEQ ID NO: 2758260 - DNA, 17 bp, Homo sapiens
aaatagcgattataatc

SEQ ID NO: 2758261 - DNA, 22 bp, Homo sapiens
aaatatcacttgtcaataaaat

SEQ ID NO: 2758262 - DNA, 17 bp, Homo sapiens
aaatatctgaacattta

SEQ ID NO: 2758263 - DNA, 19 bp, Homo sapiens
aaatatctgaacatttact

SEQ ID NO: 2758264 - DNA, 17 bp, Homo sapiens
aaatattatgttaaaac

SEQ ID NO: 2758265 - DNA, 21 bp, Homo sapiens
aaatattgaatgccttatttt

SEQ ID NO: 2758266 - DNA, 14 bp, Homo sapiens
aaatatttttgtac

SEQ ID NO: 2758267 - DNA, 17 bp, Homo sapiens
aaatcagaataaattaa

SEQ ID NO: 2758268 - DNA, 15 bp, Homo sapiens
aaatcaggagcctgc

SEQ ID NO: 2758269 - DNA, 18 bp, Homo sapiens
aaatccatacatttgtgt

SEQ ID NO: 2758270 - DNA, 18 bp, Homo sapiens
aaatctcaatatttcaga

SEQ ID NO: 2758271 - DNA, 16 bp, Homo sapiens
aaatctctagcctctt

SEQ ID NO: 2758272 - DNA, 14 bp, Homo sapiens
aaatctgtactttt

SEQ ID NO: 2758273 - DNA, 22 bp, Homo sapiens
aaatctgtacttttttcaaata

SEQ ID NO: 2758274 - DNA, 16 bp, Homo sapiens
aaatcttggtgtaact

SEQ ID NO: 2758275 - DNA, 11 bp, Homo sapiens
aaatgaagcag

SEQ ID NO: 2758276 - DNA, 15 bp, Homo sapiens
aaatgaagcagaagc

SEQ ID NO: 2758277 - DNA, 15 bp, Homo sapiens
aaatgagaccccttt

SEQ ID NO: 2758278 - DNA, 21 bp, Homo sapiens
aaatgagacccctttaaactg

SEQ ID NO: 2758279 - DNA, 17 bp, Homo sapiens
aaatgcattctatcgtt

SEQ ID NO: 2758280 - DNA, 23 bp, Homo sapiens
aaatgcattctatcgttattata

SEQ ID NO: 2758281 - DNA, 18 bp, Homo sapiens
aaatgccaccatccaata

SEQ ID NO: 2758282 - DNA, 12 bp, Homo sapiens
aaatgctaaact

SEQ ID NO: 2758283 - DNA, 14 bp, Homo sapiens
aaatgctaaacttg

SEQ ID NO: 2758284 - DNA, 18 bp, Homo sapiens
aaatgcttcactgtacgt

SEQ ID NO: 2758285 - DNA, 20 bp, Homo sapiens
aaatggaaaattaattctaa

SEQ ID NO: 2758286 - DNA, 21 bp, Homo sapiens
aaatggaaaattaattctaaa

SEQ ID NO: 2758287 - DNA, 14 bp, Homo sapiens
aaatgtctattatt

SEQ ID NO: 2758288 - DNA, 16 bp, Homo sapiens
aaatgtctattattat

SEQ ID NO: 2758289 - DNA, 13 bp, Homo sapiens
aaatgttagttct

SEQ ID NO: 2758290 - DNA, 14 bp, Homo sapiens
aaatgttagttcta

SEQ ID NO: 2758291 - DNA, 12 bp, Homo sapiens
aaatgtttttaa

SEQ ID NO: 2758292 - DNA, 15 bp, Homo sapiens
aaatgtttttaaaaa

SEQ ID NO: 2758293 - DNA, 14 bp, Homo sapiens
aaattaatattgta

SEQ ID NO: 2758294 - DNA, 14 bp, Homo sapiens
aaattaattctaaa

SEQ ID NO: 2758295 - DNA, 19 bp, Homo sapiens
aaattaattctaaacttag

SEQ ID NO: 2758296 - DNA, 14 bp, Homo sapiens
aaattatttgcagg

SEQ ID NO: 2758297 - DNA, 13 bp, Homo sapiens
aaattatttgtgt

SEQ ID NO: 2758298 - DNA, 21 bp, Homo sapiens
aaattatttgtgttgggggaa

SEQ ID NO: 2758299 - DNA, 16 bp, Homo sapiens
aaattggagaaaagca

SEQ ID NO: 2758300 - DNA, 19 bp, Homo sapiens
aaattggagaaaagcactt

SEQ ID NO: 2758301 - DNA, 20 bp, Homo sapiens
aaattggagaaaagcactta

SEQ ID NO: 2758302 - DNA, 21 bp, Homo sapiens
aaattggagaaaagcacttaa

SEQ ID NO: 2758303 - DNA, 15 bp, Homo sapiens
aaattgtgcaaaata

SEQ ID NO: 2758304 - DNA, 23 bp, Homo sapiens
aaatttaccacaaaagcaaaatt

SEQ ID NO: 2758305 - DNA, 22 bp, Homo sapiens
aaattttcattctgaatctgaa

SEQ ID NO: 2758306 - DNA, 21 bp, Homo sapiens
aaattttctctaaactgtttc

SEQ ID NO: 2758307 - DNA, 16 bp, Homo sapiens
aaattttttaaaagag

SEQ ID NO: 2758308 - DNA, 20 bp, Homo sapiens
aaattttttctctaggaaat

SEQ ID NO: 2758309 - DNA, 15 bp, Homo sapiens
aacaaattttaagtg

SEQ ID NO: 2758310 - DNA, 15 bp, Homo sapiens
aacaaccctgttgag

SEQ ID NO: 2758311 - DNA, 19 bp, Homo sapiens
aacaaccctgttgagtatt

SEQ ID NO: 2758312 - DNA, 14 bp, Homo sapiens
aacaagcccaaagc

SEQ ID NO: 2758313 - DNA, 15 bp, Homo sapiens
aacaaggatgaatta

SEQ ID NO: 2758314 - DNA, 20 bp, Homo sapiens
aacaagtacctgtgaacagt

SEQ ID NO: 2758315 - DNA, 20 bp, Homo sapiens
aacaatgccgcctgtcaata

SEQ ID NO: 2758316 - DNA, 21 bp, Homo sapiens
aacaatgccgcctgtcaataa

SEQ ID NO: 2758317 - DNA, 14 bp, Homo sapiens
aacaatgctgtatt

SEQ ID NO: 2758318 - DNA, 17 bp, Homo sapiens
aacacaactatattgtt

SEQ ID NO: 2758319 - DNA, 22 bp, Homo sapiens
aacagcttcatgttcccaaaat

SEQ ID NO: 2758320 - DNA, 12 bp, Homo sapiens
aacatatataac

SEQ ID NO: 2758321 - DNA, 22 bp, Homo sapiens
aacatcccaagattttttcatt

SEQ ID NO: 2758322 - DNA, 18 bp, Homo sapiens
aacattcctaaaatgctt

SEQ ID NO: 2758323 - DNA, 14 bp, Homo sapiens
aacattgaaatatt

SEQ ID NO: 2758324 - DNA, 15 bp, Homo sapiens
aacattgaaatatta

SEQ ID NO: 2758325 - DNA, 17 bp, Homo sapiens
aacattgaaatattagt

SEQ ID NO: 2758326 - DNA, 14 bp, Homo sapiens
aaccacaaaagttg

SEQ ID NO: 2758327 - DNA, 17 bp, Homo sapiens
aacctagggtgatatta

SEQ ID NO: 2758328 - DNA, 20 bp, Homo sapiens
aacctagggtgatattaacc

SEQ ID NO: 2758329 - DNA, 16 bp, Homo sapiens
aacctgtagatgcaga

SEQ ID NO: 2758330 - DNA, 12 bp, Homo sapiens
aacctttcaaaa

SEQ ID NO: 2758331 - DNA, 23 bp, Homo sapiens
aacggtgaaatctctagcctctt

SEQ ID NO: 2758332 - DNA, 13 bp, Homo sapiens
aactaaaattctg

SEQ ID NO: 2758333 - DNA, 15 bp, Homo sapiens
aactaaactttacta

SEQ ID NO: 2758334 - DNA, 17 bp, Homo sapiens
aactaagttattgctgc

SEQ ID NO: 2758335 - DNA, 13 bp, Homo sapiens
aactagagaaggg

SEQ ID NO: 2758336 - DNA, 12 bp, Homo sapiens
aactataaatac

SEQ ID NO: 2758337 - DNA, 15 bp, Homo sapiens
aactataaatacaaa

SEQ ID NO: 2758338 - DNA, 16 bp, Homo sapiens
aactataaatacaaat

SEQ ID NO: 2758339 - DNA, 17 bp, Homo sapiens
aactataaatacaaatc

SEQ ID NO: 2758340 - DNA, 18 bp, Homo sapiens
aactataaatacaaatct

SEQ ID NO: 2758341 - DNA, 21 bp, Homo sapiens
aactatcctatgccttcaaat

SEQ ID NO: 2758342 - DNA, 21 bp, Homo sapiens
aactattaattccatgtgata

SEQ ID NO: 2758343 - DNA, 18 bp, Homo sapiens
aactcaatatatagttag

SEQ ID NO: 2758344 - DNA, 23 bp, Homo sapiens
aactcaatatatagttagcttta

SEQ ID NO: 2758345 - DNA, 12 bp, Homo sapiens
aactcaggcatt

SEQ ID NO: 2758346 - DNA, 15 bp, Homo sapiens
aactcgcacctgtgc

SEQ ID NO: 2758347 - DNA, 17 bp, Homo sapiens
aactcgcacctgtgctg

SEQ ID NO: 2758348 - DNA, 12 bp, Homo sapiens
aactgaaatcat

SEQ ID NO: 2758349 - DNA, 23 bp, Homo sapiens
aactgatgcgacttgttttgctg

SEQ ID NO: 2758350 - DNA, 17 bp, Homo sapiens
aactgggacaggggaga

SEQ ID NO: 2758351 - DNA, 23 bp, Homo sapiens
aactggttctgtgttgaaatata

SEQ ID NO: 2758352 - DNA, 17 bp, Homo sapiens
aactgtaccttttgcga

SEQ ID NO: 2758353 - DNA, 18 bp, Homo sapiens
aactgtaccttttgcgat

SEQ ID NO: 2758354 - DNA, 13 bp, Homo sapiens
aacttagaaatat

SEQ ID NO: 2758355 - DNA, 15 bp, Homo sapiens
aacttagaaatatgc

SEQ ID NO: 2758356 - DNA, 13 bp, Homo sapiens
aacttcaaatttt

SEQ ID NO: 2758357 - DNA, 21 bp, Homo sapiens
aacttcagcggtttatataag

SEQ ID NO: 2758358 - DNA, 23 bp, Homo sapiens
aacttggctgtatgtcaaattgt

SEQ ID NO: 2758359 - DNA, 13 bp, Homo sapiens
aactttagaattc

SEQ ID NO: 2758360 - DNA, 16 bp, Homo sapiens
aactttattttgaatg

SEQ ID NO: 2758361 - DNA, 19 bp, Homo sapiens
aagaaaaaaaaagaattac

SEQ ID NO: 2758362 - DNA, 20 bp, Homo sapiens
aagaaaaaaactataaatac

SEQ ID NO: 2758363 - DNA, 12 bp, Homo sapiens
aagaaaaaagtc

SEQ ID NO: 2758364 - DNA, 17 bp, Homo sapiens
aagaaaaaagtccttca

SEQ ID NO: 2758365 - DNA, 21 bp, Homo sapiens
aagaaaaaagtccttcagttt

SEQ ID NO: 2758366 - DNA, 20 bp, Homo sapiens
aagaaaccatgcaaagcaac

SEQ ID NO: 2758367 - DNA, 14 bp, Homo sapiens
aagaaagtaaaacc

SEQ ID NO: 2758368 - DNA, 15 bp, Homo sapiens
aagaaagtaaaacca

SEQ ID NO: 2758369 - DNA, 19 bp, Homo sapiens
aagaaagtctatctaatga

SEQ ID NO: 2758370 - DNA, 11 bp, Homo sapiens
aagaactgaaa

SEQ ID NO: 2758371 - DNA, 20 bp, Homo sapiens
aagaagactgcattatattt

SEQ ID NO: 2758372 - DNA, 15 bp, Homo sapiens
aagaatgaaagtagc

SEQ ID NO: 2758373 - DNA, 18 bp, Homo sapiens
aagaatgattatgaatta

SEQ ID NO: 2758374 - DNA, 22 bp, Homo sapiens
aagaatgctgcaacttttttat

SEQ ID NO: 2758375 - DNA, 18 bp, Homo sapiens
aagaatgtgctagagtta

SEQ ID NO: 2758376 - DNA, 22 bp, Homo sapiens
aagaatgtgctagagttaaaag

SEQ ID NO: 2758377 - DNA, 10 bp, Homo sapiens
agccatatca

SEQ ID NO: 2758378 - DNA, 10 bp, Homo sapiens
agcccctgcc

SEQ ID NO: 2758379 - DNA, 11 bp, Homo sapiens
agcccctgccc

SEQ ID NO: 2758380 - DNA, 12 bp, Homo sapiens
agcccctgccca

SEQ ID NO: 2758381 - DNA, 18 bp, Homo sapiens
agcccttctttccacaga

SEQ ID NO: 2758382 - DNA, 14 bp, Homo sapiens
agccggaaggccga

SEQ ID NO: 2758383 - DNA, 18 bp, Homo sapiens
agcctagatatgaatata

SEQ ID NO: 2758384 - DNA, 19 bp, Homo sapiens
agcctagatatgaatatat

SEQ ID NO: 2758385 - DNA, 19 bp, Homo sapiens
agcctctttgtgtttttgt

SEQ ID NO: 2758386 - DNA, 23 bp, Homo sapiens
agcctctttgtgtttttgttgtt

SEQ ID NO: 2758387 - DNA, 12 bp, Homo sapiens
agcctgctaagg

SEQ ID NO: 2758388 - DNA, 19 bp, Homo sapiens
agccttccaccggcactca

SEQ ID NO: 2758389 - DNA, 20 bp, Homo sapiens
agccttccaccggcactcat

SEQ ID NO: 2758390 - DNA, 22 bp, Homo sapiens
agccttccaccggcactcatga

SEQ ID NO: 2758391 - DNA, 15 bp, Homo sapiens
agcgaacaaccacag

SEQ ID NO: 2758392 - DNA, 14 bp, Homo sapiens
agcggaataaacta

SEQ ID NO: 2758393 - DNA, 22 bp, Homo sapiens
agcggaataaactagagaaggg

SEQ ID NO: 2758394 - DNA, 14 bp, Homo sapiens
agcgtgcaccccgc

SEQ ID NO: 2758395 - DNA, 14 bp, Homo sapiens
agctaatacaaaac

SEQ ID NO: 2758396 - DNA, 17 bp, Homo sapiens
agctattacttggcaaa

SEQ ID NO: 2758397 - DNA, 19 bp, Homo sapiens
agctattacttggcaaatt

SEQ ID NO: 2758398 - DNA, 13 bp, Homo sapiens
agctgcactgttt

SEQ ID NO: 2758399 - DNA, 18 bp, Homo sapiens
agctggtttcctgcccag

SEQ ID NO: 2758400 - DNA, 17 bp, Homo sapiens
agctgtatgattcccag

SEQ ID NO: 2758401 - DNA, 18 bp, Homo sapiens
agctgtgattatgccatt

SEQ ID NO: 2758402 - DNA, 13 bp, Homo sapiens
agctgttaaaata

SEQ ID NO: 2758403 - DNA, 15 bp, Homo sapiens
agctgttaaaataca

SEQ ID NO: 2758404 - DNA, 22 bp, Homo sapiens
agctgttaaaatacataacttc

SEQ ID NO: 2758405 - DNA, 19 bp, Homo sapiens
agcttactataaatgatat

SEQ ID NO: 2758406 - DNA, 13 bp, Homo sapiens
agcttatgcctag

SEQ ID NO: 2758407 - DNA, 16 bp, Homo sapiens
agcttgtgtatcttga

SEQ ID NO: 2758408 - DNA, 12 bp, Homo sapiens
aggaaatattta

SEQ ID NO: 2758409 - DNA, 14 bp, Homo sapiens
aggaaatatttatt

SEQ ID NO: 2758410 - DNA, 13 bp, Homo sapiens
aggaacaatgccg

SEQ ID NO: 2758411 - DNA, 20 bp, Homo sapiens
aggaactcgcacctgtgctg

SEQ ID NO: 2758412 - DNA, 22 bp, Homo sapiens
aggaactgctgggcttggcagc

SEQ ID NO: 2758413 - DNA, 16 bp, Homo sapiens
aggaagtcttcaaatt

SEQ ID NO: 2758414 - DNA, 17 bp, Homo sapiens
aggacactgatatgggt

SEQ ID NO: 2758415 - DNA, 12 bp, Homo sapiens
aggacagtattt

SEQ ID NO: 2758416 - DNA, 22 bp, Homo sapiens
aggacccatatgggaattatta

SEQ ID NO: 2758417 - DNA, 16 bp, Homo sapiens
aggaggttgaggctgc

SEQ ID NO: 2758418 - DNA, 12 bp, Homo sapiens
aggattctgcag

SEQ ID NO: 2758419 - DNA, 16 bp, Homo sapiens
aggattttttaaaaat

SEQ ID NO: 2758420 - DNA, 19 bp, Homo sapiens
aggattttttaaaaattgg

SEQ ID NO: 2758421 - DNA, 12 bp, Homo sapiens
aggcacatattg

SEQ ID NO: 2758422 - DNA, 21 bp, Homo sapiens
aggcagcatgtatagttgctt

SEQ ID NO: 2758423 - DNA, 20 bp, Homo sapiens
aggcagctctaaatgtcaat

SEQ ID NO: 2758424 - DNA, 21 bp, Homo sapiens
aggccatgggcactgtgggta

SEQ ID NO: 2758425 - DNA, 23 bp, Homo sapiens
aggccatgggcactgtgggtaga

SEQ ID NO: 2758426 - DNA, 17 bp, Homo sapiens
aggccatttgttacagt

SEQ ID NO: 2758427 - DNA, 19 bp, Homo sapiens
aggctatggggatagatgt

SEQ ID NO: 2758428 - DNA, 21 bp, Homo sapiens
aggctatggggatagatgtgt

SEQ ID NO: 2758429 - DNA, 21 bp, Homo sapiens
aggctttcagctgtgcttttt

SEQ ID NO: 2758430 - DNA, 13 bp, Homo sapiens
agggaaaaagttg

SEQ ID NO: 2758431 - DNA, 20 bp, Homo sapiens
agggaaatcttggtgtaact

SEQ ID NO: 2758432 - DNA, 21 bp, Homo sapiens
agggaattgtttttataaaaa

SEQ ID NO: 2758433 - DNA, 22 bp, Homo sapiens
agggatttggggctcagagtgg

SEQ ID NO: 2758434 - DNA, 21 bp, Homo sapiens
agggcctgctgagttgcttct

SEQ ID NO: 2758435 - DNA, 13 bp, Homo sapiens
agggctggtttgt

SEQ ID NO: 2758436 - DNA, 15 bp, Homo sapiens
agggctggtttgttc

SEQ ID NO: 2758437 - DNA, 14 bp, Homo sapiens
agggtctataattc

SEQ ID NO: 2758438 - DNA, 23 bp, Homo sapiens
aggtacttcaaatccttgaagat

SEQ ID NO: 2758439 - DNA, 22 bp, Homo sapiens
aggtattggagggaaaaaacaa

SEQ ID NO: 2758440 - DNA, 21 bp, Homo sapiens
aggtcccatggcctgctgggc

SEQ ID NO: 2758441 - DNA, 21 bp, Homo sapiens
aggtcccattgttggcgctga

SEQ ID NO: 2758442 - DNA, 18 bp, Homo sapiens
aggtcttacattgcctga

SEQ ID NO: 2758443 - DNA, 22 bp, Homo sapiens
aggtggctcccacctgtagtcc

SEQ ID NO: 2758444 - DNA, 11 bp, Homo sapiens
aggttgctgtt

SEQ ID NO: 2758445 - DNA, 14 bp, Homo sapiens
aggttgctgttgtg

SEQ ID NO: 2758446 - DNA, 23 bp, Homo sapiens
aggttgggagaatgtcagtatgt

SEQ ID NO: 2758447 - DNA, 19 bp, Homo sapiens
aggtttgctcctagaactg

SEQ ID NO: 2758448 - DNA, 13 bp, Homo sapiens
agtaaaaaaataa

SEQ ID NO: 2758449 - DNA, 11 bp, Homo sapiens
agtaaattctg

SEQ ID NO: 2758450 - DNA, 13 bp, Homo sapiens
agtaaattctgtt

SEQ ID NO: 2758451 - DNA, 15 bp, Homo sapiens
agtaaattctgttga

SEQ ID NO: 2758452 - DNA, 20 bp, Homo sapiens
agtaatgataactggaaact

SEQ ID NO: 2758453 - DNA, 18 bp, Homo sapiens
agtaattaggataactaa

SEQ ID NO: 2758454 - DNA, 21 bp, Homo sapiens
agtaattaggataactaaaat

SEQ ID NO: 2758455 - DNA, 12 bp, Homo sapiens
agtaattggaaa

SEQ ID NO: 2758456 - DNA, 13 bp, Homo sapiens
agtaattggaaag

SEQ ID NO: 2758457 - DNA, 19 bp, Homo sapiens
agtagccaaacaccacttt

SEQ ID NO: 2758458 - DNA, 13 bp, Homo sapiens
agtagttaaaaca

SEQ ID NO: 2758459 - DNA, 14 bp, Homo sapiens
agtatatcttaaga

SEQ ID NO: 2758460 - DNA, 18 bp, Homo sapiens
agtattgtagaaagctaa

SEQ ID NO: 2758461 - DNA, 13 bp, Homo sapiens
agtatttctatga

SEQ ID NO: 2758462 - DNA, 17 bp, Homo sapiens
agtatttctatgaaata

SEQ ID NO: 2758463 - DNA, 22 bp, Homo sapiens
agtatttctatgaaatattatg

SEQ ID NO: 2758464 - DNA, 14 bp, Homo sapiens
agtatttgctgttt

SEQ ID NO: 2758465 - DNA, 21 bp, Homo sapiens
agtatttgctgtttgtccagt

SEQ ID NO: 2758466 - DNA, 14 bp, Homo sapiens
agtatttgtgggga

SEQ ID NO: 2758467 - DNA, 22 bp, Homo sapiens
agtcaaagagagtttttaatag

SEQ ID NO: 2758468 - DNA, 15 bp, Homo sapiens
agtcacctcatggaa

SEQ ID NO: 2758469 - DNA, 14 bp, Homo sapiens
agtcaggaaagaga

SEQ ID NO: 2758470 - DNA, 15 bp, Homo sapiens
agtcagtttctacac

SEQ ID NO: 2758471 - DNA, 21 bp, Homo sapiens
agtccaagcatttagatgtat

SEQ ID NO: 2758472 - DNA, 20 bp, Homo sapiens
agtcctgaacctttcaaaat

SEQ ID NO: 2758473 - DNA, 21 bp, Homo sapiens
agtcctgaacctttcaaaatg

SEQ ID NO: 2758474 - DNA, 13 bp, Homo sapiens
agtcctgactggg

SEQ ID NO: 2758475 - DNA, 16 bp, Homo sapiens
agtcctgactgggctg

SEQ ID NO: 2758476 - DNA, 17 bp, Homo sapiens
agtcctgactgggctgg

SEQ ID NO: 2758477 - DNA, 18 bp, Homo sapiens
agtcctgactgggctggg

SEQ ID NO: 2758478 - DNA, 19 bp, Homo sapiens
agtcctgactgggctgggt

SEQ ID NO: 2758479 - DNA, 22 bp, Homo sapiens
agtcctgactgggctgggtttg

SEQ ID NO: 2758480 - DNA, 18 bp, Homo sapiens
agtcttcttatctaaacc

SEQ ID NO: 2758481 - DNA, 15 bp, Homo sapiens
agtcttttaacttta

SEQ ID NO: 2758482 - DNA, 21 bp, Homo sapiens
agtgacttcttccctaaaatg

SEQ ID NO: 2758483 - DNA, 22 bp, Homo sapiens
agtgacttcttccctaaaatgt

SEQ ID NO: 2758484 - DNA, 18 bp, Homo sapiens
agtgcaaattgtcacagg

SEQ ID NO: 2758485 - DNA, 14 bp, Homo sapiens
agtgcaagagactt

SEQ ID NO: 2758486 - DNA, 15 bp, Homo sapiens
agtgcaagagacttt

SEQ ID NO: 2758487 - DNA, 18 bp, Homo sapiens
agtgccaggatggaatga

SEQ ID NO: 2758488 - DNA, 14 bp, Homo sapiens
agtgccctagaagg

SEQ ID NO: 2758489 - DNA, 16 bp, Homo sapiens
agtggggtaggttggg

SEQ ID NO: 2758490 - DNA, 23 bp, Homo sapiens
agtgtcaagtcctgactgggctg

SEQ ID NO: 2758491 - DNA, 19 bp, Homo sapiens
agtgtcctatgcaataaaa

SEQ ID NO: 2758492 - DNA, 23 bp, Homo sapiens
agtgtcctatgcaataaaattat

SEQ ID NO: 2758493 - DNA, 16 bp, Homo sapiens
agtgtgggtctgtgtg

SEQ ID NO: 2758494 - DNA, 23 bp, Homo sapiens
agtgtgggtctgtgtgtgtgtat

SEQ ID NO: 2758495 - DNA, 9 bp, Homo sapiens
agtgtgtaa

SEQ ID NO: 2758496 - DNA, 14 bp, Homo sapiens
agtgtgtggccccg

SEQ ID NO: 2758497 - DNA, 16 bp, Homo sapiens
agtgttggagaagaac

SEQ ID NO: 2758498 - DNA, 23 bp, Homo sapiens
agtgttggagaagaactgaaatc

SEQ ID NO: 2758499 - DNA, 23 bp, Homo sapiens
agtgtttaaaagcaaatactgat

SEQ ID NO: 2758500 - DNA, 14 bp, Homo sapiens
agtgtttctgttct

SEQ ID NO: 2758501 - DNA, 15 bp, Homo sapiens
agttacatgcataaa

SEQ ID NO: 2758502 - DNA, 16 bp, Homo sapiens
agttacttgctataaa

SEQ ID NO: 2758503 - DNA, 21 bp, Homo sapiens
agttagttttggttatttcta

SEQ ID NO: 2758504 - DNA, 21 bp, Homo sapiens
agttattgctgcataaatttg

SEQ ID NO: 2758505 - DNA, 17 bp, Homo sapiens
agttcacattaactcag

SEQ ID NO: 2758506 - DNA, 19 bp, Homo sapiens
agttctagctctatttact

SEQ ID NO: 2758507 - DNA, 21 bp, Homo sapiens
agttctgttaaatatttttgt

SEQ ID NO: 2758508 - DNA, 22 bp, Homo sapiens
agttgctggttttgaatattaa

SEQ ID NO: 2758509 - DNA, 16 bp, Homo sapiens
agttggcacttctgcc

SEQ ID NO: 2758510 - DNA, 18 bp, Homo sapiens
agttgggggtattttcta

SEQ ID NO: 2758511 - DNA, 19 bp, Homo sapiens
agttgggggtattttctaa

SEQ ID NO: 2758512 - DNA, 19 bp, Homo sapiens
agttgtactgcatcttagt

SEQ ID NO: 2758513 - DNA, 21 bp, Homo sapiens
agttgtactgcatcttagttt

SEQ ID NO: 2758514 - DNA, 17 bp, Homo sapiens
agttgtataaaagttgt

SEQ ID NO: 2758515 - DNA, 19 bp, Homo sapiens
agttgtataaaagttgtac

SEQ ID NO: 2758516 - DNA, 22 bp, Homo sapiens
agttgtataaaagttgtactgc

SEQ ID NO: 2758517 - DNA, 23 bp, Homo sapiens
agttgtatcagcacgtgtggcct

SEQ ID NO: 2758518 - DNA, 18 bp, Homo sapiens
agttgtatcagtaccatt

SEQ ID NO: 2758519 - DNA, 15 bp, Homo sapiens
agtttactggataaa

SEQ ID NO: 2758520 - DNA, 19 bp, Homo sapiens
agtttagaacctacaaaag

SEQ ID NO: 2758521 - DNA, 16 bp, Homo sapiens
agtttagctggaaaag

SEQ ID NO: 2758522 - DNA, 20 bp, Homo sapiens
agtttcttcatgcattactt

SEQ ID NO: 2758523 - DNA, 16 bp, Homo sapiens
agttttttatatatga

SEQ ID NO: 2758524 - DNA, 17 bp, Homo sapiens
ataaaaataaagttttt

SEQ ID NO: 2758525 - DNA, 21 bp, Homo sapiens
ataaaaatcaggagcctgcta

SEQ ID NO: 2758526 - DNA, 21 bp, Homo sapiens
ataaaagggtcaaacctgtag

SEQ ID NO: 2758527 - DNA, 16 bp, Homo sapiens
ataaaataatttttat

SEQ ID NO: 2758528 - DNA, 22 bp, Homo sapiens
ataaaataatttttatatttga

SEQ ID NO: 2758529 - DNA, 15 bp, Homo sapiens
ataaaattatttgca

SEQ ID NO: 2758530 - DNA, 16 bp, Homo sapiens
ataaaattatttgcag

SEQ ID NO: 2758531 - DNA, 15 bp, Homo sapiens
ataaacatttgccaa

SEQ ID NO: 2758532 - DNA, 16 bp, Homo sapiens
ataaacatttgccaaa

SEQ ID NO: 2758533 - DNA, 15 bp, Homo sapiens
ataaactagagaagg

SEQ ID NO: 2758534 - DNA, 13 bp, Homo sapiens
ataaagaatgaaa

SEQ ID NO: 2758535 - DNA, 21 bp, Homo sapiens
ataaagtcctgaacctttcaa

SEQ ID NO: 2758536 - DNA, 22 bp, Homo sapiens
ataaagtcctgaacctttcaaa

SEQ ID NO: 2758537 - DNA, 14 bp, Homo sapiens
ataaatacaaatct

SEQ ID NO: 2758538 - DNA, 16 bp, Homo sapiens
ataaatacaaatctgt

SEQ ID NO: 2758539 - DNA, 17 bp, Homo sapiens
ataaatgatatctatat

SEQ ID NO: 2758540 - DNA, 22 bp, Homo sapiens
ataaatgatatctatattctaa

SEQ ID NO: 2758541 - DNA, 20 bp, Homo sapiens
ataaatgtctattattatga

SEQ ID NO: 2758542 - DNA, 16 bp, Homo sapiens
ataaatgttagttcta

SEQ ID NO: 2758543 - DNA, 12 bp, Homo sapiens
ataaatgttgaa

SEQ ID NO: 2758544 - DNA, 12 bp, Homo sapiens
ataaatttaaaa

SEQ ID NO: 2758545 - DNA, 17 bp, Homo sapiens
ataaatttaaaacacag

SEQ ID NO: 2758546 - DNA, 13 bp, Homo sapiens
ataaatttgtaat

SEQ ID NO: 2758547 - DNA, 14 bp, Homo sapiens
ataaatttgtaata

SEQ ID NO: 2758548 - DNA, 15 bp, Homo sapiens
ataaatttgtaatat

SEQ ID NO: 2758549 - DNA, 17 bp, Homo sapiens
ataaatttgtaatatat

SEQ ID NO: 2758550 - DNA, 19 bp, Homo sapiens
ataaatttgtaatatatcc

SEQ ID NO: 2758551 - DNA, 15 bp, Homo sapiens
ataacaatgctgtat

SEQ ID NO: 2758552 - DNA, 20 bp, Homo sapiens
ataacaatgctgtattttaa

SEQ ID NO: 2758553 - DNA, 15 bp, Homo sapiens
ataactaaaattctg

SEQ ID NO: 2758554 - DNA, 13 bp, Homo sapiens
ataacttcaaatt

SEQ ID NO: 2758555 - DNA, 21 bp, Homo sapiens
ataagtatatcttaagaatgt

SEQ ID NO: 2758556 - DNA, 18 bp, Homo sapiens
ataagttgtattattaga

SEQ ID NO: 2758557 - DNA, 18 bp, Homo sapiens
ataataagacttttctct

SEQ ID NO: 2758558 - DNA, 20 bp, Homo sapiens
ataatacctttctaagggaa

SEQ ID NO: 2758559 - DNA, 13 bp, Homo sapiens
ataatgtttcaaa

SEQ ID NO: 2758560 - DNA, 23 bp, Homo sapiens
ataatgtttcaaacatatataac

SEQ ID NO: 2758561 - DNA, 18 bp, Homo sapiens
ataattccttaaaatttt

SEQ ID NO: 2758562 - DNA, 18 bp, Homo sapiens
ataattgagactgaaaga

SEQ ID NO: 2758563 - DNA, 14 bp, Homo sapiens
ataatttttatatt

SEQ ID NO: 2758564 - DNA, 14 bp, Homo sapiens
atacaaacatttca

SEQ ID NO: 2758565 - DNA, 16 bp, Homo sapiens
atacaaacatttcact

SEQ ID NO: 2758566 - DNA, 23 bp, Homo sapiens
atacaaacatttcacttctccaa

SEQ ID NO: 2758567 - DNA, 20 bp, Homo sapiens
atacaaatctgtataaatgt

SEQ ID NO: 2758568 - DNA, 14 bp, Homo sapiens
atacaatatatagc

SEQ ID NO: 2758569 - DNA, 16 bp, Homo sapiens
atacacattttgtaaa

SEQ ID NO: 2758570 - DNA, 20 bp, Homo sapiens
atacacattttgtaaatctg

SEQ ID NO: 2758571 - DNA, 18 bp, Homo sapiens
atacaggcccctgggttt

SEQ ID NO: 2758572 - DNA, 13 bp, Homo sapiens
atacataacttca

SEQ ID NO: 2758573 - DNA, 20 bp, Homo sapiens
atacatcccttacctgggaa

SEQ ID NO: 2758574 - DNA, 16 bp, Homo sapiens
atacatgaataaaaat

SEQ ID NO: 2758575 - DNA, 17 bp, Homo sapiens
atacattaggaagctga

SEQ ID NO: 2758576 - DNA, 15 bp, Homo sapiens
ataccacagtctttc

SEQ ID NO: 2758577 - DNA, 16 bp, Homo sapiens
ataccaggaccagttt

SEQ ID NO: 2758578 - DNA, 21 bp, Homo sapiens
ataccctgtctttaaaaataa

SEQ ID NO: 2758579 - DNA, 17 bp, Homo sapiens
atacctcaggaaagaat

SEQ ID NO: 2758580 - DNA, 18 bp, Homo sapiens
atacctcaggaaagaata

SEQ ID NO: 2758581 - DNA, 17 bp, Homo sapiens
atacctttctaagggaa

SEQ ID NO: 2758582 - DNA, 13 bp, Homo sapiens
atactgtctttgc

SEQ ID NO: 2758583 - DNA, 14 bp, Homo sapiens
atactgtgaagtta

SEQ ID NO: 2758584 - DNA, 23 bp, Homo sapiens
atactgtgaagttacatgcataa

SEQ ID NO: 2758585 - DNA, 23 bp, Homo sapiens
atacttgcagctcccattctatg

SEQ ID NO: 2758586 - DNA, 17 bp, Homo sapiens
atagaaattctgaattt

SEQ ID NO: 2758587 - DNA, 19 bp, Homo sapiens
atagaaggctatggggata

SEQ ID NO: 2758588 - DNA, 22 bp, Homo sapiens
atagatttagtctgttatattt

SEQ ID NO: 2758589 - DNA, 17 bp, Homo sapiens
atagctggcaagaatgg

SEQ ID NO: 2758590 - DNA, 14 bp, Homo sapiens
atagtatagaaaat

SEQ ID NO: 2758591 - DNA, 23 bp, Homo sapiens
atagtatagaaaatggaaaatat

SEQ ID NO: 2758592 - DNA, 18 bp, Homo sapiens
atagtcaaattgtgtgaa

SEQ ID NO: 2758593 - DNA, 21 bp, Homo sapiens
atagtggcacttgcctgtagt

SEQ ID NO: 2758594 - DNA, 16 bp, Homo sapiens
atagtgtcctatgcaa

SEQ ID NO: 2758595 - DNA, 18 bp, Homo sapiens
atagtgtcctatgcaata

SEQ ID NO: 2758596 - DNA, 16 bp, Homo sapiens
atagttagctttattg

SEQ ID NO: 2758597 - DNA, 12 bp, Homo sapiens
atagttgaaagt

SEQ ID NO: 2758598 - DNA, 19 bp, Homo sapiens
atataaaagatcttgcaga

SEQ ID NO: 2758599 - DNA, 13 bp, Homo sapiens
atataaagaatga

SEQ ID NO: 2758600 - DNA, 12 bp, Homo sapiens
atataacaatgc

SEQ ID NO: 2758601 - DNA, 14 bp, Homo sapiens
atatacaagtaaat

SEQ ID NO: 2758602 - DNA, 17 bp, Homo sapiens
atatacacattttgtaa

SEQ ID NO: 2758603 - DNA, 12 bp, Homo sapiens
atatagttgaaa

SEQ ID NO: 2758604 - DNA, 17 bp, Homo sapiens
atatataacaatgctgt

SEQ ID NO: 2758605 - DNA, 18 bp, Homo sapiens
atatataacaatgctgta

SEQ ID NO: 2758606 - DNA, 14 bp, Homo sapiens
atatatatcctatt

SEQ ID NO: 2758607 - DNA, 15 bp, Homo sapiens
atatatcctatttga

SEQ ID NO: 2758608 - DNA, 15 bp, Homo sapiens
atatatgaatattac

SEQ ID NO: 2758609 - DNA, 16 bp, Homo sapiens
atatatggcatttgca

SEQ ID NO: 2758610 - DNA, 19 bp, Homo sapiens
atatcatgctaaaattcta

SEQ ID NO: 2758611 - DNA, 16 bp, Homo sapiens
atatcccagctttaaa

SEQ ID NO: 2758612 - DNA, 15 bp, Homo sapiens
atatcctgtttgtat

SEQ ID NO: 2758613 - DNA, 17 bp, Homo sapiens
atatctatattctaaag

SEQ ID NO: 2758614 - DNA, 18 bp, Homo sapiens
atatctatattctaaaga

SEQ ID NO: 2758615 - DNA, 17 bp, Homo sapiens
atatgaatattacatgt

SEQ ID NO: 2758616 - DNA, 20 bp, Homo sapiens
atatgtttattcaaaatatt

SEQ ID NO: 2758617 - DNA, 18 bp, Homo sapiens
atattaagctaaaaggtt

SEQ ID NO: 2758618 - DNA, 13 bp, Homo sapiens
atattagttgctt

SEQ ID NO: 2758619 - DNA, 14 bp, Homo sapiens
atattatgttaaaa

SEQ ID NO: 2758620 - DNA, 18 bp, Homo sapiens
atattggagggaaatctt

SEQ ID NO: 2758621 - DNA, 19 bp, Homo sapiens
atattggagggaaatcttg

SEQ ID NO: 2758622 - DNA, 13 bp, Homo sapiens
atatttattttaa

SEQ ID NO: 2758623 - DNA, 14 bp, Homo sapiens
atatttattttaat

SEQ ID NO: 2758624 - DNA, 15 bp, Homo sapiens
atatttattttaata

SEQ ID NO: 2758625 - DNA, 15 bp, Homo sapiens
atatttgaaaattac

SEQ ID NO: 2758626 - DNA, 19 bp, Homo sapiens
atatttgaaaattaccttt

SEQ ID NO: 2758627 - DNA, 20 bp, Homo sapiens
atatttgaaaattaccttta

SEQ ID NO: 2758628 - DNA, 14 bp, Homo sapiens
atatttgaaatatt

SEQ ID NO: 2758629 - DNA, 16 bp, Homo sapiens
cacttgtcaataaaat

SEQ ID NO: 2758630 - DNA, 22 bp, Homo sapiens
cacttgtgttttgcaagccaga

SEQ ID NO: 2758631 - DNA, 15 bp, Homo sapiens
cactttgtaaaagga

SEQ ID NO: 2758632 - DNA, 19 bp, Homo sapiens
cagaaaaaaaaatgtttta

SEQ ID NO: 2758633 - DNA, 12 bp, Homo sapiens
cagaaaaagaaa

SEQ ID NO: 2758634 - DNA, 13 bp, Homo sapiens
cagaaattgaaag

SEQ ID NO: 2758635 - DNA, 14 bp, Homo sapiens
cagaaattgaaagc

SEQ ID NO: 2758636 - DNA, 13 bp, Homo sapiens
cagaaatttacca

SEQ ID NO: 2758637 - DNA, 21 bp, Homo sapiens
cagaaatttaccacaaaagca

SEQ ID NO: 2758638 - DNA, 18 bp, Homo sapiens
cagaatagcttatgccta

SEQ ID NO: 2758639 - DNA, 14 bp, Homo sapiens
cagaatatacacat

SEQ ID NO: 2758640 - DNA, 20 bp, Homo sapiens
cagaatatacacattttgta

SEQ ID NO: 2758641 - DNA, 22 bp, Homo sapiens
cagaatatacacattttgtaaa

SEQ ID NO: 2758642 - DNA, 22 bp, Homo sapiens
cagacaagattttttaattgtt

SEQ ID NO: 2758643 - DNA, 23 bp, Homo sapiens
cagagaactgatgcgacttgttt

SEQ ID NO: 2758644 - DNA, 15 bp, Homo sapiens
cagattttcctgaaa

SEQ ID NO: 2758645 - DNA, 23 bp, Homo sapiens
cagatttttatattagttgcttt

SEQ ID NO: 2758646 - DNA, 15 bp, Homo sapiens
cagcagtacaataaa

SEQ ID NO: 2758647 - DNA, 23 bp, Homo sapiens
cagcctggggcaaacctagccgg

SEQ ID NO: 2758648 - DNA, 17 bp, Homo sapiens
cagcgtgcaccccgccg

SEQ ID NO: 2758649 - DNA, 16 bp, Homo sapiens
cagctgtgctttttgc

SEQ ID NO: 2758650 - DNA, 20 bp, Homo sapiens
cagcttattgtctagtgaaa

SEQ ID NO: 2758651 - DNA, 20 bp, Homo sapiens
caggaaagagaacttccaga

SEQ ID NO: 2758652 - DNA, 23 bp, Homo sapiens
caggacagcccttctttccacag

SEQ ID NO: 2758653 - DNA, 12 bp, Homo sapiens
caggaccagttt

SEQ ID NO: 2758654 - DNA, 23 bp, Homo sapiens
caggacgactgttttcccaacac

SEQ ID NO: 2758655 - DNA, 14 bp, Homo sapiens
caggagcctgctaa

SEQ ID NO: 2758656 - DNA, 18 bp, Homo sapiens
caggagcctgctaaggaa

SEQ ID NO: 2758657 - DNA, 22 bp, Homo sapiens
caggagcctgctaaggaacaat

SEQ ID NO: 2758658 - DNA, 15 bp, Homo sapiens
caggcctgactctca

SEQ ID NO: 2758659 - DNA, 13 bp, Homo sapiens
caggctagatgta

SEQ ID NO: 2758660 - DNA, 17 bp, Homo sapiens
caggctcccaaactcag

SEQ ID NO: 2758661 - DNA, 12 bp, Homo sapiens
caggctctgccc

SEQ ID NO: 2758662 - DNA, 21 bp, Homo sapiens
cagggccgagaggacagaatg

SEQ ID NO: 2758663 - DNA, 16 bp, Homo sapiens
cagggctgaggcctct

SEQ ID NO: 2758664 - DNA, 14 bp, Homo sapiens
cagggctggtttgt

SEQ ID NO: 2758665 - DNA, 16 bp, Homo sapiens
caggggacaggatggt

SEQ ID NO: 2758666 - DNA, 16 bp, Homo sapiens
cagtacagtatttaca

SEQ ID NO: 2758667 - DNA, 13 bp, Homo sapiens
cagtagcaggacc

SEQ ID NO: 2758668 - DNA, 21 bp, Homo sapiens
cagtagcaggacctgccaaga

SEQ ID NO: 2758669 - DNA, 19 bp, Homo sapiens
cagtatggcaatatctaca

SEQ ID NO: 2758670 - DNA, 17 bp, Homo sapiens
cagtattgtagaaagct

SEQ ID NO: 2758671 - DNA, 15 bp, Homo sapiens
cagtcacctcatgga

SEQ ID NO: 2758672 - DNA, 16 bp, Homo sapiens
cagtcacctcatggaa

SEQ ID NO: 2758673 - DNA, 22 bp, Homo sapiens
cagtgcttctacacatttcatc

SEQ ID NO: 2758674 - DNA, 16 bp, Homo sapiens
cagtggctggatctgt

SEQ ID NO: 2758675 - DNA, 18 bp, Homo sapiens
cagtggctggatctgtga

SEQ ID NO: 2758676 - DNA, 17 bp, Homo sapiens
cagtgggttcagaacca

SEQ ID NO: 2758677 - DNA, 15 bp, Homo sapiens
cagttctgaagaaga

SEQ ID NO: 2758678 - DNA, 22 bp, Homo sapiens
cagtttagaacctacaaaagct

SEQ ID NO: 2758679 - DNA, 21 bp, Homo sapiens
cagtttcttcatgcattactt

SEQ ID NO: 2758680 - DNA, 22 bp, Homo sapiens
cagtttcttcatgcattactta

SEQ ID NO: 2758681 - DNA, 20 bp, Homo sapiens
cataaaattggattacagta

SEQ ID NO: 2758682 - DNA, 16 bp, Homo sapiens
cataaacatttgccaa

SEQ ID NO: 2758683 - DNA, 12 bp, Homo sapiens
cataaatttgta

SEQ ID NO: 2758684 - DNA, 15 bp, Homo sapiens
cataaatttgtaata

SEQ ID NO: 2758685 - DNA, 16 bp, Homo sapiens
cataaatttgtaatat

SEQ ID NO: 2758686 - DNA, 22 bp, Homo sapiens
cataactggtttgactctgtcc

SEQ ID NO: 2758687 - DNA, 19 bp, Homo sapiens
cataacttcagtgcaagag

SEQ ID NO: 2758688 - DNA, 16 bp, Homo sapiens
catacatgaataaaaa

SEQ ID NO: 2758689 - DNA, 18 bp, Homo sapiens
catacatgaataaaaata

SEQ ID NO: 2758690 - DNA, 19 bp, Homo sapiens
catacatgaataaaaataa

SEQ ID NO: 2758691 - DNA, 15 bp, Homo sapiens
catacctggccctgt

SEQ ID NO: 2758692 - DNA, 15 bp, Homo sapiens
catagttctgttaaa

SEQ ID NO: 2758693 - DNA, 13 bp, Homo sapiens
catatataacaat

SEQ ID NO: 2758694 - DNA, 16 bp, Homo sapiens
catatcatgctaaaat

SEQ ID NO: 2758695 - DNA, 16 bp, Homo sapiens
catatctgtttattct

SEQ ID NO: 2758696 - DNA, 20 bp, Homo sapiens
catatgtttattcaaaatat

SEQ ID NO: 2758697 - DNA, 21 bp, Homo sapiens
catatgtttattcaaaatatt

SEQ ID NO: 2758698 - DNA, 22 bp, Homo sapiens
catatgtttattcaaaatattt

SEQ ID NO: 2758699 - DNA, 21 bp, Homo sapiens
catcagagatgggaaaaccat

SEQ ID NO: 2758700 - DNA, 21 bp, Homo sapiens
catcagagcccttttgctata

SEQ ID NO: 2758701 - DNA, 21 bp, Homo sapiens
catcatgtttacagaggacag

SEQ ID NO: 2758702 - DNA, 17 bp, Homo sapiens
catcattgttgtgtata

SEQ ID NO: 2758703 - DNA, 14 bp, Homo sapiens
catccaataaaaat

SEQ ID NO: 2758704 - DNA, 20 bp, Homo sapiens
catccaccaaactcctgcct

SEQ ID NO: 2758705 - DNA, 13 bp, Homo sapiens
catctgtgcaggg

SEQ ID NO: 2758706 - DNA, 19 bp, Homo sapiens
catcttgaaaatgccacca

SEQ ID NO: 2758707 - DNA, 20 bp, Homo sapiens
catctttcatagttctgtta

SEQ ID NO: 2758708 - DNA, 14 bp, Homo sapiens
catgaataaaaata

SEQ ID NO: 2758709 - DNA, 14 bp, Homo sapiens
catgacagaatata

SEQ ID NO: 2758710 - DNA, 16 bp, Homo sapiens
catgacagaatataca

SEQ ID NO: 2758711 - DNA, 16 bp, Homo sapiens
catgacggcctgcctg

SEQ ID NO: 2758712 - DNA, 19 bp, Homo sapiens
catgagttggctgggaata

SEQ ID NO: 2758713 - DNA, 21 bp, Homo sapiens
catgcaaagcaacgactactt

SEQ ID NO: 2758714 - DNA, 15 bp, Homo sapiens
catgcataaaagggt

SEQ ID NO: 2758715 - DNA, 22 bp, Homo sapiens
catgcataaaagggtcaaacct

SEQ ID NO: 2758716 - DNA, 21 bp, Homo sapiens
catgcctatatgagaagaata

SEQ ID NO: 2758717 - DNA, 14 bp, Homo sapiens
catgctaaaattct

SEQ ID NO: 2758718 - DNA, 12 bp, Homo sapiens
catggcctgctg

SEQ ID NO: 2758719 - DNA, 15 bp, Homo sapiens
catggtgtgaactaa

SEQ ID NO: 2758720 - DNA, 22 bp, Homo sapiens
catgtaaagctgttaaaataca

SEQ ID NO: 2758721 - DNA, 15 bp, Homo sapiens
catgtctgcctggag

SEQ ID NO: 2758722 - DNA, 13 bp, Homo sapiens
cattaactcaggc

SEQ ID NO: 2758723 - DNA, 21 bp, Homo sapiens
cattacctcagtgagaagcca

SEQ ID NO: 2758724 - DNA, 14 bp, Homo sapiens
cattagaaaggcta

SEQ ID NO: 2758725 - DNA, 17 bp, Homo sapiens
cattagatgtttattta

SEQ ID NO: 2758726 - DNA, 15 bp, Homo sapiens
cattaggaagctgaa

SEQ ID NO: 2758727 - DNA, 22 bp, Homo sapiens
cattccaactatctcatttcca

SEQ ID NO: 2758728 - DNA, 14 bp, Homo sapiens
cattcctaaaatgc

SEQ ID NO: 2758729 - DNA, 16 bp, Homo sapiens
cattcctaaaatgctt

SEQ ID NO: 2758730 - DNA, 15 bp, Homo sapiens
cattctatcgttatt

SEQ ID NO: 2758731 - DNA, 17 bp, Homo sapiens
cattctatcgttattat

SEQ ID NO: 2758732 - DNA, 13 bp, Homo sapiens
cattgaaatatta

SEQ ID NO: 2758733 - DNA, 13 bp, Homo sapiens
cattgattggata

SEQ ID NO: 2758734 - DNA, 18 bp, Homo sapiens
cattgattggataaatgc

SEQ ID NO: 2758735 - DNA, 23 bp, Homo sapiens
cattgcctgatttgttccttctg

SEQ ID NO: 2758736 - DNA, 19 bp, Homo sapiens
cattgtccctgaagagaag

SEQ ID NO: 2758737 - DNA, 18 bp, Homo sapiens
cattgtgacaaacagcta

SEQ ID NO: 2758738 - DNA, 15 bp, Homo sapiens
catttcaaaatgctt

SEQ ID NO: 2758739 - DNA, 15 bp, Homo sapiens
catttcatctaattt

SEQ ID NO: 2758740 - DNA, 14 bp, Homo sapiens
catttgtataaaat

SEQ ID NO: 2758741 - DNA, 18 bp, Homo sapiens
catttgttacagtttctt

SEQ ID NO: 2758742 - DNA, 14 bp, Homo sapiens
cattttaggaaagg

SEQ ID NO: 2758743 - DNA, 23 bp, Homo sapiens
cattttgtaaatctgtacttttt

SEQ ID NO: 2758744 - DNA, 21 bp, Homo sapiens
catttttgtattttgtacaaa

SEQ ID NO: 2758745 - DNA, 13 bp, Homo sapiens
ccaaacacaggca

SEQ ID NO: 2758746 - DNA, 14 bp, Homo sapiens
ccaactctgtattt

SEQ ID NO: 2758747 - DNA, 14 bp, Homo sapiens
ccaagacaaactaa

SEQ ID NO: 2758748 - DNA, 11 bp, Homo sapiens
ccaagagaagg

SEQ ID NO: 2758749 - DNA, 12 bp, Homo sapiens
ccaagagaaggg

SEQ ID NO: 2758750 - DNA, 10 bp, Homo sapiens
ccaagtgtat

SEQ ID NO: 2758751 - DNA, 13 bp, Homo sapiens
ccaagtgtataat

SEQ ID NO: 2758752 - DNA, 21 bp, Homo sapiens
ccaataaaaatcaggagcctg

SEQ ID NO: 2758753 - DNA, 21 bp, Homo sapiens
ccaatgccacatacttgcagc

SEQ ID NO: 2758754 - DNA, 13 bp, Homo sapiens
ccacaaaagcaaa

SEQ ID NO: 2758755 - DNA, 21 bp, Homo sapiens
ctttattacacctcagaaatt

SEQ ID NO: 2758756 - DNA, 17 bp, Homo sapiens
ctttattttgaatgtac

SEQ ID NO: 2758757 - DNA, 20 bp, Homo sapiens
ctttattttgaatgtacctc

SEQ ID NO: 2758758 - DNA, 16 bp, Homo sapiens
ctttcagctgtgcttt

SEQ ID NO: 2758759 - DNA, 13 bp, Homo sapiens
ctttcatagttct

SEQ ID NO: 2758760 - DNA, 21 bp, Homo sapiens
ctttcatagttctgttaaata

SEQ ID NO: 2758761 - DNA, 13 bp, Homo sapiens
ctttctgaaattc

SEQ ID NO: 2758762 - DNA, 11 bp, Homo sapiens
ctttcttcctt

SEQ ID NO: 2758763 - DNA, 17 bp, Homo sapiens
ctttgctacgaagaaag

SEQ ID NO: 2758764 - DNA, 14 bp, Homo sapiens
ctttgtcacttatt

SEQ ID NO: 2758765 - DNA, 16 bp, Homo sapiens
ctttgtcacttatttc

SEQ ID NO: 2758766 - DNA, 17 bp, Homo sapiens
cttttaactttagaatt

SEQ ID NO: 2758767 - DNA, 17 bp, Homo sapiens
cttttactttttatgaa

SEQ ID NO: 2758768 - DNA, 12 bp, Homo sapiens
cttttctttgta

SEQ ID NO: 2758769 - DNA, 15 bp, Homo sapiens
cttttgtaaagtaaa

SEQ ID NO: 2758770 - DNA, 21 bp, Homo sapiens
cttttgtaaagtaaaatatgt

SEQ ID NO: 2758771 - DNA, 13 bp, Homo sapiens
ctttttattgcat

SEQ ID NO: 2758772 - DNA, 15 bp, Homo sapiens
ctttttattgcatgg

SEQ ID NO: 2758773 - DNA, 12 bp, Homo sapiens
cttttttcaaat

SEQ ID NO: 2758774 - DNA, 17 bp, Homo sapiens
cttttttcaaatattga

SEQ ID NO: 2758775 - DNA, 18 bp, Homo sapiens
cttttttcaaatattgaa

SEQ ID NO: 2758776 - DNA, 21 bp, Homo sapiens
cttttttcaaatattgaatgc

SEQ ID NO: 2758777 - DNA, 20 bp, Homo sapiens
gaaaaaaaaattatttgcct

SEQ ID NO: 2758778 - DNA, 22 bp, Homo sapiens
gaaaaaaaagaaaaaagtcctt

SEQ ID NO: 2758779 - DNA, 17 bp, Homo sapiens
gaaaaaagtccttcagt

SEQ ID NO: 2758780 - DNA, 19 bp, Homo sapiens
gaaaaaagtccttcagttt

SEQ ID NO: 2758781 - DNA, 18 bp, Homo sapiens
gaaaaagacgatgtttat

SEQ ID NO: 2758782 - DNA, 19 bp, Homo sapiens
gaaaaagacgatgtttatg

SEQ ID NO: 2758783 - DNA, 15 bp, Homo sapiens
gaaaaagccatatca

SEQ ID NO: 2758784 - DNA, 14 bp, Homo sapiens
gaaaagtatgttag

SEQ ID NO: 2758785 - DNA, 16 bp, Homo sapiens
gaaaatatacaagtaa

SEQ ID NO: 2758786 - DNA, 23 bp, Homo sapiens
gaaaatatacaagtaaattctgt

SEQ ID NO: 2758787 - DNA, 13 bp, Homo sapiens
gaaaatgccacca

SEQ ID NO: 2758788 - DNA, 20 bp, Homo sapiens
gaaaatggaaaatatacaag

SEQ ID NO: 2758789 - DNA, 16 bp, Homo sapiens
gaaaattaattctaaa

SEQ ID NO: 2758790 - DNA, 18 bp, Homo sapiens
gaaaattaattctaaact

SEQ ID NO: 2758791 - DNA, 20 bp, Homo sapiens
gaaaattaattctaaactta

SEQ ID NO: 2758792 - DNA, 16 bp, Homo sapiens
gaaacacaactatatt

SEQ ID NO: 2758793 - DNA, 11 bp, Homo sapiens
gaaacatttgg

SEQ ID NO: 2758794 - DNA, 18 bp, Homo sapiens
gaaagaaagtaaaaaagg

SEQ ID NO: 2758795 - DNA, 16 bp, Homo sapiens
gaaagctaatacaaaa

SEQ ID NO: 2758796 - DNA, 15 bp, Homo sapiens
gaaaggcacatattg

SEQ ID NO: 2758797 - DNA, 22 bp, Homo sapiens
gaaaggctaacaaattttaagt

SEQ ID NO: 2758798 - DNA, 23 bp, Homo sapiens
gaaaggcttccagatgtctaaaa

SEQ ID NO: 2758799 - DNA, 14 bp, Homo sapiens
gaaagtagctgtat

SEQ ID NO: 2758800 - DNA, 15 bp, Homo sapiens
gaaagtgatgacata

SEQ ID NO: 2758801 - DNA, 17 bp, Homo sapiens
gaaataccaggaccagt

SEQ ID NO: 2758802 - DNA, 16 bp, Homo sapiens
gaaatattatgttaaa

SEQ ID NO: 2758803 - DNA, 18 bp, Homo sapiens
gaaatatttattttaata

SEQ ID NO: 2758804 - DNA, 22 bp, Homo sapiens
gaaatatttattttaataatgt

SEQ ID NO: 2758805 - DNA, 18 bp, Homo sapiens
gaaatcttggtgtaactt

SEQ ID NO: 2758806 - DNA, 14 bp, Homo sapiens
gaaatgctaaactt

SEQ ID NO: 2758807 - DNA, 20 bp, Homo sapiens
gaaatgttgtgggggtgggg

SEQ ID NO: 2758808 - DNA, 13 bp, Homo sapiens
gaaatgttttaat

SEQ ID NO: 2758809 - DNA, 11 bp, Homo sapiens
gaaattctgaa

SEQ ID NO: 2758810 - DNA, 16 bp, Homo sapiens
gaacagtacagtattt

SEQ ID NO: 2758811 - DNA, 14 bp, Homo sapiens
gaaccacaagactg

SEQ ID NO: 2758812 - DNA, 21 bp, Homo sapiens
gaaccatgttggttgcacttt

SEQ ID NO: 2758813 - DNA, 16 bp, Homo sapiens
gaacctacaaaagctt

SEQ ID NO: 2758814 - DNA, 17 bp, Homo sapiens
gaacctacaaaagcttg

SEQ ID NO: 2758815 - DNA, 21 bp, Homo sapiens
gaacctacaaaagcttgtgta

SEQ ID NO: 2758816 - DNA, 20 bp, Homo sapiens
gaactaagttattgctgcat

SEQ ID NO: 2758817 - DNA, 17 bp, Homo sapiens
gaactgctgggcttggc

SEQ ID NO: 2758818 - DNA, 20 bp, Homo sapiens
gaactgctgggcttggcagc

SEQ ID NO: 2758819 - DNA, 18 bp, Homo sapiens
gaactggtgatataaaga

SEQ ID NO: 2758820 - DNA, 16 bp, Homo sapiens
gaactttgatacaaat

SEQ ID NO: 2758821 - DNA, 14 bp, Homo sapiens
gaagaaagactcct

SEQ ID NO: 2758822 - DNA, 15 bp, Homo sapiens
gaagcatttaaaaga

SEQ ID NO: 2758823 - DNA, 22 bp, Homo sapiens
gaagcctaggaggactggggta

SEQ ID NO: 2758824 - DNA, 14 bp, Homo sapiens
gaaggtgcagttga

SEQ ID NO: 2758825 - DNA, 14 bp, Homo sapiens
gaagtcttcaaatt

SEQ ID NO: 2758826 - DNA, 20 bp, Homo sapiens
gaagtcttcaaatttgattc

SEQ ID NO: 2758827 - DNA, 21 bp, Homo sapiens
gaagtgtgggtctgtgtgtgt

SEQ ID NO: 2758828 - DNA, 18 bp, Homo sapiens
gaataaactagagaaggg

SEQ ID NO: 2758829 - DNA, 18 bp, Homo sapiens
gaataaattaatattgta

SEQ ID NO: 2758830 - DNA, 18 bp, Homo sapiens
gaatacaaacatttcact

SEQ ID NO: 2758831 - DNA, 19 bp, Homo sapiens
gaatatacacattttgtaa

SEQ ID NO: 2758832 - DNA, 21 bp, Homo sapiens
gaatattacatgtaaagctgt

SEQ ID NO: 2758833 - DNA, 23 bp, Homo sapiens
gaatccaagacaaactaaacttt

SEQ ID NO: 2758834 - DNA, 22 bp, Homo sapiens
gaatgagagacacactgaagaa

SEQ ID NO: 2758835 - DNA, 21 bp, Homo sapiens
gaatgccatagtcaaagagag

SEQ ID NO: 2758836 - DNA, 23 bp, Homo sapiens
gaatgccatagtcaaagagagtt

SEQ ID NO: 2758837 - DNA, 16 bp, Homo sapiens
gaatgccttatttttg

SEQ ID NO: 2758838 - DNA, 13 bp, Homo sapiens
gaatgtcagtatg

SEQ ID NO: 2758839 - DNA, 16 bp, Homo sapiens
gaatgtcagtatgtgg

SEQ ID NO: 2758840 - DNA, 22 bp, Homo sapiens
gaatgtgctagagttaaaagtt

SEQ ID NO: 2758841 - DNA, 15 bp, Homo sapiens
gaatgttaccagact

SEQ ID NO: 2758842 - DNA, 20 bp, Homo sapiens
gaatgttaccagacttcaag

SEQ ID NO: 2758843 - DNA, 15 bp, Homo sapiens
gaattacatttgtat

SEQ ID NO: 2758844 - DNA, 18 bp, Homo sapiens
gaattacatttgtataaa

SEQ ID NO: 2758845 - DNA, 15 bp, Homo sapiens
gaattaccaagagaa

SEQ ID NO: 2758846 - DNA, 16 bp, Homo sapiens
gaattaccaagagaag

SEQ ID NO: 2758847 - DNA, 15 bp, Homo sapiens
gaattctttagattt

SEQ ID NO: 2758848 - DNA, 16 bp, Homo sapiens
gaattgtttttataaa

SEQ ID NO: 2758849 - DNA, 20 bp, Homo sapiens
gacaagattttttaattgtt

SEQ ID NO: 2758850 - DNA, 15 bp, Homo sapiens
gacaagctcacagac

SEQ ID NO: 2758851 - DNA, 15 bp, Homo sapiens
gacaaggttgctgtt

SEQ ID NO: 2758852 - DNA, 16 bp, Homo sapiens
gacacactgaagaagc

SEQ ID NO: 2758853 - DNA, 15 bp, Homo sapiens
gacagaatatacaca

SEQ ID NO: 2758854 - DNA, 18 bp, Homo sapiens
gacagaatatacacattt

SEQ ID NO: 2758855 - DNA, 21 bp, Homo sapiens
gacagcccttctttccacaga

SEQ ID NO: 2758856 - DNA, 13 bp, Homo sapiens
gacatgagtttaa

SEQ ID NO: 2758857 - DNA, 18 bp, Homo sapiens
gacatgcctatatgagaa

SEQ ID NO: 2758858 - DNA, 17 bp, Homo sapiens
gacatgggacatttgct

SEQ ID NO: 2758859 - DNA, 16 bp, Homo sapiens
gacatttgctcatgga

SEQ ID NO: 2758860 - DNA, 17 bp, Homo sapiens
gacatttgctcatggaa

SEQ ID NO: 2758861 - DNA, 23 bp, Homo sapiens
gaccttaaggaaaagtaagggaa

SEQ ID NO: 2758862 - DNA, 13 bp, Homo sapiens
gactaaaatgttt

SEQ ID NO: 2758863 - DNA, 15 bp, Homo sapiens
gactcttaagaagac

SEQ ID NO: 2758864 - DNA, 16 bp, Homo sapiens
gactcttaagaagact

SEQ ID NO: 2758865 - DNA, 17 bp, Homo sapiens
gactcttaagaagactg

SEQ ID NO: 2758866 - DNA, 16 bp, Homo sapiens
gactgggctgggtttg

SEQ ID NO: 2758867 - DNA, 22 bp, Homo sapiens
gactggggtaagcggaataaac

SEQ ID NO: 2758868 - DNA, 20 bp, Homo sapiens
gacttcttccctaaaatgta

SEQ ID NO: 2758869 - DNA, 22 bp, Homo sapiens
gagaacttccagatcctggaaa

SEQ ID NO: 2758870 - DNA, 13 bp, Homo sapiens
gagaagaactgaa

SEQ ID NO: 2758871 - DNA, 21 bp, Homo sapiens
gagaatgagagacacactgaa

SEQ ID NO: 2758872 - DNA, 18 bp, Homo sapiens
gagaatgttaccagactt

SEQ ID NO: 2758873 - DNA, 18 bp, Homo sapiens
gagacccctttaaactgt

SEQ ID NO: 2758874 - DNA, 17 bp, Homo sapiens
gagactgaaagaaacta

SEQ ID NO: 2758875 - DNA, 20 bp, Homo sapiens
gagactttctttctgtaggt

SEQ ID NO: 2758876 - DNA, 11 bp, Homo sapiens
gagaggacaga

SEQ ID NO: 2758877 - DNA, 20 bp, Homo sapiens
gagattttttttttaatctc

SEQ ID NO: 2758878 - DNA, 23 bp, Homo sapiens
gagcccctgcccacgcccttgga

SEQ ID NO: 2758879 - DNA, 20 bp, Homo sapiens
gagcctgctaaggaacaatg

SEQ ID NO: 2758880 - DNA, 22 bp, Homo sapiens
gaggacagtatttgtggggagg

SEQ ID NO: 2758881 - DNA, 12 bp, Homo sapiens
taccaggaccag

SEQ ID NO: 2758882 - DNA, 13 bp, Homo sapiens
taccaggaccagt

SEQ ID NO: 2758883 - DNA, 23 bp, Homo sapiens
taccaggaccagtttatgtttgt

SEQ ID NO: 2758884 - DNA, 16 bp, Homo sapiens
tacctcaggaaagaat

SEQ ID NO: 2758885 - DNA, 12 bp, Homo sapiens
taccttgtggga

SEQ ID NO: 2758886 - DNA, 22 bp, Homo sapiens
tacctttctaagggaaaaagtt

SEQ ID NO: 2758887 - DNA, 15 bp, Homo sapiens
tactccttggatttg

SEQ ID NO: 2758888 - DNA, 15 bp, Homo sapiens
tactgaactgttacc

SEQ ID NO: 2758889 - DNA, 20 bp, Homo sapiens
tactgattttcaaaaaaatg

SEQ ID NO: 2758890 - DNA, 21 bp, Homo sapiens
tactgcatcttagtttactgg

SEQ ID NO: 2758891 - DNA, 14 bp, Homo sapiens
tactggataaattt

SEQ ID NO: 2758892 - DNA, 14 bp, Homo sapiens
tactgtaagaaaat

SEQ ID NO: 2758893 - DNA, 23 bp, Homo sapiens
tactgtgaagttacatgcataaa

SEQ ID NO: 2758894 - DNA, 16 bp, Homo sapiens
tactgtgtaatataaa

SEQ ID NO: 2758895 - DNA, 13 bp, Homo sapiens
tactgttaaaact

SEQ ID NO: 2758896 - DNA, 20 bp, Homo sapiens
tactgttaaaactgtacctt

SEQ ID NO: 2758897 - DNA, 14 bp, Homo sapiens
tacttcaaatcctt

SEQ ID NO: 2758898 - DNA, 16 bp, Homo sapiens
tacttcatgctgtcta

SEQ ID NO: 2758899 - DNA, 16 bp, Homo sapiens
tacttctaatcttaaa

SEQ ID NO: 2758900 - DNA, 20 bp, Homo sapiens
tacttgcagctcccattcta

SEQ ID NO: 2758901 - DNA, 16 bp, Homo sapiens
tacttttttcaaatat

SEQ ID NO: 2758902 - DNA, 21 bp, Homo sapiens
tagaaaatggaaaatatacaa

SEQ ID NO: 2758903 - DNA, 23 bp, Homo sapiens
tagaaaatggaaaatatacaagt

SEQ ID NO: 2758904 - DNA, 16 bp, Homo sapiens
tagaaagctaatacaa

SEQ ID NO: 2758905 - DNA, 13 bp, Homo sapiens
tagaaattctgaa

SEQ ID NO: 2758906 - DNA, 21 bp, Homo sapiens
tagaaccatgttggttgcact

SEQ ID NO: 2758907 - DNA, 14 bp, Homo sapiens
tagaagaagtgtgt

SEQ ID NO: 2758908 - DNA, 20 bp, Homo sapiens
tagacaaggttgctgttgtg

SEQ ID NO: 2758909 - DNA, 21 bp, Homo sapiens
tagacataactggtttgactc

SEQ ID NO: 2758910 - DNA, 22 bp, Homo sapiens
tagacataactggtttgactct

SEQ ID NO: 2758911 - DNA, 17 bp, Homo sapiens
tagactctctagtttta

SEQ ID NO: 2758912 - DNA, 23 bp, Homo sapiens
tagactctctagttttatcttaa

SEQ ID NO: 2758913 - DNA, 14 bp, Homo sapiens
tagagggtgtgtaa

SEQ ID NO: 2758914 - DNA, 18 bp, Homo sapiens
tagagtttagctggaaaa

SEQ ID NO: 2758915 - DNA, 18 bp, Homo sapiens
tagatgcagaaaaagaaa

SEQ ID NO: 2758916 - DNA, 20 bp, Homo sapiens
tagatgcagaaaaagaaaaa

SEQ ID NO: 2758917 - DNA, 17 bp, Homo sapiens
tagatgcagttctgaag

SEQ ID NO: 2758918 - DNA, 20 bp, Homo sapiens
tagatgcagttctgaagaag

SEQ ID NO: 2758919 - DNA, 16 bp, Homo sapiens
tagatgtatgtacttc

SEQ ID NO: 2758920 - DNA, 12 bp, Homo sapiens
tagatttttaaa

SEQ ID NO: 2758921 - DNA, 18 bp, Homo sapiens
tagcaatgaattagttgc

SEQ ID NO: 2758922 - DNA, 22 bp, Homo sapiens
tagcacatccaccaaactcctg

SEQ ID NO: 2758923 - DNA, 16 bp, Homo sapiens
tagcaggacctgccaa

SEQ ID NO: 2758924 - DNA, 15 bp, Homo sapiens
tagcattgtttctag

SEQ ID NO: 2758925 - DNA, 18 bp, Homo sapiens
tagccaaacaccactttg

SEQ ID NO: 2758926 - DNA, 22 bp, Homo sapiens
tagccaaacaccactttgtaaa

SEQ ID NO: 2758927 - DNA, 23 bp, Homo sapiens
tagccggaaggccgaggtcccat

SEQ ID NO: 2758928 - DNA, 16 bp, Homo sapiens
tagcctctttgtgttt

SEQ ID NO: 2758929 - DNA, 16 bp, Homo sapiens
tagcgattataatctc

SEQ ID NO: 2758930 - DNA, 21 bp, Homo sapiens
tagctgcactgtttatggaaa

SEQ ID NO: 2758931 - DNA, 16 bp, Homo sapiens
tagctggcaagaatgg

SEQ ID NO: 2758932 - DNA, 18 bp, Homo sapiens
taggaagctgaattatta

SEQ ID NO: 2758933 - DNA, 16 bp, Homo sapiens
taggaggggttaataa

SEQ ID NO: 2758934 - DNA, 18 bp, Homo sapiens
taggataactaaaattct

SEQ ID NO: 2758935 - DNA, 16 bp, Homo sapiens
tagtatttctatgaaa

SEQ ID NO: 2758936 - DNA, 18 bp, Homo sapiens
tagtctgttatatttcct

SEQ ID NO: 2758937 - DNA, 22 bp, Homo sapiens
tagtgaaactcgttaatttgta

SEQ ID NO: 2758938 - DNA, 14 bp, Homo sapiens
tagtgcaaattgtc

SEQ ID NO: 2758939 - DNA, 21 bp, Homo sapiens
tagttacttgctataaataga

SEQ ID NO: 2758940 - DNA, 22 bp, Homo sapiens
tagttagttttggttatttcta

SEQ ID NO: 2758941 - DNA, 18 bp, Homo sapiens
tagttgcttttgaaggaa

SEQ ID NO: 2758942 - DNA, 19 bp, Homo sapiens
tagtttactggataaattt

SEQ ID NO: 2758943 - DNA, 13 bp, Homo sapiens
tagttttatctta

SEQ ID NO: 2758944 - DNA, 17 bp, Homo sapiens
tagttttatcttaaact

SEQ ID NO: 2758945 - DNA, 14 bp, Homo sapiens
tagttttgtttatg

SEQ ID NO: 2758946 - DNA, 19 bp, Homo sapiens
tataaaaacattgaaatat

SEQ ID NO: 2758947 - DNA, 20 bp, Homo sapiens
tataaaaacattgaaatatt

SEQ ID NO: 2758948 - DNA, 24 bp, Homo sapiens
tataaaaacattgaaatattagtt

SEQ ID NO: 2758949 - DNA, 14 bp, Homo sapiens
tataaaagttgtac

SEQ ID NO: 2758950 - DNA, 22 bp, Homo sapiens
tataaacatgcttgcattatat

SEQ ID NO: 2758951 - DNA, 12 bp, Homo sapiens
tataaagaatga

SEQ ID NO: 2758952 - DNA, 14 bp, Homo sapiens
tataaagaatgaaa

SEQ ID NO: 2758953 - DNA, 17 bp, Homo sapiens
tataaatacaaatctgt

SEQ ID NO: 2758954 - DNA, 21 bp, Homo sapiens
tataaatacaaatctgtataa

SEQ ID NO: 2758955 - DNA, 12 bp, Homo sapiens
tataaatgtcta

SEQ ID NO: 2758956 - DNA, 12 bp, Homo sapiens
tataataccttt

SEQ ID NO: 2758957 - DNA, 17 bp, Homo sapiens
tataatacctttctaag

SEQ ID NO: 2758958 - DNA, 17 bp, Homo sapiens
tataatctgaatcctgt

SEQ ID NO: 2758959 - DNA, 14 bp, Homo sapiens
tataattttgtgaa

SEQ ID NO: 2758960 - DNA, 19 bp, Homo sapiens
tataattttgtgaagcaaa

SEQ ID NO: 2758961 - DNA, 15 bp, Homo sapiens
tatacaagtaaattc

SEQ ID NO: 2758962 - DNA, 19 bp, Homo sapiens
tatactgtgaagttacatg

SEQ ID NO: 2758963 - DNA, 14 bp, Homo sapiens
tatagaaaatggaa

SEQ ID NO: 2758964 - DNA, 15 bp, Homo sapiens
tatagaaaatggaaa

SEQ ID NO: 2758965 - DNA, 13 bp, Homo sapiens
tatagaaattctg

SEQ ID NO: 2758966 - DNA, 15 bp, Homo sapiens
tatagaaattctgaa

SEQ ID NO: 2758967 - DNA, 20 bp, Homo sapiens
tatagaataaaagctgtgga

SEQ ID NO: 2758968 - DNA, 18 bp, Homo sapiens
tatagctggcaagaatgg

SEQ ID NO: 2758969 - DNA, 13 bp, Homo sapiens
tatagttgaaagt

SEQ ID NO: 2758970 - DNA, 13 bp, Homo sapiens
tatataacaatgc

SEQ ID NO: 2758971 - DNA, 17 bp, Homo sapiens
tatataacaatgctgta

SEQ ID NO: 2758972 - DNA, 19 bp, Homo sapiens
tatatagctggcaagaatg

SEQ ID NO: 2758973 - DNA, 23 bp, Homo sapiens
tatatagttagctttattgaagt

SEQ ID NO: 2758974 - DNA, 12 bp, Homo sapiens
tatatatcctat

SEQ ID NO: 2758975 - DNA, 16 bp, Homo sapiens
tatatcctgtttgtat

SEQ ID NO: 2758976 - DNA, 17 bp, Homo sapiens
tatatcttaagaatgtg

SEQ ID NO: 2758977 - DNA, 13 bp, Homo sapiens
tatatgaatatta

SEQ ID NO: 2758978 - DNA, 14 bp, Homo sapiens
tatatgaatattac

SEQ ID NO: 2758979 - DNA, 16 bp, Homo sapiens
tatatgagaagaatag

SEQ ID NO: 2758980 - DNA, 17 bp, Homo sapiens
tatatgagaagaatagc

SEQ ID NO: 2758981 - DNA, 20 bp, Homo sapiens
tatatgagaagaatagccta

SEQ ID NO: 2758982 - DNA, 14 bp, Homo sapiens
tatattagttgctt

SEQ ID NO: 2758983 - DNA, 13 bp, Homo sapiens
tatattctaaaga

SEQ ID NO: 2758984 - DNA, 15 bp, Homo sapiens
tatatttattactgt

SEQ ID NO: 2758985 - DNA, 20 bp, Homo sapiens
tatatttattactgtaagaa

SEQ ID NO: 2758986 - DNA, 20 bp, Homo sapiens
tatatttgaaatattgactt

SEQ ID NO: 2758987 - DNA, 15 bp, Homo sapiens
tatcaaggaagtctt

SEQ ID NO: 2758988 - DNA, 21 bp, Homo sapiens
tatcaaggaagtcttcaaatt

SEQ ID NO: 2758989 - DNA, 12 bp, Homo sapiens
tatcatgctaaa

SEQ ID NO: 2758990 - DNA, 23 bp, Homo sapiens
tatcctgtttgtatttttttcca

SEQ ID NO: 2758991 - DNA, 18 bp, Homo sapiens
tatcgttattataaatgt

SEQ ID NO: 2758992 - DNA, 21 bp, Homo sapiens
tatctaaacccagcaaaacag

SEQ ID NO: 2758993 - DNA, 13 bp, Homo sapiens
tatctaatgacat

SEQ ID NO: 2758994 - DNA, 16 bp, Homo sapiens
tatctacagcttctat

SEQ ID NO: 2758995 - DNA, 14 bp, Homo sapiens
tatctatattctaa

SEQ ID NO: 2758996 - DNA, 15 bp, Homo sapiens
tatctgaacatttac

SEQ ID NO: 2758997 - DNA, 15 bp, Homo sapiens
tatcttgattaatgt

SEQ ID NO: 2758998 - DNA, 17 bp, Homo sapiens
tatcttgattaatgtac

SEQ ID NO: 2758999 - DNA, 13 bp, Homo sapiens
tatcttgtgaagt

SEQ ID NO: 2759000 - DNA, 15 bp, Homo sapiens
tatcttgtgaagttg

SEQ ID NO: 2759001 - DNA, 20 bp, Homo sapiens
tatcttttagctagaatcca

SEQ ID NO: 2759002 - DNA, 23 bp, Homo sapiens
tatgaaaaaaaaattatttgcct

SEQ ID NO: 2759003 - DNA, 19 bp, Homo sapiens
tatgaagaattgccaatct

SEQ ID NO: 2759004 - DNA, 22 bp, Homo sapiens
tatgaagaattgccaatcttgt

SEQ ID NO: 2759005 - DNA, 15 bp, Homo sapiens
tatgaatattacatg

SEQ ID NO: 2759006 - DNA, 20 bp, Homo sapiens
tatgaccttaaggaaaagta

SEQ ID NO: 2759007 - DNA, 15 bp, Homo sapiens
tggtctgttaatctt

SEQ ID NO: 2759008 - DNA, 14 bp, Homo sapiens
tggtgctataacat

SEQ ID NO: 2759009 - DNA, 12 bp, Homo sapiens
tggtgctggttt

SEQ ID NO: 2759010 - DNA, 13 bp, Homo sapiens
tggtgctggttta

SEQ ID NO: 2759011 - DNA, 22 bp, Homo sapiens
tggtgtcttcattttacattgt

SEQ ID NO: 2759012 - DNA, 13 bp, Homo sapiens
tggttatttctaa

SEQ ID NO: 2759013 - DNA, 16 bp, Homo sapiens
tggttatttctaaacc

SEQ ID NO: 2759014 - DNA, 16 bp, Homo sapiens
tggttgcactttgtag

SEQ ID NO: 2759015 - DNA, 20 bp, Homo sapiens
tggtttatttgttgttttct

SEQ ID NO: 2759016 - DNA, 14 bp, Homo sapiens
tggtttcctgccca

SEQ ID NO: 2759017 - DNA, 15 bp, Homo sapiens
tggtttcctgcccag

SEQ ID NO: 2759018 - DNA, 20 bp, Homo sapiens
tggtttcctgcccagcctgg

SEQ ID NO: 2759019 - DNA, 21 bp, Homo sapiens
tggttttgggaaaaattattt

SEQ ID NO: 2759020 - DNA, 12 bp, Homo sapiens
tgtaaaaacttt

SEQ ID NO: 2759021 - DNA, 17 bp, Homo sapiens
tgtaaagctgttaaaat

SEQ ID NO: 2759022 - DNA, 12 bp, Homo sapiens
tgtaaagtaaaa

SEQ ID NO: 2759023 - DNA, 14 bp, Homo sapiens
tgtaaagtaaaata

SEQ ID NO: 2759024 - DNA, 15 bp, Homo sapiens
tgtaaagtaaaatat

SEQ ID NO: 2759025 - DNA, 13 bp, Homo sapiens
tgtaaatctgtac

SEQ ID NO: 2759026 - DNA, 23 bp, Homo sapiens
tgtaaatctgtacttttttcaaa

SEQ ID NO: 2759027 - DNA, 19 bp, Homo sapiens
tgtaacttaaatatttgaa

SEQ ID NO: 2759028 - DNA, 20 bp, Homo sapiens
tgtaacttaaatatttgaaa

SEQ ID NO: 2759029 - DNA, 17 bp, Homo sapiens
tgtaagaaaatatcact

SEQ ID NO: 2759030 - DNA, 21 bp, Homo sapiens
tgtaaggcttgttccaatgcc

SEQ ID NO: 2759031 - DNA, 18 bp, Homo sapiens
tgtaatttaaaattgtga

SEQ ID NO: 2759032 - DNA, 22 bp, Homo sapiens
tgtacatttggaacagtgacaa

SEQ ID NO: 2759033 - DNA, 15 bp, Homo sapiens
tgtactttttattgc

SEQ ID NO: 2759034 - DNA, 16 bp, Homo sapiens
tgtactttttattgca

SEQ ID NO: 2759035 - DNA, 19 bp, Homo sapiens
tgtactttttattgcatgg

SEQ ID NO: 2759036 - DNA, 16 bp, Homo sapiens
tgtagaaattctaact

SEQ ID NO: 2759037 - DNA, 21 bp, Homo sapiens
tgtagataaataatgtagttt

SEQ ID NO: 2759038 - DNA, 17 bp, Homo sapiens
tgtagtcccagcacttt

SEQ ID NO: 2759039 - DNA, 22 bp, Homo sapiens
tgtagtgttggagaagaactga

SEQ ID NO: 2759040 - DNA, 22 bp, Homo sapiens
tgtagtttttttggtgctataa

SEQ ID NO: 2759041 - DNA, 16 bp, Homo sapiens
tgtataaatgtctatt

SEQ ID NO: 2759042 - DNA, 18 bp, Homo sapiens
tgtataaatgtctattat

SEQ ID NO: 2759043 - DNA, 13 bp, Homo sapiens
tgtataatttacc

SEQ ID NO: 2759044 - DNA, 14 bp, Homo sapiens
tgtataatttacct

SEQ ID NO: 2759045 - DNA, 22 bp, Homo sapiens
tgtatccatccatggggctgat

SEQ ID NO: 2759046 - DNA, 21 bp, Homo sapiens
tgtatgagcagagcagttcaa

SEQ ID NO: 2759047 - DNA, 16 bp, Homo sapiens
tgtatgtcaaattgtg

SEQ ID NO: 2759048 - DNA, 14 bp, Homo sapiens
tgtattcactaaaa

SEQ ID NO: 2759049 - DNA, 17 bp, Homo sapiens
tgtattcactaaaataa

SEQ ID NO: 2759050 - DNA, 18 bp, Homo sapiens
tgtattcactaaaataaa

SEQ ID NO: 2759051 - DNA, 16 bp, Homo sapiens
tgtattgctgctgtgc

SEQ ID NO: 2759052 - DNA, 13 bp, Homo sapiens
tgtatttttttcc

SEQ ID NO: 2759053 - DNA, 16 bp, Homo sapiens
tgtatttttttccaag

SEQ ID NO: 2759054 - DNA, 21 bp, Homo sapiens
tgtcaagtcctgactgggctg

SEQ ID NO: 2759055 - DNA, 10 bp, Homo sapiens
tgtcaataaa

SEQ ID NO: 2759056 - DNA, 11 bp, Homo sapiens
tgtcaataaat

SEQ ID NO: 2759057 - DNA, 16 bp, Homo sapiens
tgtcaataaatgttga

SEQ ID NO: 2759058 - DNA, 23 bp, Homo sapiens
tgtcatcaatagtgtcctatgca

SEQ ID NO: 2759059 - DNA, 15 bp, Homo sapiens
tgtccaactctgtat

SEQ ID NO: 2759060 - DNA, 17 bp, Homo sapiens
tgtccagaagagtcaaa

SEQ ID NO: 2759061 - DNA, 14 bp, Homo sapiens
tgtccatttaaaaa

SEQ ID NO: 2759062 - DNA, 12 bp, Homo sapiens
tgtcctatgcaa

SEQ ID NO: 2759063 - DNA, 16 bp, Homo sapiens
tgtccttgaatgccat

SEQ ID NO: 2759064 - DNA, 17 bp, Homo sapiens
tgtccttgaatgccata

SEQ ID NO: 2759065 - DNA, 19 bp, Homo sapiens
tgtctaaaagattctttaa

SEQ ID NO: 2759066 - DNA, 20 bp, Homo sapiens
tgtcttcaggctctgcccag

SEQ ID NO: 2759067 - DNA, 20 bp, Homo sapiens
tgtgcagggctggtttgttc

SEQ ID NO: 2759068 - DNA, 22 bp, Homo sapiens
tgtgcctgtcactactggtctg

SEQ ID NO: 2759069 - DNA, 18 bp, Homo sapiens
tgtgctagagttaaaagt

SEQ ID NO: 2759070 - DNA, 20 bp, Homo sapiens
tgtgctagagttaaaagtta

SEQ ID NO: 2759071 - DNA, 20 bp, Homo sapiens
tgtgctggagccctgttcct

SEQ ID NO: 2759072 - DNA, 16 bp, Homo sapiens
tgtggactacaggaca

SEQ ID NO: 2759073 - DNA, 13 bp, Homo sapiens
tgtggagattttt

SEQ ID NO: 2759074 - DNA, 21 bp, Homo sapiens
tgtggccccgcccgagcccct

SEQ ID NO: 2759075 - DNA, 11 bp, Homo sapiens
tgtgtaattta

SEQ ID NO: 2759076 - DNA, 23 bp, Homo sapiens
tgtgtaatttaaaattgtgatgt

SEQ ID NO: 2759077 - DNA, 23 bp, Homo sapiens
tgtgtagtctctctagtagttaa

SEQ ID NO: 2759078 - DNA, 11 bp, Homo sapiens
tgtgtatgtgg

SEQ ID NO: 2759079 - DNA, 12 bp, Homo sapiens
tgtgtatgtggg

SEQ ID NO: 2759080 - DNA, 14 bp, Homo sapiens
tgtgtatgtggggg

SEQ ID NO: 2759081 - DNA, 12 bp, Homo sapiens
tgtgtattctta

SEQ ID NO: 2759082 - DNA, 14 bp, Homo sapiens
tgtgtattcttaaa

SEQ ID NO: 2759083 - DNA, 20 bp, Homo sapiens
tgtgtgaaaggtacttcaaa

SEQ ID NO: 2759084 - DNA, 14 bp, Homo sapiens
tgtgtgggagtgtg

SEQ ID NO: 2759085 - DNA, 15 bp, Homo sapiens
tgtgtgggagtgtgt

SEQ ID NO: 2759086 - DNA, 20 bp, Homo sapiens
tgtgtgtgggagtgtgtaat

SEQ ID NO: 2759087 - DNA, 14 bp, Homo sapiens
tgtgtgtgtatgtg

SEQ ID NO: 2759088 - DNA, 16 bp, Homo sapiens
tgtgtgtgtgtatgtg

SEQ ID NO: 2759089 - DNA, 14 bp, Homo sapiens
tgtgttgaaatata

SEQ ID NO: 2759090 - DNA, 21 bp, Homo sapiens
tgtgttgggggaaatgttgtg

SEQ ID NO: 2759091 - DNA, 13 bp, Homo sapiens
tgtgttttgcaag

SEQ ID NO: 2759092 - DNA, 14 bp, Homo sapiens
tgttaaaatacata

SEQ ID NO: 2759093 - DNA, 18 bp, Homo sapiens
tgttaaaatacataactt

SEQ ID NO: 2759094 - DNA, 21 bp, Homo sapiens
tgttaccactggtaacatgtg

SEQ ID NO: 2759095 - DNA, 15 bp, Homo sapiens
tgttataatctttca

SEQ ID NO: 2759096 - DNA, 18 bp, Homo sapiens
tgttatatttccttttgt

SEQ ID NO: 2759097 - DNA, 20 bp, Homo sapiens
tgttccaatgccacatactt

SEQ ID NO: 2759098 - DNA, 21 bp, Homo sapiens
tgttccaatgccacatacttg

SEQ ID NO: 2759099 - DNA, 15 bp, Homo sapiens
tgttcctccctccca

SEQ ID NO: 2759100 - DNA, 18 bp, Homo sapiens
tgttcctccctcccacac

SEQ ID NO: 2759101 - DNA, 19 bp, Homo sapiens
tgttctgactttttgtttc

SEQ ID NO: 2759102 - DNA, 20 bp, Homo sapiens
tgttgacatgggacatttgc

SEQ ID NO: 2759103 - DNA, 17 bp, Homo sapiens
tgttgagtatttgctgt

SEQ ID NO: 2759104 - DNA, 19 bp, Homo sapiens
tgttgagtatttgctgttt

SEQ ID NO: 2759105 - DNA, 16 bp, Homo sapiens
tgttggagaagaactg

SEQ ID NO: 2759106 - DNA, 17 bp, Homo sapiens
tgttggagaagaactga

SEQ ID NO: 2759107 - DNA, 21 bp, Homo sapiens
tgttggagaagaactgaaatc

SEQ ID NO: 2759108 - DNA, 23 bp, Homo sapiens
tgttggagtgaagcatttaaaag

SEQ ID NO: 2759109 - DNA, 13 bp, Homo sapiens
tgttggcgctgag

SEQ ID NO: 2759110 - DNA, 21 bp, Homo sapiens
tgttggtctgaatacaaacat

SEQ ID NO: 2759111 - DNA, 15 bp, Homo sapiens
tgttggttgcacttt

SEQ ID NO: 2759112 - DNA, 19 bp, Homo sapiens
tgttggttgcactttgtag

SEQ ID NO: 2759113 - DNA, 18 bp, Homo sapiens
tgttgtgcagtgtgcctg

SEQ ID NO: 2759114 - DNA, 13 bp, Homo sapiens
tgttgtgtataat

SEQ ID NO: 2759115 - DNA, 12 bp, Homo sapiens
tgttgttttata

SEQ ID NO: 2759116 - DNA, 20 bp, Homo sapiens
tgtttaaaaaccgaataaat

SEQ ID NO: 2759117 - DNA, 21 bp, Homo sapiens
tgtttaaaaaccgaataaatg

SEQ ID NO: 2759118 - DNA, 22 bp, Homo sapiens
tgtttaaaaaccgaataaatgt

SEQ ID NO: 2759119 - DNA, 13 bp, Homo sapiens
tgtttaaaagcaa

SEQ ID NO: 2759120 - DNA, 23 bp, Homo sapiens
tgtttaataagtatatcttaaga

SEQ ID NO: 2759121 - DNA, 16 bp, Homo sapiens
tgtttatgtgtgtgtg

SEQ ID NO: 2759122 - DNA, 14 bp, Homo sapiens
tgtttattcaaaat

SEQ ID NO: 2759123 - DNA, 17 bp, Homo sapiens
tgtttattcaaaatatt

SEQ ID NO: 2759124 - DNA, 19 bp, Homo sapiens
tgtttcaaacatatataac

SEQ ID NO: 2759125 - DNA, 23 bp, Homo sapiens
tgtttcttagctgcactgtttat

SEQ ID NO: 2759126 - DNA, 13 bp, Homo sapiens
tgtttgcttggtg

SEQ ID NO: 2759127 - DNA, 21 bp, Homo sapiens
tgtttgcttggtgctggttta

SEQ ID NO: 2759128 - DNA, 18 bp, Homo sapiens
tgtttggatttcctttat

SEQ ID NO: 2759129 - DNA, 18 bp, Homo sapiens
tgtttggtgctcatttaa

SEQ ID NO: 2759130 - DNA, 21 bp, Homo sapiens
tgtttgtatttttttccaagt

SEQ ID NO: 2759131 - DNA, 13 bp, Homo sapiens
tgtttgtccagtt

SEQ ID NO: 2759132 - DNA, 13 bp, Homo sapiens
tgttttaagcaaa

SEQ ID NO: 2759133 - DNA, 18 bp, Homo sapiens
tttaaaactgcattttta

SEQ ID NO: 2759134 - DNA, 17 bp, Homo sapiens
tttaaaagaatgattat

SEQ ID NO: 2759135 - DNA, 14 bp, Homo sapiens
tttaaaagagacaa

SEQ ID NO: 2759136 - DNA, 19 bp, Homo sapiens
tttaaattggagaaaagca

SEQ ID NO: 2759137 - DNA, 21 bp, Homo sapiens
tttaaattggagaaaagcact

SEQ ID NO: 2759138 - DNA, 18 bp, Homo sapiens
tttaacattgattggata

SEQ ID NO: 2759139 - DNA, 18 bp, Homo sapiens
tttaactctactgtgtaa

SEQ ID NO: 2759140 - DNA, 14 bp, Homo sapiens
tttaataagtatat

SEQ ID NO: 2759141 - DNA, 15 bp, Homo sapiens
tttaataatgtttca

SEQ ID NO: 2759142 - DNA, 19 bp, Homo sapiens
tttaataatgtttcaaaca

SEQ ID NO: 2759143 - DNA, 18 bp, Homo sapiens
tttaattgtgtggtgctt

SEQ ID NO: 2759144 - DNA, 14 bp, Homo sapiens
tttacattgtgaca

SEQ ID NO: 2759145 - DNA, 16 bp, Homo sapiens
tttaccacaaaagcaa

SEQ ID NO: 2759146 - DNA, 17 bp, Homo sapiens
tttacttctaatcttaa

SEQ ID NO: 2759147 - DNA, 19 bp, Homo sapiens
tttagaacctacaaaagct

SEQ ID NO: 2759148 - DNA, 17 bp, Homo sapiens
tttagatttttaaattg

SEQ ID NO: 2759149 - DNA, 23 bp, Homo sapiens
tttagctagaatccacacatata

SEQ ID NO: 2759150 - DNA, 20 bp, Homo sapiens
tttagctggaaaagtatgtt

SEQ ID NO: 2759151 - DNA, 22 bp, Homo sapiens
tttagctggaaaagtatgttag

SEQ ID NO: 2759152 - DNA, 20 bp, Homo sapiens
tttaggccatttgttacagt

SEQ ID NO: 2759153 - DNA, 15 bp, Homo sapiens
tttatactgtgaagt

SEQ ID NO: 2759154 - DNA, 23 bp, Homo sapiens
tttatactgtgaagttacatgca

SEQ ID NO: 2759155 - DNA, 13 bp, Homo sapiens
tttatataagctt

SEQ ID NO: 2759156 - DNA, 15 bp, Homo sapiens
tttatatatgaatat

SEQ ID NO: 2759157 - DNA, 23 bp, Homo sapiens
tttatatatgaatattacatgta

SEQ ID NO: 2759158 - DNA, 23 bp, Homo sapiens
tttatatctggaatgagcctgtt

SEQ ID NO: 2759159 - DNA, 14 bp, Homo sapiens
tttatcaaggaagt

SEQ ID NO: 2759160 - DNA, 17 bp, Homo sapiens
tttatggaaataccagg

SEQ ID NO: 2759161 - DNA, 13 bp, Homo sapiens
tttatgtgtgtgt

SEQ ID NO: 2759162 - DNA, 11 bp, Homo sapiens
tttatgttctt

SEQ ID NO: 2759163 - DNA, 16 bp, Homo sapiens
tttattactgtaagaa

SEQ ID NO: 2759164 - DNA, 12 bp, Homo sapiens
tttattcaaaat

SEQ ID NO: 2759165 - DNA, 15 bp, Homo sapiens
tttatttagaaactg

SEQ ID NO: 2759166 - DNA, 16 bp, Homo sapiens
tttcaaacatatataa

SEQ ID NO: 2759167 - DNA, 13 bp, Homo sapiens
tttcaaatattga

SEQ ID NO: 2759168 - DNA, 21 bp, Homo sapiens
tttcagataatcacaatacat

SEQ ID NO: 2759169 - DNA, 14 bp, Homo sapiens
tttcagtagcagga

SEQ ID NO: 2759170 - DNA, 14 bp, Homo sapiens
tttcatagttctgt

SEQ ID NO: 2759171 - DNA, 17 bp, Homo sapiens
tttcattctgaatctga

SEQ ID NO: 2759172 - DNA, 19 bp, Homo sapiens
tttcatttacaatttcaaa

SEQ ID NO: 2759173 - DNA, 13 bp, Homo sapiens
tttccaagtgtat

SEQ ID NO: 2759174 - DNA, 16 bp, Homo sapiens
tttccaagtgtataat

SEQ ID NO: 2759175 - DNA, 15 bp, Homo sapiens
tttccacagaagctc

SEQ ID NO: 2759176 - DNA, 15 bp, Homo sapiens
tttcctgcatctttc

SEQ ID NO: 2759177 - DNA, 16 bp, Homo sapiens
tttcctgcatctttca

SEQ ID NO: 2759178 - DNA, 23 bp, Homo sapiens
tttccttttgtaaagtaaaatat

SEQ ID NO: 2759179 - DNA, 14 bp, Homo sapiens
tttctctaaactgt

SEQ ID NO: 2759180 - DNA, 12 bp, Homo sapiens
tttctctaggaa

SEQ ID NO: 2759181 - DNA, 23 bp, Homo sapiens
tttcttccttggccaagagaagg

SEQ ID NO: 2759182 - DNA, 16 bp, Homo sapiens
tttctttgaaatgcta

SEQ ID NO: 2759183 - DNA, 17 bp, Homo sapiens
tttctttgaaatgctaa

SEQ ID NO: 2759184 - DNA, 17 bp, Homo sapiens
tttctttgtatcattca

SEQ ID NO: 2759185 - DNA, 17 bp, Homo sapiens
tttgaaaattaccttta

SEQ ID NO: 2759186 - DNA, 14 bp, Homo sapiens
tttgaaatattgac

SEQ ID NO: 2759187 - DNA, 15 bp, Homo sapiens
tttgaaatattgact

SEQ ID NO: 2759188 - DNA, 18 bp, Homo sapiens
tttgaaatgctaaacttg

SEQ ID NO: 2759189 - DNA, 19 bp, Homo sapiens
tttgaatattaagctaaaa

SEQ ID NO: 2759190 - DNA, 13 bp, Homo sapiens
tttgatacaaatg

SEQ ID NO: 2759191 - DNA, 17 bp, Homo sapiens
tttgattaatgaagaaa

SEQ ID NO: 2759192 - DNA, 20 bp, Homo sapiens
tttgattaatgaagaaagta

SEQ ID NO: 2759193 - DNA, 19 bp, Homo sapiens
tttgcatttttgtattttg

SEQ ID NO: 2759194 - DNA, 20 bp, Homo sapiens
tttgcatttttgtattttgt

SEQ ID NO: 2759195 - DNA, 13 bp, Homo sapiens
tttgctcatggaa

SEQ ID NO: 2759196 - DNA, 17 bp, Homo sapiens
tttgcttggtgctggtt

SEQ ID NO: 2759197 - DNA, 9 bp, Homo sapiens
tttgctttc

SEQ ID NO: 2759198 - DNA, 17 bp, Homo sapiens
tttgggaaaaattattt

SEQ ID NO: 2759199 - DNA, 13 bp, Homo sapiens
tttggtgctataa

SEQ ID NO: 2759200 - DNA, 16 bp, Homo sapiens
tttgtaaaaacttttt

SEQ ID NO: 2759201 - DNA, 14 bp, Homo sapiens
tttgtaaagtaaaa

SEQ ID NO: 2759202 - DNA, 17 bp, Homo sapiens
tttgtaaagtaaaatat

SEQ ID NO: 2759203 - DNA, 20 bp, Homo sapiens
tttgtaaatctgtacttttt

SEQ ID NO: 2759204 - DNA, 16 bp, Homo sapiens
tttgtacatttggaac

SEQ ID NO: 2759205 - DNA, 13 bp, Homo sapiens
tttgtataaaata

SEQ ID NO: 2759206 - DNA, 14 bp, Homo sapiens
tttgtataaaataa

SEQ ID NO: 2759207 - DNA, 18 bp, Homo sapiens
tttgtataaaataatttt

SEQ ID NO: 2759208 - DNA, 19 bp, Homo sapiens
tttgtatttttttccaagt

SEQ ID NO: 2759209 - DNA, 11 bp, Homo sapiens
tttgtggggag

SEQ ID NO: 2759210 - DNA, 14 bp, Homo sapiens
tttgttgttttctg

SEQ ID NO: 2759211 - DNA, 13 bp, Homo sapiens
tttgtttatgcat

SEQ ID NO: 2759212 - DNA, 13 bp, Homo sapiens
tttgtttttgctt

SEQ ID NO: 2759213 - DNA, 17 bp, Homo sapiens
tttgtttttgctttctg

SEQ ID NO: 2759214 - DNA, 22 bp, Homo sapiens
ttttaaaagagacaaactgtaa

SEQ ID NO: 2759215 - DNA, 15 bp, Homo sapiens
ttttaaagaatccaa

SEQ ID NO: 2759216 - DNA, 17 bp, Homo sapiens
ttttaaagaatccaaga

SEQ ID NO: 2759217 - DNA, 21 bp, Homo sapiens
ttttaaagaatccaagacaaa

SEQ ID NO: 2759218 - DNA, 15 bp, Homo sapiens
ttttaagcaaatgca

SEQ ID NO: 2759219 - DNA, 13 bp, Homo sapiens
ttttaataatgtt

SEQ ID NO: 2759220 - DNA, 20 bp, Homo sapiens
ttttaataatgtttcaaaca

SEQ ID NO: 2759221 - DNA, 12 bp, Homo sapiens
ttttaggaaagg

SEQ ID NO: 2759222 - DNA, 20 bp, Homo sapiens
ttttatatatgaatattaca

SEQ ID NO: 2759223 - DNA, 20 bp, Homo sapiens
ttttatatgcttctgtttta

SEQ ID NO: 2759224 - DNA, 16 bp, Homo sapiens
ttttatcaaggaagtc

SEQ ID NO: 2759225 - DNA, 16 bp, Homo sapiens
ttttatgtctcttaga

SEQ ID NO: 2759226 - DNA, 16 bp, Homo sapiens
ttttcaaaaaaatgtt

SEQ ID NO: 2759227 - DNA, 15 bp, Homo sapiens
ttttcaaatattgaa

SEQ ID NO: 2759228 - DNA, 20 bp, Homo sapiens
ttttcaaatattgaatgcct

SEQ ID NO: 2759229 - DNA, 16 bp, Homo sapiens
ttttcatgacagaata

SEQ ID NO: 2759230 - DNA, 17 bp, Homo sapiens
ttttcatgacagaatat

SEQ ID NO: 2759231 - DNA, 18 bp, Homo sapiens
ttttcatgacagaatata

SEQ ID NO: 2759232 - DNA, 20 bp, Homo sapiens
ttttccaagtgtataatgtt

SEQ ID NO: 2759233 - DNA, 18 bp, Homo sapiens
ttttccttcctctgtaag

SEQ ID NO: 2759234 - DNA, 19 bp, Homo sapiens
ttttctctaaactgtttct

SEQ ID NO: 2759235 - DNA, 21 bp, Homo sapiens
ttttctgggggaaaaagccat

SEQ ID NO: 2759236 - DNA, 18 bp, Homo sapiens
ttttctttgaaatgctaa

SEQ ID NO: 2759237 - DNA, 18 bp, Homo sapiens
ttttctttgtatcattca

SEQ ID NO: 2759238 - DNA, 19 bp, Homo sapiens
ttttggttatttctaaacc

SEQ ID NO: 2759239 - DNA, 20 bp, Homo sapiens
ttttgtaaagtaaaatatgt

SEQ ID NO: 2759240 - DNA, 13 bp, Homo sapiens
ttttgtaaatctg

SEQ ID NO: 2759241 - DNA, 19 bp, Homo sapiens
ttttgtacatcgcttcttt

SEQ ID NO: 2759242 - DNA, 13 bp, Homo sapiens
ttttgtcattaaa

SEQ ID NO: 2759243 - DNA, 11 bp, Homo sapiens
ttttgtttatg

SEQ ID NO: 2759244 - DNA, 17 bp, Homo sapiens
ttttgttttgtctatat

SEQ ID NO: 2759245 - DNA, 16 bp, Homo sapiens
tttttaaagaatccaa

SEQ ID NO: 2759246 - DNA, 13 bp, Homo sapiens
tttttaatagaac

SEQ ID NO: 2759247 - DNA, 13 bp, Homo sapiens
tttttaatctcct

SEQ ID NO: 2759248 - DNA, 14 bp, Homo sapiens
tttttatatatgaa

SEQ ID NO: 2759249 - DNA, 16 bp, Homo sapiens
tttttatatatgaata

SEQ ID NO: 2759250 - DNA, 17 bp, Homo sapiens
tttttatatttgaaata

SEQ ID NO: 2759251 - DNA, 17 bp, Homo sapiens
tttttatgtctcttaga

SEQ ID NO: 2759252 - DNA, 12 bp, Homo sapiens
tttttattgcat

SEQ ID NO: 2759253 - DNA, 16 bp, Homo sapiens
tttttcaaatattgaa

SEQ ID NO: 2759254 - DNA, 14 bp, Homo sapiens
tttttcatcattgt

SEQ ID NO: 2759255 - DNA, 23 bp, Homo sapiens
tttttcatcattgttgtgtataa

SEQ ID NO: 2759256 - DNA, 22 bp, Homo sapiens
tttttccaagtgtataatgttg

SEQ ID NO: 2759257 - DNA, 19 bp, Homo sapiens
tttttctctaggaaatatt

SEQ ID NO: 2759258 - DNA, 11 bp, Homo sapiens
tttttgattaa

SEQ ID NO: 2759259 - DNA, 13 bp, Homo sapiens
tttttgtaaaaac

SEQ ID NO: 2759260 - DNA, 21 bp, Homo sapiens
ctgggaactgggccagcagag

SEQ ID NO: 2759261 - DNA, 14 bp, Homo sapiens
ctgggcactgggcc

SEQ ID NO: 2759262 - DNA, 15 bp, Homo sapiens
ctgggcactgggccg

SEQ ID NO: 2759263 - DNA, 19 bp, Homo sapiens
ctgggcagtcttttgtgtc

SEQ ID NO: 2759264 - DNA, 15 bp, Homo sapiens
ctgggccagcagagc

SEQ ID NO: 2759265 - DNA, 13 bp, Homo sapiens
ctgggccctgggt

SEQ ID NO: 2759266 - DNA, 22 bp, Homo sapiens
ctggtctaagaatgacgatgcc

SEQ ID NO: 2759267 - DNA, 17 bp, Homo sapiens
ctggtttgaagaatgtt

SEQ ID NO: 2759268 - DNA, 12 bp, Homo sapiens
ctgtactgagtt

SEQ ID NO: 2759269 - DNA, 14 bp, Homo sapiens
ctgtactgagttct

SEQ ID NO: 2759270 - DNA, 17 bp, Homo sapiens
ctgtccaatcacattca

SEQ ID NO: 2759271 - DNA, 11 bp, Homo sapiens
ctgtccctcca

SEQ ID NO: 2759272 - DNA, 23 bp, Homo sapiens
ctgtcgattagactggacagctt

SEQ ID NO: 2759273 - DNA, 13 bp, Homo sapiens
ctgtgaactgaac

SEQ ID NO: 2759274 - DNA, 16 bp, Homo sapiens
ctgtgcagaaggtctg

SEQ ID NO: 2759275 - DNA, 18 bp, Homo sapiens
ctgtgcagaaggtctggt

SEQ ID NO: 2759276 - DNA, 22 bp, Homo sapiens
ctgttcatggggtttttgccct

SEQ ID NO: 2759277 - DNA, 12 bp, Homo sapiens
ctgttcctgcct

SEQ ID NO: 2759278 - DNA, 17 bp, Homo sapiens
ctgttcctgccttctct

SEQ ID NO: 2759279 - DNA, 18 bp, Homo sapiens
ctgttcctgccttctctt

SEQ ID NO: 2759280 - DNA, 19 bp, Homo sapiens
ctgtttgggaggctggagt

SEQ ID NO: 2759281 - DNA, 20 bp, Homo sapiens
ctgtttgggaggctggagtg

SEQ ID NO: 2759282 - DNA, 20 bp, Homo sapiens
ctgtttttcggacagtttat

SEQ ID NO: 2759283 - DNA, 17 bp, Homo sapiens
ctgtttttctaactggg

SEQ ID NO: 2759284 - DNA, 18 bp, Homo sapiens
cttaaaggggcctgcgca

SEQ ID NO: 2759285 - DNA, 18 bp, Homo sapiens
cttaagtcagaacagcag

SEQ ID NO: 2759286 - DNA, 17 bp, Homo sapiens
cttcaaagcaaatgtct

SEQ ID NO: 2759287 - DNA, 15 bp, Homo sapiens
cttcatctggaacca

SEQ ID NO: 2759288 - DNA, 15 bp, Homo sapiens
cttcatgcatggaaa

SEQ ID NO: 2759289 - DNA, 17 bp, Homo sapiens
cttccactaccctccct

SEQ ID NO: 2759290 - DNA, 19 bp, Homo sapiens
cttccctagatggttccct

SEQ ID NO: 2759291 - DNA, 16 bp, Homo sapiens
cttccctatctttgcc

SEQ ID NO: 2759292 - DNA, 13 bp, Homo sapiens
cttcctcctcctc

SEQ ID NO: 2759293 - DNA, 15 bp, Homo sapiens
cttcctcctcctcct

SEQ ID NO: 2759294 - DNA, 16 bp, Homo sapiens
cttcctctgaggctga

SEQ ID NO: 2759295 - DNA, 22 bp, Homo sapiens
cttcctgcctcccaagcagctg

SEQ ID NO: 2759296 - DNA, 13 bp, Homo sapiens
cttctatcctgca

SEQ ID NO: 2759297 - DNA, 14 bp, Homo sapiens
cttctcgtcttcct

SEQ ID NO: 2759298 - DNA, 22 bp, Homo sapiens
cttctcgtcttcctctctctca

SEQ ID NO: 2759299 - DNA, 13 bp, Homo sapiens
cttctgctcacat

SEQ ID NO: 2759300 - DNA, 16 bp, Homo sapiens
cttctgctcacattcc

SEQ ID NO: 2759301 - DNA, 23 bp, Homo sapiens
cttctgtgcatttgtgtctgcct

SEQ ID NO: 2759302 - DNA, 21 bp, Homo sapiens
cttgtggtggctgctccatga

SEQ ID NO: 2759303 - DNA, 22 bp, Homo sapiens
ctttaaaaaattaatctgggcc

SEQ ID NO: 2759304 - DNA, 15 bp, Homo sapiens
ctttccccatgtctc

SEQ ID NO: 2759305 - DNA, 18 bp, Homo sapiens
ctttctagttgaaaataa

SEQ ID NO: 2759306 - DNA, 15 bp, Homo sapiens
ctttgacctgcctcc

SEQ ID NO: 2759307 - DNA, 16 bp, Homo sapiens
ctttgccaccctcatg

SEQ ID NO: 2759308 - DNA, 17 bp, Homo sapiens
ctttgccaccctcatgc

SEQ ID NO: 2759309 - DNA, 18 bp, Homo sapiens
ctttgccaccctcatgct

SEQ ID NO: 2759310 - DNA, 18 bp, Homo sapiens
ctttgctgagcctgtaaa

SEQ ID NO: 2759311 - DNA, 24 bp, Homo sapiens
ctttggcaggtgcagcccccactg

SEQ ID NO: 2759312 - DNA, 14 bp, Homo sapiens
ctttggctgcatgc

SEQ ID NO: 2759313 - DNA, 16 bp, Homo sapiens
ctttggctgcatgcga

SEQ ID NO: 2759314 - DNA, 15 bp, Homo sapiens
ctttgtaaattgtca

SEQ ID NO: 2759315 - DNA, 13 bp, Homo sapiens
cttttgccattga

SEQ ID NO: 2759316 - DNA, 19 bp, Homo sapiens
gaaacaccctcacactggg

SEQ ID NO: 2759317 - DNA, 20 bp, Homo sapiens
gaaacagctcgactttaaaa

SEQ ID NO: 2759318 - DNA, 14 bp, Homo sapiens
gaaaggatgcttct

SEQ ID NO: 2759319 - DNA, 16 bp, Homo sapiens
gaaagttaatgtcaag

SEQ ID NO: 2759320 - DNA, 14 bp, Homo sapiens
gaaagtttacagga

SEQ ID NO: 2759321 - DNA, 23 bp, Homo sapiens
gaaatgtggtagcctcactttta

SEQ ID NO: 2759322 - DNA, 22 bp, Homo sapiens
gaaattcccttcatctggaacc

SEQ ID NO: 2759323 - DNA, 20 bp, Homo sapiens
gaacagcagactcagctctg

SEQ ID NO: 2759324 - DNA, 20 bp, Homo sapiens
gaactctgacaacagacttc

SEQ ID NO: 2759325 - DNA, 15 bp, Homo sapiens
gaactgggccagcag

SEQ ID NO: 2759326 - DNA, 17 bp, Homo sapiens
gaactgggccagcagag

SEQ ID NO: 2759327 - DNA, 19 bp, Homo sapiens
gaactttgctgagcctgta

SEQ ID NO: 2759328 - DNA, 18 bp, Homo sapiens
gaagtctcttcctgcctc

SEQ ID NO: 2759329 - DNA, 13 bp, Homo sapiens
gaagtgactttgg

SEQ ID NO: 2759330 - DNA, 23 bp, Homo sapiens
gaataaagctgtgagcaaacaga

SEQ ID NO: 2759331 - DNA, 20 bp, Homo sapiens
gaatattagtgacctcagct

SEQ ID NO: 2759332 - DNA, 13 bp, Homo sapiens
gaatgctttagga

SEQ ID NO: 2759333 - DNA, 21 bp, Homo sapiens
gacacaggggacactgaacct

SEQ ID NO: 2759334 - DNA, 19 bp, Homo sapiens
gacaccccccaccatggtg

SEQ ID NO: 2759335 - DNA, 18 bp, Homo sapiens
gacaccggagtatgtgca

SEQ ID NO: 2759336 - DNA, 22 bp, Homo sapiens
gacaccggagtatgtgcagtgt

SEQ ID NO: 2759337 - DNA, 16 bp, Homo sapiens
gacagtttatttgttg

SEQ ID NO: 2759338 - DNA, 13 bp, Homo sapiens
gacattctgattc

SEQ ID NO: 2759339 - DNA, 22 bp, Homo sapiens
gacattctgattcgaatgacac

SEQ ID NO: 2759340 - DNA, 19 bp, Homo sapiens
gaccaaaagttacatgttt

SEQ ID NO: 2759341 - DNA, 14 bp, Homo sapiens
gaccacactccagc

SEQ ID NO: 2759342 - DNA, 22 bp, Homo sapiens
gaccacactccagctgggatca

SEQ ID NO: 2759343 - DNA, 22 bp, Homo sapiens
gacctgcctcccttcatgcatg

SEQ ID NO: 2759344 - DNA, 23 bp, Homo sapiens
gactcagctctgacattctgatt

SEQ ID NO: 2759345 - DNA, 23 bp, Homo sapiens
gactctctttcttccactaccct

SEQ ID NO: 2759346 - DNA, 13 bp, Homo sapiens
gactggacagctt

SEQ ID NO: 2759347 - DNA, 19 bp, Homo sapiens
gactgtttttcggacagtt

SEQ ID NO: 2759348 - DNA, 16 bp, Homo sapiens
gacttgacagtggaac

SEQ ID NO: 2759349 - DNA, 18 bp, Homo sapiens
gagaaggaaaattttagc

SEQ ID NO: 2759350 - DNA, 23 bp, Homo sapiens
gagaccctccccacagtgccacc

SEQ ID NO: 2759351 - DNA, 11 bp, Homo sapiens
gagagtgtgac

SEQ ID NO: 2759352 - DNA, 14 bp, Homo sapiens
gagcaaacagagga

SEQ ID NO: 2759353 - DNA, 18 bp, Homo sapiens
gagcagctgggcactggg

SEQ ID NO: 2759354 - DNA, 21 bp, Homo sapiens
gagcagtgggagggtaccagc

SEQ ID NO: 2759355 - DNA, 15 bp, Homo sapiens
gagccgtggccgagg

SEQ ID NO: 2759356 - DNA, 13 bp, Homo sapiens
gagcctcagcagc

SEQ ID NO: 2759357 - DNA, 15 bp, Homo sapiens
gagcctcagcagcaa

SEQ ID NO: 2759358 - DNA, 17 bp, Homo sapiens
gagcctcctgaccctgt

SEQ ID NO: 2759359 - DNA, 20 bp, Homo sapiens
gagctgggagaccctcccca

SEQ ID NO: 2759360 - DNA, 16 bp, Homo sapiens
gctccccaggccaccc

SEQ ID NO: 2759361 - DNA, 23 bp, Homo sapiens
gctctgtattctgcaacagcctg

SEQ ID NO: 2759362 - DNA, 18 bp, Homo sapiens
gctgatggagccccacct

SEQ ID NO: 2759363 - DNA, 23 bp, Homo sapiens
gctgatttctaggtaggaaatgt

SEQ ID NO: 2759364 - DNA, 15 bp, Homo sapiens
gctgccgcaccagcc

SEQ ID NO: 2759365 - DNA, 16 bp, Homo sapiens
gctgccgcaccagccc

SEQ ID NO: 2759366 - DNA, 14 bp, Homo sapiens
gctgcttccactca

SEQ ID NO: 2759367 - DNA, 14 bp, Homo sapiens
gctgcttctgtgca

SEQ ID NO: 2759368 - DNA, 21 bp, Homo sapiens
gctggaaaggatgcttctgct

SEQ ID NO: 2759369 - DNA, 23 bp, Homo sapiens
gctgggcactgggccggcagcct

SEQ ID NO: 2759370 - DNA, 19 bp, Homo sapiens
gctgtgagcaaacagagga

SEQ ID NO: 2759371 - DNA, 24 bp, Homo sapiens
gctgtgagcaaacagaggaggcca

SEQ ID NO: 2759372 - DNA, 14 bp, Homo sapiens
gcttcctgtgcaga

SEQ ID NO: 2759373 - DNA, 12 bp, Homo sapiens
gcttctgctcac

SEQ ID NO: 2759374 - DNA, 19 bp, Homo sapiens
gcttctgctcacattccct

SEQ ID NO: 2759375 - DNA, 21 bp, Homo sapiens
gcttctgctcacattccctct

SEQ ID NO: 2759376 - DNA, 22 bp, Homo sapiens
gctttccccatgtctcgactca

SEQ ID NO: 2759377 - DNA, 14 bp, Homo sapiens
ggaaagttaatgtc

SEQ ID NO: 2759378 - DNA, 20 bp, Homo sapiens
ggaaattcccttcatctgga

SEQ ID NO: 2759379 - DNA, 17 bp, Homo sapiens
ggaacaccataggtcac

SEQ ID NO: 2759380 - DNA, 13 bp, Homo sapiens
ggaagcagctttc

SEQ ID NO: 2759381 - DNA, 16 bp, Homo sapiens
ggacagcccctcctcc

SEQ ID NO: 2759382 - DNA, 15 bp, Homo sapiens
ggaccagcttttccc

SEQ ID NO: 2759383 - DNA, 17 bp, Homo sapiens
ggaccagcttttcccaa

SEQ ID NO: 2759384 - DNA, 22 bp, Homo sapiens
ggaccagcttttcccaaaagcc

SEQ ID NO: 2759385 - DNA, 20 bp, Homo sapiens
ggactatcaggagtccactg

SEQ ID NO: 2759386 - DNA, 18 bp, Homo sapiens
ggactggcctctgctgat

SEQ ID NO: 2759387 - DNA, 15 bp, Homo sapiens
ggagaccctccccac

SEQ ID NO: 2759388 - DNA, 12 bp, Homo sapiens
ggagcagctggg

SEQ ID NO: 2759389 - DNA, 16 bp, Homo sapiens
ggagcatcagtgccct

SEQ ID NO: 2759390 - DNA, 15 bp, Homo sapiens
ggagcctcagcagca

SEQ ID NO: 2759391 - DNA, 16 bp, Homo sapiens
ggaggcatcagtgtcc

SEQ ID NO: 2759392 - DNA, 14 bp, Homo sapiens
ggaggggcctggcc

SEQ ID NO: 2759393 - DNA, 13 bp, Homo sapiens
ggagtatgtgcag

SEQ ID NO: 2759394 - DNA, 18 bp, Homo sapiens
ggatggggagcagctggg

SEQ ID NO: 2759395 - DNA, 19 bp, Homo sapiens
ggatggggcatgtggccaa

SEQ ID NO: 2759396 - DNA, 18 bp, Homo sapiens
ggatttgactcctccaag

SEQ ID NO: 2759397 - DNA, 15 bp, Homo sapiens
ggcactgggccggca

SEQ ID NO: 2759398 - DNA, 20 bp, Homo sapiens
ggcactgggccggcagcctg

SEQ ID NO: 2759399 - DNA, 22 bp, Homo sapiens
ggcactgggccggcagcctggt

SEQ ID NO: 2759400 - DNA, 16 bp, Homo sapiens
ggcatcaaagatgaga

SEQ ID NO: 2759401 - DNA, 18 bp, Homo sapiens
ggcatccaaatggctgct

SEQ ID NO: 2759402 - DNA, 23 bp, Homo sapiens
ggcatgcgaatgagctgggccct

SEQ ID NO: 2759403 - DNA, 24 bp, Homo sapiens
ggcatgcgaatgagctgggccctg

SEQ ID NO: 2759404 - DNA, 18 bp, Homo sapiens
ggcatggcccagcctgga

SEQ ID NO: 2759405 - DNA, 21 bp, Homo sapiens
ggcatggcttgcccctgtggc

SEQ ID NO: 2759406 - DNA, 16 bp, Homo sapiens
ggccaagggctccagg

SEQ ID NO: 2759407 - DNA, 12 bp, Homo sapiens
ggccagcagagc

SEQ ID NO: 2759408 - DNA, 23 bp, Homo sapiens
ggccaggcatggcccagcctgga

SEQ ID NO: 2759409 - DNA, 14 bp, Homo sapiens
ggcctggcctgggt

SEQ ID NO: 2759410 - DNA, 15 bp, Homo sapiens
ggcctggcctgggtg

SEQ ID NO: 2759411 - DNA, 20 bp, Homo sapiens
ggcctgggtggggcagggcc

SEQ ID NO: 2759412 - DNA, 13 bp, Homo sapiens
ggctccagggcca

SEQ ID NO: 2759413 - DNA, 17 bp, Homo sapiens
ggctccagggccagggt

SEQ ID NO: 2759414 - DNA, 14 bp, Homo sapiens
ggctgatttctagg

SEQ ID NO: 2759415 - DNA, 22 bp, Homo sapiens
ggctgggaactgggccagcaga

SEQ ID NO: 2759416 - DNA, 18 bp, Homo sapiens
ggcttctcctctgctagg

SEQ ID NO: 2759417 - DNA, 18 bp, Homo sapiens
gggaactgggccagcaga

SEQ ID NO: 2759418 - DNA, 15 bp, Homo sapiens
gggagcagctgggca

SEQ ID NO: 2759419 - DNA, 14 bp, Homo sapiens
gggaggggaaccag

SEQ ID NO: 2759420 - DNA, 16 bp, Homo sapiens
gggaggggcctggcct

SEQ ID NO: 2759421 - DNA, 20 bp, Homo sapiens
gggcttccctagatggttcc

SEQ ID NO: 2759422 - DNA, 16 bp, Homo sapiens
ggggaggggcctggcc

SEQ ID NO: 2759423 - DNA, 13 bp, Homo sapiens
gggtaacactgat

SEQ ID NO: 2759424 - DNA, 21 bp, Homo sapiens
gggtgactaaacgggcgccaa

SEQ ID NO: 2759425 - DNA, 12 bp, Homo sapiens
ggtaacactgat

SEQ ID NO: 2759426 - DNA, 19 bp, Homo sapiens
ggtactcccccagccctca

SEQ ID NO: 2759427 - DNA, 15 bp, Homo sapiens
ggtagaatgtaaagc

SEQ ID NO: 2759428 - DNA, 17 bp, Homo sapiens
ggtcccacttcacagct

SEQ ID NO: 2759429 - DNA, 15 bp, Homo sapiens
ggtctggcctagtgg

SEQ ID NO: 2759430 - DNA, 22 bp, Homo sapiens
ggtctggtcggcaaactcccta

SEQ ID NO: 2759431 - DNA, 21 bp, Homo sapiens
ggtgtgtttcaggacagctgc

SEQ ID NO: 2759432 - DNA, 12 bp, Homo sapiens
ggttccctcttt

SEQ ID NO: 2759433 - DNA, 13 bp, Homo sapiens
ggttgaggacagg

SEQ ID NO: 2759434 - DNA, 16 bp, Homo sapiens
ggttgaggacaggaga

SEQ ID NO: 2759435 - DNA, 15 bp, Homo sapiens
ggttgccagtcctgc

SEQ ID NO: 2759436 - DNA, 16 bp, Homo sapiens
gtaaaataaaaggtcg

SEQ ID NO: 2759437 - DNA, 16 bp, Homo sapiens
gtaaatacactgtgaa

SEQ ID NO: 2759438 - DNA, 18 bp, Homo sapiens
gtaaatacactgtgaaga

SEQ ID NO: 2759439 - DNA, 15 bp, Homo sapiens
gtaacaagccagatt

SEQ ID NO: 2759440 - DNA, 20 bp, Homo sapiens
gtacagttatctaagttaat

SEQ ID NO: 2759441 - DNA, 15 bp, Homo sapiens
gtaccagggctctgt

SEQ ID NO: 2759442 - DNA, 16 bp, Homo sapiens
gtactcccccagccct

SEQ ID NO: 2759443 - DNA, 16 bp, Homo sapiens
gtagaatgtaaagctt

SEQ ID NO: 2759444 - DNA, 19 bp, Homo sapiens
gtagccccagtgacagcta

SEQ ID NO: 2759445 - DNA, 17 bp, Homo sapiens
gtagggttgccagtcct

SEQ ID NO: 2759446 - DNA, 15 bp, Homo sapiens
gtaggttgaggacag

SEQ ID NO: 2759447 - DNA, 10 bp, Homo sapiens
gtatatatat

SEQ ID NO: 2759448 - DNA, 23 bp, Homo sapiens
gtatatatatatatatgtacagt

SEQ ID NO: 2759449 - DNA, 16 bp, Homo sapiens
gtatgggactggcctc

SEQ ID NO: 2759450 - DNA, 11 bp, Homo sapiens
gtatgtgcagt

SEQ ID NO: 2759451 - DNA, 14 bp, Homo sapiens
gtatgtgcagtgtg

SEQ ID NO: 2759452 - DNA, 20 bp, Homo sapiens
gtcaaaacagattgtttgca

SEQ ID NO: 2759453 - DNA, 20 bp, Homo sapiens
gtcaaggaaaggatgcacca

SEQ ID NO: 2759454 - DNA, 22 bp, Homo sapiens
gtcaagttccgtctcctctcca

SEQ ID NO: 2759455 - DNA, 22 bp, Homo sapiens
gtcagatgctgtgcaaatgtta

SEQ ID NO: 2759456 - DNA, 21 bp, Homo sapiens
gtccactgcctccatgatgca

SEQ ID NO: 2759457 - DNA, 21 bp, Homo sapiens
gtcccacttcacagctggaga

SEQ ID NO: 2759458 - DNA, 14 bp, Homo sapiens
gtcctcttgccagc

SEQ ID NO: 2759459 - DNA, 17 bp, Homo sapiens
gtcctcttgccagctca

SEQ ID NO: 2759460 - DNA, 15 bp, Homo sapiens
gaggacaggagaggg

SEQ ID NO: 2759461 - DNA, 14 bp, Homo sapiens
gaggaggccagcct

SEQ ID NO: 2759462 - DNA, 13 bp, Homo sapiens
gagggagctggga

SEQ ID NO: 2759463 - DNA, 16 bp, Homo sapiens
gaggggcctggcctgg

SEQ ID NO: 2759464 - DNA, 14 bp, Homo sapiens
gaggtgggggtctg

SEQ ID NO: 2759465 - DNA, 17 bp, Homo sapiens
gagtatgtgcagtgtgg

SEQ ID NO: 2759466 - DNA, 20 bp, Homo sapiens
gagtgtgaccaaaagttaca

SEQ ID NO: 2759467 - DNA, 21 bp, Homo sapiens
gagtgtgaccaaaagttacat

SEQ ID NO: 2759468 - DNA, 23 bp, Homo sapiens
gagttgctcctacccctgtcctg

SEQ ID NO: 2759469 - DNA, 24 bp, Homo sapiens
gatactactagatcacttgtcctc

SEQ ID NO: 2759470 - DNA, 15 bp, Homo sapiens
gatagagaatgccct

SEQ ID NO: 2759471 - DNA, 16 bp, Homo sapiens
gatatacaaagtgtac

SEQ ID NO: 2759472 - DNA, 23 bp, Homo sapiens
gatcacttgtcctcttgccagct

SEQ ID NO: 2759473 - DNA, 20 bp, Homo sapiens
gatgcctgtgaactgaactc

SEQ ID NO: 2759474 - DNA, 16 bp, Homo sapiens
gatggagccccacctt

SEQ ID NO: 2759475 - DNA, 18 bp, Homo sapiens
gatggagccccaccttgt

SEQ ID NO: 2759476 - DNA, 23 bp, Homo sapiens
gatggagccccaccttgtctgct

SEQ ID NO: 2759477 - DNA, 17 bp, Homo sapiens
gatggggagcagctggg

SEQ ID NO: 2759478 - DNA, 18 bp, Homo sapiens
gatggggagcagctgggc

SEQ ID NO: 2759479 - DNA, 20 bp, Homo sapiens
gatgtatgttgaagcctttg

SEQ ID NO: 2759480 - DNA, 19 bp, Homo sapiens
gattagactggacagcttg

SEQ ID NO: 2759481 - DNA, 17 bp, Homo sapiens
gattcgaatgacactgt

SEQ ID NO: 2759482 - DNA, 20 bp, Homo sapiens
gcaaacagaggaggccagcc

SEQ ID NO: 2759483 - DNA, 21 bp, Homo sapiens
gcaaatgccactctgggcagt

SEQ ID NO: 2759484 - DNA, 17 bp, Homo sapiens
gcaagagatgagaaaca

SEQ ID NO: 2759485 - DNA, 13 bp, Homo sapiens
gcaagccacagaa

SEQ ID NO: 2759486 - DNA, 20 bp, Homo sapiens
gcaagccagcttcctgtgca

SEQ ID NO: 2759487 - DNA, 21 bp, Homo sapiens
gcaagccagcttcctgtgcag

SEQ ID NO: 2759488 - DNA, 20 bp, Homo sapiens
gcaagtccatagctgagctg

SEQ ID NO: 2759489 - DNA, 13 bp, Homo sapiens
gcaagtgaatttg

SEQ ID NO: 2759490 - DNA, 19 bp, Homo sapiens
gcaccagcccgaacaccat

SEQ ID NO: 2759491 - DNA, 17 bp, Homo sapiens
gcacctttctagttgaa

SEQ ID NO: 2759492 - DNA, 20 bp, Homo sapiens
gcactgggccggcagcctgg

SEQ ID NO: 2759493 - DNA, 16 bp, Homo sapiens
gcagactcagctctga

SEQ ID NO: 2759494 - DNA, 18 bp, Homo sapiens
gcagcaaatgccactctg

SEQ ID NO: 2759495 - DNA, 19 bp, Homo sapiens
gcagcaaatgccactctgg

SEQ ID NO: 2759496 - DNA, 22 bp, Homo sapiens
gcagcctggttccctctttcct

SEQ ID NO: 2759497 - DNA, 23 bp, Homo sapiens
gcagcctggttccctctttcctg

SEQ ID NO: 2759498 - DNA, 22 bp, Homo sapiens
gcagctcaagttagcatttcaa

SEQ ID NO: 2759499 - DNA, 12 bp, Homo sapiens
gcagctgaaggg

SEQ ID NO: 2759500 - DNA, 14 bp, Homo sapiens
gcagctgctcccca

SEQ ID NO: 2759501 - DNA, 12 bp, Homo sapiens
gcaggctgattt

SEQ ID NO: 2759502 - DNA, 13 bp, Homo sapiens
gcagggcctggcc

SEQ ID NO: 2759503 - DNA, 17 bp, Homo sapiens
gcagggcctggcctggt

SEQ ID NO: 2759504 - DNA, 18 bp, Homo sapiens
gcatccaaatggctgctt

SEQ ID NO: 2759505 - DNA, 13 bp, Homo sapiens
gcatccgcctctg

SEQ ID NO: 2759506 - DNA, 18 bp, Homo sapiens
gcatccgcctctgagcca

SEQ ID NO: 2759507 - DNA, 21 bp, Homo sapiens
gcatccgcctctgagccagga

SEQ ID NO: 2759508 - DNA, 17 bp, Homo sapiens
gcatgcgaatgagctgg

SEQ ID NO: 2759509 - DNA, 19 bp, Homo sapiens
gcatgcgaatgagctgggc

SEQ ID NO: 2759510 - DNA, 15 bp, Homo sapiens
gcatggcccagcctg

SEQ ID NO: 2759511 - DNA, 16 bp, Homo sapiens
gcatggcccagcctgg

SEQ ID NO: 2759512 - DNA, 17 bp, Homo sapiens
gcatggcccagcctgga

SEQ ID NO: 2759513 - DNA, 16 bp, Homo sapiens
gccaagactcagggga

SEQ ID NO: 2759514 - DNA, 15 bp, Homo sapiens
gccagaatttcaaac

SEQ ID NO: 2759515 - DNA, 13 bp, Homo sapiens
gccagatttttta

SEQ ID NO: 2759516 - DNA, 16 bp, Homo sapiens
gccagattttttaaaa

SEQ ID NO: 2759517 - DNA, 23 bp, Homo sapiens
gccagattttttaaaatttatat

SEQ ID NO: 2759518 - DNA, 14 bp, Homo sapiens
gccagctgccgcac

SEQ ID NO: 2759519 - DNA, 18 bp, Homo sapiens
gccagctgccgcaccagc

SEQ ID NO: 2759520 - DNA, 19 bp, Homo sapiens
gccagctgccgcaccagcc

SEQ ID NO: 2759521 - DNA, 18 bp, Homo sapiens
gccagcttcctgtgcaga

SEQ ID NO: 2759522 - DNA, 12 bp, Homo sapiens
gccaggactctc

SEQ ID NO: 2759523 - DNA, 21 bp, Homo sapiens
gccaggcatggcccagcctgg

SEQ ID NO: 2759524 - DNA, 17 bp, Homo sapiens
gccatgtcaaacaaata

SEQ ID NO: 2759525 - DNA, 18 bp, Homo sapiens
gccattccccgtctctgg

SEQ ID NO: 2759526 - DNA, 17 bp, Homo sapiens
gccattgacttcttccc

SEQ ID NO: 2759527 - DNA, 15 bp, Homo sapiens
gcccagcctggagcc

SEQ ID NO: 2759528 - DNA, 23 bp, Homo sapiens
gcccattcattccattctggaag

SEQ ID NO: 2759529 - DNA, 14 bp, Homo sapiens
gccccagtgacagc

SEQ ID NO: 2759530 - DNA, 20 bp, Homo sapiens
gccctggagcctcagcagca

SEQ ID NO: 2759531 - DNA, 13 bp, Homo sapiens
gccgcaccagccc

SEQ ID NO: 2759532 - DNA, 13 bp, Homo sapiens
gccggcagcctgg

SEQ ID NO: 2759533 - DNA, 14 bp, Homo sapiens
gccggcagcctggt

SEQ ID NO: 2759534 - DNA, 21 bp, Homo sapiens
gcctagtggggaggggcctgg

SEQ ID NO: 2759535 - DNA, 18 bp, Homo sapiens
gcctcagcagcaaatgcc

SEQ ID NO: 2759536 - DNA, 13 bp, Homo sapiens
gcctcccaagcag

SEQ ID NO: 2759537 - DNA, 14 bp, Homo sapiens
gcctcccaagcagc

SEQ ID NO: 2759538 - DNA, 15 bp, Homo sapiens
gcctcccaagcagct

SEQ ID NO: 2759539 - DNA, 17 bp, Homo sapiens
gcctcccaagcagctga

SEQ ID NO: 2759540 - DNA, 20 bp, Homo sapiens
gcctcccaagcagctgaagg

SEQ ID NO: 2759541 - DNA, 22 bp, Homo sapiens
gcctcccttcatgcatggaaat

SEQ ID NO: 2759542 - DNA, 14 bp, Homo sapiens
gcctctgagccagg

SEQ ID NO: 2759543 - DNA, 19 bp, Homo sapiens
gcctctgagccaggagcct

SEQ ID NO: 2759544 - DNA, 20 bp, Homo sapiens
gcctctgagccaggagcctc

SEQ ID NO: 2759545 - DNA, 22 bp, Homo sapiens
gcctgacacaggggacactgaa

SEQ ID NO: 2759546 - DNA, 20 bp, Homo sapiens
gcctgctatttgaagtgtaa

SEQ ID NO: 2759547 - DNA, 14 bp, Homo sapiens
gcctggagccgtgg

SEQ ID NO: 2759548 - DNA, 20 bp, Homo sapiens
gcctgtagccccagtgacag

SEQ ID NO: 2759549 - DNA, 19 bp, Homo sapiens
gcctgtttgggaggctgga

SEQ ID NO: 2759550 - DNA, 14 bp, Homo sapiens
gcgaatgagctggg

SEQ ID NO: 2759551 - DNA, 22 bp, Homo sapiens
gctaaataaacatgtgccctca

SEQ ID NO: 2759552 - DNA, 22 bp, Homo sapiens
gctagaggaataaagctgtgag

SEQ ID NO: 2759553 - DNA, 23 bp, Homo sapiens
gctagaggaataaagctgtgagc

SEQ ID NO: 2759554 - DNA, 16 bp, Homo sapiens
gctcacattccctctc

SEQ ID NO: 2759555 - DNA, 19 bp, Homo sapiens
gctcactgacctgcctgta

SEQ ID NO: 2759556 - DNA, 15 bp, Homo sapiens
gctcagatagaatga

SEQ ID NO: 2759557 - DNA, 14 bp, Homo sapiens
gctcatttcaggat

SEQ ID NO: 2759558 - DNA, 14 bp, Homo sapiens
gctccagggccagg

SEQ ID NO: 2759559 - DNA, 15 bp, Homo sapiens
gctccatgagggtgg

SEQ ID NO: 2759560 - DNA, 18 bp, Homo sapiens
tgacagtccgtcaaaaca

SEQ ID NO: 2759561 - DNA, 19 bp, Homo sapiens
tgagagacattaactcatt

SEQ ID NO: 2759562 - DNA, 16 bp, Homo sapiens
tgagcaaacagaggag

SEQ ID NO: 2759563 - DNA, 18 bp, Homo sapiens
tgagccaggagcctcctg

SEQ ID NO: 2759564 - DNA, 22 bp, Homo sapiens
tgagctggaaaggatgcttctg

SEQ ID NO: 2759565 - DNA, 15 bp, Homo sapiens
tgaggacaggagagg

SEQ ID NO: 2759566 - DNA, 21 bp, Homo sapiens
tgaggtgggggtctggcctag

SEQ ID NO: 2759567 - DNA, 15 bp, Homo sapiens
tgagtcaaaaaatct

SEQ ID NO: 2759568 - DNA, 23 bp, Homo sapiens
tgagtttgggccccagaggctgg

SEQ ID NO: 2759569 - DNA, 22 bp, Homo sapiens
tgatgcaagccagcttcctgtg

SEQ ID NO: 2759570 - DNA, 15 bp, Homo sapiens
tgatgcctgacacag

SEQ ID NO: 2759571 - DNA, 20 bp, Homo sapiens
tgatgcctgacacaggggac

SEQ ID NO: 2759572 - DNA, 13 bp, Homo sapiens
tgcaacagcctgt

SEQ ID NO: 2759573 - DNA, 12 bp, Homo sapiens
tgcaagccagct

SEQ ID NO: 2759574 - DNA, 22 bp, Homo sapiens
tgcaagccagcttcctgtgcag

SEQ ID NO: 2759575 - DNA, 19 bp, Homo sapiens
tgcaagtccatagctgagc

SEQ ID NO: 2759576 - DNA, 15 bp, Homo sapiens
tgcaatttctcccga

SEQ ID NO: 2759577 - DNA, 18 bp, Homo sapiens
tgcacctttctagttgaa

SEQ ID NO: 2759578 - DNA, 11 bp, Homo sapiens
tgcatggaaat

SEQ ID NO: 2759579 - DNA, 14 bp, Homo sapiens
tgcatttgtgtctg

SEQ ID NO: 2759580 - DNA, 14 bp, Homo sapiens
tgccagtcctgcaa

SEQ ID NO: 2759581 - DNA, 17 bp, Homo sapiens
tgccatgtcaaacaaat

SEQ ID NO: 2759582 - DNA, 18 bp, Homo sapiens
tgccatgtcaaacaaata

SEQ ID NO: 2759583 - DNA, 16 bp, Homo sapiens
tgccctggagcctcag

SEQ ID NO: 2759584 - DNA, 18 bp, Homo sapiens
tgccctggagcctcagca

SEQ ID NO: 2759585 - DNA, 12 bp, Homo sapiens
tgccgcaccagc

SEQ ID NO: 2759586 - DNA, 20 bp, Homo sapiens
tgccgccagctgccgcacca

SEQ ID NO: 2759587 - DNA, 21 bp, Homo sapiens
tgccgccagctgccgcaccag

SEQ ID NO: 2759588 - DNA, 14 bp, Homo sapiens
tgcctcatgctctc

SEQ ID NO: 2759589 - DNA, 18 bp, Homo sapiens
tgcctcccaagcagctga

SEQ ID NO: 2759590 - DNA, 16 bp, Homo sapiens
tgcctcccttcatgca

SEQ ID NO: 2759591 - DNA, 15 bp, Homo sapiens
tgcctgcctcatgct

SEQ ID NO: 2759592 - DNA, 17 bp, Homo sapiens
tgcctgtgaactgaact

SEQ ID NO: 2759593 - DNA, 18 bp, Homo sapiens
tgccttctcttctatcct

SEQ ID NO: 2759594 - DNA, 24 bp, Homo sapiens
tgctaaataaacatgtgccctcag

SEQ ID NO: 2759595 - DNA, 24 bp, Homo sapiens
tgctaggctaccctcctctagaag

SEQ ID NO: 2759596 - DNA, 13 bp, Homo sapiens
tgctatttgaagt

SEQ ID NO: 2759597 - DNA, 14 bp, Homo sapiens
tgctcacattccct

SEQ ID NO: 2759598 - DNA, 18 bp, Homo sapiens
tgctcacattccctctca

SEQ ID NO: 2759599 - DNA, 14 bp, Homo sapiens
tgctcatttcagga

SEQ ID NO: 2759600 - DNA, 15 bp, Homo sapiens
tgctccccaggccac

SEQ ID NO: 2759601 - DNA, 16 bp, Homo sapiens
tgctccccaggccacc

SEQ ID NO: 2759602 - DNA, 18 bp, Homo sapiens
tgctctgatgaagaggag

SEQ ID NO: 2759603 - DNA, 13 bp, Homo sapiens
tgcttctgctcac

SEQ ID NO: 2759604 - DNA, 12 bp, Homo sapiens
tgcttctgtgca

SEQ ID NO: 2759605 - DNA, 16 bp, Homo sapiens
tgcttgttaactgagt

SEQ ID NO: 2759606 - DNA, 15 bp, Homo sapiens
tggaacttgaactga

SEQ ID NO: 2759607 - DNA, 23 bp, Homo sapiens
tggaaggggacacgtgacagccg

SEQ ID NO: 2759608 - DNA, 23 bp, Homo sapiens
tggaagtgactttggctgcatgc

SEQ ID NO: 2759609 - DNA, 15 bp, Homo sapiens
tggactcctgcacac

SEQ ID NO: 2759610 - DNA, 14 bp, Homo sapiens
tggagccccacctt

SEQ ID NO: 2759611 - DNA, 21 bp, Homo sapiens
tggagccccaccttgtctgct

SEQ ID NO: 2759612 - DNA, 14 bp, Homo sapiens
tggagcctcagcag

SEQ ID NO: 2759613 - DNA, 15 bp, Homo sapiens
tggagcctcagcagc

SEQ ID NO: 2759614 - DNA, 17 bp, Homo sapiens
tggagcctcagcagcaa

SEQ ID NO: 2759615 - DNA, 15 bp, Homo sapiens
tggcagcctcttcaa

SEQ ID NO: 2759616 - DNA, 16 bp, Homo sapiens
tggcagcctcttcaaa

SEQ ID NO: 2759617 - DNA, 20 bp, Homo sapiens
tggccattttgtaccagggc

SEQ ID NO: 2759618 - DNA, 14 bp, Homo sapiens
tggcccagcctgga

SEQ ID NO: 2759619 - DNA, 22 bp, Homo sapiens
tggcctagtggggaggggcctg

SEQ ID NO: 2759620 - DNA, 23 bp, Homo sapiens
tggcctagtggggaggggcctgg

SEQ ID NO: 2759621 - DNA, 21 bp, Homo sapiens
tggcctctgctgatcctccca

SEQ ID NO: 2759622 - DNA, 20 bp, Homo sapiens
tggcctggtccaggcttggg

SEQ ID NO: 2759623 - DNA, 16 bp, Homo sapiens
tgggaactgggccagc

SEQ ID NO: 2759624 - DNA, 16 bp, Homo sapiens
tgggactggcctctgc

SEQ ID NO: 2759625 - DNA, 20 bp, Homo sapiens
tgggagtaggagttgctcct

SEQ ID NO: 2759626 - DNA, 15 bp, Homo sapiens
tgggcatcaaagatg

SEQ ID NO: 2759627 - DNA, 18 bp, Homo sapiens
tgggccagaatttcaaac

SEQ ID NO: 2759628 - DNA, 17 bp, Homo sapiens
tgggccagcagagcatg

SEQ ID NO: 2759629 - DNA, 24 bp, Homo sapiens
tgggcttgtggtggctgctccatg

SEQ ID NO: 2759630 - DNA, 21 bp, Homo sapiens
tggggaggggcctggcctggg

SEQ ID NO: 2759631 - DNA, 15 bp, Homo sapiens
tggggcagggcctgg

SEQ ID NO: 2759632 - DNA, 17 bp, Homo sapiens
tggggcagggcctggcc

SEQ ID NO: 2759633 - DNA, 16 bp, Homo sapiens
tggggtttttgccctg

SEQ ID NO: 2759634 - DNA, 20 bp, Homo sapiens
tgggtgtgtttcaggacagc

SEQ ID NO: 2759635 - DNA, 22 bp, Homo sapiens
tgggtgtgtttcaggacagctg

SEQ ID NO: 2759636 - DNA, 16 bp, Homo sapiens
tgggttagggaaaaca

SEQ ID NO: 2759637 - DNA, 17 bp, Homo sapiens
tggtactcccccagccc

SEQ ID NO: 2759638 - DNA, 19 bp, Homo sapiens
tggtcccacttcacagctg

SEQ ID NO: 2759639 - DNA, 20 bp, Homo sapiens
tggtcccacttcacagctgg

SEQ ID NO: 2759640 - DNA, 12 bp, Homo sapiens
tggttcctcccc

SEQ ID NO: 2759641 - DNA, 14 bp, Homo sapiens
tgtaacaagccaga

SEQ ID NO: 2759642 - DNA, 18 bp, Homo sapiens
tgtacagttatctaagtt

SEQ ID NO: 2759643 - DNA, 15 bp, Homo sapiens
tgtaccagggctctg

SEQ ID NO: 2759644 - DNA, 18 bp, Homo sapiens
tgtactgagttctcatcc

SEQ ID NO: 2759645 - DNA, 15 bp, Homo sapiens
tgtatatatatatat

SEQ ID NO: 2759646 - DNA, 16 bp, Homo sapiens
tgtcctcttgccagct

SEQ ID NO: 2759647 - DNA, 20 bp, Homo sapiens
tgtcgattagactggacagc

SEQ ID NO: 2759648 - DNA, 20 bp, Homo sapiens
tgtcgttcccttgtgtctgt

SEQ ID NO: 2759649 - DNA, 24 bp, Homo sapiens
tgtcgttcccttgtgtctgttgct

SEQ ID NO: 2759650 - DNA, 15 bp, Homo sapiens
tgtctggctttcccg

SEQ ID NO: 2759651 - DNA, 14 bp, Homo sapiens
tgtgaactgaactc

SEQ ID NO: 2759652 - DNA, 18 bp, Homo sapiens
tgtgaccaaaagttacat

SEQ ID NO: 2759653 - DNA, 21 bp, Homo sapiens
tgtgagcaaacagaggaggcc

SEQ ID NO: 2759654 - DNA, 14 bp, Homo sapiens
tgtgcttgttaact

SEQ ID NO: 2759655 - DNA, 13 bp, Homo sapiens
tgtggtggctgct

SEQ ID NO: 2759656 - DNA, 17 bp, Homo sapiens
tgtgtctgcctgcctca

SEQ ID NO: 2759657 - DNA, 19 bp, Homo sapiens
tgtgtttcaggacagctgc

SEQ ID NO: 2759658 - DNA, 17 bp, Homo sapiens
tgttaagacttgacagt

SEQ ID NO: 2759659 - DNA, 20 bp, Homo sapiens
tgttaagacttgacagtgga

SEQ ID NO: 2759660 - DNA, 15 bp, Homo sapiens
tgttcctgccttctc

SEQ ID NO: 2759661 - DNA, 20 bp, Homo sapiens
tgttcctgccttctcttcta

SEQ ID NO: 2759662 - DNA, 22 bp, Homo sapiens
tgtttgcacctttctagttgaa

SEQ ID NO: 2759663 - DNA, 23 bp, Homo sapiens
tgtttgcacctttctagttgaaa

SEQ ID NO: 2759664 - DNA, 20 bp, Homo sapiens
tgtttttaatgctttgatat

SEQ ID NO: 2759665 - DNA, 13 bp, Homo sapiens
ttaagtcagaaca

SEQ ID NO: 2759666 - DNA, 21 bp, Homo sapiens
ttaatctgggccagaatttca

SEQ ID NO: 2759667 - DNA, 18 bp, Homo sapiens
ttaatgtcaaggaaagga

SEQ ID NO: 2759668 - DNA, 14 bp, Homo sapiens
ttacaatacaatag

SEQ ID NO: 2759669 - DNA, 13 bp, Homo sapiens
ttacatgtttgca

SEQ ID NO: 2759670 - DNA, 14 bp, Homo sapiens
ttacatgtttgcac

SEQ ID NO: 2759671 - DNA, 20 bp, Homo sapiens
ttatacgagtaatatgcctg

SEQ ID NO: 2759672 - DNA, 12 bp, Homo sapiens
ttatttgttgag

SEQ ID NO: 2759673 - DNA, 14 bp, Homo sapiens
ttatttgttgagag

SEQ ID NO: 2759674 - DNA, 14 bp, Homo sapiens
ttcacagctggaga

SEQ ID NO: 2759675 - DNA, 13 bp, Homo sapiens
ttcacatctcatt

SEQ ID NO: 2759676 - DNA, 15 bp, Homo sapiens
ttcacttacagcacc

SEQ ID NO: 2759677 - DNA, 15 bp, Homo sapiens
ttcatgcatggaaat

SEQ ID NO: 2759678 - DNA, 14 bp, Homo sapiens
ttccaacacctgcc

SEQ ID NO: 2759679 - DNA, 22 bp, Homo sapiens
ttccagtgaaatcagttactct

SEQ ID NO: 2759680 - DNA, 21 bp, Homo sapiens
ttcccaaaagcccattcattc

SEQ ID NO: 2759681 - DNA, 17 bp, Homo sapiens
ttcccatcactgctgtc

SEQ ID NO: 2759682 - DNA, 14 bp, Homo sapiens
ttccctctttcctg

SEQ ID NO: 2759683 - DNA, 19 bp, Homo sapiens
ttccctctttcctgtgcca

SEQ ID NO: 2759684 - DNA, 16 bp, Homo sapiens
ttccgtctcctctcca

SEQ ID NO: 2759685 - DNA, 12 bp, Homo sapiens
ttcctctctctc

SEQ ID NO: 2759686 - DNA, 13 bp, Homo sapiens
ttcctgccttctc

SEQ ID NO: 2759687 - DNA, 12 bp, Homo sapiens
ttcctgtgcaga

SEQ ID NO: 2759688 - DNA, 17 bp, Homo sapiens
ttcctgtgccaggactc

SEQ ID NO: 2759689 - DNA, 20 bp, Homo sapiens
ttccttcaaagcaaatgtct

SEQ ID NO: 2759690 - DNA, 13 bp, Homo sapiens
ttccttctcagca

SEQ ID NO: 2759691 - DNA, 19 bp, Homo sapiens
ttccttctcgtcttcctct

SEQ ID NO: 2759692 - DNA, 21 bp, Homo sapiens
ttccttctcgtcttcctctct

SEQ ID NO: 2759693 - DNA, 22 bp, Homo sapiens
ttccttctcgtcttcctctctc

SEQ ID NO: 2759694 - DNA, 15 bp, Homo sapiens
ttcgaatgacactgt

SEQ ID NO: 2759695 - DNA, 19 bp, Homo sapiens
ttcggacagtttatttgtt

SEQ ID NO: 2759696 - DNA, 14 bp, Homo sapiens
ttctagttgaaaat

SEQ ID NO: 2759697 - DNA, 14 bp, Homo sapiens
ttctcctctgctag

SEQ ID NO: 2759698 - DNA, 16 bp, Homo sapiens
ttctcgtcttcctctc

SEQ ID NO: 2759699 - DNA, 21 bp, Homo sapiens
ttctcgtcttcctctctctca

SEQ ID NO: 2759700 - DNA, 13 bp, Homo sapiens
ttctcttctatcc

SEQ ID NO: 2759701 - DNA, 19 bp, Homo sapiens
ttgagaaggaaaattttag

SEQ ID NO: 2759702 - DNA, 20 bp, Homo sapiens
ttgagaaggaaaattttagc

SEQ ID NO: 2759703 - DNA, 18 bp, Homo sapiens
ttgagggagctgggagac

SEQ ID NO: 2759704 - DNA, 13 bp, Homo sapiens
tcaggacagctgc

SEQ ID NO: 2759705 - DNA, 22 bp, Homo sapiens
tcaggcatgcgaatgagctggg

SEQ ID NO: 2759706 - DNA, 20 bp, Homo sapiens
tcagtgccctccaggataga

SEQ ID NO: 2759707 - DNA, 17 bp, Homo sapiens
tcagttaagcctttgga

SEQ ID NO: 2759708 - DNA, 15 bp, Homo sapiens
tcagttactcttcag

SEQ ID NO: 2759709 - DNA, 15 bp, Homo sapiens
tcatccacagaggcc

SEQ ID NO: 2759710 - DNA, 18 bp, Homo sapiens
tcatccacagaggccagg

SEQ ID NO: 2759711 - DNA, 18 bp, Homo sapiens
tcatccaggtcctttcct

SEQ ID NO: 2759712 - DNA, 14 bp, Homo sapiens
tcatgcatggaaat

SEQ ID NO: 2759713 - DNA, 21 bp, Homo sapiens
tcattccaacacctgccatag

SEQ ID NO: 2759714 - DNA, 14 bp, Homo sapiens
tcattccattctgg

SEQ ID NO: 2759715 - DNA, 12 bp, Homo sapiens
tcatttcaggat

SEQ ID NO: 2759716 - DNA, 18 bp, Homo sapiens
tcatttgtgccagaatgc

SEQ ID NO: 2759717 - DNA, 15 bp, Homo sapiens
tcatttttccgtaaa

SEQ ID NO: 2759718 - DNA, 22 bp, Homo sapiens
tccaaagaaatagggcatggct

SEQ ID NO: 2759719 - DNA, 19 bp, Homo sapiens
tccaaatgcagctttaaaa

SEQ ID NO: 2759720 - DNA, 19 bp, Homo sapiens
tccactaccctccctcgca

SEQ ID NO: 2759721 - DNA, 14 bp, Homo sapiens
tccactgcctccat

SEQ ID NO: 2759722 - DNA, 17 bp, Homo sapiens
tccagccacccagccag

SEQ ID NO: 2759723 - DNA, 21 bp, Homo sapiens
tccagccacccagccaggagg

SEQ ID NO: 2759724 - DNA, 19 bp, Homo sapiens
tccaggtcctttccttctc

SEQ ID NO: 2759725 - DNA, 19 bp, Homo sapiens
tccattcccatcactgctg

SEQ ID NO: 2759726 - DNA, 12 bp, Homo sapiens
tccattctggaa

SEQ ID NO: 2759727 - DNA, 15 bp, Homo sapiens
tcccaagcagctgaa

SEQ ID NO: 2759728 - DNA, 17 bp, Homo sapiens
tcccaagcagctgaagg

SEQ ID NO: 2759729 - DNA, 12 bp, Homo sapiens
tcccatcactgc

SEQ ID NO: 2759730 - DNA, 15 bp, Homo sapiens
tccccacagtgccac

SEQ ID NO: 2759731 - DNA, 19 bp, Homo sapiens
tccctatctttgccaccct

SEQ ID NO: 2759732 - DNA, 22 bp, Homo sapiens
tccctatgtcccagcccctggt

SEQ ID NO: 2759733 - DNA, 17 bp, Homo sapiens
tccctcgcatccgcctc

SEQ ID NO: 2759734 - DNA, 21 bp, Homo sapiens
tccctcgcatccgcctctgag

SEQ ID NO: 2759735 - DNA, 12 bp, Homo sapiens
tccctctttcct

SEQ ID NO: 2759736 - DNA, 13 bp, Homo sapiens
tccctctttcctg

SEQ ID NO: 2759737 - DNA, 15 bp, Homo sapiens
tccctctttcctgtg

SEQ ID NO: 2759738 - DNA, 16 bp, Homo sapiens
tccctctttcctgtgc

SEQ ID NO: 2759739 - DNA, 17 bp, Homo sapiens
tccctctttcctgtgcc

SEQ ID NO: 2759740 - DNA, 17 bp, Homo sapiens
tcccttgtgtctgttgc

SEQ ID NO: 2759741 - DNA, 14 bp, Homo sapiens
tccctttgttgctg

SEQ ID NO: 2759742 - DNA, 15 bp, Homo sapiens
tccctttgttgctgt

SEQ ID NO: 2759743 - DNA, 17 bp, Homo sapiens
tccctttgttgctgtct

SEQ ID NO: 2759744 - DNA, 18 bp, Homo sapiens
tccggtgtttaagacatt

SEQ ID NO: 2759745 - DNA, 16 bp, Homo sapiens
tccgtcaaaacagatt

SEQ ID NO: 2759746 - DNA, 20 bp, Homo sapiens
tcctacccctgtcctggggc

SEQ ID NO: 2759747 - DNA, 14 bp, Homo sapiens
tcctcctcctcctg

SEQ ID NO: 2759748 - DNA, 21 bp, Homo sapiens
tcctcctgttcctgccttctc

SEQ ID NO: 2759749 - DNA, 22 bp, Homo sapiens
tcctcctgttcctgccttctct

SEQ ID NO: 2759750 - DNA, 16 bp, Homo sapiens
tcctctagaaggctga

SEQ ID NO: 2759751 - DNA, 13 bp, Homo sapiens
tcctctccagccc

SEQ ID NO: 2759752 - DNA, 14 bp, Homo sapiens
tcctctgaggctga

SEQ ID NO: 2759753 - DNA, 21 bp, Homo sapiens
tcctgaggggatatccctatg

SEQ ID NO: 2759754 - DNA, 16 bp, Homo sapiens
tcctgaggtctggatt

SEQ ID NO: 2759755 - DNA, 15 bp, Homo sapiens
tcctggagtctcact

SEQ ID NO: 2759756 - DNA, 16 bp, Homo sapiens
tcctggagtctcactg

SEQ ID NO: 2759757 - DNA, 17 bp, Homo sapiens
tcctggagtctcactgt

SEQ ID NO: 2759758 - DNA, 23 bp, Homo sapiens
tcctggggctgggtgtgtttcag

SEQ ID NO: 2759759 - DNA, 16 bp, Homo sapiens
tccttcaaagcaaatg

SEQ ID NO: 2759760 - DNA, 13 bp, Homo sapiens
tccttctcagcac

SEQ ID NO: 2759761 - DNA, 15 bp, Homo sapiens
tccttctcagcactt

SEQ ID NO: 2759762 - DNA, 17 bp, Homo sapiens
tccttctcgtcttcctc

SEQ ID NO: 2759763 - DNA, 18 bp, Homo sapiens
tccttctcgtcttcctct

SEQ ID NO: 2759764 - DNA, 19 bp, Homo sapiens
tccttctcgtcttcctctc

SEQ ID NO: 2759765 - DNA, 23 bp, Homo sapiens
tccttctcgtcttcctctctctc

SEQ ID NO: 2759766 - DNA, 22 bp, Homo sapiens
tcctttccttctcgtcttcctc

SEQ ID NO: 2759767 - DNA, 21 bp, Homo sapiens
tcgattagactggacagcttg

SEQ ID NO: 2759768 - DNA, 18 bp, Homo sapiens
tcgcatccgcctctgagc

SEQ ID NO: 2759769 - DNA, 15 bp, Homo sapiens
tcgttcaaagcatga

SEQ ID NO: 2759770 - DNA, 21 bp, Homo sapiens
tctaagttaatttaaagttgt

SEQ ID NO: 2759771 - DNA, 21 bp, Homo sapiens
tctatcaaccccagacactgg

SEQ ID NO: 2759772 - DNA, 22 bp, Homo sapiens
tctatcaaccccagacactggt

SEQ ID NO: 2759773 - DNA, 18 bp, Homo sapiens
tctcacctacttcctcct

SEQ ID NO: 2759774 - DNA, 20 bp, Homo sapiens
tctcatccaggtcctttcct

SEQ ID NO: 2759775 - DNA, 21 bp, Homo sapiens
tctcatttttccgtaaaaatg

SEQ ID NO: 2759776 - DNA, 16 bp, Homo sapiens
tctctcacctacttcc

SEQ ID NO: 2759777 - DNA, 22 bp, Homo sapiens
tctctcacctacttcctcctcc

SEQ ID NO: 2759778 - DNA, 16 bp, Homo sapiens
tctcttcctgcctccc

SEQ ID NO: 2759779 - DNA, 17 bp, Homo sapiens
tctcttctatcctgcaa

SEQ ID NO: 2759780 - DNA, 14 bp, Homo sapiens
tctgagccaggagc

SEQ ID NO: 2759781 - DNA, 15 bp, Homo sapiens
tctgagccaggagcc

SEQ ID NO: 2759782 - DNA, 23 bp, Homo sapiens
tctgaggctgaaattcagaatat

SEQ ID NO: 2759783 - DNA, 15 bp, Homo sapiens
tctgctaaataaaca

SEQ ID NO: 2759784 - DNA, 18 bp, Homo sapiens
tctggaagtgactttggc

SEQ ID NO: 2759785 - DNA, 15 bp, Homo sapiens
tctgggccagaattt

SEQ ID NO: 2759786 - DNA, 14 bp, Homo sapiens
tctgtattctgcaa

SEQ ID NO: 2759787 - DNA, 22 bp, Homo sapiens
tctgtattctgcaacagcctgt

SEQ ID NO: 2759788 - DNA, 18 bp, Homo sapiens
tctgtttttctaactggg

SEQ ID NO: 2759789 - DNA, 22 bp, Homo sapiens
tcttcaggtgaaaaaggcaagc

SEQ ID NO: 2759790 - DNA, 19 bp, Homo sapiens
tcttcagttaagcctttgg

SEQ ID NO: 2759791 - DNA, 22 bp, Homo sapiens
tcttcagttaagcctttggaaa

SEQ ID NO: 2759792 - DNA, 13 bp, Homo sapiens
tcttcctctctct

SEQ ID NO: 2759793 - DNA, 15 bp, Homo sapiens
tcttctatcctgcaa

SEQ ID NO: 2759794 - DNA, 20 bp, Homo sapiens
tctttgccaccctcatgctg

SEQ ID NO: 2759795 - DNA, 21 bp, Homo sapiens
tctttgccaccctcatgctgt

SEQ ID NO: 2759796 - DNA, 17 bp, Homo sapiens
tgaaatattttcttcct

SEQ ID NO: 2759797 - DNA, 16 bp, Homo sapiens
tgaaatcagttactct

SEQ ID NO: 2759798 - DNA, 17 bp, Homo sapiens
tgaaatcagttactctt

SEQ ID NO: 2759799 - DNA, 15 bp, Homo sapiens
tgaacaaatggcctt

SEQ ID NO: 2759800 - DNA, 16 bp, Homo sapiens
tgaactttgctgagcc

SEQ ID NO: 2759801 - DNA, 15 bp, Homo sapiens
tgacaacagacttct

SEQ ID NO: 2759802 - DNA, 18 bp, Homo sapiens
tgacaacagacttctgaa

SEQ ID NO: 2759803 - DNA, 22 bp, Homo sapiens
tgacacaggggacactgaacct

SEQ ID NO: 2759804 - DNA, 13 bp, Homo sapiens
gtcgattagactg

SEQ ID NO: 2759805 - DNA, 23 bp, Homo sapiens
gtctatcaaccccagacactggt

SEQ ID NO: 2759806 - DNA, 16 bp, Homo sapiens
gtctcactgtctgctg

SEQ ID NO: 2759807 - DNA, 15 bp, Homo sapiens
gtctcctctccagcc

SEQ ID NO: 2759808 - DNA, 16 bp, Homo sapiens
gtctcctctccagccc

SEQ ID NO: 2759809 - DNA, 16 bp, Homo sapiens
gtctctggttcctccc

SEQ ID NO: 2759810 - DNA, 11 bp, Homo sapiens
gtctcttcctg

SEQ ID NO: 2759811 - DNA, 16 bp, Homo sapiens
gtctcttcctgcctcc

SEQ ID NO: 2759812 - DNA, 23 bp, Homo sapiens
gtctgcctgcctcatgctctcta

SEQ ID NO: 2759813 - DNA, 19 bp, Homo sapiens
gtcttttgtgtcagtgtct

SEQ ID NO: 2759814 - DNA, 17 bp, Homo sapiens
gtgaccaaaagttacat

SEQ ID NO: 2759815 - DNA, 19 bp, Homo sapiens
gtgcatttgtgtctgcctg

SEQ ID NO: 2759816 - DNA, 21 bp, Homo sapiens
gtgccacccatgcagctgctc

SEQ ID NO: 2759817 - DNA, 23 bp, Homo sapiens
gtgccacccatgcagctgctccc

SEQ ID NO: 2759818 - DNA, 15 bp, Homo sapiens
gtgccgccagctgcc

SEQ ID NO: 2759819 - DNA, 20 bp, Homo sapiens
gtggccaagggctccagggc

SEQ ID NO: 2759820 - DNA, 21 bp, Homo sapiens
gtgggcttgtggtggctgctc

SEQ ID NO: 2759821 - DNA, 12 bp, Homo sapiens
gtggtggctgct

SEQ ID NO: 2759822 - DNA, 23 bp, Homo sapiens
gtgtcttaaaggggcctgcgcag

SEQ ID NO: 2759823 - DNA, 15 bp, Homo sapiens
gtgtgtgtatatata

SEQ ID NO: 2759824 - DNA, 20 bp, Homo sapiens
gtgtgtttcaggacagctgc

SEQ ID NO: 2759825 - DNA, 22 bp, Homo sapiens
gttaatgtcaaggaaaggatgc

SEQ ID NO: 2759826 - DNA, 16 bp, Homo sapiens
gttacatgtttgcacc

SEQ ID NO: 2759827 - DNA, 18 bp, Homo sapiens
gttatctaagttaattta

SEQ ID NO: 2759828 - DNA, 12 bp, Homo sapiens
gttccctctttc

SEQ ID NO: 2759829 - DNA, 13 bp, Homo sapiens
gttccctctttcc

SEQ ID NO: 2759830 - DNA, 20 bp, Homo sapiens
gttcccttgtgtctgttgct

SEQ ID NO: 2759831 - DNA, 23 bp, Homo sapiens
gttcctcccctcctcctggactc

SEQ ID NO: 2759832 - DNA, 16 bp, Homo sapiens
gttcctgccttctctt

SEQ ID NO: 2759833 - DNA, 23 bp, Homo sapiens
gttctcatccacagaggccaggc

SEQ ID NO: 2759834 - DNA, 14 bp, Homo sapiens
gttgaagcctttgt

SEQ ID NO: 2759835 - DNA, 21 bp, Homo sapiens
gttgatgcctgtgaactgaac

SEQ ID NO: 2759836 - DNA, 20 bp, Homo sapiens
gttgctcctacccctgtcct

SEQ ID NO: 2759837 - DNA, 13 bp, Homo sapiens
gttgtttgtgcct

SEQ ID NO: 2759838 - DNA, 22 bp, Homo sapiens
gttttcagtcaagttccgtctc

SEQ ID NO: 2759839 - DNA, 14 bp, Homo sapiens
taaagctgtgagca

SEQ ID NO: 2759840 - DNA, 15 bp, Homo sapiens
taaaggggcctgcgc

SEQ ID NO: 2759841 - DNA, 18 bp, Homo sapiens
taaagttgtttgtgcctt

SEQ ID NO: 2759842 - DNA, 17 bp, Homo sapiens
taaatacactgtgaaga

SEQ ID NO: 2759843 - DNA, 22 bp, Homo sapiens
taaatcaattctgatacagcct

SEQ ID NO: 2759844 - DNA, 16 bp, Homo sapiens
taactcattagactgg

SEQ ID NO: 2759845 - DNA, 14 bp, Homo sapiens
taagacttgacagt

SEQ ID NO: 2759846 - DNA, 18 bp, Homo sapiens
taatctgggccagaattt

SEQ ID NO: 2759847 - DNA, 23 bp, Homo sapiens
taatctgggccagaatttcaaac

SEQ ID NO: 2759848 - DNA, 13 bp, Homo sapiens
taatgaacaaatg

SEQ ID NO: 2759849 - DNA, 14 bp, Homo sapiens
tacaaagtgtacca

SEQ ID NO: 2759850 - DNA, 13 bp, Homo sapiens
tacatgtttgcac

SEQ ID NO: 2759851 - DNA, 12 bp, Homo sapiens
taccctccctcg

SEQ ID NO: 2759852 - DNA, 18 bp, Homo sapiens
tactactagatcacttgt

SEQ ID NO: 2759853 - DNA, 18 bp, Homo sapiens
tactcttatagacaacat

SEQ ID NO: 2759854 - DNA, 17 bp, Homo sapiens
tactgagttctcatcca

SEQ ID NO: 2759855 - DNA, 19 bp, Homo sapiens
tactggtcccacttcacag

SEQ ID NO: 2759856 - DNA, 21 bp, Homo sapiens
tacttcctcctcctcctcctg

SEQ ID NO: 2759857 - DNA, 24 bp, Homo sapiens
tacttcctcctcctcctcctgttc

SEQ ID NO: 2759858 - DNA, 15 bp, Homo sapiens
tagaatataaacaca

SEQ ID NO: 2759859 - DNA, 14 bp, Homo sapiens
tagactggacagct

SEQ ID NO: 2759860 - DNA, 16 bp, Homo sapiens
tagactggacagcttg

SEQ ID NO: 2759861 - DNA, 19 bp, Homo sapiens
tagagaatgccctcagctc

SEQ ID NO: 2759862 - DNA, 19 bp, Homo sapiens
tagaggaataaagctgtga

SEQ ID NO: 2759863 - DNA, 21 bp, Homo sapiens
tagaggaataaagctgtgagc

SEQ ID NO: 2759864 - DNA, 13 bp, Homo sapiens
tagcacaagttat

SEQ ID NO: 2759865 - DNA, 13 bp, Homo sapiens
tagccccagtgac

SEQ ID NO: 2759866 - DNA, 17 bp, Homo sapiens
tagccccagtgacagct

SEQ ID NO: 2759867 - DNA, 19 bp, Homo sapiens
tagcctcaatttctgaaca

SEQ ID NO: 2759868 - DNA, 14 bp, Homo sapiens
tagctgatcagttt

SEQ ID NO: 2759869 - DNA, 17 bp, Homo sapiens
taggccgttccttcaaa

SEQ ID NO: 2759870 - DNA, 16 bp, Homo sapiens
tagggaaaacattcca

SEQ ID NO: 2759871 - DNA, 20 bp, Homo sapiens
tagtggggaggggcctggcc

SEQ ID NO: 2759872 - DNA, 22 bp, Homo sapiens
tagttacagtaaatacactgtg

SEQ ID NO: 2759873 - DNA, 23 bp, Homo sapiens
tataattatttttatctgaagct

SEQ ID NO: 2759874 - DNA, 23 bp, Homo sapiens
tatacctgaaatattttcttcct

SEQ ID NO: 2759875 - DNA, 17 bp, Homo sapiens
tatatatgtacagttat

SEQ ID NO: 2759876 - DNA, 19 bp, Homo sapiens
tatatatgtacagttatct

SEQ ID NO: 2759877 - DNA, 18 bp, Homo sapiens
tatcaaccccagacactg

SEQ ID NO: 2759878 - DNA, 17 bp, Homo sapiens
tatcaggagtccactgc

SEQ ID NO: 2759879 - DNA, 19 bp, Homo sapiens
tatcaggagtccactgcct

SEQ ID NO: 2759880 - DNA, 18 bp, Homo sapiens
tatcatcagatagcatct

SEQ ID NO: 2759881 - DNA, 19 bp, Homo sapiens
tatctaagttaatttaaag

SEQ ID NO: 2759882 - DNA, 16 bp, Homo sapiens
tatctgaagctagagg

SEQ ID NO: 2759883 - DNA, 11 bp, Homo sapiens
tatctttgcca

SEQ ID NO: 2759884 - DNA, 16 bp, Homo sapiens
tatctttgccaccctc

SEQ ID NO: 2759885 - DNA, 22 bp, Homo sapiens
tatctttgccaccctcatgctg

SEQ ID NO: 2759886 - DNA, 15 bp, Homo sapiens
tatttcaatgttagc

SEQ ID NO: 2759887 - DNA, 15 bp, Homo sapiens
tattttcttccttct

SEQ ID NO: 2759888 - DNA, 14 bp, Homo sapiens
tcaaaacagattgt

SEQ ID NO: 2759889 - DNA, 19 bp, Homo sapiens
tcaaaacagattgtttgca

SEQ ID NO: 2759890 - DNA, 23 bp, Homo sapiens
tcaaacggcctcactaggcttct

SEQ ID NO: 2759891 - DNA, 23 bp, Homo sapiens
tcaaagcaaatgtcttcctggat

SEQ ID NO: 2759892 - DNA, 23 bp, Homo sapiens
tcaagttgttccttaagtcagaa

SEQ ID NO: 2759893 - DNA, 17 bp, Homo sapiens
tcaattcttccctatct

SEQ ID NO: 2759894 - DNA, 19 bp, Homo sapiens
tcaattcttccctatcttt

SEQ ID NO: 2759895 - DNA, 15 bp, Homo sapiens
tcaatttctgaacac

SEQ ID NO: 2759896 - DNA, 15 bp, Homo sapiens
tcacagctggagaca

SEQ ID NO: 2759897 - DNA, 15 bp, Homo sapiens
tcacctacttcctcc

SEQ ID NO: 2759898 - DNA, 20 bp, Homo sapiens
tcacctcattccaacacctg

SEQ ID NO: 2759899 - DNA, 19 bp, Homo sapiens
tcacctggaagcatttgtt

SEQ ID NO: 2759900 - DNA, 20 bp, Homo sapiens
tcactgtctgctggcaaaga

SEQ ID NO: 2759901 - DNA, 21 bp, Homo sapiens
tcagaaacaccctcacactgg

SEQ ID NO: 2759902 - DNA, 23 bp, Homo sapiens
tcagaacagcagactcagctctg

SEQ ID NO: 2759903 - DNA, 22 bp, Homo sapiens
tcagagtggccaatccctgtgt

SEQ ID NO: 2759904 - DNA, 14 bp, Homo sapiens
catccttgagtcaa

SEQ ID NO: 2759905 - DNA, 17 bp, Homo sapiens
catctggaaccatcaga

SEQ ID NO: 2759906 - DNA, 18 bp, Homo sapiens
catgatgcaagccagctt

SEQ ID NO: 2759907 - DNA, 17 bp, Homo sapiens
catgcagctgctcccca

SEQ ID NO: 2759908 - DNA, 22 bp, Homo sapiens
catgcagctgctccccaggcca

SEQ ID NO: 2759909 - DNA, 23 bp, Homo sapiens
catgcagctgctccccaggccac

SEQ ID NO: 2759910 - DNA, 17 bp, Homo sapiens
catgcgaatgagctggg

SEQ ID NO: 2759911 - DNA, 18 bp, Homo sapiens
catggcttgcccctgtgg

SEQ ID NO: 2759912 - DNA, 14 bp, Homo sapiens
catgtcaaacaaat

SEQ ID NO: 2759913 - DNA, 15 bp, Homo sapiens
catgtcaaacaaata

SEQ ID NO: 2759914 - DNA, 23 bp, Homo sapiens
catgtgactgtattacctattca

SEQ ID NO: 2759915 - DNA, 13 bp, Homo sapiens
catgtgccctcag

SEQ ID NO: 2759916 - DNA, 12 bp, Homo sapiens
catgtggccaag

SEQ ID NO: 2759917 - DNA, 18 bp, Homo sapiens
catgtgttggcagcctct

SEQ ID NO: 2759918 - DNA, 20 bp, Homo sapiens
catgtttgcacctttctagt

SEQ ID NO: 2759919 - DNA, 22 bp, Homo sapiens
catgtttgcacctttctagttg

SEQ ID NO: 2759920 - DNA, 15 bp, Homo sapiens
cattaactcattaga

SEQ ID NO: 2759921 - DNA, 16 bp, Homo sapiens
cattagactggaactt

SEQ ID NO: 2759922 - DNA, 20 bp, Homo sapiens
cattagactggaacttgaac

SEQ ID NO: 2759923 - DNA, 13 bp, Homo sapiens
cattatgatgtgt

SEQ ID NO: 2759924 - DNA, 16 bp, Homo sapiens
cattcattccattctg

SEQ ID NO: 2759925 - DNA, 12 bp, Homo sapiens
cattccatcctt

SEQ ID NO: 2759926 - DNA, 14 bp, Homo sapiens
cattccatccttga

SEQ ID NO: 2759927 - DNA, 15 bp, Homo sapiens
cattccattctggaa

SEQ ID NO: 2759928 - DNA, 23 bp, Homo sapiens
cattctgattcgaatgacactgt

SEQ ID NO: 2759929 - DNA, 22 bp, Homo sapiens
cattgtgccatgtcaaacaaat

SEQ ID NO: 2759930 - DNA, 20 bp, Homo sapiens
catttgtgtctgcctgcctc

SEQ ID NO: 2759931 - DNA, 22 bp, Homo sapiens
catttgtgtttcagaaaggagt

SEQ ID NO: 2759932 - DNA, 23 bp, Homo sapiens
ccaaatggctgcttttgtctccc

SEQ ID NO: 2759933 - DNA, 21 bp, Homo sapiens
ccaatccctgtgtgtcgttcc

SEQ ID NO: 2759934 - DNA, 14 bp, Homo sapiens
ccacactccagctg

SEQ ID NO: 2759935 - DNA, 17 bp, Homo sapiens
ccacactccagctggga

SEQ ID NO: 2759936 - DNA, 19 bp, Homo sapiens
ccacagaggccaggcatgg

SEQ ID NO: 2759937 - DNA, 16 bp, Homo sapiens
ccaccccgctgatgga

SEQ ID NO: 2759938 - DNA, 15 bp, Homo sapiens
ccactaccctccctc

SEQ ID NO: 2759939 - DNA, 17 bp, Homo sapiens
ccacttcacagctggag

SEQ ID NO: 2759940 - DNA, 11 bp, Homo sapiens
ccagacactgg

SEQ ID NO: 2759941 - DNA, 24 bp, Homo sapiens
ccagagtagggttgccagtcctgc

SEQ ID NO: 2759942 - DNA, 14 bp, Homo sapiens
ccagcagagcatgt

SEQ ID NO: 2759943 - DNA, 16 bp, Homo sapiens
ccagcccgaacaccat

SEQ ID NO: 2759944 - DNA, 16 bp, Homo sapiens
ccagcctggagccgtg

SEQ ID NO: 2759945 - DNA, 15 bp, Homo sapiens
ccagctgccgcacca

SEQ ID NO: 2759946 - DNA, 18 bp, Homo sapiens
ccagctgccgcaccagcc

SEQ ID NO: 2759947 - DNA, 23 bp, Homo sapiens
ccagctgtactgagttctcatcc

SEQ ID NO: 2759948 - DNA, 14 bp, Homo sapiens
ccagcttcctgtgc

SEQ ID NO: 2759949 - DNA, 17 bp, Homo sapiens
ccagcttcctgtgcaga

SEQ ID NO: 2759950 - DNA, 20 bp, Homo sapiens
ccaggactctctttcttcca

SEQ ID NO: 2759951 - DNA, 22 bp, Homo sapiens
ccaggagcctcctgaccctgtg

SEQ ID NO: 2759952 - DNA, 21 bp, Homo sapiens
ccaggcatggcccagcctgga

SEQ ID NO: 2759953 - DNA, 23 bp, Homo sapiens
ccaggtcctttccttctcgtctt

SEQ ID NO: 2759954 - DNA, 15 bp, Homo sapiens
ccataggtagaatgt

SEQ ID NO: 2759955 - DNA, 20 bp, Homo sapiens
ccatcagaaacaccctcaca

SEQ ID NO: 2759956 - DNA, 14 bp, Homo sapiens
ccatgcagctgctc

SEQ ID NO: 2759957 - DNA, 19 bp, Homo sapiens
ccatgggctacagtgtctg

SEQ ID NO: 2759958 - DNA, 19 bp, Homo sapiens
ccattctggaagtgacttt

SEQ ID NO: 2759959 - DNA, 12 bp, Homo sapiens
cccaagcagctg

SEQ ID NO: 2759960 - DNA, 14 bp, Homo sapiens
cccaagcagctgaa

SEQ ID NO: 2759961 - DNA, 10 bp, Homo sapiens
cccagcctgg

SEQ ID NO: 2759962 - DNA, 19 bp, Homo sapiens
cccagggtgggaagggcta

SEQ ID NO: 2759963 - DNA, 18 bp, Homo sapiens
cccattcattccattctg

SEQ ID NO: 2759964 - DNA, 21 bp, Homo sapiens
cccattcattccattctggaa

SEQ ID NO: 2759965 - DNA, 16 bp, Homo sapiens
ccccacagtgccaccc

SEQ ID NO: 2759966 - DNA, 12 bp, Homo sapiens
ccccaccatggt

SEQ ID NO: 2759967 - DNA, 13 bp, Homo sapiens
ccccaccatggtg

SEQ ID NO: 2759968 - DNA, 13 bp, Homo sapiens
ccccagaggctgg

SEQ ID NO: 2759969 - DNA, 15 bp, Homo sapiens
ccccagtgacagcta

SEQ ID NO: 2759970 - DNA, 11 bp, Homo sapiens
cccccagccct

SEQ ID NO: 2759971 - DNA, 20 bp, Homo sapiens
ccccgctgatggagccccac

SEQ ID NO: 2759972 - DNA, 22 bp, Homo sapiens
cccctcctcctggactcctgca

SEQ ID NO: 2759973 - DNA, 23 bp, Homo sapiens
cccgctgatggagccccaccttg

SEQ ID NO: 2759974 - DNA, 19 bp, Homo sapiens
ccctatctttgccaccctc

SEQ ID NO: 2759975 - DNA, 15 bp, Homo sapiens
ccctatgtcccagcc

SEQ ID NO: 2759976 - DNA, 17 bp, Homo sapiens
ccctatgtcccagcccc

SEQ ID NO: 2759977 - DNA, 14 bp, Homo sapiens
ccctccccacagtg

SEQ ID NO: 2759978 - DNA, 15 bp, Homo sapiens
ccctccctcgcatcc

SEQ ID NO: 2759979 - DNA, 11 bp, Homo sapiens
ccctcctcctg

SEQ ID NO: 2759980 - DNA, 18 bp, Homo sapiens
ccctcctcctggactcct

SEQ ID NO: 2759981 - DNA, 18 bp, Homo sapiens
ccctggagcctcagcagc

SEQ ID NO: 2759982 - DNA, 22 bp, Homo sapiens
ccctggcatccaaatggctgct

SEQ ID NO: 2759983 - DNA, 12 bp, Homo sapiens
ccctgtcctggg

SEQ ID NO: 2759984 - DNA, 21 bp, Homo sapiens
cccttaccactgctctgatga

SEQ ID NO: 2759985 - DNA, 21 bp, Homo sapiens
ccctttgttgctgtctggctt

SEQ ID NO: 2759986 - DNA, 22 bp, Homo sapiens
ccgccagctgccgcaccagccc

SEQ ID NO: 2759987 - DNA, 16 bp, Homo sapiens
ccgcctctgagccagg

SEQ ID NO: 2759988 - DNA, 18 bp, Homo sapiens
ccgctacaattctgcaga

SEQ ID NO: 2759989 - DNA, 23 bp, Homo sapiens
ccggcagcctggttccctctttc

SEQ ID NO: 2759990 - DNA, 14 bp, Homo sapiens
cctacttcctcctc

SEQ ID NO: 2759991 - DNA, 16 bp, Homo sapiens
cctacttcctcctcct

SEQ ID NO: 2759992 - DNA, 17 bp, Homo sapiens
cctacttcctcctcctc

SEQ ID NO: 2759993 - DNA, 18 bp, Homo sapiens
cctagatggttccctttg

SEQ ID NO: 2759994 - DNA, 23 bp, Homo sapiens
cctagtggggaggggcctggcct

SEQ ID NO: 2759995 - DNA, 16 bp, Homo sapiens
cctcaatttctgaaca

SEQ ID NO: 2759996 - DNA, 21 bp, Homo sapiens
cctcactaggcttctggttga

SEQ ID NO: 2759997 - DNA, 18 bp, Homo sapiens
cctcacttttaatgaaca

SEQ ID NO: 2759998 - DNA, 21 bp, Homo sapiens
cctcagcagcaaatgccactc

SEQ ID NO: 2759999 - DNA, 16 bp, Homo sapiens
cctcccaagcagctga

SEQ ID NO: 2760000 - DNA, 18 bp, Homo sapiens
cctccccacagtgccacc

SEQ ID NO: 2760001 - DNA, 16 bp, Homo sapiens
cctcctcctcctcctg

SEQ ID NO: 2760002 - DNA, 15 bp, Homo sapiens
cctcctgttcctgcc

SEQ ID NO: 2760003 - DNA, 19 bp, Homo sapiens
cctcctgttcctgccttct

SEQ ID NO: 2760004 - DNA, 12 bp, Homo sapiens
gcctggcctggt

SEQ ID NO: 2760005 - DNA, 13 bp, Homo sapiens
gcctggcctggtc

SEQ ID NO: 2760006 - DNA, 21 bp, Homo sapiens
gcctgggtggggcagggcctg

SEQ ID NO: 2760007 - DNA, 17 bp, Homo sapiens
gcctggttccctctttc

SEQ ID NO: 2760008 - DNA, 19 bp, Homo sapiens
gcctgtaacaagccagatt

SEQ ID NO: 2760009 - DNA, 21 bp, Homo sapiens
gcctgtagccccagtgacagc

SEQ ID NO: 2760010 - DNA, 21 bp, Homo sapiens
gcctgtttgggaggctggagt

SEQ ID NO: 2760011 - DNA, 13 bp, Homo sapiens
gcctttggcaggt

SEQ ID NO: 2760012 - DNA, 24 bp, Homo sapiens
gctagaggaataaagctgtgagca

SEQ ID NO: 2760013 - DNA, 14 bp, Homo sapiens
gctattccctggag

SEQ ID NO: 2760014 - DNA, 14 bp, Homo sapiens
gctatttgaagtgt

SEQ ID NO: 2760015 - DNA, 14 bp, Homo sapiens
gctctgtattctgc

SEQ ID NO: 2760016 - DNA, 20 bp, Homo sapiens
gctgaacttgttttctggga

SEQ ID NO: 2760017 - DNA, 11 bp, Homo sapiens
gctgagctgga

SEQ ID NO: 2760018 - DNA, 13 bp, Homo sapiens
gctgatggagccc

SEQ ID NO: 2760019 - DNA, 15 bp, Homo sapiens
gctgatggagcccca

SEQ ID NO: 2760020 - DNA, 17 bp, Homo sapiens
gctgatggagccccacc

SEQ ID NO: 2760021 - DNA, 13 bp, Homo sapiens
gctgctccccagg

SEQ ID NO: 2760022 - DNA, 17 bp, Homo sapiens
gctgggaactgggccag

SEQ ID NO: 2760023 - DNA, 16 bp, Homo sapiens
gctgtccctcctgagg

SEQ ID NO: 2760024 - DNA, 20 bp, Homo sapiens
gctgtccctcctgaggtctg

SEQ ID NO: 2760025 - DNA, 15 bp, Homo sapiens
gcttccctagatggt

SEQ ID NO: 2760026 - DNA, 13 bp, Homo sapiens
gcttcctgtgcag

SEQ ID NO: 2760027 - DNA, 14 bp, Homo sapiens
gcttctcctctgct

SEQ ID NO: 2760028 - DNA, 15 bp, Homo sapiens
gcttctcctctgcta

SEQ ID NO: 2760029 - DNA, 22 bp, Homo sapiens
gcttctgtgcatttgtgtctgc

SEQ ID NO: 2760030 - DNA, 16 bp, Homo sapiens
gcttgtggtggctgct

SEQ ID NO: 2760031 - DNA, 20 bp, Homo sapiens
ggaaagttaatgtcaaggaa

SEQ ID NO: 2760032 - DNA, 19 bp, Homo sapiens
ggaaattcccttcatctgg

SEQ ID NO: 2760033 - DNA, 16 bp, Homo sapiens
ggaaattctgctcaga

SEQ ID NO: 2760034 - DNA, 13 bp, Homo sapiens
ggaactgggccag

SEQ ID NO: 2760035 - DNA, 17 bp, Homo sapiens
ggaactgggccagcaga

SEQ ID NO: 2760036 - DNA, 16 bp, Homo sapiens
ggaacttgaactgatt

SEQ ID NO: 2760037 - DNA, 18 bp, Homo sapiens
ggaacttgaactgattca

SEQ ID NO: 2760038 - DNA, 19 bp, Homo sapiens
ggaagcatttgtttctact

SEQ ID NO: 2760039 - DNA, 23 bp, Homo sapiens
ggaagtctcttcctgcctcccaa

SEQ ID NO: 2760040 - DNA, 23 bp, Homo sapiens
ggacaaagaaatagcaagagatg

SEQ ID NO: 2760041 - DNA, 19 bp, Homo sapiens
ggacactgaaccttgttga

SEQ ID NO: 2760042 - DNA, 15 bp, Homo sapiens
ggacagcccctcctc

SEQ ID NO: 2760043 - DNA, 19 bp, Homo sapiens
ggacttgcaaaaagggtca

SEQ ID NO: 2760044 - DNA, 20 bp, Homo sapiens
ggagccccaccttgtctgct

SEQ ID NO: 2760045 - DNA, 14 bp, Homo sapiens
ggagcctcagcagc

SEQ ID NO: 2760046 - DNA, 20 bp, Homo sapiens
ggagcctcctgaccctgtga

SEQ ID NO: 2760047 - DNA, 21 bp, Homo sapiens
ggagctgggagaccctcccca

SEQ ID NO: 2760048 - DNA, 14 bp, Homo sapiens
ggagtatgtgcagt

SEQ ID NO: 2760049 - DNA, 13 bp, Homo sapiens
ggagtccactgcc

SEQ ID NO: 2760050 - DNA, 14 bp, Homo sapiens
ggagtccactgcct

SEQ ID NO: 2760051 - DNA, 22 bp, Homo sapiens
ggatggtcatcgtgacagcagc

SEQ ID NO: 2760052 - DNA, 21 bp, Homo sapiens
ggatgtacaaggacagcccct

SEQ ID NO: 2760053 - DNA, 17 bp, Homo sapiens
ggcacaaagttggtgcc

SEQ ID NO: 2760054 - DNA, 11 bp, Homo sapiens
ggcagcctggt

SEQ ID NO: 2760055 - DNA, 14 bp, Homo sapiens
ggcagggcctggcc

SEQ ID NO: 2760056 - DNA, 20 bp, Homo sapiens
ggcatcagtgtccttggcag

SEQ ID NO: 2760057 - DNA, 17 bp, Homo sapiens
ggcatggcccagcctgg

SEQ ID NO: 2760058 - DNA, 19 bp, Homo sapiens
ggcatggcccagcctggag

SEQ ID NO: 2760059 - DNA, 20 bp, Homo sapiens
ggcatggcccagcctggagc

SEQ ID NO: 2760060 - DNA, 21 bp, Homo sapiens
ggcatggcccagcctggagcc

SEQ ID NO: 2760061 - DNA, 16 bp, Homo sapiens
ggccaggcatggccca

SEQ ID NO: 2760062 - DNA, 13 bp, Homo sapiens
ggcccagcctgga

SEQ ID NO: 2760063 - DNA, 15 bp, Homo sapiens
ggcccagcctggagc

SEQ ID NO: 2760064 - DNA, 14 bp, Homo sapiens
ggccggcagcctgg

SEQ ID NO: 2760065 - DNA, 15 bp, Homo sapiens
ggccggcagcctggt

SEQ ID NO: 2760066 - DNA, 21 bp, Homo sapiens
ggcctagtggggaggggcctg

SEQ ID NO: 2760067 - DNA, 13 bp, Homo sapiens
ggcctgcgcaggc

SEQ ID NO: 2760068 - DNA, 22 bp, Homo sapiens
ggctacaccttagcctgccctc

SEQ ID NO: 2760069 - DNA, 23 bp, Homo sapiens
ggctacaccttagcctgccctcc

SEQ ID NO: 2760070 - DNA, 16 bp, Homo sapiens
ggctattccctggaga

SEQ ID NO: 2760071 - DNA, 13 bp, Homo sapiens
ggctccattccca

SEQ ID NO: 2760072 - DNA, 20 bp, Homo sapiens
ggctctgtattctgcaacag

SEQ ID NO: 2760073 - DNA, 19 bp, Homo sapiens
ggctgcttttgtctccctt

SEQ ID NO: 2760074 - DNA, 19 bp, Homo sapiens
ggctgtccaatcacattca

SEQ ID NO: 2760075 - DNA, 14 bp, Homo sapiens
ggcttctcctctgc

SEQ ID NO: 2760076 - DNA, 17 bp, Homo sapiens
ggcttgtggtggctgct

SEQ ID NO: 2760077 - DNA, 11 bp, Homo sapiens
gggacactgaa

SEQ ID NO: 2760078 - DNA, 19 bp, Homo sapiens
gggaccaacgggagcgagt

SEQ ID NO: 2760079 - DNA, 23 bp, Homo sapiens
gggagctgggagaccctccccac

SEQ ID NO: 2760080 - DNA, 13 bp, Homo sapiens
gggaggggcctgg

SEQ ID NO: 2760081 - DNA, 22 bp, Homo sapiens
gggcactgggccggcagcctgg

SEQ ID NO: 2760082 - DNA, 16 bp, Homo sapiens
gggccggcagcctggt

SEQ ID NO: 2760083 - DNA, 14 bp, Homo sapiens
gggcctggcctggg

SEQ ID NO: 2760084 - DNA, 12 bp, Homo sapiens
gggcttccctag

SEQ ID NO: 2760085 - DNA, 18 bp, Homo sapiens
gggtttttgccctggagc

SEQ ID NO: 2760086 - DNA, 21 bp, Homo sapiens
ggtaccagcagaaaggttagt

SEQ ID NO: 2760087 - DNA, 19 bp, Homo sapiens
ggtagaatgtaaagcttgt

SEQ ID NO: 2760088 - DNA, 12 bp, Homo sapiens
ggtcctttcctt

SEQ ID NO: 2760089 - DNA, 18 bp, Homo sapiens
ggtgtgtttcaggacagc

SEQ ID NO: 2760090 - DNA, 16 bp, Homo sapiens
ggttccctctttcctg

SEQ ID NO: 2760091 - DNA, 16 bp, Homo sapiens
ggttcctcccctcctc

SEQ ID NO: 2760092 - DNA, 15 bp, Homo sapiens
gtaaaaatgatttca

SEQ ID NO: 2760093 - DNA, 16 bp, Homo sapiens
gtaaagcttgtctgat

SEQ ID NO: 2760094 - DNA, 13 bp, Homo sapiens
gtaacaagccaga

SEQ ID NO: 2760095 - DNA, 14 bp, Homo sapiens
gtaacaagccagat

SEQ ID NO: 2760096 - DNA, 22 bp, Homo sapiens
gtacccgctacaattctgcaga

SEQ ID NO: 2760097 - DNA, 15 bp, Homo sapiens
gtactcccccagccc

SEQ ID NO: 2760098 - DNA, 17 bp, Homo sapiens
gtactgagttctcatcc

SEQ ID NO: 2760099 - DNA, 23 bp, Homo sapiens
gtagcacaagttatttaaatctg

SEQ ID NO: 2760100 - DNA, 13 bp, Homo sapiens
gtaggaaatgtgg

SEQ ID NO: 2760101 - DNA, 16 bp, Homo sapiens
gtaggttgaggacagg

SEQ ID NO: 2760102 - DNA, 17 bp, Homo sapiens
gtatgttgaagcctttg

SEQ ID NO: 2760103 - DNA, 13 bp, Homo sapiens
gtcaaaacagatt

SEQ ID NO: 2760104 - DNA, 17 bp, Homo sapiens
gtcactttgttttactg

SEQ ID NO: 2760105 - DNA, 12 bp, Homo sapiens
tggttccctctt

SEQ ID NO: 2760106 - DNA, 17 bp, Homo sapiens
tggttccctctttcctg

SEQ ID NO: 2760107 - DNA, 23 bp, Homo sapiens
tgtacaaggacagcccctcctcc

SEQ ID NO: 2760108 - DNA, 21 bp, Homo sapiens
tgtacagttatctaagttaat

SEQ ID NO: 2760109 - DNA, 17 bp, Homo sapiens
tgtaccagggctctgta

SEQ ID NO: 2760110 - DNA, 21 bp, Homo sapiens
tgtagccccagtgacagctag

SEQ ID NO: 2760111 - DNA, 23 bp, Homo sapiens
tgtagttacagtaaatacactgt

SEQ ID NO: 2760112 - DNA, 16 bp, Homo sapiens
tgtatattaaggtgtg

SEQ ID NO: 2760113 - DNA, 20 bp, Homo sapiens
tgtattctgcaacagcctgt

SEQ ID NO: 2760114 - DNA, 13 bp, Homo sapiens
tgtcaaacaaata

SEQ ID NO: 2760115 - DNA, 18 bp, Homo sapiens
tgtcaaggaaaggatgca

SEQ ID NO: 2760116 - DNA, 16 bp, Homo sapiens
tgtccaatcacattca

SEQ ID NO: 2760117 - DNA, 13 bp, Homo sapiens
tgtcccagcccct

SEQ ID NO: 2760118 - DNA, 16 bp, Homo sapiens
tgtcccagcccctggt

SEQ ID NO: 2760119 - DNA, 13 bp, Homo sapiens
tgtcctcttgcca

SEQ ID NO: 2760120 - DNA, 22 bp, Homo sapiens
tgtcctgcctaaggctgaactt

SEQ ID NO: 2760121 - DNA, 16 bp, Homo sapiens
tgtctcccttacctcg

SEQ ID NO: 2760122 - DNA, 12 bp, Homo sapiens
tgtctgctggca

SEQ ID NO: 2760123 - DNA, 22 bp, Homo sapiens
tgtcttaaaggggcctgcgcag

SEQ ID NO: 2760124 - DNA, 23 bp, Homo sapiens
tgtgaactgaactctgacaacag

SEQ ID NO: 2760125 - DNA, 18 bp, Homo sapiens
tgtgagcaaacagaggag

SEQ ID NO: 2760126 - DNA, 16 bp, Homo sapiens
tgttaactgagtgcct

SEQ ID NO: 2760127 - DNA, 15 bp, Homo sapiens
tgttaagacttgaca

SEQ ID NO: 2760128 - DNA, 17 bp, Homo sapiens
tgttcctgccttctctt

SEQ ID NO: 2760129 - DNA, 19 bp, Homo sapiens
tgttccttaagtcagaaca

SEQ ID NO: 2760130 - DNA, 15 bp, Homo sapiens
tgttgaagcctttgt

SEQ ID NO: 2760131 - DNA, 15 bp, Homo sapiens
tgttgagagtgtgac

SEQ ID NO: 2760132 - DNA, 13 bp, Homo sapiens
tgttgctgtctgg

SEQ ID NO: 2760133 - DNA, 17 bp, Homo sapiens
tgttgctgtctggcttt

SEQ ID NO: 2760134 - DNA, 19 bp, Homo sapiens
tgtttcaggacagctgctt

SEQ ID NO: 2760135 - DNA, 20 bp, Homo sapiens
tgtttgcacctttctagttg

SEQ ID NO: 2760136 - DNA, 14 bp, Homo sapiens
ttaaaaactgagtg

SEQ ID NO: 2760137 - DNA, 15 bp, Homo sapiens
ttaaagttgtttgtg

SEQ ID NO: 2760138 - DNA, 16 bp, Homo sapiens
ttaactcattagactg

SEQ ID NO: 2760139 - DNA, 13 bp, Homo sapiens
ttaagacttgaca

SEQ ID NO: 2760140 - DNA, 15 bp, Homo sapiens
ttaagcctttggaaa

SEQ ID NO: 2760141 - DNA, 23 bp, Homo sapiens
ttactcttcagttaagcctttgg

SEQ ID NO: 2760142 - DNA, 16 bp, Homo sapiens
ttagactggaacttga

SEQ ID NO: 2760143 - DNA, 17 bp, Homo sapiens
ttagactggaacttgaa

SEQ ID NO: 2760144 - DNA, 16 bp, Homo sapiens
ttagactggacagctt

SEQ ID NO: 2760145 - DNA, 15 bp, Homo sapiens
ttagggaaaacattc

SEQ ID NO: 2760146 - DNA, 19 bp, Homo sapiens
ttagtgacctcagctttga

SEQ ID NO: 2760147 - DNA, 13 bp, Homo sapiens
ttatatggaaatt

SEQ ID NO: 2760148 - DNA, 22 bp, Homo sapiens
ttcaaaatgctgcttccactca

SEQ ID NO: 2760149 - DNA, 16 bp, Homo sapiens
ttcaatcccaggatgt

SEQ ID NO: 2760150 - DNA, 13 bp, Homo sapiens
ttcacagctggag

SEQ ID NO: 2760151 - DNA, 21 bp, Homo sapiens
ttcacctggaagcatttgttt

SEQ ID NO: 2760152 - DNA, 23 bp, Homo sapiens
ttcatctggaaccatcagaaaca

SEQ ID NO: 2760153 - DNA, 13 bp, Homo sapiens
ttcatgcatggaa

SEQ ID NO: 2760154 - DNA, 21 bp, Homo sapiens
ttcccacccaattcaaaacat

SEQ ID NO: 2760155 - DNA, 14 bp, Homo sapiens
ttccctctcatcca

SEQ ID NO: 2760156 - DNA, 15 bp, Homo sapiens
ttcccttgtgtctgt

SEQ ID NO: 2760157 - DNA, 14 bp, Homo sapiens
ttccctttgttgct

SEQ ID NO: 2760158 - DNA, 14 bp, Homo sapiens
ttccgtctcctctc

SEQ ID NO: 2760159 - DNA, 23 bp, Homo sapiens
ttcctcctcctcctcctgttcct

SEQ ID NO: 2760160 - DNA, 24 bp, Homo sapiens
ttcctcctcctcctcctgttcctg

SEQ ID NO: 2760161 - DNA, 14 bp, Homo sapiens
ttcctctctctcac

SEQ ID NO: 2760162 - DNA, 20 bp, Homo sapiens
ttcctgcctcccaagcagct

SEQ ID NO: 2760163 - DNA, 16 bp, Homo sapiens
ttcctgccttctcttc

SEQ ID NO: 2760164 - DNA, 18 bp, Homo sapiens
ttcctgccttctcttcta

SEQ ID NO: 2760165 - DNA, 12 bp, Homo sapiens
ttccttctcgtc

SEQ ID NO: 2760166 - DNA, 14 bp, Homo sapiens
ttctaggtaggaaa

SEQ ID NO: 2760167 - DNA, 18 bp, Homo sapiens
ttctaggtaggaaatgtg

SEQ ID NO: 2760168 - DNA, 15 bp, Homo sapiens
ttctcttctatcctg

SEQ ID NO: 2760169 - DNA, 18 bp, Homo sapiens
ttctgctcacattccctc

SEQ ID NO: 2760170 - DNA, 13 bp, Homo sapiens
ttgaactgattca

SEQ ID NO: 2760171 - DNA, 21 bp, Homo sapiens
ttgaagaatgttaagacttga

SEQ ID NO: 2760172 - DNA, 13 bp, Homo sapiens
ttgaagcctttgt

SEQ ID NO: 2760173 - DNA, 13 bp, Homo sapiens
ttgccctggagcc

SEQ ID NO: 2760174 - DNA, 19 bp, Homo sapiens
ttgcctgtaacaagccaga

SEQ ID NO: 2760175 - DNA, 11 bp, Homo sapiens
ttgctcctacc

SEQ ID NO: 2760176 - DNA, 12 bp, Homo sapiens
ttgctcctaccc

SEQ ID NO: 2760177 - DNA, 19 bp, Homo sapiens
ttgctcctacccctgtcct

SEQ ID NO: 2760178 - DNA, 15 bp, Homo sapiens
ttgctgtctggcttt

SEQ ID NO: 2760179 - DNA, 19 bp, Homo sapiens
ttgctgtctggctttcccg

SEQ ID NO: 2760180 - DNA, 15 bp, Homo sapiens
ttgggaggctggagt

SEQ ID NO: 2760181 - DNA, 18 bp, Homo sapiens
ttgggccccagaggctgg

SEQ ID NO: 2760182 - DNA, 16 bp, Homo sapiens
ttgtgccagaatgctt

SEQ ID NO: 2760183 - DNA, 21 bp, Homo sapiens
ttgtgccatgtcaaacaaata

SEQ ID NO: 2760184 - DNA, 16 bp, Homo sapiens
ttgtggcaagtgaatt

SEQ ID NO: 2760185 - DNA, 22 bp, Homo sapiens
ttgtggcaagtgaatttgcctg

SEQ ID NO: 2760186 - DNA, 18 bp, Homo sapiens
ttgtgtctgcctgcctca

SEQ ID NO: 2760187 - DNA, 12 bp, Homo sapiens
ttgtgtctgttg

SEQ ID NO: 2760188 - DNA, 17 bp, Homo sapiens
tttaaaaaattaatctg

SEQ ID NO: 2760189 - DNA, 21 bp, Homo sapiens
tttaaaaaattaatctgggcc

SEQ ID NO: 2760190 - DNA, 12 bp, Homo sapiens
tttaaatctgtt

SEQ ID NO: 2760191 - DNA, 19 bp, Homo sapiens
tttaagacatttttggaag

SEQ ID NO: 2760192 - DNA, 18 bp, Homo sapiens
tttattaaaaactgagtg

SEQ ID NO: 2760193 - DNA, 12 bp, Homo sapiens
tttatttgttga

SEQ ID NO: 2760194 - DNA, 18 bp, Homo sapiens
tttatttgttgagagtgt

SEQ ID NO: 2760195 - DNA, 22 bp, Homo sapiens
tttcacctggaagcatttgttt

SEQ ID NO: 2760196 - DNA, 23 bp, Homo sapiens
tttcagtcaagttccgtctcctc

SEQ ID NO: 2760197 - DNA, 20 bp, Homo sapiens
tttccttctcgtcttcctct

SEQ ID NO: 2760198 - DNA, 13 bp, Homo sapiens
tttctagttgaaa

SEQ ID NO: 2760199 - DNA, 19 bp, Homo sapiens
tttctcccgaatcctgagg

SEQ ID NO: 2760200 - DNA, 15 bp, Homo sapiens
tttgtgtctgcctgc

SEQ ID NO: 2760201 - DNA, 23 bp, Homo sapiens
atgcttctgctcacattccctct

SEQ ID NO: 2760202 - DNA, 18 bp, Homo sapiens
atggaaattctgctcaga

SEQ ID NO: 2760203 - DNA, 15 bp, Homo sapiens
atggagccccacctt

SEQ ID NO: 2760204 - DNA, 15 bp, Homo sapiens
atggcccagcctgga

SEQ ID NO: 2760205 - DNA, 21 bp, Homo sapiens
atggctgcttttgtctccctt

SEQ ID NO: 2760206 - DNA, 15 bp, Homo sapiens
atgggactggcctct

SEQ ID NO: 2760207 - DNA, 19 bp, Homo sapiens
atggtgggcttgtggtggc

SEQ ID NO: 2760208 - DNA, 14 bp, Homo sapiens
atgtaaagcttgtc

SEQ ID NO: 2760209 - DNA, 13 bp, Homo sapiens
atgtcttcctgga

SEQ ID NO: 2760210 - DNA, 13 bp, Homo sapiens
atgtgcagtgtgg

SEQ ID NO: 2760211 - DNA, 15 bp, Homo sapiens
atgtgcagtgtggga

SEQ ID NO: 2760212 - DNA, 17 bp, Homo sapiens
atgtgcattctccagcc

SEQ ID NO: 2760213 - DNA, 22 bp, Homo sapiens
atgtggccaagggctccagggc

SEQ ID NO: 2760214 - DNA, 16 bp, Homo sapiens
atgttaagacttgaca

SEQ ID NO: 2760215 - DNA, 20 bp, Homo sapiens
atgttaagacttgacagtgg

SEQ ID NO: 2760216 - DNA, 13 bp, Homo sapiens
attaaaaactgag

SEQ ID NO: 2760217 - DNA, 20 bp, Homo sapiens
attaaaaactgagtgactct

SEQ ID NO: 2760218 - DNA, 14 bp, Homo sapiens
attagactggacag

SEQ ID NO: 2760219 - DNA, 15 bp, Homo sapiens
attagactggacagc

SEQ ID NO: 2760220 - DNA, 16 bp, Homo sapiens
attagactggacagct

SEQ ID NO: 2760221 - DNA, 16 bp, Homo sapiens
attcacatctcatttt

SEQ ID NO: 2760222 - DNA, 12 bp, Homo sapiens
attcattccatt

SEQ ID NO: 2760223 - DNA, 21 bp, Homo sapiens
attccattctggaagtgactt

SEQ ID NO: 2760224 - DNA, 22 bp, Homo sapiens
attcccacccaattcaaaacat

SEQ ID NO: 2760225 - DNA, 20 bp, Homo sapiens
attcccatcactgctgtccc

SEQ ID NO: 2760226 - DNA, 23 bp, Homo sapiens
attccccgtctctggttcctccc

SEQ ID NO: 2760227 - DNA, 16 bp, Homo sapiens
attctgatacagcctt

SEQ ID NO: 2760228 - DNA, 11 bp, Homo sapiens
attgacttctt

SEQ ID NO: 2760229 - DNA, 13 bp, Homo sapiens
attgggagtagga

SEQ ID NO: 2760230 - DNA, 14 bp, Homo sapiens
attgtaaatattgt

SEQ ID NO: 2760231 - DNA, 14 bp, Homo sapiens
atttatgcactgtg

SEQ ID NO: 2760232 - DNA, 22 bp, Homo sapiens
atttcatttgtgccagaatgct

SEQ ID NO: 2760233 - DNA, 13 bp, Homo sapiens
atttgaagtgtaa

SEQ ID NO: 2760234 - DNA, 11 bp, Homo sapiens
atttgcctgta

SEQ ID NO: 2760235 - DNA, 13 bp, Homo sapiens
atttgcctgtaac

SEQ ID NO: 2760236 - DNA, 16 bp, Homo sapiens
atttgcctgtaacaag

SEQ ID NO: 2760237 - DNA, 22 bp, Homo sapiens
atttgcctgtaacaagccagat

SEQ ID NO: 2760238 - DNA, 14 bp, Homo sapiens
atttgtgccagaat

SEQ ID NO: 2760239 - DNA, 18 bp, Homo sapiens
attttcttccttctcagc

SEQ ID NO: 2760240 - DNA, 22 bp, Homo sapiens
caaaagcccattcattccattc

SEQ ID NO: 2760241 - DNA, 18 bp, Homo sapiens
caaaagttacatgtttgc

SEQ ID NO: 2760242 - DNA, 14 bp, Homo sapiens
caaagaaatagcaa

SEQ ID NO: 2760243 - DNA, 22 bp, Homo sapiens
caaaggggaggcatcagtgtcc

SEQ ID NO: 2760244 - DNA, 13 bp, Homo sapiens
caaatgcagcttt

SEQ ID NO: 2760245 - DNA, 19 bp, Homo sapiens
caaatgccactctgggcag

SEQ ID NO: 2760246 - DNA, 20 bp, Homo sapiens
caaatgccactctgggcagt

SEQ ID NO: 2760247 - DNA, 11 bp, Homo sapiens
caacacctgcc

SEQ ID NO: 2760248 - DNA, 10 bp, Homo sapiens
caacagaaac

SEQ ID NO: 2760249 - DNA, 20 bp, Homo sapiens
caagccagcttcctgtgcag

SEQ ID NO: 2760250 - DNA, 18 bp, Homo sapiens
caagggctccagggccag

SEQ ID NO: 2760251 - DNA, 17 bp, Homo sapiens
caagtccatagctgagc

SEQ ID NO: 2760252 - DNA, 20 bp, Homo sapiens
caagtccatagctgagctgg

SEQ ID NO: 2760253 - DNA, 21 bp, Homo sapiens
caagtccatagctgagctgga

SEQ ID NO: 2760254 - DNA, 22 bp, Homo sapiens
caatgttagcctcaatttctga

SEQ ID NO: 2760255 - DNA, 20 bp, Homo sapiens
caattcttccctatctttgc

SEQ ID NO: 2760256 - DNA, 22 bp, Homo sapiens
caatttctcccgaatcctgagg

SEQ ID NO: 2760257 - DNA, 16 bp, Homo sapiens
cacaagttatttaaat

SEQ ID NO: 2760258 - DNA, 9 bp, Homo sapiens
cacagaaat

SEQ ID NO: 2760259 - DNA, 17 bp, Homo sapiens
cacagaggccaggcatg

SEQ ID NO: 2760260 - DNA, 16 bp, Homo sapiens
cacaggggacactgaa

SEQ ID NO: 2760261 - DNA, 23 bp, Homo sapiens
cacaggtgccgccagctgccgca

SEQ ID NO: 2760262 - DNA, 17 bp, Homo sapiens
caccataggtagaatgt

SEQ ID NO: 2760263 - DNA, 16 bp, Homo sapiens
cacccagccaggaggg

SEQ ID NO: 2760264 - DNA, 14 bp, Homo sapiens
cacccatgcagctg

SEQ ID NO: 2760265 - DNA, 17 bp, Homo sapiens
cacccatgcagctgctc

SEQ ID NO: 2760266 - DNA, 19 bp, Homo sapiens
cacccatgcagctgctccc

SEQ ID NO: 2760267 - DNA, 13 bp, Homo sapiens
cacctacttcctc

SEQ ID NO: 2760268 - DNA, 22 bp, Homo sapiens
cacctggaagcatttgtttcta

SEQ ID NO: 2760269 - DNA, 22 bp, Homo sapiens
caccttagcctgccctcctttc

SEQ ID NO: 2760270 - DNA, 22 bp, Homo sapiens
caccttgtctgctaaataaaca

SEQ ID NO: 2760271 - DNA, 23 bp, Homo sapiens
cacctttattctggcagaggagg

SEQ ID NO: 2760272 - DNA, 12 bp, Homo sapiens
cacctttctagt

SEQ ID NO: 2760273 - DNA, 13 bp, Homo sapiens
cacctttctagtt

SEQ ID NO: 2760274 - DNA, 14 bp, Homo sapiens
cacgctccttcctc

SEQ ID NO: 2760275 - DNA, 14 bp, Homo sapiens
cactaggcttctgg

SEQ ID NO: 2760276 - DNA, 21 bp, Homo sapiens
cactgattacttttgggaggg

SEQ ID NO: 2760277 - DNA, 20 bp, Homo sapiens
cactgctctgatgaagagga

SEQ ID NO: 2760278 - DNA, 18 bp, Homo sapiens
cactgctgtccctcctga

SEQ ID NO: 2760279 - DNA, 14 bp, Homo sapiens
cacttcacagctgg

SEQ ID NO: 2760280 - DNA, 17 bp, Homo sapiens
cacttttaatgaacaaa

SEQ ID NO: 2760281 - DNA, 19 bp, Homo sapiens
cagaaaaagaatgtgtctt

SEQ ID NO: 2760282 - DNA, 18 bp, Homo sapiens
cagaaacaccctcacact

SEQ ID NO: 2760283 - DNA, 14 bp, Homo sapiens
cagaatgtatatta

SEQ ID NO: 2760284 - DNA, 23 bp, Homo sapiens
cagagagtgagagacattaactc

SEQ ID NO: 2760285 - DNA, 21 bp, Homo sapiens
cagccatcaagagactgagtc

SEQ ID NO: 2760286 - DNA, 21 bp, Homo sapiens
cagcccccactgcctttgacc

SEQ ID NO: 2760287 - DNA, 14 bp, Homo sapiens
cagcctggagccgt

SEQ ID NO: 2760288 - DNA, 18 bp, Homo sapiens
cagcctggttccctcttt

SEQ ID NO: 2760289 - DNA, 19 bp, Homo sapiens
cagcctggttccctctttc

SEQ ID NO: 2760290 - DNA, 20 bp, Homo sapiens
cagcctggttccctctttcc

SEQ ID NO: 2760291 - DNA, 20 bp, Homo sapiens
cagctctgacattctgattc

SEQ ID NO: 2760292 - DNA, 16 bp, Homo sapiens
cagctgccgcaccagc

SEQ ID NO: 2760293 - DNA, 13 bp, Homo sapiens
cagctgctcccca

SEQ ID NO: 2760294 - DNA, 18 bp, Homo sapiens
cagctgctccccaggcca

SEQ ID NO: 2760295 - DNA, 15 bp, Homo sapiens
cagctgcttctgtgc

SEQ ID NO: 2760296 - DNA, 23 bp, Homo sapiens
cagctgggatcacatgtggactt

SEQ ID NO: 2760297 - DNA, 15 bp, Homo sapiens
cagctgtactgagtt

SEQ ID NO: 2760298 - DNA, 13 bp, Homo sapiens
cagcttcctgtgc

SEQ ID NO: 2760299 - DNA, 15 bp, Homo sapiens
cagcttcctgtgcag

SEQ ID NO: 2760300 - DNA, 18 bp, Homo sapiens
cagcttgtggcaagtgaa

SEQ ID NO: 2760301 - DNA, 17 bp, Homo sapiens
cccctacaactccagcc

SEQ ID NO: 2760302 - DNA, 17 bp, Homo sapiens
cccctgtggccctggca

SEQ ID NO: 2760303 - DNA, 14 bp, Homo sapiens
ccccttaccactgc

SEQ ID NO: 2760304 - DNA, 19 bp, Homo sapiens
cccgctacaattctgcaga

SEQ ID NO: 2760305 - DNA, 22 bp, Homo sapiens
cccgctgatggagccccacctt

SEQ ID NO: 2760306 - DNA, 16 bp, Homo sapiens
ccctatctttgccacc

SEQ ID NO: 2760307 - DNA, 14 bp, Homo sapiens
ccctatgtcccagc

SEQ ID NO: 2760308 - DNA, 24 bp, Homo sapiens
ccctatgtcccagcccctggtact

SEQ ID NO: 2760309 - DNA, 12 bp, Homo sapiens
ccctcagctctt

SEQ ID NO: 2760310 - DNA, 12 bp, Homo sapiens
ccctcatgctgt

SEQ ID NO: 2760311 - DNA, 14 bp, Homo sapiens
ccctcctctagaag

SEQ ID NO: 2760312 - DNA, 15 bp, Homo sapiens
ccctctttcctgtgc

SEQ ID NO: 2760313 - DNA, 19 bp, Homo sapiens
ccctctttcctgtgccagg

SEQ ID NO: 2760314 - DNA, 13 bp, Homo sapiens
ccctggagcctca

SEQ ID NO: 2760315 - DNA, 16 bp, Homo sapiens
ccctggagcctcagca

SEQ ID NO: 2760316 - DNA, 19 bp, Homo sapiens
ccctggagcctcagcagca

SEQ ID NO: 2760317 - DNA, 23 bp, Homo sapiens
ccctggtactcccccagccctca

SEQ ID NO: 2760318 - DNA, 20 bp, Homo sapiens
ccctgtgtgtcgttcccttg

SEQ ID NO: 2760319 - DNA, 21 bp, Homo sapiens
ccgcaccagcccgaacaccat

SEQ ID NO: 2760320 - DNA, 14 bp, Homo sapiens
ccgccagctgccgc

SEQ ID NO: 2760321 - DNA, 19 bp, Homo sapiens
ccgctacaattctgcagaa

SEQ ID NO: 2760322 - DNA, 14 bp, Homo sapiens
ccgctgatggagcc

SEQ ID NO: 2760323 - DNA, 18 bp, Homo sapiens
ccgctgatggagccccac

SEQ ID NO: 2760324 - DNA, 19 bp, Homo sapiens
ccgctgatggagccccacc

SEQ ID NO: 2760325 - DNA, 12 bp, Homo sapiens
ccggcagcctgg

SEQ ID NO: 2760326 - DNA, 22 bp, Homo sapiens
ccgtcaaaacagattgtttgca

SEQ ID NO: 2760327 - DNA, 18 bp, Homo sapiens
ccgtctctggttcctccc

SEQ ID NO: 2760328 - DNA, 15 bp, Homo sapiens
cctagatggttccct

SEQ ID NO: 2760329 - DNA, 12 bp, Homo sapiens
cctagtggggag

SEQ ID NO: 2760330 - DNA, 14 bp, Homo sapiens
cctagtggggaggg

SEQ ID NO: 2760331 - DNA, 20 bp, Homo sapiens
cctagtggggaggggcctgg

SEQ ID NO: 2760332 - DNA, 12 bp, Homo sapiens
cctatctttgcc

SEQ ID NO: 2760333 - DNA, 13 bp, Homo sapiens
cctatctttgcca

SEQ ID NO: 2760334 - DNA, 12 bp, Homo sapiens
cctcacactggg

SEQ ID NO: 2760335 - DNA, 13 bp, Homo sapiens
cctcacactggga

SEQ ID NO: 2760336 - DNA, 14 bp, Homo sapiens
cctcatgctctcta

SEQ ID NO: 2760337 - DNA, 14 bp, Homo sapiens
cctccaaggttttg

SEQ ID NO: 2760338 - DNA, 21 bp, Homo sapiens
cctccatgatgcaagccagct

SEQ ID NO: 2760339 - DNA, 14 bp, Homo sapiens
cctcccaagcagct

SEQ ID NO: 2760340 - DNA, 14 bp, Homo sapiens
cctcctcctgttcc

SEQ ID NO: 2760341 - DNA, 17 bp, Homo sapiens
cctcctctagaaggctg

SEQ ID NO: 2760342 - DNA, 17 bp, Homo sapiens
cctcctgttcctgcctt

SEQ ID NO: 2760343 - DNA, 18 bp, Homo sapiens
cctcctgttcctgccttc

SEQ ID NO: 2760344 - DNA, 21 bp, Homo sapiens
cctcctgttcctgccttctct

SEQ ID NO: 2760345 - DNA, 21 bp, Homo sapiens
cctcgcatccgcctctgagcc

SEQ ID NO: 2760346 - DNA, 20 bp, Homo sapiens
cctctctctcacctacttcc

SEQ ID NO: 2760347 - DNA, 18 bp, Homo sapiens
cctctgagccaggagcct

SEQ ID NO: 2760348 - DNA, 18 bp, Homo sapiens
cctctgctgatcctccca

SEQ ID NO: 2760349 - DNA, 17 bp, Homo sapiens
cctgatggccaggccag

SEQ ID NO: 2760350 - DNA, 15 bp, Homo sapiens
cctgcctcatgctct

SEQ ID NO: 2760351 - DNA, 16 bp, Homo sapiens
cctgcctcccaagcag

SEQ ID NO: 2760352 - DNA, 15 bp, Homo sapiens
cctggagtctcactg

SEQ ID NO: 2760353 - DNA, 12 bp, Homo sapiens
cctggcctggtc

SEQ ID NO: 2760354 - DNA, 16 bp, Homo sapiens
cctggcctggtccagg

SEQ ID NO: 2760355 - DNA, 17 bp, Homo sapiens
cctgtcctgcctaaggc

SEQ ID NO: 2760356 - DNA, 17 bp, Homo sapiens
cctgtgcagaaggtctg

SEQ ID NO: 2760357 - DNA, 17 bp, Homo sapiens
cctgtgccaggactctc

SEQ ID NO: 2760358 - DNA, 16 bp, Homo sapiens
cctgttcctgccttct

SEQ ID NO: 2760359 - DNA, 17 bp, Homo sapiens
cctgtttgggaggctgg

SEQ ID NO: 2760360 - DNA, 18 bp, Homo sapiens
cctgtttgggaggctgga

SEQ ID NO: 2760361 - DNA, 15 bp, Homo sapiens
ccttcaaaatgctgc

SEQ ID NO: 2760362 - DNA, 16 bp, Homo sapiens
ccttcaaaatgctgct

SEQ ID NO: 2760363 - DNA, 13 bp, Homo sapiens
ccttcctctgagg

SEQ ID NO: 2760364 - DNA, 14 bp, Homo sapiens
ccttcctctgaggc

SEQ ID NO: 2760365 - DNA, 22 bp, Homo sapiens
ccttctcgtcttcctctctctc

SEQ ID NO: 2760366 - DNA, 18 bp, Homo sapiens
ccttctcttctatcctgc

SEQ ID NO: 2760367 - DNA, 15 bp, Homo sapiens
ccttgttgatgccag

SEQ ID NO: 2760368 - DNA, 19 bp, Homo sapiens
cctttccttctcgtcttcc

SEQ ID NO: 2760369 - DNA, 14 bp, Homo sapiens
cctttctagttgaa

SEQ ID NO: 2760370 - DNA, 16 bp, Homo sapiens
cctttgacctgcctcc

SEQ ID NO: 2760371 - DNA, 15 bp, Homo sapiens
cgagtaatatgcctg

SEQ ID NO: 2760372 - DNA, 15 bp, Homo sapiens
cgagtgctcatttca

SEQ ID NO: 2760373 - DNA, 11 bp, Homo sapiens
cgattagactg

SEQ ID NO: 2760374 - DNA, 20 bp, Homo sapiens
cgcaccagcccgaacaccat

SEQ ID NO: 2760375 - DNA, 12 bp, Homo sapiens
cgccaagactca

SEQ ID NO: 2760376 - DNA, 12 bp, Homo sapiens
cgcctctgagcc

SEQ ID NO: 2760377 - DNA, 14 bp, Homo sapiens
cggagtatgtgcag

SEQ ID NO: 2760378 - DNA, 12 bp, Homo sapiens
cggcagcctggt

SEQ ID NO: 2760379 - DNA, 17 bp, Homo sapiens
cggcagcctggttccct

SEQ ID NO: 2760380 - DNA, 21 bp, Homo sapiens
cggctgggaactgggccagca

SEQ ID NO: 2760381 - DNA, 22 bp, Homo sapiens
cggctgggaactgggccagcag

SEQ ID NO: 2760382 - DNA, 23 bp, Homo sapiens
cggtgtttaagacatttttggaa

SEQ ID NO: 2760383 - DNA, 16 bp, Homo sapiens
cgtaaaaatgatttca

SEQ ID NO: 2760384 - DNA, 17 bp, Homo sapiens
cgtcttcctctctctca

SEQ ID NO: 2760385 - DNA, 20 bp, Homo sapiens
cgttcccttgtgtctgttgc

SEQ ID NO: 2760386 - DNA, 14 bp, Homo sapiens
ctaaggctgaactt

SEQ ID NO: 2760387 - DNA, 15 bp, Homo sapiens
ctaagttaatttaaa

SEQ ID NO: 2760388 - DNA, 17 bp, Homo sapiens
ctaagttaatttaaagt

SEQ ID NO: 2760389 - DNA, 14 bp, Homo sapiens
ctacccctgtcctg

SEQ ID NO: 2760390 - DNA, 22 bp, Homo sapiens
ctaccctcctctagaaggctga

SEQ ID NO: 2760391 - DNA, 15 bp, Homo sapiens
ctactagatcacttg

SEQ ID NO: 2760392 - DNA, 16 bp, Homo sapiens
ctacttcctcctcctc

SEQ ID NO: 2760393 - DNA, 21 bp, Homo sapiens
ctactttgatatgactgtttt

SEQ ID NO: 2760394 - DNA, 22 bp, Homo sapiens
ctagaggaataaagctgtgagc

SEQ ID NO: 2760395 - DNA, 20 bp, Homo sapiens
ctagatcacttgtcctcttg

SEQ ID NO: 2760396 - DNA, 15 bp, Homo sapiens
ctagatggttccctt

SEQ ID NO: 2760397 - DNA, 20 bp, Homo sapiens
ctagatggttccctttgttg

SEQ ID NO: 2760398 - DNA, 15 bp, Homo sapiens
ctaggctaccctcct

SEQ ID NO: 2760399 - DNA, 19 bp, Homo sapiens
ctatcaaccccagacactg

SEQ ID NO: 2760400 - DNA, 20 bp, Homo sapiens
ctatcaaccccagacactgg

SEQ ID NO: 2760401 - DNA, 19 bp, Homo sapiens
ctatcctgcaatttctccc

SEQ ID NO: 2760402 - DNA, 17 bp, Homo sapiens
taagacatttttggaag

SEQ ID NO: 2760403 - DNA, 17 bp, Homo sapiens
taagcctttggaaacag

SEQ ID NO: 2760404 - DNA, 15 bp, Homo sapiens
tacaattctgcagaa

SEQ ID NO: 2760405 - DNA, 19 bp, Homo sapiens
tacagtaaatacactgtga

SEQ ID NO: 2760406 - DNA, 20 bp, Homo sapiens
tacagtaaatacactgtgaa

SEQ ID NO: 2760407 - DNA, 12 bp, Homo sapiens
tacatgtttgca

SEQ ID NO: 2760408 - DNA, 22 bp, Homo sapiens
tacatgtttgcacctttctagt

SEQ ID NO: 2760409 - DNA, 15 bp, Homo sapiens
tactcccccagccct

SEQ ID NO: 2760410 - DNA, 12 bp, Homo sapiens
tagaatgacagt

SEQ ID NO: 2760411 - DNA, 18 bp, Homo sapiens
tagaatgtaaagcttgtc

SEQ ID NO: 2760412 - DNA, 19 bp, Homo sapiens
tagactggaacttgaactg

SEQ ID NO: 2760413 - DNA, 16 bp, Homo sapiens
tagcgtgctcactgac

SEQ ID NO: 2760414 - DNA, 16 bp, Homo sapiens
tagctgagctggaaag

SEQ ID NO: 2760415 - DNA, 22 bp, Homo sapiens
taggctaccctcctctagaagg

SEQ ID NO: 2760416 - DNA, 18 bp, Homo sapiens
tagggttgccagtcctgc

SEQ ID NO: 2760417 - DNA, 23 bp, Homo sapiens
tagtggggaggggcctggcctgg

SEQ ID NO: 2760418 - DNA, 14 bp, Homo sapiens
tatatatatatatg

SEQ ID NO: 2760419 - DNA, 23 bp, Homo sapiens
tatctaagttaatttaaagttgt

SEQ ID NO: 2760420 - DNA, 14 bp, Homo sapiens
tatgaccacactcc

SEQ ID NO: 2760421 - DNA, 19 bp, Homo sapiens
tatgaccacactccagctg

SEQ ID NO: 2760422 - DNA, 19 bp, Homo sapiens
tattccgatacaaagtgtt

SEQ ID NO: 2760423 - DNA, 17 bp, Homo sapiens
tattctgcaacagcctg

SEQ ID NO: 2760424 - DNA, 19 bp, Homo sapiens
tattctgcaacagcctgtt

SEQ ID NO: 2760425 - DNA, 12 bp, Homo sapiens
tcaaaacattgt

SEQ ID NO: 2760426 - DNA, 22 bp, Homo sapiens
tcaaaacattgtgccatgtcaa

SEQ ID NO: 2760427 - DNA, 20 bp, Homo sapiens
tcaaaccaaatcactgaact

SEQ ID NO: 2760428 - DNA, 17 bp, Homo sapiens
tcaaccccagacactgg

SEQ ID NO: 2760429 - DNA, 15 bp, Homo sapiens
tcaagagactgagtc

SEQ ID NO: 2760430 - DNA, 21 bp, Homo sapiens
tcaagttccgtctcctctcca

SEQ ID NO: 2760431 - DNA, 20 bp, Homo sapiens
tcaattctgatacagcctta

SEQ ID NO: 2760432 - DNA, 13 bp, Homo sapiens
tcacagctggaga

SEQ ID NO: 2760433 - DNA, 16 bp, Homo sapiens
tcacattccctctcat

SEQ ID NO: 2760434 - DNA, 18 bp, Homo sapiens
tcacctacttcctcctcc

SEQ ID NO: 2760435 - DNA, 13 bp, Homo sapiens
tcacctttattct

SEQ ID NO: 2760436 - DNA, 16 bp, Homo sapiens
tcactgctgtccctcc

SEQ ID NO: 2760437 - DNA, 20 bp, Homo sapiens
tcactgctgtccctcctgag

SEQ ID NO: 2760438 - DNA, 17 bp, Homo sapiens
tcactgtctgctggcaa

SEQ ID NO: 2760439 - DNA, 21 bp, Homo sapiens
tcacttttaatgaacaaatgg

SEQ ID NO: 2760440 - DNA, 12 bp, Homo sapiens
tcagaataaatg

SEQ ID NO: 2760441 - DNA, 21 bp, Homo sapiens
tcagatgctgtgcaaatgtta

SEQ ID NO: 2760442 - DNA, 21 bp, Homo sapiens
tcagcagcaaatgccactctg

SEQ ID NO: 2760443 - DNA, 22 bp, Homo sapiens
tcagctctgacattctgattcg

SEQ ID NO: 2760444 - DNA, 19 bp, Homo sapiens
tcaggaatcggaatcctgt

SEQ ID NO: 2760445 - DNA, 12 bp, Homo sapiens
tcaggacagctg

SEQ ID NO: 2760446 - DNA, 17 bp, Homo sapiens
tcaggagtccactgcct

SEQ ID NO: 2760447 - DNA, 14 bp, Homo sapiens
tcagggcttctcct

SEQ ID NO: 2760448 - DNA, 23 bp, Homo sapiens
tcagggcttctcctctgctaggc

SEQ ID NO: 2760449 - DNA, 23 bp, Homo sapiens
tcagtcaagttccgtctcctctc

SEQ ID NO: 2760450 - DNA, 20 bp, Homo sapiens
tcagtggggcccatggatgt

SEQ ID NO: 2760451 - DNA, 16 bp, Homo sapiens
tcatccacagaggcca

SEQ ID NO: 2760452 - DNA, 19 bp, Homo sapiens
tcatccaggtcctttcctt

SEQ ID NO: 2760453 - DNA, 16 bp, Homo sapiens
tcattccattctggaa

SEQ ID NO: 2760454 - DNA, 14 bp, Homo sapiens
tccactaccctccc

SEQ ID NO: 2760455 - DNA, 13 bp, Homo sapiens
tccactgcctcca

SEQ ID NO: 2760456 - DNA, 18 bp, Homo sapiens
tccagccacccagccagg

SEQ ID NO: 2760457 - DNA, 20 bp, Homo sapiens
tccaggtcctttccttctcg

SEQ ID NO: 2760458 - DNA, 17 bp, Homo sapiens
tccatagctgagctgga

SEQ ID NO: 2760459 - DNA, 18 bp, Homo sapiens
tccatgagggtgggggtg

SEQ ID NO: 2760460 - DNA, 20 bp, Homo sapiens
tcccaaaagcccattcattc

SEQ ID NO: 2760461 - DNA, 19 bp, Homo sapiens
tcccagcccctggtactcc

SEQ ID NO: 2760462 - DNA, 22 bp, Homo sapiens
tcccagcccctggtactccccc

SEQ ID NO: 2760463 - DNA, 16 bp, Homo sapiens
tcccatcactgctgtc

SEQ ID NO: 2760464 - DNA, 17 bp, Homo sapiens
tcccatcactgctgtcc

SEQ ID NO: 2760465 - DNA, 17 bp, Homo sapiens
tccccacagtgccaccc

SEQ ID NO: 2760466 - DNA, 19 bp, Homo sapiens
tccccacagtgccacccat

SEQ ID NO: 2760467 - DNA, 16 bp, Homo sapiens
tcccccagccctcagt

SEQ ID NO: 2760468 - DNA, 21 bp, Homo sapiens
tcccgaatctttttaggccac

SEQ ID NO: 2760469 - DNA, 21 bp, Homo sapiens
tccctagatggttccctttgt

SEQ ID NO: 2760470 - DNA, 13 bp, Homo sapiens
tccctctcatcca

SEQ ID NO: 2760471 - DNA, 11 bp, Homo sapiens
tccctggagac

SEQ ID NO: 2760472 - DNA, 21 bp, Homo sapiens
tcccttcatctggaaccatca

SEQ ID NO: 2760473 - DNA, 17 bp, Homo sapiens
tcccttcatgcatggaa

SEQ ID NO: 2760474 - DNA, 13 bp, Homo sapiens
tccgcctctgagc

SEQ ID NO: 2760475 - DNA, 15 bp, Homo sapiens
tccgtaaaaatgatt

SEQ ID NO: 2760476 - DNA, 23 bp, Homo sapiens
tccgtcaaaacagattgtttgca

SEQ ID NO: 2760477 - DNA, 17 bp, Homo sapiens
tccgtctcctctccagc

SEQ ID NO: 2760478 - DNA, 22 bp, Homo sapiens
tcctcccctcctcctggactcc

SEQ ID NO: 2760479 - DNA, 13 bp, Homo sapiens
tcctcctggactc

SEQ ID NO: 2760480 - DNA, 16 bp, Homo sapiens
tcctgcaatttctccc

SEQ ID NO: 2760481 - DNA, 14 bp, Homo sapiens
tcctgcacacgctc

SEQ ID NO: 2760482 - DNA, 19 bp, Homo sapiens
tcctgcctaaggctgaact

SEQ ID NO: 2760483 - DNA, 14 bp, Homo sapiens
tcctgccttctctt

SEQ ID NO: 2760484 - DNA, 18 bp, Homo sapiens
tcctggagtctcactgtc

SEQ ID NO: 2760485 - DNA, 17 bp, Homo sapiens
tcctgtcgattagactg

SEQ ID NO: 2760486 - DNA, 21 bp, Homo sapiens
tcctgtcgattagactggaca

SEQ ID NO: 2760487 - DNA, 22 bp, Homo sapiens
tcctgtcgattagactggacag

SEQ ID NO: 2760488 - DNA, 11 bp, Homo sapiens
tcctgtgcaga

SEQ ID NO: 2760489 - DNA, 23 bp, Homo sapiens
tcctgttcatggggtttttgccc

SEQ ID NO: 2760490 - DNA, 15 bp, Homo sapiens
tcctgttcctgcctt

SEQ ID NO: 2760491 - DNA, 16 bp, Homo sapiens
tccttcctctgaggct

SEQ ID NO: 2760492 - DNA, 21 bp, Homo sapiens
tccttggcaggctgatttcta

SEQ ID NO: 2760493 - DNA, 23 bp, Homo sapiens
tccttggcaggctgatttctagg

SEQ ID NO: 2760494 - DNA, 15 bp, Homo sapiens
tcgaatgacactgtt

SEQ ID NO: 2760495 - DNA, 22 bp, Homo sapiens
tcgtgaagaggggaagtctctt

SEQ ID NO: 2760496 - DNA, 18 bp, Homo sapiens
tcgttcccttgtgtctgt

SEQ ID NO: 2760497 - DNA, 20 bp, Homo sapiens
tctaagttaatttaaagttg

SEQ ID NO: 2760498 - DNA, 19 bp, Homo sapiens
tctagttgaaaataaagtg

SEQ ID NO: 2760499 - DNA, 21 bp, Homo sapiens
tctcacctacttcctcctcct

SEQ ID NO: 2760500 - DNA, 13 bp, Homo sapiens
tctctcacctact

SEQ ID NO: 2760501 - DNA, 21 bp, Homo sapiens
tcagaggggaataaactgttg

SEQ ID NO: 2760502 - DNA, 19 bp, Homo sapiens
tcaggacagctgcttctgt

SEQ ID NO: 2760503 - DNA, 15 bp, Homo sapiens
tcaggagtccactgc

SEQ ID NO: 2760504 - DNA, 19 bp, Homo sapiens
tcagtcaagttccgtctcc

SEQ ID NO: 2760505 - DNA, 13 bp, Homo sapiens
tcatccatccagg

SEQ ID NO: 2760506 - DNA, 13 bp, Homo sapiens
tcatctggaacca

SEQ ID NO: 2760507 - DNA, 20 bp, Homo sapiens
tcattagactggaacttgaa

SEQ ID NO: 2760508 - DNA, 19 bp, Homo sapiens
tcattccattctggaagtg

SEQ ID NO: 2760509 - DNA, 14 bp, Homo sapiens
tccaaatgcagctt

SEQ ID NO: 2760510 - DNA, 15 bp, Homo sapiens
tccacagaggccagg

SEQ ID NO: 2760511 - DNA, 17 bp, Homo sapiens
tccactaccctccctcg

SEQ ID NO: 2760512 - DNA, 23 bp, Homo sapiens
tccactcagggcttctcctctgc

SEQ ID NO: 2760513 - DNA, 12 bp, Homo sapiens
tccactgcctcc

SEQ ID NO: 2760514 - DNA, 19 bp, Homo sapiens
tccagccatcaagagactg

SEQ ID NO: 2760515 - DNA, 24 bp, Homo sapiens
tccagccatcaagagactgagtca

SEQ ID NO: 2760516 - DNA, 15 bp, Homo sapiens
tccaggtcctttcct

SEQ ID NO: 2760517 - DNA, 16 bp, Homo sapiens
tccaggtcctttcctt

SEQ ID NO: 2760518 - DNA, 18 bp, Homo sapiens
tccaggtcctttccttct

SEQ ID NO: 2760519 - DNA, 16 bp, Homo sapiens
tccatccaggccattc

SEQ ID NO: 2760520 - DNA, 20 bp, Homo sapiens
tccatccttgagtcaaaaaa

SEQ ID NO: 2760521 - DNA, 13 bp, Homo sapiens
tccattctggaag

SEQ ID NO: 2760522 - DNA, 12 bp, Homo sapiens
tcccaagcagct

SEQ ID NO: 2760523 - DNA, 16 bp, Homo sapiens
tcccaagcagctgaag

SEQ ID NO: 2760524 - DNA, 18 bp, Homo sapiens
tcccaagcagctgaaggg

SEQ ID NO: 2760525 - DNA, 19 bp, Homo sapiens
tcccacccaattcaaaaca

SEQ ID NO: 2760526 - DNA, 15 bp, Homo sapiens
tcccacttcacagct

SEQ ID NO: 2760527 - DNA, 15 bp, Homo sapiens
tcccagcccctggta

SEQ ID NO: 2760528 - DNA, 16 bp, Homo sapiens
tcccaggatgtacaag

SEQ ID NO: 2760529 - DNA, 22 bp, Homo sapiens
tcccatcactgctgtccctcct

SEQ ID NO: 2760530 - DNA, 17 bp, Homo sapiens
tcccatttgtgtttcag

SEQ ID NO: 2760531 - DNA, 17 bp, Homo sapiens
tccccatgtctcgactc

SEQ ID NO: 2760532 - DNA, 16 bp, Homo sapiens
tccctatgtcccagcc

SEQ ID NO: 2760533 - DNA, 13 bp, Homo sapiens
tcccttgtgtctg

SEQ ID NO: 2760534 - DNA, 18 bp, Homo sapiens
tcccttgtgtctgttgct

SEQ ID NO: 2760535 - DNA, 15 bp, Homo sapiens
tccgcctctgagcca

SEQ ID NO: 2760536 - DNA, 16 bp, Homo sapiens
tccgcctctgagccag

SEQ ID NO: 2760537 - DNA, 18 bp, Homo sapiens
tccgcctctgagccagga

SEQ ID NO: 2760538 - DNA, 21 bp, Homo sapiens
tccgtctcctctccagcccta

SEQ ID NO: 2760539 - DNA, 18 bp, Homo sapiens
tcctcccctcctcctgga

SEQ ID NO: 2760540 - DNA, 20 bp, Homo sapiens
tcctcccctcctcctggact

SEQ ID NO: 2760541 - DNA, 14 bp, Homo sapiens
tcctcctcctcctc

SEQ ID NO: 2760542 - DNA, 16 bp, Homo sapiens
tcctcctcctgttcct

SEQ ID NO: 2760543 - DNA, 19 bp, Homo sapiens
tcctcctgttcctgccttc

SEQ ID NO: 2760544 - DNA, 20 bp, Homo sapiens
tcctctctctcacctacttc

SEQ ID NO: 2760545 - DNA, 21 bp, Homo sapiens
tcctctctctcacctacttcc

SEQ ID NO: 2760546 - DNA, 16 bp, Homo sapiens
tcctcttgccagctca

SEQ ID NO: 2760547 - DNA, 18 bp, Homo sapiens
tcctgcctcccaagcagc

SEQ ID NO: 2760548 - DNA, 15 bp, Homo sapiens
tcctgccttctcttc

SEQ ID NO: 2760549 - DNA, 21 bp, Homo sapiens
tcctggggctgggtgtgtttc

SEQ ID NO: 2760550 - DNA, 14 bp, Homo sapiens
tcctgtgcagaagg

SEQ ID NO: 2760551 - DNA, 18 bp, Homo sapiens
gacttttatttccagtga

SEQ ID NO: 2760552 - DNA, 21 bp, Homo sapiens
gagacaccggagtatgtgcag

SEQ ID NO: 2760553 - DNA, 17 bp, Homo sapiens
gagaccccagagtaggg

SEQ ID NO: 2760554 - DNA, 13 bp, Homo sapiens
gagcaaacagagg

SEQ ID NO: 2760555 - DNA, 18 bp, Homo sapiens
gagcaaacagaggaggcc

SEQ ID NO: 2760556 - DNA, 12 bp, Homo sapiens
gagccaggagcc

SEQ ID NO: 2760557 - DNA, 13 bp, Homo sapiens
gagccaggagcct

SEQ ID NO: 2760558 - DNA, 12 bp, Homo sapiens
gagcgagttggt

SEQ ID NO: 2760559 - DNA, 23 bp, Homo sapiens
gaggatggtcatcgtgacagcag

SEQ ID NO: 2760560 - DNA, 19 bp, Homo sapiens
gaggccaggcatggcccag

SEQ ID NO: 2760561 - DNA, 15 bp, Homo sapiens
gaggggcctggcctg

SEQ ID NO: 2760562 - DNA, 19 bp, Homo sapiens
gaggggcctggcctgggtg

SEQ ID NO: 2760563 - DNA, 21 bp, Homo sapiens
gaggtgggggtctggcctagt

SEQ ID NO: 2760564 - DNA, 22 bp, Homo sapiens
gagtagggttgccagtcctgca

SEQ ID NO: 2760565 - DNA, 14 bp, Homo sapiens
gagtcaagttgttc

SEQ ID NO: 2760566 - DNA, 12 bp, Homo sapiens
gagtctcactgt

SEQ ID NO: 2760567 - DNA, 16 bp, Homo sapiens
gatcacatgtggactt

SEQ ID NO: 2760568 - DNA, 16 bp, Homo sapiens
gatcgttcaaagcatg

SEQ ID NO: 2760569 - DNA, 15 bp, Homo sapiens
gatgcctgacacagg

SEQ ID NO: 2760570 - DNA, 11 bp, Homo sapiens
gatgcttctgc

SEQ ID NO: 2760571 - DNA, 15 bp, Homo sapiens
gatggagccccacct

SEQ ID NO: 2760572 - DNA, 11 bp, Homo sapiens
gatgtgcattc

SEQ ID NO: 2760573 - DNA, 20 bp, Homo sapiens
gattagactggacagcttgt

SEQ ID NO: 2760574 - DNA, 18 bp, Homo sapiens
gatttctaggtaggaaat

SEQ ID NO: 2760575 - DNA, 11 bp, Homo sapiens
gcaacagcctg

SEQ ID NO: 2760576 - DNA, 12 bp, Homo sapiens
gcaacagcctgt

SEQ ID NO: 2760577 - DNA, 15 bp, Homo sapiens
gcaagccacagaaat

SEQ ID NO: 2760578 - DNA, 22 bp, Homo sapiens
gcaagccagcttcctgtgcaga

SEQ ID NO: 2760579 - DNA, 21 bp, Homo sapiens
gcacaaagttggtgccaagct

SEQ ID NO: 2760580 - DNA, 18 bp, Homo sapiens
gcacctttctagttgaaa

SEQ ID NO: 2760581 - DNA, 16 bp, Homo sapiens
gcactgggccggcagc

SEQ ID NO: 2760582 - DNA, 17 bp, Homo sapiens
gcagcctggttccctct

SEQ ID NO: 2760583 - DNA, 13 bp, Homo sapiens
gcagctgctcccc

SEQ ID NO: 2760584 - DNA, 22 bp, Homo sapiens
gcagctgctccccaggccaccc

SEQ ID NO: 2760585 - DNA, 17 bp, Homo sapiens
gcatccaaatggctgct

SEQ ID NO: 2760586 - DNA, 18 bp, Homo sapiens
gcatggcttgcccctgtg

SEQ ID NO: 2760587 - DNA, 11 bp, Homo sapiens
gccacagaaat

SEQ ID NO: 2760588 - DNA, 14 bp, Homo sapiens
gccacccagccagg

SEQ ID NO: 2760589 - DNA, 15 bp, Homo sapiens
gccacccagccagga

SEQ ID NO: 2760590 - DNA, 21 bp, Homo sapiens
gccacccatgcagctgctccc

SEQ ID NO: 2760591 - DNA, 13 bp, Homo sapiens
gccaccctcatgc

SEQ ID NO: 2760592 - DNA, 16 bp, Homo sapiens
gccaccctcatgctgt

SEQ ID NO: 2760593 - DNA, 15 bp, Homo sapiens
gccagcagagcatgt

SEQ ID NO: 2760594 - DNA, 16 bp, Homo sapiens
gccagcttcctgtgca

SEQ ID NO: 2760595 - DNA, 14 bp, Homo sapiens
gccaggactctctt

SEQ ID NO: 2760596 - DNA, 18 bp, Homo sapiens
gccaggaggggctgtcca

SEQ ID NO: 2760597 - DNA, 19 bp, Homo sapiens
gccaggcatggcccagcct

SEQ ID NO: 2760598 - DNA, 23 bp, Homo sapiens
gccaggcatggcccagcctggag

SEQ ID NO: 2760599 - DNA, 13 bp, Homo sapiens
gccagtcctgcaa

SEQ ID NO: 2760600 - DNA, 14 bp, Homo sapiens
gccatagggaccaa

SEQ ID NO: 2760601 - DNA, 15 bp, Homo sapiens
gccatcaagagactg

SEQ ID NO: 2760602 - DNA, 12 bp, Homo sapiens
gcccagcctgga

SEQ ID NO: 2760603 - DNA, 14 bp, Homo sapiens
gcccagcctggagc

SEQ ID NO: 2760604 - DNA, 16 bp, Homo sapiens
gcccagcctggagccg

SEQ ID NO: 2760605 - DNA, 16 bp, Homo sapiens
gcccattcattccatt

SEQ ID NO: 2760606 - DNA, 19 bp, Homo sapiens
gcccccactgcctttgacc

SEQ ID NO: 2760607 - DNA, 18 bp, Homo sapiens
gccctggagcctcagcag

SEQ ID NO: 2760608 - DNA, 12 bp, Homo sapiens
gccgcaccagcc

SEQ ID NO: 2760609 - DNA, 16 bp, Homo sapiens
gccgccagctgccgca

SEQ ID NO: 2760610 - DNA, 23 bp, Homo sapiens
gcctcacttttaatgaacaaatg

SEQ ID NO: 2760611 - DNA, 19 bp, Homo sapiens
gcctcatgctctctataga

SEQ ID NO: 2760612 - DNA, 21 bp, Homo sapiens
gcctccatgatgcaagccagc

SEQ ID NO: 2760613 - DNA, 22 bp, Homo sapiens
gcctccatgatgcaagccagct

SEQ ID NO: 2760614 - DNA, 22 bp, Homo sapiens
gcctcccaagcagctgaagggt

SEQ ID NO: 2760615 - DNA, 15 bp, Homo sapiens
gcctcccttcatgca

SEQ ID NO: 2760616 - DNA, 18 bp, Homo sapiens
gcctcccttcatgcatgg

SEQ ID NO: 2760617 - DNA, 20 bp, Homo sapiens
gcctcccttcatgcatggaa

SEQ ID NO: 2760618 - DNA, 17 bp, Homo sapiens
gcctctgagccaggagc

SEQ ID NO: 2760619 - DNA, 18 bp, Homo sapiens
gcctctgctgatcctccc

SEQ ID NO: 2760620 - DNA, 21 bp, Homo sapiens
gcctgacacaggggacactga

SEQ ID NO: 2760621 - DNA, 15 bp, Homo sapiens
gcctggcctggtcca

SEQ ID NO: 2760622 - DNA, 20 bp, Homo sapiens
gcctgggtggggcagggcct

SEQ ID NO: 2760623 - DNA, 22 bp, Homo sapiens
gcctgggtggggcagggcctgg

SEQ ID NO: 2760624 - DNA, 21 bp, Homo sapiens
gcctggttccctctttcctgt

SEQ ID NO: 2760625 - DNA, 24 bp, Homo sapiens
gcctggttccctctttcctgtgcc

SEQ ID NO: 2760626 - DNA, 17 bp, Homo sapiens
gcctgtttgggaggctg

SEQ ID NO: 2760627 - DNA, 21 bp, Homo sapiens
gcctttattaaaaactgagtg

SEQ ID NO: 2760628 - DNA, 22 bp, Homo sapiens
gcctttggaaacagctcgactt

SEQ ID NO: 2760629 - DNA, 20 bp, Homo sapiens
gctcacattccctctcatcc

SEQ ID NO: 2760630 - DNA, 23 bp, Homo sapiens
gctcacattccctctcatccagg

SEQ ID NO: 2760631 - DNA, 19 bp, Homo sapiens
gctcagatagaatgacagt

SEQ ID NO: 2760632 - DNA, 12 bp, Homo sapiens
gctccattccca

SEQ ID NO: 2760633 - DNA, 21 bp, Homo sapiens
gctcctacccctgtcctgggg

SEQ ID NO: 2760634 - DNA, 15 bp, Homo sapiens
gctctgtattctgca

SEQ ID NO: 2760635 - DNA, 19 bp, Homo sapiens
gctgatggagccccacctt

SEQ ID NO: 2760636 - DNA, 16 bp, Homo sapiens
gctgctccccaggcca

SEQ ID NO: 2760637 - DNA, 11 bp, Homo sapiens
gctgcttctgt

SEQ ID NO: 2760638 - DNA, 12 bp, Homo sapiens
gctgcttctgtg

SEQ ID NO: 2760639 - DNA, 18 bp, Homo sapiens
gctgcttttgtctccctt

SEQ ID NO: 2760640 - DNA, 19 bp, Homo sapiens
gctgggaactgggccagca

SEQ ID NO: 2760641 - DNA, 13 bp, Homo sapiens
gctgggagaccct

SEQ ID NO: 2760642 - DNA, 22 bp, Homo sapiens
gctgggtgtgtttcaggacagc

SEQ ID NO: 2760643 - DNA, 14 bp, Homo sapiens
gcttccactcaggg

SEQ ID NO: 2760644 - DNA, 21 bp, Homo sapiens
gcttctcctctgctaggctac

SEQ ID NO: 2760645 - DNA, 15 bp, Homo sapiens
gcttgcccctgtggc

SEQ ID NO: 2760646 - DNA, 18 bp, Homo sapiens
gcttgtggcaagtgaatt

SEQ ID NO: 2760647 - DNA, 21 bp, Homo sapiens
gctttccccatgtctcgactc

SEQ ID NO: 2760648 - DNA, 16 bp, Homo sapiens
gcttttcccaaaagcc

SEQ ID NO: 2760649 - DNA, 14 bp, Homo sapiens
ggaacttgaactga

SEQ ID NO: 2760650 - DNA, 20 bp, Homo sapiens
ggacaccccccaccatggtg

SEQ ID NO: 2760651 - DNA, 12 bp, Homo sapiens
ggacagcttgtg

SEQ ID NO: 2760652 - DNA, 21 bp, Homo sapiens
tgaaccttgttgatgccagct

SEQ ID NO: 2760653 - DNA, 15 bp, Homo sapiens
tgaactttgctgagc

SEQ ID NO: 2760654 - DNA, 12 bp, Homo sapiens
tgaagcctttgt

SEQ ID NO: 2760655 - DNA, 19 bp, Homo sapiens
tgacacaggggacactgaa

SEQ ID NO: 2760656 - DNA, 22 bp, Homo sapiens
tgacagtccgtcaaaacagatt

SEQ ID NO: 2760657 - DNA, 16 bp, Homo sapiens
tgacagtggaactaca

SEQ ID NO: 2760658 - DNA, 19 bp, Homo sapiens
tgacatgtgttggcagcct

SEQ ID NO: 2760659 - DNA, 15 bp, Homo sapiens
tgaccaaaagttaca

SEQ ID NO: 2760660 - DNA, 22 bp, Homo sapiens
tgaccaaaagttacatgtttgc

SEQ ID NO: 2760661 - DNA, 19 bp, Homo sapiens
tgaccacactccagctggg

SEQ ID NO: 2760662 - DNA, 20 bp, Homo sapiens
tgaccacactccagctggga

SEQ ID NO: 2760663 - DNA, 22 bp, Homo sapiens
tgacctcagctttgatatttca

SEQ ID NO: 2760664 - DNA, 19 bp, Homo sapiens
tgactgtttttcggacagt

SEQ ID NO: 2760665 - DNA, 16 bp, Homo sapiens
tgactttggctgcatg

SEQ ID NO: 2760666 - DNA, 19 bp, Homo sapiens
tgagaagccaaagccccta

SEQ ID NO: 2760667 - DNA, 18 bp, Homo sapiens
tgagagacattaactcat

SEQ ID NO: 2760668 - DNA, 20 bp, Homo sapiens
tgagcaaacagaggaggcca

SEQ ID NO: 2760669 - DNA, 23 bp, Homo sapiens
tgagcaaacagaggaggccagcc

SEQ ID NO: 2760670 - DNA, 13 bp, Homo sapiens
tgagccaggagcc

SEQ ID NO: 2760671 - DNA, 23 bp, Homo sapiens
tgagctggaaaggatgcttctgc

SEQ ID NO: 2760672 - DNA, 16 bp, Homo sapiens
tgagctgggccctggg

SEQ ID NO: 2760673 - DNA, 13 bp, Homo sapiens
tgaggtctggatt

SEQ ID NO: 2760674 - DNA, 18 bp, Homo sapiens
tgagtcaagttgttcctt

SEQ ID NO: 2760675 - DNA, 14 bp, Homo sapiens
tgagttctcatcca

SEQ ID NO: 2760676 - DNA, 12 bp, Homo sapiens
tgatacagcctt

SEQ ID NO: 2760677 - DNA, 14 bp, Homo sapiens
tgatatacaaagtg

SEQ ID NO: 2760678 - DNA, 21 bp, Homo sapiens
tgatcagttttttcacctgga

SEQ ID NO: 2760679 - DNA, 14 bp, Homo sapiens
tgatgaagaggagt

SEQ ID NO: 2760680 - DNA, 20 bp, Homo sapiens
tgatgcaagccagcttcctg

SEQ ID NO: 2760681 - DNA, 11 bp, Homo sapiens
tgatggagccc

SEQ ID NO: 2760682 - DNA, 18 bp, Homo sapiens
tgattcgaatgacactgt

SEQ ID NO: 2760683 - DNA, 22 bp, Homo sapiens
tgatttcagtagcacaagttat

SEQ ID NO: 2760684 - DNA, 11 bp, Homo sapiens
tgatttctagg

SEQ ID NO: 2760685 - DNA, 23 bp, Homo sapiens
tgcaagccagcttcctgtgcaga

SEQ ID NO: 2760686 - DNA, 22 bp, Homo sapiens
tgcacaggtgccgccagctgcc

SEQ ID NO: 2760687 - DNA, 13 bp, Homo sapiens
tgcagctgctccc

SEQ ID NO: 2760688 - DNA, 15 bp, Homo sapiens
tgcagctgctcccca

SEQ ID NO: 2760689 - DNA, 16 bp, Homo sapiens
tgcagctgctccccag

SEQ ID NO: 2760690 - DNA, 18 bp, Homo sapiens
tgcagctgctccccaggc

SEQ ID NO: 2760691 - DNA, 23 bp, Homo sapiens
tgcatggaaattcccttcatctg

SEQ ID NO: 2760692 - DNA, 15 bp, Homo sapiens
tgcatttgtgtctgc

SEQ ID NO: 2760693 - DNA, 17 bp, Homo sapiens
tgccaccctcatgctgt

SEQ ID NO: 2760694 - DNA, 18 bp, Homo sapiens
tgccaggactctctttct

SEQ ID NO: 2760695 - DNA, 13 bp, Homo sapiens
tgccagtcctgca

SEQ ID NO: 2760696 - DNA, 17 bp, Homo sapiens
tgccgccagctgccgca

SEQ ID NO: 2760697 - DNA, 23 bp, Homo sapiens
tgccgccagctgccgcaccagcc

SEQ ID NO: 2760698 - DNA, 13 bp, Homo sapiens
tgcctcatgctct

SEQ ID NO: 2760699 - DNA, 21 bp, Homo sapiens
tgcctgtagccccagtgacag

SEQ ID NO: 2760700 - DNA, 16 bp, Homo sapiens
tgccttctcttctatc

SEQ ID NO: 2760701 - DNA, 22 bp, Homo sapiens
tgcctttttatttttgttttta

SEQ ID NO: 2760702 - DNA, 19 bp, Homo sapiens
tgcgaatgagctgggccct

SEQ ID NO: 2760703 - DNA, 14 bp, Homo sapiens
tgctccccaggcca

SEQ ID NO: 2760704 - DNA, 15 bp, Homo sapiens
aaaaactgagtgact

SEQ ID NO: 2760705 - DNA, 16 bp, Homo sapiens
aaacaaagggtgggca

SEQ ID NO: 2760706 - DNA, 15 bp, Homo sapiens
aaacaccctcacact

SEQ ID NO: 2760707 - DNA, 18 bp, Homo sapiens
aaaccaaatcactgaact

SEQ ID NO: 2760708 - DNA, 22 bp, Homo sapiens
aaacgggcgccaagactcaggg

SEQ ID NO: 2760709 - DNA, 13 bp, Homo sapiens
aaactgagtgact

SEQ ID NO: 2760710 - DNA, 22 bp, Homo sapiens
aaagctgtgagcaaacagagga

SEQ ID NO: 2760711 - DNA, 22 bp, Homo sapiens
aaagggggctattccctggaga

SEQ ID NO: 2760712 - DNA, 21 bp, Homo sapiens
aaagttggtgccaagcttctt

SEQ ID NO: 2760713 - DNA, 22 bp, Homo sapiens
aaatcaattctgatacagcctt

SEQ ID NO: 2760714 - DNA, 21 bp, Homo sapiens
aaatgctgcttccactcaggg

SEQ ID NO: 2760715 - DNA, 18 bp, Homo sapiens
aaattcccttcatctgga

SEQ ID NO: 2760716 - DNA, 12 bp, Homo sapiens
aacaacagaaac

SEQ ID NO: 2760717 - DNA, 14 bp, Homo sapiens
aacagaggaggcca

SEQ ID NO: 2760718 - DNA, 15 bp, Homo sapiens
aacagaggaggccag

SEQ ID NO: 2760719 - DNA, 19 bp, Homo sapiens
aacagcagactcagctctg

SEQ ID NO: 2760720 - DNA, 22 bp, Homo sapiens
aacagcctgtttgggaggctgg

SEQ ID NO: 2760721 - DNA, 10 bp, Homo sapiens
aacattccat

SEQ ID NO: 2760722 - DNA, 13 bp, Homo sapiens
aacattccatcct

SEQ ID NO: 2760723 - DNA, 23 bp, Homo sapiens
aactcattagactggaacttgaa

SEQ ID NO: 2760724 - DNA, 22 bp, Homo sapiens
aactccagccacccagccagga

SEQ ID NO: 2760725 - DNA, 14 bp, Homo sapiens
aactgaactctgac

SEQ ID NO: 2760726 - DNA, 23 bp, Homo sapiens
aactgaactctgacaacagactt

SEQ ID NO: 2760727 - DNA, 18 bp, Homo sapiens
aactgggccagcagagca

SEQ ID NO: 2760728 - DNA, 13 bp, Homo sapiens
aacttgttttctg

SEQ ID NO: 2760729 - DNA, 23 bp, Homo sapiens
aagaccccttaccactgctctga

SEQ ID NO: 2760730 - DNA, 12 bp, Homo sapiens
aagactcagggg

SEQ ID NO: 2760731 - DNA, 16 bp, Homo sapiens
aagatgagaagccaaa

SEQ ID NO: 2760732 - DNA, 17 bp, Homo sapiens
aagatgagaagccaaag

SEQ ID NO: 2760733 - DNA, 17 bp, Homo sapiens
aagattcaatcccagga

SEQ ID NO: 2760734 - DNA, 12 bp, Homo sapiens
aagcaaatgtct

SEQ ID NO: 2760735 - DNA, 23 bp, Homo sapiens
aagccagattttttaaaatttat

SEQ ID NO: 2760736 - DNA, 14 bp, Homo sapiens
aagccagcttcctg

SEQ ID NO: 2760737 - DNA, 19 bp, Homo sapiens
aagccagcttcctgtgcag

SEQ ID NO: 2760738 - DNA, 20 bp, Homo sapiens
aagctagaggaataaagctg

SEQ ID NO: 2760739 - DNA, 13 bp, Homo sapiens
aaggacagcccct

SEQ ID NO: 2760740 - DNA, 23 bp, Homo sapiens
aagggggctattccctggagacc

SEQ ID NO: 2760741 - DNA, 12 bp, Homo sapiens
aagtctcttcct

SEQ ID NO: 2760742 - DNA, 16 bp, Homo sapiens
aagtgaatttgcctgt

SEQ ID NO: 2760743 - DNA, 17 bp, Homo sapiens
aagtgaatttgcctgta

SEQ ID NO: 2760744 - DNA, 19 bp, Homo sapiens
aagtgactttggctgcatg

SEQ ID NO: 2760745 - DNA, 22 bp, Homo sapiens
aagtgatttgggggtgcaatga

SEQ ID NO: 2760746 - DNA, 12 bp, Homo sapiens
aagttaatttaa

SEQ ID NO: 2760747 - DNA, 15 bp, Homo sapiens
aagttaatttaaagt

SEQ ID NO: 2760748 - DNA, 17 bp, Homo sapiens
agcatttgtttctactt

SEQ ID NO: 2760749 - DNA, 16 bp, Homo sapiens
agccacagaaatgtgt

SEQ ID NO: 2760750 - DNA, 13 bp, Homo sapiens
agccacccagcca

SEQ ID NO: 2760751 - DNA, 15 bp, Homo sapiens
agccacccagccagg

SEQ ID NO: 2760752 - DNA, 18 bp, Homo sapiens
agccagattttttaaaat

SEQ ID NO: 2760753 - DNA, 23 bp, Homo sapiens
agccagattttttaaaatttata

SEQ ID NO: 2760754 - DNA, 23 bp, Homo sapiens
agccagcttcctgtgcagaaggt

SEQ ID NO: 2760755 - DNA, 20 bp, Homo sapiens
agccaggagcctcctgaccc

SEQ ID NO: 2760756 - DNA, 17 bp, Homo sapiens
agccatcaagagactga

SEQ ID NO: 2760757 - DNA, 17 bp, Homo sapiens
agcccattcattccatt

SEQ ID NO: 2760758 - DNA, 11 bp, Homo sapiens
agccccacctt

SEQ ID NO: 2760759 - DNA, 17 bp, Homo sapiens
agccccagtgacagcta

SEQ ID NO: 2760760 - DNA, 22 bp, Homo sapiens
agccgtggccgagggcttccct

SEQ ID NO: 2760761 - DNA, 12 bp, Homo sapiens
agcctcctgacc

SEQ ID NO: 2760762 - DNA, 12 bp, Homo sapiens
agcctgccctcc

SEQ ID NO: 2760763 - DNA, 13 bp, Homo sapiens
agcctggagccgt

SEQ ID NO: 2760764 - DNA, 16 bp, Homo sapiens
agcctggttccctctt

SEQ ID NO: 2760765 - DNA, 20 bp, Homo sapiens
agcctggttccctctttcct

SEQ ID NO: 2760766 - DNA, 21 bp, Homo sapiens
agcctggttccctctttcctg

SEQ ID NO: 2760767 - DNA, 20 bp, Homo sapiens
agcctgtttgggaggctgga

SEQ ID NO: 2760768 - DNA, 13 bp, Homo sapiens
agcgcacttccca

SEQ ID NO: 2760769 - DNA, 20 bp, Homo sapiens
agctctgacattctgattcg

SEQ ID NO: 2760770 - DNA, 13 bp, Homo sapiens
agctgatcagttt

SEQ ID NO: 2760771 - DNA, 12 bp, Homo sapiens
agctgctcccca

SEQ ID NO: 2760772 - DNA, 12 bp, Homo sapiens
agctgtgagcaa

SEQ ID NO: 2760773 - DNA, 14 bp, Homo sapiens
agcttcctgtgcag

SEQ ID NO: 2760774 - DNA, 15 bp, Homo sapiens
agcttcctgtgcaga

SEQ ID NO: 2760775 - DNA, 21 bp, Homo sapiens
aggaaaattttagcgtgctca

SEQ ID NO: 2760776 - DNA, 23 bp, Homo sapiens
aggaaatgtggtagcctcacttt

SEQ ID NO: 2760777 - DNA, 14 bp, Homo sapiens
aggactctctttct

SEQ ID NO: 2760778 - DNA, 14 bp, Homo sapiens
aggagcctcctgac

SEQ ID NO: 2760779 - DNA, 21 bp, Homo sapiens
aggagggagcatcagtgccct

SEQ ID NO: 2760780 - DNA, 16 bp, Homo sapiens
aggagtccactgcctc

SEQ ID NO: 2760781 - DNA, 21 bp, Homo sapiens
aggagtccactgcctccatga

SEQ ID NO: 2760782 - DNA, 13 bp, Homo sapiens
aggagttgctcct

SEQ ID NO: 2760783 - DNA, 23 bp, Homo sapiens
aggatgctttcctgttcatgggg

SEQ ID NO: 2760784 - DNA, 14 bp, Homo sapiens
aggatgtggcacaa

SEQ ID NO: 2760785 - DNA, 20 bp, Homo sapiens
aggcatgcgaatgagctggg

SEQ ID NO: 2760786 - DNA, 19 bp, Homo sapiens
aggcatggcccagcctgga

SEQ ID NO: 2760787 - DNA, 21 bp, Homo sapiens
aggcatggcccagcctggagc

SEQ ID NO: 2760788 - DNA, 20 bp, Homo sapiens
aggccacctccaaggactct

SEQ ID NO: 2760789 - DNA, 20 bp, Homo sapiens
aggccattccccgtctctgg

SEQ ID NO: 2760790 - DNA, 20 bp, Homo sapiens
agggatggggagcagctggg

SEQ ID NO: 2760791 - DNA, 13 bp, Homo sapiens
agggcctggcctg

SEQ ID NO: 2760792 - DNA, 15 bp, Homo sapiens
agggcctggcctggt

SEQ ID NO: 2760793 - DNA, 18 bp, Homo sapiens
agggctccagggccaggg

SEQ ID NO: 2760794 - DNA, 16 bp, Homo sapiens
agggcttctcctctgc

SEQ ID NO: 2760795 - DNA, 23 bp, Homo sapiens
aggggaagtctcttcctgcctcc

SEQ ID NO: 2760796 - DNA, 15 bp, Homo sapiens
aggggcctgcgcagg

SEQ ID NO: 2760797 - DNA, 14 bp, Homo sapiens
aggggcctggcctg

SEQ ID NO: 2760798 - DNA, 18 bp, Homo sapiens
agggggctattccctgga

SEQ ID NO: 2760799 - DNA, 14 bp, Homo sapiens
agggtaccagcaga

SEQ ID NO: 2760800 - DNA, 21 bp, Homo sapiens
aggtagaatgtaaagcttgtc

SEQ ID NO: 2760801 - DNA, 16 bp, Homo sapiens
aggtcctttccttctc

SEQ ID NO: 2760802 - DNA, 19 bp, Homo sapiens
aggtgccgccagctgccgc

SEQ ID NO: 2760803 - DNA, 20 bp, Homo sapiens
agtacacagcaccagaatgt

SEQ ID NO: 2760804 - DNA, 12 bp, Homo sapiens
agtcagaacagc

SEQ ID NO: 2760805 - DNA, 14 bp, Homo sapiens
agtcagaacagcag

SEQ ID NO: 2760806 - DNA, 20 bp, Homo sapiens
agtctcactgtctgctggca

SEQ ID NO: 2760807 - DNA, 16 bp, Homo sapiens
agtctcttcctgcctc

SEQ ID NO: 2760808 - DNA, 12 bp, Homo sapiens
agtgacagctag

SEQ ID NO: 2760809 - DNA, 20 bp, Homo sapiens
agtgacagctaggatgtgca

SEQ ID NO: 2760810 - DNA, 18 bp, Homo sapiens
agtgactctatatagctg

SEQ ID NO: 2760811 - DNA, 18 bp, Homo sapiens
agtgactttggctgcatg

SEQ ID NO: 2760812 - DNA, 14 bp, Homo sapiens
agtgtaattgagaa

SEQ ID NO: 2760813 - DNA, 22 bp, Homo sapiens
agtgtgaccaaaagttacatgt

SEQ ID NO: 2760814 - DNA, 13 bp, Homo sapiens
agttaagcctttg

SEQ ID NO: 2760815 - DNA, 15 bp, Homo sapiens
agttacatgtttgca

SEQ ID NO: 2760816 - DNA, 15 bp, Homo sapiens
agttatctaagttaa

SEQ ID NO: 2760817 - DNA, 13 bp, Homo sapiens
agttccgtctcct

SEQ ID NO: 2760818 - DNA, 14 bp, Homo sapiens
agttccgtctcctc

SEQ ID NO: 2760819 - DNA, 14 bp, Homo sapiens
agttctcatccaca

SEQ ID NO: 2760820 - DNA, 23 bp, Homo sapiens
agttctcatccacagaggccagg

SEQ ID NO: 2760821 - DNA, 18 bp, Homo sapiens
agttgaaaataaagtgta

SEQ ID NO: 2760822 - DNA, 19 bp, Homo sapiens
agttgaaaataaagtgtat

SEQ ID NO: 2760823 - DNA, 19 bp, Homo sapiens
agttgttccttaagtcaga

SEQ ID NO: 2760824 - DNA, 22 bp, Homo sapiens
ataattatttttatctgaagct

SEQ ID NO: 2760825 - DNA, 17 bp, Homo sapiens
atacttgccttctgata

SEQ ID NO: 2760826 - DNA, 14 bp, Homo sapiens
atagctgatcagtt

SEQ ID NO: 2760827 - DNA, 17 bp, Homo sapiens
atatagctgatcagttt

SEQ ID NO: 2760828 - DNA, 17 bp, Homo sapiens
atatccctatgtcccag

SEQ ID NO: 2760829 - DNA, 21 bp, Homo sapiens
atatgactgtttttcggacag

SEQ ID NO: 2760830 - DNA, 14 bp, Homo sapiens
atatgtacagttat

SEQ ID NO: 2760831 - DNA, 13 bp, Homo sapiens
atattttcttcct

SEQ ID NO: 2760832 - DNA, 19 bp, Homo sapiens
atcaaccccagacactggt

SEQ ID NO: 2760833 - DNA, 19 bp, Homo sapiens
atcacttgtcctcttgcca

SEQ ID NO: 2760834 - DNA, 22 bp, Homo sapiens
atcacttgtcctcttgccagct

SEQ ID NO: 2760835 - DNA, 16 bp, Homo sapiens
atcagaaacaccctca

SEQ ID NO: 2760836 - DNA, 18 bp, Homo sapiens
atccacagaggccaggca

SEQ ID NO: 2760837 - DNA, 16 bp, Homo sapiens
atccaggtcctttcct

SEQ ID NO: 2760838 - DNA, 18 bp, Homo sapiens
atccaggtcctttccttc

SEQ ID NO: 2760839 - DNA, 19 bp, Homo sapiens
atccaggtcctttccttct

SEQ ID NO: 2760840 - DNA, 17 bp, Homo sapiens
atcccaggatgtacaag

SEQ ID NO: 2760841 - DNA, 16 bp, Homo sapiens
atcctgcaatttctcc

SEQ ID NO: 2760842 - DNA, 23 bp, Homo sapiens
atcctggagtctcactgtctgct

SEQ ID NO: 2760843 - DNA, 19 bp, Homo sapiens
atcctgtcgattagactgg

SEQ ID NO: 2760844 - DNA, 18 bp, Homo sapiens
atctaagttaatttaaag

SEQ ID NO: 2760845 - DNA, 16 bp, Homo sapiens
atctcaattcttccct

SEQ ID NO: 2760846 - DNA, 23 bp, Homo sapiens
atctcatttttccgtaaaaatga

SEQ ID NO: 2760847 - DNA, 15 bp, Homo sapiens
atctgggccagaatt

SEQ ID NO: 2760848 - DNA, 19 bp, Homo sapiens
aagttacatgtttgcacct

SEQ ID NO: 2760849 - DNA, 16 bp, Homo sapiens
aagttatttaaatctg

SEQ ID NO: 2760850 - DNA, 12 bp, Homo sapiens
aataaagtgtat

SEQ ID NO: 2760851 - DNA, 18 bp, Homo sapiens
aatagacccacaagaggc

SEQ ID NO: 2760852 - DNA, 21 bp, Homo sapiens
aatattagtgacctcagcttt

SEQ ID NO: 2760853 - DNA, 9 bp, Homo sapiens
aatattgtg

SEQ ID NO: 2760854 - DNA, 16 bp, Homo sapiens
aatcagagtggccaat

SEQ ID NO: 2760855 - DNA, 23 bp, Homo sapiens
aatcagagtggccaatccctgtg

SEQ ID NO: 2760856 - DNA, 20 bp, Homo sapiens
aatcctggagtctcactgtc

SEQ ID NO: 2760857 - DNA, 19 bp, Homo sapiens
aatcctgtcgattagactg

SEQ ID NO: 2760858 - DNA, 17 bp, Homo sapiens
aatctgggccagaattt

SEQ ID NO: 2760859 - DNA, 22 bp, Homo sapiens
aatgacagtccgtcaaaacaga

SEQ ID NO: 2760860 - DNA, 11 bp, Homo sapiens
aatgatttcag

SEQ ID NO: 2760861 - DNA, 18 bp, Homo sapiens
aatgccactctgggcagt

SEQ ID NO: 2760862 - DNA, 13 bp, Homo sapiens
aatgccctcagct

SEQ ID NO: 2760863 - DNA, 11 bp, Homo sapiens
aattcttccct

SEQ ID NO: 2760864 - DNA, 15 bp, Homo sapiens
aattgagaaggaaaa

SEQ ID NO: 2760865 - DNA, 22 bp, Homo sapiens
aatttaaagttgtttgtgcctt

SEQ ID NO: 2760866 - DNA, 16 bp, Homo sapiens
aatttatattgtaaat

SEQ ID NO: 2760867 - DNA, 22 bp, Homo sapiens
aatttgcctgtaacaagccaga

SEQ ID NO: 2760868 - DNA, 12 bp, Homo sapiens
acaactccagcc

SEQ ID NO: 2760869 - DNA, 13 bp, Homo sapiens
acaactccagcca

SEQ ID NO: 2760870 - DNA, 22 bp, Homo sapiens
acaactccagccacccagccag

SEQ ID NO: 2760871 - DNA, 21 bp, Homo sapiens
acaaggacagcccctcctcca

SEQ ID NO: 2760872 - DNA, 14 bp, Homo sapiens
acaattctgcagaa

SEQ ID NO: 2760873 - DNA, 21 bp, Homo sapiens
acaccataggtagaatgtaaa

SEQ ID NO: 2760874 - DNA, 21 bp, Homo sapiens
acaccttagcctgccctcctt

SEQ ID NO: 2760875 - DNA, 14 bp, Homo sapiens
acacgctccttcct

SEQ ID NO: 2760876 - DNA, 13 bp, Homo sapiens
acagacttctgaa

SEQ ID NO: 2760877 - DNA, 15 bp, Homo sapiens
acagaggccaggcat

SEQ ID NO: 2760878 - DNA, 18 bp, Homo sapiens
acagcagactcagctctg

SEQ ID NO: 2760879 - DNA, 21 bp, Homo sapiens
acagcctgtttgggaggctgg

SEQ ID NO: 2760880 - DNA, 21 bp, Homo sapiens
acagggcctttggcaggtgca

SEQ ID NO: 2760881 - DNA, 22 bp, Homo sapiens
acaggtgccgccagctgccgca

SEQ ID NO: 2760882 - DNA, 19 bp, Homo sapiens
acagtaaatacactgtgaa

SEQ ID NO: 2760883 - DNA, 20 bp, Homo sapiens
acagtaaatacactgtgaag

SEQ ID NO: 2760884 - DNA, 12 bp, Homo sapiens
acagtgccaccc

SEQ ID NO: 2760885 - DNA, 14 bp, Homo sapiens
acatgtgccctcag

SEQ ID NO: 2760886 - DNA, 13 bp, Homo sapiens
acattaactcatt

SEQ ID NO: 2760887 - DNA, 12 bp, Homo sapiens
acattccctctc

SEQ ID NO: 2760888 - DNA, 23 bp, Homo sapiens
acattctgattcgaatgacactg

SEQ ID NO: 2760889 - DNA, 11 bp, Homo sapiens
acattgtgcca

SEQ ID NO: 2760890 - DNA, 21 bp, Homo sapiens
accaaaagttacatgtttgca

SEQ ID NO: 2760891 - DNA, 14 bp, Homo sapiens
accacactccagct

SEQ ID NO: 2760892 - DNA, 23 bp, Homo sapiens
accactgctctgatgaagaggag

SEQ ID NO: 2760893 - DNA, 12 bp, Homo sapiens
accagggctctg

SEQ ID NO: 2760894 - DNA, 13 bp, Homo sapiens
accagggctctgt

SEQ ID NO: 2760895 - DNA, 17 bp, Homo sapiens
acccatgcagctgctcc

SEQ ID NO: 2760896 - DNA, 18 bp, Homo sapiens
acccatgcagctgctccc

SEQ ID NO: 2760897 - DNA, 14 bp, Homo sapiens
accccagacactgg

SEQ ID NO: 2760898 - DNA, 18 bp, Homo sapiens
accccgctgatggagccc

SEQ ID NO: 2760899 - DNA, 18 bp, Homo sapiens
acccctgtcctggggctg

SEQ ID NO: 2760900 - DNA, 20 bp, Homo sapiens
accctcatgctgtgtgactc

SEQ ID NO: 2760901 - DNA, 21 bp, Homo sapiens
accctccccacagtgccaccc

SEQ ID NO: 2760902 - DNA, 18 bp, Homo sapiens
accctggcacccagggtg

SEQ ID NO: 2760903 - DNA, 23 bp, Homo sapiens
acctgcctcccttcatgcatgga

SEQ ID NO: 2760904 - DNA, 14 bp, Homo sapiens
accttagcctgccc

SEQ ID NO: 2760905 - DNA, 12 bp, Homo sapiens
accttgtctgct

SEQ ID NO: 2760906 - DNA, 22 bp, Homo sapiens
accttgtctgctaaataaacat

SEQ ID NO: 2760907 - DNA, 17 bp, Homo sapiens
accttgttgatgccagc

SEQ ID NO: 2760908 - DNA, 11 bp, Homo sapiens
acctttctagt

SEQ ID NO: 2760909 - DNA, 15 bp, Homo sapiens
acgctccttcctctg

SEQ ID NO: 2760910 - DNA, 17 bp, Homo sapiens
actactagatcacttgt

SEQ ID NO: 2760911 - DNA, 15 bp, Homo sapiens
actcattagactgga

SEQ ID NO: 2760912 - DNA, 14 bp, Homo sapiens
actcccccagccct

SEQ ID NO: 2760913 - DNA, 16 bp, Homo sapiens
actcccccagccctca

SEQ ID NO: 2760914 - DNA, 16 bp, Homo sapiens
actctctttcttccac

SEQ ID NO: 2760915 - DNA, 18 bp, Homo sapiens
actctctttcttccacta

SEQ ID NO: 2760916 - DNA, 18 bp, Homo sapiens
actctgacaacagacttc

SEQ ID NO: 2760917 - DNA, 20 bp, Homo sapiens
actctgacaacagacttctg

SEQ ID NO: 2760918 - DNA, 22 bp, Homo sapiens
actctgacaacagacttctgaa

SEQ ID NO: 2760919 - DNA, 21 bp, Homo sapiens
actgaaccttgttgatgccag

SEQ ID NO: 2760920 - DNA, 16 bp, Homo sapiens
actgagtgccttttgg

SEQ ID NO: 2760921 - DNA, 13 bp, Homo sapiens
actgcctttgacc

SEQ ID NO: 2760922 - DNA, 15 bp, Homo sapiens
actgggccagcagag

SEQ ID NO: 2760923 - DNA, 17 bp, Homo sapiens
actgggccggcagcctg

SEQ ID NO: 2760924 - DNA, 23 bp, Homo sapiens
actggtcccacttcacagctgga

SEQ ID NO: 2760925 - DNA, 16 bp, Homo sapiens
acttcacagctggaga

SEQ ID NO: 2760926 - DNA, 12 bp, Homo sapiens
acttgacagtgg

SEQ ID NO: 2760927 - DNA, 23 bp, Homo sapiens
acttttatttccagtgaaatcag

SEQ ID NO: 2760928 - DNA, 13 bp, Homo sapiens
acttttttctcta

SEQ ID NO: 2760929 - DNA, 16 bp, Homo sapiens
agaaaggttagtatca

SEQ ID NO: 2760930 - DNA, 22 bp, Homo sapiens
agaaatagggcatggcttgccc

SEQ ID NO: 2760931 - DNA, 13 bp, Homo sapiens
agaataaatgggt

SEQ ID NO: 2760932 - DNA, 12 bp, Homo sapiens
agaatgtaaagc

SEQ ID NO: 2760933 - DNA, 16 bp, Homo sapiens
agaatgtaaagcttgt

SEQ ID NO: 2760934 - DNA, 21 bp, Homo sapiens
agacaccggagtatgtgcagt

SEQ ID NO: 2760935 - DNA, 12 bp, Homo sapiens
agacactggttt

SEQ ID NO: 2760936 - DNA, 14 bp, Homo sapiens
agactggacagctt

SEQ ID NO: 2760937 - DNA, 15 bp, Homo sapiens
agactggacagcttg

SEQ ID NO: 2760938 - DNA, 17 bp, Homo sapiens
agagactttattgccta

SEQ ID NO: 2760939 - DNA, 16 bp, Homo sapiens
agagcatgttggacac

SEQ ID NO: 2760940 - DNA, 22 bp, Homo sapiens
agagtgagagacattaactcat

SEQ ID NO: 2760941 - DNA, 11 bp, Homo sapiens
agagtgtgacc

SEQ ID NO: 2760942 - DNA, 12 bp, Homo sapiens
agatagaatgac

SEQ ID NO: 2760943 - DNA, 15 bp, Homo sapiens
agatagaatgacagt

SEQ ID NO: 2760944 - DNA, 12 bp, Homo sapiens
agattgtttgca

SEQ ID NO: 2760945 - DNA, 24 bp, Homo sapiens
agcaagagatgagaaacaacagaa

SEQ ID NO: 2760946 - DNA, 17 bp, Homo sapiens
agcacaagttatttaaa

SEQ ID NO: 2760947 - DNA, 21 bp, Homo sapiens
agcacaagttatttaaatctg

SEQ ID NO: 2760948 - DNA, 20 bp, Homo sapiens
agcagactcagctctgacat

SEQ ID NO: 2760949 - DNA, 15 bp, Homo sapiens
ctacccctgtcctgg

SEQ ID NO: 2760950 - DNA, 16 bp, Homo sapiens
ctacccctgtcctggg

SEQ ID NO: 2760951 - DNA, 13 bp, Homo sapiens
ctaccctccctcg

SEQ ID NO: 2760952 - DNA, 19 bp, Homo sapiens
ctagaggaataaagctgtg

SEQ ID NO: 2760953 - DNA, 18 bp, Homo sapiens
ctagatcacttgtcctct

SEQ ID NO: 2760954 - DNA, 12 bp, Homo sapiens
ctagatggttcc

SEQ ID NO: 2760955 - DNA, 22 bp, Homo sapiens
ctaggatgtgcattctccagcc

SEQ ID NO: 2760956 - DNA, 13 bp, Homo sapiens
ctatagaggagga

SEQ ID NO: 2760957 - DNA, 17 bp, Homo sapiens
ctatcaaccccagacac

SEQ ID NO: 2760958 - DNA, 16 bp, Homo sapiens
ctatcaggagtccact

SEQ ID NO: 2760959 - DNA, 20 bp, Homo sapiens
ctatcctgcaatttctcccg

SEQ ID NO: 2760960 - DNA, 20 bp, Homo sapiens
ctatgtcccagcccctggta

SEQ ID NO: 2760961 - DNA, 19 bp, Homo sapiens
ctattcagaataaatgggt

SEQ ID NO: 2760962 - DNA, 14 bp, Homo sapiens
ctattccctggaga

SEQ ID NO: 2760963 - DNA, 18 bp, Homo sapiens
ctcaaaccaaatcactga

SEQ ID NO: 2760964 - DNA, 18 bp, Homo sapiens
ctcaagttagcatttcaa

SEQ ID NO: 2760965 - DNA, 17 bp, Homo sapiens
ctcacctacttcctcct

SEQ ID NO: 2760966 - DNA, 20 bp, Homo sapiens
ctcactaggcttctggttga

SEQ ID NO: 2760967 - DNA, 21 bp, Homo sapiens
ctcacttttaatgaacaaatg

SEQ ID NO: 2760968 - DNA, 15 bp, Homo sapiens
ctcagggcttctcct

SEQ ID NO: 2760969 - DNA, 20 bp, Homo sapiens
ctcagggcttctcctctgct

SEQ ID NO: 2760970 - DNA, 24 bp, Homo sapiens
ctcagggcttctcctctgctaggc

SEQ ID NO: 2760971 - DNA, 22 bp, Homo sapiens
ctcaggggatcggctgggaact

SEQ ID NO: 2760972 - DNA, 13 bp, Homo sapiens
ctcatccacagag

SEQ ID NO: 2760973 - DNA, 17 bp, Homo sapiens
ctcatccacagaggcca

SEQ ID NO: 2760974 - DNA, 22 bp, Homo sapiens
ctcatccaggtcctttccttct

SEQ ID NO: 2760975 - DNA, 12 bp, Homo sapiens
ctcattagactg

SEQ ID NO: 2760976 - DNA, 13 bp, Homo sapiens
ctcattagactgg

SEQ ID NO: 2760977 - DNA, 22 bp, Homo sapiens
ctccaaagaaatagggcatggc

SEQ ID NO: 2760978 - DNA, 20 bp, Homo sapiens
ctccagccacccagccagga

SEQ ID NO: 2760979 - DNA, 23 bp, Homo sapiens
ctccagccatcaagagactgagt

SEQ ID NO: 2760980 - DNA, 17 bp, Homo sapiens
ctccccacagtgccacc

SEQ ID NO: 2760981 - DNA, 13 bp, Homo sapiens
ctcccccagccct

SEQ ID NO: 2760982 - DNA, 13 bp, Homo sapiens
ctcccgaatcctg

SEQ ID NO: 2760983 - DNA, 14 bp, Homo sapiens
ctcccgaatcctga

SEQ ID NO: 2760984 - DNA, 15 bp, Homo sapiens
ctcctacccctgtcc

SEQ ID NO: 2760985 - DNA, 14 bp, Homo sapiens
ctcctcctcctcct

SEQ ID NO: 2760986 - DNA, 14 bp, Homo sapiens
ctcctcctggactc

SEQ ID NO: 2760987 - DNA, 12 bp, Homo sapiens
ctcctctgctag

SEQ ID NO: 2760988 - DNA, 13 bp, Homo sapiens
ctcctctgctagg

SEQ ID NO: 2760989 - DNA, 11 bp, Homo sapiens
ctcctggactc

SEQ ID NO: 2760990 - DNA, 15 bp, Homo sapiens
ctcctggactcctgc

SEQ ID NO: 2760991 - DNA, 19 bp, Homo sapiens
ctcctgttcctgccttctc

SEQ ID NO: 2760992 - DNA, 18 bp, Homo sapiens
ctcgcatccgcctctgag

SEQ ID NO: 2760993 - DNA, 13 bp, Homo sapiens
ctctagaaggctg

SEQ ID NO: 2760994 - DNA, 19 bp, Homo sapiens
ctctcacctacttcctcct

SEQ ID NO: 2760995 - DNA, 20 bp, Homo sapiens
ctctcatccaggtcctttcc

SEQ ID NO: 2760996 - DNA, 19 bp, Homo sapiens
ctctctcacctacttcctc

SEQ ID NO: 2760997 - DNA, 16 bp, Homo sapiens
ctctgacaacagactt

SEQ ID NO: 2760998 - DNA, 22 bp, Homo sapiens
ctctgacaacagacttctgaaa

SEQ ID NO: 2760999 - DNA, 21 bp, Homo sapiens
ctctgagccaggagcctcctg

SEQ ID NO: 2761000 - DNA, 23 bp, Homo sapiens
ctctgagccaggagcctcctgac

SEQ ID NO: 2761001 - DNA, 15 bp, Homo sapiens
ctcttctatcctgca

SEQ ID NO: 2761002 - DNA, 13 bp, Homo sapiens
ctctttcctgtgc

SEQ ID NO: 2761003 - DNA, 20 bp, Homo sapiens
ctctttcctgtgccaggact

SEQ ID NO: 2761004 - DNA, 20 bp, Homo sapiens
ctctttcttccactaccctc

SEQ ID NO: 2761005 - DNA, 22 bp, Homo sapiens
ctgaaatattttcttccttctc

SEQ ID NO: 2761006 - DNA, 17 bp, Homo sapiens
ctgaactctgacaacag

SEQ ID NO: 2761007 - DNA, 12 bp, Homo sapiens
ctgaactttgct

SEQ ID NO: 2761008 - DNA, 21 bp, Homo sapiens
ctgaactttgctgagcctgta

SEQ ID NO: 2761009 - DNA, 14 bp, Homo sapiens
ctgaagctagagga

SEQ ID NO: 2761010 - DNA, 15 bp, Homo sapiens
ctgaagctagaggaa

SEQ ID NO: 2761011 - DNA, 19 bp, Homo sapiens
ctgacaacagacttctgaa

SEQ ID NO: 2761012 - DNA, 18 bp, Homo sapiens
ctgacacaggggacactg

SEQ ID NO: 2761013 - DNA, 18 bp, Homo sapiens
ctgaccctgtgatgcctg

SEQ ID NO: 2761014 - DNA, 16 bp, Homo sapiens
ctgagccaggagcctc

SEQ ID NO: 2761015 - DNA, 20 bp, Homo sapiens
ctgagccaggagcctcctga

SEQ ID NO: 2761016 - DNA, 21 bp, Homo sapiens
ctgagccaggagcctcctgac

SEQ ID NO: 2761017 - DNA, 22 bp, Homo sapiens
ctgagtaccatgggctacagtg

SEQ ID NO: 2761018 - DNA, 15 bp, Homo sapiens
ctgagtcaagttgtt

SEQ ID NO: 2761019 - DNA, 21 bp, Homo sapiens
ctgagtgactctatatagctg

SEQ ID NO: 2761020 - DNA, 15 bp, Homo sapiens
ctgagttctcatcca

SEQ ID NO: 2761021 - DNA, 21 bp, Homo sapiens
ctgagttctcatccacagagg

SEQ ID NO: 2761022 - DNA, 22 bp, Homo sapiens
ctgagttctcatccacagaggc

SEQ ID NO: 2761023 - DNA, 13 bp, Homo sapiens
ctgatacagcctt

SEQ ID NO: 2761024 - DNA, 12 bp, Homo sapiens
ctgatggagccc

SEQ ID NO: 2761025 - DNA, 15 bp, Homo sapiens
ctgcaacagcctgtt

SEQ ID NO: 2761026 - DNA, 17 bp, Homo sapiens
ctgcctcatgctctcta

SEQ ID NO: 2761027 - DNA, 17 bp, Homo sapiens
ctgcctcccaagcagct

SEQ ID NO: 2761028 - DNA, 23 bp, Homo sapiens
ctgcctcccaagcagctgaaggg

SEQ ID NO: 2761029 - DNA, 23 bp, Homo sapiens
ctgcctcccttcatgcatggaaa

SEQ ID NO: 2761030 - DNA, 13 bp, Homo sapiens
ctgccttctcttc

SEQ ID NO: 2761031 - DNA, 16 bp, Homo sapiens
ctgccttctcttctat

SEQ ID NO: 2761032 - DNA, 18 bp, Homo sapiens
ctgctaggctaccctcct

SEQ ID NO: 2761033 - DNA, 14 bp, Homo sapiens
ctgctatttgaagt

SEQ ID NO: 2761034 - DNA, 21 bp, Homo sapiens
ctgctcacattccctctcatc

SEQ ID NO: 2761035 - DNA, 18 bp, Homo sapiens
ctgctccccaggccaccc

SEQ ID NO: 2761036 - DNA, 12 bp, Homo sapiens
ctgctctgatga

SEQ ID NO: 2761037 - DNA, 14 bp, Homo sapiens
ctgctgtccctcct

SEQ ID NO: 2761038 - DNA, 15 bp, Homo sapiens
ctgctgtccctcctg

SEQ ID NO: 2761039 - DNA, 17 bp, Homo sapiens
ctgctgtccctcctgag

SEQ ID NO: 2761040 - DNA, 19 bp, Homo sapiens
ctggaaaggatgcttctgc

SEQ ID NO: 2761041 - DNA, 23 bp, Homo sapiens
ctggaaaggatgcttctgctcac

SEQ ID NO: 2761042 - DNA, 20 bp, Homo sapiens
ctggaacttgaactgattca

SEQ ID NO: 2761043 - DNA, 17 bp, Homo sapiens
ctggagcctcagcagca

SEQ ID NO: 2761044 - DNA, 22 bp, Homo sapiens
ctggagcctcagcagcaaatgc

SEQ ID NO: 2761045 - DNA, 14 bp, Homo sapiens
ctggagtctcactg

SEQ ID NO: 2761046 - DNA, 20 bp, Homo sapiens
ctggcatccaaatggctgct

SEQ ID NO: 2761047 - DNA, 20 bp, Homo sapiens
ctggcctgggtggggcaggg

SEQ ID NO: 2761048 - DNA, 22 bp, Homo sapiens
ctggcctgggtggggcagggcc

SEQ ID NO: 2761049 - DNA, 15 bp, Homo sapiens
ccccacagtgccacc

SEQ ID NO: 2761050 - DNA, 13 bp, Homo sapiens
ccccagacactgg

SEQ ID NO: 2761051 - DNA, 13 bp, Homo sapiens
ccccaggccaccc

SEQ ID NO: 2761052 - DNA, 18 bp, Homo sapiens
cccctcctcctggactcc

SEQ ID NO: 2761053 - DNA, 23 bp, Homo sapiens
cccctggtactcccccagccctc

SEQ ID NO: 2761054 - DNA, 22 bp, Homo sapiens
cccgtctctggttcctcccctc

SEQ ID NO: 2761055 - DNA, 19 bp, Homo sapiens
ccctagatggttccctttg

SEQ ID NO: 2761056 - DNA, 21 bp, Homo sapiens
ccctatctttgccaccctcat

SEQ ID NO: 2761057 - DNA, 10 bp, Homo sapiens
ccctcacact

SEQ ID NO: 2761058 - DNA, 14 bp, Homo sapiens
ccctcacactggga

SEQ ID NO: 2761059 - DNA, 19 bp, Homo sapiens
ccctccccacagtgccacc

SEQ ID NO: 2761060 - DNA, 16 bp, Homo sapiens
ccctcctcctggactc

SEQ ID NO: 2761061 - DNA, 21 bp, Homo sapiens
ccctcctctagaaggctgagt

SEQ ID NO: 2761062 - DNA, 21 bp, Homo sapiens
ccctcgcatccgcctctgagc

SEQ ID NO: 2761063 - DNA, 21 bp, Homo sapiens
ccctctcatccaggtcctttc

SEQ ID NO: 2761064 - DNA, 13 bp, Homo sapiens
ccctctttcctgt

SEQ ID NO: 2761065 - DNA, 17 bp, Homo sapiens
ccctctttcctgtgcca

SEQ ID NO: 2761066 - DNA, 18 bp, Homo sapiens
ccctctttcctgtgccag

SEQ ID NO: 2761067 - DNA, 19 bp, Homo sapiens
ccctgtgtgtcgttccctt

SEQ ID NO: 2761068 - DNA, 17 bp, Homo sapiens
cccttaccactgctctg

SEQ ID NO: 2761069 - DNA, 13 bp, Homo sapiens
cccttacctcgtg

SEQ ID NO: 2761070 - DNA, 16 bp, Homo sapiens
cccttcatctggaacc

SEQ ID NO: 2761071 - DNA, 15 bp, Homo sapiens
ccctttgttgctgtc

SEQ ID NO: 2761072 - DNA, 15 bp, Homo sapiens
ccgccagctgccgca

SEQ ID NO: 2761073 - DNA, 17 bp, Homo sapiens
ccgccagctgccgcacc

SEQ ID NO: 2761074 - DNA, 12 bp, Homo sapiens
ccgcctctgagc

SEQ ID NO: 2761075 - DNA, 13 bp, Homo sapiens
ccgcctctgagcc

SEQ ID NO: 2761076 - DNA, 17 bp, Homo sapiens
ccggagtatgtgcagtg

SEQ ID NO: 2761077 - DNA, 14 bp, Homo sapiens
ccggcagcctggtt

SEQ ID NO: 2761078 - DNA, 13 bp, Homo sapiens
ccgtctcctctcc

SEQ ID NO: 2761079 - DNA, 16 bp, Homo sapiens
ccgtctcctctccagc

SEQ ID NO: 2761080 - DNA, 15 bp, Homo sapiens
cctacccctgtcctg

SEQ ID NO: 2761081 - DNA, 17 bp, Homo sapiens
cctagtggggaggggcc

SEQ ID NO: 2761082 - DNA, 18 bp, Homo sapiens
cctagtggggaggggcct

SEQ ID NO: 2761083 - DNA, 15 bp, Homo sapiens
cctatctttgccacc

SEQ ID NO: 2761084 - DNA, 20 bp, Homo sapiens
cctatctttgccaccctcat

SEQ ID NO: 2761085 - DNA, 15 bp, Homo sapiens
cctcacactgggact

SEQ ID NO: 2761086 - DNA, 13 bp, Homo sapiens
cctcatgctctct

SEQ ID NO: 2761087 - DNA, 20 bp, Homo sapiens
cctcattccaacacctgcca

SEQ ID NO: 2761088 - DNA, 15 bp, Homo sapiens
cctccaaggactcta

SEQ ID NO: 2761089 - DNA, 15 bp, Homo sapiens
cctcccaagcagctg

SEQ ID NO: 2761090 - DNA, 13 bp, Homo sapiens
cctcctcctcctg

SEQ ID NO: 2761091 - DNA, 15 bp, Homo sapiens
cctcctcctgttcct

SEQ ID NO: 2761092 - DNA, 15 bp, Homo sapiens
cctcctctagaaggc

SEQ ID NO: 2761093 - DNA, 13 bp, Homo sapiens
cctcctggactcc

SEQ ID NO: 2761094 - DNA, 20 bp, Homo sapiens
cctctcatccaggtcctttc

SEQ ID NO: 2761095 - DNA, 22 bp, Homo sapiens
cctctcatccaggtcctttcct

SEQ ID NO: 2761096 - DNA, 13 bp, Homo sapiens
cctctgaggctga

SEQ ID NO: 2761097 - DNA, 17 bp, Homo sapiens
cctgaggggatatccct

SEQ ID NO: 2761098 - DNA, 20 bp, Homo sapiens
cctgccttctcttctatcct

SEQ ID NO: 2761099 - DNA, 15 bp, Homo sapiens
cctgctatttgaagt

SEQ ID NO: 2761100 - DNA, 19 bp, Homo sapiens
cctggagccgtggccgagg

SEQ ID NO: 2761101 - DNA, 16 bp, Homo sapiens
cctggagcctcagcag

SEQ ID NO: 2761102 - DNA, 12 bp, Homo sapiens
cctggcctgggt

SEQ ID NO: 2761103 - DNA, 13 bp, Homo sapiens
cctggcctggtcc

SEQ ID NO: 2761104 - DNA, 19 bp, Homo sapiens
cctgggtggggcagggcct

SEQ ID NO: 2761105 - DNA, 23 bp, Homo sapiens
cctgggtggggcagggcctggcc

SEQ ID NO: 2761106 - DNA, 17 bp, Homo sapiens
cctggttccctctttcc

SEQ ID NO: 2761107 - DNA, 20 bp, Homo sapiens
cctgtagccccagtgacagc

SEQ ID NO: 2761108 - DNA, 22 bp, Homo sapiens
cctgtagccccagtgacagcta

SEQ ID NO: 2761109 - DNA, 16 bp, Homo sapiens
cctgtgaactgaactc

SEQ ID NO: 2761110 - DNA, 17 bp, Homo sapiens
cctgtgaactgaactct

SEQ ID NO: 2761111 - DNA, 12 bp, Homo sapiens
cctgtgcagaag

SEQ ID NO: 2761112 - DNA, 13 bp, Homo sapiens
cctgtgcagaagg

SEQ ID NO: 2761113 - DNA, 21 bp, Homo sapiens
cctgtgccaggactctctttc

SEQ ID NO: 2761114 - DNA, 22 bp, Homo sapiens
cctgtgccaggactctctttct

SEQ ID NO: 2761115 - DNA, 20 bp, Homo sapiens
cctgtgtgtcgttcccttgt

SEQ ID NO: 2761116 - DNA, 14 bp, Homo sapiens
cctgttcctgcctt

SEQ ID NO: 2761117 - DNA, 21 bp, Homo sapiens
cctgttcctgccttctcttct

SEQ ID NO: 2761118 - DNA, 22 bp, Homo sapiens
cctgttcctgccttctcttcta

SEQ ID NO: 2761119 - DNA, 12 bp, Homo sapiens
ccttaagtcaga

SEQ ID NO: 2761120 - DNA, 18 bp, Homo sapiens
ccttcaaaatgctgcttc

SEQ ID NO: 2761121 - DNA, 13 bp, Homo sapiens
ccttcatctggaa

SEQ ID NO: 2761122 - DNA, 21 bp, Homo sapiens
ccttcatgcatggaaattccc

SEQ ID NO: 2761123 - DNA, 18 bp, Homo sapiens
ccttctcgtcttcctctc

SEQ ID NO: 2761124 - DNA, 23 bp, Homo sapiens
ccttctcgtcttcctctctctca

SEQ ID NO: 2761125 - DNA, 15 bp, Homo sapiens
ccttgtgtctgttgc

SEQ ID NO: 2761126 - DNA, 14 bp, Homo sapiens
cctttattctggca

SEQ ID NO: 2761127 - DNA, 12 bp, Homo sapiens
cctttccttctc

SEQ ID NO: 2761128 - DNA, 15 bp, Homo sapiens
cctttctagttgaaa

SEQ ID NO: 2761129 - DNA, 18 bp, Homo sapiens
cctttggcaggtgcagcc

SEQ ID NO: 2761130 - DNA, 19 bp, Homo sapiens
cctttggcaggtgcagccc

SEQ ID NO: 2761131 - DNA, 21 bp, Homo sapiens
cctttgtaaattgtcagatgc

SEQ ID NO: 2761132 - DNA, 15 bp, Homo sapiens
cctttgttgctgtct

SEQ ID NO: 2761133 - DNA, 17 bp, Homo sapiens
cctttgttgctgtctgg

SEQ ID NO: 2761134 - DNA, 13 bp, Homo sapiens
cgaatgacactgt

SEQ ID NO: 2761135 - DNA, 18 bp, Homo sapiens
cgattagactggacagct

SEQ ID NO: 2761136 - DNA, 17 bp, Homo sapiens
cgcacttcccatttgtg

SEQ ID NO: 2761137 - DNA, 18 bp, Homo sapiens
cgcaggcgggactatcag

SEQ ID NO: 2761138 - DNA, 23 bp, Homo sapiens
cgccagctgccgcaccagcccga

SEQ ID NO: 2761139 - DNA, 13 bp, Homo sapiens
cgcctctgagcca

SEQ ID NO: 2761140 - DNA, 16 bp, Homo sapiens
cgcctctgagccagga

SEQ ID NO: 2761141 - DNA, 18 bp, Homo sapiens
cgcctctgagccaggagc

SEQ ID NO: 2761142 - DNA, 21 bp, Homo sapiens
cgcctctgagccaggagcctc

SEQ ID NO: 2761143 - DNA, 13 bp, Homo sapiens
cggcagcctggtt

SEQ ID NO: 2761144 - DNA, 22 bp, Homo sapiens
cgttccttcaaagcaaatgtct

SEQ ID NO: 2761145 - DNA, 14 bp, Homo sapiens
ctaaaggactggtt

SEQ ID NO: 2761146 - DNA, 12 bp, Homo sapiens
ctaaataaacat

SEQ ID NO: 2761147 - DNA, 21 bp, Homo sapiens
ctaagttaatttaaagttgtt

SEQ ID NO: 2761148 - DNA, 16 bp, Homo sapiens
ctaatcagagtggcca

SEQ ID NO: 2761149 - DNA, 21 bp, Homo sapiens
ctacaattctgcagaaaaaga

SEQ ID NO: 2761150 - DNA, 14 bp, Homo sapiens
atctgtttttctaa

SEQ ID NO: 2761151 - DNA, 15 bp, Homo sapiens
atctttgccaccctc

SEQ ID NO: 2761152 - DNA, 15 bp, Homo sapiens
atgagaaacaacaga

SEQ ID NO: 2761153 - DNA, 16 bp, Homo sapiens
atgatgtgtgaaaact

SEQ ID NO: 2761154 - DNA, 14 bp, Homo sapiens
atgatttcagtagc

SEQ ID NO: 2761155 - DNA, 16 bp, Homo sapiens
atgcagctgctcccca

SEQ ID NO: 2761156 - DNA, 12 bp, Homo sapiens
atgcatggaaat

SEQ ID NO: 2761157 - DNA, 16 bp, Homo sapiens
atgccactctgggcag

SEQ ID NO: 2761158 - DNA, 22 bp, Homo sapiens
atgcgaatgagctgggccctgg

SEQ ID NO: 2761159 - DNA, 19 bp, Homo sapiens
atgcgagtgctcatttcag

SEQ ID NO: 2761160 - DNA, 20 bp, Homo sapiens
atgctctctatagaggagga

SEQ ID NO: 2761161 - DNA, 16 bp, Homo sapiens
atgctgcttccactca

SEQ ID NO: 2761162 - DNA, 15 bp, Homo sapiens
atgcttctgctcaca

SEQ ID NO: 2761163 - DNA, 22 bp, Homo sapiens
atgcttctgctcacattccctc

SEQ ID NO: 2761164 - DNA, 18 bp, Homo sapiens
atgctttaggatgtacag

SEQ ID NO: 2761165 - DNA, 14 bp, Homo sapiens
atggcccagcctgg

SEQ ID NO: 2761166 - DNA, 17 bp, Homo sapiens
atggcccagcctggagc

SEQ ID NO: 2761167 - DNA, 16 bp, Homo sapiens
atggggagcagctggg

SEQ ID NO: 2761168 - DNA, 15 bp, Homo sapiens
atgggtaacactgat

SEQ ID NO: 2761169 - DNA, 23 bp, Homo sapiens
atggtgggcttgtggtggctgct

SEQ ID NO: 2761170 - DNA, 16 bp, Homo sapiens
atgtaaagcttgtctg

SEQ ID NO: 2761171 - DNA, 14 bp, Homo sapiens
atgtcaaacaaata

SEQ ID NO: 2761172 - DNA, 19 bp, Homo sapiens
atgtcaaggaaaggatgca

SEQ ID NO: 2761173 - DNA, 23 bp, Homo sapiens
atgtgttcttctttctctgtatt

SEQ ID NO: 2761174 - DNA, 15 bp, Homo sapiens
atgttgaagcctttg

SEQ ID NO: 2761175 - DNA, 17 bp, Homo sapiens
atgtttgcacctttcta

SEQ ID NO: 2761176 - DNA, 21 bp, Homo sapiens
atgtttgcacctttctagttg

SEQ ID NO: 2761177 - DNA, 19 bp, Homo sapiens
attagactggacagcttgt

SEQ ID NO: 2761178 - DNA, 18 bp, Homo sapiens
attcaaaataaacaataa

SEQ ID NO: 2761179 - DNA, 16 bp, Homo sapiens
attcaaaatgatgtat

SEQ ID NO: 2761180 - DNA, 22 bp, Homo sapiens
attcaggaagcagctttcccca

SEQ ID NO: 2761181 - DNA, 17 bp, Homo sapiens
attcattccattctgga

SEQ ID NO: 2761182 - DNA, 18 bp, Homo sapiens
attcattccattctggaa

SEQ ID NO: 2761183 - DNA, 13 bp, Homo sapiens
attccctctcatc

SEQ ID NO: 2761184 - DNA, 14 bp, Homo sapiens
attccctctcatcc

SEQ ID NO: 2761185 - DNA, 20 bp, Homo sapiens
attccctctcatccaggtcc

SEQ ID NO: 2761186 - DNA, 13 bp, Homo sapiens
attccctggagac

SEQ ID NO: 2761187 - DNA, 23 bp, Homo sapiens
attctccagccatcaagagactg

SEQ ID NO: 2761188 - DNA, 21 bp, Homo sapiens
attctgattcgaatgacactg

SEQ ID NO: 2761189 - DNA, 14 bp, Homo sapiens
attctgtccctcca

SEQ ID NO: 2761190 - DNA, 20 bp, Homo sapiens
attcttccctatctttgcca

SEQ ID NO: 2761191 - DNA, 22 bp, Homo sapiens
attgtgccatgtcaaacaaata

SEQ ID NO: 2761192 - DNA, 14 bp, Homo sapiens
atttaaagttgttt

SEQ ID NO: 2761193 - DNA, 22 bp, Homo sapiens
atttaaagttgtttgtgccttt

SEQ ID NO: 2761194 - DNA, 13 bp, Homo sapiens
atttaaatctgtt

SEQ ID NO: 2761195 - DNA, 20 bp, Homo sapiens
atttccagtgaaatcagtta

SEQ ID NO: 2761196 - DNA, 20 bp, Homo sapiens
atttctaggtaggaaatgtg

SEQ ID NO: 2761197 - DNA, 15 bp, Homo sapiens
atttgcctgtaacaa

SEQ ID NO: 2761198 - DNA, 13 bp, Homo sapiens
atttgttgagagt

SEQ ID NO: 2761199 - DNA, 15 bp, Homo sapiens
caaaagcccattcat

SEQ ID NO: 2761200 - DNA, 19 bp, Homo sapiens
caaaagcccattcattcca

SEQ ID NO: 2761201 - DNA, 20 bp, Homo sapiens
caaaagcccattcattccat

SEQ ID NO: 2761202 - DNA, 16 bp, Homo sapiens
caaaagttacatgttt

SEQ ID NO: 2761203 - DNA, 19 bp, Homo sapiens
caaaagttacatgtttgca

SEQ ID NO: 2761204 - DNA, 21 bp, Homo sapiens
caaaatgagccctgtcctgcc

SEQ ID NO: 2761205 - DNA, 23 bp, Homo sapiens
caaagatagagaatgccctcagc

SEQ ID NO: 2761206 - DNA, 16 bp, Homo sapiens
caaagatgagaagcca

SEQ ID NO: 2761207 - DNA, 16 bp, Homo sapiens
caaagcatgaaatgga

SEQ ID NO: 2761208 - DNA, 15 bp, Homo sapiens
caaatcactgaactt

SEQ ID NO: 2761209 - DNA, 12 bp, Homo sapiens
caaatggctgct

SEQ ID NO: 2761210 - DNA, 18 bp, Homo sapiens
caaatgtcttcctggatt

SEQ ID NO: 2761211 - DNA, 22 bp, Homo sapiens
caacagcctgtttgggaggctg

SEQ ID NO: 2761212 - DNA, 16 bp, Homo sapiens
caaccccagacactgg

SEQ ID NO: 2761213 - DNA, 17 bp, Homo sapiens
caaccctggcacccagg

SEQ ID NO: 2761214 - DNA, 13 bp, Homo sapiens
caacgggagcgag

SEQ ID NO: 2761215 - DNA, 22 bp, Homo sapiens
caactccagccacccagccagg

SEQ ID NO: 2761216 - DNA, 14 bp, Homo sapiens
caagactcagggga

SEQ ID NO: 2761217 - DNA, 12 bp, Homo sapiens
caagagactgag

SEQ ID NO: 2761218 - DNA, 15 bp, Homo sapiens
caagagactgagtca

SEQ ID NO: 2761219 - DNA, 18 bp, Homo sapiens
caagccacagaaatgtgt

SEQ ID NO: 2761220 - DNA, 15 bp, Homo sapiens
caagccagatttttt

SEQ ID NO: 2761221 - DNA, 19 bp, Homo sapiens
caagccagcttcctgtgca

SEQ ID NO: 2761222 - DNA, 22 bp, Homo sapiens
caagccagcttcctgtgcagaa

SEQ ID NO: 2761223 - DNA, 16 bp, Homo sapiens
caagttccgtctcctc

SEQ ID NO: 2761224 - DNA, 17 bp, Homo sapiens
caagttccgtctcctct

SEQ ID NO: 2761225 - DNA, 20 bp, Homo sapiens
caagttccgtctcctctcca

SEQ ID NO: 2761226 - DNA, 21 bp, Homo sapiens
caagttgttccttaagtcaga

SEQ ID NO: 2761227 - DNA, 14 bp, Homo sapiens
caattctgcagaaa

SEQ ID NO: 2761228 - DNA, 17 bp, Homo sapiens
caattcttccctatctt

SEQ ID NO: 2761229 - DNA, 14 bp, Homo sapiens
cacactccagctgg

SEQ ID NO: 2761230 - DNA, 19 bp, Homo sapiens
cacactgggacttgcaaaa

SEQ ID NO: 2761231 - DNA, 14 bp, Homo sapiens
cacagaggccaggc

SEQ ID NO: 2761232 - DNA, 15 bp, Homo sapiens
cacagaggccaggca

SEQ ID NO: 2761233 - DNA, 13 bp, Homo sapiens
cacagtgccaccc

SEQ ID NO: 2761234 - DNA, 14 bp, Homo sapiens
cacagtgccaccca

SEQ ID NO: 2761235 - DNA, 13 bp, Homo sapiens
cacattccctctc

SEQ ID NO: 2761236 - DNA, 16 bp, Homo sapiens
cacattccctctcatc

SEQ ID NO: 2761237 - DNA, 12 bp, Homo sapiens
caccctcacact

SEQ ID NO: 2761238 - DNA, 16 bp, Homo sapiens
cacctacttcctcctc

SEQ ID NO: 2761239 - DNA, 22 bp, Homo sapiens
cactgaaccttgttgatgccag

SEQ ID NO: 2761240 - DNA, 20 bp, Homo sapiens
cactgaactttgctgagcct

SEQ ID NO: 2761241 - DNA, 19 bp, Homo sapiens
cactgctgtccctcctgag

SEQ ID NO: 2761242 - DNA, 17 bp, Homo sapiens
cactgggacttgcaaaa

SEQ ID NO: 2761243 - DNA, 18 bp, Homo sapiens
cactgggccggcagcctg

SEQ ID NO: 2761244 - DNA, 19 bp, Homo sapiens
cactgggccggcagcctgg

SEQ ID NO: 2761245 - DNA, 20 bp, Homo sapiens
cactgggccggcagcctggt

SEQ ID NO: 2761246 - DNA, 15 bp, Homo sapiens
cacttcacagctgga

SEQ ID NO: 2761247 - DNA, 16 bp, Homo sapiens
cacttcccatttgtgt

SEQ ID NO: 2761248 - DNA, 21 bp, Homo sapiens
cagaaacaccctcacactggg

SEQ ID NO: 2761249 - DNA, 23 bp, Homo sapiens
cagaaacttttttctctaaagga

SEQ ID NO: 2761250 - DNA, 18 bp, Homo sapiens
cagagcatgttggacacc

SEQ ID NO: 2761251 - DNA, 15 bp, Homo sapiens
cagatgctgtgcaaa

SEQ ID NO: 2761252 - DNA, 13 bp, Homo sapiens
cagattgtttgca

SEQ ID NO: 2761253 - DNA, 18 bp, Homo sapiens
cagcaaatgccactctgg

SEQ ID NO: 2761254 - DNA, 14 bp, Homo sapiens
cagcaccagaatgt

SEQ ID NO: 2761255 - DNA, 17 bp, Homo sapiens
cagcagactcagctctg

SEQ ID NO: 2761256 - DNA, 21 bp, Homo sapiens
cagcagactcagctctgacat

SEQ ID NO: 2761257 - DNA, 15 bp, Homo sapiens
cagccacccagccag

SEQ ID NO: 2761258 - DNA, 19 bp, Homo sapiens
cagccacccagccaggagg

SEQ ID NO: 2761259 - DNA, 11 bp, Homo sapiens
cagccaggagg

SEQ ID NO: 2761260 - DNA, 13 bp, Homo sapiens
cagcccgaacacc

SEQ ID NO: 2761261 - DNA, 13 bp, Homo sapiens
cagccctcagttt

SEQ ID NO: 2761262 - DNA, 11 bp, Homo sapiens
cagcctggagc

SEQ ID NO: 2761263 - DNA, 19 bp, Homo sapiens
cagcctgtttgggaggctg

SEQ ID NO: 2761264 - DNA, 12 bp, Homo sapiens
cagctcaagtta

SEQ ID NO: 2761265 - DNA, 21 bp, Homo sapiens
cagctctgacattctgattcg

SEQ ID NO: 2761266 - DNA, 17 bp, Homo sapiens
cagctgccgcaccagcc

SEQ ID NO: 2761267 - DNA, 13 bp, Homo sapiens
cagctgcttctgt

SEQ ID NO: 2761268 - DNA, 14 bp, Homo sapiens
cagctgtactgagt

SEQ ID NO: 2761269 - DNA, 22 bp, Homo sapiens
cagctgtactgagttctcatcc

SEQ ID NO: 2761270 - DNA, 19 bp, Homo sapiens
cagcttcctgtgcagaagg

SEQ ID NO: 2761271 - DNA, 23 bp, Homo sapiens
cagctttccccatgtctcgactc

SEQ ID NO: 2761272 - DNA, 12 bp, Homo sapiens
caggacagctgc

SEQ ID NO: 2761273 - DNA, 14 bp, Homo sapiens
caggactctctttc

SEQ ID NO: 2761274 - DNA, 16 bp, Homo sapiens
caggactctctttctt

SEQ ID NO: 2761275 - DNA, 18 bp, Homo sapiens
caggagtccactgcctcc

SEQ ID NO: 2761276 - DNA, 13 bp, Homo sapiens
caggatagacttt

SEQ ID NO: 2761277 - DNA, 21 bp, Homo sapiens
caggcatgcgaatgagctggg

SEQ ID NO: 2761278 - DNA, 19 bp, Homo sapiens
caggcatggcccagcctgg

SEQ ID NO: 2761279 - DNA, 19 bp, Homo sapiens
caggccaccccgctgatgg

SEQ ID NO: 2761280 - DNA, 18 bp, Homo sapiens
caggccattccccgtctc

SEQ ID NO: 2761281 - DNA, 16 bp, Homo sapiens
caggctgatttctagg

SEQ ID NO: 2761282 - DNA, 14 bp, Homo sapiens
caggctgtgagttt

SEQ ID NO: 2761283 - DNA, 13 bp, Homo sapiens
cagggcctggcct

SEQ ID NO: 2761284 - DNA, 20 bp, Homo sapiens
caggtgcagcccccactgcc

SEQ ID NO: 2761285 - DNA, 16 bp, Homo sapiens
caggtgccgccagctg

SEQ ID NO: 2761286 - DNA, 11 bp, Homo sapiens
cagtcctgcaa

SEQ ID NO: 2761287 - DNA, 15 bp, Homo sapiens
cagtgccctccagga

SEQ ID NO: 2761288 - DNA, 14 bp, Homo sapiens
cagttaagcctttg

SEQ ID NO: 2761289 - DNA, 15 bp, Homo sapiens
catcactgctgtccc

SEQ ID NO: 2761290 - DNA, 12 bp, Homo sapiens
catccatccagg

SEQ ID NO: 2761291 - DNA, 19 bp, Homo sapiens
catctggaaccatcagaaa

SEQ ID NO: 2761292 - DNA, 14 bp, Homo sapiens
catgcagctgctcc

SEQ ID NO: 2761293 - DNA, 16 bp, Homo sapiens
catgcagctgctcccc

SEQ ID NO: 2761294 - DNA, 15 bp, Homo sapiens
catgcatggaaattc

SEQ ID NO: 2761295 - DNA, 18 bp, Homo sapiens
catgcgaatgagctgggc

SEQ ID NO: 2761296 - DNA, 21 bp, Homo sapiens
catgctgtgtgactcaaacca

SEQ ID NO: 2761297 - DNA, 21 bp, Homo sapiens
catggaaattcccttcatctg

SEQ ID NO: 2761298 - DNA, 16 bp, Homo sapiens
catggcccagcctgga

SEQ ID NO: 2761299 - DNA, 19 bp, Homo sapiens
catggcccagcctggagcc

SEQ ID NO: 2761300 - DNA, 14 bp, Homo sapiens
catggccgtgaact

SEQ ID NO: 2761301 - DNA, 23 bp, Homo sapiens
catggtgggcttgtggtggctgc

SEQ ID NO: 2761302 - DNA, 18 bp, Homo sapiens
cattaactcattagactg

SEQ ID NO: 2761303 - DNA, 15 bp, Homo sapiens
cattccaacacctgc

SEQ ID NO: 2761304 - DNA, 17 bp, Homo sapiens
cattccaacacctgcca

SEQ ID NO: 2761305 - DNA, 14 bp, Homo sapiens
cattccattctgga

SEQ ID NO: 2761306 - DNA, 18 bp, Homo sapiens
cattctaggtttgcaaga

SEQ ID NO: 2761307 - DNA, 12 bp, Homo sapiens
cattctggaagt

SEQ ID NO: 2761308 - DNA, 18 bp, Homo sapiens
catttcatttgtgccaga

SEQ ID NO: 2761309 - DNA, 16 bp, Homo sapiens
catttttccgtaaaaa

SEQ ID NO: 2761310 - DNA, 20 bp, Homo sapiens
ccaaagaaatagggcatggc

SEQ ID NO: 2761311 - DNA, 20 bp, Homo sapiens
ccaaatcactgaactttgct

SEQ ID NO: 2761312 - DNA, 12 bp, Homo sapiens
ccaaatgcagct

SEQ ID NO: 2761313 - DNA, 13 bp, Homo sapiens
ccaaatgcagctt

SEQ ID NO: 2761314 - DNA, 22 bp, Homo sapiens
ccaagcctacttttgccattga

SEQ ID NO: 2761315 - DNA, 13 bp, Homo sapiens
ccaatcacattca

SEQ ID NO: 2761316 - DNA, 20 bp, Homo sapiens
ccaatcacattcaggcatgc

SEQ ID NO: 2761317 - DNA, 16 bp, Homo sapiens
ccaatccctgtgtgtc

SEQ ID NO: 2761318 - DNA, 13 bp, Homo sapiens
ccacactccagct

SEQ ID NO: 2761319 - DNA, 14 bp, Homo sapiens
ccacagtgccaccc

SEQ ID NO: 2761320 - DNA, 22 bp, Homo sapiens
ccacccaattcaaaacattgtg

SEQ ID NO: 2761321 - DNA, 14 bp, Homo sapiens
ccacccagccagga

SEQ ID NO: 2761322 - DNA, 20 bp, Homo sapiens
ccacccatgcagctgctccc

SEQ ID NO: 2761323 - DNA, 13 bp, Homo sapiens
ccagacactggtt

SEQ ID NO: 2761324 - DNA, 23 bp, Homo sapiens
ccagagtagggttgccagtcctg

SEQ ID NO: 2761325 - DNA, 20 bp, Homo sapiens
ccagccatcaagagactgag

SEQ ID NO: 2761326 - DNA, 19 bp, Homo sapiens
ccagcctcacctcattcca

SEQ ID NO: 2761327 - DNA, 17 bp, Homo sapiens
ccagctgccgcaccagc

SEQ ID NO: 2761328 - DNA, 16 bp, Homo sapiens
ccagctgtactgagtt

SEQ ID NO: 2761329 - DNA, 16 bp, Homo sapiens
ccagcttcctgtgcag

SEQ ID NO: 2761330 - DNA, 18 bp, Homo sapiens
ccagcttcctgtgcagaa

SEQ ID NO: 2761331 - DNA, 13 bp, Homo sapiens
ccagcttttccca

SEQ ID NO: 2761332 - DNA, 13 bp, Homo sapiens
ccaggactctctt

SEQ ID NO: 2761333 - DNA, 16 bp, Homo sapiens
ccaggactctctttct

SEQ ID NO: 2761334 - DNA, 15 bp, Homo sapiens
ccaggcatggcccag

SEQ ID NO: 2761335 - DNA, 19 bp, Homo sapiens
ccaggcatggcccagcctg

SEQ ID NO: 2761336 - DNA, 23 bp, Homo sapiens
ccaggcatggcccagcctggagc

SEQ ID NO: 2761337 - DNA, 19 bp, Homo sapiens
ccagtaggttgaggacagg

SEQ ID NO: 2761338 - DNA, 20 bp, Homo sapiens
ccagtgaaatcagttactct

SEQ ID NO: 2761339 - DNA, 12 bp, Homo sapiens
ccagtgacagct

SEQ ID NO: 2761340 - DNA, 14 bp, Homo sapiens
ccagtgacagctag

SEQ ID NO: 2761341 - DNA, 21 bp, Homo sapiens
ccatagtatgggactggcctc

SEQ ID NO: 2761342 - DNA, 22 bp, Homo sapiens
ccatcagaaacaccctcacact

SEQ ID NO: 2761343 - DNA, 15 bp, Homo sapiens
ccatgcagctgctcc

SEQ ID NO: 2761344 - DNA, 21 bp, Homo sapiens
ccatggtgggcttgtggtggc

SEQ ID NO: 2761345 - DNA, 20 bp, Homo sapiens
ccattcattccattctggaa

SEQ ID NO: 2761346 - DNA, 12 bp, Homo sapiens
ccattctggaag

SEQ ID NO: 2761347 - DNA, 15 bp, Homo sapiens
ccattctggaagtga

SEQ ID NO: 2761348 - DNA, 17 bp, Homo sapiens
cccacttcacagctgga

SEQ ID NO: 2761349 - DNA, 16 bp, Homo sapiens
cccagaggctgggtga

SEQ ID NO: 2761350 - DNA, 13 bp, Homo sapiens
cccagcctggagc

SEQ ID NO: 2761351 - DNA, 19 bp, Homo sapiens
aaaagttacatgtttgcac

SEQ ID NO: 2761352 - DNA, 20 bp, Homo sapiens
aaaatttatattgtaaatat

SEQ ID NO: 2761353 - DNA, 13 bp, Homo sapiens
aaacaacagaaac

SEQ ID NO: 2761354 - DNA, 13 bp, Homo sapiens
aaagcaaatgtct

SEQ ID NO: 2761355 - DNA, 17 bp, Homo sapiens
aaagcccattcattcca

SEQ ID NO: 2761356 - DNA, 16 bp, Homo sapiens
aaaggggcctgcgcag

SEQ ID NO: 2761357 - DNA, 13 bp, Homo sapiens
aaagtgttgtatc

SEQ ID NO: 2761358 - DNA, 14 bp, Homo sapiens
aaatacactgtgaa

SEQ ID NO: 2761359 - DNA, 16 bp, Homo sapiens
aaatacactgtgaaga

SEQ ID NO: 2761360 - DNA, 16 bp, Homo sapiens
aaattcccttcatctg

SEQ ID NO: 2761361 - DNA, 15 bp, Homo sapiens
aaattctgctcagat

SEQ ID NO: 2761362 - DNA, 18 bp, Homo sapiens
aaattgtcagatgctgtg

SEQ ID NO: 2761363 - DNA, 16 bp, Homo sapiens
aaatttatattgtaaa

SEQ ID NO: 2761364 - DNA, 23 bp, Homo sapiens
aaattttagcgtgctcactgacc

SEQ ID NO: 2761365 - DNA, 17 bp, Homo sapiens
aacaccctcacactggg

SEQ ID NO: 2761366 - DNA, 17 bp, Homo sapiens
aacagaggaggccagcc

SEQ ID NO: 2761367 - DNA, 16 bp, Homo sapiens
aacagattgtttgcaa

SEQ ID NO: 2761368 - DNA, 23 bp, Homo sapiens
aacagcctgtttgggaggctgga

SEQ ID NO: 2761369 - DNA, 23 bp, Homo sapiens
aacattccatccttgagtcaaaa

SEQ ID NO: 2761370 - DNA, 15 bp, Homo sapiens
aaccccagacactgg

SEQ ID NO: 2761371 - DNA, 15 bp, Homo sapiens
aactcattagactgg

SEQ ID NO: 2761372 - DNA, 22 bp, Homo sapiens
aactctgacaacagacttctga

SEQ ID NO: 2761373 - DNA, 12 bp, Homo sapiens
aactgggccagc

SEQ ID NO: 2761374 - DNA, 14 bp, Homo sapiens
aacttgaactgatt

SEQ ID NO: 2761375 - DNA, 21 bp, Homo sapiens
aacttgaactgattcacatct

SEQ ID NO: 2761376 - DNA, 19 bp, Homo sapiens
aagagactttattgcctat

SEQ ID NO: 2761377 - DNA, 13 bp, Homo sapiens
aagcagctgaagg

SEQ ID NO: 2761378 - DNA, 12 bp, Homo sapiens
aagcatgaaatg

SEQ ID NO: 2761379 - DNA, 20 bp, Homo sapiens
aagccagcttcctgtgcaga

SEQ ID NO: 2761380 - DNA, 23 bp, Homo sapiens
aagccagcttcctgtgcagaagg

SEQ ID NO: 2761381 - DNA, 16 bp, Homo sapiens
aagcccattcattcca

SEQ ID NO: 2761382 - DNA, 23 bp, Homo sapiens
aagcccattcattccattctgga

SEQ ID NO: 2761383 - DNA, 13 bp, Homo sapiens
aagctgtgagcaa

SEQ ID NO: 2761384 - DNA, 21 bp, Homo sapiens
aagctgtgagcaaacagagga

SEQ ID NO: 2761385 - DNA, 14 bp, Homo sapiens
aaggaaaggatgca

SEQ ID NO: 2761386 - DNA, 20 bp, Homo sapiens
aagtccatagctgagctgga

SEQ ID NO: 2761387 - DNA, 13 bp, Homo sapiens
aagtctcttcctg

SEQ ID NO: 2761388 - DNA, 20 bp, Homo sapiens
aagtgaatttgcctgtaaca

SEQ ID NO: 2761389 - DNA, 14 bp, Homo sapiens
aagtgtaattgaga

SEQ ID NO: 2761390 - DNA, 16 bp, Homo sapiens
aagttaatttaaagtt

SEQ ID NO: 2761391 - DNA, 17 bp, Homo sapiens
aagttaatttaaagttg

SEQ ID NO: 2761392 - DNA, 16 bp, Homo sapiens
aagttacatgtttgca

SEQ ID NO: 2761393 - DNA, 18 bp, Homo sapiens
aagttccgtctcctctcc

SEQ ID NO: 2761394 - DNA, 14 bp, Homo sapiens
aataaagctgtgag

SEQ ID NO: 2761395 - DNA, 15 bp, Homo sapiens
aatatttataggtca

SEQ ID NO: 2761396 - DNA, 21 bp, Homo sapiens
aatcaattctgatacagcctt

SEQ ID NO: 2761397 - DNA, 11 bp, Homo sapiens
aatcacattca

SEQ ID NO: 2761398 - DNA, 17 bp, Homo sapiens
aatctcaattcttccct

SEQ ID NO: 2761399 - DNA, 16 bp, Homo sapiens
aatctgggccagaatt

SEQ ID NO: 2761400 - DNA, 15 bp, Homo sapiens
aatctgtttttctaa

SEQ ID NO: 2761401 - DNA, 11 bp, Homo sapiens
aatgacactgt

SEQ ID NO: 2761402 - DNA, 13 bp, Homo sapiens
aatgagctgggcc

SEQ ID NO: 2761403 - DNA, 14 bp, Homo sapiens
aatgagctgggccc

SEQ ID NO: 2761404 - DNA, 13 bp, Homo sapiens
aatggcctttatt

SEQ ID NO: 2761405 - DNA, 16 bp, Homo sapiens
aatgtggtagcctcac

SEQ ID NO: 2761406 - DNA, 16 bp, Homo sapiens
aattctgctcagatag

SEQ ID NO: 2761407 - DNA, 16 bp, Homo sapiens
aatttgcctgtaacaa

SEQ ID NO: 2761408 - DNA, 20 bp, Homo sapiens
acaactccagccacccagcc

SEQ ID NO: 2761409 - DNA, 22 bp, Homo sapiens
acaagttatttaaatctgtttt

SEQ ID NO: 2761410 - DNA, 13 bp, Homo sapiens
acaccctcacact

SEQ ID NO: 2761411 - DNA, 19 bp, Homo sapiens
acaccggagtatgtgcagt

SEQ ID NO: 2761412 - DNA, 16 bp, Homo sapiens
acacgctccttcctct

SEQ ID NO: 2761413 - DNA, 19 bp, Homo sapiens
acacgctccttcctctgag

SEQ ID NO: 2761414 - DNA, 13 bp, Homo sapiens
acactgggacttg

SEQ ID NO: 2761415 - DNA, 21 bp, Homo sapiens
acagaacacataattcaggaa

SEQ ID NO: 2761416 - DNA, 23 bp, Homo sapiens
acagcagactcagctctgacatt

SEQ ID NO: 2761417 - DNA, 18 bp, Homo sapiens
acagccgtttgttcccca

SEQ ID NO: 2761418 - DNA, 13 bp, Homo sapiens
acagctgcttctg

SEQ ID NO: 2761419 - DNA, 17 bp, Homo sapiens
acagctgcttctgtgca

SEQ ID NO: 2761420 - DNA, 21 bp, Homo sapiens
cagcttgtggcaagtgaattt

SEQ ID NO: 2761421 - DNA, 20 bp, Homo sapiens
cagcttttcccaaaagccca

SEQ ID NO: 2761422 - DNA, 19 bp, Homo sapiens
caggatgtacaaggacagc

SEQ ID NO: 2761423 - DNA, 17 bp, Homo sapiens
caggcatggcccagcct

SEQ ID NO: 2761424 - DNA, 18 bp, Homo sapiens
caggcatggcccagcctg

SEQ ID NO: 2761425 - DNA, 20 bp, Homo sapiens
caggcatggcccagcctgga

SEQ ID NO: 2761426 - DNA, 21 bp, Homo sapiens
caggcatggcccagcctggag

SEQ ID NO: 2761427 - DNA, 18 bp, Homo sapiens
caggccaccccgctgatg

SEQ ID NO: 2761428 - DNA, 17 bp, Homo sapiens
caggctgatttctaggt

SEQ ID NO: 2761429 - DNA, 23 bp, Homo sapiens
caggcttgggctccattcccatc

SEQ ID NO: 2761430 - DNA, 14 bp, Homo sapiens
cagggcctggcctg

SEQ ID NO: 2761431 - DNA, 17 bp, Homo sapiens
cagggcctggcctggtc

SEQ ID NO: 2761432 - DNA, 18 bp, Homo sapiens
cagggcttctcctctgct

SEQ ID NO: 2761433 - DNA, 22 bp, Homo sapiens
caggggacactgaaccttgttg

SEQ ID NO: 2761434 - DNA, 14 bp, Homo sapiens
caggtcctttcctt

SEQ ID NO: 2761435 - DNA, 18 bp, Homo sapiens
caggtcctttccttctcg

SEQ ID NO: 2761436 - DNA, 23 bp, Homo sapiens
caggtgcagcccccactgccttt

SEQ ID NO: 2761437 - DNA, 17 bp, Homo sapiens
caggtgccgccagctgc

SEQ ID NO: 2761438 - DNA, 19 bp, Homo sapiens
caggtgccgccagctgccg

SEQ ID NO: 2761439 - DNA, 22 bp, Homo sapiens
caggtgccgccagctgccgcac

SEQ ID NO: 2761440 - DNA, 16 bp, Homo sapiens
cagtatgggttaggga

SEQ ID NO: 2761441 - DNA, 23 bp, Homo sapiens
cagtcaagttccgtctcctctcc

SEQ ID NO: 2761442 - DNA, 15 bp, Homo sapiens
cagtgacagctagga

SEQ ID NO: 2761443 - DNA, 12 bp, Homo sapiens
cagtgccaccca

SEQ ID NO: 2761444 - DNA, 14 bp, Homo sapiens
cagtgccacccatg

SEQ ID NO: 2761445 - DNA, 20 bp, Homo sapiens
cagtgccacccatgcagctg

SEQ ID NO: 2761446 - DNA, 15 bp, Homo sapiens
cagttaagcctttgg

SEQ ID NO: 2761447 - DNA, 17 bp, Homo sapiens
cagttaagcctttggaa

SEQ ID NO: 2761448 - DNA, 16 bp, Homo sapiens
cagttatctaagttaa

SEQ ID NO: 2761449 - DNA, 14 bp, Homo sapiens
cagtttatttgttg

SEQ ID NO: 2761450 - DNA, 17 bp, Homo sapiens
catcaagagactgagtc

SEQ ID NO: 2761451 - DNA, 18 bp, Homo sapiens
catcactgctgtccctcc

SEQ ID NO: 2761452 - DNA, 15 bp, Homo sapiens
catccaaatggctgc

SEQ ID NO: 2761453 - DNA, 17 bp, Homo sapiens
catccgcctctgagcca

SEQ ID NO: 2761454 - DNA, 22 bp, Homo sapiens
catccgcctctgagccaggagc

SEQ ID NO: 2761455 - DNA, 17 bp, Homo sapiens
catgatgcaagccagct

SEQ ID NO: 2761456 - DNA, 17 bp, Homo sapiens
catgcatggaaattccc

SEQ ID NO: 2761457 - DNA, 13 bp, Homo sapiens
catggcccagcct

SEQ ID NO: 2761458 - DNA, 17 bp, Homo sapiens
catggcccagcctggag

SEQ ID NO: 2761459 - DNA, 14 bp, Homo sapiens
catgtctcgactca

SEQ ID NO: 2761460 - DNA, 21 bp, Homo sapiens
catgtttgcacctttctagtt

SEQ ID NO: 2761461 - DNA, 21 bp, Homo sapiens
cattagtacacagcaccagaa

SEQ ID NO: 2761462 - DNA, 17 bp, Homo sapiens
cattccccgtctctggt

SEQ ID NO: 2761463 - DNA, 15 bp, Homo sapiens
cattccctctcatcc

SEQ ID NO: 2761464 - DNA, 16 bp, Homo sapiens
cattctggaagtgact

SEQ ID NO: 2761465 - DNA, 15 bp, Homo sapiens
catttgtgtctgcct

SEQ ID NO: 2761466 - DNA, 15 bp, Homo sapiens
catttgtttctactt

SEQ ID NO: 2761467 - DNA, 17 bp, Homo sapiens
ccaaaagttacatgttt

SEQ ID NO: 2761468 - DNA, 18 bp, Homo sapiens
ccaaatgcagctttaaaa

SEQ ID NO: 2761469 - DNA, 20 bp, Homo sapiens
ccaagggctccagggccagg

SEQ ID NO: 2761470 - DNA, 12 bp, Homo sapiens
ccacactccagc

SEQ ID NO: 2761471 - DNA, 13 bp, Homo sapiens
ccacagaggccag

SEQ ID NO: 2761472 - DNA, 16 bp, Homo sapiens
ccacagtgccacccat

SEQ ID NO: 2761473 - DNA, 12 bp, Homo sapiens
ccacccagccag

SEQ ID NO: 2761474 - DNA, 23 bp, Homo sapiens
ccacccatgcagctgctccccag

SEQ ID NO: 2761475 - DNA, 14 bp, Homo sapiens
ccaccttgtctgct

SEQ ID NO: 2761476 - DNA, 17 bp, Homo sapiens
ccactcagggcttctcc

SEQ ID NO: 2761477 - DNA, 13 bp, Homo sapiens
ccactctgggcag

SEQ ID NO: 2761478 - DNA, 14 bp, Homo sapiens
ccactgcctttgac

SEQ ID NO: 2761479 - DNA, 16 bp, Homo sapiens
ccacttcacagctgga

SEQ ID NO: 2761480 - DNA, 16 bp, Homo sapiens
ccagaatgctttagga

SEQ ID NO: 2761481 - DNA, 12 bp, Homo sapiens
ccagacactggt

SEQ ID NO: 2761482 - DNA, 22 bp, Homo sapiens
ccagattttttaaaatttatat

SEQ ID NO: 2761483 - DNA, 18 bp, Homo sapiens
ccagccacccagccagga

SEQ ID NO: 2761484 - DNA, 18 bp, Homo sapiens
ccagccatcaagagactg

SEQ ID NO: 2761485 - DNA, 17 bp, Homo sapiens
ccagcccgaacaccatt

SEQ ID NO: 2761486 - DNA, 19 bp, Homo sapiens
ccagcttcctgtgcagaag

SEQ ID NO: 2761487 - DNA, 23 bp, Homo sapiens
ccagcttttcccaaaagcccatt

SEQ ID NO: 2761488 - DNA, 15 bp, Homo sapiens
ccaggactctctttc

SEQ ID NO: 2761489 - DNA, 15 bp, Homo sapiens
ccaggagcctcctga

SEQ ID NO: 2761490 - DNA, 19 bp, Homo sapiens
ccaggagcctcctgaccct

SEQ ID NO: 2761491 - DNA, 22 bp, Homo sapiens
ccaggatgtacaaggacagccc

SEQ ID NO: 2761492 - DNA, 20 bp, Homo sapiens
ccaggcatggcccagcctgg

SEQ ID NO: 2761493 - DNA, 18 bp, Homo sapiens
ccagggtgtgagggatgg

SEQ ID NO: 2761494 - DNA, 14 bp, Homo sapiens
ccaggtcctttcct

SEQ ID NO: 2761495 - DNA, 12 bp, Homo sapiens
ccagtcctgcaa

SEQ ID NO: 2761496 - DNA, 12 bp, Homo sapiens
ccataggtcacc

SEQ ID NO: 2761497 - DNA, 18 bp, Homo sapiens
ccatcagaaacaccctca

SEQ ID NO: 2761498 - DNA, 19 bp, Homo sapiens
ccatgatgcaagccagctt

SEQ ID NO: 2761499 - DNA, 16 bp, Homo sapiens
ccatgcagctgctccc

SEQ ID NO: 2761500 - DNA, 17 bp, Homo sapiens
ccatgcagctgctcccc

SEQ ID NO: 2761501 - DNA, 16 bp, Homo sapiens
ccatgtcaaacaaata

SEQ ID NO: 2761502 - DNA, 14 bp, Homo sapiens
ccatgtctcgactc

SEQ ID NO: 2761503 - DNA, 18 bp, Homo sapiens
ccattcattccattctgg

SEQ ID NO: 2761504 - DNA, 22 bp, Homo sapiens
ccatttcatttgtgccagaatg

SEQ ID NO: 2761505 - DNA, 15 bp, Homo sapiens
cccaaccctggcacc

SEQ ID NO: 2761506 - DNA, 16 bp, Homo sapiens
cccaagcagctgaagg

SEQ ID NO: 2761507 - DNA, 23 bp, Homo sapiens
cccaagcctacttttgccattga

SEQ ID NO: 2761508 - DNA, 14 bp, Homo sapiens
cccacagtgccacc

SEQ ID NO: 2761509 - DNA, 15 bp, Homo sapiens
cccacagtgccaccc

SEQ ID NO: 2761510 - DNA, 14 bp, Homo sapiens
cccactgcctttga

SEQ ID NO: 2761511 - DNA, 19 bp, Homo sapiens
cccacttcacagctggaga

SEQ ID NO: 2761512 - DNA, 16 bp, Homo sapiens
cccagacactggtttg

SEQ ID NO: 2761513 - DNA, 17 bp, Homo sapiens
cccagccaggaggggct

SEQ ID NO: 2761514 - DNA, 15 bp, Homo sapiens
cccagtgacagctag

SEQ ID NO: 2761515 - DNA, 22 bp, Homo sapiens
cccattcattccattctggaag

SEQ ID NO: 2761516 - DNA, 15 bp, Homo sapiens
ccccaccttgtctgc

SEQ ID NO: 2761517 - DNA, 17 bp, Homo sapiens
ccccagaggctgggtga

SEQ ID NO: 2761518 - DNA, 17 bp, Homo sapiens
cccccactgcctttgac

SEQ ID NO: 2761519 - DNA, 17 bp, Homo sapiens
ccccgctgatggagccc

SEQ ID NO: 2761520 - DNA, 18 bp, Homo sapiens
ggatacttatatggaaat

SEQ ID NO: 2761521 - DNA, 21 bp, Homo sapiens
ggcactgggccggcagcctgg

SEQ ID NO: 2761522 - DNA, 16 bp, Homo sapiens
ggcagcctcttcaaaa

SEQ ID NO: 2761523 - DNA, 16 bp, Homo sapiens
ggcagggcctggcctg

SEQ ID NO: 2761524 - DNA, 17 bp, Homo sapiens
ggcatgcgaatgagctg

SEQ ID NO: 2761525 - DNA, 22 bp, Homo sapiens
ggccaggcatggcccagcctgg

SEQ ID NO: 2761526 - DNA, 21 bp, Homo sapiens
ggccgagggcttccctagatg

SEQ ID NO: 2761527 - DNA, 13 bp, Homo sapiens
ggcctggcctggg

SEQ ID NO: 2761528 - DNA, 21 bp, Homo sapiens
ggcctgggtggggcagggcct

SEQ ID NO: 2761529 - DNA, 22 bp, Homo sapiens
ggcctgggtggggcagggcctg

SEQ ID NO: 2761530 - DNA, 23 bp, Homo sapiens
ggctaccctcctctagaaggctg

SEQ ID NO: 2761531 - DNA, 17 bp, Homo sapiens
ggcttctcctctgctag

SEQ ID NO: 2761532 - DNA, 19 bp, Homo sapiens
ggcttgcccctgtggccct

SEQ ID NO: 2761533 - DNA, 16 bp, Homo sapiens
gggagaccctccccac

SEQ ID NO: 2761534 - DNA, 13 bp, Homo sapiens
gggagcagctggg

SEQ ID NO: 2761535 - DNA, 19 bp, Homo sapiens
gggagcagctgggcactgg

SEQ ID NO: 2761536 - DNA, 19 bp, Homo sapiens
gggaggggcctggcctggg

SEQ ID NO: 2761537 - DNA, 15 bp, Homo sapiens
gggagggtaccagca

SEQ ID NO: 2761538 - DNA, 23 bp, Homo sapiens
gggatatccctatgtcccagccc

SEQ ID NO: 2761539 - DNA, 14 bp, Homo sapiens
gggccccagaggct

SEQ ID NO: 2761540 - DNA, 15 bp, Homo sapiens
gggccggcagcctgg

SEQ ID NO: 2761541 - DNA, 17 bp, Homo sapiens
gggctattccctggaga

SEQ ID NO: 2761542 - DNA, 18 bp, Homo sapiens
gggcttgtggtggctgct

SEQ ID NO: 2761543 - DNA, 15 bp, Homo sapiens
ggggacactgaacct

SEQ ID NO: 2761544 - DNA, 15 bp, Homo sapiens
ggggcctgcgcaggc

SEQ ID NO: 2761545 - DNA, 12 bp, Homo sapiens
ggggcctggcct

SEQ ID NO: 2761546 - DNA, 18 bp, Homo sapiens
ggggctattccctggaga

SEQ ID NO: 2761547 - DNA, 22 bp, Homo sapiens
gggtgggcatcaaagatgagaa

SEQ ID NO: 2761548 - DNA, 12 bp, Homo sapiens
ggtaggaaatgt

SEQ ID NO: 2761549 - DNA, 22 bp, Homo sapiens
ggtcctgggatggggcatgtgg

SEQ ID NO: 2761550 - DNA, 16 bp, Homo sapiens
ggtcctttccttctcg

SEQ ID NO: 2761551 - DNA, 21 bp, Homo sapiens
ggtcctttccttctcgtcttc

SEQ ID NO: 2761552 - DNA, 13 bp, Homo sapiens
ggtcggaccagct

SEQ ID NO: 2761553 - DNA, 14 bp, Homo sapiens
ggtcggaccagctt

SEQ ID NO: 2761554 - DNA, 20 bp, Homo sapiens
ggtctaagaatgacgatgcc

SEQ ID NO: 2761555 - DNA, 21 bp, Homo sapiens
ggtgaggtgggggtctggcct

SEQ ID NO: 2761556 - DNA, 23 bp, Homo sapiens
ggtgaggtgggggtctggcctag

SEQ ID NO: 2761557 - DNA, 16 bp, Homo sapiens
gtaacaagccagattt

SEQ ID NO: 2761558 - DNA, 23 bp, Homo sapiens
gtaacaagccagattttttaaaa

SEQ ID NO: 2761559 - DNA, 16 bp, Homo sapiens
gtacacagcaccagaa

SEQ ID NO: 2761560 - DNA, 14 bp, Homo sapiens
gtacagttatctaa

SEQ ID NO: 2761561 - DNA, 21 bp, Homo sapiens
gtaccatgggctacagtgtct

SEQ ID NO: 2761562 - DNA, 21 bp, Homo sapiens
gtactgagttctcatccacag

SEQ ID NO: 2761563 - DNA, 21 bp, Homo sapiens
gtagaatgtaaagcttgtctg

SEQ ID NO: 2761564 - DNA, 15 bp, Homo sapiens
gtagccccagtgaca

SEQ ID NO: 2761565 - DNA, 16 bp, Homo sapiens
gtagccccagtgacag

SEQ ID NO: 2761566 - DNA, 18 bp, Homo sapiens
gtatatatatatatatgt

SEQ ID NO: 2761567 - DNA, 21 bp, Homo sapiens
gtatgggttagggaaaacatt

SEQ ID NO: 2761568 - DNA, 19 bp, Homo sapiens
gtattctgcaacagcctgt

SEQ ID NO: 2761569 - DNA, 21 bp, Homo sapiens
gtattgatactggtcccactt

SEQ ID NO: 2761570 - DNA, 12 bp, Homo sapiens
gtcaaacaaata

SEQ ID NO: 2761571 - DNA, 17 bp, Homo sapiens
gtcaagttccgtctcct

SEQ ID NO: 2761572 - DNA, 19 bp, Homo sapiens
gtccactgcctccatgatg

SEQ ID NO: 2761573 - DNA, 14 bp, Homo sapiens
gtcgattagactgg

SEQ ID NO: 2761574 - DNA, 23 bp, Homo sapiens
gtcgttcccttgtgtctgttgct

SEQ ID NO: 2761575 - DNA, 21 bp, Homo sapiens
gtctatcaaccccagacactg

SEQ ID NO: 2761576 - DNA, 17 bp, Homo sapiens
gtctctggttcctcccc

SEQ ID NO: 2761577 - DNA, 17 bp, Homo sapiens
gtctgcctgcctcatgc

SEQ ID NO: 2761578 - DNA, 17 bp, Homo sapiens
gtctgctaaataaacat

SEQ ID NO: 2761579 - DNA, 20 bp, Homo sapiens
gtctggccttgggaagaagt

SEQ ID NO: 2761580 - DNA, 22 bp, Homo sapiens
gtgacatgtgttggcagcctct

SEQ ID NO: 2761581 - DNA, 16 bp, Homo sapiens
gtgacctcagctttga

SEQ ID NO: 2761582 - DNA, 18 bp, Homo sapiens
gtgactttggctgcatgc

SEQ ID NO: 2761583 - DNA, 23 bp, Homo sapiens
gtgagagacattaactcattaga

SEQ ID NO: 2761584 - DNA, 15 bp, Homo sapiens
gtgagcaaacagagg

SEQ ID NO: 2761585 - DNA, 22 bp, Homo sapiens
gtgaggtgggggtctggcctag

SEQ ID NO: 2761586 - DNA, 18 bp, Homo sapiens
gtgcatttgtgtctgcct

SEQ ID NO: 2761587 - DNA, 13 bp, Homo sapiens
gtgccaggactct

SEQ ID NO: 2761588 - DNA, 17 bp, Homo sapiens
gtgccaggactctcttt

SEQ ID NO: 2761589 - DNA, 19 bp, Homo sapiens
gtgccatgtcaaacaaata

SEQ ID NO: 2761590 - DNA, 16 bp, Homo sapiens
gtgctcatttcaggat

SEQ ID NO: 2761591 - DNA, 23 bp, Homo sapiens
gtggaactacattagtacacagc

SEQ ID NO: 2761592 - DNA, 13 bp, Homo sapiens
gtggacttttatt

SEQ ID NO: 2761593 - DNA, 19 bp, Homo sapiens
gtggcaagtgaatttgcct

SEQ ID NO: 2761594 - DNA, 18 bp, Homo sapiens
gtgtaattgagaaggaaa

SEQ ID NO: 2761595 - DNA, 12 bp, Homo sapiens
gtgtatatatat

SEQ ID NO: 2761596 - DNA, 17 bp, Homo sapiens
gtgtttcaggacagctg

SEQ ID NO: 2761597 - DNA, 12 bp, Homo sapiens
gttaatttaaag

SEQ ID NO: 2761598 - DNA, 23 bp, Homo sapiens
gttacagtaaatacactgtgaag

SEQ ID NO: 2761599 - DNA, 15 bp, Homo sapiens
gttagggaaaacatt

SEQ ID NO: 2761600 - DNA, 23 bp, Homo sapiens
gttagggaaaacattccatcctt

SEQ ID NO: 2761601 - DNA, 21 bp, Homo sapiens
gttatctaagttaatttaaag

SEQ ID NO: 2761602 - DNA, 16 bp, Homo sapiens
gttccgtctcctctcc

SEQ ID NO: 2761603 - DNA, 14 bp, Homo sapiens
gttcctgccttctc

SEQ ID NO: 2761604 - DNA, 18 bp, Homo sapiens
gttcctgccttctcttct

SEQ ID NO: 2761605 - DNA, 21 bp, Homo sapiens
gttctcatccacagaggccag

SEQ ID NO: 2761606 - DNA, 19 bp, Homo sapiens
gttcttctttctctgtatt

SEQ ID NO: 2761607 - DNA, 17 bp, Homo sapiens
gttgagagtgtgaccaa

SEQ ID NO: 2761608 - DNA, 21 bp, Homo sapiens
gttgctcctacccctgtcctg

SEQ ID NO: 2761609 - DNA, 13 bp, Homo sapiens
gtttcaggacagc

SEQ ID NO: 2761610 - DNA, 23 bp, Homo sapiens
gtttgtgcctttttatttttgtt

SEQ ID NO: 2761611 - DNA, 18 bp, Homo sapiens
gtttgttccccaagacat

SEQ ID NO: 2761612 - DNA, 16 bp, Homo sapiens
gtttttcggacagttt

SEQ ID NO: 2761613 - DNA, 16 bp, Homo sapiens
taaaaactgagtgact

SEQ ID NO: 2761614 - DNA, 21 bp, Homo sapiens
taaaaactgagtgactctata

SEQ ID NO: 2761615 - DNA, 17 bp, Homo sapiens
taaaatttatattgtaa

SEQ ID NO: 2761616 - DNA, 13 bp, Homo sapiens
taaagctgtgagc

SEQ ID NO: 2761617 - DNA, 12 bp, Homo sapiens
taactcattaga

SEQ ID NO: 2761618 - DNA, 17 bp, Homo sapiens
taactgagtgccttttg

SEQ ID NO: 2761619 - DNA, 13 bp, Homo sapiens
tttgtaaattgtc

SEQ ID NO: 2761620 - DNA, 12 bp, Homo sapiens
tttgtgtttcag

SEQ ID NO: 2761621 - DNA, 11 bp, Homo sapiens
ttttcttcctt

SEQ ID NO: 2761622 - DNA, 14 bp, Homo sapiens
tttttccgtaaaaa

SEQ ID NO: 2761623 - DNA, 15 bp, Homo sapiens
tttttccgtaaaaat

SEQ ID NO: 2761624 - DNA, 24 bp, Homo sapiens
tttttgccctggagcctcagcagc

SEQ ID NO: 2761625 - DNA, 16 bp, Homo sapiens
aaaaaggcaagccaca

SEQ ID NO: 2761626 - DNA, 21 bp, Homo sapiens
aaaaatatgaccacactccag

SEQ ID NO: 2761627 - DNA, 16 bp, Homo sapiens
aaaacattccatcctt

SEQ ID NO: 2761628 - DNA, 23 bp, Homo sapiens
aaaagggggctattccctggaga

SEQ ID NO: 2761629 - DNA, 22 bp, Homo sapiens
aaaatatgaccacactccagct

SEQ ID NO: 2761630 - DNA, 23 bp, Homo sapiens
aaaattaatctgggccagaattt

SEQ ID NO: 2761631 - DNA, 16 bp, Homo sapiens
aaacagattgtttgca

SEQ ID NO: 2761632 - DNA, 15 bp, Homo sapiens
aaacattatgatgtg

SEQ ID NO: 2761633 - DNA, 23 bp, Homo sapiens
aaacggcctcactaggcttctgg

SEQ ID NO: 2761634 - DNA, 12 bp, Homo sapiens
aaagctgtgagc

SEQ ID NO: 2761635 - DNA, 22 bp, Homo sapiens
aaatattttcttccttctcagc

SEQ ID NO: 2761636 - DNA, 18 bp, Homo sapiens
aaatgccactctgggcag

SEQ ID NO: 2761637 - DNA, 14 bp, Homo sapiens
aacattccatcctt

SEQ ID NO: 2761638 - DNA, 22 bp, Homo sapiens
aaccaaatcactgaactttgct

SEQ ID NO: 2761639 - DNA, 21 bp, Homo sapiens
aactccagccacccagccagg

SEQ ID NO: 2761640 - DNA, 16 bp, Homo sapiens
aactgaactctgacaa

SEQ ID NO: 2761641 - DNA, 16 bp, Homo sapiens
aactgagtgccttttg

SEQ ID NO: 2761642 - DNA, 13 bp, Homo sapiens
aactgggccagca

SEQ ID NO: 2761643 - DNA, 15 bp, Homo sapiens
aactttgctgagcct

SEQ ID NO: 2761644 - DNA, 19 bp, Homo sapiens
aagaatgacgatgccttca

SEQ ID NO: 2761645 - DNA, 12 bp, Homo sapiens
aagaatgttaag

SEQ ID NO: 2761646 - DNA, 18 bp, Homo sapiens
aagaatgttaagacttga

SEQ ID NO: 2761647 - DNA, 13 bp, Homo sapiens
aagactcagggga

SEQ ID NO: 2761648 - DNA, 19 bp, Homo sapiens
aagcatttgtttctacttt

SEQ ID NO: 2761649 - DNA, 19 bp, Homo sapiens
aaggacagcccctcctcca

SEQ ID NO: 2761650 - DNA, 15 bp, Homo sapiens
aaggactctaaaagg

SEQ ID NO: 2761651 - DNA, 14 bp, Homo sapiens
aaggggcctgcgca

SEQ ID NO: 2761652 - DNA, 18 bp, Homo sapiens
aagggtgggcatcaaaga

SEQ ID NO: 2761653 - DNA, 23 bp, Homo sapiens
aagggtgggcatcaaagatgaga

SEQ ID NO: 2761654 - DNA, 19 bp, Homo sapiens
aagtccatagctgagctgg

SEQ ID NO: 2761655 - DNA, 15 bp, Homo sapiens
aagtctcttcctgcc

SEQ ID NO: 2761656 - DNA, 19 bp, Homo sapiens
aagtctcttcctgcctccc

SEQ ID NO: 2761657 - DNA, 22 bp, Homo sapiens
aagtgttgtatcaaagtgtgat

SEQ ID NO: 2761658 - DNA, 20 bp, Homo sapiens
aagttacatgtttgcacctt

SEQ ID NO: 2761659 - DNA, 22 bp, Homo sapiens
aagttccgtctcctctccagcc

SEQ ID NO: 2761660 - DNA, 19 bp, Homo sapiens
aatacaatagtatgcagct

SEQ ID NO: 2761661 - DNA, 23 bp, Homo sapiens
aatacaatagtatgcagctaaaa

SEQ ID NO: 2761662 - DNA, 12 bp, Homo sapiens
aatacactgtga

SEQ ID NO: 2761663 - DNA, 14 bp, Homo sapiens
aatacactgtgaag

SEQ ID NO: 2761664 - DNA, 21 bp, Homo sapiens
aatatgcctgctatttgaagt

SEQ ID NO: 2761665 - DNA, 15 bp, Homo sapiens
aatattttcttcctt

SEQ ID NO: 2761666 - DNA, 21 bp, Homo sapiens
aatcctgaggggatatcccta

SEQ ID NO: 2761667 - DNA, 20 bp, Homo sapiens
aatcctgtcgattagactgg

SEQ ID NO: 2761668 - DNA, 16 bp, Homo sapiens
aatctgtttttctaac

SEQ ID NO: 2761669 - DNA, 13 bp, Homo sapiens
aatgccactctgg

SEQ ID NO: 2761670 - DNA, 12 bp, Homo sapiens
aatgctttgata

SEQ ID NO: 2761671 - DNA, 18 bp, Homo sapiens
aatgctttgatatttcaa

SEQ ID NO: 2761672 - DNA, 19 bp, Homo sapiens
aatgtaaagcttgtctgat

SEQ ID NO: 2761673 - DNA, 19 bp, Homo sapiens
aatgttaagacttgacagt

SEQ ID NO: 2761674 - DNA, 17 bp, Homo sapiens
aatgttagcctcaattt

SEQ ID NO: 2761675 - DNA, 22 bp, Homo sapiens
aattaatctgggccagaatttc

SEQ ID NO: 2761676 - DNA, 12 bp, Homo sapiens
aattctgcagaa

SEQ ID NO: 2761677 - DNA, 21 bp, Homo sapiens
aattcttccctatctttgcca

SEQ ID NO: 2761678 - DNA, 21 bp, Homo sapiens
aatttctcccgaatcctgagg

SEQ ID NO: 2761679 - DNA, 14 bp, Homo sapiens
acaaatggccttta

SEQ ID NO: 2761680 - DNA, 14 bp, Homo sapiens
acaactccagccac

SEQ ID NO: 2761681 - DNA, 16 bp, Homo sapiens
acaagttatttaaatc

SEQ ID NO: 2761682 - DNA, 23 bp, Homo sapiens
acaccggagtatgtgcagtgtgg

SEQ ID NO: 2761683 - DNA, 17 bp, Homo sapiens
acacgctccttcctctg

SEQ ID NO: 2761684 - DNA, 23 bp, Homo sapiens
acactgattacttttgggagggg

SEQ ID NO: 2761685 - DNA, 18 bp, Homo sapiens
acactgggacttgcaaaa

SEQ ID NO: 2761686 - DNA, 19 bp, Homo sapiens
acactgggacttgcaaaaa

SEQ ID NO: 2761687 - DNA, 17 bp, Homo sapiens
acacttacacccttttg

SEQ ID NO: 2761688 - DNA, 13 bp, Homo sapiens
acagaggccaggc

SEQ ID NO: 2761689 - DNA, 15 bp, Homo sapiens
acagattgtttgcaa

SEQ ID NO: 2761690 - DNA, 13 bp, Homo sapiens
acagcagactcag

SEQ ID NO: 2761691 - DNA, 13 bp, Homo sapiens
acagcagcagctc

SEQ ID NO: 2761692 - DNA, 14 bp, Homo sapiens
acagcccctcctcc

SEQ ID NO: 2761693 - DNA, 16 bp, Homo sapiens
acagcccctcctccat

SEQ ID NO: 2761694 - DNA, 22 bp, Homo sapiens
acagcctgtttgggaggctgga

SEQ ID NO: 2761695 - DNA, 15 bp, Homo sapiens
acaggggacactgaa

SEQ ID NO: 2761696 - DNA, 20 bp, Homo sapiens
acaggtgccgccagctgccg

SEQ ID NO: 2761697 - DNA, 17 bp, Homo sapiens
acagtaaatacactgtg

SEQ ID NO: 2761698 - DNA, 17 bp, Homo sapiens
acagtccgtcaaaacag

SEQ ID NO: 2761699 - DNA, 16 bp, Homo sapiens
acagtggaactacatt

SEQ ID NO: 2761700 - DNA, 18 bp, Homo sapiens
acagtggaactacattag

SEQ ID NO: 2761701 - DNA, 15 bp, Homo sapiens
acagttatctaagtt

SEQ ID NO: 2761702 - DNA, 16 bp, Homo sapiens
acagttatctaagtta

SEQ ID NO: 2761703 - DNA, 15 bp, Homo sapiens
acagtttatttgttg

SEQ ID NO: 2761704 - DNA, 12 bp, Homo sapiens
acatctcatttt

SEQ ID NO: 2761705 - DNA, 22 bp, Homo sapiens
acatgtttgcacctttctagtt

SEQ ID NO: 2761706 - DNA, 14 bp, Homo sapiens
acattaactcatta

SEQ ID NO: 2761707 - DNA, 13 bp, Homo sapiens
acattccctctca

SEQ ID NO: 2761708 - DNA, 17 bp, Homo sapiens
acattccctctcatcca

SEQ ID NO: 2761709 - DNA, 14 bp, Homo sapiens
accaaaagttacat

SEQ ID NO: 2761710 - DNA, 17 bp, Homo sapiens
accactgctctgatgaa

SEQ ID NO: 2761711 - DNA, 14 bp, Homo sapiens
acccagccaggagg

SEQ ID NO: 2761712 - DNA, 16 bp, Homo sapiens
acccatgcagctgctc

SEQ ID NO: 2761713 - DNA, 23 bp, Homo sapiens
accccgctgatggagccccacct

SEQ ID NO: 2761714 - DNA, 13 bp, Homo sapiens
accctcatgctgt

SEQ ID NO: 2761715 - DNA, 22 bp, Homo sapiens
accctccccacagtgccaccca

SEQ ID NO: 2761716 - DNA, 21 bp, Homo sapiens
acctgcctcccttcatgcatg

SEQ ID NO: 2761717 - DNA, 21 bp, Homo sapiens
accttgttgatgccagctgta

SEQ ID NO: 2761718 - DNA, 12 bp, Homo sapiens
acctttattctg

SEQ ID NO: 2761719 - DNA, 13 bp, Homo sapiens
acctttattctgg

SEQ ID NO: 2761720 - DNA, 15 bp, Homo sapiens
acctttctagttgaa

SEQ ID NO: 2761721 - DNA, 23 bp, Homo sapiens
actaaacgggcgccaagactcag

SEQ ID NO: 2761722 - DNA, 19 bp, Homo sapiens
actactagatcacttgtcc

SEQ ID NO: 2761723 - DNA, 19 bp, Homo sapiens
attcccttcatctggaacc

SEQ ID NO: 2761724 - DNA, 20 bp, Homo sapiens
attctgcaacagcctgtttg

SEQ ID NO: 2761725 - DNA, 21 bp, Homo sapiens
attcttccctatctttgccac

SEQ ID NO: 2761726 - DNA, 16 bp, Homo sapiens
attgaagagttgagga

SEQ ID NO: 2761727 - DNA, 21 bp, Homo sapiens
attgtgccatgtcaaacaaat

SEQ ID NO: 2761728 - DNA, 20 bp, Homo sapiens
atttatattgtaaatattgt

SEQ ID NO: 2761729 - DNA, 21 bp, Homo sapiens
atttatattgtaaatattgtg

SEQ ID NO: 2761730 - DNA, 15 bp, Homo sapiens
atttatgcactgtgg

SEQ ID NO: 2761731 - DNA, 19 bp, Homo sapiens
atttctaggtaggaaatgt

SEQ ID NO: 2761732 - DNA, 14 bp, Homo sapiens
atttgactcctcca

SEQ ID NO: 2761733 - DNA, 17 bp, Homo sapiens
atttgtgtctgcctgcc

SEQ ID NO: 2761734 - DNA, 22 bp, Homo sapiens
atttgttgagagtgtgaccaaa

SEQ ID NO: 2761735 - DNA, 18 bp, Homo sapiens
attttagcgtgctcactg

SEQ ID NO: 2761736 - DNA, 12 bp, Homo sapiens
attttcttcctt

SEQ ID NO: 2761737 - DNA, 17 bp, Homo sapiens
atttttatctgaagcta

SEQ ID NO: 2761738 - DNA, 18 bp, Homo sapiens
caaaacagattgtttgca

SEQ ID NO: 2761739 - DNA, 19 bp, Homo sapiens
caaaatgctgcttccactc

SEQ ID NO: 2761740 - DNA, 18 bp, Homo sapiens
caaagaaatagcaagaga

SEQ ID NO: 2761741 - DNA, 22 bp, Homo sapiens
caaagcccctacaactccagcc

SEQ ID NO: 2761742 - DNA, 14 bp, Homo sapiens
caaatcactgaact

SEQ ID NO: 2761743 - DNA, 15 bp, Homo sapiens
caaatgccactctgg

SEQ ID NO: 2761744 - DNA, 17 bp, Homo sapiens
caaatgccactctgggc

SEQ ID NO: 2761745 - DNA, 15 bp, Homo sapiens
caaatgtcttcctgg

SEQ ID NO: 2761746 - DNA, 11 bp, Homo sapiens
caacagcctgt

SEQ ID NO: 2761747 - DNA, 13 bp, Homo sapiens
caactccagccac

SEQ ID NO: 2761748 - DNA, 20 bp, Homo sapiens
caactccagccacccagcca

SEQ ID NO: 2761749 - DNA, 23 bp, Homo sapiens
caactccagccacccagccagga

SEQ ID NO: 2761750 - DNA, 14 bp, Homo sapiens
caagccagcttcct

SEQ ID NO: 2761751 - DNA, 16 bp, Homo sapiens
caagccagcttcctgt

SEQ ID NO: 2761752 - DNA, 21 bp, Homo sapiens
caagccagcttcctgtgcaga

SEQ ID NO: 2761753 - DNA, 18 bp, Homo sapiens
caaggacagcccctcctc

SEQ ID NO: 2761754 - DNA, 12 bp, Homo sapiens
caatcacattca

SEQ ID NO: 2761755 - DNA, 12 bp, Homo sapiens
caattcaaaaca

SEQ ID NO: 2761756 - DNA, 19 bp, Homo sapiens
cacagcaccagaatgtata

SEQ ID NO: 2761757 - DNA, 22 bp, Homo sapiens
cacataattcaggaagcagctt

SEQ ID NO: 2761758 - DNA, 17 bp, Homo sapiens
cacattccctctcatcc

SEQ ID NO: 2761759 - DNA, 18 bp, Homo sapiens
caccataggtcaccttta

SEQ ID NO: 2761760 - DNA, 17 bp, Homo sapiens
cacccaattcaaaacat

SEQ ID NO: 2761761 - DNA, 15 bp, Homo sapiens
caccccgctgatgga

SEQ ID NO: 2761762 - DNA, 23 bp, Homo sapiens
caccccgctgatggagccccacc

SEQ ID NO: 2761763 - DNA, 14 bp, Homo sapiens
caccctcatgctgt

SEQ ID NO: 2761764 - DNA, 17 bp, Homo sapiens
caccggagtatgtgcag

SEQ ID NO: 2761765 - DNA, 14 bp, Homo sapiens
cacctttattctgg

SEQ ID NO: 2761766 - DNA, 13 bp, Homo sapiens
cacgtgacagccg

SEQ ID NO: 2761767 - DNA, 21 bp, Homo sapiens
cactgggccggcagcctggtt

SEQ ID NO: 2761768 - DNA, 14 bp, Homo sapiens
cactggtttgaaga

SEQ ID NO: 2761769 - DNA, 19 bp, Homo sapiens
cacttcccatttgtgtttc

SEQ ID NO: 2761770 - DNA, 17 bp, Homo sapiens
cacttgtcctcttgcca

SEQ ID NO: 2761771 - DNA, 21 bp, Homo sapiens
cacttgtcctcttgccagctc

SEQ ID NO: 2761772 - DNA, 15 bp, Homo sapiens
cagaacacataattc

SEQ ID NO: 2761773 - DNA, 19 bp, Homo sapiens
cagaaggtctggtcggcaa

SEQ ID NO: 2761774 - DNA, 22 bp, Homo sapiens
cagaataaatgggtaacactga

SEQ ID NO: 2761775 - DNA, 22 bp, Homo sapiens
cagacactggtttgaagaatgt

SEQ ID NO: 2761776 - DNA, 15 bp, Homo sapiens
cagaggaggccagcc

SEQ ID NO: 2761777 - DNA, 18 bp, Homo sapiens
cagaggaggccagcctca

SEQ ID NO: 2761778 - DNA, 23 bp, Homo sapiens
cagcagactcagctctgacattc

SEQ ID NO: 2761779 - DNA, 14 bp, Homo sapiens
cagcagcagctcaa

SEQ ID NO: 2761780 - DNA, 13 bp, Homo sapiens
cagcctggagccg

SEQ ID NO: 2761781 - DNA, 14 bp, Homo sapiens
cagcctggttccct

SEQ ID NO: 2761782 - DNA, 17 bp, Homo sapiens
cagcctggttccctctt

SEQ ID NO: 2761783 - DNA, 22 bp, Homo sapiens
cagcctggttccctctttcctg

SEQ ID NO: 2761784 - DNA, 20 bp, Homo sapiens
cagcctgtttgggaggctgg

SEQ ID NO: 2761785 - DNA, 14 bp, Homo sapiens
cagctctgacattc

SEQ ID NO: 2761786 - DNA, 15 bp, Homo sapiens
cagctcttagctggt

SEQ ID NO: 2761787 - DNA, 22 bp, Homo sapiens
cagctgcttctgtgcatttgtg

SEQ ID NO: 2761788 - DNA, 20 bp, Homo sapiens
cagcttgtggcaagtgaatt

SEQ ID NO: 2761789 - DNA, 22 bp, Homo sapiens
cagctttaaaaaattaatctgg

SEQ ID NO: 2761790 - DNA, 14 bp, Homo sapiens
cagctttgatattt

SEQ ID NO: 2761791 - DNA, 18 bp, Homo sapiens
cagcttttcccaaaagcc

SEQ ID NO: 2761792 - DNA, 19 bp, Homo sapiens
caggacagctgcttctgtg

SEQ ID NO: 2761793 - DNA, 21 bp, Homo sapiens
caggccattccccgtctctgg

SEQ ID NO: 2761794 - DNA, 12 bp, Homo sapiens
cagggcctggcc

SEQ ID NO: 2761795 - DNA, 17 bp, Homo sapiens
cagggcttctcctctgc

SEQ ID NO: 2761796 - DNA, 22 bp, Homo sapiens
cagggcttctcctctgctaggc

SEQ ID NO: 2761797 - DNA, 12 bp, Homo sapiens
caggtcctttcc

SEQ ID NO: 2761798 - DNA, 23 bp, Homo sapiens
caggtcctttccttctcgtcttc

SEQ ID NO: 2761799 - DNA, 23 bp, Homo sapiens
caggtgccgccagctgccgcacc

SEQ ID NO: 2761800 - DNA, 16 bp, Homo sapiens
cagtaaatacactgtg

SEQ ID NO: 2761801 - DNA, 19 bp, Homo sapiens
cagtaaatacactgtgaag

SEQ ID NO: 2761802 - DNA, 18 bp, Homo sapiens
cagtagcacaagttattt

SEQ ID NO: 2761803 - DNA, 23 bp, Homo sapiens
cagtagcacaagttatttaaatc

SEQ ID NO: 2761804 - DNA, 18 bp, Homo sapiens
cagtaggttgaggacagg

SEQ ID NO: 2761805 - DNA, 21 bp, Homo sapiens
cagtatgggttagggaaaaca

SEQ ID NO: 2761806 - DNA, 23 bp, Homo sapiens
cagtatgggttagggaaaacatt

SEQ ID NO: 2761807 - DNA, 19 bp, Homo sapiens
cagtccgtcaaaacagatt

SEQ ID NO: 2761808 - DNA, 13 bp, Homo sapiens
cagtgccacccat

SEQ ID NO: 2761809 - DNA, 21 bp, Homo sapiens
cagtgccacccatgcagctgc

SEQ ID NO: 2761810 - DNA, 22 bp, Homo sapiens
cagtgggagggtaccagcagaa

SEQ ID NO: 2761811 - DNA, 20 bp, Homo sapiens
cagttaagcctttggaaaca

SEQ ID NO: 2761812 - DNA, 20 bp, Homo sapiens
catcaaagatgagaagccaa

SEQ ID NO: 2761813 - DNA, 17 bp, Homo sapiens
catcactgctgtccctc

SEQ ID NO: 2761814 - DNA, 19 bp, Homo sapiens
catcactgctgtccctcct

SEQ ID NO: 2761815 - DNA, 17 bp, Homo sapiens
catcagaaacaccctca

SEQ ID NO: 2761816 - DNA, 16 bp, Homo sapiens
catccaaatggctgct

SEQ ID NO: 2761817 - DNA, 15 bp, Homo sapiens
catccaggtcctttc

SEQ ID NO: 2761818 - DNA, 16 bp, Homo sapiens
catccaggtcctttcc

SEQ ID NO: 2761819 - DNA, 20 bp, Homo sapiens
catccaggtcctttccttct

SEQ ID NO: 2761820 - DNA, 13 bp, Homo sapiens
catccgcctctga

SEQ ID NO: 2761821 - DNA, 15 bp, Homo sapiens
catccgcctctgagc

SEQ ID NO: 2761822 - DNA, 17 bp, Homo sapiens
gaaatattttcttcctt

SEQ ID NO: 2761823 - DNA, 23 bp, Homo sapiens
gaaatattttcttccttctcagc

SEQ ID NO: 2761824 - DNA, 15 bp, Homo sapiens
gaacaaatggccttt

SEQ ID NO: 2761825 - DNA, 20 bp, Homo sapiens
gaacacataattcaggaagc

SEQ ID NO: 2761826 - DNA, 21 bp, Homo sapiens
gaacagcagactcagctctga

SEQ ID NO: 2761827 - DNA, 22 bp, Homo sapiens
gaaccttgttgatgccagctgt

SEQ ID NO: 2761828 - DNA, 15 bp, Homo sapiens
gaacttgaactgatt

SEQ ID NO: 2761829 - DNA, 16 bp, Homo sapiens
gaacttgaactgattc

SEQ ID NO: 2761830 - DNA, 15 bp, Homo sapiens
gaacttgttttctgg

SEQ ID NO: 2761831 - DNA, 17 bp, Homo sapiens
gaagaagtgattctgtc

SEQ ID NO: 2761832 - DNA, 13 bp, Homo sapiens
gaagaatggccat

SEQ ID NO: 2761833 - DNA, 22 bp, Homo sapiens
gaagaggggaagtctcttcctg

SEQ ID NO: 2761834 - DNA, 13 bp, Homo sapiens
gaagcatttgttt

SEQ ID NO: 2761835 - DNA, 21 bp, Homo sapiens
gaagtctcttcctgcctccca

SEQ ID NO: 2761836 - DNA, 20 bp, Homo sapiens
gaagtgactttggctgcatg

SEQ ID NO: 2761837 - DNA, 14 bp, Homo sapiens
gaatcctgtcgatt

SEQ ID NO: 2761838 - DNA, 22 bp, Homo sapiens
gaatcctgtcgattagactgga

SEQ ID NO: 2761839 - DNA, 12 bp, Homo sapiens
gaatgagctggg

SEQ ID NO: 2761840 - DNA, 14 bp, Homo sapiens
gaatgagctgggcc

SEQ ID NO: 2761841 - DNA, 21 bp, Homo sapiens
gaatgagctgggccctgggtg

SEQ ID NO: 2761842 - DNA, 14 bp, Homo sapiens
gaatgccctcagct

SEQ ID NO: 2761843 - DNA, 20 bp, Homo sapiens
gaatgttaagacttgacagt

SEQ ID NO: 2761844 - DNA, 20 bp, Homo sapiens
gacaaagaaatagcaagaga

SEQ ID NO: 2761845 - DNA, 16 bp, Homo sapiens
gacacaggggacactg

SEQ ID NO: 2761846 - DNA, 23 bp, Homo sapiens
gacaccggagtatgtgcagtgtg

SEQ ID NO: 2761847 - DNA, 14 bp, Homo sapiens
gacagctgcttctg

SEQ ID NO: 2761848 - DNA, 18 bp, Homo sapiens
gacagctgcttctgtgca

SEQ ID NO: 2761849 - DNA, 21 bp, Homo sapiens
gacattaactcattagactgg

SEQ ID NO: 2761850 - DNA, 22 bp, Homo sapiens
gacattaactcattagactgga

SEQ ID NO: 2761851 - DNA, 23 bp, Homo sapiens
gacattctgattcgaatgacact

SEQ ID NO: 2761852 - DNA, 11 bp, Homo sapiens
gacctgcctcc

SEQ ID NO: 2761853 - DNA, 12 bp, Homo sapiens
gacctgcctgta

SEQ ID NO: 2761854 - DNA, 21 bp, Homo sapiens
gactaaacgggcgccaagact

SEQ ID NO: 2761855 - DNA, 14 bp, Homo sapiens
gactcaaaccaaat

SEQ ID NO: 2761856 - DNA, 15 bp, Homo sapiens
gactggacagcttgt

SEQ ID NO: 2761857 - DNA, 19 bp, Homo sapiens
gactttggctgcatgcgag

SEQ ID NO: 2761858 - DNA, 14 bp, Homo sapiens
gagaccctccccac

SEQ ID NO: 2761859 - DNA, 17 bp, Homo sapiens
gagatgagaaacaacag

SEQ ID NO: 2761860 - DNA, 14 bp, Homo sapiens
gagccaggagcctc

SEQ ID NO: 2761861 - DNA, 22 bp, Homo sapiens
gagctggaaaggatgcttctgc

SEQ ID NO: 2761862 - DNA, 16 bp, Homo sapiens
gagctgggccctgggt

SEQ ID NO: 2761863 - DNA, 21 bp, Homo sapiens
gaggaataaagctgtgagcaa

SEQ ID NO: 2761864 - DNA, 12 bp, Homo sapiens
gaggggcctggc

SEQ ID NO: 2761865 - DNA, 16 bp, Homo sapiens
gagtatgtgcagtgtg

SEQ ID NO: 2761866 - DNA, 15 bp, Homo sapiens
gagtccactgcctcc

SEQ ID NO: 2761867 - DNA, 21 bp, Homo sapiens
gagtccactgcctccatgatg

SEQ ID NO: 2761868 - DNA, 19 bp, Homo sapiens
gagtctcactgtctgctgg

SEQ ID NO: 2761869 - DNA, 19 bp, Homo sapiens
gagttctcatccacagagg

SEQ ID NO: 2761870 - DNA, 13 bp, Homo sapiens
gatacaaagtgtt

SEQ ID NO: 2761871 - DNA, 12 bp, Homo sapiens
gatagaatgaca

SEQ ID NO: 2761872 - DNA, 19 bp, Homo sapiens
gatagagaatgccctcagc

SEQ ID NO: 2761873 - DNA, 22 bp, Homo sapiens
gatatccctatgtcccagcccc

SEQ ID NO: 2761874 - DNA, 16 bp, Homo sapiens
gatcctcccaggcttc

SEQ ID NO: 2761875 - DNA, 20 bp, Homo sapiens
gatgcaagccagcttcctgt

SEQ ID NO: 2761876 - DNA, 14 bp, Homo sapiens
gatgcctgacacag

SEQ ID NO: 2761877 - DNA, 14 bp, Homo sapiens
gatggggacaaaga

SEQ ID NO: 2761878 - DNA, 16 bp, Homo sapiens
gatggggagcagctgg

SEQ ID NO: 2761879 - DNA, 19 bp, Homo sapiens
gatgtgcttgttaactgag

SEQ ID NO: 2761880 - DNA, 20 bp, Homo sapiens
gatgtgcttgttaactgagt

SEQ ID NO: 2761881 - DNA, 18 bp, Homo sapiens
gattagactggacagctt

SEQ ID NO: 2761882 - DNA, 15 bp, Homo sapiens
gattcacatctcatt

SEQ ID NO: 2761883 - DNA, 16 bp, Homo sapiens
gattcgaatgacactg

SEQ ID NO: 2761884 - DNA, 12 bp, Homo sapiens
gcaaacagagga

SEQ ID NO: 2761885 - DNA, 13 bp, Homo sapiens
gcaagagatgaga

SEQ ID NO: 2761886 - DNA, 18 bp, Homo sapiens
gcaagtccatagctgagc

SEQ ID NO: 2761887 - DNA, 22 bp, Homo sapiens
gcaagtccatagctgagctgga

SEQ ID NO: 2761888 - DNA, 13 bp, Homo sapiens
gcacctttctagt

SEQ ID NO: 2761889 - DNA, 21 bp, Homo sapiens
gcactgggccggcagcctggt

SEQ ID NO: 2761890 - DNA, 15 bp, Homo sapiens
gcagactcagctctg

SEQ ID NO: 2761891 - DNA, 14 bp, Homo sapiens
gcagctgggcactg

SEQ ID NO: 2761892 - DNA, 24 bp, Homo sapiens
gcaggcgggactatcaggagtcca

SEQ ID NO: 2761893 - DNA, 15 bp, Homo sapiens
gcagggcctggcctg

SEQ ID NO: 2761894 - DNA, 16 bp, Homo sapiens
gcagggcctggcctgg

SEQ ID NO: 2761895 - DNA, 15 bp, Homo sapiens
gcatcagtgccctcc

SEQ ID NO: 2761896 - DNA, 17 bp, Homo sapiens
gcatccgcctctgagcc

SEQ ID NO: 2761897 - DNA, 19 bp, Homo sapiens
gcatccgcctctgagccag

SEQ ID NO: 2761898 - DNA, 14 bp, Homo sapiens
gcatggcccagcct

SEQ ID NO: 2761899 - DNA, 21 bp, Homo sapiens
gcatggcttgcccctgtggcc

SEQ ID NO: 2761900 - DNA, 23 bp, Homo sapiens
gccaagggctccagggccagggt

SEQ ID NO: 2761901 - DNA, 22 bp, Homo sapiens
gccaccccgctgatggagcccc

SEQ ID NO: 2761902 - DNA, 13 bp, Homo sapiens
gccactctgggca

SEQ ID NO: 2761903 - DNA, 12 bp, Homo sapiens
gccagatttttt

SEQ ID NO: 2761904 - DNA, 13 bp, Homo sapiens
gccagctgccgca

SEQ ID NO: 2761905 - DNA, 16 bp, Homo sapiens
gccaggagcctcctga

SEQ ID NO: 2761906 - DNA, 21 bp, Homo sapiens
gccaggagcctcctgaccctg

SEQ ID NO: 2761907 - DNA, 17 bp, Homo sapiens
gccattccccgtctctg

SEQ ID NO: 2761908 - DNA, 13 bp, Homo sapiens
gcccagcctggag

SEQ ID NO: 2761909 - DNA, 19 bp, Homo sapiens
gcccattcattccattctg

SEQ ID NO: 2761910 - DNA, 17 bp, Homo sapiens
gccccaccttgtctgct

SEQ ID NO: 2761911 - DNA, 19 bp, Homo sapiens
gcccctgtggccctggcat

SEQ ID NO: 2761912 - DNA, 19 bp, Homo sapiens
gccctggagcctcagcagc

SEQ ID NO: 2761913 - DNA, 22 bp, Homo sapiens
gccctgtcctgcctaaggctga

SEQ ID NO: 2761914 - DNA, 11 bp, Homo sapiens
gccgccagctg

SEQ ID NO: 2761915 - DNA, 17 bp, Homo sapiens
gccgccagctgccgcac

SEQ ID NO: 2761916 - DNA, 19 bp, Homo sapiens
gcctagtggggaggggcct

SEQ ID NO: 2761917 - DNA, 23 bp, Homo sapiens
gcctcccttcatgcatggaaatt

SEQ ID NO: 2761918 - DNA, 12 bp, Homo sapiens
gcctctgagcca

SEQ ID NO: 2761919 - DNA, 13 bp, Homo sapiens
gcctctgagccag

SEQ ID NO: 2761920 - DNA, 19 bp, Homo sapiens
gcctctgctgatcctccca

SEQ ID NO: 2761921 - DNA, 13 bp, Homo sapiens
gcctggcctgggt

SEQ ID NO: 2761922 - DNA, 14 bp, Homo sapiens
tcttctatcctgca

SEQ ID NO: 2761923 - DNA, 14 bp, Homo sapiens
tctttcctgtgcca

SEQ ID NO: 2761924 - DNA, 15 bp, Homo sapiens
tctttcctgtgccag

SEQ ID NO: 2761925 - DNA, 14 bp, Homo sapiens
tctttgccaccctc

SEQ ID NO: 2761926 - DNA, 18 bp, Homo sapiens
tctttgccaccctcatgc

SEQ ID NO: 2761927 - DNA, 15 bp, Homo sapiens
tcttttgtgtcagtg

SEQ ID NO: 2761928 - DNA, 16 bp, Homo sapiens
tgaactctgacaacag

SEQ ID NO: 2761929 - DNA, 14 bp, Homo sapiens
tgaactgaactctg

SEQ ID NO: 2761930 - DNA, 17 bp, Homo sapiens
tgaactgattcacatct

SEQ ID NO: 2761931 - DNA, 21 bp, Homo sapiens
tgaactgattcacatctcatt

SEQ ID NO: 2761932 - DNA, 11 bp, Homo sapiens
tgaactttgct

SEQ ID NO: 2761933 - DNA, 14 bp, Homo sapiens
tgaagctagaggaa

SEQ ID NO: 2761934 - DNA, 19 bp, Homo sapiens
tgacaacagacttctgaaa

SEQ ID NO: 2761935 - DNA, 22 bp, Homo sapiens
tgacagctaggatgtgcattct

SEQ ID NO: 2761936 - DNA, 18 bp, Homo sapiens
tgacagtggaactacatt

SEQ ID NO: 2761937 - DNA, 16 bp, Homo sapiens
tgaccaaaagttacat

SEQ ID NO: 2761938 - DNA, 23 bp, Homo sapiens
tgaccaaaagttacatgtttgca

SEQ ID NO: 2761939 - DNA, 12 bp, Homo sapiens
tgaccacactcc

SEQ ID NO: 2761940 - DNA, 17 bp, Homo sapiens
tgaccacactccagctg

SEQ ID NO: 2761941 - DNA, 20 bp, Homo sapiens
tgaccctgtgatgcctgaca

SEQ ID NO: 2761942 - DNA, 16 bp, Homo sapiens
tgacctcagctttgat

SEQ ID NO: 2761943 - DNA, 16 bp, Homo sapiens
tgacctgcctcccttc

SEQ ID NO: 2761944 - DNA, 17 bp, Homo sapiens
tgacctgcctcccttca

SEQ ID NO: 2761945 - DNA, 21 bp, Homo sapiens
tgacctgcctcccttcatgca

SEQ ID NO: 2761946 - DNA, 12 bp, Homo sapiens
tgagagtgtgac

SEQ ID NO: 2761947 - DNA, 13 bp, Homo sapiens
tgagagtgtgacc

SEQ ID NO: 2761948 - DNA, 22 bp, Homo sapiens
tgagcaaacagaggaggccagc

SEQ ID NO: 2761949 - DNA, 12 bp, Homo sapiens
tgagccaggagc

SEQ ID NO: 2761950 - DNA, 20 bp, Homo sapiens
tgagccaggagcctcctgac

SEQ ID NO: 2761951 - DNA, 17 bp, Homo sapiens
tgagctgggccctgggt

SEQ ID NO: 2761952 - DNA, 14 bp, Homo sapiens
tgaggacaggagag

SEQ ID NO: 2761953 - DNA, 20 bp, Homo sapiens
tgatactactagatcacttg

SEQ ID NO: 2761954 - DNA, 13 bp, Homo sapiens
tgatgaagaggag

SEQ ID NO: 2761955 - DNA, 15 bp, Homo sapiens
tgatgcaagccagct

SEQ ID NO: 2761956 - DNA, 21 bp, Homo sapiens
tgatgccagctgtactgagtt

SEQ ID NO: 2761957 - DNA, 21 bp, Homo sapiens
tgatgcctgacacaggggaca

SEQ ID NO: 2761958 - DNA, 15 bp, Homo sapiens
tgatgcctgtgaact

SEQ ID NO: 2761959 - DNA, 20 bp, Homo sapiens
tgatgcctgtgaactgaact

SEQ ID NO: 2761960 - DNA, 21 bp, Homo sapiens
tgatgcctgtgaactgaactc

SEQ ID NO: 2761961 - DNA, 14 bp, Homo sapiens
tgatggagccccac

SEQ ID NO: 2761962 - DNA, 16 bp, Homo sapiens
tgatggagccccacct

SEQ ID NO: 2761963 - DNA, 22 bp, Homo sapiens
tgatggagccccaccttgtctg

SEQ ID NO: 2761964 - DNA, 14 bp, Homo sapiens
tgcaaaaagggtca

SEQ ID NO: 2761965 - DNA, 18 bp, Homo sapiens
tgcaagccagcttcctgt

SEQ ID NO: 2761966 - DNA, 20 bp, Homo sapiens
tgcaagccagcttcctgtgc

SEQ ID NO: 2761967 - DNA, 23 bp, Homo sapiens
tgcaagtccatagctgagctgga

SEQ ID NO: 2761968 - DNA, 14 bp, Homo sapiens
tgcacctttctagt

SEQ ID NO: 2761969 - DNA, 17 bp, Homo sapiens
tgcagcccccactgcct

SEQ ID NO: 2761970 - DNA, 12 bp, Homo sapiens
tgcagctgctcc

SEQ ID NO: 2761971 - DNA, 19 bp, Homo sapiens
tgcatttgtgtctgcctgc

SEQ ID NO: 2761972 - DNA, 16 bp, Homo sapiens
tgccaccctcatgctg

SEQ ID NO: 2761973 - DNA, 13 bp, Homo sapiens
tgccaggactctc

SEQ ID NO: 2761974 - DNA, 15 bp, Homo sapiens
tgccaggactctctt

SEQ ID NO: 2761975 - DNA, 12 bp, Homo sapiens
tgccctcagctc

SEQ ID NO: 2761976 - DNA, 17 bp, Homo sapiens
tgccctggagcctcagc

SEQ ID NO: 2761977 - DNA, 19 bp, Homo sapiens
tgccctggagcctcagcag

SEQ ID NO: 2761978 - DNA, 22 bp, Homo sapiens
tgccctggagcctcagcagcaa

SEQ ID NO: 2761979 - DNA, 17 bp, Homo sapiens
tgccgcaccagcccgaa

SEQ ID NO: 2761980 - DNA, 16 bp, Homo sapiens
tgcctcatgctctcta

SEQ ID NO: 2761981 - DNA, 15 bp, Homo sapiens
tgcctcccaagcagc

SEQ ID NO: 2761982 - DNA, 16 bp, Homo sapiens
tgcctcccaagcagct

SEQ ID NO: 2761983 - DNA, 19 bp, Homo sapiens
tgcctgcctcatgctctct

SEQ ID NO: 2761984 - DNA, 17 bp, Homo sapiens
tgcctgctatttgaagt

SEQ ID NO: 2761985 - DNA, 21 bp, Homo sapiens
tgcctgtgaactgaactctga

SEQ ID NO: 2761986 - DNA, 18 bp, Homo sapiens
tgccttcaaaatgctgct

SEQ ID NO: 2761987 - DNA, 14 bp, Homo sapiens
tgccttctcttcta

SEQ ID NO: 2761988 - DNA, 13 bp, Homo sapiens
tgcctttgacctg

SEQ ID NO: 2761989 - DNA, 17 bp, Homo sapiens
tgcctttgacctgcctc

SEQ ID NO: 2761990 - DNA, 15 bp, Homo sapiens
tgcgaatgagctggg

SEQ ID NO: 2761991 - DNA, 20 bp, Homo sapiens
tgcgagtgctcatttcagga

SEQ ID NO: 2761992 - DNA, 17 bp, Homo sapiens
tgctcacattccctctc

SEQ ID NO: 2761993 - DNA, 18 bp, Homo sapiens
tgctccccaggccacccc

SEQ ID NO: 2761994 - DNA, 23 bp, Homo sapiens
tgctcctacccctgtcctggggc

SEQ ID NO: 2761995 - DNA, 23 bp, Homo sapiens
tgctgagcctgtaaaataaaagg

SEQ ID NO: 2761996 - DNA, 13 bp, Homo sapiens
tgctgtccctcct

SEQ ID NO: 2761997 - DNA, 13 bp, Homo sapiens
tgctgtgcaaatg

SEQ ID NO: 2761998 - DNA, 12 bp, Homo sapiens
tgcttctgctca

SEQ ID NO: 2761999 - DNA, 17 bp, Homo sapiens
tggaaacagctcgactt

SEQ ID NO: 2762000 - DNA, 21 bp, Homo sapiens
tggaaagttaatgtcaaggaa

SEQ ID NO: 2762001 - DNA, 16 bp, Homo sapiens
tggaacttgaactgat

SEQ ID NO: 2762002 - DNA, 15 bp, Homo sapiens
tggaagtgactttgg

SEQ ID NO: 2762003 - DNA, 19 bp, Homo sapiens
tggagccccaccttgtctg

SEQ ID NO: 2762004 - DNA, 12 bp, Homo sapiens
tggcagaggagg

SEQ ID NO: 2762005 - DNA, 15 bp, Homo sapiens
tggcaggtgcagccc

SEQ ID NO: 2762006 - DNA, 19 bp, Homo sapiens
tggcccagcctggagccgt

SEQ ID NO: 2762007 - DNA, 21 bp, Homo sapiens
tggcctgggtggggcagggcc

SEQ ID NO: 2762008 - DNA, 14 bp, Homo sapiens
tggcctggtccagg

SEQ ID NO: 2762009 - DNA, 20 bp, Homo sapiens
tggctttaggagcagtggga

SEQ ID NO: 2762010 - DNA, 12 bp, Homo sapiens
tgggaactgggc

SEQ ID NO: 2762011 - DNA, 20 bp, Homo sapiens
tgggaactgggccagcagag

SEQ ID NO: 2762012 - DNA, 17 bp, Homo sapiens
tgggccagaatttcaaa

SEQ ID NO: 2762013 - DNA, 14 bp, Homo sapiens
tgggccggcagcct

SEQ ID NO: 2762014 - DNA, 22 bp, Homo sapiens
tggggaggggcctggcctgggt

SEQ ID NO: 2762015 - DNA, 14 bp, Homo sapiens
tgggtaacactgat

SEQ ID NO: 2762016 - DNA, 21 bp, Homo sapiens
tgggtggggcagggcctggcc

SEQ ID NO: 2762017 - DNA, 14 bp, Homo sapiens
tgggtgtgtttcag

SEQ ID NO: 2762018 - DNA, 19 bp, Homo sapiens
tgggttagggaaaacattc

SEQ ID NO: 2762019 - DNA, 19 bp, Homo sapiens
tggtactcccccagccctc

SEQ ID NO: 2762020 - DNA, 18 bp, Homo sapiens
tggtcatcgtgacagcag

SEQ ID NO: 2762021 - DNA, 17 bp, Homo sapiens
tggtcccacttcacagc

SEQ ID NO: 2762022 - DNA, 21 bp, Homo sapiens
tggtcccacttcacagctgga

SEQ ID NO: 2762023 - DNA, 20 bp, Homo sapiens
agtaggttgaggacaggaga

SEQ ID NO: 2762024 - DNA, 21 bp, Homo sapiens
cacagggcctttggcaggtgc

SEQ ID NO: 2762025 - DNA, 15 bp, Homo sapiens
cacaggggacactga

SEQ ID NO: 2762026 - DNA, 17 bp, Homo sapiens
cacaggggacactgaac

SEQ ID NO: 2762027 - DNA, 18 bp, Homo sapiens
cacaggtgccgccagctg

SEQ ID NO: 2762028 - DNA, 18 bp, Homo sapiens
ccaaccctggcacccagg

SEQ ID NO: 2762029 - DNA, 15 bp, Homo sapiens
ccaacgggagcgagt

SEQ ID NO: 2762030 - DNA, 14 bp, Homo sapiens
ccaagcagctgaag

SEQ ID NO: 2762031 - DNA, 19 bp, Homo sapiens
ccaatcacattcaggcatg

SEQ ID NO: 2762032 - DNA, 16 bp, Homo sapiens
ccacccatgcagctgc

SEQ ID NO: 2762033 - DNA, 22 bp, Homo sapiens
ccactgcctttgacctgcctcc

SEQ ID NO: 2762034 - DNA, 13 bp, Homo sapiens
ccagaatttcaaa

SEQ ID NO: 2762035 - DNA, 16 bp, Homo sapiens
ccagccacccagccag

SEQ ID NO: 2762036 - DNA, 17 bp, Homo sapiens
ccagccacccagccagg

SEQ ID NO: 2762037 - DNA, 14 bp, Homo sapiens
ccagccaggagggg

SEQ ID NO: 2762038 - DNA, 17 bp, Homo sapiens
ccagccaggaggggctg

SEQ ID NO: 2762039 - DNA, 12 bp, Homo sapiens
ccagcctggagc

SEQ ID NO: 2762040 - DNA, 15 bp, Homo sapiens
ccagcttcctgtgca

SEQ ID NO: 2762041 - DNA, 16 bp, Homo sapiens
ccatagctgagctgga

SEQ ID NO: 2762042 - DNA, 22 bp, Homo sapiens
ccatcactgctgtccctcctga

SEQ ID NO: 2762043 - DNA, 23 bp, Homo sapiens
ccatcagaaacaccctcacactg

SEQ ID NO: 2762044 - DNA, 18 bp, Homo sapiens
ccatgatgcaagccagct

SEQ ID NO: 2762045 - DNA, 15 bp, Homo sapiens
ccatgtctcgactca

SEQ ID NO: 2762046 - DNA, 13 bp, Homo sapiens
ccattcattccat

SEQ ID NO: 2762047 - DNA, 14 bp, Homo sapiens
ccattcattccatt

SEQ ID NO: 2762048 - DNA, 21 bp, Homo sapiens
ccatttcatttgtgccagaat

SEQ ID NO: 2762049 - DNA, 19 bp, Homo sapiens
cccaagcagctgaagggtg

SEQ ID NO: 2762050 - DNA, 11 bp, Homo sapiens
cccagcctgga

SEQ ID NO: 2762051 - DNA, 15 bp, Homo sapiens
cccagcctggagccg

SEQ ID NO: 2762052 - DNA, 14 bp, Homo sapiens
cccagtgacagcta

SEQ ID NO: 2762053 - DNA, 15 bp, Homo sapiens
cccatgcagctgctc

SEQ ID NO: 2762054 - DNA, 19 bp, Homo sapiens
cccatgcagctgctcccca

SEQ ID NO: 2762055 - DNA, 16 bp, Homo sapiens
cccatgtctcgactca

SEQ ID NO: 2762056 - DNA, 17 bp, Homo sapiens
cccatgtctcgactcat

SEQ ID NO: 2762057 - DNA, 16 bp, Homo sapiens
cccatttgtgtttcag

SEQ ID NO: 2762058 - DNA, 21 bp, Homo sapiens
ccccgtctctggttcctcccc

SEQ ID NO: 2762059 - DNA, 13 bp, Homo sapiens
cccgaatcctgag

SEQ ID NO: 2762060 - DNA, 14 bp, Homo sapiens
cccgaatcctgagg

SEQ ID NO: 2762061 - DNA, 20 bp, Homo sapiens
cccgctacaattctgcagaa

SEQ ID NO: 2762062 - DNA, 16 bp, Homo sapiens
cccgctgatggagccc

SEQ ID NO: 2762063 - DNA, 20 bp, Homo sapiens
cccgctgatggagccccacc

SEQ ID NO: 2762064 - DNA, 15 bp, Homo sapiens
ccctacaactccagc

SEQ ID NO: 2762065 - DNA, 23 bp, Homo sapiens
ccctagatggttccctttgttgc

SEQ ID NO: 2762066 - DNA, 14 bp, Homo sapiens
ccctatctttgcca

SEQ ID NO: 2762067 - DNA, 12 bp, Homo sapiens
ccctcacactgg

SEQ ID NO: 2762068 - DNA, 13 bp, Homo sapiens
ccctcacactggg

SEQ ID NO: 2762069 - DNA, 23 bp, Homo sapiens
ccctccccacagtgccacccatg

SEQ ID NO: 2762070 - DNA, 24 bp, Homo sapiens
ccctcgcatccgcctctgagccag

SEQ ID NO: 2762071 - DNA, 18 bp, Homo sapiens
ccctctcatccaggtcct

SEQ ID NO: 2762072 - DNA, 17 bp, Homo sapiens
ccctggagcctcagcag

SEQ ID NO: 2762073 - DNA, 13 bp, Homo sapiens
ccctgtgatgcct

SEQ ID NO: 2762074 - DNA, 14 bp, Homo sapiens
ccctgtgatgcctg

SEQ ID NO: 2762075 - DNA, 14 bp, Homo sapiens
cccttcatctggaa

SEQ ID NO: 2762076 - DNA, 16 bp, Homo sapiens
cccttcatgcatggaa

SEQ ID NO: 2762077 - DNA, 12 bp, Homo sapiens
cccttgtgtctg

SEQ ID NO: 2762078 - DNA, 17 bp, Homo sapiens
ccctttgttgctgtctg

SEQ ID NO: 2762079 - DNA, 15 bp, Homo sapiens
ccgctgatggagccc

SEQ ID NO: 2762080 - DNA, 17 bp, Homo sapiens
ccgctgatggagcccca

SEQ ID NO: 2762081 - DNA, 16 bp, Homo sapiens
ccggagtatgtgcagt

SEQ ID NO: 2762082 - DNA, 13 bp, Homo sapiens
ccggcagcctggt

SEQ ID NO: 2762083 - DNA, 22 bp, Homo sapiens
cctagtggggaggggcctggcc

SEQ ID NO: 2762084 - DNA, 19 bp, Homo sapiens
cctatctttgccaccctca

SEQ ID NO: 2762085 - DNA, 22 bp, Homo sapiens
cctcacttttaatgaacaaatg

SEQ ID NO: 2762086 - DNA, 22 bp, Homo sapiens
cctccatgatgcaagccagctt

SEQ ID NO: 2762087 - DNA, 19 bp, Homo sapiens
cctcccaagcagctgaagg

SEQ ID NO: 2762088 - DNA, 20 bp, Homo sapiens
cctcccaagcagctgaaggg

SEQ ID NO: 2762089 - DNA, 22 bp, Homo sapiens
cctcccaagcagctgaagggtg

SEQ ID NO: 2762090 - DNA, 19 bp, Homo sapiens
cctccccacagtgccaccc

SEQ ID NO: 2762091 - DNA, 15 bp, Homo sapiens
cctcccctcctcctg

SEQ ID NO: 2762092 - DNA, 13 bp, Homo sapiens
cctcctcctcctc

SEQ ID NO: 2762093 - DNA, 14 bp, Homo sapiens
cctcctcctcctgt

SEQ ID NO: 2762094 - DNA, 14 bp, Homo sapiens
cctcctcctggact

SEQ ID NO: 2762095 - DNA, 13 bp, Homo sapiens
cctcctgaccctg

SEQ ID NO: 2762096 - DNA, 20 bp, Homo sapiens
cctcctgaccctgtgatgcc

SEQ ID NO: 2762097 - DNA, 23 bp, Homo sapiens
cctctcatccaggtcctttcctt

SEQ ID NO: 2762098 - DNA, 10 bp, Homo sapiens
cctctctctc

SEQ ID NO: 2762099 - DNA, 12 bp, Homo sapiens
cctctctctcac

SEQ ID NO: 2762100 - DNA, 14 bp, Homo sapiens
cctctgagccagga

SEQ ID NO: 2762101 - DNA, 14 bp, Homo sapiens
cctcttgccagctc

SEQ ID NO: 2762102 - DNA, 15 bp, Homo sapiens
cctcttgccagctca

SEQ ID NO: 2762103 - DNA, 19 bp, Homo sapiens
cctctttcctgtgccagga

SEQ ID NO: 2762104 - DNA, 22 bp, Homo sapiens
cctgacacaggggacactgaac

SEQ ID NO: 2762105 - DNA, 17 bp, Homo sapiens
cctgcctcccaagcagc

SEQ ID NO: 2762106 - DNA, 21 bp, Homo sapiens
cctgcctcccaagcagctgaa

SEQ ID NO: 2762107 - DNA, 14 bp, Homo sapiens
cctgccttctcttc

SEQ ID NO: 2762108 - DNA, 23 bp, Homo sapiens
cctggaagcatttgtttctactt

SEQ ID NO: 2762109 - DNA, 18 bp, Homo sapiens
cctggagcctcagcagca

SEQ ID NO: 2762110 - DNA, 21 bp, Homo sapiens
cctggagtctcactgtctgct

SEQ ID NO: 2762111 - DNA, 23 bp, Homo sapiens
cctggcatccaaatggctgcttt

SEQ ID NO: 2762112 - DNA, 21 bp, Homo sapiens
cctgggtggggcagggcctgg

SEQ ID NO: 2762113 - DNA, 20 bp, Homo sapiens
cctggtactcccccagccct

SEQ ID NO: 2762114 - DNA, 13 bp, Homo sapiens
cctggttccctct

SEQ ID NO: 2762115 - DNA, 19 bp, Homo sapiens
cctgtcctgcctaaggctg

SEQ ID NO: 2762116 - DNA, 16 bp, Homo sapiens
cctgtcgattagactg

SEQ ID NO: 2762117 - DNA, 22 bp, Homo sapiens
cctgtcgattagactggacagc

SEQ ID NO: 2762118 - DNA, 18 bp, Homo sapiens
cctgttcctgccttctct

SEQ ID NO: 2762119 - DNA, 12 bp, Homo sapiens
ctctttcctgtg

SEQ ID NO: 2762120 - DNA, 22 bp, Homo sapiens
ctgaacaccataggtagaatgt

SEQ ID NO: 2762121 - DNA, 16 bp, Homo sapiens
ctgaactctgacaaca

SEQ ID NO: 2762122 - DNA, 13 bp, Homo sapiens
ctgaactttgctg

SEQ ID NO: 2762123 - DNA, 22 bp, Homo sapiens
ctgaagctagaggaataaagct

SEQ ID NO: 2762124 - DNA, 18 bp, Homo sapiens
ctgacaacagacttctga

SEQ ID NO: 2762125 - DNA, 15 bp, Homo sapiens
ctgacattctgattc

SEQ ID NO: 2762126 - DNA, 13 bp, Homo sapiens
ctgagccaggagc

SEQ ID NO: 2762127 - DNA, 15 bp, Homo sapiens
ctgaggtctggattg

SEQ ID NO: 2762128 - DNA, 11 bp, Homo sapiens
ctgagtgactc

SEQ ID NO: 2762129 - DNA, 14 bp, Homo sapiens
ctgagtgccttttg

SEQ ID NO: 2762130 - DNA, 15 bp, Homo sapiens
ctgatggagccccac

SEQ ID NO: 2762131 - DNA, 17 bp, Homo sapiens
ctgatggagccccacct

SEQ ID NO: 2762132 - DNA, 17 bp, Homo sapiens
ctgattcacatctcatt

SEQ ID NO: 2762133 - DNA, 20 bp, Homo sapiens
ctgcctcccaagcagctgaa

SEQ ID NO: 2762134 - DNA, 14 bp, Homo sapiens
ctgcctcccttcat

SEQ ID NO: 2762135 - DNA, 18 bp, Homo sapiens
ctgcctcccttcatgcat

SEQ ID NO: 2762136 - DNA, 16 bp, Homo sapiens
ctgcctgcctcatgct

SEQ ID NO: 2762137 - DNA, 12 bp, Homo sapiens
ctgccttctctt

SEQ ID NO: 2762138 - DNA, 13 bp, Homo sapiens
ctgctcacattcc

SEQ ID NO: 2762139 - DNA, 19 bp, Homo sapiens
ctgctcacattccctctca

SEQ ID NO: 2762140 - DNA, 20 bp, Homo sapiens
ctgctgtccctcctgaggtc

SEQ ID NO: 2762141 - DNA, 12 bp, Homo sapiens
ctgcttccactc

SEQ ID NO: 2762142 - DNA, 16 bp, Homo sapiens
ctgcttttgtctccct

SEQ ID NO: 2762143 - DNA, 17 bp, Homo sapiens
ctgcttttgtctccctt

SEQ ID NO: 2762144 - DNA, 22 bp, Homo sapiens
ctggaagcatttgtttctactt

SEQ ID NO: 2762145 - DNA, 15 bp, Homo sapiens
ctggaagtgactttg

SEQ ID NO: 2762146 - DNA, 14 bp, Homo sapiens
ctggacagcttgtg

SEQ ID NO: 2762147 - DNA, 18 bp, Homo sapiens
ctggagcctcagcagcaa

SEQ ID NO: 2762148 - DNA, 20 bp, Homo sapiens
cttgtggtggctgctccatg

SEQ ID NO: 2762149 - DNA, 14 bp, Homo sapiens
cttgtgtctgttgc

SEQ ID NO: 2762150 - DNA, 21 bp, Homo sapiens
ctttccggtgtttaagacatt

SEQ ID NO: 2762151 - DNA, 14 bp, Homo sapiens
ctttccttctcgtc

SEQ ID NO: 2762152 - DNA, 14 bp, Homo sapiens
ctttctagttgaaa

SEQ ID NO: 2762153 - DNA, 21 bp, Homo sapiens
ctttctagttgaaaataaagt

SEQ ID NO: 2762154 - DNA, 21 bp, Homo sapiens
ctttcttccactaccctccct

SEQ ID NO: 2762155 - DNA, 20 bp, Homo sapiens
ctttgacctgcctcccttca

SEQ ID NO: 2762156 - DNA, 23 bp, Homo sapiens
ctttgacctgcctcccttcatgc

SEQ ID NO: 2762157 - DNA, 15 bp, Homo sapiens
ctttgatatttcaat

SEQ ID NO: 2762158 - DNA, 13 bp, Homo sapiens
ctttggcaggtgc

SEQ ID NO: 2762159 - DNA, 17 bp, Homo sapiens
ctttgttttactgtctt

SEQ ID NO: 2762160 - DNA, 14 bp, Homo sapiens
cttttgtctccctt

SEQ ID NO: 2762161 - DNA, 13 bp, Homo sapiens
gaaaacattccat

SEQ ID NO: 2762162 - DNA, 18 bp, Homo sapiens
gaaacaccctcacactgg

SEQ ID NO: 2762163 - DNA, 15 bp, Homo sapiens
gaaacagctcgactt

SEQ ID NO: 2762164 - DNA, 16 bp, Homo sapiens
gaaagtttacaggaaa

SEQ ID NO: 2762165 - DNA, 17 bp, Homo sapiens
gaacacataattcagga

SEQ ID NO: 2762166 - DNA, 20 bp, Homo sapiens
gaacaccataggtagaatgt

SEQ ID NO: 2762167 - DNA, 23 bp, Homo sapiens
gaactgattcacatctcattttt

SEQ ID NO: 2762168 - DNA, 14 bp, Homo sapiens
gaactgggccagca

SEQ ID NO: 2762169 - DNA, 16 bp, Homo sapiens
gaactgggccagcaga

SEQ ID NO: 2762170 - DNA, 18 bp, Homo sapiens
gaactgggccagcagagc

SEQ ID NO: 2762171 - DNA, 22 bp, Homo sapiens
gaagaatgttaagacttgacag

SEQ ID NO: 2762172 - DNA, 19 bp, Homo sapiens
gaagcatttgtttctactt

SEQ ID NO: 2762173 - DNA, 10 bp, Homo sapiens
gaagcctttg

SEQ ID NO: 2762174 - DNA, 11 bp, Homo sapiens
gaagcctttgt

SEQ ID NO: 2762175 - DNA, 13 bp, Homo sapiens
gaagtctcttcct

SEQ ID NO: 2762176 - DNA, 14 bp, Homo sapiens
gaagtctcttcctg

SEQ ID NO: 2762177 - DNA, 21 bp, Homo sapiens
gaagtgactttggctgcatgc

SEQ ID NO: 2762178 - DNA, 12 bp, Homo sapiens
gaatgacactgt

SEQ ID NO: 2762179 - DNA, 16 bp, Homo sapiens
gacaacagacttctga

SEQ ID NO: 2762180 - DNA, 20 bp, Homo sapiens
gacaccggagtatgtgcagt

SEQ ID NO: 2762181 - DNA, 16 bp, Homo sapiens
gacactggtttgaaga

SEQ ID NO: 2762182 - DNA, 14 bp, Homo sapiens
gacattaactcatt

SEQ ID NO: 2762183 - DNA, 22 bp, Homo sapiens
gaccagcttttcccaaaagccc

SEQ ID NO: 2762184 - DNA, 12 bp, Homo sapiens
gactcagctctg

SEQ ID NO: 2762185 - DNA, 22 bp, Homo sapiens
gactcagctctgacattctgat

SEQ ID NO: 2762186 - DNA, 23 bp, Homo sapiens
gactcctgcacacgctccttcct

SEQ ID NO: 2762187 - DNA, 12 bp, Homo sapiens
gactctctttct

SEQ ID NO: 2762188 - DNA, 14 bp, Homo sapiens
gactggacagcttg

SEQ ID NO: 2762189 - DNA, 21 bp, Homo sapiens
gactggacagcttgtggcaag

SEQ ID NO: 2762190 - DNA, 21 bp, Homo sapiens
ggagcagctgggcactgggcc

SEQ ID NO: 2762191 - DNA, 12 bp, Homo sapiens
ggagccccacct

SEQ ID NO: 2762192 - DNA, 12 bp, Homo sapiens
ggagcctcagca

SEQ ID NO: 2762193 - DNA, 13 bp, Homo sapiens
ggaggggcctggc

SEQ ID NO: 2762194 - DNA, 16 bp, Homo sapiens
ggaggggcctggcctg

SEQ ID NO: 2762195 - DNA, 15 bp, Homo sapiens
ggagtatgtgcagtg

SEQ ID NO: 2762196 - DNA, 24 bp, Homo sapiens
ggagttgctcctacccctgtcctg

SEQ ID NO: 2762197 - DNA, 19 bp, Homo sapiens
ggatggtcatcgtgacagc

SEQ ID NO: 2762198 - DNA, 14 bp, Homo sapiens
ggcaagccacagaa

SEQ ID NO: 2762199 - DNA, 13 bp, Homo sapiens
ggcagggcctggc

SEQ ID NO: 2762200 - DNA, 15 bp, Homo sapiens
ggcagggcctggcct

SEQ ID NO: 2762201 - DNA, 20 bp, Homo sapiens
ggcagtcttttgtgtcagtg

SEQ ID NO: 2762202 - DNA, 13 bp, Homo sapiens
ggcatcaaagatg

SEQ ID NO: 2762203 - DNA, 18 bp, Homo sapiens
ggcatcaaagatgagaag

SEQ ID NO: 2762204 - DNA, 17 bp, Homo sapiens
ggcatccaaatggctgc

SEQ ID NO: 2762205 - DNA, 16 bp, Homo sapiens
ggcatgcgaatgagct

SEQ ID NO: 2762206 - DNA, 19 bp, Homo sapiens
ggcatgcgaatgagctggg

SEQ ID NO: 2762207 - DNA, 22 bp, Homo sapiens
ggcatggcccagcctggagccg

SEQ ID NO: 2762208 - DNA, 20 bp, Homo sapiens
ggccacctccaaggactcta

SEQ ID NO: 2762209 - DNA, 14 bp, Homo sapiens
ggccagcagagcat

SEQ ID NO: 2762210 - DNA, 12 bp, Homo sapiens
ggcccagcctgg

SEQ ID NO: 2762211 - DNA, 19 bp, Homo sapiens
ggcctcactaggcttctgg

SEQ ID NO: 2762212 - DNA, 13 bp, Homo sapiens
ggcctggcctggt

SEQ ID NO: 2762213 - DNA, 18 bp, Homo sapiens
ggctacagtgtctggcct

SEQ ID NO: 2762214 - DNA, 15 bp, Homo sapiens
ggctattccctggag

SEQ ID NO: 2762215 - DNA, 16 bp, Homo sapiens
ggctctgtattctgca

SEQ ID NO: 2762216 - DNA, 20 bp, Homo sapiens
ggctgggaactgggccagca

SEQ ID NO: 2762217 - DNA, 16 bp, Homo sapiens
gggaactgggccagca

SEQ ID NO: 2762218 - DNA, 19 bp, Homo sapiens
gggaagaagtgattctgtc

SEQ ID NO: 2762219 - DNA, 10 bp, Homo sapiens
gggagtagga

SEQ ID NO: 2762220 - DNA, 13 bp, Homo sapiens
gggcagggcctgg

SEQ ID NO: 2762221 - DNA, 13 bp, Homo sapiens
gggcatggcttgc

SEQ ID NO: 2762222 - DNA, 16 bp, Homo sapiens
gggcctttggcaggtg

SEQ ID NO: 2762223 - DNA, 23 bp, Homo sapiens
gggctacaccttagcctgccctc

SEQ ID NO: 2762224 - DNA, 14 bp, Homo sapiens
gggctattccctgg

SEQ ID NO: 2762225 - DNA, 12 bp, Homo sapiens
gggcttctcctc

SEQ ID NO: 2762226 - DNA, 13 bp, Homo sapiens
gggcttctcctct

SEQ ID NO: 2762227 - DNA, 16 bp, Homo sapiens
ggggcagggcctggcc

SEQ ID NO: 2762228 - DNA, 13 bp, Homo sapiens
ggggcctggcctg

SEQ ID NO: 2762229 - DNA, 21 bp, Homo sapiens
gggtgcaatgataatgaagaa

SEQ ID NO: 2762230 - DNA, 16 bp, Homo sapiens
gggttgccagtcctgc

SEQ ID NO: 2762231 - DNA, 17 bp, Homo sapiens
gggttgccagtcctgca

SEQ ID NO: 2762232 - DNA, 10 bp, Homo sapiens
ggtggctgct

SEQ ID NO: 2762233 - DNA, 16 bp, Homo sapiens
ggttagggaaaacatt

SEQ ID NO: 2762234 - DNA, 14 bp, Homo sapiens
ggttccctctttcc

SEQ ID NO: 2762235 - DNA, 18 bp, Homo sapiens
gtacacagcaccagaatg

SEQ ID NO: 2762236 - DNA, 14 bp, Homo sapiens
gtaccatgggctac

SEQ ID NO: 2762237 - DNA, 17 bp, Homo sapiens
gtactcccccagccctc

SEQ ID NO: 2762238 - DNA, 19 bp, Homo sapiens
gtagaatgtaaagcttgtc

SEQ ID NO: 2762239 - DNA, 19 bp, Homo sapiens
gtagggttgccagtcctgc

SEQ ID NO: 2762240 - DNA, 15 bp, Homo sapiens
gtcaaaacagattgt

SEQ ID NO: 2762241 - DNA, 16 bp, Homo sapiens
gtcccacttcacagct

SEQ ID NO: 2762242 - DNA, 19 bp, Homo sapiens
gtcccacttcacagctgga

SEQ ID NO: 2762243 - DNA, 13 bp, Homo sapiens
gtccctcctgagg

SEQ ID NO: 2762244 - DNA, 17 bp, Homo sapiens
taactgggggaaaagat

SEQ ID NO: 2762245 - DNA, 17 bp, Homo sapiens
taagacttgacagtgga

SEQ ID NO: 2762246 - DNA, 14 bp, Homo sapiens
taagtcagaacagc

SEQ ID NO: 2762247 - DNA, 14 bp, Homo sapiens
taagttaatttaaa

SEQ ID NO: 2762248 - DNA, 20 bp, Homo sapiens
taatcctggagtctcactgt

SEQ ID NO: 2762249 - DNA, 14 bp, Homo sapiens
taatgaacaaatgg

SEQ ID NO: 2762250 - DNA, 14 bp, Homo sapiens
tacaaggacagccc

SEQ ID NO: 2762251 - DNA, 14 bp, Homo sapiens
tacaattctgcaga

SEQ ID NO: 2762252 - DNA, 17 bp, Homo sapiens
tacacagcaccagaatg

SEQ ID NO: 2762253 - DNA, 19 bp, Homo sapiens
tacagttatctaagttaat

SEQ ID NO: 2762254 - DNA, 21 bp, Homo sapiens
tacccgctacaattctgcaga

SEQ ID NO: 2762255 - DNA, 19 bp, Homo sapiens
tactcccccagccctcagt

SEQ ID NO: 2762256 - DNA, 22 bp, Homo sapiens
tactcttcagttaagcctttgg

SEQ ID NO: 2762257 - DNA, 16 bp, Homo sapiens
tacttatatggaaatt

SEQ ID NO: 2762258 - DNA, 14 bp, Homo sapiens
tacttcctcctcct

SEQ ID NO: 2762259 - DNA, 18 bp, Homo sapiens
tagaatataaacacataa

SEQ ID NO: 2762260 - DNA, 15 bp, Homo sapiens
tagaatgtaaagctt

SEQ ID NO: 2762261 - DNA, 18 bp, Homo sapiens
tagagaatgccctcagct

SEQ ID NO: 2762262 - DNA, 13 bp, Homo sapiens
tagctgagctgga

SEQ ID NO: 2762263 - DNA, 19 bp, Homo sapiens
taggctaccctcctctaga

SEQ ID NO: 2762264 - DNA, 13 bp, Homo sapiens
tagggaaaacatt

SEQ ID NO: 2762265 - DNA, 18 bp, Homo sapiens
tagggaaaacattccatc

SEQ ID NO: 2762266 - DNA, 23 bp, Homo sapiens
tagttacagtaaatacactgtga

SEQ ID NO: 2762267 - DNA, 17 bp, Homo sapiens
tagttgaaaataaagtg

SEQ ID NO: 2762268 - DNA, 22 bp, Homo sapiens
tataattatttttatctgaagc

SEQ ID NO: 2762269 - DNA, 20 bp, Homo sapiens
tatactcttatagacaacat

SEQ ID NO: 2762270 - DNA, 17 bp, Homo sapiens
tatatggaaattctgct

SEQ ID NO: 2762271 - DNA, 17 bp, Homo sapiens
tatcaaccccagacact

SEQ ID NO: 2762272 - DNA, 21 bp, Homo sapiens
tatcaaccccagacactggtt

SEQ ID NO: 2762273 - DNA, 14 bp, Homo sapiens
tatgcctgctattt

SEQ ID NO: 2762274 - DNA, 17 bp, Homo sapiens
tatgttgaagcctttgt

SEQ ID NO: 2762275 - DNA, 19 bp, Homo sapiens
tattagtgacctcagcttt

SEQ ID NO: 2762276 - DNA, 13 bp, Homo sapiens
tattccctggaga

SEQ ID NO: 2762277 - DNA, 18 bp, Homo sapiens
tattctgcaacagcctgt

SEQ ID NO: 2762278 - DNA, 12 bp, Homo sapiens
tattttcttcct

SEQ ID NO: 2762279 - DNA, 16 bp, Homo sapiens
tcaaaacagattgttt

SEQ ID NO: 2762280 - DNA, 15 bp, Homo sapiens
tcaaagcaaatgtct

SEQ ID NO: 2762281 - DNA, 23 bp, Homo sapiens
tcaattcttccctatctttgcca

SEQ ID NO: 2762282 - DNA, 11 bp, Homo sapiens
tcacactggga

SEQ ID NO: 2762283 - DNA, 13 bp, Homo sapiens
tcacattccctct

SEQ ID NO: 2762284 - DNA, 17 bp, Homo sapiens
tcacattccctctcatc

SEQ ID NO: 2762285 - DNA, 19 bp, Homo sapiens
tcacattccctctcatcca

SEQ ID NO: 2762286 - DNA, 17 bp, Homo sapiens
tcacctacttcctcctc

SEQ ID NO: 2762287 - DNA, 13 bp, Homo sapiens
tcacctggaagca

SEQ ID NO: 2762288 - DNA, 21 bp, Homo sapiens
tcactgaactttgctgagcct

SEQ ID NO: 2762289 - DNA, 17 bp, Homo sapiens
tcactgctgtccctcct

SEQ ID NO: 2762290 - DNA, 18 bp, Homo sapiens
tcactgctgtccctcctg

SEQ ID NO: 2762291 - DNA, 21 bp, Homo sapiens
tcactgctgtccctcctgagg

SEQ ID NO: 2762292 - DNA, 19 bp, Homo sapiens
tcacttttaatgaacaaat

SEQ ID NO: 2762293 - DNA, 19 bp, Homo sapiens
tcagaaacaccctcacact

SEQ ID NO: 2762294 - DNA, 14 bp, Homo sapiens
tcagaacagcagac

SEQ ID NO: 2762295 - DNA, 14 bp, Homo sapiens
tgctcctacccctg

SEQ ID NO: 2762296 - DNA, 21 bp, Homo sapiens
tgctcctacccctgtcctggg

SEQ ID NO: 2762297 - DNA, 19 bp, Homo sapiens
tgctctgatgaagaggagt

SEQ ID NO: 2762298 - DNA, 16 bp, Homo sapiens
tgctgtccctcctgag

SEQ ID NO: 2762299 - DNA, 14 bp, Homo sapiens
tgctgtctggcttt

SEQ ID NO: 2762300 - DNA, 20 bp, Homo sapiens
tgcttatgtatgcctattca

SEQ ID NO: 2762301 - DNA, 16 bp, Homo sapiens
tgcttccactcagggc

SEQ ID NO: 2762302 - DNA, 14 bp, Homo sapiens
tgcttgttaactga

SEQ ID NO: 2762303 - DNA, 18 bp, Homo sapiens
tgcttgttaactgagtgc

SEQ ID NO: 2762304 - DNA, 22 bp, Homo sapiens
tggaaacagctcgactttaaaa

SEQ ID NO: 2762305 - DNA, 23 bp, Homo sapiens
tggaaaggatgcttctgctcaca

SEQ ID NO: 2762306 - DNA, 17 bp, Homo sapiens
tggaaattcccttcatc

SEQ ID NO: 2762307 - DNA, 13 bp, Homo sapiens
tggaacttgaact

SEQ ID NO: 2762308 - DNA, 12 bp, Homo sapiens
tggacagcttgt

SEQ ID NO: 2762309 - DNA, 13 bp, Homo sapiens
tggagccccacct

SEQ ID NO: 2762310 - DNA, 18 bp, Homo sapiens
tggagccccaccttgtct

SEQ ID NO: 2762311 - DNA, 22 bp, Homo sapiens
tggagccccaccttgtctgcta

SEQ ID NO: 2762312 - DNA, 17 bp, Homo sapiens
tggagccgtggccgagg

SEQ ID NO: 2762313 - DNA, 16 bp, Homo sapiens
tggagcctcagcagca

SEQ ID NO: 2762314 - DNA, 15 bp, Homo sapiens
tggcacaaagttggt

SEQ ID NO: 2762315 - DNA, 16 bp, Homo sapiens
tggcccagcctggagc

SEQ ID NO: 2762316 - DNA, 20 bp, Homo sapiens
tggcctagtggggaggggcc

SEQ ID NO: 2762317 - DNA, 18 bp, Homo sapiens
tggcctgggtggggcagg

SEQ ID NO: 2762318 - DNA, 15 bp, Homo sapiens
tggcctggtccaggc

SEQ ID NO: 2762319 - DNA, 12 bp, Homo sapiens
tggcctttatta

SEQ ID NO: 2762320 - DNA, 22 bp, Homo sapiens
tggcctttattaaaaactgagt

SEQ ID NO: 2762321 - DNA, 12 bp, Homo sapiens
tggctgcatgcg

SEQ ID NO: 2762322 - DNA, 17 bp, Homo sapiens
tggctttaggagcagtg

SEQ ID NO: 2762323 - DNA, 17 bp, Homo sapiens
tgggaactgggccagca

SEQ ID NO: 2762324 - DNA, 19 bp, Homo sapiens
tgggaactgggccagcaga

SEQ ID NO: 2762325 - DNA, 23 bp, Homo sapiens
tgggcactgggccggcagcctgg

SEQ ID NO: 2762326 - DNA, 12 bp, Homo sapiens
tgggccagcaga

SEQ ID NO: 2762327 - DNA, 13 bp, Homo sapiens
tgggccagcagag

SEQ ID NO: 2762328 - DNA, 15 bp, Homo sapiens
tgggccggcagcctg

SEQ ID NO: 2762329 - DNA, 16 bp, Homo sapiens
tgggccggcagcctgg

SEQ ID NO: 2762330 - DNA, 17 bp, Homo sapiens
tgggccggcagcctggt

SEQ ID NO: 2762331 - DNA, 14 bp, Homo sapiens
tggggcagggcctg

SEQ ID NO: 2762332 - DNA, 21 bp, Homo sapiens
tggggtttttgccctggagcc

SEQ ID NO: 2762333 - DNA, 18 bp, Homo sapiens
tgggttagggaaaacatt

SEQ ID NO: 2762334 - DNA, 21 bp, Homo sapiens
tgggttagggaaaacattcca

SEQ ID NO: 2762335 - DNA, 24 bp, Homo sapiens
tggttccctctttcctgtgccagg

SEQ ID NO: 2762336 - DNA, 23 bp, Homo sapiens
tggtttgaagaatgttaagactt

SEQ ID NO: 2762337 - DNA, 14 bp, Homo sapiens
tgtaaatattgtgt

SEQ ID NO: 2762338 - DNA, 15 bp, Homo sapiens
tgtaaatattgtgtg

SEQ ID NO: 2762339 - DNA, 18 bp, Homo sapiens
tgtaacaagccagatttt

SEQ ID NO: 2762340 - DNA, 16 bp, Homo sapiens
tttaatgaacaaatgg

SEQ ID NO: 2762341 - DNA, 11 bp, Homo sapiens
tttcaggacag

SEQ ID NO: 2762342 - DNA, 21 bp, Homo sapiens
tttcaggacagctgcttctgt

SEQ ID NO: 2762343 - DNA, 22 bp, Homo sapiens
tttccgtaaaaatgatttcagt

SEQ ID NO: 2762344 - DNA, 13 bp, Homo sapiens
tttgaagtgtaat

SEQ ID NO: 2762345 - DNA, 20 bp, Homo sapiens
tttgcacctttctagttgaa

SEQ ID NO: 2762346 - DNA, 19 bp, Homo sapiens
tttgccaccctcatgctgt

SEQ ID NO: 2762347 - DNA, 12 bp, Homo sapiens
tttgcctgtaac

SEQ ID NO: 2762348 - DNA, 13 bp, Homo sapiens
tttgcctgtaaca

SEQ ID NO: 2762349 - DNA, 16 bp, Homo sapiens
tttgtgagcaggctgt

SEQ ID NO: 2762350 - DNA, 20 bp, Homo sapiens
tttgtgtctgcctgcctcat

SEQ ID NO: 2762351 - DNA, 13 bp, Homo sapiens
tttgtgtttcaga

SEQ ID NO: 2762352 - DNA, 16 bp, Homo sapiens
ttttaatgaacaaatg

SEQ ID NO: 2762353 - DNA, 12 bp, Homo sapiens
ttttctaactgg

SEQ ID NO: 2762354 - DNA, 16 bp, Homo sapiens
tttttccgtaaaaatg

SEQ ID NO: 2762355 - DNA, 13 bp, Homo sapiens
actagatcacttg

SEQ ID NO: 2762356 - DNA, 19 bp, Homo sapiens
actatcaggagtccactgc

SEQ ID NO: 2762357 - DNA, 20 bp, Homo sapiens
actcaaaccaaatcactgaa

SEQ ID NO: 2762358 - DNA, 14 bp, Homo sapiens
actcattagactgg

SEQ ID NO: 2762359 - DNA, 22 bp, Homo sapiens
actctatatagctgatcagttt

SEQ ID NO: 2762360 - DNA, 15 bp, Homo sapiens
actctctttcttcca

SEQ ID NO: 2762361 - DNA, 23 bp, Homo sapiens
actctgacaacagacttctgaaa

SEQ ID NO: 2762362 - DNA, 21 bp, Homo sapiens
actcttcagttaagcctttgg

SEQ ID NO: 2762363 - DNA, 21 bp, Homo sapiens
actgaactttgctgagcctgt

SEQ ID NO: 2762364 - DNA, 12 bp, Homo sapiens
actgagtgactc

SEQ ID NO: 2762365 - DNA, 23 bp, Homo sapiens
actgagtgactctatatagctga

SEQ ID NO: 2762366 - DNA, 19 bp, Homo sapiens
actgattcacatctcattt

SEQ ID NO: 2762367 - DNA, 20 bp, Homo sapiens
actgattcacatctcatttt

SEQ ID NO: 2762368 - DNA, 18 bp, Homo sapiens
actgctgtccctcctgag

SEQ ID NO: 2762369 - DNA, 19 bp, Homo sapiens
actgctgtccctcctgagg

SEQ ID NO: 2762370 - DNA, 17 bp, Homo sapiens
actggaacttgaactga

SEQ ID NO: 2762371 - DNA, 16 bp, Homo sapiens
actggcctctgctgat

SEQ ID NO: 2762372 - DNA, 23 bp, Homo sapiens
actggcctctgctgatcctccca

SEQ ID NO: 2762373 - DNA, 18 bp, Homo sapiens
actgggccagcagagcat

SEQ ID NO: 2762374 - DNA, 18 bp, Homo sapiens
actgggccggcagcctgg

SEQ ID NO: 2762375 - DNA, 19 bp, Homo sapiens
actgggccggcagcctggt

SEQ ID NO: 2762376 - DNA, 17 bp, Homo sapiens
actggtttgaagaatgt

SEQ ID NO: 2762377 - DNA, 20 bp, Homo sapiens
actggtttgaagaatgttaa

SEQ ID NO: 2762378 - DNA, 14 bp, Homo sapiens
acttcctcctcctc

SEQ ID NO: 2762379 - DNA, 13 bp, Homo sapiens
acttgaactgatt

SEQ ID NO: 2762380 - DNA, 17 bp, Homo sapiens
acttgcaaaaagggtca

SEQ ID NO: 2762381 - DNA, 13 bp, Homo sapiens
actttggctgcat

SEQ ID NO: 2762382 - DNA, 18 bp, Homo sapiens
acttttaatgaacaaatg

SEQ ID NO: 2762383 - DNA, 19 bp, Homo sapiens
agaaaaatatgaccacact

SEQ ID NO: 2762384 - DNA, 17 bp, Homo sapiens
agaaacaccctcacact

SEQ ID NO: 2762385 - DNA, 21 bp, Homo sapiens
agaagtgattctgtccctcca

SEQ ID NO: 2762386 - DNA, 14 bp, Homo sapiens
agaatgccctcagc

SEQ ID NO: 2762387 - DNA, 23 bp, Homo sapiens
agaatgtatattaaggtgtggct

SEQ ID NO: 2762388 - DNA, 18 bp, Homo sapiens
agacaccggagtatgtgc

SEQ ID NO: 2762389 - DNA, 20 bp, Homo sapiens
agacattaactcattagact

SEQ ID NO: 2762390 - DNA, 16 bp, Homo sapiens
agaccccagagtaggg

SEQ ID NO: 2762391 - DNA, 13 bp, Homo sapiens
agactcagctctg

SEQ ID NO: 2762392 - DNA, 18 bp, Homo sapiens
agactcagctctgacatt

SEQ ID NO: 2762393 - DNA, 20 bp, Homo sapiens
agactcagctctgacattct

SEQ ID NO: 2762394 - DNA, 13 bp, Homo sapiens
agactggaacttg

SEQ ID NO: 2762395 - DNA, 18 bp, Homo sapiens
agactggaacttgaactg

SEQ ID NO: 2762396 - DNA, 13 bp, Homo sapiens
agactggacagct

SEQ ID NO: 2762397 - DNA, 17 bp, Homo sapiens
agactggacagcttgtg

SEQ ID NO: 2762398 - DNA, 12 bp, Homo sapiens
agacttgacagt

SEQ ID NO: 2762399 - DNA, 14 bp, Homo sapiens
agacttgacagtgg

SEQ ID NO: 2762400 - DNA, 15 bp, Homo sapiens
agacttgacagtgga

SEQ ID NO: 2762401 - DNA, 14 bp, Homo sapiens
agagaatgccctca

SEQ ID NO: 2762402 - DNA, 20 bp, Homo sapiens
agaggaataaagctgtgagc

SEQ ID NO: 2762403 - DNA, 21 bp, Homo sapiens
agaggaataaagctgtgagca

SEQ ID NO: 2762404 - DNA, 12 bp, Homo sapiens
agaggaggatgg

SEQ ID NO: 2762405 - DNA, 19 bp, Homo sapiens
agagtggccaatccctgtg

SEQ ID NO: 2762406 - DNA, 14 bp, Homo sapiens
agagttgaggatgt

SEQ ID NO: 2762407 - DNA, 21 bp, Homo sapiens
agatcacttgtcctcttgcca

SEQ ID NO: 2762408 - DNA, 17 bp, Homo sapiens
agcaaatgtcttcctgg

SEQ ID NO: 2762409 - DNA, 19 bp, Homo sapiens
agcacaagttatttaaatc

SEQ ID NO: 2762410 - DNA, 14 bp, Homo sapiens
agcaccagaatgta

SEQ ID NO: 2762411 - DNA, 19 bp, Homo sapiens
agcagactcagctctgaca

SEQ ID NO: 2762412 - DNA, 12 bp, Homo sapiens
agcagctgggca

SEQ ID NO: 2762413 - DNA, 17 bp, Homo sapiens
agccagcttcctgtgca

SEQ ID NO: 2762414 - DNA, 18 bp, Homo sapiens
agccagcttcctgtgcag

SEQ ID NO: 2762415 - DNA, 14 bp, Homo sapiens
agcccgaacaccat

SEQ ID NO: 2762416 - DNA, 21 bp, Homo sapiens
agcccgaacaccattgaggga

SEQ ID NO: 2762417 - DNA, 19 bp, Homo sapiens
agccgtttgttccccaaga

SEQ ID NO: 2762418 - DNA, 13 bp, Homo sapiens
agcctcacctcat

SEQ ID NO: 2762419 - DNA, 23 bp, Homo sapiens
agcctcacttttaatgaacaaat

SEQ ID NO: 2762420 - DNA, 12 bp, Homo sapiens
agcctcagcagc

SEQ ID NO: 2762421 - DNA, 15 bp, Homo sapiens
agcctcagcagcaaa

SEQ ID NO: 2762422 - DNA, 18 bp, Homo sapiens
agcctggttccctctttc

SEQ ID NO: 2762423 - DNA, 19 bp, Homo sapiens
agcctggttccctctttcc

SEQ ID NO: 2762424 - DNA, 22 bp, Homo sapiens
agctgccgcaccagcccgaaca

SEQ ID NO: 2762425 - DNA, 16 bp, Homo sapiens
agctgctccccaggcc

SEQ ID NO: 2762426 - DNA, 19 bp, Homo sapiens
agctgctccccaggccacc

SEQ ID NO: 2762427 - DNA, 22 bp, Homo sapiens
agctgggatcacatgtggactt

SEQ ID NO: 2762428 - DNA, 16 bp, Homo sapiens
agctgtgagcaaacag

SEQ ID NO: 2762429 - DNA, 19 bp, Homo sapiens
agctgtgagcaaacagagg

SEQ ID NO: 2762430 - DNA, 13 bp, Homo sapiens
agcttcctgtgca

SEQ ID NO: 2762431 - DNA, 18 bp, Homo sapiens
agcttttcccaaaagccc

SEQ ID NO: 2762432 - DNA, 17 bp, Homo sapiens
aggacagcccctcctcc

SEQ ID NO: 2762433 - DNA, 19 bp, Homo sapiens
aggactctctttcttccac

SEQ ID NO: 2762434 - DNA, 13 bp, Homo sapiens
aggaggccagcct

SEQ ID NO: 2762435 - DNA, 21 bp, Homo sapiens
aggaggccagcctcacctcat

SEQ ID NO: 2762436 - DNA, 14 bp, Homo sapiens
aggatgcttctgct

SEQ ID NO: 2762437 - DNA, 18 bp, Homo sapiens
aggatgcttctgctcaca

SEQ ID NO: 2762438 - DNA, 15 bp, Homo sapiens
aggcaagccacagaa

SEQ ID NO: 2762439 - DNA, 19 bp, Homo sapiens
aggcatgcgaatgagctgg

SEQ ID NO: 2762440 - DNA, 16 bp, Homo sapiens
aggcatggcccagcct

SEQ ID NO: 2762441 - DNA, 13 bp, Homo sapiens
aggccagcctcac

SEQ ID NO: 2762442 - DNA, 23 bp, Homo sapiens
aggccaggcatggcccagcctgg

SEQ ID NO: 2762443 - DNA, 14 bp, Homo sapiens
aggcccggcctctc

SEQ ID NO: 2762444 - DNA, 15 bp, Homo sapiens
aggcccggcctctca

SEQ ID NO: 2762445 - DNA, 19 bp, Homo sapiens
aggcgggactatcaggagt

SEQ ID NO: 2762446 - DNA, 22 bp, Homo sapiens
aggctaccctcctctagaaggc

SEQ ID NO: 2762447 - DNA, 20 bp, Homo sapiens
aggctgaacttgttttctgg

SEQ ID NO: 2762448 - DNA, 15 bp, Homo sapiens
agggaaaacattcca

SEQ ID NO: 2762449 - DNA, 16 bp, Homo sapiens
agggaaaacattccat

SEQ ID NO: 2762450 - DNA, 15 bp, Homo sapiens
agggatggggagcag

SEQ ID NO: 2762451 - DNA, 18 bp, Homo sapiens
agggatggggagcagctg

SEQ ID NO: 2762452 - DNA, 12 bp, Homo sapiens
agggcctggcct

SEQ ID NO: 2762453 - DNA, 14 bp, Homo sapiens
agggctccagggcc

SEQ ID NO: 2762454 - DNA, 17 bp, Homo sapiens
agggctccagggccagg

SEQ ID NO: 2762455 - DNA, 20 bp, Homo sapiens
cctcgcatccgcctctgagc

SEQ ID NO: 2762456 - DNA, 19 bp, Homo sapiens
cctcgtgaagaggggaagt

SEQ ID NO: 2762457 - DNA, 13 bp, Homo sapiens
cctctccagccct

SEQ ID NO: 2762458 - DNA, 11 bp, Homo sapiens
cctctgagcca

SEQ ID NO: 2762459 - DNA, 13 bp, Homo sapiens
cctctgagccagg

SEQ ID NO: 2762460 - DNA, 16 bp, Homo sapiens
cctctgagccaggagc

SEQ ID NO: 2762461 - DNA, 21 bp, Homo sapiens
cctctgagccaggagcctcct

SEQ ID NO: 2762462 - DNA, 15 bp, Homo sapiens
cctctgctgatcctc

SEQ ID NO: 2762463 - DNA, 21 bp, Homo sapiens
cctctttcctgtgccaggact

SEQ ID NO: 2762464 - DNA, 20 bp, Homo sapiens
cctgaaatattttcttcctt

SEQ ID NO: 2762465 - DNA, 19 bp, Homo sapiens
cctgacacaggggacactg

SEQ ID NO: 2762466 - DNA, 21 bp, Homo sapiens
cctgaccctgtgatgcctgac

SEQ ID NO: 2762467 - DNA, 21 bp, Homo sapiens
cctgaggggatatccctatgt

SEQ ID NO: 2762468 - DNA, 21 bp, Homo sapiens
cctgcaagtccatagctgagc

SEQ ID NO: 2762469 - DNA, 21 bp, Homo sapiens
cctgcacacgctccttcctct

SEQ ID NO: 2762470 - DNA, 14 bp, Homo sapiens
cctgcctcatgctc

SEQ ID NO: 2762471 - DNA, 18 bp, Homo sapiens
cctgcctcccaagcagct

SEQ ID NO: 2762472 - DNA, 19 bp, Homo sapiens
cctgcctcccaagcagctg

SEQ ID NO: 2762473 - DNA, 23 bp, Homo sapiens
cctgcctcccaagcagctgaagg

SEQ ID NO: 2762474 - DNA, 16 bp, Homo sapiens
cctgcctcccttcatg

SEQ ID NO: 2762475 - DNA, 14 bp, Homo sapiens
cctggactcctgca

SEQ ID NO: 2762476 - DNA, 15 bp, Homo sapiens
cctggagcctcagca

SEQ ID NO: 2762477 - DNA, 17 bp, Homo sapiens
cctggagcctcagcagc

SEQ ID NO: 2762478 - DNA, 13 bp, Homo sapiens
cctggggctgggt

SEQ ID NO: 2762479 - DNA, 14 bp, Homo sapiens
cctggtccaggctt

SEQ ID NO: 2762480 - DNA, 14 bp, Homo sapiens
cctggttccctctt

SEQ ID NO: 2762481 - DNA, 18 bp, Homo sapiens
cctggttccctctttcct

SEQ ID NO: 2762482 - DNA, 20 bp, Homo sapiens
cctggttccctctttcctgt

SEQ ID NO: 2762483 - DNA, 16 bp, Homo sapiens
cctgtaacaagccaga

SEQ ID NO: 2762484 - DNA, 14 bp, Homo sapiens
cctgtgatgcctga

SEQ ID NO: 2762485 - DNA, 19 bp, Homo sapiens
cctgtgatgcctgacacag

SEQ ID NO: 2762486 - DNA, 22 bp, Homo sapiens
cctgtgtgtcgttcccttgtgt

SEQ ID NO: 2762487 - DNA, 17 bp, Homo sapiens
cctgttcctgccttctc

SEQ ID NO: 2762488 - DNA, 20 bp, Homo sapiens
ccttaccactgctctgatga

SEQ ID NO: 2762489 - DNA, 14 bp, Homo sapiens
ccttcatctggaac

SEQ ID NO: 2762490 - DNA, 12 bp, Homo sapiens
ccttcatgcatg

SEQ ID NO: 2762491 - DNA, 16 bp, Homo sapiens
ccttctcgtcttcctc

SEQ ID NO: 2762492 - DNA, 14 bp, Homo sapiens
ccttgttgatgcca

SEQ ID NO: 2762493 - DNA, 23 bp, Homo sapiens
ccttgttgatgccagctgtactg

SEQ ID NO: 2762494 - DNA, 14 bp, Homo sapiens
cctttccttctcgt

SEQ ID NO: 2762495 - DNA, 15 bp, Homo sapiens
cctttgacctgcctc

SEQ ID NO: 2762496 - DNA, 12 bp, Homo sapiens
cgaatgacactg

SEQ ID NO: 2762497 - DNA, 20 bp, Homo sapiens
cgaatgagctgggccctggg

SEQ ID NO: 2762498 - DNA, 19 bp, Homo sapiens
cgcatccgcctctgagcca

SEQ ID NO: 2762499 - DNA, 22 bp, Homo sapiens
cgcatccgcctctgagccagga

SEQ ID NO: 2762500 - DNA, 15 bp, Homo sapiens
cgccagctgccgcac

SEQ ID NO: 2762501 - DNA, 20 bp, Homo sapiens
cgccagctgccgcaccagcc

SEQ ID NO: 2762502 - DNA, 17 bp, Homo sapiens
cgctacaattctgcaga

SEQ ID NO: 2762503 - DNA, 19 bp, Homo sapiens
cgctacaattctgcagaaa

SEQ ID NO: 2762504 - DNA, 14 bp, Homo sapiens
cgctgatggagccc

SEQ ID NO: 2762505 - DNA, 16 bp, Homo sapiens
cgctgatggagcccca

SEQ ID NO: 2762506 - DNA, 18 bp, Homo sapiens
cgctgatggagccccacc

SEQ ID NO: 2762507 - DNA, 20 bp, Homo sapiens
cgctgatggagccccacctt

SEQ ID NO: 2762508 - DNA, 22 bp, Homo sapiens
cggaatcctgtcgattagactg

SEQ ID NO: 2762509 - DNA, 20 bp, Homo sapiens
cggcagcctggttccctctt

SEQ ID NO: 2762510 - DNA, 19 bp, Homo sapiens
cgggactatcaggagtcca

SEQ ID NO: 2762511 - DNA, 21 bp, Homo sapiens
cgtcaaaacagattgtttgca

SEQ ID NO: 2762512 - DNA, 22 bp, Homo sapiens
cgtcaaaacagattgtttgcaa

SEQ ID NO: 2762513 - DNA, 12 bp, Homo sapiens
cgtctcctctcc

SEQ ID NO: 2762514 - DNA, 21 bp, Homo sapiens
cgttcccttgtgtctgttgct

SEQ ID NO: 2762515 - DNA, 20 bp, Homo sapiens
cgtttgttccccaagacatt

SEQ ID NO: 2762516 - DNA, 17 bp, Homo sapiens
ctaaataaacatgtgcc

SEQ ID NO: 2762517 - DNA, 14 bp, Homo sapiens
ctacaactccagcc

SEQ ID NO: 2762518 - DNA, 15 bp, Homo sapiens
ctacaattctgcaga

SEQ ID NO: 2762519 - DNA, 17 bp, Homo sapiens
ctacaattctgcagaaa

SEQ ID NO: 2762520 - DNA, 16 bp, Homo sapiens
ctactagatcacttgt

SEQ ID NO: 2762521 - DNA, 15 bp, Homo sapiens
ctacttcctcctcct

SEQ ID NO: 2762522 - DNA, 18 bp, Homo sapiens
ctatcaggagtccactgc

SEQ ID NO: 2762523 - DNA, 21 bp, Homo sapiens
ctatctttgccaccctcatgc

SEQ ID NO: 2762524 - DNA, 19 bp, Homo sapiens
ctatgtcccagcccctggt

SEQ ID NO: 2762525 - DNA, 13 bp, Homo sapiens
ctattcaaaataa

SEQ ID NO: 2762526 - DNA, 22 bp, Homo sapiens
ctcaaaccaaatcactgaactt

SEQ ID NO: 2762527 - DNA, 19 bp, Homo sapiens
ctcaattcttccctatctt

SEQ ID NO: 2762528 - DNA, 17 bp, Homo sapiens
ctcacattccctctcat

SEQ ID NO: 2762529 - DNA, 20 bp, Homo sapiens
ctcacattccctctcatcca

SEQ ID NO: 2762530 - DNA, 14 bp, Homo sapiens
ctcacctacttcct

SEQ ID NO: 2762531 - DNA, 13 bp, Homo sapiens
ctcactaggcttc

SEQ ID NO: 2762532 - DNA, 18 bp, Homo sapiens
ctcactgtctgctggcaa

SEQ ID NO: 2762533 - DNA, 22 bp, Homo sapiens
ctcacttttaatgaacaaatgg

SEQ ID NO: 2762534 - DNA, 23 bp, Homo sapiens
ctcagcagcaaatgccactctgg

SEQ ID NO: 2762535 - DNA, 18 bp, Homo sapiens
ctcagggcttctcctctg

SEQ ID NO: 2762536 - DNA, 20 bp, Homo sapiens
ctcaggggatcggctgggaa

SEQ ID NO: 2762537 - DNA, 15 bp, Homo sapiens
ctcatccaggtcctt

SEQ ID NO: 2762538 - DNA, 19 bp, Homo sapiens
ctcatccaggtcctttcct

SEQ ID NO: 2762539 - DNA, 14 bp, Homo sapiens
ctcatgctctctat

SEQ ID NO: 2762540 - DNA, 18 bp, Homo sapiens
ctccagccacccagccag

SEQ ID NO: 2762541 - DNA, 21 bp, Homo sapiens
ctccagccatcaagagactga

SEQ ID NO: 2762542 - DNA, 23 bp, Homo sapiens
ctccatgatgcaagccagcttcc

SEQ ID NO: 2762543 - DNA, 15 bp, Homo sapiens
ctcccaagcagctga

SEQ ID NO: 2762544 - DNA, 12 bp, Homo sapiens
ctcccccagccc

SEQ ID NO: 2762545 - DNA, 15 bp, Homo sapiens
ctcctcctcctgttc

SEQ ID NO: 2762546 - DNA, 15 bp, Homo sapiens
ctcctcctgttcctg

SEQ ID NO: 2762547 - DNA, 20 bp, Homo sapiens
ctcctcctgttcctgccttc

SEQ ID NO: 2762548 - DNA, 13 bp, Homo sapiens
ctcctgaggtctg

SEQ ID NO: 2762549 - DNA, 15 bp, Homo sapiens
ctcctgaggtctgga

SEQ ID NO: 2762550 - DNA, 18 bp, Homo sapiens
ctcctgaggtctggattg

SEQ ID NO: 2762551 - DNA, 12 bp, Homo sapiens
ctcctggactcc

SEQ ID NO: 2762552 - DNA, 17 bp, Homo sapiens
ctcgcatccgcctctga

SEQ ID NO: 2762553 - DNA, 23 bp, Homo sapiens
ctcgcatccgcctctgagccagg

SEQ ID NO: 2762554 - DNA, 16 bp, Homo sapiens
ctcgtcttcctctctc

SEQ ID NO: 2762555 - DNA, 23 bp, Homo sapiens
tcagaataaatgggtaacactga

SEQ ID NO: 2762556 - DNA, 21 bp, Homo sapiens
tcagagtggccaatccctgtg

SEQ ID NO: 2762557 - DNA, 17 bp, Homo sapiens
tcagatagaatgacagt

SEQ ID NO: 2762558 - DNA, 16 bp, Homo sapiens
tcagctctgacattct

SEQ ID NO: 2762559 - DNA, 17 bp, Homo sapiens
tcaggacagctgcttct

SEQ ID NO: 2762560 - DNA, 14 bp, Homo sapiens
tcaggagtccactg

SEQ ID NO: 2762561 - DNA, 20 bp, Homo sapiens
tcaggagtccactgcctcca

SEQ ID NO: 2762562 - DNA, 18 bp, Homo sapiens
tcagggcttctcctctgc

SEQ ID NO: 2762563 - DNA, 21 bp, Homo sapiens
tcaggtgaaaaaggcaagcca

SEQ ID NO: 2762564 - DNA, 22 bp, Homo sapiens
tcagtcaagttccgtctcctct

SEQ ID NO: 2762565 - DNA, 16 bp, Homo sapiens
tcagttaagcctttgg

SEQ ID NO: 2762566 - DNA, 12 bp, Homo sapiens
tcatctggaacc

SEQ ID NO: 2762567 - DNA, 18 bp, Homo sapiens
tcatctggaaccatcaga

SEQ ID NO: 2762568 - DNA, 15 bp, Homo sapiens
tcatgcatggaaatt

SEQ ID NO: 2762569 - DNA, 22 bp, Homo sapiens
tcatggggtttttgccctggag

SEQ ID NO: 2762570 - DNA, 18 bp, Homo sapiens
tcattccaacacctgcca

SEQ ID NO: 2762571 - DNA, 15 bp, Homo sapiens
tcattccattctgga

SEQ ID NO: 2762572 - DNA, 15 bp, Homo sapiens
tccaaatgcagcttt

SEQ ID NO: 2762573 - DNA, 14 bp, Homo sapiens
tccaaatggctgct

SEQ ID NO: 2762574 - DNA, 21 bp, Homo sapiens
tccactaccctccctcgcatc

SEQ ID NO: 2762575 - DNA, 19 bp, Homo sapiens
tccactcagggcttctcct

SEQ ID NO: 2762576 - DNA, 19 bp, Homo sapiens
tccagccacccagccagga

SEQ ID NO: 2762577 - DNA, 20 bp, Homo sapiens
tccagccatcaagagactga

SEQ ID NO: 2762578 - DNA, 21 bp, Homo sapiens
tccagccatcaagagactgag

SEQ ID NO: 2762579 - DNA, 23 bp, Homo sapiens
tccaggcttgggctccattccca

SEQ ID NO: 2762580 - DNA, 19 bp, Homo sapiens
tccagggtggactctgtct

SEQ ID NO: 2762581 - DNA, 20 bp, Homo sapiens
tccatgagggtgggggtgat

SEQ ID NO: 2762582 - DNA, 19 bp, Homo sapiens
tccatgatgcaagccagct

SEQ ID NO: 2762583 - DNA, 14 bp, Homo sapiens
tccattctggaagt

SEQ ID NO: 2762584 - DNA, 23 bp, Homo sapiens
tcccaagcagctgaagggtgact

SEQ ID NO: 2762585 - DNA, 14 bp, Homo sapiens
tcccagcccctggt

SEQ ID NO: 2762586 - DNA, 23 bp, Homo sapiens
tcccagcccctggtactccccca

SEQ ID NO: 2762587 - DNA, 15 bp, Homo sapiens
tcccatttgtgtttc

SEQ ID NO: 2762588 - DNA, 14 bp, Homo sapiens
tccccaggccaccc

SEQ ID NO: 2762589 - DNA, 15 bp, Homo sapiens
tcccgaatcctgagg

SEQ ID NO: 2762590 - DNA, 23 bp, Homo sapiens
tccctcgcatccgcctctgagcc

SEQ ID NO: 2762591 - DNA, 14 bp, Homo sapiens
tccctctcatccag

SEQ ID NO: 2762592 - DNA, 14 bp, Homo sapiens
tccctctttcctgt

SEQ ID NO: 2762593 - DNA, 22 bp, Homo sapiens
tccctgtgtgtcgttcccttgt

SEQ ID NO: 2762594 - DNA, 18 bp, Homo sapiens
tcccttcatgcatggaaa

SEQ ID NO: 2762595 - DNA, 21 bp, Homo sapiens
tccctttgttgctgtctggct

SEQ ID NO: 2762596 - DNA, 21 bp, Homo sapiens
tccgcctctgagccaggagcc

SEQ ID NO: 2762597 - DNA, 13 bp, Homo sapiens
tccgtaaaaatga

SEQ ID NO: 2762598 - DNA, 13 bp, Homo sapiens
tccgtctcctctc

SEQ ID NO: 2762599 - DNA, 20 bp, Homo sapiens
tccgtctcctctccagccct

SEQ ID NO: 2762600 - DNA, 15 bp, Homo sapiens
tcctacccctgtcct

SEQ ID NO: 2762601 - DNA, 16 bp, Homo sapiens
tcctacccctgtcctg

SEQ ID NO: 2762602 - DNA, 16 bp, Homo sapiens
tcctcccctcctcctg

SEQ ID NO: 2762603 - DNA, 16 bp, Homo sapiens
tcctcctcctcctcct

SEQ ID NO: 2762604 - DNA, 15 bp, Homo sapiens
tcctcctcctcctgt

SEQ ID NO: 2762605 - DNA, 15 bp, Homo sapiens
tcctcctgttcctgc

SEQ ID NO: 2762606 - DNA, 17 bp, Homo sapiens
tcctcctgttcctgcct

SEQ ID NO: 2762607 - DNA, 18 bp, Homo sapiens
tcctcctgttcctgcctt

SEQ ID NO: 2762608 - DNA, 20 bp, Homo sapiens
tcctcctgttcctgccttct

SEQ ID NO: 2762609 - DNA, 21 bp, Homo sapiens
tcctgcacacgctccttcctc

SEQ ID NO: 2762610 - DNA, 22 bp, Homo sapiens
tcctgcacacgctccttcctct

SEQ ID NO: 2762611 - DNA, 16 bp, Homo sapiens
tcctgcctaaggctga

SEQ ID NO: 2762612 - DNA, 21 bp, Homo sapiens
tcctgccttctcttctatcct

SEQ ID NO: 2762613 - DNA, 19 bp, Homo sapiens
tcctgctgctcctctgact

SEQ ID NO: 2762614 - DNA, 13 bp, Homo sapiens
tcctgtgccagga

SEQ ID NO: 2762615 - DNA, 22 bp, Homo sapiens
tcctgtgccaggactctctttc

SEQ ID NO: 2762616 - DNA, 17 bp, Homo sapiens
tcctgttcatggggttt

SEQ ID NO: 2762617 - DNA, 17 bp, Homo sapiens
tcctgttcctgccttct

SEQ ID NO: 2762618 - DNA, 14 bp, Homo sapiens
tccttctcgtcttc

SEQ ID NO: 2762619 - DNA, 16 bp, Homo sapiens
tccttctcgtcttcct

SEQ ID NO: 2762620 - DNA, 24 bp, Homo sapiens
tccttctcgtcttcctctctctca

SEQ ID NO: 2762621 - DNA, 13 bp, Homo sapiens
tcctttccttctc

SEQ ID NO: 2762622 - DNA, 12 bp, Homo sapiens
tcgattagactg

SEQ ID NO: 2762623 - DNA, 13 bp, Homo sapiens
tcgattagactgg

SEQ ID NO: 2762624 - DNA, 18 bp, Homo sapiens
tcgattagactggacagc

SEQ ID NO: 2762625 - DNA, 22 bp, Homo sapiens
tcgattagactggacagcttgt

SEQ ID NO: 2762626 - DNA, 23 bp, Homo sapiens
tcgcatccgcctctgagccagga

SEQ ID NO: 2762627 - DNA, 10 bp, Homo sapiens
tcggaccagc

SEQ ID NO: 2762628 - DNA, 12 bp, Homo sapiens
tcgtcttcctct

SEQ ID NO: 2762629 - DNA, 15 bp, Homo sapiens
tcgtcttcctctctc

SEQ ID NO: 2762630 - DNA, 14 bp, Homo sapiens
tctaaaggactggt

SEQ ID NO: 2762631 - DNA, 18 bp, Homo sapiens
tctaagttaatttaaagt

SEQ ID NO: 2762632 - DNA, 17 bp, Homo sapiens
tctaggtaggaaatgtg

SEQ ID NO: 2762633 - DNA, 19 bp, Homo sapiens
tctatcaaccccagacact

SEQ ID NO: 2762634 - DNA, 13 bp, Homo sapiens
tctccagccctat

SEQ ID NO: 2762635 - DNA, 16 bp, Homo sapiens
tctcccgaatcctgag

SEQ ID NO: 2762636 - DNA, 17 bp, Homo sapiens
tctcccgaatcctgagg

SEQ ID NO: 2762637 - DNA, 16 bp, Homo sapiens
tctcctctccagccct

SEQ ID NO: 2762638 - DNA, 13 bp, Homo sapiens
tctcctctgctag

SEQ ID NO: 2762639 - DNA, 18 bp, Homo sapiens
tctcttctatcctgcaat

SEQ ID NO: 2762640 - DNA, 20 bp, Homo sapiens
tctgattcgaatgacactgt

SEQ ID NO: 2762641 - DNA, 22 bp, Homo sapiens
tctgattcgaatgacactgttc

SEQ ID NO: 2762642 - DNA, 13 bp, Homo sapiens
tctgcctgcctca

SEQ ID NO: 2762643 - DNA, 19 bp, Homo sapiens
tctgcctgcctcatgctct

SEQ ID NO: 2762644 - DNA, 22 bp, Homo sapiens
tctgcctgcctcatgctctcta

SEQ ID NO: 2762645 - DNA, 17 bp, Homo sapiens
tctgctcacattccctc

SEQ ID NO: 2762646 - DNA, 22 bp, Homo sapiens
tctgctcacattccctctcatc

SEQ ID NO: 2762647 - DNA, 19 bp, Homo sapiens
tctggaagtgactttggct

SEQ ID NO: 2762648 - DNA, 21 bp, Homo sapiens
tctggttcctcccctcctcct

SEQ ID NO: 2762649 - DNA, 18 bp, Homo sapiens
tctgtgcatttgtgtctg

SEQ ID NO: 2762650 - DNA, 23 bp, Homo sapiens
tctgtgcatttgtgtctgcctgc

SEQ ID NO: 2762651 - DNA, 15 bp, Homo sapiens
tcttcctctctctca

SEQ ID NO: 2762652 - DNA, 16 bp, Homo sapiens
tcttcctctctctcac

SEQ ID NO: 2762653 - DNA, 13 bp, Homo sapiens
tcttcctgcctcc

SEQ ID NO: 2762654 - DNA, 17 bp, Homo sapiens
tcttcctggattattca

SEQ ID NO: 2762655 - DNA, 13 bp, Homo sapiens
acagctggagaca

SEQ ID NO: 2762656 - DNA, 18 bp, Homo sapiens
acaggggacactgaacct

SEQ ID NO: 2762657 - DNA, 19 bp, Homo sapiens
acaggtgccgccagctgcc

SEQ ID NO: 2762658 - DNA, 16 bp, Homo sapiens
acagtaaatacactgt

SEQ ID NO: 2762659 - DNA, 18 bp, Homo sapiens
acagtaaatacactgtga

SEQ ID NO: 2762660 - DNA, 17 bp, Homo sapiens
acagttatctaagttaa

SEQ ID NO: 2762661 - DNA, 17 bp, Homo sapiens
acatgtgttggcagcct

SEQ ID NO: 2762662 - DNA, 21 bp, Homo sapiens
acatgtttgcacctttctagt

SEQ ID NO: 2762663 - DNA, 22 bp, Homo sapiens
acattaactcattagactggaa

SEQ ID NO: 2762664 - DNA, 23 bp, Homo sapiens
accaaaagttacatgtttgcacc

SEQ ID NO: 2762665 - DNA, 17 bp, Homo sapiens
accagcccgaacaccat

SEQ ID NO: 2762666 - DNA, 23 bp, Homo sapiens
accagtaggttgaggacaggaga

SEQ ID NO: 2762667 - DNA, 20 bp, Homo sapiens
accatcagaaacaccctcac

SEQ ID NO: 2762668 - DNA, 23 bp, Homo sapiens
accatcagaaacaccctcacact

SEQ ID NO: 2762669 - DNA, 15 bp, Homo sapiens
accctcacactggga

SEQ ID NO: 2762670 - DNA, 11 bp, Homo sapiens
accctccccac

SEQ ID NO: 2762671 - DNA, 17 bp, Homo sapiens
accggagtatgtgcagt

SEQ ID NO: 2762672 - DNA, 15 bp, Homo sapiens
acctacttcctcctc

SEQ ID NO: 2762673 - DNA, 12 bp, Homo sapiens
acctcgtgaaga

SEQ ID NO: 2762674 - DNA, 20 bp, Homo sapiens
acctgaaatattttcttcct

SEQ ID NO: 2762675 - DNA, 22 bp, Homo sapiens
acctgcctcccttcatgcatgg

SEQ ID NO: 2762676 - DNA, 23 bp, Homo sapiens
acctggaagcatttgtttctact

SEQ ID NO: 2762677 - DNA, 20 bp, Homo sapiens
accttgttgatgccagctgt

SEQ ID NO: 2762678 - DNA, 14 bp, Homo sapiens
acgctccttcctct

SEQ ID NO: 2762679 - DNA, 19 bp, Homo sapiens
actcaaaccaaatcactga

SEQ ID NO: 2762680 - DNA, 13 bp, Homo sapiens
actcattagactg

SEQ ID NO: 2762681 - DNA, 21 bp, Homo sapiens
actccagccacccagccagga

SEQ ID NO: 2762682 - DNA, 23 bp, Homo sapiens
actcctgcacacgctccttcctc

SEQ ID NO: 2762683 - DNA, 17 bp, Homo sapiens
actctgacaacagactt

SEQ ID NO: 2762684 - DNA, 20 bp, Homo sapiens
actcttcagttaagcctttg

SEQ ID NO: 2762685 - DNA, 16 bp, Homo sapiens
actgaactttgctgag

SEQ ID NO: 2762686 - DNA, 19 bp, Homo sapiens
actgaactttgctgagcct

SEQ ID NO: 2762687 - DNA, 11 bp, Homo sapiens
actgcctttga

SEQ ID NO: 2762688 - DNA, 15 bp, Homo sapiens
actgctgtccctcct

SEQ ID NO: 2762689 - DNA, 16 bp, Homo sapiens
actgctgtccctcctg

SEQ ID NO: 2762690 - DNA, 13 bp, Homo sapiens
actggacagcttg

SEQ ID NO: 2762691 - DNA, 15 bp, Homo sapiens
actggacagcttgtg

SEQ ID NO: 2762692 - DNA, 14 bp, Homo sapiens
actgggccagcaga

SEQ ID NO: 2762693 - DNA, 16 bp, Homo sapiens
actgggccagcagagc

SEQ ID NO: 2762694 - DNA, 15 bp, Homo sapiens
actgggggaaaagat

SEQ ID NO: 2762695 - DNA, 18 bp, Homo sapiens
actggttaaatcaattct

SEQ ID NO: 2762696 - DNA, 14 bp, Homo sapiens
actgtctgctggca

SEQ ID NO: 2762697 - DNA, 18 bp, Homo sapiens
acttatatggaaattctg

SEQ ID NO: 2762698 - DNA, 16 bp, Homo sapiens
acttcctcctcctcct

SEQ ID NO: 2762699 - DNA, 21 bp, Homo sapiens
acttgaactgattcacatctc

SEQ ID NO: 2762700 - DNA, 16 bp, Homo sapiens
acttgttttctgggaa

SEQ ID NO: 2762701 - DNA, 17 bp, Homo sapiens
actttggctgcatgcga

SEQ ID NO: 2762702 - DNA, 14 bp, Homo sapiens
agaaacaacagaaa

SEQ ID NO: 2762703 - DNA, 20 bp, Homo sapiens
agaaatagggcatggcttgc

SEQ ID NO: 2762704 - DNA, 18 bp, Homo sapiens
agaacagcagactcagct

SEQ ID NO: 2762705 - DNA, 21 bp, Homo sapiens
agaaggaaaattttagcgtgc

SEQ ID NO: 2762706 - DNA, 17 bp, Homo sapiens
agaatgtgtcttgcgag

SEQ ID NO: 2762707 - DNA, 19 bp, Homo sapiens
agaatgttaagacttgaca

SEQ ID NO: 2762708 - DNA, 19 bp, Homo sapiens
agacaccggagtatgtgca

SEQ ID NO: 2762709 - DNA, 20 bp, Homo sapiens
agacaccggagtatgtgcag

SEQ ID NO: 2762710 - DNA, 14 bp, Homo sapiens
agaccctccccaca

SEQ ID NO: 2762711 - DNA, 15 bp, Homo sapiens
agaccctccccacag

SEQ ID NO: 2762712 - DNA, 21 bp, Homo sapiens
agaccctccccacagtgccac

SEQ ID NO: 2762713 - DNA, 17 bp, Homo sapiens
agactggaacttgaact

SEQ ID NO: 2762714 - DNA, 23 bp, Homo sapiens
agaggagggagcatcagtgccct

SEQ ID NO: 2762715 - DNA, 23 bp, Homo sapiens
agaggggaagtctcttcctgcct

SEQ ID NO: 2762716 - DNA, 21 bp, Homo sapiens
agagtagggttgccagtcctg

SEQ ID NO: 2762717 - DNA, 13 bp, Homo sapiens
agagtgagagaca

SEQ ID NO: 2762718 - DNA, 21 bp, Homo sapiens
agagtgtgaccaaaagttaca

SEQ ID NO: 2762719 - DNA, 15 bp, Homo sapiens
agatcacttgtcctc

SEQ ID NO: 2762720 - DNA, 16 bp, Homo sapiens
agatcacttgtcctct

SEQ ID NO: 2762721 - DNA, 17 bp, Homo sapiens
agatcacttgtcctctt

SEQ ID NO: 2762722 - DNA, 19 bp, Homo sapiens
agatcacttgtcctcttgc

SEQ ID NO: 2762723 - DNA, 22 bp, Homo sapiens
agatcacttgtcctcttgccag

SEQ ID NO: 2762724 - DNA, 14 bp, Homo sapiens
agatggttcccttt

SEQ ID NO: 2762725 - DNA, 14 bp, Homo sapiens
agcaagagatgaga

SEQ ID NO: 2762726 - DNA, 16 bp, Homo sapiens
agcaagagatgagaaa

SEQ ID NO: 2762727 - DNA, 13 bp, Homo sapiens
agcagctgaaggg

SEQ ID NO: 2762728 - DNA, 15 bp, Homo sapiens
agcagctgggcactg

SEQ ID NO: 2762729 - DNA, 16 bp, Homo sapiens
agcagctgggcactgg

SEQ ID NO: 2762730 - DNA, 15 bp, Homo sapiens
agcaggctgtgagtt

SEQ ID NO: 2762731 - DNA, 20 bp, Homo sapiens
agcatgttggacacccccca

SEQ ID NO: 2762732 - DNA, 14 bp, Homo sapiens
agcatttgtttcta

SEQ ID NO: 2762733 - DNA, 19 bp, Homo sapiens
agcatttgtttctactttg

SEQ ID NO: 2762734 - DNA, 16 bp, Homo sapiens
agccacccagccagga

SEQ ID NO: 2762735 - DNA, 15 bp, Homo sapiens
agccagcttcctgtg

SEQ ID NO: 2762736 - DNA, 16 bp, Homo sapiens
agccaggagcctcctg

SEQ ID NO: 2762737 - DNA, 18 bp, Homo sapiens
agccaggagcctcctgac

SEQ ID NO: 2762738 - DNA, 14 bp, Homo sapiens
agcccattcattcc

SEQ ID NO: 2762739 - DNA, 22 bp, Homo sapiens
agcccattcattccattctgga

SEQ ID NO: 2762740 - DNA, 15 bp, Homo sapiens
agcctcaatttctga

SEQ ID NO: 2762741 - DNA, 14 bp, Homo sapiens
agcctggagccgtg

SEQ ID NO: 2762742 - DNA, 22 bp, Homo sapiens
agcctggttccctctttcctgt

SEQ ID NO: 2762743 - DNA, 19 bp, Homo sapiens
agcgagttggtcaccgctc

SEQ ID NO: 2762744 - DNA, 13 bp, Homo sapiens
agctgctccccag

SEQ ID NO: 2762745 - DNA, 20 bp, Homo sapiens
agctgggagaccctccccac

SEQ ID NO: 2762746 - DNA, 21 bp, Homo sapiens
agctgggagaccctccccaca

SEQ ID NO: 2762747 - DNA, 14 bp, Homo sapiens
agctggtctaagaa

SEQ ID NO: 2762748 - DNA, 17 bp, Homo sapiens
agcttgtggcaagtgaa

SEQ ID NO: 2762749 - DNA, 18 bp, Homo sapiens
agcttgtggcaagtgaat

SEQ ID NO: 2762750 - DNA, 22 bp, Homo sapiens
agctttccccatgtctcgactc

SEQ ID NO: 2762751 - DNA, 18 bp, Homo sapiens
aggaagcagctttcccca

SEQ ID NO: 2762752 - DNA, 18 bp, Homo sapiens
aggaataaagctgtgagc

SEQ ID NO: 2762753 - DNA, 19 bp, Homo sapiens
aggaataaagctgtgagca

SEQ ID NO: 2762754 - DNA, 15 bp, Homo sapiens
aggactctctttctt

SEQ ID NO: 2762755 - DNA, 16 bp, Homo sapiens
ctggagtctcactgtc

SEQ ID NO: 2762756 - DNA, 23 bp, Homo sapiens
ctggagtctcactgtctgctggc

SEQ ID NO: 2762757 - DNA, 23 bp, Homo sapiens
ctggattattcaaaatgatgtat

SEQ ID NO: 2762758 - DNA, 19 bp, Homo sapiens
ctggcatccaaatggctgc

SEQ ID NO: 2762759 - DNA, 21 bp, Homo sapiens
ctggcatccaaatggctgctt

SEQ ID NO: 2762760 - DNA, 21 bp, Homo sapiens
ctggcctagtggggaggggcc

SEQ ID NO: 2762761 - DNA, 22 bp, Homo sapiens
ctggcctagtggggaggggcct

SEQ ID NO: 2762762 - DNA, 23 bp, Homo sapiens
ctggcctagtggggaggggcctg

SEQ ID NO: 2762763 - DNA, 12 bp, Homo sapiens
ctgggagaccct

SEQ ID NO: 2762764 - DNA, 12 bp, Homo sapiens
ctgggccagaat

SEQ ID NO: 2762765 - DNA, 13 bp, Homo sapiens
ctgggccagcaga

SEQ ID NO: 2762766 - DNA, 14 bp, Homo sapiens
ctgggccagcagag

SEQ ID NO: 2762767 - DNA, 19 bp, Homo sapiens
ctgggccggcagcctggtt

SEQ ID NO: 2762768 - DNA, 14 bp, Homo sapiens
ctggtccaggcttg

SEQ ID NO: 2762769 - DNA, 20 bp, Homo sapiens
ctggtcccacttcacagctg

SEQ ID NO: 2762770 - DNA, 22 bp, Homo sapiens
ctggtcccacttcacagctgga

SEQ ID NO: 2762771 - DNA, 21 bp, Homo sapiens
ctggttccctctttcctgtgc

SEQ ID NO: 2762772 - DNA, 17 bp, Homo sapiens
ctggttgatgcctgtga

SEQ ID NO: 2762773 - DNA, 17 bp, Homo sapiens
ctgtagccccagtgaca

SEQ ID NO: 2762774 - DNA, 20 bp, Homo sapiens
ctgtattctgcaacagcctg

SEQ ID NO: 2762775 - DNA, 21 bp, Homo sapiens
ctgtattctgcaacagcctgt

SEQ ID NO: 2762776 - DNA, 14 bp, Homo sapiens
ctgtccctccaaag

SEQ ID NO: 2762777 - DNA, 13 bp, Homo sapiens
ctgtccctcctga

SEQ ID NO: 2762778 - DNA, 17 bp, Homo sapiens
ctgtcgattagactgga

SEQ ID NO: 2762779 - DNA, 20 bp, Homo sapiens
ctgtcgattagactggacag

SEQ ID NO: 2762780 - DNA, 15 bp, Homo sapiens
ctgtgaactgaactc

SEQ ID NO: 2762781 - DNA, 12 bp, Homo sapiens
ctgtgagcaaac

SEQ ID NO: 2762782 - DNA, 15 bp, Homo sapiens
ctgtgatgcctgaca

SEQ ID NO: 2762783 - DNA, 19 bp, Homo sapiens
ctgtgcagaaggtctggtc

SEQ ID NO: 2762784 - DNA, 17 bp, Homo sapiens
ctgtgcatttgtgtctg

SEQ ID NO: 2762785 - DNA, 18 bp, Homo sapiens
ctgtgcatttgtgtctgc

SEQ ID NO: 2762786 - DNA, 15 bp, Homo sapiens
ctgtggccctggcat

SEQ ID NO: 2762787 - DNA, 15 bp, Homo sapiens
ctgtttttcggacag

SEQ ID NO: 2762788 - DNA, 22 bp, Homo sapiens
ctgtttttcggacagtttattt

SEQ ID NO: 2762789 - DNA, 18 bp, Homo sapiens
cttcagttaagcctttgg

SEQ ID NO: 2762790 - DNA, 13 bp, Homo sapiens
cttcatctggaac

SEQ ID NO: 2762791 - DNA, 13 bp, Homo sapiens
cttcatgcatgga

SEQ ID NO: 2762792 - DNA, 21 bp, Homo sapiens
cttcatgcatggaaattccct

SEQ ID NO: 2762793 - DNA, 13 bp, Homo sapiens
cttccactcaggg

SEQ ID NO: 2762794 - DNA, 15 bp, Homo sapiens
cttccactcagggct

SEQ ID NO: 2762795 - DNA, 12 bp, Homo sapiens
cttcctgtgcag

SEQ ID NO: 2762796 - DNA, 15 bp, Homo sapiens
cttcctgtgcagaag

SEQ ID NO: 2762797 - DNA, 13 bp, Homo sapiens
cttccttctcagc

SEQ ID NO: 2762798 - DNA, 14 bp, Homo sapiens
cttgaactgattca

SEQ ID NO: 2762799 - DNA, 14 bp, Homo sapiens
cttgcccctgtggc

SEQ ID NO: 2762800 - DNA, 18 bp, Homo sapiens
cttgtcctcttgccagct

SEQ ID NO: 2762801 - DNA, 15 bp, Homo sapiens
cttgtggtggctgct

SEQ ID NO: 2762802 - DNA, 21 bp, Homo sapiens
ctttaaaaagctccaaatgca

SEQ ID NO: 2762803 - DNA, 17 bp, Homo sapiens
ctttattaaaaactgag

SEQ ID NO: 2762804 - DNA, 20 bp, Homo sapiens
ctttattctggcagaggagg

SEQ ID NO: 2762805 - DNA, 17 bp, Homo sapiens
ctttcctgtgccaggac

SEQ ID NO: 2762806 - DNA, 15 bp, Homo sapiens
cttttaatgaacaaa

SEQ ID NO: 2762807 - DNA, 17 bp, Homo sapiens
gaaaacattccatcctt

SEQ ID NO: 2762808 - DNA, 14 bp, Homo sapiens
gaaacaacagaaac

SEQ ID NO: 2762809 - DNA, 22 bp, Homo sapiens
gaaacaccctcacactgggact

SEQ ID NO: 2762810 - DNA, 17 bp, Homo sapiens
gaaaggatgcttctgct

SEQ ID NO: 2762811 - DNA, 17 bp, Homo sapiens
gaaattcccttcatctg

SEQ ID NO: 2762812 - DNA, 21 bp, Homo sapiens
gaaattcccttcatctggaac

SEQ ID NO: 2762813 - DNA, 12 bp, Homo sapiens
gaaccatcagaa

SEQ ID NO: 2762814 - DNA, 21 bp, Homo sapiens
gaactgattcacatctcattt

SEQ ID NO: 2762815 - DNA, 15 bp, Homo sapiens
gaagtgactttggct

SEQ ID NO: 2762816 - DNA, 16 bp, Homo sapiens
gaataaagctgtgagc

SEQ ID NO: 2762817 - DNA, 15 bp, Homo sapiens
gaatgagctgggccc

SEQ ID NO: 2762818 - DNA, 15 bp, Homo sapiens
gaatgtaaagcttgt

SEQ ID NO: 2762819 - DNA, 20 bp, Homo sapiens
gaatgtaaagcttgtctgat

SEQ ID NO: 2762820 - DNA, 19 bp, Homo sapiens
gacaccggagtatgtgcag

SEQ ID NO: 2762821 - DNA, 21 bp, Homo sapiens
gacagcttgtggcaagtgaat

SEQ ID NO: 2762822 - DNA, 21 bp, Homo sapiens
gacagtccgtcaaaacagatt

SEQ ID NO: 2762823 - DNA, 14 bp, Homo sapiens
gaccaaaagttaca

SEQ ID NO: 2762824 - DNA, 16 bp, Homo sapiens
gaccacactccagctg

SEQ ID NO: 2762825 - DNA, 15 bp, Homo sapiens
gaccccagagtaggg

SEQ ID NO: 2762826 - DNA, 21 bp, Homo sapiens
gaccctccccacagtgccacc

SEQ ID NO: 2762827 - DNA, 22 bp, Homo sapiens
gaccctccccacagtgccaccc

SEQ ID NO: 2762828 - DNA, 22 bp, Homo sapiens
gaccctgtgatgcctgacacag

SEQ ID NO: 2762829 - DNA, 21 bp, Homo sapiens
gactatcaggagtccactgcc

SEQ ID NO: 2762830 - DNA, 18 bp, Homo sapiens
gactgtttttcggacagt

SEQ ID NO: 2762831 - DNA, 16 bp, Homo sapiens
gactttggctgcatgc

SEQ ID NO: 2762832 - DNA, 20 bp, Homo sapiens
gagacaccggagtatgtgca

SEQ ID NO: 2762833 - DNA, 23 bp, Homo sapiens
gagacaccggagtatgtgcagtg

SEQ ID NO: 2762834 - DNA, 16 bp, Homo sapiens
gagacattaactcatt

SEQ ID NO: 2762835 - DNA, 22 bp, Homo sapiens
gagacattaactcattagactg

SEQ ID NO: 2762836 - DNA, 20 bp, Homo sapiens
gagaccctccccacagtgcc

SEQ ID NO: 2762837 - DNA, 17 bp, Homo sapiens
gagactttattgcctat

SEQ ID NO: 2762838 - DNA, 15 bp, Homo sapiens
gagcaaacagaggag

SEQ ID NO: 2762839 - DNA, 16 bp, Homo sapiens
gagcagctgggcactg

SEQ ID NO: 2762840 - DNA, 20 bp, Homo sapiens
gagcagctgggcactgggcc

SEQ ID NO: 2762841 - DNA, 11 bp, Homo sapiens
gagccccacct

SEQ ID NO: 2762842 - DNA, 20 bp, Homo sapiens
gagccccaccttgtctgcta

SEQ ID NO: 2762843 - DNA, 22 bp, Homo sapiens
gagccctgtcctgcctaaggct

SEQ ID NO: 2762844 - DNA, 14 bp, Homo sapiens
gagcctcagcagca

SEQ ID NO: 2762845 - DNA, 22 bp, Homo sapiens
gagcctcagcagcaaatgccac

SEQ ID NO: 2762846 - DNA, 14 bp, Homo sapiens
gagctgggagaccc

SEQ ID NO: 2762847 - DNA, 19 bp, Homo sapiens
gaggaataaagctgtgagc

SEQ ID NO: 2762848 - DNA, 13 bp, Homo sapiens
gaggcccggcctc

SEQ ID NO: 2762849 - DNA, 17 bp, Homo sapiens
gagggcttccctagatg

SEQ ID NO: 2762850 - DNA, 13 bp, Homo sapiens
gaggggcctggcc

SEQ ID NO: 2762851 - DNA, 16 bp, Homo sapiens
gagtaatatgcctgct

SEQ ID NO: 2762852 - DNA, 17 bp, Homo sapiens
gagtagggttgccagtc

SEQ ID NO: 2762853 - DNA, 19 bp, Homo sapiens
gagtagggttgccagtcct

SEQ ID NO: 2762854 - DNA, 13 bp, Homo sapiens
gagtatgtgcagt

SEQ ID NO: 2762855 - DNA, 11 bp, Homo sapiens
tctctctcacc

SEQ ID NO: 2762856 - DNA, 13 bp, Homo sapiens
tctgaagctagag

SEQ ID NO: 2762857 - DNA, 15 bp, Homo sapiens
tctgaagctagagga

SEQ ID NO: 2762858 - DNA, 16 bp, Homo sapiens
tctgaagctagaggaa

SEQ ID NO: 2762859 - DNA, 15 bp, Homo sapiens
tctgacaacagactt

SEQ ID NO: 2762860 - DNA, 14 bp, Homo sapiens
tctgcaacagcctg

SEQ ID NO: 2762861 - DNA, 16 bp, Homo sapiens
tctgctaaataaacat

SEQ ID NO: 2762862 - DNA, 18 bp, Homo sapiens
tctgctcacattccctct

SEQ ID NO: 2762863 - DNA, 20 bp, Homo sapiens
tctgctcacattccctctca

SEQ ID NO: 2762864 - DNA, 21 bp, Homo sapiens
tctgctcacattccctctcat

SEQ ID NO: 2762865 - DNA, 22 bp, Homo sapiens
tctggaagtgactttggctgca

SEQ ID NO: 2762866 - DNA, 22 bp, Homo sapiens
tctggcctagtggggaggggcc

SEQ ID NO: 2762867 - DNA, 19 bp, Homo sapiens
tctgtgcatttgtgtctgc

SEQ ID NO: 2762868 - DNA, 15 bp, Homo sapiens
tcttccttctcagca

SEQ ID NO: 2762869 - DNA, 17 bp, Homo sapiens
tgaaaataaagtgtata

SEQ ID NO: 2762870 - DNA, 23 bp, Homo sapiens
tgaaatagacccacaagaggcag

SEQ ID NO: 2762871 - DNA, 14 bp, Homo sapiens
tgaaatattttctt

SEQ ID NO: 2762872 - DNA, 17 bp, Homo sapiens
tgaaatggatacttata

SEQ ID NO: 2762873 - DNA, 17 bp, Homo sapiens
tgaactgaactctgaca

SEQ ID NO: 2762874 - DNA, 19 bp, Homo sapiens
tgaactgaactctgacaac

SEQ ID NO: 2762875 - DNA, 12 bp, Homo sapiens
tgaactgattca

SEQ ID NO: 2762876 - DNA, 20 bp, Homo sapiens
tgaactgattcacatctcat

SEQ ID NO: 2762877 - DNA, 13 bp, Homo sapiens
tgaagaatgttaa

SEQ ID NO: 2762878 - DNA, 20 bp, Homo sapiens
tgacagctaggatgtgcatt

SEQ ID NO: 2762879 - DNA, 18 bp, Homo sapiens
tgaccctgtgatgcctga

SEQ ID NO: 2762880 - DNA, 19 bp, Homo sapiens
tgacctgcctcccttcatg

SEQ ID NO: 2762881 - DNA, 23 bp, Homo sapiens
tgacctgcctcccttcatgcatg

SEQ ID NO: 2762882 - DNA, 16 bp, Homo sapiens
tgactcctccaaggtt

SEQ ID NO: 2762883 - DNA, 20 bp, Homo sapiens
tgactgtttttcggacagtt

SEQ ID NO: 2762884 - DNA, 14 bp, Homo sapiens
tgagagtgtgacca

SEQ ID NO: 2762885 - DNA, 15 bp, Homo sapiens
tgagcaaacagagga

SEQ ID NO: 2762886 - DNA, 14 bp, Homo sapiens
tgagccaggagcct

SEQ ID NO: 2762887 - DNA, 18 bp, Homo sapiens
tgagccctgtcctgccta

SEQ ID NO: 2762888 - DNA, 21 bp, Homo sapiens
tgagctgggccctgggtgagg

SEQ ID NO: 2762889 - DNA, 16 bp, Homo sapiens
tgaggatgtggcacaa

SEQ ID NO: 2762890 - DNA, 20 bp, Homo sapiens
tgagggagctgggagaccct

SEQ ID NO: 2762891 - DNA, 18 bp, Homo sapiens
tgagggatggggagcagc

SEQ ID NO: 2762892 - DNA, 21 bp, Homo sapiens
tgagggatggggagcagctgg

SEQ ID NO: 2762893 - DNA, 19 bp, Homo sapiens
tgagtaccatgggctacag

SEQ ID NO: 2762894 - DNA, 22 bp, Homo sapiens
tgagtttgggccccagaggctg

SEQ ID NO: 2762895 - DNA, 13 bp, Homo sapiens
tgatgccagctgt

SEQ ID NO: 2762896 - DNA, 16 bp, Homo sapiens
tgattcacatctcatt

SEQ ID NO: 2762897 - DNA, 21 bp, Homo sapiens
tgcaagccagcttcctgtgca

SEQ ID NO: 2762898 - DNA, 23 bp, Homo sapiens
tgcagcccccactgcctttgacc

SEQ ID NO: 2762899 - DNA, 13 bp, Homo sapiens
tgcagctttaaaa

SEQ ID NO: 2762900 - DNA, 22 bp, Homo sapiens
tgcagctttaaaaaattaatct

SEQ ID NO: 2762901 - DNA, 19 bp, Homo sapiens
tgcatggaaattcccttca

SEQ ID NO: 2762902 - DNA, 15 bp, Homo sapiens
tgccactctgggcag

SEQ ID NO: 2762903 - DNA, 16 bp, Homo sapiens
tgccactctgggcagt

SEQ ID NO: 2762904 - DNA, 15 bp, Homo sapiens
tgccatagggaccaa

SEQ ID NO: 2762905 - DNA, 11 bp, Homo sapiens
tgccctcagct

SEQ ID NO: 2762906 - DNA, 20 bp, Homo sapiens
tgccctggagcctcagcagc

SEQ ID NO: 2762907 - DNA, 21 bp, Homo sapiens
tgccctggagcctcagcagca

SEQ ID NO: 2762908 - DNA, 23 bp, Homo sapiens
tgccctggagcctcagcagcaaa

SEQ ID NO: 2762909 - DNA, 16 bp, Homo sapiens
tgccgccagctgccgc

SEQ ID NO: 2762910 - DNA, 19 bp, Homo sapiens
tgcctaaggctgaacttgt

SEQ ID NO: 2762911 - DNA, 23 bp, Homo sapiens
tgcctccatgatgcaagccagct

SEQ ID NO: 2762912 - DNA, 17 bp, Homo sapiens
tgcctgacacaggggac

SEQ ID NO: 2762913 - DNA, 20 bp, Homo sapiens
tgcctgtagccccagtgaca

SEQ ID NO: 2762914 - DNA, 22 bp, Homo sapiens
tgcctgtagccccagtgacagc

SEQ ID NO: 2762915 - DNA, 14 bp, Homo sapiens
tgcctgtgaactga

SEQ ID NO: 2762916 - DNA, 18 bp, Homo sapiens
tgcctgtgaactgaactc

SEQ ID NO: 2762917 - DNA, 13 bp, Homo sapiens
tgccttctcttct

SEQ ID NO: 2762918 - DNA, 23 bp, Homo sapiens
tgcctttgacctgcctcccttca

SEQ ID NO: 2762919 - DNA, 13 bp, Homo sapiens
tgctaaataaaca

SEQ ID NO: 2762920 - DNA, 19 bp, Homo sapiens
tgctgcttccactcagggc

SEQ ID NO: 2762921 - DNA, 15 bp, Homo sapiens
tgctgtccctcctga

SEQ ID NO: 2762922 - DNA, 17 bp, Homo sapiens
tgctgtctggctttccc

SEQ ID NO: 2762923 - DNA, 23 bp, Homo sapiens
tgcttctgctcacattccctctc

SEQ ID NO: 2762924 - DNA, 13 bp, Homo sapiens
tgctttgatattt

SEQ ID NO: 2762925 - DNA, 17 bp, Homo sapiens
tgctttgatatttcaat

SEQ ID NO: 2762926 - DNA, 18 bp, Homo sapiens
tggaaattcccttcatct

SEQ ID NO: 2762927 - DNA, 22 bp, Homo sapiens
tggaaattcccttcatctggaa

SEQ ID NO: 2762928 - DNA, 23 bp, Homo sapiens
tggaactacattagtacacagca

SEQ ID NO: 2762929 - DNA, 17 bp, Homo sapiens
tggaagtgactttggct

SEQ ID NO: 2762930 - DNA, 13 bp, Homo sapiens
tggacagcttgtg

SEQ ID NO: 2762931 - DNA, 20 bp, Homo sapiens
tggagaggcccggcctctca

SEQ ID NO: 2762932 - DNA, 14 bp, Homo sapiens
tggcaagtgaattt

SEQ ID NO: 2762933 - DNA, 19 bp, Homo sapiens
tggcatccaaatggctgct

SEQ ID NO: 2762934 - DNA, 13 bp, Homo sapiens
tggcccagcctgg

SEQ ID NO: 2762935 - DNA, 12 bp, Homo sapiens
tggccctggcat

SEQ ID NO: 2762936 - DNA, 16 bp, Homo sapiens
tggcttgcccctgtgg

SEQ ID NO: 2762937 - DNA, 20 bp, Homo sapiens
tgggaacaccataggtcacc

SEQ ID NO: 2762938 - DNA, 13 bp, Homo sapiens
tgggactggcctc

SEQ ID NO: 2762939 - DNA, 14 bp, Homo sapiens
tgggactggcctct

SEQ ID NO: 2762940 - DNA, 19 bp, Homo sapiens
tgggatcacatgtggactt

SEQ ID NO: 2762941 - DNA, 14 bp, Homo sapiens
tgggcactgggccg

SEQ ID NO: 2762942 - DNA, 14 bp, Homo sapiens
tgggccagcagagc

SEQ ID NO: 2762943 - DNA, 19 bp, Homo sapiens
tgggcttgtggtggctgct

SEQ ID NO: 2762944 - DNA, 15 bp, Homo sapiens
tggggagcagctggg

SEQ ID NO: 2762945 - DNA, 17 bp, Homo sapiens
tggggaggggcctggcc

SEQ ID NO: 2762946 - DNA, 20 bp, Homo sapiens
tggggaggggcctggcctgg

SEQ ID NO: 2762947 - DNA, 19 bp, Homo sapiens
tggggatggggacaaagaa

SEQ ID NO: 2762948 - DNA, 19 bp, Homo sapiens
tggggcagggcctggcctg

SEQ ID NO: 2762949 - DNA, 16 bp, Homo sapiens
tgggggtctggcctag

SEQ ID NO: 2762950 - DNA, 20 bp, Homo sapiens
tggggtttttgccctggagc

SEQ ID NO: 2762951 - DNA, 18 bp, Homo sapiens
tgggtgtgtttcaggaca

SEQ ID NO: 2762952 - DNA, 19 bp, Homo sapiens
tggtccaggcttgggctcc

SEQ ID NO: 2762953 - DNA, 21 bp, Homo sapiens
tggtggagaggcccggcctct

SEQ ID NO: 2762954 - DNA, 18 bp, Homo sapiens
tggttcctcccctcctcc

SEQ ID NO: 2762955 - DNA, 20 bp, Homo sapiens
aaaaagctccaaatgcagct

SEQ ID NO: 2762956 - DNA, 23 bp, Homo sapiens
aaaaatatgaccacactccagct

SEQ ID NO: 2762957 - DNA, 16 bp, Homo sapiens
aaaaatgatttcagta

SEQ ID NO: 2762958 - DNA, 20 bp, Homo sapiens
aaaaatgatttcagtagcac

SEQ ID NO: 2762959 - DNA, 18 bp, Homo sapiens
aaaagttacatgtttgca

SEQ ID NO: 2762960 - DNA, 20 bp, Homo sapiens
aaaatgctgcttccactcag

SEQ ID NO: 2762961 - DNA, 23 bp, Homo sapiens
aaacagaggaggccagcctcacc

SEQ ID NO: 2762962 - DNA, 16 bp, Homo sapiens
aaagcccattcattcc

SEQ ID NO: 2762963 - DNA, 15 bp, Homo sapiens
aaaggggcctgcgca

SEQ ID NO: 2762964 - DNA, 16 bp, Homo sapiens
aaatattttcttcctt

SEQ ID NO: 2762965 - DNA, 16 bp, Homo sapiens
aaatctcaattcttcc

SEQ ID NO: 2762966 - DNA, 14 bp, Homo sapiens
aaatgccactctgg

SEQ ID NO: 2762967 - DNA, 23 bp, Homo sapiens
aaatggctgcttttgtctccctt

SEQ ID NO: 2762968 - DNA, 14 bp, Homo sapiens
aaatgtcttcctgg

SEQ ID NO: 2762969 - DNA, 14 bp, Homo sapiens
aaattaatctgggc

SEQ ID NO: 2762970 - DNA, 16 bp, Homo sapiens
aacaaatagtctatca

SEQ ID NO: 2762971 - DNA, 20 bp, Homo sapiens
aacaccataggtagaatgta

SEQ ID NO: 2762972 - DNA, 21 bp, Homo sapiens
aacaccctcacactgggactt

SEQ ID NO: 2762973 - DNA, 16 bp, Homo sapiens
aacagaggaggccagc

SEQ ID NO: 2762974 - DNA, 15 bp, Homo sapiens
aacagattgtttgca

SEQ ID NO: 2762975 - DNA, 20 bp, Homo sapiens
aacagcagactcagctctga

SEQ ID NO: 2762976 - DNA, 13 bp, Homo sapiens
aacagctcgactt

SEQ ID NO: 2762977 - DNA, 16 bp, Homo sapiens
aactctgacaacagac

SEQ ID NO: 2762978 - DNA, 20 bp, Homo sapiens
aactctgacaacagacttct

SEQ ID NO: 2762979 - DNA, 23 bp, Homo sapiens
aactctgacaacagacttctgaa

SEQ ID NO: 2762980 - DNA, 19 bp, Homo sapiens
aactgaactctgacaacag

SEQ ID NO: 2762981 - DNA, 20 bp, Homo sapiens
aactgaactctgacaacaga

SEQ ID NO: 2762982 - DNA, 17 bp, Homo sapiens
aactgattcacatctca

SEQ ID NO: 2762983 - DNA, 19 bp, Homo sapiens
aactgattcacatctcatt

SEQ ID NO: 2762984 - DNA, 16 bp, Homo sapiens
aactgggggaaaagat

SEQ ID NO: 2762985 - DNA, 19 bp, Homo sapiens
aagaatgttaagacttgac

SEQ ID NO: 2762986 - DNA, 13 bp, Homo sapiens
aagacttgacagt

SEQ ID NO: 2762987 - DNA, 14 bp, Homo sapiens
aagacttgacagtg

SEQ ID NO: 2762988 - DNA, 23 bp, Homo sapiens
aagcatttgtttctactttgata

SEQ ID NO: 2762989 - DNA, 13 bp, Homo sapiens
aagccacagaaat

SEQ ID NO: 2762990 - DNA, 21 bp, Homo sapiens
aagcccattcattccattctg

SEQ ID NO: 2762991 - DNA, 10 bp, Homo sapiens
aagcctttgt

SEQ ID NO: 2762992 - DNA, 23 bp, Homo sapiens
aaggatgcttctgctcacattcc

SEQ ID NO: 2762993 - DNA, 16 bp, Homo sapiens
aaggcaagccacagaa

SEQ ID NO: 2762994 - DNA, 21 bp, Homo sapiens
aagggggctattccctggaga

SEQ ID NO: 2762995 - DNA, 22 bp, Homo sapiens
aagggggctattccctggagac

SEQ ID NO: 2762996 - DNA, 14 bp, Homo sapiens
aaggtcggaccagc

SEQ ID NO: 2762997 - DNA, 24 bp, Homo sapiens
aagtacccgctacaattctgcaga

SEQ ID NO: 2762998 - DNA, 18 bp, Homo sapiens
aagtcagaacagcagact

SEQ ID NO: 2762999 - DNA, 14 bp, Homo sapiens
aagtctcttcctgc

SEQ ID NO: 2763000 - DNA, 20 bp, Homo sapiens
aagtctcttcctgcctccca

SEQ ID NO: 2763001 - DNA, 15 bp, Homo sapiens
aagtgaatttgcctg

SEQ ID NO: 2763002 - DNA, 21 bp, Homo sapiens
aagtgtaccaacataagtgtt

SEQ ID NO: 2763003 - DNA, 12 bp, Homo sapiens
aagtgttgtatc

SEQ ID NO: 2763004 - DNA, 20 bp, Homo sapiens
aagttgttccttaagtcaga

SEQ ID NO: 2763005 - DNA, 13 bp, Homo sapiens
aatacactgtgaa

SEQ ID NO: 2763006 - DNA, 22 bp, Homo sapiens
aatattttcttccttctcagca

SEQ ID NO: 2763007 - DNA, 23 bp, Homo sapiens
aatattttcttccttctcagcac

SEQ ID NO: 2763008 - DNA, 17 bp, Homo sapiens
aatcacattcaggcatg

SEQ ID NO: 2763009 - DNA, 12 bp, Homo sapiens
aatcccaggatg

SEQ ID NO: 2763010 - DNA, 21 bp, Homo sapiens
aatcctgtcgattagactgga

SEQ ID NO: 2763011 - DNA, 18 bp, Homo sapiens
aatctgggccagaatttc

SEQ ID NO: 2763012 - DNA, 12 bp, Homo sapiens
aatgaacaaatg

SEQ ID NO: 2763013 - DNA, 19 bp, Homo sapiens
aatgagctgggccctgggt

SEQ ID NO: 2763014 - DNA, 20 bp, Homo sapiens
aatgatgtatgttgaagcct

SEQ ID NO: 2763015 - DNA, 23 bp, Homo sapiens
aatgatgtatgttgaagcctttg

SEQ ID NO: 2763016 - DNA, 22 bp, Homo sapiens
aatgctgcttccactcagggct

SEQ ID NO: 2763017 - DNA, 16 bp, Homo sapiens
acaaagttggtgccaa

SEQ ID NO: 2763018 - DNA, 22 bp, Homo sapiens
acaaggacagcccctcctccat

SEQ ID NO: 2763019 - DNA, 17 bp, Homo sapiens
acaagttatttaaatct

SEQ ID NO: 2763020 - DNA, 16 bp, Homo sapiens
acacaggggacactga

SEQ ID NO: 2763021 - DNA, 17 bp, Homo sapiens
acaccataggtagaatg

SEQ ID NO: 2763022 - DNA, 16 bp, Homo sapiens
acaccctcacactggg

SEQ ID NO: 2763023 - DNA, 24 bp, Homo sapiens
acactgaaccttgttgatgccagc

SEQ ID NO: 2763024 - DNA, 14 bp, Homo sapiens
acagacttctgaaa

SEQ ID NO: 2763025 - DNA, 14 bp, Homo sapiens
acagattgtttgca

SEQ ID NO: 2763026 - DNA, 19 bp, Homo sapiens
acagcagactcagctctga

SEQ ID NO: 2763027 - DNA, 21 bp, Homo sapiens
acagtccgtcaaaacagattg

SEQ ID NO: 2763028 - DNA, 23 bp, Homo sapiens
acagttatctaagttaatttaaa

SEQ ID NO: 2763029 - DNA, 20 bp, Homo sapiens
acataattcaggaagcagct

SEQ ID NO: 2763030 - DNA, 15 bp, Homo sapiens
acattaactcattag

SEQ ID NO: 2763031 - DNA, 14 bp, Homo sapiens
acattcaggcatgc

SEQ ID NO: 2763032 - DNA, 13 bp, Homo sapiens
acattccatcctt

SEQ ID NO: 2763033 - DNA, 15 bp, Homo sapiens
accactgctctgatg

SEQ ID NO: 2763034 - DNA, 22 bp, Homo sapiens
accagggctctgtattctgcaa

SEQ ID NO: 2763035 - DNA, 12 bp, Homo sapiens
accctcatgctg

SEQ ID NO: 2763036 - DNA, 18 bp, Homo sapiens
acctggaagcatttgttt

SEQ ID NO: 2763037 - DNA, 21 bp, Homo sapiens
accttgtctgctaaataaaca

SEQ ID NO: 2763038 - DNA, 18 bp, Homo sapiens
accttgttgatgccagct

SEQ ID NO: 2763039 - DNA, 11 bp, Homo sapiens
actcagctctg

SEQ ID NO: 2763040 - DNA, 19 bp, Homo sapiens
actcagctctgacattctg

SEQ ID NO: 2763041 - DNA, 16 bp, Homo sapiens
actcagggcttctcct

SEQ ID NO: 2763042 - DNA, 19 bp, Homo sapiens
actcagggcttctcctctg

SEQ ID NO: 2763043 - DNA, 21 bp, Homo sapiens
actcattagactggaacttga

SEQ ID NO: 2763044 - DNA, 20 bp, Homo sapiens
actccagccacccagccagg

SEQ ID NO: 2763045 - DNA, 13 bp, Homo sapiens
actcccccagccc

SEQ ID NO: 2763046 - DNA, 18 bp, Homo sapiens
actcccccagccctcagt

SEQ ID NO: 2763047 - DNA, 13 bp, Homo sapiens
actctgacaacag

SEQ ID NO: 2763048 - DNA, 20 bp, Homo sapiens
actgaactctgacaacagac

SEQ ID NO: 2763049 - DNA, 12 bp, Homo sapiens
actgctctgatg

SEQ ID NO: 2763050 - DNA, 18 bp, Homo sapiens
actggaacttgaactgat

SEQ ID NO: 2763051 - DNA, 12 bp, Homo sapiens
actggacagctt

SEQ ID NO: 2763052 - DNA, 14 bp, Homo sapiens
actggacagcttgt

SEQ ID NO: 2763053 - DNA, 14 bp, Homo sapiens
actggcctctgctg

SEQ ID NO: 2763054 - DNA, 12 bp, Homo sapiens
actgggccggca

SEQ ID NO: 2763055 - DNA, 18 bp, Homo sapiens
actgtttttcggacagtt

SEQ ID NO: 2763056 - DNA, 19 bp, Homo sapiens
actgtttttcggacagttt

SEQ ID NO: 2763057 - DNA, 13 bp, Homo sapiens
acttcctcctcct

SEQ ID NO: 2763058 - DNA, 13 bp, Homo sapiens
acttgacagtgga

SEQ ID NO: 2763059 - DNA, 14 bp, Homo sapiens
acttgacagtggaa

SEQ ID NO: 2763060 - DNA, 23 bp, Homo sapiens
acttgcaaaaagggtcagtatgg

SEQ ID NO: 2763061 - DNA, 14 bp, Homo sapiens
actttggctgcatg

SEQ ID NO: 2763062 - DNA, 15 bp, Homo sapiens
agaaatagcaagaga

SEQ ID NO: 2763063 - DNA, 16 bp, Homo sapiens
agaaatagggcatggc

SEQ ID NO: 2763064 - DNA, 13 bp, Homo sapiens
agaaggctgagta

SEQ ID NO: 2763065 - DNA, 17 bp, Homo sapiens
agaatataaacacataa

SEQ ID NO: 2763066 - DNA, 15 bp, Homo sapiens
agaatgccctcagct

SEQ ID NO: 2763067 - DNA, 13 bp, Homo sapiens
agaatgtaaagct

SEQ ID NO: 2763068 - DNA, 17 bp, Homo sapiens
agaatgtaaagcttgtc

SEQ ID NO: 2763069 - DNA, 14 bp, Homo sapiens
agaatgtgtcttgc

SEQ ID NO: 2763070 - DNA, 14 bp, Homo sapiens
agaatgttaagact

SEQ ID NO: 2763071 - DNA, 21 bp, Homo sapiens
agaatgttaagacttgacagt

SEQ ID NO: 2763072 - DNA, 22 bp, Homo sapiens
agacattaactcattagactgg

SEQ ID NO: 2763073 - DNA, 23 bp, Homo sapiens
agactcaggggatcggctgggaa

SEQ ID NO: 2763074 - DNA, 23 bp, Homo sapiens
agactggaacttgaactgattca

SEQ ID NO: 2763075 - DNA, 11 bp, Homo sapiens
agactggacag

SEQ ID NO: 2763076 - DNA, 16 bp, Homo sapiens
agactggacagcttgt

SEQ ID NO: 2763077 - DNA, 13 bp, Homo sapiens
agacttgacagtg

SEQ ID NO: 2763078 - DNA, 15 bp, Homo sapiens
agactttattgccta

SEQ ID NO: 2763079 - DNA, 16 bp, Homo sapiens
agactttattgcctat

SEQ ID NO: 2763080 - DNA, 18 bp, Homo sapiens
agagacattaactcatta

SEQ ID NO: 2763081 - DNA, 22 bp, Homo sapiens
agagacattaactcattagact

SEQ ID NO: 2763082 - DNA, 23 bp, Homo sapiens
agagacattaactcattagactg

SEQ ID NO: 2763083 - DNA, 19 bp, Homo sapiens
agaggaataaagctgtgag

SEQ ID NO: 2763084 - DNA, 22 bp, Homo sapiens
agaggaggccagcctcacctca

SEQ ID NO: 2763085 - DNA, 14 bp, Homo sapiens
agaggccaggcatg

SEQ ID NO: 2763086 - DNA, 20 bp, Homo sapiens
agaggggaagtctcttcctg

SEQ ID NO: 2763087 - DNA, 14 bp, Homo sapiens
agagtgtgaccaaa

SEQ ID NO: 2763088 - DNA, 16 bp, Homo sapiens
agatagaatgacagtc

SEQ ID NO: 2763089 - DNA, 16 bp, Homo sapiens
agatgagaagccaaag

SEQ ID NO: 2763090 - DNA, 15 bp, Homo sapiens
agatggttccctttg

SEQ ID NO: 2763091 - DNA, 16 bp, Homo sapiens
agattcaatcccagga

SEQ ID NO: 2763092 - DNA, 20 bp, Homo sapiens
agcaaatgccactctgggca

SEQ ID NO: 2763093 - DNA, 20 bp, Homo sapiens
agcaaatgtcttcctggatt

SEQ ID NO: 2763094 - DNA, 18 bp, Homo sapiens
agcacaagttatttaaat

SEQ ID NO: 2763095 - DNA, 16 bp, Homo sapiens
agcagactcagctctg

SEQ ID NO: 2763096 - DNA, 14 bp, Homo sapiens
agcagagcatgttg

SEQ ID NO: 2763097 - DNA, 16 bp, Homo sapiens
agcagagcatgttgga

SEQ ID NO: 2763098 - DNA, 12 bp, Homo sapiens
agcagctgaagg

SEQ ID NO: 2763099 - DNA, 14 bp, Homo sapiens
agccacccagccag

SEQ ID NO: 2763100 - DNA, 19 bp, Homo sapiens
agccacccagccaggaggg

SEQ ID NO: 2763101 - DNA, 22 bp, Homo sapiens
agccagattttttaaaatttat

SEQ ID NO: 2763102 - DNA, 14 bp, Homo sapiens
agccagcttcctgt

SEQ ID NO: 2763103 - DNA, 19 bp, Homo sapiens
agccagcttcctgtgcaga

SEQ ID NO: 2763104 - DNA, 20 bp, Homo sapiens
agccagcttcctgtgcagaa

SEQ ID NO: 2763105 - DNA, 19 bp, Homo sapiens
agccaggagcctcctgacc

SEQ ID NO: 2763106 - DNA, 23 bp, Homo sapiens
agcccattcattccattctggaa

SEQ ID NO: 2763107 - DNA, 19 bp, Homo sapiens
agcccctacaactccagcc

SEQ ID NO: 2763108 - DNA, 23 bp, Homo sapiens
agccgtttgttccccaagacatt

SEQ ID NO: 2763109 - DNA, 22 bp, Homo sapiens
agcctcacttttaatgaacaaa

SEQ ID NO: 2763110 - DNA, 13 bp, Homo sapiens
agcctcagcagca

SEQ ID NO: 2763111 - DNA, 15 bp, Homo sapiens
agcctcctgaccctg

SEQ ID NO: 2763112 - DNA, 15 bp, Homo sapiens
agcctggttccctct

SEQ ID NO: 2763113 - DNA, 18 bp, Homo sapiens
agcctgtttgggaggctg

SEQ ID NO: 2763114 - DNA, 23 bp, Homo sapiens
agcctgtttgggaggctggagtg

SEQ ID NO: 2763115 - DNA, 15 bp, Homo sapiens
agcctttggaaacag

SEQ ID NO: 2763116 - DNA, 21 bp, Homo sapiens
agctagaggaataaagctgtg

SEQ ID NO: 2763117 - DNA, 12 bp, Homo sapiens
agctgagctgga

SEQ ID NO: 2763118 - DNA, 17 bp, Homo sapiens
agctgccgcaccagccc

SEQ ID NO: 2763119 - DNA, 20 bp, Homo sapiens
agctgctccccaggccaccc

SEQ ID NO: 2763120 - DNA, 17 bp, Homo sapiens
agctgggcactgggccg

SEQ ID NO: 2763121 - DNA, 16 bp, Homo sapiens
agctgtactgagttct

SEQ ID NO: 2763122 - DNA, 15 bp, Homo sapiens
agctgtgagcaaaca

SEQ ID NO: 2763123 - DNA, 20 bp, Homo sapiens
agctgtgagcaaacagagga

SEQ ID NO: 2763124 - DNA, 18 bp, Homo sapiens
aggagtccactgcctcca

SEQ ID NO: 2763125 - DNA, 22 bp, Homo sapiens
aggatgtacaaggacagcccct

SEQ ID NO: 2763126 - DNA, 22 bp, Homo sapiens
aggcatggcccagcctggagcc

SEQ ID NO: 2763127 - DNA, 19 bp, Homo sapiens
aggccaccccgctgatgga

SEQ ID NO: 2763128 - DNA, 21 bp, Homo sapiens
aggctgaacttgttttctggg

SEQ ID NO: 2763129 - DNA, 23 bp, Homo sapiens
aggcttctggttgatgcctgtga

SEQ ID NO: 2763130 - DNA, 18 bp, Homo sapiens
agggagcatcagtgccct

SEQ ID NO: 2763131 - DNA, 11 bp, Homo sapiens
agggcctggcc

SEQ ID NO: 2763132 - DNA, 14 bp, Homo sapiens
agggcctggcctgg

SEQ ID NO: 2763133 - DNA, 15 bp, Homo sapiens
agggcttctcctctg

SEQ ID NO: 2763134 - DNA, 21 bp, Homo sapiens
aggggaataaactgttgagtc

SEQ ID NO: 2763135 - DNA, 17 bp, Homo sapiens
aggggaggcatcagtgt

SEQ ID NO: 2763136 - DNA, 12 bp, Homo sapiens
aggggcctggcc

SEQ ID NO: 2763137 - DNA, 20 bp, Homo sapiens
aggggctgtccaatcacatt

SEQ ID NO: 2763138 - DNA, 14 bp, Homo sapiens
aggtagaatgtaaa

SEQ ID NO: 2763139 - DNA, 15 bp, Homo sapiens
aggtcctttccttct

SEQ ID NO: 2763140 - DNA, 21 bp, Homo sapiens
aggtcctttccttctcgtctt

SEQ ID NO: 2763141 - DNA, 18 bp, Homo sapiens
aggtctggtcggcaaact

SEQ ID NO: 2763142 - DNA, 16 bp, Homo sapiens
aggtgggggtctggcc

SEQ ID NO: 2763143 - DNA, 23 bp, Homo sapiens
aggtgtggctttaggagcagtgg

SEQ ID NO: 2763144 - DNA, 23 bp, Homo sapiens
agtagcacaagttatttaaatct

SEQ ID NO: 2763145 - DNA, 21 bp, Homo sapiens
cacaggtgccgccagctgccg

SEQ ID NO: 2763146 - DNA, 22 bp, Homo sapiens
cacaggtgccgccagctgccgc

SEQ ID NO: 2763147 - DNA, 13 bp, Homo sapiens
cacatgtggactt

SEQ ID NO: 2763148 - DNA, 16 bp, Homo sapiens
cacccaattcaaaaca

SEQ ID NO: 2763149 - DNA, 13 bp, Homo sapiens
caccctcatgctg

SEQ ID NO: 2763150 - DNA, 16 bp, Homo sapiens
caccctcatgctgtgt

SEQ ID NO: 2763151 - DNA, 21 bp, Homo sapiens
caccctcatgctgtgtgactc

SEQ ID NO: 2763152 - DNA, 16 bp, Homo sapiens
caccggagtatgtgca

SEQ ID NO: 2763153 - DNA, 18 bp, Homo sapiens
caccggagtatgtgcagt

SEQ ID NO: 2763154 - DNA, 22 bp, Homo sapiens
caccggagtatgtgcagtgtgg

SEQ ID NO: 2763155 - DNA, 15 bp, Homo sapiens
cacctacttcctcct

SEQ ID NO: 2763156 - DNA, 21 bp, Homo sapiens
cacctggaagcatttgtttct

SEQ ID NO: 2763157 - DNA, 13 bp, Homo sapiens
caccttgtctgct

SEQ ID NO: 2763158 - DNA, 17 bp, Homo sapiens
cacctttctagttgaaa

SEQ ID NO: 2763159 - DNA, 11 bp, Homo sapiens
cactccagctg

SEQ ID NO: 2763160 - DNA, 12 bp, Homo sapiens
cactccagctgg

SEQ ID NO: 2763161 - DNA, 15 bp, Homo sapiens
cactccagctgggat

SEQ ID NO: 2763162 - DNA, 23 bp, Homo sapiens
cactgaaccttgttgatgccagc

SEQ ID NO: 2763163 - DNA, 14 bp, Homo sapiens
cactgcctccatga

SEQ ID NO: 2763164 - DNA, 18 bp, Homo sapiens
cactgcctccatgatgca

SEQ ID NO: 2763165 - DNA, 22 bp, Homo sapiens
cactgcctccatgatgcaagcc

SEQ ID NO: 2763166 - DNA, 12 bp, Homo sapiens
cactgcctttga

SEQ ID NO: 2763167 - DNA, 13 bp, Homo sapiens
cactgggccggca

SEQ ID NO: 2763168 - DNA, 20 bp, Homo sapiens
cacttgtcctcttgccagct

SEQ ID NO: 2763169 - DNA, 20 bp, Homo sapiens
cagaaacaccctcacactgg

SEQ ID NO: 2763170 - DNA, 23 bp, Homo sapiens
cagaaacaccctcacactgggac

SEQ ID NO: 2763171 - DNA, 23 bp, Homo sapiens
cagaataaatgggtaacactgat

SEQ ID NO: 2763172 - DNA, 22 bp, Homo sapiens
cagaatattagtgacctcagct

SEQ ID NO: 2763173 - DNA, 14 bp, Homo sapiens
cagactcagctctg

SEQ ID NO: 2763174 - DNA, 15 bp, Homo sapiens
cagactcagctctga

SEQ ID NO: 2763175 - DNA, 20 bp, Homo sapiens
cagagtggccaatccctgtg

SEQ ID NO: 2763176 - DNA, 15 bp, Homo sapiens
cagcactttcccatg

SEQ ID NO: 2763177 - DNA, 15 bp, Homo sapiens
cagcagactcagctc

SEQ ID NO: 2763178 - DNA, 18 bp, Homo sapiens
cagcagactcagctctga

SEQ ID NO: 2763179 - DNA, 13 bp, Homo sapiens
cagcagagcatgt

SEQ ID NO: 2763180 - DNA, 17 bp, Homo sapiens
cagccacccagccagga

SEQ ID NO: 2763181 - DNA, 13 bp, Homo sapiens
cagccaggagggg

SEQ ID NO: 2763182 - DNA, 20 bp, Homo sapiens
cagccaggaggggctgtcca

SEQ ID NO: 2763183 - DNA, 18 bp, Homo sapiens
cagccatcaagagactga

SEQ ID NO: 2763184 - DNA, 19 bp, Homo sapiens
cagcccctggtactccccc

SEQ ID NO: 2763185 - DNA, 16 bp, Homo sapiens
cagcctggagccgtgg

SEQ ID NO: 2763186 - DNA, 15 bp, Homo sapiens
cagcctggttccctc

SEQ ID NO: 2763187 - DNA, 16 bp, Homo sapiens
cagcctggttccctct

SEQ ID NO: 2763188 - DNA, 14 bp, Homo sapiens
cagctgctccccag

SEQ ID NO: 2763189 - DNA, 20 bp, Homo sapiens
cagctgctccccaggccacc

SEQ ID NO: 2763190 - DNA, 16 bp, Homo sapiens
cagctgtactgagttc

SEQ ID NO: 2763191 - DNA, 14 bp, Homo sapiens
cagcttcctgtgca

SEQ ID NO: 2763192 - DNA, 16 bp, Homo sapiens
cagcttcctgtgcaga

SEQ ID NO: 2763193 - DNA, 18 bp, Homo sapiens
cagcttcctgtgcagaag

SEQ ID NO: 2763194 - DNA, 14 bp, Homo sapiens
caggaagcagcttt

SEQ ID NO: 2763195 - DNA, 13 bp, Homo sapiens
caggactctcttt

SEQ ID NO: 2763196 - DNA, 22 bp, Homo sapiens
caggagtccactgcctccatga

SEQ ID NO: 2763197 - DNA, 20 bp, Homo sapiens
caggcatgcgaatgagctgg

SEQ ID NO: 2763198 - DNA, 22 bp, Homo sapiens
caggcatggcccagcctggagc

SEQ ID NO: 2763199 - DNA, 20 bp, Homo sapiens
caggcgggactatcaggagt

SEQ ID NO: 2763200 - DNA, 17 bp, Homo sapiens
caggcttgggctccatt

SEQ ID NO: 2763201 - DNA, 21 bp, Homo sapiens
caggcttgggctccattccca

SEQ ID NO: 2763202 - DNA, 16 bp, Homo sapiens
cagggcttctcctctg

SEQ ID NO: 2763203 - DNA, 14 bp, Homo sapiens
caggggacactgaa

SEQ ID NO: 2763204 - DNA, 16 bp, Homo sapiens
caggtcctttccttct

SEQ ID NO: 2763205 - DNA, 18 bp, Homo sapiens
caggtgcagcccccactg

SEQ ID NO: 2763206 - DNA, 17 bp, Homo sapiens
cagtaaatacactgtga

SEQ ID NO: 2763207 - DNA, 21 bp, Homo sapiens
cagtagcacaagttatttaaa

SEQ ID NO: 2763208 - DNA, 19 bp, Homo sapiens
cagtcaagttccgtctcct

SEQ ID NO: 2763209 - DNA, 12 bp, Homo sapiens
cagtgacagcta

SEQ ID NO: 2763210 - DNA, 20 bp, Homo sapiens
cagtgtccttggcaggctga

SEQ ID NO: 2763211 - DNA, 22 bp, Homo sapiens
cagttatctaagttaatttaaa

SEQ ID NO: 2763212 - DNA, 19 bp, Homo sapiens
cagttttcagtcaagttcc

SEQ ID NO: 2763213 - DNA, 19 bp, Homo sapiens
cagttttttcacctggaag

SEQ ID NO: 2763214 - DNA, 15 bp, Homo sapiens
catagctgagctgga

SEQ ID NO: 2763215 - DNA, 17 bp, Homo sapiens
cataggtagaatgtaaa

SEQ ID NO: 2763216 - DNA, 23 bp, Homo sapiens
cataggtagaatgtaaagcttgt

SEQ ID NO: 2763217 - DNA, 20 bp, Homo sapiens
catcactgctgtccctcctg

SEQ ID NO: 2763218 - DNA, 19 bp, Homo sapiens
catcagaaacaccctcaca

SEQ ID NO: 2763219 - DNA, 17 bp, Homo sapiens
catccaggtcctttcct

SEQ ID NO: 2763220 - DNA, 18 bp, Homo sapiens
catccgcctctgagccag

SEQ ID NO: 2763221 - DNA, 19 bp, Homo sapiens
catccgcctctgagccagg

SEQ ID NO: 2763222 - DNA, 20 bp, Homo sapiens
catccgcctctgagccagga

SEQ ID NO: 2763223 - DNA, 12 bp, Homo sapiens
catctggaacca

SEQ ID NO: 2763224 - DNA, 18 bp, Homo sapiens
catgcagctgctccccag

SEQ ID NO: 2763225 - DNA, 24 bp, Homo sapiens
catgcagctgctccccaggccacc

SEQ ID NO: 2763226 - DNA, 19 bp, Homo sapiens
catgcgaatgagctgggcc

SEQ ID NO: 2763227 - DNA, 14 bp, Homo sapiens
catgctgtgtgact

SEQ ID NO: 2763228 - DNA, 17 bp, Homo sapiens
catgctgtgtgactcaa

SEQ ID NO: 2763229 - DNA, 22 bp, Homo sapiens
catgctgtgtgactcaaaccaa

SEQ ID NO: 2763230 - DNA, 14 bp, Homo sapiens
catggcccagcctg

SEQ ID NO: 2763231 - DNA, 15 bp, Homo sapiens
catggcccagcctgg

SEQ ID NO: 2763232 - DNA, 18 bp, Homo sapiens
catggcccagcctggagc

SEQ ID NO: 2763233 - DNA, 20 bp, Homo sapiens
catggcccagcctggagccg

SEQ ID NO: 2763234 - DNA, 12 bp, Homo sapiens
catggcttgccc

SEQ ID NO: 2763235 - DNA, 23 bp, Homo sapiens
catggggtttttgccctggagcc

SEQ ID NO: 2763236 - DNA, 14 bp, Homo sapiens
cattcaaaaacccc

SEQ ID NO: 2763237 - DNA, 15 bp, Homo sapiens
cattcattccattct

SEQ ID NO: 2763238 - DNA, 17 bp, Homo sapiens
cattcattccattctgg

SEQ ID NO: 2763239 - DNA, 18 bp, Homo sapiens
cattcccatcactgctgt

SEQ ID NO: 2763240 - DNA, 22 bp, Homo sapiens
cattctgattcgaatgacactg

SEQ ID NO: 2763241 - DNA, 17 bp, Homo sapiens
cattgaagagttgagga

SEQ ID NO: 2763242 - DNA, 20 bp, Homo sapiens
ccaaaagttacatgtttgca

SEQ ID NO: 2763243 - DNA, 23 bp, Homo sapiens
ccaaagaaatagggcatggcttg

SEQ ID NO: 2763244 - DNA, 15 bp, Homo sapiens
ccaaatgcagcttta

SEQ ID NO: 2763245 - DNA, 13 bp, Homo sapiens
cctgtttgggagg

SEQ ID NO: 2763246 - DNA, 20 bp, Homo sapiens
cctgtttgggaggctggagt

SEQ ID NO: 2763247 - DNA, 17 bp, Homo sapiens
ccttaccactgctctga

SEQ ID NO: 2763248 - DNA, 15 bp, Homo sapiens
ccttcaaagcaaatg

SEQ ID NO: 2763249 - DNA, 19 bp, Homo sapiens
ccttcaaagcaaatgtctt

SEQ ID NO: 2763250 - DNA, 15 bp, Homo sapiens
ccttcatgcatggaa

SEQ ID NO: 2763251 - DNA, 12 bp, Homo sapiens
ccttctcagcac

SEQ ID NO: 2763252 - DNA, 19 bp, Homo sapiens
ccttctcgtcttcctctct

SEQ ID NO: 2763253 - DNA, 21 bp, Homo sapiens
cctttgacctgcctcccttca

SEQ ID NO: 2763254 - DNA, 22 bp, Homo sapiens
cctttgacctgcctcccttcat

SEQ ID NO: 2763255 - DNA, 20 bp, Homo sapiens
cctttggcaggtgcagcccc

SEQ ID NO: 2763256 - DNA, 23 bp, Homo sapiens
cctttgtaaattgtcagatgctg

SEQ ID NO: 2763257 - DNA, 16 bp, Homo sapiens
cgaatgacactgttca

SEQ ID NO: 2763258 - DNA, 20 bp, Homo sapiens
cgcatccgcctctgagccag

SEQ ID NO: 2763259 - DNA, 15 bp, Homo sapiens
cgccaagactcaggg

SEQ ID NO: 2763260 - DNA, 14 bp, Homo sapiens
cgcctctgagccag

SEQ ID NO: 2763261 - DNA, 15 bp, Homo sapiens
cgctgatggagcccc

SEQ ID NO: 2763262 - DNA, 21 bp, Homo sapiens
cggaatcctgtcgattagact

SEQ ID NO: 2763263 - DNA, 15 bp, Homo sapiens
cggagtatgtgcagt

SEQ ID NO: 2763264 - DNA, 16 bp, Homo sapiens
cggagtatgtgcagtg

SEQ ID NO: 2763265 - DNA, 23 bp, Homo sapiens
cggctgggaactgggccagcaga

SEQ ID NO: 2763266 - DNA, 16 bp, Homo sapiens
cgtctcctctccagcc

SEQ ID NO: 2763267 - DNA, 20 bp, Homo sapiens
cgtgaagaggggaagtctct

SEQ ID NO: 2763268 - DNA, 21 bp, Homo sapiens
ctaaaggactggttaaatcaa

SEQ ID NO: 2763269 - DNA, 14 bp, Homo sapiens
ctacagtgtctggc

SEQ ID NO: 2763270 - DNA, 14 bp, Homo sapiens
ctacttcctcctcc

SEQ ID NO: 2763271 - DNA, 17 bp, Homo sapiens
ctactttgatatgactg

SEQ ID NO: 2763272 - DNA, 23 bp, Homo sapiens
ctagaaggctgagtaccatgggc

SEQ ID NO: 2763273 - DNA, 21 bp, Homo sapiens
ctagaggaataaagctgtgag

SEQ ID NO: 2763274 - DNA, 23 bp, Homo sapiens
ctagaggaataaagctgtgagca

SEQ ID NO: 2763275 - DNA, 17 bp, Homo sapiens
ctaggtaggaaatgtgg

SEQ ID NO: 2763276 - DNA, 18 bp, Homo sapiens
ctagtggggaggggcctg

SEQ ID NO: 2763277 - DNA, 21 bp, Homo sapiens
ctagtggggaggggcctggcc

SEQ ID NO: 2763278 - DNA, 23 bp, Homo sapiens
ctagtggggaggggcctggcctg

SEQ ID NO: 2763279 - DNA, 19 bp, Homo sapiens
ctatatagctgatcagttt

SEQ ID NO: 2763280 - DNA, 21 bp, Homo sapiens
ctatcaaccccagacactggt

SEQ ID NO: 2763281 - DNA, 14 bp, Homo sapiens
ctatctttgccacc

SEQ ID NO: 2763282 - DNA, 15 bp, Homo sapiens
ctatctttgccaccc

SEQ ID NO: 2763283 - DNA, 13 bp, Homo sapiens
ctattcagaataa

SEQ ID NO: 2763284 - DNA, 14 bp, Homo sapiens
ctcaattcttccct

SEQ ID NO: 2763285 - DNA, 15 bp, Homo sapiens
ctcacattccctctc

SEQ ID NO: 2763286 - DNA, 19 bp, Homo sapiens
ctcacattccctctcatcc

SEQ ID NO: 2763287 - DNA, 23 bp, Homo sapiens
ctcacattccctctcatccaggt

SEQ ID NO: 2763288 - DNA, 16 bp, Homo sapiens
ctcacctacttcctcc

SEQ ID NO: 2763289 - DNA, 16 bp, Homo sapiens
ctcactaggcttctgg

SEQ ID NO: 2763290 - DNA, 15 bp, Homo sapiens
ctcactgtctgctgg

SEQ ID NO: 2763291 - DNA, 16 bp, Homo sapiens
ctcagctcttagctgg

SEQ ID NO: 2763292 - DNA, 23 bp, Homo sapiens
ctcatccaggtcctttccttctc

SEQ ID NO: 2763293 - DNA, 14 bp, Homo sapiens
ctcattagactgga

SEQ ID NO: 2763294 - DNA, 12 bp, Homo sapiens
ctcatttcagga

SEQ ID NO: 2763295 - DNA, 13 bp, Homo sapiens
ctcatttcaggat

SEQ ID NO: 2763296 - DNA, 22 bp, Homo sapiens
ctcatttttccgtaaaaatgat

SEQ ID NO: 2763297 - DNA, 14 bp, Homo sapiens
ctccaaggactcta

SEQ ID NO: 2763298 - DNA, 20 bp, Homo sapiens
ctccatgatgcaagccagct

SEQ ID NO: 2763299 - DNA, 13 bp, Homo sapiens
ctcccaagcagct

SEQ ID NO: 2763300 - DNA, 14 bp, Homo sapiens
ctccccacagtgcc

SEQ ID NO: 2763301 - DNA, 18 bp, Homo sapiens
ctccccacagtgccaccc

SEQ ID NO: 2763302 - DNA, 14 bp, Homo sapiens
ctccccaggccacc

SEQ ID NO: 2763303 - DNA, 22 bp, Homo sapiens
ctccccaggccaccccgctgat

SEQ ID NO: 2763304 - DNA, 15 bp, Homo sapiens
ctcccgaatcctgag

SEQ ID NO: 2763305 - DNA, 22 bp, Homo sapiens
ctccctcgcatccgcctctgag

SEQ ID NO: 2763306 - DNA, 21 bp, Homo sapiens
ctcctacccctgtcctggggc

SEQ ID NO: 2763307 - DNA, 23 bp, Homo sapiens
ctcctacccctgtcctggggctg

SEQ ID NO: 2763308 - DNA, 12 bp, Homo sapiens
ctcctcctgttc

SEQ ID NO: 2763309 - DNA, 12 bp, Homo sapiens
ctcctctccagc

SEQ ID NO: 2763310 - DNA, 13 bp, Homo sapiens
ctcctctccagcc

SEQ ID NO: 2763311 - DNA, 15 bp, Homo sapiens
ctcctctccagccct

SEQ ID NO: 2763312 - DNA, 14 bp, Homo sapiens
ctcctgaccctgtg

SEQ ID NO: 2763313 - DNA, 20 bp, Homo sapiens
ctcctgaccctgtgatgcct

SEQ ID NO: 2763314 - DNA, 17 bp, Homo sapiens
ctcctgaggtctggatt

SEQ ID NO: 2763315 - DNA, 13 bp, Homo sapiens
ctcctgttcctgc

SEQ ID NO: 2763316 - DNA, 21 bp, Homo sapiens
ctcctgttcctgccttctctt

SEQ ID NO: 2763317 - DNA, 22 bp, Homo sapiens
ctcgcatccgcctctgagccag

SEQ ID NO: 2763318 - DNA, 13 bp, Homo sapiens
ctcgtcttcctct

SEQ ID NO: 2763319 - DNA, 15 bp, Homo sapiens
ctctaaaagggggct

SEQ ID NO: 2763320 - DNA, 22 bp, Homo sapiens
ctctcatccaggtcctttcctt

SEQ ID NO: 2763321 - DNA, 21 bp, Homo sapiens
ctctctcacctacttcctcct

SEQ ID NO: 2763322 - DNA, 13 bp, Homo sapiens
ctctctctcacct

SEQ ID NO: 2763323 - DNA, 17 bp, Homo sapiens
ctctgatgaagaggagt

SEQ ID NO: 2763324 - DNA, 14 bp, Homo sapiens
ctctgtattctgca

SEQ ID NO: 2763325 - DNA, 23 bp, Homo sapiens
ctctgtattctgcaacagcctgt

SEQ ID NO: 2763326 - DNA, 13 bp, Homo sapiens
ctcttgccagctc

SEQ ID NO: 2763327 - DNA, 17 bp, Homo sapiens
ctggagtctcactgtct

SEQ ID NO: 2763328 - DNA, 21 bp, Homo sapiens
ctggcaaagatagagaatgcc

SEQ ID NO: 2763329 - DNA, 16 bp, Homo sapiens
ctggcctggtccaggc

SEQ ID NO: 2763330 - DNA, 15 bp, Homo sapiens
ctggccttgggaaga

SEQ ID NO: 2763331 - DNA, 19 bp, Homo sapiens
ctgggaacaccataggtca

SEQ ID NO: 2763332 - DNA, 18 bp, Homo sapiens
ctgggaactgggccagca

SEQ ID NO: 2763333 - DNA, 22 bp, Homo sapiens
ctgggaactgggccagcagagc

SEQ ID NO: 2763334 - DNA, 18 bp, Homo sapiens
ctgggagaccctccccac

SEQ ID NO: 2763335 - DNA, 19 bp, Homo sapiens
ctgggagaccctccccaca

SEQ ID NO: 2763336 - DNA, 23 bp, Homo sapiens
ctgggcagtcttttgtgtcagtg

SEQ ID NO: 2763337 - DNA, 14 bp, Homo sapiens
ctgggccagaattt

SEQ ID NO: 2763338 - DNA, 16 bp, Homo sapiens
ctgggccagcagagca

SEQ ID NO: 2763339 - DNA, 16 bp, Homo sapiens
ctgggccggcagcctg

SEQ ID NO: 2763340 - DNA, 18 bp, Homo sapiens
ctgggccggcagcctggt

SEQ ID NO: 2763341 - DNA, 19 bp, Homo sapiens
ctgggtggggcagggcctg

SEQ ID NO: 2763342 - DNA, 20 bp, Homo sapiens
ctgggtggggcagggcctgg

SEQ ID NO: 2763343 - DNA, 23 bp, Homo sapiens
ctgggtggggcagggcctggcct

SEQ ID NO: 2763344 - DNA, 14 bp, Homo sapiens
ctggtcccacttca

SEQ ID NO: 2763345 - DNA, 15 bp, Homo sapiens
ctggtctaagaatga

SEQ ID NO: 2763346 - DNA, 12 bp, Homo sapiens
ctggttcctccc

SEQ ID NO: 2763347 - DNA, 17 bp, Homo sapiens
ctgtaaaataaaaggtc

SEQ ID NO: 2763348 - DNA, 16 bp, Homo sapiens
ctgtaacaagccagat

SEQ ID NO: 2763349 - DNA, 20 bp, Homo sapiens
ctgtagccccagtgacagct

SEQ ID NO: 2763350 - DNA, 21 bp, Homo sapiens
ctgtagccccagtgacagcta

SEQ ID NO: 2763351 - DNA, 20 bp, Homo sapiens
ctgtattccgatacaaagtg

SEQ ID NO: 2763352 - DNA, 12 bp, Homo sapiens
ctgtattctgca

SEQ ID NO: 2763353 - DNA, 14 bp, Homo sapiens
ctgtccctcctgag

SEQ ID NO: 2763354 - DNA, 12 bp, Homo sapiens
ctgtcctgccta

SEQ ID NO: 2763355 - DNA, 15 bp, Homo sapiens
ctgtcgattagactg

SEQ ID NO: 2763356 - DNA, 19 bp, Homo sapiens
ctgtcgattagactggaca

SEQ ID NO: 2763357 - DNA, 17 bp, Homo sapiens
ctgtgatgcctgacaca

SEQ ID NO: 2763358 - DNA, 18 bp, Homo sapiens
ctgtgtgactcaaaccaa

SEQ ID NO: 2763359 - DNA, 17 bp, Homo sapiens
ctgtttttcggacagtt

SEQ ID NO: 2763360 - DNA, 13 bp, Homo sapiens
cttaacacttaca

SEQ ID NO: 2763361 - DNA, 17 bp, Homo sapiens
cttaagtcagaacagca

SEQ ID NO: 2763362 - DNA, 16 bp, Homo sapiens
cttatacgagtaatat

SEQ ID NO: 2763363 - DNA, 14 bp, Homo sapiens
cttatagacaacat

SEQ ID NO: 2763364 - DNA, 16 bp, Homo sapiens
cttattgggagtagga

SEQ ID NO: 2763365 - DNA, 11 bp, Homo sapiens
cttcatctgga

SEQ ID NO: 2763366 - DNA, 22 bp, Homo sapiens
cttccctagatggttccctttg

SEQ ID NO: 2763367 - DNA, 18 bp, Homo sapiens
cttccctatctttgccac

SEQ ID NO: 2763368 - DNA, 22 bp, Homo sapiens
cttccctatctttgccaccctc

SEQ ID NO: 2763369 - DNA, 23 bp, Homo sapiens
cttccctatctttgccaccctca

SEQ ID NO: 2763370 - DNA, 19 bp, Homo sapiens
cttcctcctcctcctcctg

SEQ ID NO: 2763371 - DNA, 15 bp, Homo sapiens
cttcctctctctcac

SEQ ID NO: 2763372 - DNA, 20 bp, Homo sapiens
cttcctgcctcccaagcagc

SEQ ID NO: 2763373 - DNA, 13 bp, Homo sapiens
cttcctgtgcaga

SEQ ID NO: 2763374 - DNA, 14 bp, Homo sapiens
cttctatcctgcaa

SEQ ID NO: 2763375 - DNA, 16 bp, Homo sapiens
cttctcagcactttcc

SEQ ID NO: 2763376 - DNA, 16 bp, Homo sapiens
cttctcgtcttcctct

SEQ ID NO: 2763377 - DNA, 18 bp, Homo sapiens
cttctgctcacattccct

SEQ ID NO: 2763378 - DNA, 14 bp, Homo sapiens
cttctggttgatgc

SEQ ID NO: 2763379 - DNA, 21 bp, Homo sapiens
cttctgtgcatttgtgtctgc

SEQ ID NO: 2763380 - DNA, 15 bp, Homo sapiens
cttgcaaaaagggtc

SEQ ID NO: 2763381 - DNA, 16 bp, Homo sapiens
cttgcaaaaagggtca

SEQ ID NO: 2763382 - DNA, 17 bp, Homo sapiens
cttgcccctgtggccct

SEQ ID NO: 2763383 - DNA, 22 bp, Homo sapiens
cttgcccctgtggccctggcat

SEQ ID NO: 2763384 - DNA, 22 bp, Homo sapiens
cttgggctccattcccatcact

SEQ ID NO: 2763385 - DNA, 19 bp, Homo sapiens
cttgtcctcttgccagctc

SEQ ID NO: 2763386 - DNA, 16 bp, Homo sapiens
gtcctcttgccagctc

SEQ ID NO: 2763387 - DNA, 22 bp, Homo sapiens
gtcctgcaagtccatagctgag

SEQ ID NO: 2763388 - DNA, 20 bp, Homo sapiens
gtccttggcaggctgatttc

SEQ ID NO: 2763389 - DNA, 14 bp, Homo sapiens
gtcctttccttctc

SEQ ID NO: 2763390 - DNA, 17 bp, Homo sapiens
gtctcctctccagccct

SEQ ID NO: 2763391 - DNA, 16 bp, Homo sapiens
gtctgctaaataaaca

SEQ ID NO: 2763392 - DNA, 18 bp, Homo sapiens
gtgaagaggggaagtctc

SEQ ID NO: 2763393 - DNA, 20 bp, Homo sapiens
gtgactttggctgcatgcga

SEQ ID NO: 2763394 - DNA, 19 bp, Homo sapiens
gtgagagacattaactcat

SEQ ID NO: 2763395 - DNA, 17 bp, Homo sapiens
gtgagcaggctgtgagt

SEQ ID NO: 2763396 - DNA, 18 bp, Homo sapiens
gtgatatacaaagtgtac

SEQ ID NO: 2763397 - DNA, 13 bp, Homo sapiens
gtgattctgtccc

SEQ ID NO: 2763398 - DNA, 19 bp, Homo sapiens
gtgcagcccccactgcctt

SEQ ID NO: 2763399 - DNA, 23 bp, Homo sapiens
gtgcagtgtgggatttgactcct

SEQ ID NO: 2763400 - DNA, 14 bp, Homo sapiens
gtgcattctccagc

SEQ ID NO: 2763401 - DNA, 23 bp, Homo sapiens
gtgcatttgtgtctgcctgcctc

SEQ ID NO: 2763402 - DNA, 19 bp, Homo sapiens
gtgccaggactctctttct

SEQ ID NO: 2763403 - DNA, 18 bp, Homo sapiens
gtggagaggcccggcctc

SEQ ID NO: 2763404 - DNA, 13 bp, Homo sapiens
gtggccctggcat

SEQ ID NO: 2763405 - DNA, 19 bp, Homo sapiens
gtggctttaggagcagtgg

SEQ ID NO: 2763406 - DNA, 15 bp, Homo sapiens
gtgggagggtaccag

SEQ ID NO: 2763407 - DNA, 16 bp, Homo sapiens
gtgggagggtaccagc

SEQ ID NO: 2763408 - DNA, 14 bp, Homo sapiens
gtgtcgttcccttg

SEQ ID NO: 2763409 - DNA, 19 bp, Homo sapiens
gtgtgtttcaggacagctg

SEQ ID NO: 2763410 - DNA, 14 bp, Homo sapiens
gtgtttaagacatt

SEQ ID NO: 2763411 - DNA, 22 bp, Homo sapiens
gtgtttaagacatttttggaag

SEQ ID NO: 2763412 - DNA, 15 bp, Homo sapiens
gttaagacttgacag

SEQ ID NO: 2763413 - DNA, 19 bp, Homo sapiens
gttaagacttgacagtgga

SEQ ID NO: 2763414 - DNA, 13 bp, Homo sapiens
gttaagcctttgg

SEQ ID NO: 2763415 - DNA, 19 bp, Homo sapiens
gttaatatttataggtcac

SEQ ID NO: 2763416 - DNA, 23 bp, Homo sapiens
gttaatttaaagttgtttgtgcc

SEQ ID NO: 2763417 - DNA, 19 bp, Homo sapiens
gttacagtaaatacactgt

SEQ ID NO: 2763418 - DNA, 23 bp, Homo sapiens
gttactcttcagttaagcctttg

SEQ ID NO: 2763419 - DNA, 20 bp, Homo sapiens
gttagggaaaacattccatc

SEQ ID NO: 2763420 - DNA, 15 bp, Homo sapiens
gttatctaagttaat

SEQ ID NO: 2763421 - DNA, 20 bp, Homo sapiens
gttccctttgttgctgtctg

SEQ ID NO: 2763422 - DNA, 9 bp, Homo sapiens
gttcctgcc

SEQ ID NO: 2763423 - DNA, 17 bp, Homo sapiens
gttcctgccttctcttc

SEQ ID NO: 2763424 - DNA, 13 bp, Homo sapiens
gttgaagcctttg

SEQ ID NO: 2763425 - DNA, 18 bp, Homo sapiens
gttgaggacaggagaggg

SEQ ID NO: 2763426 - DNA, 17 bp, Homo sapiens
gttgaggatgtggcaca

SEQ ID NO: 2763427 - DNA, 19 bp, Homo sapiens
taaaaatgatttcagtagc

SEQ ID NO: 2763428 - DNA, 14 bp, Homo sapiens
taaaatttatattg

SEQ ID NO: 2763429 - DNA, 13 bp, Homo sapiens
taaacaataaatg

SEQ ID NO: 2763430 - DNA, 15 bp, Homo sapiens
taaatacactgtgaa

SEQ ID NO: 2763431 - DNA, 15 bp, Homo sapiens
taacaagccagattt

SEQ ID NO: 2763432 - DNA, 16 bp, Homo sapiens
taactgagtgcctttt

SEQ ID NO: 2763433 - DNA, 21 bp, Homo sapiens
tcctgtgccaggactctcttt

SEQ ID NO: 2763434 - DNA, 13 bp, Homo sapiens
tcctgttcctgcc

SEQ ID NO: 2763435 - DNA, 14 bp, Homo sapiens
tcctgttcctgcct

SEQ ID NO: 2763436 - DNA, 16 bp, Homo sapiens
tcctgttcctgccttc

SEQ ID NO: 2763437 - DNA, 19 bp, Homo sapiens
tcctgttcctgccttctct

SEQ ID NO: 2763438 - DNA, 21 bp, Homo sapiens
tcctgttcctgccttctcttc

SEQ ID NO: 2763439 - DNA, 17 bp, Homo sapiens
tccttaagtcagaacag

SEQ ID NO: 2763440 - DNA, 20 bp, Homo sapiens
tccttctcgtcttcctctct

SEQ ID NO: 2763441 - DNA, 15 bp, Homo sapiens
tcctttccttctcgt

SEQ ID NO: 2763442 - DNA, 14 bp, Homo sapiens
tcgaatgacactgt

SEQ ID NO: 2763443 - DNA, 14 bp, Homo sapiens
tcgattagactgga

SEQ ID NO: 2763444 - DNA, 18 bp, Homo sapiens
tcgtcttcctctctctca

SEQ ID NO: 2763445 - DNA, 14 bp, Homo sapiens
tcgttcccttgtgt

SEQ ID NO: 2763446 - DNA, 14 bp, Homo sapiens
tctaagttaattta

SEQ ID NO: 2763447 - DNA, 16 bp, Homo sapiens
tctaagttaatttaaa

SEQ ID NO: 2763448 - DNA, 20 bp, Homo sapiens
tctatcaaccccagacactg

SEQ ID NO: 2763449 - DNA, 15 bp, Homo sapiens
tctcactgtctgctg

SEQ ID NO: 2763450 - DNA, 21 bp, Homo sapiens
tctcactgtctgctggcaaag

SEQ ID NO: 2763451 - DNA, 23 bp, Homo sapiens
tctcatccaggtcctttccttct

SEQ ID NO: 2763452 - DNA, 17 bp, Homo sapiens
tctcatttttccgtaaa

SEQ ID NO: 2763453 - DNA, 14 bp, Homo sapiens
tctcctctccagcc

SEQ ID NO: 2763454 - DNA, 17 bp, Homo sapiens
tctcctctccagcccta

SEQ ID NO: 2763455 - DNA, 13 bp, Homo sapiens
tctcttcctgcct

SEQ ID NO: 2763456 - DNA, 21 bp, Homo sapiens
tctctttcttccactaccctc

SEQ ID NO: 2763457 - DNA, 16 bp, Homo sapiens
tctgacaacagacttc

SEQ ID NO: 2763458 - DNA, 17 bp, Homo sapiens
tctgacattctgattcg

SEQ ID NO: 2763459 - DNA, 11 bp, Homo sapiens
tctgaggctga

SEQ ID NO: 2763460 - DNA, 19 bp, Homo sapiens
tctgattcgaatgacactg

SEQ ID NO: 2763461 - DNA, 15 bp, Homo sapiens
tctgcaacagcctgt

SEQ ID NO: 2763462 - DNA, 16 bp, Homo sapiens
tctgcaacagcctgtt

SEQ ID NO: 2763463 - DNA, 17 bp, Homo sapiens
tctgcctgcctcatgct

SEQ ID NO: 2763464 - DNA, 21 bp, Homo sapiens
tctgcctgcctcatgctctct

SEQ ID NO: 2763465 - DNA, 23 bp, Homo sapiens
tctgctcacattccctctcatcc

SEQ ID NO: 2763466 - DNA, 18 bp, Homo sapiens
tctgctcagatagaatga

SEQ ID NO: 2763467 - DNA, 22 bp, Homo sapiens
tctgctgatcctcccaggcttc

SEQ ID NO: 2763468 - DNA, 14 bp, Homo sapiens
tctgggccagaatt

SEQ ID NO: 2763469 - DNA, 13 bp, Homo sapiens
tctggttcctccc

SEQ ID NO: 2763470 - DNA, 20 bp, Homo sapiens
tctggttcctcccctcctcc

SEQ ID NO: 2763471 - DNA, 15 bp, Homo sapiens
tctgtccctccaaag

SEQ ID NO: 2763472 - DNA, 22 bp, Homo sapiens
tctgtgcatttgtgtctgcctg

SEQ ID NO: 2763473 - DNA, 17 bp, Homo sapiens
tcttcaaaatgagccct

SEQ ID NO: 2763474 - DNA, 20 bp, Homo sapiens
tcttcagttaagcctttgga

SEQ ID NO: 2763475 - DNA, 15 bp, Homo sapiens
tcttcctgcctccca

SEQ ID NO: 2763476 - DNA, 14 bp, Homo sapiens
tcttccttctcagc

SEQ ID NO: 2763477 - DNA, 22 bp, Homo sapiens
tctttcttccactaccctccct

SEQ ID NO: 2763478 - DNA, 16 bp, Homo sapiens
tctttgccaccctcat

SEQ ID NO: 2763479 - DNA, 17 bp, Homo sapiens
tctttgccaccctcatg

SEQ ID NO: 2763480 - DNA, 22 bp, Homo sapiens
tctttgccaccctcatgctgtg

SEQ ID NO: 2763481 - DNA, 20 bp, Homo sapiens
tgtacaaggacagcccctcc

SEQ ID NO: 2763482 - DNA, 17 bp, Homo sapiens
tgtacagttatctaagt

SEQ ID NO: 2763483 - DNA, 16 bp, Homo sapiens
tgtagccccagtgaca

SEQ ID NO: 2763484 - DNA, 19 bp, Homo sapiens
tgtatattaaggtgtggct

SEQ ID NO: 2763485 - DNA, 21 bp, Homo sapiens
tgtcaaacaaatagtctatca

SEQ ID NO: 2763486 - DNA, 14 bp, Homo sapiens
tgtcccagcccctg

SEQ ID NO: 2763487 - DNA, 14 bp, Homo sapiens
tgtccctcctgagg

SEQ ID NO: 2763488 - DNA, 14 bp, Homo sapiens
tgtcgattagactg

SEQ ID NO: 2763489 - DNA, 23 bp, Homo sapiens
tgtcgattagactggacagcttg

SEQ ID NO: 2763490 - DNA, 14 bp, Homo sapiens
tgtcgttcccttgt

SEQ ID NO: 2763491 - DNA, 21 bp, Homo sapiens
tgtcgttcccttgtgtctgtt

SEQ ID NO: 2763492 - DNA, 23 bp, Homo sapiens
tgtcgttcccttgtgtctgttgc

SEQ ID NO: 2763493 - DNA, 21 bp, Homo sapiens
tgtctgatcgttcaaagcatg

SEQ ID NO: 2763494 - DNA, 13 bp, Homo sapiens
tgtctgcctgcct

SEQ ID NO: 2763495 - DNA, 17 bp, Homo sapiens
tgtctgctaaataaaca

SEQ ID NO: 2763496 - DNA, 18 bp, Homo sapiens
tgtctgctaaataaacat

SEQ ID NO: 2763497 - DNA, 21 bp, Homo sapiens
tgtctgttgcttattgggagt

SEQ ID NO: 2763498 - DNA, 17 bp, Homo sapiens
tgtgaccaaaagttaca

SEQ ID NO: 2763499 - DNA, 15 bp, Homo sapiens
tgtgcatttgtgtct

SEQ ID NO: 2763500 - DNA, 19 bp, Homo sapiens
tgtgcatttgtgtctgcct

SEQ ID NO: 2763501 - DNA, 17 bp, Homo sapiens
tgtgccaggactctctt

SEQ ID NO: 2763502 - DNA, 15 bp, Homo sapiens
tgtggcaagtgaatt

SEQ ID NO: 2763503 - DNA, 14 bp, Homo sapiens
tgtggccctggcat

SEQ ID NO: 2763504 - DNA, 16 bp, Homo sapiens
tgtggtggctgctcca

SEQ ID NO: 2763505 - DNA, 21 bp, Homo sapiens
tgtgtatatatatatatatgt

SEQ ID NO: 2763506 - DNA, 12 bp, Homo sapiens
tgtgtctgcctg

SEQ ID NO: 2763507 - DNA, 15 bp, Homo sapiens
tgtgtctgcctgcct

SEQ ID NO: 2763508 - DNA, 11 bp, Homo sapiens
tgtgtttcagg

SEQ ID NO: 2763509 - DNA, 16 bp, Homo sapiens
tgtgtttcaggacagc

SEQ ID NO: 2763510 - DNA, 24 bp, Homo sapiens
tgtgtttcaggacagctgcttctg

SEQ ID NO: 2763511 - DNA, 22 bp, Homo sapiens
tgttaactgagtgccttttggt

SEQ ID NO: 2763512 - DNA, 19 bp, Homo sapiens
tgttagcctcaatttctga

SEQ ID NO: 2763513 - DNA, 22 bp, Homo sapiens
tgttcatggggtttttgccctg

SEQ ID NO: 2763514 - DNA, 13 bp, Homo sapiens
tgttcctgccttc

SEQ ID NO: 2763515 - DNA, 16 bp, Homo sapiens
tgttgctgtctggctt

SEQ ID NO: 2763516 - DNA, 18 bp, Homo sapiens
tgtttgggaggctggagt

SEQ ID NO: 2763517 - DNA, 18 bp, Homo sapiens
ttaaatctgtttttctaa

SEQ ID NO: 2763518 - DNA, 17 bp, Homo sapiens
ttaactcattagactgg

SEQ ID NO: 2763519 - DNA, 18 bp, Homo sapiens
ttaagacatttttggaag

SEQ ID NO: 2763520 - DNA, 22 bp, Homo sapiens
ttaatatttataggtcactttg

SEQ ID NO: 2763521 - DNA, 14 bp, Homo sapiens
ttaatgaacaaatg

SEQ ID NO: 2763522 - DNA, 14 bp, Homo sapiens
ttacttttgggagg

SEQ ID NO: 2763523 - DNA, 21 bp, Homo sapiens
ttagactggaacttgaactga

SEQ ID NO: 2763524 - DNA, 15 bp, Homo sapiens
ttagactggacagct

SEQ ID NO: 2763525 - DNA, 17 bp, Homo sapiens
ttagactggacagcttg

SEQ ID NO: 2763526 - DNA, 19 bp, Homo sapiens
ttagactggacagcttgtg

SEQ ID NO: 2763527 - DNA, 20 bp, Homo sapiens
ttagcctcaatttctgaaca

SEQ ID NO: 2763528 - DNA, 14 bp, Homo sapiens
ttagggaaaacatt

SEQ ID NO: 2763529 - DNA, 22 bp, Homo sapiens
ttagtattatacctgaaatatt

SEQ ID NO: 2763530 - DNA, 14 bp, Homo sapiens
ttatatggaaattc

SEQ ID NO: 2763531 - DNA, 14 bp, Homo sapiens
ttatttaaatctgt

SEQ ID NO: 2763532 - DNA, 18 bp, Homo sapiens
ttcaaaacattgtgccat

SEQ ID NO: 2763533 - DNA, 21 bp, Homo sapiens
ttcaaaataaacaataaatgg

SEQ ID NO: 2763534 - DNA, 16 bp, Homo sapiens
ttcaaagcatgaaatg

SEQ ID NO: 2763535 - DNA, 14 bp, Homo sapiens
ttcagaataaatgg

SEQ ID NO: 2763536 - DNA, 20 bp, Homo sapiens
agtatcatcagatagcatct

SEQ ID NO: 2763537 - DNA, 18 bp, Homo sapiens
agtatgggttagggaaaa

SEQ ID NO: 2763538 - DNA, 17 bp, Homo sapiens
agtcagaacagcagact

SEQ ID NO: 2763539 - DNA, 22 bp, Homo sapiens
agtcagaacagcagactcagct

SEQ ID NO: 2763540 - DNA, 13 bp, Homo sapiens
agtccactgcctc

SEQ ID NO: 2763541 - DNA, 19 bp, Homo sapiens
agtctcactgtctgctggc

SEQ ID NO: 2763542 - DNA, 13 bp, Homo sapiens
agtctcttcctgc

SEQ ID NO: 2763543 - DNA, 19 bp, Homo sapiens
agtctcttcctgcctccca

SEQ ID NO: 2763544 - DNA, 18 bp, Homo sapiens
agtgacctcagctttgat

SEQ ID NO: 2763545 - DNA, 21 bp, Homo sapiens
agtgattctgtccctccaaag

SEQ ID NO: 2763546 - DNA, 22 bp, Homo sapiens
agtgggagggtaccagcagaaa

SEQ ID NO: 2763547 - DNA, 19 bp, Homo sapiens
agtggggaggggcctggcc

SEQ ID NO: 2763548 - DNA, 23 bp, Homo sapiens
agtggggaggggcctggcctggg

SEQ ID NO: 2763549 - DNA, 16 bp, Homo sapiens
agttaatgtcaaggaa

SEQ ID NO: 2763550 - DNA, 23 bp, Homo sapiens
agttacagtaaatacactgtgaa

SEQ ID NO: 2763551 - DNA, 21 bp, Homo sapiens
agttactcttcagttaagcct

SEQ ID NO: 2763552 - DNA, 15 bp, Homo sapiens
agttccgtctcctct

SEQ ID NO: 2763553 - DNA, 13 bp, Homo sapiens
agttctcatccac

SEQ ID NO: 2763554 - DNA, 18 bp, Homo sapiens
agttctcatccacagagg

SEQ ID NO: 2763555 - DNA, 22 bp, Homo sapiens
agttctcatccacagaggccag

SEQ ID NO: 2763556 - DNA, 16 bp, Homo sapiens
agttgaaaataaagtg

SEQ ID NO: 2763557 - DNA, 16 bp, Homo sapiens
agttgaggatgtggca

SEQ ID NO: 2763558 - DNA, 21 bp, Homo sapiens
agttgctcctacccctgtcct

SEQ ID NO: 2763559 - DNA, 15 bp, Homo sapiens
agttgtttgtgcctt

SEQ ID NO: 2763560 - DNA, 16 bp, Homo sapiens
agtttatttgttgaga

SEQ ID NO: 2763561 - DNA, 20 bp, Homo sapiens
agtttatttgttgagagtgt

SEQ ID NO: 2763562 - DNA, 23 bp, Homo sapiens
agtttatttgttgagagtgtgac

SEQ ID NO: 2763563 - DNA, 14 bp, Homo sapiens
ataaagctgtgagc

SEQ ID NO: 2763564 - DNA, 18 bp, Homo sapiens
ataatgaagaatggccat

SEQ ID NO: 2763565 - DNA, 23 bp, Homo sapiens
ataggtagaatgtaaagcttgtc

SEQ ID NO: 2763566 - DNA, 16 bp, Homo sapiens
atatatatgtacagtt

SEQ ID NO: 2763567 - DNA, 14 bp, Homo sapiens
atatatgtacagtt

SEQ ID NO: 2763568 - DNA, 14 bp, Homo sapiens
atattttcttcctt

SEQ ID NO: 2763569 - DNA, 13 bp, Homo sapiens
atcaagagactga

SEQ ID NO: 2763570 - DNA, 18 bp, Homo sapiens
atcactgctgtccctcct

SEQ ID NO: 2763571 - DNA, 17 bp, Homo sapiens
atcagtgccctccagga

SEQ ID NO: 2763572 - DNA, 17 bp, Homo sapiens
atccaggtcctttcctt

SEQ ID NO: 2763573 - DNA, 21 bp, Homo sapiens
atccgcctctgagccaggagc

SEQ ID NO: 2763574 - DNA, 14 bp, Homo sapiens
atcctggagtctca

SEQ ID NO: 2763575 - DNA, 14 bp, Homo sapiens
atcgtgacagcagc

SEQ ID NO: 2763576 - DNA, 17 bp, Homo sapiens
atctaagttaatttaaa

SEQ ID NO: 2763577 - DNA, 17 bp, Homo sapiens
atctgggccagaatttc

SEQ ID NO: 2763578 - DNA, 16 bp, Homo sapiens
atctttgccaccctca

SEQ ID NO: 2763579 - DNA, 18 bp, Homo sapiens
atctttttaggccacctc

SEQ ID NO: 2763580 - DNA, 11 bp, Homo sapiens
atgaagaggag

SEQ ID NO: 2763581 - DNA, 16 bp, Homo sapiens
atgacactgttcagga

SEQ ID NO: 2763582 - DNA, 21 bp, Homo sapiens
atgacagtccgtcaaaacaga

SEQ ID NO: 2763583 - DNA, 12 bp, Homo sapiens
atgagctgggcc

SEQ ID NO: 2763584 - DNA, 17 bp, Homo sapiens
atgagctgggccctggg

SEQ ID NO: 2763585 - DNA, 23 bp, Homo sapiens
atgatgtatgttgaagcctttgt

SEQ ID NO: 2763586 - DNA, 12 bp, Homo sapiens
atgccctcagct

SEQ ID NO: 2763587 - DNA, 15 bp, Homo sapiens
atgcgaatgagctgg

SEQ ID NO: 2763588 - DNA, 21 bp, Homo sapiens
atgctgcttccactcagggct

SEQ ID NO: 2763589 - DNA, 13 bp, Homo sapiens
atgcttctgctca

SEQ ID NO: 2763590 - DNA, 16 bp, Homo sapiens
atggagccccaccttg

SEQ ID NO: 2763591 - DNA, 21 bp, Homo sapiens
atggagccccaccttgtctgc

SEQ ID NO: 2763592 - DNA, 22 bp, Homo sapiens
atggagccccaccttgtctgct

SEQ ID NO: 2763593 - DNA, 18 bp, Homo sapiens
atggcccagcctggagcc

SEQ ID NO: 2763594 - DNA, 16 bp, Homo sapiens
atgttgaagcctttgt

SEQ ID NO: 2763595 - DNA, 19 bp, Homo sapiens
atgtttgcacctttctagt

SEQ ID NO: 2763596 - DNA, 14 bp, Homo sapiens
attaaaaactgagt

SEQ ID NO: 2763597 - DNA, 12 bp, Homo sapiens
attaactcatta

SEQ ID NO: 2763598 - DNA, 22 bp, Homo sapiens
attagactggaacttgaactga

SEQ ID NO: 2763599 - DNA, 18 bp, Homo sapiens
attatttttatctgaagc

SEQ ID NO: 2763600 - DNA, 19 bp, Homo sapiens
attcattccattctggaag

SEQ ID NO: 2763601 - DNA, 11 bp, Homo sapiens
attccatcctt

SEQ ID NO: 2763602 - DNA, 16 bp, Homo sapiens
attcccatcactgctg

SEQ ID NO: 2763603 - DNA, 12 bp, Homo sapiens
attccctggaga

SEQ ID NO: 2763604 - DNA, 16 bp, Homo sapiens
attcgaatgacactgt

SEQ ID NO: 2763605 - DNA, 17 bp, Homo sapiens
attctgatacagcctta

SEQ ID NO: 2763606 - DNA, 20 bp, Homo sapiens
attctgattcgaatgacact

SEQ ID NO: 2763607 - DNA, 22 bp, Homo sapiens
attctgattcgaatgacactgt

SEQ ID NO: 2763608 - DNA, 17 bp, Homo sapiens
attctgcaacagcctgt

SEQ ID NO: 2763609 - DNA, 18 bp, Homo sapiens
attgtgccatgtcaaaca

SEQ ID NO: 2763610 - DNA, 15 bp, Homo sapiens
atttatattgtaaat

SEQ ID NO: 2763611 - DNA, 18 bp, Homo sapiens
atttatattgtaaatatt

SEQ ID NO: 2763612 - DNA, 16 bp, Homo sapiens
atttcaaacggcctca

SEQ ID NO: 2763613 - DNA, 11 bp, Homo sapiens
atttctaggta

SEQ ID NO: 2763614 - DNA, 18 bp, Homo sapiens
atttgggggtgcaatgat

SEQ ID NO: 2763615 - DNA, 19 bp, Homo sapiens
atttgtgtctgcctgcctc

SEQ ID NO: 2763616 - DNA, 13 bp, Homo sapiens
atttgtttctact

SEQ ID NO: 2763617 - DNA, 22 bp, Homo sapiens
attttcttccttctcagcactt

SEQ ID NO: 2763618 - DNA, 13 bp, Homo sapiens
caaaacagattgt

SEQ ID NO: 2763619 - DNA, 13 bp, Homo sapiens
caagagactgagt

SEQ ID NO: 2763620 - DNA, 22 bp, Homo sapiens
caagagatgagaaacaacagaa

SEQ ID NO: 2763621 - DNA, 13 bp, Homo sapiens
caagcagctgaag

SEQ ID NO: 2763622 - DNA, 14 bp, Homo sapiens
caagcagctgaagg

SEQ ID NO: 2763623 - DNA, 12 bp, Homo sapiens
caagccacagaa

SEQ ID NO: 2763624 - DNA, 23 bp, Homo sapiens
caagttccgtctcctctccagcc

SEQ ID NO: 2763625 - DNA, 22 bp, Homo sapiens
caagttgttccttaagtcagaa

SEQ ID NO: 2763626 - DNA, 15 bp, Homo sapiens
caatgttagcctcaa

SEQ ID NO: 2763627 - DNA, 18 bp, Homo sapiens
caattctgatacagcctt

SEQ ID NO: 2763628 - DNA, 21 bp, Homo sapiens
caattcttccctatctttgcc

SEQ ID NO: 2763629 - DNA, 22 bp, Homo sapiens
caattcttccctatctttgcca

SEQ ID NO: 2763630 - DNA, 13 bp, Homo sapiens
caatttctgaaca

SEQ ID NO: 2763631 - DNA, 16 bp, Homo sapiens
cacagcaccagaatgt

SEQ ID NO: 2763632 - DNA, 12 bp, Homo sapiens
cacagctggaga

SEQ ID NO: 2763633 - DNA, 13 bp, Homo sapiens
ttcaggacagctg

SEQ ID NO: 2763634 - DNA, 12 bp, Homo sapiens
ttcatctggaac

SEQ ID NO: 2763635 - DNA, 16 bp, Homo sapiens
ttcatgcatggaaatt

SEQ ID NO: 2763636 - DNA, 16 bp, Homo sapiens
ttccactaccctccct

SEQ ID NO: 2763637 - DNA, 13 bp, Homo sapiens
ttccattctggaa

SEQ ID NO: 2763638 - DNA, 15 bp, Homo sapiens
ttccattctggaagt

SEQ ID NO: 2763639 - DNA, 14 bp, Homo sapiens
ttccccaagacatt

SEQ ID NO: 2763640 - DNA, 13 bp, Homo sapiens
ttccctctcatcc

SEQ ID NO: 2763641 - DNA, 11 bp, Homo sapiens
ttccctggaga

SEQ ID NO: 2763642 - DNA, 15 bp, Homo sapiens
ttcccttcatctgga

SEQ ID NO: 2763643 - DNA, 18 bp, Homo sapiens
ttccctttgttgctgtct

SEQ ID NO: 2763644 - DNA, 19 bp, Homo sapiens
ttcctcctcctcctcctgt

SEQ ID NO: 2763645 - DNA, 23 bp, Homo sapiens
ttcctgtgccaggactctctttc

SEQ ID NO: 2763646 - DNA, 19 bp, Homo sapiens
ttccttaagtcagaacagc

SEQ ID NO: 2763647 - DNA, 14 bp, Homo sapiens
ttccttctcgtctt

SEQ ID NO: 2763648 - DNA, 20 bp, Homo sapiens
ttcggacagtttatttgttg

SEQ ID NO: 2763649 - DNA, 19 bp, Homo sapiens
ttctactttgatatgactg

SEQ ID NO: 2763650 - DNA, 18 bp, Homo sapiens
ttctcgtcttcctctctc

SEQ ID NO: 2763651 - DNA, 17 bp, Homo sapiens
ttctcttctatcctgca

SEQ ID NO: 2763652 - DNA, 21 bp, Homo sapiens
ttctgattcgaatgacactgt

SEQ ID NO: 2763653 - DNA, 15 bp, Homo sapiens
ttctgcaacagcctg

SEQ ID NO: 2763654 - DNA, 16 bp, Homo sapiens
ttctgcaacagcctgt

SEQ ID NO: 2763655 - DNA, 17 bp, Homo sapiens
ttctgctcacattccct

SEQ ID NO: 2763656 - DNA, 20 bp, Homo sapiens
ttctgctcacattccctctc

SEQ ID NO: 2763657 - DNA, 24 bp, Homo sapiens
ttctgtgcatttgtgtctgcctgc

SEQ ID NO: 2763658 - DNA, 14 bp, Homo sapiens
ttcttccttctcag

SEQ ID NO: 2763659 - DNA, 15 bp, Homo sapiens
ttgaagaatgttaag

SEQ ID NO: 2763660 - DNA, 23 bp, Homo sapiens
ttgaagaatgttaagacttgaca

SEQ ID NO: 2763661 - DNA, 15 bp, Homo sapiens
ttgagagtgtgacca

SEQ ID NO: 2763662 - DNA, 16 bp, Homo sapiens
ttgagtcaaaaaatct

SEQ ID NO: 2763663 - DNA, 20 bp, Homo sapiens
ttgatactggtcccacttca

SEQ ID NO: 2763664 - DNA, 21 bp, Homo sapiens
ttgatactggtcccacttcac

SEQ ID NO: 2763665 - DNA, 21 bp, Homo sapiens
ttgatgccagctgtactgagt

SEQ ID NO: 2763666 - DNA, 13 bp, Homo sapiens
ttgccaccctcat

SEQ ID NO: 2763667 - DNA, 15 bp, Homo sapiens
ttgccagtcctgcaa

SEQ ID NO: 2763668 - DNA, 19 bp, Homo sapiens
ttgccctggagcctcagca

SEQ ID NO: 2763669 - DNA, 11 bp, Homo sapiens
ttgctgagcct

SEQ ID NO: 2763670 - DNA, 14 bp, Homo sapiens
ttgtaaatattgtg

SEQ ID NO: 2763671 - DNA, 18 bp, Homo sapiens
ttgtggcaagtgaatttg

SEQ ID NO: 2763672 - DNA, 13 bp, Homo sapiens
ttgtgtctgcctg

SEQ ID NO: 2763673 - DNA, 14 bp, Homo sapiens
ttgtttctactttg

SEQ ID NO: 2763674 - DNA, 15 bp, Homo sapiens
ttgttttactgtctt

SEQ ID NO: 2763675 - DNA, 20 bp, Homo sapiens
tttaaatctgtttttctaac

SEQ ID NO: 2763676 - DNA, 15 bp, Homo sapiens
ttgatatgactgttt

SEQ ID NO: 2763677 - DNA, 16 bp, Homo sapiens
ttgccaccctcatgct

SEQ ID NO: 2763678 - DNA, 21 bp, Homo sapiens
ttgccctggagcctcagcagc

SEQ ID NO: 2763679 - DNA, 20 bp, Homo sapiens
ttgctcctacccctgtcctg

SEQ ID NO: 2763680 - DNA, 13 bp, Homo sapiens
ttgtaaatattgt

SEQ ID NO: 2763681 - DNA, 14 bp, Homo sapiens
ttgtggtggctgct

SEQ ID NO: 2763682 - DNA, 15 bp, Homo sapiens
ttgtgtctgcctgcc

SEQ ID NO: 2763683 - DNA, 23 bp, Homo sapiens
ttgtttctactttgatatgactg

SEQ ID NO: 2763684 - DNA, 17 bp, Homo sapiens
tttaaaatttatattgt

SEQ ID NO: 2763685 - DNA, 20 bp, Homo sapiens
tttaaaatttatattgtaaa

SEQ ID NO: 2763686 - DNA, 17 bp, Homo sapiens
tttaaagttgtttgtgc

SEQ ID NO: 2763687 - DNA, 14 bp, Homo sapiens
tttatattgtaaat

SEQ ID NO: 2763688 - DNA, 16 bp, Homo sapiens
tttatattgtaaatat

SEQ ID NO: 2763689 - DNA, 13 bp, Homo sapiens
tttatttccagtg

SEQ ID NO: 2763690 - DNA, 14 bp, Homo sapiens
tttatttgttgaga

SEQ ID NO: 2763691 - DNA, 18 bp, Homo sapiens
tttcacctggaagcattt

SEQ ID NO: 2763692 - DNA, 13 bp, Homo sapiens
tttccttctcgtc

SEQ ID NO: 2763693 - DNA, 22 bp, Homo sapiens
tttccttctcgtcttcctctct

SEQ ID NO: 2763694 - DNA, 18 bp, Homo sapiens
tttcggacagtttatttg

SEQ ID NO: 2763695 - DNA, 16 bp, Homo sapiens
tttgcacctttctagt

SEQ ID NO: 2763696 - DNA, 21 bp, Homo sapiens
tttgcacctttctagttgaaa

SEQ ID NO: 2763697 - DNA, 22 bp, Homo sapiens
tttgccctggagcctcagcagc

SEQ ID NO: 2763698 - DNA, 14 bp, Homo sapiens
tttgcctgtaacaa

SEQ ID NO: 2763699 - DNA, 21 bp, Homo sapiens
tttgcctgtaacaagccagat

SEQ ID NO: 2763700 - DNA, 13 bp, Homo sapiens
tttggcaggtgca

SEQ ID NO: 2763701 - DNA, 17 bp, Homo sapiens
tttgttaataaaatact

SEQ ID NO: 2763702 - DNA, 23 bp, Homo sapiens
ttttcacctggaagcatttgttt

SEQ ID NO: 2763703 - DNA, 23 bp, Homo sapiens
ttttcagtcaagttccgtctcct

SEQ ID NO: 2763704 - DNA, 12 bp, Homo sapiens
tttttaggccac

SEQ ID NO: 2763705 - DNA, 20 bp, Homo sapiens
aggagcctcctgaccctgtg

SEQ ID NO: 2763706 - DNA, 14 bp, Homo sapiens
aggaggccagcctc

SEQ ID NO: 2763707 - DNA, 20 bp, Homo sapiens
aggaggccagcctcacctca

SEQ ID NO: 2763708 - DNA, 23 bp, Homo sapiens
aggagtagaatataaacacataa

SEQ ID NO: 2763709 - DNA, 21 bp, Homo sapiens
aggatgtggcacaaagttggt

SEQ ID NO: 2763710 - DNA, 16 bp, Homo sapiens
aggcaagccacagaaa

SEQ ID NO: 2763711 - DNA, 17 bp, Homo sapiens
aggcatggcccagcctg

SEQ ID NO: 2763712 - DNA, 18 bp, Homo sapiens
aggcatggcccagcctgg

SEQ ID NO: 2763713 - DNA, 23 bp, Homo sapiens
aggccaccccgctgatggagccc

SEQ ID NO: 2763714 - DNA, 16 bp, Homo sapiens
aggccagcctcacctc

SEQ ID NO: 2763715 - DNA, 13 bp, Homo sapiens
aggcccggcctct

SEQ ID NO: 2763716 - DNA, 22 bp, Homo sapiens
aggcgggactatcaggagtcca

SEQ ID NO: 2763717 - DNA, 15 bp, Homo sapiens
aggctgatttctagg

SEQ ID NO: 2763718 - DNA, 18 bp, Homo sapiens
agggaaaacattccatcc

SEQ ID NO: 2763719 - DNA, 15 bp, Homo sapiens
agggcatggcttgcc

SEQ ID NO: 2763720 - DNA, 15 bp, Homo sapiens
aggggcctggcctgg

SEQ ID NO: 2763721 - DNA, 17 bp, Homo sapiens
aggggcctggcctgggt

SEQ ID NO: 2763722 - DNA, 19 bp, Homo sapiens
aggtagaatgtaaagcttg

SEQ ID NO: 2763723 - DNA, 18 bp, Homo sapiens
aggtcacctttattctgg

SEQ ID NO: 2763724 - DNA, 13 bp, Homo sapiens
aggtcctttcctt

SEQ ID NO: 2763725 - DNA, 20 bp, Homo sapiens
aggtgccgccagctgccgca

SEQ ID NO: 2763726 - DNA, 17 bp, Homo sapiens
agtaaatacactgtgaa

SEQ ID NO: 2763727 - DNA, 18 bp, Homo sapiens
agtaaatacactgtgaag

SEQ ID NO: 2763728 - DNA, 22 bp, Homo sapiens
agtaatatgcctgctatttgaa

SEQ ID NO: 2763729 - DNA, 23 bp, Homo sapiens
agtacccgctacaattctgcaga

SEQ ID NO: 2763730 - DNA, 23 bp, Homo sapiens
agtaggttgaggacaggagaggg

SEQ ID NO: 2763731 - DNA, 17 bp, Homo sapiens
agtatgggactggcctc

SEQ ID NO: 2763732 - DNA, 20 bp, Homo sapiens
agtatgggactggcctctgc

SEQ ID NO: 2763733 - DNA, 12 bp, Homo sapiens
agtatgtgcagt

SEQ ID NO: 2763734 - DNA, 16 bp, Homo sapiens
agtatgtgcagtgtgg

SEQ ID NO: 2763735 - DNA, 22 bp, Homo sapiens
agtattcctttatacacagtgg

SEQ ID NO: 2763736 - DNA, 20 bp, Homo sapiens
agtccactgcctccatgatg

SEQ ID NO: 2763737 - DNA, 23 bp, Homo sapiens
agtccactgcctccatgatgcaa

SEQ ID NO: 2763738 - DNA, 15 bp, Homo sapiens
agtccatagctgagc

SEQ ID NO: 2763739 - DNA, 13 bp, Homo sapiens
agtgagagacatt

SEQ ID NO: 2763740 - DNA, 21 bp, Homo sapiens
agtgagagacattaactcatt

SEQ ID NO: 2763741 - DNA, 17 bp, Homo sapiens
agtgctcatttcaggat

SEQ ID NO: 2763742 - DNA, 17 bp, Homo sapiens
agtggggaggggcctgg

SEQ ID NO: 2763743 - DNA, 18 bp, Homo sapiens
agtggggaggggcctggc

SEQ ID NO: 2763744 - DNA, 14 bp, Homo sapiens
agttaatttaaagt

SEQ ID NO: 2763745 - DNA, 22 bp, Homo sapiens
agttatctaagttaatttaaag

SEQ ID NO: 2763746 - DNA, 12 bp, Homo sapiens
agttatttaaat

SEQ ID NO: 2763747 - DNA, 17 bp, Homo sapiens
agttctcatccacagag

SEQ ID NO: 2763748 - DNA, 13 bp, Homo sapiens
agtttatttgttg

SEQ ID NO: 2763749 - DNA, 18 bp, Homo sapiens
agtttatttgttgagagt

SEQ ID NO: 2763750 - DNA, 19 bp, Homo sapiens
agtttatttgttgagagtg

SEQ ID NO: 2763751 - DNA, 20 bp, Homo sapiens
ataaaaggtcggaccagctt

SEQ ID NO: 2763752 - DNA, 17 bp, Homo sapiens
ataaacatgtgccctca

SEQ ID NO: 2763753 - DNA, 20 bp, Homo sapiens
ataaatgggtaacactgatt

SEQ ID NO: 2763754 - DNA, 13 bp, Homo sapiens
ataatgaagaatg

SEQ ID NO: 2763755 - DNA, 20 bp, Homo sapiens
ataattcaggaagcagcttt

SEQ ID NO: 2763756 - DNA, 19 bp, Homo sapiens
atacttatatggaaattct

SEQ ID NO: 2763757 - DNA, 13 bp, Homo sapiens
atagaatgacagt

SEQ ID NO: 2763758 - DNA, 18 bp, Homo sapiens
atagacccacaagaggca

SEQ ID NO: 2763759 - DNA, 17 bp, Homo sapiens
atagctgagctggaaag

SEQ ID NO: 2763760 - DNA, 20 bp, Homo sapiens
ataggtagaatgtaaagctt

SEQ ID NO: 2763761 - DNA, 22 bp, Homo sapiens
atagtatgcagctaaaaaataa

SEQ ID NO: 2763762 - DNA, 13 bp, Homo sapiens
atataaacacata

SEQ ID NO: 2763763 - DNA, 14 bp, Homo sapiens
atataaacacataa

SEQ ID NO: 2763764 - DNA, 18 bp, Homo sapiens
atatagctgatcagtttt

SEQ ID NO: 2763765 - DNA, 20 bp, Homo sapiens
atatatatgtacagttatct

SEQ ID NO: 2763766 - DNA, 20 bp, Homo sapiens
atatccctatgtcccagccc

SEQ ID NO: 2763767 - DNA, 12 bp, Homo sapiens
atattgtaaata

SEQ ID NO: 2763768 - DNA, 19 bp, Homo sapiens
atcaattctgatacagcct

SEQ ID NO: 2763769 - DNA, 21 bp, Homo sapiens
atcaattctgatacagcctta

SEQ ID NO: 2763770 - DNA, 15 bp, Homo sapiens
atcacatgtggactt

SEQ ID NO: 2763771 - DNA, 24 bp, Homo sapiens
atcacattcaggcatgcgaatgag

SEQ ID NO: 2763772 - DNA, 14 bp, Homo sapiens
atcactgaactttg

SEQ ID NO: 2763773 - DNA, 21 bp, Homo sapiens
atcactgaactttgctgagcc

SEQ ID NO: 2763774 - DNA, 20 bp, Homo sapiens
atcagaaacaccctcacact

SEQ ID NO: 2763775 - DNA, 15 bp, Homo sapiens
atcagatagcatctt

SEQ ID NO: 2763776 - DNA, 13 bp, Homo sapiens
atcagtgccctcc

SEQ ID NO: 2763777 - DNA, 15 bp, Homo sapiens
atcagtgccctccag

SEQ ID NO: 2763778 - DNA, 15 bp, Homo sapiens
atccaaatggctgct

SEQ ID NO: 2763779 - DNA, 21 bp, Homo sapiens
atccaggtcctttccttctcg

SEQ ID NO: 2763780 - DNA, 18 bp, Homo sapiens
atccctatgtcccagccc

SEQ ID NO: 2763781 - DNA, 19 bp, Homo sapiens
atccctatgtcccagcccc

SEQ ID NO: 2763782 - DNA, 20 bp, Homo sapiens
atccctatgtcccagcccct

SEQ ID NO: 2763783 - DNA, 21 bp, Homo sapiens
atccctatgtcccagcccctg

SEQ ID NO: 2763784 - DNA, 14 bp, Homo sapiens
atccgcctctgagc

SEQ ID NO: 2763785 - DNA, 18 bp, Homo sapiens
atccgcctctgagccagg

SEQ ID NO: 2763786 - DNA, 12 bp, Homo sapiens
atcctcccaggc

SEQ ID NO: 2763787 - DNA, 21 bp, Homo sapiens
atcctgtcgattagactggac

SEQ ID NO: 2763788 - DNA, 15 bp, Homo sapiens
atcgtgacagcagca

SEQ ID NO: 2763789 - DNA, 18 bp, Homo sapiens
atctggaaccatcagaaa

SEQ ID NO: 2763790 - DNA, 14 bp, Homo sapiens
atctttgccaccct

SEQ ID NO: 2763791 - DNA, 20 bp, Homo sapiens
atgacagtccgtcaaaacag

SEQ ID NO: 2763792 - DNA, 22 bp, Homo sapiens
atgacagtccgtcaaaacagat

SEQ ID NO: 2763793 - DNA, 19 bp, Homo sapiens
atgactgtttttcggacag

SEQ ID NO: 2763794 - DNA, 21 bp, Homo sapiens
atgactgtttttcggacagtt

SEQ ID NO: 2763795 - DNA, 12 bp, Homo sapiens
atgatgcaagcc

SEQ ID NO: 2763796 - DNA, 17 bp, Homo sapiens
atgcagctgctccccag

SEQ ID NO: 2763797 - DNA, 16 bp, Homo sapiens
atgccctcagctctta

SEQ ID NO: 2763798 - DNA, 18 bp, Homo sapiens
atgcctgacacaggggac

SEQ ID NO: 2763799 - DNA, 16 bp, Homo sapiens
atgcgaatgagctggg

SEQ ID NO: 2763800 - DNA, 16 bp, Homo sapiens
atgctctctatagagg

SEQ ID NO: 2763801 - DNA, 15 bp, Homo sapiens
atgctgcttccactc

SEQ ID NO: 2763802 - DNA, 14 bp, Homo sapiens
atgctgtgtgactc

SEQ ID NO: 2763803 - DNA, 19 bp, Homo sapiens
atgcttctgctcacattcc

SEQ ID NO: 2763804 - DNA, 21 bp, Homo sapiens
atgcttctgctcacattccct

SEQ ID NO: 2763805 - DNA, 12 bp, Homo sapiens
ctatctttgcca

SEQ ID NO: 2763806 - DNA, 18 bp, Homo sapiens
ctatctttgccaccctca

SEQ ID NO: 2763807 - DNA, 19 bp, Homo sapiens
ctatctttgccaccctcat

SEQ ID NO: 2763808 - DNA, 13 bp, Homo sapiens
ctatgtcccagcc

SEQ ID NO: 2763809 - DNA, 15 bp, Homo sapiens
ctattccctggagac

SEQ ID NO: 2763810 - DNA, 19 bp, Homo sapiens
ctcaaaccaaatcactgaa

SEQ ID NO: 2763811 - DNA, 16 bp, Homo sapiens
ctcaatttctgaacac

SEQ ID NO: 2763812 - DNA, 11 bp, Homo sapiens
ctcacaaaaga

SEQ ID NO: 2763813 - DNA, 16 bp, Homo sapiens
ctcactgtctgctggc

SEQ ID NO: 2763814 - DNA, 16 bp, Homo sapiens
ctcagatagaatgaca

SEQ ID NO: 2763815 - DNA, 18 bp, Homo sapiens
ctcagatagaatgacagt

SEQ ID NO: 2763816 - DNA, 23 bp, Homo sapiens
ctcagctctgacattctgattcg

SEQ ID NO: 2763817 - DNA, 15 bp, Homo sapiens
ctcatccacagaggc

SEQ ID NO: 2763818 - DNA, 18 bp, Homo sapiens
ctcatccacagaggccag

SEQ ID NO: 2763819 - DNA, 20 bp, Homo sapiens
ctcatccacagaggccaggc

SEQ ID NO: 2763820 - DNA, 18 bp, Homo sapiens
ctcatccaggtcctttcc

SEQ ID NO: 2763821 - DNA, 23 bp, Homo sapiens
ctccaaagaaatagggcatggct

SEQ ID NO: 2763822 - DNA, 20 bp, Homo sapiens
ctccagccatcaagagactg

SEQ ID NO: 2763823 - DNA, 17 bp, Homo sapiens
ctccagggccagggtgt

SEQ ID NO: 2763824 - DNA, 21 bp, Homo sapiens
ctccatgatgcaagccagctt

SEQ ID NO: 2763825 - DNA, 18 bp, Homo sapiens
ctccattcccatcactgc

SEQ ID NO: 2763826 - DNA, 20 bp, Homo sapiens
ctccattcccatcactgctg

SEQ ID NO: 2763827 - DNA, 22 bp, Homo sapiens
ctccattcccatcactgctgtc

SEQ ID NO: 2763828 - DNA, 14 bp, Homo sapiens
ctcccaagcagctg

SEQ ID NO: 2763829 - DNA, 16 bp, Homo sapiens
ctcccaagcagctgaa

SEQ ID NO: 2763830 - DNA, 15 bp, Homo sapiens
ctccccaggccaccc

SEQ ID NO: 2763831 - DNA, 12 bp, Homo sapiens
ctcccctcctcc

SEQ ID NO: 2763832 - DNA, 20 bp, Homo sapiens
ctcccctcctcctggactcc

SEQ ID NO: 2763833 - DNA, 16 bp, Homo sapiens
ctcccgaatcctgagg

SEQ ID NO: 2763834 - DNA, 13 bp, Homo sapiens
ctccctcgcatcc

SEQ ID NO: 2763835 - DNA, 14 bp, Homo sapiens
ctccctcgcatccg

SEQ ID NO: 2763836 - DNA, 21 bp, Homo sapiens
ctccctcgcatccgcctctga

SEQ ID NO: 2763837 - DNA, 19 bp, Homo sapiens
ctcccttcatgcatggaaa

SEQ ID NO: 2763838 - DNA, 13 bp, Homo sapiens
ctcctacccctgt

SEQ ID NO: 2763839 - DNA, 19 bp, Homo sapiens
ctcctacccctgtcctggg

SEQ ID NO: 2763840 - DNA, 15 bp, Homo sapiens
ctcctcctcctcctg

SEQ ID NO: 2763841 - DNA, 16 bp, Homo sapiens
ctcctcctcctcctgt

SEQ ID NO: 2763842 - DNA, 13 bp, Homo sapiens
ctcctcctcctgt

SEQ ID NO: 2763843 - DNA, 15 bp, Homo sapiens
ctcctcctggactcc

SEQ ID NO: 2763844 - DNA, 19 bp, Homo sapiens
ctcctcctggactcctgca

SEQ ID NO: 2763845 - DNA, 13 bp, Homo sapiens
ctcctgaccctgt

SEQ ID NO: 2763846 - DNA, 15 bp, Homo sapiens
ctcctgaccctgtga

SEQ ID NO: 2763847 - DNA, 14 bp, Homo sapiens
ctcctgttcctgcc

SEQ ID NO: 2763848 - DNA, 22 bp, Homo sapiens
ctcctgttcctgccttctcttc

SEQ ID NO: 2763849 - DNA, 19 bp, Homo sapiens
ctcgcatccgcctctgagc

SEQ ID NO: 2763850 - DNA, 14 bp, Homo sapiens
ctcgtcttcctctc

SEQ ID NO: 2763851 - DNA, 15 bp, Homo sapiens
ctcgtcttcctctct

SEQ ID NO: 2763852 - DNA, 19 bp, Homo sapiens
ctcgtcttcctctctctca

SEQ ID NO: 2763853 - DNA, 22 bp, Homo sapiens
ctctaaaagggggctattccct

SEQ ID NO: 2763854 - DNA, 14 bp, Homo sapiens
ctctcatccaggtc

SEQ ID NO: 2763855 - DNA, 19 bp, Homo sapiens
ctctcatccaggtcctttc

SEQ ID NO: 2763856 - DNA, 21 bp, Homo sapiens
ctctgacaacagacttctgaa

SEQ ID NO: 2763857 - DNA, 13 bp, Homo sapiens
ctctgagccagga

SEQ ID NO: 2763858 - DNA, 14 bp, Homo sapiens
ctctggttcctccc

SEQ ID NO: 2763859 - DNA, 22 bp, Homo sapiens
ctctgtattctgcaacagcctg

SEQ ID NO: 2763860 - DNA, 19 bp, Homo sapiens
ctcttcagttaagcctttg

SEQ ID NO: 2763861 - DNA, 23 bp, Homo sapiens
ctcttcagttaagcctttggaaa

SEQ ID NO: 2763862 - DNA, 16 bp, Homo sapiens
ctcttctatcctgcaa

SEQ ID NO: 2763863 - DNA, 13 bp, Homo sapiens
ctctttcttccac

SEQ ID NO: 2763864 - DNA, 22 bp, Homo sapiens
ctctttcttccactaccctccc

SEQ ID NO: 2763865 - DNA, 22 bp, Homo sapiens
ctgaaatagacccacaagaggc

SEQ ID NO: 2763866 - DNA, 14 bp, Homo sapiens
ctgaactttgctga

SEQ ID NO: 2763867 - DNA, 19 bp, Homo sapiens
ctgacacaggggacactga

SEQ ID NO: 2763868 - DNA, 20 bp, Homo sapiens
ctgacacaggggacactgaa

SEQ ID NO: 2763869 - DNA, 14 bp, Homo sapiens
ctgagccaggagcc

SEQ ID NO: 2763870 - DNA, 13 bp, Homo sapiens
ctgagctggaaag

SEQ ID NO: 2763871 - DNA, 23 bp, Homo sapiens
ctgagctggaaaggatgcttctg

SEQ ID NO: 2763872 - DNA, 15 bp, Homo sapiens
ctgagtgccttttgg

SEQ ID NO: 2763873 - DNA, 14 bp, Homo sapiens
ctgatacagcctta

SEQ ID NO: 2763874 - DNA, 21 bp, Homo sapiens
ctgatacagccttacaataca

SEQ ID NO: 2763875 - DNA, 18 bp, Homo sapiens
ctgatggagccccacctt

SEQ ID NO: 2763876 - DNA, 21 bp, Homo sapiens
ctgattcacatctcatttttc

SEQ ID NO: 2763877 - DNA, 17 bp, Homo sapiens
ctgattcgaatgacact

SEQ ID NO: 2763878 - DNA, 19 bp, Homo sapiens
ctgattcgaatgacactgt

SEQ ID NO: 2763879 - DNA, 22 bp, Homo sapiens
ctgcaagtccatagctgagctg

SEQ ID NO: 2763880 - DNA, 22 bp, Homo sapiens
ctgcacacgctccttcctctga

SEQ ID NO: 2763881 - DNA, 20 bp, Homo sapiens
ctgcagaaaaagaatgtgtc

SEQ ID NO: 2763882 - DNA, 23 bp, Homo sapiens
ctgcatgcgagtgctcatttcag

SEQ ID NO: 2763883 - DNA, 14 bp, Homo sapiens
ctgccgcaccagcc

SEQ ID NO: 2763884 - DNA, 17 bp, Homo sapiens
ctgcctcccttcatgca

SEQ ID NO: 2763885 - DNA, 21 bp, Homo sapiens
ctgcctcccttcatgcatgga

SEQ ID NO: 2763886 - DNA, 16 bp, Homo sapiens
ctgcctgccttggcct

SEQ ID NO: 2763887 - DNA, 11 bp, Homo sapiens
ctgccttctct

SEQ ID NO: 2763888 - DNA, 14 bp, Homo sapiens
ctgctcacattccc

SEQ ID NO: 2763889 - DNA, 15 bp, Homo sapiens
ctgctcacattccct

SEQ ID NO: 2763890 - DNA, 16 bp, Homo sapiens
ctgctcacattccctc

SEQ ID NO: 2763891 - DNA, 17 bp, Homo sapiens
ctgctcacattccctct

SEQ ID NO: 2763892 - DNA, 18 bp, Homo sapiens
ctgctcacattccctctc

SEQ ID NO: 2763893 - DNA, 16 bp, Homo sapiens
ctgctccccaggccac

SEQ ID NO: 2763894 - DNA, 17 bp, Homo sapiens
ctgctccccaggccacc

SEQ ID NO: 2763895 - DNA, 13 bp, Homo sapiens
ctgctggcaaaga

SEQ ID NO: 2763896 - DNA, 13 bp, Homo sapiens
ctgcttctgtgca

SEQ ID NO: 2763897 - DNA, 16 bp, Homo sapiens
ctgcttctgtgcattt

SEQ ID NO: 2763898 - DNA, 20 bp, Homo sapiens
ctgcttctgtgcatttgtgt

SEQ ID NO: 2763899 - DNA, 20 bp, Homo sapiens
ctggaaaggatgcttctgct

SEQ ID NO: 2763900 - DNA, 15 bp, Homo sapiens
ctggaaccatcagaa

SEQ ID NO: 2763901 - DNA, 16 bp, Homo sapiens
ctggaacttgaactga

SEQ ID NO: 2763902 - DNA, 18 bp, Homo sapiens
ctggaagtgactttggct

SEQ ID NO: 2763903 - DNA, 20 bp, Homo sapiens
ctggagaccccagagtaggg

SEQ ID NO: 2763904 - DNA, 16 bp, Homo sapiens
ctggagcctcagcagc

SEQ ID NO: 2763905 - DNA, 20 bp, Homo sapiens
gagtggccaatccctgtgtg

SEQ ID NO: 2763906 - DNA, 12 bp, Homo sapiens
gagtgtgaccaa

SEQ ID NO: 2763907 - DNA, 21 bp, Homo sapiens
gatactggtcccacttcacag

SEQ ID NO: 2763908 - DNA, 14 bp, Homo sapiens
gatagaatgacagt

SEQ ID NO: 2763909 - DNA, 18 bp, Homo sapiens
gatatacaaagtgtacca

SEQ ID NO: 2763910 - DNA, 19 bp, Homo sapiens
gatgagaaacaacagaaac

SEQ ID NO: 2763911 - DNA, 14 bp, Homo sapiens
gatgcaagccagct

SEQ ID NO: 2763912 - DNA, 12 bp, Homo sapiens
gatgccagctgt

SEQ ID NO: 2763913 - DNA, 20 bp, Homo sapiens
gatgcttctgctcacattcc

SEQ ID NO: 2763914 - DNA, 14 bp, Homo sapiens
gatggagccccacc

SEQ ID NO: 2763915 - DNA, 21 bp, Homo sapiens
gatgtatgttgaagcctttgt

SEQ ID NO: 2763916 - DNA, 16 bp, Homo sapiens
gattcacatctcattt

SEQ ID NO: 2763917 - DNA, 18 bp, Homo sapiens
gattctgtccctccaaag

SEQ ID NO: 2763918 - DNA, 11 bp, Homo sapiens
gattgtttgca

SEQ ID NO: 2763919 - DNA, 19 bp, Homo sapiens
gcaaatgccactctgggca

SEQ ID NO: 2763920 - DNA, 17 bp, Homo sapiens
gcacaagttatttaaat

SEQ ID NO: 2763921 - DNA, 16 bp, Homo sapiens
gcaccagaatgtatat

SEQ ID NO: 2763922 - DNA, 19 bp, Homo sapiens
gcactgggccggcagcctg

SEQ ID NO: 2763923 - DNA, 22 bp, Homo sapiens
gcagaaaaagaatgtgtcttgc

SEQ ID NO: 2763924 - DNA, 23 bp, Homo sapiens
gcagcaaatgccactctgggcag

SEQ ID NO: 2763925 - DNA, 18 bp, Homo sapiens
gcagcctggttccctctt

SEQ ID NO: 2763926 - DNA, 15 bp, Homo sapiens
gcagctgctccccag

SEQ ID NO: 2763927 - DNA, 13 bp, Homo sapiens
gcagctgggcact

SEQ ID NO: 2763928 - DNA, 22 bp, Homo sapiens
gcagctgggcactgggccggca

SEQ ID NO: 2763929 - DNA, 17 bp, Homo sapiens
gcaggctgatttctagg

SEQ ID NO: 2763930 - DNA, 18 bp, Homo sapiens
gcagtgggagggtaccag

SEQ ID NO: 2763931 - DNA, 23 bp, Homo sapiens
gcatcagtgccctccaggataga

SEQ ID NO: 2763932 - DNA, 23 bp, Homo sapiens
gcatccgcctctgagccaggagc

SEQ ID NO: 2763933 - DNA, 23 bp, Homo sapiens
gcatggaaattcccttcatctgg

SEQ ID NO: 2763934 - DNA, 19 bp, Homo sapiens
gcatggcccagcctggagc

SEQ ID NO: 2763935 - DNA, 19 bp, Homo sapiens
gcatggcttgcccctgtgg

SEQ ID NO: 2763936 - DNA, 18 bp, Homo sapiens
gcatttgtgtctgcctgc

SEQ ID NO: 2763937 - DNA, 15 bp, Homo sapiens
gccaagactcagggg

SEQ ID NO: 2763938 - DNA, 22 bp, Homo sapiens
gccacccatgcagctgctcccc

SEQ ID NO: 2763939 - DNA, 15 bp, Homo sapiens
gccaccctcatgctg

SEQ ID NO: 2763940 - DNA, 17 bp, Homo sapiens
gccagctgccgcaccag

SEQ ID NO: 2763941 - DNA, 16 bp, Homo sapiens
gccagctgtactgagt

SEQ ID NO: 2763942 - DNA, 17 bp, Homo sapiens
gccagctgtactgagtt

SEQ ID NO: 2763943 - DNA, 17 bp, Homo sapiens
gccagcttcctgtgcag

SEQ ID NO: 2763944 - DNA, 19 bp, Homo sapiens
gccagcttcctgtgcagaa

SEQ ID NO: 2763945 - DNA, 20 bp, Homo sapiens
gccagcttcctgtgcagaag

SEQ ID NO: 2763946 - DNA, 22 bp, Homo sapiens
gccaggcatggcccagcctgga

SEQ ID NO: 2763947 - DNA, 16 bp, Homo sapiens
gccatcaagagactga

SEQ ID NO: 2763948 - DNA, 11 bp, Homo sapiens
gcccagcctgg

SEQ ID NO: 2763949 - DNA, 17 bp, Homo sapiens
gccctcagctcttagct

SEQ ID NO: 2763950 - DNA, 16 bp, Homo sapiens
gcctaaggctgaactt

SEQ ID NO: 2763951 - DNA, 16 bp, Homo sapiens
gcctagtggggagggg

SEQ ID NO: 2763952 - DNA, 20 bp, Homo sapiens
gcctagtggggaggggcctg

SEQ ID NO: 2763953 - DNA, 23 bp, Homo sapiens
gcctagtggggaggggcctggcc

SEQ ID NO: 2763954 - DNA, 22 bp, Homo sapiens
gcctcaatttctgaacaccata

SEQ ID NO: 2763955 - DNA, 22 bp, Homo sapiens
gcctcacttttaatgaacaaat

SEQ ID NO: 2763956 - DNA, 12 bp, Homo sapiens
gcctcagcagca

SEQ ID NO: 2763957 - DNA, 15 bp, Homo sapiens
gcctctgagccagga

SEQ ID NO: 2763958 - DNA, 20 bp, Homo sapiens
gcctgacacaggggacactg

SEQ ID NO: 2763959 - DNA, 18 bp, Homo sapiens
gcctgcctcatgctctct

SEQ ID NO: 2763960 - DNA, 23 bp, Homo sapiens
gcctgggtggggcagggcctggc

SEQ ID NO: 2763961 - DNA, 14 bp, Homo sapiens
gcctggttccctct

SEQ ID NO: 2763962 - DNA, 15 bp, Homo sapiens
gcctggttccctctt

SEQ ID NO: 2763963 - DNA, 20 bp, Homo sapiens
gcctggttccctctttcctg

SEQ ID NO: 2763964 - DNA, 17 bp, Homo sapiens
gcctgtgaactgaactc

SEQ ID NO: 2763965 - DNA, 18 bp, Homo sapiens
gccttctcttctatcctg

SEQ ID NO: 2763966 - DNA, 21 bp, Homo sapiens
gccttctcttctatcctgcaa

SEQ ID NO: 2763967 - DNA, 16 bp, Homo sapiens
gcctttgacctgcctc

SEQ ID NO: 2763968 - DNA, 15 bp, Homo sapiens
gcctttggcaggtgc

SEQ ID NO: 2763969 - DNA, 22 bp, Homo sapiens
gcgcaggcgggactatcaggag

SEQ ID NO: 2763970 - DNA, 12 bp, Homo sapiens
gctaaataaaca

SEQ ID NO: 2763971 - DNA, 13 bp, Homo sapiens
gctaaataaacat

SEQ ID NO: 2763972 - DNA, 16 bp, Homo sapiens
gctacaattctgcaga

SEQ ID NO: 2763973 - DNA, 15 bp, Homo sapiens
gctattccctggaga

SEQ ID NO: 2763974 - DNA, 15 bp, Homo sapiens
gctcacattccctct

SEQ ID NO: 2763975 - DNA, 18 bp, Homo sapiens
gctcacattccctctcat

SEQ ID NO: 2763976 - DNA, 16 bp, Homo sapiens
gctccaaatgcagctt

SEQ ID NO: 2763977 - DNA, 15 bp, Homo sapiens
gctccattcccatca

SEQ ID NO: 2763978 - DNA, 18 bp, Homo sapiens
gctccttcctctgaggct

SEQ ID NO: 2763979 - DNA, 20 bp, Homo sapiens
gctccttcctctgaggctga

SEQ ID NO: 2763980 - DNA, 20 bp, Homo sapiens
gctcttagctggtctaagaa

SEQ ID NO: 2763981 - DNA, 13 bp, Homo sapiens
gctgatttctagg

SEQ ID NO: 2763982 - DNA, 17 bp, Homo sapiens
gctgctccccaggccac

SEQ ID NO: 2763983 - DNA, 18 bp, Homo sapiens
gctgcttccactcagggc

SEQ ID NO: 2763984 - DNA, 22 bp, Homo sapiens
gctgggaactgggccagcagag

SEQ ID NO: 2763985 - DNA, 20 bp, Homo sapiens
gctgggagaccctccccaca

SEQ ID NO: 2763986 - DNA, 20 bp, Homo sapiens
gctgtactgagttctcatcc

SEQ ID NO: 2763987 - DNA, 15 bp, Homo sapiens
gctgtccctcctgag

SEQ ID NO: 2763988 - DNA, 21 bp, Homo sapiens
gctgtccctcctgaggtctgg

SEQ ID NO: 2763989 - DNA, 22 bp, Homo sapiens
gcttctgctcacattccctctc

SEQ ID NO: 2763990 - DNA, 15 bp, Homo sapiens
gcttgggctccattc

SEQ ID NO: 2763991 - DNA, 23 bp, Homo sapiens
gcttttaattttaatcctggagt

SEQ ID NO: 2763992 - DNA, 15 bp, Homo sapiens
gcttttgtctccctt

SEQ ID NO: 2763993 - DNA, 15 bp, Homo sapiens
ggaaaacattccatc

SEQ ID NO: 2763994 - DNA, 22 bp, Homo sapiens
ggaaattcccttcatctggaac

SEQ ID NO: 2763995 - DNA, 23 bp, Homo sapiens
ggaaccagtaggttgaggacagg

SEQ ID NO: 2763996 - DNA, 22 bp, Homo sapiens
ggacagcttgtggcaagtgaat

SEQ ID NO: 2763997 - DNA, 13 bp, Homo sapiens
ggactctctttct

SEQ ID NO: 2763998 - DNA, 18 bp, Homo sapiens
ggacttttatttccagtg

SEQ ID NO: 2763999 - DNA, 16 bp, Homo sapiens
ggagcctcagcagcaa

SEQ ID NO: 2764000 - DNA, 12 bp, Homo sapiens
ggagctgggaga

SEQ ID NO: 2764001 - DNA, 13 bp, Homo sapiens
ggaggccagcctc

SEQ ID NO: 2764002 - DNA, 15 bp, Homo sapiens
ggagtccactgcctc

SEQ ID NO: 2764003 - DNA, 14 bp, Homo sapiens
ggagtggaaacaaa

SEQ ID NO: 2764004 - DNA, 12 bp, Homo sapiens
ggagttgctcct

SEQ ID NO: 2764005 - DNA, 23 bp, Homo sapiens
tggttcctcccctcctcctggac

SEQ ID NO: 2764006 - DNA, 13 bp, Homo sapiens
tgtaaagcttgtc

SEQ ID NO: 2764007 - DNA, 16 bp, Homo sapiens
tgtacaaggacagccc

SEQ ID NO: 2764008 - DNA, 22 bp, Homo sapiens
tgtacagttatctaagttaatt

SEQ ID NO: 2764009 - DNA, 13 bp, Homo sapiens
tgtccctcctgag

SEQ ID NO: 2764010 - DNA, 18 bp, Homo sapiens
tgtcgattagactggaca

SEQ ID NO: 2764011 - DNA, 14 bp, Homo sapiens
tgtctgcctgcctc

SEQ ID NO: 2764012 - DNA, 15 bp, Homo sapiens
tgtctggccttggga

SEQ ID NO: 2764013 - DNA, 21 bp, Homo sapiens
tgtcttaaaggggcctgcgca

SEQ ID NO: 2764014 - DNA, 23 bp, Homo sapiens
tgtcttaaaggggcctgcgcagg

SEQ ID NO: 2764015 - DNA, 17 bp, Homo sapiens
tgtgagcaaacagagga

SEQ ID NO: 2764016 - DNA, 22 bp, Homo sapiens
tgtgagggatggggagcagctg

SEQ ID NO: 2764017 - DNA, 18 bp, Homo sapiens
tgtgcatttgtgtctgcc

SEQ ID NO: 2764018 - DNA, 22 bp, Homo sapiens
tgtgcatttgtgtctgcctgcc

SEQ ID NO: 2764019 - DNA, 21 bp, Homo sapiens
tgtgccaggactctctttctt

SEQ ID NO: 2764020 - DNA, 16 bp, Homo sapiens
tgtgccatgtcaaaca

SEQ ID NO: 2764021 - DNA, 21 bp, Homo sapiens
tgtgccatgtcaaacaaatag

SEQ ID NO: 2764022 - DNA, 14 bp, Homo sapiens
tgtggcaagtgaat

SEQ ID NO: 2764023 - DNA, 21 bp, Homo sapiens
tgtggcacaaagttggtgcca

SEQ ID NO: 2764024 - DNA, 23 bp, Homo sapiens
tgtggccaagggctccagggcca

SEQ ID NO: 2764025 - DNA, 13 bp, Homo sapiens
tgtgtctgcctgc

SEQ ID NO: 2764026 - DNA, 16 bp, Homo sapiens
tgtgtctgcctgcctc

SEQ ID NO: 2764027 - DNA, 23 bp, Homo sapiens
tgtgtctgcctgcctcatgctct

SEQ ID NO: 2764028 - DNA, 23 bp, Homo sapiens
tgtgtttcaggacagctgcttct

SEQ ID NO: 2764029 - DNA, 10 bp, Homo sapiens
tgttcctgcc

SEQ ID NO: 2764030 - DNA, 12 bp, Homo sapiens
tgttcctgcctt

SEQ ID NO: 2764031 - DNA, 16 bp, Homo sapiens
tgttcctgccttctct

SEQ ID NO: 2764032 - DNA, 14 bp, Homo sapiens
tgttggcagcctct

SEQ ID NO: 2764033 - DNA, 23 bp, Homo sapiens
tgtttcaggacagctgcttctgt

SEQ ID NO: 2764034 - DNA, 17 bp, Homo sapiens
tgtttctactttgatat

SEQ ID NO: 2764035 - DNA, 18 bp, Homo sapiens
tgtttgcacctttctagt

SEQ ID NO: 2764036 - DNA, 15 bp, Homo sapiens
ttaactcattagact

SEQ ID NO: 2764037 - DNA, 23 bp, Homo sapiens
ttaagacatttttggaaggggac

SEQ ID NO: 2764038 - DNA, 17 bp, Homo sapiens
ttaagacttgacagtgg

SEQ ID NO: 2764039 - DNA, 16 bp, Homo sapiens
ttaagcctttggaaac

SEQ ID NO: 2764040 - DNA, 20 bp, Homo sapiens
ttacagtaaatacactgtga

SEQ ID NO: 2764041 - DNA, 12 bp, Homo sapiens
ttacatgtttgc

SEQ ID NO: 2764042 - DNA, 15 bp, Homo sapiens
ttagactggaacttg

SEQ ID NO: 2764043 - DNA, 22 bp, Homo sapiens
ttagactggaacttgaactgat

SEQ ID NO: 2764044 - DNA, 17 bp, Homo sapiens
ttagggaaaacattcca

SEQ ID NO: 2764045 - DNA, 21 bp, Homo sapiens
ttatctaagttaatttaaagt

SEQ ID NO: 2764046 - DNA, 19 bp, Homo sapiens
ttatttgttgagagtgtga

SEQ ID NO: 2764047 - DNA, 15 bp, Homo sapiens
ttcaaagcaaatgtc

SEQ ID NO: 2764048 - DNA, 15 bp, Homo sapiens
ttcaatgttagcctc

SEQ ID NO: 2764049 - DNA, 17 bp, Homo sapiens
ttcatctggaaccatca

SEQ ID NO: 2764050 - DNA, 14 bp, Homo sapiens
ttcatgcatggaaa

SEQ ID NO: 2764051 - DNA, 16 bp, Homo sapiens
ttcattccattctgga

SEQ ID NO: 2764052 - DNA, 18 bp, Homo sapiens
ttccactaccctccctcg

SEQ ID NO: 2764053 - DNA, 11 bp, Homo sapiens
ttcccaaaagc

SEQ ID NO: 2764054 - DNA, 19 bp, Homo sapiens
ttccccatgtctcgactca

SEQ ID NO: 2764055 - DNA, 16 bp, Homo sapiens
ttccctagatggttcc

SEQ ID NO: 2764056 - DNA, 21 bp, Homo sapiens
ttccctagatggttccctttg

SEQ ID NO: 2764057 - DNA, 16 bp, Homo sapiens
ttccctatctttgcca

SEQ ID NO: 2764058 - DNA, 20 bp, Homo sapiens
ttccctggagaccccagagt

SEQ ID NO: 2764059 - DNA, 14 bp, Homo sapiens
ttcccttcatctgg

SEQ ID NO: 2764060 - DNA, 16 bp, Homo sapiens
ttcccttcatctggaa

SEQ ID NO: 2764061 - DNA, 17 bp, Homo sapiens
ttccctttgttgctgtc

SEQ ID NO: 2764062 - DNA, 13 bp, Homo sapiens
ttccgtctcctct

SEQ ID NO: 2764063 - DNA, 15 bp, Homo sapiens
ttcctctctctcacc

SEQ ID NO: 2764064 - DNA, 21 bp, Homo sapiens
ttcctctgaggctgaaattca

SEQ ID NO: 2764065 - DNA, 15 bp, Homo sapiens
ttcctgccttctctt

SEQ ID NO: 2764066 - DNA, 14 bp, Homo sapiens
ttcctgtgccagga

SEQ ID NO: 2764067 - DNA, 21 bp, Homo sapiens
ttcctgtgccaggactctctt

SEQ ID NO: 2764068 - DNA, 20 bp, Homo sapiens
ttccttaagtcagaacagca

SEQ ID NO: 2764069 - DNA, 22 bp, Homo sapiens
ttctcgtcttcctctctctcac

SEQ ID NO: 2764070 - DNA, 15 bp, Homo sapiens
ttctgctcacattcc

SEQ ID NO: 2764071 - DNA, 21 bp, Homo sapiens
ttctgctcacattccctctca

SEQ ID NO: 2764072 - DNA, 15 bp, Homo sapiens
ttctggcagaggagg

SEQ ID NO: 2764073 - DNA, 22 bp, Homo sapiens
ttctggttgatgcctgtgaact

SEQ ID NO: 2764074 - DNA, 21 bp, Homo sapiens
ttctgtgcatttgtgtctgcc

SEQ ID NO: 2764075 - DNA, 22 bp, Homo sapiens
ttctgtgcatttgtgtctgcct

SEQ ID NO: 2764076 - DNA, 16 bp, Homo sapiens
ttgaaagtttacagga

SEQ ID NO: 2764077 - DNA, 19 bp, Homo sapiens
ttgaagaatgttaagactt

SEQ ID NO: 2764078 - DNA, 21 bp, Homo sapiens
ttgacctgcctcccttcatgc

SEQ ID NO: 2764079 - DNA, 22 bp, Homo sapiens
ttgacctgcctcccttcatgca

SEQ ID NO: 2764080 - DNA, 23 bp, Homo sapiens
ttgacctgcctcccttcatgcat

SEQ ID NO: 2764081 - DNA, 13 bp, Homo sapiens
ttgagagtgtgac

SEQ ID NO: 2764082 - DNA, 15 bp, Homo sapiens
ttgaggacaggagag

SEQ ID NO: 2764083 - DNA, 22 bp, Homo sapiens
ttgagggagctgggagaccctc

SEQ ID NO: 2764084 - DNA, 14 bp, Homo sapiens
ttgatgccagctgt

SEQ ID NO: 2764085 - DNA, 15 bp, Homo sapiens
ttgcacctttctagt

SEQ ID NO: 2764086 - DNA, 20 bp, Homo sapiens
ttgccctggagcctcagcag

SEQ ID NO: 2764087 - DNA, 22 bp, Homo sapiens
ttgccctggagcctcagcagca

SEQ ID NO: 2764088 - DNA, 14 bp, Homo sapiens
ttgcctgtaacaag

SEQ ID NO: 2764089 - DNA, 18 bp, Homo sapiens
ttgctgtctggctttccc

SEQ ID NO: 2764090 - DNA, 13 bp, Homo sapiens
ttgtaaattgtca

SEQ ID NO: 2764091 - DNA, 21 bp, Homo sapiens
ttgtgccagaatgctttagga

SEQ ID NO: 2764092 - DNA, 15 bp, Homo sapiens
tttaatgaacaaatg

SEQ ID NO: 2764093 - DNA, 13 bp, Homo sapiens
tttaggagcagtg

SEQ ID NO: 2764094 - DNA, 19 bp, Homo sapiens
tttatattgtaaatattgt

SEQ ID NO: 2764095 - DNA, 13 bp, Homo sapiens
tttattaaaaact

SEQ ID NO: 2764096 - DNA, 13 bp, Homo sapiens
tttatttgttgag

SEQ ID NO: 2764097 - DNA, 22 bp, Homo sapiens
tttcctgtgccaggactctctt

SEQ ID NO: 2764098 - DNA, 17 bp, Homo sapiens
tttctaggtaggaaatg

SEQ ID NO: 2764099 - DNA, 21 bp, Homo sapiens
tttctaggtaggaaatgtggt

SEQ ID NO: 2764100 - DNA, 20 bp, Homo sapiens
tttcttccactaccctccct

SEQ ID NO: 2764101 - DNA, 17 bp, Homo sapiens
tttgcacctttctagtt

SEQ ID NO: 2764102 - DNA, 18 bp, Homo sapiens
tttgccaccctcatgctg

SEQ ID NO: 2764103 - DNA, 20 bp, Homo sapiens
tttgccctggagcctcagca

SEQ ID NO: 2764104 - DNA, 16 bp, Homo sapiens
aggggacactgaacct

SEQ ID NO: 2764105 - DNA, 20 bp, Homo sapiens
agggggctattccctggaga

SEQ ID NO: 2764106 - DNA, 15 bp, Homo sapiens
agggtaccagcagaa

SEQ ID NO: 2764107 - DNA, 16 bp, Homo sapiens
agggtgtgagggatgg

SEQ ID NO: 2764108 - DNA, 19 bp, Homo sapiens
aggtcacctttattctggc

SEQ ID NO: 2764109 - DNA, 15 bp, Homo sapiens
aggttgaggacagga

SEQ ID NO: 2764110 - DNA, 15 bp, Homo sapiens
agtaaatacactgtg

SEQ ID NO: 2764111 - DNA, 16 bp, Homo sapiens
agtagggttgccagtc

SEQ ID NO: 2764112 - DNA, 17 bp, Homo sapiens
agtaggttgaggacagg

SEQ ID NO: 2764113 - DNA, 20 bp, Homo sapiens
agtcaagttccgtctcctct

SEQ ID NO: 2764114 - DNA, 15 bp, Homo sapiens
agtcagaacagcaga

SEQ ID NO: 2764115 - DNA, 15 bp, Homo sapiens
agtccactgcctcca

SEQ ID NO: 2764116 - DNA, 22 bp, Homo sapiens
agtccactgcctccatgatgca

SEQ ID NO: 2764117 - DNA, 18 bp, Homo sapiens
agtccatagctgagctgg

SEQ ID NO: 2764118 - DNA, 19 bp, Homo sapiens
agtccatagctgagctgga

SEQ ID NO: 2764119 - DNA, 14 bp, Homo sapiens
agtccgtcaaaaca

SEQ ID NO: 2764120 - DNA, 15 bp, Homo sapiens
agtccgtcaaaacag

SEQ ID NO: 2764121 - DNA, 22 bp, Homo sapiens
agtctatcaaccccagacactg

SEQ ID NO: 2764122 - DNA, 23 bp, Homo sapiens
agtctatcaaccccagacactgg

SEQ ID NO: 2764123 - DNA, 12 bp, Homo sapiens
agtctcactgtc

SEQ ID NO: 2764124 - DNA, 12 bp, Homo sapiens
agtctcttcctg

SEQ ID NO: 2764125 - DNA, 21 bp, Homo sapiens
agtctcttcctgcctcccaag

SEQ ID NO: 2764126 - DNA, 14 bp, Homo sapiens
agtgaatttgcctg

SEQ ID NO: 2764127 - DNA, 11 bp, Homo sapiens
agtgacagcta

SEQ ID NO: 2764128 - DNA, 17 bp, Homo sapiens
agtgacctcagctttga

SEQ ID NO: 2764129 - DNA, 22 bp, Homo sapiens
agtgagagacattaactcatta

SEQ ID NO: 2764130 - DNA, 23 bp, Homo sapiens
agtgatttgggggtgcaatgata

SEQ ID NO: 2764131 - DNA, 22 bp, Homo sapiens
agtgccacccatgcagctgctc

SEQ ID NO: 2764132 - DNA, 16 bp, Homo sapiens
agtgccctccaggata

SEQ ID NO: 2764133 - DNA, 20 bp, Homo sapiens
agtggggaggggcctggcct

SEQ ID NO: 2764134 - DNA, 22 bp, Homo sapiens
agtgtccttggcaggctgattt

SEQ ID NO: 2764135 - DNA, 17 bp, Homo sapiens
agtgtgaccaaaagtta

SEQ ID NO: 2764136 - DNA, 19 bp, Homo sapiens
agtgtgaccaaaagttaca

SEQ ID NO: 2764137 - DNA, 14 bp, Homo sapiens
agttaagcctttgg

SEQ ID NO: 2764138 - DNA, 19 bp, Homo sapiens
agttccgtctcctctccag

SEQ ID NO: 2764139 - DNA, 22 bp, Homo sapiens
agttccgtctcctctccagccc

SEQ ID NO: 2764140 - DNA, 12 bp, Homo sapiens
agttctcatcca

SEQ ID NO: 2764141 - DNA, 20 bp, Homo sapiens
agttgctcctacccctgtcc

SEQ ID NO: 2764142 - DNA, 13 bp, Homo sapiens
ataaagctgtgag

SEQ ID NO: 2764143 - DNA, 18 bp, Homo sapiens
ataaatgggtaacactga

SEQ ID NO: 2764144 - DNA, 18 bp, Homo sapiens
atacagccttacaataca

SEQ ID NO: 2764145 - DNA, 18 bp, Homo sapiens
atactcttatagacaaca

SEQ ID NO: 2764146 - DNA, 13 bp, Homo sapiens
atagcaagagatg

SEQ ID NO: 2764147 - DNA, 13 bp, Homo sapiens
atagctgagctgg

SEQ ID NO: 2764148 - DNA, 14 bp, Homo sapiens
atagctgagctgga

SEQ ID NO: 2764149 - DNA, 18 bp, Homo sapiens
ataggtagaatgtaaagc

SEQ ID NO: 2764150 - DNA, 18 bp, Homo sapiens
atagtatgcagctaaaaa

SEQ ID NO: 2764151 - DNA, 16 bp, Homo sapiens
atatatatatatatgt

SEQ ID NO: 2764152 - DNA, 14 bp, Homo sapiens
atatatatatatgt

SEQ ID NO: 2764153 - DNA, 15 bp, Homo sapiens
atatatatatgtaca

SEQ ID NO: 2764154 - DNA, 15 bp, Homo sapiens
atatatatgtacagt

SEQ ID NO: 2764155 - DNA, 13 bp, Homo sapiens
atatatgtacagt

SEQ ID NO: 2764156 - DNA, 22 bp, Homo sapiens
atatgactgtttttcggacagt

SEQ ID NO: 2764157 - DNA, 16 bp, Homo sapiens
atatgtacagttatct

SEQ ID NO: 2764158 - DNA, 18 bp, Homo sapiens
atcaaccccagacactgg

SEQ ID NO: 2764159 - DNA, 19 bp, Homo sapiens
atcactgctgtccctcctg

SEQ ID NO: 2764160 - DNA, 21 bp, Homo sapiens
atcagttttttcacctggaag

SEQ ID NO: 2764161 - DNA, 20 bp, Homo sapiens
atccctgtgtgtcgttccct

SEQ ID NO: 2764162 - DNA, 16 bp, Homo sapiens
atccgcctctgagcca

SEQ ID NO: 2764163 - DNA, 19 bp, Homo sapiens
atccgcctctgagccagga

SEQ ID NO: 2764164 - DNA, 22 bp, Homo sapiens
atcctgaggggatatccctatg

SEQ ID NO: 2764165 - DNA, 16 bp, Homo sapiens
atccttgagtcaaaaa

SEQ ID NO: 2764166 - DNA, 16 bp, Homo sapiens
atctaagttaatttaa

SEQ ID NO: 2764167 - DNA, 14 bp, Homo sapiens
atctcaattcttcc

SEQ ID NO: 2764168 - DNA, 21 bp, Homo sapiens
atctcatttttccgtaaaaat

SEQ ID NO: 2764169 - DNA, 17 bp, Homo sapiens
atctgaagctagaggaa

SEQ ID NO: 2764170 - DNA, 12 bp, Homo sapiens
atgaacaaatgg

SEQ ID NO: 2764171 - DNA, 19 bp, Homo sapiens
atgacagtccgtcaaaaca

SEQ ID NO: 2764172 - DNA, 15 bp, Homo sapiens
atgaccacactccag

SEQ ID NO: 2764173 - DNA, 18 bp, Homo sapiens
atgaccacactccagctg

SEQ ID NO: 2764174 - DNA, 22 bp, Homo sapiens
atgactgtttttcggacagttt

SEQ ID NO: 2764175 - DNA, 15 bp, Homo sapiens
atgagctgggccctg

SEQ ID NO: 2764176 - DNA, 18 bp, Homo sapiens
atgagctgggccctgggt

SEQ ID NO: 2764177 - DNA, 20 bp, Homo sapiens
atgatgcaagccagcttcct

SEQ ID NO: 2764178 - DNA, 13 bp, Homo sapiens
atgcaagccagct

SEQ ID NO: 2764179 - DNA, 22 bp, Homo sapiens
atgcaagccagcttcctgtgca

SEQ ID NO: 2764180 - DNA, 16 bp, Homo sapiens
atgcatggaaattccc

SEQ ID NO: 2764181 - DNA, 17 bp, Homo sapiens
atgccactctgggcagt

SEQ ID NO: 2764182 - DNA, 21 bp, Homo sapiens
atgcctgacacaggggacact

SEQ ID NO: 2764183 - DNA, 14 bp, Homo sapiens
atgcttctgctcac

SEQ ID NO: 2764184 - DNA, 17 bp, Homo sapiens
atgcttctgctcacatt

SEQ ID NO: 2764185 - DNA, 21 bp, Homo sapiens
atgctttaggatgtacagtta

SEQ ID NO: 2764186 - DNA, 13 bp, Homo sapiens
atgctttcctgtt

SEQ ID NO: 2764187 - DNA, 20 bp, Homo sapiens
atggaaattcccttcatctg

SEQ ID NO: 2764188 - DNA, 13 bp, Homo sapiens
atggagccccacc

SEQ ID NO: 2764189 - DNA, 14 bp, Homo sapiens
atggagccccacct

SEQ ID NO: 2764190 - DNA, 19 bp, Homo sapiens
atggcccagcctggagccg

SEQ ID NO: 2764191 - DNA, 22 bp, Homo sapiens
atgggttagggaaaacattcca

SEQ ID NO: 2764192 - DNA, 13 bp, Homo sapiens
atgtcaaacaaat

SEQ ID NO: 2764193 - DNA, 18 bp, Homo sapiens
atgttaagacttgacagt

SEQ ID NO: 2764194 - DNA, 22 bp, Homo sapiens
atgtttgcacctttctagttga

SEQ ID NO: 2764195 - DNA, 17 bp, Homo sapiens
attaactcattagactg

SEQ ID NO: 2764196 - DNA, 15 bp, Homo sapiens
attagactggaactt

SEQ ID NO: 2764197 - DNA, 20 bp, Homo sapiens
attagactggacagcttgtg

SEQ ID NO: 2764198 - DNA, 19 bp, Homo sapiens
attagtacacagcaccaga

SEQ ID NO: 2764199 - DNA, 11 bp, Homo sapiens
attcaaaacat

SEQ ID NO: 2764200 - DNA, 15 bp, Homo sapiens
attcacatctcattt

SEQ ID NO: 2764201 - DNA, 16 bp, Homo sapiens
attccaacacctgcca

SEQ ID NO: 2764202 - DNA, 22 bp, Homo sapiens
attcccatcactgctgtccctc

SEQ ID NO: 2764203 - DNA, 16 bp, Homo sapiens
attcccttcatctgga

SEQ ID NO: 2764204 - DNA, 23 bp, Homo sapiens
ctctaaaagggggctattccctg

SEQ ID NO: 2764205 - DNA, 18 bp, Homo sapiens
ctctcacctacttcctcc

SEQ ID NO: 2764206 - DNA, 13 bp, Homo sapiens
ctctccagcccta

SEQ ID NO: 2764207 - DNA, 14 bp, Homo sapiens
ctctccagccctat

SEQ ID NO: 2764208 - DNA, 16 bp, Homo sapiens
ctctctttcttccact

SEQ ID NO: 2764209 - DNA, 12 bp, Homo sapiens
ctctgagccagg

SEQ ID NO: 2764210 - DNA, 20 bp, Homo sapiens
ctctgagccaggagcctcct

SEQ ID NO: 2764211 - DNA, 20 bp, Homo sapiens
ctcttcagttaagcctttgg

SEQ ID NO: 2764212 - DNA, 10 bp, Homo sapiens
ctctttcctg

SEQ ID NO: 2764213 - DNA, 20 bp, Homo sapiens
ctgaaccttgttgatgccag

SEQ ID NO: 2764214 - DNA, 15 bp, Homo sapiens
ctgacaacagacttc

SEQ ID NO: 2764215 - DNA, 14 bp, Homo sapiens
ctgacacaggggac

SEQ ID NO: 2764216 - DNA, 21 bp, Homo sapiens
ctgaccctgtgatgcctgaca

SEQ ID NO: 2764217 - DNA, 19 bp, Homo sapiens
ctgagccaggagcctcctg

SEQ ID NO: 2764218 - DNA, 22 bp, Homo sapiens
ctgagccaggagcctcctgacc

SEQ ID NO: 2764219 - DNA, 16 bp, Homo sapiens
ctgagtcaagttgttc

SEQ ID NO: 2764220 - DNA, 16 bp, Homo sapiens
ctgagtgccttttggt

SEQ ID NO: 2764221 - DNA, 16 bp, Homo sapiens
ctgatggagccccacc

SEQ ID NO: 2764222 - DNA, 12 bp, Homo sapiens
ctgatttctagg

SEQ ID NO: 2764223 - DNA, 14 bp, Homo sapiens
ctgcaacagcctgt

SEQ ID NO: 2764224 - DNA, 23 bp, Homo sapiens
ctgcaagtccatagctgagctgg

SEQ ID NO: 2764225 - DNA, 20 bp, Homo sapiens
ctgcacacgctccttcctct

SEQ ID NO: 2764226 - DNA, 18 bp, Homo sapiens
ctgcagaaaaagaatgtg

SEQ ID NO: 2764227 - DNA, 16 bp, Homo sapiens
ctgcctcccaagcagc

SEQ ID NO: 2764228 - DNA, 19 bp, Homo sapiens
ctgcctcccaagcagctga

SEQ ID NO: 2764229 - DNA, 22 bp, Homo sapiens
ctgcctcccaagcagctgaagg

SEQ ID NO: 2764230 - DNA, 15 bp, Homo sapiens
ctgcctcccttcatg

SEQ ID NO: 2764231 - DNA, 19 bp, Homo sapiens
ctgcctcccttcatgcatg

SEQ ID NO: 2764232 - DNA, 14 bp, Homo sapiens
ctgccttctcttct

SEQ ID NO: 2764233 - DNA, 13 bp, Homo sapiens
ctgctaaataaac

SEQ ID NO: 2764234 - DNA, 15 bp, Homo sapiens
ctgctaaataaacat

SEQ ID NO: 2764235 - DNA, 15 bp, Homo sapiens
ctgctccatgagggt

SEQ ID NO: 2764236 - DNA, 20 bp, Homo sapiens
ctgctctgatgaagaggagt

SEQ ID NO: 2764237 - DNA, 16 bp, Homo sapiens
ctgctgtccctcctga

SEQ ID NO: 2764238 - DNA, 18 bp, Homo sapiens
ctgctgtccctcctgagg

SEQ ID NO: 2764239 - DNA, 23 bp, Homo sapiens
ctgcttctgtgcatttgtgtctg

SEQ ID NO: 2764240 - DNA, 21 bp, Homo sapiens
ctggaaaggatgcttctgctc

SEQ ID NO: 2764241 - DNA, 16 bp, Homo sapiens
ctggaaccatcagaaa

SEQ ID NO: 2764242 - DNA, 19 bp, Homo sapiens
ctggaacttgaactgattc

SEQ ID NO: 2764243 - DNA, 12 bp, Homo sapiens
ctggacagcttg

SEQ ID NO: 2764244 - DNA, 18 bp, Homo sapiens
ctggagtctcactgtctg

SEQ ID NO: 2764245 - DNA, 14 bp, Homo sapiens
ctggcagaggaggg

SEQ ID NO: 2764246 - DNA, 20 bp, Homo sapiens
ctgggaactgggccagcaga

SEQ ID NO: 2764247 - DNA, 18 bp, Homo sapiens
ctgggacttgcaaaaagg

SEQ ID NO: 2764248 - DNA, 20 bp, Homo sapiens
ctgggatcacatgtggactt

SEQ ID NO: 2764249 - DNA, 23 bp, Homo sapiens
ctgggatggggcatgtggccaag

SEQ ID NO: 2764250 - DNA, 16 bp, Homo sapiens
ctgggccctgggtgag

SEQ ID NO: 2764251 - DNA, 17 bp, Homo sapiens
ctgggccggcagcctgg

SEQ ID NO: 2764252 - DNA, 19 bp, Homo sapiens
ctggtactcccccagccct

SEQ ID NO: 2764253 - DNA, 17 bp, Homo sapiens
ctggtcccacttcacag

SEQ ID NO: 2764254 - DNA, 19 bp, Homo sapiens
ctggtcccacttcacagct

SEQ ID NO: 2764255 - DNA, 23 bp, Homo sapiens
ctggtcccacttcacagctggag

SEQ ID NO: 2764256 - DNA, 23 bp, Homo sapiens
ctggttaatatttataggtcact

SEQ ID NO: 2764257 - DNA, 13 bp, Homo sapiens
ctggttccctctt

SEQ ID NO: 2764258 - DNA, 18 bp, Homo sapiens
ctggttccctctttcctg

SEQ ID NO: 2764259 - DNA, 20 bp, Homo sapiens
ctggttccctctttcctgtg

SEQ ID NO: 2764260 - DNA, 22 bp, Homo sapiens
ctggttccctctttcctgtgcc

SEQ ID NO: 2764261 - DNA, 13 bp, Homo sapiens
ctggttcctcccc

SEQ ID NO: 2764262 - DNA, 20 bp, Homo sapiens
ctgtactgagttctcatcca

SEQ ID NO: 2764263 - DNA, 18 bp, Homo sapiens
ctgtagccccagtgacag

SEQ ID NO: 2764264 - DNA, 15 bp, Homo sapiens
ctgtccctcctgagg

SEQ ID NO: 2764265 - DNA, 16 bp, Homo sapiens
ctgtgaactgaactct

SEQ ID NO: 2764266 - DNA, 13 bp, Homo sapiens
ctgtgagcaaaca

SEQ ID NO: 2764267 - DNA, 13 bp, Homo sapiens
ctgtgcagaaggt

SEQ ID NO: 2764268 - DNA, 14 bp, Homo sapiens
ctgtggccctggca

SEQ ID NO: 2764269 - DNA, 11 bp, Homo sapiens
ctgttcctgcc

SEQ ID NO: 2764270 - DNA, 19 bp, Homo sapiens
cttaaaggggcctgcgcag

SEQ ID NO: 2764271 - DNA, 20 bp, Homo sapiens
cttaaaggggcctgcgcagg

SEQ ID NO: 2764272 - DNA, 16 bp, Homo sapiens
cttaagtttatactct

SEQ ID NO: 2764273 - DNA, 14 bp, Homo sapiens
cttcacagctggag

SEQ ID NO: 2764274 - DNA, 17 bp, Homo sapiens
cttcagttaagcctttg

SEQ ID NO: 2764275 - DNA, 12 bp, Homo sapiens
cttcatctggaa

SEQ ID NO: 2764276 - DNA, 23 bp, Homo sapiens
cttcatgcatggaaattcccttc

SEQ ID NO: 2764277 - DNA, 17 bp, Homo sapiens
cttccctatctttgcca

SEQ ID NO: 2764278 - DNA, 22 bp, Homo sapiens
cttcctctgaggctgaaattca

SEQ ID NO: 2764279 - DNA, 14 bp, Homo sapiens
cttccttctcagca

SEQ ID NO: 2764280 - DNA, 15 bp, Homo sapiens
cttccttctcagcac

SEQ ID NO: 2764281 - DNA, 16 bp, Homo sapiens
cttccttctcagcact

SEQ ID NO: 2764282 - DNA, 21 bp, Homo sapiens
cttctatcctgcaatttctcc

SEQ ID NO: 2764283 - DNA, 15 bp, Homo sapiens
cttctcctctgctag

SEQ ID NO: 2764284 - DNA, 15 bp, Homo sapiens
cttctcgtcttcctc

SEQ ID NO: 2764285 - DNA, 15 bp, Homo sapiens
cttctcttctatcct

SEQ ID NO: 2764286 - DNA, 21 bp, Homo sapiens
cttctgctcacattccctctc

SEQ ID NO: 2764287 - DNA, 22 bp, Homo sapiens
cttctgctcacattccctctca

SEQ ID NO: 2764288 - DNA, 20 bp, Homo sapiens
cttgacagtggaactacatt

SEQ ID NO: 2764289 - DNA, 17 bp, Homo sapiens
cttgcgagctgttgtag

SEQ ID NO: 2764290 - DNA, 12 bp, Homo sapiens
cttgtgtctgtt

SEQ ID NO: 2764291 - DNA, 14 bp, Homo sapiens
cttgttttctggga

SEQ ID NO: 2764292 - DNA, 15 bp, Homo sapiens
ctttaggagcagtgg

SEQ ID NO: 2764293 - DNA, 15 bp, Homo sapiens
ctttatacacagtgg

SEQ ID NO: 2764294 - DNA, 14 bp, Homo sapiens
ctttattaaaaact

SEQ ID NO: 2764295 - DNA, 20 bp, Homo sapiens
ctttccccatgtctcgactc

SEQ ID NO: 2764296 - DNA, 21 bp, Homo sapiens
ctttccccatgtctcgactca

SEQ ID NO: 2764297 - DNA, 16 bp, Homo sapiens
ctttctagttgaaaat

SEQ ID NO: 2764298 - DNA, 14 bp, Homo sapiens
ctttgacctgcctc

SEQ ID NO: 2764299 - DNA, 18 bp, Homo sapiens
ctttgacctgcctccctt

SEQ ID NO: 2764300 - DNA, 21 bp, Homo sapiens
ctttgccaccctcatgctgtg

SEQ ID NO: 2764301 - DNA, 16 bp, Homo sapiens
cttttaatgaacaaat

SEQ ID NO: 2764302 - DNA, 18 bp, Homo sapiens
cttttaatgaacaaatgg

SEQ ID NO: 2764303 - DNA, 23 bp, Homo sapiens
ctttttaggccacctccaaggac

SEQ ID NO: 2764304 - DNA, 16 bp, Homo sapiens
gtcagaacagcagact

SEQ ID NO: 2764305 - DNA, 19 bp, Homo sapiens
gtcagaacagcagactcag

SEQ ID NO: 2764306 - DNA, 18 bp, Homo sapiens
gtcccacttcacagctgg

SEQ ID NO: 2764307 - DNA, 15 bp, Homo sapiens
gtcctcttgccagct

SEQ ID NO: 2764308 - DNA, 21 bp, Homo sapiens
gtcctgcaagtccatagctga

SEQ ID NO: 2764309 - DNA, 15 bp, Homo sapiens
gtcctggggctgggt

SEQ ID NO: 2764310 - DNA, 22 bp, Homo sapiens
gtctatcaaccccagacactgg

SEQ ID NO: 2764311 - DNA, 20 bp, Homo sapiens
gtctcactgtctgctggcaa

SEQ ID NO: 2764312 - DNA, 18 bp, Homo sapiens
gtctcctctccagcccta

SEQ ID NO: 2764313 - DNA, 20 bp, Homo sapiens
gtctgcctgcctcatgctct

SEQ ID NO: 2764314 - DNA, 21 bp, Homo sapiens
gtcttaaaggggcctgcgcag

SEQ ID NO: 2764315 - DNA, 17 bp, Homo sapiens
gtcttcctctctctcac

SEQ ID NO: 2764316 - DNA, 19 bp, Homo sapiens
gtgagcaaacagaggaggc

SEQ ID NO: 2764317 - DNA, 15 bp, Homo sapiens
gtgagcaggctgtga

SEQ ID NO: 2764318 - DNA, 22 bp, Homo sapiens
gtgcagaaggtctggtcggcaa

SEQ ID NO: 2764319 - DNA, 17 bp, Homo sapiens
gtgggaagggctacacc

SEQ ID NO: 2764320 - DNA, 20 bp, Homo sapiens
gtgggagggtaccagcagaa

SEQ ID NO: 2764321 - DNA, 21 bp, Homo sapiens
gtgtcttaaaggggcctgcgc

SEQ ID NO: 2764322 - DNA, 15 bp, Homo sapiens
gtgtgtttcaggaca

SEQ ID NO: 2764323 - DNA, 13 bp, Homo sapiens
gtgtttaagacat

SEQ ID NO: 2764324 - DNA, 19 bp, Homo sapiens
gtgtttcaggacagctgct

SEQ ID NO: 2764325 - DNA, 18 bp, Homo sapiens
gttaactgagtgcctttt

SEQ ID NO: 2764326 - DNA, 16 bp, Homo sapiens
gttaagacttgacagt

SEQ ID NO: 2764327 - DNA, 17 bp, Homo sapiens
gttaagacttgacagtg

SEQ ID NO: 2764328 - DNA, 12 bp, Homo sapiens
gttaagcctttg

SEQ ID NO: 2764329 - DNA, 16 bp, Homo sapiens
gttaagcctttggaaa

SEQ ID NO: 2764330 - DNA, 14 bp, Homo sapiens
gttacatgtttgca

SEQ ID NO: 2764331 - DNA, 11 bp, Homo sapiens
gttatttaaat

SEQ ID NO: 2764332 - DNA, 15 bp, Homo sapiens
gttccccaagacatt

SEQ ID NO: 2764333 - DNA, 15 bp, Homo sapiens
gttccctctttcctg

SEQ ID NO: 2764334 - DNA, 20 bp, Homo sapiens
gttccctctttcctgtgcca

SEQ ID NO: 2764335 - DNA, 12 bp, Homo sapiens
gttcccttgtgt

SEQ ID NO: 2764336 - DNA, 14 bp, Homo sapiens
gttccgtctcctct

SEQ ID NO: 2764337 - DNA, 22 bp, Homo sapiens
gttccgtctcctctccagccct

SEQ ID NO: 2764338 - DNA, 11 bp, Homo sapiens
gttcctgcctt

SEQ ID NO: 2764339 - DNA, 13 bp, Homo sapiens
gttcctgccttct

SEQ ID NO: 2764340 - DNA, 15 bp, Homo sapiens
gttcctgccttctct

SEQ ID NO: 2764341 - DNA, 16 bp, Homo sapiens
gttctcatccacagag

SEQ ID NO: 2764342 - DNA, 22 bp, Homo sapiens
gttgaaaataaagtgtatattt

SEQ ID NO: 2764343 - DNA, 15 bp, Homo sapiens
gttgagagtgtgacc

SEQ ID NO: 2764344 - DNA, 20 bp, Homo sapiens
gtttaagacatttttggaag

SEQ ID NO: 2764345 - DNA, 16 bp, Homo sapiens
gtttcaggacagctgc

SEQ ID NO: 2764346 - DNA, 17 bp, Homo sapiens
gtttgcacctttctagt

SEQ ID NO: 2764347 - DNA, 20 bp, Homo sapiens
gtttgggccccagaggctgg

SEQ ID NO: 2764348 - DNA, 23 bp, Homo sapiens
gtttttgccctggagcctcagca

SEQ ID NO: 2764349 - DNA, 22 bp, Homo sapiens
taaaaagctccaaatgcagctt

SEQ ID NO: 2764350 - DNA, 16 bp, Homo sapiens
taaaaatgatttcagt

SEQ ID NO: 2764351 - DNA, 23 bp, Homo sapiens
taaaagggggctattccctggag

SEQ ID NO: 2764352 - DNA, 11 bp, Homo sapiens
taaagcttgtc

SEQ ID NO: 2764353 - DNA, 17 bp, Homo sapiens
taaaggggcctgcgcag

SEQ ID NO: 2764354 - DNA, 14 bp, Homo sapiens
taaatacactgtga

SEQ ID NO: 2764355 - DNA, 16 bp, Homo sapiens
taaatacactgtgaag

SEQ ID NO: 2764356 - DNA, 14 bp, Homo sapiens
taagcctttggaaa

SEQ ID NO: 2764357 - DNA, 21 bp, Homo sapiens
taagcctttggaaacagctcg

SEQ ID NO: 2764358 - DNA, 13 bp, Homo sapiens
taagtcagaacag

SEQ ID NO: 2764359 - DNA, 17 bp, Homo sapiens
tacagtaaatacactgt

SEQ ID NO: 2764360 - DNA, 18 bp, Homo sapiens
tacagtaaatacactgtg

SEQ ID NO: 2764361 - DNA, 13 bp, Homo sapiens
tacccctgtcctg

SEQ ID NO: 2764362 - DNA, 17 bp, Homo sapiens
tagaatgtaaagcttgt

SEQ ID NO: 2764363 - DNA, 18 bp, Homo sapiens
tagactggacagcttgtg

SEQ ID NO: 2764364 - DNA, 17 bp, Homo sapiens
tagagaatgccctcagc

SEQ ID NO: 2764365 - DNA, 19 bp, Homo sapiens
tagcacaagttatttaaat

SEQ ID NO: 2764366 - DNA, 18 bp, Homo sapiens
tagcctcacttttaatga

SEQ ID NO: 2764367 - DNA, 23 bp, Homo sapiens
tagcctcacttttaatgaacaaa

SEQ ID NO: 2764368 - DNA, 17 bp, Homo sapiens
tagcgtgctcactgacc

SEQ ID NO: 2764369 - DNA, 15 bp, Homo sapiens
tagggaccaacggga

SEQ ID NO: 2764370 - DNA, 21 bp, Homo sapiens
tagggaccaacgggagcgagt

SEQ ID NO: 2764371 - DNA, 15 bp, Homo sapiens
tagggcatggcttgc

SEQ ID NO: 2764372 - DNA, 14 bp, Homo sapiens
taggtaggaaatgt

SEQ ID NO: 2764373 - DNA, 18 bp, Homo sapiens
taggttgaggacaggaga

SEQ ID NO: 2764374 - DNA, 18 bp, Homo sapiens
tagtatcatcagatagca

SEQ ID NO: 2764375 - DNA, 21 bp, Homo sapiens
tagttacagtaaatacactgt

SEQ ID NO: 2764376 - DNA, 14 bp, Homo sapiens
tatacaaagtgtac

SEQ ID NO: 2764377 - DNA, 15 bp, Homo sapiens
tatatatatatgtac

SEQ ID NO: 2764378 - DNA, 14 bp, Homo sapiens
tatatatgtacagt

SEQ ID NO: 2764379 - DNA, 12 bp, Homo sapiens
tatatgtacagt

SEQ ID NO: 2764380 - DNA, 19 bp, Homo sapiens
tatcaaccccagacactgg

SEQ ID NO: 2764381 - DNA, 21 bp, Homo sapiens
tatcaggagtccactgcctcc

SEQ ID NO: 2764382 - DNA, 20 bp, Homo sapiens
tatctaagttaatttaaagt

SEQ ID NO: 2764383 - DNA, 22 bp, Homo sapiens
tatctaagttaatttaaagttg

SEQ ID NO: 2764384 - DNA, 14 bp, Homo sapiens
tatctttgccaccc

SEQ ID NO: 2764385 - DNA, 18 bp, Homo sapiens
tatgcctgctatttgaag

SEQ ID NO: 2764386 - DNA, 12 bp, Homo sapiens
tatgtacagtta

SEQ ID NO: 2764387 - DNA, 14 bp, Homo sapiens
tatgtcccagcccc

SEQ ID NO: 2764388 - DNA, 16 bp, Homo sapiens
tattaaggtgtggctt

SEQ ID NO: 2764389 - DNA, 21 bp, Homo sapiens
tattagtgacctcagctttga

SEQ ID NO: 2764390 - DNA, 22 bp, Homo sapiens
tattcctttatacacagtggat

SEQ ID NO: 2764391 - DNA, 23 bp, Homo sapiens
tattgggagtaggagttgctcct

SEQ ID NO: 2764392 - DNA, 15 bp, Homo sapiens
tattgtaaatattgt

SEQ ID NO: 2764393 - DNA, 19 bp, Homo sapiens
tatttatgcactgtgggat

SEQ ID NO: 2764394 - DNA, 16 bp, Homo sapiens
tatttcaatgttagcc

SEQ ID NO: 2764395 - DNA, 16 bp, Homo sapiens
tcaaccccagacactg

SEQ ID NO: 2764396 - DNA, 18 bp, Homo sapiens
tcaaccccagacactggt

SEQ ID NO: 2764397 - DNA, 18 bp, Homo sapiens
tcaagttccgtctcctct

SEQ ID NO: 2764398 - DNA, 15 bp, Homo sapiens
tcacattcaggcatg

SEQ ID NO: 2764399 - DNA, 14 bp, Homo sapiens
tcacattccctctc

SEQ ID NO: 2764400 - DNA, 19 bp, Homo sapiens
tcacctacttcctcctcct

SEQ ID NO: 2764401 - DNA, 16 bp, Homo sapiens
tcactaggcttctggt

SEQ ID NO: 2764402 - DNA, 21 bp, Homo sapiens
tcacttgtcctcttgccagct

SEQ ID NO: 2764403 - DNA, 22 bp, Homo sapiens
tcagaaacaccctcacactggg

SEQ ID NO: 2764404 - DNA, 13 bp, Homo sapiens
aaaaatttacttt

SEQ ID NO: 2764405 - DNA, 22 bp, Homo sapiens
aaaaggggtagggtttaaagat

SEQ ID NO: 2764406 - DNA, 19 bp, Homo sapiens
aaaataattaggtattttc

SEQ ID NO: 2764407 - DNA, 16 bp, Homo sapiens
aaacatgctgtacata

SEQ ID NO: 2764408 - DNA, 18 bp, Homo sapiens
aaacatgctgtacatact

SEQ ID NO: 2764409 - DNA, 22 bp, Homo sapiens
aaacatgctgtacatacttttt

SEQ ID NO: 2764410 - DNA, 15 bp, Homo sapiens
aaacatttcatttcc

SEQ ID NO: 2764411 - DNA, 20 bp, Homo sapiens
aaactacattaggttgtgaa

SEQ ID NO: 2764412 - DNA, 21 bp, Homo sapiens
aaactacattaggttgtgaat

SEQ ID NO: 2764413 - DNA, 18 bp, Homo sapiens
aaactacattgacagatt

SEQ ID NO: 2764414 - DNA, 19 bp, Homo sapiens
aaagatgaaggtctgtttt

SEQ ID NO: 2764415 - DNA, 13 bp, Homo sapiens
aaagcttttgcat

SEQ ID NO: 2764416 - DNA, 17 bp, Homo sapiens
aaagcttttgcatattg

SEQ ID NO: 2764417 - DNA, 16 bp, Homo sapiens
aaaggtactttgcagg

SEQ ID NO: 2764418 - DNA, 22 bp, Homo sapiens
aaatatcccttggacattttat

SEQ ID NO: 2764419 - DNA, 17 bp, Homo sapiens
aaatggtgttttatctt

SEQ ID NO: 2764420 - DNA, 15 bp, Homo sapiens
aacaaaggatactta

SEQ ID NO: 2764421 - DNA, 12 bp, Homo sapiens
aacacaaagctt

SEQ ID NO: 2764422 - DNA, 18 bp, Homo sapiens
aacacaaagcttttgcat

SEQ ID NO: 2764423 - DNA, 19 bp, Homo sapiens
aacacaaagcttttgcata

SEQ ID NO: 2764424 - DNA, 20 bp, Homo sapiens
aacacattaaaggtactttg

SEQ ID NO: 2764425 - DNA, 16 bp, Homo sapiens
aacactggttttaaat

SEQ ID NO: 2764426 - DNA, 18 bp, Homo sapiens
aacactggttttaaatat

SEQ ID NO: 2764427 - DNA, 22 bp, Homo sapiens
aacagcaacacaaagcttttgc

SEQ ID NO: 2764428 - DNA, 19 bp, Homo sapiens
aacatgctgtacatacttt

SEQ ID NO: 2764429 - DNA, 15 bp, Homo sapiens
aactaaaatgttcta

SEQ ID NO: 2764430 - DNA, 22 bp, Homo sapiens
aactaacaggcttagtgatgta

SEQ ID NO: 2764431 - DNA, 20 bp, Homo sapiens
aactcacctggcatcttaca

SEQ ID NO: 2764432 - DNA, 12 bp, Homo sapiens
aactcatttcta

SEQ ID NO: 2764433 - DNA, 20 bp, Homo sapiens
aactctgagtgcaaacttca

SEQ ID NO: 2764434 - DNA, 13 bp, Homo sapiens
aactctgtaattc

SEQ ID NO: 2764435 - DNA, 15 bp, Homo sapiens
aactgaacttcagag

SEQ ID NO: 2764436 - DNA, 23 bp, Homo sapiens
aactgacacatgctgaacatcac

SEQ ID NO: 2764437 - DNA, 13 bp, Homo sapiens
aactgtttagatg

SEQ ID NO: 2764438 - DNA, 19 bp, Homo sapiens
aacttatggggccaaaata

SEQ ID NO: 2764439 - DNA, 16 bp, Homo sapiens
aactttttatattctc

SEQ ID NO: 2764440 - DNA, 22 bp, Homo sapiens
aagacagagccccaccctcaga

SEQ ID NO: 2764441 - DNA, 13 bp, Homo sapiens
actgacacatgct

SEQ ID NO: 2764442 - DNA, 19 bp, Homo sapiens
actggaacactctataaca

SEQ ID NO: 2764443 - DNA, 11 bp, Homo sapiens
actttaaacta

SEQ ID NO: 2764444 - DNA, 16 bp, Homo sapiens
actttatttctctcat

SEQ ID NO: 2764445 - DNA, 16 bp, Homo sapiens
agaagtcaaggcttag

SEQ ID NO: 2764446 - DNA, 19 bp, Homo sapiens
agaagtcaaggcttagacc

SEQ ID NO: 2764447 - DNA, 18 bp, Homo sapiens
agaagtcttctatttatt

SEQ ID NO: 2764448 - DNA, 21 bp, Homo sapiens
agaagtcttctatttatttat

SEQ ID NO: 2764449 - DNA, 12 bp, Homo sapiens
agaatgttttca

SEQ ID NO: 2764450 - DNA, 16 bp, Homo sapiens
agaattgattgggcac

SEQ ID NO: 2764451 - DNA, 24 bp, Homo sapiens
agaattgattgggcacatcatttc

SEQ ID NO: 2764452 - DNA, 17 bp, Homo sapiens
agaccctcatgctgcca

SEQ ID NO: 2764453 - DNA, 20 bp, Homo sapiens
agaccctcatgctgccaata

SEQ ID NO: 2764454 - DNA, 21 bp, Homo sapiens
agaccctcatgctgccaatat

SEQ ID NO: 2764455 - DNA, 21 bp, Homo sapiens
agacgtgcacgcacactgtct

SEQ ID NO: 2764456 - DNA, 22 bp, Homo sapiens
agacgtgcacgcacactgtctg

SEQ ID NO: 2764457 - DNA, 16 bp, Homo sapiens
agactggatagtccgt

SEQ ID NO: 2764458 - DNA, 17 bp, Homo sapiens
agactttggttatttta

SEQ ID NO: 2764459 - DNA, 23 bp, Homo sapiens
agactttggttattttacttttt

SEQ ID NO: 2764460 - DNA, 23 bp, Homo sapiens
agagcagtttggtttctagcatg

SEQ ID NO: 2764461 - DNA, 11 bp, Homo sapiens
agatgaatgtc

SEQ ID NO: 2764462 - DNA, 18 bp, Homo sapiens
agatgacattgactattt

SEQ ID NO: 2764463 - DNA, 16 bp, Homo sapiens
agatgcacatgagctg

SEQ ID NO: 2764464 - DNA, 12 bp, Homo sapiens
agatgttgctaa

SEQ ID NO: 2764465 - DNA, 21 bp, Homo sapiens
agcaacacaaagcttttgcat

SEQ ID NO: 2764466 - DNA, 13 bp, Homo sapiens
agcagagtgcttt

SEQ ID NO: 2764467 - DNA, 20 bp, Homo sapiens
agcagccctcaattgtgaaa

SEQ ID NO: 2764468 - DNA, 12 bp, Homo sapiens
agcatgaagaca

SEQ ID NO: 2764469 - DNA, 19 bp, Homo sapiens
agccccaccctcagatgca

SEQ ID NO: 2764470 - DNA, 20 bp, Homo sapiens
agcttatttcctcattttta

SEQ ID NO: 2764471 - DNA, 18 bp, Homo sapiens
aggaagctgtgagagcag

SEQ ID NO: 2764472 - DNA, 17 bp, Homo sapiens
aggaatgcaaagatgaa

SEQ ID NO: 2764473 - DNA, 23 bp, Homo sapiens
aggagaagtcttctatttattta

SEQ ID NO: 2764474 - DNA, 12 bp, Homo sapiens
aggagtttggcc

SEQ ID NO: 2764475 - DNA, 16 bp, Homo sapiens
aggatacttatttaaa

SEQ ID NO: 2764476 - DNA, 21 bp, Homo sapiens
aggcttagaccctcatgctgc

SEQ ID NO: 2764477 - DNA, 23 bp, Homo sapiens
aggcttagaccctcatgctgcca

SEQ ID NO: 2764478 - DNA, 19 bp, Homo sapiens
aggcttagtgatgtaatta

SEQ ID NO: 2764479 - DNA, 12 bp, Homo sapiens
aggttgtgaatg

SEQ ID NO: 2764480 - DNA, 14 bp, Homo sapiens
agtagaggtacact

SEQ ID NO: 2764481 - DNA, 20 bp, Homo sapiens
agtaggggtctgtcttttaa

SEQ ID NO: 2764482 - DNA, 16 bp, Homo sapiens
agtcaaggcttagacc

SEQ ID NO: 2764483 - DNA, 23 bp, Homo sapiens
agtcagactggatagtccgtctc

SEQ ID NO: 2764484 - DNA, 16 bp, Homo sapiens
agtcccctctcctcca

SEQ ID NO: 2764485 - DNA, 22 bp, Homo sapiens
agtcccctctcctccacatttg

SEQ ID NO: 2764486 - DNA, 22 bp, Homo sapiens
agtctggcagactttcttctct

SEQ ID NO: 2764487 - DNA, 18 bp, Homo sapiens
agtcttcagtttgcagag

SEQ ID NO: 2764488 - DNA, 20 bp, Homo sapiens
agtcttcagtttgcagagta

SEQ ID NO: 2764489 - DNA, 14 bp, Homo sapiens
agtgcttggcccag

SEQ ID NO: 2764490 - DNA, 15 bp, Homo sapiens
agtgcttggcccagg

SEQ ID NO: 2764491 - DNA, 23 bp, Homo sapiens
agtggcagtcttcagtttgcaga

SEQ ID NO: 2764492 - DNA, 19 bp, Homo sapiens
agtgtgtggtcaacatttc

SEQ ID NO: 2764493 - DNA, 14 bp, Homo sapiens
agttattgaagcag

SEQ ID NO: 2764494 - DNA, 17 bp, Homo sapiens
agttattgaagcagagt

SEQ ID NO: 2764495 - DNA, 19 bp, Homo sapiens
agttattgaagcagagtgg

SEQ ID NO: 2764496 - DNA, 13 bp, Homo sapiens
agtttgcagagta

SEQ ID NO: 2764497 - DNA, 13 bp, Homo sapiens
agtttggccagaa

SEQ ID NO: 2764498 - DNA, 16 bp, Homo sapiens
agtttggtttctagca

SEQ ID NO: 2764499 - DNA, 15 bp, Homo sapiens
agttttacagtgttt

SEQ ID NO: 2764500 - DNA, 16 bp, Homo sapiens
ataactggaacactct

SEQ ID NO: 2764501 - DNA, 18 bp, Homo sapiens
ataactggaacactctat

SEQ ID NO: 2764502 - DNA, 12 bp, Homo sapiens
ataactttttat

SEQ ID NO: 2764503 - DNA, 20 bp, Homo sapiens
atactgccttgtttaatggt

SEQ ID NO: 2764504 - DNA, 13 bp, Homo sapiens
atataaggttttt

SEQ ID NO: 2764505 - DNA, 22 bp, Homo sapiens
atatcccttggacattttatgt

SEQ ID NO: 2764506 - DNA, 23 bp, Homo sapiens
atatcccttggacattttatgtc

SEQ ID NO: 2764507 - DNA, 23 bp, Homo sapiens
atatcctaataaaaaggtgacca

SEQ ID NO: 2764508 - DNA, 16 bp, Homo sapiens
atattctcagcagagt

SEQ ID NO: 2764509 - DNA, 22 bp, Homo sapiens
atattgcatactattaaacatg

SEQ ID NO: 2764510 - DNA, 19 bp, Homo sapiens
atattggttgggatgactt

SEQ ID NO: 2764511 - DNA, 20 bp, Homo sapiens
atattggttgggatgacttg

SEQ ID NO: 2764512 - DNA, 13 bp, Homo sapiens
atatttaatcttt

SEQ ID NO: 2764513 - DNA, 16 bp, Homo sapiens
atccaattgctgcttg

SEQ ID NO: 2764514 - DNA, 20 bp, Homo sapiens
atcccttggacattttatgt

SEQ ID NO: 2764515 - DNA, 16 bp, Homo sapiens
atcctaataaaaaggt

SEQ ID NO: 2764516 - DNA, 22 bp, Homo sapiens
atcctaataaaaaggtgaccat

SEQ ID NO: 2764517 - DNA, 17 bp, Homo sapiens
atcgctccaccttgcag

SEQ ID NO: 2764518 - DNA, 14 bp, Homo sapiens
atgacattccctgc

SEQ ID NO: 2764519 - DNA, 16 bp, Homo sapiens
atgacattgactattt

SEQ ID NO: 2764520 - DNA, 14 bp, Homo sapiens
atgactgtttttaa

SEQ ID NO: 2764521 - DNA, 16 bp, Homo sapiens
ctctccccttctctgt

SEQ ID NO: 2764522 - DNA, 16 bp, Homo sapiens
ctctctgtaataaact

SEQ ID NO: 2764523 - DNA, 16 bp, Homo sapiens
ctgaaataaggaatga

SEQ ID NO: 2764524 - DNA, 18 bp, Homo sapiens
ctgccaatatcctaataa

SEQ ID NO: 2764525 - DNA, 20 bp, Homo sapiens
ctggacacttcacgcccttg

SEQ ID NO: 2764526 - DNA, 23 bp, Homo sapiens
ctggggtgggtggggcagtgctt

SEQ ID NO: 2764527 - DNA, 16 bp, Homo sapiens
ctggtttgttccctgt

SEQ ID NO: 2764528 - DNA, 16 bp, Homo sapiens
ctgtacatactttttg

SEQ ID NO: 2764529 - DNA, 15 bp, Homo sapiens
ctgtcctattatatt

SEQ ID NO: 2764530 - DNA, 17 bp, Homo sapiens
ctgtcggagccctgtct

SEQ ID NO: 2764531 - DNA, 15 bp, Homo sapiens
ctgtcttttaaactc

SEQ ID NO: 2764532 - DNA, 21 bp, Homo sapiens
ctgtgcatctagcctcaagct

SEQ ID NO: 2764533 - DNA, 19 bp, Homo sapiens
cttaataaactgtggtgct

SEQ ID NO: 2764534 - DNA, 16 bp, Homo sapiens
cttaattattgatgtt

SEQ ID NO: 2764535 - DNA, 14 bp, Homo sapiens
cttagaccctcatg

SEQ ID NO: 2764536 - DNA, 19 bp, Homo sapiens
cttagaccctcatgctgcc

SEQ ID NO: 2764537 - DNA, 13 bp, Homo sapiens
cttatttaaatag

SEQ ID NO: 2764538 - DNA, 19 bp, Homo sapiens
cttatttaaatagatgaca

SEQ ID NO: 2764539 - DNA, 15 bp, Homo sapiens
cttatttcctcattt

SEQ ID NO: 2764540 - DNA, 14 bp, Homo sapiens
cttcaagaatgcag

SEQ ID NO: 2764541 - DNA, 17 bp, Homo sapiens
cttcacgcccttggcca

SEQ ID NO: 2764542 - DNA, 14 bp, Homo sapiens
cttctatataattc

SEQ ID NO: 2764543 - DNA, 22 bp, Homo sapiens
cttctatttatttatttattca

SEQ ID NO: 2764544 - DNA, 22 bp, Homo sapiens
cttctctgtattcctagaaact

SEQ ID NO: 2764545 - DNA, 22 bp, Homo sapiens
cttgcagctctccccttctctg

SEQ ID NO: 2764546 - DNA, 17 bp, Homo sapiens
cttggacattttatgtc

SEQ ID NO: 2764547 - DNA, 18 bp, Homo sapiens
cttggacattttatgtct

SEQ ID NO: 2764548 - DNA, 13 bp, Homo sapiens
cttggcccaggag

SEQ ID NO: 2764549 - DNA, 22 bp, Homo sapiens
cttgtgaataaagagggtgggt

SEQ ID NO: 2764550 - DNA, 22 bp, Homo sapiens
cttgttgagggtatgttttata

SEQ ID NO: 2764551 - DNA, 12 bp, Homo sapiens
ctttcccttggt

SEQ ID NO: 2764552 - DNA, 17 bp, Homo sapiens
ctttggttattttactt

SEQ ID NO: 2764553 - DNA, 19 bp, Homo sapiens
ctttggttattttactttt

SEQ ID NO: 2764554 - DNA, 11 bp, Homo sapiens
cttttaaactc

SEQ ID NO: 2764555 - DNA, 15 bp, Homo sapiens
cttttgcatattgca

SEQ ID NO: 2764556 - DNA, 16 bp, Homo sapiens
ctttttataacttttt

SEQ ID NO: 2764557 - DNA, 16 bp, Homo sapiens
gaaactgacacatgct

SEQ ID NO: 2764558 - DNA, 22 bp, Homo sapiens
gaacagtaacatagctgtgatt

SEQ ID NO: 2764559 - DNA, 17 bp, Homo sapiens
gaagattctatgttaat

SEQ ID NO: 2764560 - DNA, 11 bp, Homo sapiens
gaagcagagtg

SEQ ID NO: 2764561 - DNA, 17 bp, Homo sapiens
gaaggtagaatgttttc

SEQ ID NO: 2764562 - DNA, 20 bp, Homo sapiens
gaaggtagaatgttttcaaa

SEQ ID NO: 2764563 - DNA, 19 bp, Homo sapiens
gaaggtctgttttgtgtac

SEQ ID NO: 2764564 - DNA, 17 bp, Homo sapiens
gaagtaaaatgtggcag

SEQ ID NO: 2764565 - DNA, 18 bp, Homo sapiens
gaagtcaaggcttagacc

SEQ ID NO: 2764566 - DNA, 17 bp, Homo sapiens
gaagtcttctatttatt

SEQ ID NO: 2764567 - DNA, 17 bp, Homo sapiens
gaatgtcagttgttatt

SEQ ID NO: 2764568 - DNA, 21 bp, Homo sapiens
gaatgtcagttgttatttatt

SEQ ID NO: 2764569 - DNA, 17 bp, Homo sapiens
gaatgttttcaaatgtt

SEQ ID NO: 2764570 - DNA, 21 bp, Homo sapiens
gacagagccccaccctcagat

SEQ ID NO: 2764571 - DNA, 13 bp, Homo sapiens
gacagttgggttt

SEQ ID NO: 2764572 - DNA, 17 bp, Homo sapiens
gacagttgggtttttta

SEQ ID NO: 2764573 - DNA, 22 bp, Homo sapiens
gacattgactatttttgttttt

SEQ ID NO: 2764574 - DNA, 16 bp, Homo sapiens
gacattttatgtcttt

SEQ ID NO: 2764575 - DNA, 12 bp, Homo sapiens
gaccctcatgct

SEQ ID NO: 2764576 - DNA, 18 bp, Homo sapiens
gaccctcatgctgccaat

SEQ ID NO: 2764577 - DNA, 18 bp, Homo sapiens
gactatttttgtttttat

SEQ ID NO: 2764578 - DNA, 21 bp, Homo sapiens
gactatttttgtttttattaa

SEQ ID NO: 2764579 - DNA, 16 bp, Homo sapiens
gactggatagtccgtc

SEQ ID NO: 2764580 - DNA, 16 bp, Homo sapiens
gagccccaccctcaga

SEQ ID NO: 2764581 - DNA, 21 bp, Homo sapiens
gagtgctcagtagtcagactg

SEQ ID NO: 2764582 - DNA, 19 bp, Homo sapiens
gatacttatttaaatagat

SEQ ID NO: 2764583 - DNA, 15 bp, Homo sapiens
gatgacattccctgc

SEQ ID NO: 2764584 - DNA, 17 bp, Homo sapiens
gatgacattgactattt

SEQ ID NO: 2764585 - DNA, 21 bp, Homo sapiens
gattcttgtatttattacaac

SEQ ID NO: 2764586 - DNA, 22 bp, Homo sapiens
gattgcctttttataacttttt

SEQ ID NO: 2764587 - DNA, 18 bp, Homo sapiens
gattgtgcctaatgtgtt

SEQ ID NO: 2764588 - DNA, 20 bp, Homo sapiens
gatttaaacacattaaaggt

SEQ ID NO: 2764589 - DNA, 11 bp, Homo sapiens
gattttcagcc

SEQ ID NO: 2764590 - DNA, 15 bp, Homo sapiens
gattttcagccctca

SEQ ID NO: 2764591 - DNA, 15 bp, Homo sapiens
gcaaacttcagagtt

SEQ ID NO: 2764592 - DNA, 21 bp, Homo sapiens
gcacattaaatgactcttccc

SEQ ID NO: 2764593 - DNA, 17 bp, Homo sapiens
gcactggtttgttccct

SEQ ID NO: 2764594 - DNA, 13 bp, Homo sapiens
gcagagtggcagt

SEQ ID NO: 2764595 - DNA, 22 bp, Homo sapiens
gcagagtggcagtcttcagttt

SEQ ID NO: 2764596 - DNA, 19 bp, Homo sapiens
gcagccctcaattgtgaaa

SEQ ID NO: 2764597 - DNA, 16 bp, Homo sapiens
gcaggaagctgtgaga

SEQ ID NO: 2764598 - DNA, 18 bp, Homo sapiens
gcagtgcttggcccagga

SEQ ID NO: 2764599 - DNA, 20 bp, Homo sapiens
gcagtgcttggcccaggagt

SEQ ID NO: 2764600 - DNA, 16 bp, Homo sapiens
gccaatatcctaataa

SEQ ID NO: 2764601 - DNA, 16 bp, Homo sapiens
gccagaagtcaaggct

SEQ ID NO: 2764602 - DNA, 20 bp, Homo sapiens
gccagaagtcaaggcttaga

SEQ ID NO: 2764603 - DNA, 15 bp, Homo sapiens
gcccaggagtttggc

SEQ ID NO: 2764604 - DNA, 15 bp, Homo sapiens
gccccaccctcagat

SEQ ID NO: 2764605 - DNA, 18 bp, Homo sapiens
gccccaccctcagatgca

SEQ ID NO: 2764606 - DNA, 16 bp, Homo sapiens
gcccttggccatgggt

SEQ ID NO: 2764607 - DNA, 18 bp, Homo sapiens
gcctaatatgatgactgt

SEQ ID NO: 2764608 - DNA, 17 bp, Homo sapiens
gctcaccccatcatccc

SEQ ID NO: 2764609 - DNA, 23 bp, Homo sapiens
gctgccaatatcctaataaaaag

SEQ ID NO: 2764610 - DNA, 16 bp, Homo sapiens
gctgctgatttaaaca

SEQ ID NO: 2764611 - DNA, 16 bp, Homo sapiens
gctgtacatacttttt

SEQ ID NO: 2764612 - DNA, 17 bp, Homo sapiens
gctgtacatactttttg

SEQ ID NO: 2764613 - DNA, 22 bp, Homo sapiens
gcttaattattgatgttttcat

SEQ ID NO: 2764614 - DNA, 21 bp, Homo sapiens
gcttagaccctcatgctgcca

SEQ ID NO: 2764615 - DNA, 17 bp, Homo sapiens
gcttatttcctcatttt

SEQ ID NO: 2764616 - DNA, 22 bp, Homo sapiens
gcttggcccaggagtttggcca

SEQ ID NO: 2764617 - DNA, 13 bp, Homo sapiens
ggaaaggaatgca

SEQ ID NO: 2764618 - DNA, 20 bp, Homo sapiens
ggaatgatataaggtttttt

SEQ ID NO: 2764619 - DNA, 13 bp, Homo sapiens
ggaatgcaaagat

SEQ ID NO: 2764620 - DNA, 15 bp, Homo sapiens
ggacattttatgtct

SEQ ID NO: 2764621 - DNA, 19 bp, Homo sapiens
ggagttattgaagcagagt

SEQ ID NO: 2764622 - DNA, 13 bp, Homo sapiens
ggagtttggccag

SEQ ID NO: 2764623 - DNA, 15 bp, Homo sapiens
ggcacatcatttcaa

SEQ ID NO: 2764624 - DNA, 20 bp, Homo sapiens
ggcactggtttgttccctgt

SEQ ID NO: 2764625 - DNA, 18 bp, Homo sapiens
ggcccaggagtttggcca

SEQ ID NO: 2764626 - DNA, 21 bp, Homo sapiens
ggcccaggagtttggccagaa

SEQ ID NO: 2764627 - DNA, 18 bp, Homo sapiens
ggctgaactttgtggtcg

SEQ ID NO: 2764628 - DNA, 23 bp, Homo sapiens
ggctggagttattgaagcagagt

SEQ ID NO: 2764629 - DNA, 18 bp, Homo sapiens
gggcagtgcttggcccag

SEQ ID NO: 2764630 - DNA, 16 bp, Homo sapiens
ggggtaaggtgcatct

SEQ ID NO: 2764631 - DNA, 15 bp, Homo sapiens
ggtacacttgtgaat

SEQ ID NO: 2764632 - DNA, 23 bp, Homo sapiens
ggtagaatgttttcaaatgttct

SEQ ID NO: 2764633 - DNA, 14 bp, Homo sapiens
ggtctgtcttttaa

SEQ ID NO: 2764634 - DNA, 21 bp, Homo sapiens
ggtctgttttgtgtactttta

SEQ ID NO: 2764635 - DNA, 16 bp, Homo sapiens
ggttattttacttttt

SEQ ID NO: 2764636 - DNA, 11 bp, Homo sapiens
ggtttatttgg

SEQ ID NO: 2764637 - DNA, 12 bp, Homo sapiens
ggtttctagcat

SEQ ID NO: 2764638 - DNA, 17 bp, Homo sapiens
gtaacatagctgtgatt

SEQ ID NO: 2764639 - DNA, 14 bp, Homo sapiens
gtacacttgtgaat

SEQ ID NO: 2764640 - DNA, 15 bp, Homo sapiens
gtacacttgtgaata

SEQ ID NO: 2764641 - DNA, 13 bp, Homo sapiens
gtacatacttttt

SEQ ID NO: 2764642 - DNA, 14 bp, Homo sapiens
gtacttttaagact

SEQ ID NO: 2764643 - DNA, 16 bp, Homo sapiens
gtagacagttgggttt

SEQ ID NO: 2764644 - DNA, 20 bp, Homo sapiens
gtagacgtgcacgcacactg

SEQ ID NO: 2764645 - DNA, 15 bp, Homo sapiens
gtagaggtacacttg

SEQ ID NO: 2764646 - DNA, 15 bp, Homo sapiens
gtatagatgttgcta

SEQ ID NO: 2764647 - DNA, 18 bp, Homo sapiens
gtcaaggcttagaccctc

SEQ ID NO: 2764648 - DNA, 16 bp, Homo sapiens
gtcagttgttatttat

SEQ ID NO: 2764649 - DNA, 18 bp, Homo sapiens
gtcagttgttatttattg

SEQ ID NO: 2764650 - DNA, 19 bp, Homo sapiens
gtcattatgttaatatttc

SEQ ID NO: 2764651 - DNA, 18 bp, Homo sapiens
gtcctgtcggagccctgt

SEQ ID NO: 2764652 - DNA, 16 bp, Homo sapiens
gtcggagccctgtctc

SEQ ID NO: 2764653 - DNA, 17 bp, Homo sapiens
gtctgtcttttaaactc

SEQ ID NO: 2764654 - DNA, 15 bp, Homo sapiens
gtctgttttgtgtac

SEQ ID NO: 2764655 - DNA, 18 bp, Homo sapiens
atgacttggtgtctaatg

SEQ ID NO: 2764656 - DNA, 23 bp, Homo sapiens
atgacttggtgtctaatgtgtag

SEQ ID NO: 2764657 - DNA, 14 bp, Homo sapiens
atgagcttaagaaa

SEQ ID NO: 2764658 - DNA, 16 bp, Homo sapiens
atgatataaggttttt

SEQ ID NO: 2764659 - DNA, 19 bp, Homo sapiens
atgattgcctttttataac

SEQ ID NO: 2764660 - DNA, 13 bp, Homo sapiens
atgcaggttttat

SEQ ID NO: 2764661 - DNA, 18 bp, Homo sapiens
atgcagtactaacattta

SEQ ID NO: 2764662 - DNA, 22 bp, Homo sapiens
atgctgccaatatcctaataaa

SEQ ID NO: 2764663 - DNA, 23 bp, Homo sapiens
atgctgccaatatcctaataaaa

SEQ ID NO: 2764664 - DNA, 15 bp, Homo sapiens
atgctgtacatactt

SEQ ID NO: 2764665 - DNA, 16 bp, Homo sapiens
atgcttgctgctgatt

SEQ ID NO: 2764666 - DNA, 22 bp, Homo sapiens
atgcttgctgctgatttaaaca

SEQ ID NO: 2764667 - DNA, 18 bp, Homo sapiens
atggataaatattggttg

SEQ ID NO: 2764668 - DNA, 21 bp, Homo sapiens
atggtagttttacagtgtttc

SEQ ID NO: 2764669 - DNA, 20 bp, Homo sapiens
atgtagacagttgggttttt

SEQ ID NO: 2764670 - DNA, 13 bp, Homo sapiens
atgtcagtatttc

SEQ ID NO: 2764671 - DNA, 14 bp, Homo sapiens
atgtgttctattca

SEQ ID NO: 2764672 - DNA, 22 bp, Homo sapiens
atgttaatattttaggtgtaaa

SEQ ID NO: 2764673 - DNA, 20 bp, Homo sapiens
atgttctccagtcattatgt

SEQ ID NO: 2764674 - DNA, 12 bp, Homo sapiens
atgttttcaaat

SEQ ID NO: 2764675 - DNA, 18 bp, Homo sapiens
atgttttcaaatgttctc

SEQ ID NO: 2764676 - DNA, 14 bp, Homo sapiens
attaaatgactctt

SEQ ID NO: 2764677 - DNA, 17 bp, Homo sapiens
attacaactctatttaa

SEQ ID NO: 2764678 - DNA, 14 bp, Homo sapiens
attaggttgtgaat

SEQ ID NO: 2764679 - DNA, 21 bp, Homo sapiens
attagttttgaagattctatg

SEQ ID NO: 2764680 - DNA, 16 bp, Homo sapiens
attatgttaatatttc

SEQ ID NO: 2764681 - DNA, 11 bp, Homo sapiens
attattaacaa

SEQ ID NO: 2764682 - DNA, 24 bp, Homo sapiens
attcctagaaactgacacatgctg

SEQ ID NO: 2764683 - DNA, 18 bp, Homo sapiens
attctatgttaatatttt

SEQ ID NO: 2764684 - DNA, 14 bp, Homo sapiens
attctcagcagagt

SEQ ID NO: 2764685 - DNA, 15 bp, Homo sapiens
attctcagcagagtg

SEQ ID NO: 2764686 - DNA, 15 bp, Homo sapiens
attgaagcagagtgg

SEQ ID NO: 2764687 - DNA, 18 bp, Homo sapiens
attgaagcagagtggcag

SEQ ID NO: 2764688 - DNA, 15 bp, Homo sapiens
attgaagtaaaatgt

SEQ ID NO: 2764689 - DNA, 17 bp, Homo sapiens
attgatgttttcataga

SEQ ID NO: 2764690 - DNA, 19 bp, Homo sapiens
attgattgggcacatcatt

SEQ ID NO: 2764691 - DNA, 17 bp, Homo sapiens
attgcatactattaaac

SEQ ID NO: 2764692 - DNA, 19 bp, Homo sapiens
attgcctttttataacttt

SEQ ID NO: 2764693 - DNA, 20 bp, Homo sapiens
attgcctttttataactttt

SEQ ID NO: 2764694 - DNA, 23 bp, Homo sapiens
attgggcacatcatttcaagaag

SEQ ID NO: 2764695 - DNA, 13 bp, Homo sapiens
atttattgaaatg

SEQ ID NO: 2764696 - DNA, 22 bp, Homo sapiens
atttattgaaatgatttcacag

SEQ ID NO: 2764697 - DNA, 23 bp, Homo sapiens
atttcaagaagtcccctctcctc

SEQ ID NO: 2764698 - DNA, 23 bp, Homo sapiens
atttgaaggtagaatgttttcaa

SEQ ID NO: 2764699 - DNA, 19 bp, Homo sapiens
atttttgtttttattaaaa

SEQ ID NO: 2764700 - DNA, 17 bp, Homo sapiens
caaacagtctcccttcc

SEQ ID NO: 2764701 - DNA, 16 bp, Homo sapiens
caaaggatacttattt

SEQ ID NO: 2764702 - DNA, 17 bp, Homo sapiens
caacataactcaagtct

SEQ ID NO: 2764703 - DNA, 20 bp, Homo sapiens
caagaagtcccctctcctcc

SEQ ID NO: 2764704 - DNA, 15 bp, Homo sapiens
caaggcttagaccct

SEQ ID NO: 2764705 - DNA, 19 bp, Homo sapiens
caataaacatttcatttcc

SEQ ID NO: 2764706 - DNA, 16 bp, Homo sapiens
caatatcctaataaaa

SEQ ID NO: 2764707 - DNA, 20 bp, Homo sapiens
caatatcctaataaaaaggt

SEQ ID NO: 2764708 - DNA, 22 bp, Homo sapiens
caatatcctaataaaaaggtga

SEQ ID NO: 2764709 - DNA, 18 bp, Homo sapiens
caatatttaatcttttat

SEQ ID NO: 2764710 - DNA, 19 bp, Homo sapiens
caatgagatcattgtgaag

SEQ ID NO: 2764711 - DNA, 23 bp, Homo sapiens
caattgaagtaaaatgtggcagg

SEQ ID NO: 2764712 - DNA, 15 bp, Homo sapiens
cacaaagcagatcct

SEQ ID NO: 2764713 - DNA, 17 bp, Homo sapiens
cacaaggaaataaaatt

SEQ ID NO: 2764714 - DNA, 21 bp, Homo sapiens
cacagtgtgtggtcaacattt

SEQ ID NO: 2764715 - DNA, 23 bp, Homo sapiens
cacagtgtgtggtcaacatttct

SEQ ID NO: 2764716 - DNA, 15 bp, Homo sapiens
cacatctgttttgta

SEQ ID NO: 2764717 - DNA, 17 bp, Homo sapiens
cacattaaaggtacttt

SEQ ID NO: 2764718 - DNA, 16 bp, Homo sapiens
caccatgggattaata

SEQ ID NO: 2764719 - DNA, 18 bp, Homo sapiens
cacccaggaactcctgac

SEQ ID NO: 2764720 - DNA, 15 bp, Homo sapiens
cacgcacactgtctg

SEQ ID NO: 2764721 - DNA, 16 bp, Homo sapiens
cactggttttaaatat

SEQ ID NO: 2764722 - DNA, 17 bp, Homo sapiens
cacttcacgcccttggc

SEQ ID NO: 2764723 - DNA, 18 bp, Homo sapiens
cagaagtcaaggcttaga

SEQ ID NO: 2764724 - DNA, 20 bp, Homo sapiens
cagagtaggggtctgtcttt

SEQ ID NO: 2764725 - DNA, 21 bp, Homo sapiens
cagagtgctttaccaattgaa

SEQ ID NO: 2764726 - DNA, 19 bp, Homo sapiens
cagcacaaggaaataaaat

SEQ ID NO: 2764727 - DNA, 18 bp, Homo sapiens
cagccctcaattgtgaaa

SEQ ID NO: 2764728 - DNA, 13 bp, Homo sapiens
caggagtttggcc

SEQ ID NO: 2764729 - DNA, 20 bp, Homo sapiens
cagtaaaaaatggtgtttta

SEQ ID NO: 2764730 - DNA, 21 bp, Homo sapiens
cagtaatgagcttaagaaatt

SEQ ID NO: 2764731 - DNA, 18 bp, Homo sapiens
cagtactaacatttattt

SEQ ID NO: 2764732 - DNA, 13 bp, Homo sapiens
cagtgcttggccc

SEQ ID NO: 2764733 - DNA, 14 bp, Homo sapiens
cagtgcttggccca

SEQ ID NO: 2764734 - DNA, 17 bp, Homo sapiens
cagtgcttggcccagga

SEQ ID NO: 2764735 - DNA, 16 bp, Homo sapiens
cagttgggttttttaa

SEQ ID NO: 2764736 - DNA, 18 bp, Homo sapiens
cagttgggttttttaagg

SEQ ID NO: 2764737 - DNA, 19 bp, Homo sapiens
cagttgttatttattgaaa

SEQ ID NO: 2764738 - DNA, 21 bp, Homo sapiens
cagttgttatttattgaaatg

SEQ ID NO: 2764739 - DNA, 14 bp, Homo sapiens
catactattaaaca

SEQ ID NO: 2764740 - DNA, 18 bp, Homo sapiens
catactttttgggtttat

SEQ ID NO: 2764741 - DNA, 15 bp, Homo sapiens
catagctgtgatttt

SEQ ID NO: 2764742 - DNA, 18 bp, Homo sapiens
catagctgtgatttttgg

SEQ ID NO: 2764743 - DNA, 15 bp, Homo sapiens
catgctgccaatatc

SEQ ID NO: 2764744 - DNA, 17 bp, Homo sapiens
catgctgccaatatcct

SEQ ID NO: 2764745 - DNA, 19 bp, Homo sapiens
catgctgccaatatcctaa

SEQ ID NO: 2764746 - DNA, 21 bp, Homo sapiens
catgctgtacatactttttgg

SEQ ID NO: 2764747 - DNA, 14 bp, Homo sapiens
cattaaatgactct

SEQ ID NO: 2764748 - DNA, 15 bp, Homo sapiens
cattaggttgtgaat

SEQ ID NO: 2764749 - DNA, 16 bp, Homo sapiens
cattaggttgtgaatg

SEQ ID NO: 2764750 - DNA, 15 bp, Homo sapiens
cattatgttaatatt

SEQ ID NO: 2764751 - DNA, 14 bp, Homo sapiens
cattctttttgaaa

SEQ ID NO: 2764752 - DNA, 14 bp, Homo sapiens
cattgacagattga

SEQ ID NO: 2764753 - DNA, 12 bp, Homo sapiens
ccaatatcctaa

SEQ ID NO: 2764754 - DNA, 18 bp, Homo sapiens
ccaatatcctaataaaaa

SEQ ID NO: 2764755 - DNA, 14 bp, Homo sapiens
ccagcacaaagcag

SEQ ID NO: 2764756 - DNA, 14 bp, Homo sapiens
ccaggagtttggcc

SEQ ID NO: 2764757 - DNA, 16 bp, Homo sapiens
ccaggagtttggccag

SEQ ID NO: 2764758 - DNA, 21 bp, Homo sapiens
ccagtcattatgttaatattt

SEQ ID NO: 2764759 - DNA, 16 bp, Homo sapiens
ccattcttggcccagg

SEQ ID NO: 2764760 - DNA, 20 bp, Homo sapiens
cccaggagtttggccagaag

SEQ ID NO: 2764761 - DNA, 16 bp, Homo sapiens
cccagtgttttaggag

SEQ ID NO: 2764762 - DNA, 17 bp, Homo sapiens
ccctcatgctgccaata

SEQ ID NO: 2764763 - DNA, 20 bp, Homo sapiens
cctaataaaaaggtgaccat

SEQ ID NO: 2764764 - DNA, 18 bp, Homo sapiens
cctcaataaacatttcat

SEQ ID NO: 2764765 - DNA, 14 bp, Homo sapiens
cctcaattgtgaaa

SEQ ID NO: 2764766 - DNA, 20 bp, Homo sapiens
cctcagatgcacatgagctg

SEQ ID NO: 2764767 - DNA, 15 bp, Homo sapiens
cctcatgctgccaat

SEQ ID NO: 2764768 - DNA, 20 bp, Homo sapiens
cctcatgctgccaatatcct

SEQ ID NO: 2764769 - DNA, 14 bp, Homo sapiens
cctctcctccacat

SEQ ID NO: 2764770 - DNA, 14 bp, Homo sapiens
cctgtttttattat

SEQ ID NO: 2764771 - DNA, 15 bp, Homo sapiens
cctgtttttattatt

SEQ ID NO: 2764772 - DNA, 23 bp, Homo sapiens
ccttcttcccaatagcaaggctg

SEQ ID NO: 2764773 - DNA, 16 bp, Homo sapiens
ccttggacattttatg

SEQ ID NO: 2764774 - DNA, 21 bp, Homo sapiens
cctttttataactttttatat

SEQ ID NO: 2764775 - DNA, 13 bp, Homo sapiens
ctaaaatgttcta

SEQ ID NO: 2764776 - DNA, 13 bp, Homo sapiens
ctaataaaaaggt

SEQ ID NO: 2764777 - DNA, 18 bp, Homo sapiens
ctacattaggttgtgaat

SEQ ID NO: 2764778 - DNA, 13 bp, Homo sapiens
ctaccaatattta

SEQ ID NO: 2764779 - DNA, 21 bp, Homo sapiens
ctaccaatatttaatctttta

SEQ ID NO: 2764780 - DNA, 16 bp, Homo sapiens
ctagcatgaagacaga

SEQ ID NO: 2764781 - DNA, 21 bp, Homo sapiens
ctatttttgtttttattaaaa

SEQ ID NO: 2764782 - DNA, 17 bp, Homo sapiens
ctcaataaacatttcat

SEQ ID NO: 2764783 - DNA, 12 bp, Homo sapiens
ctcaattgtgaa

SEQ ID NO: 2764784 - DNA, 15 bp, Homo sapiens
ctcacagaagatgaa

SEQ ID NO: 2764785 - DNA, 21 bp, Homo sapiens
ctcagatgcacatgagctggc

SEQ ID NO: 2764786 - DNA, 11 bp, Homo sapiens
ctcagcagagt

SEQ ID NO: 2764787 - DNA, 16 bp, Homo sapiens
ctcagcagagtgcttt

SEQ ID NO: 2764788 - DNA, 14 bp, Homo sapiens
ctcatttctagcag

SEQ ID NO: 2764789 - DNA, 15 bp, Homo sapiens
gtgcctaatgtgttt

SEQ ID NO: 2764790 - DNA, 19 bp, Homo sapiens
gtgcttggcccaggagttt

SEQ ID NO: 2764791 - DNA, 17 bp, Homo sapiens
gtggctaacttgggtta

SEQ ID NO: 2764792 - DNA, 23 bp, Homo sapiens
gtgtgtggtcaacatttctcatg

SEQ ID NO: 2764793 - DNA, 14 bp, Homo sapiens
gttacacaaagaac

SEQ ID NO: 2764794 - DNA, 16 bp, Homo sapiens
gttattgaagcagagt

SEQ ID NO: 2764795 - DNA, 18 bp, Homo sapiens
gttattgaagcagagtgg

SEQ ID NO: 2764796 - DNA, 23 bp, Homo sapiens
gttgctaacagcaacacaaagct

SEQ ID NO: 2764797 - DNA, 12 bp, Homo sapiens
gtttaatggtag

SEQ ID NO: 2764798 - DNA, 20 bp, Homo sapiens
gtttaatggtagttttacag

SEQ ID NO: 2764799 - DNA, 21 bp, Homo sapiens
gtttctagcatgaagacagag

SEQ ID NO: 2764800 - DNA, 20 bp, Homo sapiens
gttttgaagattctatgtta

SEQ ID NO: 2764801 - DNA, 13 bp, Homo sapiens
gtttttattaaaa

SEQ ID NO: 2764802 - DNA, 18 bp, Homo sapiens
gtttttattattaacaaa

SEQ ID NO: 2764803 - DNA, 15 bp, Homo sapiens
taaaaaggtgaccat

SEQ ID NO: 2764804 - DNA, 12 bp, Homo sapiens
taaacacattaa

SEQ ID NO: 2764805 - DNA, 14 bp, Homo sapiens
taaatagatgacat

SEQ ID NO: 2764806 - DNA, 19 bp, Homo sapiens
taaatagatgacattgact

SEQ ID NO: 2764807 - DNA, 22 bp, Homo sapiens
taaatattggttgggatgactt

SEQ ID NO: 2764808 - DNA, 23 bp, Homo sapiens
taaatattggttgggatgacttg

SEQ ID NO: 2764809 - DNA, 18 bp, Homo sapiens
taaatattttgacttgtt

SEQ ID NO: 2764810 - DNA, 15 bp, Homo sapiens
taacaaaggatactt

SEQ ID NO: 2764811 - DNA, 16 bp, Homo sapiens
taacaaaggatactta

SEQ ID NO: 2764812 - DNA, 17 bp, Homo sapiens
taacaaaggatacttat

SEQ ID NO: 2764813 - DNA, 18 bp, Homo sapiens
taacagcaacacaaagct

SEQ ID NO: 2764814 - DNA, 14 bp, Homo sapiens
taacaggcttagtg

SEQ ID NO: 2764815 - DNA, 21 bp, Homo sapiens
taactatcactggtttggttc

SEQ ID NO: 2764816 - DNA, 13 bp, Homo sapiens
taactttttatat

SEQ ID NO: 2764817 - DNA, 14 bp, Homo sapiens
taactttttatatt

SEQ ID NO: 2764818 - DNA, 12 bp, Homo sapiens
taataaaaaggt

SEQ ID NO: 2764819 - DNA, 14 bp, Homo sapiens
taataaaaaggtga

SEQ ID NO: 2764820 - DNA, 15 bp, Homo sapiens
taatatgatgactgt

SEQ ID NO: 2764821 - DNA, 17 bp, Homo sapiens
taatgtcagtatttcaa

SEQ ID NO: 2764822 - DNA, 21 bp, Homo sapiens
taattatggttagtagaggta

SEQ ID NO: 2764823 - DNA, 13 bp, Homo sapiens
tacacttgtgaat

SEQ ID NO: 2764824 - DNA, 19 bp, Homo sapiens
tacatgcctaccaatattt

SEQ ID NO: 2764825 - DNA, 17 bp, Homo sapiens
tacattaggttgtgaat

SEQ ID NO: 2764826 - DNA, 19 bp, Homo sapiens
ttaagactttggttatttt

SEQ ID NO: 2764827 - DNA, 20 bp, Homo sapiens
ttactaaaagttttgagaaa

SEQ ID NO: 2764828 - DNA, 13 bp, Homo sapiens
ttactttaaacta

SEQ ID NO: 2764829 - DNA, 20 bp, Homo sapiens
ttagaccctcatgctgccaa

SEQ ID NO: 2764830 - DNA, 21 bp, Homo sapiens
ttagccgtggtgatttagcag

SEQ ID NO: 2764831 - DNA, 12 bp, Homo sapiens
ttaggttgtgaa

SEQ ID NO: 2764832 - DNA, 17 bp, Homo sapiens
ttaggttgtgaatgcag

SEQ ID NO: 2764833 - DNA, 13 bp, Homo sapiens
ttatatagcaaga

SEQ ID NO: 2764834 - DNA, 15 bp, Homo sapiens
ttatgattgcctttt

SEQ ID NO: 2764835 - DNA, 13 bp, Homo sapiens
ttattattaacaa

SEQ ID NO: 2764836 - DNA, 18 bp, Homo sapiens
ttattcattagttttgaa

SEQ ID NO: 2764837 - DNA, 21 bp, Homo sapiens
ttattcattagttttgaagat

SEQ ID NO: 2764838 - DNA, 13 bp, Homo sapiens
ttatttaaataga

SEQ ID NO: 2764839 - DNA, 16 bp, Homo sapiens
ttatttggaaaggaat

SEQ ID NO: 2764840 - DNA, 20 bp, Homo sapiens
ttatttggaaaggaatgcaa

SEQ ID NO: 2764841 - DNA, 12 bp, Homo sapiens
ttcaataactgg

SEQ ID NO: 2764842 - DNA, 16 bp, Homo sapiens
ttcaataactggaaca

SEQ ID NO: 2764843 - DNA, 20 bp, Homo sapiens
ttcaatctggattcatattt

SEQ ID NO: 2764844 - DNA, 14 bp, Homo sapiens
ttcacgcccttggc

SEQ ID NO: 2764845 - DNA, 14 bp, Homo sapiens
ttcattagttttga

SEQ ID NO: 2764846 - DNA, 16 bp, Homo sapiens
ttccagtaatgagctt

SEQ ID NO: 2764847 - DNA, 22 bp, Homo sapiens
ttcctgtttttattattaacaa

SEQ ID NO: 2764848 - DNA, 21 bp, Homo sapiens
ttctatttatttatttattca

SEQ ID NO: 2764849 - DNA, 13 bp, Homo sapiens
ttctcacagaaga

SEQ ID NO: 2764850 - DNA, 19 bp, Homo sapiens
ttctccagtcattatgtta

SEQ ID NO: 2764851 - DNA, 14 bp, Homo sapiens
ttctctcatctgtt

SEQ ID NO: 2764852 - DNA, 15 bp, Homo sapiens
ttctggactaaaact

SEQ ID NO: 2764853 - DNA, 15 bp, Homo sapiens
ttcttggcccaggat

SEQ ID NO: 2764854 - DNA, 13 bp, Homo sapiens
ttcttgtatttat

SEQ ID NO: 2764855 - DNA, 15 bp, Homo sapiens
ttctttttgaaatgt

SEQ ID NO: 2764856 - DNA, 14 bp, Homo sapiens
ttgaaactttaaga

SEQ ID NO: 2764857 - DNA, 23 bp, Homo sapiens
ttgaagattctatgttaatattt

SEQ ID NO: 2764858 - DNA, 14 bp, Homo sapiens
ttgaaggatgctgt

SEQ ID NO: 2764859 - DNA, 21 bp, Homo sapiens
ttgaaggatgctgtcttcgta

SEQ ID NO: 2764860 - DNA, 15 bp, Homo sapiens
ttgaaggtagaatgt

SEQ ID NO: 2764861 - DNA, 14 bp, Homo sapiens
ttgagtgtcaagct

SEQ ID NO: 2764862 - DNA, 17 bp, Homo sapiens
ttgattgggcacatcat

SEQ ID NO: 2764863 - DNA, 22 bp, Homo sapiens
ttgattgggcacatcatttcaa

SEQ ID NO: 2764864 - DNA, 11 bp, Homo sapiens
ttgcacattaa

SEQ ID NO: 2764865 - DNA, 17 bp, Homo sapiens
ttgcatattgcatacta

SEQ ID NO: 2764866 - DNA, 23 bp, Homo sapiens
ttgccaatttgcacattaaatga

SEQ ID NO: 2764867 - DNA, 16 bp, Homo sapiens
ttgctgcttgtacact

SEQ ID NO: 2764868 - DNA, 17 bp, Homo sapiens
ttggacattttatgtct

SEQ ID NO: 2764869 - DNA, 20 bp, Homo sapiens
ttggccagaagtcaaggctt

SEQ ID NO: 2764870 - DNA, 15 bp, Homo sapiens
ttggcccaggagttt

SEQ ID NO: 2764871 - DNA, 22 bp, Homo sapiens
ttggcccaggagtttggccaga

SEQ ID NO: 2764872 - DNA, 20 bp, Homo sapiens
ttgggcacatcatttcaaga

SEQ ID NO: 2764873 - DNA, 12 bp, Homo sapiens
ttgggtttattt

SEQ ID NO: 2764874 - DNA, 15 bp, Homo sapiens
ttggtatttgaaaca

SEQ ID NO: 2764875 - DNA, 18 bp, Homo sapiens
ttggttctggactaaaac

SEQ ID NO: 2764876 - DNA, 14 bp, Homo sapiens
ttgtgaataaagag

SEQ ID NO: 2764877 - DNA, 22 bp, Homo sapiens
ttgtgaatgcaggttttatcag

SEQ ID NO: 2764878 - DNA, 15 bp, Homo sapiens
ttgtgcctaatgtgt

SEQ ID NO: 2764879 - DNA, 18 bp, Homo sapiens
ttgttttgccaatttgca

SEQ ID NO: 2764880 - DNA, 18 bp, Homo sapiens
tttaagggccctttttca

SEQ ID NO: 2764881 - DNA, 13 bp, Homo sapiens
tttaatcttttat

SEQ ID NO: 2764882 - DNA, 19 bp, Homo sapiens
tttacagtgtttctggctt

SEQ ID NO: 2764883 - DNA, 23 bp, Homo sapiens
tttactttttggaaaagaataaa

SEQ ID NO: 2764884 - DNA, 13 bp, Homo sapiens
tttataacttttt

SEQ ID NO: 2764885 - DNA, 18 bp, Homo sapiens
tttatcagaactatgttt

SEQ ID NO: 2764886 - DNA, 23 bp, Homo sapiens
tttgagaaatttttttttccagt

SEQ ID NO: 2764887 - DNA, 16 bp, Homo sapiens
tttgcacattaaatga

SEQ ID NO: 2764888 - DNA, 11 bp, Homo sapiens
tttgcagagta

SEQ ID NO: 2764889 - DNA, 20 bp, Homo sapiens
tttgcatattgcatactatt

SEQ ID NO: 2764890 - DNA, 16 bp, Homo sapiens
tttggaaaggaatgca

SEQ ID NO: 2764891 - DNA, 19 bp, Homo sapiens
tttggaaaggaatgcaaag

SEQ ID NO: 2764892 - DNA, 14 bp, Homo sapiens
tttggttattttac

SEQ ID NO: 2764893 - DNA, 23 bp, Homo sapiens
tttgtaactgtttagatgaatgt

SEQ ID NO: 2764894 - DNA, 13 bp, Homo sapiens
ttttatcttctat

SEQ ID NO: 2764895 - DNA, 13 bp, Homo sapiens
ttttcaataactg

SEQ ID NO: 2764896 - DNA, 19 bp, Homo sapiens
ttttcaataactggaacac

SEQ ID NO: 2764897 - DNA, 13 bp, Homo sapiens
ttttccttcaaga

SEQ ID NO: 2764898 - DNA, 14 bp, Homo sapiens
ttttccttcaagaa

SEQ ID NO: 2764899 - DNA, 19 bp, Homo sapiens
ttttctcacagaagatgaa

SEQ ID NO: 2764900 - DNA, 18 bp, Homo sapiens
ttttgcatattgcatact

SEQ ID NO: 2764901 - DNA, 17 bp, Homo sapiens
ttttgggtttatttgga

SEQ ID NO: 2764902 - DNA, 16 bp, Homo sapiens
ttttggtatttgaaac

SEQ ID NO: 2764903 - DNA, 12 bp, Homo sapiens
ttttgtgtactt

SEQ ID NO: 2764904 - DNA, 18 bp, Homo sapiens
tttttggaaaagaataaa

SEQ ID NO: 2764905 - DNA, 22 bp, Homo sapiens
acagtgtgtggtcaacatttct

SEQ ID NO: 2764906 - DNA, 16 bp, Homo sapiens
acagttgggtttttta

SEQ ID NO: 2764907 - DNA, 18 bp, Homo sapiens
acagttgggttttttaag

SEQ ID NO: 2764908 - DNA, 13 bp, Homo sapiens
acatactttttgg

SEQ ID NO: 2764909 - DNA, 14 bp, Homo sapiens
acatcatttcaaga

SEQ ID NO: 2764910 - DNA, 19 bp, Homo sapiens
acatgcctaccaatattta

SEQ ID NO: 2764911 - DNA, 19 bp, Homo sapiens
acatgctgtacatactttt

SEQ ID NO: 2764912 - DNA, 12 bp, Homo sapiens
acattaaatgac

SEQ ID NO: 2764913 - DNA, 17 bp, Homo sapiens
acattaggttgtgaatg

SEQ ID NO: 2764914 - DNA, 14 bp, Homo sapiens
acattgactatttt

SEQ ID NO: 2764915 - DNA, 17 bp, Homo sapiens
acattgactatttttgt

SEQ ID NO: 2764916 - DNA, 17 bp, Homo sapiens
acatttctcatgttgaa

SEQ ID NO: 2764917 - DNA, 15 bp, Homo sapiens
acattttatgtcttt

SEQ ID NO: 2764918 - DNA, 16 bp, Homo sapiens
accaatatttaatctt

SEQ ID NO: 2764919 - DNA, 22 bp, Homo sapiens
accctcatgctgccaatatcct

SEQ ID NO: 2764920 - DNA, 14 bp, Homo sapiens
accctctcaaacta

SEQ ID NO: 2764921 - DNA, 16 bp, Homo sapiens
acgtgcacgcacactg

SEQ ID NO: 2764922 - DNA, 12 bp, Homo sapiens
actaacaggctt

SEQ ID NO: 2764923 - DNA, 17 bp, Homo sapiens
actatcactggtttggt

SEQ ID NO: 2764924 - DNA, 21 bp, Homo sapiens
actatttttgtttttattaaa

SEQ ID NO: 2764925 - DNA, 16 bp, Homo sapiens
actctacctgcacact

SEQ ID NO: 2764926 - DNA, 15 bp, Homo sapiens
actgaacagtaacat

SEQ ID NO: 2764927 - DNA, 17 bp, Homo sapiens
actggtttgttccctgt

SEQ ID NO: 2764928 - DNA, 14 bp, Homo sapiens
actgtttagatgaa

SEQ ID NO: 2764929 - DNA, 18 bp, Homo sapiens
acttatttaaatagatga

SEQ ID NO: 2764930 - DNA, 16 bp, Homo sapiens
acttcacgcccttggc

SEQ ID NO: 2764931 - DNA, 15 bp, Homo sapiens
acttgtgaataaaga

SEQ ID NO: 2764932 - DNA, 13 bp, Homo sapiens
actttggttattt

SEQ ID NO: 2764933 - DNA, 21 bp, Homo sapiens
actttggttattttacttttt

SEQ ID NO: 2764934 - DNA, 22 bp, Homo sapiens
actttggttattttactttttg

SEQ ID NO: 2764935 - DNA, 12 bp, Homo sapiens
acttttaagact

SEQ ID NO: 2764936 - DNA, 16 bp, Homo sapiens
actttttatattctca

SEQ ID NO: 2764937 - DNA, 20 bp, Homo sapiens
agaacaaaggggcttaatta

SEQ ID NO: 2764938 - DNA, 17 bp, Homo sapiens
agaactaaaatgttcta

SEQ ID NO: 2764939 - DNA, 18 bp, Homo sapiens
agaagtcaaggcttagac

SEQ ID NO: 2764940 - DNA, 16 bp, Homo sapiens
agaataaaccaagaat

SEQ ID NO: 2764941 - DNA, 22 bp, Homo sapiens
agacagagccccaccctcagat

SEQ ID NO: 2764942 - DNA, 24 bp, Homo sapiens
agacagagccccaccctcagatgc

SEQ ID NO: 2764943 - DNA, 24 bp, Homo sapiens
agaccctcatgctgccaatatcct

SEQ ID NO: 2764944 - DNA, 16 bp, Homo sapiens
agaccctctcaaacta

SEQ ID NO: 2764945 - DNA, 21 bp, Homo sapiens
agactggatagtccgtctctg

SEQ ID NO: 2764946 - DNA, 17 bp, Homo sapiens
agatgaaggtctgtttt

SEQ ID NO: 2764947 - DNA, 23 bp, Homo sapiens
agatgacattgactatttttgtt

SEQ ID NO: 2764948 - DNA, 22 bp, Homo sapiens
agattcttgtatttattacaac

SEQ ID NO: 2764949 - DNA, 15 bp, Homo sapiens
agcaacacaaagctt

SEQ ID NO: 2764950 - DNA, 16 bp, Homo sapiens
agcaacacaaagcttt

SEQ ID NO: 2764951 - DNA, 14 bp, Homo sapiens
agcaagacattata

SEQ ID NO: 2764952 - DNA, 20 bp, Homo sapiens
agcagtttggtttctagcat

SEQ ID NO: 2764953 - DNA, 19 bp, Homo sapiens
agcatcgcttaggagaagt

SEQ ID NO: 2764954 - DNA, 21 bp, Homo sapiens
atttgttttgccaatttgcac

SEQ ID NO: 2764955 - DNA, 19 bp, Homo sapiens
atttttggtatttgaaaca

SEQ ID NO: 2764956 - DNA, 13 bp, Homo sapiens
caaacccagtgtt

SEQ ID NO: 2764957 - DNA, 20 bp, Homo sapiens
caaactaacaggcttagtga

SEQ ID NO: 2764958 - DNA, 18 bp, Homo sapiens
caataactggaacactct

SEQ ID NO: 2764959 - DNA, 18 bp, Homo sapiens
caatatcctaataaaaag

SEQ ID NO: 2764960 - DNA, 19 bp, Homo sapiens
caatatcctaataaaaagg

SEQ ID NO: 2764961 - DNA, 16 bp, Homo sapiens
caatctggattcatat

SEQ ID NO: 2764962 - DNA, 23 bp, Homo sapiens
caatctgtgatgacattccctgc

SEQ ID NO: 2764963 - DNA, 22 bp, Homo sapiens
caattgtgaaaaaatttacttt

SEQ ID NO: 2764964 - DNA, 23 bp, Homo sapiens
caattgtgaaaaaatttacttta

SEQ ID NO: 2764965 - DNA, 22 bp, Homo sapiens
caatttgcacattaaatgactc

SEQ ID NO: 2764966 - DNA, 16 bp, Homo sapiens
cacaaagcttttgcat

SEQ ID NO: 2764967 - DNA, 13 bp, Homo sapiens
cacattaaatgac

SEQ ID NO: 2764968 - DNA, 13 bp, Homo sapiens
caccttgcagctc

SEQ ID NO: 2764969 - DNA, 18 bp, Homo sapiens
cactggtttgttccctgt

SEQ ID NO: 2764970 - DNA, 21 bp, Homo sapiens
cacttcacgcccttggccatg

SEQ ID NO: 2764971 - DNA, 11 bp, Homo sapiens
cacttgtgaat

SEQ ID NO: 2764972 - DNA, 12 bp, Homo sapiens
cacttgtgaata

SEQ ID NO: 2764973 - DNA, 17 bp, Homo sapiens
cagaactatgtttttgt

SEQ ID NO: 2764974 - DNA, 16 bp, Homo sapiens
cagaagtcaaggctta

SEQ ID NO: 2764975 - DNA, 20 bp, Homo sapiens
cagagccccaccctcagatg

SEQ ID NO: 2764976 - DNA, 23 bp, Homo sapiens
cagagtaggggtctgtcttttaa

SEQ ID NO: 2764977 - DNA, 9 bp, Homo sapiens
cagcagagt

SEQ ID NO: 2764978 - DNA, 11 bp, Homo sapiens
cagcagagtgc

SEQ ID NO: 2764979 - DNA, 15 bp, Homo sapiens
cagcagagtgcttta

SEQ ID NO: 2764980 - DNA, 17 bp, Homo sapiens
caggagtttggccagaa

SEQ ID NO: 2764981 - DNA, 13 bp, Homo sapiens
cagtaacatagct

SEQ ID NO: 2764982 - DNA, 19 bp, Homo sapiens
cagtgcttggcccaggagt

SEQ ID NO: 2764983 - DNA, 20 bp, Homo sapiens
cagtgcttggcccaggagtt

SEQ ID NO: 2764984 - DNA, 17 bp, Homo sapiens
cagtgtgtggtcaacat

SEQ ID NO: 2764985 - DNA, 20 bp, Homo sapiens
cagtgttttaggagcatgag

SEQ ID NO: 2764986 - DNA, 11 bp, Homo sapiens
cagttgggttt

SEQ ID NO: 2764987 - DNA, 14 bp, Homo sapiens
cagtttgcagagta

SEQ ID NO: 2764988 - DNA, 18 bp, Homo sapiens
cataagtgctattgcaga

SEQ ID NO: 2764989 - DNA, 12 bp, Homo sapiens
catactttttgg

SEQ ID NO: 2764990 - DNA, 22 bp, Homo sapiens
catattgcatactattaaacat

SEQ ID NO: 2764991 - DNA, 14 bp, Homo sapiens
catccctttccctt

SEQ ID NO: 2764992 - DNA, 21 bp, Homo sapiens
catgctgccaatatcctaata

SEQ ID NO: 2764993 - DNA, 15 bp, Homo sapiens
cattagttttgaaga

SEQ ID NO: 2764994 - DNA, 13 bp, Homo sapiens
cattcttggccca

SEQ ID NO: 2764995 - DNA, 22 bp, Homo sapiens
cattgactatttttgtttttat

SEQ ID NO: 2764996 - DNA, 19 bp, Homo sapiens
gggccctttttcaataact

SEQ ID NO: 2764997 - DNA, 23 bp, Homo sapiens
ggggcagtgcttggcccaggagt

SEQ ID NO: 2764998 - DNA, 16 bp, Homo sapiens
gtaaaaaatggtgttt

SEQ ID NO: 2764999 - DNA, 13 bp, Homo sapiens
gtaataaactcat

SEQ ID NO: 2765000 - DNA, 19 bp, Homo sapiens
gtacatactttttgggttt

SEQ ID NO: 2765001 - DNA, 21 bp, Homo sapiens
gtactctgccactttatttct

SEQ ID NO: 2765002 - DNA, 17 bp, Homo sapiens
gtagaggtacacttgtg

SEQ ID NO: 2765003 - DNA, 19 bp, Homo sapiens
gtagaggtacacttgtgaa

SEQ ID NO: 2765004 - DNA, 16 bp, Homo sapiens
gtatagatgttgctaa

SEQ ID NO: 2765005 - DNA, 21 bp, Homo sapiens
gtcagttgttatttattgaaa

SEQ ID NO: 2765006 - DNA, 12 bp, Homo sapiens
gtcggagccctg

SEQ ID NO: 2765007 - DNA, 14 bp, Homo sapiens
gtctgttttgtgta

SEQ ID NO: 2765008 - DNA, 14 bp, Homo sapiens
gtcttctatttatt

SEQ ID NO: 2765009 - DNA, 18 bp, Homo sapiens
gtgcacgcacactgtctg

SEQ ID NO: 2765010 - DNA, 14 bp, Homo sapiens
gtgcttggcccagg

SEQ ID NO: 2765011 - DNA, 24 bp, Homo sapiens
gtgcttggcccaggagtttggcca

SEQ ID NO: 2765012 - DNA, 14 bp, Homo sapiens
gtggggcagtgctt

SEQ ID NO: 2765013 - DNA, 23 bp, Homo sapiens
gtggggcagtgcttggcccagga

SEQ ID NO: 2765014 - DNA, 15 bp, Homo sapiens
gtgggtggggcagtg

SEQ ID NO: 2765015 - DNA, 15 bp, Homo sapiens
gttattttacttttt

SEQ ID NO: 2765016 - DNA, 17 bp, Homo sapiens
gtttagatgaatgtcag

SEQ ID NO: 2765017 - DNA, 22 bp, Homo sapiens
gtttatttggaaaggaatgcaa

SEQ ID NO: 2765018 - DNA, 11 bp, Homo sapiens
gtttggccaga

SEQ ID NO: 2765019 - DNA, 12 bp, Homo sapiens
gtttggccagaa

SEQ ID NO: 2765020 - DNA, 18 bp, Homo sapiens
gtttggccagaagtcaag

SEQ ID NO: 2765021 - DNA, 14 bp, Homo sapiens
gttttacagtgttt

SEQ ID NO: 2765022 - DNA, 17 bp, Homo sapiens
gttttgaagattctatg

SEQ ID NO: 2765023 - DNA, 16 bp, Homo sapiens
gttttgtgtactttta

SEQ ID NO: 2765024 - DNA, 17 bp, Homo sapiens
gttttgtgtacttttaa

SEQ ID NO: 2765025 - DNA, 17 bp, Homo sapiens
gtttttattaaaaggaa

SEQ ID NO: 2765026 - DNA, 15 bp, Homo sapiens
gtttttattattaac

SEQ ID NO: 2765027 - DNA, 21 bp, Homo sapiens
taaaaggaagcttacatgcct

SEQ ID NO: 2765028 - DNA, 19 bp, Homo sapiens
taaacatgctgtacatact

SEQ ID NO: 2765029 - DNA, 21 bp, Homo sapiens
taaacatgctgtacatacttt

SEQ ID NO: 2765030 - DNA, 23 bp, Homo sapiens
taaacatgctgtacatacttttt

SEQ ID NO: 2765031 - DNA, 21 bp, Homo sapiens
taaatagatgacattgactat

SEQ ID NO: 2765032 - DNA, 22 bp, Homo sapiens
taaatatcccttggacatttta

SEQ ID NO: 2765033 - DNA, 18 bp, Homo sapiens
taacaaaggatacttatt

SEQ ID NO: 2765034 - DNA, 20 bp, Homo sapiens
taacagcaacacaaagcttt

SEQ ID NO: 2765035 - DNA, 15 bp, Homo sapiens
taataaaaaggtgac

SEQ ID NO: 2765036 - DNA, 11 bp, Homo sapiens
taatcttttat

SEQ ID NO: 2765037 - DNA, 19 bp, Homo sapiens
taatgcttgctgctgattt

SEQ ID NO: 2765038 - DNA, 18 bp, Homo sapiens
taatggtagttttacagt

SEQ ID NO: 2765039 - DNA, 18 bp, Homo sapiens
taattcctgtttttatta

SEQ ID NO: 2765040 - DNA, 14 bp, Homo sapiens
tacatactttttgg

SEQ ID NO: 2765041 - DNA, 21 bp, Homo sapiens
tactaaaagttttgagaaatt

SEQ ID NO: 2765042 - DNA, 13 bp, Homo sapiens
tactattaaacat

SEQ ID NO: 2765043 - DNA, 14 bp, Homo sapiens
tactgaacagtaac

SEQ ID NO: 2765044 - DNA, 23 bp, Homo sapiens
tactgggaaagggattttcagcc

SEQ ID NO: 2765045 - DNA, 21 bp, Homo sapiens
tacttatttaaatagatgaca

SEQ ID NO: 2765046 - DNA, 23 bp, Homo sapiens
tagaccctcatgctgccaatatc

SEQ ID NO: 2765047 - DNA, 18 bp, Homo sapiens
tagatgacattgactatt

SEQ ID NO: 2765048 - DNA, 20 bp, Homo sapiens
tagcagccctcaattgtgaa

SEQ ID NO: 2765049 - DNA, 18 bp, Homo sapiens
tagcatgtcctaatgctt

SEQ ID NO: 2765050 - DNA, 22 bp, Homo sapiens
taggggtctgtcttttaaactc

SEQ ID NO: 2765051 - DNA, 22 bp, Homo sapiens
tagtagaggtacacttgtgaat

SEQ ID NO: 2765052 - DNA, 14 bp, Homo sapiens
tagtcattcttccc

SEQ ID NO: 2765053 - DNA, 20 bp, Homo sapiens
tataacaaaggatacttatt

SEQ ID NO: 2765054 - DNA, 12 bp, Homo sapiens
tataacttttta

SEQ ID NO: 2765055 - DNA, 20 bp, Homo sapiens
tataactttttatattctca

SEQ ID NO: 2765056 - DNA, 10 bp, Homo sapiens
tatagatgtt

SEQ ID NO: 2765057 - DNA, 20 bp, Homo sapiens
tatagatgttgctaacagca

SEQ ID NO: 2765058 - DNA, 19 bp, Homo sapiens
tatattctcagcagagtgc

SEQ ID NO: 2765059 - DNA, 14 bp, Homo sapiens
tatccaatctgtga

SEQ ID NO: 2765060 - DNA, 19 bp, Homo sapiens
tatcccttggacattttat

SEQ ID NO: 2765061 - DNA, 18 bp, Homo sapiens
tatcctaataaaaaggtg

SEQ ID NO: 2765062 - DNA, 14 bp, Homo sapiens
tatgttaatatttt

SEQ ID NO: 2765063 - DNA, 15 bp, Homo sapiens
tatgttttatatagc

SEQ ID NO: 2765064 - DNA, 17 bp, Homo sapiens
tattaaacatgctgtac

SEQ ID NO: 2765065 - DNA, 13 bp, Homo sapiens
tattaacaaaaca

SEQ ID NO: 2765066 - DNA, 23 bp, Homo sapiens
tattatattcattctttttgaaa

SEQ ID NO: 2765067 - DNA, 18 bp, Homo sapiens
tattcattctttttgaaa

SEQ ID NO: 2765068 - DNA, 16 bp, Homo sapiens
tattgaaatgatttca

SEQ ID NO: 2765069 - DNA, 16 bp, Homo sapiens
tattgaagcagagtgg

SEQ ID NO: 2765070 - DNA, 20 bp, Homo sapiens
tatttattgaaatgatttca

SEQ ID NO: 2765071 - DNA, 23 bp, Homo sapiens
tatttctgaggagcctgcaacat

SEQ ID NO: 2765072 - DNA, 18 bp, Homo sapiens
tatttgaaacactggttt

SEQ ID NO: 2765073 - DNA, 14 bp, Homo sapiens
tattttactttttg

SEQ ID NO: 2765074 - DNA, 13 bp, Homo sapiens
tcaaactaacagg

SEQ ID NO: 2765075 - DNA, 16 bp, Homo sapiens
tcacactgtcttctga

SEQ ID NO: 2765076 - DNA, 17 bp, Homo sapiens
tcactggtactctgcca

SEQ ID NO: 2765077 - DNA, 11 bp, Homo sapiens
tcagcagagtg

SEQ ID NO: 2765078 - DNA, 12 bp, Homo sapiens
tcagccctcaga

SEQ ID NO: 2765079 - DNA, 13 bp, Homo sapiens
tcagccctcagaa

SEQ ID NO: 2765080 - DNA, 16 bp, Homo sapiens
tcagtttatctgttca

SEQ ID NO: 2765081 - DNA, 15 bp, Homo sapiens
tcagtttgcagagta

SEQ ID NO: 2765082 - DNA, 17 bp, Homo sapiens
tcatgctgccaatatcc

SEQ ID NO: 2765083 - DNA, 23 bp, Homo sapiens
tcatgctgccaatatcctaataa

SEQ ID NO: 2765084 - DNA, 12 bp, Homo sapiens
tcattactaaaa

SEQ ID NO: 2765085 - DNA, 22 bp, Homo sapiens
tccaatctgtgatgacattccc

SEQ ID NO: 2765086 - DNA, 21 bp, Homo sapiens
tccacatttgttttgccaatt

SEQ ID NO: 2765087 - DNA, 15 bp, Homo sapiens
tccagtcattatgtt

SEQ ID NO: 2765088 - DNA, 23 bp, Homo sapiens
tccagtcattatgttaatatttc

SEQ ID NO: 2765089 - DNA, 12 bp, Homo sapiens
tcctaataaaaa

SEQ ID NO: 2765090 - DNA, 15 bp, Homo sapiens
tcctaataaaaaggt

SEQ ID NO: 2765091 - DNA, 18 bp, Homo sapiens
tcctaataaaaaggtgac

SEQ ID NO: 2765092 - DNA, 17 bp, Homo sapiens
tcctagtcattcttccc

SEQ ID NO: 2765093 - DNA, 12 bp, Homo sapiens
tcctattatatt

SEQ ID NO: 2765094 - DNA, 16 bp, Homo sapiens
tcctccacatttgttt

SEQ ID NO: 2765095 - DNA, 15 bp, Homo sapiens
tcctgtttttattat

SEQ ID NO: 2765096 - DNA, 22 bp, Homo sapiens
tctataacaaaggatacttatt

SEQ ID NO: 2765097 - DNA, 23 bp, Homo sapiens
tctataacaaaggatacttattt

SEQ ID NO: 2765098 - DNA, 16 bp, Homo sapiens
tctatgttaatatttt

SEQ ID NO: 2765099 - DNA, 14 bp, Homo sapiens
tctatttatttatt

SEQ ID NO: 2765100 - DNA, 15 bp, Homo sapiens
tctatttatttgtga

SEQ ID NO: 2765101 - DNA, 15 bp, Homo sapiens
tctcctctctctgta

SEQ ID NO: 2765102 - DNA, 18 bp, Homo sapiens
tctctcatctgttacaca

SEQ ID NO: 2765103 - DNA, 23 bp, Homo sapiens
tctgagtgcaaacttcagagttc

SEQ ID NO: 2765104 - DNA, 19 bp, Homo sapiens
tctgtaataaactcatttc

SEQ ID NO: 2765105 - DNA, 23 bp, Homo sapiens
tctgtaataaactcatttctagc

SEQ ID NO: 2765106 - DNA, 12 bp, Homo sapiens
tctgtatgtgtt

SEQ ID NO: 2765107 - DNA, 19 bp, Homo sapiens
tctgttttgtgtactttta

SEQ ID NO: 2765108 - DNA, 15 bp, Homo sapiens
tcttacatctgaaat

SEQ ID NO: 2765109 - DNA, 13 bp, Homo sapiens
tcttctatataat

SEQ ID NO: 2765110 - DNA, 11 bp, Homo sapiens
tcttttaaact

SEQ ID NO: 2765111 - DNA, 17 bp, Homo sapiens
tgaagcagagtggcagt

SEQ ID NO: 2765112 - DNA, 18 bp, Homo sapiens
tgaatgcaggttttatca

SEQ ID NO: 2765113 - DNA, 13 bp, Homo sapiens
tgacattccctgc

SEQ ID NO: 2765114 - DNA, 16 bp, Homo sapiens
tgacattgactatttt

SEQ ID NO: 2765115 - DNA, 15 bp, Homo sapiens
tgactcttccctcaa

SEQ ID NO: 2765116 - DNA, 18 bp, Homo sapiens
tgatgacattccctgcta

SEQ ID NO: 2765117 - DNA, 17 bp, Homo sapiens
tgatttagcaggaagct

SEQ ID NO: 2765118 - DNA, 16 bp, Homo sapiens
tgcaaacttcagagtt

SEQ ID NO: 2765119 - DNA, 12 bp, Homo sapiens
tgcaaagatgaa

SEQ ID NO: 2765120 - DNA, 13 bp, Homo sapiens
tgcacatctgttt

SEQ ID NO: 2765121 - DNA, 18 bp, Homo sapiens
tgcacattaaatgactct

SEQ ID NO: 2765122 - DNA, 17 bp, Homo sapiens
tgcacgcacactgtctg

SEQ ID NO: 2765123 - DNA, 14 bp, Homo sapiens
tgccaatatcctaa

SEQ ID NO: 2765124 - DNA, 22 bp, Homo sapiens
tgcctaatatgatgactgtttt

SEQ ID NO: 2765125 - DNA, 21 bp, Homo sapiens
tgctaacagcaacacaaagct

SEQ ID NO: 2765126 - DNA, 16 bp, Homo sapiens
tgctcagtagtcagac

SEQ ID NO: 2765127 - DNA, 21 bp, Homo sapiens
aaacacattaaaggtactttg

SEQ ID NO: 2765128 - DNA, 16 bp, Homo sapiens
aaacagtctcccttcc

SEQ ID NO: 2765129 - DNA, 20 bp, Homo sapiens
aaacatgctgtacatacttt

SEQ ID NO: 2765130 - DNA, 21 bp, Homo sapiens
aaacatgctgtacatactttt

SEQ ID NO: 2765131 - DNA, 13 bp, Homo sapiens
aaactctgagtgc

SEQ ID NO: 2765132 - DNA, 14 bp, Homo sapiens
aaagcttttgcata

SEQ ID NO: 2765133 - DNA, 22 bp, Homo sapiens
aaaggaatgcaaagatgaaggt

SEQ ID NO: 2765134 - DNA, 12 bp, Homo sapiens
aaagtgcccagc

SEQ ID NO: 2765135 - DNA, 14 bp, Homo sapiens
aaatagatgacatt

SEQ ID NO: 2765136 - DNA, 23 bp, Homo sapiens
aaatatcccttggacattttatg

SEQ ID NO: 2765137 - DNA, 21 bp, Homo sapiens
aaatattggttgggatgactt

SEQ ID NO: 2765138 - DNA, 15 bp, Homo sapiens
aaatgatttcacagt

SEQ ID NO: 2765139 - DNA, 19 bp, Homo sapiens
aacaaaggatacttattta

SEQ ID NO: 2765140 - DNA, 21 bp, Homo sapiens
aacactctataacaaaggata

SEQ ID NO: 2765141 - DNA, 18 bp, Homo sapiens
aacagcaacacaaagctt

SEQ ID NO: 2765142 - DNA, 18 bp, Homo sapiens
aacaggcttagtgatgta

SEQ ID NO: 2765143 - DNA, 22 bp, Homo sapiens
aacagtaacatagctgtgattt

SEQ ID NO: 2765144 - DNA, 18 bp, Homo sapiens
aacatgctgtacatactt

SEQ ID NO: 2765145 - DNA, 21 bp, Homo sapiens
aacatgctgtacatacttttt

SEQ ID NO: 2765146 - DNA, 22 bp, Homo sapiens
aacatttatttgagtggagtta

SEQ ID NO: 2765147 - DNA, 18 bp, Homo sapiens
aactaacaggcttagtga

SEQ ID NO: 2765148 - DNA, 18 bp, Homo sapiens
aactctgagtgcaaactt

SEQ ID NO: 2765149 - DNA, 18 bp, Homo sapiens
aactgaagttctatttat

SEQ ID NO: 2765150 - DNA, 23 bp, Homo sapiens
aagactttggttattttactttt

SEQ ID NO: 2765151 - DNA, 17 bp, Homo sapiens
aagagggtgggtgggta

SEQ ID NO: 2765152 - DNA, 11 bp, Homo sapiens
aagattctatg

SEQ ID NO: 2765153 - DNA, 16 bp, Homo sapiens
aagggccctttttcaa

SEQ ID NO: 2765154 - DNA, 14 bp, Homo sapiens
aaggtagaatgttt

SEQ ID NO: 2765155 - DNA, 12 bp, Homo sapiens
aaggtgcatctg

SEQ ID NO: 2765156 - DNA, 20 bp, Homo sapiens
aagtcccctctcctccacat

SEQ ID NO: 2765157 - DNA, 22 bp, Homo sapiens
aatagcagccctcaattgtgaa

SEQ ID NO: 2765158 - DNA, 20 bp, Homo sapiens
aatagcatgtcctaatgctt

SEQ ID NO: 2765159 - DNA, 20 bp, Homo sapiens
aatatccaattgctgcttgt

SEQ ID NO: 2765160 - DNA, 21 bp, Homo sapiens
aatatcccttggacattttat

SEQ ID NO: 2765161 - DNA, 21 bp, Homo sapiens
aatatcctaataaaaaggtga

SEQ ID NO: 2765162 - DNA, 21 bp, Homo sapiens
aatattggttgggatgacttg

SEQ ID NO: 2765163 - DNA, 21 bp, Homo sapiens
aatattttaggtgtaaaataa

SEQ ID NO: 2765164 - DNA, 14 bp, Homo sapiens
aatgagcttaagaa

SEQ ID NO: 2765165 - DNA, 20 bp, Homo sapiens
aatgcttgctgctgatttaa

SEQ ID NO: 2765166 - DNA, 19 bp, Homo sapiens
aatgtcagttgttatttat

SEQ ID NO: 2765167 - DNA, 22 bp, Homo sapiens
aatgttcactggtactctgcca

SEQ ID NO: 2765168 - DNA, 21 bp, Homo sapiens
aattaatgtcagtatttcaac

SEQ ID NO: 2765169 - DNA, 20 bp, Homo sapiens
aattatggttagtagaggta

SEQ ID NO: 2765170 - DNA, 19 bp, Homo sapiens
aattcctgtttttattatt

SEQ ID NO: 2765171 - DNA, 23 bp, Homo sapiens
aattgattgggcacatcatttca

SEQ ID NO: 2765172 - DNA, 15 bp, Homo sapiens
aatttactttaaact

SEQ ID NO: 2765173 - DNA, 21 bp, Homo sapiens
acaaaggatacttatttaaat

SEQ ID NO: 2765174 - DNA, 23 bp, Homo sapiens
acaaaggatacttatttaaatag

SEQ ID NO: 2765175 - DNA, 24 bp, Homo sapiens
acaaaggatacttatttaaataga

SEQ ID NO: 2765176 - DNA, 18 bp, Homo sapiens
acacaaagcttttgcata

SEQ ID NO: 2765177 - DNA, 14 bp, Homo sapiens
acacacctaactta

SEQ ID NO: 2765178 - DNA, 18 bp, Homo sapiens
acacatgctgaacatcac

SEQ ID NO: 2765179 - DNA, 13 bp, Homo sapiens
acacttgtgaata

SEQ ID NO: 2765180 - DNA, 12 bp, Homo sapiens
acagattgaatt

SEQ ID NO: 2765181 - DNA, 19 bp, Homo sapiens
acaggcttagtgatgtaat

SEQ ID NO: 2765182 - DNA, 20 bp, Homo sapiens
acaggcttagtgatgtaatt

SEQ ID NO: 2765183 - DNA, 17 bp, Homo sapiens
acatactttttgggttt

SEQ ID NO: 2765184 - DNA, 14 bp, Homo sapiens
acatgcctaccaat

SEQ ID NO: 2765185 - DNA, 15 bp, Homo sapiens
acattaaatgactct

SEQ ID NO: 2765186 - DNA, 21 bp, Homo sapiens
acattaaatgactcttccctc

SEQ ID NO: 2765187 - DNA, 15 bp, Homo sapiens
acattaggttgtgaa

SEQ ID NO: 2765188 - DNA, 17 bp, Homo sapiens
accaagaattgattggg

SEQ ID NO: 2765189 - DNA, 22 bp, Homo sapiens
acccagtgttttaggagcatga

SEQ ID NO: 2765190 - DNA, 20 bp, Homo sapiens
accctcagatgcacatgagc

SEQ ID NO: 2765191 - DNA, 14 bp, Homo sapiens
accctcatgctgcc

SEQ ID NO: 2765192 - DNA, 17 bp, Homo sapiens
acgcccttggccatggg

SEQ ID NO: 2765193 - DNA, 14 bp, Homo sapiens
actaaaatgttcta

SEQ ID NO: 2765194 - DNA, 17 bp, Homo sapiens
actaacaggcttagtga

SEQ ID NO: 2765195 - DNA, 18 bp, Homo sapiens
actacattaggttgtgaa

SEQ ID NO: 2765196 - DNA, 20 bp, Homo sapiens
actatgtttttgttcagttt

SEQ ID NO: 2765197 - DNA, 22 bp, Homo sapiens
actctgagtgcaaacttcagag

SEQ ID NO: 2765198 - DNA, 16 bp, Homo sapiens
actctgccactttatt

SEQ ID NO: 2765199 - DNA, 21 bp, Homo sapiens
actgaacagtaacatagctgt

SEQ ID NO: 2765200 - DNA, 14 bp, Homo sapiens
actggttttaaata

SEQ ID NO: 2765201 - DNA, 16 bp, Homo sapiens
actgtcctattatatt

SEQ ID NO: 2765202 - DNA, 18 bp, Homo sapiens
actgtcctattatattca

SEQ ID NO: 2765203 - DNA, 13 bp, Homo sapiens
acttatttaaata

SEQ ID NO: 2765204 - DNA, 13 bp, Homo sapiens
acttttaagactt

SEQ ID NO: 2765205 - DNA, 12 bp, Homo sapiens
actttttatatt

SEQ ID NO: 2765206 - DNA, 22 bp, Homo sapiens
actttttatattctcagcagag

SEQ ID NO: 2765207 - DNA, 17 bp, Homo sapiens
agaagtcaaggcttaga

SEQ ID NO: 2765208 - DNA, 15 bp, Homo sapiens
agaatgttttcaaat

SEQ ID NO: 2765209 - DNA, 22 bp, Homo sapiens
agaattgattgggcacatcatt

SEQ ID NO: 2765210 - DNA, 23 bp, Homo sapiens
agaattgattgggcacatcattt

SEQ ID NO: 2765211 - DNA, 14 bp, Homo sapiens
agacagttgggttt

SEQ ID NO: 2765212 - DNA, 18 bp, Homo sapiens
agaccctcatgctgccaa

SEQ ID NO: 2765213 - DNA, 16 bp, Homo sapiens
agaggtacacttgtga

SEQ ID NO: 2765214 - DNA, 17 bp, Homo sapiens
agaggtacacttgtgaa

SEQ ID NO: 2765215 - DNA, 14 bp, Homo sapiens
agatgaaggtctgt

SEQ ID NO: 2765216 - DNA, 13 bp, Homo sapiens
agatgcacatgag

SEQ ID NO: 2765217 - DNA, 20 bp, Homo sapiens
agatgtagacagttgggttt

SEQ ID NO: 2765218 - DNA, 21 bp, Homo sapiens
agattctatgttaatatttta

SEQ ID NO: 2765219 - DNA, 18 bp, Homo sapiens
agcaacacaaagcttttg

SEQ ID NO: 2765220 - DNA, 10 bp, Homo sapiens
agcagagtgc

SEQ ID NO: 2765221 - DNA, 20 bp, Homo sapiens
agcaggaagctgtgagagca

SEQ ID NO: 2765222 - DNA, 23 bp, Homo sapiens
agcagtttggtttctagcatgaa

SEQ ID NO: 2765223 - DNA, 15 bp, Homo sapiens
agcatgaagacagag

SEQ ID NO: 2765224 - DNA, 23 bp, Homo sapiens
agcatgtcctaatgcttgctgct

SEQ ID NO: 2765225 - DNA, 17 bp, Homo sapiens
agccctcaattgtgaaa

SEQ ID NO: 2765226 - DNA, 18 bp, Homo sapiens
agccctgtctcctctctc

SEQ ID NO: 2765227 - DNA, 20 bp, Homo sapiens
agcttaagaaatttgtggaa

SEQ ID NO: 2765228 - DNA, 23 bp, Homo sapiens
aggaaagcaaatcagtttggttg

SEQ ID NO: 2765229 - DNA, 15 bp, Homo sapiens
aggaatgcaaagatg

SEQ ID NO: 2765230 - DNA, 13 bp, Homo sapiens
aggagtttggcca

SEQ ID NO: 2765231 - DNA, 14 bp, Homo sapiens
aggagtttggccag

SEQ ID NO: 2765232 - DNA, 13 bp, Homo sapiens
aggatacttattt

SEQ ID NO: 2765233 - DNA, 14 bp, Homo sapiens
aggcaggggaatgt

SEQ ID NO: 2765234 - DNA, 19 bp, Homo sapiens
aggcaggggaatgtatgtg

SEQ ID NO: 2765235 - DNA, 18 bp, Homo sapiens
aggcttagtgatgtaatt

SEQ ID NO: 2765236 - DNA, 14 bp, Homo sapiens
agggtttaaagatg

SEQ ID NO: 2765237 - DNA, 16 bp, Homo sapiens
aggtacacttgtgaat

SEQ ID NO: 2765238 - DNA, 17 bp, Homo sapiens
aggtagaatgttttcaa

SEQ ID NO: 2765239 - DNA, 22 bp, Homo sapiens
aggtgggatatcacttccatga

SEQ ID NO: 2765240 - DNA, 16 bp, Homo sapiens
aggtttttttttctca

SEQ ID NO: 2765241 - DNA, 16 bp, Homo sapiens
agtactaacatttatt

SEQ ID NO: 2765242 - DNA, 21 bp, Homo sapiens
agtagaggtacacttgtgaat

SEQ ID NO: 2765243 - DNA, 18 bp, Homo sapiens
agtcattatgttaatatt

SEQ ID NO: 2765244 - DNA, 13 bp, Homo sapiens
agtcattctttaa

SEQ ID NO: 2765245 - DNA, 22 bp, Homo sapiens
agtgctacacacctaacttatg

SEQ ID NO: 2765246 - DNA, 19 bp, Homo sapiens
agtgcttggcccaggagtt

SEQ ID NO: 2765247 - DNA, 20 bp, Homo sapiens
agtgcttggcccaggagttt

SEQ ID NO: 2765248 - DNA, 15 bp, Homo sapiens
agtggagttactgaa

SEQ ID NO: 2765249 - DNA, 16 bp, Homo sapiens
agttattgaagcagag

SEQ ID NO: 2765250 - DNA, 22 bp, Homo sapiens
agttcttgccttggctgcagtt

SEQ ID NO: 2765251 - DNA, 17 bp, Homo sapiens
agttgttatttattgaa

SEQ ID NO: 2765252 - DNA, 11 bp, Homo sapiens
agtttggccag

SEQ ID NO: 2765253 - DNA, 14 bp, Homo sapiens
agtttggccagaag

SEQ ID NO: 2765254 - DNA, 17 bp, Homo sapiens
agttttgaagattctat

SEQ ID NO: 2765255 - DNA, 20 bp, Homo sapiens
ataacaaaggatacttattt

SEQ ID NO: 2765256 - DNA, 14 bp, Homo sapiens
tttgtgtactttta

SEQ ID NO: 2765257 - DNA, 17 bp, Homo sapiens
tttgtgtacttttaaga

SEQ ID NO: 2765258 - DNA, 12 bp, Homo sapiens
tttgttccctgt

SEQ ID NO: 2765259 - DNA, 17 bp, Homo sapiens
ttttaagactttggtta

SEQ ID NO: 2765260 - DNA, 15 bp, Homo sapiens
ttttatattctcagc

SEQ ID NO: 2765261 - DNA, 16 bp, Homo sapiens
ttttcaataactggaa

SEQ ID NO: 2765262 - DNA, 21 bp, Homo sapiens
ttttccttcaagaatgcagta

SEQ ID NO: 2765263 - DNA, 14 bp, Homo sapiens
ttttggaaaagaat

SEQ ID NO: 2765264 - DNA, 20 bp, Homo sapiens
ttttgtttttattaaaagga

SEQ ID NO: 2765265 - DNA, 19 bp, Homo sapiens
aaacactggttttaaatat

SEQ ID NO: 2765266 - DNA, 15 bp, Homo sapiens
aaacatgctgtacat

SEQ ID NO: 2765267 - DNA, 16 bp, Homo sapiens
aaactcatttctagca

SEQ ID NO: 2765268 - DNA, 15 bp, Homo sapiens
aaactctgagtgcaa

SEQ ID NO: 2765269 - DNA, 22 bp, Homo sapiens
aaataaggaatgatataaggtt

SEQ ID NO: 2765270 - DNA, 21 bp, Homo sapiens
aaatagatgacattgactatt

SEQ ID NO: 2765271 - DNA, 22 bp, Homo sapiens
aaatagcagccctcaattgtga

SEQ ID NO: 2765272 - DNA, 17 bp, Homo sapiens
aaatttactttaaacta

SEQ ID NO: 2765273 - DNA, 20 bp, Homo sapiens
aaatttactttaaactacat

SEQ ID NO: 2765274 - DNA, 17 bp, Homo sapiens
aacagcaacacaaagct

SEQ ID NO: 2765275 - DNA, 15 bp, Homo sapiens
aacagtaacatagct

SEQ ID NO: 2765276 - DNA, 20 bp, Homo sapiens
aactacattaggttgtgaat

SEQ ID NO: 2765277 - DNA, 20 bp, Homo sapiens
aactgggatgaggtgactat

SEQ ID NO: 2765278 - DNA, 14 bp, Homo sapiens
aacttcagagttct

SEQ ID NO: 2765279 - DNA, 21 bp, Homo sapiens
aactttaagaactaaaatgtt

SEQ ID NO: 2765280 - DNA, 24 bp, Homo sapiens
aagaatgcagtactaacatttatt

SEQ ID NO: 2765281 - DNA, 23 bp, Homo sapiens
aagaattgattgggcacatcatt

SEQ ID NO: 2765282 - DNA, 17 bp, Homo sapiens
aagaccctctcaaacta

SEQ ID NO: 2765283 - DNA, 15 bp, Homo sapiens
aagactttggttatt

SEQ ID NO: 2765284 - DNA, 19 bp, Homo sapiens
aagattctatgttaatatt

SEQ ID NO: 2765285 - DNA, 21 bp, Homo sapiens
aagattctatgttaatatttt

SEQ ID NO: 2765286 - DNA, 16 bp, Homo sapiens
aaggaatgcaaagatg

SEQ ID NO: 2765287 - DNA, 18 bp, Homo sapiens
aaggcaggggaatgtatg

SEQ ID NO: 2765288 - DNA, 15 bp, Homo sapiens
aagggattttcagcc

SEQ ID NO: 2765289 - DNA, 22 bp, Homo sapiens
aagggccctttttcaataactg

SEQ ID NO: 2765290 - DNA, 13 bp, Homo sapiens
aaggtagaatgtt

SEQ ID NO: 2765291 - DNA, 19 bp, Homo sapiens
aaggtctgttttgtgtact

SEQ ID NO: 2765292 - DNA, 20 bp, Homo sapiens
aaggtctgttttgtgtactt

SEQ ID NO: 2765293 - DNA, 23 bp, Homo sapiens
aaggtctgttttgtgtactttta

SEQ ID NO: 2765294 - DNA, 17 bp, Homo sapiens
aagtcttctatttattt

SEQ ID NO: 2765295 - DNA, 13 bp, Homo sapiens
aagttttgagaaa

SEQ ID NO: 2765296 - DNA, 13 bp, Homo sapiens
aataaaaaggtga

SEQ ID NO: 2765297 - DNA, 17 bp, Homo sapiens
aataaaattttagttga

SEQ ID NO: 2765298 - DNA, 21 bp, Homo sapiens
aatagatgacattgactattt

SEQ ID NO: 2765299 - DNA, 21 bp, Homo sapiens
aatagcaaggctgtgcatcta

SEQ ID NO: 2765300 - DNA, 22 bp, Homo sapiens
aatatcccttggacattttatg

SEQ ID NO: 2765301 - DNA, 12 bp, Homo sapiens
aatatcctaata

SEQ ID NO: 2765302 - DNA, 15 bp, Homo sapiens
aatatcctaataaaa

SEQ ID NO: 2765303 - DNA, 19 bp, Homo sapiens
aatatcctaataaaaaggt

SEQ ID NO: 2765304 - DNA, 17 bp, Homo sapiens
aatatgatgactgtttt

SEQ ID NO: 2765305 - DNA, 15 bp, Homo sapiens
aatattggttgggat

SEQ ID NO: 2765306 - DNA, 23 bp, Homo sapiens
aatattttgacttgttgagggta

SEQ ID NO: 2765307 - DNA, 19 bp, Homo sapiens
aatcacactgtcttctgat

SEQ ID NO: 2765308 - DNA, 16 bp, Homo sapiens
aatctggattcatatt

SEQ ID NO: 2765309 - DNA, 17 bp, Homo sapiens
aatctggattcatattt

SEQ ID NO: 2765310 - DNA, 22 bp, Homo sapiens
aatgcttgctgctgatttaaac

SEQ ID NO: 2765311 - DNA, 20 bp, Homo sapiens
aatgtcagttgttatttatt

SEQ ID NO: 2765312 - DNA, 16 bp, Homo sapiens
aatttactttaaacta

SEQ ID NO: 2765313 - DNA, 14 bp, Homo sapiens
aatttgcacattaa

SEQ ID NO: 2765314 - DNA, 16 bp, Homo sapiens
aatttgcacattaaat

SEQ ID NO: 2765315 - DNA, 23 bp, Homo sapiens
aatttgcctaatatgatgactgt

SEQ ID NO: 2765316 - DNA, 22 bp, Homo sapiens
acaaagcttttgcatattgcat

SEQ ID NO: 2765317 - DNA, 13 bp, Homo sapiens
acacaaagctttt

SEQ ID NO: 2765318 - DNA, 12 bp, Homo sapiens
acacttgtgaat

SEQ ID NO: 2765319 - DNA, 20 bp, Homo sapiens
acagcaacacaaagcttttg

SEQ ID NO: 2765320 - DNA, 14 bp, Homo sapiens
acaggcttagtgat

SEQ ID NO: 2765321 - DNA, 21 bp, Homo sapiens
acagtaacatagctgtgattt

SEQ ID NO: 2765322 - DNA, 14 bp, Homo sapiens
gccaatatcctaat

SEQ ID NO: 2765323 - DNA, 19 bp, Homo sapiens
gccaatatcctaataaaaa

SEQ ID NO: 2765324 - DNA, 20 bp, Homo sapiens
gccaatatcctaataaaaag

SEQ ID NO: 2765325 - DNA, 22 bp, Homo sapiens
gccaatatcctaataaaaaggt

SEQ ID NO: 2765326 - DNA, 14 bp, Homo sapiens
gccactttatttct

SEQ ID NO: 2765327 - DNA, 16 bp, Homo sapiens
gcccaggagtttggcc

SEQ ID NO: 2765328 - DNA, 17 bp, Homo sapiens
gcccaggagtttggcca

SEQ ID NO: 2765329 - DNA, 19 bp, Homo sapiens
gcccaggagtttggccaga

SEQ ID NO: 2765330 - DNA, 18 bp, Homo sapiens
gccctttttcaataactg

SEQ ID NO: 2765331 - DNA, 15 bp, Homo sapiens
gcctaccaatattta

SEQ ID NO: 2765332 - DNA, 19 bp, Homo sapiens
gcctttttataacttttta

SEQ ID NO: 2765333 - DNA, 19 bp, Homo sapiens
gcgtcctgtcggagccctg

SEQ ID NO: 2765334 - DNA, 13 bp, Homo sapiens
gctacacacctaa

SEQ ID NO: 2765335 - DNA, 19 bp, Homo sapiens
gctccaccttgcagctctc

SEQ ID NO: 2765336 - DNA, 12 bp, Homo sapiens
gctgaacatcac

SEQ ID NO: 2765337 - DNA, 14 bp, Homo sapiens
gctgccaatatcct

SEQ ID NO: 2765338 - DNA, 18 bp, Homo sapiens
gctgccaatatcctaata

SEQ ID NO: 2765339 - DNA, 21 bp, Homo sapiens
gctgccaatatcctaataaaa

SEQ ID NO: 2765340 - DNA, 14 bp, Homo sapiens
gctgtacatacttt

SEQ ID NO: 2765341 - DNA, 23 bp, Homo sapiens
gcttggcccaggagtttggccag

SEQ ID NO: 2765342 - DNA, 22 bp, Homo sapiens
gctttaccaattgaagtaaaat

SEQ ID NO: 2765343 - DNA, 13 bp, Homo sapiens
gcttttgcatatt

SEQ ID NO: 2765344 - DNA, 10 bp, Homo sapiens
ggaaaagaat

SEQ ID NO: 2765345 - DNA, 17 bp, Homo sapiens
ggaaaggaatgcaaaga

SEQ ID NO: 2765346 - DNA, 19 bp, Homo sapiens
ggagaagtcttctatttat

SEQ ID NO: 2765347 - DNA, 18 bp, Homo sapiens
ggagccctgtctcctctc

SEQ ID NO: 2765348 - DNA, 14 bp, Homo sapiens
ggagtttggccaga

SEQ ID NO: 2765349 - DNA, 19 bp, Homo sapiens
ggattgaaggatgctgtct

SEQ ID NO: 2765350 - DNA, 23 bp, Homo sapiens
ggattgtgcctaatgtgtttgag

SEQ ID NO: 2765351 - DNA, 21 bp, Homo sapiens
tgactattctgagatgactat

SEQ ID NO: 2765352 - DNA, 23 bp, Homo sapiens
tgactatttttgtttttattaaa

SEQ ID NO: 2765353 - DNA, 11 bp, Homo sapiens
tgactgttttt

SEQ ID NO: 2765354 - DNA, 21 bp, Homo sapiens
tgagagcagtttggtttctag

SEQ ID NO: 2765355 - DNA, 23 bp, Homo sapiens
tgagcatcgcttaggagaagtct

SEQ ID NO: 2765356 - DNA, 18 bp, Homo sapiens
tgagtgcaaacttcagag

SEQ ID NO: 2765357 - DNA, 13 bp, Homo sapiens
tgatgactgtttt

SEQ ID NO: 2765358 - DNA, 17 bp, Homo sapiens
tgattgggcacatcatt

SEQ ID NO: 2765359 - DNA, 23 bp, Homo sapiens
tgattgggcacatcatttcaaga

SEQ ID NO: 2765360 - DNA, 15 bp, Homo sapiens
tgatttaaacacatt

SEQ ID NO: 2765361 - DNA, 16 bp, Homo sapiens
tgatttaaacacatta

SEQ ID NO: 2765362 - DNA, 18 bp, Homo sapiens
tgatttaaacacattaaa

SEQ ID NO: 2765363 - DNA, 20 bp, Homo sapiens
tgatttagcaggaagctgtg

SEQ ID NO: 2765364 - DNA, 16 bp, Homo sapiens
tgatttcacagtgtgt

SEQ ID NO: 2765365 - DNA, 23 bp, Homo sapiens
tgcaaagatgaaggtctgttttg

SEQ ID NO: 2765366 - DNA, 21 bp, Homo sapiens
tgcacactgtcctattatatt

SEQ ID NO: 2765367 - DNA, 13 bp, Homo sapiens
tgcacattaaatg

SEQ ID NO: 2765368 - DNA, 15 bp, Homo sapiens
tgcacattaaatgac

SEQ ID NO: 2765369 - DNA, 19 bp, Homo sapiens
tgcacgcacactgtctgcc

SEQ ID NO: 2765370 - DNA, 22 bp, Homo sapiens
tgcagctctccccttctctgta

SEQ ID NO: 2765371 - DNA, 18 bp, Homo sapiens
tgcatactattaaacatg

SEQ ID NO: 2765372 - DNA, 20 bp, Homo sapiens
tgcatactattaaacatgct

SEQ ID NO: 2765373 - DNA, 15 bp, Homo sapiens
tgcatattgcatact

SEQ ID NO: 2765374 - DNA, 16 bp, Homo sapiens
tgccaatatcctaata

SEQ ID NO: 2765375 - DNA, 17 bp, Homo sapiens
tgccaatatcctaataa

SEQ ID NO: 2765376 - DNA, 19 bp, Homo sapiens
tgccaatatcctaataaaa

SEQ ID NO: 2765377 - DNA, 21 bp, Homo sapiens
tgccaatatcctaataaaaag

SEQ ID NO: 2765378 - DNA, 13 bp, Homo sapiens
tgccaatttgcac

SEQ ID NO: 2765379 - DNA, 23 bp, Homo sapiens
tgcctaccaatatttaatctttt

SEQ ID NO: 2765380 - DNA, 17 bp, Homo sapiens
tgctgatttaaacacat

SEQ ID NO: 2765381 - DNA, 17 bp, Homo sapiens
tgctgccaatatcctaa

SEQ ID NO: 2765382 - DNA, 21 bp, Homo sapiens
tgctgccaatatcctaataaa

SEQ ID NO: 2765383 - DNA, 16 bp, Homo sapiens
tgcttggcccaggagt

SEQ ID NO: 2765384 - DNA, 21 bp, Homo sapiens
tgctttaccaattgaagtaaa

SEQ ID NO: 2765385 - DNA, 15 bp, Homo sapiens
tggaaaggaatgcaa

SEQ ID NO: 2765386 - DNA, 19 bp, Homo sapiens
tggaacactctataacaaa

SEQ ID NO: 2765387 - DNA, 22 bp, Homo sapiens
tggagttattgaagcagagtgg

SEQ ID NO: 2765388 - DNA, 19 bp, Homo sapiens
tggatctgtatgtgttcta

SEQ ID NO: 2765389 - DNA, 23 bp, Homo sapiens
tggattgtgcctaatgtgtttga

SEQ ID NO: 2765390 - DNA, 12 bp, Homo sapiens
tggcccaggagt

SEQ ID NO: 2765391 - DNA, 14 bp, Homo sapiens
tggcccaggagttt

SEQ ID NO: 2765392 - DNA, 22 bp, Homo sapiens
tggcccaggagtttggccagaa

SEQ ID NO: 2765393 - DNA, 16 bp, Homo sapiens
tggctaacttgggtta

SEQ ID NO: 2765394 - DNA, 20 bp, Homo sapiens
tgggcacatcatttcaagaa

SEQ ID NO: 2765395 - DNA, 20 bp, Homo sapiens
tggggcagtgcttggcccag

SEQ ID NO: 2765396 - DNA, 22 bp, Homo sapiens
tggggcagtgcttggcccagga

SEQ ID NO: 2765397 - DNA, 14 bp, Homo sapiens
tgggtatagatgtt

SEQ ID NO: 2765398 - DNA, 13 bp, Homo sapiens
tgggtttatttgg

SEQ ID NO: 2765399 - DNA, 15 bp, Homo sapiens
tggtatttgaaacac

SEQ ID NO: 2765400 - DNA, 14 bp, Homo sapiens
tggtcaacatttct

SEQ ID NO: 2765401 - DNA, 22 bp, Homo sapiens
tggtgatttagcaggaagctgt

SEQ ID NO: 2765402 - DNA, 18 bp, Homo sapiens
tggttattttactttttg

SEQ ID NO: 2765403 - DNA, 21 bp, Homo sapiens
tgtaactgtttagatgaatgt

SEQ ID NO: 2765404 - DNA, 15 bp, Homo sapiens
tgtacatactttttg

SEQ ID NO: 2765405 - DNA, 17 bp, Homo sapiens
tgtagacagttgggttt

SEQ ID NO: 2765406 - DNA, 15 bp, Homo sapiens
tgtcagtatttcaac

SEQ ID NO: 2765407 - DNA, 17 bp, Homo sapiens
tgtcagttgttatttat

SEQ ID NO: 2765408 - DNA, 18 bp, Homo sapiens
tgtcagttgttatttatt

SEQ ID NO: 2765409 - DNA, 22 bp, Homo sapiens
tgtcagttgttatttattgaaa

SEQ ID NO: 2765410 - DNA, 21 bp, Homo sapiens
tgtgaataaagagggtgggtg

SEQ ID NO: 2765411 - DNA, 14 bp, Homo sapiens
tgtgaatgcaggtt

SEQ ID NO: 2765412 - DNA, 15 bp, Homo sapiens
tgtgcacatctgttt

SEQ ID NO: 2765413 - DNA, 17 bp, Homo sapiens
tgtgcctaatgtgtttg

SEQ ID NO: 2765414 - DNA, 14 bp, Homo sapiens
tgtgcgtcctgtcg

SEQ ID NO: 2765415 - DNA, 22 bp, Homo sapiens
tgtggtcaacatttctcatgtt

SEQ ID NO: 2765416 - DNA, 12 bp, Homo sapiens
tgtgtactttta

SEQ ID NO: 2765417 - DNA, 15 bp, Homo sapiens
tgtgtacttttaaga

SEQ ID NO: 2765418 - DNA, 13 bp, Homo sapiens
tgttatttattga

SEQ ID NO: 2765419 - DNA, 17 bp, Homo sapiens
tgttatttattgaaatg

SEQ ID NO: 2765420 - DNA, 19 bp, Homo sapiens
tgttatttattgaaatgat

SEQ ID NO: 2765421 - DNA, 18 bp, Homo sapiens
tgtttctggcttagaaca

SEQ ID NO: 2765422 - DNA, 14 bp, Homo sapiens
tgttttaggagcat

SEQ ID NO: 2765423 - DNA, 21 bp, Homo sapiens
tgttttatatagcaagacatt

SEQ ID NO: 2765424 - DNA, 14 bp, Homo sapiens
tgttttcaaatgtt

SEQ ID NO: 2765425 - DNA, 17 bp, Homo sapiens
tgttttgccaatttgca

SEQ ID NO: 2765426 - DNA, 15 bp, Homo sapiens
tgtttttattattaa

SEQ ID NO: 2765427 - DNA, 23 bp, Homo sapiens
ttaaacatgctgtacatactttt

SEQ ID NO: 2765428 - DNA, 22 bp, Homo sapiens
ttaaactacattaggttgtgaa

SEQ ID NO: 2765429 - DNA, 21 bp, Homo sapiens
ttaaactctgagtgcaaactt

SEQ ID NO: 2765430 - DNA, 14 bp, Homo sapiens
ttaaatagatgaca

SEQ ID NO: 2765431 - DNA, 16 bp, Homo sapiens
ttaaatagatgacatt

SEQ ID NO: 2765432 - DNA, 16 bp, Homo sapiens
ttaagaactaaaatgt

SEQ ID NO: 2765433 - DNA, 20 bp, Homo sapiens
ttaagaactaaaatgttcta

SEQ ID NO: 2765434 - DNA, 13 bp, Homo sapiens
ttaagggtatgat

SEQ ID NO: 2765435 - DNA, 23 bp, Homo sapiens
ttaccaattgaagtaaaatgtgg

SEQ ID NO: 2765436 - DNA, 15 bp, Homo sapiens
ttactgaacagtaac

SEQ ID NO: 2765437 - DNA, 23 bp, Homo sapiens
ttactgaacagtaacatagctgt

SEQ ID NO: 2765438 - DNA, 22 bp, Homo sapiens
ttagtagaggtacacttgtgaa

SEQ ID NO: 2765439 - DNA, 23 bp, Homo sapiens
ttagtagaggtacacttgtgaat

SEQ ID NO: 2765440 - DNA, 14 bp, Homo sapiens
ttagtgatgtaatt

SEQ ID NO: 2765441 - DNA, 17 bp, Homo sapiens
ttataactttttatatt

SEQ ID NO: 2765442 - DNA, 18 bp, Homo sapiens
ttatattctcagcagagt

SEQ ID NO: 2765443 - DNA, 19 bp, Homo sapiens
ttatattctcagcagagtg

SEQ ID NO: 2765444 - DNA, 20 bp, Homo sapiens
ttatattctcagcagagtgc

SEQ ID NO: 2765445 - DNA, 13 bp, Homo sapiens
ttattgaagcaga

SEQ ID NO: 2765446 - DNA, 17 bp, Homo sapiens
ttattgaagcagagtgg

SEQ ID NO: 2765447 - DNA, 11 bp, Homo sapiens
ttatttattga

SEQ ID NO: 2765448 - DNA, 21 bp, Homo sapiens
ttatttctctcatctgttaca

SEQ ID NO: 2765449 - DNA, 13 bp, Homo sapiens
ttattttactttt

SEQ ID NO: 2765450 - DNA, 15 bp, Homo sapiens
ttcagccctcagaat

SEQ ID NO: 2765451 - DNA, 13 bp, Homo sapiens
ttcatatttaatt

SEQ ID NO: 2765452 - DNA, 20 bp, Homo sapiens
ttcatatttaatttgaaggt

SEQ ID NO: 2765453 - DNA, 21 bp, Homo sapiens
ttccttcaagaatgcagtact

SEQ ID NO: 2765454 - DNA, 14 bp, Homo sapiens
ttctatttatttgt

SEQ ID NO: 2765455 - DNA, 17 bp, Homo sapiens
ttctccagtcattatgt

SEQ ID NO: 2765456 - DNA, 20 bp, Homo sapiens
ttcttcccaatagcaaggct

SEQ ID NO: 2765457 - DNA, 16 bp, Homo sapiens
ttgaaggatgctgtct

SEQ ID NO: 2765458 - DNA, 16 bp, Homo sapiens
ttgattgggcacatca

SEQ ID NO: 2765459 - DNA, 17 bp, Homo sapiens
aggaagcttacatgcct

SEQ ID NO: 2765460 - DNA, 22 bp, Homo sapiens
aggagaagtcttctatttattt

SEQ ID NO: 2765461 - DNA, 15 bp, Homo sapiens
aggatacttatttaa

SEQ ID NO: 2765462 - DNA, 16 bp, Homo sapiens
aggcaggggaatgtat

SEQ ID NO: 2765463 - DNA, 12 bp, Homo sapiens
aggcttagaccc

SEQ ID NO: 2765464 - DNA, 17 bp, Homo sapiens
agggattttcagccctc

SEQ ID NO: 2765465 - DNA, 22 bp, Homo sapiens
agggattttcagccctcagaat

SEQ ID NO: 2765466 - DNA, 14 bp, Homo sapiens
aggtacacttgtga

SEQ ID NO: 2765467 - DNA, 17 bp, Homo sapiens
aggtacacttgtgaata

SEQ ID NO: 2765468 - DNA, 22 bp, Homo sapiens
aggtctgttttgtgtactttta

SEQ ID NO: 2765469 - DNA, 17 bp, Homo sapiens
agtaatgagcttaagaa

SEQ ID NO: 2765470 - DNA, 22 bp, Homo sapiens
agtagaggtacacttgtgaata

SEQ ID NO: 2765471 - DNA, 14 bp, Homo sapiens
agtcaaggcttaga

SEQ ID NO: 2765472 - DNA, 12 bp, Homo sapiens
agtcattatgtt

SEQ ID NO: 2765473 - DNA, 14 bp, Homo sapiens
agtcattcttccct

SEQ ID NO: 2765474 - DNA, 21 bp, Homo sapiens
agtcccctctcctccacattt

SEQ ID NO: 2765475 - DNA, 21 bp, Homo sapiens
agtcttcagtttgcagagtag

SEQ ID NO: 2765476 - DNA, 18 bp, Homo sapiens
agtgatgtaattatggtt

SEQ ID NO: 2765477 - DNA, 14 bp, Homo sapiens
agtgctattgcaga

SEQ ID NO: 2765478 - DNA, 12 bp, Homo sapiens
agtgcttggccc

SEQ ID NO: 2765479 - DNA, 16 bp, Homo sapiens
agtgcttggcccagga

SEQ ID NO: 2765480 - DNA, 22 bp, Homo sapiens
agtgctttaccaattgaagtaa

SEQ ID NO: 2765481 - DNA, 18 bp, Homo sapiens
agttattgaagcagagtg

SEQ ID NO: 2765482 - DNA, 15 bp, Homo sapiens
agtttatctgttcat

SEQ ID NO: 2765483 - DNA, 12 bp, Homo sapiens
agtttggccaga

SEQ ID NO: 2765484 - DNA, 19 bp, Homo sapiens
agtttttttccttcaagaa

SEQ ID NO: 2765485 - DNA, 21 bp, Homo sapiens
ataacaaaggatacttattta

SEQ ID NO: 2765486 - DNA, 18 bp, Homo sapiens
ataactttttatattctc

SEQ ID NO: 2765487 - DNA, 15 bp, Homo sapiens
ataatgtcccttcac

SEQ ID NO: 2765488 - DNA, 17 bp, Homo sapiens
atactattaaacatgct

SEQ ID NO: 2765489 - DNA, 18 bp, Homo sapiens
atactattaaacatgctg

SEQ ID NO: 2765490 - DNA, 20 bp, Homo sapiens
atagatgttgctaacagcaa

SEQ ID NO: 2765491 - DNA, 16 bp, Homo sapiens
atagcatgtcctaatg

SEQ ID NO: 2765492 - DNA, 22 bp, Homo sapiens
atagctgtgatttttggtattt

SEQ ID NO: 2765493 - DNA, 16 bp, Homo sapiens
atataattcctgtttt

SEQ ID NO: 2765494 - DNA, 22 bp, Homo sapiens
atataattcctgtttttattat

SEQ ID NO: 2765495 - DNA, 19 bp, Homo sapiens
atatcccttggacatttta

SEQ ID NO: 2765496 - DNA, 12 bp, Homo sapiens
atatcctaataa

SEQ ID NO: 2765497 - DNA, 16 bp, Homo sapiens
atatgatgactgtttt

SEQ ID NO: 2765498 - DNA, 17 bp, Homo sapiens
atattctcagcagagtg

SEQ ID NO: 2765499 - DNA, 20 bp, Homo sapiens
atattgcatactattaaaca

SEQ ID NO: 2765500 - DNA, 15 bp, Homo sapiens
atcatccctttccct

SEQ ID NO: 2765501 - DNA, 12 bp, Homo sapiens
atcctaataaaa

SEQ ID NO: 2765502 - DNA, 20 bp, Homo sapiens
atcctagtcattcttcccta

SEQ ID NO: 2765503 - DNA, 21 bp, Homo sapiens
atcgctccaccttgcagctct

SEQ ID NO: 2765504 - DNA, 17 bp, Homo sapiens
atctgaaataaggaatg

SEQ ID NO: 2765505 - DNA, 23 bp, Homo sapiens
atgagcttaagaaatttgtggaa

SEQ ID NO: 2765506 - DNA, 13 bp, Homo sapiens
atgatttcacagt

SEQ ID NO: 2765507 - DNA, 20 bp, Homo sapiens
atgcaaagatgaaggtctgt

SEQ ID NO: 2765508 - DNA, 15 bp, Homo sapiens
atgcccagtgagact

SEQ ID NO: 2765509 - DNA, 13 bp, Homo sapiens
atgctgccaatat

SEQ ID NO: 2765510 - DNA, 14 bp, Homo sapiens
atgctgccaatatc

SEQ ID NO: 2765511 - DNA, 17 bp, Homo sapiens
atgctgccaatatccta

SEQ ID NO: 2765512 - DNA, 18 bp, Homo sapiens
atgctgccaatatcctaa

SEQ ID NO: 2765513 - DNA, 19 bp, Homo sapiens
atgctgccaatatcctaat

SEQ ID NO: 2765514 - DNA, 23 bp, Homo sapiens
atgcttgctgctgatttaaacac

SEQ ID NO: 2765515 - DNA, 15 bp, Homo sapiens
atggtagttttacag

SEQ ID NO: 2765516 - DNA, 22 bp, Homo sapiens
atggtagttttacagtgtttct

SEQ ID NO: 2765517 - DNA, 18 bp, Homo sapiens
atgtagacagttgggttt

SEQ ID NO: 2765518 - DNA, 15 bp, Homo sapiens
atgtcagttgttatt

SEQ ID NO: 2765519 - DNA, 13 bp, Homo sapiens
atgttaatatttc

SEQ ID NO: 2765520 - DNA, 14 bp, Homo sapiens
atgttgctaacagc

SEQ ID NO: 2765521 - DNA, 12 bp, Homo sapiens
attaaatgactc

SEQ ID NO: 2765522 - DNA, 15 bp, Homo sapiens
attaggttgtgaatg

SEQ ID NO: 2765523 - DNA, 14 bp, Homo sapiens
attatgttaatatt

SEQ ID NO: 2765524 - DNA, 15 bp, Homo sapiens
attcattagttttga

SEQ ID NO: 2765525 - DNA, 21 bp, Homo sapiens
attcctaactatcactggttt

SEQ ID NO: 2765526 - DNA, 17 bp, Homo sapiens
attctcagcagagtgct

SEQ ID NO: 2765527 - DNA, 19 bp, Homo sapiens
attctgagatgactattca

SEQ ID NO: 2765528 - DNA, 16 bp, Homo sapiens
attctttttgaaatgt

SEQ ID NO: 2765529 - DNA, 17 bp, Homo sapiens
attgaaggatgctgtct

SEQ ID NO: 2765530 - DNA, 16 bp, Homo sapiens
attgacagattgaatt

SEQ ID NO: 2765531 - DNA, 13 bp, Homo sapiens
attgatgttttca

SEQ ID NO: 2765532 - DNA, 16 bp, Homo sapiens
attgatgttttcatag

SEQ ID NO: 2765533 - DNA, 23 bp, Homo sapiens
attgattgggcacatcatttcaa

SEQ ID NO: 2765534 - DNA, 18 bp, Homo sapiens
attgggcacatcatttca

SEQ ID NO: 2765535 - DNA, 21 bp, Homo sapiens
attgggcacatcatttcaaga

SEQ ID NO: 2765536 - DNA, 17 bp, Homo sapiens
atttaaacacattaaag

SEQ ID NO: 2765537 - DNA, 15 bp, Homo sapiens
atttaaatagatgac

SEQ ID NO: 2765538 - DNA, 17 bp, Homo sapiens
atttaatcttttatgat

SEQ ID NO: 2765539 - DNA, 12 bp, Homo sapiens
atttcaagaagt

SEQ ID NO: 2765540 - DNA, 14 bp, Homo sapiens
atttgaaacactgg

SEQ ID NO: 2765541 - DNA, 21 bp, Homo sapiens
atttgcacattaaatgactct

SEQ ID NO: 2765542 - DNA, 21 bp, Homo sapiens
atttgcctaatatgatgactg

SEQ ID NO: 2765543 - DNA, 15 bp, Homo sapiens
atttggaaaggaatg

SEQ ID NO: 2765544 - DNA, 23 bp, Homo sapiens
ttgcagctctccccttctctgta

SEQ ID NO: 2765545 - DNA, 19 bp, Homo sapiens
ttgccaatttgcacattaa

SEQ ID NO: 2765546 - DNA, 20 bp, Homo sapiens
ttgcctaatatgatgactgt

SEQ ID NO: 2765547 - DNA, 20 bp, Homo sapiens
ttgctaacagcaacacaaag

SEQ ID NO: 2765548 - DNA, 23 bp, Homo sapiens
ttgctaacagcaacacaaagctt

SEQ ID NO: 2765549 - DNA, 17 bp, Homo sapiens
ttgctgctgatttaaac

SEQ ID NO: 2765550 - DNA, 15 bp, Homo sapiens
ttggacattttatgt

SEQ ID NO: 2765551 - DNA, 18 bp, Homo sapiens
ttggacattttatgtctt

SEQ ID NO: 2765552 - DNA, 14 bp, Homo sapiens
ttggcccaggagtt

SEQ ID NO: 2765553 - DNA, 20 bp, Homo sapiens
ttggcccaggattattgtca

SEQ ID NO: 2765554 - DNA, 17 bp, Homo sapiens
ttgggtttatttggaaa

SEQ ID NO: 2765555 - DNA, 18 bp, Homo sapiens
ttggtaactctgtaattc

SEQ ID NO: 2765556 - DNA, 17 bp, Homo sapiens
ttggttgggatgacttg

SEQ ID NO: 2765557 - DNA, 21 bp, Homo sapiens
ttggttggtaactctgtaatt

SEQ ID NO: 2765558 - DNA, 20 bp, Homo sapiens
ttgtacactcattcattact

SEQ ID NO: 2765559 - DNA, 20 bp, Homo sapiens
ttgttatttattgaaatgat

SEQ ID NO: 2765560 - DNA, 16 bp, Homo sapiens
ttgtttttattaaaag

SEQ ID NO: 2765561 - DNA, 14 bp, Homo sapiens
tttaaacacattaa

SEQ ID NO: 2765562 - DNA, 15 bp, Homo sapiens
tttaaacacattaaa

SEQ ID NO: 2765563 - DNA, 15 bp, Homo sapiens
tttaaactacattag

SEQ ID NO: 2765564 - DNA, 17 bp, Homo sapiens
tttaagaactaaaatgt

SEQ ID NO: 2765565 - DNA, 16 bp, Homo sapiens
tttaagactttggtta

SEQ ID NO: 2765566 - DNA, 18 bp, Homo sapiens
tttaatcttttatgattg

SEQ ID NO: 2765567 - DNA, 17 bp, Homo sapiens
tttacagtgtttctggc

SEQ ID NO: 2765568 - DNA, 15 bp, Homo sapiens
tttactttttggaaa

SEQ ID NO: 2765569 - DNA, 16 bp, Homo sapiens
tttataactttttata

SEQ ID NO: 2765570 - DNA, 16 bp, Homo sapiens
tttatttatttattca

SEQ ID NO: 2765571 - DNA, 20 bp, Homo sapiens
tttccttcaagaatgcagta

SEQ ID NO: 2765572 - DNA, 22 bp, Homo sapiens
tttctcacagaagatgaagcac

SEQ ID NO: 2765573 - DNA, 23 bp, Homo sapiens
tttgaaacactggttttaaatat

SEQ ID NO: 2765574 - DNA, 12 bp, Homo sapiens
tttgcacattaa

SEQ ID NO: 2765575 - DNA, 15 bp, Homo sapiens
tttgcaggaaatcct

SEQ ID NO: 2765576 - DNA, 15 bp, Homo sapiens
tttgcatattgcata

SEQ ID NO: 2765577 - DNA, 20 bp, Homo sapiens
tttgccaatttgcacattaa

SEQ ID NO: 2765578 - DNA, 10 bp, Homo sapiens
tttggccaga

SEQ ID NO: 2765579 - DNA, 13 bp, Homo sapiens
tttggttatttta

SEQ ID NO: 2765580 - DNA, 22 bp, Homo sapiens
tttgtaactgtttagatgaatg

SEQ ID NO: 2765581 - DNA, 17 bp, Homo sapiens
tttgtggaaaataactc

SEQ ID NO: 2765582 - DNA, 17 bp, Homo sapiens
tttgtttttattaaaag

SEQ ID NO: 2765583 - DNA, 22 bp, Homo sapiens
ttttaagggccctttttcaata

SEQ ID NO: 2765584 - DNA, 19 bp, Homo sapiens
ttttaatatggatctgtat

SEQ ID NO: 2765585 - DNA, 13 bp, Homo sapiens
ttttatatagcaa

SEQ ID NO: 2765586 - DNA, 22 bp, Homo sapiens
ttttatcagaactatgtttttg

SEQ ID NO: 2765587 - DNA, 23 bp, Homo sapiens
ttttcaataactggaacactcta

SEQ ID NO: 2765588 - DNA, 21 bp, Homo sapiens
ttttgaagattctatgttaat

SEQ ID NO: 2765589 - DNA, 15 bp, Homo sapiens
ttttgcatattgcat

SEQ ID NO: 2765590 - DNA, 18 bp, Homo sapiens
ttttgccaatttgcacat

SEQ ID NO: 2765591 - DNA, 22 bp, Homo sapiens
tttttatattctcagcagagtg

SEQ ID NO: 2765592 - DNA, 15 bp, Homo sapiens
tttttggtatttgaa

SEQ ID NO: 2765593 - DNA, 12 bp, Homo sapiens
cctttttataac

SEQ ID NO: 2765594 - DNA, 15 bp, Homo sapiens
cctttttataacttt

SEQ ID NO: 2765595 - DNA, 18 bp, Homo sapiens
cgtgcacgcacactgtct

SEQ ID NO: 2765596 - DNA, 20 bp, Homo sapiens
cgtgtgtgtgcgtcctgtcg

SEQ ID NO: 2765597 - DNA, 20 bp, Homo sapiens
ctaacagcaacacaaagctt

SEQ ID NO: 2765598 - DNA, 19 bp, Homo sapiens
ctaatatgatgactgtttt

SEQ ID NO: 2765599 - DNA, 21 bp, Homo sapiens
ctaatatgatgactgttttta

SEQ ID NO: 2765600 - DNA, 17 bp, Homo sapiens
ctacattaggttgtgaa

SEQ ID NO: 2765601 - DNA, 17 bp, Homo sapiens
ctacattgacagattga

SEQ ID NO: 2765602 - DNA, 15 bp, Homo sapiens
ctaccaatatttaat

SEQ ID NO: 2765603 - DNA, 20 bp, Homo sapiens
ctatataattcctgttttta

SEQ ID NO: 2765604 - DNA, 17 bp, Homo sapiens
ctatcactggtttggtt

SEQ ID NO: 2765605 - DNA, 22 bp, Homo sapiens
ctatgctgttcactggacactt

SEQ ID NO: 2765606 - DNA, 14 bp, Homo sapiens
ctatgttaatattt

SEQ ID NO: 2765607 - DNA, 15 bp, Homo sapiens
ctatgttaatatttt

SEQ ID NO: 2765608 - DNA, 17 bp, Homo sapiens
ctatgttaatattttag

SEQ ID NO: 2765609 - DNA, 21 bp, Homo sapiens
ctatgttaatattttaggtgt

SEQ ID NO: 2765610 - DNA, 12 bp, Homo sapiens
ctatgtttttgt

SEQ ID NO: 2765611 - DNA, 23 bp, Homo sapiens
ctattcagcacaaggaaataaaa

SEQ ID NO: 2765612 - DNA, 19 bp, Homo sapiens
ctatttatttatttattca

SEQ ID NO: 2765613 - DNA, 15 bp, Homo sapiens
ctcaagtctggcaga

SEQ ID NO: 2765614 - DNA, 13 bp, Homo sapiens
ctcaattgtgaaa

SEQ ID NO: 2765615 - DNA, 17 bp, Homo sapiens
ctcacaatccttgccac

SEQ ID NO: 2765616 - DNA, 14 bp, Homo sapiens
ctcatgctgccaat

SEQ ID NO: 2765617 - DNA, 23 bp, Homo sapiens
ctcatttttataatgtcccttca

SEQ ID NO: 2765618 - DNA, 13 bp, Homo sapiens
ctcctccacattt

SEQ ID NO: 2765619 - DNA, 13 bp, Homo sapiens
ctctatttctgga

SEQ ID NO: 2765620 - DNA, 16 bp, Homo sapiens
ctgaacttcagagcat

SEQ ID NO: 2765621 - DNA, 17 bp, Homo sapiens
ctgccaatatcctaata

SEQ ID NO: 2765622 - DNA, 19 bp, Homo sapiens
ctgccaatatcctaataaa

SEQ ID NO: 2765623 - DNA, 22 bp, Homo sapiens
ctgccaatatcctaataaaaag

SEQ ID NO: 2765624 - DNA, 16 bp, Homo sapiens
ctgctgatttaaacac

SEQ ID NO: 2765625 - DNA, 22 bp, Homo sapiens
ctgctgatttaaacacattaaa

SEQ ID NO: 2765626 - DNA, 22 bp, Homo sapiens
ctggacacttcacgcccttggc

SEQ ID NO: 2765627 - DNA, 22 bp, Homo sapiens
ctggagttattgaagcagagtg

SEQ ID NO: 2765628 - DNA, 18 bp, Homo sapiens
ctggatagtccgtctctg

SEQ ID NO: 2765629 - DNA, 22 bp, Homo sapiens
ctggcactggtttgttccctgt

SEQ ID NO: 2765630 - DNA, 20 bp, Homo sapiens
ctgggaaagggattttcagc

SEQ ID NO: 2765631 - DNA, 21 bp, Homo sapiens
ctggtactctgccactttatt

SEQ ID NO: 2765632 - DNA, 22 bp, Homo sapiens
ctgtgatttttggtatttgaaa

SEQ ID NO: 2765633 - DNA, 18 bp, Homo sapiens
cttaagaaatttgtggaa

SEQ ID NO: 2765634 - DNA, 15 bp, Homo sapiens
cttagtgatgtaatt

SEQ ID NO: 2765635 - DNA, 16 bp, Homo sapiens
cttagtgatgtaatta

SEQ ID NO: 2765636 - DNA, 16 bp, Homo sapiens
cttctatttatttatt

SEQ ID NO: 2765637 - DNA, 16 bp, Homo sapiens
cttgagtgctcagtag

SEQ ID NO: 2765638 - DNA, 16 bp, Homo sapiens
cttggcccaggagttt

SEQ ID NO: 2765639 - DNA, 20 bp, Homo sapiens
cttggcccaggagtttggcc

SEQ ID NO: 2765640 - DNA, 20 bp, Homo sapiens
cttgttgagggtatgtttta

SEQ ID NO: 2765641 - DNA, 19 bp, Homo sapiens
ctttaaactacattaggtt

SEQ ID NO: 2765642 - DNA, 16 bp, Homo sapiens
ctttaccaattgaagt

SEQ ID NO: 2765643 - DNA, 19 bp, Homo sapiens
ctttaccaattgaagtaaa

SEQ ID NO: 2765644 - DNA, 20 bp, Homo sapiens
ctttaccaattgaagtaaaa

SEQ ID NO: 2765645 - DNA, 14 bp, Homo sapiens
ctttgcaggaaatc

SEQ ID NO: 2765646 - DNA, 22 bp, Homo sapiens
cttttatgattgcctttttata

SEQ ID NO: 2765647 - DNA, 12 bp, Homo sapiens
ctttttataact

SEQ ID NO: 2765648 - DNA, 18 bp, Homo sapiens
ctttttatattctcagca

SEQ ID NO: 2765649 - DNA, 22 bp, Homo sapiens
ctttttatattctcagcagagt

SEQ ID NO: 2765650 - DNA, 20 bp, Homo sapiens
gaaaggaatgcaaagatgaa

SEQ ID NO: 2765651 - DNA, 12 bp, Homo sapiens
gaaagggatttt

SEQ ID NO: 2765652 - DNA, 15 bp, Homo sapiens
gaacactctataaca

SEQ ID NO: 2765653 - DNA, 21 bp, Homo sapiens
gaacactctataacaaaggat

SEQ ID NO: 2765654 - DNA, 20 bp, Homo sapiens
gaagattcttgtatttatta

SEQ ID NO: 2765655 - DNA, 12 bp, Homo sapiens
gaagcagagtgg

SEQ ID NO: 2765656 - DNA, 14 bp, Homo sapiens
gaaggatgctgtct

SEQ ID NO: 2765657 - DNA, 15 bp, Homo sapiens
gaaggtagaatgttt

SEQ ID NO: 2765658 - DNA, 13 bp, Homo sapiens
gaagtcttctatt

SEQ ID NO: 2765659 - DNA, 22 bp, Homo sapiens
gaattgattgggcacatcattt

SEQ ID NO: 2765660 - DNA, 19 bp, Homo sapiens
gacagagccccaccctcag

SEQ ID NO: 2765661 - DNA, 14 bp, Homo sapiens
gacattgactattt

SEQ ID NO: 2765662 - DNA, 17 bp, Homo sapiens
gaccctcatgctgccaa

SEQ ID NO: 2765663 - DNA, 17 bp, Homo sapiens
gactatttttgttttta

SEQ ID NO: 2765664 - DNA, 17 bp, Homo sapiens
gactggatagtccgtct

SEQ ID NO: 2765665 - DNA, 20 bp, Homo sapiens
gagaagtcttctatttattt

SEQ ID NO: 2765666 - DNA, 21 bp, Homo sapiens
gagaagtcttctatttattta

SEQ ID NO: 2765667 - DNA, 17 bp, Homo sapiens
gagccccaccctcagat

SEQ ID NO: 2765668 - DNA, 12 bp, Homo sapiens
gagccctgtctc

SEQ ID NO: 2765669 - DNA, 11 bp, Homo sapiens
gagtggagtta

SEQ ID NO: 2765670 - DNA, 12 bp, Homo sapiens
gagtttggccag

SEQ ID NO: 2765671 - DNA, 13 bp, Homo sapiens
gatacttatttaa

SEQ ID NO: 2765672 - DNA, 21 bp, Homo sapiens
gatgacattgactatttttgt

SEQ ID NO: 2765673 - DNA, 23 bp, Homo sapiens
gatgacattgactatttttgttt

SEQ ID NO: 2765674 - DNA, 15 bp, Homo sapiens
gatgactgtttttaa

SEQ ID NO: 2765675 - DNA, 17 bp, Homo sapiens
gattctatgttaatatt

SEQ ID NO: 2765676 - DNA, 15 bp, Homo sapiens
gattgcctttttata

SEQ ID NO: 2765677 - DNA, 14 bp, Homo sapiens
gcaaagatgaaggt

SEQ ID NO: 2765678 - DNA, 18 bp, Homo sapiens
gcaaagatgaaggtctgt

SEQ ID NO: 2765679 - DNA, 13 bp, Homo sapiens
gcacactgtctgc

SEQ ID NO: 2765680 - DNA, 21 bp, Homo sapiens
gcacatgagctggcgggattg

SEQ ID NO: 2765681 - DNA, 14 bp, Homo sapiens
gcacattaaatgac

SEQ ID NO: 2765682 - DNA, 15 bp, Homo sapiens
gcagtactaacattt

SEQ ID NO: 2765683 - DNA, 17 bp, Homo sapiens
gcatactattaaacatg

SEQ ID NO: 2765684 - DNA, 17 bp, Homo sapiens
gccaatatcctaataaa

SEQ ID NO: 2765685 - DNA, 18 bp, Homo sapiens
gccaatatcctaataaaa

SEQ ID NO: 2765686 - DNA, 23 bp, Homo sapiens
gccaatatcctaataaaaaggtg

SEQ ID NO: 2765687 - DNA, 13 bp, Homo sapiens
gcccaggagtttg

SEQ ID NO: 2765688 - DNA, 18 bp, Homo sapiens
gcccaggagtttggccag

SEQ ID NO: 2765689 - DNA, 16 bp, Homo sapiens
gccctcaattgtgaaa

SEQ ID NO: 2765690 - DNA, 14 bp, Homo sapiens
gccctttttcaata

SEQ ID NO: 2765691 - DNA, 22 bp, Homo sapiens
gccgtgtgtgtgcgtcctgtcg

SEQ ID NO: 2765692 - DNA, 23 bp, Homo sapiens
gccttgtttaatggtagttttac

SEQ ID NO: 2765693 - DNA, 22 bp, Homo sapiens
gcgtcctgtcggagccctgtct

SEQ ID NO: 2765694 - DNA, 14 bp, Homo sapiens
gctaacttgggtta

SEQ ID NO: 2765695 - DNA, 19 bp, Homo sapiens
gctcaccccatcatccctt

SEQ ID NO: 2765696 - DNA, 14 bp, Homo sapiens
gctgaccttgctga

SEQ ID NO: 2765697 - DNA, 19 bp, Homo sapiens
gctgatttaaacacattaa

SEQ ID NO: 2765698 - DNA, 13 bp, Homo sapiens
gctgcagtttttt

SEQ ID NO: 2765699 - DNA, 15 bp, Homo sapiens
gctgccaatatccta

SEQ ID NO: 2765700 - DNA, 17 bp, Homo sapiens
gctgccaatatcctaat

SEQ ID NO: 2765701 - DNA, 19 bp, Homo sapiens
gctgccaatatcctaataa

SEQ ID NO: 2765702 - DNA, 20 bp, Homo sapiens
gctgccaatatcctaataaa

SEQ ID NO: 2765703 - DNA, 22 bp, Homo sapiens
gctgtacatactttttgggttt

SEQ ID NO: 2765704 - DNA, 22 bp, Homo sapiens
gcttacatgcctaccaatattt

SEQ ID NO: 2765705 - DNA, 16 bp, Homo sapiens
gcttagaccctcatgc

SEQ ID NO: 2765706 - DNA, 13 bp, Homo sapiens
gcttggcccagga

SEQ ID NO: 2765707 - DNA, 16 bp, Homo sapiens
gcttgtacactcattc

SEQ ID NO: 2765708 - DNA, 23 bp, Homo sapiens
ggaaagggattttcagccctcag

SEQ ID NO: 2765709 - DNA, 23 bp, Homo sapiens
ggaacagaagaggaaagagagac

SEQ ID NO: 2765710 - DNA, 18 bp, Homo sapiens
ggatctgtatgtgttcta

SEQ ID NO: 2765711 - DNA, 19 bp, Homo sapiens
ggcagtgcttggcccagga

SEQ ID NO: 2765712 - DNA, 21 bp, Homo sapiens
ggcagtgcttggcccaggagt

SEQ ID NO: 2765713 - DNA, 11 bp, Homo sapiens
ggcccaggagt

SEQ ID NO: 2765714 - DNA, 13 bp, Homo sapiens
ggcccaggagttt

SEQ ID NO: 2765715 - DNA, 19 bp, Homo sapiens
ggcccaggagtttggccag

SEQ ID NO: 2765716 - DNA, 15 bp, Homo sapiens
ggctaacttgggtta

SEQ ID NO: 2765717 - DNA, 21 bp, Homo sapiens
ggcttaattattgatgttttc

SEQ ID NO: 2765718 - DNA, 18 bp, Homo sapiens
ggcttagaccctcatgct

SEQ ID NO: 2765719 - DNA, 17 bp, Homo sapiens
gggattgaaggatgctg

SEQ ID NO: 2765720 - DNA, 21 bp, Homo sapiens
gggattttcagccctcagaat

SEQ ID NO: 2765721 - DNA, 19 bp, Homo sapiens
gggcagtgcttggcccagg

SEQ ID NO: 2765722 - DNA, 20 bp, Homo sapiens
gggcagtgcttggcccagga

SEQ ID NO: 2765723 - DNA, 16 bp, Homo sapiens
cctaataaaaaggtga

SEQ ID NO: 2765724 - DNA, 21 bp, Homo sapiens
cctcatttttataatgtccct

SEQ ID NO: 2765725 - DNA, 15 bp, Homo sapiens
cctccacatttgttt

SEQ ID NO: 2765726 - DNA, 16 bp, Homo sapiens
cctgtcggagccctgt

SEQ ID NO: 2765727 - DNA, 17 bp, Homo sapiens
cctgtcggagccctgtc

SEQ ID NO: 2765728 - DNA, 21 bp, Homo sapiens
cctgtcggagccctgtctcct

SEQ ID NO: 2765729 - DNA, 13 bp, Homo sapiens
ccttgtttaatgg

SEQ ID NO: 2765730 - DNA, 16 bp, Homo sapiens
cctttttcaataactg

SEQ ID NO: 2765731 - DNA, 22 bp, Homo sapiens
cgtggtgatttagcaggaagct

SEQ ID NO: 2765732 - DNA, 13 bp, Homo sapiens
ctaacttgggtta

SEQ ID NO: 2765733 - DNA, 14 bp, Homo sapiens
ctaataaaaaggtg

SEQ ID NO: 2765734 - DNA, 15 bp, Homo sapiens
ctaataaaaaggtga

SEQ ID NO: 2765735 - DNA, 18 bp, Homo sapiens
ctataacaaaggatactt

SEQ ID NO: 2765736 - DNA, 22 bp, Homo sapiens
ctataacaaaggatacttattt

SEQ ID NO: 2765737 - DNA, 13 bp, Homo sapiens
ctatgttaatatt

SEQ ID NO: 2765738 - DNA, 21 bp, Homo sapiens
ctattaaacatgctgtacata

SEQ ID NO: 2765739 - DNA, 15 bp, Homo sapiens
ctattctgagatgac

SEQ ID NO: 2765740 - DNA, 16 bp, Homo sapiens
ctattctgagatgact

SEQ ID NO: 2765741 - DNA, 18 bp, Homo sapiens
ctattctgagatgactat

SEQ ID NO: 2765742 - DNA, 12 bp, Homo sapiens
ctatttatttat

SEQ ID NO: 2765743 - DNA, 15 bp, Homo sapiens
ctatttttgttttta

SEQ ID NO: 2765744 - DNA, 13 bp, Homo sapiens
ctcagcagagtgc

SEQ ID NO: 2765745 - DNA, 22 bp, Homo sapiens
ctcatgctgccaatatcctaat

SEQ ID NO: 2765746 - DNA, 13 bp, Homo sapiens
ctcattcattact

SEQ ID NO: 2765747 - DNA, 17 bp, Homo sapiens
ctcattcattactaaaa

SEQ ID NO: 2765748 - DNA, 13 bp, Homo sapiens
ctccacatttgtt

SEQ ID NO: 2765749 - DNA, 22 bp, Homo sapiens
ctccagtcattatgttaatatt

SEQ ID NO: 2765750 - DNA, 21 bp, Homo sapiens
ctctctgtaataaactcattt

SEQ ID NO: 2765751 - DNA, 22 bp, Homo sapiens
ctgcagtttttttccttcaaga

SEQ ID NO: 2765752 - DNA, 23 bp, Homo sapiens
ctgcagtttttttccttcaagaa

SEQ ID NO: 2765753 - DNA, 13 bp, Homo sapiens
ctgccaatatcct

SEQ ID NO: 2765754 - DNA, 14 bp, Homo sapiens
ctgccaatatccta

SEQ ID NO: 2765755 - DNA, 16 bp, Homo sapiens
ctgccaatatcctaat

SEQ ID NO: 2765756 - DNA, 20 bp, Homo sapiens
ctgccaatatcctaataaaa

SEQ ID NO: 2765757 - DNA, 23 bp, Homo sapiens
ctggagttattgaagcagagtgg

SEQ ID NO: 2765758 - DNA, 24 bp, Homo sapiens
ctggagttattgaagcagagtggc

SEQ ID NO: 2765759 - DNA, 19 bp, Homo sapiens
ctggatagtccgtctctgc

SEQ ID NO: 2765760 - DNA, 22 bp, Homo sapiens
ctggttttaaatattttgactt

SEQ ID NO: 2765761 - DNA, 21 bp, Homo sapiens
ctgtaagttacatgaaggcag

SEQ ID NO: 2765762 - DNA, 22 bp, Homo sapiens
ctgtaataaactcatttctagc

SEQ ID NO: 2765763 - DNA, 21 bp, Homo sapiens
ctgtcctattatattcattct

SEQ ID NO: 2765764 - DNA, 23 bp, Homo sapiens
ctgtcggagccctgtctcctctc

SEQ ID NO: 2765765 - DNA, 17 bp, Homo sapiens
ctgtctcctctctctgt

SEQ ID NO: 2765766 - DNA, 20 bp, Homo sapiens
ctgtctcctctctctgtaat

SEQ ID NO: 2765767 - DNA, 15 bp, Homo sapiens
ctgtgttgtacagct

SEQ ID NO: 2765768 - DNA, 18 bp, Homo sapiens
ctgtttttattattaaca

SEQ ID NO: 2765769 - DNA, 20 bp, Homo sapiens
ctgtttttattattaacaaa

SEQ ID NO: 2765770 - DNA, 18 bp, Homo sapiens
cttagaccctcatgctgc

SEQ ID NO: 2765771 - DNA, 21 bp, Homo sapiens
cttagaccctcatgctgccaa

SEQ ID NO: 2765772 - DNA, 22 bp, Homo sapiens
cttagaccctcatgctgccaat

SEQ ID NO: 2765773 - DNA, 14 bp, Homo sapiens
cttatttaaataga

SEQ ID NO: 2765774 - DNA, 15 bp, Homo sapiens
cttcacgcccttggc

SEQ ID NO: 2765775 - DNA, 17 bp, Homo sapiens
cttgctgctgatttaaa

SEQ ID NO: 2765776 - DNA, 19 bp, Homo sapiens
cttgctgctgatttaaaca

SEQ ID NO: 2765777 - DNA, 19 bp, Homo sapiens
cttggacattttatgtctt

SEQ ID NO: 2765778 - DNA, 14 bp, Homo sapiens
cttggcccaggagt

SEQ ID NO: 2765779 - DNA, 15 bp, Homo sapiens
cttggcccaggagtt

SEQ ID NO: 2765780 - DNA, 22 bp, Homo sapiens
cttggcccaggagtttggccag

SEQ ID NO: 2765781 - DNA, 23 bp, Homo sapiens
cttggcccaggagtttggccaga

SEQ ID NO: 2765782 - DNA, 16 bp, Homo sapiens
cttgtacactcattca

SEQ ID NO: 2765783 - DNA, 21 bp, Homo sapiens
cttgttgagggtatgttttat

SEQ ID NO: 2765784 - DNA, 16 bp, Homo sapiens
cttgtttaatggtagt

SEQ ID NO: 2765785 - DNA, 18 bp, Homo sapiens
ctttaccaattgaagtaa

SEQ ID NO: 2765786 - DNA, 13 bp, Homo sapiens
ctttggttatttt

SEQ ID NO: 2765787 - DNA, 23 bp, Homo sapiens
cttttgcatattgcatactatta

SEQ ID NO: 2765788 - DNA, 15 bp, Homo sapiens
ctttttcaataactg

SEQ ID NO: 2765789 - DNA, 20 bp, Homo sapiens
gaaaaaatttactttaaact

SEQ ID NO: 2765790 - DNA, 20 bp, Homo sapiens
gaaagggattttcagccctc

SEQ ID NO: 2765791 - DNA, 14 bp, Homo sapiens
gaagaaaataatta

SEQ ID NO: 2765792 - DNA, 23 bp, Homo sapiens
gaaggtgcctctggatgctgtga

SEQ ID NO: 2765793 - DNA, 18 bp, Homo sapiens
gaagtaaaatgtggcagg

SEQ ID NO: 2765794 - DNA, 18 bp, Homo sapiens
gaagtcccctctcctcca

SEQ ID NO: 2765795 - DNA, 16 bp, Homo sapiens
gaagttctatttattt

SEQ ID NO: 2765796 - DNA, 22 bp, Homo sapiens
gaatgtcagttgttatttattg

SEQ ID NO: 2765797 - DNA, 12 bp, Homo sapiens
gacattccctgc

SEQ ID NO: 2765798 - DNA, 16 bp, Homo sapiens
gaccctcatgctgcca

SEQ ID NO: 2765799 - DNA, 22 bp, Homo sapiens
gaccctcatgctgccaatatcc

SEQ ID NO: 2765800 - DNA, 22 bp, Homo sapiens
gactatttttgtttttattaaa

SEQ ID NO: 2765801 - DNA, 13 bp, Homo sapiens
gactcttccctca

SEQ ID NO: 2765802 - DNA, 22 bp, Homo sapiens
gactttggttattttacttttt

SEQ ID NO: 2765803 - DNA, 13 bp, Homo sapiens
gagtttggccaga

SEQ ID NO: 2765804 - DNA, 16 bp, Homo sapiens
gatacttatttaaata

SEQ ID NO: 2765805 - DNA, 15 bp, Homo sapiens
gatgaaggtctgttt

SEQ ID NO: 2765806 - DNA, 18 bp, Homo sapiens
gatgaaggtctgttttgt

SEQ ID NO: 2765807 - DNA, 22 bp, Homo sapiens
gatgaatgtcagttgttattta

SEQ ID NO: 2765808 - DNA, 21 bp, Homo sapiens
gatgctgtcttcgtactggga

SEQ ID NO: 2765809 - DNA, 15 bp, Homo sapiens
gattcttgtatttat

SEQ ID NO: 2765810 - DNA, 21 bp, Homo sapiens
gattgcctttttataactttt

SEQ ID NO: 2765811 - DNA, 20 bp, Homo sapiens
gattgggcacatcatttcaa

SEQ ID NO: 2765812 - DNA, 13 bp, Homo sapiens
gcacatcatttca

SEQ ID NO: 2765813 - DNA, 16 bp, Homo sapiens
gcacattaaatgactc

SEQ ID NO: 2765814 - DNA, 19 bp, Homo sapiens
gcactggtttgttccctgt

SEQ ID NO: 2765815 - DNA, 15 bp, Homo sapiens
gcagctctccccttc

SEQ ID NO: 2765816 - DNA, 19 bp, Homo sapiens
gcagtaaaaaatggtgttt

SEQ ID NO: 2765817 - DNA, 22 bp, Homo sapiens
gcagtaaaaaatggtgttttat

SEQ ID NO: 2765818 - DNA, 21 bp, Homo sapiens
gcagtactaacatttatttga

SEQ ID NO: 2765819 - DNA, 14 bp, Homo sapiens
gcagtcttcagttt

SEQ ID NO: 2765820 - DNA, 16 bp, Homo sapiens
gcagtgcttggcccag

SEQ ID NO: 2765821 - DNA, 17 bp, Homo sapiens
gcagtgcttggcccagg

SEQ ID NO: 2765822 - DNA, 19 bp, Homo sapiens
gcagtgcttggcccaggag

SEQ ID NO: 2765823 - DNA, 14 bp, Homo sapiens
gcatactattaaac

SEQ ID NO: 2765824 - DNA, 22 bp, Homo sapiens
gcatactgccttgtttaatggt

SEQ ID NO: 2765825 - DNA, 13 bp, Homo sapiens
gccaatatcctaa

SEQ ID NO: 2765826 - DNA, 15 bp, Homo sapiens
gccaatatcctaata

SEQ ID NO: 2765827 - DNA, 12 bp, Homo sapiens
gccaatttgcac

SEQ ID NO: 2765828 - DNA, 22 bp, Homo sapiens
gccagaagtcaaggcttagacc

SEQ ID NO: 2765829 - DNA, 23 bp, Homo sapiens
gccagaagtcaaggcttagaccc

SEQ ID NO: 2765830 - DNA, 20 bp, Homo sapiens
gcccaggagtttggccagaa

SEQ ID NO: 2765831 - DNA, 23 bp, Homo sapiens
gccgtggtgatttagcaggaagc

SEQ ID NO: 2765832 - DNA, 15 bp, Homo sapiens
gccttgtttaatggt

SEQ ID NO: 2765833 - DNA, 16 bp, Homo sapiens
gctgccaatatcctaa

SEQ ID NO: 2765834 - DNA, 22 bp, Homo sapiens
gctggagttattgaagcagagt

SEQ ID NO: 2765835 - DNA, 13 bp, Homo sapiens
gctgtacatactt

SEQ ID NO: 2765836 - DNA, 21 bp, Homo sapiens
gcttaggagaagtcttctatt

SEQ ID NO: 2765837 - DNA, 14 bp, Homo sapiens
gcttggcccaggag

SEQ ID NO: 2765838 - DNA, 15 bp, Homo sapiens
gcttggcccaggagt

SEQ ID NO: 2765839 - DNA, 16 bp, Homo sapiens
gcttggcccaggagtt

SEQ ID NO: 2765840 - DNA, 20 bp, Homo sapiens
ggagaagtcttctatttatt

SEQ ID NO: 2765841 - DNA, 23 bp, Homo sapiens
ggagccctgtctcctctctctgt

SEQ ID NO: 2765842 - DNA, 15 bp, Homo sapiens
ggagtttggccagaa

SEQ ID NO: 2765843 - DNA, 13 bp, Homo sapiens
ggatacttattta

SEQ ID NO: 2765844 - DNA, 19 bp, Homo sapiens
ggatctgtatgtgttctat

SEQ ID NO: 2765845 - DNA, 14 bp, Homo sapiens
ggcacatcatttca

SEQ ID NO: 2765846 - DNA, 16 bp, Homo sapiens
ggcagtgcttggccca

SEQ ID NO: 2765847 - DNA, 17 bp, Homo sapiens
ggcagtgcttggcccag

SEQ ID NO: 2765848 - DNA, 20 bp, Homo sapiens
ggcagtgcttggcccaggag

SEQ ID NO: 2765849 - DNA, 23 bp, Homo sapiens
ggcagtgcttggcccaggagttt

SEQ ID NO: 2765850 - DNA, 22 bp, Homo sapiens
ggcccaggagtttggccagaag

SEQ ID NO: 2765851 - DNA, 23 bp, Homo sapiens
ggcccaggagtttggccagaagt

SEQ ID NO: 2765852 - DNA, 17 bp, Homo sapiens
ccaggagtttggccaga

SEQ ID NO: 2765853 - DNA, 18 bp, Homo sapiens
ccaggagtttggccagaa

SEQ ID NO: 2765854 - DNA, 20 bp, Homo sapiens
ccaggattattgtcaaagaa

SEQ ID NO: 2765855 - DNA, 22 bp, Homo sapiens
ccagtcattatgttaatatttc

SEQ ID NO: 2765856 - DNA, 18 bp, Homo sapiens
cccaggagtttggccaga

SEQ ID NO: 2765857 - DNA, 12 bp, Homo sapiens
ccctaatcttcc

SEQ ID NO: 2765858 - DNA, 14 bp, Homo sapiens
cccttggacatttt

SEQ ID NO: 2765859 - DNA, 17 bp, Homo sapiens
ccctttttcaataactg

SEQ ID NO: 2765860 - DNA, 14 bp, Homo sapiens
cctaataaaaaggt

SEQ ID NO: 2765861 - DNA, 16 bp, Homo sapiens
cctccccctggcactg

SEQ ID NO: 2765862 - DNA, 22 bp, Homo sapiens
cctgtcggagccctgtctcctc

SEQ ID NO: 2765863 - DNA, 18 bp, Homo sapiens
ccttggacattttatgtc

SEQ ID NO: 2765864 - DNA, 22 bp, Homo sapiens
cgccagctcaccccatcatccc

SEQ ID NO: 2765865 - DNA, 15 bp, Homo sapiens
cgtggtgatttagca

SEQ ID NO: 2765866 - DNA, 11 bp, Homo sapiens
ctaataaaaag

SEQ ID NO: 2765867 - DNA, 19 bp, Homo sapiens
ctaataaaaaggtgaccat

SEQ ID NO: 2765868 - DNA, 18 bp, Homo sapiens
ctacacacctaacttatg

SEQ ID NO: 2765869 - DNA, 18 bp, Homo sapiens
ctatataattcctgtttt

SEQ ID NO: 2765870 - DNA, 22 bp, Homo sapiens
ctatggggtaaaaggggtaggg

SEQ ID NO: 2765871 - DNA, 21 bp, Homo sapiens
ctcaaactaacaggcttagtg

SEQ ID NO: 2765872 - DNA, 21 bp, Homo sapiens
ctcaataaacatttcatttcc

SEQ ID NO: 2765873 - DNA, 12 bp, Homo sapiens
ctcagcagagtg

SEQ ID NO: 2765874 - DNA, 18 bp, Homo sapiens
ctcagtagtcagactgga

SEQ ID NO: 2765875 - DNA, 12 bp, Homo sapiens
ctcatgctgcca

SEQ ID NO: 2765876 - DNA, 17 bp, Homo sapiens
ctcatgttgaaacttta

SEQ ID NO: 2765877 - DNA, 15 bp, Homo sapiens
ctccacatttgtttt

SEQ ID NO: 2765878 - DNA, 17 bp, Homo sapiens
ctccaccttgcagctct

SEQ ID NO: 2765879 - DNA, 22 bp, Homo sapiens
ctcccttcctatgctgttcact

SEQ ID NO: 2765880 - DNA, 17 bp, Homo sapiens
ctgaacatcacagctta

SEQ ID NO: 2765881 - DNA, 21 bp, Homo sapiens
ctgacacatgctgaacatcac

SEQ ID NO: 2765882 - DNA, 23 bp, Homo sapiens
ctgacgacttgagtgctcagtag

SEQ ID NO: 2765883 - DNA, 22 bp, Homo sapiens
ctgatttaaacacattaaaggt

SEQ ID NO: 2765884 - DNA, 17 bp, Homo sapiens
ctgcagggacagagcat

SEQ ID NO: 2765885 - DNA, 20 bp, Homo sapiens
ctgcagtttttttccttcaa

SEQ ID NO: 2765886 - DNA, 20 bp, Homo sapiens
ctgcttatccgttagccgtg

SEQ ID NO: 2765887 - DNA, 21 bp, Homo sapiens
ctggagttattgaagcagagt

SEQ ID NO: 2765888 - DNA, 15 bp, Homo sapiens
ctgtacatacttttt

SEQ ID NO: 2765889 - DNA, 14 bp, Homo sapiens
ctgtcttttaaact

SEQ ID NO: 2765890 - DNA, 19 bp, Homo sapiens
ctgtgatgacattccctgc

SEQ ID NO: 2765891 - DNA, 10 bp, Homo sapiens
cttaattatt

SEQ ID NO: 2765892 - DNA, 20 bp, Homo sapiens
cttagaccctcatgctgcca

SEQ ID NO: 2765893 - DNA, 23 bp, Homo sapiens
cttagaccctcatgctgccaata

SEQ ID NO: 2765894 - DNA, 18 bp, Homo sapiens
cttatttaaatagatgac

SEQ ID NO: 2765895 - DNA, 16 bp, Homo sapiens
cttcagtttgcagagt

SEQ ID NO: 2765896 - DNA, 17 bp, Homo sapiens
cttcagtttgcagagta

SEQ ID NO: 2765897 - DNA, 16 bp, Homo sapiens
cttccacttgagtgtc

SEQ ID NO: 2765898 - DNA, 22 bp, Homo sapiens
cttgagtgtcaagctgaccttg

SEQ ID NO: 2765899 - DNA, 16 bp, Homo sapiens
cttggacattttatgt

SEQ ID NO: 2765900 - DNA, 16 bp, Homo sapiens
cttgttgagggtatgt

SEQ ID NO: 2765901 - DNA, 15 bp, Homo sapiens
ctttaagaactaaaa

SEQ ID NO: 2765902 - DNA, 23 bp, Homo sapiens
ctttggttattttactttttgga

SEQ ID NO: 2765903 - DNA, 17 bp, Homo sapiens
cttttaagactttggtt

SEQ ID NO: 2765904 - DNA, 14 bp, Homo sapiens
ctttttgaaatgtc

SEQ ID NO: 2765905 - DNA, 21 bp, Homo sapiens
ctttttgggtttatttggaaa

SEQ ID NO: 2765906 - DNA, 17 bp, Homo sapiens
gaaaaggccttcttccc

SEQ ID NO: 2765907 - DNA, 13 bp, Homo sapiens
gaaacactggttt

SEQ ID NO: 2765908 - DNA, 22 bp, Homo sapiens
gaaacactggttttaaatattt

SEQ ID NO: 2765909 - DNA, 14 bp, Homo sapiens
gaacatcacagctt

SEQ ID NO: 2765910 - DNA, 20 bp, Homo sapiens
gaagattctatgttaatatt

SEQ ID NO: 2765911 - DNA, 23 bp, Homo sapiens
gaagattctatgttaatatttta

SEQ ID NO: 2765912 - DNA, 16 bp, Homo sapiens
gaaggtagaatgtttt

SEQ ID NO: 2765913 - DNA, 23 bp, Homo sapiens
gaagtcccctctcctccacattt

SEQ ID NO: 2765914 - DNA, 19 bp, Homo sapiens
gacacttcacgcccttggc

SEQ ID NO: 2765915 - DNA, 20 bp, Homo sapiens
gacattttatgtctttcttg

SEQ ID NO: 2765916 - DNA, 14 bp, Homo sapiens
gaccctcatgctgc

SEQ ID NO: 2765917 - DNA, 21 bp, Homo sapiens
gaccctcatgctgccaatatc

SEQ ID NO: 2765918 - DNA, 23 bp, Homo sapiens
gaccctcatgctgccaatatcct

SEQ ID NO: 2765919 - DNA, 21 bp, Homo sapiens
gaccctctcaaactaacaggc

SEQ ID NO: 2765920 - DNA, 13 bp, Homo sapiens
gactatttttgtt

SEQ ID NO: 2765921 - DNA, 22 bp, Homo sapiens
gactggatagtccgtctctgct

SEQ ID NO: 2765922 - DNA, 18 bp, Homo sapiens
gaggtacacttgtgaata

SEQ ID NO: 2765923 - DNA, 17 bp, Homo sapiens
gagtggagttactgaac

SEQ ID NO: 2765924 - DNA, 17 bp, Homo sapiens
gagttattgaagcagag

SEQ ID NO: 2765925 - DNA, 18 bp, Homo sapiens
gagttattgaagcagagt

SEQ ID NO: 2765926 - DNA, 19 bp, Homo sapiens
gagttattgaagcagagtg

SEQ ID NO: 2765927 - DNA, 20 bp, Homo sapiens
gagttattgaagcagagtgg

SEQ ID NO: 2765928 - DNA, 14 bp, Homo sapiens
gagtttggccagaa

SEQ ID NO: 2765929 - DNA, 17 bp, Homo sapiens
gatgacattccctgcta

SEQ ID NO: 2765930 - DNA, 16 bp, Homo sapiens
gatgttgctaacagca

SEQ ID NO: 2765931 - DNA, 12 bp, Homo sapiens
gattcatattta

SEQ ID NO: 2765932 - DNA, 20 bp, Homo sapiens
gattctatgttaatatttta

SEQ ID NO: 2765933 - DNA, 19 bp, Homo sapiens
gattttcagccctcagaat

SEQ ID NO: 2765934 - DNA, 15 bp, Homo sapiens
gcacatctgttttgt

SEQ ID NO: 2765935 - DNA, 12 bp, Homo sapiens
gcacattaaatg

SEQ ID NO: 2765936 - DNA, 15 bp, Homo sapiens
gcacgcacactgtct

SEQ ID NO: 2765937 - DNA, 16 bp, Homo sapiens
gcacgcacactgtctg

SEQ ID NO: 2765938 - DNA, 22 bp, Homo sapiens
gcagagtaggggtctgtctttt

SEQ ID NO: 2765939 - DNA, 14 bp, Homo sapiens
gcaggctggagtta

SEQ ID NO: 2765940 - DNA, 13 bp, Homo sapiens
gcatactattaaa

SEQ ID NO: 2765941 - DNA, 21 bp, Homo sapiens
gcatactattaaacatgctgt

SEQ ID NO: 2765942 - DNA, 22 bp, Homo sapiens
gcatattgcatactattaaaca

SEQ ID NO: 2765943 - DNA, 12 bp, Homo sapiens
ggattttcagcc

SEQ ID NO: 2765944 - DNA, 18 bp, Homo sapiens
ggcagtgcttggcccagg

SEQ ID NO: 2765945 - DNA, 22 bp, Homo sapiens
ggcagtgcttggcccaggagtt

SEQ ID NO: 2765946 - DNA, 20 bp, Homo sapiens
ggcccaggagtttggccaga

SEQ ID NO: 2765947 - DNA, 19 bp, Homo sapiens
ggccctttttcaataactg

SEQ ID NO: 2765948 - DNA, 16 bp, Homo sapiens
ggcttagaccctcatg

SEQ ID NO: 2765949 - DNA, 22 bp, Homo sapiens
ggcttagaccctcatgctgcca

SEQ ID NO: 2765950 - DNA, 23 bp, Homo sapiens
ggcttagaccctcatgctgccaa

SEQ ID NO: 2765951 - DNA, 21 bp, Homo sapiens
ggggcagtgcttggcccagga

SEQ ID NO: 2765952 - DNA, 14 bp, Homo sapiens
gggtggggcagtgc

SEQ ID NO: 2765953 - DNA, 20 bp, Homo sapiens
ggtgatttagcaggaagctg

SEQ ID NO: 2765954 - DNA, 18 bp, Homo sapiens
ggtggggcagtgcttggc

SEQ ID NO: 2765955 - DNA, 10 bp, Homo sapiens
ggttgtgaat

SEQ ID NO: 2765956 - DNA, 14 bp, Homo sapiens
gtaactctgtaatt

SEQ ID NO: 2765957 - DNA, 22 bp, Homo sapiens
gtaactgtttagatgaatgtca

SEQ ID NO: 2765958 - DNA, 14 bp, Homo sapiens
gtagaatgttttca

SEQ ID NO: 2765959 - DNA, 22 bp, Homo sapiens
gtattttctccaaatgttcact

SEQ ID NO: 2765960 - DNA, 17 bp, Homo sapiens
gtcagttgttatttatt

SEQ ID NO: 2765961 - DNA, 19 bp, Homo sapiens
gtcctattatattcattct

SEQ ID NO: 2765962 - DNA, 20 bp, Homo sapiens
gtcctgtcggagccctgtct

SEQ ID NO: 2765963 - DNA, 21 bp, Homo sapiens
gtcctgtcggagccctgtctc

SEQ ID NO: 2765964 - DNA, 13 bp, Homo sapiens
gtgcgtcctgtcg

SEQ ID NO: 2765965 - DNA, 13 bp, Homo sapiens
gtgcttggcccag

SEQ ID NO: 2765966 - DNA, 15 bp, Homo sapiens
gtgcttggcccagga

SEQ ID NO: 2765967 - DNA, 16 bp, Homo sapiens
gtgcttggcccaggag

SEQ ID NO: 2765968 - DNA, 17 bp, Homo sapiens
gtgcttggcccaggagt

SEQ ID NO: 2765969 - DNA, 17 bp, Homo sapiens
gttattgaagcagagtg

SEQ ID NO: 2765970 - DNA, 18 bp, Homo sapiens
gttctccagtcattatgt

SEQ ID NO: 2765971 - DNA, 20 bp, Homo sapiens
gttctccagtcattatgtta

SEQ ID NO: 2765972 - DNA, 14 bp, Homo sapiens
gttgctaacagcaa

SEQ ID NO: 2765973 - DNA, 23 bp, Homo sapiens
gtttggccagaagtcaaggctta

SEQ ID NO: 2765974 - DNA, 13 bp, Homo sapiens
gtttgttccctgt

SEQ ID NO: 2765975 - DNA, 23 bp, Homo sapiens
gttttttaagggccctttttcaa

SEQ ID NO: 2765976 - DNA, 22 bp, Homo sapiens
taaacacattaaaggtactttg

SEQ ID NO: 2765977 - DNA, 22 bp, Homo sapiens
taaactacattaggttgtgaat

SEQ ID NO: 2765978 - DNA, 12 bp, Homo sapiens
taaactcatttc

SEQ ID NO: 2765979 - DNA, 17 bp, Homo sapiens
taaactcatttctagca

SEQ ID NO: 2765980 - DNA, 20 bp, Homo sapiens
taaactctgagtgcaaactt

SEQ ID NO: 2765981 - DNA, 15 bp, Homo sapiens
taaatattttgactt

SEQ ID NO: 2765982 - DNA, 20 bp, Homo sapiens
taacaaaggatacttattta

SEQ ID NO: 2765983 - DNA, 21 bp, Homo sapiens
taacaaaggatacttatttaa

SEQ ID NO: 2765984 - DNA, 21 bp, Homo sapiens
taacaggcttagtgatgtaat

SEQ ID NO: 2765985 - DNA, 16 bp, Homo sapiens
taactatcactggttt

SEQ ID NO: 2765986 - DNA, 10 bp, Homo sapiens
taactggaac

SEQ ID NO: 2765987 - DNA, 16 bp, Homo sapiens
taagaactaaaatgtt

SEQ ID NO: 2765988 - DNA, 12 bp, Homo sapiens
taataaactcat

SEQ ID NO: 2765989 - DNA, 18 bp, Homo sapiens
taatgagcttaagaaatt

SEQ ID NO: 2765990 - DNA, 20 bp, Homo sapiens
taatttgaaggtagaatgtt

SEQ ID NO: 2765991 - DNA, 15 bp, Homo sapiens
tacatactttttggg

SEQ ID NO: 2765992 - DNA, 17 bp, Homo sapiens
tactaacatttatttga

SEQ ID NO: 2765993 - DNA, 16 bp, Homo sapiens
tactattaaacatgct

SEQ ID NO: 2765994 - DNA, 18 bp, Homo sapiens
tactattaaacatgctgt

SEQ ID NO: 2765995 - DNA, 16 bp, Homo sapiens
tagcatgaagacagag

SEQ ID NO: 2765996 - DNA, 12 bp, Homo sapiens
taggagcatgag

SEQ ID NO: 2765997 - DNA, 21 bp, Homo sapiens
tagtagaggtacacttgtgaa

SEQ ID NO: 2765998 - DNA, 17 bp, Homo sapiens
tataactttttatattc

SEQ ID NO: 2765999 - DNA, 21 bp, Homo sapiens
tatagatgttgctaacagcaa

SEQ ID NO: 2766000 - DNA, 18 bp, Homo sapiens
tatagcagtaaaaaatgg

SEQ ID NO: 2766001 - DNA, 18 bp, Homo sapiens
tatatagcaagacattat

SEQ ID NO: 2766002 - DNA, 20 bp, Homo sapiens
tatattcattctttttgaaa

SEQ ID NO: 2766003 - DNA, 17 bp, Homo sapiens
tatattctcagcagagt

SEQ ID NO: 2766004 - DNA, 20 bp, Homo sapiens
tatcacttccatgacataag

SEQ ID NO: 2766005 - DNA, 20 bp, Homo sapiens
tatcagaactatgtttttgt

SEQ ID NO: 2766006 - DNA, 19 bp, Homo sapiens
tatcctaataaaaaggtga

SEQ ID NO: 2766007 - DNA, 20 bp, Homo sapiens
tatcctagtcattcttccct

SEQ ID NO: 2766008 - DNA, 18 bp, Homo sapiens
tatctgttcatatggata

SEQ ID NO: 2766009 - DNA, 14 bp, Homo sapiens
tatgatgactgttt

SEQ ID NO: 2766010 - DNA, 20 bp, Homo sapiens
tatgattgcctttttataac

SEQ ID NO: 2766011 - DNA, 23 bp, Homo sapiens
tatgattgcctttttataacttt

SEQ ID NO: 2766012 - DNA, 20 bp, Homo sapiens
tatgtgcacatctgttttgt

SEQ ID NO: 2766013 - DNA, 13 bp, Homo sapiens
tatgtgttctatt

SEQ ID NO: 2766014 - DNA, 13 bp, Homo sapiens
tatgttaatattt

SEQ ID NO: 2766015 - DNA, 16 bp, Homo sapiens
tatgttaatatttctg

SEQ ID NO: 2766016 - DNA, 15 bp, Homo sapiens
tattaaacatgctgt

SEQ ID NO: 2766017 - DNA, 13 bp, Homo sapiens
tattatattcatt

SEQ ID NO: 2766018 - DNA, 21 bp, Homo sapiens
tattctcagcagagtgcttta

SEQ ID NO: 2766019 - DNA, 14 bp, Homo sapiens
tattgatgttttca

SEQ ID NO: 2766020 - DNA, 23 bp, Homo sapiens
tattgcatactattaaacatgct

SEQ ID NO: 2766021 - DNA, 15 bp, Homo sapiens
tatttaaatagatga

SEQ ID NO: 2766022 - DNA, 13 bp, Homo sapiens
tatttaatctttt

SEQ ID NO: 2766023 - DNA, 13 bp, Homo sapiens
tatttatttgtga

SEQ ID NO: 2766024 - DNA, 15 bp, Homo sapiens
tatttgtgagactgt

SEQ ID NO: 2766025 - DNA, 12 bp, Homo sapiens
tattttactttt

SEQ ID NO: 2766026 - DNA, 13 bp, Homo sapiens
tattttacttttt

SEQ ID NO: 2766027 - DNA, 20 bp, Homo sapiens
tattttgacttgttgagggt

SEQ ID NO: 2766028 - DNA, 20 bp, Homo sapiens
tatttttgtttttattaaaa

SEQ ID NO: 2766029 - DNA, 12 bp, Homo sapiens
tcaaactaacag

SEQ ID NO: 2766030 - DNA, 19 bp, Homo sapiens
tcaatctggattcatattt

SEQ ID NO: 2766031 - DNA, 12 bp, Homo sapiens
tcaattgtgaaa

SEQ ID NO: 2766032 - DNA, 20 bp, Homo sapiens
tcaattgtgaaaaaatttac

SEQ ID NO: 2766033 - DNA, 22 bp, Homo sapiens
tcacagcttatttcctcatttt

SEQ ID NO: 2766034 - DNA, 16 bp, Homo sapiens
tcagaactatgttttt

SEQ ID NO: 2766035 - DNA, 15 bp, Homo sapiens
tcagttgttatttat

SEQ ID NO: 2766036 - DNA, 12 bp, Homo sapiens
tcagtttggttg

SEQ ID NO: 2766037 - DNA, 15 bp, Homo sapiens
tcatatggataaata

SEQ ID NO: 2766038 - DNA, 13 bp, Homo sapiens
tcatgctgccaat

SEQ ID NO: 2766039 - DNA, 16 bp, Homo sapiens
tcattatgttaatatt

SEQ ID NO: 2766040 - DNA, 21 bp, Homo sapiens
tcattctttttgaaatgtcaa

SEQ ID NO: 2766041 - DNA, 21 bp, Homo sapiens
tccagtcattatgttaatatt

SEQ ID NO: 2766042 - DNA, 15 bp, Homo sapiens
tcccattcttggccc

SEQ ID NO: 2766043 - DNA, 16 bp, Homo sapiens
tcccattcttggccca

SEQ ID NO: 2766044 - DNA, 17 bp, Homo sapiens
tccccctggcactggtt

SEQ ID NO: 2766045 - DNA, 14 bp, Homo sapiens
tcccctctcctcca

SEQ ID NO: 2766046 - DNA, 16 bp, Homo sapiens
tcccttggacatttta

SEQ ID NO: 2766047 - DNA, 18 bp, Homo sapiens
tcccttggacattttatg

SEQ ID NO: 2766048 - DNA, 11 bp, Homo sapiens
tcctaaatagc

SEQ ID NO: 2766049 - DNA, 22 bp, Homo sapiens
tcctgtcggagccctgtctcct

SEQ ID NO: 2766050 - DNA, 18 bp, Homo sapiens
tcgctccaccttgcagct

SEQ ID NO: 2766051 - DNA, 15 bp, Homo sapiens
tcggagccctgtctc

SEQ ID NO: 2766052 - DNA, 12 bp, Homo sapiens
tctagcatgaag

SEQ ID NO: 2766053 - DNA, 13 bp, Homo sapiens
tctatttatttat

SEQ ID NO: 2766054 - DNA, 21 bp, Homo sapiens
tctatttctggatgaatgccc

SEQ ID NO: 2766055 - DNA, 15 bp, Homo sapiens
tctcaaactaacagg

SEQ ID NO: 2766056 - DNA, 14 bp, Homo sapiens
tctcagcagagtgc

SEQ ID NO: 2766057 - DNA, 22 bp, Homo sapiens
tctctgtaataaactcatttct

SEQ ID NO: 2766058 - DNA, 12 bp, Homo sapiens
tctgactataac

SEQ ID NO: 2766059 - DNA, 22 bp, Homo sapiens
tctgagtgcaaacttcagagtt

SEQ ID NO: 2766060 - DNA, 19 bp, Homo sapiens
tctggattcatatttaatt

SEQ ID NO: 2766061 - DNA, 24 bp, Homo sapiens
tctgtaataaactcatttctagca

SEQ ID NO: 2766062 - DNA, 15 bp, Homo sapiens
tctgtatgtgttcta

SEQ ID NO: 2766063 - DNA, 22 bp, Homo sapiens
tcttctatataattcctgtttt

SEQ ID NO: 2766064 - DNA, 14 bp, Homo sapiens
tctttttgaaatgt

SEQ ID NO: 2766065 - DNA, 13 bp, Homo sapiens
tgaaatgtcaacc

SEQ ID NO: 2766066 - DNA, 12 bp, Homo sapiens
tgaagcagagtg

SEQ ID NO: 2766067 - DNA, 18 bp, Homo sapiens
tgaagtaaaatgtggcag

SEQ ID NO: 2766068 - DNA, 19 bp, Homo sapiens
tgaagtaaaatgtggcagg

SEQ ID NO: 2766069 - DNA, 20 bp, Homo sapiens
tgaatgcaggttttatcaga

SEQ ID NO: 2766070 - DNA, 15 bp, Homo sapiens
tgaatgtcagttgtt

SEQ ID NO: 2766071 - DNA, 14 bp, Homo sapiens
tgaatttgcctaat

SEQ ID NO: 2766072 - DNA, 14 bp, Homo sapiens
tgacagattgaatt

SEQ ID NO: 2766073 - DNA, 14 bp, Homo sapiens
tgacattgcacctg

SEQ ID NO: 2766074 - DNA, 14 bp, Homo sapiens
tgctgatttaaaca

SEQ ID NO: 2766075 - DNA, 16 bp, Homo sapiens
tgctgccaatatccta

SEQ ID NO: 2766076 - DNA, 22 bp, Homo sapiens
tgctgccaatatcctaataaaa

SEQ ID NO: 2766077 - DNA, 11 bp, Homo sapiens
tgctgtacata

SEQ ID NO: 2766078 - DNA, 15 bp, Homo sapiens
tgctgtacatacttt

SEQ ID NO: 2766079 - DNA, 17 bp, Homo sapiens
tgctgtacatacttttt

SEQ ID NO: 2766080 - DNA, 18 bp, Homo sapiens
tgcttgctgctgatttaa

SEQ ID NO: 2766081 - DNA, 18 bp, Homo sapiens
tgcttggcccaggagttt

SEQ ID NO: 2766082 - DNA, 19 bp, Homo sapiens
tgcttgtacactcattcat

SEQ ID NO: 2766083 - DNA, 17 bp, Homo sapiens
tggacattttatgtctt

SEQ ID NO: 2766084 - DNA, 20 bp, Homo sapiens
tggagttattgaagcagagt

SEQ ID NO: 2766085 - DNA, 17 bp, Homo sapiens
tggattcatatttaatt

SEQ ID NO: 2766086 - DNA, 19 bp, Homo sapiens
tggattgtgcctaatgtgt

SEQ ID NO: 2766087 - DNA, 20 bp, Homo sapiens
tggattgtgcctaatgtgtt

SEQ ID NO: 2766088 - DNA, 11 bp, Homo sapiens
tggcccaggag

SEQ ID NO: 2766089 - DNA, 13 bp, Homo sapiens
tggcccaggagtt

SEQ ID NO: 2766090 - DNA, 20 bp, Homo sapiens
tggcccaggagtttggccag

SEQ ID NO: 2766091 - DNA, 20 bp, Homo sapiens
tgggaaagggattttcagcc

SEQ ID NO: 2766092 - DNA, 15 bp, Homo sapiens
tggtagttttacagt

SEQ ID NO: 2766093 - DNA, 21 bp, Homo sapiens
tggttagtagaggtacacttg

SEQ ID NO: 2766094 - DNA, 16 bp, Homo sapiens
tggttattttactttt

SEQ ID NO: 2766095 - DNA, 15 bp, Homo sapiens
tggtttgttccctgt

SEQ ID NO: 2766096 - DNA, 20 bp, Homo sapiens
tgtaataaactcatttctag

SEQ ID NO: 2766097 - DNA, 20 bp, Homo sapiens
tgtacatactttttgggttt

SEQ ID NO: 2766098 - DNA, 15 bp, Homo sapiens
tgtacttttaagact

SEQ ID NO: 2766099 - DNA, 18 bp, Homo sapiens
tgtacttttaagactttg

SEQ ID NO: 2766100 - DNA, 15 bp, Homo sapiens
tgtcctattatattc

SEQ ID NO: 2766101 - DNA, 18 bp, Homo sapiens
tgtgatgacattccctgc

SEQ ID NO: 2766102 - DNA, 19 bp, Homo sapiens
tgtgatttttggtatttga

SEQ ID NO: 2766103 - DNA, 20 bp, Homo sapiens
tgtgatttttggtatttgaa

SEQ ID NO: 2766104 - DNA, 21 bp, Homo sapiens
tgtgatttttggtatttgaaa

SEQ ID NO: 2766105 - DNA, 17 bp, Homo sapiens
tgtgcacatctgttttg

SEQ ID NO: 2766106 - DNA, 19 bp, Homo sapiens
tgtgtgcgtcctgtcggag

SEQ ID NO: 2766107 - DNA, 14 bp, Homo sapiens
tgtgtggtcaacat

SEQ ID NO: 2766108 - DNA, 23 bp, Homo sapiens
tgtgtggtcaacatttctcatgt

SEQ ID NO: 2766109 - DNA, 13 bp, Homo sapiens
tgttaatatttta

SEQ ID NO: 2766110 - DNA, 15 bp, Homo sapiens
tgttatttattgaaa

SEQ ID NO: 2766111 - DNA, 22 bp, Homo sapiens
tgttctaaatatcccttggaca

SEQ ID NO: 2766112 - DNA, 16 bp, Homo sapiens
tgttgaaactttaaga

SEQ ID NO: 2766113 - DNA, 14 bp, Homo sapiens
tgttgctaacagca

SEQ ID NO: 2766114 - DNA, 15 bp, Homo sapiens
tgtttagatgaatgt

SEQ ID NO: 2766115 - DNA, 20 bp, Homo sapiens
tgtttagatgaatgtcagtt

SEQ ID NO: 2766116 - DNA, 17 bp, Homo sapiens
tgttttatatagcaaga

SEQ ID NO: 2766117 - DNA, 14 bp, Homo sapiens
ttaaacacattaaa

SEQ ID NO: 2766118 - DNA, 13 bp, Homo sapiens
ttaaatagatgac

SEQ ID NO: 2766119 - DNA, 11 bp, Homo sapiens
ttaaatgactc

SEQ ID NO: 2766120 - DNA, 22 bp, Homo sapiens
ttaccaattgaagtaaaatgtg

SEQ ID NO: 2766121 - DNA, 18 bp, Homo sapiens
ttagcaggaagctgtgag

SEQ ID NO: 2766122 - DNA, 20 bp, Homo sapiens
ttaggagaagtcttctattt

SEQ ID NO: 2766123 - DNA, 13 bp, Homo sapiens
ttaggttgtgaat

SEQ ID NO: 2766124 - DNA, 14 bp, Homo sapiens
ttataactttttat

SEQ ID NO: 2766125 - DNA, 19 bp, Homo sapiens
ttatatagcaagacattat

SEQ ID NO: 2766126 - DNA, 16 bp, Homo sapiens
ttatattctcagcaga

SEQ ID NO: 2766127 - DNA, 15 bp, Homo sapiens
ttatcagaactatgt

SEQ ID NO: 2766128 - DNA, 21 bp, Homo sapiens
ttatgattgcctttttataac

SEQ ID NO: 2766129 - DNA, 14 bp, Homo sapiens
ttattattaacaaa

SEQ ID NO: 2766130 - DNA, 22 bp, Homo sapiens
ttatttgagtggagttactgaa

SEQ ID NO: 2766131 - DNA, 19 bp, Homo sapiens
ttcaatctggattcatatt

SEQ ID NO: 2766132 - DNA, 23 bp, Homo sapiens
ttcaatctggattcatatttaat

SEQ ID NO: 2766133 - DNA, 18 bp, Homo sapiens
ttcactggtactctgcca

SEQ ID NO: 2766134 - DNA, 18 bp, Homo sapiens
ttcagtttatctgttcat

SEQ ID NO: 2766135 - DNA, 11 bp, Homo sapiens
ttcatagagaa

SEQ ID NO: 2766136 - DNA, 19 bp, Homo sapiens
ttcattagttttgaagatt

SEQ ID NO: 2766137 - DNA, 19 bp, Homo sapiens
ttcattctttttgaaatgt

SEQ ID NO: 2766138 - DNA, 17 bp, Homo sapiens
ttccacttgagtgtcaa

SEQ ID NO: 2766139 - DNA, 14 bp, Homo sapiens
ttccttcaagaatg

SEQ ID NO: 2766140 - DNA, 22 bp, Homo sapiens
ttctaaatatcccttggacatt

SEQ ID NO: 2766141 - DNA, 19 bp, Homo sapiens
ttctagcatgaagacagag

SEQ ID NO: 2766142 - DNA, 21 bp, Homo sapiens
ttctatataattcctgttttt

SEQ ID NO: 2766143 - DNA, 22 bp, Homo sapiens
ttctcatgttgaaactttaaga

SEQ ID NO: 2766144 - DNA, 14 bp, Homo sapiens
ttgaaatgatttca

SEQ ID NO: 2766145 - DNA, 19 bp, Homo sapiens
ttgaaggtagaatgttttc

SEQ ID NO: 2766146 - DNA, 19 bp, Homo sapiens
ttgactatttttgttttta

SEQ ID NO: 2766147 - DNA, 18 bp, Homo sapiens
ttgagggtatgttttata

SEQ ID NO: 2766148 - DNA, 16 bp, Homo sapiens
ttgcatactattaaac

SEQ ID NO: 2766149 - DNA, 19 bp, Homo sapiens
ttgcatactattaaacatg

SEQ ID NO: 2766150 - DNA, 13 bp, Homo sapiens
ttgctaacagcaa

SEQ ID NO: 2766151 - DNA, 21 bp, Homo sapiens
ttggaaaggaatgcaaagatg

SEQ ID NO: 2766152 - DNA, 13 bp, Homo sapiens
ttggcccaggagt

SEQ ID NO: 2766153 - DNA, 20 bp, Homo sapiens
ttggcccaggagtttggcca

SEQ ID NO: 2766154 - DNA, 23 bp, Homo sapiens
ttggcctgtctttggattgttaa

SEQ ID NO: 2766155 - DNA, 21 bp, Homo sapiens
ttgtaactgtttagatgaatg

SEQ ID NO: 2766156 - DNA, 22 bp, Homo sapiens
ttgtaactgtttagatgaatgt

SEQ ID NO: 2766157 - DNA, 22 bp, Homo sapiens
ttgtgaaggcaggggaatgtat

SEQ ID NO: 2766158 - DNA, 18 bp, Homo sapiens
ttgtgcctaatgtgtttg

SEQ ID NO: 2766159 - DNA, 16 bp, Homo sapiens
ttgtgtacttttaaga

SEQ ID NO: 2766160 - DNA, 15 bp, Homo sapiens
ttgttatttattgaa

SEQ ID NO: 2766161 - DNA, 23 bp, Homo sapiens
ttgtttaatggtagttttacagt

SEQ ID NO: 2766162 - DNA, 15 bp, Homo sapiens
tttaaatagatgaca

SEQ ID NO: 2766163 - DNA, 20 bp, Homo sapiens
tttaagggccctttttcaat

SEQ ID NO: 2766164 - DNA, 14 bp, Homo sapiens
tttactttaaacta

SEQ ID NO: 2766165 - DNA, 22 bp, Homo sapiens
tttagatgaatgtcagttgtta

SEQ ID NO: 2766166 - DNA, 17 bp, Homo sapiens
tttatcagaactatgtt

SEQ ID NO: 2766167 - DNA, 22 bp, Homo sapiens
tttatcctagtcattcttccct

SEQ ID NO: 2766168 - DNA, 23 bp, Homo sapiens
tttatcctagtcattcttcccta

SEQ ID NO: 2766169 - DNA, 22 bp, Homo sapiens
tttcacagtgtgtggtcaacat

SEQ ID NO: 2766170 - DNA, 18 bp, Homo sapiens
tttctcacagaagatgaa

SEQ ID NO: 2766171 - DNA, 13 bp, Homo sapiens
tttctcatgttga

SEQ ID NO: 2766172 - DNA, 15 bp, Homo sapiens
tttctcatgttgaaa

SEQ ID NO: 2766173 - DNA, 21 bp, Homo sapiens
tttgaaggtagaatgttttca

SEQ ID NO: 2766174 - DNA, 22 bp, Homo sapiens
tttgagtggagttactgaacag

SEQ ID NO: 2766175 - DNA, 18 bp, Homo sapiens
tttggaaaggaatgcaaa

SEQ ID NO: 2766176 - DNA, 14 bp, Homo sapiens
tttggccagaagtc

SEQ ID NO: 2766177 - DNA, 17 bp, Homo sapiens
tttgggtttatttggaa

SEQ ID NO: 2766178 - DNA, 13 bp, Homo sapiens
tttggtatttgaa

SEQ ID NO: 2766179 - DNA, 22 bp, Homo sapiens
tttggttggtaactctgtaatt

SEQ ID NO: 2766180 - DNA, 13 bp, Homo sapiens
tttggtttctagc

SEQ ID NO: 2766181 - DNA, 13 bp, Homo sapiens
tttgtgtactttt

SEQ ID NO: 2766182 - DNA, 15 bp, Homo sapiens
ttttattattaacaa

SEQ ID NO: 2766183 - DNA, 15 bp, Homo sapiens
ttttcaaatgttctc

SEQ ID NO: 2766184 - DNA, 23 bp, Homo sapiens
ttttccagtaatgagcttaagaa

SEQ ID NO: 2766185 - DNA, 13 bp, Homo sapiens
ttttgaaatgtca

SEQ ID NO: 2766186 - DNA, 16 bp, Homo sapiens
ttttgccaatttgcac

SEQ ID NO: 2766187 - DNA, 19 bp, Homo sapiens
ttttgccaatttgcacatt

SEQ ID NO: 2766188 - DNA, 18 bp, Homo sapiens
ttttgggtttatttggaa

SEQ ID NO: 2766189 - DNA, 14 bp, Homo sapiens
ttttggtatttgaa

SEQ ID NO: 2766190 - DNA, 20 bp, Homo sapiens
tttttaagggccctttttca

SEQ ID NO: 2766191 - DNA, 21 bp, Homo sapiens
tttttatattctcagcagagt

SEQ ID NO: 2766192 - DNA, 21 bp, Homo sapiens
tttttccttcaagaatgcagt

SEQ ID NO: 2766193 - DNA, 23 bp, Homo sapiens
ataactggaacactctataacaa

SEQ ID NO: 2766194 - DNA, 22 bp, Homo sapiens
ataactttttatattctcagca

SEQ ID NO: 2766195 - DNA, 21 bp, Homo sapiens
ataagtgctattgcagagccg

SEQ ID NO: 2766196 - DNA, 18 bp, Homo sapiens
atactgccttgtttaatg

SEQ ID NO: 2766197 - DNA, 15 bp, Homo sapiens
atacttatttaaata

SEQ ID NO: 2766198 - DNA, 22 bp, Homo sapiens
atacttatttaaatagatgaca

SEQ ID NO: 2766199 - DNA, 14 bp, Homo sapiens
atagatgttgctaa

SEQ ID NO: 2766200 - DNA, 16 bp, Homo sapiens
atagcaagacattata

SEQ ID NO: 2766201 - DNA, 22 bp, Homo sapiens
atagcagccctcaattgtgaaa

SEQ ID NO: 2766202 - DNA, 15 bp, Homo sapiens
atagcagtaaaaaat

SEQ ID NO: 2766203 - DNA, 19 bp, Homo sapiens
atagcatgtcctaatgctt

SEQ ID NO: 2766204 - DNA, 14 bp, Homo sapiens
atatcctaataaaa

SEQ ID NO: 2766205 - DNA, 20 bp, Homo sapiens
atatcctaataaaaaggtga

SEQ ID NO: 2766206 - DNA, 18 bp, Homo sapiens
atattctcagcagagtgc

SEQ ID NO: 2766207 - DNA, 23 bp, Homo sapiens
atatttctgaggagcctgcaaca

SEQ ID NO: 2766208 - DNA, 13 bp, Homo sapiens
atcatttcaagaa

SEQ ID NO: 2766209 - DNA, 17 bp, Homo sapiens
atcccttggacatttta

SEQ ID NO: 2766210 - DNA, 19 bp, Homo sapiens
atcccttggacattttatg

SEQ ID NO: 2766211 - DNA, 16 bp, Homo sapiens
atccctttcccttggt

SEQ ID NO: 2766212 - DNA, 15 bp, Homo sapiens
atcctaataaaaagg

SEQ ID NO: 2766213 - DNA, 21 bp, Homo sapiens
atctgtgatgacattccctgc

SEQ ID NO: 2766214 - DNA, 12 bp, Homo sapiens
atctgttacaca

SEQ ID NO: 2766215 - DNA, 21 bp, Homo sapiens
atgaatgcccagtgagactgt

SEQ ID NO: 2766216 - DNA, 19 bp, Homo sapiens
atgacattgactatttttg

SEQ ID NO: 2766217 - DNA, 16 bp, Homo sapiens
atgcccagtgagactg

SEQ ID NO: 2766218 - DNA, 16 bp, Homo sapiens
atgcctaccaatattt

SEQ ID NO: 2766219 - DNA, 23 bp, Homo sapiens
atgcctaccaatatttaatcttt

SEQ ID NO: 2766220 - DNA, 21 bp, Homo sapiens
atgctgccaatatcctaataa

SEQ ID NO: 2766221 - DNA, 12 bp, Homo sapiens
atgctgtacata

SEQ ID NO: 2766222 - DNA, 16 bp, Homo sapiens
atgctgtacatacttt

SEQ ID NO: 2766223 - DNA, 16 bp, Homo sapiens
atgtcagtatttcaac

SEQ ID NO: 2766224 - DNA, 17 bp, Homo sapiens
atgtcagttgttattta

SEQ ID NO: 2766225 - DNA, 19 bp, Homo sapiens
atgtgcacatctgttttgt

SEQ ID NO: 2766226 - DNA, 13 bp, Homo sapiens
atgttaatatttt

SEQ ID NO: 2766227 - DNA, 16 bp, Homo sapiens
attaaacatgctgtac

SEQ ID NO: 2766228 - DNA, 21 bp, Homo sapiens
attaaatgactcttccctcaa

SEQ ID NO: 2766229 - DNA, 20 bp, Homo sapiens
attaatgtcagtatttcaac

SEQ ID NO: 2766230 - DNA, 17 bp, Homo sapiens
attattgatgttttcat

SEQ ID NO: 2766231 - DNA, 14 bp, Homo sapiens
attcattagttttg

SEQ ID NO: 2766232 - DNA, 15 bp, Homo sapiens
attcattctttttga

SEQ ID NO: 2766233 - DNA, 15 bp, Homo sapiens
attctatgttaatat

SEQ ID NO: 2766234 - DNA, 14 bp, Homo sapiens
attgaagcagagtg

SEQ ID NO: 2766235 - DNA, 17 bp, Homo sapiens
attgcacctggatgtac

SEQ ID NO: 2766236 - DNA, 20 bp, Homo sapiens
attgcatactattaaacatg

SEQ ID NO: 2766237 - DNA, 22 bp, Homo sapiens
attgcatactattaaacatgct

SEQ ID NO: 2766238 - DNA, 19 bp, Homo sapiens
attgggcacatcatttcaa

SEQ ID NO: 2766239 - DNA, 14 bp, Homo sapiens
atttaaatagatga

SEQ ID NO: 2766240 - DNA, 14 bp, Homo sapiens
atttaatcttttat

SEQ ID NO: 2766241 - DNA, 15 bp, Homo sapiens
atttaatttgaaggt

SEQ ID NO: 2766242 - DNA, 12 bp, Homo sapiens
atttattacaac

SEQ ID NO: 2766243 - DNA, 15 bp, Homo sapiens
atttattgaaatgat

SEQ ID NO: 2766244 - DNA, 14 bp, Homo sapiens
atttatttattcat

SEQ ID NO: 2766245 - DNA, 23 bp, Homo sapiens
atttcaaacagtctcccttccta

SEQ ID NO: 2766246 - DNA, 17 bp, Homo sapiens
atttcacagtgtgtggt

SEQ ID NO: 2766247 - DNA, 14 bp, Homo sapiens
atttgcacattaaa

SEQ ID NO: 2766248 - DNA, 15 bp, Homo sapiens
atttgcacattaaat

SEQ ID NO: 2766249 - DNA, 19 bp, Homo sapiens
atttgcacattaaatgact

SEQ ID NO: 2766250 - DNA, 18 bp, Homo sapiens
atttggaaaggaatgcaa

SEQ ID NO: 2766251 - DNA, 23 bp, Homo sapiens
atttgttttgccaatttgcacat

SEQ ID NO: 2766252 - DNA, 14 bp, Homo sapiens
attttactttttgg

SEQ ID NO: 2766253 - DNA, 17 bp, Homo sapiens
attttctccaaatgttc

SEQ ID NO: 2766254 - DNA, 21 bp, Homo sapiens
atttttgtttttattaaaagg

SEQ ID NO: 2766255 - DNA, 24 bp, Homo sapiens
caaacccagtgttttaggagcatg

SEQ ID NO: 2766256 - DNA, 16 bp, Homo sapiens
caaactaacaggctta

SEQ ID NO: 2766257 - DNA, 17 bp, Homo sapiens
caaagcttttgcatatt

SEQ ID NO: 2766258 - DNA, 21 bp, Homo sapiens
caaaggatacttatttaaata

SEQ ID NO: 2766259 - DNA, 23 bp, Homo sapiens
caacatgccagccactgtgatag

SEQ ID NO: 2766260 - DNA, 22 bp, Homo sapiens
caacatttctcatgttgaaact

SEQ ID NO: 2766261 - DNA, 23 bp, Homo sapiens
caactggggtgggtggggcagtg

SEQ ID NO: 2766262 - DNA, 18 bp, Homo sapiens
caaggcttagaccctcat

SEQ ID NO: 2766263 - DNA, 19 bp, Homo sapiens
caaggcttagaccctcatg

SEQ ID NO: 2766264 - DNA, 22 bp, Homo sapiens
caaggcttagaccctcatgctg

SEQ ID NO: 2766265 - DNA, 16 bp, Homo sapiens
caagttagttcaatct

SEQ ID NO: 2766266 - DNA, 15 bp, Homo sapiens
caatatcctaataaa

SEQ ID NO: 2766267 - DNA, 21 bp, Homo sapiens
caatatcctaataaaaaggtg

SEQ ID NO: 2766268 - DNA, 20 bp, Homo sapiens
caatctggattcatatttaa

SEQ ID NO: 2766269 - DNA, 15 bp, Homo sapiens
caatttgcacattaa

SEQ ID NO: 2766270 - DNA, 23 bp, Homo sapiens
cacaaagaaccaccaggaaagca

SEQ ID NO: 2766271 - DNA, 13 bp, Homo sapiens
cacaaagcttttg

SEQ ID NO: 2766272 - DNA, 22 bp, Homo sapiens
caccttgcagctctccccttct

SEQ ID NO: 2766273 - DNA, 13 bp, Homo sapiens
cactctataacaa

SEQ ID NO: 2766274 - DNA, 14 bp, Homo sapiens
cactggtttggttc

SEQ ID NO: 2766275 - DNA, 12 bp, Homo sapiens
cactggttttaa

SEQ ID NO: 2766276 - DNA, 16 bp, Homo sapiens
cactgtcctattatat

SEQ ID NO: 2766277 - DNA, 20 bp, Homo sapiens
cacttcacgcccttggccat

SEQ ID NO: 2766278 - DNA, 17 bp, Homo sapiens
cagaagtcaaggcttag

SEQ ID NO: 2766279 - DNA, 21 bp, Homo sapiens
cagagaagattcttgtattta

SEQ ID NO: 2766280 - DNA, 10 bp, Homo sapiens
cagcagagtg

SEQ ID NO: 2766281 - DNA, 13 bp, Homo sapiens
cagccctcagaat

SEQ ID NO: 2766282 - DNA, 16 bp, Homo sapiens
cagctctccccttctc

SEQ ID NO: 2766283 - DNA, 13 bp, Homo sapiens
caggaagctgtga

SEQ ID NO: 2766284 - DNA, 16 bp, Homo sapiens
caggagtttggccaga

SEQ ID NO: 2766285 - DNA, 13 bp, Homo sapiens
caggctggagtta

SEQ ID NO: 2766286 - DNA, 16 bp, Homo sapiens
caggctggagttattg

SEQ ID NO: 2766287 - DNA, 23 bp, Homo sapiens
cagtcagggaaggtgcctctgga

SEQ ID NO: 2766288 - DNA, 19 bp, Homo sapiens
cagtcattatgttaatatt

SEQ ID NO: 2766289 - DNA, 12 bp, Homo sapiens
cagtgcttggcc

SEQ ID NO: 2766290 - DNA, 18 bp, Homo sapiens
cagtgcttggcccaggag

SEQ ID NO: 2766291 - DNA, 16 bp, Homo sapiens
cagtgttttaggagca

SEQ ID NO: 2766292 - DNA, 14 bp, Homo sapiens
cagttgttatttat

SEQ ID NO: 2766293 - DNA, 21 bp, Homo sapiens
cagtttggttggtaactctgt

SEQ ID NO: 2766294 - DNA, 19 bp, Homo sapiens
cagtttttttccttcaaga

SEQ ID NO: 2766295 - DNA, 13 bp, Homo sapiens
catagctgtgatt

SEQ ID NO: 2766296 - DNA, 21 bp, Homo sapiens
catattgcatactattaaaca

SEQ ID NO: 2766297 - DNA, 17 bp, Homo sapiens
catatttaatttgaagg

SEQ ID NO: 2766298 - DNA, 11 bp, Homo sapiens
catcatccctt

SEQ ID NO: 2766299 - DNA, 18 bp, Homo sapiens
catctgttacacaaagaa

SEQ ID NO: 2766300 - DNA, 13 bp, Homo sapiens
catgctgtacata

SEQ ID NO: 2766301 - DNA, 19 bp, Homo sapiens
catgctgtacatacttttt

SEQ ID NO: 2766302 - DNA, 13 bp, Homo sapiens
cattaaatgactc

SEQ ID NO: 2766303 - DNA, 14 bp, Homo sapiens
cattaggttgtgaa

SEQ ID NO: 2766304 - DNA, 13 bp, Homo sapiens
cattagttttgaa

SEQ ID NO: 2766305 - DNA, 14 bp, Homo sapiens
cattagttttgaag

SEQ ID NO: 2766306 - DNA, 17 bp, Homo sapiens
cattatatagcagtaaa

SEQ ID NO: 2766307 - DNA, 20 bp, Homo sapiens
cattatatagcagtaaaaaa

SEQ ID NO: 2766308 - DNA, 14 bp, Homo sapiens
cattatgttaatat

SEQ ID NO: 2766309 - DNA, 17 bp, Homo sapiens
cattatgttaatatttc

SEQ ID NO: 2766310 - DNA, 13 bp, Homo sapiens
cattctttttgaa

SEQ ID NO: 2766311 - DNA, 14 bp, Homo sapiens
catttcaagaagtc

SEQ ID NO: 2766312 - DNA, 16 bp, Homo sapiens
catttctcatgttgaa

SEQ ID NO: 2766313 - DNA, 16 bp, Homo sapiens
ccaatatcctaataaa

SEQ ID NO: 2766314 - DNA, 21 bp, Homo sapiens
ccaatatttaatcttttatga

SEQ ID NO: 2766315 - DNA, 20 bp, Homo sapiens
ccaatttgcacattaaatga

SEQ ID NO: 2766316 - DNA, 18 bp, Homo sapiens
ccagaagtcaaggcttag

SEQ ID NO: 2766317 - DNA, 15 bp, Homo sapiens
ccaggagtttggcca

SEQ ID NO: 2766318 - DNA, 16 bp, Homo sapiens
cccaggagtttggcca

SEQ ID NO: 2766319 - DNA, 19 bp, Homo sapiens
ccctgtctcctctctctgt

SEQ ID NO: 2766320 - DNA, 16 bp, Homo sapiens
ccctgtgtcatttcaa

SEQ ID NO: 2766321 - DNA, 13 bp, Homo sapiens
cccttctctgtat

SEQ ID NO: 2766322 - DNA, 22 bp, Homo sapiens
ccctttttcaataactggaaca

SEQ ID NO: 2766323 - DNA, 18 bp, Homo sapiens
tgaaggtagaatgttttc

SEQ ID NO: 2766324 - DNA, 19 bp, Homo sapiens
tgaaggtagaatgttttca

SEQ ID NO: 2766325 - DNA, 14 bp, Homo sapiens
tgacattgactatt

SEQ ID NO: 2766326 - DNA, 17 bp, Homo sapiens
tgacattgcacctggat

SEQ ID NO: 2766327 - DNA, 16 bp, Homo sapiens
tgactataaccttgtt

SEQ ID NO: 2766328 - DNA, 23 bp, Homo sapiens
tgagagcagtttggtttctagca

SEQ ID NO: 2766329 - DNA, 14 bp, Homo sapiens
tgagtggagttact

SEQ ID NO: 2766330 - DNA, 15 bp, Homo sapiens
tgatgacattccctg

SEQ ID NO: 2766331 - DNA, 22 bp, Homo sapiens
tgattgcctttttataactttt

SEQ ID NO: 2766332 - DNA, 21 bp, Homo sapiens
tgattgggcacatcatttcaa

SEQ ID NO: 2766333 - DNA, 17 bp, Homo sapiens
tgatttaaacacattaa

SEQ ID NO: 2766334 - DNA, 14 bp, Homo sapiens
tgatttcacagtgt

SEQ ID NO: 2766335 - DNA, 14 bp, Homo sapiens
tgcacactgtccta

SEQ ID NO: 2766336 - DNA, 16 bp, Homo sapiens
tgcacgcacactgtct

SEQ ID NO: 2766337 - DNA, 22 bp, Homo sapiens
tgcagagtaggggtctgtcttt

SEQ ID NO: 2766338 - DNA, 20 bp, Homo sapiens
tgcagctctccccttctctg

SEQ ID NO: 2766339 - DNA, 16 bp, Homo sapiens
tgcagggacagagcat

SEQ ID NO: 2766340 - DNA, 14 bp, Homo sapiens
tgcagtactaacat

SEQ ID NO: 2766341 - DNA, 12 bp, Homo sapiens
tgcatactatta

SEQ ID NO: 2766342 - DNA, 16 bp, Homo sapiens
tgcatactattaaaca

SEQ ID NO: 2766343 - DNA, 17 bp, Homo sapiens
tgcatactattaaacat

SEQ ID NO: 2766344 - DNA, 23 bp, Homo sapiens
tgcatattgcatactattaaaca

SEQ ID NO: 2766345 - DNA, 18 bp, Homo sapiens
tgcatctagcctcaagct

SEQ ID NO: 2766346 - DNA, 15 bp, Homo sapiens
tgccaatatcctaat

SEQ ID NO: 2766347 - DNA, 18 bp, Homo sapiens
tgccaatatcctaataaa

SEQ ID NO: 2766348 - DNA, 23 bp, Homo sapiens
tgccaatatcctaataaaaaggt

SEQ ID NO: 2766349 - DNA, 15 bp, Homo sapiens
tgccaatttgcacat

SEQ ID NO: 2766350 - DNA, 17 bp, Homo sapiens
tgccaatttgcacatta

SEQ ID NO: 2766351 - DNA, 21 bp, Homo sapiens
tgccaatttgcacattaaatg

SEQ ID NO: 2766352 - DNA, 17 bp, Homo sapiens
tgccagccactgtgata

SEQ ID NO: 2766353 - DNA, 17 bp, Homo sapiens
tgcctaatatgatgact

SEQ ID NO: 2766354 - DNA, 22 bp, Homo sapiens
tgctaacagcaacacaaagctt

SEQ ID NO: 2766355 - DNA, 15 bp, Homo sapiens
tgctgccaatatcct

SEQ ID NO: 2766356 - DNA, 18 bp, Homo sapiens
tgctgccaatatcctaat

SEQ ID NO: 2766357 - DNA, 19 bp, Homo sapiens
tgctgccaatatcctaata

SEQ ID NO: 2766358 - DNA, 22 bp, Homo sapiens
tgctgtacatactttttgggtt

SEQ ID NO: 2766359 - DNA, 12 bp, Homo sapiens
tgcttggcccag

SEQ ID NO: 2766360 - DNA, 23 bp, Homo sapiens
tgcttggcccaggagtttggcca

SEQ ID NO: 2766361 - DNA, 16 bp, Homo sapiens
tgcttgtacactcatt

SEQ ID NO: 2766362 - DNA, 22 bp, Homo sapiens
tgcttgtacactcattcattac

SEQ ID NO: 2766363 - DNA, 14 bp, Homo sapiens
tggaaaagaataaa

SEQ ID NO: 2766364 - DNA, 12 bp, Homo sapiens
tggaaaggaatg

SEQ ID NO: 2766365 - DNA, 21 bp, Homo sapiens
tggaaaggaatgcaaagatga

SEQ ID NO: 2766366 - DNA, 22 bp, Homo sapiens
tggaaaggaatgcaaagatgaa

SEQ ID NO: 2766367 - DNA, 11 bp, Homo sapiens
tggacatttta

SEQ ID NO: 2766368 - DNA, 16 bp, Homo sapiens
tggacattttatgtct

SEQ ID NO: 2766369 - DNA, 16 bp, Homo sapiens
tggcatcttacatctg

SEQ ID NO: 2766370 - DNA, 19 bp, Homo sapiens
tggcccaggagtttggcca

SEQ ID NO: 2766371 - DNA, 15 bp, Homo sapiens
tgggcacatcatttc

SEQ ID NO: 2766372 - DNA, 18 bp, Homo sapiens
tggggcagtgcttggccc

SEQ ID NO: 2766373 - DNA, 18 bp, Homo sapiens
tgggtatagatgttgcta

SEQ ID NO: 2766374 - DNA, 20 bp, Homo sapiens
tgtccagccccgtagacgtg

SEQ ID NO: 2766375 - DNA, 22 bp, Homo sapiens
tgtcctaatgcttgctgctgat

SEQ ID NO: 2766376 - DNA, 12 bp, Homo sapiens
tgtgaaaaaatt

SEQ ID NO: 2766377 - DNA, 23 bp, Homo sapiens
tgtgaaaaaatttactttaaact

SEQ ID NO: 2766378 - DNA, 23 bp, Homo sapiens
tgtgaaggcaggggaatgtatgt

SEQ ID NO: 2766379 - DNA, 14 bp, Homo sapiens
tgtgcctaatgtgt

SEQ ID NO: 2766380 - DNA, 15 bp, Homo sapiens
tgtgcctaatgtgtt

SEQ ID NO: 2766381 - DNA, 18 bp, Homo sapiens
tgttatttattgaaatga

SEQ ID NO: 2766382 - DNA, 15 bp, Homo sapiens
tgtttaatggtagtt

SEQ ID NO: 2766383 - DNA, 22 bp, Homo sapiens
tgtttgagcatcgcttaggaga

SEQ ID NO: 2766384 - DNA, 16 bp, Homo sapiens
tgttttatcttctata

SEQ ID NO: 2766385 - DNA, 22 bp, Homo sapiens
tgttttgccaatttgcacatta

SEQ ID NO: 2766386 - DNA, 18 bp, Homo sapiens
ttaaatgactcttccctc

SEQ ID NO: 2766387 - DNA, 19 bp, Homo sapiens
ttaatggtagttttacagt

SEQ ID NO: 2766388 - DNA, 19 bp, Homo sapiens
ttactaaaagttttgagaa

SEQ ID NO: 2766389 - DNA, 19 bp, Homo sapiens
ttagaccctcatgctgcca

SEQ ID NO: 2766390 - DNA, 16 bp, Homo sapiens
ttataactttttatat

SEQ ID NO: 2766391 - DNA, 21 bp, Homo sapiens
ttatattctcagcagagtgct

SEQ ID NO: 2766392 - DNA, 13 bp, Homo sapiens
ttatgttaatatt

SEQ ID NO: 2766393 - DNA, 16 bp, Homo sapiens
ttattaacaaaacagt

SEQ ID NO: 2766394 - DNA, 12 bp, Homo sapiens
ttattgaagcag

SEQ ID NO: 2766395 - DNA, 15 bp, Homo sapiens
ttattgaagcagagt

SEQ ID NO: 2766396 - DNA, 16 bp, Homo sapiens
ttattgaagcagagtg

SEQ ID NO: 2766397 - DNA, 15 bp, Homo sapiens
ttattgatgttttca

SEQ ID NO: 2766398 - DNA, 15 bp, Homo sapiens
ttattttactttttg

SEQ ID NO: 2766399 - DNA, 23 bp, Homo sapiens
ttcaagaagtcccctctcctcca

SEQ ID NO: 2766400 - DNA, 23 bp, Homo sapiens
ttcaagaatgcagtactaacatt

SEQ ID NO: 2766401 - DNA, 22 bp, Homo sapiens
ttcaataactggaacactctat

SEQ ID NO: 2766402 - DNA, 15 bp, Homo sapiens
ttcagtttatctgtt

SEQ ID NO: 2766403 - DNA, 18 bp, Homo sapiens
ttcatagagaatataaaa

SEQ ID NO: 2766404 - DNA, 21 bp, Homo sapiens
ttccacttgagtgtcaagctg

SEQ ID NO: 2766405 - DNA, 15 bp, Homo sapiens
ttccctcaaatgtgt

SEQ ID NO: 2766406 - DNA, 13 bp, Homo sapiens
ttctcagcagagt

SEQ ID NO: 2766407 - DNA, 14 bp, Homo sapiens
ttctttttgaaatg

SEQ ID NO: 2766408 - DNA, 15 bp, Homo sapiens
ttgaaacactggttt

SEQ ID NO: 2766409 - DNA, 13 bp, Homo sapiens
ttgaagattctat

SEQ ID NO: 2766410 - DNA, 22 bp, Homo sapiens
ttgaagattctatgttaatatt

SEQ ID NO: 2766411 - DNA, 12 bp, Homo sapiens
ttgaagcagagt

SEQ ID NO: 2766412 - DNA, 14 bp, Homo sapiens
ttgaagcagagtgg

SEQ ID NO: 2766413 - DNA, 16 bp, Homo sapiens
ttgaaggtagaatgtt

SEQ ID NO: 2766414 - DNA, 14 bp, Homo sapiens
ttgaagtaaaatgt

SEQ ID NO: 2766415 - DNA, 12 bp, Homo sapiens
ttgactattttt

SEQ ID NO: 2766416 - DNA, 21 bp, Homo sapiens
ttgactatttttgtttttatt

SEQ ID NO: 2766417 - DNA, 23 bp, Homo sapiens
ttgcacattaaatgactcttccc

SEQ ID NO: 2766418 - DNA, 18 bp, Homo sapiens
ttgcatactattaaacat

SEQ ID NO: 2766419 - DNA, 22 bp, Homo sapiens
ttgccaatttgcacattaaatg

SEQ ID NO: 2766420 - DNA, 18 bp, Homo sapiens
ttgccttggctgcagttt

SEQ ID NO: 2766421 - DNA, 17 bp, Homo sapiens
ttgcctttttataactt

SEQ ID NO: 2766422 - DNA, 19 bp, Homo sapiens
ttgctgctgatttaaacac

SEQ ID NO: 2766423 - DNA, 21 bp, Homo sapiens
ttgctgctgatttaaacacat

SEQ ID NO: 2766424 - DNA, 16 bp, Homo sapiens
ttggacattttatgtc

SEQ ID NO: 2766425 - DNA, 20 bp, Homo sapiens
ttggacattttatgtctttc

SEQ ID NO: 2766426 - DNA, 21 bp, Homo sapiens
ttggcccaggagtttggccag

SEQ ID NO: 2766427 - DNA, 20 bp, Homo sapiens
ttggttctggactaaaacta

SEQ ID NO: 2766428 - DNA, 20 bp, Homo sapiens
ttgtgaaaaaatttacttta

SEQ ID NO: 2766429 - DNA, 22 bp, Homo sapiens
ttgttccctgtgtcatttcaaa

SEQ ID NO: 2766430 - DNA, 19 bp, Homo sapiens
ttgttgagggtatgtttta

SEQ ID NO: 2766431 - DNA, 12 bp, Homo sapiens
ttgtttaatggt

SEQ ID NO: 2766432 - DNA, 17 bp, Homo sapiens
tttaaagatgtagacag

SEQ ID NO: 2766433 - DNA, 16 bp, Homo sapiens
tttaagaccctctcaa

SEQ ID NO: 2766434 - DNA, 21 bp, Homo sapiens
tttaagggccctttttcaata

SEQ ID NO: 2766435 - DNA, 15 bp, Homo sapiens
tttaatcttttatga

SEQ ID NO: 2766436 - DNA, 22 bp, Homo sapiens
tttaatttgaaggtagaatgtt

SEQ ID NO: 2766437 - DNA, 17 bp, Homo sapiens
tttagatgaatgtcagt

SEQ ID NO: 2766438 - DNA, 18 bp, Homo sapiens
tttagatgaatgtcagtt

SEQ ID NO: 2766439 - DNA, 18 bp, Homo sapiens
tttatatagcaagacatt

SEQ ID NO: 2766440 - DNA, 22 bp, Homo sapiens
tttatatagcaagacattatat

SEQ ID NO: 2766441 - DNA, 16 bp, Homo sapiens
tttatcagaactatgt

SEQ ID NO: 2766442 - DNA, 15 bp, Homo sapiens
tttatctgttcatat

SEQ ID NO: 2766443 - DNA, 16 bp, Homo sapiens
tttatctgttcatatg

SEQ ID NO: 2766444 - DNA, 22 bp, Homo sapiens
tttatttggaaaggaatgcaaa

SEQ ID NO: 2766445 - DNA, 14 bp, Homo sapiens
tttcaaatgttctc

SEQ ID NO: 2766446 - DNA, 18 bp, Homo sapiens
tttcctcatttttataat

SEQ ID NO: 2766447 - DNA, 16 bp, Homo sapiens
tttgaagattctatgt

SEQ ID NO: 2766448 - DNA, 13 bp, Homo sapiens
tttgcacattaaa

SEQ ID NO: 2766449 - DNA, 15 bp, Homo sapiens
tttgccaatttgcac

SEQ ID NO: 2766450 - DNA, 14 bp, Homo sapiens
tttggaaaagaata

SEQ ID NO: 2766451 - DNA, 17 bp, Homo sapiens
tttggaaaggaatgcaa

SEQ ID NO: 2766452 - DNA, 12 bp, Homo sapiens
tttggccagaag

SEQ ID NO: 2766453 - DNA, 18 bp, Homo sapiens
aaaaatttactttaaact

SEQ ID NO: 2766454 - DNA, 23 bp, Homo sapiens
aaacatgctgtacatactttttg

SEQ ID NO: 2766455 - DNA, 18 bp, Homo sapiens
aaagatgaaggtctgttt

SEQ ID NO: 2766456 - DNA, 19 bp, Homo sapiens
aaaggaatgcaaagatgaa

SEQ ID NO: 2766457 - DNA, 15 bp, Homo sapiens
aaaggatacttattt

SEQ ID NO: 2766458 - DNA, 17 bp, Homo sapiens
aaaggatacttatttaa

SEQ ID NO: 2766459 - DNA, 21 bp, Homo sapiens
aaaggggtagggtttaaagat

SEQ ID NO: 2766460 - DNA, 17 bp, Homo sapiens
aaataattaggtatttt

SEQ ID NO: 2766461 - DNA, 18 bp, Homo sapiens
aaatggtgttttatcttc

SEQ ID NO: 2766462 - DNA, 12 bp, Homo sapiens
aaatttgtggaa

SEQ ID NO: 2766463 - DNA, 20 bp, Homo sapiens
aacacaaagcttttgcatat

SEQ ID NO: 2766464 - DNA, 21 bp, Homo sapiens
aacacaaagcttttgcatatt

SEQ ID NO: 2766465 - DNA, 15 bp, Homo sapiens
aacacattaaaggta

SEQ ID NO: 2766466 - DNA, 22 bp, Homo sapiens
aacactggttttaaatattttg

SEQ ID NO: 2766467 - DNA, 15 bp, Homo sapiens
aacatagctgtgatt

SEQ ID NO: 2766468 - DNA, 20 bp, Homo sapiens
aacatgctgtacatactttt

SEQ ID NO: 2766469 - DNA, 16 bp, Homo sapiens
aaccccaagttagttc

SEQ ID NO: 2766470 - DNA, 19 bp, Homo sapiens
aactctgagtgcaaacttc

SEQ ID NO: 2766471 - DNA, 22 bp, Homo sapiens
aactctgagtgcaaacttcaga

SEQ ID NO: 2766472 - DNA, 13 bp, Homo sapiens
aagaaatttgtgg

SEQ ID NO: 2766473 - DNA, 18 bp, Homo sapiens
aagatgaaggtctgtttt

SEQ ID NO: 2766474 - DNA, 11 bp, Homo sapiens
aagcagagtgg

SEQ ID NO: 2766475 - DNA, 14 bp, Homo sapiens
aagcagagtggcag

SEQ ID NO: 2766476 - DNA, 22 bp, Homo sapiens
aagcttttgcatattgcatact

SEQ ID NO: 2766477 - DNA, 13 bp, Homo sapiens
aaggatacttatt

SEQ ID NO: 2766478 - DNA, 16 bp, Homo sapiens
aaggatacttatttaa

SEQ ID NO: 2766479 - DNA, 22 bp, Homo sapiens
aagtcaaggcttagaccctcat

SEQ ID NO: 2766480 - DNA, 21 bp, Homo sapiens
aagtcccctctcctccacatt

SEQ ID NO: 2766481 - DNA, 12 bp, Homo sapiens
aataaaaaggtg

SEQ ID NO: 2766482 - DNA, 22 bp, Homo sapiens
aatagatgacattgactatttt

SEQ ID NO: 2766483 - DNA, 13 bp, Homo sapiens
aatataaaaataa

SEQ ID NO: 2766484 - DNA, 20 bp, Homo sapiens
aatatcccttggacatttta

SEQ ID NO: 2766485 - DNA, 14 bp, Homo sapiens
aatatcctaataaa

SEQ ID NO: 2766486 - DNA, 16 bp, Homo sapiens
aatatgatgactgttt

SEQ ID NO: 2766487 - DNA, 23 bp, Homo sapiens
aatcgctccaccttgcagctctc

SEQ ID NO: 2766488 - DNA, 13 bp, Homo sapiens
aatgactcttccc

SEQ ID NO: 2766489 - DNA, 12 bp, Homo sapiens
aatgcaaagatg

SEQ ID NO: 2766490 - DNA, 14 bp, Homo sapiens
aatgcaaagatgaa

SEQ ID NO: 2766491 - DNA, 18 bp, Homo sapiens
aatgcaaagatgaaggtc

SEQ ID NO: 2766492 - DNA, 18 bp, Homo sapiens
aatgcttgctgctgattt

SEQ ID NO: 2766493 - DNA, 23 bp, Homo sapiens
aatgcttgctgctgatttaaaca

SEQ ID NO: 2766494 - DNA, 14 bp, Homo sapiens
aatggtagttttac

SEQ ID NO: 2766495 - DNA, 22 bp, Homo sapiens
aatgtcagttgttatttattga

SEQ ID NO: 2766496 - DNA, 21 bp, Homo sapiens
aattcctgtttttattattaa

SEQ ID NO: 2766497 - DNA, 19 bp, Homo sapiens
aattgattgggcacatcat

SEQ ID NO: 2766498 - DNA, 18 bp, Homo sapiens
aatttactttaaactaca

SEQ ID NO: 2766499 - DNA, 12 bp, Homo sapiens
aatttgcacatt

SEQ ID NO: 2766500 - DNA, 23 bp, Homo sapiens
acaaagcttttgcatattgcata

SEQ ID NO: 2766501 - DNA, 16 bp, Homo sapiens
acactcattcattact

SEQ ID NO: 2766502 - DNA, 18 bp, Homo sapiens
acagattgaatttgccta

SEQ ID NO: 2766503 - DNA, 20 bp, Homo sapiens
acatactttttgggtttatt

SEQ ID NO: 2766504 - DNA, 14 bp, Homo sapiens
acatagctgtgatt

SEQ ID NO: 2766505 - DNA, 13 bp, Homo sapiens
acatctgttttgt

SEQ ID NO: 2766506 - DNA, 18 bp, Homo sapiens
acatgcctaccaatattt

SEQ ID NO: 2766507 - DNA, 14 bp, Homo sapiens
acatgctgaacatc

SEQ ID NO: 2766508 - DNA, 11 bp, Homo sapiens
acattaaatga

SEQ ID NO: 2766509 - DNA, 19 bp, Homo sapiens
acattaaatgactcttccc

SEQ ID NO: 2766510 - DNA, 16 bp, Homo sapiens
acattaggttgtgaat

SEQ ID NO: 2766511 - DNA, 11 bp, Homo sapiens
acattccctgc

SEQ ID NO: 2766512 - DNA, 13 bp, Homo sapiens
acattttatgtct

SEQ ID NO: 2766513 - DNA, 19 bp, Homo sapiens
acccagtgttttaggagca

SEQ ID NO: 2766514 - DNA, 22 bp, Homo sapiens
acctggattgtgcctaatgtgt

SEQ ID NO: 2766515 - DNA, 14 bp, Homo sapiens
acgcacactgtctg

SEQ ID NO: 2766516 - DNA, 18 bp, Homo sapiens
actaacaggcttagtgat

SEQ ID NO: 2766517 - DNA, 18 bp, Homo sapiens
actaacatttatttgagt

SEQ ID NO: 2766518 - DNA, 19 bp, Homo sapiens
actacattaggttgtgaat

SEQ ID NO: 2766519 - DNA, 21 bp, Homo sapiens
actattaaacatgctgtacat

SEQ ID NO: 2766520 - DNA, 18 bp, Homo sapiens
actattctgagatgacta

SEQ ID NO: 2766521 - DNA, 19 bp, Homo sapiens
actattctgagatgactat

SEQ ID NO: 2766522 - DNA, 20 bp, Homo sapiens
actatttttgtttttattaa

SEQ ID NO: 2766523 - DNA, 15 bp, Homo sapiens
actcttccctcaaat

SEQ ID NO: 2766524 - DNA, 15 bp, Homo sapiens
actgtcctattatat

SEQ ID NO: 2766525 - DNA, 20 bp, Homo sapiens
acttgttgagggtatgtttt

SEQ ID NO: 2766526 - DNA, 10 bp, Homo sapiens
actttggtta

SEQ ID NO: 2766527 - DNA, 23 bp, Homo sapiens
actttggttattttactttttgg

SEQ ID NO: 2766528 - DNA, 15 bp, Homo sapiens
actttttatattctc

SEQ ID NO: 2766529 - DNA, 17 bp, Homo sapiens
agaactatgtttttgtt

SEQ ID NO: 2766530 - DNA, 23 bp, Homo sapiens
agaatgcagtactaacatttatt

SEQ ID NO: 2766531 - DNA, 21 bp, Homo sapiens
agaatgttttcaaatgttctc

SEQ ID NO: 2766532 - DNA, 19 bp, Homo sapiens
agaccctcatgctgccaat

SEQ ID NO: 2766533 - DNA, 20 bp, Homo sapiens
agactggatagtccgtctct

SEQ ID NO: 2766534 - DNA, 21 bp, Homo sapiens
agagcagtttggtttctagca

SEQ ID NO: 2766535 - DNA, 18 bp, Homo sapiens
agaggtacacttgtgaat

SEQ ID NO: 2766536 - DNA, 15 bp, Homo sapiens
agatgaatgtcagtt

SEQ ID NO: 2766537 - DNA, 18 bp, Homo sapiens
agattctatgttaatatt

SEQ ID NO: 2766538 - DNA, 13 bp, Homo sapiens
agcaaatcagttt

SEQ ID NO: 2766539 - DNA, 22 bp, Homo sapiens
agcagtttggtttctagcatga

SEQ ID NO: 2766540 - DNA, 16 bp, Homo sapiens
agccctcaattgtgaa

SEQ ID NO: 2766541 - DNA, 11 bp, Homo sapiens
agccctgtctc

SEQ ID NO: 2766542 - DNA, 12 bp, Homo sapiens
agcttttgcata

SEQ ID NO: 2766543 - DNA, 15 bp, Homo sapiens
aggagtttggccaga

SEQ ID NO: 2766544 - DNA, 16 bp, Homo sapiens
aggagtttggccagaa

SEQ ID NO: 2766545 - DNA, 17 bp, Homo sapiens
aggagtttggccagaag

SEQ ID NO: 2766546 - DNA, 18 bp, Homo sapiens
aggagtttggccagaagt

SEQ ID NO: 2766547 - DNA, 14 bp, Homo sapiens
aggcttagaccctc

SEQ ID NO: 2766548 - DNA, 22 bp, Homo sapiens
aggcttagaccctcatgctgcc

SEQ ID NO: 2766549 - DNA, 24 bp, Homo sapiens
aggcttagaccctcatgctgccaa

SEQ ID NO: 2766550 - DNA, 17 bp, Homo sapiens
aggcttagtgatgtaat

SEQ ID NO: 2766551 - DNA, 17 bp, Homo sapiens
agggccctttttcaata

SEQ ID NO: 2766552 - DNA, 21 bp, Homo sapiens
aggggcttaattattgatgtt

SEQ ID NO: 2766553 - DNA, 20 bp, Homo sapiens
agtaaaaaatggtgttttat

SEQ ID NO: 2766554 - DNA, 16 bp, Homo sapiens
agtaaaatgtggcagg

SEQ ID NO: 2766555 - DNA, 20 bp, Homo sapiens
agtagaggtacacttgtgaa

SEQ ID NO: 2766556 - DNA, 13 bp, Homo sapiens
agtagtcagactg

SEQ ID NO: 2766557 - DNA, 15 bp, Homo sapiens
agtctcccttcctat

SEQ ID NO: 2766558 - DNA, 14 bp, Homo sapiens
agtcttctatttat

SEQ ID NO: 2766559 - DNA, 18 bp, Homo sapiens
agtgcaaacttcagagtt

SEQ ID NO: 2766560 - DNA, 18 bp, Homo sapiens
agtgcttggcccaggagt

SEQ ID NO: 2766561 - DNA, 16 bp, Homo sapiens
agttactgaacagtaa

SEQ ID NO: 2766562 - DNA, 23 bp, Homo sapiens
agttattgaagcagagtggcagt

SEQ ID NO: 2766563 - DNA, 24 bp, Homo sapiens
agttcaatctggattcatatttaa

SEQ ID NO: 2766564 - DNA, 23 bp, Homo sapiens
agttctatttatttgtgagactg

SEQ ID NO: 2766565 - DNA, 15 bp, Homo sapiens
agttgggttttttaa

SEQ ID NO: 2766566 - DNA, 18 bp, Homo sapiens
agttttgaagattctatg

SEQ ID NO: 2766567 - DNA, 15 bp, Homo sapiens
ataaactcatttcta

SEQ ID NO: 2766568 - DNA, 23 bp, Homo sapiens
ataaatattggttgggatgactt

SEQ ID NO: 2766569 - DNA, 21 bp, Homo sapiens
ataactggaacactctataac

SEQ ID NO: 2766570 - DNA, 19 bp, Homo sapiens
atactattaaacatgctgt

SEQ ID NO: 2766571 - DNA, 13 bp, Homo sapiens
atacttatttaaa

SEQ ID NO: 2766572 - DNA, 21 bp, Homo sapiens
atacttatttaaatagatgac

SEQ ID NO: 2766573 - DNA, 21 bp, Homo sapiens
atagcagccctcaattgtgaa

SEQ ID NO: 2766574 - DNA, 21 bp, Homo sapiens
atagcagtaaaaaatggtgtt

SEQ ID NO: 2766575 - DNA, 14 bp, Homo sapiens
tggattcatattta

SEQ ID NO: 2766576 - DNA, 17 bp, Homo sapiens
tggccagaagtcaaggc

SEQ ID NO: 2766577 - DNA, 21 bp, Homo sapiens
tggcccaggagtttggccaga

SEQ ID NO: 2766578 - DNA, 23 bp, Homo sapiens
tggggcagtgcttggcccaggag

SEQ ID NO: 2766579 - DNA, 16 bp, Homo sapiens
tggtgatttagcagga

SEQ ID NO: 2766580 - DNA, 15 bp, Homo sapiens
tggttattttacttt

SEQ ID NO: 2766581 - DNA, 15 bp, Homo sapiens
tggtttctagcatga

SEQ ID NO: 2766582 - DNA, 23 bp, Homo sapiens
tgtaattatggttagtagaggta

SEQ ID NO: 2766583 - DNA, 20 bp, Homo sapiens
tgtcaaccccaagttagttc

SEQ ID NO: 2766584 - DNA, 19 bp, Homo sapiens
tgtcaagctgaccttgctg

SEQ ID NO: 2766585 - DNA, 15 bp, Homo sapiens
tgtctcctctctctg

SEQ ID NO: 2766586 - DNA, 14 bp, Homo sapiens
tgtcttttaaactc

SEQ ID NO: 2766587 - DNA, 17 bp, Homo sapiens
tgtgaaaaaatttactt

SEQ ID NO: 2766588 - DNA, 20 bp, Homo sapiens
tgtgaatgcaggttttatca

SEQ ID NO: 2766589 - DNA, 18 bp, Homo sapiens
tgtgcctaatgtgtttga

SEQ ID NO: 2766590 - DNA, 13 bp, Homo sapiens
tgtgtcatttcaa

SEQ ID NO: 2766591 - DNA, 14 bp, Homo sapiens
tgtgtcatttcaaa

SEQ ID NO: 2766592 - DNA, 18 bp, Homo sapiens
tgttcactggacacttca

SEQ ID NO: 2766593 - DNA, 21 bp, Homo sapiens
tgttctccagtcattatgtta

SEQ ID NO: 2766594 - DNA, 13 bp, Homo sapiens
tgttttcaaatgt

SEQ ID NO: 2766595 - DNA, 19 bp, Homo sapiens
tgttttgccaatttgcaca

SEQ ID NO: 2766596 - DNA, 21 bp, Homo sapiens
tgttttgccaatttgcacatt

SEQ ID NO: 2766597 - DNA, 23 bp, Homo sapiens
tgttttgccaatttgcacattaa

SEQ ID NO: 2766598 - DNA, 18 bp, Homo sapiens
tgtttttattattaacaa

SEQ ID NO: 2766599 - DNA, 19 bp, Homo sapiens
ttaaacatgctgtacatac

SEQ ID NO: 2766600 - DNA, 21 bp, Homo sapiens
ttaaacatgctgtacatactt

SEQ ID NO: 2766601 - DNA, 22 bp, Homo sapiens
ttaaacatgctgtacatacttt

SEQ ID NO: 2766602 - DNA, 23 bp, Homo sapiens
ttaaactacattaggttgtgaat

SEQ ID NO: 2766603 - DNA, 20 bp, Homo sapiens
ttaaatattttgacttgttg

SEQ ID NO: 2766604 - DNA, 19 bp, Homo sapiens
ttaagaactaaaatgttct

SEQ ID NO: 2766605 - DNA, 13 bp, Homo sapiens
aagactttggtta

SEQ ID NO: 2766606 - DNA, 17 bp, Homo sapiens
aagactttggttatttt

SEQ ID NO: 2766607 - DNA, 22 bp, Homo sapiens
aagattctatgttaatatttta

SEQ ID NO: 2766608 - DNA, 10 bp, Homo sapiens
aagcagagtg

SEQ ID NO: 2766609 - DNA, 20 bp, Homo sapiens
aagcagagtggcagtcttca

SEQ ID NO: 2766610 - DNA, 13 bp, Homo sapiens
aagcttttgcata

SEQ ID NO: 2766611 - DNA, 15 bp, Homo sapiens
aagcttttgcatatt

SEQ ID NO: 2766612 - DNA, 19 bp, Homo sapiens
aagcttttgcatattgcat

SEQ ID NO: 2766613 - DNA, 15 bp, Homo sapiens
aaggaatgcaaagat

SEQ ID NO: 2766614 - DNA, 20 bp, Homo sapiens
aaggcaggggaatgtatgtg

SEQ ID NO: 2766615 - DNA, 21 bp, Homo sapiens
aagggattttcagccctcaga

SEQ ID NO: 2766616 - DNA, 23 bp, Homo sapiens
aagggattttcagccctcagaat

SEQ ID NO: 2766617 - DNA, 13 bp, Homo sapiens
aagtcaaggctta

SEQ ID NO: 2766618 - DNA, 13 bp, Homo sapiens
aagtcttctattt

SEQ ID NO: 2766619 - DNA, 16 bp, Homo sapiens
aataaaaaggtgacca

SEQ ID NO: 2766620 - DNA, 17 bp, Homo sapiens
aataactggaacactct

SEQ ID NO: 2766621 - DNA, 19 bp, Homo sapiens
aatagatgacattgactat

SEQ ID NO: 2766622 - DNA, 23 bp, Homo sapiens
aatagcagccctcaattgtgaaa

SEQ ID NO: 2766623 - DNA, 13 bp, Homo sapiens
aatatcctaataa

SEQ ID NO: 2766624 - DNA, 13 bp, Homo sapiens
aatatttaatctt

SEQ ID NO: 2766625 - DNA, 18 bp, Homo sapiens
aatctggattcatattta

SEQ ID NO: 2766626 - DNA, 19 bp, Homo sapiens
aatctggattcatatttaa

SEQ ID NO: 2766627 - DNA, 19 bp, Homo sapiens
aatcttttatgattgcctt

SEQ ID NO: 2766628 - DNA, 21 bp, Homo sapiens
aatgcaaagatgaaggtctgt

SEQ ID NO: 2766629 - DNA, 18 bp, Homo sapiens
aatgcagtactaacattt

SEQ ID NO: 2766630 - DNA, 17 bp, Homo sapiens
aattattgatgttttca

SEQ ID NO: 2766631 - DNA, 13 bp, Homo sapiens
aattcctgttttt

SEQ ID NO: 2766632 - DNA, 22 bp, Homo sapiens
aattcctgtttttattattaac

SEQ ID NO: 2766633 - DNA, 20 bp, Homo sapiens
aattgattgggcacatcatt

SEQ ID NO: 2766634 - DNA, 15 bp, Homo sapiens
acaaagcttttgcat

SEQ ID NO: 2766635 - DNA, 17 bp, Homo sapiens
acaaaggggcttaatta

SEQ ID NO: 2766636 - DNA, 19 bp, Homo sapiens
acacaaagcttttgcatat

SEQ ID NO: 2766637 - DNA, 20 bp, Homo sapiens
acacaaagcttttgcatatt

SEQ ID NO: 2766638 - DNA, 15 bp, Homo sapiens
acactctataacaaa

SEQ ID NO: 2766639 - DNA, 18 bp, Homo sapiens
acactgtcctattatatt

SEQ ID NO: 2766640 - DNA, 18 bp, Homo sapiens
acacttgtgaataaagag

SEQ ID NO: 2766641 - DNA, 17 bp, Homo sapiens
acagcaacacaaagctt

SEQ ID NO: 2766642 - DNA, 11 bp, Homo sapiens
acatacttttt

SEQ ID NO: 2766643 - DNA, 21 bp, Homo sapiens
acatgctgaacatcacagctt

SEQ ID NO: 2766644 - DNA, 17 bp, Homo sapiens
acatgctgtacatactt

SEQ ID NO: 2766645 - DNA, 20 bp, Homo sapiens
acatgctgtacatacttttt

SEQ ID NO: 2766646 - DNA, 21 bp, Homo sapiens
acatgctgtacatactttttg

SEQ ID NO: 2766647 - DNA, 13 bp, Homo sapiens
acattaaaggtac

SEQ ID NO: 2766648 - DNA, 17 bp, Homo sapiens
accaatatttaatcttt

SEQ ID NO: 2766649 - DNA, 20 bp, Homo sapiens
accaatatttaatcttttat

SEQ ID NO: 2766650 - DNA, 23 bp, Homo sapiens
accaatatttaatcttttatgat

SEQ ID NO: 2766651 - DNA, 15 bp, Homo sapiens
accccatcatccctt

SEQ ID NO: 2766652 - DNA, 16 bp, Homo sapiens
accctcatgctgccaa

SEQ ID NO: 2766653 - DNA, 20 bp, Homo sapiens
acctgcacactgtcctatta

SEQ ID NO: 2766654 - DNA, 20 bp, Homo sapiens
actacattaggttgtgaatg

SEQ ID NO: 2766655 - DNA, 22 bp, Homo sapiens
actatttttgtttttattaaaa

SEQ ID NO: 2766656 - DNA, 22 bp, Homo sapiens
actctataacaaaggatactta

SEQ ID NO: 2766657 - DNA, 17 bp, Homo sapiens
actctgccactttattt

SEQ ID NO: 2766658 - DNA, 23 bp, Homo sapiens
taccaatatttaatcttttatga

SEQ ID NO: 2766659 - DNA, 18 bp, Homo sapiens
tactaacatttatttgag

SEQ ID NO: 2766660 - DNA, 20 bp, Homo sapiens
tactctgccactttatttct

SEQ ID NO: 2766661 - DNA, 12 bp, Homo sapiens
tactttaaacta

SEQ ID NO: 2766662 - DNA, 10 bp, Homo sapiens
tactttttgg

SEQ ID NO: 2766663 - DNA, 18 bp, Homo sapiens
tagaatgttttcaaatgt

SEQ ID NO: 2766664 - DNA, 18 bp, Homo sapiens
tagaccctcatgctgcca

SEQ ID NO: 2766665 - DNA, 13 bp, Homo sapiens
tagaggtacactt

SEQ ID NO: 2766666 - DNA, 18 bp, Homo sapiens
tagaggtacacttgtgaa

SEQ ID NO: 2766667 - DNA, 19 bp, Homo sapiens
tagaggtacacttgtgaat

SEQ ID NO: 2766668 - DNA, 20 bp, Homo sapiens
tagatgaatgtcagttgtta

SEQ ID NO: 2766669 - DNA, 11 bp, Homo sapiens
tagatgttgct

SEQ ID NO: 2766670 - DNA, 13 bp, Homo sapiens
tagatgttgctaa

SEQ ID NO: 2766671 - DNA, 21 bp, Homo sapiens
tagcagccctcaattgtgaaa

SEQ ID NO: 2766672 - DNA, 20 bp, Homo sapiens
taggagaagtcttctattta

SEQ ID NO: 2766673 - DNA, 17 bp, Homo sapiens
tagtagaggtacacttg

SEQ ID NO: 2766674 - DNA, 20 bp, Homo sapiens
tagtagaggtacacttgtga

SEQ ID NO: 2766675 - DNA, 22 bp, Homo sapiens
tataacaaaggatacttattta

SEQ ID NO: 2766676 - DNA, 15 bp, Homo sapiens
tatatagcagtaaaa

SEQ ID NO: 2766677 - DNA, 17 bp, Homo sapiens
tatcccttggacatttt

SEQ ID NO: 2766678 - DNA, 18 bp, Homo sapiens
tatcccttggacatttta

SEQ ID NO: 2766679 - DNA, 12 bp, Homo sapiens
tatcctaataaa

SEQ ID NO: 2766680 - DNA, 15 bp, Homo sapiens
tatcctaataaaaag

SEQ ID NO: 2766681 - DNA, 15 bp, Homo sapiens
tatgatgactgtttt

SEQ ID NO: 2766682 - DNA, 23 bp, Homo sapiens
tatgtttttgttcagtttatctg

SEQ ID NO: 2766683 - DNA, 18 bp, Homo sapiens
tattcagtggctaacttg

SEQ ID NO: 2766684 - DNA, 17 bp, Homo sapiens
tattctcagcagagtgc

SEQ ID NO: 2766685 - DNA, 14 bp, Homo sapiens
tattgaagcagagt

SEQ ID NO: 2766686 - DNA, 20 bp, Homo sapiens
tattgaagcagagtggcagt

SEQ ID NO: 2766687 - DNA, 15 bp, Homo sapiens
tatttaatcttttat

SEQ ID NO: 2766688 - DNA, 16 bp, Homo sapiens
tatttaatttgaaggt

SEQ ID NO: 2766689 - DNA, 16 bp, Homo sapiens
tatttattgaaatgat

SEQ ID NO: 2766690 - DNA, 14 bp, Homo sapiens
tatttatttattta

SEQ ID NO: 2766691 - DNA, 14 bp, Homo sapiens
tattttgacttgtt

SEQ ID NO: 2766692 - DNA, 12 bp, Homo sapiens
tcaaatgtgtac

SEQ ID NO: 2766693 - DNA, 17 bp, Homo sapiens
tcaacatttctcatgtt

SEQ ID NO: 2766694 - DNA, 16 bp, Homo sapiens
tcaattgtgaaaaaat

SEQ ID NO: 2766695 - DNA, 14 bp, Homo sapiens
tcacagaagatgaa

SEQ ID NO: 2766696 - DNA, 12 bp, Homo sapiens
tcagcagagtgc

SEQ ID NO: 2766697 - DNA, 22 bp, Homo sapiens
tcagcagagtgctttaccaatt

SEQ ID NO: 2766698 - DNA, 14 bp, Homo sapiens
tcagccctcagaat

SEQ ID NO: 2766699 - DNA, 13 bp, Homo sapiens
tcagtagtcagac

SEQ ID NO: 2766700 - DNA, 14 bp, Homo sapiens
tcagtttatctgtt

SEQ ID NO: 2766701 - DNA, 16 bp, Homo sapiens
tcagtttgcagagtag

SEQ ID NO: 2766702 - DNA, 20 bp, Homo sapiens
tcatgctgccaatatcctaa

SEQ ID NO: 2766703 - DNA, 21 bp, Homo sapiens
tcatgctgccaatatcctaat

SEQ ID NO: 2766704 - DNA, 23 bp, Homo sapiens
tcattagttttgaagattctatg

SEQ ID NO: 2766705 - DNA, 20 bp, Homo sapiens
tcccttcacaaacccagtgt

SEQ ID NO: 2766706 - DNA, 21 bp, Homo sapiens
tcccttggacattttatgtct

SEQ ID NO: 2766707 - DNA, 15 bp, Homo sapiens
tccctttcccttggt

SEQ ID NO: 2766708 - DNA, 14 bp, Homo sapiens
tcctaataaaaagg

SEQ ID NO: 2766709 - DNA, 16 bp, Homo sapiens
tcctaataaaaaggtg

SEQ ID NO: 2766710 - DNA, 17 bp, Homo sapiens
tcctaataaaaaggtga

SEQ ID NO: 2766711 - DNA, 13 bp, Homo sapiens
tcctccacatttg

SEQ ID NO: 2766712 - DNA, 19 bp, Homo sapiens
tcctgtcggagccctgtct

SEQ ID NO: 2766713 - DNA, 20 bp, Homo sapiens
tcctgtttttattattaaca

SEQ ID NO: 2766714 - DNA, 21 bp, Homo sapiens
tcctgtttttattattaacaa

SEQ ID NO: 2766715 - DNA, 17 bp, Homo sapiens
tctcaaactaacaggct

SEQ ID NO: 2766716 - DNA, 13 bp, Homo sapiens
tctcagcagagtg

SEQ ID NO: 2766717 - DNA, 18 bp, Homo sapiens
tctctgtaataaactcat

SEQ ID NO: 2766718 - DNA, 14 bp, Homo sapiens
tctgagtgcaaact

SEQ ID NO: 2766719 - DNA, 14 bp, Homo sapiens
tctggactaaaact

SEQ ID NO: 2766720 - DNA, 16 bp, Homo sapiens
tctggattcatattta

SEQ ID NO: 2766721 - DNA, 16 bp, Homo sapiens
tctgtcttttaaactc

SEQ ID NO: 2766722 - DNA, 18 bp, Homo sapiens
tctgtcttttaaactctg

SEQ ID NO: 2766723 - DNA, 20 bp, Homo sapiens
tctgtgatgacattccctgc

SEQ ID NO: 2766724 - DNA, 20 bp, Homo sapiens
tctgttacacaaagaaccac

SEQ ID NO: 2766725 - DNA, 13 bp, Homo sapiens
tctgttttgtgta

SEQ ID NO: 2766726 - DNA, 17 bp, Homo sapiens
tcttcagtttgcagagt

SEQ ID NO: 2766727 - DNA, 18 bp, Homo sapiens
tcttcagtttgcagagta

SEQ ID NO: 2766728 - DNA, 22 bp, Homo sapiens
tcttctatttatttatttattc

SEQ ID NO: 2766729 - DNA, 21 bp, Homo sapiens
tgaaaaaatttactttaaact

SEQ ID NO: 2766730 - DNA, 15 bp, Homo sapiens
tgaaacactggtttt

SEQ ID NO: 2766731 - DNA, 20 bp, Homo sapiens
tgaaacactggttttaaata

SEQ ID NO: 2766732 - DNA, 21 bp, Homo sapiens
tgaaacactggttttaaatat

SEQ ID NO: 2766733 - DNA, 17 bp, Homo sapiens
tgaacagtaacatagct

SEQ ID NO: 2766734 - DNA, 20 bp, Homo sapiens
tgaatgcccagtgagactgt

SEQ ID NO: 2766735 - DNA, 19 bp, Homo sapiens
tgactattctgagatgact

SEQ ID NO: 2766736 - DNA, 22 bp, Homo sapiens
tgactattctgagatgactatt

SEQ ID NO: 2766737 - DNA, 22 bp, Homo sapiens
tgactatttttgtttttattaa

SEQ ID NO: 2766738 - DNA, 20 bp, Homo sapiens
tgagtgcaaacttcagagtt

SEQ ID NO: 2766739 - DNA, 22 bp, Homo sapiens
tgagtgcaaacttcagagttct

SEQ ID NO: 2766740 - DNA, 16 bp, Homo sapiens
tgatgtaattatggtt

SEQ ID NO: 2766741 - DNA, 17 bp, Homo sapiens
tgattgcctttttataa

SEQ ID NO: 2766742 - DNA, 18 bp, Homo sapiens
tgattgggcacatcattt

SEQ ID NO: 2766743 - DNA, 20 bp, Homo sapiens
tgattgggcacatcatttca

SEQ ID NO: 2766744 - DNA, 17 bp, Homo sapiens
tgcacatctgttttgta

SEQ ID NO: 2766745 - DNA, 15 bp, Homo sapiens
tgcatactattaaac

SEQ ID NO: 2766746 - DNA, 17 bp, Homo sapiens
tgcctaccaatatttaa

SEQ ID NO: 2766747 - DNA, 20 bp, Homo sapiens
tgcctttttataacttttta

SEQ ID NO: 2766748 - DNA, 23 bp, Homo sapiens
tgctaacagcaacacaaagcttt

SEQ ID NO: 2766749 - DNA, 15 bp, Homo sapiens
tgctgatttaaacac

SEQ ID NO: 2766750 - DNA, 23 bp, Homo sapiens
tgctgccaatatcctaataaaaa

SEQ ID NO: 2766751 - DNA, 21 bp, Homo sapiens
tgctgttcactggacacttca

SEQ ID NO: 2766752 - DNA, 15 bp, Homo sapiens
tgcttggcccaggag

SEQ ID NO: 2766753 - DNA, 15 bp, Homo sapiens
tgctttttttggcct

SEQ ID NO: 2766754 - DNA, 13 bp, Homo sapiens
tggacattttatg

SEQ ID NO: 2766755 - DNA, 19 bp, Homo sapiens
atagctgtgatttttggta

SEQ ID NO: 2766756 - DNA, 17 bp, Homo sapiens
atatagcaagacattat

SEQ ID NO: 2766757 - DNA, 11 bp, Homo sapiens
atatcacttcc

SEQ ID NO: 2766758 - DNA, 20 bp, Homo sapiens
atatcccttggacattttat

SEQ ID NO: 2766759 - DNA, 13 bp, Homo sapiens
atatcctaataaa

SEQ ID NO: 2766760 - DNA, 16 bp, Homo sapiens
atatcctaataaaaag

SEQ ID NO: 2766761 - DNA, 18 bp, Homo sapiens
atatcctaataaaaaggt

SEQ ID NO: 2766762 - DNA, 17 bp, Homo sapiens
atattcattctttttga

SEQ ID NO: 2766763 - DNA, 15 bp, Homo sapiens
atattctcagcagag

SEQ ID NO: 2766764 - DNA, 14 bp, Homo sapiens
atcacttccatgac

SEQ ID NO: 2766765 - DNA, 19 bp, Homo sapiens
atcatccctttcccttggt

SEQ ID NO: 2766766 - DNA, 21 bp, Homo sapiens
atcccttggacattttatgtc

SEQ ID NO: 2766767 - DNA, 14 bp, Homo sapiens
atcctaataaaaag

SEQ ID NO: 2766768 - DNA, 17 bp, Homo sapiens
atcctaataaaaaggtg

SEQ ID NO: 2766769 - DNA, 18 bp, Homo sapiens
atcctaataaaaaggtga

SEQ ID NO: 2766770 - DNA, 19 bp, Homo sapiens
atctgtgatgacattccct

SEQ ID NO: 2766771 - DNA, 23 bp, Homo sapiens
atcttctatataattcctgtttt

SEQ ID NO: 2766772 - DNA, 13 bp, Homo sapiens
atcttttatgatt

SEQ ID NO: 2766773 - DNA, 13 bp, Homo sapiens
atgaatgcccagt

SEQ ID NO: 2766774 - DNA, 18 bp, Homo sapiens
atgactattcagtggcta

SEQ ID NO: 2766775 - DNA, 18 bp, Homo sapiens
atgactcttccctcaaat

SEQ ID NO: 2766776 - DNA, 17 bp, Homo sapiens
atgcctaccaatattta

SEQ ID NO: 2766777 - DNA, 20 bp, Homo sapiens
atgctgccaatatcctaata

SEQ ID NO: 2766778 - DNA, 18 bp, Homo sapiens
atgctgtacatacttttt

SEQ ID NO: 2766779 - DNA, 23 bp, Homo sapiens
atgtctagaccaggacctccctc

SEQ ID NO: 2766780 - DNA, 17 bp, Homo sapiens
atgttttatatagcaag

SEQ ID NO: 2766781 - DNA, 15 bp, Homo sapiens
atgttttcaaatgtt

SEQ ID NO: 2766782 - DNA, 13 bp, Homo sapiens
attaaatgactct

SEQ ID NO: 2766783 - DNA, 17 bp, Homo sapiens
attaaatgactcttccc

SEQ ID NO: 2766784 - DNA, 13 bp, Homo sapiens
attaggttgtgaa

SEQ ID NO: 2766785 - DNA, 17 bp, Homo sapiens
attatatagcagtaaaa

SEQ ID NO: 2766786 - DNA, 16 bp, Homo sapiens
attatattcattcttt

SEQ ID NO: 2766787 - DNA, 13 bp, Homo sapiens
attatgttaatat

SEQ ID NO: 2766788 - DNA, 17 bp, Homo sapiens
attatgttaatatttct

SEQ ID NO: 2766789 - DNA, 16 bp, Homo sapiens
attcattctttttgaa

SEQ ID NO: 2766790 - DNA, 21 bp, Homo sapiens
attcattctttttgaaatgtc

SEQ ID NO: 2766791 - DNA, 16 bp, Homo sapiens
attctcagcagagtgc

SEQ ID NO: 2766792 - DNA, 13 bp, Homo sapiens
attgaagcagagt

SEQ ID NO: 2766793 - DNA, 14 bp, Homo sapiens
attgaagtaaaatg

SEQ ID NO: 2766794 - DNA, 18 bp, Homo sapiens
attgcatactattaaaca

SEQ ID NO: 2766795 - DNA, 19 bp, Homo sapiens
attgcatactattaaacat

SEQ ID NO: 2766796 - DNA, 21 bp, Homo sapiens
attgcctttttataacttttt

SEQ ID NO: 2766797 - DNA, 17 bp, Homo sapiens
attgctgcttgtacact

SEQ ID NO: 2766798 - DNA, 17 bp, Homo sapiens
attgggcacatcatttc

SEQ ID NO: 2766799 - DNA, 18 bp, Homo sapiens
atttaaacacattaaagg

SEQ ID NO: 2766800 - DNA, 13 bp, Homo sapiens
atttaatttgaag

SEQ ID NO: 2766801 - DNA, 22 bp, Homo sapiens
atttaatttgaaggtagaatgt

SEQ ID NO: 2766802 - DNA, 15 bp, Homo sapiens
atttactttaaacta

SEQ ID NO: 2766803 - DNA, 14 bp, Homo sapiens
atttattcattagt

SEQ ID NO: 2766804 - DNA, 16 bp, Homo sapiens
atttatttatttattc

SEQ ID NO: 2766805 - DNA, 15 bp, Homo sapiens
atttctcatgttgaa

SEQ ID NO: 2766806 - DNA, 17 bp, Homo sapiens
atttctctcatctgtta

SEQ ID NO: 2766807 - DNA, 17 bp, Homo sapiens
atttgaaacactggttt

SEQ ID NO: 2766808 - DNA, 18 bp, Homo sapiens
atttgaaggtagaatgtt

SEQ ID NO: 2766809 - DNA, 17 bp, Homo sapiens
atttgcacattaaatga

SEQ ID NO: 2766810 - DNA, 20 bp, Homo sapiens
atttgcacattaaatgactc

SEQ ID NO: 2766811 - DNA, 12 bp, Homo sapiens
atttgtgagact

SEQ ID NO: 2766812 - DNA, 14 bp, Homo sapiens
atttgtgagactgt

SEQ ID NO: 2766813 - DNA, 18 bp, Homo sapiens
atttgtggaaaataactc

SEQ ID NO: 2766814 - DNA, 17 bp, Homo sapiens
attttactttttggaaa

SEQ ID NO: 2766815 - DNA, 13 bp, Homo sapiens
attttatgtcttt

SEQ ID NO: 2766816 - DNA, 14 bp, Homo sapiens
caaactaacaggct

SEQ ID NO: 2766817 - DNA, 15 bp, Homo sapiens
caaggctgtgcatct

SEQ ID NO: 2766818 - DNA, 14 bp, Homo sapiens
caaggcttagaccc

SEQ ID NO: 2766819 - DNA, 12 bp, Homo sapiens
caatatcctaat

SEQ ID NO: 2766820 - DNA, 13 bp, Homo sapiens
caatatcctaata

SEQ ID NO: 2766821 - DNA, 14 bp, Homo sapiens
caatatcctaataa

SEQ ID NO: 2766822 - DNA, 14 bp, Homo sapiens
caatttgcacatta

SEQ ID NO: 2766823 - DNA, 13 bp, Homo sapiens
cacagaagatgaa

SEQ ID NO: 2766824 - DNA, 15 bp, Homo sapiens
cacattaaatgactc

SEQ ID NO: 2766825 - DNA, 20 bp, Homo sapiens
caccctcagatgcacatgag

SEQ ID NO: 2766826 - DNA, 15 bp, Homo sapiens
caccttgcagctctc

SEQ ID NO: 2766827 - DNA, 13 bp, Homo sapiens
cactggttttaaa

SEQ ID NO: 2766828 - DNA, 15 bp, Homo sapiens
cactggttttaaata

SEQ ID NO: 2766829 - DNA, 19 bp, Homo sapiens
cacttcacgcccttggcca

SEQ ID NO: 2766830 - DNA, 23 bp, Homo sapiens
cagaatcgctccaccttgcagct

SEQ ID NO: 2766831 - DNA, 19 bp, Homo sapiens
cagactggatagtccgtct

SEQ ID NO: 2766832 - DNA, 22 bp, Homo sapiens
cagagtaggggtctgtctttta

SEQ ID NO: 2766833 - DNA, 12 bp, Homo sapiens
cagagtggcagt

SEQ ID NO: 2766834 - DNA, 17 bp, Homo sapiens
cagatgcacatgagctg

SEQ ID NO: 2766835 - DNA, 15 bp, Homo sapiens
cagcaacacaaagct

SEQ ID NO: 2766836 - DNA, 23 bp, Homo sapiens
cagcaacacaaagcttttgcata

SEQ ID NO: 2766837 - DNA, 22 bp, Homo sapiens
caggaagctgtgagagcagttt

SEQ ID NO: 2766838 - DNA, 14 bp, Homo sapiens
caggagtttggcca

SEQ ID NO: 2766839 - DNA, 15 bp, Homo sapiens
caggagtttggccag

SEQ ID NO: 2766840 - DNA, 21 bp, Homo sapiens
cagtaaaaaatggtgttttat

SEQ ID NO: 2766841 - DNA, 15 bp, Homo sapiens
cagtgcttggcccag

SEQ ID NO: 2766842 - DNA, 16 bp, Homo sapiens
cagtgcttggcccagg

SEQ ID NO: 2766843 - DNA, 21 bp, Homo sapiens
cagtgtgtggtcaacatttct

SEQ ID NO: 2766844 - DNA, 11 bp, Homo sapiens
cagtttggttg

SEQ ID NO: 2766845 - DNA, 22 bp, Homo sapiens
cataagtgctattgcagagccg

SEQ ID NO: 2766846 - DNA, 18 bp, Homo sapiens
catactattaaacatgct

SEQ ID NO: 2766847 - DNA, 16 bp, Homo sapiens
catactttttgggttt

SEQ ID NO: 2766848 - DNA, 14 bp, Homo sapiens
catatggataaata

SEQ ID NO: 2766849 - DNA, 19 bp, Homo sapiens
catattgcatactattaaa

SEQ ID NO: 2766850 - DNA, 12 bp, Homo sapiens
catcatttcaag

SEQ ID NO: 2766851 - DNA, 14 bp, Homo sapiens
catcatttcaagaa

SEQ ID NO: 2766852 - DNA, 17 bp, Homo sapiens
catccctttcccttggt

SEQ ID NO: 2766853 - DNA, 17 bp, Homo sapiens
catgcctaccaatattt

SEQ ID NO: 2766854 - DNA, 22 bp, Homo sapiens
catgctgccaatatcctaataa

SEQ ID NO: 2766855 - DNA, 16 bp, Homo sapiens
catgctgtacatactt

SEQ ID NO: 2766856 - DNA, 18 bp, Homo sapiens
cattaaatgactcttccc

SEQ ID NO: 2766857 - DNA, 16 bp, Homo sapiens
cattagttttgaagat

SEQ ID NO: 2766858 - DNA, 16 bp, Homo sapiens
cattatgttaatattt

SEQ ID NO: 2766859 - DNA, 16 bp, Homo sapiens
cattcttggcccagga

SEQ ID NO: 2766860 - DNA, 16 bp, Homo sapiens
cattctttttgaaatg

SEQ ID NO: 2766861 - DNA, 17 bp, Homo sapiens
catttctcatgttgaaa

SEQ ID NO: 2766862 - DNA, 13 bp, Homo sapiens
ccaatatcctaat

SEQ ID NO: 2766863 - DNA, 14 bp, Homo sapiens
ccaatatcctaata

SEQ ID NO: 2766864 - DNA, 15 bp, Homo sapiens
ccaatatcctaataa

SEQ ID NO: 2766865 - DNA, 17 bp, Homo sapiens
ccaatatcctaataaaa

SEQ ID NO: 2766866 - DNA, 19 bp, Homo sapiens
ccaatatcctaataaaaag

SEQ ID NO: 2766867 - DNA, 19 bp, Homo sapiens
ccaatttgcacattaaatg

SEQ ID NO: 2766868 - DNA, 18 bp, Homo sapiens
ccacttgagtgtcaagct

SEQ ID NO: 2766869 - DNA, 18 bp, Homo sapiens
ccagtgacagtcagggaa

SEQ ID NO: 2766870 - DNA, 13 bp, Homo sapiens
ccagtgagactgt

SEQ ID NO: 2766871 - DNA, 19 bp, Homo sapiens
ccagtgttttaggagcatg

SEQ ID NO: 2766872 - DNA, 20 bp, Homo sapiens
cccagcacaaagcagatcct

SEQ ID NO: 2766873 - DNA, 15 bp, Homo sapiens
cccaggagtttggcc

SEQ ID NO: 2766874 - DNA, 17 bp, Homo sapiens
cccaggagtttggccag

SEQ ID NO: 2766875 - DNA, 19 bp, Homo sapiens
cccaggagtttggccagaa

SEQ ID NO: 2766876 - DNA, 17 bp, Homo sapiens
cccagtgttttaggagc

SEQ ID NO: 2766877 - DNA, 14 bp, Homo sapiens
ccctcatgctgcca

SEQ ID NO: 2766878 - DNA, 15 bp, Homo sapiens
cccttggacatttta

SEQ ID NO: 2766879 - DNA, 24 bp, Homo sapiens
ccgtagacgtgcacgcacactgtc

SEQ ID NO: 2766880 - DNA, 15 bp, Homo sapiens
cctaataaaaaggtg

SEQ ID NO: 2766881 - DNA, 12 bp, Homo sapiens
cctaatgtgttt

SEQ ID NO: 2766882 - DNA, 13 bp, Homo sapiens
cctcatgctgcca

SEQ ID NO: 2766883 - DNA, 16 bp, Homo sapiens
cctcatgctgccaata

SEQ ID NO: 2766884 - DNA, 21 bp, Homo sapiens
cctcatgctgccaatatccta

SEQ ID NO: 2766885 - DNA, 21 bp, Homo sapiens
ccttggacattttatgtcttt

SEQ ID NO: 2766886 - DNA, 13 bp, Homo sapiens
cctttcccttggt

SEQ ID NO: 2766887 - DNA, 19 bp, Homo sapiens
aaaaatttactttaaacta

SEQ ID NO: 2766888 - DNA, 20 bp, Homo sapiens
aaaaggaagcttacatgcct

SEQ ID NO: 2766889 - DNA, 21 bp, Homo sapiens
aaaaggaagcttacatgccta

SEQ ID NO: 2766890 - DNA, 20 bp, Homo sapiens
aaaatggtgttttatcttct

SEQ ID NO: 2766891 - DNA, 11 bp, Homo sapiens
aaacacattaa

SEQ ID NO: 2766892 - DNA, 15 bp, Homo sapiens
aaacacattaaaggt

SEQ ID NO: 2766893 - DNA, 15 bp, Homo sapiens
ggctggagttattga

SEQ ID NO: 2766894 - DNA, 17 bp, Homo sapiens
ggcttagtgatgtaatt

SEQ ID NO: 2766895 - DNA, 18 bp, Homo sapiens
gggatatcacttccatga

SEQ ID NO: 2766896 - DNA, 16 bp, Homo sapiens
gggcacatcatttcaa

SEQ ID NO: 2766897 - DNA, 22 bp, Homo sapiens
gggcagtgcttggcccaggagt

SEQ ID NO: 2766898 - DNA, 23 bp, Homo sapiens
gggcagtgcttggcccaggagtt

SEQ ID NO: 2766899 - DNA, 21 bp, Homo sapiens
gggtagccactggactgacga

SEQ ID NO: 2766900 - DNA, 16 bp, Homo sapiens
ggtatagatgttgcta

SEQ ID NO: 2766901 - DNA, 13 bp, Homo sapiens
ggtctgtctttta

SEQ ID NO: 2766902 - DNA, 18 bp, Homo sapiens
gtaaaaaatggtgtttta

SEQ ID NO: 2766903 - DNA, 14 bp, Homo sapiens
gtacatactttttg

SEQ ID NO: 2766904 - DNA, 18 bp, Homo sapiens
gtactaacatttatttga

SEQ ID NO: 2766905 - DNA, 23 bp, Homo sapiens
gtagacgtgcacgcacactgtct

SEQ ID NO: 2766906 - DNA, 20 bp, Homo sapiens
gtagaggtacacttgtgaat

SEQ ID NO: 2766907 - DNA, 20 bp, Homo sapiens
gtatgttttatatagcaaga

SEQ ID NO: 2766908 - DNA, 13 bp, Homo sapiens
gtcaacatttctc

SEQ ID NO: 2766909 - DNA, 17 bp, Homo sapiens
gtcaacatttctcatgt

SEQ ID NO: 2766910 - DNA, 13 bp, Homo sapiens
gtcaaggcttaga

SEQ ID NO: 2766911 - DNA, 14 bp, Homo sapiens
gtcaaggcttagac

SEQ ID NO: 2766912 - DNA, 16 bp, Homo sapiens
gtcaaggcttagaccc

SEQ ID NO: 2766913 - DNA, 20 bp, Homo sapiens
gtcaaggcttagaccctcat

SEQ ID NO: 2766914 - DNA, 17 bp, Homo sapiens
gtcattatgttaatatt

SEQ ID NO: 2766915 - DNA, 14 bp, Homo sapiens
gtcattcttcccta

SEQ ID NO: 2766916 - DNA, 21 bp, Homo sapiens
gtcctattatattcattcttt

SEQ ID NO: 2766917 - DNA, 20 bp, Homo sapiens
gtctgttttgtgtactttta

SEQ ID NO: 2766918 - DNA, 12 bp, Homo sapiens
gtcttctattta

SEQ ID NO: 2766919 - DNA, 17 bp, Homo sapiens
gtcttctatttatttat

SEQ ID NO: 2766920 - DNA, 17 bp, Homo sapiens
gtgcacatctgttttgt

SEQ ID NO: 2766921 - DNA, 14 bp, Homo sapiens
gtggaaaataactc

SEQ ID NO: 2766922 - DNA, 13 bp, Homo sapiens
gtgtcatttcaaa

SEQ ID NO: 2766923 - DNA, 14 bp, Homo sapiens
gtgtgcgtcctgtc

SEQ ID NO: 2766924 - DNA, 16 bp, Homo sapiens
gtgtgcgtcctgtcgg

SEQ ID NO: 2766925 - DNA, 24 bp, Homo sapiens
gttagttcaatctggattcatatt

SEQ ID NO: 2766926 - DNA, 16 bp, Homo sapiens
gttattttactttttg

SEQ ID NO: 2766927 - DNA, 23 bp, Homo sapiens
gttcaatctggattcatatttaa

SEQ ID NO: 2766928 - DNA, 24 bp, Homo sapiens
gttcactggacacttcacgccctt

SEQ ID NO: 2766929 - DNA, 17 bp, Homo sapiens
gtttaatggtagtttta

SEQ ID NO: 2766930 - DNA, 18 bp, Homo sapiens
gtttagatgaatgtcagt

SEQ ID NO: 2766931 - DNA, 16 bp, Homo sapiens
gttttgaagattctat

SEQ ID NO: 2766932 - DNA, 14 bp, Homo sapiens
gtttttattaaaag

SEQ ID NO: 2766933 - DNA, 13 bp, Homo sapiens
taaaaaggtgacc

SEQ ID NO: 2766934 - DNA, 18 bp, Homo sapiens
taaaaggaagcttacatg

SEQ ID NO: 2766935 - DNA, 20 bp, Homo sapiens
taaacatgctgtacatactt

SEQ ID NO: 2766936 - DNA, 22 bp, Homo sapiens
taaacatgctgtacatactttt

SEQ ID NO: 2766937 - DNA, 19 bp, Homo sapiens
taaatattttgacttgttg

SEQ ID NO: 2766938 - DNA, 16 bp, Homo sapiens
taaatgactcttccct

SEQ ID NO: 2766939 - DNA, 19 bp, Homo sapiens
taacaaaggatacttattt

SEQ ID NO: 2766940 - DNA, 18 bp, Homo sapiens
taactcacctggcatctt

SEQ ID NO: 2766941 - DNA, 15 bp, Homo sapiens
taactttttatattc

SEQ ID NO: 2766942 - DNA, 16 bp, Homo sapiens
taactttttatattct

SEQ ID NO: 2766943 - DNA, 16 bp, Homo sapiens
taatggtagttttaca

SEQ ID NO: 2766944 - DNA, 16 bp, Homo sapiens
taattattgatgtttt

SEQ ID NO: 2766945 - DNA, 18 bp, Homo sapiens
taattattgatgttttca

SEQ ID NO: 2766946 - DNA, 12 bp, Homo sapiens
tacatacttttt

SEQ ID NO: 2766947 - DNA, 16 bp, Homo sapiens
tacatgcctaccaata

SEQ ID NO: 2766948 - DNA, 16 bp, Homo sapiens
tacattaggttgtgaa

SEQ ID NO: 2766949 - DNA, 13 bp, Homo sapiens
taccaatatttaa

SEQ ID NO: 2766950 - DNA, 16 bp, Homo sapiens
taccaatatttaatct

SEQ ID NO: 2766951 - DNA, 21 bp, Homo sapiens
taccaatatttaatcttttat

SEQ ID NO: 2766952 - DNA, 14 bp, Homo sapiens
tactattaaacatg

SEQ ID NO: 2766953 - DNA, 15 bp, Homo sapiens
tactattaaacatgc

SEQ ID NO: 2766954 - DNA, 12 bp, Homo sapiens
tacttatttaaa

SEQ ID NO: 2766955 - DNA, 14 bp, Homo sapiens
tacttatttaaata

SEQ ID NO: 2766956 - DNA, 19 bp, Homo sapiens
tagaatgttttcaaatgtt

SEQ ID NO: 2766957 - DNA, 17 bp, Homo sapiens
tagaccctcatgctgcc

SEQ ID NO: 2766958 - DNA, 19 bp, Homo sapiens
tagaccctcatgctgccaa

SEQ ID NO: 2766959 - DNA, 19 bp, Homo sapiens
tagatgacattgactattt

SEQ ID NO: 2766960 - DNA, 23 bp, Homo sapiens
tagcagtaaaaaatggtgtttta

SEQ ID NO: 2766961 - DNA, 12 bp, Homo sapiens
taggttgtgaat

SEQ ID NO: 2766962 - DNA, 15 bp, Homo sapiens
tagtcattcttccct

SEQ ID NO: 2766963 - DNA, 23 bp, Homo sapiens
tagttcaatctggattcatattt

SEQ ID NO: 2766964 - DNA, 23 bp, Homo sapiens
tataattcctgtttttattatta

SEQ ID NO: 2766965 - DNA, 15 bp, Homo sapiens
tatagatgttgctaa

SEQ ID NO: 2766966 - DNA, 13 bp, Homo sapiens
tatagcaagacat

SEQ ID NO: 2766967 - DNA, 20 bp, Homo sapiens
tatatagcaagacattatat

SEQ ID NO: 2766968 - DNA, 16 bp, Homo sapiens
tatatagcagtaaaaa

SEQ ID NO: 2766969 - DNA, 23 bp, Homo sapiens
tatatagcagtaaaaaatggtgt

SEQ ID NO: 2766970 - DNA, 19 bp, Homo sapiens
tatattcattctttttgaa

SEQ ID NO: 2766971 - DNA, 14 bp, Homo sapiens
tatcagaactatgt

SEQ ID NO: 2766972 - DNA, 15 bp, Homo sapiens
tatccaattgctgct

SEQ ID NO: 2766973 - DNA, 23 bp, Homo sapiens
tatccaattgctgcttgtacact

SEQ ID NO: 2766974 - DNA, 22 bp, Homo sapiens
tatcctaataaaaaggtgacca

SEQ ID NO: 2766975 - DNA, 19 bp, Homo sapiens
tattaaacatgctgtacat

SEQ ID NO: 2766976 - DNA, 17 bp, Homo sapiens
tattatattcattcttt

SEQ ID NO: 2766977 - DNA, 23 bp, Homo sapiens
tattcattctttttgaaatgtca

SEQ ID NO: 2766978 - DNA, 15 bp, Homo sapiens
tattctcagcagagt

SEQ ID NO: 2766979 - DNA, 15 bp, Homo sapiens
tattctgagatgact

SEQ ID NO: 2766980 - DNA, 13 bp, Homo sapiens
tattgatgttttc

SEQ ID NO: 2766981 - DNA, 19 bp, Homo sapiens
tattgcatactattaaaca

SEQ ID NO: 2766982 - DNA, 17 bp, Homo sapiens
tatttaaatagatgaca

SEQ ID NO: 2766983 - DNA, 13 bp, Homo sapiens
tatttaatttgaa

SEQ ID NO: 2766984 - DNA, 23 bp, Homo sapiens
tatttaatttgaaggtagaatgt

SEQ ID NO: 2766985 - DNA, 12 bp, Homo sapiens
tatttattgaaa

SEQ ID NO: 2766986 - DNA, 23 bp, Homo sapiens
tatttgagtggagttactgaaca

SEQ ID NO: 2766987 - DNA, 15 bp, Homo sapiens
tattttactttttgg

SEQ ID NO: 2766988 - DNA, 22 bp, Homo sapiens
tattttaggtgtaaaataatta

SEQ ID NO: 2766989 - DNA, 17 bp, Homo sapiens
tattttctccaaatgtt

SEQ ID NO: 2766990 - DNA, 18 bp, Homo sapiens
tatttttgtttttattaa

SEQ ID NO: 2766991 - DNA, 16 bp, Homo sapiens
tcaagaatgcagtact

SEQ ID NO: 2766992 - DNA, 18 bp, Homo sapiens
tcaagctgaccttgctga

SEQ ID NO: 2766993 - DNA, 14 bp, Homo sapiens
tcaaggcttagacc

SEQ ID NO: 2766994 - DNA, 19 bp, Homo sapiens
tcagaactatgtttttgtt

SEQ ID NO: 2766995 - DNA, 18 bp, Homo sapiens
tcagatgcacatgagctg

SEQ ID NO: 2766996 - DNA, 20 bp, Homo sapiens
tcagttgttatttattgaaa

SEQ ID NO: 2766997 - DNA, 15 bp, Homo sapiens
tcatctgttacacaa

SEQ ID NO: 2766998 - DNA, 19 bp, Homo sapiens
tcatgctgccaatatccta

SEQ ID NO: 2766999 - DNA, 14 bp, Homo sapiens
tcattagttttgaa

SEQ ID NO: 2767000 - DNA, 17 bp, Homo sapiens
tcattatgttaatattt

SEQ ID NO: 2767001 - DNA, 14 bp, Homo sapiens
tccagtcattatgt

SEQ ID NO: 2767002 - DNA, 16 bp, Homo sapiens
tccctgtgtcatttca

SEQ ID NO: 2767003 - DNA, 17 bp, Homo sapiens
tccctgtgtcatttcaa

SEQ ID NO: 2767004 - DNA, 15 bp, Homo sapiens
tcccttggacatttt

SEQ ID NO: 2767005 - DNA, 19 bp, Homo sapiens
tcccttggacattttatgt

SEQ ID NO: 2767006 - DNA, 13 bp, Homo sapiens
tcctaataaaaag

SEQ ID NO: 2767007 - DNA, 22 bp, Homo sapiens
tcctcatttttataatgtccct

SEQ ID NO: 2767008 - DNA, 16 bp, Homo sapiens
tcctgtttttattatt

SEQ ID NO: 2767009 - DNA, 14 bp, Homo sapiens
tcggagccctgtct

SEQ ID NO: 2767010 - DNA, 22 bp, Homo sapiens
tctaaatatcccttggacattt

SEQ ID NO: 2767011 - DNA, 14 bp, Homo sapiens
tctatgttaatatt

SEQ ID NO: 2767012 - DNA, 12 bp, Homo sapiens
tctcagcagagt

SEQ ID NO: 2767013 - DNA, 15 bp, Homo sapiens
tctggattcatattt

SEQ ID NO: 2767014 - DNA, 12 bp, Homo sapiens
tctgtcttttaa

SEQ ID NO: 2767015 - DNA, 17 bp, Homo sapiens
tctgtgatgacattccc

SEQ ID NO: 2767016 - DNA, 16 bp, Homo sapiens
tcttccctcaaatgtg

SEQ ID NO: 2767017 - DNA, 12 bp, Homo sapiens
tcttctatttat

SEQ ID NO: 2767018 - DNA, 12 bp, Homo sapiens
tcttttaaactc

SEQ ID NO: 2767019 - DNA, 14 bp, Homo sapiens
tgaaataaggaatg

SEQ ID NO: 2767020 - DNA, 18 bp, Homo sapiens
tgaaataaggaatgatat

SEQ ID NO: 2767021 - DNA, 21 bp, Homo sapiens
tgaagattctatgttaatatt

SEQ ID NO: 2767022 - DNA, 13 bp, Homo sapiens
tgaagcagagtgg

SEQ ID NO: 2767023 - DNA, 16 bp, Homo sapiens
tgaagcagagtggcag

SEQ ID NO: 2767024 - DNA, 16 bp, Homo sapiens
aaaccgtaattttatt

SEQ ID NO: 2767025 - DNA, 22 bp, Homo sapiens
aaacctcacccgaggctgccca

SEQ ID NO: 2767026 - DNA, 18 bp, Homo sapiens
aaacctcatgacagccag

SEQ ID NO: 2767027 - DNA, 23 bp, Homo sapiens
aaacctcatgacagccagagcct

SEQ ID NO: 2767028 - DNA, 23 bp, Homo sapiens
aaacctgaggatgcaacaaatat

SEQ ID NO: 2767029 - DNA, 19 bp, Homo sapiens
aaacctgatgttaaaattc

SEQ ID NO: 2767030 - DNA, 18 bp, Homo sapiens
aaaccttattgtacctct

SEQ ID NO: 2767031 - DNA, 17 bp, Homo sapiens
aaacctttcttcaccaa

SEQ ID NO: 2767032 - DNA, 12 bp, Homo sapiens
aaacgccatgtc

SEQ ID NO: 2767033 - DNA, 22 bp, Homo sapiens
aaactagaggtgagaaatttaa

SEQ ID NO: 2767034 - DNA, 22 bp, Homo sapiens
aaactataagcaagaaggcaaa

SEQ ID NO: 2767035 - DNA, 21 bp, Homo sapiens
aaactcaaaatatttgtacat

SEQ ID NO: 2767036 - DNA, 16 bp, Homo sapiens
aaactcaccatgtaaa

SEQ ID NO: 2767037 - DNA, 14 bp, Homo sapiens
aaactcagttaaaa

SEQ ID NO: 2767038 - DNA, 16 bp, Homo sapiens
aaactcagttaaaatg

SEQ ID NO: 2767039 - DNA, 16 bp, Homo sapiens
aaactcgttttttaca

SEQ ID NO: 2767040 - DNA, 22 bp, Homo sapiens
aaactctgggaaataagagaga

SEQ ID NO: 2767041 - DNA, 14 bp, Homo sapiens
aaactcttctactt

SEQ ID NO: 2767042 - DNA, 14 bp, Homo sapiens
aaactgaggaattt

SEQ ID NO: 2767043 - DNA, 20 bp, Homo sapiens
aaactgaggccattatttca

SEQ ID NO: 2767044 - DNA, 14 bp, Homo sapiens
aaactgcattagaa

SEQ ID NO: 2767045 - DNA, 17 bp, Homo sapiens
aaactgcattagaaatt

SEQ ID NO: 2767046 - DNA, 19 bp, Homo sapiens
aaactggaaatctggattt

SEQ ID NO: 2767047 - DNA, 12 bp, Homo sapiens
aaactggccagg

SEQ ID NO: 2767048 - DNA, 19 bp, Homo sapiens
aaactgttaatagttcagg

SEQ ID NO: 2767049 - DNA, 21 bp, Homo sapiens
aaacttaattacatccagaaa

SEQ ID NO: 2767050 - DNA, 21 bp, Homo sapiens
aaacttagtgcggacaagttt

SEQ ID NO: 2767051 - DNA, 12 bp, Homo sapiens
aaacttgtaaat

SEQ ID NO: 2767052 - DNA, 13 bp, Homo sapiens
aaacttgtcagaa

SEQ ID NO: 2767053 - DNA, 22 bp, Homo sapiens
aaactttaaagcgtttgcacag

SEQ ID NO: 2767054 - DNA, 19 bp, Homo sapiens
aaacttttaatgccttcca

SEQ ID NO: 2767055 - DNA, 16 bp, Homo sapiens
aaagaaaaaaatatat

SEQ ID NO: 2767056 - DNA, 18 bp, Homo sapiens
aaagaaaaaaatatattt

SEQ ID NO: 2767057 - DNA, 22 bp, Homo sapiens
aaagaaaaaaatatattttatg

SEQ ID NO: 2767058 - DNA, 19 bp, Homo sapiens
aaagaaaccgtaattttat

SEQ ID NO: 2767059 - DNA, 20 bp, Homo sapiens
aaagaaaccgtaattttatt

SEQ ID NO: 2767060 - DNA, 12 bp, Homo sapiens
aaagaaactttc

SEQ ID NO: 2767061 - DNA, 18 bp, Homo sapiens
aaagaacggcatgtgaat

SEQ ID NO: 2767062 - DNA, 12 bp, Homo sapiens
aaagaaggaagt

SEQ ID NO: 2767063 - DNA, 17 bp, Homo sapiens
aaagaataaatgaatct

SEQ ID NO: 2767064 - DNA, 18 bp, Homo sapiens
aaagagaaaaaaagtttg

SEQ ID NO: 2767065 - DNA, 15 bp, Homo sapiens
aaagagaaaaaccaa

SEQ ID NO: 2767066 - DNA, 22 bp, Homo sapiens
aaagagtgggctgcatctggga

SEQ ID NO: 2767067 - DNA, 16 bp, Homo sapiens
aaagagttcttaagga

SEQ ID NO: 2767068 - DNA, 22 bp, Homo sapiens
aaagataacaagatctttcagg

SEQ ID NO: 2767069 - DNA, 22 bp, Homo sapiens
aaagatggctgtgcctctgcct

SEQ ID NO: 2767070 - DNA, 20 bp, Homo sapiens
aaagatgtttgtcagatatg

SEQ ID NO: 2767071 - DNA, 14 bp, Homo sapiens
aaagcaaaaaagaa

SEQ ID NO: 2767072 - DNA, 13 bp, Homo sapiens
aaagcaaaagaag

SEQ ID NO: 2767073 - DNA, 14 bp, Homo sapiens
aaagcaaaagaagt

SEQ ID NO: 2767074 - DNA, 18 bp, Homo sapiens
aaagcaacagtagcaggg

SEQ ID NO: 2767075 - DNA, 22 bp, Homo sapiens
aaagcaagcattcagaagaaaa

SEQ ID NO: 2767076 - DNA, 22 bp, Homo sapiens
aaagcaccgcagcatgtgggga

SEQ ID NO: 2767077 - DNA, 12 bp, Homo sapiens
aaagcacctgcc

SEQ ID NO: 2767078 - DNA, 19 bp, Homo sapiens
aaagcacgaaatgttattt

SEQ ID NO: 2767079 - DNA, 14 bp, Homo sapiens
aaagcactttttaa

SEQ ID NO: 2767080 - DNA, 21 bp, Homo sapiens
aaagcagtcctcttattccta

SEQ ID NO: 2767081 - DNA, 13 bp, Homo sapiens
aaagcagtgtttt

SEQ ID NO: 2767082 - DNA, 18 bp, Homo sapiens
aaagcagtgttttcacct

SEQ ID NO: 2767083 - DNA, 17 bp, Homo sapiens
aaagcatcacctcaggc

SEQ ID NO: 2767084 - DNA, 18 bp, Homo sapiens
aaagcatcacctcaggcc

SEQ ID NO: 2767085 - DNA, 20 bp, Homo sapiens
aaagcatcatggctatctgt

SEQ ID NO: 2767086 - DNA, 17 bp, Homo sapiens
aaagccaaactctgcca

SEQ ID NO: 2767087 - DNA, 15 bp, Homo sapiens
aaagccaaagctagg

SEQ ID NO: 2767088 - DNA, 12 bp, Homo sapiens
aaagccaaattt

SEQ ID NO: 2767089 - DNA, 16 bp, Homo sapiens
aaagcccaacctcctg

SEQ ID NO: 2767090 - DNA, 22 bp, Homo sapiens
aaagcccttccatgtcgcctct

SEQ ID NO: 2767091 - DNA, 23 bp, Homo sapiens
aaagcccttccatgtcgcctctg

SEQ ID NO: 2767092 - DNA, 12 bp, Homo sapiens
aaagcgaaaaaa

SEQ ID NO: 2767093 - DNA, 14 bp, Homo sapiens
aaagctaggcctgg

SEQ ID NO: 2767094 - DNA, 16 bp, Homo sapiens
aaagctaggcctggcc

SEQ ID NO: 2767095 - DNA, 18 bp, Homo sapiens
aaagctaggcctggccag

SEQ ID NO: 2767096 - DNA, 17 bp, Homo sapiens
aaagctgcctgtagtta

SEQ ID NO: 2767097 - DNA, 21 bp, Homo sapiens
aaagctgcctgtagttaggaa

SEQ ID NO: 2767098 - DNA, 23 bp, Homo sapiens
aaagctgcctgtagttaggaaat

SEQ ID NO: 2767099 - DNA, 23 bp, Homo sapiens
aaagctgcttgactatcacatac

SEQ ID NO: 2767100 - DNA, 16 bp, Homo sapiens
aaagctggtttaatgt

SEQ ID NO: 2767101 - DNA, 23 bp, Homo sapiens
aaagctgtggccagcttgttatt

SEQ ID NO: 2767102 - DNA, 18 bp, Homo sapiens
aaagctgtgtgtttggaa

SEQ ID NO: 2767103 - DNA, 16 bp, Homo sapiens
aaagcttaaaactttg

SEQ ID NO: 2767104 - DNA, 19 bp, Homo sapiens
aaagcttaaaactttgaag

SEQ ID NO: 2767105 - DNA, 21 bp, Homo sapiens
aaagcttctatcccaggaggt

SEQ ID NO: 2767106 - DNA, 19 bp, Homo sapiens
aaagcttgcaacaaaattc

SEQ ID NO: 2767107 - DNA, 21 bp, Homo sapiens
aaagctttgcttatggtaata

SEQ ID NO: 2767108 - DNA, 12 bp, Homo sapiens
aaaggaaggaaa

SEQ ID NO: 2767109 - DNA, 20 bp, Homo sapiens
aaaggatgtaaacagtgcct

SEQ ID NO: 2767110 - DNA, 11 bp, Homo sapiens
aaaggcctggg

SEQ ID NO: 2767111 - DNA, 19 bp, Homo sapiens
aaaggctagtttattttgt

SEQ ID NO: 2767112 - DNA, 19 bp, Homo sapiens
aaaggctcagtctcaggag

SEQ ID NO: 2767113 - DNA, 12 bp, Homo sapiens
aaaggcttttgg

SEQ ID NO: 2767114 - DNA, 23 bp, Homo sapiens
aaaaaggctggctgaaaatcact

SEQ ID NO: 2767115 - DNA, 14 bp, Homo sapiens
aaaaagtatttttt

SEQ ID NO: 2767116 - DNA, 20 bp, Homo sapiens
aaaaagtatttttttaagtt

SEQ ID NO: 2767117 - DNA, 13 bp, Homo sapiens
aaaaagtttgttt

SEQ ID NO: 2767118 - DNA, 22 bp, Homo sapiens
aaaaataagaagaatgcttaat

SEQ ID NO: 2767119 - DNA, 21 bp, Homo sapiens
aaaaatagctaaatacctcaa

SEQ ID NO: 2767120 - DNA, 14 bp, Homo sapiens
aaaaatagtttgga

SEQ ID NO: 2767121 - DNA, 13 bp, Homo sapiens
aaaaatattccat

SEQ ID NO: 2767122 - DNA, 11 bp, Homo sapiens
aaaaatattta

SEQ ID NO: 2767123 - DNA, 16 bp, Homo sapiens
aaaaatccagaaagaa

SEQ ID NO: 2767124 - DNA, 16 bp, Homo sapiens
aaaaatgatttcagta

SEQ ID NO: 2767125 - DNA, 18 bp, Homo sapiens
aaaaattaagagatacat

SEQ ID NO: 2767126 - DNA, 13 bp, Homo sapiens
aaaaattgaagag

SEQ ID NO: 2767127 - DNA, 19 bp, Homo sapiens
aaaaattgaagagagatat

SEQ ID NO: 2767128 - DNA, 12 bp, Homo sapiens
aaaaattgcaca

SEQ ID NO: 2767129 - DNA, 17 bp, Homo sapiens
aaaaattgcacaatttg

SEQ ID NO: 2767130 - DNA, 14 bp, Homo sapiens
aaaaattgtgatca

SEQ ID NO: 2767131 - DNA, 20 bp, Homo sapiens
aaaatccttgcttatgacat

SEQ ID NO: 2767132 - DNA, 19 bp, Homo sapiens
aaaatctgtttgatccctg

SEQ ID NO: 2767133 - DNA, 18 bp, Homo sapiens
aaaatcttggcacagaaa

SEQ ID NO: 2767134 - DNA, 19 bp, Homo sapiens
aaaatgaaagcatgtctca

SEQ ID NO: 2767135 - DNA, 15 bp, Homo sapiens
aaaatgacagatgtt

SEQ ID NO: 2767136 - DNA, 19 bp, Homo sapiens
aaaatgagcctgtaatcct

SEQ ID NO: 2767137 - DNA, 18 bp, Homo sapiens
aaaatgaggttcaactgt

SEQ ID NO: 2767138 - DNA, 21 bp, Homo sapiens
aaaatgcagtccagaataagt

SEQ ID NO: 2767139 - DNA, 15 bp, Homo sapiens
aaaatgcattatgtg

SEQ ID NO: 2767140 - DNA, 12 bp, Homo sapiens
aaaatggaaaga

SEQ ID NO: 2767141 - DNA, 13 bp, Homo sapiens
aaaatggaaagaa

SEQ ID NO: 2767142 - DNA, 17 bp, Homo sapiens
aaaatgtgtcagcatgc

SEQ ID NO: 2767143 - DNA, 18 bp, Homo sapiens
aaaattaagagatacatt

SEQ ID NO: 2767144 - DNA, 19 bp, Homo sapiens
aaaattaggatttcatgat

SEQ ID NO: 2767145 - DNA, 13 bp, Homo sapiens
aaaattcagtgga

SEQ ID NO: 2767146 - DNA, 21 bp, Homo sapiens
aaaattccatcccatcatctt

SEQ ID NO: 2767147 - DNA, 13 bp, Homo sapiens
aaaattcttggaa

SEQ ID NO: 2767148 - DNA, 23 bp, Homo sapiens
aaaattgatatacttttttctta

SEQ ID NO: 2767149 - DNA, 9 bp, Homo sapiens
aaaattgca

SEQ ID NO: 2767150 - DNA, 12 bp, Homo sapiens
aaaattgcacaa

SEQ ID NO: 2767151 - DNA, 14 bp, Homo sapiens
aaaattgcacaatt

SEQ ID NO: 2767152 - DNA, 16 bp, Homo sapiens
aaaattgcacaatttg

SEQ ID NO: 2767153 - DNA, 21 bp, Homo sapiens
aaaattgtgtttagattttat

SEQ ID NO: 2767154 - DNA, 18 bp, Homo sapiens
aaaatttgaaatttagct

SEQ ID NO: 2767155 - DNA, 12 bp, Homo sapiens
aaaattttcaaa

SEQ ID NO: 2767156 - DNA, 16 bp, Homo sapiens
aaaattttcaaacttt

SEQ ID NO: 2767157 - DNA, 18 bp, Homo sapiens
aaacaaaaacaaaaccag

SEQ ID NO: 2767158 - DNA, 17 bp, Homo sapiens
aaacaaataatcacatt

SEQ ID NO: 2767159 - DNA, 22 bp, Homo sapiens
aaacaagtatttgttaatttag

SEQ ID NO: 2767160 - DNA, 17 bp, Homo sapiens
aaacacattgagtttaa

SEQ ID NO: 2767161 - DNA, 19 bp, Homo sapiens
aaacaccaacataaaaatg

SEQ ID NO: 2767162 - DNA, 14 bp, Homo sapiens
aaacactgtaatct

SEQ ID NO: 2767163 - DNA, 12 bp, Homo sapiens
aaacactgtgta

SEQ ID NO: 2767164 - DNA, 16 bp, Homo sapiens
aaacagagacaggccc

SEQ ID NO: 2767165 - DNA, 22 bp, Homo sapiens
aaacagagacaggcccaagaga

SEQ ID NO: 2767166 - DNA, 15 bp, Homo sapiens
aaacagatataaatg

SEQ ID NO: 2767167 - DNA, 17 bp, Homo sapiens
aaacaggggatcaaagt

SEQ ID NO: 2767168 - DNA, 18 bp, Homo sapiens
aaacaggggatcaaagtt

SEQ ID NO: 2767169 - DNA, 20 bp, Homo sapiens
aaacaggggatcaaagttcc

SEQ ID NO: 2767170 - DNA, 17 bp, Homo sapiens
aaacagtcgatcaaggg

SEQ ID NO: 2767171 - DNA, 14 bp, Homo sapiens
aaacagtgagcctg

SEQ ID NO: 2767172 - DNA, 14 bp, Homo sapiens
aaacagttaacttt

SEQ ID NO: 2767173 - DNA, 23 bp, Homo sapiens
aaacagttaactttcagaagaga

SEQ ID NO: 2767174 - DNA, 21 bp, Homo sapiens
aaacataattcttgtatatta

SEQ ID NO: 2767175 - DNA, 22 bp, Homo sapiens
aaacatatcaattcaacacatt

SEQ ID NO: 2767176 - DNA, 22 bp, Homo sapiens
aaacatatttgttaaatattta

SEQ ID NO: 2767177 - DNA, 13 bp, Homo sapiens
aaacatgagaaat

SEQ ID NO: 2767178 - DNA, 15 bp, Homo sapiens
aaacatgagaaatgt

SEQ ID NO: 2767179 - DNA, 19 bp, Homo sapiens
aaacatgagaaatgtgaac

SEQ ID NO: 2767180 - DNA, 21 bp, Homo sapiens
aaacatggtagaattggagag

SEQ ID NO: 2767181 - DNA, 22 bp, Homo sapiens
aaacatgtggcaacctgttctt

SEQ ID NO: 2767182 - DNA, 12 bp, Homo sapiens
aaacattaaaca

SEQ ID NO: 2767183 - DNA, 15 bp, Homo sapiens
aaacattaaacactg

SEQ ID NO: 2767184 - DNA, 18 bp, Homo sapiens
aaacattaaacactgtaa

SEQ ID NO: 2767185 - DNA, 15 bp, Homo sapiens
aaacattaagattga

SEQ ID NO: 2767186 - DNA, 20 bp, Homo sapiens
aaacattatagattttcatg

SEQ ID NO: 2767187 - DNA, 18 bp, Homo sapiens
aaacatttacaataaata

SEQ ID NO: 2767188 - DNA, 23 bp, Homo sapiens
aaacatttacaataaatattctg

SEQ ID NO: 2767189 - DNA, 18 bp, Homo sapiens
aaacatttgtacattcct

SEQ ID NO: 2767190 - DNA, 17 bp, Homo sapiens
aaaccaatgattcataa

SEQ ID NO: 2767191 - DNA, 16 bp, Homo sapiens
aaaccactgaacattt

SEQ ID NO: 2767192 - DNA, 14 bp, Homo sapiens
aaaccagcagaaaa

SEQ ID NO: 2767193 - DNA, 15 bp, Homo sapiens
aaaccagcagaaaag

SEQ ID NO: 2767194 - DNA, 17 bp, Homo sapiens
aaaccagcagaaaagtg

SEQ ID NO: 2767195 - DNA, 11 bp, Homo sapiens
aaaccagctgc

SEQ ID NO: 2767196 - DNA, 12 bp, Homo sapiens
aaaccagctgct

SEQ ID NO: 2767197 - DNA, 13 bp, Homo sapiens
aaaccataaactt

SEQ ID NO: 2767198 - DNA, 15 bp, Homo sapiens
aaaccataaacttca

SEQ ID NO: 2767199 - DNA, 14 bp, Homo sapiens
aaaccatgcagctt

SEQ ID NO: 2767200 - DNA, 16 bp, Homo sapiens
aaaccatgcagcttca

SEQ ID NO: 2767201 - DNA, 20 bp, Homo sapiens
aaaccatgcagcttcatcaa

SEQ ID NO: 2767202 - DNA, 20 bp, Homo sapiens
aaaccatttaattcataatt

SEQ ID NO: 2767203 - DNA, 17 bp, Homo sapiens
aaacccaaataaatgtg

SEQ ID NO: 2767204 - DNA, 14 bp, Homo sapiens
aaacccaccagcct

SEQ ID NO: 2767205 - DNA, 23 bp, Homo sapiens
aaacccaccagcctaagaagctc

SEQ ID NO: 2767206 - DNA, 20 bp, Homo sapiens
aaatccagttacgggtggag

SEQ ID NO: 2767207 - DNA, 16 bp, Homo sapiens
aaatccagtttcccac

SEQ ID NO: 2767208 - DNA, 21 bp, Homo sapiens
aaatcccattcataactttca

SEQ ID NO: 2767209 - DNA, 15 bp, Homo sapiens
aaatcctactgaatg

SEQ ID NO: 2767210 - DNA, 12 bp, Homo sapiens
aaatcctctggc

SEQ ID NO: 2767211 - DNA, 19 bp, Homo sapiens
aaatcctttttctttataa

SEQ ID NO: 2767212 - DNA, 13 bp, Homo sapiens
aaatcgaatgaaa

SEQ ID NO: 2767213 - DNA, 20 bp, Homo sapiens
aaatcgaatgaaattaactg

SEQ ID NO: 2767214 - DNA, 16 bp, Homo sapiens
aaatctagatcaatta

SEQ ID NO: 2767215 - DNA, 21 bp, Homo sapiens
aaatctagatcaattaattct

SEQ ID NO: 2767216 - DNA, 19 bp, Homo sapiens
aaatctgagcctaaatcta

SEQ ID NO: 2767217 - DNA, 18 bp, Homo sapiens
aaatctttgattcagaca

SEQ ID NO: 2767218 - DNA, 17 bp, Homo sapiens
aaatgaaaatcgtgaca

SEQ ID NO: 2767219 - DNA, 21 bp, Homo sapiens
aaatgaaacaaataatcacat

SEQ ID NO: 2767220 - DNA, 14 bp, Homo sapiens
aaatgaaagggtca

SEQ ID NO: 2767221 - DNA, 22 bp, Homo sapiens
aaatgaaattactacaaaattt

SEQ ID NO: 2767222 - DNA, 14 bp, Homo sapiens
aaatgaatagagag

SEQ ID NO: 2767223 - DNA, 20 bp, Homo sapiens
aaatgaatttatctgaatat

SEQ ID NO: 2767224 - DNA, 15 bp, Homo sapiens
aaatgacattttgct

SEQ ID NO: 2767225 - DNA, 14 bp, Homo sapiens
aaatgacccaaaga

SEQ ID NO: 2767226 - DNA, 17 bp, Homo sapiens
aaatgacccaaagacca

SEQ ID NO: 2767227 - DNA, 22 bp, Homo sapiens
aaatgagcattagctacttttc

SEQ ID NO: 2767228 - DNA, 14 bp, Homo sapiens
aaatgagctcctgc

SEQ ID NO: 2767229 - DNA, 18 bp, Homo sapiens
aaatgagtgtgtttgtca

SEQ ID NO: 2767230 - DNA, 21 bp, Homo sapiens
aaatgataaagatgtcaaata

SEQ ID NO: 2767231 - DNA, 13 bp, Homo sapiens
aaatgatctaaac

SEQ ID NO: 2767232 - DNA, 16 bp, Homo sapiens
aaatgattttcatcaa

SEQ ID NO: 2767233 - DNA, 19 bp, Homo sapiens
aaatgattttcatcaattt

SEQ ID NO: 2767234 - DNA, 20 bp, Homo sapiens
aaatgattttcatcaattta

SEQ ID NO: 2767235 - DNA, 21 bp, Homo sapiens
aaatgattttcatcaatttaa

SEQ ID NO: 2767236 - DNA, 17 bp, Homo sapiens
aaatgcaaacactgtgt

SEQ ID NO: 2767237 - DNA, 20 bp, Homo sapiens
aaatgcaaacactgtgtatt

SEQ ID NO: 2767238 - DNA, 15 bp, Homo sapiens
aaatgcaatatgtat

SEQ ID NO: 2767239 - DNA, 14 bp, Homo sapiens
aaatgcagtccaga

SEQ ID NO: 2767240 - DNA, 15 bp, Homo sapiens
aaatgcataaatgca

SEQ ID NO: 2767241 - DNA, 22 bp, Homo sapiens
aaatgcatccattcctcaggga

SEQ ID NO: 2767242 - DNA, 21 bp, Homo sapiens
aaatgccttttcccaaaatgt

SEQ ID NO: 2767243 - DNA, 18 bp, Homo sapiens
aaatgctaaatgcaaaca

SEQ ID NO: 2767244 - DNA, 19 bp, Homo sapiens
aaatgctgttggtgagaat

SEQ ID NO: 2767245 - DNA, 16 bp, Homo sapiens
aaatggagaagctctg

SEQ ID NO: 2767246 - DNA, 19 bp, Homo sapiens
aaatggagcttgtacatat

SEQ ID NO: 2767247 - DNA, 13 bp, Homo sapiens
aaatggccatttg

SEQ ID NO: 2767248 - DNA, 19 bp, Homo sapiens
aaatggccatttgcttttt

SEQ ID NO: 2767249 - DNA, 22 bp, Homo sapiens
aaatggccatttgctttttcac

SEQ ID NO: 2767250 - DNA, 20 bp, Homo sapiens
aaatggctctgtgaaatcag

SEQ ID NO: 2767251 - DNA, 17 bp, Homo sapiens
aaatggctggtttttag

SEQ ID NO: 2767252 - DNA, 23 bp, Homo sapiens
aaatggtggtttgtcatatattc

SEQ ID NO: 2767253 - DNA, 20 bp, Homo sapiens
aaatgtatcatagaaatgta

SEQ ID NO: 2767254 - DNA, 21 bp, Homo sapiens
aaatgtatcctgataaacatt

SEQ ID NO: 2767255 - DNA, 23 bp, Homo sapiens
aaatgtatcctgataaacattaa

SEQ ID NO: 2767256 - DNA, 12 bp, Homo sapiens
aaatgtgtaaat

SEQ ID NO: 2767257 - DNA, 19 bp, Homo sapiens
aaatgtgtaaatgtggaca

SEQ ID NO: 2767258 - DNA, 15 bp, Homo sapiens
aaatgtgtggtgcta

SEQ ID NO: 2767259 - DNA, 20 bp, Homo sapiens
aaatgttattttttaattat

SEQ ID NO: 2767260 - DNA, 15 bp, Homo sapiens
aaatgttcagaaggt

SEQ ID NO: 2767261 - DNA, 19 bp, Homo sapiens
aaatgtttcactatgattt

SEQ ID NO: 2767262 - DNA, 16 bp, Homo sapiens
aaatgtttcattttca

SEQ ID NO: 2767263 - DNA, 13 bp, Homo sapiens
aaatgtttctgca

SEQ ID NO: 2767264 - DNA, 23 bp, Homo sapiens
aaatgtttctgcagtagtctctg

SEQ ID NO: 2767265 - DNA, 21 bp, Homo sapiens
aaattaacactgcttgtgttt

SEQ ID NO: 2767266 - DNA, 22 bp, Homo sapiens
aaattacacccaaagaggtatt

SEQ ID NO: 2767267 - DNA, 15 bp, Homo sapiens
aaattactacaaaat

SEQ ID NO: 2767268 - DNA, 23 bp, Homo sapiens
aaattaggttttgtacaattgaa

SEQ ID NO: 2767269 - DNA, 20 bp, Homo sapiens
aaattagtgaagttctttta

SEQ ID NO: 2767270 - DNA, 22 bp, Homo sapiens
aaattataacttaaaatatttt

SEQ ID NO: 2767271 - DNA, 22 bp, Homo sapiens
aaattcaaaccatttaattcat

SEQ ID NO: 2767272 - DNA, 19 bp, Homo sapiens
aaattcaacctgtgtctta

SEQ ID NO: 2767273 - DNA, 20 bp, Homo sapiens
aaattcaaggagatataaaa

SEQ ID NO: 2767274 - DNA, 16 bp, Homo sapiens
aaattcacaatagaaa

SEQ ID NO: 2767275 - DNA, 13 bp, Homo sapiens
aaattccaaactt

SEQ ID NO: 2767276 - DNA, 20 bp, Homo sapiens
aaattctcagtcagtaattg

SEQ ID NO: 2767277 - DNA, 15 bp, Homo sapiens
aaattctttttcaaa

SEQ ID NO: 2767278 - DNA, 16 bp, Homo sapiens
aaattctttttcaaaa

SEQ ID NO: 2767279 - DNA, 9 bp, Homo sapiens
aaattgcac

SEQ ID NO: 2767280 - DNA, 11 bp, Homo sapiens
aaattgcacaa

SEQ ID NO: 2767281 - DNA, 23 bp, Homo sapiens
aaattgcacaatttgagcaattc

SEQ ID NO: 2767282 - DNA, 20 bp, Homo sapiens
aaattggtatcaagaaagtc

SEQ ID NO: 2767283 - DNA, 16 bp, Homo sapiens
aaattggtgataagtg

SEQ ID NO: 2767284 - DNA, 18 bp, Homo sapiens
aaattggtgataagtgga

SEQ ID NO: 2767285 - DNA, 19 bp, Homo sapiens
aaattggtgataagtggaa

SEQ ID NO: 2767286 - DNA, 22 bp, Homo sapiens
aaattggtgataagtggaaaaa

SEQ ID NO: 2767287 - DNA, 22 bp, Homo sapiens
aaattgtgtttagattttatga

SEQ ID NO: 2767288 - DNA, 12 bp, Homo sapiens
aaatttcagatt

SEQ ID NO: 2767289 - DNA, 19 bp, Homo sapiens
aaatttccagtgagcttat

SEQ ID NO: 2767290 - DNA, 14 bp, Homo sapiens
aaatttgaagtaaa

SEQ ID NO: 2767291 - DNA, 20 bp, Homo sapiens
aaatttggatttacgactga

SEQ ID NO: 2767292 - DNA, 18 bp, Homo sapiens
aaattttactgacagaaa

SEQ ID NO: 2767293 - DNA, 23 bp, Homo sapiens
aaattttagcgtgctcactgacc

SEQ ID NO: 2767294 - DNA, 17 bp, Homo sapiens
aaattttatctcttatt

SEQ ID NO: 2767295 - DNA, 12 bp, Homo sapiens
aaattttattcc

SEQ ID NO: 2767296 - DNA, 13 bp, Homo sapiens
aaattttattcct

SEQ ID NO: 2767297 - DNA, 13 bp, Homo sapiens
aaattttcaaact

SEQ ID NO: 2767298 - DNA, 16 bp, Homo sapiens
aaatttttatttttga

SEQ ID NO: 2767299 - DNA, 13 bp, Homo sapiens
aacaaaacaagaa

SEQ ID NO: 2767300 - DNA, 16 bp, Homo sapiens
aacaaaacaagaaaga

SEQ ID NO: 2767301 - DNA, 11 bp, Homo sapiens
aacaaaaccag

SEQ ID NO: 2767302 - DNA, 16 bp, Homo sapiens
aacaaaaccagctgct

SEQ ID NO: 2767303 - DNA, 15 bp, Homo sapiens
aacaaaatcacaagc

SEQ ID NO: 2767304 - DNA, 16 bp, Homo sapiens
aacaaactcgtttttt

SEQ ID NO: 2767305 - DNA, 19 bp, Homo sapiens
aacaaagagaaaaaataca

SEQ ID NO: 2767306 - DNA, 19 bp, Homo sapiens
aacaaattaggttttgtac

SEQ ID NO: 2767307 - DNA, 20 bp, Homo sapiens
aacaaattaggttttgtaca

SEQ ID NO: 2767308 - DNA, 21 bp, Homo sapiens
aacaaattaggttttgtacaa

SEQ ID NO: 2767309 - DNA, 18 bp, Homo sapiens
aacaactatttataaact

SEQ ID NO: 2767310 - DNA, 21 bp, Homo sapiens
aacaactccaggaaaactgtt

SEQ ID NO: 2767311 - DNA, 22 bp, Homo sapiens
aacaacttaatgttctgaataa

SEQ ID NO: 2767312 - DNA, 16 bp, Homo sapiens
aacaacttctttgtaa

SEQ ID NO: 2767313 - DNA, 13 bp, Homo sapiens
aacaagaaagaaa

SEQ ID NO: 2767314 - DNA, 14 bp, Homo sapiens
aacaagaaagaaac

SEQ ID NO: 2767315 - DNA, 19 bp, Homo sapiens
aacaagagcgaaactccgt

SEQ ID NO: 2767316 - DNA, 14 bp, Homo sapiens
aacaataaagagct

SEQ ID NO: 2767317 - DNA, 14 bp, Homo sapiens
aacaatagctattg

SEQ ID NO: 2767318 - DNA, 16 bp, Homo sapiens
aacaatagctattgca

SEQ ID NO: 2767319 - DNA, 12 bp, Homo sapiens
aacaatgtatgt

SEQ ID NO: 2767320 - DNA, 23 bp, Homo sapiens
aacaatgtatgtgaaagtgtaaa

SEQ ID NO: 2767321 - DNA, 14 bp, Homo sapiens
aacaattctaaaat

SEQ ID NO: 2767322 - DNA, 19 bp, Homo sapiens
aacaattctaaaatgattg

SEQ ID NO: 2767323 - DNA, 22 bp, Homo sapiens
aacaattctaaaatgattgtag

SEQ ID NO: 2767324 - DNA, 23 bp, Homo sapiens
aacaattttaggaggaccagagc

SEQ ID NO: 2767325 - DNA, 14 bp, Homo sapiens
aacacaaatgtaaa

SEQ ID NO: 2767326 - DNA, 14 bp, Homo sapiens
aacacacaaaggta

SEQ ID NO: 2767327 - DNA, 15 bp, Homo sapiens
aacacagctttacaa

SEQ ID NO: 2767328 - DNA, 17 bp, Homo sapiens
aacacataactagaaac

SEQ ID NO: 2767329 - DNA, 17 bp, Homo sapiens
aacacatactagaaagc

SEQ ID NO: 2767330 - DNA, 18 bp, Homo sapiens
aacacattacttgcacaa

SEQ ID NO: 2767331 - DNA, 15 bp, Homo sapiens
aacaccaacataaaa

SEQ ID NO: 2767332 - DNA, 16 bp, Homo sapiens
aacacccggaaagact

SEQ ID NO: 2767333 - DNA, 20 bp, Homo sapiens
aacacccggaaagactgaaa

SEQ ID NO: 2767334 - DNA, 13 bp, Homo sapiens
aacacctgacaca

SEQ ID NO: 2767335 - DNA, 14 bp, Homo sapiens
aacactaaaaataa

SEQ ID NO: 2767336 - DNA, 14 bp, Homo sapiens
aacactatatggca

SEQ ID NO: 2767337 - DNA, 21 bp, Homo sapiens
aacactcacatttattctgct

SEQ ID NO: 2767338 - DNA, 21 bp, Homo sapiens
aacactctctgagatgcccct

SEQ ID NO: 2767339 - DNA, 15 bp, Homo sapiens
aacactgcaagaagt

SEQ ID NO: 2767340 - DNA, 16 bp, Homo sapiens
aacactgcaagaagtc

SEQ ID NO: 2767341 - DNA, 17 bp, Homo sapiens
aacactgggggagggga

SEQ ID NO: 2767342 - DNA, 16 bp, Homo sapiens
aacactgtgtatttat

SEQ ID NO: 2767343 - DNA, 22 bp, Homo sapiens
aacacttaagggttttagaaaa

SEQ ID NO: 2767344 - DNA, 21 bp, Homo sapiens
aacagaggcgtctcacatttt

SEQ ID NO: 2767345 - DNA, 13 bp, Homo sapiens
aacagagtatata

SEQ ID NO: 2767346 - DNA, 17 bp, Homo sapiens
aacagcagaggttcttt

SEQ ID NO: 2767347 - DNA, 15 bp, Homo sapiens
aacagccaacaggtg

SEQ ID NO: 2767348 - DNA, 21 bp, Homo sapiens
aacagccgctcctgtctgcca

SEQ ID NO: 2767349 - DNA, 18 bp, Homo sapiens
aacagctcaagtcttccc

SEQ ID NO: 2767350 - DNA, 23 bp, Homo sapiens
aacagctccctagtggcttcctc

SEQ ID NO: 2767351 - DNA, 21 bp, Homo sapiens
aacaggctcaatattcctgaa

SEQ ID NO: 2767352 - DNA, 13 bp, Homo sapiens
aacaggctgggct

SEQ ID NO: 2767353 - DNA, 23 bp, Homo sapiens
aacaggctgggcttcagtggcag

SEQ ID NO: 2767354 - DNA, 23 bp, Homo sapiens
aacagggaaggcaggcagggctc

SEQ ID NO: 2767355 - DNA, 16 bp, Homo sapiens
aacaggggatcaaagt

SEQ ID NO: 2767356 - DNA, 19 bp, Homo sapiens
aacaggggatcaaagttcc

SEQ ID NO: 2767357 - DNA, 15 bp, Homo sapiens
aacaggtctcctctt

SEQ ID NO: 2767358 - DNA, 19 bp, Homo sapiens
aacaggtggcaggaccagg

SEQ ID NO: 2767359 - DNA, 17 bp, Homo sapiens
aacagtcaaaacagaga

SEQ ID NO: 2767360 - DNA, 20 bp, Homo sapiens
aacagtcatgaggcagcttt

SEQ ID NO: 2767361 - DNA, 13 bp, Homo sapiens
aacagtgcctgct

SEQ ID NO: 2767362 - DNA, 14 bp, Homo sapiens
aacagtgcctgctg

SEQ ID NO: 2767363 - DNA, 19 bp, Homo sapiens
aacagtgtttcccataatt

SEQ ID NO: 2767364 - DNA, 23 bp, Homo sapiens
aacagtgtttcccataattttct

SEQ ID NO: 2767365 - DNA, 13 bp, Homo sapiens
aacagttcaaaga

SEQ ID NO: 2767366 - DNA, 14 bp, Homo sapiens
aacagttcaaagaa

SEQ ID NO: 2767367 - DNA, 15 bp, Homo sapiens
aacagttcaaagaag

SEQ ID NO: 2767368 - DNA, 16 bp, Homo sapiens
aacataaaacaatgaa

SEQ ID NO: 2767369 - DNA, 15 bp, Homo sapiens
aacatagacagaaga

SEQ ID NO: 2767370 - DNA, 21 bp, Homo sapiens
aacatagacagaagaaacaag

SEQ ID NO: 2767371 - DNA, 15 bp, Homo sapiens
aacatatcaattcaa

SEQ ID NO: 2767372 - DNA, 13 bp, Homo sapiens
aacatatttgtta

SEQ ID NO: 2767373 - DNA, 22 bp, Homo sapiens
aacatccaaggagaaacagaga

SEQ ID NO: 2767374 - DNA, 18 bp, Homo sapiens
aacatcccattgccctgg

SEQ ID NO: 2767375 - DNA, 19 bp, Homo sapiens
aacatcccattgccctggt

SEQ ID NO: 2767376 - DNA, 13 bp, Homo sapiens
aacatctcacttt

SEQ ID NO: 2767377 - DNA, 21 bp, Homo sapiens
aacatctgagaaaagctttga

SEQ ID NO: 2767378 - DNA, 13 bp, Homo sapiens
aacatgagaaatg

SEQ ID NO: 2767379 - DNA, 14 bp, Homo sapiens
aacatgagaaatgt

SEQ ID NO: 2767380 - DNA, 15 bp, Homo sapiens
aacatgagaaatgtg

SEQ ID NO: 2767381 - DNA, 19 bp, Homo sapiens
aacatgcaattttgcattt

SEQ ID NO: 2767382 - DNA, 22 bp, Homo sapiens
aacatgcaattttgcatttgaa

SEQ ID NO: 2767383 - DNA, 12 bp, Homo sapiens
aacatgcacatt

SEQ ID NO: 2767384 - DNA, 20 bp, Homo sapiens
aacatgcacatttatatata

SEQ ID NO: 2767385 - DNA, 19 bp, Homo sapiens
aacatggagaaaccctgtc

SEQ ID NO: 2767386 - DNA, 20 bp, Homo sapiens
aacatggttttgaaatgctt

SEQ ID NO: 2767387 - DNA, 20 bp, Homo sapiens
aacatgtttacttttcaggg

SEQ ID NO: 2767388 - DNA, 11 bp, Homo sapiens
aacattaaaca

SEQ ID NO: 2767389 - DNA, 11 bp, Homo sapiens
aacattcatcc

SEQ ID NO: 2767390 - DNA, 23 bp, Homo sapiens
aacattcatccagttgcaataaa

SEQ ID NO: 2767391 - DNA, 20 bp, Homo sapiens
aacatttacaataaatattc

SEQ ID NO: 2767392 - DNA, 22 bp, Homo sapiens
aacatttctatagccaaaaata

SEQ ID NO: 2767393 - DNA, 21 bp, Homo sapiens
aacatttgctttgttttctaa

SEQ ID NO: 2767394 - DNA, 22 bp, Homo sapiens
aacattttgtggtcattaagca

SEQ ID NO: 2767395 - DNA, 19 bp, Homo sapiens
aaccaaagagactggagca

SEQ ID NO: 2767396 - DNA, 14 bp, Homo sapiens
aaccaacctccccg

SEQ ID NO: 2767397 - DNA, 15 bp, Homo sapiens
aaccaatatttgtag

SEQ ID NO: 2767398 - DNA, 23 bp, Homo sapiens
aaccaatgattcataacaatgta

SEQ ID NO: 2767399 - DNA, 13 bp, Homo sapiens
aaccacatcttgc

SEQ ID NO: 2767400 - DNA, 13 bp, Homo sapiens
aaccacgctggac

SEQ ID NO: 2767401 - DNA, 19 bp, Homo sapiens
aaccactcaaattaatctt

SEQ ID NO: 2767402 - DNA, 20 bp, Homo sapiens
aaccactgtaaaatgaaatt

SEQ ID NO: 2767403 - DNA, 23 bp, Homo sapiens
aaccactgtggcgttctgctgcc

SEQ ID NO: 2767404 - DNA, 13 bp, Homo sapiens
aaccacttaaaaa

SEQ ID NO: 2767405 - DNA, 15 bp, Homo sapiens
aaccagaatcataat

SEQ ID NO: 2767406 - DNA, 17 bp, Homo sapiens
aaccagaatcataattt

SEQ ID NO: 2767407 - DNA, 18 bp, Homo sapiens
aaccagaatcataatttt

SEQ ID NO: 2767408 - DNA, 11 bp, Homo sapiens
aaccagagccc

SEQ ID NO: 2767409 - DNA, 18 bp, Homo sapiens
aaccagagccccccacaa

SEQ ID NO: 2767410 - DNA, 17 bp, Homo sapiens
aaccagcattttactac

SEQ ID NO: 2767411 - DNA, 11 bp, Homo sapiens
aaccagctgct

SEQ ID NO: 2767412 - DNA, 22 bp, Homo sapiens
aaccatagcacaggctaatttt

SEQ ID NO: 2767413 - DNA, 16 bp, Homo sapiens
aaccatcattataaac

SEQ ID NO: 2767414 - DNA, 20 bp, Homo sapiens
aaccatccatctgtggaaat

SEQ ID NO: 2767415 - DNA, 18 bp, Homo sapiens
aaccatgcagcttcatca

SEQ ID NO: 2767416 - DNA, 20 bp, Homo sapiens
aaccatgcagcttcatcaat

SEQ ID NO: 2767417 - DNA, 23 bp, Homo sapiens
aaccatgcagcttcatcaatttt

SEQ ID NO: 2767418 - DNA, 22 bp, Homo sapiens
aacccaaataaatgtgtaaatg

SEQ ID NO: 2767419 - DNA, 21 bp, Homo sapiens
aacccaaatgtccaatataaa

SEQ ID NO: 2767420 - DNA, 22 bp, Homo sapiens
aacccaaattacgtgtactaca

SEQ ID NO: 2767421 - DNA, 14 bp, Homo sapiens
aacccacctgctga

SEQ ID NO: 2767422 - DNA, 13 bp, Homo sapiens
aacccactgtgct

SEQ ID NO: 2767423 - DNA, 18 bp, Homo sapiens
aacccagaactggacgcc

SEQ ID NO: 2767424 - DNA, 11 bp, Homo sapiens
aacccagagag

SEQ ID NO: 2767425 - DNA, 11 bp, Homo sapiens
aacccaggagg

SEQ ID NO: 2767426 - DNA, 19 bp, Homo sapiens
aacccatcagaaggagaag

SEQ ID NO: 2767427 - DNA, 17 bp, Homo sapiens
aacccatttttgagcca

SEQ ID NO: 2767428 - DNA, 15 bp, Homo sapiens
aaccccagacactgg

SEQ ID NO: 2767429 - DNA, 12 bp, Homo sapiens
aaccccagctcc

SEQ ID NO: 2767430 - DNA, 18 bp, Homo sapiens
aaccccagttctgctcct

SEQ ID NO: 2767431 - DNA, 19 bp, Homo sapiens
aaccccagttctgctcctc

SEQ ID NO: 2767432 - DNA, 23 bp, Homo sapiens
aaccccagttctgctcctctcca

SEQ ID NO: 2767433 - DNA, 18 bp, Homo sapiens
aacccccagtgccacaga

SEQ ID NO: 2767434 - DNA, 10 bp, Homo sapiens
aacccctgtg

SEQ ID NO: 2767435 - DNA, 11 bp, Homo sapiens
aacccctgtgt

SEQ ID NO: 2767436 - DNA, 11 bp, Homo sapiens
aacccctttcc

SEQ ID NO: 2767437 - DNA, 14 bp, Homo sapiens
aacccgtgccaagt

SEQ ID NO: 2767438 - DNA, 14 bp, Homo sapiens
aacccgtggaggct

SEQ ID NO: 2767439 - DNA, 15 bp, Homo sapiens
aaccctcagccttga

SEQ ID NO: 2767440 - DNA, 16 bp, Homo sapiens
aaccctcagccttgaa

SEQ ID NO: 2767441 - DNA, 16 bp, Homo sapiens
aaccctgctttttgac

SEQ ID NO: 2767442 - DNA, 13 bp, Homo sapiens
aaccctgtttcct

SEQ ID NO: 2767443 - DNA, 15 bp, Homo sapiens
aaccctgttttatac

SEQ ID NO: 2767444 - DNA, 16 bp, Homo sapiens
aaccgctaaaagaaac

SEQ ID NO: 2767445 - DNA, 17 bp, Homo sapiens
aaccgtggcccttcctg

SEQ ID NO: 2767446 - DNA, 21 bp, Homo sapiens
aaccgtggcccttcctggaca

SEQ ID NO: 2767447 - DNA, 17 bp, Homo sapiens
aaccgtgtccagcacag

SEQ ID NO: 2767448 - DNA, 16 bp, Homo sapiens
aaccgtttttcaagaa

SEQ ID NO: 2767449 - DNA, 13 bp, Homo sapiens
aacctaagcaaaa

SEQ ID NO: 2767450 - DNA, 19 bp, Homo sapiens
aacctaccaccccttcctg

SEQ ID NO: 2767451 - DNA, 13 bp, Homo sapiens
aacctcaaactgg

SEQ ID NO: 2767452 - DNA, 11 bp, Homo sapiens
aacctcacttg

SEQ ID NO: 2767453 - DNA, 13 bp, Homo sapiens
aacctcagtgtca

SEQ ID NO: 2767454 - DNA, 18 bp, Homo sapiens
aacctcagtgtcatttat

SEQ ID NO: 2767455 - DNA, 19 bp, Homo sapiens
aacctcatgacagccagag

SEQ ID NO: 2767456 - DNA, 14 bp, Homo sapiens
aacctcctgggcta

SEQ ID NO: 2767457 - DNA, 21 bp, Homo sapiens
aacctcctgttagctgttatt

SEQ ID NO: 2767458 - DNA, 20 bp, Homo sapiens
aacctgacagatgtcagccg

SEQ ID NO: 2767459 - DNA, 15 bp, Homo sapiens
aaccttactatggaa

SEQ ID NO: 2767460 - DNA, 17 bp, Homo sapiens
aaccttattgtacctct

SEQ ID NO: 2767461 - DNA, 22 bp, Homo sapiens
aaccttcatgatgaattacttc

SEQ ID NO: 2767462 - DNA, 15 bp, Homo sapiens
aacctttccctcacc

SEQ ID NO: 2767463 - DNA, 22 bp, Homo sapiens
aacctttccctcaccccctccc

SEQ ID NO: 2767464 - DNA, 16 bp, Homo sapiens
aacctttgtgtaataa

SEQ ID NO: 2767465 - DNA, 17 bp, Homo sapiens
aacgaacccactgtgct

SEQ ID NO: 2767466 - DNA, 11 bp, Homo sapiens
aacgaatgaag

SEQ ID NO: 2767467 - DNA, 20 bp, Homo sapiens
aacgcaaagggctgaaagcc

SEQ ID NO: 2767468 - DNA, 13 bp, Homo sapiens
aacgcctgagccc

SEQ ID NO: 2767469 - DNA, 21 bp, Homo sapiens
aacgcctgcttgtccctgccc

SEQ ID NO: 2767470 - DNA, 12 bp, Homo sapiens
aacggggagaaa

SEQ ID NO: 2767471 - DNA, 17 bp, Homo sapiens
aacgtaaccacggaaaa

SEQ ID NO: 2767472 - DNA, 19 bp, Homo sapiens
aacgtacttaactgtgtga

SEQ ID NO: 2767473 - DNA, 20 bp, Homo sapiens
aacgtgatgatcagctgttt

SEQ ID NO: 2767474 - DNA, 15 bp, Homo sapiens
aactaatttaaacca

SEQ ID NO: 2767475 - DNA, 18 bp, Homo sapiens
aactactttttatactcc

SEQ ID NO: 2767476 - DNA, 21 bp, Homo sapiens
aactagaagaaagggcaagaa

SEQ ID NO: 2767477 - DNA, 17 bp, Homo sapiens
aactagaatttattcaa

SEQ ID NO: 2767478 - DNA, 19 bp, Homo sapiens
aactagaatttattcaatt

SEQ ID NO: 2767479 - DNA, 20 bp, Homo sapiens
aactagatcaaggagcccag

SEQ ID NO: 2767480 - DNA, 20 bp, Homo sapiens
aactagatctcctatttttc

SEQ ID NO: 2767481 - DNA, 18 bp, Homo sapiens
aactagcttggaaactgg

SEQ ID NO: 2767482 - DNA, 23 bp, Homo sapiens
aactagtaatgggccaattaaaa

SEQ ID NO: 2767483 - DNA, 16 bp, Homo sapiens
aactatggttcccaat

SEQ ID NO: 2767484 - DNA, 20 bp, Homo sapiens
aactcaatattttccatgaa

SEQ ID NO: 2767485 - DNA, 17 bp, Homo sapiens
aactcactcttatgaaa

SEQ ID NO: 2767486 - DNA, 15 bp, Homo sapiens
aactcagttttaact

SEQ ID NO: 2767487 - DNA, 18 bp, Homo sapiens
aactcagttttaactaga

SEQ ID NO: 2767488 - DNA, 17 bp, Homo sapiens
aactcatctgttatcct

SEQ ID NO: 2767489 - DNA, 15 bp, Homo sapiens
aactcattagactgg

SEQ ID NO: 2767490 - DNA, 12 bp, Homo sapiens
aactcctggcct

SEQ ID NO: 2767491 - DNA, 21 bp, Homo sapiens
aactctgggctgctacccaga

SEQ ID NO: 2767492 - DNA, 15 bp, Homo sapiens
aactcttctactttc

SEQ ID NO: 2767493 - DNA, 12 bp, Homo sapiens
aactgaaaagac

SEQ ID NO: 2767494 - DNA, 19 bp, Homo sapiens
aactgaagggggcggccta

SEQ ID NO: 2767495 - DNA, 17 bp, Homo sapiens
aactgagcctagctacc

SEQ ID NO: 2767496 - DNA, 16 bp, Homo sapiens
aactgcattagaaatt

SEQ ID NO: 2767497 - DNA, 13 bp, Homo sapiens
aactgccaagaaa

SEQ ID NO: 2767498 - DNA, 15 bp, Homo sapiens
aactgcctctttcct

SEQ ID NO: 2767499 - DNA, 20 bp, Homo sapiens
aactggaagcatgtaggaga

SEQ ID NO: 2767500 - DNA, 14 bp, Homo sapiens
aactggaataagaa

SEQ ID NO: 2767501 - DNA, 21 bp, Homo sapiens
aactggccaagctgaggtgcc

SEQ ID NO: 2767502 - DNA, 16 bp, Homo sapiens
aactgggggaaaagat

SEQ ID NO: 2767503 - DNA, 16 bp, Homo sapiens
aactgggtacttgtgg

SEQ ID NO: 2767504 - DNA, 21 bp, Homo sapiens
aactgggtacttgtggacaca

SEQ ID NO: 2767505 - DNA, 13 bp, Homo sapiens
aactggtttagca

SEQ ID NO: 2767506 - DNA, 22 bp, Homo sapiens
aactggtttagcacaatttata

SEQ ID NO: 2767507 - DNA, 16 bp, Homo sapiens
aactgtgaacctggag

SEQ ID NO: 2767508 - DNA, 15 bp, Homo sapiens
aactgtgacaggaag

SEQ ID NO: 2767509 - DNA, 15 bp, Homo sapiens
aactgtgtgaagaaa

SEQ ID NO: 2767510 - DNA, 21 bp, Homo sapiens
aactgttctggcctcagacca

SEQ ID NO: 2767511 - DNA, 14 bp, Homo sapiens
aactgtttatggta

SEQ ID NO: 2767512 - DNA, 14 bp, Homo sapiens
aacttaaaatattt

SEQ ID NO: 2767513 - DNA, 16 bp, Homo sapiens
aacttaaaatatttta

SEQ ID NO: 2767514 - DNA, 15 bp, Homo sapiens
aacttaaacaatttc

SEQ ID NO: 2767515 - DNA, 15 bp, Homo sapiens
aacttaaatcactga

SEQ ID NO: 2767516 - DNA, 16 bp, Homo sapiens
aacttaacattctgta

SEQ ID NO: 2767517 - DNA, 21 bp, Homo sapiens
aacttaacattctgtaaaatg

SEQ ID NO: 2767518 - DNA, 21 bp, Homo sapiens
aacttaccaggcaccaaaaga

SEQ ID NO: 2767519 - DNA, 19 bp, Homo sapiens
aacttagcatgtgttgaaa

SEQ ID NO: 2767520 - DNA, 22 bp, Homo sapiens
aacttagtgcggacaagtttta

SEQ ID NO: 2767521 - DNA, 22 bp, Homo sapiens
aacttcaagtgcatgctctctg

SEQ ID NO: 2767522 - DNA, 15 bp, Homo sapiens
aacttcagacacaaa

SEQ ID NO: 2767523 - DNA, 22 bp, Homo sapiens
aacttcagagggaaagtaaata

SEQ ID NO: 2767524 - DNA, 14 bp, Homo sapiens
aacttcatttgatg

SEQ ID NO: 2767525 - DNA, 20 bp, Homo sapiens
aacttcgaaagcatcattat

SEQ ID NO: 2767526 - DNA, 16 bp, Homo sapiens
aacttgaggacacatg

SEQ ID NO: 2767527 - DNA, 20 bp, Homo sapiens
aacttgaggacacatgtcca

SEQ ID NO: 2767528 - DNA, 20 bp, Homo sapiens
aacttgatatatttcattct

SEQ ID NO: 2767529 - DNA, 21 bp, Homo sapiens
aacttggttttgctacataat

SEQ ID NO: 2767530 - DNA, 13 bp, Homo sapiens
aacttgtatattc

SEQ ID NO: 2767531 - DNA, 17 bp, Homo sapiens
aacttgtatctgaagac

SEQ ID NO: 2767532 - DNA, 19 bp, Homo sapiens
aactttaaagcgtttgcac

SEQ ID NO: 2767533 - DNA, 13 bp, Homo sapiens
aactttcattttt

SEQ ID NO: 2767534 - DNA, 17 bp, Homo sapiens
aactttccatctgcttg

SEQ ID NO: 2767535 - DNA, 15 bp, Homo sapiens
aactttgaagttagc

SEQ ID NO: 2767536 - DNA, 22 bp, Homo sapiens
aactttgtacagtggagaaata

SEQ ID NO: 2767537 - DNA, 18 bp, Homo sapiens
aacttttaaacatgagaa

SEQ ID NO: 2767538 - DNA, 23 bp, Homo sapiens
aacttttttatttaaaaaactaa

SEQ ID NO: 2767539 - DNA, 16 bp, Homo sapiens
aagaaaaaaaaaatat

SEQ ID NO: 2767540 - DNA, 14 bp, Homo sapiens
aagaaaactggaaa

SEQ ID NO: 2767541 - DNA, 13 bp, Homo sapiens
aagaaaaggcatg

SEQ ID NO: 2767542 - DNA, 19 bp, Homo sapiens
aagaaaatacataagacca

SEQ ID NO: 2767543 - DNA, 16 bp, Homo sapiens
aagaaacaaggttttc

SEQ ID NO: 2767544 - DNA, 20 bp, Homo sapiens
aagaaacaggggatcaaagt

SEQ ID NO: 2767545 - DNA, 22 bp, Homo sapiens
aagaaacaggggatcaaagttc

SEQ ID NO: 2767546 - DNA, 14 bp, Homo sapiens
aagaaactttttta

SEQ ID NO: 2767547 - DNA, 16 bp, Homo sapiens
aagaaagcatagacat

SEQ ID NO: 2767548 - DNA, 22 bp, Homo sapiens
aagaaagcttcaaactgcatga

SEQ ID NO: 2767549 - DNA, 15 bp, Homo sapiens
aagaaagggcaagaa

SEQ ID NO: 2767550 - DNA, 14 bp, Homo sapiens
aagaaattcctgta

SEQ ID NO: 2767551 - DNA, 14 bp, Homo sapiens
aagaacaagaattt

SEQ ID NO: 2767552 - DNA, 19 bp, Homo sapiens
aagaacaccctatattttg

SEQ ID NO: 2767553 - DNA, 12 bp, Homo sapiens
aagaagaatata

SEQ ID NO: 2767554 - DNA, 14 bp, Homo sapiens
aagaagagacagga

SEQ ID NO: 2767555 - DNA, 23 bp, Homo sapiens
aggccgggcttgggccctgcaca

SEQ ID NO: 2767556 - DNA, 16 bp, Homo sapiens
aggcctaaaagtaaac

SEQ ID NO: 2767557 - DNA, 23 bp, Homo sapiens
aggcctcttggacctctgctctg

SEQ ID NO: 2767558 - DNA, 16 bp, Homo sapiens
aggcctgccctcaggg

SEQ ID NO: 2767559 - DNA, 11 bp, Homo sapiens
aggcctggcca

SEQ ID NO: 2767560 - DNA, 23 bp, Homo sapiens
aggcctggccagatgcaccagcc

SEQ ID NO: 2767561 - DNA, 19 bp, Homo sapiens
agggccggggaactggcca

SEQ ID NO: 2767562 - DNA, 14 bp, Homo sapiens
agggcctgatgggg

SEQ ID NO: 2767563 - DNA, 15 bp, Homo sapiens
agggccttgcccaga

SEQ ID NO: 2767564 - DNA, 19 bp, Homo sapiens
agggccttgcccagagatg

SEQ ID NO: 2767565 - DNA, 22 bp, Homo sapiens
agggcgtcgctggacaacccag

SEQ ID NO: 2767566 - DNA, 16 bp, Homo sapiens
agggcgtgactcaccc

SEQ ID NO: 2767567 - DNA, 14 bp, Homo sapiens
agggctaagagcta

SEQ ID NO: 2767568 - DNA, 19 bp, Homo sapiens
agggctcagcggggacagc

SEQ ID NO: 2767569 - DNA, 20 bp, Homo sapiens
agggctcagcggggacagct

SEQ ID NO: 2767570 - DNA, 17 bp, Homo sapiens
agggctctcctggcttc

SEQ ID NO: 2767571 - DNA, 14 bp, Homo sapiens
agggctgaaagcca

SEQ ID NO: 2767572 - DNA, 20 bp, Homo sapiens
agggctgcgagcatttccct

SEQ ID NO: 2767573 - DNA, 18 bp, Homo sapiens
agggctggaaaagtcaca

SEQ ID NO: 2767574 - DNA, 22 bp, Homo sapiens
agggctggactctggcacccag

SEQ ID NO: 2767575 - DNA, 16 bp, Homo sapiens
agggctggtctctgct

SEQ ID NO: 2767576 - DNA, 20 bp, Homo sapiens
aggggaaaccagtgtagcct

SEQ ID NO: 2767577 - DNA, 21 bp, Homo sapiens
aggggaaaccagtgtagcctt

SEQ ID NO: 2767578 - DNA, 14 bp, Homo sapiens
aggggaagggccag

SEQ ID NO: 2767579 - DNA, 13 bp, Homo sapiens
aggggaatgtttg

SEQ ID NO: 2767580 - DNA, 19 bp, Homo sapiens
aggggaatgtttgcctctg

SEQ ID NO: 2767581 - DNA, 20 bp, Homo sapiens
aggggaatgtttgcctctgc

SEQ ID NO: 2767582 - DNA, 20 bp, Homo sapiens
aggggacatttccctcctgg

SEQ ID NO: 2767583 - DNA, 19 bp, Homo sapiens
aggggactatttatgaagg

SEQ ID NO: 2767584 - DNA, 17 bp, Homo sapiens
aggggagagggtctgga

SEQ ID NO: 2767585 - DNA, 17 bp, Homo sapiens
aggggaggcatcagtgt

SEQ ID NO: 2767586 - DNA, 21 bp, Homo sapiens
aggggaggggcctagggagcc

SEQ ID NO: 2767587 - DNA, 22 bp, Homo sapiens
aggggaggggcctagggagccg

SEQ ID NO: 2767588 - DNA, 22 bp, Homo sapiens
aggggagggtgtatctagctct

SEQ ID NO: 2767589 - DNA, 22 bp, Homo sapiens
aggggcacgcctgcccagcctc

SEQ ID NO: 2767590 - DNA, 23 bp, Homo sapiens
aggggccaaactggtgggaggca

SEQ ID NO: 2767591 - DNA, 20 bp, Homo sapiens
aggggccccggtcctggccc

SEQ ID NO: 2767592 - DNA, 16 bp, Homo sapiens
aggggcctagggagcc

SEQ ID NO: 2767593 - DNA, 17 bp, Homo sapiens
aggggcctagggagccg

SEQ ID NO: 2767594 - DNA, 14 bp, Homo sapiens
aggggctccacctg

SEQ ID NO: 2767595 - DNA, 18 bp, Homo sapiens
aggggctccacctgttca

SEQ ID NO: 2767596 - DNA, 14 bp, Homo sapiens
aggggctcctggaa

SEQ ID NO: 2767597 - DNA, 16 bp, Homo sapiens
aggggctttctggaga

SEQ ID NO: 2767598 - DNA, 16 bp, Homo sapiens
agggggagactatgtg

SEQ ID NO: 2767599 - DNA, 17 bp, Homo sapiens
agggggattggagggaa

SEQ ID NO: 2767600 - DNA, 14 bp, Homo sapiens
aggggggagggctg

SEQ ID NO: 2767601 - DNA, 15 bp, Homo sapiens
agggggtcgtggaga

SEQ ID NO: 2767602 - DNA, 19 bp, Homo sapiens
agggggtcgtggagagcta

SEQ ID NO: 2767603 - DNA, 17 bp, Homo sapiens
aggggtaggcagagcct

SEQ ID NO: 2767604 - DNA, 13 bp, Homo sapiens
aggggtctccctg

SEQ ID NO: 2767605 - DNA, 15 bp, Homo sapiens
aggggtctccctgga

SEQ ID NO: 2767606 - DNA, 22 bp, Homo sapiens
aggggtgatttcagagagggca

SEQ ID NO: 2767607 - DNA, 18 bp, Homo sapiens
aggggtgggagagccagc

SEQ ID NO: 2767608 - DNA, 20 bp, Homo sapiens
aggggtgggttcctcttccc

SEQ ID NO: 2767609 - DNA, 17 bp, Homo sapiens
agggtagtctggtttct

SEQ ID NO: 2767610 - DNA, 16 bp, Homo sapiens
agggtatcaggtgctg

SEQ ID NO: 2767611 - DNA, 18 bp, Homo sapiens
agggtatcaggtgctgcc

SEQ ID NO: 2767612 - DNA, 18 bp, Homo sapiens
agggtcaggagaggggca

SEQ ID NO: 2767613 - DNA, 22 bp, Homo sapiens
agggtcgccacacccggctccc

SEQ ID NO: 2767614 - DNA, 16 bp, Homo sapiens
agggtctagggagaga

SEQ ID NO: 2767615 - DNA, 22 bp, Homo sapiens
agggtctcactatgttgcccag

SEQ ID NO: 2767616 - DNA, 23 bp, Homo sapiens
agggtctcactatgttgcccagg

SEQ ID NO: 2767617 - DNA, 16 bp, Homo sapiens
agggtctcactctgtc

SEQ ID NO: 2767618 - DNA, 14 bp, Homo sapiens
agggtctggagaag

SEQ ID NO: 2767619 - DNA, 18 bp, Homo sapiens
agggtctggctgtccctt

SEQ ID NO: 2767620 - DNA, 18 bp, Homo sapiens
agggtgagaggaagggtg

SEQ ID NO: 2767621 - DNA, 20 bp, Homo sapiens
agggtggatccactgtgcag

SEQ ID NO: 2767622 - DNA, 17 bp, Homo sapiens
agggtgggatggaggag

SEQ ID NO: 2767623 - DNA, 18 bp, Homo sapiens
agggtggtgacctctgcc

SEQ ID NO: 2767624 - DNA, 15 bp, Homo sapiens
agggttatattttac

SEQ ID NO: 2767625 - DNA, 16 bp, Homo sapiens
agggttcagagactca

SEQ ID NO: 2767626 - DNA, 23 bp, Homo sapiens
agggttgggttcatctgagcaag

SEQ ID NO: 2767627 - DNA, 17 bp, Homo sapiens
aggtaagagctgatgtg

SEQ ID NO: 2767628 - DNA, 22 bp, Homo sapiens
aggtacagcaacaggaatctca

SEQ ID NO: 2767629 - DNA, 21 bp, Homo sapiens
aggtaccactgatttggagat

SEQ ID NO: 2767630 - DNA, 21 bp, Homo sapiens
aggtacccctttctggctctc

SEQ ID NO: 2767631 - DNA, 20 bp, Homo sapiens
aggtagcccagcactgtgaa

SEQ ID NO: 2767632 - DNA, 23 bp, Homo sapiens
aggtagcccagcactgtgaagac

SEQ ID NO: 2767633 - DNA, 18 bp, Homo sapiens
aggtagctcccagcactc

SEQ ID NO: 2767634 - DNA, 21 bp, Homo sapiens
aggtagtgggtgaatgtgtga

SEQ ID NO: 2767635 - DNA, 15 bp, Homo sapiens
aggtataattttatg

SEQ ID NO: 2767636 - DNA, 13 bp, Homo sapiens
aggtatgaataag

SEQ ID NO: 2767637 - DNA, 20 bp, Homo sapiens
aggtatgaccttctaggaag

SEQ ID NO: 2767638 - DNA, 22 bp, Homo sapiens
aggtattgagccattttttaaa

SEQ ID NO: 2767639 - DNA, 14 bp, Homo sapiens
aggtcaacagagaa

SEQ ID NO: 2767640 - DNA, 21 bp, Homo sapiens
aggtcaacatctaagcctgtt

SEQ ID NO: 2767641 - DNA, 18 bp, Homo sapiens
aggtcaatgaaatatttg

SEQ ID NO: 2767642 - DNA, 18 bp, Homo sapiens
aggtcacattcaggaaga

SEQ ID NO: 2767643 - DNA, 19 bp, Homo sapiens
aggtcactagatggcgagc

SEQ ID NO: 2767644 - DNA, 14 bp, Homo sapiens
aggtcagagcctgc

SEQ ID NO: 2767645 - DNA, 21 bp, Homo sapiens
aggtcctctacttaatgagat

SEQ ID NO: 2767646 - DNA, 17 bp, Homo sapiens
aggtcctgagcactgcc

SEQ ID NO: 2767647 - DNA, 19 bp, Homo sapiens
aggtcctgagcactgccag

SEQ ID NO: 2767648 - DNA, 22 bp, Homo sapiens
aggtcctgagcactgccaggag

SEQ ID NO: 2767649 - DNA, 23 bp, Homo sapiens
aggtcctgagcactgccaggagg

SEQ ID NO: 2767650 - DNA, 14 bp, Homo sapiens
aggtcctggtgggg

SEQ ID NO: 2767651 - DNA, 14 bp, Homo sapiens
agtagaattatatc

SEQ ID NO: 2767652 - DNA, 16 bp, Homo sapiens
agtagaattatatcta

SEQ ID NO: 2767653 - DNA, 22 bp, Homo sapiens
agtagaattatatctaatttat

SEQ ID NO: 2767654 - DNA, 18 bp, Homo sapiens
agtagcaccctggattga

SEQ ID NO: 2767655 - DNA, 22 bp, Homo sapiens
agtagcagtgattgtcttaata

SEQ ID NO: 2767656 - DNA, 14 bp, Homo sapiens
agtagcatgagaga

SEQ ID NO: 2767657 - DNA, 15 bp, Homo sapiens
agtagccgagagcct

SEQ ID NO: 2767658 - DNA, 17 bp, Homo sapiens
agtagccgagagcctgc

SEQ ID NO: 2767659 - DNA, 18 bp, Homo sapiens
agtagccgagagcctgct

SEQ ID NO: 2767660 - DNA, 13 bp, Homo sapiens
agtagctgggact

SEQ ID NO: 2767661 - DNA, 17 bp, Homo sapiens
agtagcttaaataaatt

SEQ ID NO: 2767662 - DNA, 20 bp, Homo sapiens
agtagcttaaataaattcaa

SEQ ID NO: 2767663 - DNA, 21 bp, Homo sapiens
agtagtgtcttcctagtatat

SEQ ID NO: 2767664 - DNA, 21 bp, Homo sapiens
agtagttgatgaccaatctct

SEQ ID NO: 2767665 - DNA, 17 bp, Homo sapiens
agtagtttgagaccagc

SEQ ID NO: 2767666 - DNA, 13 bp, Homo sapiens
agtataaaaacaa

SEQ ID NO: 2767667 - DNA, 14 bp, Homo sapiens
agtatatatgtaca

SEQ ID NO: 2767668 - DNA, 13 bp, Homo sapiens
agtatatattcta

SEQ ID NO: 2767669 - DNA, 15 bp, Homo sapiens
agtatatctggacaa

SEQ ID NO: 2767670 - DNA, 16 bp, Homo sapiens
agtatatctggacaag

SEQ ID NO: 2767671 - DNA, 14 bp, Homo sapiens
agtatattatgtat

SEQ ID NO: 2767672 - DNA, 15 bp, Homo sapiens
agtatattatgtatt

SEQ ID NO: 2767673 - DNA, 19 bp, Homo sapiens
agtatattttcttttcctc

SEQ ID NO: 2767674 - DNA, 17 bp, Homo sapiens
agtatgcaagaagaata

SEQ ID NO: 2767675 - DNA, 18 bp, Homo sapiens
agtatgcaagaagaatat

SEQ ID NO: 2767676 - DNA, 21 bp, Homo sapiens
agtatgccttcctgtttaaaa

SEQ ID NO: 2767677 - DNA, 19 bp, Homo sapiens
agtatgctgttttaataat

SEQ ID NO: 2767678 - DNA, 16 bp, Homo sapiens
agtatgttaagctctt

SEQ ID NO: 2767679 - DNA, 19 bp, Homo sapiens
agtatgttaagctctttat

SEQ ID NO: 2767680 - DNA, 16 bp, Homo sapiens
agtattctcagtgctc

SEQ ID NO: 2767681 - DNA, 17 bp, Homo sapiens
agtatttatatatttat

SEQ ID NO: 2767682 - DNA, 20 bp, Homo sapiens
agtatttatatatttataac

SEQ ID NO: 2767683 - DNA, 13 bp, Homo sapiens
agtatttgttaat

SEQ ID NO: 2767684 - DNA, 14 bp, Homo sapiens
agtcaaaacagaga

SEQ ID NO: 2767685 - DNA, 21 bp, Homo sapiens
agtcaaagtaaaacttgctgc

SEQ ID NO: 2767686 - DNA, 22 bp, Homo sapiens
agtcaaatttgaaaataattgt

SEQ ID NO: 2767687 - DNA, 15 bp, Homo sapiens
agtcaacagttcaaa

SEQ ID NO: 2767688 - DNA, 16 bp, Homo sapiens
agtcaattagtacagt

SEQ ID NO: 2767689 - DNA, 22 bp, Homo sapiens
agtcacacagtattacttctgc

SEQ ID NO: 2767690 - DNA, 15 bp, Homo sapiens
agtcacatcacagga

SEQ ID NO: 2767691 - DNA, 14 bp, Homo sapiens
agtcaccaagccca

SEQ ID NO: 2767692 - DNA, 20 bp, Homo sapiens
agtcacccatgaagacagga

SEQ ID NO: 2767693 - DNA, 12 bp, Homo sapiens
agtcagaacagc

SEQ ID NO: 2767694 - DNA, 17 bp, Homo sapiens
agtcagagagagtgttt

SEQ ID NO: 2767695 - DNA, 21 bp, Homo sapiens
agtcagtcatgatggcaccac

SEQ ID NO: 2767696 - DNA, 22 bp, Homo sapiens
agtcagtgggaacgtgactgcc

SEQ ID NO: 2767697 - DNA, 16 bp, Homo sapiens
agtcatccacagccca

SEQ ID NO: 2767698 - DNA, 15 bp, Homo sapiens
agtcatgatctccct

SEQ ID NO: 2767699 - DNA, 17 bp, Homo sapiens
agtcatgatctccctgc

SEQ ID NO: 2767700 - DNA, 20 bp, Homo sapiens
agtcatgatctccctgccgc

SEQ ID NO: 2767701 - DNA, 19 bp, Homo sapiens
agtcatggcccaaatccag

SEQ ID NO: 2767702 - DNA, 21 bp, Homo sapiens
agtcattttaactttatcaca

SEQ ID NO: 2767703 - DNA, 17 bp, Homo sapiens
agtccagaataagtgct

SEQ ID NO: 2767704 - DNA, 18 bp, Homo sapiens
agtccagaataagtgctg

SEQ ID NO: 2767705 - DNA, 14 bp, Homo sapiens
agtccagccagctc

SEQ ID NO: 2767706 - DNA, 20 bp, Homo sapiens
agtccagggcgggagtgggg

SEQ ID NO: 2767707 - DNA, 21 bp, Homo sapiens
agtccatatttcaatttccaa

SEQ ID NO: 2767708 - DNA, 19 bp, Homo sapiens
agtcccaccttggctgcag

SEQ ID NO: 2767709 - DNA, 20 bp, Homo sapiens
agtcccaccttggctgcagg

SEQ ID NO: 2767710 - DNA, 16 bp, Homo sapiens
agtccccctgccccag

SEQ ID NO: 2767711 - DNA, 15 bp, Homo sapiens
agtccccgtgccccg

SEQ ID NO: 2767712 - DNA, 18 bp, Homo sapiens
agtccccgtgccccgcct

SEQ ID NO: 2767713 - DNA, 21 bp, Homo sapiens
agtccctgactctctgtgacc

SEQ ID NO: 2767714 - DNA, 21 bp, Homo sapiens
agtccctgccacactcagtcc

SEQ ID NO: 2767715 - DNA, 17 bp, Homo sapiens
agtccctgggggaagcc

SEQ ID NO: 2767716 - DNA, 21 bp, Homo sapiens
agtccctgggggaagccctgg

SEQ ID NO: 2767717 - DNA, 23 bp, Homo sapiens
agtccgaaagggacttggaagct

SEQ ID NO: 2767718 - DNA, 18 bp, Homo sapiens
agtccgcctggccggctc

SEQ ID NO: 2767719 - DNA, 19 bp, Homo sapiens
agtccgcctggccggctcc

SEQ ID NO: 2767720 - DNA, 15 bp, Homo sapiens
agtccgtcaaaacag

SEQ ID NO: 2767721 - DNA, 16 bp, Homo sapiens
agtcctattctattgc

SEQ ID NO: 2767722 - DNA, 12 bp, Homo sapiens
agtcctggaagc

SEQ ID NO: 2767723 - DNA, 21 bp, Homo sapiens
agtcctgggagaacctcaggc

SEQ ID NO: 2767724 - DNA, 19 bp, Homo sapiens
agtcctggtctgctcagga

SEQ ID NO: 2767725 - DNA, 20 bp, Homo sapiens
agtcctggtctgctcaggaa

SEQ ID NO: 2767726 - DNA, 15 bp, Homo sapiens
agtcctttgattcca

SEQ ID NO: 2767727 - DNA, 16 bp, Homo sapiens
agtcgaggacagggag

SEQ ID NO: 2767728 - DNA, 19 bp, Homo sapiens
agtcgctgtggttgtttta

SEQ ID NO: 2767729 - DNA, 20 bp, Homo sapiens
agtcgttggcaccttcaata

SEQ ID NO: 2767730 - DNA, 21 bp, Homo sapiens
agtctaaagctggtttaatgt

SEQ ID NO: 2767731 - DNA, 17 bp, Homo sapiens
agtctacctcttcagta

SEQ ID NO: 2767732 - DNA, 17 bp, Homo sapiens
agtctacgctctccttt

SEQ ID NO: 2767733 - DNA, 18 bp, Homo sapiens
agtctaggagctgggagg

SEQ ID NO: 2767734 - DNA, 22 bp, Homo sapiens
agtctaggagctgggaggaaaa

SEQ ID NO: 2767735 - DNA, 22 bp, Homo sapiens
agtctatcaaccccagacactg

SEQ ID NO: 2767736 - DNA, 23 bp, Homo sapiens
agtctatcaaccccagacactgg

SEQ ID NO: 2767737 - DNA, 20 bp, Homo sapiens
agtctcaagcactaaaaagt

SEQ ID NO: 2767738 - DNA, 19 bp, Homo sapiens
atagtcaatgtttctttta

SEQ ID NO: 2767739 - DNA, 22 bp, Homo sapiens
atagtgctaagaaagcaagcca

SEQ ID NO: 2767740 - DNA, 15 bp, Homo sapiens
atagtttactatttt

SEQ ID NO: 2767741 - DNA, 22 bp, Homo sapiens
atagtttgctttgctttttaat

SEQ ID NO: 2767742 - DNA, 13 bp, Homo sapiens
atagttttaaata

SEQ ID NO: 2767743 - DNA, 15 bp, Homo sapiens
atataaacactatat

SEQ ID NO: 2767744 - DNA, 13 bp, Homo sapiens
atataaacttgtg

SEQ ID NO: 2767745 - DNA, 13 bp, Homo sapiens
atataaatgcatg

SEQ ID NO: 2767746 - DNA, 14 bp, Homo sapiens
atataaatgcatga

SEQ ID NO: 2767747 - DNA, 17 bp, Homo sapiens
atataaatgcatgattt

SEQ ID NO: 2767748 - DNA, 19 bp, Homo sapiens
atataagaacttgatatat

SEQ ID NO: 2767749 - DNA, 21 bp, Homo sapiens
atataataaatgtacattaat

SEQ ID NO: 2767750 - DNA, 19 bp, Homo sapiens
atataatggtttactgctg

SEQ ID NO: 2767751 - DNA, 21 bp, Homo sapiens
atataatgttgttatttaaag

SEQ ID NO: 2767752 - DNA, 14 bp, Homo sapiens
atataattatcgga

SEQ ID NO: 2767753 - DNA, 21 bp, Homo sapiens
atataattatcggaagcagtg

SEQ ID NO: 2767754 - DNA, 14 bp, Homo sapiens
atatacaaatatat

SEQ ID NO: 2767755 - DNA, 16 bp, Homo sapiens
atatacaataacataa

SEQ ID NO: 2767756 - DNA, 19 bp, Homo sapiens
atatacacaggatcctatt

SEQ ID NO: 2767757 - DNA, 21 bp, Homo sapiens
atatacatattataaataaat

SEQ ID NO: 2767758 - DNA, 14 bp, Homo sapiens
atatacatgtatag

SEQ ID NO: 2767759 - DNA, 18 bp, Homo sapiens
atatacattctttatctt

SEQ ID NO: 2767760 - DNA, 13 bp, Homo sapiens
atatagagaaagt

SEQ ID NO: 2767761 - DNA, 21 bp, Homo sapiens
atatagctatttttatggaat

SEQ ID NO: 2767762 - DNA, 17 bp, Homo sapiens
atatagctgatcagttt

SEQ ID NO: 2767763 - DNA, 18 bp, Homo sapiens
atatagctgatcagtttt

SEQ ID NO: 2767764 - DNA, 13 bp, Homo sapiens
atatagtatattt

SEQ ID NO: 2767765 - DNA, 15 bp, Homo sapiens
atatagtattcattt

SEQ ID NO: 2767766 - DNA, 15 bp, Homo sapiens
atatataaatatata

SEQ ID NO: 2767767 - DNA, 18 bp, Homo sapiens
atatataatggtttactg

SEQ ID NO: 2767768 - DNA, 15 bp, Homo sapiens
atatatatagtaact

SEQ ID NO: 2767769 - DNA, 12 bp, Homo sapiens
atatatatatgt

SEQ ID NO: 2767770 - DNA, 15 bp, Homo sapiens
atatatatatgtaca

SEQ ID NO: 2767771 - DNA, 20 bp, Homo sapiens
atatatatgtacagttatct

SEQ ID NO: 2767772 - DNA, 14 bp, Homo sapiens
atatatattaaaat

SEQ ID NO: 2767773 - DNA, 13 bp, Homo sapiens
atatatattttaa

SEQ ID NO: 2767774 - DNA, 16 bp, Homo sapiens
atatatcataaagtat

SEQ ID NO: 2767775 - DNA, 12 bp, Homo sapiens
atatatcttatg

SEQ ID NO: 2767776 - DNA, 20 bp, Homo sapiens
atatatcttatgttaaagga

SEQ ID NO: 2767777 - DNA, 13 bp, Homo sapiens
atatatgtacagt

SEQ ID NO: 2767778 - DNA, 17 bp, Homo sapiens
atatatgtatatgtata

SEQ ID NO: 2767779 - DNA, 20 bp, Homo sapiens
atatatgtatatgtatatat

SEQ ID NO: 2767780 - DNA, 17 bp, Homo sapiens
atatatgtatttattgt

SEQ ID NO: 2767781 - DNA, 20 bp, Homo sapiens
atatatgtatttattgtcat

SEQ ID NO: 2767782 - DNA, 23 bp, Homo sapiens
atatattcatgtaataaatctga

SEQ ID NO: 2767783 - DNA, 12 bp, Homo sapiens
atatatttataa

SEQ ID NO: 2767784 - DNA, 22 bp, Homo sapiens
atatatttcacgtgttccctct

SEQ ID NO: 2767785 - DNA, 18 bp, Homo sapiens
atatatttgaatatcatt

SEQ ID NO: 2767786 - DNA, 21 bp, Homo sapiens
atatatttgaatatcattaaa

SEQ ID NO: 2767787 - DNA, 13 bp, Homo sapiens
atatattttaatt

SEQ ID NO: 2767788 - DNA, 16 bp, Homo sapiens
atatatttttcaacca

SEQ ID NO: 2767789 - DNA, 17 bp, Homo sapiens
atatatttttcaaccag

SEQ ID NO: 2767790 - DNA, 20 bp, Homo sapiens
atatatttttggttgtcaat

SEQ ID NO: 2767791 - DNA, 16 bp, Homo sapiens
atatcaattcaacaca

SEQ ID NO: 2767792 - DNA, 12 bp, Homo sapiens
atatcagaaaag

SEQ ID NO: 2767793 - DNA, 15 bp, Homo sapiens
atatcagaaaagtag

SEQ ID NO: 2767794 - DNA, 21 bp, Homo sapiens
atatcagcctgagtctcctgt

SEQ ID NO: 2767795 - DNA, 21 bp, Homo sapiens
atatcagttactcagccctgg

SEQ ID NO: 2767796 - DNA, 12 bp, Homo sapiens
atatcataaagt

SEQ ID NO: 2767797 - DNA, 20 bp, Homo sapiens
atatcatcagcataccttta

SEQ ID NO: 2767798 - DNA, 21 bp, Homo sapiens
atatcatcagcatacctttat

SEQ ID NO: 2767799 - DNA, 15 bp, Homo sapiens
atatcatgaaacact

SEQ ID NO: 2767800 - DNA, 17 bp, Homo sapiens
atatcattaaattggaa

SEQ ID NO: 2767801 - DNA, 13 bp, Homo sapiens
atatcctaaacat

SEQ ID NO: 2767802 - DNA, 22 bp, Homo sapiens
atatcctaaacatcattcattt

SEQ ID NO: 2767803 - DNA, 20 bp, Homo sapiens
atatcctttgccccaaggct

SEQ ID NO: 2767804 - DNA, 15 bp, Homo sapiens
atatctaatttatac

SEQ ID NO: 2767805 - DNA, 16 bp, Homo sapiens
atatctaatttataca

SEQ ID NO: 2767806 - DNA, 17 bp, Homo sapiens
atatctaatttatacaa

SEQ ID NO: 2767807 - DNA, 19 bp, Homo sapiens
atatctaatttatacaaaa

SEQ ID NO: 2767808 - DNA, 23 bp, Homo sapiens
atatctaatttatacaaaataat

SEQ ID NO: 2767809 - DNA, 22 bp, Homo sapiens
atatctatagtagtcaattagt

SEQ ID NO: 2767810 - DNA, 13 bp, Homo sapiens
atatctatatctc

SEQ ID NO: 2767811 - DNA, 18 bp, Homo sapiens
atatctatatctctaaac

SEQ ID NO: 2767812 - DNA, 13 bp, Homo sapiens
atatctatctatt

SEQ ID NO: 2767813 - DNA, 14 bp, Homo sapiens
atatctatcttata

SEQ ID NO: 2767814 - DNA, 19 bp, Homo sapiens
atatgaaaaatatgatatt

SEQ ID NO: 2767815 - DNA, 22 bp, Homo sapiens
atatgaatacagggcatgcatt

SEQ ID NO: 2767816 - DNA, 21 bp, Homo sapiens
atatgacagctgtccctgtca

SEQ ID NO: 2767817 - DNA, 21 bp, Homo sapiens
atatgactgtttttcggacag

SEQ ID NO: 2767818 - DNA, 22 bp, Homo sapiens
atatgactgtttttcggacagt

SEQ ID NO: 2767819 - DNA, 16 bp, Homo sapiens
atatgatattgcatat

SEQ ID NO: 2767820 - DNA, 21 bp, Homo sapiens
atatgatgttaaaaaaataag

SEQ ID NO: 2767821 - DNA, 16 bp, Homo sapiens
atatggaaatcctgtt

SEQ ID NO: 2767822 - DNA, 16 bp, Homo sapiens
atatggactctgcaca

SEQ ID NO: 2767823 - DNA, 12 bp, Homo sapiens
atatgtaaaaca

SEQ ID NO: 2767824 - DNA, 13 bp, Homo sapiens
atatgtaaaacat

SEQ ID NO: 2767825 - DNA, 14 bp, Homo sapiens
atatgtaaaacatt

SEQ ID NO: 2767826 - DNA, 14 bp, Homo sapiens
atcacggcatgttt

SEQ ID NO: 2767827 - DNA, 15 bp, Homo sapiens
atcacggctcactgc

SEQ ID NO: 2767828 - DNA, 15 bp, Homo sapiens
atcactatctttctg

SEQ ID NO: 2767829 - DNA, 16 bp, Homo sapiens
atcactatctttctga

SEQ ID NO: 2767830 - DNA, 10 bp, Homo sapiens
atcactggag

SEQ ID NO: 2767831 - DNA, 16 bp, Homo sapiens
agtctcactgttgccc

SEQ ID NO: 2767832 - DNA, 22 bp, Homo sapiens
agtctccagtggttgctgttga

SEQ ID NO: 2767833 - DNA, 20 bp, Homo sapiens
agctgtaaatacatgtgtgg

SEQ ID NO: 2767834 - DNA, 16 bp, Homo sapiens
agctgtagaaatgtat

SEQ ID NO: 2767835 - DNA, 18 bp, Homo sapiens
agctgtccctgtcaccaa

SEQ ID NO: 2767836 - DNA, 20 bp, Homo sapiens
agctgtccctgtcaccaagc

SEQ ID NO: 2767837 - DNA, 17 bp, Homo sapiens
agctgtctgctcagaca

SEQ ID NO: 2767838 - DNA, 15 bp, Homo sapiens
agctgtgacctgctg

SEQ ID NO: 2767839 - DNA, 17 bp, Homo sapiens
agctgtgacctgctgag

SEQ ID NO: 2767840 - DNA, 21 bp, Homo sapiens
agctgtgctctggacaggcat

SEQ ID NO: 2767841 - DNA, 21 bp, Homo sapiens
agctgtgtccttgcacctgca

SEQ ID NO: 2767842 - DNA, 24 bp, Homo sapiens
agctgtgtccttgcacctgcatcc

SEQ ID NO: 2767843 - DNA, 22 bp, Homo sapiens
agctgtgtgtttggaagactat

SEQ ID NO: 2767844 - DNA, 19 bp, Homo sapiens
agctgttccacttctctag

SEQ ID NO: 2767845 - DNA, 16 bp, Homo sapiens
agctgttgagctgttt

SEQ ID NO: 2767846 - DNA, 15 bp, Homo sapiens
agctgttggcctggg

SEQ ID NO: 2767847 - DNA, 13 bp, Homo sapiens
agctgtttgtcat

SEQ ID NO: 2767848 - DNA, 12 bp, Homo sapiens
agcttaaataaa

SEQ ID NO: 2767849 - DNA, 13 bp, Homo sapiens
agcttaaataaat

SEQ ID NO: 2767850 - DNA, 17 bp, Homo sapiens
agcttaaataaattcaa

SEQ ID NO: 2767851 - DNA, 16 bp, Homo sapiens
agcttagacctcagcc

SEQ ID NO: 2767852 - DNA, 17 bp, Homo sapiens
agcttagacctcagcct

SEQ ID NO: 2767853 - DNA, 19 bp, Homo sapiens
agcttagacctcagcctgt

SEQ ID NO: 2767854 - DNA, 19 bp, Homo sapiens
agcttcaaccctcagcctt

SEQ ID NO: 2767855 - DNA, 18 bp, Homo sapiens
agcttcaagtgatatatg

SEQ ID NO: 2767856 - DNA, 23 bp, Homo sapiens
agcttcagacttttatcaaaatc

SEQ ID NO: 2767857 - DNA, 22 bp, Homo sapiens
agcttcatcaatttttatacat

SEQ ID NO: 2767858 - DNA, 15 bp, Homo sapiens
agcttcatttccgtg

SEQ ID NO: 2767859 - DNA, 15 bp, Homo sapiens
agcttcccctcgctg

SEQ ID NO: 2767860 - DNA, 16 bp, Homo sapiens
agcttcccctcgctgt

SEQ ID NO: 2767861 - DNA, 21 bp, Homo sapiens
agcttctacagattttagaca

SEQ ID NO: 2767862 - DNA, 15 bp, Homo sapiens
agcttctccaggctc

SEQ ID NO: 2767863 - DNA, 22 bp, Homo sapiens
agcttgaagatcgttagtatct

SEQ ID NO: 2767864 - DNA, 14 bp, Homo sapiens
agcttgagggttgg

SEQ ID NO: 2767865 - DNA, 22 bp, Homo sapiens
agcttgagggttgggctggtgt

SEQ ID NO: 2767866 - DNA, 23 bp, Homo sapiens
agcttggaaactggatgaggtca

SEQ ID NO: 2767867 - DNA, 14 bp, Homo sapiens
agcttgggaatgga

SEQ ID NO: 2767868 - DNA, 18 bp, Homo sapiens
agcttgggtttttgttac

SEQ ID NO: 2767869 - DNA, 16 bp, Homo sapiens
agcttgtatatacata

SEQ ID NO: 2767870 - DNA, 17 bp, Homo sapiens
agcttgtatatacatat

SEQ ID NO: 2767871 - DNA, 22 bp, Homo sapiens
agcttgtatatacatattataa

SEQ ID NO: 2767872 - DNA, 18 bp, Homo sapiens
agcttgtggcaagtgaat

SEQ ID NO: 2767873 - DNA, 22 bp, Homo sapiens
agctttcaaaaattagtgaagt

SEQ ID NO: 2767874 - DNA, 10 bp, Homo sapiens
agctttgctc

SEQ ID NO: 2767875 - DNA, 21 bp, Homo sapiens
agctttgctctttggtagaaa

SEQ ID NO: 2767876 - DNA, 16 bp, Homo sapiens
agctttggaaacagga

SEQ ID NO: 2767877 - DNA, 14 bp, Homo sapiens
aggaaaaagaaatg

SEQ ID NO: 2767878 - DNA, 13 bp, Homo sapiens
aggaaaagaaaag

SEQ ID NO: 2767879 - DNA, 17 bp, Homo sapiens
aggaaaaggcctggggt

SEQ ID NO: 2767880 - DNA, 14 bp, Homo sapiens
aggaaaatcctctg

SEQ ID NO: 2767881 - DNA, 13 bp, Homo sapiens
aggaaaatttcac

SEQ ID NO: 2767882 - DNA, 21 bp, Homo sapiens
aggaaaattttagcgtgctca

SEQ ID NO: 2767883 - DNA, 17 bp, Homo sapiens
aggaaagaaagaaggaa

SEQ ID NO: 2767884 - DNA, 19 bp, Homo sapiens
aggaaagccccagcactaa

SEQ ID NO: 2767885 - DNA, 20 bp, Homo sapiens
aggaaataaaacctttcaaa

SEQ ID NO: 2767886 - DNA, 23 bp, Homo sapiens
aggaaatagtgttctttttaaaa

SEQ ID NO: 2767887 - DNA, 18 bp, Homo sapiens
aggaaatggagaagctct

SEQ ID NO: 2767888 - DNA, 23 bp, Homo sapiens
aggaaatgtggtagcctcacttt

SEQ ID NO: 2767889 - DNA, 23 bp, Homo sapiens
aggaacacccgactcctcaaaag

SEQ ID NO: 2767890 - DNA, 12 bp, Homo sapiens
aggaacagctcc

SEQ ID NO: 2767891 - DNA, 16 bp, Homo sapiens
aggaacctcaaactgg

SEQ ID NO: 2767892 - DNA, 14 bp, Homo sapiens
aggaacctgaacct

SEQ ID NO: 2767893 - DNA, 23 bp, Homo sapiens
aggaactcccagcaacacaagct

SEQ ID NO: 2767894 - DNA, 13 bp, Homo sapiens
aggaactctggct

SEQ ID NO: 2767895 - DNA, 16 bp, Homo sapiens
aggaactctggcttcc

SEQ ID NO: 2767896 - DNA, 18 bp, Homo sapiens
aggaactctggcttccag

SEQ ID NO: 2767897 - DNA, 14 bp, Homo sapiens
aggaagagaaacca

SEQ ID NO: 2767898 - DNA, 20 bp, Homo sapiens
aggaagagcaggcacatgga

SEQ ID NO: 2767899 - DNA, 17 bp, Homo sapiens
aggaagatgaaagagga

SEQ ID NO: 2767900 - DNA, 23 bp, Homo sapiens
aggaagattccctcttcctgcca

SEQ ID NO: 2767901 - DNA, 15 bp, Homo sapiens
aggaagccacagctg

SEQ ID NO: 2767902 - DNA, 20 bp, Homo sapiens
aggaagccaggctgagtgag

SEQ ID NO: 2767903 - DNA, 12 bp, Homo sapiens
aggaaggaaaga

SEQ ID NO: 2767904 - DNA, 16 bp, Homo sapiens
aggaaggactatgaaa

SEQ ID NO: 2767905 - DNA, 12 bp, Homo sapiens
aggaagggcaaa

SEQ ID NO: 2767906 - DNA, 16 bp, Homo sapiens
aggaagggggttgtgg

SEQ ID NO: 2767907 - DNA, 12 bp, Homo sapiens
aggaaggtagcc

SEQ ID NO: 2767908 - DNA, 14 bp, Homo sapiens
aggaaggttttctc

SEQ ID NO: 2767909 - DNA, 14 bp, Homo sapiens
agccagcgcctccc

SEQ ID NO: 2767910 - DNA, 16 bp, Homo sapiens
agccagcgcctccctc

SEQ ID NO: 2767911 - DNA, 17 bp, Homo sapiens
agccagcgcctccctcc

SEQ ID NO: 2767912 - DNA, 18 bp, Homo sapiens
agccagcgcctccctcca

SEQ ID NO: 2767913 - DNA, 22 bp, Homo sapiens
agccagcgcctccctccacccc

SEQ ID NO: 2767914 - DNA, 11 bp, Homo sapiens
agccagctctc

SEQ ID NO: 2767915 - DNA, 13 bp, Homo sapiens
agccagctctcag

SEQ ID NO: 2767916 - DNA, 14 bp, Homo sapiens
agccagctctcagc

SEQ ID NO: 2767917 - DNA, 13 bp, Homo sapiens
agccagctctctc

SEQ ID NO: 2767918 - DNA, 15 bp, Homo sapiens
agccagctctctcta

SEQ ID NO: 2767919 - DNA, 23 bp, Homo sapiens
agccaggagcaaatgtttctgca

SEQ ID NO: 2767920 - DNA, 21 bp, Homo sapiens
agccaggaggagaggaaagga

SEQ ID NO: 2767921 - DNA, 13 bp, Homo sapiens
agccagggccagg

SEQ ID NO: 2767922 - DNA, 19 bp, Homo sapiens
agccatcatgtgcctggaa

SEQ ID NO: 2767923 - DNA, 21 bp, Homo sapiens
agccatgtaccagtgtactgc

SEQ ID NO: 2767924 - DNA, 22 bp, Homo sapiens
agccatgtaccagtgtactgct

SEQ ID NO: 2767925 - DNA, 18 bp, Homo sapiens
agccatttgttggggcag

SEQ ID NO: 2767926 - DNA, 14 bp, Homo sapiens
agcccaaagaagga

SEQ ID NO: 2767927 - DNA, 16 bp, Homo sapiens
agcccaaagctgttgg

SEQ ID NO: 2767928 - DNA, 14 bp, Homo sapiens
agcccaccttggct

SEQ ID NO: 2767929 - DNA, 22 bp, Homo sapiens
agcccacttctgccatattctg

SEQ ID NO: 2767930 - DNA, 20 bp, Homo sapiens
agcccagcactgtgaagacc

SEQ ID NO: 2767931 - DNA, 23 bp, Homo sapiens
agcccagcctctgtccctctttg

SEQ ID NO: 2767932 - DNA, 18 bp, Homo sapiens
agacggagtcccaccttg

SEQ ID NO: 2767933 - DNA, 15 bp, Homo sapiens
agacgtcctggaatg

SEQ ID NO: 2767934 - DNA, 19 bp, Homo sapiens
agacgtcctggaatgaagc

SEQ ID NO: 2767935 - DNA, 14 bp, Homo sapiens
agactaagccctgt

SEQ ID NO: 2767936 - DNA, 15 bp, Homo sapiens
agactaagccctgtc

SEQ ID NO: 2767937 - DNA, 23 bp, Homo sapiens
agactaagccctgtcgagacact

SEQ ID NO: 2767938 - DNA, 15 bp, Homo sapiens
agactacagccagaa

SEQ ID NO: 2767939 - DNA, 19 bp, Homo sapiens
agactacagccagaagccc

SEQ ID NO: 2767940 - DNA, 15 bp, Homo sapiens
agactagtgctttac

SEQ ID NO: 2767941 - DNA, 14 bp, Homo sapiens
agactagttgaaca

SEQ ID NO: 2767942 - DNA, 17 bp, Homo sapiens
agactatcttactattt

SEQ ID NO: 2767943 - DNA, 20 bp, Homo sapiens
agactatcttactatttcac

SEQ ID NO: 2767944 - DNA, 23 bp, Homo sapiens
agactatgtgtcatgatttcaat

SEQ ID NO: 2767945 - DNA, 16 bp, Homo sapiens
agactcacctctgcct

SEQ ID NO: 2767946 - DNA, 12 bp, Homo sapiens
agactcagggcc

SEQ ID NO: 2767947 - DNA, 16 bp, Homo sapiens
agactcagggccccag

SEQ ID NO: 2767948 - DNA, 18 bp, Homo sapiens
agactcagggccccagca

SEQ ID NO: 2767949 - DNA, 12 bp, Homo sapiens
agactcagtgtt

SEQ ID NO: 2767950 - DNA, 16 bp, Homo sapiens
agactcagtttgtcag

SEQ ID NO: 2767951 - DNA, 21 bp, Homo sapiens
agactcagtttgtcagacttt

SEQ ID NO: 2767952 - DNA, 18 bp, Homo sapiens
agactcattcttctgtac

SEQ ID NO: 2767953 - DNA, 14 bp, Homo sapiens
agactcctgccctg

SEQ ID NO: 2767954 - DNA, 16 bp, Homo sapiens
agactcctgccctgtt

SEQ ID NO: 2767955 - DNA, 16 bp, Homo sapiens
agactctgaaatctca

SEQ ID NO: 2767956 - DNA, 16 bp, Homo sapiens
agactctgtggggcct

SEQ ID NO: 2767957 - DNA, 16 bp, Homo sapiens
agactgagcacctgct

SEQ ID NO: 2767958 - DNA, 17 bp, Homo sapiens
agactgagcacctgctt

SEQ ID NO: 2767959 - DNA, 20 bp, Homo sapiens
agactgcgggatggtcctgg

SEQ ID NO: 2767960 - DNA, 22 bp, Homo sapiens
agactgcgggatggtcctgggg

SEQ ID NO: 2767961 - DNA, 15 bp, Homo sapiens
agactgctgggactg

SEQ ID NO: 2767962 - DNA, 19 bp, Homo sapiens
agactgctgggactggcca

SEQ ID NO: 2767963 - DNA, 17 bp, Homo sapiens
agactggaacttgaact

SEQ ID NO: 2767964 - DNA, 16 bp, Homo sapiens
agactggaagcacagc

SEQ ID NO: 2767965 - DNA, 15 bp, Homo sapiens
agactggacagcttg

SEQ ID NO: 2767966 - DNA, 18 bp, Homo sapiens
agactggagcatctgact

SEQ ID NO: 2767967 - DNA, 20 bp, Homo sapiens
agactggctggctgcagtga

SEQ ID NO: 2767968 - DNA, 11 bp, Homo sapiens
agactgtggct

SEQ ID NO: 2767969 - DNA, 20 bp, Homo sapiens
agactgtggctgctagcact

SEQ ID NO: 2767970 - DNA, 22 bp, Homo sapiens
agacttaaatagttcagtataa

SEQ ID NO: 2767971 - DNA, 18 bp, Homo sapiens
agacttagtatattttct

SEQ ID NO: 2767972 - DNA, 22 bp, Homo sapiens
agacttagtatattttcttttc

SEQ ID NO: 2767973 - DNA, 13 bp, Homo sapiens
acatgaagaagct

SEQ ID NO: 2767974 - DNA, 19 bp, Homo sapiens
acatgaagtgtgtttcctt

SEQ ID NO: 2767975 - DNA, 20 bp, Homo sapiens
acatgaatcccacccacatg

SEQ ID NO: 2767976 - DNA, 23 bp, Homo sapiens
acatgaatcccacccacatgtga

SEQ ID NO: 2767977 - DNA, 14 bp, Homo sapiens
acatgacgtaaaat

SEQ ID NO: 2767978 - DNA, 11 bp, Homo sapiens
acatgagaaat

SEQ ID NO: 2767979 - DNA, 12 bp, Homo sapiens
acatgagaaatg

SEQ ID NO: 2767980 - DNA, 18 bp, Homo sapiens
acatgcacttggctgcat

SEQ ID NO: 2767981 - DNA, 22 bp, Homo sapiens
acatgcacttggctgcataaat

SEQ ID NO: 2767982 - DNA, 21 bp, Homo sapiens
acatgccatttgtactgaccc

SEQ ID NO: 2767983 - DNA, 23 bp, Homo sapiens
acatgcctgattttaaaaggttg

SEQ ID NO: 2767984 - DNA, 17 bp, Homo sapiens
acatgctaagagaagta

SEQ ID NO: 2767985 - DNA, 21 bp, Homo sapiens
acatggagactcctgccctgt

SEQ ID NO: 2767986 - DNA, 14 bp, Homo sapiens
acatggccagtgtg

SEQ ID NO: 2767987 - DNA, 20 bp, Homo sapiens
acatggcctatgcacatatg

SEQ ID NO: 2767988 - DNA, 21 bp, Homo sapiens
acatggtgaaacctcatctct

SEQ ID NO: 2767989 - DNA, 21 bp, Homo sapiens
acatgtaacatagatttatgt

SEQ ID NO: 2767990 - DNA, 15 bp, Homo sapiens
acatgtatagtgagt

SEQ ID NO: 2767991 - DNA, 15 bp, Homo sapiens
acatgtccctacacc

SEQ ID NO: 2767992 - DNA, 16 bp, Homo sapiens
acatgtccttgtgtgt

SEQ ID NO: 2767993 - DNA, 17 bp, Homo sapiens
acatgtcggagtagaaa

SEQ ID NO: 2767994 - DNA, 13 bp, Homo sapiens
acatgtcttgtac

SEQ ID NO: 2767995 - DNA, 19 bp, Homo sapiens
acatgtcttgtacatgtgt

SEQ ID NO: 2767996 - DNA, 12 bp, Homo sapiens
acatgtgacaca

SEQ ID NO: 2767997 - DNA, 16 bp, Homo sapiens
acatgtgcacatgcac

SEQ ID NO: 2767998 - DNA, 21 bp, Homo sapiens
acatgtttacttttcagggca

SEQ ID NO: 2767999 - DNA, 23 bp, Homo sapiens
acatgtttatttattctgcattt

SEQ ID NO: 2768000 - DNA, 22 bp, Homo sapiens
acatgtttgcacctttctagtt

SEQ ID NO: 2768001 - DNA, 21 bp, Homo sapiens
acattaaaagaagactggaag

SEQ ID NO: 2768002 - DNA, 20 bp, Homo sapiens
acattaagattgaggcctgc

SEQ ID NO: 2768003 - DNA, 15 bp, Homo sapiens
acattaattagattt

SEQ ID NO: 2768004 - DNA, 14 bp, Homo sapiens
acattacttgcaca

SEQ ID NO: 2768005 - DNA, 16 bp, Homo sapiens
acattacttgcacaag

SEQ ID NO: 2768006 - DNA, 18 bp, Homo sapiens
acattaggaacagagtat

SEQ ID NO: 2768007 - DNA, 18 bp, Homo sapiens
acattattatcaacaata

SEQ ID NO: 2768008 - DNA, 18 bp, Homo sapiens
acattccctatcaaaaca

SEQ ID NO: 2768009 - DNA, 19 bp, Homo sapiens
acattccctatcaaaacat

SEQ ID NO: 2768010 - DNA, 20 bp, Homo sapiens
acattccctatcaaaacata

SEQ ID NO: 2768011 - DNA, 21 bp, Homo sapiens
acattccctatcaaaacatat

SEQ ID NO: 2768012 - DNA, 22 bp, Homo sapiens
acattccctatcaaaacatatc

SEQ ID NO: 2768013 - DNA, 13 bp, Homo sapiens
acattccctggcc

SEQ ID NO: 2768014 - DNA, 15 bp, Homo sapiens
acattccctggcctg

SEQ ID NO: 2768015 - DNA, 21 bp, Homo sapiens
acattgatttattttttaatc

SEQ ID NO: 2768016 - DNA, 17 bp, Homo sapiens
acattgggaaatcttat

SEQ ID NO: 2768017 - DNA, 18 bp, Homo sapiens
acatttataatgtttgct

SEQ ID NO: 2768018 - DNA, 20 bp, Homo sapiens
acatttataatgtttgctat

SEQ ID NO: 2768019 - DNA, 16 bp, Homo sapiens
acatttatatatatat

SEQ ID NO: 2768020 - DNA, 17 bp, Homo sapiens
acatttatatatatatg

SEQ ID NO: 2768021 - DNA, 18 bp, Homo sapiens
acatttatatatatatgt

SEQ ID NO: 2768022 - DNA, 16 bp, Homo sapiens
acatttattttgacat

SEQ ID NO: 2768023 - DNA, 21 bp, Homo sapiens
acatttgctttgttttctaaa

SEQ ID NO: 2768024 - DNA, 13 bp, Homo sapiens
acatttgtacatt

SEQ ID NO: 2768025 - DNA, 17 bp, Homo sapiens
acattttaaaaaacaaa

SEQ ID NO: 2768026 - DNA, 10 bp, Homo sapiens
acattttatt

SEQ ID NO: 2768027 - DNA, 22 bp, Homo sapiens
acattttatttattagctgtaa

SEQ ID NO: 2768028 - DNA, 19 bp, Homo sapiens
acattttctctttaaaaga

SEQ ID NO: 2768029 - DNA, 22 bp, Homo sapiens
accaaaaaagtatttttttaag

SEQ ID NO: 2768030 - DNA, 14 bp, Homo sapiens
accaaaagttacat

SEQ ID NO: 2768031 - DNA, 21 bp, Homo sapiens
accaaagagactggagcatct

SEQ ID NO: 2768032 - DNA, 14 bp, Homo sapiens
accaacataaaaat

SEQ ID NO: 2768033 - DNA, 15 bp, Homo sapiens
accaacataaaaatg

SEQ ID NO: 2768034 - DNA, 18 bp, Homo sapiens
accaacatcccattgccc

SEQ ID NO: 2768035 - DNA, 22 bp, Homo sapiens
accaacatcccattgccctggt

SEQ ID NO: 2768036 - DNA, 22 bp, Homo sapiens
accaacccatcagaaggagaag

SEQ ID NO: 2768037 - DNA, 20 bp, Homo sapiens
accaagagagaaagaagtag

SEQ ID NO: 2768038 - DNA, 17 bp, Homo sapiens
accaagctcacagttcc

SEQ ID NO: 2768039 - DNA, 23 bp, Homo sapiens
accaagctgttccacttctctag

SEQ ID NO: 2768040 - DNA, 18 bp, Homo sapiens
accaataacttcagagaa

SEQ ID NO: 2768041 - DNA, 11 bp, Homo sapiens
accaatatttg

SEQ ID NO: 2768042 - DNA, 18 bp, Homo sapiens
accaatcccgtgaaagaa

SEQ ID NO: 2768043 - DNA, 15 bp, Homo sapiens
accaatctctgtgac

SEQ ID NO: 2768044 - DNA, 14 bp, Homo sapiens
accacaaccaggaa

SEQ ID NO: 2768045 - DNA, 16 bp, Homo sapiens
accacacccagcccac

SEQ ID NO: 2768046 - DNA, 21 bp, Homo sapiens
accacagcagctgaacagcca

SEQ ID NO: 2768047 - DNA, 13 bp, Homo sapiens
accacagtgtctg

SEQ ID NO: 2768048 - DNA, 23 bp, Homo sapiens
accacatccacacacgcaggaac

SEQ ID NO: 2768049 - DNA, 16 bp, Homo sapiens
accacatcttgctctg

SEQ ID NO: 2768050 - DNA, 16 bp, Homo sapiens
aagaatacaaacatat

SEQ ID NO: 2768051 - DNA, 22 bp, Homo sapiens
aagaatacaaacatatttgtta

SEQ ID NO: 2768052 - DNA, 14 bp, Homo sapiens
aagaatacagaaag

SEQ ID NO: 2768053 - DNA, 17 bp, Homo sapiens
aagaatacttctcattt

SEQ ID NO: 2768054 - DNA, 13 bp, Homo sapiens
aagaatataaata

SEQ ID NO: 2768055 - DNA, 12 bp, Homo sapiens
aagaatattgtt

SEQ ID NO: 2768056 - DNA, 17 bp, Homo sapiens
aagaatgcttaatcaga

SEQ ID NO: 2768057 - DNA, 17 bp, Homo sapiens
aagaattatttttgtgt

SEQ ID NO: 2768058 - DNA, 22 bp, Homo sapiens
aagaattatttttgtgtttcta

SEQ ID NO: 2768059 - DNA, 19 bp, Homo sapiens
aagaattgaacccaggagg

SEQ ID NO: 2768060 - DNA, 22 bp, Homo sapiens
aagaattttcagaccccagcgg

SEQ ID NO: 2768061 - DNA, 17 bp, Homo sapiens
aagacaaaggttttcct

SEQ ID NO: 2768062 - DNA, 14 bp, Homo sapiens
aagacacattccta

SEQ ID NO: 2768063 - DNA, 19 bp, Homo sapiens
aagacaggtctagactttc

SEQ ID NO: 2768064 - DNA, 18 bp, Homo sapiens
aagacatgaatgcacact

SEQ ID NO: 2768065 - DNA, 12 bp, Homo sapiens
aagaccagtcca

SEQ ID NO: 2768066 - DNA, 17 bp, Homo sapiens
aagacccagtgtaaaga

SEQ ID NO: 2768067 - DNA, 22 bp, Homo sapiens
aagacctaccagggacaagcag

SEQ ID NO: 2768068 - DNA, 17 bp, Homo sapiens
aagactcctgggcttca

SEQ ID NO: 2768069 - DNA, 12 bp, Homo sapiens
aagactgaaaga

SEQ ID NO: 2768070 - DNA, 15 bp, Homo sapiens
aagactgagcacctg

SEQ ID NO: 2768071 - DNA, 12 bp, Homo sapiens
aagactgtggct

SEQ ID NO: 2768072 - DNA, 15 bp, Homo sapiens
aagactgtggctgct

SEQ ID NO: 2768073 - DNA, 19 bp, Homo sapiens
aagagacaaacacctccca

SEQ ID NO: 2768074 - DNA, 15 bp, Homo sapiens
aagagaggacacaaa

SEQ ID NO: 2768075 - DNA, 14 bp, Homo sapiens
aagagatacattcc

SEQ ID NO: 2768076 - DNA, 13 bp, Homo sapiens
aagagatgaagag

SEQ ID NO: 2768077 - DNA, 17 bp, Homo sapiens
aagagatgggcttgttt

SEQ ID NO: 2768078 - DNA, 18 bp, Homo sapiens
aagagatttcaacatatc

SEQ ID NO: 2768079 - DNA, 18 bp, Homo sapiens
aagagcatcatgcctctg

SEQ ID NO: 2768080 - DNA, 22 bp, Homo sapiens
aagagcatcatgcctctgaggc

SEQ ID NO: 2768081 - DNA, 11 bp, Homo sapiens
aagagcctgga

SEQ ID NO: 2768082 - DNA, 13 bp, Homo sapiens
aagagcctggaga

SEQ ID NO: 2768083 - DNA, 20 bp, Homo sapiens
aagagctacgtatttaatag

SEQ ID NO: 2768084 - DNA, 22 bp, Homo sapiens
aagagctgatgtgagtgtgtgt

SEQ ID NO: 2768085 - DNA, 23 bp, Homo sapiens
aagagctgatgtgagtgtgtgtg

SEQ ID NO: 2768086 - DNA, 20 bp, Homo sapiens
aagaggagtttcgaggtaga

SEQ ID NO: 2768087 - DNA, 11 bp, Homo sapiens
aagaggcaggg

SEQ ID NO: 2768088 - DNA, 16 bp, Homo sapiens
aagaggtgaccccagg

SEQ ID NO: 2768089 - DNA, 18 bp, Homo sapiens
aagaggtgaccccagggc

SEQ ID NO: 2768090 - DNA, 24 bp, Homo sapiens
aagaggtgaccccagggcacagga

SEQ ID NO: 2768091 - DNA, 17 bp, Homo sapiens
aagaggtgttttttcta

SEQ ID NO: 2768092 - DNA, 21 bp, Homo sapiens
aagagtagcaagttctagaga

SEQ ID NO: 2768093 - DNA, 14 bp, Homo sapiens
aagagtgcattttc

SEQ ID NO: 2768094 - DNA, 16 bp, Homo sapiens
aagagtgggctgcatc

SEQ ID NO: 2768095 - DNA, 19 bp, Homo sapiens
aagataacaagatctttca

SEQ ID NO: 2768096 - DNA, 18 bp, Homo sapiens
aagatatttatatatatt

SEQ ID NO: 2768097 - DNA, 19 bp, Homo sapiens
aagatctcagataaagtga

SEQ ID NO: 2768098 - DNA, 12 bp, Homo sapiens
aagatcttttaa

SEQ ID NO: 2768099 - DNA, 21 bp, Homo sapiens
aagatcttttaaaaaggcagt

SEQ ID NO: 2768100 - DNA, 14 bp, Homo sapiens
aagatgacagctct

SEQ ID NO: 2768101 - DNA, 17 bp, Homo sapiens
aagatgagagaactgga

SEQ ID NO: 2768102 - DNA, 15 bp, Homo sapiens
aagatggatgtgctt

SEQ ID NO: 2768103 - DNA, 14 bp, Homo sapiens
aagatgtcaaatat

SEQ ID NO: 2768104 - DNA, 16 bp, Homo sapiens
aagatgtttgtcagat

SEQ ID NO: 2768105 - DNA, 16 bp, Homo sapiens
aagattaaaattagtg

SEQ ID NO: 2768106 - DNA, 12 bp, Homo sapiens
aagattaaagga

SEQ ID NO: 2768107 - DNA, 13 bp, Homo sapiens
aagattaaaggaa

SEQ ID NO: 2768108 - DNA, 17 bp, Homo sapiens
aagattaaaggaaggaa

SEQ ID NO: 2768109 - DNA, 14 bp, Homo sapiens
aagattatatatca

SEQ ID NO: 2768110 - DNA, 16 bp, Homo sapiens
aagattatatatcata

SEQ ID NO: 2768111 - DNA, 21 bp, Homo sapiens
aagattatatatcataaagta

SEQ ID NO: 2768112 - DNA, 23 bp, Homo sapiens
aagattatatatcataaagtatg

SEQ ID NO: 2768113 - DNA, 18 bp, Homo sapiens
aagattatattataataa

SEQ ID NO: 2768114 - DNA, 24 bp, Homo sapiens
aagattatattataataatgttct

SEQ ID NO: 2768115 - DNA, 12 bp, Homo sapiens
aagattcccaga

SEQ ID NO: 2768116 - DNA, 13 bp, Homo sapiens
aagattcccagag

SEQ ID NO: 2768117 - DNA, 15 bp, Homo sapiens
aagattcccagagac

SEQ ID NO: 2768118 - DNA, 21 bp, Homo sapiens
aagattttggaggagaaggac

SEQ ID NO: 2768119 - DNA, 15 bp, Homo sapiens
aagcaaaagaagtaa

SEQ ID NO: 2768120 - DNA, 17 bp, Homo sapiens
aagcaaagccacatttt

SEQ ID NO: 2768121 - DNA, 18 bp, Homo sapiens
aagcaacctcagtaattt

SEQ ID NO: 2768122 - DNA, 18 bp, Homo sapiens
aagcaagacgtcctggaa

SEQ ID NO: 2768123 - DNA, 17 bp, Homo sapiens
aagcaagccaatttgga

SEQ ID NO: 2768124 - DNA, 16 bp, Homo sapiens
aagcacatgtttattt

SEQ ID NO: 2768125 - DNA, 14 bp, Homo sapiens
aagcaccctgttcc

SEQ ID NO: 2768126 - DNA, 16 bp, Homo sapiens
aagcaccgcagcatgt

SEQ ID NO: 2768127 - DNA, 13 bp, Homo sapiens
aagcacctcctgc

SEQ ID NO: 2768128 - DNA, 17 bp, Homo sapiens
aagcacctcctgcctcg

SEQ ID NO: 2768129 - DNA, 12 bp, Homo sapiens
aagcacctgccg

SEQ ID NO: 2768130 - DNA, 16 bp, Homo sapiens
aagcaccttagctggc

SEQ ID NO: 2768131 - DNA, 13 bp, Homo sapiens
aagcactgctgtg

SEQ ID NO: 2768132 - DNA, 20 bp, Homo sapiens
accacgatgtggccctggcc

SEQ ID NO: 2768133 - DNA, 22 bp, Homo sapiens
accacgatgtggccctggcctg

SEQ ID NO: 2768134 - DNA, 14 bp, Homo sapiens
accactctggcagc

SEQ ID NO: 2768135 - DNA, 17 bp, Homo sapiens
accactctggcagccac

SEQ ID NO: 2768136 - DNA, 18 bp, Homo sapiens
accactgcactccagcct

SEQ ID NO: 2768137 - DNA, 19 bp, Homo sapiens
accactgtaaaatgaaatt

SEQ ID NO: 2768138 - DNA, 20 bp, Homo sapiens
accactgtggcgttctgctg

SEQ ID NO: 2768139 - DNA, 18 bp, Homo sapiens
accacttaaaaaatgtcc

SEQ ID NO: 2768140 - DNA, 17 bp, Homo sapiens
accacttcattcttgaa

SEQ ID NO: 2768141 - DNA, 13 bp, Homo sapiens
accagaacaaggt

SEQ ID NO: 2768142 - DNA, 17 bp, Homo sapiens
accagacaccttgacag

SEQ ID NO: 2768143 - DNA, 13 bp, Homo sapiens
accagactgtgga

SEQ ID NO: 2768144 - DNA, 18 bp, Homo sapiens
accagactgtggagaaat

SEQ ID NO: 2768145 - DNA, 20 bp, Homo sapiens
accagactgtggagaaataa

SEQ ID NO: 2768146 - DNA, 12 bp, Homo sapiens
accagagcccac

SEQ ID NO: 2768147 - DNA, 14 bp, Homo sapiens
accagagcccacct

SEQ ID NO: 2768148 - DNA, 16 bp, Homo sapiens
accagagcccaccttg

SEQ ID NO: 2768149 - DNA, 22 bp, Homo sapiens
accagagcccaccttggctcaa

SEQ ID NO: 2768150 - DNA, 12 bp, Homo sapiens
accagagcccat

SEQ ID NO: 2768151 - DNA, 14 bp, Homo sapiens
accagagccccaca

SEQ ID NO: 2768152 - DNA, 20 bp, Homo sapiens
accagagccccccacaatga

SEQ ID NO: 2768153 - DNA, 21 bp, Homo sapiens
accagagccccccacaatgat

SEQ ID NO: 2768154 - DNA, 16 bp, Homo sapiens
accagaggaagcccct

SEQ ID NO: 2768155 - DNA, 15 bp, Homo sapiens
accagaggctgcaga

SEQ ID NO: 2768156 - DNA, 22 bp, Homo sapiens
accagaggctgcagaaggccaa

SEQ ID NO: 2768157 - DNA, 17 bp, Homo sapiens
accagagggaacacggc

SEQ ID NO: 2768158 - DNA, 21 bp, Homo sapiens
accagataagaatgctggttt

SEQ ID NO: 2768159 - DNA, 20 bp, Homo sapiens
accagatgaaataatgttct

SEQ ID NO: 2768160 - DNA, 13 bp, Homo sapiens
accagcagaaaag

SEQ ID NO: 2768161 - DNA, 14 bp, Homo sapiens
accagcagaaaagt

SEQ ID NO: 2768162 - DNA, 19 bp, Homo sapiens
accagcattttactacttg

SEQ ID NO: 2768163 - DNA, 17 bp, Homo sapiens
accagccacacagagcc

SEQ ID NO: 2768164 - DNA, 15 bp, Homo sapiens
accagccatcatgtg

SEQ ID NO: 2768165 - DNA, 14 bp, Homo sapiens
accagccccagcaa

SEQ ID NO: 2768166 - DNA, 18 bp, Homo sapiens
accagccccagtgcccac

SEQ ID NO: 2768167 - DNA, 14 bp, Homo sapiens
accagcccggcctg

SEQ ID NO: 2768168 - DNA, 15 bp, Homo sapiens
accagcccggcctgc

SEQ ID NO: 2768169 - DNA, 21 bp, Homo sapiens
accagcccggcctgctcccag

SEQ ID NO: 2768170 - DNA, 16 bp, Homo sapiens
accagcccttccctgc

SEQ ID NO: 2768171 - DNA, 20 bp, Homo sapiens
accagccgaccggccctgcc

SEQ ID NO: 2768172 - DNA, 19 bp, Homo sapiens
accagcctccatgctgcct

SEQ ID NO: 2768173 - DNA, 20 bp, Homo sapiens
accagcctgaccaacatggt

SEQ ID NO: 2768174 - DNA, 13 bp, Homo sapiens
accagcctgggca

SEQ ID NO: 2768175 - DNA, 21 bp, Homo sapiens
accagctcagaggcccaggaa

SEQ ID NO: 2768176 - DNA, 10 bp, Homo sapiens
accagctgct

SEQ ID NO: 2768177 - DNA, 18 bp, Homo sapiens
accagcttctccaggctc

SEQ ID NO: 2768178 - DNA, 20 bp, Homo sapiens
accagcttctccaggctctt

SEQ ID NO: 2768179 - DNA, 20 bp, Homo sapiens
accaggaatgttaaagtcag

SEQ ID NO: 2768180 - DNA, 14 bp, Homo sapiens
accaggacaggacc

SEQ ID NO: 2768181 - DNA, 19 bp, Homo sapiens
accaggactatagcccagg

SEQ ID NO: 2768182 - DNA, 17 bp, Homo sapiens
accaggagtccctggta

SEQ ID NO: 2768183 - DNA, 14 bp, Homo sapiens
accaggatggccct

SEQ ID NO: 2768184 - DNA, 21 bp, Homo sapiens
accaggcaccaaaagaagtaa

SEQ ID NO: 2768185 - DNA, 22 bp, Homo sapiens
accaggcacgaacccacctgct

SEQ ID NO: 2768186 - DNA, 19 bp, Homo sapiens
accaggctcacaactgttt

SEQ ID NO: 2768187 - DNA, 21 bp, Homo sapiens
accagggagaccgagcgcttt

SEQ ID NO: 2768188 - DNA, 20 bp, Homo sapiens
accagggagcccctttgatg

SEQ ID NO: 2768189 - DNA, 14 bp, Homo sapiens
accaggttgaaaga

SEQ ID NO: 2768190 - DNA, 18 bp, Homo sapiens
accagtgaaccaaagaga

SEQ ID NO: 2768191 - DNA, 16 bp, Homo sapiens
accagtgccgcctgtg

SEQ ID NO: 2768192 - DNA, 14 bp, Homo sapiens
accagtgtactgct

SEQ ID NO: 2768193 - DNA, 15 bp, Homo sapiens
accagtgtactgctt

SEQ ID NO: 2768194 - DNA, 16 bp, Homo sapiens
accagtgtactgcttt

SEQ ID NO: 2768195 - DNA, 13 bp, Homo sapiens
accagtgtagcct

SEQ ID NO: 2768196 - DNA, 15 bp, Homo sapiens
accataatgttacat

SEQ ID NO: 2768197 - DNA, 18 bp, Homo sapiens
accataatgttacattat

SEQ ID NO: 2768198 - DNA, 13 bp, Homo sapiens
accatcagttact

SEQ ID NO: 2768199 - DNA, 17 bp, Homo sapiens
accatcagttactggtt

SEQ ID NO: 2768200 - DNA, 23 bp, Homo sapiens
accatcagttactggtttcagtt

SEQ ID NO: 2768201 - DNA, 16 bp, Homo sapiens
accatcctatttaact

SEQ ID NO: 2768202 - DNA, 17 bp, Homo sapiens
accatcctgcagcctcc

SEQ ID NO: 2768203 - DNA, 19 bp, Homo sapiens
accatctgtcttgccagcc

SEQ ID NO: 2768204 - DNA, 13 bp, Homo sapiens
accatgaagctgg

SEQ ID NO: 2768205 - DNA, 18 bp, Homo sapiens
accatgagaagagggcct

SEQ ID NO: 2768206 - DNA, 23 bp, Homo sapiens
accatgagaataagagaaagaaa

SEQ ID NO: 2768207 - DNA, 17 bp, Homo sapiens
accatgcagcttcatca

SEQ ID NO: 2768208 - DNA, 18 bp, Homo sapiens
accctgttccctctttct

SEQ ID NO: 2768209 - DNA, 13 bp, Homo sapiens
acccttcctcctc

SEQ ID NO: 2768210 - DNA, 15 bp, Homo sapiens
acccttcctcctcct

SEQ ID NO: 2768211 - DNA, 16 bp, Homo sapiens
acccttctttcctctt

SEQ ID NO: 2768212 - DNA, 14 bp, Homo sapiens
accctttccttcct

SEQ ID NO: 2768213 - DNA, 20 bp, Homo sapiens
accgagcgctttctggaaaa

SEQ ID NO: 2768214 - DNA, 17 bp, Homo sapiens
accgcgtctaccctggg

SEQ ID NO: 2768215 - DNA, 13 bp, Homo sapiens
accgctaaaagaa

SEQ ID NO: 2768216 - DNA, 16 bp, Homo sapiens
accgctaaaagaaact

SEQ ID NO: 2768217 - DNA, 16 bp, Homo sapiens
accgggcactcagaag

SEQ ID NO: 2768218 - DNA, 19 bp, Homo sapiens
accgggccacagagaaagt

SEQ ID NO: 2768219 - DNA, 16 bp, Homo sapiens
accgtggcccttcctg

SEQ ID NO: 2768220 - DNA, 18 bp, Homo sapiens
accgtggcccttcctgga

SEQ ID NO: 2768221 - DNA, 20 bp, Homo sapiens
accgtggcccttcctggaca

SEQ ID NO: 2768222 - DNA, 14 bp, Homo sapiens
accgtgtccagcac

SEQ ID NO: 2768223 - DNA, 16 bp, Homo sapiens
acctaacccctttcct

SEQ ID NO: 2768224 - DNA, 18 bp, Homo sapiens
acctaacccctttcctgc

SEQ ID NO: 2768225 - DNA, 17 bp, Homo sapiens
acctaccacagtgtctg

SEQ ID NO: 2768226 - DNA, 14 bp, Homo sapiens
acctactcacacag

SEQ ID NO: 2768227 - DNA, 17 bp, Homo sapiens
acctactcacacaggca

SEQ ID NO: 2768228 - DNA, 18 bp, Homo sapiens
acctaggccactcctcca

SEQ ID NO: 2768229 - DNA, 23 bp, Homo sapiens
  misc_feature (6)..(6): n is a, c, g or t
  misc_feature (13)..(13): n is a, c, g or t
acctanccccccnacccccagtg

SEQ ID NO: 2768230 - DNA, 16 bp, Homo sapiens
acctatagtcccagct

SEQ ID NO: 2768231 - DNA, 16 bp, Homo sapiens
acctatggctgcctgc

SEQ ID NO: 2768232 - DNA, 22 bp, Homo sapiens
acctatggtataatggttgact

SEQ ID NO: 2768233 - DNA, 18 bp, Homo sapiens
acctatgtcatttcattt

SEQ ID NO: 2768234 - DNA, 14 bp, Homo sapiens
acctattttttaaa

SEQ ID NO: 2768235 - DNA, 14 bp, Homo sapiens
acctcactcctgtt

SEQ ID NO: 2768236 - DNA, 23 bp, Homo sapiens
acctcagccatgaggagttgctg

SEQ ID NO: 2768237 - DNA, 19 bp, Homo sapiens
acctcagcctgtgctgccc

SEQ ID NO: 2768238 - DNA, 21 bp, Homo sapiens
acctcaggccaggtgcagtgg

SEQ ID NO: 2768239 - DNA, 13 bp, Homo sapiens
acctcagtttctc

SEQ ID NO: 2768240 - DNA, 16 bp, Homo sapiens
acctcatgacagccag

SEQ ID NO: 2768241 - DNA, 17 bp, Homo sapiens
acctcatgacagccaga

SEQ ID NO: 2768242 - DNA, 22 bp, Homo sapiens
acctcatgacagccagagcctg

SEQ ID NO: 2768243 - DNA, 23 bp, Homo sapiens
acctcatgcctggcccccctcca

SEQ ID NO: 2768244 - DNA, 18 bp, Homo sapiens
acctccacagtagcattt

SEQ ID NO: 2768245 - DNA, 15 bp, Homo sapiens
acctcccagccctat

SEQ ID NO: 2768246 - DNA, 20 bp, Homo sapiens
acctcccagccctatggatg

SEQ ID NO: 2768247 - DNA, 16 bp, Homo sapiens
acctccccccactgca

SEQ ID NO: 2768248 - DNA, 20 bp, Homo sapiens
acctccccgcagagctccct

SEQ ID NO: 2768249 - DNA, 20 bp, Homo sapiens
acctccccggcctctctctt

SEQ ID NO: 2768250 - DNA, 14 bp, Homo sapiens
acctcccctatcca

SEQ ID NO: 2768251 - DNA, 17 bp, Homo sapiens
acctcccctatccaccc

SEQ ID NO: 2768252 - DNA, 14 bp, Homo sapiens
acctccctgaacca

SEQ ID NO: 2768253 - DNA, 18 bp, Homo sapiens
acctccctgccctgtcct

SEQ ID NO: 2768254 - DNA, 18 bp, Homo sapiens
acctccgccccagacaca

SEQ ID NO: 2768255 - DNA, 13 bp, Homo sapiens
acctcctgcccag

SEQ ID NO: 2768256 - DNA, 14 bp, Homo sapiens
acctcctgcccagg

SEQ ID NO: 2768257 - DNA, 18 bp, Homo sapiens
acctcctgcccaggagag

SEQ ID NO: 2768258 - DNA, 19 bp, Homo sapiens
acctcctgcccaggagagc

SEQ ID NO: 2768259 - DNA, 21 bp, Homo sapiens
acctccttcctcagtcctgga

SEQ ID NO: 2768260 - DNA, 20 bp, Homo sapiens
acctctatatgttgctgaaa

SEQ ID NO: 2768261 - DNA, 12 bp, Homo sapiens
acctctctcctt

SEQ ID NO: 2768262 - DNA, 15 bp, Homo sapiens
acctctctccttctg

SEQ ID NO: 2768263 - DNA, 22 bp, Homo sapiens
acctctcttatagaatatttat

SEQ ID NO: 2768264 - DNA, 13 bp, Homo sapiens
acctctgatacct

SEQ ID NO: 2768265 - DNA, 13 bp, Homo sapiens
acctctgcctcaa

SEQ ID NO: 2768266 - DNA, 14 bp, Homo sapiens
acctctgcctcaat

SEQ ID NO: 2768267 - DNA, 12 bp, Homo sapiens
acctctgcctga

SEQ ID NO: 2768268 - DNA, 20 bp, Homo sapiens
acctctgcctgaagtcacac

SEQ ID NO: 2768269 - DNA, 17 bp, Homo sapiens
acctcttctcttcctgt

SEQ ID NO: 2768270 - DNA, 22 bp, Homo sapiens
acctctttattttttgattgaa

SEQ ID NO: 2768271 - DNA, 11 bp, Homo sapiens
acctgaagaat

SEQ ID NO: 2768272 - DNA, 20 bp, Homo sapiens
acctgactattgaagttgca

SEQ ID NO: 2768273 - DNA, 23 bp, Homo sapiens
acctgagaccagttgggagcact

SEQ ID NO: 2768274 - DNA, 13 bp, Homo sapiens
acctgagcctgcc

SEQ ID NO: 2768275 - DNA, 21 bp, Homo sapiens
acctgagcctgccgagcaacc

SEQ ID NO: 2768276 - DNA, 14 bp, Homo sapiens
acctgcacctcccc

SEQ ID NO: 2768277 - DNA, 19 bp, Homo sapiens
acgcctgtaatcccagcag

SEQ ID NO: 2768278 - DNA, 20 bp, Homo sapiens
acgcgtgcacacaccagagc

SEQ ID NO: 2768279 - DNA, 13 bp, Homo sapiens
acgctctctgtct

SEQ ID NO: 2768280 - DNA, 17 bp, Homo sapiens
acgctttttgaaaaagc

SEQ ID NO: 2768281 - DNA, 16 bp, Homo sapiens
acggagagtgcttggg

SEQ ID NO: 2768282 - DNA, 20 bp, Homo sapiens
acggatccatgtagcaggac

SEQ ID NO: 2768283 - DNA, 21 bp, Homo sapiens
acggatccatgtagcaggact

SEQ ID NO: 2768284 - DNA, 20 bp, Homo sapiens
acggcacctgggccctgggg

SEQ ID NO: 2768285 - DNA, 17 bp, Homo sapiens
acggcagcttgagcctg

SEQ ID NO: 2768286 - DNA, 11 bp, Homo sapiens
acggccctgtt

SEQ ID NO: 2768287 - DNA, 16 bp, Homo sapiens
acggctcactgcagcc

SEQ ID NO: 2768288 - DNA, 16 bp, Homo sapiens
acgggcagtagctgtg

SEQ ID NO: 2768289 - DNA, 14 bp, Homo sapiens
acgggctgccctgc

SEQ ID NO: 2768290 - DNA, 15 bp, Homo sapiens
acgggtggaggggaa

SEQ ID NO: 2768291 - DNA, 15 bp, Homo sapiens
acggttaacttgtat

SEQ ID NO: 2768292 - DNA, 20 bp, Homo sapiens
acggttaacttgtatattcc

SEQ ID NO: 2768293 - DNA, 18 bp, Homo sapiens
acgtaaccacggaaaaga

SEQ ID NO: 2768294 - DNA, 16 bp, Homo sapiens
acgtacttaactgtgt

SEQ ID NO: 2768295 - DNA, 19 bp, Homo sapiens
acgtataaatatgaaatga

SEQ ID NO: 2768296 - DNA, 16 bp, Homo sapiens
acgtattggtccagct

SEQ ID NO: 2768297 - DNA, 14 bp, Homo sapiens
acgtcaaacatgaa

SEQ ID NO: 2768298 - DNA, 21 bp, Homo sapiens
acgtcctggaatgaagcatgt

SEQ ID NO: 2768299 - DNA, 14 bp, Homo sapiens
acgtgagccaggta

SEQ ID NO: 2768300 - DNA, 23 bp, Homo sapiens
agaagctctgtttataaaaacaa

SEQ ID NO: 2768301 - DNA, 17 bp, Homo sapiens
agaaggaagtgaagagg

SEQ ID NO: 2768302 - DNA, 15 bp, Homo sapiens
agaaggagaaggaag

SEQ ID NO: 2768303 - DNA, 16 bp, Homo sapiens
agaaggagcaagagaa

SEQ ID NO: 2768304 - DNA, 14 bp, Homo sapiens
agaaggatgaatga

SEQ ID NO: 2768305 - DNA, 13 bp, Homo sapiens
agaaggccaagaa

SEQ ID NO: 2768306 - DNA, 14 bp, Homo sapiens
agaaggccgctgcc

SEQ ID NO: 2768307 - DNA, 16 bp, Homo sapiens
agaaggccgctgcccc

SEQ ID NO: 2768308 - DNA, 12 bp, Homo sapiens
agaagggaaatt

SEQ ID NO: 2768309 - DNA, 20 bp, Homo sapiens
agaagggaaattcacactgt

SEQ ID NO: 2768310 - DNA, 23 bp, Homo sapiens
agaagggggattggagggaagac

SEQ ID NO: 2768311 - DNA, 16 bp, Homo sapiens
agaagggttatatttt

SEQ ID NO: 2768312 - DNA, 19 bp, Homo sapiens
agaagggttatattttact

SEQ ID NO: 2768313 - DNA, 21 bp, Homo sapiens
agaagggttttccaccctgga

SEQ ID NO: 2768314 - DNA, 15 bp, Homo sapiens
agaagtaaaagcaaa

SEQ ID NO: 2768315 - DNA, 22 bp, Homo sapiens
agaagtaaaagcaaaaaagaaa

SEQ ID NO: 2768316 - DNA, 17 bp, Homo sapiens
agaagtaggcatgaggg

SEQ ID NO: 2768317 - DNA, 17 bp, Homo sapiens
agaagtatccaattatg

SEQ ID NO: 2768318 - DNA, 21 bp, Homo sapiens
agaagtatccaattatgtgac

SEQ ID NO: 2768319 - DNA, 17 bp, Homo sapiens
agaagtcagttggagaa

SEQ ID NO: 2768320 - DNA, 20 bp, Homo sapiens
agaagtcatggcccaaatcc

SEQ ID NO: 2768321 - DNA, 15 bp, Homo sapiens
agaagtctcttccag

SEQ ID NO: 2768322 - DNA, 15 bp, Homo sapiens
agaagtggaccagga

SEQ ID NO: 2768323 - DNA, 17 bp, Homo sapiens
agaagtgggccaggaca

SEQ ID NO: 2768324 - DNA, 19 bp, Homo sapiens
agaagttaagcagcctttc

SEQ ID NO: 2768325 - DNA, 19 bp, Homo sapiens
agaagtttcatcatttttt

SEQ ID NO: 2768326 - DNA, 21 bp, Homo sapiens
agaagtttcatcattttttac

SEQ ID NO: 2768327 - DNA, 23 bp, Homo sapiens
agaagtttctggccctggctgac

SEQ ID NO: 2768328 - DNA, 13 bp, Homo sapiens
agaataaaaattg

SEQ ID NO: 2768329 - DNA, 22 bp, Homo sapiens
agaataaaaattgacttcttgc

SEQ ID NO: 2768330 - DNA, 15 bp, Homo sapiens
agaataaagaaaaac

SEQ ID NO: 2768331 - DNA, 17 bp, Homo sapiens
agaataaagttctgagt

SEQ ID NO: 2768332 - DNA, 15 bp, Homo sapiens
agaataagtgctgtt

SEQ ID NO: 2768333 - DNA, 22 bp, Homo sapiens
agaataatatgctgccaaattt

SEQ ID NO: 2768334 - DNA, 16 bp, Homo sapiens
agaataatctttgggt

SEQ ID NO: 2768335 - DNA, 15 bp, Homo sapiens
agaataattgtgtac

SEQ ID NO: 2768336 - DNA, 21 bp, Homo sapiens
agaatacagaaagatggatgt

SEQ ID NO: 2768337 - DNA, 18 bp, Homo sapiens
agaatacagtaagctgct

SEQ ID NO: 2768338 - DNA, 21 bp, Homo sapiens
agaatacattttatatctgga

SEQ ID NO: 2768339 - DNA, 14 bp, Homo sapiens
agaatataattatc

SEQ ID NO: 2768340 - DNA, 14 bp, Homo sapiens
agaatatggacaaa

SEQ ID NO: 2768341 - DNA, 12 bp, Homo sapiens
agaatattcagg

SEQ ID NO: 2768342 - DNA, 13 bp, Homo sapiens
agaatattcagga

SEQ ID NO: 2768343 - DNA, 15 bp, Homo sapiens
agaatcataattttc

SEQ ID NO: 2768344 - DNA, 17 bp, Homo sapiens
agaatccaaagatcaca

SEQ ID NO: 2768345 - DNA, 14 bp, Homo sapiens
agaatccctgcagc

SEQ ID NO: 2768346 - DNA, 17 bp, Homo sapiens
agaatccctgcagcctg

SEQ ID NO: 2768347 - DNA, 22 bp, Homo sapiens
agaaaacattcatccagttgca

SEQ ID NO: 2768348 - DNA, 14 bp, Homo sapiens
agaaaacctccagt

SEQ ID NO: 2768349 - DNA, 19 bp, Homo sapiens
agaaaacgcacctccatcc

SEQ ID NO: 2768350 - DNA, 18 bp, Homo sapiens
agaaaagatttaagtaat

SEQ ID NO: 2768351 - DNA, 15 bp, Homo sapiens
agaaaagcacctgcc

SEQ ID NO: 2768352 - DNA, 16 bp, Homo sapiens
agaaaagcacctgccg

SEQ ID NO: 2768353 - DNA, 22 bp, Homo sapiens
agaaaagtagaattatatctaa

SEQ ID NO: 2768354 - DNA, 23 bp, Homo sapiens
agaaaagtagaattatatctaat

SEQ ID NO: 2768355 - DNA, 18 bp, Homo sapiens
agaaaagtgcaaagttat

SEQ ID NO: 2768356 - DNA, 13 bp, Homo sapiens
agaaaatataaat

SEQ ID NO: 2768357 - DNA, 17 bp, Homo sapiens
agaaaatataaatgcat

SEQ ID NO: 2768358 - DNA, 14 bp, Homo sapiens
agaaaatgaagaaa

SEQ ID NO: 2768359 - DNA, 18 bp, Homo sapiens
agaaacaaggttttcagt

SEQ ID NO: 2768360 - DNA, 15 bp, Homo sapiens
agaaacagagacagg

SEQ ID NO: 2768361 - DNA, 18 bp, Homo sapiens
agaaacaggggatcaaag

SEQ ID NO: 2768362 - DNA, 20 bp, Homo sapiens
agaaacaggggatcaaagtt

SEQ ID NO: 2768363 - DNA, 21 bp, Homo sapiens
agaaacaggggatcaaagttc

SEQ ID NO: 2768364 - DNA, 22 bp, Homo sapiens
agaaacaggggatcaaagttcc

SEQ ID NO: 2768365 - DNA, 23 bp, Homo sapiens
agaaacctgaggatgcaacaaat

SEQ ID NO: 2768366 - DNA, 18 bp, Homo sapiens
agaaactgaggaattttc

SEQ ID NO: 2768367 - DNA, 12 bp, Homo sapiens
agaaagaagccc

SEQ ID NO: 2768368 - DNA, 13 bp, Homo sapiens
agaaagaaggaag

SEQ ID NO: 2768369 - DNA, 14 bp, Homo sapiens
agaaagaaggaagt

SEQ ID NO: 2768370 - DNA, 15 bp, Homo sapiens
agaaagacagagctg

SEQ ID NO: 2768371 - DNA, 21 bp, Homo sapiens
agaaagaggtgaccccagggc

SEQ ID NO: 2768372 - DNA, 19 bp, Homo sapiens
agaaagatggatgtgcttt

SEQ ID NO: 2768373 - DNA, 19 bp, Homo sapiens
agaaagctctgcatgtgtg

SEQ ID NO: 2768374 - DNA, 20 bp, Homo sapiens
agaaaggaggggatagagag

SEQ ID NO: 2768375 - DNA, 21 bp, Homo sapiens
agaaagggagggctctgaggc

SEQ ID NO: 2768376 - DNA, 15 bp, Homo sapiens
agaaagggtctgata

SEQ ID NO: 2768377 - DNA, 16 bp, Homo sapiens
agaaaggttagtatca

SEQ ID NO: 2768378 - DNA, 22 bp, Homo sapiens
agaaagtacttctccaccctgc

SEQ ID NO: 2768379 - DNA, 13 bp, Homo sapiens
agaaataagtttt

SEQ ID NO: 2768380 - DNA, 17 bp, Homo sapiens
agaaataggacaattca

SEQ ID NO: 2768381 - DNA, 15 bp, Homo sapiens
agaaatatgtggttt

SEQ ID NO: 2768382 - DNA, 12 bp, Homo sapiens
agaaatgcagaa

SEQ ID NO: 2768383 - DNA, 14 bp, Homo sapiens
agaaattagccggg

SEQ ID NO: 2768384 - DNA, 17 bp, Homo sapiens
agaaattagctgtgtga

SEQ ID NO: 2768385 - DNA, 19 bp, Homo sapiens
agaaattcctgtagcatct

SEQ ID NO: 2768386 - DNA, 19 bp, Homo sapiens
agaaattgttcctgatgtg

SEQ ID NO: 2768387 - DNA, 16 bp, Homo sapiens
agaaatttaaactata

SEQ ID NO: 2768388 - DNA, 22 bp, Homo sapiens
agaaattttactgacagaaatg

SEQ ID NO: 2768389 - DNA, 18 bp, Homo sapiens
agaaatttttatttttga

SEQ ID NO: 2768390 - DNA, 15 bp, Homo sapiens
agaacaaacctctat

SEQ ID NO: 2768391 - DNA, 19 bp, Homo sapiens
agaacaaggtagtttttac

SEQ ID NO: 2768392 - DNA, 16 bp, Homo sapiens
actctgtggggccttg

SEQ ID NO: 2768393 - DNA, 14 bp, Homo sapiens
actcttaatcaaat

SEQ ID NO: 2768394 - DNA, 16 bp, Homo sapiens
actcttatgaaatggg

SEQ ID NO: 2768395 - DNA, 21 bp, Homo sapiens
actcttattgcccacgctgga

SEQ ID NO: 2768396 - DNA, 15 bp, Homo sapiens
actcttccatttatt

SEQ ID NO: 2768397 - DNA, 22 bp, Homo sapiens
actcttgcctttccacctgctt

SEQ ID NO: 2768398 - DNA, 14 bp, Homo sapiens
actctttgtaagag

SEQ ID NO: 2768399 - DNA, 16 bp, Homo sapiens
actgaacatttgcttt

SEQ ID NO: 2768400 - DNA, 13 bp, Homo sapiens
actgaaggagaag

SEQ ID NO: 2768401 - DNA, 21 bp, Homo sapiens
actgaatgcctcaatgtgacc

SEQ ID NO: 2768402 - DNA, 16 bp, Homo sapiens
actgacacctcactga

SEQ ID NO: 2768403 - DNA, 17 bp, Homo sapiens
actgacacctcactgag

SEQ ID NO: 2768404 - DNA, 13 bp, Homo sapiens
actgaccagcctc

SEQ ID NO: 2768405 - DNA, 20 bp, Homo sapiens
actgaccagcctccatgctg

SEQ ID NO: 2768406 - DNA, 15 bp, Homo sapiens
actgacccacagcct

SEQ ID NO: 2768407 - DNA, 22 bp, Homo sapiens
actgaccctggagcggctctcc

SEQ ID NO: 2768408 - DNA, 17 bp, Homo sapiens
actgagcctagctacct

SEQ ID NO: 2768409 - DNA, 17 bp, Homo sapiens
actgagcttctctgtga

SEQ ID NO: 2768410 - DNA, 18 bp, Homo sapiens
actgagcttctctgtgaa

SEQ ID NO: 2768411 - DNA, 17 bp, Homo sapiens
actgaggaagggagaca

SEQ ID NO: 2768412 - DNA, 24 bp, Homo sapiens
actgaggaagggagacatattctt

SEQ ID NO: 2768413 - DNA, 15 bp, Homo sapiens
actgaggcagacagc

SEQ ID NO: 2768414 - DNA, 19 bp, Homo sapiens
actgaggcagacagcagct

SEQ ID NO: 2768415 - DNA, 22 bp, Homo sapiens
actgaggcatttttactactat

SEQ ID NO: 2768416 - DNA, 21 bp, Homo sapiens
actgaggcctaaaagtaaaca

SEQ ID NO: 2768417 - DNA, 22 bp, Homo sapiens
actgagggccacactattacca

SEQ ID NO: 2768418 - DNA, 15 bp, Homo sapiens
actgataaagaaaga

SEQ ID NO: 2768419 - DNA, 14 bp, Homo sapiens
actgatatattttc

SEQ ID NO: 2768420 - DNA, 12 bp, Homo sapiens
actgatgggcaa

SEQ ID NO: 2768421 - DNA, 21 bp, Homo sapiens
actgatgttacatcacagtgt

SEQ ID NO: 2768422 - DNA, 16 bp, Homo sapiens
actgatttggagatat

SEQ ID NO: 2768423 - DNA, 22 bp, Homo sapiens
actgattttgttatttttatat

SEQ ID NO: 2768424 - DNA, 17 bp, Homo sapiens
actgcaagagccttggt

SEQ ID NO: 2768425 - DNA, 18 bp, Homo sapiens
actgcaagagccttggtg

SEQ ID NO: 2768426 - DNA, 17 bp, Homo sapiens
actgcaagaggctcctg

SEQ ID NO: 2768427 - DNA, 20 bp, Homo sapiens
actgcactatagcctaggtg

SEQ ID NO: 2768428 - DNA, 18 bp, Homo sapiens
actgcactccagcctggg

SEQ ID NO: 2768429 - DNA, 19 bp, Homo sapiens
actgcactccagcctgggc

SEQ ID NO: 2768430 - DNA, 20 bp, Homo sapiens
actgcactccagcctgggcg

SEQ ID NO: 2768431 - DNA, 21 bp, Homo sapiens
actgcactccagcctgggcga

SEQ ID NO: 2768432 - DNA, 19 bp, Homo sapiens
actgcagcctcaacctcct

SEQ ID NO: 2768433 - DNA, 15 bp, Homo sapiens
actgcaggccccgct

SEQ ID NO: 2768434 - DNA, 23 bp, Homo sapiens
actgcaggccccgcttgtccagc

SEQ ID NO: 2768435 - DNA, 17 bp, Homo sapiens
actgcagggactgccag

SEQ ID NO: 2768436 - DNA, 12 bp, Homo sapiens
actgcatgcact

SEQ ID NO: 2768437 - DNA, 18 bp, Homo sapiens
actgcatgcacttcttac

SEQ ID NO: 2768438 - DNA, 15 bp, Homo sapiens
actgccaaaacaatg

SEQ ID NO: 2768439 - DNA, 22 bp, Homo sapiens
acttatatcatcagcatacctt

SEQ ID NO: 2768440 - DNA, 17 bp, Homo sapiens
acttattttccaataaa

SEQ ID NO: 2768441 - DNA, 21 bp, Homo sapiens
acttattttctggatctatct

SEQ ID NO: 2768442 - DNA, 14 bp, Homo sapiens
acttatttttgaca

SEQ ID NO: 2768443 - DNA, 19 bp, Homo sapiens
acttcaagcatggctattt

SEQ ID NO: 2768444 - DNA, 23 bp, Homo sapiens
acttcaagcatggctattttata

SEQ ID NO: 2768445 - DNA, 22 bp, Homo sapiens
acttcaagtgcatgctctctgc

SEQ ID NO: 2768446 - DNA, 16 bp, Homo sapiens
acttcacactgcaaga

SEQ ID NO: 2768447 - DNA, 19 bp, Homo sapiens
acttcacactgcaagagcc

SEQ ID NO: 2768448 - DNA, 13 bp, Homo sapiens
acttcagagaagt

SEQ ID NO: 2768449 - DNA, 15 bp, Homo sapiens
acttcagagaagtca

SEQ ID NO: 2768450 - DNA, 16 bp, Homo sapiens
acttcagtcctggtct

SEQ ID NO: 2768451 - DNA, 17 bp, Homo sapiens
acttcagtcctggtctg

SEQ ID NO: 2768452 - DNA, 21 bp, Homo sapiens
acttcattcttgaaagctgtg

SEQ ID NO: 2768453 - DNA, 17 bp, Homo sapiens
acttcattttcagagtg

SEQ ID NO: 2768454 - DNA, 23 bp, Homo sapiens
acttcccagttcaggagtcccaa

SEQ ID NO: 2768455 - DNA, 17 bp, Homo sapiens
acttcctcgcctctccc

SEQ ID NO: 2768456 - DNA, 15 bp, Homo sapiens
acttcgactcaggat

SEQ ID NO: 2768457 - DNA, 19 bp, Homo sapiens
acttcgactcaggatccag

SEQ ID NO: 2768458 - DNA, 15 bp, Homo sapiens
acttctaaatgaagt

SEQ ID NO: 2768459 - DNA, 16 bp, Homo sapiens
acttctaaatgaagtg

SEQ ID NO: 2768460 - DNA, 13 bp, Homo sapiens
acttctaaatgtt

SEQ ID NO: 2768461 - DNA, 18 bp, Homo sapiens
acttctcaggacacaggc

SEQ ID NO: 2768462 - DNA, 23 bp, Homo sapiens
acttctcatcatattgtatgtaa

SEQ ID NO: 2768463 - DNA, 22 bp, Homo sapiens
acttctccagacccaccacacc

SEQ ID NO: 2768464 - DNA, 16 bp, Homo sapiens
acttctctccaggctg

SEQ ID NO: 2768465 - DNA, 20 bp, Homo sapiens
acttctgccatattctgttg

SEQ ID NO: 2768466 - DNA, 23 bp, Homo sapiens
acttcttaatgctttcctccctg

SEQ ID NO: 2768467 - DNA, 23 bp, Homo sapiens
acttctttcctctccaattgtaa

SEQ ID NO: 2768468 - DNA, 17 bp, Homo sapiens
acttgaaattatatctg

SEQ ID NO: 2768469 - DNA, 23 bp, Homo sapiens
acttgaaattatatctgtggtct

SEQ ID NO: 2768470 - DNA, 13 bp, Homo sapiens
acttgaactgatt

SEQ ID NO: 2768471 - DNA, 16 bp, Homo sapiens
acttgaatgtgtcact

SEQ ID NO: 2768472 - DNA, 17 bp, Homo sapiens
acttgacagaacactgt

SEQ ID NO: 2768473 - DNA, 18 bp, Homo sapiens
acttgacagaacactgtc

SEQ ID NO: 2768474 - DNA, 22 bp, Homo sapiens
acttgagcctccatttctggct

SEQ ID NO: 2768475 - DNA, 11 bp, Homo sapiens
acttgaggaca

SEQ ID NO: 2768476 - DNA, 12 bp, Homo sapiens
acttgaggacac

SEQ ID NO: 2768477 - DNA, 13 bp, Homo sapiens
acttgaggacaca

SEQ ID NO: 2768478 - DNA, 15 bp, Homo sapiens
acttgaggacacatg

SEQ ID NO: 2768479 - DNA, 18 bp, Homo sapiens
acttgatatatttcattc

SEQ ID NO: 2768480 - DNA, 17 bp, Homo sapiens
acttgcacaagcttgta

SEQ ID NO: 2768481 - DNA, 20 bp, Homo sapiens
acttgcacaagcttgtatat

SEQ ID NO: 2768482 - DNA, 22 bp, Homo sapiens
acttgcagactctacagaggcc

SEQ ID NO: 2768483 - DNA, 21 bp, Homo sapiens
acccaatttaattccataatc

SEQ ID NO: 2768484 - DNA, 16 bp, Homo sapiens
acccacatgtgacaca

SEQ ID NO: 2768485 - DNA, 18 bp, Homo sapiens
acccaccgggccactcct

SEQ ID NO: 2768486 - DNA, 23 bp, Homo sapiens
acccaccgggccactccttcctg

SEQ ID NO: 2768487 - DNA, 14 bp, Homo sapiens
acccacctcagcct

SEQ ID NO: 2768488 - DNA, 15 bp, Homo sapiens
acccacctcagcctc

SEQ ID NO: 2768489 - DNA, 11 bp, Homo sapiens
acccactgctt

SEQ ID NO: 2768490 - DNA, 24 bp, Homo sapiens
acccagagcattacgtgagccagg

SEQ ID NO: 2768491 - DNA, 15 bp, Homo sapiens
acccagagccttctc

SEQ ID NO: 2768492 - DNA, 22 bp, Homo sapiens
acccagcaggaagccaggctga

SEQ ID NO: 2768493 - DNA, 11 bp, Homo sapiens
acccagcccat

SEQ ID NO: 2768494 - DNA, 19 bp, Homo sapiens
acccagcccattctctctc

SEQ ID NO: 2768495 - DNA, 19 bp, Homo sapiens
acccagccctgcccctcac

SEQ ID NO: 2768496 - DNA, 13 bp, Homo sapiens
acccagcgagccc

SEQ ID NO: 2768497 - DNA, 13 bp, Homo sapiens
acccaggagcccc

SEQ ID NO: 2768498 - DNA, 11 bp, Homo sapiens
acccaggaggt

SEQ ID NO: 2768499 - DNA, 19 bp, Homo sapiens
acccaggagtttgtgtgtc

SEQ ID NO: 2768500 - DNA, 20 bp, Homo sapiens
acccaggagtttgtgtgtct

SEQ ID NO: 2768501 - DNA, 15 bp, Homo sapiens
acccagtgtaaagaa

SEQ ID NO: 2768502 - DNA, 21 bp, Homo sapiens
acccagtgtaaagaataaatg

SEQ ID NO: 2768503 - DNA, 18 bp, Homo sapiens
acccatagatcttctgaa

SEQ ID NO: 2768504 - DNA, 21 bp, Homo sapiens
acccatagatcttctgaaatg

SEQ ID NO: 2768505 - DNA, 14 bp, Homo sapiens
acccatcagaagga

SEQ ID NO: 2768506 - DNA, 13 bp, Homo sapiens
acccatgaggcaa

SEQ ID NO: 2768507 - DNA, 18 bp, Homo sapiens
acccatgatgagctcctc

SEQ ID NO: 2768508 - DNA, 13 bp, Homo sapiens
acccatgccatag

SEQ ID NO: 2768509 - DNA, 17 bp, Homo sapiens
acccattcctatttctt

SEQ ID NO: 2768510 - DNA, 20 bp, Homo sapiens
acccattttgagtgactcga

SEQ ID NO: 2768511 - DNA, 16 bp, Homo sapiens
acccatttttgagcca

SEQ ID NO: 2768512 - DNA, 22 bp, Homo sapiens
acccatttttgagccaagcttc

SEQ ID NO: 2768513 - DNA, 22 bp, Homo sapiens
accccaaagagcctggagaagc

SEQ ID NO: 2768514 - DNA, 15 bp, Homo sapiens
accccaagtccacct

SEQ ID NO: 2768515 - DNA, 21 bp, Homo sapiens
accccacccccttcagtgccc

SEQ ID NO: 2768516 - DNA, 22 bp, Homo sapiens
accccacccccttcagtgccca

SEQ ID NO: 2768517 - DNA, 19 bp, Homo sapiens
accccacctcatgcctggc

SEQ ID NO: 2768518 - DNA, 18 bp, Homo sapiens
accccagctagggctgga

SEQ ID NO: 2768519 - DNA, 17 bp, Homo sapiens
accccagctccctagga

SEQ ID NO: 2768520 - DNA, 11 bp, Homo sapiens
accccaggacg

SEQ ID NO: 2768521 - DNA, 23 bp, Homo sapiens
accccaggacgccactcatttca

SEQ ID NO: 2768522 - DNA, 15 bp, Homo sapiens
accccagggcacagg

SEQ ID NO: 2768523 - DNA, 16 bp, Homo sapiens
accccagggcacagga

SEQ ID NO: 2768524 - DNA, 17 bp, Homo sapiens
accccagttctgctcct

SEQ ID NO: 2768525 - DNA, 22 bp, Homo sapiens
accccagttctgctcctctcca

SEQ ID NO: 2768526 - DNA, 15 bp, Homo sapiens
accccatctctcttc

SEQ ID NO: 2768527 - DNA, 14 bp, Homo sapiens
acccccagccccga

SEQ ID NO: 2768528 - DNA, 20 bp, Homo sapiens
acccccagccccgactccag

SEQ ID NO: 2768529 - DNA, 13 bp, Homo sapiens
acccccagcctgg

SEQ ID NO: 2768530 - DNA, 14 bp, Homo sapiens
acccccagcctggg

SEQ ID NO: 2768531 - DNA, 15 bp, Homo sapiens
acccccagtgccaca

SEQ ID NO: 2768532 - DNA, 17 bp, Homo sapiens
acccccagtgccacaga

SEQ ID NO: 2768533 - DNA, 19 bp, Homo sapiens
acccccagtgccacagaga

SEQ ID NO: 2768534 - DNA, 11 bp, Homo sapiens
acccccagtgt

SEQ ID NO: 2768535 - DNA, 12 bp, Homo sapiens
accccccacctg

SEQ ID NO: 2768536 - DNA, 16 bp, Homo sapiens
acccccgtggtctttg

SEQ ID NO: 2768537 - DNA, 13 bp, Homo sapiens
accccctcccacc

SEQ ID NO: 2768538 - DNA, 19 bp, Homo sapiens
accccctcccacccccagc

SEQ ID NO: 2768539 - DNA, 12 bp, Homo sapiens
accccctggaga

SEQ ID NO: 2768540 - DNA, 18 bp, Homo sapiens
acccccttcagtgcccac

SEQ ID NO: 2768541 - DNA, 19 bp, Homo sapiens
acccccttctactgagcct

SEQ ID NO: 2768542 - DNA, 18 bp, Homo sapiens
accccgaccacctgccca

SEQ ID NO: 2768543 - DNA, 16 bp, Homo sapiens
acccctacatgaaaca

SEQ ID NO: 2768544 - DNA, 17 bp, Homo sapiens
acccctcccctcccccc

SEQ ID NO: 2768545 - DNA, 15 bp, Homo sapiens
acccctctcagcccc

SEQ ID NO: 2768546 - DNA, 20 bp, Homo sapiens
acccctgcaccagcccttcc

SEQ ID NO: 2768547 - DNA, 16 bp, Homo sapiens
accccttatccaggac

SEQ ID NO: 2768548 - DNA, 18 bp, Homo sapiens
accccttatccaggactc

SEQ ID NO: 2768549 - DNA, 11 bp, Homo sapiens
accccttcctt

SEQ ID NO: 2768550 - DNA, 16 bp, Homo sapiens
accccttcctttcctc

SEQ ID NO: 2768551 - DNA, 15 bp, Homo sapiens
acccgctctggacca

SEQ ID NO: 2768552 - DNA, 12 bp, Homo sapiens
acccggaaagac

SEQ ID NO: 2768553 - DNA, 22 bp, Homo sapiens
acccggcccagagaccccttcc

SEQ ID NO: 2768554 - DNA, 17 bp, Homo sapiens
acccggcccctgctggt

SEQ ID NO: 2768555 - DNA, 20 bp, Homo sapiens
acccggcccctgctggttca

SEQ ID NO: 2768556 - DNA, 17 bp, Homo sapiens
acccggctccccctgct

SEQ ID NO: 2768557 - DNA, 19 bp, Homo sapiens
acccggctccccctgcttc

SEQ ID NO: 2768558 - DNA, 23 bp, Homo sapiens
acccgtacccccgtggtctttga

SEQ ID NO: 2768559 - DNA, 16 bp, Homo sapiens
actatcacatacaatt

SEQ ID NO: 2768560 - DNA, 20 bp, Homo sapiens
actatcacatacaatttgca

SEQ ID NO: 2768561 - DNA, 23 bp, Homo sapiens
actatcacatacaatttgcactg

SEQ ID NO: 2768562 - DNA, 14 bp, Homo sapiens
actatctttctgat

SEQ ID NO: 2768563 - DNA, 16 bp, Homo sapiens
actatgaaaagctaga

SEQ ID NO: 2768564 - DNA, 18 bp, Homo sapiens
actatgaactacaaagct

SEQ ID NO: 2768565 - DNA, 15 bp, Homo sapiens
actatgacactgagc

SEQ ID NO: 2768566 - DNA, 16 bp, Homo sapiens
actatgatctcaggag

SEQ ID NO: 2768567 - DNA, 17 bp, Homo sapiens
actatggctgtattttt

SEQ ID NO: 2768568 - DNA, 16 bp, Homo sapiens
actatggtatttgagt

SEQ ID NO: 2768569 - DNA, 21 bp, Homo sapiens
actatggttcccaataaaagt

SEQ ID NO: 2768570 - DNA, 23 bp, Homo sapiens
actatggttcccaataaaagtga

SEQ ID NO: 2768571 - DNA, 18 bp, Homo sapiens
actatgtgtcatgatttc

SEQ ID NO: 2768572 - DNA, 16 bp, Homo sapiens
actatgttgcccaggc

SEQ ID NO: 2768573 - DNA, 17 bp, Homo sapiens
actattataatttaatg

SEQ ID NO: 2768574 - DNA, 18 bp, Homo sapiens
actattatccccatttct

SEQ ID NO: 2768575 - DNA, 17 bp, Homo sapiens
actattctgttaaaatc

SEQ ID NO: 2768576 - DNA, 19 bp, Homo sapiens
actattggagggtgggaga

SEQ ID NO: 2768577 - DNA, 12 bp, Homo sapiens
actatttatctg

SEQ ID NO: 2768578 - DNA, 15 bp, Homo sapiens
actcaaaatatttgt

SEQ ID NO: 2768579 - DNA, 19 bp, Homo sapiens
actcaaaatatttgtacat

SEQ ID NO: 2768580 - DNA, 15 bp, Homo sapiens
actcaagaggctgag

SEQ ID NO: 2768581 - DNA, 13 bp, Homo sapiens
actcaagctgcgt

SEQ ID NO: 2768582 - DNA, 18 bp, Homo sapiens
actcaatattttccatga

SEQ ID NO: 2768583 - DNA, 22 bp, Homo sapiens
actcaatattttccatgaaaat

SEQ ID NO: 2768584 - DNA, 14 bp, Homo sapiens
actcaatgcactga

SEQ ID NO: 2768585 - DNA, 16 bp, Homo sapiens
actcaatgcactgaca

SEQ ID NO: 2768586 - DNA, 14 bp, Homo sapiens
actcacacaggcat

SEQ ID NO: 2768587 - DNA, 12 bp, Homo sapiens
actcacatgccg

SEQ ID NO: 2768588 - DNA, 19 bp, Homo sapiens
actcacatggctatgtttt

SEQ ID NO: 2768589 - DNA, 20 bp, Homo sapiens
actcacatggctatgtttta

SEQ ID NO: 2768590 - DNA, 19 bp, Homo sapiens
actcacatttattctgctc

SEQ ID NO: 2768591 - DNA, 17 bp, Homo sapiens
actcacccatgtgccaa

SEQ ID NO: 2768592 - DNA, 18 bp, Homo sapiens
actcacccatgtgccaag

SEQ ID NO: 2768593 - DNA, 15 bp, Homo sapiens
actcacctgttactt

SEQ ID NO: 2768594 - DNA, 18 bp, Homo sapiens
actcactcttatgaaatg

SEQ ID NO: 2768595 - DNA, 15 bp, Homo sapiens
actcactgctcaaga

SEQ ID NO: 2768596 - DNA, 22 bp, Homo sapiens
actcactgctcaagaagacatg

SEQ ID NO: 2768597 - DNA, 12 bp, Homo sapiens
tataaatgcatg

SEQ ID NO: 2768598 - DNA, 17 bp, Homo sapiens
tataaatgcatgatttt

SEQ ID NO: 2768599 - DNA, 18 bp, Homo sapiens
tataaatgcatgatttta

SEQ ID NO: 2768600 - DNA, 13 bp, Homo sapiens
tataaatgtgtgg

SEQ ID NO: 2768601 - DNA, 13 bp, Homo sapiens
tataaccccacct

SEQ ID NO: 2768602 - DNA, 15 bp, Homo sapiens
tataaccccagctcc

SEQ ID NO: 2768603 - DNA, 16 bp, Homo sapiens
tataactcatcataaa

SEQ ID NO: 2768604 - DNA, 18 bp, Homo sapiens
tataacttaaaatatttt

SEQ ID NO: 2768605 - DNA, 21 bp, Homo sapiens
tataagcccaaatggctctgt

SEQ ID NO: 2768606 - DNA, 17 bp, Homo sapiens
tataatatactatattt

SEQ ID NO: 2768607 - DNA, 20 bp, Homo sapiens
tataatcttccatacttctt

SEQ ID NO: 2768608 - DNA, 20 bp, Homo sapiens
tataatggaaacatttacaa

SEQ ID NO: 2768609 - DNA, 12 bp, Homo sapiens
tataatggttta

SEQ ID NO: 2768610 - DNA, 19 bp, Homo sapiens
tataatggtttactgctgt

SEQ ID NO: 2768611 - DNA, 18 bp, Homo sapiens
tataatgtggatttccta

SEQ ID NO: 2768612 - DNA, 22 bp, Homo sapiens
tataatgtggatttcctatttt

SEQ ID NO: 2768613 - DNA, 17 bp, Homo sapiens
tataatgttgttattta

SEQ ID NO: 2768614 - DNA, 13 bp, Homo sapiens
tataattccctat

SEQ ID NO: 2768615 - DNA, 11 bp, Homo sapiens
tataattggga

SEQ ID NO: 2768616 - DNA, 17 bp, Homo sapiens
tataattttgcagcaga

SEQ ID NO: 2768617 - DNA, 13 bp, Homo sapiens
tatacaaaataat

SEQ ID NO: 2768618 - DNA, 18 bp, Homo sapiens
tatacaaaataatttaac

SEQ ID NO: 2768619 - DNA, 17 bp, Homo sapiens
tatacatacctctctct

SEQ ID NO: 2768620 - DNA, 16 bp, Homo sapiens
tatacatatcagaaaa

SEQ ID NO: 2768621 - DNA, 16 bp, Homo sapiens
tatacatattataaat

SEQ ID NO: 2768622 - DNA, 17 bp, Homo sapiens
tatacatattataaata

SEQ ID NO: 2768623 - DNA, 20 bp, Homo sapiens
tatacatattataaataaat

SEQ ID NO: 2768624 - DNA, 17 bp, Homo sapiens
tatacattctttatctt

SEQ ID NO: 2768625 - DNA, 22 bp, Homo sapiens
tatacattctttatcttgacat

SEQ ID NO: 2768626 - DNA, 22 bp, Homo sapiens
tatactaaaaaatgtctataga

SEQ ID NO: 2768627 - DNA, 16 bp, Homo sapiens
tatactatatttatgg

SEQ ID NO: 2768628 - DNA, 21 bp, Homo sapiens
tatagaatatttattacctct

SEQ ID NO: 2768629 - DNA, 16 bp, Homo sapiens
tatagacaaataataa

SEQ ID NO: 2768630 - DNA, 23 bp, Homo sapiens
tatagcaatccatgttagttttt

SEQ ID NO: 2768631 - DNA, 13 bp, Homo sapiens
tatagcccaggtc

SEQ ID NO: 2768632 - DNA, 16 bp, Homo sapiens
tatagctatcatttct

SEQ ID NO: 2768633 - DNA, 13 bp, Homo sapiens
tatagctattttt

SEQ ID NO: 2768634 - DNA, 17 bp, Homo sapiens
tatagctcttctattta

SEQ ID NO: 2768635 - DNA, 14 bp, Homo sapiens
tataggctggagaa

SEQ ID NO: 2768636 - DNA, 19 bp, Homo sapiens
tatagtagtcaattagtac

SEQ ID NO: 2768637 - DNA, 17 bp, Homo sapiens
tatagtatatttatact

SEQ ID NO: 2768638 - DNA, 19 bp, Homo sapiens
tatagtttattgacaataa

SEQ ID NO: 2768639 - DNA, 20 bp, Homo sapiens
tatagtttgctttgcttttt

SEQ ID NO: 2768640 - DNA, 21 bp, Homo sapiens
tatataatggtttactgctgt

SEQ ID NO: 2768641 - DNA, 22 bp, Homo sapiens
tatataatggtttactgctgtc

SEQ ID NO: 2768642 - DNA, 17 bp, Homo sapiens
tatatacaataacataa

SEQ ID NO: 2768643 - DNA, 13 bp, Homo sapiens
tatatacatgtat

SEQ ID NO: 2768644 - DNA, 18 bp, Homo sapiens
tatatacatgtatagtga

SEQ ID NO: 2768645 - DNA, 11 bp, Homo sapiens
tatatagtata

SEQ ID NO: 2768646 - DNA, 11 bp, Homo sapiens
tatatataaat

SEQ ID NO: 2768647 - DNA, 14 bp, Homo sapiens
tatatataaatata

SEQ ID NO: 2768648 - DNA, 15 bp, Homo sapiens
tatatatacatgtat

SEQ ID NO: 2768649 - DNA, 12 bp, Homo sapiens
tatatatagtaa

SEQ ID NO: 2768650 - DNA, 14 bp, Homo sapiens
tatatatatatatg

SEQ ID NO: 2768651 - DNA, 13 bp, Homo sapiens
tatatatatatgt

SEQ ID NO: 2768652 - DNA, 13 bp, Homo sapiens
tatatatatgtat

SEQ ID NO: 2768653 - DNA, 15 bp, Homo sapiens
tatatatatgtatat

SEQ ID NO: 2768654 - DNA, 14 bp, Homo sapiens
tatatatgtacagt

SEQ ID NO: 2768655 - DNA, 22 bp, Homo sapiens
tatatattctacacatatatgt

SEQ ID NO: 2768656 - DNA, 22 bp, Homo sapiens
tatatattggtaacatcctttc

SEQ ID NO: 2768657 - DNA, 15 bp, Homo sapiens
tatatatttataact

SEQ ID NO: 2768658 - DNA, 17 bp, Homo sapiens
tatatcaaggatgttct

SEQ ID NO: 2768659 - DNA, 21 bp, Homo sapiens
tatatcaaggatgttctggct

SEQ ID NO: 2768660 - DNA, 23 bp, Homo sapiens
tatatcagcctgagtctcctgtg

SEQ ID NO: 2768661 - DNA, 14 bp, Homo sapiens
tatatctaatttat

SEQ ID NO: 2768662 - DNA, 19 bp, Homo sapiens
tatatctaatttatacaaa

SEQ ID NO: 2768663 - DNA, 20 bp, Homo sapiens
tatatctaatttatacaaaa

SEQ ID NO: 2768664 - DNA, 14 bp, Homo sapiens
tatatctatctatt

SEQ ID NO: 2768665 - DNA, 15 bp, Homo sapiens
tatatctatcttata

SEQ ID NO: 2768666 - DNA, 14 bp, Homo sapiens
tatatctgtggtct

SEQ ID NO: 2768667 - DNA, 16 bp, Homo sapiens
tatatcttatgttaaa

SEQ ID NO: 2768668 - DNA, 17 bp, Homo sapiens
tatatgctcaaccagaa

SEQ ID NO: 2768669 - DNA, 20 bp, Homo sapiens
tatatgtacagttatacata

SEQ ID NO: 2768670 - DNA, 21 bp, Homo sapiens
tatatgtatatatatatagta

SEQ ID NO: 2768671 - DNA, 13 bp, Homo sapiens
tatatgtatatct

SEQ ID NO: 2768672 - DNA, 14 bp, Homo sapiens
tatatgtatatgta

SEQ ID NO: 2768673 - DNA, 18 bp, Homo sapiens
tatatgtatatgtatata

SEQ ID NO: 2768674 - DNA, 19 bp, Homo sapiens
tatatgttttaagaggcag

SEQ ID NO: 2768675 - DNA, 23 bp, Homo sapiens
tatattagcatttagtccaatgt

SEQ ID NO: 2768676 - DNA, 15 bp, Homo sapiens
tatatttaacaagat

SEQ ID NO: 2768677 - DNA, 13 bp, Homo sapiens
tatatttaattgt

SEQ ID NO: 2768678 - DNA, 14 bp, Homo sapiens
tatatttataactc

SEQ ID NO: 2768679 - DNA, 21 bp, Homo sapiens
tatatttataactcatcataa

SEQ ID NO: 2768680 - DNA, 12 bp, Homo sapiens
tatatttatact

SEQ ID NO: 2768681 - DNA, 13 bp, Homo sapiens
tatatttatactc

SEQ ID NO: 2768682 - DNA, 17 bp, Homo sapiens
tatatttgaatatcatt

SEQ ID NO: 2768683 - DNA, 14 bp, Homo sapiens
tatatttggaaaga

SEQ ID NO: 2768684 - DNA, 13 bp, Homo sapiens
tatatttttcaac

SEQ ID NO: 2768685 - DNA, 15 bp, Homo sapiens
tatatttttcacagt

SEQ ID NO: 2768686 - DNA, 21 bp, Homo sapiens
tatatttttgatggtaagact

SEQ ID NO: 2768687 - DNA, 15 bp, Homo sapiens
tatcaaaacatatca

SEQ ID NO: 2768688 - DNA, 18 bp, Homo sapiens
tagcttagacctcagcct

SEQ ID NO: 2768689 - DNA, 23 bp, Homo sapiens
tagcttagacctcagcctgtgct

SEQ ID NO: 2768690 - DNA, 19 bp, Homo sapiens
tagcttgaaggatctgttt

SEQ ID NO: 2768691 - DNA, 19 bp, Homo sapiens
tagctttattttttaagta

SEQ ID NO: 2768692 - DNA, 20 bp, Homo sapiens
tagctttattttttaagtat

SEQ ID NO: 2768693 - DNA, 15 bp, Homo sapiens
tagctttccacagga

SEQ ID NO: 2768694 - DNA, 18 bp, Homo sapiens
taggaacagagtatatat

SEQ ID NO: 2768695 - DNA, 13 bp, Homo sapiens
taggaagcatatg

SEQ ID NO: 2768696 - DNA, 23 bp, Homo sapiens
taggaagtgaccgagtctaggaa

SEQ ID NO: 2768697 - DNA, 15 bp, Homo sapiens
taggactctgaggct

SEQ ID NO: 2768698 - DNA, 14 bp, Homo sapiens
taggagaccaaggc

SEQ ID NO: 2768699 - DNA, 16 bp, Homo sapiens
taggagataccaggtt

SEQ ID NO: 2768700 - DNA, 22 bp, Homo sapiens
taggagataccaggttgaaaga

SEQ ID NO: 2768701 - DNA, 17 bp, Homo sapiens
taggagttcgagaccag

SEQ ID NO: 2768702 - DNA, 20 bp, Homo sapiens
taggatcatttgttggaatg

SEQ ID NO: 2768703 - DNA, 19 bp, Homo sapiens
taggatctatgcaattttt

SEQ ID NO: 2768704 - DNA, 18 bp, Homo sapiens
taggatgtttttcatgaa

SEQ ID NO: 2768705 - DNA, 21 bp, Homo sapiens
taggatttatttaaaatagca

SEQ ID NO: 2768706 - DNA, 16 bp, Homo sapiens
taggcatcccagggga

SEQ ID NO: 2768707 - DNA, 14 bp, Homo sapiens
taggccactcctcc

SEQ ID NO: 2768708 - DNA, 22 bp, Homo sapiens
taggctgccccgggtccccagc

SEQ ID NO: 2768709 - DNA, 12 bp, Homo sapiens
taggctggagaa

SEQ ID NO: 2768710 - DNA, 15 bp, Homo sapiens
taggctggagaagct

SEQ ID NO: 2768711 - DNA, 19 bp, Homo sapiens
taggctggagaagctcacc

SEQ ID NO: 2768712 - DNA, 14 bp, Homo sapiens
tagggctggaccta

SEQ ID NO: 2768713 - DNA, 23 bp, Homo sapiens
tagggctggactctggcacccag

SEQ ID NO: 2768714 - DNA, 15 bp, Homo sapiens
tagggtaaggtgcct

SEQ ID NO: 2768715 - DNA, 15 bp, Homo sapiens
taggtcaatgaaata

SEQ ID NO: 2768716 - DNA, 16 bp, Homo sapiens
taggtcaatgaaatat

SEQ ID NO: 2768717 - DNA, 19 bp, Homo sapiens
taggtttttttgtatagta

SEQ ID NO: 2768718 - DNA, 21 bp, Homo sapiens
tagtaactactttttatactc

SEQ ID NO: 2768719 - DNA, 22 bp, Homo sapiens
tagtaactactttttatactcc

SEQ ID NO: 2768720 - DNA, 16 bp, Homo sapiens
tagtaagaaaacatca

SEQ ID NO: 2768721 - DNA, 16 bp, Homo sapiens
tagtaatgggccaatt

SEQ ID NO: 2768722 - DNA, 19 bp, Homo sapiens
tagtaatgggccaattaaa

SEQ ID NO: 2768723 - DNA, 16 bp, Homo sapiens
tagtacagtagcttaa

SEQ ID NO: 2768724 - DNA, 23 bp, Homo sapiens
tagtacagtagcttaaataaatt

SEQ ID NO: 2768725 - DNA, 12 bp, Homo sapiens
tagtacataaag

SEQ ID NO: 2768726 - DNA, 21 bp, Homo sapiens
tagtacataaaggtggtatgt

SEQ ID NO: 2768727 - DNA, 17 bp, Homo sapiens
tagtactcctgcaaaat

SEQ ID NO: 2768728 - DNA, 13 bp, Homo sapiens
tagtagagacagg

SEQ ID NO: 2768729 - DNA, 22 bp, Homo sapiens
tagtagagacagggttttgcca

SEQ ID NO: 2768730 - DNA, 22 bp, Homo sapiens
tagtagttgatgaccaatctct

SEQ ID NO: 2768731 - DNA, 14 bp, Homo sapiens
tagtataaagaaaa

SEQ ID NO: 2768732 - DNA, 16 bp, Homo sapiens
tagtatatctggacaa

SEQ ID NO: 2768733 - DNA, 13 bp, Homo sapiens
tagtatcctgtta

SEQ ID NO: 2768734 - DNA, 14 bp, Homo sapiens
tagtattgaaagtg

SEQ ID NO: 2768735 - DNA, 16 bp, Homo sapiens
tagtatttatttaatg

SEQ ID NO: 2768736 - DNA, 16 bp, Homo sapiens
tagtcaattagtacag

SEQ ID NO: 2768737 - DNA, 17 bp, Homo sapiens
tagtcacttatttcata

SEQ ID NO: 2768738 - DNA, 14 bp, Homo sapiens
tagtcctattctat

SEQ ID NO: 2768739 - DNA, 14 bp, Homo sapiens
tagtctctgtgctt

SEQ ID NO: 2768740 - DNA, 23 bp, Homo sapiens
tagtctggtgttctgagtacttg

SEQ ID NO: 2768741 - DNA, 12 bp, Homo sapiens
tagtctggtttc

SEQ ID NO: 2768742 - DNA, 13 bp, Homo sapiens
tagtctggtttct

SEQ ID NO: 2768743 - DNA, 14 bp, Homo sapiens
tagtctgtcatcca

SEQ ID NO: 2768744 - DNA, 20 bp, Homo sapiens
tagtgagatttgtatttata

SEQ ID NO: 2768745 - DNA, 23 bp, Homo sapiens
tagtgagtgtggcttagtaatag

SEQ ID NO: 2768746 - DNA, 22 bp, Homo sapiens
tagtgccccctctaacccccag

SEQ ID NO: 2768747 - DNA, 23 bp, Homo sapiens
tagtgccctccacagccgcagcc

SEQ ID NO: 2768748 - DNA, 15 bp, Homo sapiens
tagtggcaataagtt

SEQ ID NO: 2768749 - DNA, 20 bp, Homo sapiens
tagtggcttaaaacaacact

SEQ ID NO: 2768750 - DNA, 18 bp, Homo sapiens
tagtggggtctccctctc

SEQ ID NO: 2768751 - DNA, 16 bp, Homo sapiens
tagtgtgttgtctgtg

SEQ ID NO: 2768752 - DNA, 22 bp, Homo sapiens
tagttaggaaataaaacctttc

SEQ ID NO: 2768753 - DNA, 21 bp, Homo sapiens
tagttaggtgtgccaaactac

SEQ ID NO: 2768754 - DNA, 18 bp, Homo sapiens
tagttcaggtaacaggca

SEQ ID NO: 2768755 - DNA, 17 bp, Homo sapiens
tagttcctttatttaat

SEQ ID NO: 2768756 - DNA, 19 bp, Homo sapiens
tagttgaacatctcacttt

SEQ ID NO: 2768757 - DNA, 20 bp, Homo sapiens
tagttgatgaccaatctctg

SEQ ID NO: 2768758 - DNA, 22 bp, Homo sapiens
tagttgatgaccaatctctgtg

SEQ ID NO: 2768759 - DNA, 18 bp, Homo sapiens
tagttgcagactcagttt

SEQ ID NO: 2768760 - DNA, 23 bp, Homo sapiens
tagttgcagactcagtttgtcag

SEQ ID NO: 2768761 - DNA, 15 bp, Homo sapiens
tagtttactatttta

SEQ ID NO: 2768762 - DNA, 14 bp, Homo sapiens
tagtttattttgtt

SEQ ID NO: 2768763 - DNA, 19 bp, Homo sapiens
tagtttcatataaagtatc

SEQ ID NO: 2768764 - DNA, 11 bp, Homo sapiens
tagtttggata

SEQ ID NO: 2768765 - DNA, 14 bp, Homo sapiens
tagttttaaatatg

SEQ ID NO: 2768766 - DNA, 15 bp, Homo sapiens
tagttttaaatatga

SEQ ID NO: 2768767 - DNA, 14 bp, Homo sapiens
tataaaaatacaac

SEQ ID NO: 2768768 - DNA, 17 bp, Homo sapiens
tataaacattaaaagaa

SEQ ID NO: 2768769 - DNA, 16 bp, Homo sapiens
tataaactagatctcc

SEQ ID NO: 2768770 - DNA, 23 bp, Homo sapiens
tataaacttagtgcggacaagtt

SEQ ID NO: 2768771 - DNA, 22 bp, Homo sapiens
tataaagaacaaggtagttttt

SEQ ID NO: 2768772 - DNA, 22 bp, Homo sapiens
tataaagtcaggacctggcttg

SEQ ID NO: 2768773 - DNA, 20 bp, Homo sapiens
tataaataaataaaaatatt

SEQ ID NO: 2768774 - DNA, 12 bp, Homo sapiens
tataaataaatg

SEQ ID NO: 2768775 - DNA, 13 bp, Homo sapiens
tataaataaatgc

SEQ ID NO: 2768776 - DNA, 14 bp, Homo sapiens
tataaataaatgcc

SEQ ID NO: 2768777 - DNA, 17 bp, Homo sapiens
tataaatatgaaatgat

SEQ ID NO: 2768778 - DNA, 21 bp, Homo sapiens
taccccacctcatgcctggcc

SEQ ID NO: 2768779 - DNA, 15 bp, Homo sapiens
tacccccgtggtctt

SEQ ID NO: 2768780 - DNA, 16 bp, Homo sapiens
tacccccgtggtcttt

SEQ ID NO: 2768781 - DNA, 22 bp, Homo sapiens
tacccggcccagagaccccttc

SEQ ID NO: 2768782 - DNA, 14 bp, Homo sapiens
tacccttctttaaa

SEQ ID NO: 2768783 - DNA, 18 bp, Homo sapiens
tacccttctttaaatcaa

SEQ ID NO: 2768784 - DNA, 15 bp, Homo sapiens
tacctaaacagatat

SEQ ID NO: 2768785 - DNA, 17 bp, Homo sapiens
tacctaccacagtgtct

SEQ ID NO: 2768786 - DNA, 18 bp, Homo sapiens
tacctaccacagtgtctg

SEQ ID NO: 2768787 - DNA, 13 bp, Homo sapiens
tacctagatttac

SEQ ID NO: 2768788 - DNA, 18 bp, Homo sapiens
tacctatggctgcctgca

SEQ ID NO: 2768789 - DNA, 17 bp, Homo sapiens
tacctcaacctatggta

SEQ ID NO: 2768790 - DNA, 16 bp, Homo sapiens
tacctcctgcccagga

SEQ ID NO: 2768791 - DNA, 14 bp, Homo sapiens
tacctctgtgtgct

SEQ ID NO: 2768792 - DNA, 19 bp, Homo sapiens
tacctctttgtcagtctgg

SEQ ID NO: 2768793 - DNA, 16 bp, Homo sapiens
tacctgtgtggacagg

SEQ ID NO: 2768794 - DNA, 21 bp, Homo sapiens
tacctgtgtttcttgcctcat

SEQ ID NO: 2768795 - DNA, 17 bp, Homo sapiens
taccttcaataaagtat

SEQ ID NO: 2768796 - DNA, 19 bp, Homo sapiens
taccttctctacccatctc

SEQ ID NO: 2768797 - DNA, 12 bp, Homo sapiens
tacctttgtcac

SEQ ID NO: 2768798 - DNA, 22 bp, Homo sapiens
tacgaacccctcccctcccccc

SEQ ID NO: 2768799 - DNA, 15 bp, Homo sapiens
tacgctctcctttct

SEQ ID NO: 2768800 - DNA, 21 bp, Homo sapiens
tacgctctcctttctttctaa

SEQ ID NO: 2768801 - DNA, 13 bp, Homo sapiens
tacgctctctgtc

SEQ ID NO: 2768802 - DNA, 16 bp, Homo sapiens
tacgtatttaatagca

SEQ ID NO: 2768803 - DNA, 18 bp, Homo sapiens
tacgtcaaacatgaagtg

SEQ ID NO: 2768804 - DNA, 16 bp, Homo sapiens
tacgtctgacaggcaa

SEQ ID NO: 2768805 - DNA, 11 bp, Homo sapiens
tactaaaagaa

SEQ ID NO: 2768806 - DNA, 11 bp, Homo sapiens
tactaaagcag

SEQ ID NO: 2768807 - DNA, 21 bp, Homo sapiens
tactacagttgttttttgaaa

SEQ ID NO: 2768808 - DNA, 13 bp, Homo sapiens
tactacatgcact

SEQ ID NO: 2768809 - DNA, 16 bp, Homo sapiens
tactactattctgtta

SEQ ID NO: 2768810 - DNA, 22 bp, Homo sapiens
tactactgtggaaaaatattta

SEQ ID NO: 2768811 - DNA, 23 bp, Homo sapiens
tactagaaagctctgcatgtgtg

SEQ ID NO: 2768812 - DNA, 15 bp, Homo sapiens
tactagaatttgtat

SEQ ID NO: 2768813 - DNA, 19 bp, Homo sapiens
tactagaatttgtattttg

SEQ ID NO: 2768814 - DNA, 14 bp, Homo sapiens
tactatatttatgg

SEQ ID NO: 2768815 - DNA, 16 bp, Homo sapiens
tactatgatctcagga

SEQ ID NO: 2768816 - DNA, 22 bp, Homo sapiens
tactatgatctcaggagcttgc

SEQ ID NO: 2768817 - DNA, 21 bp, Homo sapiens
tactatggaaagcagccatat

SEQ ID NO: 2768818 - DNA, 23 bp, Homo sapiens
tactatggctgtatttttagaga

SEQ ID NO: 2768819 - DNA, 18 bp, Homo sapiens
tactatgttaataacttg

SEQ ID NO: 2768820 - DNA, 12 bp, Homo sapiens
tactatttcaca

SEQ ID NO: 2768821 - DNA, 13 bp, Homo sapiens
tactatttcacaa

SEQ ID NO: 2768822 - DNA, 15 bp, Homo sapiens
tactcaagaggctga

SEQ ID NO: 2768823 - DNA, 21 bp, Homo sapiens
tactcacagtctctttaatct

SEQ ID NO: 2768824 - DNA, 14 bp, Homo sapiens
tactcagcagccct

SEQ ID NO: 2768825 - DNA, 17 bp, Homo sapiens
tactcagcagccctcct

SEQ ID NO: 2768826 - DNA, 19 bp, Homo sapiens
tactcagcagccctcctca

SEQ ID NO: 2768827 - DNA, 15 bp, Homo sapiens
tactccaagcttcaa

SEQ ID NO: 2768828 - DNA, 18 bp, Homo sapiens
tactccaagcttcaagtg

SEQ ID NO: 2768829 - DNA, 22 bp, Homo sapiens
tactccacagcggaggagacca

SEQ ID NO: 2768830 - DNA, 12 bp, Homo sapiens
tactcctgcaaa

SEQ ID NO: 2768831 - DNA, 14 bp, Homo sapiens
tactcctgcaaaat

SEQ ID NO: 2768832 - DNA, 12 bp, Homo sapiens
tactcctgtggg

SEQ ID NO: 2768833 - DNA, 20 bp, Homo sapiens
tactctagaacatgcacatt

SEQ ID NO: 2768834 - DNA, 21 bp, Homo sapiens
tactctagaacatgcacattt

SEQ ID NO: 2768835 - DNA, 14 bp, Homo sapiens
tactctgtgccaga

SEQ ID NO: 2768836 - DNA, 16 bp, Homo sapiens
tactctgtgccagagc

SEQ ID NO: 2768837 - DNA, 19 bp, Homo sapiens
tactctgtgccagagcctg

SEQ ID NO: 2768838 - DNA, 23 bp, Homo sapiens
tactctgtgccagagcctggggc

SEQ ID NO: 2768839 - DNA, 12 bp, Homo sapiens
tactctgtgtca

SEQ ID NO: 2768840 - DNA, 15 bp, Homo sapiens
tactgagccttgtaa

SEQ ID NO: 2768841 - DNA, 19 bp, Homo sapiens
tactgagccttgtaattct

SEQ ID NO: 2768842 - DNA, 22 bp, Homo sapiens
tactgcagaatacagtaagctg

SEQ ID NO: 2768843 - DNA, 19 bp, Homo sapiens
tactgcccaggcctgcctg

SEQ ID NO: 2768844 - DNA, 20 bp, Homo sapiens
tactgcccaggcctgcctgt

SEQ ID NO: 2768845 - DNA, 22 bp, Homo sapiens
tactgcccaggcctgcctgttc

SEQ ID NO: 2768846 - DNA, 18 bp, Homo sapiens
tactggaagttttgcatt

SEQ ID NO: 2768847 - DNA, 13 bp, Homo sapiens
tactgtgactgat

SEQ ID NO: 2768848 - DNA, 16 bp, Homo sapiens
tactgtggaaaaatat

SEQ ID NO: 2768849 - DNA, 20 bp, Homo sapiens
tacttaaatagcatctgctc

SEQ ID NO: 2768850 - DNA, 21 bp, Homo sapiens
tacttaaatagcatctgctct

SEQ ID NO: 2768851 - DNA, 17 bp, Homo sapiens
tacttaaatgaaagcat

SEQ ID NO: 2768852 - DNA, 17 bp, Homo sapiens
tacttaacattgattta

SEQ ID NO: 2768853 - DNA, 17 bp, Homo sapiens
tacttaactgtgtgaag

SEQ ID NO: 2768854 - DNA, 13 bp, Homo sapiens
tacttaataaatt

SEQ ID NO: 2768855 - DNA, 14 bp, Homo sapiens
tacttaataaattc

SEQ ID NO: 2768856 - DNA, 23 bp, Homo sapiens
tacttacatgcattactgcatgc

SEQ ID NO: 2768857 - DNA, 19 bp, Homo sapiens
tacttcactttaattctca

SEQ ID NO: 2768858 - DNA, 19 bp, Homo sapiens
tacttcattttcagagtga

SEQ ID NO: 2768859 - DNA, 19 bp, Homo sapiens
tacttcctatcaagccagt

SEQ ID NO: 2768860 - DNA, 22 bp, Homo sapiens
tacttcgtgtccgactcttctg

SEQ ID NO: 2768861 - DNA, 21 bp, Homo sapiens
tacttctctctatctggaatt

SEQ ID NO: 2768862 - DNA, 15 bp, Homo sapiens
tacttctgctacata

SEQ ID NO: 2768863 - DNA, 22 bp, Homo sapiens
tacttgcacaagcttgtatata

SEQ ID NO: 2768864 - DNA, 23 bp, Homo sapiens
tacttgggagacctgtaatcata

SEQ ID NO: 2768865 - DNA, 21 bp, Homo sapiens
tacttgtaatttctaactcct

SEQ ID NO: 2768866 - DNA, 15 bp, Homo sapiens
tacttgtggacacag

SEQ ID NO: 2768867 - DNA, 21 bp, Homo sapiens
tacttttaaacagtgagcctg

SEQ ID NO: 2768868 - DNA, 20 bp, Homo sapiens
tacttttgttctgtattttc

SEQ ID NO: 2768869 - DNA, 18 bp, Homo sapiens
tacttttttcttatttaa

SEQ ID NO: 2768870 - DNA, 14 bp, Homo sapiens
tagaaaacattcat

SEQ ID NO: 2768871 - DNA, 17 bp, Homo sapiens
tagaaagacagagctgg

SEQ ID NO: 2768872 - DNA, 17 bp, Homo sapiens
tagaaatcattttgcaa

SEQ ID NO: 2768873 - DNA, 14 bp, Homo sapiens
tagaaatgtatcct

SEQ ID NO: 2768874 - DNA, 19 bp, Homo sapiens
tagaaattacacccaaaga

SEQ ID NO: 2768875 - DNA, 18 bp, Homo sapiens
tagaaattagctgtgtga

SEQ ID NO: 2768876 - DNA, 16 bp, Homo sapiens
tagaaattgttcctga

SEQ ID NO: 2768877 - DNA, 23 bp, Homo sapiens
tagaacaatagctattgcatgta

SEQ ID NO: 2768878 - DNA, 14 bp, Homo sapiens
tagaacatgcacat

SEQ ID NO: 2768879 - DNA, 20 bp, Homo sapiens
tagaacatgcacatttatat

SEQ ID NO: 2768880 - DNA, 15 bp, Homo sapiens
tagaacctaattcaa

SEQ ID NO: 2768881 - DNA, 19 bp, Homo sapiens
tagaactcagttttaacta

SEQ ID NO: 2768882 - DNA, 23 bp, Homo sapiens
tagaactctccatcttattttca

SEQ ID NO: 2768883 - DNA, 15 bp, Homo sapiens
tagaagagcctgact

SEQ ID NO: 2768884 - DNA, 18 bp, Homo sapiens
tagaagagcctgactgtg

SEQ ID NO: 2768885 - DNA, 18 bp, Homo sapiens
tagaagcggtttccaggc

SEQ ID NO: 2768886 - DNA, 23 bp, Homo sapiens
tagaagtccaggcagagacaata

SEQ ID NO: 2768887 - DNA, 16 bp, Homo sapiens
tagaagtggaccagga

SEQ ID NO: 2768888 - DNA, 15 bp, Homo sapiens
tagaataaagaaaaa

SEQ ID NO: 2768889 - DNA, 12 bp, Homo sapiens
tagaatgacagt

SEQ ID NO: 2768890 - DNA, 17 bp, Homo sapiens
tagaatgtaaagcttgt

SEQ ID NO: 2768891 - DNA, 17 bp, Homo sapiens
tagaattatatctaatt

SEQ ID NO: 2768892 - DNA, 19 bp, Homo sapiens
tagaattatatctaattta

SEQ ID NO: 2768893 - DNA, 17 bp, Homo sapiens
tagaattgagtgtttaa

SEQ ID NO: 2768894 - DNA, 22 bp, Homo sapiens
tagaattgggaagctgggggaa

SEQ ID NO: 2768895 - DNA, 16 bp, Homo sapiens
tagaattttaagtgct

SEQ ID NO: 2768896 - DNA, 10 bp, Homo sapiens
tagacagagt

SEQ ID NO: 2768897 - DNA, 19 bp, Homo sapiens
tagacatttgtaaatgtaa

SEQ ID NO: 2768898 - DNA, 11 bp, Homo sapiens
tagacctcagc

SEQ ID NO: 2768899 - DNA, 21 bp, Homo sapiens
tagacctcagcctgtgctgcc

SEQ ID NO: 2768900 - DNA, 19 bp, Homo sapiens
tagactggaacttgaactg

SEQ ID NO: 2768901 - DNA, 21 bp, Homo sapiens
tagactttctcagtgggacaa

SEQ ID NO: 2768902 - DNA, 15 bp, Homo sapiens
tagagaagtatccaa

SEQ ID NO: 2768903 - DNA, 14 bp, Homo sapiens
tagagattaatttg

SEQ ID NO: 2768904 - DNA, 15 bp, Homo sapiens
tagagattaatttgt

SEQ ID NO: 2768905 - DNA, 13 bp, Homo sapiens
tagagcctggaag

SEQ ID NO: 2768906 - DNA, 23 bp, Homo sapiens
tagagggaggagaatgagcctcg

SEQ ID NO: 2768907 - DNA, 13 bp, Homo sapiens
tagagtcagcctt

SEQ ID NO: 2768908 - DNA, 20 bp, Homo sapiens
tagagtggcccagaattgca

SEQ ID NO: 2768909 - DNA, 16 bp, Homo sapiens
tagatccacacacaga

SEQ ID NO: 2768910 - DNA, 12 bp, Homo sapiens
tagatctcctgt

SEQ ID NO: 2768911 - DNA, 16 bp, Homo sapiens
tagatcttctgaaatg

SEQ ID NO: 2768912 - DNA, 15 bp, Homo sapiens
tagatgttttacaaa

SEQ ID NO: 2768913 - DNA, 16 bp, Homo sapiens
tagatgttttacaaat

SEQ ID NO: 2768914 - DNA, 14 bp, Homo sapiens
tagattagctctgg

SEQ ID NO: 2768915 - DNA, 19 bp, Homo sapiens
tagatttatgtaatgcttt

SEQ ID NO: 2768916 - DNA, 14 bp, Homo sapiens
tagcaaagaattga

SEQ ID NO: 2768917 - DNA, 12 bp, Homo sapiens
tagcaagacaca

SEQ ID NO: 2768918 - DNA, 17 bp, Homo sapiens
tagcaagttctagagaa

SEQ ID NO: 2768919 - DNA, 19 bp, Homo sapiens
tagcaagttctagagaaga

SEQ ID NO: 2768920 - DNA, 15 bp, Homo sapiens
tagcagacagtgttt

SEQ ID NO: 2768921 - DNA, 19 bp, Homo sapiens
tagcagagaatgaaagggc

SEQ ID NO: 2768922 - DNA, 18 bp, Homo sapiens
tagcagattttaattttg

SEQ ID NO: 2768923 - DNA, 13 bp, Homo sapiens
tagcagctgcagt

SEQ ID NO: 2768924 - DNA, 11 bp, Homo sapiens
tagcagggaaa

SEQ ID NO: 2768925 - DNA, 15 bp, Homo sapiens
tagcaggtggtcctg

SEQ ID NO: 2768926 - DNA, 12 bp, Homo sapiens
tagcatatcaat

SEQ ID NO: 2768927 - DNA, 12 bp, Homo sapiens
tagcatttcttg

SEQ ID NO: 2768928 - DNA, 21 bp, Homo sapiens
tagccaaggtgggctgagccc

SEQ ID NO: 2768929 - DNA, 23 bp, Homo sapiens
tagccacttaccttcaataaagt

SEQ ID NO: 2768930 - DNA, 13 bp, Homo sapiens
tagcccagcactg

SEQ ID NO: 2768931 - DNA, 16 bp, Homo sapiens
tagcccagcactgtga

SEQ ID NO: 2768932 - DNA, 19 bp, Homo sapiens
tagcccaggtcctctgata

SEQ ID NO: 2768933 - DNA, 15 bp, Homo sapiens
tagccgacctcagcc

SEQ ID NO: 2768934 - DNA, 18 bp, Homo sapiens
tagccgagagcctgctcc

SEQ ID NO: 2768935 - DNA, 19 bp, Homo sapiens
tagccgagagcctgctccc

SEQ ID NO: 2768936 - DNA, 18 bp, Homo sapiens
tagcctcacttttaatga

SEQ ID NO: 2768937 - DNA, 13 bp, Homo sapiens
tagccttctctgt

SEQ ID NO: 2768938 - DNA, 22 bp, Homo sapiens
tagccttctctgttcatttcct

SEQ ID NO: 2768939 - DNA, 17 bp, Homo sapiens
tagcgcccagttgggtg

SEQ ID NO: 2768940 - DNA, 17 bp, Homo sapiens
tagcgtgctcactgacc

SEQ ID NO: 2768941 - DNA, 14 bp, Homo sapiens
tagctatcatttct

SEQ ID NO: 2768942 - DNA, 14 bp, Homo sapiens
tagctattgcatgt

SEQ ID NO: 2768943 - DNA, 16 bp, Homo sapiens
tagctattgcatgtaa

SEQ ID NO: 2768944 - DNA, 22 bp, Homo sapiens
tagctattgcatgtaaaatgca

SEQ ID NO: 2768945 - DNA, 11 bp, Homo sapiens
tagctattttt

SEQ ID NO: 2768946 - DNA, 20 bp, Homo sapiens
tagctcaggtgtccctgcac

SEQ ID NO: 2768947 - DNA, 12 bp, Homo sapiens
tagctcagttta

SEQ ID NO: 2768948 - DNA, 11 bp, Homo sapiens
tagctgagctc

SEQ ID NO: 2768949 - DNA, 12 bp, Homo sapiens
tagctgcagaac

SEQ ID NO: 2768950 - DNA, 14 bp, Homo sapiens
tagctgtgacctgc

SEQ ID NO: 2768951 - DNA, 18 bp, Homo sapiens
tagctgtgacctgctgag

SEQ ID NO: 2768952 - DNA, 14 bp, Homo sapiens
tagctgtggtgagg

SEQ ID NO: 2768953 - DNA, 17 bp, Homo sapiens
tagctgttatttctatt

SEQ ID NO: 2768954 - DNA, 20 bp, Homo sapiens
tagctgttatttctattttt

SEQ ID NO: 2768955 - DNA, 14 bp, Homo sapiens
tagcttaaataaat

SEQ ID NO: 2768956 - DNA, 15 bp, Homo sapiens
tagcttaaataaatt

SEQ ID NO: 2768957 - DNA, 15 bp, Homo sapiens
tagcttagacctcag

SEQ ID NO: 2768958 - DNA, 16 bp, Homo sapiens
tagcttagacctcagc

SEQ ID NO: 2768959 - DNA, 22 bp, Homo sapiens
tatcaaaacatatcaattcaac

SEQ ID NO: 2768960 - DNA, 19 bp, Homo sapiens
tatcaaaactttcttttct

SEQ ID NO: 2768961 - DNA, 13 bp, Homo sapiens
tatcaaactgaag

SEQ ID NO: 2768962 - DNA, 19 bp, Homo sapiens
tatcaacctaagcaacaga

SEQ ID NO: 2768963 - DNA, 12 bp, Homo sapiens
tatcaagaaagt

SEQ ID NO: 2768964 - DNA, 23 bp, Homo sapiens
tatcaagccagtacgtgctaaca

SEQ ID NO: 2768965 - DNA, 15 bp, Homo sapiens
tatcaatagtcaaga

SEQ ID NO: 2768966 - DNA, 13 bp, Homo sapiens
tatcaattacagt

SEQ ID NO: 2768967 - DNA, 15 bp, Homo sapiens
tatcacatacaattt

SEQ ID NO: 2768968 - DNA, 18 bp, Homo sapiens
tatcacatacaatttgca

SEQ ID NO: 2768969 - DNA, 22 bp, Homo sapiens
tatcacatacaatttgcactgt

SEQ ID NO: 2768970 - DNA, 12 bp, Homo sapiens
tatcagaaaagt

SEQ ID NO: 2768971 - DNA, 14 bp, Homo sapiens
tatcagacctctga

SEQ ID NO: 2768972 - DNA, 16 bp, Homo sapiens
tatcagacctctgatc

SEQ ID NO: 2768973 - DNA, 22 bp, Homo sapiens
tatcagagttgcttttctaatc

SEQ ID NO: 2768974 - DNA, 17 bp, Homo sapiens
tatcaggtgctgccatc

SEQ ID NO: 2768975 - DNA, 20 bp, Homo sapiens
tatcaggtgctgccatccag

SEQ ID NO: 2768976 - DNA, 20 bp, Homo sapiens
tatcagtgacagagttcact

SEQ ID NO: 2768977 - DNA, 16 bp, Homo sapiens
tatcagttactcagcc

SEQ ID NO: 2768978 - DNA, 18 bp, Homo sapiens
tatcagttactcagccct

SEQ ID NO: 2768979 - DNA, 21 bp, Homo sapiens
tatcagttactcagccctggg

SEQ ID NO: 2768980 - DNA, 13 bp, Homo sapiens
tatcataaagtat

SEQ ID NO: 2768981 - DNA, 21 bp, Homo sapiens
tatcatcagcatacctttatt

SEQ ID NO: 2768982 - DNA, 23 bp, Homo sapiens
tatcatcagtgtagaacctaatt

SEQ ID NO: 2768983 - DNA, 20 bp, Homo sapiens
tatcatgaaacacttctcat

SEQ ID NO: 2768984 - DNA, 18 bp, Homo sapiens
tatcatgcccctgtactc

SEQ ID NO: 2768985 - DNA, 15 bp, Homo sapiens
tatcatggagtgacg

SEQ ID NO: 2768986 - DNA, 16 bp, Homo sapiens
tatcattaaattggaa

SEQ ID NO: 2768987 - DNA, 12 bp, Homo sapiens
tatccacccagc

SEQ ID NO: 2768988 - DNA, 13 bp, Homo sapiens
tatccacccagcc

SEQ ID NO: 2768989 - DNA, 14 bp, Homo sapiens
tatccacctggggt

SEQ ID NO: 2768990 - DNA, 15 bp, Homo sapiens
tatccactttgcaca

SEQ ID NO: 2768991 - DNA, 11 bp, Homo sapiens
tatccaggact

SEQ ID NO: 2768992 - DNA, 16 bp, Homo sapiens
tatcctgaaatttcag

SEQ ID NO: 2768993 - DNA, 14 bp, Homo sapiens
tatcctgataaaca

SEQ ID NO: 2768994 - DNA, 18 bp, Homo sapiens
tatcctgctagctgtaga

SEQ ID NO: 2768995 - DNA, 19 bp, Homo sapiens
tatcctgctagctgtagaa

SEQ ID NO: 2768996 - DNA, 16 bp, Homo sapiens
tatcctttgccccaag

SEQ ID NO: 2768997 - DNA, 17 bp, Homo sapiens
tatcctttgccccaagg

SEQ ID NO: 2768998 - DNA, 14 bp, Homo sapiens
tatcggaagcagtg

SEQ ID NO: 2768999 - DNA, 17 bp, Homo sapiens
tatcgggaacagtgttt

SEQ ID NO: 2769000 - DNA, 14 bp, Homo sapiens
tatcgggagcagtg

SEQ ID NO: 2769001 - DNA, 18 bp, Homo sapiens
tatcgggagcagtgtctt

SEQ ID NO: 2769002 - DNA, 15 bp, Homo sapiens
tatctaatacctctg

SEQ ID NO: 2769003 - DNA, 16 bp, Homo sapiens
tatctaatacctctgt

SEQ ID NO: 2769004 - DNA, 16 bp, Homo sapiens
tatctaatttatacaa

SEQ ID NO: 2769005 - DNA, 14 bp, Homo sapiens
tatctatatctcta

SEQ ID NO: 2769006 - DNA, 23 bp, Homo sapiens
tatctatatctctaaactgctgt

SEQ ID NO: 2769007 - DNA, 15 bp, Homo sapiens
tatctcagaggctat

SEQ ID NO: 2769008 - DNA, 16 bp, Homo sapiens
tatctctgtgtgcaca

SEQ ID NO: 2769009 - DNA, 17 bp, Homo sapiens
tatctctgtgtgcacaa

SEQ ID NO: 2769010 - DNA, 18 bp, Homo sapiens
tatctctgtgtgcacaaa

SEQ ID NO: 2769011 - DNA, 12 bp, Homo sapiens
tatctgaaaact

SEQ ID NO: 2769012 - DNA, 14 bp, Homo sapiens
tatctgaacacata

SEQ ID NO: 2769013 - DNA, 21 bp, Homo sapiens
tatctgaacacatactagaaa

SEQ ID NO: 2769014 - DNA, 19 bp, Homo sapiens
tatctgaagacctaccagg

SEQ ID NO: 2769015 - DNA, 13 bp, Homo sapiens
tatctgaggtcac

SEQ ID NO: 2769016 - DNA, 21 bp, Homo sapiens
tatctgatcgggataacaaaa

SEQ ID NO: 2769017 - DNA, 21 bp, Homo sapiens
tatctgtcatttgagcagggc

SEQ ID NO: 2769018 - DNA, 23 bp, Homo sapiens
tatctgtcatttgagcagggctc

SEQ ID NO: 2769019 - DNA, 23 bp, Homo sapiens
tatcttatttaatttttgcaatt

SEQ ID NO: 2769020 - DNA, 17 bp, Homo sapiens
tatcttgtctctgggct

SEQ ID NO: 2769021 - DNA, 21 bp, Homo sapiens
tatgaaaaactcttctacttt

SEQ ID NO: 2769022 - DNA, 16 bp, Homo sapiens
tatgaaaacagatgcc

SEQ ID NO: 2769023 - DNA, 20 bp, Homo sapiens
tatgaaagatggctgtgcct

SEQ ID NO: 2769024 - DNA, 22 bp, Homo sapiens
tatgaaagatggctgtgcctct

SEQ ID NO: 2769025 - DNA, 21 bp, Homo sapiens
tatgaaatgataaagatgtca

SEQ ID NO: 2769026 - DNA, 22 bp, Homo sapiens
tatgaaatgataaagatgtcaa

SEQ ID NO: 2769027 - DNA, 14 bp, Homo sapiens
tatgaaatgtttca

SEQ ID NO: 2769028 - DNA, 16 bp, Homo sapiens
tatgaacttgaggaca

SEQ ID NO: 2769029 - DNA, 18 bp, Homo sapiens
tatgaacttgaggacaca

SEQ ID NO: 2769030 - DNA, 19 bp, Homo sapiens
tatgaacttgaggacacat

SEQ ID NO: 2769031 - DNA, 12 bp, Homo sapiens
tatgaatacagg

SEQ ID NO: 2769032 - DNA, 19 bp, Homo sapiens
tatgacatcacttgtacaa

SEQ ID NO: 2769033 - DNA, 16 bp, Homo sapiens
tatgaccttctaggaa

SEQ ID NO: 2769034 - DNA, 18 bp, Homo sapiens
tatgagttgttttcagac

SEQ ID NO: 2769035 - DNA, 23 bp, Homo sapiens
tatgagtttttgatagctttatt

SEQ ID NO: 2769036 - DNA, 12 bp, Homo sapiens
tatgatttaaaa

SEQ ID NO: 2769037 - DNA, 21 bp, Homo sapiens
tatgatttaaaaaataaatat

SEQ ID NO: 2769038 - DNA, 18 bp, Homo sapiens
tatgcaatttttaaacta

SEQ ID NO: 2769039 - DNA, 13 bp, Homo sapiens
tatgcacatatgg

SEQ ID NO: 2769040 - DNA, 19 bp, Homo sapiens
tatgcacatatggactctg

SEQ ID NO: 2769041 - DNA, 19 bp, Homo sapiens
tatgcaccttgtgtctgta

SEQ ID NO: 2769042 - DNA, 17 bp, Homo sapiens
tatgccagctcagtccc

SEQ ID NO: 2769043 - DNA, 22 bp, Homo sapiens
tatgccatagcaagattgctta

SEQ ID NO: 2769044 - DNA, 14 bp, Homo sapiens
tatgcctcatgctg

SEQ ID NO: 2769045 - DNA, 14 bp, Homo sapiens
tatgcctgctattt

SEQ ID NO: 2769046 - DNA, 13 bp, Homo sapiens
tatgctaatcagg

SEQ ID NO: 2769047 - DNA, 16 bp, Homo sapiens
tatgctgccaaatttt

SEQ ID NO: 2769048 - DNA, 13 bp, Homo sapiens
tatgcttatttta

SEQ ID NO: 2769049 - DNA, 21 bp, Homo sapiens
tcacgcccagcctcctcccac

SEQ ID NO: 2769050 - DNA, 18 bp, Homo sapiens
tcacgcctataatcccag

SEQ ID NO: 2769051 - DNA, 21 bp, Homo sapiens
tcacgcctatgatcccagcac

SEQ ID NO: 2769052 - DNA, 22 bp, Homo sapiens
tcacgcctgtaatcccagcact

SEQ ID NO: 2769053 - DNA, 22 bp, Homo sapiens
tcacgtgaaatatttaagtata

SEQ ID NO: 2769054 - DNA, 17 bp, Homo sapiens
tcactagatggcgagca

SEQ ID NO: 2769055 - DNA, 13 bp, Homo sapiens
tcactagcagctg

SEQ ID NO: 2769056 - DNA, 13 bp, Homo sapiens
tcactataaatgg

SEQ ID NO: 2769057 - DNA, 16 bp, Homo sapiens
tcactatctttctgat

SEQ ID NO: 2769058 - DNA, 15 bp, Homo sapiens
tcactatgacactga

SEQ ID NO: 2769059 - DNA, 16 bp, Homo sapiens
tcactccaccacccaa

SEQ ID NO: 2769060 - DNA, 14 bp, Homo sapiens
tcactccggtgtgc

SEQ ID NO: 2769061 - DNA, 17 bp, Homo sapiens
tcactccggtgtgcctg

SEQ ID NO: 2769062 - DNA, 12 bp, Homo sapiens
tcactctgtcgc

SEQ ID NO: 2769063 - DNA, 19 bp, Homo sapiens
tcactctgtcgcccagtct

SEQ ID NO: 2769064 - DNA, 17 bp, Homo sapiens
tcactcttatgaaatgg

SEQ ID NO: 2769065 - DNA, 20 bp, Homo sapiens
tcactcttattgcccacgct

SEQ ID NO: 2769066 - DNA, 19 bp, Homo sapiens
tcactcttcctgcaaggac

SEQ ID NO: 2769067 - DNA, 16 bp, Homo sapiens
tcactgaccctggagc

SEQ ID NO: 2769068 - DNA, 12 bp, Homo sapiens
tcactgccttcc

SEQ ID NO: 2769069 - DNA, 15 bp, Homo sapiens
tcactgccttccagg

SEQ ID NO: 2769070 - DNA, 18 bp, Homo sapiens
tcactgctggggagtccc

SEQ ID NO: 2769071 - DNA, 18 bp, Homo sapiens
tcactggaccactgggca

SEQ ID NO: 2769072 - DNA, 18 bp, Homo sapiens
tcactggagcaccaggca

SEQ ID NO: 2769073 - DNA, 11 bp, Homo sapiens
tcactggagcc

SEQ ID NO: 2769074 - DNA, 15 bp, Homo sapiens
tcactggagcccagg

SEQ ID NO: 2769075 - DNA, 17 bp, Homo sapiens
tcactggagcccaggag

SEQ ID NO: 2769076 - DNA, 19 bp, Homo sapiens
tcactggggtcctggggcc

SEQ ID NO: 2769077 - DNA, 20 bp, Homo sapiens
tcactggggtcctggggcct

SEQ ID NO: 2769078 - DNA, 16 bp, Homo sapiens
tcactgtaagtttatt

SEQ ID NO: 2769079 - DNA, 21 bp, Homo sapiens
tcactgtagaatgatttcatg

SEQ ID NO: 2769080 - DNA, 16 bp, Homo sapiens
tcactgttgcccaggc

SEQ ID NO: 2769081 - DNA, 23 bp, Homo sapiens
tcactgttgcccaggctggcgtg

SEQ ID NO: 2769082 - DNA, 17 bp, Homo sapiens
tcacttaatgaaccacg

SEQ ID NO: 2769083 - DNA, 15 bp, Homo sapiens
tcacttgtacaaaat

SEQ ID NO: 2769084 - DNA, 16 bp, Homo sapiens
tcacttgtacaaaata

SEQ ID NO: 2769085 - DNA, 17 bp, Homo sapiens
tcacttgtacaaaataa

SEQ ID NO: 2769086 - DNA, 15 bp, Homo sapiens
tcactttaattctca

SEQ ID NO: 2769087 - DNA, 12 bp, Homo sapiens
tcacttttcctc

SEQ ID NO: 2769088 - DNA, 13 bp, Homo sapiens
tcacttttcctcc

SEQ ID NO: 2769089 - DNA, 18 bp, Homo sapiens
tcacttttcctccctcag

SEQ ID NO: 2769090 - DNA, 13 bp, Homo sapiens
tcacttttctgta

SEQ ID NO: 2769091 - DNA, 21 bp, Homo sapiens
tcacttttctgtaacgcctgc

SEQ ID NO: 2769092 - DNA, 13 bp, Homo sapiens
tcagaaaagtaga

SEQ ID NO: 2769093 - DNA, 17 bp, Homo sapiens
tcagaaaagtagaatta

SEQ ID NO: 2769094 - DNA, 18 bp, Homo sapiens
tcagaaaagtagaattat

SEQ ID NO: 2769095 - DNA, 22 bp, Homo sapiens
tcagaaaccagttatgtgaatg

SEQ ID NO: 2769096 - DNA, 17 bp, Homo sapiens
tcagaaagcattacatt

SEQ ID NO: 2769097 - DNA, 17 bp, Homo sapiens
tcagaaagggagggctc

SEQ ID NO: 2769098 - DNA, 23 bp, Homo sapiens
tcagaaagggagggctctgaggc

SEQ ID NO: 2769099 - DNA, 23 bp, Homo sapiens
tcagaacagcagactcagctctg

SEQ ID NO: 2769100 - DNA, 17 bp, Homo sapiens
tcagaacatcctccaat

SEQ ID NO: 2769101 - DNA, 18 bp, Homo sapiens
tcagaagaaaaagaagca

SEQ ID NO: 2769102 - DNA, 16 bp, Homo sapiens
tcagaagcctgggggc

SEQ ID NO: 2769103 - DNA, 12 bp, Homo sapiens
tcagaatccaaa

SEQ ID NO: 2769104 - DNA, 23 bp, Homo sapiens
tcagaccataatgttacattatt

SEQ ID NO: 2769105 - DNA, 13 bp, Homo sapiens
tcagaccctaccc

SEQ ID NO: 2769106 - DNA, 14 bp, Homo sapiens
tcagaccctacccc

SEQ ID NO: 2769107 - DNA, 16 bp, Homo sapiens
tcagacctctgatccc

SEQ ID NO: 2769108 - DNA, 13 bp, Homo sapiens
tcagactgctggg

SEQ ID NO: 2769109 - DNA, 15 bp, Homo sapiens
tcagactgctgggac

SEQ ID NO: 2769110 - DNA, 16 bp, Homo sapiens
tcagactgctgggact

SEQ ID NO: 2769111 - DNA, 20 bp, Homo sapiens
tcagactggctggctgcagt

SEQ ID NO: 2769112 - DNA, 20 bp, Homo sapiens
tcagagactcagggccccag

SEQ ID NO: 2769113 - DNA, 22 bp, Homo sapiens
tcagagaggccttttggaatgt

SEQ ID NO: 2769114 - DNA, 15 bp, Homo sapiens
tcagagcctgcagtt

SEQ ID NO: 2769115 - DNA, 18 bp, Homo sapiens
tcagagcctgcagttatt

SEQ ID NO: 2769116 - DNA, 14 bp, Homo sapiens
tcagaggccctgga

SEQ ID NO: 2769117 - DNA, 13 bp, Homo sapiens
tcagaggctgcag

SEQ ID NO: 2769118 - DNA, 16 bp, Homo sapiens
tcagaggctgggggag

SEQ ID NO: 2769119 - DNA, 23 bp, Homo sapiens
tcagagtgacacccaagagggct

SEQ ID NO: 2769120 - DNA, 17 bp, Homo sapiens
tcagagttgctttaaag

SEQ ID NO: 2769121 - DNA, 22 bp, Homo sapiens
tcagatattttttcagaaatat

SEQ ID NO: 2769122 - DNA, 19 bp, Homo sapiens
tcagatcgtattaattatc

SEQ ID NO: 2769123 - DNA, 14 bp, Homo sapiens
tcagattcccagag

SEQ ID NO: 2769124 - DNA, 19 bp, Homo sapiens
tcagcaagacttctctttg

SEQ ID NO: 2769125 - DNA, 13 bp, Homo sapiens
gtgcccacaggga

SEQ ID NO: 2769126 - DNA, 15 bp, Homo sapiens
gtgcccacagggacc

SEQ ID NO: 2769127 - DNA, 13 bp, Homo sapiens
gtgcccaggagaa

SEQ ID NO: 2769128 - DNA, 19 bp, Homo sapiens
gtgcccaggggcccacagg

SEQ ID NO: 2769129 - DNA, 13 bp, Homo sapiens
gtgccccccttgc

SEQ ID NO: 2769130 - DNA, 12 bp, Homo sapiens
gtgcccctgtaa

SEQ ID NO: 2769131 - DNA, 20 bp, Homo sapiens
gtgccctccacagccgcagc

SEQ ID NO: 2769132 - DNA, 18 bp, Homo sapiens
gtgccctgacccctgcac

SEQ ID NO: 2769133 - DNA, 22 bp, Homo sapiens
gtgccgtgaactgcgtgccagt

SEQ ID NO: 2769134 - DNA, 15 bp, Homo sapiens
gtgccgttactctcc

SEQ ID NO: 2769135 - DNA, 14 bp, Homo sapiens
gtgcctcctgtctt

SEQ ID NO: 2769136 - DNA, 15 bp, Homo sapiens
gtgcctctgcctgtc

SEQ ID NO: 2769137 - DNA, 14 bp, Homo sapiens
gtgcctggcaaggc

SEQ ID NO: 2769138 - DNA, 18 bp, Homo sapiens
gtgcctggcgcccctgcc

SEQ ID NO: 2769139 - DNA, 18 bp, Homo sapiens
gtgcctgggtggggctgc

SEQ ID NO: 2769140 - DNA, 15 bp, Homo sapiens
gtgcctgtgaggcag

SEQ ID NO: 2769141 - DNA, 18 bp, Homo sapiens
gtgccttacctcctgccc

SEQ ID NO: 2769142 - DNA, 19 bp, Homo sapiens
gtgccttacctcctgccca

SEQ ID NO: 2769143 - DNA, 19 bp, Homo sapiens
gtgccttcttattctcact

SEQ ID NO: 2769144 - DNA, 23 bp, Homo sapiens
gtgccttcttattctcactccac

SEQ ID NO: 2769145 - DNA, 13 bp, Homo sapiens
gtgccttggagca

SEQ ID NO: 2769146 - DNA, 17 bp, Homo sapiens
gtgcgacttcacaaaat

SEQ ID NO: 2769147 - DNA, 22 bp, Homo sapiens
gtgctaaatggtcgcccaggag

SEQ ID NO: 2769148 - DNA, 16 bp, Homo sapiens
gtgctaaattttcagt

SEQ ID NO: 2769149 - DNA, 16 bp, Homo sapiens
gtgctataggctggag

SEQ ID NO: 2769150 - DNA, 19 bp, Homo sapiens
gtgctataggctggagaag

SEQ ID NO: 2769151 - DNA, 17 bp, Homo sapiens
gtgctctggacaggcat

SEQ ID NO: 2769152 - DNA, 22 bp, Homo sapiens
gtgctgatcgtgctaaattttc

SEQ ID NO: 2769153 - DNA, 18 bp, Homo sapiens
gtgctgccatccaggttc

SEQ ID NO: 2769154 - DNA, 22 bp, Homo sapiens
gtgctgcgagatcgctggcaga

SEQ ID NO: 2769155 - DNA, 20 bp, Homo sapiens
gtgctgggattacaggtgta

SEQ ID NO: 2769156 - DNA, 14 bp, Homo sapiens
gtgctgtggccagg

SEQ ID NO: 2769157 - DNA, 16 bp, Homo sapiens
gtgctgtggccagggt

SEQ ID NO: 2769158 - DNA, 16 bp, Homo sapiens
gtgctgtggcctgggc

SEQ ID NO: 2769159 - DNA, 12 bp, Homo sapiens
gtgctgtttgag

SEQ ID NO: 2769160 - DNA, 20 bp, Homo sapiens
gtgctgtttgagatgtgatg

SEQ ID NO: 2769161 - DNA, 15 bp, Homo sapiens
gtgcttacagtgact

SEQ ID NO: 2769162 - DNA, 14 bp, Homo sapiens
gtgcttagaaagtt

SEQ ID NO: 2769163 - DNA, 15 bp, Homo sapiens
gtgcttcaattaata

SEQ ID NO: 2769164 - DNA, 15 bp, Homo sapiens
gtgcttcagcctgag

SEQ ID NO: 2769165 - DNA, 18 bp, Homo sapiens
gtgcttcagcctgaggct

SEQ ID NO: 2769166 - DNA, 14 bp, Homo sapiens
gtggaaaaaagaga

SEQ ID NO: 2769167 - DNA, 14 bp, Homo sapiens
gtggaaaaatattt

SEQ ID NO: 2769168 - DNA, 15 bp, Homo sapiens
gtggaaaaatattta

SEQ ID NO: 2769169 - DNA, 12 bp, Homo sapiens
gtggacacctgc

SEQ ID NO: 2769170 - DNA, 13 bp, Homo sapiens
gtggacacctgcc

SEQ ID NO: 2769171 - DNA, 17 bp, Homo sapiens
gtggacacctgccctgc

SEQ ID NO: 2769172 - DNA, 13 bp, Homo sapiens
gtggacagtcctg

SEQ ID NO: 2769173 - DNA, 14 bp, Homo sapiens
gtggacagtcctgg

SEQ ID NO: 2769174 - DNA, 13 bp, Homo sapiens
gtggaccaggaca

SEQ ID NO: 2769175 - DNA, 14 bp, Homo sapiens
gtggaccaggacag

SEQ ID NO: 2769176 - DNA, 22 bp, Homo sapiens
gtggacccagggatgacatgtc

SEQ ID NO: 2769177 - DNA, 17 bp, Homo sapiens
gtggactctgcacatgt

SEQ ID NO: 2769178 - DNA, 23 bp, Homo sapiens
gtggagaaataaaaatacctctt

SEQ ID NO: 2769179 - DNA, 22 bp, Homo sapiens
gtggagaaattccttgattcac

SEQ ID NO: 2769180 - DNA, 23 bp, Homo sapiens
gtggagagtgagaataattgtgt

SEQ ID NO: 2769181 - DNA, 16 bp, Homo sapiens
gtggaggaagatccaa

SEQ ID NO: 2769182 - DNA, 23 bp, Homo sapiens
gtggaggagctcaggacactaat

SEQ ID NO: 2769183 - DNA, 19 bp, Homo sapiens
gtggagggtcgccacaccc

SEQ ID NO: 2769184 - DNA, 17 bp, Homo sapiens
gtggaggttgcagtgag

SEQ ID NO: 2769185 - DNA, 16 bp, Homo sapiens
tcagcactcagaaaag

SEQ ID NO: 2769186 - DNA, 12 bp, Homo sapiens
tcagcagccctc

SEQ ID NO: 2769187 - DNA, 16 bp, Homo sapiens
tcagcagccctcctca

SEQ ID NO: 2769188 - DNA, 17 bp, Homo sapiens
tcagcagttaccgagga

SEQ ID NO: 2769189 - DNA, 19 bp, Homo sapiens
tcagcatttaataaatgta

SEQ ID NO: 2769190 - DNA, 16 bp, Homo sapiens
tcagccaaatgtaatt

SEQ ID NO: 2769191 - DNA, 23 bp, Homo sapiens
tcagccaaatgtaattgaataaa

SEQ ID NO: 2769192 - DNA, 14 bp, Homo sapiens
tcagccacacctgt

SEQ ID NO: 2769193 - DNA, 13 bp, Homo sapiens
tcagccagggcca

SEQ ID NO: 2769194 - DNA, 21 bp, Homo sapiens
tcagccatgaggagttgctgt

SEQ ID NO: 2769195 - DNA, 18 bp, Homo sapiens
tcagccccgggcctgcct

SEQ ID NO: 2769196 - DNA, 19 bp, Homo sapiens
tcagccccgggcctgcctc

SEQ ID NO: 2769197 - DNA, 13 bp, Homo sapiens
tcagcccctcctc

SEQ ID NO: 2769198 - DNA, 17 bp, Homo sapiens
tcagcccctcctctgcc

SEQ ID NO: 2769199 - DNA, 18 bp, Homo sapiens
tcagcccctcctctgcca

SEQ ID NO: 2769200 - DNA, 19 bp, Homo sapiens
tcagccctgggccccacca

SEQ ID NO: 2769201 - DNA, 22 bp, Homo sapiens
tcagccctgggccccaccacct

SEQ ID NO: 2769202 - DNA, 12 bp, Homo sapiens
tcagcctcccaa

SEQ ID NO: 2769203 - DNA, 14 bp, Homo sapiens
tcagcctcccaaag

SEQ ID NO: 2769204 - DNA, 17 bp, Homo sapiens
tcagcctcccaacccca

SEQ ID NO: 2769205 - DNA, 12 bp, Homo sapiens
tcagcctccccc

SEQ ID NO: 2769206 - DNA, 17 bp, Homo sapiens
tcagcctccccccgctg

SEQ ID NO: 2769207 - DNA, 12 bp, Homo sapiens
tcagcctcccga

SEQ ID NO: 2769208 - DNA, 21 bp, Homo sapiens
tcagcctcccgaatagctggg

SEQ ID NO: 2769209 - DNA, 22 bp, Homo sapiens
tcagcctcccgaatagctggga

SEQ ID NO: 2769210 - DNA, 18 bp, Homo sapiens
tcagcctcccgagtagct

SEQ ID NO: 2769211 - DNA, 10 bp, Homo sapiens
tcagcctgag

SEQ ID NO: 2769212 - DNA, 18 bp, Homo sapiens
tcagcctgaggctgagac

SEQ ID NO: 2769213 - DNA, 11 bp, Homo sapiens
tcagcctgagt

SEQ ID NO: 2769214 - DNA, 15 bp, Homo sapiens
tcagcctgagtctcc

SEQ ID NO: 2769215 - DNA, 19 bp, Homo sapiens
tcagcctgagtctcctgtg

SEQ ID NO: 2769216 - DNA, 22 bp, Homo sapiens
tcagccttccccctcccagggc

SEQ ID NO: 2769217 - DNA, 21 bp, Homo sapiens
tcagccttccccttgcccagg

SEQ ID NO: 2769218 - DNA, 22 bp, Homo sapiens
tcagccttccccttgcccaggg

SEQ ID NO: 2769219 - DNA, 15 bp, Homo sapiens
tcagcggggacagct

SEQ ID NO: 2769220 - DNA, 17 bp, Homo sapiens
tcagcggggacagctcc

SEQ ID NO: 2769221 - DNA, 20 bp, Homo sapiens
tcagcggggacagctccttc

SEQ ID NO: 2769222 - DNA, 21 bp, Homo sapiens
tcagcggggacagctccttct

SEQ ID NO: 2769223 - DNA, 13 bp, Homo sapiens
tcagcgtggcctt

SEQ ID NO: 2769224 - DNA, 14 bp, Homo sapiens
tcagcgtggccttg

SEQ ID NO: 2769225 - DNA, 14 bp, Homo sapiens
tcagctccagctca

SEQ ID NO: 2769226 - DNA, 18 bp, Homo sapiens
tcagctccagctcaccag

SEQ ID NO: 2769227 - DNA, 21 bp, Homo sapiens
tcagctccagctcaccagccc

SEQ ID NO: 2769228 - DNA, 23 bp, Homo sapiens
tcagctccagctcaccagcccca

SEQ ID NO: 2769229 - DNA, 24 bp, Homo sapiens
tcagctccagctcaccagccccag

SEQ ID NO: 2769230 - DNA, 14 bp, Homo sapiens
tcagctgctcgcac

SEQ ID NO: 2769231 - DNA, 17 bp, Homo sapiens
tcagctgctcgcacaga

SEQ ID NO: 2769232 - DNA, 15 bp, Homo sapiens
tcagctgtttgtcat

SEQ ID NO: 2769233 - DNA, 16 bp, Homo sapiens
tcagcttttaataaaa

SEQ ID NO: 2769234 - DNA, 18 bp, Homo sapiens
tcagcttttaataaaatt

SEQ ID NO: 2769235 - DNA, 18 bp, Homo sapiens
tcagctttttgtcttttc

SEQ ID NO: 2769236 - DNA, 20 bp, Homo sapiens
tcagctttttgtcttttctg

SEQ ID NO: 2769237 - DNA, 16 bp, Homo sapiens
tcaggaaaaggcctgg

SEQ ID NO: 2769238 - DNA, 18 bp, Homo sapiens
tcaggaaaaggcctgggg

SEQ ID NO: 2769239 - DNA, 19 bp, Homo sapiens
tcaggaaaaggcctggggt

SEQ ID NO: 2769240 - DNA, 14 bp, Homo sapiens
tcaggaaagacgga

SEQ ID NO: 2769241 - DNA, 13 bp, Homo sapiens
tcaggaacagaag

SEQ ID NO: 2769242 - DNA, 16 bp, Homo sapiens
tcaggacctggcttgg

SEQ ID NO: 2769243 - DNA, 20 bp, Homo sapiens
tcaggacttaacggctccag

SEQ ID NO: 2769244 - DNA, 15 bp, Homo sapiens
tcaggacttgggaaa

SEQ ID NO: 2769245 - DNA, 11 bp, Homo sapiens
tcaggagcaca

SEQ ID NO: 2769246 - DNA, 18 bp, Homo sapiens
tcaggagcacaggcagct

SEQ ID NO: 2769247 - DNA, 12 bp, Homo sapiens
tcaggagcttgc

SEQ ID NO: 2769248 - DNA, 18 bp, Homo sapiens
tcaggaggctgaggggag

SEQ ID NO: 2769249 - DNA, 20 bp, Homo sapiens
tcaggatcaaaccccgacca

SEQ ID NO: 2769250 - DNA, 16 bp, Homo sapiens
tcaggattttagtgct

SEQ ID NO: 2769251 - DNA, 13 bp, Homo sapiens
tcaggccacttga

SEQ ID NO: 2769252 - DNA, 17 bp, Homo sapiens
tcaggccaggtgcagtg

SEQ ID NO: 2769253 - DNA, 18 bp, Homo sapiens
tcaggccaggtgcagtgg

SEQ ID NO: 2769254 - DNA, 18 bp, Homo sapiens
tcaggcctataaccccag

SEQ ID NO: 2769255 - DNA, 15 bp, Homo sapiens
tcaggcttccttggc

SEQ ID NO: 2769256 - DNA, 18 bp, Homo sapiens
tcaggcttgaaatgcatt

SEQ ID NO: 2769257 - DNA, 15 bp, Homo sapiens
tcagggatcttgcat

SEQ ID NO: 2769258 - DNA, 23 bp, Homo sapiens
tcagggccccagcactaaagcag

SEQ ID NO: 2769259 - DNA, 24 bp, Homo sapiens
tcagggctggaaaagtcacacaga

SEQ ID NO: 2769260 - DNA, 20 bp, Homo sapiens
tcaggggggttgtgaggcct

SEQ ID NO: 2769261 - DNA, 23 bp, Homo sapiens
tcaggggtcgtcaccacctctcc

SEQ ID NO: 2769262 - DNA, 15 bp, Homo sapiens
tcagggtccagaccc

SEQ ID NO: 2769263 - DNA, 13 bp, Homo sapiens
tcaggtaacaggc

SEQ ID NO: 2769264 - DNA, 15 bp, Homo sapiens
tcaggtaacaggcag

SEQ ID NO: 2769265 - DNA, 21 bp, Homo sapiens
tcaggtaacaggcagatacag

SEQ ID NO: 2769266 - DNA, 13 bp, Homo sapiens
tcaggtcaataac

SEQ ID NO: 2769267 - DNA, 23 bp, Homo sapiens
tcaggtgatccacccacctcagc

SEQ ID NO: 2769268 - DNA, 13 bp, Homo sapiens
tcaggtgctgcca

SEQ ID NO: 2769269 - DNA, 14 bp, Homo sapiens
tcaggtgctgccat

SEQ ID NO: 2769270 - DNA, 15 bp, Homo sapiens
tcaggtgctgccatc

SEQ ID NO: 2769271 - DNA, 18 bp, Homo sapiens
tcaggtgctgccatccag

SEQ ID NO: 2769272 - DNA, 20 bp, Homo sapiens
tcaggtgctgccatccaggt

SEQ ID NO: 2769273 - DNA, 16 bp, Homo sapiens
tcaggtggggcagctt

SEQ ID NO: 2769274 - DNA, 18 bp, Homo sapiens
tcaggtgtccctgcactt

SEQ ID NO: 2769275 - DNA, 22 bp, Homo sapiens
tcaggtgtccctgcacttgcag

SEQ ID NO: 2769276 - DNA, 23 bp, Homo sapiens
tcccagcactttgggaggccaag

SEQ ID NO: 2769277 - DNA, 21 bp, Homo sapiens
tcccagcagccctaaggatct

SEQ ID NO: 2769278 - DNA, 20 bp, Homo sapiens
tcccagcatgctgagattac

SEQ ID NO: 2769279 - DNA, 20 bp, Homo sapiens
tcccagccactcgggaggct

SEQ ID NO: 2769280 - DNA, 15 bp, Homo sapiens
tcccagccctatgga

SEQ ID NO: 2769281 - DNA, 22 bp, Homo sapiens
tcccagccctttgggaggctga

SEQ ID NO: 2769282 - DNA, 10 bp, Homo sapiens
tcccagcctg

SEQ ID NO: 2769283 - DNA, 21 bp, Homo sapiens
tcccagctactcagaagcctg

SEQ ID NO: 2769284 - DNA, 17 bp, Homo sapiens
tcccagctacttgggag

SEQ ID NO: 2769285 - DNA, 16 bp, Homo sapiens
tcccagctctccctct

SEQ ID NO: 2769286 - DNA, 19 bp, Homo sapiens
tcccagctctccctctggc

SEQ ID NO: 2769287 - DNA, 20 bp, Homo sapiens
tcccagctgtgctctggaca

SEQ ID NO: 2769288 - DNA, 23 bp, Homo sapiens
tcccagctgtgctctggacaggc

SEQ ID NO: 2769289 - DNA, 22 bp, Homo sapiens
tcccaggagacagttcaagaaa

SEQ ID NO: 2769290 - DNA, 18 bp, Homo sapiens
tcccaggccccatgacct

SEQ ID NO: 2769291 - DNA, 22 bp, Homo sapiens
tcccaggccccatgacctccag

SEQ ID NO: 2769292 - DNA, 18 bp, Homo sapiens
tcccaggcttcaccctga

SEQ ID NO: 2769293 - DNA, 16 bp, Homo sapiens
tcccagggccagggcc

SEQ ID NO: 2769294 - DNA, 23 bp, Homo sapiens
tcccagggccagggccctgcaga

SEQ ID NO: 2769295 - DNA, 17 bp, Homo sapiens
tcccaggggctccacct

SEQ ID NO: 2769296 - DNA, 19 bp, Homo sapiens
tcccaggggctccacctgt

SEQ ID NO: 2769297 - DNA, 20 bp, Homo sapiens
tcccagttcaggagtcccaa

SEQ ID NO: 2769298 - DNA, 14 bp, Homo sapiens
tcccatcactggag

SEQ ID NO: 2769299 - DNA, 17 bp, Homo sapiens
tcccatctaagctgcag

SEQ ID NO: 2769300 - DNA, 19 bp, Homo sapiens
tcccatctaagctgcagct

SEQ ID NO: 2769301 - DNA, 20 bp, Homo sapiens
tcccatctaagctgcagctt

SEQ ID NO: 2769302 - DNA, 13 bp, Homo sapiens
tcccatctgctcc

SEQ ID NO: 2769303 - DNA, 20 bp, Homo sapiens
tcccatctgctcctcccatt

SEQ ID NO: 2769304 - DNA, 15 bp, Homo sapiens
tcccatgagcctcag

SEQ ID NO: 2769305 - DNA, 20 bp, Homo sapiens
tcccatgagcctcagcatcc

SEQ ID NO: 2769306 - DNA, 21 bp, Homo sapiens
tcccatgatgccgctcttctg

SEQ ID NO: 2769307 - DNA, 23 bp, Homo sapiens
tcccatgatgccgctcttctgtc

SEQ ID NO: 2769308 - DNA, 19 bp, Homo sapiens
tcccatgctgaattatttt

SEQ ID NO: 2769309 - DNA, 23 bp, Homo sapiens
tcccatgggggtgctgcagccag

SEQ ID NO: 2769310 - DNA, 13 bp, Homo sapiens
tcccatgtgcatg

SEQ ID NO: 2769311 - DNA, 15 bp, Homo sapiens
tcccattgccctggt

SEQ ID NO: 2769312 - DNA, 12 bp, Homo sapiens
tcccatttcctt

SEQ ID NO: 2769313 - DNA, 16 bp, Homo sapiens
tcccatttccttggag

SEQ ID NO: 2769314 - DNA, 18 bp, Homo sapiens
tcccatttccttggaggc

SEQ ID NO: 2769315 - DNA, 20 bp, Homo sapiens
tcccatttccttggaggcca

SEQ ID NO: 2769316 - DNA, 13 bp, Homo sapiens
tcccattttgcaa

SEQ ID NO: 2769317 - DNA, 22 bp, Homo sapiens
tcccattttgcaaaatttccag

SEQ ID NO: 2769318 - DNA, 19 bp, Homo sapiens
tcccattttggaagttttc

SEQ ID NO: 2769319 - DNA, 20 bp, Homo sapiens
tcccattttggaagttttca

SEQ ID NO: 2769320 - DNA, 22 bp, Homo sapiens
tccccaaaaacctcacccgagg

SEQ ID NO: 2769321 - DNA, 18 bp, Homo sapiens
tccccaaagtcttaaaat

SEQ ID NO: 2769322 - DNA, 13 bp, Homo sapiens
tccccacagcagg

SEQ ID NO: 2769323 - DNA, 18 bp, Homo sapiens
tccccaccttcaattcct

SEQ ID NO: 2769324 - DNA, 17 bp, Homo sapiens
tccccactctgctctga

SEQ ID NO: 2769325 - DNA, 12 bp, Homo sapiens
tccccagactca

SEQ ID NO: 2769326 - DNA, 19 bp, Homo sapiens
tccccagattgcaacaggc

SEQ ID NO: 2769327 - DNA, 23 bp, Homo sapiens
tccccagattgcaacaggctggg

SEQ ID NO: 2769328 - DNA, 21 bp, Homo sapiens
tccccagcaagtgagagctgg

SEQ ID NO: 2769329 - DNA, 22 bp, Homo sapiens
tccccagcaagtgagagctggg

SEQ ID NO: 2769330 - DNA, 15 bp, Homo sapiens
tccccagccagaagt

SEQ ID NO: 2769331 - DNA, 12 bp, Homo sapiens
tccccagctccc

SEQ ID NO: 2769332 - DNA, 19 bp, Homo sapiens
tccccagctccccaggact

SEQ ID NO: 2769333 - DNA, 18 bp, Homo sapiens
tccccaggactcaccctc

SEQ ID NO: 2769334 - DNA, 22 bp, Homo sapiens
tccccaggccaggccaccagga

SEQ ID NO: 2769335 - DNA, 23 bp, Homo sapiens
tccccaggccaggccaccaggat

SEQ ID NO: 2769336 - DNA, 16 bp, Homo sapiens
tccccaggtctctcca

SEQ ID NO: 2769337 - DNA, 22 bp, Homo sapiens
tccccaggtggctgacccagtc

SEQ ID NO: 2769338 - DNA, 14 bp, Homo sapiens
tccccatcatccca

SEQ ID NO: 2769339 - DNA, 18 bp, Homo sapiens
tccccattcacagagcct

SEQ ID NO: 2769340 - DNA, 19 bp, Homo sapiens
tccccattcagacacttca

SEQ ID NO: 2769341 - DNA, 17 bp, Homo sapiens
tccccattcttcctagt

SEQ ID NO: 2769342 - DNA, 18 bp, Homo sapiens
tcccccaccccctcccca

SEQ ID NO: 2769343 - DNA, 20 bp, Homo sapiens
tcccccactgccacaccctc

SEQ ID NO: 2769344 - DNA, 21 bp, Homo sapiens
tcccccatcatatcctttgcc

SEQ ID NO: 2769345 - DNA, 13 bp, Homo sapiens
tcccccatccccc

SEQ ID NO: 2769346 - DNA, 18 bp, Homo sapiens
tcccccatcccctttcct

SEQ ID NO: 2769347 - DNA, 13 bp, Homo sapiens
tccccccactgca

SEQ ID NO: 2769348 - DNA, 19 bp, Homo sapiens
tccccccactgcaggcccc

SEQ ID NO: 2769349 - DNA, 14 bp, Homo sapiens
tccccccagcccct

SEQ ID NO: 2769350 - DNA, 18 bp, Homo sapiens
tccccccagcccctcctc

SEQ ID NO: 2769351 - DNA, 18 bp, Homo sapiens
tccccccccaacctttcc

SEQ ID NO: 2769352 - DNA, 14 bp, Homo sapiens
tcccccctcactcc

SEQ ID NO: 2769353 - DNA, 18 bp, Homo sapiens
tccccctcccagggccag

SEQ ID NO: 2769354 - DNA, 16 bp, Homo sapiens
tccccctgccagtgcc

SEQ ID NO: 2769355 - DNA, 17 bp, Homo sapiens
tccccctgccagtgcct

SEQ ID NO: 2769356 - DNA, 13 bp, Homo sapiens
tccccctgcccca

SEQ ID NO: 2769357 - DNA, 15 bp, Homo sapiens
tccccctgggctctg

SEQ ID NO: 2769358 - DNA, 24 bp, Homo sapiens
tccccgaaacaggctactctcctc

SEQ ID NO: 2769359 - DNA, 14 bp, Homo sapiens
tccccgcagagctc

SEQ ID NO: 2769360 - DNA, 22 bp, Homo sapiens
tccccggtcccttgagacctca

SEQ ID NO: 2769361 - DNA, 14 bp, Homo sapiens
tcccctccctcttc

SEQ ID NO: 2769362 - DNA, 15 bp, Homo sapiens
tcccctccctcttcc

SEQ ID NO: 2769363 - DNA, 15 bp, Homo sapiens
tcccctcgctgtcct

SEQ ID NO: 2769364 - DNA, 16 bp, Homo sapiens
tcccctgccctgctgc

SEQ ID NO: 2769365 - DNA, 23 bp, Homo sapiens
tcccctgccctgctgccgcctcc

SEQ ID NO: 2769366 - DNA, 20 bp, Homo sapiens
tcagtaatttagaaatcatt

SEQ ID NO: 2769367 - DNA, 15 bp, Homo sapiens
tcagtaatttgagga

SEQ ID NO: 2769368 - DNA, 18 bp, Homo sapiens
tcagtagtttgagaccag

SEQ ID NO: 2769369 - DNA, 20 bp, Homo sapiens
tcagtagtttgagaccagcc

SEQ ID NO: 2769370 - DNA, 16 bp, Homo sapiens
tcagtatgctgtttta

SEQ ID NO: 2769371 - DNA, 20 bp, Homo sapiens
tcagtatgctgttttaataa

SEQ ID NO: 2769372 - DNA, 17 bp, Homo sapiens
tcagtcccatcagagag

SEQ ID NO: 2769373 - DNA, 21 bp, Homo sapiens
tcagtcccccaccacactgaa

SEQ ID NO: 2769374 - DNA, 18 bp, Homo sapiens
tcagtccccgtgaaggag

SEQ ID NO: 2769375 - DNA, 19 bp, Homo sapiens
tcagtccgcctggccggct

SEQ ID NO: 2769376 - DNA, 22 bp, Homo sapiens
tcagtccgcctggccggctcca

SEQ ID NO: 2769377 - DNA, 16 bp, Homo sapiens
tcagtcggtgtgtaat

SEQ ID NO: 2769378 - DNA, 18 bp, Homo sapiens
tcagtctcagaatgtcat

SEQ ID NO: 2769379 - DNA, 19 bp, Homo sapiens
tcagtctgattcccaagct

SEQ ID NO: 2769380 - DNA, 22 bp, Homo sapiens
tcagtctgattcccaagctctg

SEQ ID NO: 2769381 - DNA, 24 bp, Homo sapiens
tcagtctgattcccaagctctgct

SEQ ID NO: 2769382 - DNA, 12 bp, Homo sapiens
tcagtcttggag

SEQ ID NO: 2769383 - DNA, 12 bp, Homo sapiens
tcagtgctgtgg

SEQ ID NO: 2769384 - DNA, 17 bp, Homo sapiens
tcagtgctgtggcctgg

SEQ ID NO: 2769385 - DNA, 19 bp, Homo sapiens
tcagtgctgtggcctgggc

SEQ ID NO: 2769386 - DNA, 13 bp, Homo sapiens
tcagtggcagctg

SEQ ID NO: 2769387 - DNA, 15 bp, Homo sapiens
tcagtgggaacgtga

SEQ ID NO: 2769388 - DNA, 20 bp, Homo sapiens
tcagtgggacaaaccagagc

SEQ ID NO: 2769389 - DNA, 23 bp, Homo sapiens
tcagtgggacaaaccagagcaga

SEQ ID NO: 2769390 - DNA, 13 bp, Homo sapiens
tcagtgggagaaa

SEQ ID NO: 2769391 - DNA, 22 bp, Homo sapiens
tcagtgtaccgcgtctaccctg

SEQ ID NO: 2769392 - DNA, 22 bp, Homo sapiens
tcagtgtagaacctaattcaat

SEQ ID NO: 2769393 - DNA, 18 bp, Homo sapiens
tcagttactcagccctgg

SEQ ID NO: 2769394 - DNA, 20 bp, Homo sapiens
tcagttcctgcccttggcct

SEQ ID NO: 2769395 - DNA, 22 bp, Homo sapiens
tcagttgacaaaatatataatg

SEQ ID NO: 2769396 - DNA, 16 bp, Homo sapiens
tcagttggagaaaatg

SEQ ID NO: 2769397 - DNA, 19 bp, Homo sapiens
tcagtttcaattcagtgct

SEQ ID NO: 2769398 - DNA, 17 bp, Homo sapiens
tcagttttatcattttc

SEQ ID NO: 2769399 - DNA, 16 bp, Homo sapiens
tcataaaataaagtat

SEQ ID NO: 2769400 - DNA, 21 bp, Homo sapiens
tcataaacaacttaatgttct

SEQ ID NO: 2769401 - DNA, 13 bp, Homo sapiens
tcataaagtatgc

SEQ ID NO: 2769402 - DNA, 17 bp, Homo sapiens
tcataacaatgtatgtg

SEQ ID NO: 2769403 - DNA, 17 bp, Homo sapiens
tcataattagaacaata

SEQ ID NO: 2769404 - DNA, 19 bp, Homo sapiens
tcataattagaacaatagc

SEQ ID NO: 2769405 - DNA, 20 bp, Homo sapiens
tcataattttcaagagaaga

SEQ ID NO: 2769406 - DNA, 17 bp, Homo sapiens
tcataccatctgctgcc

SEQ ID NO: 2769407 - DNA, 23 bp, Homo sapiens
tcatagaaatgtaacttttgtaa

SEQ ID NO: 2769408 - DNA, 18 bp, Homo sapiens
tcatagggtctcttcagg

SEQ ID NO: 2769409 - DNA, 20 bp, Homo sapiens
tcatagggtctcttcaggtt

SEQ ID NO: 2769410 - DNA, 21 bp, Homo sapiens
tcatagggtctcttcaggttc

SEQ ID NO: 2769411 - DNA, 16 bp, Homo sapiens
tcatataataaatgta

SEQ ID NO: 2769412 - DNA, 13 bp, Homo sapiens
tcatatattcatg

SEQ ID NO: 2769413 - DNA, 15 bp, Homo sapiens
tcatatattcatgta

SEQ ID NO: 2769414 - DNA, 22 bp, Homo sapiens
tcatatattcatgtaataaatc

SEQ ID NO: 2769415 - DNA, 15 bp, Homo sapiens
tcatatcctttgccc

SEQ ID NO: 2769416 - DNA, 22 bp, Homo sapiens
tcatcaatttttatacatatca

SEQ ID NO: 2769417 - DNA, 20 bp, Homo sapiens
tcatcacacccttttaacat

SEQ ID NO: 2769418 - DNA, 22 bp, Homo sapiens
tcatcagaagtggtaggaaagc

SEQ ID NO: 2769419 - DNA, 14 bp, Homo sapiens
tcatcagcatacct

SEQ ID NO: 2769420 - DNA, 15 bp, Homo sapiens
tcatcaggcttggaa

SEQ ID NO: 2769421 - DNA, 17 bp, Homo sapiens
tcatcattccttgagaa

SEQ ID NO: 2769422 - DNA, 21 bp, Homo sapiens
tcatccactgtgccatgtgcc

SEQ ID NO: 2769423 - DNA, 14 bp, Homo sapiens
tcatccagttgcaa

SEQ ID NO: 2769424 - DNA, 20 bp, Homo sapiens
tcatccagttgcaataaaat

SEQ ID NO: 2769425 - DNA, 13 bp, Homo sapiens
tcatcccagctgc

SEQ ID NO: 2769426 - DNA, 22 bp, Homo sapiens
tcatcccatctaagctgcagct

SEQ ID NO: 2769427 - DNA, 14 bp, Homo sapiens
tcatccccaccttg

SEQ ID NO: 2769428 - DNA, 21 bp, Homo sapiens
tcatccctatgggattcagtg

SEQ ID NO: 2769429 - DNA, 22 bp, Homo sapiens
tcatctatggcagtccagccag

SEQ ID NO: 2769430 - DNA, 20 bp, Homo sapiens
tcatctcaggcctccctcaa

SEQ ID NO: 2769431 - DNA, 11 bp, Homo sapiens
tcatctcaggg

SEQ ID NO: 2769432 - DNA, 22 bp, Homo sapiens
tcatctcagtgaagaatacttc

SEQ ID NO: 2769433 - DNA, 16 bp, Homo sapiens
tcatctcatttaaggg

SEQ ID NO: 2769434 - DNA, 14 bp, Homo sapiens
tcatctcttctttt

SEQ ID NO: 2769435 - DNA, 15 bp, Homo sapiens
tcatcttagctttcc

SEQ ID NO: 2769436 - DNA, 20 bp, Homo sapiens
tcatcttagctttccacagg

SEQ ID NO: 2769437 - DNA, 21 bp, Homo sapiens
tcatgaatatttcaaaataaa

SEQ ID NO: 2769438 - DNA, 13 bp, Homo sapiens
tcatgacagccag

SEQ ID NO: 2769439 - DNA, 15 bp, Homo sapiens
tcatgacagccagag

SEQ ID NO: 2769440 - DNA, 19 bp, Homo sapiens
tcatgacagccagagcctg

SEQ ID NO: 2769441 - DNA, 21 bp, Homo sapiens
tcatgataatgaacagaacat

SEQ ID NO: 2769442 - DNA, 13 bp, Homo sapiens
tcatgatctccct

SEQ ID NO: 2769443 - DNA, 15 bp, Homo sapiens
tcatgatctccctgc

SEQ ID NO: 2769444 - DNA, 19 bp, Homo sapiens
tcatgatctccctgccgcc

SEQ ID NO: 2769445 - DNA, 23 bp, Homo sapiens
tcatgatttcatttcaactgttt

SEQ ID NO: 2769446 - DNA, 16 bp, Homo sapiens
tcatgcaatgacatct

SEQ ID NO: 2769447 - DNA, 20 bp, Homo sapiens
tcatgccaaagcaaaagaag

SEQ ID NO: 2769448 - DNA, 13 bp, Homo sapiens
tcatgcctctgag

SEQ ID NO: 2769449 - DNA, 21 bp, Homo sapiens
tcatgcctctgaggccagcct

SEQ ID NO: 2769450 - DNA, 14 bp, Homo sapiens
tcatgcctggcccc

SEQ ID NO: 2769451 - DNA, 15 bp, Homo sapiens
tcatgcctggccccc

SEQ ID NO: 2769452 - DNA, 15 bp, Homo sapiens
tcatgctatctctgt

SEQ ID NO: 2769453 - DNA, 13 bp, Homo sapiens
tcatgctgacttg

SEQ ID NO: 2769454 - DNA, 19 bp, Homo sapiens
tcatgctgacttgcagagt

SEQ ID NO: 2769455 - DNA, 19 bp, Homo sapiens
tcatgcttcagttgtactt

SEQ ID NO: 2769456 - DNA, 21 bp, Homo sapiens
tcatggcagatgtaggaggga

SEQ ID NO: 2769457 - DNA, 22 bp, Homo sapiens
tcatggcagatgtaggagggac

SEQ ID NO: 2769458 - DNA, 21 bp, Homo sapiens
tcatgtaaacctaagcacgta

SEQ ID NO: 2769459 - DNA, 16 bp, Homo sapiens
tcatgtaaatgattat

SEQ ID NO: 2769460 - DNA, 14 bp, Homo sapiens
tcatgtacagcatg

SEQ ID NO: 2769461 - DNA, 16 bp, Homo sapiens
tcatgtacagcatgca

SEQ ID NO: 2769462 - DNA, 12 bp, Homo sapiens
tcatgtacattt

SEQ ID NO: 2769463 - DNA, 16 bp, Homo sapiens
tcatgtaccatcaata

SEQ ID NO: 2769464 - DNA, 18 bp, Homo sapiens
tcatgtggaatataaaga

SEQ ID NO: 2769465 - DNA, 16 bp, Homo sapiens
tcattactgcctttgg

SEQ ID NO: 2769466 - DNA, 18 bp, Homo sapiens
tcattactgcctttggaa

SEQ ID NO: 2769467 - DNA, 17 bp, Homo sapiens
tcattcaatatctgaca

SEQ ID NO: 2769468 - DNA, 12 bp, Homo sapiens
tcattcaggaaa

SEQ ID NO: 2769469 - DNA, 23 bp, Homo sapiens
tcattccccaggtggctgaccca

SEQ ID NO: 2769470 - DNA, 16 bp, Homo sapiens
tcattcctgaaagaaa

SEQ ID NO: 2769471 - DNA, 21 bp, Homo sapiens
tcattcctgaaagaaacagtt

SEQ ID NO: 2769472 - DNA, 22 bp, Homo sapiens
tcattcctgaaagaaacagtta

SEQ ID NO: 2769473 - DNA, 18 bp, Homo sapiens
tcattcttgaaagctgtg

SEQ ID NO: 2769474 - DNA, 23 bp, Homo sapiens
tcattgagggaaaacataatatc

SEQ ID NO: 2769475 - DNA, 16 bp, Homo sapiens
tcattgggagaagccg

SEQ ID NO: 2769476 - DNA, 11 bp, Homo sapiens
tcattgttaca

SEQ ID NO: 2769477 - DNA, 15 bp, Homo sapiens
tcatttatccctcaa

SEQ ID NO: 2769478 - DNA, 11 bp, Homo sapiens
tcatttcatct

SEQ ID NO: 2769479 - DNA, 19 bp, Homo sapiens
tcatttctactgtgactga

SEQ ID NO: 2769480 - DNA, 16 bp, Homo sapiens
tcatttgaacaactag

SEQ ID NO: 2769481 - DNA, 19 bp, Homo sapiens
tcatttgagcagggctcag

SEQ ID NO: 2769482 - DNA, 16 bp, Homo sapiens
tcatttgatgctaaat

SEQ ID NO: 2769483 - DNA, 20 bp, Homo sapiens
tcatttgctaactagcttgg

SEQ ID NO: 2769484 - DNA, 20 bp, Homo sapiens
tcattttaacatctgagaaa

SEQ ID NO: 2769485 - DNA, 13 bp, Homo sapiens
tcattttaattat

SEQ ID NO: 2769486 - DNA, 16 bp, Homo sapiens
tcattttttaaaaaag

SEQ ID NO: 2769487 - DNA, 18 bp, Homo sapiens
tcatttttttaacacata

SEQ ID NO: 2769488 - DNA, 23 bp, Homo sapiens
tccaaaatttgaaatattaaaat

SEQ ID NO: 2769489 - DNA, 23 bp, Homo sapiens
tccaaaggaagtctaggagctgg

SEQ ID NO: 2769490 - DNA, 20 bp, Homo sapiens
tccaacaactccaggaaaac

SEQ ID NO: 2769491 - DNA, 19 bp, Homo sapiens
tccaacaataaagagctca

SEQ ID NO: 2769492 - DNA, 22 bp, Homo sapiens
tccaacccatgatgagctcctc

SEQ ID NO: 2769493 - DNA, 17 bp, Homo sapiens
tccaaccccccacctgc

SEQ ID NO: 2769494 - DNA, 20 bp, Homo sapiens
tccaacctaacccctttcct

SEQ ID NO: 2769495 - DNA, 23 bp, Homo sapiens
tccaacctaacccctttcctgcg

SEQ ID NO: 2769496 - DNA, 20 bp, Homo sapiens
tccaacgttaaaagacagtg

SEQ ID NO: 2769497 - DNA, 19 bp, Homo sapiens
tccaagaatacagaaaatg

SEQ ID NO: 2769498 - DNA, 18 bp, Homo sapiens
tccaagctccatctccac

SEQ ID NO: 2769499 - DNA, 17 bp, Homo sapiens
tccaagcttcaagtgat

SEQ ID NO: 2769500 - DNA, 19 bp, Homo sapiens
tccaaggagaaacagagac

SEQ ID NO: 2769501 - DNA, 21 bp, Homo sapiens
tccaaggagttccatgaagac

SEQ ID NO: 2769502 - DNA, 22 bp, Homo sapiens
tccaatcccatagatgggtctg

SEQ ID NO: 2769503 - DNA, 18 bp, Homo sapiens
tccaatggagttcagaga

SEQ ID NO: 2769504 - DNA, 16 bp, Homo sapiens
tccaattatgtgacaa

SEQ ID NO: 2769505 - DNA, 20 bp, Homo sapiens
tccaattccacagtctctgg

SEQ ID NO: 2769506 - DNA, 13 bp, Homo sapiens
tccacacacagag

SEQ ID NO: 2769507 - DNA, 15 bp, Homo sapiens
tccacacacagagga

SEQ ID NO: 2769508 - DNA, 19 bp, Homo sapiens
tccacacacagaggaagag

SEQ ID NO: 2769509 - DNA, 14 bp, Homo sapiens
tccacagccgcagc

SEQ ID NO: 2769510 - DNA, 17 bp, Homo sapiens
tccacagccgcagcctc

SEQ ID NO: 2769511 - DNA, 22 bp, Homo sapiens
tccacagcggaggagaccagct

SEQ ID NO: 2769512 - DNA, 22 bp, Homo sapiens
tccacattaattagattttctt

SEQ ID NO: 2769513 - DNA, 18 bp, Homo sapiens
tccaccaacccatcagaa

SEQ ID NO: 2769514 - DNA, 15 bp, Homo sapiens
tccacccaggagccc

SEQ ID NO: 2769515 - DNA, 16 bp, Homo sapiens
tccaccctgagcctga

SEQ ID NO: 2769516 - DNA, 13 bp, Homo sapiens
tccaccgctgcct

SEQ ID NO: 2769517 - DNA, 15 bp, Homo sapiens
tccaccgctgcctaa

SEQ ID NO: 2769518 - DNA, 14 bp, Homo sapiens
tccacctcagcctt

SEQ ID NO: 2769519 - DNA, 18 bp, Homo sapiens
tccacctgctttctcctg

SEQ ID NO: 2769520 - DNA, 13 bp, Homo sapiens
tccacctggcccc

SEQ ID NO: 2769521 - DNA, 12 bp, Homo sapiens
tccacctggggt

SEQ ID NO: 2769522 - DNA, 19 bp, Homo sapiens
tccaccttcccatgccctg

SEQ ID NO: 2769523 - DNA, 16 bp, Homo sapiens
tccacgtccccctggg

SEQ ID NO: 2769524 - DNA, 19 bp, Homo sapiens
tccactaaatgagctcctg

SEQ ID NO: 2769525 - DNA, 21 bp, Homo sapiens
tccactaaatgagctcctgcg

SEQ ID NO: 2769526 - DNA, 20 bp, Homo sapiens
tccactgctctcagcctccc

SEQ ID NO: 2769527 - DNA, 12 bp, Homo sapiens
tccactggactt

SEQ ID NO: 2769528 - DNA, 22 bp, Homo sapiens
tccactgtgccatgtgccaggt

SEQ ID NO: 2769529 - DNA, 17 bp, Homo sapiens
tccacttctctagagaa

SEQ ID NO: 2769530 - DNA, 18 bp, Homo sapiens
tccagaaaaccccagcat

SEQ ID NO: 2769531 - DNA, 14 bp, Homo sapiens
tccagaaaatataa

SEQ ID NO: 2769532 - DNA, 18 bp, Homo sapiens
tccagaaaatataaatgc

SEQ ID NO: 2769533 - DNA, 19 bp, Homo sapiens
tccagaaaatataaatgca

SEQ ID NO: 2769534 - DNA, 22 bp, Homo sapiens
tccagaaaatataaatgcatga

SEQ ID NO: 2769535 - DNA, 16 bp, Homo sapiens
tccagaagaatattca

SEQ ID NO: 2769536 - DNA, 22 bp, Homo sapiens
tccagaagaatattcaggactt

SEQ ID NO: 2769537 - DNA, 17 bp, Homo sapiens
tccagaataagtgctgt

SEQ ID NO: 2769538 - DNA, 18 bp, Homo sapiens
tccagaatggtctttcta

SEQ ID NO: 2769539 - DNA, 16 bp, Homo sapiens
tccagaattgaccttt

SEQ ID NO: 2769540 - DNA, 23 bp, Homo sapiens
tccagactgcttccaattttctg

SEQ ID NO: 2769541 - DNA, 20 bp, Homo sapiens
tccagagggttgtgattttg

SEQ ID NO: 2769542 - DNA, 23 bp, Homo sapiens
tccagcacagaaggaatctgtgc

SEQ ID NO: 2769543 - DNA, 13 bp, Homo sapiens
tccagccagcgcc

SEQ ID NO: 2769544 - DNA, 14 bp, Homo sapiens
tccagccagcgcct

SEQ ID NO: 2769545 - DNA, 20 bp, Homo sapiens
tccagccagcgcctccctcc

SEQ ID NO: 2769546 - DNA, 17 bp, Homo sapiens
tcctgtctttaaggaaa

SEQ ID NO: 2769547 - DNA, 18 bp, Homo sapiens
tcctgtgacttcagctct

SEQ ID NO: 2769548 - DNA, 15 bp, Homo sapiens
tcctgtgggagcctc

SEQ ID NO: 2769549 - DNA, 16 bp, Homo sapiens
tcctgtgggagcctcg

SEQ ID NO: 2769550 - DNA, 23 bp, Homo sapiens
tcctgtgtcttgcaatggcagcc

SEQ ID NO: 2769551 - DNA, 23 bp, Homo sapiens
tcctgttagctgttatttctatt

SEQ ID NO: 2769552 - DNA, 24 bp, Homo sapiens
tcctgttattttttatttccacat

SEQ ID NO: 2769553 - DNA, 14 bp, Homo sapiens
tccttactcctgtg

SEQ ID NO: 2769554 - DNA, 22 bp, Homo sapiens
tccttactcctgtgggagcctc

SEQ ID NO: 2769555 - DNA, 23 bp, Homo sapiens
tccttactcctgtgggagcctcg

SEQ ID NO: 2769556 - DNA, 19 bp, Homo sapiens
tccttagcttagacctcag

SEQ ID NO: 2769557 - DNA, 21 bp, Homo sapiens
tccttagcttagacctcagcc

SEQ ID NO: 2769558 - DNA, 23 bp, Homo sapiens
tccttatgtttgaagagaaacct

SEQ ID NO: 2769559 - DNA, 19 bp, Homo sapiens
tccttcaagaactctgggc

SEQ ID NO: 2769560 - DNA, 23 bp, Homo sapiens
tccttcaagaactctgggctgct

SEQ ID NO: 2769561 - DNA, 14 bp, Homo sapiens
tccttcaccagagc

SEQ ID NO: 2769562 - DNA, 18 bp, Homo sapiens
tccttcagcttccatttc

SEQ ID NO: 2769563 - DNA, 14 bp, Homo sapiens
tccttcatttcctc

SEQ ID NO: 2769564 - DNA, 15 bp, Homo sapiens
tccttcatttcctcc

SEQ ID NO: 2769565 - DNA, 16 bp, Homo sapiens
tccttccagctagtga

SEQ ID NO: 2769566 - DNA, 21 bp, Homo sapiens
tccttccaggcccccaccact

SEQ ID NO: 2769567 - DNA, 22 bp, Homo sapiens
tccttcccccatcccctttcct

SEQ ID NO: 2769568 - DNA, 10 bp, Homo sapiens
tccttcctgc

SEQ ID NO: 2769569 - DNA, 13 bp, Homo sapiens
tccttctctgccc

SEQ ID NO: 2769570 - DNA, 12 bp, Homo sapiens
tccttctgtcct

SEQ ID NO: 2769571 - DNA, 19 bp, Homo sapiens
tccttctgtcctactctgt

SEQ ID NO: 2769572 - DNA, 23 bp, Homo sapiens
tccttgattttagccttctctgt

SEQ ID NO: 2769573 - DNA, 12 bp, Homo sapiens
tccttgcctggt

SEQ ID NO: 2769574 - DNA, 17 bp, Homo sapiens
tccttgctgtcctaggc

SEQ ID NO: 2769575 - DNA, 21 bp, Homo sapiens
tccttgctgtcctaggccaca

SEQ ID NO: 2769576 - DNA, 13 bp, Homo sapiens
tccttggaggaca

SEQ ID NO: 2769577 - DNA, 13 bp, Homo sapiens
tccttggaggcca

SEQ ID NO: 2769578 - DNA, 23 bp, Homo sapiens
tccttggcaggctgatttctagg

SEQ ID NO: 2769579 - DNA, 14 bp, Homo sapiens
tccttgggtcctgc

SEQ ID NO: 2769580 - DNA, 18 bp, Homo sapiens
tccttggtgcctggcctg

SEQ ID NO: 2769581 - DNA, 13 bp, Homo sapiens
tccttgtcactgg

SEQ ID NO: 2769582 - DNA, 15 bp, Homo sapiens
tcctttagcgcccag

SEQ ID NO: 2769583 - DNA, 14 bp, Homo sapiens
tcctttctcagccg

SEQ ID NO: 2769584 - DNA, 18 bp, Homo sapiens
tcctttctccagccagca

SEQ ID NO: 2769585 - DNA, 14 bp, Homo sapiens
tcctttgagaaaga

SEQ ID NO: 2769586 - DNA, 15 bp, Homo sapiens
tcctttgcactgagg

SEQ ID NO: 2769587 - DNA, 20 bp, Homo sapiens
tcctttgcactgagggccac

SEQ ID NO: 2769588 - DNA, 23 bp, Homo sapiens
tcctttgcctaggaggccttctc

SEQ ID NO: 2769589 - DNA, 21 bp, Homo sapiens
tcctttgttattatcctgcat

SEQ ID NO: 2769590 - DNA, 22 bp, Homo sapiens
tcctttgttattatcctgcatt

SEQ ID NO: 2769591 - DNA, 24 bp, Homo sapiens
tcctttgttcttacctgtatgtct

SEQ ID NO: 2769592 - DNA, 17 bp, Homo sapiens
tccttttgtgtacagtg

SEQ ID NO: 2769593 - DNA, 15 bp, Homo sapiens
tcgaactggctgcaa

SEQ ID NO: 2769594 - DNA, 16 bp, Homo sapiens
tcgactcaggatccag

SEQ ID NO: 2769595 - DNA, 21 bp, Homo sapiens
tcgactcaggatccagtccct

SEQ ID NO: 2769596 - DNA, 15 bp, Homo sapiens
tcgagaccagcctgg

SEQ ID NO: 2769597 - DNA, 13 bp, Homo sapiens
tcgagccctgcag

SEQ ID NO: 2769598 - DNA, 16 bp, Homo sapiens
tcgagccctgcagcca

SEQ ID NO: 2769599 - DNA, 15 bp, Homo sapiens
tcgagcgccctgcag

SEQ ID NO: 2769600 - DNA, 13 bp, Homo sapiens
tcgagtttacttc

SEQ ID NO: 2769601 - DNA, 18 bp, Homo sapiens
tcgagtttacttcatgag

SEQ ID NO: 2769602 - DNA, 15 bp, Homo sapiens
tcgatctgtactgta

SEQ ID NO: 2769603 - DNA, 19 bp, Homo sapiens
tcgatgaagcccaataaac

SEQ ID NO: 2769604 - DNA, 22 bp, Homo sapiens
tcgattagactggacagcttgt

SEQ ID NO: 2769605 - DNA, 20 bp, Homo sapiens
tcgattattccctgtacaat

SEQ ID NO: 2769606 - DNA, 23 bp, Homo sapiens
tcgcacagattacttcagggctg

SEQ ID NO: 2769607 - DNA, 21 bp, Homo sapiens
tcgcaccactgtgtatttaac

SEQ ID NO: 2769608 - DNA, 13 bp, Homo sapiens
tcgcagccaccct

SEQ ID NO: 2769609 - DNA, 14 bp, Homo sapiens
tcgcccagtctgga

SEQ ID NO: 2769610 - DNA, 15 bp, Homo sapiens
tcgcccccacacccc

SEQ ID NO: 2769611 - DNA, 17 bp, Homo sapiens
tcgccgttgaagaggaa

SEQ ID NO: 2769612 - DNA, 15 bp, Homo sapiens
tcgctctgctggcct

SEQ ID NO: 2769613 - DNA, 16 bp, Homo sapiens
tcgctgcttcgtggga

SEQ ID NO: 2769614 - DNA, 15 bp, Homo sapiens
tcgctgtcctgctgt

SEQ ID NO: 2769615 - DNA, 15 bp, Homo sapiens
tcggaagcagtgcct

SEQ ID NO: 2769616 - DNA, 14 bp, Homo sapiens
tcggagacagtgat

SEQ ID NO: 2769617 - DNA, 19 bp, Homo sapiens
tcggcccacagctcccacc

SEQ ID NO: 2769618 - DNA, 23 bp, Homo sapiens
tcggcccacagctcccaccccac

SEQ ID NO: 2769619 - DNA, 19 bp, Homo sapiens
tcggcctcccaaagtgctg

SEQ ID NO: 2769620 - DNA, 21 bp, Homo sapiens
tcggctgtaaacagctctgtg

SEQ ID NO: 2769621 - DNA, 15 bp, Homo sapiens
tcgggaacagtgttt

SEQ ID NO: 2769622 - DNA, 23 bp, Homo sapiens
tcgggagcagtgtcttccataat

SEQ ID NO: 2769623 - DNA, 16 bp, Homo sapiens
tcgggaggctgagaca

SEQ ID NO: 2769624 - DNA, 18 bp, Homo sapiens
tcgggataacaaaatcac

SEQ ID NO: 2769625 - DNA, 19 bp, Homo sapiens
tcggggagaggctgaggac

SEQ ID NO: 2769626 - DNA, 16 bp, Homo sapiens
tcggggcatgctgggg

SEQ ID NO: 2769627 - DNA, 17 bp, Homo sapiens
tcggggcatgctggggc

SEQ ID NO: 2769628 - DNA, 19 bp, Homo sapiens
tcggggcgacccctcagtg

SEQ ID NO: 2769629 - DNA, 16 bp, Homo sapiens
tcggggctgggaagtc

SEQ ID NO: 2769630 - DNA, 15 bp, Homo sapiens
tcggggtgcacagga

SEQ ID NO: 2769631 - DNA, 16 bp, Homo sapiens
tcggggtgcacaggag

SEQ ID NO: 2769632 - DNA, 22 bp, Homo sapiens
tcggggtgcacaggagggggtc

SEQ ID NO: 2769633 - DNA, 13 bp, Homo sapiens
tcgtcctccccct

SEQ ID NO: 2769634 - DNA, 14 bp, Homo sapiens
tcgtgcatttgtga

SEQ ID NO: 2769635 - DNA, 14 bp, Homo sapiens
tcgtggacacctgc

SEQ ID NO: 2769636 - DNA, 22 bp, Homo sapiens
tccagccagcgcctccctccac

SEQ ID NO: 2769637 - DNA, 13 bp, Homo sapiens
tccagccagctcc

SEQ ID NO: 2769638 - DNA, 14 bp, Homo sapiens
tccagccagctcct

SEQ ID NO: 2769639 - DNA, 21 bp, Homo sapiens
tccagccagctcctgggcagc

SEQ ID NO: 2769640 - DNA, 22 bp, Homo sapiens
tccagccagctcctgggcagct

SEQ ID NO: 2769641 - DNA, 20 bp, Homo sapiens
tccagccatcaagagactga

SEQ ID NO: 2769642 - DNA, 24 bp, Homo sapiens
tccagccatcaagagactgagtca

SEQ ID NO: 2769643 - DNA, 11 bp, Homo sapiens
tccagcctggg

SEQ ID NO: 2769644 - DNA, 17 bp, Homo sapiens
tccagcctgggcgacag

SEQ ID NO: 2769645 - DNA, 15 bp, Homo sapiens
tccagctcaccagcc

SEQ ID NO: 2769646 - DNA, 14 bp, Homo sapiens
tccagctcttggcc

SEQ ID NO: 2769647 - DNA, 15 bp, Homo sapiens
tccagctcttggccc

SEQ ID NO: 2769648 - DNA, 20 bp, Homo sapiens
tccagcttcccctcgctgtc

SEQ ID NO: 2769649 - DNA, 16 bp, Homo sapiens
tccaggaaaactgttt

SEQ ID NO: 2769650 - DNA, 19 bp, Homo sapiens
tccaggaaggtagcccagc

SEQ ID NO: 2769651 - DNA, 21 bp, Homo sapiens
tccaggagcaatttgcacatg

SEQ ID NO: 2769652 - DNA, 19 bp, Homo sapiens
tccaggattgaagagcatt

SEQ ID NO: 2769653 - DNA, 17 bp, Homo sapiens
tccaggcatgctggcct

SEQ ID NO: 2769654 - DNA, 19 bp, Homo sapiens
tccaggcatgctggcctcc

SEQ ID NO: 2769655 - DNA, 22 bp, Homo sapiens
tccaggctcctttagcgcccag

SEQ ID NO: 2769656 - DNA, 22 bp, Homo sapiens
tccaggctctttggggtcagcc

SEQ ID NO: 2769657 - DNA, 23 bp, Homo sapiens
tccaggctctttggggtcagcca

SEQ ID NO: 2769658 - DNA, 14 bp, Homo sapiens
tccaggctgtatcc

SEQ ID NO: 2769659 - DNA, 21 bp, Homo sapiens
tccaggctgtatcccatgagc

SEQ ID NO: 2769660 - DNA, 22 bp, Homo sapiens
tccagggccacgtgccaggccc

SEQ ID NO: 2769661 - DNA, 23 bp, Homo sapiens
tccagggccacgtgccaggcccg

SEQ ID NO: 2769662 - DNA, 13 bp, Homo sapiens
tccagggccctga

SEQ ID NO: 2769663 - DNA, 16 bp, Homo sapiens
tccaggtatctccagg

SEQ ID NO: 2769664 - DNA, 21 bp, Homo sapiens
tccaggtcctggtggggcagc

SEQ ID NO: 2769665 - DNA, 17 bp, Homo sapiens
tccagtacctttgtcac

SEQ ID NO: 2769666 - DNA, 22 bp, Homo sapiens
tccagtatggaagaatggggtg

SEQ ID NO: 2769667 - DNA, 12 bp, Homo sapiens
tccagtgagccg

SEQ ID NO: 2769668 - DNA, 23 bp, Homo sapiens
tccagtgggaggtgagaccacct

SEQ ID NO: 2769669 - DNA, 23 bp, Homo sapiens
tccagtggtaccagctcactccc

SEQ ID NO: 2769670 - DNA, 12 bp, Homo sapiens
tccagtggtgaa

SEQ ID NO: 2769671 - DNA, 15 bp, Homo sapiens
tccagtggttgctgt

SEQ ID NO: 2769672 - DNA, 17 bp, Homo sapiens
tccagtgtgcacccctc

SEQ ID NO: 2769673 - DNA, 19 bp, Homo sapiens
tccagtgtgcacccctccc

SEQ ID NO: 2769674 - DNA, 21 bp, Homo sapiens
tccagtgtgcacccctcccca

SEQ ID NO: 2769675 - DNA, 13 bp, Homo sapiens
tccagtttccaaa

SEQ ID NO: 2769676 - DNA, 15 bp, Homo sapiens
tccagtttccccatg

SEQ ID NO: 2769677 - DNA, 20 bp, Homo sapiens
tccataatgtataaagaaca

SEQ ID NO: 2769678 - DNA, 17 bp, Homo sapiens
tccataattatgacagt

SEQ ID NO: 2769679 - DNA, 16 bp, Homo sapiens
tccatatcagacctct

SEQ ID NO: 2769680 - DNA, 14 bp, Homo sapiens
tccatcagctccct

SEQ ID NO: 2769681 - DNA, 13 bp, Homo sapiens
tccatcaggactt

SEQ ID NO: 2769682 - DNA, 19 bp, Homo sapiens
tccatcaggttccatcccg

SEQ ID NO: 2769683 - DNA, 16 bp, Homo sapiens
tccatgaaaatgcaac

SEQ ID NO: 2769684 - DNA, 16 bp, Homo sapiens
tccatgattttacaga

SEQ ID NO: 2769685 - DNA, 15 bp, Homo sapiens
tccatgcctacagat

SEQ ID NO: 2769686 - DNA, 21 bp, Homo sapiens
tccatgcctgagggtggagac

SEQ ID NO: 2769687 - DNA, 14 bp, Homo sapiens
tccatgtagcagga

SEQ ID NO: 2769688 - DNA, 17 bp, Homo sapiens
tccatgtagcaggactg

SEQ ID NO: 2769689 - DNA, 21 bp, Homo sapiens
tccatgtattcacacacccct

SEQ ID NO: 2769690 - DNA, 16 bp, Homo sapiens
tccatgtcgcctctgc

SEQ ID NO: 2769691 - DNA, 19 bp, Homo sapiens
tccatgttaaaatagacaa

SEQ ID NO: 2769692 - DNA, 14 bp, Homo sapiens
tccattaggatttg

SEQ ID NO: 2769693 - DNA, 23 bp, Homo sapiens
tccatttcatctatttctgagaa

SEQ ID NO: 2769694 - DNA, 20 bp, Homo sapiens
tccatttccagttcatctat

SEQ ID NO: 2769695 - DNA, 12 bp, Homo sapiens
tccatttctggc

SEQ ID NO: 2769696 - DNA, 16 bp, Homo sapiens
tccatttcttcctcac

SEQ ID NO: 2769697 - DNA, 19 bp, Homo sapiens
tccatttttactaaagcag

SEQ ID NO: 2769698 - DNA, 21 bp, Homo sapiens
tcccaaagaagttctggtatg

SEQ ID NO: 2769699 - DNA, 15 bp, Homo sapiens
tcccaaagtgctggg

SEQ ID NO: 2769700 - DNA, 22 bp, Homo sapiens
tcccaaattggtgtttctgaat

SEQ ID NO: 2769701 - DNA, 22 bp, Homo sapiens
tcccaaccccagggcccccaca

SEQ ID NO: 2769702 - DNA, 17 bp, Homo sapiens
tcccaactcctataatt

SEQ ID NO: 2769703 - DNA, 13 bp, Homo sapiens
tcccaagagctac

SEQ ID NO: 2769704 - DNA, 14 bp, Homo sapiens
tcccaagctctgct

SEQ ID NO: 2769705 - DNA, 15 bp, Homo sapiens
tcccaagctctgctc

SEQ ID NO: 2769706 - DNA, 22 bp, Homo sapiens
tcccaaggaaagccccagcact

SEQ ID NO: 2769707 - DNA, 18 bp, Homo sapiens
tcccaaggctctgagcaa

SEQ ID NO: 2769708 - DNA, 11 bp, Homo sapiens
tcccaataaaa

SEQ ID NO: 2769709 - DNA, 12 bp, Homo sapiens
tcccaataaagc

SEQ ID NO: 2769710 - DNA, 13 bp, Homo sapiens
tcccaataaagct

SEQ ID NO: 2769711 - DNA, 15 bp, Homo sapiens
tcccacatccctggg

SEQ ID NO: 2769712 - DNA, 16 bp, Homo sapiens
tcccacatccctgggc

SEQ ID NO: 2769713 - DNA, 21 bp, Homo sapiens
tcccacatccctgggcctgct

SEQ ID NO: 2769714 - DNA, 23 bp, Homo sapiens
tcccacatccctgggcctgctgc

SEQ ID NO: 2769715 - DNA, 18 bp, Homo sapiens
tcccaccaaggtcttcag

SEQ ID NO: 2769716 - DNA, 19 bp, Homo sapiens
tcccaccagcatgtcactc

SEQ ID NO: 2769717 - DNA, 20 bp, Homo sapiens
tcccaccagcatgtcactcc

SEQ ID NO: 2769718 - DNA, 12 bp, Homo sapiens
tcccaccccacc

SEQ ID NO: 2769719 - DNA, 13 bp, Homo sapiens
tcccaccccaccc

SEQ ID NO: 2769720 - DNA, 12 bp, Homo sapiens
tcccacccccag

SEQ ID NO: 2769721 - DNA, 15 bp, Homo sapiens
tcccacccccagccc

SEQ ID NO: 2769722 - DNA, 15 bp, Homo sapiens
tcccacctcagcctc

SEQ ID NO: 2769723 - DNA, 14 bp, Homo sapiens
tcccactcagtcca

SEQ ID NO: 2769724 - DNA, 20 bp, Homo sapiens
tcccagaccacctccctgcc

SEQ ID NO: 2769725 - DNA, 20 bp, Homo sapiens
tcccagagacaggaaaatcc

SEQ ID NO: 2769726 - DNA, 21 bp, Homo sapiens
tccccttcactccctccctgg

SEQ ID NO: 2769727 - DNA, 18 bp, Homo sapiens
tccccttcctgcacccgt

SEQ ID NO: 2769728 - DNA, 24 bp, Homo sapiens
tccccttgcccagggctcagcctg

SEQ ID NO: 2769729 - DNA, 19 bp, Homo sapiens
tccccttgcccttgccctg

SEQ ID NO: 2769730 - DNA, 15 bp, Homo sapiens
tcccgaatagctggg

SEQ ID NO: 2769731 - DNA, 18 bp, Homo sapiens
tcccgaatagctgggact

SEQ ID NO: 2769732 - DNA, 16 bp, Homo sapiens
tcccgagtagctggga

SEQ ID NO: 2769733 - DNA, 19 bp, Homo sapiens
tcccgcctcttcttcttca

SEQ ID NO: 2769734 - DNA, 21 bp, Homo sapiens
tcccgcctcttcttcttcaga

SEQ ID NO: 2769735 - DNA, 12 bp, Homo sapiens
tcccgctcctgc

SEQ ID NO: 2769736 - DNA, 15 bp, Homo sapiens
tcccgctcctgctga

SEQ ID NO: 2769737 - DNA, 19 bp, Homo sapiens
tcccgtgaaagaattattt

SEQ ID NO: 2769738 - DNA, 19 bp, Homo sapiens
tccctaaaataaaaaccag

SEQ ID NO: 2769739 - DNA, 19 bp, Homo sapiens
tccctagaggcaaacattt

SEQ ID NO: 2769740 - DNA, 17 bp, Homo sapiens
tccctagtggcttcctc

SEQ ID NO: 2769741 - DNA, 14 bp, Homo sapiens
tccctcactgcctt

SEQ ID NO: 2769742 - DNA, 17 bp, Homo sapiens
tccctcactgccttcca

SEQ ID NO: 2769743 - DNA, 11 bp, Homo sapiens
tccctccaccc

SEQ ID NO: 2769744 - DNA, 16 bp, Homo sapiens
tccctccaccccagga

SEQ ID NO: 2769745 - DNA, 17 bp, Homo sapiens
tccctccaccccaggac

SEQ ID NO: 2769746 - DNA, 15 bp, Homo sapiens
tccctctcccaggcc

SEQ ID NO: 2769747 - DNA, 20 bp, Homo sapiens
tccctctcccaggccccatg

SEQ ID NO: 2769748 - DNA, 13 bp, Homo sapiens
tccctctcctgcc

SEQ ID NO: 2769749 - DNA, 16 bp, Homo sapiens
tccctctcctgcctac

SEQ ID NO: 2769750 - DNA, 13 bp, Homo sapiens
tccctctttgcct

SEQ ID NO: 2769751 - DNA, 15 bp, Homo sapiens
tccctgaaaacccag

SEQ ID NO: 2769752 - DNA, 18 bp, Homo sapiens
tccctgaaaacccagaga

SEQ ID NO: 2769753 - DNA, 20 bp, Homo sapiens
tccctgactctctgtgacct

SEQ ID NO: 2769754 - DNA, 14 bp, Homo sapiens
tccctgagtcacca

SEQ ID NO: 2769755 - DNA, 23 bp, Homo sapiens
  misc_feature (14)..(14): n is a, c, g or t
tccctgcacctgcnttgtccctg

SEQ ID NO: 2769756 - DNA, 23 bp, Homo sapiens
tccctgcccagaattcccagctg

SEQ ID NO: 2769757 - DNA, 21 bp, Homo sapiens
tccctgccctgtcctccagct

SEQ ID NO: 2769758 - DNA, 20 bp, Homo sapiens
tccctggcatgaccatcctg

SEQ ID NO: 2769759 - DNA, 22 bp, Homo sapiens
tccctggcatgaccatcctgtc

SEQ ID NO: 2769760 - DNA, 12 bp, Homo sapiens
tccctggcctca

SEQ ID NO: 2769761 - DNA, 20 bp, Homo sapiens
tccctggctctcagaaggta

SEQ ID NO: 2769762 - DNA, 15 bp, Homo sapiens
tccctggctctgcca

SEQ ID NO: 2769763 - DNA, 16 bp, Homo sapiens
tccctggctctgccag

SEQ ID NO: 2769764 - DNA, 11 bp, Homo sapiens
tccctggcttg

SEQ ID NO: 2769765 - DNA, 19 bp, Homo sapiens
tccctgggcctgctgctga

SEQ ID NO: 2769766 - DNA, 21 bp, Homo sapiens
tccctgggcctgctgctgaga

SEQ ID NO: 2769767 - DNA, 19 bp, Homo sapiens
tccctgggggaagccctgg

SEQ ID NO: 2769768 - DNA, 21 bp, Homo sapiens
tccctgggggaagccctggat

SEQ ID NO: 2769769 - DNA, 13 bp, Homo sapiens
tccctggtccctt

SEQ ID NO: 2769770 - DNA, 14 bp, Homo sapiens
tccctggtcccttg

SEQ ID NO: 2769771 - DNA, 14 bp, Homo sapiens
tccctgtcctcctc

SEQ ID NO: 2769772 - DNA, 14 bp, Homo sapiens
tcccttaatatcct

SEQ ID NO: 2769773 - DNA, 16 bp, Homo sapiens
tcccttcctgaccctc

SEQ ID NO: 2769774 - DNA, 16 bp, Homo sapiens
tcccttgagacctcag

SEQ ID NO: 2769775 - DNA, 19 bp, Homo sapiens
tcccttgagacctcagcca

SEQ ID NO: 2769776 - DNA, 21 bp, Homo sapiens
tccgaaagggacttggaagct

SEQ ID NO: 2769777 - DNA, 21 bp, Homo sapiens
tccgaagtatgagggaaaatg

SEQ ID NO: 2769778 - DNA, 12 bp, Homo sapiens
tccgaggcaggg

SEQ ID NO: 2769779 - DNA, 14 bp, Homo sapiens
tccgaggcagggtc

SEQ ID NO: 2769780 - DNA, 15 bp, Homo sapiens
tccgatgacagtgct

SEQ ID NO: 2769781 - DNA, 14 bp, Homo sapiens
tccgcctcttgggt

SEQ ID NO: 2769782 - DNA, 18 bp, Homo sapiens
tccgcctggccggctcca

SEQ ID NO: 2769783 - DNA, 16 bp, Homo sapiens
tccgctttcatgaaca

SEQ ID NO: 2769784 - DNA, 18 bp, Homo sapiens
tccgctttctacccagcg

SEQ ID NO: 2769785 - DNA, 21 bp, Homo sapiens
tccgctttctacccagcgagc

SEQ ID NO: 2769786 - DNA, 12 bp, Homo sapiens
tccggtgtgcct

SEQ ID NO: 2769787 - DNA, 15 bp, Homo sapiens
tccgtagttccctga

SEQ ID NO: 2769788 - DNA, 15 bp, Homo sapiens
tcctaaatgcagtga

SEQ ID NO: 2769789 - DNA, 18 bp, Homo sapiens
tcctaagacttcagtcct

SEQ ID NO: 2769790 - DNA, 20 bp, Homo sapiens
tcctaagacttcagtcctgg

SEQ ID NO: 2769791 - DNA, 18 bp, Homo sapiens
tcctaaggacacactaat

SEQ ID NO: 2769792 - DNA, 16 bp, Homo sapiens
tcctacagatagtcaa

SEQ ID NO: 2769793 - DNA, 15 bp, Homo sapiens
tcctacccaaccact

SEQ ID NO: 2769794 - DNA, 14 bp, Homo sapiens
tcctaccccacctc

SEQ ID NO: 2769795 - DNA, 14 bp, Homo sapiens
tcctacctcagcct

SEQ ID NO: 2769796 - DNA, 12 bp, Homo sapiens
tcctactctgtg

SEQ ID NO: 2769797 - DNA, 17 bp, Homo sapiens
tcctactttagccactg

SEQ ID NO: 2769798 - DNA, 17 bp, Homo sapiens
tcctagccactcaggag

SEQ ID NO: 2769799 - DNA, 20 bp, Homo sapiens
tcctaggctccaccccatcc

SEQ ID NO: 2769800 - DNA, 13 bp, Homo sapiens
tcctagtatatta

SEQ ID NO: 2769801 - DNA, 20 bp, Homo sapiens
tcctataattccctatcttt

SEQ ID NO: 2769802 - DNA, 18 bp, Homo sapiens
tcctattaaaacacagct

SEQ ID NO: 2769803 - DNA, 14 bp, Homo sapiens
tcctattctcacca

SEQ ID NO: 2769804 - DNA, 21 bp, Homo sapiens
tcctattgtgcaatgtaaata

SEQ ID NO: 2769805 - DNA, 18 bp, Homo sapiens
tcctatttggggcttgca

SEQ ID NO: 2769806 - DNA, 15 bp, Homo sapiens
tcctatttttcagaa

SEQ ID NO: 2769807 - DNA, 16 bp, Homo sapiens
tcctcaccaataactt

SEQ ID NO: 2769808 - DNA, 22 bp, Homo sapiens
tcctcaccaataacttcagaga

SEQ ID NO: 2769809 - DNA, 20 bp, Homo sapiens
tcctcaccccgtctggggtt

SEQ ID NO: 2769810 - DNA, 19 bp, Homo sapiens
tcctcactgccccaccagc

SEQ ID NO: 2769811 - DNA, 11 bp, Homo sapiens
tcctcagactg

SEQ ID NO: 2769812 - DNA, 19 bp, Homo sapiens
tcctcagatcatccagaag

SEQ ID NO: 2769813 - DNA, 16 bp, Homo sapiens
tcctcagtcctggaag

SEQ ID NO: 2769814 - DNA, 17 bp, Homo sapiens
tcctcagtcctggaagc

SEQ ID NO: 2769815 - DNA, 22 bp, Homo sapiens
tcctcatagtatggtggctggg

SEQ ID NO: 2769816 - DNA, 14 bp, Homo sapiens
tcctcattcctgaa

SEQ ID NO: 2769817 - DNA, 17 bp, Homo sapiens
tcctccaattccacagt

SEQ ID NO: 2769818 - DNA, 20 bp, Homo sapiens
tcctccagggccacgtgcca

SEQ ID NO: 2769819 - DNA, 15 bp, Homo sapiens
tcctcccaccaccct

SEQ ID NO: 2769820 - DNA, 24 bp, Homo sapiens
tcctcccaccaccctcccaccatg

SEQ ID NO: 2769821 - DNA, 12 bp, Homo sapiens
tcctcccacctc

SEQ ID NO: 2769822 - DNA, 13 bp, Homo sapiens
tcctcccacctca

SEQ ID NO: 2769823 - DNA, 14 bp, Homo sapiens
tcctcccacctcag

SEQ ID NO: 2769824 - DNA, 15 bp, Homo sapiens
tcctcccacctcagc

SEQ ID NO: 2769825 - DNA, 13 bp, Homo sapiens
tcctcccattccc

SEQ ID NO: 2769826 - DNA, 14 bp, Homo sapiens
tcctccccaccttc

SEQ ID NO: 2769827 - DNA, 20 bp, Homo sapiens
tcctccccaccttccccaga

SEQ ID NO: 2769828 - DNA, 14 bp, Homo sapiens
tcctccccctgcca

SEQ ID NO: 2769829 - DNA, 24 bp, Homo sapiens
tcctccccctgccagtgccttacc

SEQ ID NO: 2769830 - DNA, 15 bp, Homo sapiens
tcctccccttcctgc

SEQ ID NO: 2769831 - DNA, 18 bp, Homo sapiens
tcctccccttcctgcacc

SEQ ID NO: 2769832 - DNA, 16 bp, Homo sapiens
tcctccttggtgcctg

SEQ ID NO: 2769833 - DNA, 17 bp, Homo sapiens
tcctccttggtgcctgg

SEQ ID NO: 2769834 - DNA, 20 bp, Homo sapiens
tcctcctttgcctaggaggc

SEQ ID NO: 2769835 - DNA, 14 bp, Homo sapiens
tcctcgccctgggt

SEQ ID NO: 2769836 - DNA, 14 bp, Homo sapiens
tcctcggccccctc

SEQ ID NO: 2769837 - DNA, 19 bp, Homo sapiens
tcctcggccccctccatcg

SEQ ID NO: 2769838 - DNA, 21 bp, Homo sapiens
tcctctccagccttctctctc

SEQ ID NO: 2769839 - DNA, 11 bp, Homo sapiens
tcctctccagg

SEQ ID NO: 2769840 - DNA, 12 bp, Homo sapiens
tcctctccccag

SEQ ID NO: 2769841 - DNA, 15 bp, Homo sapiens
tcctctccccagcaa

SEQ ID NO: 2769842 - DNA, 16 bp, Homo sapiens
tcctctctctgtgtta

SEQ ID NO: 2769843 - DNA, 14 bp, Homo sapiens
tcctctgccacctc

SEQ ID NO: 2769844 - DNA, 18 bp, Homo sapiens
tcctctgccacctcccct

SEQ ID NO: 2769845 - DNA, 9 bp, Homo sapiens
tcctctggc

SEQ ID NO: 2769846 - DNA, 22 bp, Homo sapiens
tcctctgtccaggcactgctgc

SEQ ID NO: 2769847 - DNA, 23 bp, Homo sapiens
tcctctgtctcgagcgccctgca

SEQ ID NO: 2769848 - DNA, 15 bp, Homo sapiens
tcctctgtctctgct

SEQ ID NO: 2769849 - DNA, 21 bp, Homo sapiens
tcctgaaaaggtttatgaaaa

SEQ ID NO: 2769850 - DNA, 23 bp, Homo sapiens
tcctgaaaaggtttatgaaaaag

SEQ ID NO: 2769851 - DNA, 16 bp, Homo sapiens
tcctgaatattaatcc

SEQ ID NO: 2769852 - DNA, 20 bp, Homo sapiens
tcctgacctcctcctgccct

SEQ ID NO: 2769853 - DNA, 21 bp, Homo sapiens
tcctgacctcctcctgccctc

SEQ ID NO: 2769854 - DNA, 13 bp, Homo sapiens
tcctgagaggtgc

SEQ ID NO: 2769855 - DNA, 14 bp, Homo sapiens
tcctgagcactgcc

SEQ ID NO: 2769856 - DNA, 18 bp, Homo sapiens
tcctgagcactgccagga

SEQ ID NO: 2769857 - DNA, 21 bp, Homo sapiens
tcctgagcactgccaggaggg

SEQ ID NO: 2769858 - DNA, 13 bp, Homo sapiens
tcctgagtagctg

SEQ ID NO: 2769859 - DNA, 17 bp, Homo sapiens
tcctgcaaaattttata

SEQ ID NO: 2769860 - DNA, 19 bp, Homo sapiens
tcctgcaaaattttatagc

SEQ ID NO: 2769861 - DNA, 19 bp, Homo sapiens
tcctgcaatctccagggct

SEQ ID NO: 2769862 - DNA, 20 bp, Homo sapiens
tcctgcacgccgtggagcat

SEQ ID NO: 2769863 - DNA, 12 bp, Homo sapiens
tcctgcagcctc

SEQ ID NO: 2769864 - DNA, 22 bp, Homo sapiens
tcctgcagcctcctcctgacca

SEQ ID NO: 2769865 - DNA, 16 bp, Homo sapiens
tcctgccaccagtcac

SEQ ID NO: 2769866 - DNA, 13 bp, Homo sapiens
tcctgcccaggag

SEQ ID NO: 2769867 - DNA, 18 bp, Homo sapiens
tcctgcccaggagagcca

SEQ ID NO: 2769868 - DNA, 19 bp, Homo sapiens
tcctgcccaggagagccag

SEQ ID NO: 2769869 - DNA, 23 bp, Homo sapiens
tcctgcccaggagagccagccct

SEQ ID NO: 2769870 - DNA, 22 bp, Homo sapiens
tcctgcctacattccctggcct

SEQ ID NO: 2769871 - DNA, 19 bp, Homo sapiens
tcctgcctcagcctcccaa

SEQ ID NO: 2769872 - DNA, 21 bp, Homo sapiens
tcctgcctctactgggaaggc

SEQ ID NO: 2769873 - DNA, 12 bp, Homo sapiens
tcctgcgggctt

SEQ ID NO: 2769874 - DNA, 20 bp, Homo sapiens
tcctgcgggcttttccccgg

SEQ ID NO: 2769875 - DNA, 22 bp, Homo sapiens
tcctgctgtgtgaattcccagg

SEQ ID NO: 2769876 - DNA, 16 bp, Homo sapiens
tcctggaaaggctcag

SEQ ID NO: 2769877 - DNA, 19 bp, Homo sapiens
tcctggaaaggctcagtct

SEQ ID NO: 2769878 - DNA, 17 bp, Homo sapiens
tcctggaatgaagcatg

SEQ ID NO: 2769879 - DNA, 20 bp, Homo sapiens
tcctggaatgaagcatgtag

SEQ ID NO: 2769880 - DNA, 13 bp, Homo sapiens
tcctggacagctg

SEQ ID NO: 2769881 - DNA, 14 bp, Homo sapiens
tcctggacagctgt

SEQ ID NO: 2769882 - DNA, 21 bp, Homo sapiens
tcctggcacccggcccctgct

SEQ ID NO: 2769883 - DNA, 22 bp, Homo sapiens
tcctggcacccggcccctgctg

SEQ ID NO: 2769884 - DNA, 13 bp, Homo sapiens
tcctggccccagc

SEQ ID NO: 2769885 - DNA, 15 bp, Homo sapiens
tcctggccccagccc

SEQ ID NO: 2769886 - DNA, 18 bp, Homo sapiens
tcctggccccagccccca

SEQ ID NO: 2769887 - DNA, 22 bp, Homo sapiens
tcctggcttcccatccccagcg

SEQ ID NO: 2769888 - DNA, 23 bp, Homo sapiens
tcctgggagaacctcaggcttcc

SEQ ID NO: 2769889 - DNA, 17 bp, Homo sapiens
tcctgggagtgagctgg

SEQ ID NO: 2769890 - DNA, 16 bp, Homo sapiens
tcctggggctctgtgc

SEQ ID NO: 2769891 - DNA, 22 bp, Homo sapiens
tcctgggggttctttcttcctc

SEQ ID NO: 2769892 - DNA, 23 bp, Homo sapiens
tcctgggggttctttcttcctct

SEQ ID NO: 2769893 - DNA, 15 bp, Homo sapiens
tcctgggtggctact

SEQ ID NO: 2769894 - DNA, 17 bp, Homo sapiens
tcctgggtggctactct

SEQ ID NO: 2769895 - DNA, 16 bp, Homo sapiens
tcctggtggggcagct

SEQ ID NO: 2769896 - DNA, 23 bp, Homo sapiens
tcctgtaacacaagccacagaag

SEQ ID NO: 2769897 - DNA, 16 bp, Homo sapiens
tcctgtaattttgtag

SEQ ID NO: 2769898 - DNA, 15 bp, Homo sapiens
tcctgtagcatcttc

SEQ ID NO: 2769899 - DNA, 22 bp, Homo sapiens
tcctgtagttgcgtggactctg

SEQ ID NO: 2769900 - DNA, 23 bp, Homo sapiens
tcctgtagttgcgtggactctgc

SEQ ID NO: 2769901 - DNA, 22 bp, Homo sapiens
tcctgtataatctctctcctgt

SEQ ID NO: 2769902 - DNA, 20 bp, Homo sapiens
tcctgtccaacctaacccct

SEQ ID NO: 2769903 - DNA, 13 bp, Homo sapiens
tcctgtccagcag

SEQ ID NO: 2769904 - DNA, 22 bp, Homo sapiens
tcctgtcgattagactggacag

SEQ ID NO: 2769905 - DNA, 13 bp, Homo sapiens
tcctgtctgccag

SEQ ID NO: 2769906 - DNA, 16 bp, Homo sapiens
tcctgtctgccagcca

SEQ ID NO: 2769907 - DNA, 18 bp, Homo sapiens
taaatgcaaacactgtgt

SEQ ID NO: 2769908 - DNA, 18 bp, Homo sapiens
taaatgcaatatgtatta

SEQ ID NO: 2769909 - DNA, 15 bp, Homo sapiens
taaatgcatgatttt

SEQ ID NO: 2769910 - DNA, 14 bp, Homo sapiens
taaatgcattatag

SEQ ID NO: 2769911 - DNA, 15 bp, Homo sapiens
taaatgccctctctg

SEQ ID NO: 2769912 - DNA, 17 bp, Homo sapiens
taaatggggctcacaaa

SEQ ID NO: 2769913 - DNA, 16 bp, Homo sapiens
taaatgtaggtatgaa

SEQ ID NO: 2769914 - DNA, 12 bp, Homo sapiens
taaatgtgtaaa

SEQ ID NO: 2769915 - DNA, 13 bp, Homo sapiens
taaatgtgtaaat

SEQ ID NO: 2769916 - DNA, 20 bp, Homo sapiens
taaatgtgtggtgctaactg

SEQ ID NO: 2769917 - DNA, 19 bp, Homo sapiens
taaatgttggaattttcaa

SEQ ID NO: 2769918 - DNA, 13 bp, Homo sapiens
taaattccactgg

SEQ ID NO: 2769919 - DNA, 15 bp, Homo sapiens
taaattctttttcaa

SEQ ID NO: 2769920 - DNA, 13 bp, Homo sapiens
taaattgaaatat

SEQ ID NO: 2769921 - DNA, 20 bp, Homo sapiens
taaattgaaatataatgcaa

SEQ ID NO: 2769922 - DNA, 15 bp, Homo sapiens
taaattgctccttga

SEQ ID NO: 2769923 - DNA, 16 bp, Homo sapiens
taaattggaattttct

SEQ ID NO: 2769924 - DNA, 17 bp, Homo sapiens
taaatttatttcaaaaa

SEQ ID NO: 2769925 - DNA, 15 bp, Homo sapiens
taaatttattttctt

SEQ ID NO: 2769926 - DNA, 14 bp, Homo sapiens
taacaaaacaagaa

SEQ ID NO: 2769927 - DNA, 18 bp, Homo sapiens
taacaaaacaagaaagaa

SEQ ID NO: 2769928 - DNA, 13 bp, Homo sapiens
taacaagccaccc

SEQ ID NO: 2769929 - DNA, 16 bp, Homo sapiens
taacacaagccacaga

SEQ ID NO: 2769930 - DNA, 19 bp, Homo sapiens
taacactcagaagcctggg

SEQ ID NO: 2769931 - DNA, 17 bp, Homo sapiens
taacagggaaggcaggc

SEQ ID NO: 2769932 - DNA, 22 bp, Homo sapiens
taacagggaaggcaggcagggc

SEQ ID NO: 2769933 - DNA, 16 bp, Homo sapiens
taacatagatttatgt

SEQ ID NO: 2769934 - DNA, 14 bp, Homo sapiens
taacatataatgtt

SEQ ID NO: 2769935 - DNA, 23 bp, Homo sapiens
taacatataatgttgttatttaa

SEQ ID NO: 2769936 - DNA, 20 bp, Homo sapiens
taacattgggaaatcttata

SEQ ID NO: 2769937 - DNA, 17 bp, Homo sapiens
taaccacaaccaggaag

SEQ ID NO: 2769938 - DNA, 15 bp, Homo sapiens
taaccacggaaaaga

SEQ ID NO: 2769939 - DNA, 13 bp, Homo sapiens
taaccatcagtta

SEQ ID NO: 2769940 - DNA, 16 bp, Homo sapiens
taaccatcagttactg

SEQ ID NO: 2769941 - DNA, 23 bp, Homo sapiens
taacccccagtgccacagagaag

SEQ ID NO: 2769942 - DNA, 16 bp, Homo sapiens
taacccctttcctgcg

SEQ ID NO: 2769943 - DNA, 14 bp, Homo sapiens
taaccctctcttcc

SEQ ID NO: 2769944 - DNA, 16 bp, Homo sapiens
taaccctctcttccct

SEQ ID NO: 2769945 - DNA, 13 bp, Homo sapiens
taaccgtttttca

SEQ ID NO: 2769946 - DNA, 18 bp, Homo sapiens
taacggctccaggatttt

SEQ ID NO: 2769947 - DNA, 17 bp, Homo sapiens
taacgtttaagccaaaa

SEQ ID NO: 2769948 - DNA, 16 bp, Homo sapiens
taactaaattaacatt

SEQ ID NO: 2769949 - DNA, 13 bp, Homo sapiens
taactaatttaaa

SEQ ID NO: 2769950 - DNA, 18 bp, Homo sapiens
taactaatttaaaccagc

SEQ ID NO: 2769951 - DNA, 18 bp, Homo sapiens
taactactttttatactc

SEQ ID NO: 2769952 - DNA, 15 bp, Homo sapiens
taactagatctcctg

SEQ ID NO: 2769953 - DNA, 16 bp, Homo sapiens
taactagatctcctgt

SEQ ID NO: 2769954 - DNA, 22 bp, Homo sapiens
taactagtcctgcagaggattt

SEQ ID NO: 2769955 - DNA, 22 bp, Homo sapiens
taactggaagcatgtaggagaa

SEQ ID NO: 2769956 - DNA, 20 bp, Homo sapiens
taactgtgtgaagaaatgga

SEQ ID NO: 2769957 - DNA, 14 bp, Homo sapiens
taacttaaatagta

SEQ ID NO: 2769958 - DNA, 15 bp, Homo sapiens
taacttagcatgtgt

SEQ ID NO: 2769959 - DNA, 15 bp, Homo sapiens
taacttcagagaagt

SEQ ID NO: 2769960 - DNA, 15 bp, Homo sapiens
taacttgtatattcc

SEQ ID NO: 2769961 - DNA, 16 bp, Homo sapiens
taacttgtatattcca

SEQ ID NO: 2769962 - DNA, 17 bp, Homo sapiens
taactttatcacattat

SEQ ID NO: 2769963 - DNA, 13 bp, Homo sapiens
taactttcagaag

SEQ ID NO: 2769964 - DNA, 13 bp, Homo sapiens
taagaaacagagg

SEQ ID NO: 2769965 - DNA, 19 bp, Homo sapiens
taagaaacttttttattta

SEQ ID NO: 2769966 - DNA, 20 bp, Homo sapiens
taagaaacttttttatttaa

SEQ ID NO: 2769967 - DNA, 22 bp, Homo sapiens
taagaacaaagagaaaaaatac

SEQ ID NO: 2769968 - DNA, 21 bp, Homo sapiens
taagaagaatgcttaatcaga

SEQ ID NO: 2769969 - DNA, 11 bp, Homo sapiens
taagaagctct

SEQ ID NO: 2769970 - DNA, 15 bp, Homo sapiens
taagaatgctggttt

SEQ ID NO: 2769971 - DNA, 22 bp, Homo sapiens
taagaatgctggttttcctaaa

SEQ ID NO: 2769972 - DNA, 23 bp, Homo sapiens
taagaatgctggttttcctaaat

SEQ ID NO: 2769973 - DNA, 18 bp, Homo sapiens
taagagaagtagaaatca

SEQ ID NO: 2769974 - DNA, 22 bp, Homo sapiens
taagagaattctaagattgtac

SEQ ID NO: 2769975 - DNA, 18 bp, Homo sapiens
taagagctagcgctgccg

SEQ ID NO: 2769976 - DNA, 20 bp, Homo sapiens
taagagctagcgctgccgca

SEQ ID NO: 2769977 - DNA, 21 bp, Homo sapiens
taagagctgatgtgagtgtgt

SEQ ID NO: 2769978 - DNA, 12 bp, Homo sapiens
taagaggcaggg

SEQ ID NO: 2769979 - DNA, 13 bp, Homo sapiens
taagataattata

SEQ ID NO: 2769980 - DNA, 22 bp, Homo sapiens
taagatggcttatttgtataat

SEQ ID NO: 2769981 - DNA, 15 bp, Homo sapiens
taagattaaaggaag

SEQ ID NO: 2769982 - DNA, 15 bp, Homo sapiens
taagattgtacatat

SEQ ID NO: 2769983 - DNA, 16 bp, Homo sapiens
taagattgtacatatg

SEQ ID NO: 2769984 - DNA, 19 bp, Homo sapiens
taagatttagagatgaatt

SEQ ID NO: 2769985 - DNA, 15 bp, Homo sapiens
taagcaacagaaata

SEQ ID NO: 2769986 - DNA, 17 bp, Homo sapiens
taagcagcctttctgtg

SEQ ID NO: 2769987 - DNA, 18 bp, Homo sapiens
taagcagcctttctgtgg

SEQ ID NO: 2769988 - DNA, 20 bp, Homo sapiens
taagcagcctttctgtggag

SEQ ID NO: 2769989 - DNA, 16 bp, Homo sapiens
taagcagtgcttgtaa

SEQ ID NO: 2769990 - DNA, 19 bp, Homo sapiens
taagcatgatcttgttaat

SEQ ID NO: 2769991 - DNA, 22 bp, Homo sapiens
taagcattgaatggctatgttt

SEQ ID NO: 2769992 - DNA, 18 bp, Homo sapiens
taagcattgggtgggtaa

SEQ ID NO: 2769993 - DNA, 20 bp, Homo sapiens
taagcattttactgtctgta

SEQ ID NO: 2769994 - DNA, 16 bp, Homo sapiens
taagccaaaacaatgt

SEQ ID NO: 2769995 - DNA, 11 bp, Homo sapiens
taagccctgtc

SEQ ID NO: 2769996 - DNA, 22 bp, Homo sapiens
taagccctgtcgagacacttgc

SEQ ID NO: 2769997 - DNA, 21 bp, Homo sapiens
taagcctccatttagttcttt

SEQ ID NO: 2769998 - DNA, 19 bp, Homo sapiens
taaaatcatgtacatttct

SEQ ID NO: 2769999 - DNA, 20 bp, Homo sapiens
taaaatcattcaatatctga

SEQ ID NO: 2770000 - DNA, 13 bp, Homo sapiens
taaaatgtttcat

SEQ ID NO: 2770001 - DNA, 17 bp, Homo sapiens
taaaattagtgagattt

SEQ ID NO: 2770002 - DNA, 17 bp, Homo sapiens
taaaattcttgggagtg

SEQ ID NO: 2770003 - DNA, 21 bp, Homo sapiens
taaaattgacaacattttatt

SEQ ID NO: 2770004 - DNA, 22 bp, Homo sapiens
taaaattgacaacattttatta

SEQ ID NO: 2770005 - DNA, 14 bp, Homo sapiens
taaaatttatattg

SEQ ID NO: 2770006 - DNA, 13 bp, Homo sapiens
taaaattttcaaa

SEQ ID NO: 2770007 - DNA, 12 bp, Homo sapiens
taaacaaatgta

SEQ ID NO: 2770008 - DNA, 19 bp, Homo sapiens
taaacaaatgtatgattac

SEQ ID NO: 2770009 - DNA, 13 bp, Homo sapiens
taaacaagtattt

SEQ ID NO: 2770010 - DNA, 18 bp, Homo sapiens
taaacaagtatttgttaa

SEQ ID NO: 2770011 - DNA, 22 bp, Homo sapiens
taaacaagtatttgttaattta

SEQ ID NO: 2770012 - DNA, 16 bp, Homo sapiens
taaacaattcaagtga

SEQ ID NO: 2770013 - DNA, 22 bp, Homo sapiens
taaacaatttctgcattcttaa

SEQ ID NO: 2770014 - DNA, 23 bp, Homo sapiens
taaacacagaggttttaaacagt

SEQ ID NO: 2770015 - DNA, 12 bp, Homo sapiens
taaacacagtgc

SEQ ID NO: 2770016 - DNA, 22 bp, Homo sapiens
taaacacccatgaatcaaagac

SEQ ID NO: 2770017 - DNA, 11 bp, Homo sapiens
taaacacctga

SEQ ID NO: 2770018 - DNA, 16 bp, Homo sapiens
taaacacctgacacat

SEQ ID NO: 2770019 - DNA, 18 bp, Homo sapiens
taaacacctgacacatct

SEQ ID NO: 2770020 - DNA, 16 bp, Homo sapiens
taaacactgtaatctt

SEQ ID NO: 2770021 - DNA, 17 bp, Homo sapiens
taaacactgtaatctta

SEQ ID NO: 2770022 - DNA, 20 bp, Homo sapiens
taaacataattcttgtatat

SEQ ID NO: 2770023 - DNA, 16 bp, Homo sapiens
taaacatgagaataaa

SEQ ID NO: 2770024 - DNA, 14 bp, Homo sapiens
taaacattaaaaga

SEQ ID NO: 2770025 - DNA, 20 bp, Homo sapiens
taaacattaaacactgtaat

SEQ ID NO: 2770026 - DNA, 14 bp, Homo sapiens
taaaccagcagaaa

SEQ ID NO: 2770027 - DNA, 17 bp, Homo sapiens
taaaccgctaaaagaaa

SEQ ID NO: 2770028 - DNA, 22 bp, Homo sapiens
taaactagatctcctatttttc

SEQ ID NO: 2770029 - DNA, 23 bp, Homo sapiens
taaactggggagttataaaaata

SEQ ID NO: 2770030 - DNA, 13 bp, Homo sapiens
taaacttcagcac

SEQ ID NO: 2770031 - DNA, 14 bp, Homo sapiens
taaacttcagcacc

SEQ ID NO: 2770032 - DNA, 12 bp, Homo sapiens
taaacttctgat

SEQ ID NO: 2770033 - DNA, 14 bp, Homo sapiens
taaacttgtcagaa

SEQ ID NO: 2770034 - DNA, 20 bp, Homo sapiens
taaacttgtgtatgatccaa

SEQ ID NO: 2770035 - DNA, 15 bp, Homo sapiens
taaagaataatatgc

SEQ ID NO: 2770036 - DNA, 14 bp, Homo sapiens
taaagacagaaaaa

SEQ ID NO: 2770037 - DNA, 16 bp, Homo sapiens
taaagacttcatgttc

SEQ ID NO: 2770038 - DNA, 10 bp, Homo sapiens
taaagagctc

SEQ ID NO: 2770039 - DNA, 19 bp, Homo sapiens
taaagaggcgtcttgtatt

SEQ ID NO: 2770040 - DNA, 22 bp, Homo sapiens
taaagaggcgtcttgtattttc

SEQ ID NO: 2770041 - DNA, 23 bp, Homo sapiens
taaagaggcgtcttgtattttct

SEQ ID NO: 2770042 - DNA, 22 bp, Homo sapiens
taaagatgccctaagtgttgaa

SEQ ID NO: 2770043 - DNA, 14 bp, Homo sapiens
taaagatgtcaaat

SEQ ID NO: 2770044 - DNA, 19 bp, Homo sapiens
taaagcagtggacaccagg

SEQ ID NO: 2770045 - DNA, 21 bp, Homo sapiens
taaagcgtttgcacagatcaa

SEQ ID NO: 2770046 - DNA, 17 bp, Homo sapiens
taaagctgcctgtagtt

SEQ ID NO: 2770047 - DNA, 19 bp, Homo sapiens
taaagctggacaagaagct

SEQ ID NO: 2770048 - DNA, 22 bp, Homo sapiens
taaaggagaaggcatgaaattg

SEQ ID NO: 2770049 - DNA, 17 bp, Homo sapiens
taaaggtggtatgtgtg

SEQ ID NO: 2770050 - DNA, 21 bp, Homo sapiens
taaaggtggtatgtgtgtgta

SEQ ID NO: 2770051 - DNA, 15 bp, Homo sapiens
taaagtaattttgtg

SEQ ID NO: 2770052 - DNA, 22 bp, Homo sapiens
taaagtacctgtagtgagaaac

SEQ ID NO: 2770053 - DNA, 19 bp, Homo sapiens
taaagtatatatagaatct

SEQ ID NO: 2770054 - DNA, 19 bp, Homo sapiens
taaagtctgagtgggcggc

SEQ ID NO: 2770055 - DNA, 15 bp, Homo sapiens
taaagtgaccaggct

SEQ ID NO: 2770056 - DNA, 22 bp, Homo sapiens
taaagtgtaaatcctttttctt

SEQ ID NO: 2770057 - DNA, 20 bp, Homo sapiens
taaagttgaagctaagattt

SEQ ID NO: 2770058 - DNA, 21 bp, Homo sapiens
taaagttgttcacatatatgt

SEQ ID NO: 2770059 - DNA, 16 bp, Homo sapiens
taaataaaaatattct

SEQ ID NO: 2770060 - DNA, 14 bp, Homo sapiens
taaataaaagcagc

SEQ ID NO: 2770061 - DNA, 20 bp, Homo sapiens
taaataaaagcagcatctgc

SEQ ID NO: 2770062 - DNA, 16 bp, Homo sapiens
taaataaataaaaata

SEQ ID NO: 2770063 - DNA, 13 bp, Homo sapiens
taaataaatgcca

SEQ ID NO: 2770064 - DNA, 17 bp, Homo sapiens
taaataaattcaaacca

SEQ ID NO: 2770065 - DNA, 18 bp, Homo sapiens
taaataaattcaaaccat

SEQ ID NO: 2770066 - DNA, 11 bp, Homo sapiens
taaataagaaa

SEQ ID NO: 2770067 - DNA, 13 bp, Homo sapiens
taaataagaaact

SEQ ID NO: 2770068 - DNA, 16 bp, Homo sapiens
taaataagaaactttt

SEQ ID NO: 2770069 - DNA, 15 bp, Homo sapiens
taaatacagacacta

SEQ ID NO: 2770070 - DNA, 17 bp, Homo sapiens
taaatacatgtgtggat

SEQ ID NO: 2770071 - DNA, 16 bp, Homo sapiens
taaatagcatctgctc

SEQ ID NO: 2770072 - DNA, 21 bp, Homo sapiens
taaatagtaggaccaatgttg

SEQ ID NO: 2770073 - DNA, 21 bp, Homo sapiens
taaatagttcagtataaattg

SEQ ID NO: 2770074 - DNA, 19 bp, Homo sapiens
taaatagttttaaatatga

SEQ ID NO: 2770075 - DNA, 18 bp, Homo sapiens
taaatatatatttttcaa

SEQ ID NO: 2770076 - DNA, 19 bp, Homo sapiens
taaatatatatttttcaac

SEQ ID NO: 2770077 - DNA, 13 bp, Homo sapiens
taaatatgaacaa

SEQ ID NO: 2770078 - DNA, 18 bp, Homo sapiens
taaatatgttagcaaaga

SEQ ID NO: 2770079 - DNA, 10 bp, Homo sapiens
taaatattta

SEQ ID NO: 2770080 - DNA, 16 bp, Homo sapiens
taaatcaaaagctgct

SEQ ID NO: 2770081 - DNA, 17 bp, Homo sapiens
taaatcaaaagctgctt

SEQ ID NO: 2770082 - DNA, 16 bp, Homo sapiens
taaatcaactccagct

SEQ ID NO: 2770083 - DNA, 15 bp, Homo sapiens
taaatcccattcata

SEQ ID NO: 2770084 - DNA, 19 bp, Homo sapiens
taaatcctttttctttata

SEQ ID NO: 2770085 - DNA, 19 bp, Homo sapiens
taaatctgagcctaaatct

SEQ ID NO: 2770086 - DNA, 18 bp, Homo sapiens
taaatgaaaatcgtgaca

SEQ ID NO: 2770087 - DNA, 12 bp, Homo sapiens
taaatgaagaaa

SEQ ID NO: 2770088 - DNA, 16 bp, Homo sapiens
gtttgagctcagaccc

SEQ ID NO: 2770089 - DNA, 16 bp, Homo sapiens
gtttgatagattttct

SEQ ID NO: 2770090 - DNA, 21 bp, Homo sapiens
gtttgattttagctgcagaac

SEQ ID NO: 2770091 - DNA, 13 bp, Homo sapiens
gtttgcaaggaag

SEQ ID NO: 2770092 - DNA, 17 bp, Homo sapiens
gtttgcaaggaagccac

SEQ ID NO: 2770093 - DNA, 20 bp, Homo sapiens
gtttgcactgtatgctggac

SEQ ID NO: 2770094 - DNA, 19 bp, Homo sapiens
gtttgcagaaaagcacctg

SEQ ID NO: 2770095 - DNA, 18 bp, Homo sapiens
gtttgccttctactttta

SEQ ID NO: 2770096 - DNA, 21 bp, Homo sapiens
gtttggggcaggagtagctga

SEQ ID NO: 2770097 - DNA, 13 bp, Homo sapiens
gtttgtatattgt

SEQ ID NO: 2770098 - DNA, 19 bp, Homo sapiens
gtttgtcatatattcatgt

SEQ ID NO: 2770099 - DNA, 23 bp, Homo sapiens
gtttgtgcctttttatttttgtt

SEQ ID NO: 2770100 - DNA, 12 bp, Homo sapiens
gtttgtgtgtct

SEQ ID NO: 2770101 - DNA, 18 bp, Homo sapiens
gtttgtttctccccctgg

SEQ ID NO: 2770102 - DNA, 21 bp, Homo sapiens
gtttgtttctccccctgggct

SEQ ID NO: 2770103 - DNA, 19 bp, Homo sapiens
gttttaaacatagaaagtt

SEQ ID NO: 2770104 - DNA, 15 bp, Homo sapiens
gttttaaatatgaac

SEQ ID NO: 2770105 - DNA, 22 bp, Homo sapiens
gttttacaaatttaattttgca

SEQ ID NO: 2770106 - DNA, 13 bp, Homo sapiens
gttttagaatgat

SEQ ID NO: 2770107 - DNA, 21 bp, Homo sapiens
gttttagctccttgactcctt

SEQ ID NO: 2770108 - DNA, 19 bp, Homo sapiens
gttttatatttttatagac

SEQ ID NO: 2770109 - DNA, 17 bp, Homo sapiens
gttttcagactcagact

SEQ ID NO: 2770110 - DNA, 14 bp, Homo sapiens
gttttccaccctgg

SEQ ID NO: 2770111 - DNA, 21 bp, Homo sapiens
gttttccctgacctccctcta

SEQ ID NO: 2770112 - DNA, 18 bp, Homo sapiens
gttttctcctcccaggaa

SEQ ID NO: 2770113 - DNA, 15 bp, Homo sapiens
gttttcttcccatca

SEQ ID NO: 2770114 - DNA, 13 bp, Homo sapiens
gttttgaaatgct

SEQ ID NO: 2770115 - DNA, 19 bp, Homo sapiens
gttttgatttgtactgaaa

SEQ ID NO: 2770116 - DNA, 16 bp, Homo sapiens
gttttgccatgttggc

SEQ ID NO: 2770117 - DNA, 20 bp, Homo sapiens
gttttgccatgttggccagg

SEQ ID NO: 2770118 - DNA, 22 bp, Homo sapiens
gttttgccatgttggccaggct

SEQ ID NO: 2770119 - DNA, 16 bp, Homo sapiens
gttttgctgtttcctt

SEQ ID NO: 2770120 - DNA, 18 bp, Homo sapiens
gttttgtcctttgagaaa

SEQ ID NO: 2770121 - DNA, 15 bp, Homo sapiens
gtttttaagctgttt

SEQ ID NO: 2770122 - DNA, 13 bp, Homo sapiens
gtttttaatgtat

SEQ ID NO: 2770123 - DNA, 17 bp, Homo sapiens
gtttttactttctgttg

SEQ ID NO: 2770124 - DNA, 16 bp, Homo sapiens
gtttttcggacagttt

SEQ ID NO: 2770125 - DNA, 19 bp, Homo sapiens
gtttttttgtatagtaaag

SEQ ID NO: 2770126 - DNA, 20 bp, Homo sapiens
gttttttttaaataaaagca

SEQ ID NO: 2770127 - DNA, 20 bp, Homo sapiens
taaaaaaataagaagaatgc

SEQ ID NO: 2770128 - DNA, 16 bp, Homo sapiens
taaaaaaatacagtaa

SEQ ID NO: 2770129 - DNA, 16 bp, Homo sapiens
taaaaaacatttgtac

SEQ ID NO: 2770130 - DNA, 17 bp, Homo sapiens
taaaaaacatttgtaca

SEQ ID NO: 2770131 - DNA, 17 bp, Homo sapiens
taaaaaactaaaaacta

SEQ ID NO: 2770132 - DNA, 15 bp, Homo sapiens
taaaaaacttgtaaa

SEQ ID NO: 2770133 - DNA, 17 bp, Homo sapiens
taaaaaataaatataat

SEQ ID NO: 2770134 - DNA, 15 bp, Homo sapiens
taaaaacatgagaaa

SEQ ID NO: 2770135 - DNA, 13 bp, Homo sapiens
taaaaaccctgta

SEQ ID NO: 2770136 - DNA, 21 bp, Homo sapiens
taaaaactgagtgactctata

SEQ ID NO: 2770137 - DNA, 12 bp, Homo sapiens
taaaaagattat

SEQ ID NO: 2770138 - DNA, 14 bp, Homo sapiens
taaaaagattatat

SEQ ID NO: 2770139 - DNA, 13 bp, Homo sapiens
taaaaagatttgt

SEQ ID NO: 2770140 - DNA, 15 bp, Homo sapiens
taaaaagttgcacat

SEQ ID NO: 2770141 - DNA, 18 bp, Homo sapiens
taaaaagtttgccctgga

SEQ ID NO: 2770142 - DNA, 13 bp, Homo sapiens
taaaaatataaga

SEQ ID NO: 2770143 - DNA, 18 bp, Homo sapiens
taaaaatataagaacttg

SEQ ID NO: 2770144 - DNA, 10 bp, Homo sapiens
taaaaatatt

SEQ ID NO: 2770145 - DNA, 20 bp, Homo sapiens
taaaaatcataaactgtgtg

SEQ ID NO: 2770146 - DNA, 17 bp, Homo sapiens
taaaaatctttgattca

SEQ ID NO: 2770147 - DNA, 17 bp, Homo sapiens
taaaaattgtgatcaga

SEQ ID NO: 2770148 - DNA, 15 bp, Homo sapiens
taaaacaacactcac

SEQ ID NO: 2770149 - DNA, 23 bp, Homo sapiens
taaaacaatgaaggaaaacctca

SEQ ID NO: 2770150 - DNA, 19 bp, Homo sapiens
taaaacacttccataatct

SEQ ID NO: 2770151 - DNA, 11 bp, Homo sapiens
taaaacattcc

SEQ ID NO: 2770152 - DNA, 14 bp, Homo sapiens
taaaacatttattt

SEQ ID NO: 2770153 - DNA, 14 bp, Homo sapiens
taaaaccttactta

SEQ ID NO: 2770154 - DNA, 18 bp, Homo sapiens
taaaaccttacttaaagc

SEQ ID NO: 2770155 - DNA, 11 bp, Homo sapiens
taaaacctttc

SEQ ID NO: 2770156 - DNA, 16 bp, Homo sapiens
taaaacctttcaaatt

SEQ ID NO: 2770157 - DNA, 21 bp, Homo sapiens
taaaactatggttcccaataa

SEQ ID NO: 2770158 - DNA, 14 bp, Homo sapiens
taaaactttgaagt

SEQ ID NO: 2770159 - DNA, 13 bp, Homo sapiens
taaaagaaacttt

SEQ ID NO: 2770160 - DNA, 17 bp, Homo sapiens
taaaagaaactttcttt

SEQ ID NO: 2770161 - DNA, 18 bp, Homo sapiens
taaaagaacagtaaacat

SEQ ID NO: 2770162 - DNA, 23 bp, Homo sapiens
taaaagataacaagatctttcag

SEQ ID NO: 2770163 - DNA, 18 bp, Homo sapiens
taaaagcaaaaaagaaaa

SEQ ID NO: 2770164 - DNA, 18 bp, Homo sapiens
taaaagcataaatgcaaa

SEQ ID NO: 2770165 - DNA, 12 bp, Homo sapiens
taaaaggagcca

SEQ ID NO: 2770166 - DNA, 13 bp, Homo sapiens
taaaaggtattga

SEQ ID NO: 2770167 - DNA, 16 bp, Homo sapiens
taaaataaaaaccaga

SEQ ID NO: 2770168 - DNA, 13 bp, Homo sapiens
taaaataaagtat

SEQ ID NO: 2770169 - DNA, 21 bp, Homo sapiens
taaaataactagtgttgcttg

SEQ ID NO: 2770170 - DNA, 24 bp, Homo sapiens
taaaataactagtgttgcttggac

SEQ ID NO: 2770171 - DNA, 22 bp, Homo sapiens
taaaataatgatttaagcattt

SEQ ID NO: 2770172 - DNA, 21 bp, Homo sapiens
taaaatagccacttaccttca

SEQ ID NO: 2770173 - DNA, 19 bp, Homo sapiens
taaaatagtattgaaagtg

SEQ ID NO: 2770174 - DNA, 16 bp, Homo sapiens
taaaatatacaaacat

SEQ ID NO: 2770175 - DNA, 17 bp, Homo sapiens
taaaatatatataaata

SEQ ID NO: 2770176 - DNA, 17 bp, Homo sapiens
taaaatatatttcagat

SEQ ID NO: 2770177 - DNA, 20 bp, Homo sapiens
taaaatcaggattttagtgc

SEQ ID NO: 2770178 - DNA, 18 bp, Homo sapiens
taaaatcatgtacatttc

SEQ ID NO: 2770179 - DNA, 13 bp, Homo sapiens
gtgtgtgatggga

SEQ ID NO: 2770180 - DNA, 21 bp, Homo sapiens
gtgtgtgcgcctacaggagtg

SEQ ID NO: 2770181 - DNA, 16 bp, Homo sapiens
gtgtgttgtctgtgca

SEQ ID NO: 2770182 - DNA, 21 bp, Homo sapiens
gtgtgttttgagagtatatta

SEQ ID NO: 2770183 - DNA, 12 bp, Homo sapiens
gtgttaattttt

SEQ ID NO: 2770184 - DNA, 23 bp, Homo sapiens
gtgttacccagtaactcatctgt

SEQ ID NO: 2770185 - DNA, 19 bp, Homo sapiens
gtgttcctcaccaataact

SEQ ID NO: 2770186 - DNA, 17 bp, Homo sapiens
gtgttctcaatgctttt

SEQ ID NO: 2770187 - DNA, 16 bp, Homo sapiens
gtgtttacaaaaggca

SEQ ID NO: 2770188 - DNA, 15 bp, Homo sapiens
gtgtttagttgcaga

SEQ ID NO: 2770189 - DNA, 15 bp, Homo sapiens
gtgtttcccataatt

SEQ ID NO: 2770190 - DNA, 21 bp, Homo sapiens
gttaaaataactagtgttgct

SEQ ID NO: 2770191 - DNA, 15 bp, Homo sapiens
gttaaaatgtacact

SEQ ID NO: 2770192 - DNA, 23 bp, Homo sapiens
gttaacccatttttgagccaagc

SEQ ID NO: 2770193 - DNA, 17 bp, Homo sapiens
gttaacctcagtgtcat

SEQ ID NO: 2770194 - DNA, 14 bp, Homo sapiens
gttaacgtcatctc

SEQ ID NO: 2770195 - DNA, 14 bp, Homo sapiens
gttaacttgtatat

SEQ ID NO: 2770196 - DNA, 16 bp, Homo sapiens
gttaagacttgacagt

SEQ ID NO: 2770197 - DNA, 22 bp, Homo sapiens
gttaagttacttcactttaatt

SEQ ID NO: 2770198 - DNA, 17 bp, Homo sapiens
gttaatacttaacattg

SEQ ID NO: 2770199 - DNA, 23 bp, Homo sapiens
gttaatacttaacattgatttat

SEQ ID NO: 2770200 - DNA, 12 bp, Homo sapiens
gttaatcttagg

SEQ ID NO: 2770201 - DNA, 14 bp, Homo sapiens
gttaatttttgata

SEQ ID NO: 2770202 - DNA, 13 bp, Homo sapiens
gttacaaaaatag

SEQ ID NO: 2770203 - DNA, 16 bp, Homo sapiens
gttacatgtttgcacc

SEQ ID NO: 2770204 - DNA, 17 bp, Homo sapiens
gttacctcctataaact

SEQ ID NO: 2770205 - DNA, 17 bp, Homo sapiens
gttacctttcccatgct

SEQ ID NO: 2770206 - DNA, 19 bp, Homo sapiens
gttacctttcccatgctga

SEQ ID NO: 2770207 - DNA, 12 bp, Homo sapiens
gttgcaataaaa

SEQ ID NO: 2770208 - DNA, 23 bp, Homo sapiens
gttgcaataaaatagtattgaaa

SEQ ID NO: 2770209 - DNA, 20 bp, Homo sapiens
gttgcattaaaaatgcatat

SEQ ID NO: 2770210 - DNA, 17 bp, Homo sapiens
gttgcccaggcaggtct

SEQ ID NO: 2770211 - DNA, 12 bp, Homo sapiens
gttgcccaggct

SEQ ID NO: 2770212 - DNA, 16 bp, Homo sapiens
gttgcccaggctggcg

SEQ ID NO: 2770213 - DNA, 17 bp, Homo sapiens
gttgcccaggctggcgt

SEQ ID NO: 2770214 - DNA, 20 bp, Homo sapiens
gttgctcaaatctattcaga

SEQ ID NO: 2770215 - DNA, 20 bp, Homo sapiens
gttgctgagttcctgtgggt

SEQ ID NO: 2770216 - DNA, 20 bp, Homo sapiens
gttgctttaaagtacctgta

SEQ ID NO: 2770217 - DNA, 20 bp, Homo sapiens
gttggaaaagaatacagaaa

SEQ ID NO: 2770218 - DNA, 19 bp, Homo sapiens
gttggagaaaatgaagaaa

SEQ ID NO: 2770219 - DNA, 17 bp, Homo sapiens
gttggccaggctggtct

SEQ ID NO: 2770220 - DNA, 14 bp, Homo sapiens
gttggccagtgtga

SEQ ID NO: 2770221 - DNA, 22 bp, Homo sapiens
gttggccgtggtccagctcttg

SEQ ID NO: 2770222 - DNA, 17 bp, Homo sapiens
gttgggctggtgtcacc

SEQ ID NO: 2770223 - DNA, 13 bp, Homo sapiens
gttgggtggatgc

SEQ ID NO: 2770224 - DNA, 14 bp, Homo sapiens
gttgtaaatattta

SEQ ID NO: 2770225 - DNA, 21 bp, Homo sapiens
gttgtcaatattaaatacaga

SEQ ID NO: 2770226 - DNA, 13 bp, Homo sapiens
gttgtctctctaa

SEQ ID NO: 2770227 - DNA, 14 bp, Homo sapiens
gttgtctgtgcagc

SEQ ID NO: 2770228 - DNA, 19 bp, Homo sapiens
gttgtgagcactctactgc

SEQ ID NO: 2770229 - DNA, 22 bp, Homo sapiens
gttgtgaggcctggccaggcac

SEQ ID NO: 2770230 - DNA, 21 bp, Homo sapiens
gttgtgatcatcccatctaag

SEQ ID NO: 2770231 - DNA, 21 bp, Homo sapiens
gttgttaaacacgtgtctata

SEQ ID NO: 2770232 - DNA, 16 bp, Homo sapiens
gttgttaatgaaaatg

SEQ ID NO: 2770233 - DNA, 18 bp, Homo sapiens
gttgttaatgaaaatgtc

SEQ ID NO: 2770234 - DNA, 13 bp, Homo sapiens
gttgttaatgttg

SEQ ID NO: 2770235 - DNA, 14 bp, Homo sapiens
gttgttaatgttgg

SEQ ID NO: 2770236 - DNA, 24 bp, Homo sapiens
gttgttgttaatgaaaatgtcaga

SEQ ID NO: 2770237 - DNA, 22 bp, Homo sapiens
gtttaaaaaaagtatatattct

SEQ ID NO: 2770238 - DNA, 14 bp, Homo sapiens
gtttaaaaaataca

SEQ ID NO: 2770239 - DNA, 16 bp, Homo sapiens
gtttacactctttgta

SEQ ID NO: 2770240 - DNA, 13 bp, Homo sapiens
gtttactatttta

SEQ ID NO: 2770241 - DNA, 14 bp, Homo sapiens
gtttactgctgtca

SEQ ID NO: 2770242 - DNA, 19 bp, Homo sapiens
gtttagaagagcctgactg

SEQ ID NO: 2770243 - DNA, 17 bp, Homo sapiens
gtttataagcccaaatg

SEQ ID NO: 2770244 - DNA, 13 bp, Homo sapiens
gtttattaacaaa

SEQ ID NO: 2770245 - DNA, 22 bp, Homo sapiens
gtttatttaacttttagtaaag

SEQ ID NO: 2770246 - DNA, 16 bp, Homo sapiens
gtttatttatcagtga

SEQ ID NO: 2770247 - DNA, 19 bp, Homo sapiens
gtttatttatcagtgacag

SEQ ID NO: 2770248 - DNA, 19 bp, Homo sapiens
gtttcactatgattttcta

SEQ ID NO: 2770249 - DNA, 21 bp, Homo sapiens
gtttcactatgattttctatt

SEQ ID NO: 2770250 - DNA, 22 bp, Homo sapiens
gtttccactgtcttgcctgcca

SEQ ID NO: 2770251 - DNA, 23 bp, Homo sapiens
gtttccagaaaatataaatgcat

SEQ ID NO: 2770252 - DNA, 14 bp, Homo sapiens
gtttcccaccacct

SEQ ID NO: 2770253 - DNA, 13 bp, Homo sapiens
gtttcccataatt

SEQ ID NO: 2770254 - DNA, 21 bp, Homo sapiens
gtttcccataattttcttcat

SEQ ID NO: 2770255 - DNA, 20 bp, Homo sapiens
gtttcctcattcctgaaaga

SEQ ID NO: 2770256 - DNA, 23 bp, Homo sapiens
gtttctattctctcctcagactg

SEQ ID NO: 2770257 - DNA, 19 bp, Homo sapiens
gtttctcagaatccaaaga

SEQ ID NO: 2770258 - DNA, 17 bp, Homo sapiens
gtttctccccctgggct

SEQ ID NO: 2770259 - DNA, 23 bp, Homo sapiens
gtttctccccctgggctctgccc

SEQ ID NO: 2770260 - DNA, 18 bp, Homo sapiens
gtttctcctttattgctc

SEQ ID NO: 2770261 - DNA, 20 bp, Homo sapiens
gtttctcctttattgctcct

SEQ ID NO: 2770262 - DNA, 20 bp, Homo sapiens
gtttctgagttcctgcatgc

SEQ ID NO: 2770263 - DNA, 22 bp, Homo sapiens
gtttctgcagtagtctctgtgc

SEQ ID NO: 2770264 - DNA, 21 bp, Homo sapiens
gtttctgcccacattggaccc

SEQ ID NO: 2770265 - DNA, 22 bp, Homo sapiens
gtttcttaaataagaaactttt

SEQ ID NO: 2770266 - DNA, 13 bp, Homo sapiens
gtttcttgcctca

SEQ ID NO: 2770267 - DNA, 19 bp, Homo sapiens
gtttgaaagtgaataaact

SEQ ID NO: 2770268 - DNA, 17 bp, Homo sapiens
gtttgaaggaggtgagg

SEQ ID NO: 2770269 - DNA, 17 bp, Homo sapiens
gtttgaatataaacact

SEQ ID NO: 2770270 - DNA, 16 bp, Homo sapiens
taagctaacccccttc

SEQ ID NO: 2770271 - DNA, 12 bp, Homo sapiens
taagctgcagct

SEQ ID NO: 2770272 - DNA, 15 bp, Homo sapiens
taagctgcagcttcc

SEQ ID NO: 2770273 - DNA, 16 bp, Homo sapiens
taagctgcagcttcct

SEQ ID NO: 2770274 - DNA, 11 bp, Homo sapiens
taagctgtttc

SEQ ID NO: 2770275 - DNA, 14 bp, Homo sapiens
taagcttatttaat

SEQ ID NO: 2770276 - DNA, 15 bp, Homo sapiens
taaggacacactaat

SEQ ID NO: 2770277 - DNA, 16 bp, Homo sapiens
taaggagatgggcctt

SEQ ID NO: 2770278 - DNA, 19 bp, Homo sapiens
taaggatcagaacagcaga

SEQ ID NO: 2770279 - DNA, 20 bp, Homo sapiens
taaggcaacatttccgaaga

SEQ ID NO: 2770280 - DNA, 11 bp, Homo sapiens
taagggaaaaa

SEQ ID NO: 2770281 - DNA, 12 bp, Homo sapiens
taagggaaaaat

SEQ ID NO: 2770282 - DNA, 17 bp, Homo sapiens
taagggaaaaatatata

SEQ ID NO: 2770283 - DNA, 18 bp, Homo sapiens
taagggaataagccatga

SEQ ID NO: 2770284 - DNA, 13 bp, Homo sapiens
taagggttttaga

SEQ ID NO: 2770285 - DNA, 20 bp, Homo sapiens
taaggtaatttctgtgtatt

SEQ ID NO: 2770286 - DNA, 18 bp, Homo sapiens
taaggtacaagaagcatt

SEQ ID NO: 2770287 - DNA, 15 bp, Homo sapiens
taaggtgtgctctga

SEQ ID NO: 2770288 - DNA, 12 bp, Homo sapiens
taagtatatagt

SEQ ID NO: 2770289 - DNA, 23 bp, Homo sapiens
taagtatatagtatatttatact

SEQ ID NO: 2770290 - DNA, 12 bp, Homo sapiens
taagtatttagg

SEQ ID NO: 2770291 - DNA, 14 bp, Homo sapiens
taagtatttatata

SEQ ID NO: 2770292 - DNA, 18 bp, Homo sapiens
taagtatttatatattta

SEQ ID NO: 2770293 - DNA, 13 bp, Homo sapiens
taagtcagaacag

SEQ ID NO: 2770294 - DNA, 14 bp, Homo sapiens
taagtcagaacagc

SEQ ID NO: 2770295 - DNA, 18 bp, Homo sapiens
taagtcatccacagccca

SEQ ID NO: 2770296 - DNA, 22 bp, Homo sapiens
taagtgctgtttgagatgtgat

SEQ ID NO: 2770297 - DNA, 13 bp, Homo sapiens
taagtggaaaaaa

SEQ ID NO: 2770298 - DNA, 17 bp, Homo sapiens
taagtggaaaaaagaga

SEQ ID NO: 2770299 - DNA, 22 bp, Homo sapiens
taagtggaaaaaagagaaaaac

SEQ ID NO: 2770300 - DNA, 13 bp, Homo sapiens
taagtggctgctg

SEQ ID NO: 2770301 - DNA, 14 bp, Homo sapiens
taagtgttgtaaat

SEQ ID NO: 2770302 - DNA, 14 bp, Homo sapiens
taagttaatttaaa

SEQ ID NO: 2770303 - DNA, 19 bp, Homo sapiens
taagttagagaatatattt

SEQ ID NO: 2770304 - DNA, 17 bp, Homo sapiens
taagttgaatggcctgc

SEQ ID NO: 2770305 - DNA, 20 bp, Homo sapiens
taagttggaccagaggaagc

SEQ ID NO: 2770306 - DNA, 12 bp, Homo sapiens
taagtttgatca

SEQ ID NO: 2770307 - DNA, 16 bp, Homo sapiens
taataaaaatttgttt

SEQ ID NO: 2770308 - DNA, 23 bp, Homo sapiens
taataaatctgagcctaaatcta

SEQ ID NO: 2770309 - DNA, 13 bp, Homo sapiens
taataaattcaga

SEQ ID NO: 2770310 - DNA, 16 bp, Homo sapiens
taataatgttctctgg

SEQ ID NO: 2770311 - DNA, 14 bp, Homo sapiens
taatacctctgtgt

SEQ ID NO: 2770312 - DNA, 12 bp, Homo sapiens
taatagaagaac

SEQ ID NO: 2770313 - DNA, 14 bp, Homo sapiens
taatagatgtttga

SEQ ID NO: 2770314 - DNA, 16 bp, Homo sapiens
taatagatgtttgata

SEQ ID NO: 2770315 - DNA, 21 bp, Homo sapiens
taatagatgtttgatagattt

SEQ ID NO: 2770316 - DNA, 18 bp, Homo sapiens
taatatagctatcatttc

SEQ ID NO: 2770317 - DNA, 17 bp, Homo sapiens
taatatcctaaacatca

SEQ ID NO: 2770318 - DNA, 19 bp, Homo sapiens
taatatctgagaagtgtat

SEQ ID NO: 2770319 - DNA, 13 bp, Homo sapiens
taatatctgtgag

SEQ ID NO: 2770320 - DNA, 15 bp, Homo sapiens
taatatctgtgaggt

SEQ ID NO: 2770321 - DNA, 21 bp, Homo sapiens
taatatctgtgaggtgctgat

SEQ ID NO: 2770322 - DNA, 12 bp, Homo sapiens
taatatcttgaa

SEQ ID NO: 2770323 - DNA, 14 bp, Homo sapiens
taatatcttgaaga

SEQ ID NO: 2770324 - DNA, 16 bp, Homo sapiens
taatatggggatgcag

SEQ ID NO: 2770325 - DNA, 21 bp, Homo sapiens
taatatgttaacctcagtgtc

SEQ ID NO: 2770326 - DNA, 15 bp, Homo sapiens
taatcaggctgaggt

SEQ ID NO: 2770327 - DNA, 19 bp, Homo sapiens
taatcagggaggtcatttt

SEQ ID NO: 2770328 - DNA, 22 bp, Homo sapiens
taatcaggtcctcagagaattt

SEQ ID NO: 2770329 - DNA, 17 bp, Homo sapiens
taatcaggttgttaatg

SEQ ID NO: 2770330 - DNA, 18 bp, Homo sapiens
taatcaggttgttaatgt

SEQ ID NO: 2770331 - DNA, 20 bp, Homo sapiens
taatcatataataaatgtac

SEQ ID NO: 2770332 - DNA, 19 bp, Homo sapiens
taatcccagcactttggga

SEQ ID NO: 2770333 - DNA, 12 bp, Homo sapiens
taatcccagcta

SEQ ID NO: 2770334 - DNA, 20 bp, Homo sapiens
taatcccagctactcaggag

SEQ ID NO: 2770335 - DNA, 19 bp, Homo sapiens
taatcccagctacttggga

SEQ ID NO: 2770336 - DNA, 22 bp, Homo sapiens
taatcctattaaaacacagctt

SEQ ID NO: 2770337 - DNA, 16 bp, Homo sapiens
taatcctgtatattat

SEQ ID NO: 2770338 - DNA, 15 bp, Homo sapiens
taatcgaaatgaatt

SEQ ID NO: 2770339 - DNA, 21 bp, Homo sapiens
taatcgaaatgaatttatctg

SEQ ID NO: 2770340 - DNA, 22 bp, Homo sapiens
taatcggcccacagctcccacc

SEQ ID NO: 2770341 - DNA, 15 bp, Homo sapiens
taatcgttatgtgtg

SEQ ID NO: 2770342 - DNA, 18 bp, Homo sapiens
taatcgttatgtgtgtat

SEQ ID NO: 2770343 - DNA, 14 bp, Homo sapiens
taatctagaacaca

SEQ ID NO: 2770344 - DNA, 15 bp, Homo sapiens
taatctggactcctc

SEQ ID NO: 2770345 - DNA, 18 bp, Homo sapiens
taatctggactcctctgt

SEQ ID NO: 2770346 - DNA, 20 bp, Homo sapiens
taatctgtagggctggacct

SEQ ID NO: 2770347 - DNA, 19 bp, Homo sapiens
taatcttaggggagagctt

SEQ ID NO: 2770348 - DNA, 16 bp, Homo sapiens
taatcttcagttttat

SEQ ID NO: 2770349 - DNA, 20 bp, Homo sapiens
taatcttcagttttatcttt

SEQ ID NO: 2770350 - DNA, 18 bp, Homo sapiens
taatctttctttacctga

SEQ ID NO: 2770351 - DNA, 13 bp, Homo sapiens
taatgaaacaaag

SEQ ID NO: 2770352 - DNA, 17 bp, Homo sapiens
taatgaaacaaagagtt

SEQ ID NO: 2770353 - DNA, 14 bp, Homo sapiens
taatgaactgtgac

SEQ ID NO: 2770354 - DNA, 14 bp, Homo sapiens
taatgactttttat

SEQ ID NO: 2770355 - DNA, 18 bp, Homo sapiens
taatgactttttataatg

SEQ ID NO: 2770356 - DNA, 22 bp, Homo sapiens
taatgactttttataatgtgga

SEQ ID NO: 2770357 - DNA, 19 bp, Homo sapiens
taatgatttaagcatttta

SEQ ID NO: 2770358 - DNA, 13 bp, Homo sapiens
taatgcacaattt

SEQ ID NO: 2770359 - DNA, 14 bp, Homo sapiens
taatgcacaattta

SEQ ID NO: 2770360 - DNA, 17 bp, Homo sapiens
taatgcatgttaggaaa

SEQ ID NO: 2770361 - DNA, 13 bp, Homo sapiens
taatgccttccac

SEQ ID NO: 2770362 - DNA, 14 bp, Homo sapiens
taatgctgttgcct

SEQ ID NO: 2770363 - DNA, 15 bp, Homo sapiens
taatggtttgaatat

SEQ ID NO: 2770364 - DNA, 14 bp, Homo sapiens
taatgtaagaaaat

SEQ ID NO: 2770365 - DNA, 22 bp, Homo sapiens
taatgtaagaaaatttgaagta

SEQ ID NO: 2770366 - DNA, 14 bp, Homo sapiens
taatgtatcttatt

SEQ ID NO: 2770367 - DNA, 18 bp, Homo sapiens
taatgtatcttatttata

SEQ ID NO: 2770368 - DNA, 15 bp, Homo sapiens
taatgtcaaaatcat

SEQ ID NO: 2770369 - DNA, 15 bp, Homo sapiens
taatgtcaccacctt

SEQ ID NO: 2770370 - DNA, 23 bp, Homo sapiens
taatgtggatttcctattttaaa

SEQ ID NO: 2770371 - DNA, 13 bp, Homo sapiens
taatgttctctgg

SEQ ID NO: 2770372 - DNA, 21 bp, Homo sapiens
taatgttgggatttatatcta

SEQ ID NO: 2770373 - DNA, 22 bp, Homo sapiens
taatgttgggatttatatctat

SEQ ID NO: 2770374 - DNA, 16 bp, Homo sapiens
taattaatatgttcat

SEQ ID NO: 2770375 - DNA, 19 bp, Homo sapiens
taattaatcgaaatgaatt

SEQ ID NO: 2770376 - DNA, 14 bp, Homo sapiens
taattagaacaata

SEQ ID NO: 2770377 - DNA, 20 bp, Homo sapiens
taattagaacaatagctatt

SEQ ID NO: 2770378 - DNA, 22 bp, Homo sapiens
taattagaacaatagctattgc

SEQ ID NO: 2770379 - DNA, 17 bp, Homo sapiens
taattaggggttgctaa

SEQ ID NO: 2770380 - DNA, 14 bp, Homo sapiens
taattatccaggaa

SEQ ID NO: 2770381 - DNA, 19 bp, Homo sapiens
taattatcggaagcagtgc

SEQ ID NO: 2770382 - DNA, 21 bp, Homo sapiens
taattatcggaagcagtgcct

SEQ ID NO: 2770383 - DNA, 19 bp, Homo sapiens
taattatcgggaacagtgt

SEQ ID NO: 2770384 - DNA, 23 bp, Homo sapiens
taattatcgggaacagtgtttcc

SEQ ID NO: 2770385 - DNA, 22 bp, Homo sapiens
taattattatttatatatgtat

SEQ ID NO: 2770386 - DNA, 16 bp, Homo sapiens
taattcaattcaaagc

SEQ ID NO: 2770387 - DNA, 14 bp, Homo sapiens
taattcataattag

SEQ ID NO: 2770388 - DNA, 16 bp, Homo sapiens
taattcataattagaa

SEQ ID NO: 2770389 - DNA, 16 bp, Homo sapiens
taattcccattttgca

SEQ ID NO: 2770390 - DNA, 18 bp, Homo sapiens
taattcccattttgcaaa

SEQ ID NO: 2770391 - DNA, 20 bp, Homo sapiens
taattcccattttgcaaaat

SEQ ID NO: 2770392 - DNA, 23 bp, Homo sapiens
taattcccattttgcaaaatttc

SEQ ID NO: 2770393 - DNA, 12 bp, Homo sapiens
taattctactaa

SEQ ID NO: 2770394 - DNA, 16 bp, Homo sapiens
taattctactaaatat

SEQ ID NO: 2770395 - DNA, 12 bp, Homo sapiens
taattcttaata

SEQ ID NO: 2770396 - DNA, 19 bp, Homo sapiens
taattgatttcaagacctt

SEQ ID NO: 2770397 - DNA, 20 bp, Homo sapiens
taattgggattttaaaaaca

SEQ ID NO: 2770398 - DNA, 18 bp, Homo sapiens
taattggtccgatctttg

SEQ ID NO: 2770399 - DNA, 21 bp, Homo sapiens
taattgtaggtcaatgaaata

SEQ ID NO: 2770400 - DNA, 12 bp, Homo sapiens
taattgtgtaca

SEQ ID NO: 2770401 - DNA, 14 bp, Homo sapiens
taattgtgtacaaa

SEQ ID NO: 2770402 - DNA, 19 bp, Homo sapiens
taatttaaaccagcagaaa

SEQ ID NO: 2770403 - DNA, 20 bp, Homo sapiens
taatttaaaccagcagaaaa

SEQ ID NO: 2770404 - DNA, 17 bp, Homo sapiens
taatttaactaatttaa

SEQ ID NO: 2770405 - DNA, 18 bp, Homo sapiens
taatttaactaatttaaa

SEQ ID NO: 2770406 - DNA, 14 bp, Homo sapiens
taatttagaaaact

SEQ ID NO: 2770407 - DNA, 16 bp, Homo sapiens
taatttagtttcatat

SEQ ID NO: 2770408 - DNA, 13 bp, Homo sapiens
taatttatacaaa

SEQ ID NO: 2770409 - DNA, 14 bp, Homo sapiens
taatttatacaaaa

SEQ ID NO: 2770410 - DNA, 23 bp, Homo sapiens
taatttattttgtatttttgaat

SEQ ID NO: 2770411 - DNA, 22 bp, Homo sapiens
taatttgatagtattgtgcata

SEQ ID NO: 2770412 - DNA, 14 bp, Homo sapiens
taatttgatgttta

SEQ ID NO: 2770413 - DNA, 21 bp, Homo sapiens
taatttgtacatatgtaaaat

SEQ ID NO: 2770414 - DNA, 18 bp, Homo sapiens
taattttatgaatgtctt

SEQ ID NO: 2770415 - DNA, 12 bp, Homo sapiens
taattttattat

SEQ ID NO: 2770416 - DNA, 19 bp, Homo sapiens
taattttcaagagaagaaa

SEQ ID NO: 2770417 - DNA, 12 bp, Homo sapiens
taattttctacc

SEQ ID NO: 2770418 - DNA, 14 bp, Homo sapiens
taattttcttcatg

SEQ ID NO: 2770419 - DNA, 14 bp, Homo sapiens
taattttgcagcag

SEQ ID NO: 2770420 - DNA, 15 bp, Homo sapiens
taattttgtagtagt

SEQ ID NO: 2770421 - DNA, 13 bp, Homo sapiens
taatttttaaagt

SEQ ID NO: 2770422 - DNA, 21 bp, Homo sapiens
taatttttgatactaagcatt

SEQ ID NO: 2770423 - DNA, 13 bp, Homo sapiens
taatttttgcaat

SEQ ID NO: 2770424 - DNA, 18 bp, Homo sapiens
taatttttttgagacaga

SEQ ID NO: 2770425 - DNA, 22 bp, Homo sapiens
tacaaaaatgagctaggcatgg

SEQ ID NO: 2770426 - DNA, 19 bp, Homo sapiens
tacaaaacctgatgttaaa

SEQ ID NO: 2770427 - DNA, 19 bp, Homo sapiens
tacaaaataaacaaataac

SEQ ID NO: 2770428 - DNA, 13 bp, Homo sapiens
tacaaaataattt

SEQ ID NO: 2770429 - DNA, 15 bp, Homo sapiens
tacaaaataatttaa

SEQ ID NO: 2770430 - DNA, 19 bp, Homo sapiens
tacaaactcccacttgtca

SEQ ID NO: 2770431 - DNA, 17 bp, Homo sapiens
tacaaagcccttttata

SEQ ID NO: 2770432 - DNA, 16 bp, Homo sapiens
tacaaagtagagaagt

SEQ ID NO: 2770433 - DNA, 17 bp, Homo sapiens
tacaaagtagagaagta

SEQ ID NO: 2770434 - DNA, 17 bp, Homo sapiens
tacaaatactcttagga

SEQ ID NO: 2770435 - DNA, 16 bp, Homo sapiens
tacaaatatatttaat

SEQ ID NO: 2770436 - DNA, 16 bp, Homo sapiens
tacaaccagagccccc

SEQ ID NO: 2770437 - DNA, 21 bp, Homo sapiens
tacaagaagcattttgtaagt

SEQ ID NO: 2770438 - DNA, 22 bp, Homo sapiens
tacaagagccatgtaccagtgt

SEQ ID NO: 2770439 - DNA, 21 bp, Homo sapiens
tacaagcattctgtcttgaag

SEQ ID NO: 2770440 - DNA, 18 bp, Homo sapiens
tacaagggtctagggaga

SEQ ID NO: 2770441 - DNA, 13 bp, Homo sapiens
tacaataaagtct

SEQ ID NO: 2770442 - DNA, 15 bp, Homo sapiens
tacaataaatattct

SEQ ID NO: 2770443 - DNA, 12 bp, Homo sapiens
tacaatatttaa

SEQ ID NO: 2770444 - DNA, 16 bp, Homo sapiens
tacaatatttaaaatt

SEQ ID NO: 2770445 - DNA, 19 bp, Homo sapiens
tacaattaaagctgttatt

SEQ ID NO: 2770446 - DNA, 17 bp, Homo sapiens
tacacagcaccagaatg

SEQ ID NO: 2770447 - DNA, 14 bp, Homo sapiens
tacacagcctggac

SEQ ID NO: 2770448 - DNA, 15 bp, Homo sapiens
tacacagctctagac

SEQ ID NO: 2770449 - DNA, 15 bp, Homo sapiens
tacacagtaaaaact

SEQ ID NO: 2770450 - DNA, 21 bp, Homo sapiens
tacacatccccagccagaagt

SEQ ID NO: 2770451 - DNA, 14 bp, Homo sapiens
tacaccactctggc

SEQ ID NO: 2770452 - DNA, 16 bp, Homo sapiens
tacaccactctggcag

SEQ ID NO: 2770453 - DNA, 20 bp, Homo sapiens
tacaccactctggcagccac

SEQ ID NO: 2770454 - DNA, 19 bp, Homo sapiens
tacaccatgtttgagctca

SEQ ID NO: 2770455 - DNA, 14 bp, Homo sapiens
tacacctatgtcat

SEQ ID NO: 2770456 - DNA, 17 bp, Homo sapiens
tacacctatgtcatttc

SEQ ID NO: 2770457 - DNA, 18 bp, Homo sapiens
tacacctgaggctgaggc

SEQ ID NO: 2770458 - DNA, 17 bp, Homo sapiens
tacacgtgtcctgtagt

SEQ ID NO: 2770459 - DNA, 13 bp, Homo sapiens
tacactcttatag

SEQ ID NO: 2770460 - DNA, 18 bp, Homo sapiens
tacagaaattagccgggc

SEQ ID NO: 2770461 - DNA, 14 bp, Homo sapiens
tacagaacaaagaa

SEQ ID NO: 2770462 - DNA, 11 bp, Homo sapiens
tacagaatttt

SEQ ID NO: 2770463 - DNA, 12 bp, Homo sapiens
tacagaattttt

SEQ ID NO: 2770464 - DNA, 16 bp, Homo sapiens
tacagaatttttaatg

SEQ ID NO: 2770465 - DNA, 17 bp, Homo sapiens
tacagaatttttaatga

SEQ ID NO: 2770466 - DNA, 19 bp, Homo sapiens
tacagacactaagttatag

SEQ ID NO: 2770467 - DNA, 17 bp, Homo sapiens
tacagacgtatgcttat

SEQ ID NO: 2770468 - DNA, 18 bp, Homo sapiens
tacagacgtatgcttatt

SEQ ID NO: 2770469 - DNA, 14 bp, Homo sapiens
tacagacttctcca

SEQ ID NO: 2770470 - DNA, 16 bp, Homo sapiens
tacagataatttattt

SEQ ID NO: 2770471 - DNA, 19 bp, Homo sapiens
tacagataatttattttgt

SEQ ID NO: 2770472 - DNA, 20 bp, Homo sapiens
tacagataatttattttgta

SEQ ID NO: 2770473 - DNA, 18 bp, Homo sapiens
tacagatgagattccctc

SEQ ID NO: 2770474 - DNA, 14 bp, Homo sapiens
tacagccagaagcc

SEQ ID NO: 2770475 - DNA, 16 bp, Homo sapiens
tacagcgagaggcaga

SEQ ID NO: 2770476 - DNA, 19 bp, Homo sapiens
tacagcgagaggcagagaa

SEQ ID NO: 2770477 - DNA, 21 bp, Homo sapiens
tacagctcagaagtttcttct

SEQ ID NO: 2770478 - DNA, 17 bp, Homo sapiens
tacaggaaaagctgctg

SEQ ID NO: 2770479 - DNA, 15 bp, Homo sapiens
tacaggagtgagcac

SEQ ID NO: 2770480 - DNA, 16 bp, Homo sapiens
tacaggtgtgagtcac

SEQ ID NO: 2770481 - DNA, 19 bp, Homo sapiens
tacagtaaagtttaaaaaa

SEQ ID NO: 2770482 - DNA, 18 bp, Homo sapiens
tacagtaagctgctctat

SEQ ID NO: 2770483 - DNA, 17 bp, Homo sapiens
tacagtagcttaaataa

SEQ ID NO: 2770484 - DNA, 22 bp, Homo sapiens
tacagtagcttaaataaattca

SEQ ID NO: 2770485 - DNA, 23 bp, Homo sapiens
tacagtagcttaaataaattcaa

SEQ ID NO: 2770486 - DNA, 14 bp, Homo sapiens
tacagtctaaagct

SEQ ID NO: 2770487 - DNA, 15 bp, Homo sapiens
tacagtctaaagctg

SEQ ID NO: 2770488 - DNA, 22 bp, Homo sapiens
tacagtgactgtcgtgtttaca

SEQ ID NO: 2770489 - DNA, 12 bp, Homo sapiens
tacagtgagcca

SEQ ID NO: 2770490 - DNA, 13 bp, Homo sapiens
tacagtggagaaa

SEQ ID NO: 2770491 - DNA, 17 bp, Homo sapiens
tacagttatacatacct

SEQ ID NO: 2770492 - DNA, 13 bp, Homo sapiens
tacataaaggtgg

SEQ ID NO: 2770493 - DNA, 18 bp, Homo sapiens
tacataacttgatataga

SEQ ID NO: 2770494 - DNA, 19 bp, Homo sapiens
tacatacctctctctatat

SEQ ID NO: 2770495 - DNA, 16 bp, Homo sapiens
tacatatcagaaaagt

SEQ ID NO: 2770496 - DNA, 18 bp, Homo sapiens
tacatatcagaaaagtag

SEQ ID NO: 2770497 - DNA, 20 bp, Homo sapiens
tacatatcagaaaagtagaa

SEQ ID NO: 2770498 - DNA, 21 bp, Homo sapiens
tacatatcagaaaagtagaat

SEQ ID NO: 2770499 - DNA, 18 bp, Homo sapiens
tacatatggaaatcctgt

SEQ ID NO: 2770500 - DNA, 22 bp, Homo sapiens
tacatatggaaatcctgttact

SEQ ID NO: 2770501 - DNA, 17 bp, Homo sapiens
tacatatgtaaaataaa

SEQ ID NO: 2770502 - DNA, 20 bp, Homo sapiens
tacatatgtaaaataaaatt

SEQ ID NO: 2770503 - DNA, 15 bp, Homo sapiens
tacatattataaata

SEQ ID NO: 2770504 - DNA, 18 bp, Homo sapiens
tacatattataaataaat

SEQ ID NO: 2770505 - DNA, 20 bp, Homo sapiens
tacatattataaataaatgc

SEQ ID NO: 2770506 - DNA, 21 bp, Homo sapiens
tacatattataaataaatgcc

SEQ ID NO: 2770507 - DNA, 15 bp, Homo sapiens
tacatattctttaaa

SEQ ID NO: 2770508 - DNA, 12 bp, Homo sapiens
tacatgaaacag

SEQ ID NO: 2770509 - DNA, 18 bp, Homo sapiens
tacatgaattgcatttta

SEQ ID NO: 2770510 - DNA, 14 bp, Homo sapiens
tacatgattcattt

SEQ ID NO: 2770511 - DNA, 15 bp, Homo sapiens
tacatgattcatttt

SEQ ID NO: 2770512 - DNA, 18 bp, Homo sapiens
tacatgctaagagaagta

SEQ ID NO: 2770513 - DNA, 16 bp, Homo sapiens
tacatggccagtgtga

SEQ ID NO: 2770514 - DNA, 19 bp, Homo sapiens
tacatgtgtggatgtgtaa

SEQ ID NO: 2770515 - DNA, 12 bp, Homo sapiens
tacatgtttgca

SEQ ID NO: 2770516 - DNA, 23 bp, Homo sapiens
tacattaattattattgctgttg

SEQ ID NO: 2770517 - DNA, 21 bp, Homo sapiens
tacattccctatcaaaacata

SEQ ID NO: 2770518 - DNA, 12 bp, Homo sapiens
tacattcctgat

SEQ ID NO: 2770519 - DNA, 19 bp, Homo sapiens
tacattgtttgtctgtctt

SEQ ID NO: 2770520 - DNA, 15 bp, Homo sapiens
tacatttccaaatga

SEQ ID NO: 2770521 - DNA, 22 bp, Homo sapiens
tacattttatttattagctgta

SEQ ID NO: 2770522 - DNA, 17 bp, Homo sapiens
taccaaatataaacttg

SEQ ID NO: 2770523 - DNA, 22 bp, Homo sapiens
taccaatcattttaattattat

SEQ ID NO: 2770524 - DNA, 12 bp, Homo sapiens
taccacagcagc

SEQ ID NO: 2770525 - DNA, 16 bp, Homo sapiens
taccaccccttcctgt

SEQ ID NO: 2770526 - DNA, 18 bp, Homo sapiens
taccaccccttcctgtcc

SEQ ID NO: 2770527 - DNA, 19 bp, Homo sapiens
taccaccccttcctgtccc

SEQ ID NO: 2770528 - DNA, 17 bp, Homo sapiens
taccaggcaccaaaaga

SEQ ID NO: 2770529 - DNA, 15 bp, Homo sapiens
taccagtgaaccaaa

SEQ ID NO: 2770530 - DNA, 18 bp, Homo sapiens
taccagtgaaccaaagag

SEQ ID NO: 2770531 - DNA, 15 bp, Homo sapiens
taccagtgtactgct

SEQ ID NO: 2770532 - DNA, 15 bp, Homo sapiens
taccatcaataaagt

SEQ ID NO: 2770533 - DNA, 20 bp, Homo sapiens
taccatctgtcttgccagcc

SEQ ID NO: 2770534 - DNA, 12 bp, Homo sapiens
taccatttcaga

SEQ ID NO: 2770535 - DNA, 16 bp, Homo sapiens
taccatttcagagagg

SEQ ID NO: 2770536 - DNA, 20 bp, Homo sapiens
tacccaccgggccactcctt

SEQ ID NO: 2770537 - DNA, 20 bp, Homo sapiens
tacccagagaatatatacat

SEQ ID NO: 2770538 - DNA, 15 bp, Homo sapiens
tacccagagccttct

SEQ ID NO: 2770539 - DNA, 22 bp, Homo sapiens
tacccagtaactcatctgtcac

SEQ ID NO: 2770540 - DNA, 21 bp, Homo sapiens
tacccattcgtggtgatcaat

SEQ ID NO: 2770541 - DNA, 22 bp, Homo sapiens
taccccaccacgatgtggccct

SEQ ID NO: 2770542 - DNA, 15 bp, Homo sapiens
gtcctgggagtgagc

SEQ ID NO: 2770543 - DNA, 18 bp, Homo sapiens
gtcctgggagtgagctgg

SEQ ID NO: 2770544 - DNA, 21 bp, Homo sapiens
gtcctggtctgctcaggaatt

SEQ ID NO: 2770545 - DNA, 18 bp, Homo sapiens
gtcctggtggggcagctc

SEQ ID NO: 2770546 - DNA, 22 bp, Homo sapiens
gtcctgttaacgtcatctcagg

SEQ ID NO: 2770547 - DNA, 23 bp, Homo sapiens
gtcctgttaacgtcatctcaggg

SEQ ID NO: 2770548 - DNA, 18 bp, Homo sapiens
gtccttactcctgtggga

SEQ ID NO: 2770549 - DNA, 22 bp, Homo sapiens
gtccttccaggcccccaccact

SEQ ID NO: 2770550 - DNA, 14 bp, Homo sapiens
gtccttgcacctgc

SEQ ID NO: 2770551 - DNA, 18 bp, Homo sapiens
gtccttgcacctgcatcc

SEQ ID NO: 2770552 - DNA, 17 bp, Homo sapiens
gtccttttgtaccatgg

SEQ ID NO: 2770553 - DNA, 19 bp, Homo sapiens
gtcgccacacccggctccc

SEQ ID NO: 2770554 - DNA, 12 bp, Homo sapiens
gtcgcccaggag

SEQ ID NO: 2770555 - DNA, 13 bp, Homo sapiens
gtcgcccaggaga

SEQ ID NO: 2770556 - DNA, 13 bp, Homo sapiens
gtcgcccagtctg

SEQ ID NO: 2770557 - DNA, 23 bp, Homo sapiens
gtcgcccagtctggaatgcagtg

SEQ ID NO: 2770558 - DNA, 18 bp, Homo sapiens
gtcgctggacaacccaga

SEQ ID NO: 2770559 - DNA, 17 bp, Homo sapiens
gtcggcacgtcccatgt

SEQ ID NO: 2770560 - DNA, 20 bp, Homo sapiens
gtcgtagccaaggtgggctg

SEQ ID NO: 2770561 - DNA, 19 bp, Homo sapiens
gtcgtggagagctaggagc

SEQ ID NO: 2770562 - DNA, 20 bp, Homo sapiens
gtcgtggagagctaggagca

SEQ ID NO: 2770563 - DNA, 21 bp, Homo sapiens
gtcgtggagagctaggagcaa

SEQ ID NO: 2770564 - DNA, 23 bp, Homo sapiens
gtcgtggcagataatcagcctct

SEQ ID NO: 2770565 - DNA, 14 bp, Homo sapiens
gtcgtgggtgtgtg

SEQ ID NO: 2770566 - DNA, 12 bp, Homo sapiens
gtctaaaaacac

SEQ ID NO: 2770567 - DNA, 21 bp, Homo sapiens
gtctaaagctggtttaatgtt

SEQ ID NO: 2770568 - DNA, 13 bp, Homo sapiens
gtctaccctggga

SEQ ID NO: 2770569 - DNA, 17 bp, Homo sapiens
gtctatatgaaaaacaa

SEQ ID NO: 2770570 - DNA, 21 bp, Homo sapiens
gtctatgacttatttccttca

SEQ ID NO: 2770571 - DNA, 22 bp, Homo sapiens
gtctatgggactcaatgcactg

SEQ ID NO: 2770572 - DNA, 18 bp, Homo sapiens
gtctcactatgttgccca

SEQ ID NO: 2770573 - DNA, 13 bp, Homo sapiens
gtctcactgttgc

SEQ ID NO: 2770574 - DNA, 17 bp, Homo sapiens
gtctcactgttgcccag

SEQ ID NO: 2770575 - DNA, 18 bp, Homo sapiens
gtctcactgttgcccagg

SEQ ID NO: 2770576 - DNA, 15 bp, Homo sapiens
gtgaagaaatggaat

SEQ ID NO: 2770577 - DNA, 23 bp, Homo sapiens
gtgaagaatgaagtggaggaagt

SEQ ID NO: 2770578 - DNA, 18 bp, Homo sapiens
gtgaataaaaaccctgta

SEQ ID NO: 2770579 - DNA, 19 bp, Homo sapiens
gtgaattgtgaccaagtta

SEQ ID NO: 2770580 - DNA, 18 bp, Homo sapiens
gtgacaaaattggccaga

SEQ ID NO: 2770581 - DNA, 16 bp, Homo sapiens
gtgacaacacttgtgt

SEQ ID NO: 2770582 - DNA, 21 bp, Homo sapiens
gtgacaacctttgtgtaataa

SEQ ID NO: 2770583 - DNA, 22 bp, Homo sapiens
gtgacaacctttgtgtaataaa

SEQ ID NO: 2770584 - DNA, 23 bp, Homo sapiens
gtgacaagctcctggtcttgaga

SEQ ID NO: 2770585 - DNA, 20 bp, Homo sapiens
gtgacaaggattgctactgt

SEQ ID NO: 2770586 - DNA, 18 bp, Homo sapiens
gtgacacccaagagggct

SEQ ID NO: 2770587 - DNA, 20 bp, Homo sapiens
gtgacacccaagagggctgc

SEQ ID NO: 2770588 - DNA, 23 bp, Homo sapiens
gtgacagaggcagccccattctg

SEQ ID NO: 2770589 - DNA, 20 bp, Homo sapiens
gtgacagagtgagactctgt

SEQ ID NO: 2770590 - DNA, 15 bp, Homo sapiens
gtgacatgggtgtgc

SEQ ID NO: 2770591 - DNA, 17 bp, Homo sapiens
gtgaccaaaagttacat

SEQ ID NO: 2770592 - DNA, 17 bp, Homo sapiens
gtgacccggcaccccct

SEQ ID NO: 2770593 - DNA, 21 bp, Homo sapiens
gtgacccggcaccccctgcag

SEQ ID NO: 2770594 - DNA, 22 bp, Homo sapiens
gtgacccggcaccccctgcagc

SEQ ID NO: 2770595 - DNA, 21 bp, Homo sapiens
gtgaccctctgaatggtccag

SEQ ID NO: 2770596 - DNA, 13 bp, Homo sapiens
gtgacggtcccac

SEQ ID NO: 2770597 - DNA, 15 bp, Homo sapiens
gtgacggtcccacac

SEQ ID NO: 2770598 - DNA, 22 bp, Homo sapiens
gtgacggtcccacactggtgac

SEQ ID NO: 2770599 - DNA, 21 bp, Homo sapiens
gtgactgccccaactcctgga

SEQ ID NO: 2770600 - DNA, 16 bp, Homo sapiens
gtgactgtcgtgttta

SEQ ID NO: 2770601 - DNA, 13 bp, Homo sapiens
gtgagaccacctc

SEQ ID NO: 2770602 - DNA, 20 bp, Homo sapiens
gtgagactgacacctcactg

SEQ ID NO: 2770603 - DNA, 22 bp, Homo sapiens
gtgagactgacacctcactgag

SEQ ID NO: 2770604 - DNA, 16 bp, Homo sapiens
gtgagaggaagggtgg

SEQ ID NO: 2770605 - DNA, 23 bp, Homo sapiens
gtgagagggcatgcgcacaaggc

SEQ ID NO: 2770606 - DNA, 13 bp, Homo sapiens
gtgagagtgagct

SEQ ID NO: 2770607 - DNA, 23 bp, Homo sapiens
gtgagataaccacaaccaggaag

SEQ ID NO: 2770608 - DNA, 15 bp, Homo sapiens
gtgagatgtaattgt

SEQ ID NO: 2770609 - DNA, 23 bp, Homo sapiens
gtgagatttgtatttatattaga

SEQ ID NO: 2770610 - DNA, 15 bp, Homo sapiens
gtgagccacagacca

SEQ ID NO: 2770611 - DNA, 13 bp, Homo sapiens
gtgagccactgca

SEQ ID NO: 2770612 - DNA, 15 bp, Homo sapiens
gtgagccactgcacc

SEQ ID NO: 2770613 - DNA, 20 bp, Homo sapiens
gtgagccactgcaccgggcc

SEQ ID NO: 2770614 - DNA, 12 bp, Homo sapiens
gtgagccgcatc

SEQ ID NO: 2770615 - DNA, 18 bp, Homo sapiens
gtgaggtgctgatgagtg

SEQ ID NO: 2770616 - DNA, 17 bp, Homo sapiens
gtgagtcaccaagccca

SEQ ID NO: 2770617 - DNA, 22 bp, Homo sapiens
gtgagtgtgtgtgatgggatct

SEQ ID NO: 2770618 - DNA, 17 bp, Homo sapiens
gtgagttacagcgagag

SEQ ID NO: 2770619 - DNA, 13 bp, Homo sapiens
gtgataagtggaa

SEQ ID NO: 2770620 - DNA, 16 bp, Homo sapiens
gtgataagtggaaaaa

SEQ ID NO: 2770621 - DNA, 20 bp, Homo sapiens
gtgatacaacttcaagtgca

SEQ ID NO: 2770622 - DNA, 20 bp, Homo sapiens
gtgatacccatagcttccat

SEQ ID NO: 2770623 - DNA, 14 bp, Homo sapiens
gtgatatatgtatt

SEQ ID NO: 2770624 - DNA, 21 bp, Homo sapiens
gtgatatatgtatttattgtc

SEQ ID NO: 2770625 - DNA, 17 bp, Homo sapiens
gtgatcaattaaatgta

SEQ ID NO: 2770626 - DNA, 15 bp, Homo sapiens
gtgatccacccacct

SEQ ID NO: 2770627 - DNA, 24 bp, Homo sapiens
gtgatccacccacctcagcctccc

SEQ ID NO: 2770628 - DNA, 18 bp, Homo sapiens
gtgatcctcccacctcag

SEQ ID NO: 2770629 - DNA, 22 bp, Homo sapiens
gtgatcctcccacctcagcctc

SEQ ID NO: 2770630 - DNA, 16 bp, Homo sapiens
gtgatgagggcagcag

SEQ ID NO: 2770631 - DNA, 21 bp, Homo sapiens
gtgatgagggcagcagccagc

SEQ ID NO: 2770632 - DNA, 21 bp, Homo sapiens
gtgatgctggtaccactggaa

SEQ ID NO: 2770633 - DNA, 16 bp, Homo sapiens
gtccagcttgctcttc

SEQ ID NO: 2770634 - DNA, 17 bp, Homo sapiens
gtccagcttgctcttca

SEQ ID NO: 2770635 - DNA, 13 bp, Homo sapiens
gtccaggagcctg

SEQ ID NO: 2770636 - DNA, 15 bp, Homo sapiens
gtccagggccctgag

SEQ ID NO: 2770637 - DNA, 16 bp, Homo sapiens
gtccagggccctgagc

SEQ ID NO: 2770638 - DNA, 19 bp, Homo sapiens
gtccagggcgggagtgggg

SEQ ID NO: 2770639 - DNA, 15 bp, Homo sapiens
gtccaggtcctggtg

SEQ ID NO: 2770640 - DNA, 17 bp, Homo sapiens
gtccaggtcctggtggg

SEQ ID NO: 2770641 - DNA, 23 bp, Homo sapiens
gtccaggtcctggtggggcagct

SEQ ID NO: 2770642 - DNA, 11 bp, Homo sapiens
gtccataaagt

SEQ ID NO: 2770643 - DNA, 19 bp, Homo sapiens
gtccatgcctacagataat

SEQ ID NO: 2770644 - DNA, 23 bp, Homo sapiens
gtccatgtattcacacacccctc

SEQ ID NO: 2770645 - DNA, 15 bp, Homo sapiens
gtcccaacttgtaaa

SEQ ID NO: 2770646 - DNA, 16 bp, Homo sapiens
gtcccaaggaaagccc

SEQ ID NO: 2770647 - DNA, 15 bp, Homo sapiens
gtcccacatccctgg

SEQ ID NO: 2770648 - DNA, 19 bp, Homo sapiens
gtcccacatccctgggcct

SEQ ID NO: 2770649 - DNA, 18 bp, Homo sapiens
gtcccaccttggctgcag

SEQ ID NO: 2770650 - DNA, 20 bp, Homo sapiens
gtcccaccttggctgcaggg

SEQ ID NO: 2770651 - DNA, 14 bp, Homo sapiens
gtcccatttccttg

SEQ ID NO: 2770652 - DNA, 17 bp, Homo sapiens
gtcccatttccttggag

SEQ ID NO: 2770653 - DNA, 18 bp, Homo sapiens
gtcccatttccttggagg

SEQ ID NO: 2770654 - DNA, 12 bp, Homo sapiens
gtccccagctcc

SEQ ID NO: 2770655 - DNA, 14 bp, Homo sapiens
gtccccagctcccc

SEQ ID NO: 2770656 - DNA, 18 bp, Homo sapiens
gtccccagctccccagga

SEQ ID NO: 2770657 - DNA, 22 bp, Homo sapiens
gtccccctggggcttctcctga

SEQ ID NO: 2770658 - DNA, 22 bp, Homo sapiens
gtccccgtgccccgcctccccg

SEQ ID NO: 2770659 - DNA, 21 bp, Homo sapiens
gtccctacacccctcccctgc

SEQ ID NO: 2770660 - DNA, 16 bp, Homo sapiens
gtccctcactgccttc

SEQ ID NO: 2770661 - DNA, 18 bp, Homo sapiens
gtccctcactgccttcca

SEQ ID NO: 2770662 - DNA, 18 bp, Homo sapiens
gtccctgccacactcagt

SEQ ID NO: 2770663 - DNA, 20 bp, Homo sapiens
gtccctgggggaagccctgg

SEQ ID NO: 2770664 - DNA, 23 bp, Homo sapiens
gtccctgggggaagccctggatt

SEQ ID NO: 2770665 - DNA, 18 bp, Homo sapiens
gtcccttgagacctcagc

SEQ ID NO: 2770666 - DNA, 20 bp, Homo sapiens
gtcccttgagacctcagcca

SEQ ID NO: 2770667 - DNA, 15 bp, Homo sapiens
gtcctactctgtgtc

SEQ ID NO: 2770668 - DNA, 18 bp, Homo sapiens
gtcctagccactcaggag

SEQ ID NO: 2770669 - DNA, 18 bp, Homo sapiens
gtcctatccaaaggaatc

SEQ ID NO: 2770670 - DNA, 20 bp, Homo sapiens
gtcctatccaaaggaatcag

SEQ ID NO: 2770671 - DNA, 22 bp, Homo sapiens
gtcctccaacaataaagagctc

SEQ ID NO: 2770672 - DNA, 23 bp, Homo sapiens
gtcctccagcttcccctcgctgt

SEQ ID NO: 2770673 - DNA, 15 bp, Homo sapiens
gtcctccccctgcca

SEQ ID NO: 2770674 - DNA, 16 bp, Homo sapiens
gtcctccccctgccag

SEQ ID NO: 2770675 - DNA, 22 bp, Homo sapiens
gtcctcctcggatcaccgagag

SEQ ID NO: 2770676 - DNA, 19 bp, Homo sapiens
gtcctctgatacccagagc

SEQ ID NO: 2770677 - DNA, 11 bp, Homo sapiens
gtcctctggat

SEQ ID NO: 2770678 - DNA, 16 bp, Homo sapiens
gtcctgagcactgcca

SEQ ID NO: 2770679 - DNA, 19 bp, Homo sapiens
gtcctgagcactgccagga

SEQ ID NO: 2770680 - DNA, 17 bp, Homo sapiens
gtcctgcaatctccagg

SEQ ID NO: 2770681 - DNA, 20 bp, Homo sapiens
gtcctgcaatctccagggct

SEQ ID NO: 2770682 - DNA, 22 bp, Homo sapiens
gtcctgcatttctcagtcggtg

SEQ ID NO: 2770683 - DNA, 22 bp, Homo sapiens
gtcctggaatgaagcatgtagc

SEQ ID NO: 2770684 - DNA, 20 bp, Homo sapiens
gtcctgggagaacctcaggc

SEQ ID NO: 2770685 - DNA, 14 bp, Homo sapiens
gtggatcacagagg

SEQ ID NO: 2770686 - DNA, 15 bp, Homo sapiens
gtggatcacagaggc

SEQ ID NO: 2770687 - DNA, 15 bp, Homo sapiens
gtggatccactgtgc

SEQ ID NO: 2770688 - DNA, 17 bp, Homo sapiens
gtggatctccaaggacc

SEQ ID NO: 2770689 - DNA, 19 bp, Homo sapiens
gtggatctccaaggaccag

SEQ ID NO: 2770690 - DNA, 17 bp, Homo sapiens
gtggatctgtccaagga

SEQ ID NO: 2770691 - DNA, 23 bp, Homo sapiens
gtggatttcctattttaaaacca

SEQ ID NO: 2770692 - DNA, 15 bp, Homo sapiens
gtggattttcctgaa

SEQ ID NO: 2770693 - DNA, 21 bp, Homo sapiens
gtggcagataatcagcctctt

SEQ ID NO: 2770694 - DNA, 14 bp, Homo sapiens
gtggcagccctgta

SEQ ID NO: 2770695 - DNA, 22 bp, Homo sapiens
gtggcagctgcggtccacccag

SEQ ID NO: 2770696 - DNA, 23 bp, Homo sapiens
gtggcagctgcggtccacccagg

SEQ ID NO: 2770697 - DNA, 12 bp, Homo sapiens
gtggcagctgct

SEQ ID NO: 2770698 - DNA, 13 bp, Homo sapiens
gtggcaggaccag

SEQ ID NO: 2770699 - DNA, 16 bp, Homo sapiens
gtggccatcagggtgg

SEQ ID NO: 2770700 - DNA, 15 bp, Homo sapiens
gtggccatgcttctt

SEQ ID NO: 2770701 - DNA, 15 bp, Homo sapiens
gtggcccttcctgga

SEQ ID NO: 2770702 - DNA, 16 bp, Homo sapiens
gtggcccttcctggac

SEQ ID NO: 2770703 - DNA, 20 bp, Homo sapiens
gtggccttgttctgtcacca

SEQ ID NO: 2770704 - DNA, 20 bp, Homo sapiens
gtggcgactctatagactct

SEQ ID NO: 2770705 - DNA, 14 bp, Homo sapiens
gtggcggtgcctgg

SEQ ID NO: 2770706 - DNA, 22 bp, Homo sapiens
gtggctaaatgcctaataaaca

SEQ ID NO: 2770707 - DNA, 14 bp, Homo sapiens
gtggctaattcaat

SEQ ID NO: 2770708 - DNA, 16 bp, Homo sapiens
gtggctactctgtgcc

SEQ ID NO: 2770709 - DNA, 23 bp, Homo sapiens
gtggctcacgcctataatcccag

SEQ ID NO: 2770710 - DNA, 23 bp, Homo sapiens
gtggctcacgcctgtaatcccag

SEQ ID NO: 2770711 - DNA, 14 bp, Homo sapiens
gtggctgtctctgt

SEQ ID NO: 2770712 - DNA, 17 bp, Homo sapiens
gtgggaagcgtctgtcc

SEQ ID NO: 2770713 - DNA, 13 bp, Homo sapiens
gtgggaagggaga

SEQ ID NO: 2770714 - DNA, 19 bp, Homo sapiens
ggtggctgacccagtccct

SEQ ID NO: 2770715 - DNA, 21 bp, Homo sapiens
ggtggctgacccagtccctgg

SEQ ID NO: 2770716 - DNA, 23 bp, Homo sapiens
ggtggctgacccagtccctgggg

SEQ ID NO: 2770717 - DNA, 12 bp, Homo sapiens
ggtggctgggtt

SEQ ID NO: 2770718 - DNA, 17 bp, Homo sapiens
ggtggctgtctctgtcc

SEQ ID NO: 2770719 - DNA, 13 bp, Homo sapiens
ggtgggagagcca

SEQ ID NO: 2770720 - DNA, 16 bp, Homo sapiens
ggtgggagagcccagc

SEQ ID NO: 2770721 - DNA, 17 bp, Homo sapiens
ggtgggatggaggagaa

SEQ ID NO: 2770722 - DNA, 14 bp, Homo sapiens
ggtgggcagggctg

SEQ ID NO: 2770723 - DNA, 12 bp, Homo sapiens
ggtgggccactc

SEQ ID NO: 2770724 - DNA, 18 bp, Homo sapiens
ggtgggctgagccctggc

SEQ ID NO: 2770725 - DNA, 14 bp, Homo sapiens
ggtggggagacctg

SEQ ID NO: 2770726 - DNA, 13 bp, Homo sapiens
ggtggggctgctc

SEQ ID NO: 2770727 - DNA, 18 bp, Homo sapiens
ggtggggctgctcctcca

SEQ ID NO: 2770728 - DNA, 22 bp, Homo sapiens
ggtggggctgctcctccagggc

SEQ ID NO: 2770729 - DNA, 16 bp, Homo sapiens
ggtgggttttcttccc

SEQ ID NO: 2770730 - DNA, 17 bp, Homo sapiens
ggtggtcctgagacctg

SEQ ID NO: 2770731 - DNA, 19 bp, Homo sapiens
ggtggtggcagctgggcag

SEQ ID NO: 2770732 - DNA, 10 bp, Homo sapiens
ggtgtaaata

SEQ ID NO: 2770733 - DNA, 15 bp, Homo sapiens
ggtgtaatgcacaat

SEQ ID NO: 2770734 - DNA, 17 bp, Homo sapiens
ggtgtaatgcacaattt

SEQ ID NO: 2770735 - DNA, 20 bp, Homo sapiens
ggtgtctggaaaagcacttt

SEQ ID NO: 2770736 - DNA, 20 bp, Homo sapiens
ggtgtgaaagtcagatgccc

SEQ ID NO: 2770737 - DNA, 15 bp, Homo sapiens
ggtgtgcctgcagcc

SEQ ID NO: 2770738 - DNA, 13 bp, Homo sapiens
ggtgtgctctgat

SEQ ID NO: 2770739 - DNA, 16 bp, Homo sapiens
ggtgtggtggctcacg

SEQ ID NO: 2770740 - DNA, 12 bp, Homo sapiens
ggtgtgtctgct

SEQ ID NO: 2770741 - DNA, 14 bp, Homo sapiens
ggtgtgtgtagcca

SEQ ID NO: 2770742 - DNA, 13 bp, Homo sapiens
ggtgtttatacag

SEQ ID NO: 2770743 - DNA, 16 bp, Homo sapiens
ggttatgcctcatgct

SEQ ID NO: 2770744 - DNA, 16 bp, Homo sapiens
ggttcagcccctcctc

SEQ ID NO: 2770745 - DNA, 21 bp, Homo sapiens
ggttcagcccctcctctgcca

SEQ ID NO: 2770746 - DNA, 22 bp, Homo sapiens
ggttcagcccctcctctgccac

SEQ ID NO: 2770747 - DNA, 12 bp, Homo sapiens
ggttcagcttgt

SEQ ID NO: 2770748 - DNA, 16 bp, Homo sapiens
ggttccatgcctgagg

SEQ ID NO: 2770749 - DNA, 18 bp, Homo sapiens
ggttcccaataaaagtga

SEQ ID NO: 2770750 - DNA, 13 bp, Homo sapiens
ggttccctctgag

SEQ ID NO: 2770751 - DNA, 18 bp, Homo sapiens
ggttctccccctttctct

SEQ ID NO: 2770752 - DNA, 16 bp, Homo sapiens
ggttctttcttcctct

SEQ ID NO: 2770753 - DNA, 15 bp, Homo sapiens
ggttctttggaagga

SEQ ID NO: 2770754 - DNA, 17 bp, Homo sapiens
ggttctttggaaggagt

SEQ ID NO: 2770755 - DNA, 18 bp, Homo sapiens
ggttgaggggctcctgga

SEQ ID NO: 2770756 - DNA, 19 bp, Homo sapiens
ggttgaggggctcctggaa

SEQ ID NO: 2770757 - DNA, 15 bp, Homo sapiens
ggtctttgaataaag

SEQ ID NO: 2770758 - DNA, 18 bp, Homo sapiens
ggtctttgaataaagtct

SEQ ID NO: 2770759 - DNA, 19 bp, Homo sapiens
ggtgaatgtgtgaaggtct

SEQ ID NO: 2770760 - DNA, 13 bp, Homo sapiens
ggtgaccccaggg

SEQ ID NO: 2770761 - DNA, 22 bp, Homo sapiens
ggtgaccccagggcacaggagc

SEQ ID NO: 2770762 - DNA, 23 bp, Homo sapiens
ggtgaccccagggcacaggagct

SEQ ID NO: 2770763 - DNA, 21 bp, Homo sapiens
ggtgacccggcaccccctgca

SEQ ID NO: 2770764 - DNA, 23 bp, Homo sapiens
ggtgacccggcaccccctgcagc

SEQ ID NO: 2770765 - DNA, 13 bp, Homo sapiens
ggtgagaaattta

SEQ ID NO: 2770766 - DNA, 17 bp, Homo sapiens
ggtgagaggaagggtgg

SEQ ID NO: 2770767 - DNA, 16 bp, Homo sapiens
ggtgagaggggaacag

SEQ ID NO: 2770768 - DNA, 12 bp, Homo sapiens
ggtgagggatgt

SEQ ID NO: 2770769 - DNA, 24 bp, Homo sapiens
ggtgatccacccacctcagcctcc

SEQ ID NO: 2770770 - DNA, 15 bp, Homo sapiens
ggtgatgagggcagc

SEQ ID NO: 2770771 - DNA, 16 bp, Homo sapiens
ggtgatgagggcagca

SEQ ID NO: 2770772 - DNA, 15 bp, Homo sapiens
ggtgatttcagagag

SEQ ID NO: 2770773 - DNA, 17 bp, Homo sapiens
ggtgcactggccccacc

SEQ ID NO: 2770774 - DNA, 18 bp, Homo sapiens
ggtgcagaggtgagcaga

SEQ ID NO: 2770775 - DNA, 18 bp, Homo sapiens
ggtgcagttgacagcagg

SEQ ID NO: 2770776 - DNA, 13 bp, Homo sapiens
ggtgcccaggaga

SEQ ID NO: 2770777 - DNA, 12 bp, Homo sapiens
ggtgcctcctgt

SEQ ID NO: 2770778 - DNA, 22 bp, Homo sapiens
ggtgcctgggtggggctgctcc

SEQ ID NO: 2770779 - DNA, 23 bp, Homo sapiens
ggtgcctgggtggggctgctcct

SEQ ID NO: 2770780 - DNA, 17 bp, Homo sapiens
ggtgcctggtgggccac

SEQ ID NO: 2770781 - DNA, 19 bp, Homo sapiens
ggtgcctgtgaggcagggg

SEQ ID NO: 2770782 - DNA, 22 bp, Homo sapiens
ggtgcgagagaggtgggcagca

SEQ ID NO: 2770783 - DNA, 21 bp, Homo sapiens
ggtgctaaatggtcgcccagg

SEQ ID NO: 2770784 - DNA, 12 bp, Homo sapiens
ggtgctggagga

SEQ ID NO: 2770785 - DNA, 16 bp, Homo sapiens
ggtgctgtggccaggg

SEQ ID NO: 2770786 - DNA, 13 bp, Homo sapiens
ggtggaagccctc

SEQ ID NO: 2770787 - DNA, 18 bp, Homo sapiens
ggtggaagccctccttcc

SEQ ID NO: 2770788 - DNA, 19 bp, Homo sapiens
ggtggaagccctccttcca

SEQ ID NO: 2770789 - DNA, 13 bp, Homo sapiens
ggtggacacacaa

SEQ ID NO: 2770790 - DNA, 16 bp, Homo sapiens
ggtggacagtcctggg

SEQ ID NO: 2770791 - DNA, 22 bp, Homo sapiens
ggtggaggagctgggcttctgt

SEQ ID NO: 2770792 - DNA, 15 bp, Homo sapiens
ggtggatcacagagg

SEQ ID NO: 2770793 - DNA, 21 bp, Homo sapiens
ggtggatgcctggtggcagct

SEQ ID NO: 2770794 - DNA, 15 bp, Homo sapiens
ggtggcagccctgta

SEQ ID NO: 2770795 - DNA, 14 bp, Homo sapiens
ggtggcaggaccag

SEQ ID NO: 2770796 - DNA, 18 bp, Homo sapiens
ggtggcaggaccaggact

SEQ ID NO: 2770797 - DNA, 16 bp, Homo sapiens
ggtggcagtgggagct

SEQ ID NO: 2770798 - DNA, 12 bp, Homo sapiens
ggtggccatgct

SEQ ID NO: 2770799 - DNA, 16 bp, Homo sapiens
ggtggctactctgtgc

SEQ ID NO: 2770800 - DNA, 19 bp, Homo sapiens
ggtggctactctgtgccag

SEQ ID NO: 2770801 - DNA, 23 bp, Homo sapiens
ggtggctactctgtgccagagcc

SEQ ID NO: 2770802 - DNA, 15 bp, Homo sapiens
ggtggctagtcagag

SEQ ID NO: 2770803 - DNA, 19 bp, Homo sapiens
ggtggctcacgcctataat

SEQ ID NO: 2770804 - DNA, 18 bp, Homo sapiens
ggtggctgacccagtccc

SEQ ID NO: 2770805 - DNA, 10 bp, Homo sapiens
gtaataaact

SEQ ID NO: 2770806 - DNA, 14 bp, Homo sapiens
gtaataaactctct

SEQ ID NO: 2770807 - DNA, 15 bp, Homo sapiens
gtaataaactctcta

SEQ ID NO: 2770808 - DNA, 17 bp, Homo sapiens
gtaatagattatagttg

SEQ ID NO: 2770809 - DNA, 21 bp, Homo sapiens
gtaatatctattattataaaa

SEQ ID NO: 2770810 - DNA, 16 bp, Homo sapiens
gtaatcccagcacttt

SEQ ID NO: 2770811 - DNA, 13 bp, Homo sapiens
gtaatcccagcag

SEQ ID NO: 2770812 - DNA, 20 bp, Homo sapiens
gtaatcctattaaaacacag

SEQ ID NO: 2770813 - DNA, 16 bp, Homo sapiens
gtaatgaatatctgct

SEQ ID NO: 2770814 - DNA, 14 bp, Homo sapiens
gtaatgagggactg

SEQ ID NO: 2770815 - DNA, 22 bp, Homo sapiens
gtaatgcacaatttagaaaaca

SEQ ID NO: 2770816 - DNA, 21 bp, Homo sapiens
gtaatgggccaattaaaatat

SEQ ID NO: 2770817 - DNA, 19 bp, Homo sapiens
gtaatgtatcttatttata

SEQ ID NO: 2770818 - DNA, 20 bp, Homo sapiens
gtaatgtatcttatttatat

SEQ ID NO: 2770819 - DNA, 19 bp, Homo sapiens
gtaatgtcaccaccttccc

SEQ ID NO: 2770820 - DNA, 20 bp, Homo sapiens
gtaatgtcaccaccttccca

SEQ ID NO: 2770821 - DNA, 22 bp, Homo sapiens
gtaatgtcaccaccttcccagc

SEQ ID NO: 2770822 - DNA, 12 bp, Homo sapiens
gtaattctaaat

SEQ ID NO: 2770823 - DNA, 18 bp, Homo sapiens
gtaattctaaatgaatgt

SEQ ID NO: 2770824 - DNA, 19 bp, Homo sapiens
gtaattggtgacaatgtca

SEQ ID NO: 2770825 - DNA, 16 bp, Homo sapiens
gtaatttgaggacaac

SEQ ID NO: 2770826 - DNA, 16 bp, Homo sapiens
gtacaaaataaacaaa

SEQ ID NO: 2770827 - DNA, 16 bp, Homo sapiens
gtacaaagatatgcta

SEQ ID NO: 2770828 - DNA, 20 bp, Homo sapiens
gtacaaagatatgctaagca

SEQ ID NO: 2770829 - DNA, 14 bp, Homo sapiens
gtacaaagtagaga

SEQ ID NO: 2770830 - DNA, 18 bp, Homo sapiens
gtacaaagtagagaagta

SEQ ID NO: 2770831 - DNA, 12 bp, Homo sapiens
gtacaatattta

SEQ ID NO: 2770832 - DNA, 17 bp, Homo sapiens
gtacaatcctttgagtt

SEQ ID NO: 2770833 - DNA, 20 bp, Homo sapiens
gtacacagctctagacactg

SEQ ID NO: 2770834 - DNA, 14 bp, Homo sapiens
gtacacgtgtcctg

SEQ ID NO: 2770835 - DNA, 20 bp, Homo sapiens
gtacagaattctgctacctc

SEQ ID NO: 2770836 - DNA, 15 bp, Homo sapiens
gtacagaatttttaa

SEQ ID NO: 2770837 - DNA, 16 bp, Homo sapiens
gtacagaatttttaat

SEQ ID NO: 2770838 - DNA, 17 bp, Homo sapiens
gtacagacgtatgctta

SEQ ID NO: 2770839 - DNA, 19 bp, Homo sapiens
gtacagcatgcatcacgga

SEQ ID NO: 2770840 - DNA, 18 bp, Homo sapiens
gtacagtagcttaaataa

SEQ ID NO: 2770841 - DNA, 20 bp, Homo sapiens
gtacagtagcttaaataaat

SEQ ID NO: 2770842 - DNA, 21 bp, Homo sapiens
gtacagtagcttaaataaatt

SEQ ID NO: 2770843 - DNA, 16 bp, Homo sapiens
gtacagtgtgtaaagt

SEQ ID NO: 2770844 - DNA, 14 bp, Homo sapiens
gtacagttatctaa

SEQ ID NO: 2770845 - DNA, 22 bp, Homo sapiens
gtacataaaggtggtatgtgtg

SEQ ID NO: 2770846 - DNA, 16 bp, Homo sapiens
gtacatatggaaatcc

SEQ ID NO: 2770847 - DNA, 21 bp, Homo sapiens
gtacatatggaaatcctgtta

SEQ ID NO: 2770848 - DNA, 18 bp, Homo sapiens
gtacatatgtaaaataaa

SEQ ID NO: 2770849 - DNA, 18 bp, Homo sapiens
gtacattcctgatactgg

SEQ ID NO: 2770850 - DNA, 13 bp, Homo sapiens
gtacatttctgaa

SEQ ID NO: 2770851 - DNA, 17 bp, Homo sapiens
gtacatttctgaaatga

SEQ ID NO: 2770852 - DNA, 23 bp, Homo sapiens
gtaccatctgtcttgccagccag

SEQ ID NO: 2770853 - DNA, 21 bp, Homo sapiens
gtacccactcctcactgcccc

SEQ ID NO: 2770854 - DNA, 22 bp, Homo sapiens
gtacccccgtggtctttgaata

SEQ ID NO: 2770855 - DNA, 17 bp, Homo sapiens
gtacctatggctgcctg

SEQ ID NO: 2770856 - DNA, 12 bp, Homo sapiens
gtacctcagttt

SEQ ID NO: 2770857 - DNA, 21 bp, Homo sapiens
gtacctgtagtgagaaactga

SEQ ID NO: 2770858 - DNA, 19 bp, Homo sapiens
gtacgaacccctcccctcc

SEQ ID NO: 2770859 - DNA, 14 bp, Homo sapiens
gtacgtctgacagg

SEQ ID NO: 2770860 - DNA, 20 bp, Homo sapiens
gtactactagatgtctttag

SEQ ID NO: 2770861 - DNA, 16 bp, Homo sapiens
gtactatgttaataac

SEQ ID NO: 2770862 - DNA, 16 bp, Homo sapiens
gtactcctgcaaaatt

SEQ ID NO: 2770863 - DNA, 13 bp, Homo sapiens
gtactgcctgctt

SEQ ID NO: 2770864 - DNA, 16 bp, Homo sapiens
gtactgcctgcttggg

SEQ ID NO: 2770865 - DNA, 23 bp, Homo sapiens
gtacttacccggagaaggccgct

SEQ ID NO: 2770866 - DNA, 14 bp, Homo sapiens
gtacttctccaccc

SEQ ID NO: 2770867 - DNA, 19 bp, Homo sapiens
gtacttctccaccctgctc

SEQ ID NO: 2770868 - DNA, 21 bp, Homo sapiens
gtacttgtggacacagctctt

SEQ ID NO: 2770869 - DNA, 18 bp, Homo sapiens
gtagaaagacagagctgg

SEQ ID NO: 2770870 - DNA, 18 bp, Homo sapiens
gtagaacgtaaccacgga

SEQ ID NO: 2770871 - DNA, 17 bp, Homo sapiens
gtagaataaagaaaaac

SEQ ID NO: 2770872 - DNA, 19 bp, Homo sapiens
gtagaatgtaaagcttgtc

SEQ ID NO: 2770873 - DNA, 21 bp, Homo sapiens
gtagaatgtaaagcttgtctg

SEQ ID NO: 2770874 - DNA, 14 bp, Homo sapiens
gtagaccaaaataa

SEQ ID NO: 2770875 - DNA, 16 bp, Homo sapiens
gtagaccaaaataaaa

SEQ ID NO: 2770876 - DNA, 20 bp, Homo sapiens
gtagagtttgaaggaggtga

SEQ ID NO: 2770877 - DNA, 20 bp, Homo sapiens
gtagcaagttctagagaaga

SEQ ID NO: 2770878 - DNA, 21 bp, Homo sapiens
gtagcaagttctagagaagag

SEQ ID NO: 2770879 - DNA, 15 bp, Homo sapiens
gtagcccagcactgt

SEQ ID NO: 2770880 - DNA, 15 bp, Homo sapiens
gtagccccagtgaca

SEQ ID NO: 2770881 - DNA, 19 bp, Homo sapiens
gtagccgagagcctgctcc

SEQ ID NO: 2770882 - DNA, 21 bp, Homo sapiens
gtagcctcgccgtctgtgaat

SEQ ID NO: 2770883 - DNA, 15 bp, Homo sapiens
gtagccttgcccgga

SEQ ID NO: 2770884 - DNA, 11 bp, Homo sapiens
gtagctgagct

SEQ ID NO: 2770885 - DNA, 21 bp, Homo sapiens
gtagctgagctcacaaggcag

SEQ ID NO: 2770886 - DNA, 17 bp, Homo sapiens
gtagctgggactacagg

SEQ ID NO: 2770887 - DNA, 14 bp, Homo sapiens
gtagctgtgacctg

SEQ ID NO: 2770888 - DNA, 20 bp, Homo sapiens
gtagctgtgacctgctgagc

SEQ ID NO: 2770889 - DNA, 18 bp, Homo sapiens
gtagctgtggtgaggtgg

SEQ ID NO: 2770890 - DNA, 14 bp, Homo sapiens
gtaggaggtttgga

SEQ ID NO: 2770891 - DNA, 16 bp, Homo sapiens
gtagggcgggaggatg

SEQ ID NO: 2770892 - DNA, 21 bp, Homo sapiens
gtagggcgggaggatgttctg

SEQ ID NO: 2770893 - DNA, 22 bp, Homo sapiens
gtagggcgggaggatgttctgg

SEQ ID NO: 2770894 - DNA, 23 bp, Homo sapiens
gtagggcgggaggatgttctggg

SEQ ID NO: 2770895 - DNA, 18 bp, Homo sapiens
gtatgctgttttaataat

SEQ ID NO: 2770896 - DNA, 15 bp, Homo sapiens
gtatggcctgtgtca

SEQ ID NO: 2770897 - DNA, 13 bp, Homo sapiens
gtatggtggctgg

SEQ ID NO: 2770898 - DNA, 14 bp, Homo sapiens
gtatggtggctggg

SEQ ID NO: 2770899 - DNA, 13 bp, Homo sapiens
gtatgtctccagt

SEQ ID NO: 2770900 - DNA, 15 bp, Homo sapiens
gtatgtgtgtgtatg

SEQ ID NO: 2770901 - DNA, 18 bp, Homo sapiens
gtatgtgtgtgtatgcta

SEQ ID NO: 2770902 - DNA, 17 bp, Homo sapiens
gtattaaacttgtcaga

SEQ ID NO: 2770903 - DNA, 16 bp, Homo sapiens
gtattaattatctgat

SEQ ID NO: 2770904 - DNA, 19 bp, Homo sapiens
gtattatttacaatgcaga

SEQ ID NO: 2770905 - DNA, 19 bp, Homo sapiens
gtattccagacctgaagaa

SEQ ID NO: 2770906 - DNA, 14 bp, Homo sapiens
gtattgtaatgaat

SEQ ID NO: 2770907 - DNA, 18 bp, Homo sapiens
gtattttcgtgcatttgt

SEQ ID NO: 2770908 - DNA, 20 bp, Homo sapiens
gtattttcttcccatttgta

SEQ ID NO: 2770909 - DNA, 23 bp, Homo sapiens
gtattttcttcccatttgtaatg

SEQ ID NO: 2770910 - DNA, 22 bp, Homo sapiens
gtatttttagagattaatttgt

SEQ ID NO: 2770911 - DNA, 15 bp, Homo sapiens
gtatttttgaataaa

SEQ ID NO: 2770912 - DNA, 20 bp, Homo sapiens
gtcaaaacagattgtttgca

SEQ ID NO: 2770913 - DNA, 12 bp, Homo sapiens
gtcaaacaaata

SEQ ID NO: 2770914 - DNA, 13 bp, Homo sapiens
gtcaaaccgcact

SEQ ID NO: 2770915 - DNA, 13 bp, Homo sapiens
gtcaaagtaaaac

SEQ ID NO: 2770916 - DNA, 22 bp, Homo sapiens
gtcaacagagaaggcaggaatg

SEQ ID NO: 2770917 - DNA, 13 bp, Homo sapiens
gtcaagtcaacca

SEQ ID NO: 2770918 - DNA, 14 bp, Homo sapiens
gtcaatattaaata

SEQ ID NO: 2770919 - DNA, 16 bp, Homo sapiens
gtcaatattaaataca

SEQ ID NO: 2770920 - DNA, 20 bp, Homo sapiens
gtcaatgaaatatttgctta

SEQ ID NO: 2770921 - DNA, 17 bp, Homo sapiens
gtcacaagagcccagca

SEQ ID NO: 2770922 - DNA, 16 bp, Homo sapiens
gtcacacactttggct

SEQ ID NO: 2770923 - DNA, 20 bp, Homo sapiens
gtcacacagtattacttctg

SEQ ID NO: 2770924 - DNA, 19 bp, Homo sapiens
gtcacaggactctgcctcc

SEQ ID NO: 2770925 - DNA, 15 bp, Homo sapiens
gtcacaggcaggtcc

SEQ ID NO: 2770926 - DNA, 16 bp, Homo sapiens
gtcacaggcaggtcca

SEQ ID NO: 2770927 - DNA, 14 bp, Homo sapiens
gtcacattcaggaa

SEQ ID NO: 2770928 - DNA, 16 bp, Homo sapiens
gtcacattcaggaaga

SEQ ID NO: 2770929 - DNA, 12 bp, Homo sapiens
gtcaccaagccc

SEQ ID NO: 2770930 - DNA, 17 bp, Homo sapiens
gtcaccaagctcacagt

SEQ ID NO: 2770931 - DNA, 19 bp, Homo sapiens
gtcaccaccttcccagctc

SEQ ID NO: 2770932 - DNA, 20 bp, Homo sapiens
gtcaccaccttcccagctct

SEQ ID NO: 2770933 - DNA, 22 bp, Homo sapiens
gtcaccaccttcccagctctcc

SEQ ID NO: 2770934 - DNA, 18 bp, Homo sapiens
gtcaccgtggaccttcct

SEQ ID NO: 2770935 - DNA, 20 bp, Homo sapiens
gtcacctgaagactcattct

SEQ ID NO: 2770936 - DNA, 16 bp, Homo sapiens
gtcacgtgaaatattt

SEQ ID NO: 2770937 - DNA, 16 bp, Homo sapiens
gtcactagcagctgca

SEQ ID NO: 2770938 - DNA, 11 bp, Homo sapiens
gtcactcccag

SEQ ID NO: 2770939 - DNA, 23 bp, Homo sapiens
gtcactgctacaccttagcagct

SEQ ID NO: 2770940 - DNA, 19 bp, Homo sapiens
gtcactggaccactgggca

SEQ ID NO: 2770941 - DNA, 17 bp, Homo sapiens
gtcactgtccctcaaat

SEQ ID NO: 2770942 - DNA, 20 bp, Homo sapiens
gtcagactgctgggactggc

SEQ ID NO: 2770943 - DNA, 16 bp, Homo sapiens
gtcagactttaaagaa

SEQ ID NO: 2770944 - DNA, 15 bp, Homo sapiens
gtcagaggccctgga

SEQ ID NO: 2770945 - DNA, 16 bp, Homo sapiens
acaggcaagcacctcc

SEQ ID NO: 2770946 - DNA, 18 bp, Homo sapiens
acaggcaagcacctcctg

SEQ ID NO: 2770947 - DNA, 20 bp, Homo sapiens
acaggcaagcacctcctgcc

SEQ ID NO: 2770948 - DNA, 14 bp, Homo sapiens
acaggcacccacca

SEQ ID NO: 2770949 - DNA, 13 bp, Homo sapiens
acaggcaggtcca

SEQ ID NO: 2770950 - DNA, 14 bp, Homo sapiens
acaggcatgttctc

SEQ ID NO: 2770951 - DNA, 19 bp, Homo sapiens
acaggcatgttctctgagg

SEQ ID NO: 2770952 - DNA, 20 bp, Homo sapiens
acaggcatgttctctgagga

SEQ ID NO: 2770953 - DNA, 17 bp, Homo sapiens
acaggcatttcctgggt

SEQ ID NO: 2770954 - DNA, 18 bp, Homo sapiens
acaggcccggctccaggc

SEQ ID NO: 2770955 - DNA, 20 bp, Homo sapiens
acaggcccggctccaggctc

SEQ ID NO: 2770956 - DNA, 15 bp, Homo sapiens
ctgtcattgtccatg

SEQ ID NO: 2770957 - DNA, 17 bp, Homo sapiens
ctgtcatttgagcaggg

SEQ ID NO: 2770958 - DNA, 18 bp, Homo sapiens
ctgtcatttgagcagggc

SEQ ID NO: 2770959 - DNA, 20 bp, Homo sapiens
ctgtccaacctaaccccttt

SEQ ID NO: 2770960 - DNA, 23 bp, Homo sapiens
ctgtccaggcactgctgcccagc

SEQ ID NO: 2770961 - DNA, 20 bp, Homo sapiens
ctgtccagggccctgagctc

SEQ ID NO: 2770962 - DNA, 22 bp, Homo sapiens
ctgtccatgtattcacacaccc

SEQ ID NO: 2770963 - DNA, 23 bp, Homo sapiens
ctgtcccacctcttctcttcctg

SEQ ID NO: 2770964 - DNA, 22 bp, Homo sapiens
ctgtccccacagcaggtgcctg

SEQ ID NO: 2770965 - DNA, 22 bp, Homo sapiens
ctgtccccctgagatcagagtc

SEQ ID NO: 2770966 - DNA, 15 bp, Homo sapiens
ctgtccctcaaatga

SEQ ID NO: 2770967 - DNA, 23 bp, Homo sapiens
ctgtccctcaaatgacccaaaga

SEQ ID NO: 2770968 - DNA, 17 bp, Homo sapiens
ctgtccctcactgcctt

SEQ ID NO: 2770969 - DNA, 18 bp, Homo sapiens
ctgtccctcactgccttc

SEQ ID NO: 2770970 - DNA, 13 bp, Homo sapiens
ctgtccctctttg

SEQ ID NO: 2770971 - DNA, 12 bp, Homo sapiens
ctgtccctgtca

SEQ ID NO: 2770972 - DNA, 15 bp, Homo sapiens
ctgtccctgtcacca

SEQ ID NO: 2770973 - DNA, 19 bp, Homo sapiens
ctgtcccttcccccataag

SEQ ID NO: 2770974 - DNA, 19 bp, Homo sapiens
ctgtcccttgctgttttca

SEQ ID NO: 2770975 - DNA, 17 bp, Homo sapiens
ctgtcctactctgtgtc

SEQ ID NO: 2770976 - DNA, 20 bp, Homo sapiens
ctgtcctactctgtgtcagg

SEQ ID NO: 2770977 - DNA, 15 bp, Homo sapiens
ctgtcctaggccaca

SEQ ID NO: 2770978 - DNA, 13 bp, Homo sapiens
ctgtcctgctgtg

SEQ ID NO: 2770979 - DNA, 21 bp, Homo sapiens
ctgtcctgggagtgagctggt

SEQ ID NO: 2770980 - DNA, 14 bp, Homo sapiens
ctgtcgagacactt

SEQ ID NO: 2770981 - DNA, 18 bp, Homo sapiens
ctgtcgagacacttgcct

SEQ ID NO: 2770982 - DNA, 15 bp, Homo sapiens
ctgtcgattagactg

SEQ ID NO: 2770983 - DNA, 20 bp, Homo sapiens
ctgtcgattagactggacag

SEQ ID NO: 2770984 - DNA, 23 bp, Homo sapiens
ctgtcgattagactggacagctt

SEQ ID NO: 2770985 - DNA, 13 bp, Homo sapiens
ctgtcgcccagtc

SEQ ID NO: 2770986 - DNA, 13 bp, Homo sapiens
ctgtcgctgcttc

SEQ ID NO: 2770987 - DNA, 17 bp, Homo sapiens
ctgtcgctgcttcgtgg

SEQ ID NO: 2770988 - DNA, 21 bp, Homo sapiens
ctgtcgtgtttacaaaaggca

SEQ ID NO: 2770989 - DNA, 14 bp, Homo sapiens
ctgtctccctgggg

SEQ ID NO: 2770990 - DNA, 15 bp, Homo sapiens
ctgtctcgagcgccc

SEQ ID NO: 2770991 - DNA, 18 bp, Homo sapiens
ctgtctcgagcgccctgc

SEQ ID NO: 2770992 - DNA, 23 bp, Homo sapiens
ctgtctcgagcgccctgcagacc

SEQ ID NO: 2770993 - DNA, 20 bp, Homo sapiens
ctgtctctgctcttgcctgc

SEQ ID NO: 2770994 - DNA, 17 bp, Homo sapiens
ctgtctctgtccctcac

SEQ ID NO: 2770995 - DNA, 14 bp, Homo sapiens
ctgtctgccagcca

SEQ ID NO: 2770996 - DNA, 15 bp, Homo sapiens
ctgtctgctcagaca

SEQ ID NO: 2770997 - DNA, 18 bp, Homo sapiens
ctgtctgtaagagaattc

SEQ ID NO: 2770998 - DNA, 15 bp, Homo sapiens
ctgtctgtctgtctg

SEQ ID NO: 2770999 - DNA, 12 bp, Homo sapiens
ctgtctgtggct

SEQ ID NO: 2771000 - DNA, 13 bp, Homo sapiens
ctgtcttgccagc

SEQ ID NO: 2771001 - DNA, 17 bp, Homo sapiens
ctgtcttgccagccaga

SEQ ID NO: 2771002 - DNA, 16 bp, Homo sapiens
ctgtctttaaggaaaa

SEQ ID NO: 2771003 - DNA, 16 bp, Homo sapiens
ctgtgaacccaggaca

SEQ ID NO: 2771004 - DNA, 22 bp, Homo sapiens
ctgtgaacccaggacaagcatg

SEQ ID NO: 2771005 - DNA, 22 bp, Homo sapiens
ctgtgaacgatttagaaagaag

SEQ ID NO: 2771006 - DNA, 16 bp, Homo sapiens
ctgtgaagaatgaagt

SEQ ID NO: 2771007 - DNA, 15 bp, Homo sapiens
ctgtgaagacccagc

SEQ ID NO: 2771008 - DNA, 16 bp, Homo sapiens
ctgtgaagacccagca

SEQ ID NO: 2771009 - DNA, 21 bp, Homo sapiens
ctgtgaagacccagcaggaag

SEQ ID NO: 2771010 - DNA, 21 bp, Homo sapiens
ctgtgaataaaaaccctgtat

SEQ ID NO: 2771011 - DNA, 19 bp, Homo sapiens
ctgtgacctgctgagctct

SEQ ID NO: 2771012 - DNA, 20 bp, Homo sapiens
ctgtgacctgctgagctctg

SEQ ID NO: 2771013 - DNA, 21 bp, Homo sapiens
ctgtgacctgctgagctctga

SEQ ID NO: 2771014 - DNA, 21 bp, Homo sapiens
ctgtgaggtgctgatgagtga

SEQ ID NO: 2771015 - DNA, 16 bp, Homo sapiens
ctgtgcaaatccttga

SEQ ID NO: 2771016 - DNA, 17 bp, Homo sapiens
ctgtgcacggccagctg

SEQ ID NO: 2771017 - DNA, 17 bp, Homo sapiens
ctgtgcagatgagcagt

SEQ ID NO: 2771018 - DNA, 15 bp, Homo sapiens
ctgtgcagggaggag

SEQ ID NO: 2771019 - DNA, 14 bp, Homo sapiens
ctgtgccagagcct

SEQ ID NO: 2771020 - DNA, 17 bp, Homo sapiens
ctgtgccagagcctggg

SEQ ID NO: 2771021 - DNA, 18 bp, Homo sapiens
ctgtgccagagcctgggg

SEQ ID NO: 2771022 - DNA, 20 bp, Homo sapiens
ctgtgccagagcctggggct

SEQ ID NO: 2771023 - DNA, 15 bp, Homo sapiens
ctgtgccatgtgcca

SEQ ID NO: 2771024 - DNA, 18 bp, Homo sapiens
ctgtgccatgtgccaggt

SEQ ID NO: 2771025 - DNA, 24 bp, Homo sapiens
ctgtgcctcgctccccactctgct

SEQ ID NO: 2771026 - DNA, 16 bp, Homo sapiens
ctgtgcctctgcctgt

SEQ ID NO: 2771027 - DNA, 16 bp, Homo sapiens
ctgtgcgttttagagt

SEQ ID NO: 2771028 - DNA, 15 bp, Homo sapiens
ctgtgctctggacag

SEQ ID NO: 2771029 - DNA, 18 bp, Homo sapiens
ctgtgcttcaattaataa

SEQ ID NO: 2771030 - DNA, 16 bp, Homo sapiens
ctgtgctttgactcac

SEQ ID NO: 2771031 - DNA, 22 bp, Homo sapiens
ctgtggagagtgagaataattg

SEQ ID NO: 2771032 - DNA, 22 bp, Homo sapiens
ctgtggccagcttgttatttat

SEQ ID NO: 2771033 - DNA, 23 bp, Homo sapiens
ctgtggccagcttgttatttata

SEQ ID NO: 2771034 - DNA, 11 bp, Homo sapiens
ctgtggcctgg

SEQ ID NO: 2771035 - DNA, 14 bp, Homo sapiens
ctgtggcctgggca

SEQ ID NO: 2771036 - DNA, 24 bp, Homo sapiens
ctgtggctgcagagaccttgcgac

SEQ ID NO: 2771037 - DNA, 17 bp, Homo sapiens
ctgtggctgctagcact

SEQ ID NO: 2771038 - DNA, 21 bp, Homo sapiens
ctgtgggagcctcgcaacccg

SEQ ID NO: 2771039 - DNA, 15 bp, Homo sapiens
ctgtggggccccaga

SEQ ID NO: 2771040 - DNA, 22 bp, Homo sapiens
ctgtggtcttcaaattgtcttt

SEQ ID NO: 2771041 - DNA, 16 bp, Homo sapiens
ctgtggtggctgtctc

SEQ ID NO: 2771042 - DNA, 17 bp, Homo sapiens
ctgtggtggctgtctct

SEQ ID NO: 2771043 - DNA, 13 bp, Homo sapiens
cttggacctctgc

SEQ ID NO: 2771044 - DNA, 14 bp, Homo sapiens
cttggactcctccc

SEQ ID NO: 2771045 - DNA, 20 bp, Homo sapiens
cttggagagggacgaagaaa

SEQ ID NO: 2771046 - DNA, 21 bp, Homo sapiens
cttggagagggacgaagaaag

SEQ ID NO: 2771047 - DNA, 15 bp, Homo sapiens
cttggcagctgaact

SEQ ID NO: 2771048 - DNA, 15 bp, Homo sapiens
cttggcccctgtgtg

SEQ ID NO: 2771049 - DNA, 18 bp, Homo sapiens
cttgggaatggatcctgg

SEQ ID NO: 2771050 - DNA, 22 bp, Homo sapiens
cttgggcacccccagcctgggc

SEQ ID NO: 2771051 - DNA, 14 bp, Homo sapiens
cttggggcttccta

SEQ ID NO: 2771052 - DNA, 13 bp, Homo sapiens
cttggggggtgat

SEQ ID NO: 2771053 - DNA, 15 bp, Homo sapiens
cttgggtaggcggga

SEQ ID NO: 2771054 - DNA, 15 bp, Homo sapiens
cttggtaagaagccg

SEQ ID NO: 2771055 - DNA, 23 bp, Homo sapiens
cttggtactactagatgtcttta

SEQ ID NO: 2771056 - DNA, 13 bp, Homo sapiens
cttggtctcagct

SEQ ID NO: 2771057 - DNA, 15 bp, Homo sapiens
cttggtctcagcttc

SEQ ID NO: 2771058 - DNA, 17 bp, Homo sapiens
cttggtctcagcttcat

SEQ ID NO: 2771059 - DNA, 21 bp, Homo sapiens
cttgtaaatagctcaggtgtc

SEQ ID NO: 2771060 - DNA, 23 bp, Homo sapiens
cttgtacatgtgtagcctgtgca

SEQ ID NO: 2771061 - DNA, 16 bp, Homo sapiens
cttgtactatgttaat

SEQ ID NO: 2771062 - DNA, 17 bp, Homo sapiens
cttgtactatgttaata

SEQ ID NO: 2771063 - DNA, 22 bp, Homo sapiens
cttgtatatacatattataaat

SEQ ID NO: 2771064 - DNA, 16 bp, Homo sapiens
cttgtatattccacca

SEQ ID NO: 2771065 - DNA, 13 bp, Homo sapiens
cttgtatctgaag

SEQ ID NO: 2771066 - DNA, 21 bp, Homo sapiens
cttgtatgaaagatggctgtg

SEQ ID NO: 2771067 - DNA, 19 bp, Homo sapiens
cttgtattttcttcccatt

SEQ ID NO: 2771068 - DNA, 22 bp, Homo sapiens
cttgtattttcttcccatttgt

SEQ ID NO: 2771069 - DNA, 18 bp, Homo sapiens
cttgtcactagcagctgc

SEQ ID NO: 2771070 - DNA, 19 bp, Homo sapiens
cttgtcactagcagctgca

SEQ ID NO: 2771071 - DNA, 17 bp, Homo sapiens
cttgtcatgtaccatca

SEQ ID NO: 2771072 - DNA, 16 bp, Homo sapiens
cttgtccctgcccaga

SEQ ID NO: 2771073 - DNA, 23 bp, Homo sapiens
cttgtccttttgtaccatggtgt

SEQ ID NO: 2771074 - DNA, 13 bp, Homo sapiens
cttgtctctgggc

SEQ ID NO: 2771075 - DNA, 14 bp, Homo sapiens
cttgtctctgggct

SEQ ID NO: 2771076 - DNA, 20 bp, Homo sapiens
cttgtgctgatcgtgctaaa

SEQ ID NO: 2771077 - DNA, 18 bp, Homo sapiens
cttgtggaattgggagct

SEQ ID NO: 2771078 - DNA, 13 bp, Homo sapiens
cttgtggacacag

SEQ ID NO: 2771079 - DNA, 16 bp, Homo sapiens
cttgtggacacagctc

SEQ ID NO: 2771080 - DNA, 18 bp, Homo sapiens
cttgtggacacagctctt

SEQ ID NO: 2771081 - DNA, 10 bp, Homo sapiens
cttgtgtatg

SEQ ID NO: 2771082 - DNA, 15 bp, Homo sapiens
cttgtgtctctgtgc

SEQ ID NO: 2771083 - DNA, 18 bp, Homo sapiens
cttgtgtctctgtgcttt

SEQ ID NO: 2771084 - DNA, 13 bp, Homo sapiens
cttgtgtctgcgt

SEQ ID NO: 2771085 - DNA, 19 bp, Homo sapiens
cttgtgtgttttgagagta

SEQ ID NO: 2771086 - DNA, 19 bp, Homo sapiens
cttgttgcatgatgtattt

SEQ ID NO: 2771087 - DNA, 12 bp, Homo sapiens
cttgtttcaatt

SEQ ID NO: 2771088 - DNA, 20 bp, Homo sapiens
cttgtttgattttagctgca

SEQ ID NO: 2771089 - DNA, 14 bp, Homo sapiens
cttgtttggggcag

SEQ ID NO: 2771090 - DNA, 12 bp, Homo sapiens
ctttaaatcaaa

SEQ ID NO: 2771091 - DNA, 13 bp, Homo sapiens
ctttaaatcaaaa

SEQ ID NO: 2771092 - DNA, 14 bp, Homo sapiens
ctttaaatcaaaag

SEQ ID NO: 2771093 - DNA, 19 bp, Homo sapiens
ctttaaatcaaaagctgct

SEQ ID NO: 2771094 - DNA, 21 bp, Homo sapiens
ctttaaatcaaaagctgcttg

SEQ ID NO: 2771095 - DNA, 23 bp, Homo sapiens
ctttaacaaaacaagaaagaaac

SEQ ID NO: 2771096 - DNA, 18 bp, Homo sapiens
ctttaaccctctcttccc

SEQ ID NO: 2771097 - DNA, 19 bp, Homo sapiens
ctttaaccctctcttccct

SEQ ID NO: 2771098 - DNA, 22 bp, Homo sapiens
ctttaaccgtttttcaagaaaa

SEQ ID NO: 2771099 - DNA, 17 bp, Homo sapiens
ctttaatgtcacaggca

SEQ ID NO: 2771100 - DNA, 18 bp, Homo sapiens
ctttaatgtcacaggcag

SEQ ID NO: 2771101 - DNA, 22 bp, Homo sapiens
ctttacagatgagattccctct

SEQ ID NO: 2771102 - DNA, 22 bp, Homo sapiens
ctttacattttatttattagct

SEQ ID NO: 2771103 - DNA, 13 bp, Homo sapiens
ctttacctgagac

SEQ ID NO: 2771104 - DNA, 16 bp, Homo sapiens
ctttacctgagaccag

SEQ ID NO: 2771105 - DNA, 14 bp, Homo sapiens
ctttagcgcccagt

SEQ ID NO: 2771106 - DNA, 15 bp, Homo sapiens
ctttaggcattaaat

SEQ ID NO: 2771107 - DNA, 23 bp, Homo sapiens
ctttaggcattaaattttagcaa

SEQ ID NO: 2771108 - DNA, 20 bp, Homo sapiens
ctttaggtgcctcctgtctt

SEQ ID NO: 2771109 - DNA, 19 bp, Homo sapiens
ctttatcacattatttgca

SEQ ID NO: 2771110 - DNA, 14 bp, Homo sapiens
ctttatcagtgatg

SEQ ID NO: 2771111 - DNA, 22 bp, Homo sapiens
ctttatctaatacctctgtgtg

SEQ ID NO: 2771112 - DNA, 13 bp, Homo sapiens
ctttatggtttct

SEQ ID NO: 2771113 - DNA, 21 bp, Homo sapiens
ctttatgtctgtggatttttt

SEQ ID NO: 2771114 - DNA, 20 bp, Homo sapiens
ctttatgttactacatgcac

SEQ ID NO: 2771115 - DNA, 16 bp, Homo sapiens
ctttattaattcatta

SEQ ID NO: 2771116 - DNA, 18 bp, Homo sapiens
ctttattttttaagtatt

SEQ ID NO: 2771117 - DNA, 22 bp, Homo sapiens
ctttattttttaagtatttata

SEQ ID NO: 2771118 - DNA, 23 bp, Homo sapiens
ctttattttttaagtatttatat

SEQ ID NO: 2771119 - DNA, 14 bp, Homo sapiens
ctttcaaaaacatg

SEQ ID NO: 2771120 - DNA, 16 bp, Homo sapiens
ctttcaacttaaatca

SEQ ID NO: 2771121 - DNA, 18 bp, Homo sapiens
ctttcaacttaaatcact

SEQ ID NO: 2771122 - DNA, 21 bp, Homo sapiens
ctttcaacttaaatcactgag

SEQ ID NO: 2771123 - DNA, 20 bp, Homo sapiens
ctttcaatggtttgcaagga

SEQ ID NO: 2771124 - DNA, 18 bp, Homo sapiens
ctttcatgaacacagcct

SEQ ID NO: 2771125 - DNA, 14 bp, Homo sapiens
ctttccacaggagg

SEQ ID NO: 2771126 - DNA, 14 bp, Homo sapiens
ctttccacctgctt

SEQ ID NO: 2771127 - DNA, 16 bp, Homo sapiens
ctttccacctgctttc

SEQ ID NO: 2771128 - DNA, 15 bp, Homo sapiens
ctttccatctgcttg

SEQ ID NO: 2771129 - DNA, 23 bp, Homo sapiens
ctttcccaccagcatgtcactcc

SEQ ID NO: 2771130 - DNA, 13 bp, Homo sapiens
ctttcccatgctg

SEQ ID NO: 2771131 - DNA, 13 bp, Homo sapiens
ctttccccagtgt

SEQ ID NO: 2771132 - DNA, 16 bp, Homo sapiens
ctttccctcaccccct

SEQ ID NO: 2771133 - DNA, 22 bp, Homo sapiens
ctttttaaaaagtactctttaa

SEQ ID NO: 2771134 - DNA, 23 bp, Homo sapiens
ctttttataatgtggatttccta

SEQ ID NO: 2771135 - DNA, 18 bp, Homo sapiens
ctttttatactccataca

SEQ ID NO: 2771136 - DNA, 17 bp, Homo sapiens
gaaatggtatgagctga

SEQ ID NO: 2771137 - DNA, 21 bp, Homo sapiens
gaaatggtatgagctgagggg

SEQ ID NO: 2771138 - DNA, 16 bp, Homo sapiens
gaaatgtatcctgata

SEQ ID NO: 2771139 - DNA, 16 bp, Homo sapiens
gaaattagctgtgtga

SEQ ID NO: 2771140 - DNA, 20 bp, Homo sapiens
gaaattcaacctgtgtctta

SEQ ID NO: 2771141 - DNA, 15 bp, Homo sapiens
gaaattcacactgtg

SEQ ID NO: 2771142 - DNA, 16 bp, Homo sapiens
gaaattcctgtagcat

SEQ ID NO: 2771143 - DNA, 14 bp, Homo sapiens
gaaattggctggat

SEQ ID NO: 2771144 - DNA, 15 bp, Homo sapiens
gaaattggctggatg

SEQ ID NO: 2771145 - DNA, 20 bp, Homo sapiens
gaaattgtctagcagagcag

SEQ ID NO: 2771146 - DNA, 22 bp, Homo sapiens
gaaattgtttaagtgttgtaaa

SEQ ID NO: 2771147 - DNA, 23 bp, Homo sapiens
gaaatttcagattcccagagcaa

SEQ ID NO: 2771148 - DNA, 19 bp, Homo sapiens
gaaattttactgacagaaa

SEQ ID NO: 2771149 - DNA, 17 bp, Homo sapiens
gaacaaaaattgggttt

SEQ ID NO: 2771150 - DNA, 17 bp, Homo sapiens
gaacaaagaaaaaaata

SEQ ID NO: 2771151 - DNA, 18 bp, Homo sapiens
gaacaaagaaaaaaatat

SEQ ID NO: 2771152 - DNA, 20 bp, Homo sapiens
gaacaaagaaaaaaatatat

SEQ ID NO: 2771153 - DNA, 21 bp, Homo sapiens
gaacaaagaacggcatgtgaa

SEQ ID NO: 2771154 - DNA, 15 bp, Homo sapiens
gaacaactactgtga

SEQ ID NO: 2771155 - DNA, 22 bp, Homo sapiens
gaacaatagctattgcatgtaa

SEQ ID NO: 2771156 - DNA, 22 bp, Homo sapiens
gaacacagcctgggaccagggc

SEQ ID NO: 2771157 - DNA, 23 bp, Homo sapiens
gaacacagcctgggaccagggca

SEQ ID NO: 2771158 - DNA, 18 bp, Homo sapiens
gaacacatactagaaagc

SEQ ID NO: 2771159 - DNA, 22 bp, Homo sapiens
gaacaccaacttttatttggaa

SEQ ID NO: 2771160 - DNA, 20 bp, Homo sapiens
gaacaccataggtagaatgt

SEQ ID NO: 2771161 - DNA, 19 bp, Homo sapiens
gaacacccggaaagactga

SEQ ID NO: 2771162 - DNA, 16 bp, Homo sapiens
gaacaccctatatttt

SEQ ID NO: 2771163 - DNA, 16 bp, Homo sapiens
gaacactgggggaggg

SEQ ID NO: 2771164 - DNA, 14 bp, Homo sapiens
gaacagaaggatga

SEQ ID NO: 2771165 - DNA, 19 bp, Homo sapiens
gaacagaaggatgaatgag

SEQ ID NO: 2771166 - DNA, 16 bp, Homo sapiens
gaacagactggaagca

SEQ ID NO: 2771167 - DNA, 13 bp, Homo sapiens
gaacagagtatat

SEQ ID NO: 2771168 - DNA, 17 bp, Homo sapiens
gaacagagtatatatgt

SEQ ID NO: 2771169 - DNA, 19 bp, Homo sapiens
gaacaggcaagtgaagaaa

SEQ ID NO: 2771170 - DNA, 13 bp, Homo sapiens
gaacagtaaacat

SEQ ID NO: 2771171 - DNA, 14 bp, Homo sapiens
gaacagtaactgcc

SEQ ID NO: 2771172 - DNA, 16 bp, Homo sapiens
gaacagtgtttcccat

SEQ ID NO: 2771173 - DNA, 21 bp, Homo sapiens
gaacagtgtttcccataattt

SEQ ID NO: 2771174 - DNA, 14 bp, Homo sapiens
gaacagtttgtaca

SEQ ID NO: 2771175 - DNA, 12 bp, Homo sapiens
gaacatccaagg

SEQ ID NO: 2771176 - DNA, 23 bp, Homo sapiens
gaacatgcctgattttaaaaggt

SEQ ID NO: 2771177 - DNA, 17 bp, Homo sapiens
gaaccaaagagactgga

SEQ ID NO: 2771178 - DNA, 20 bp, Homo sapiens
gaaccaccacacccagccca

SEQ ID NO: 2771179 - DNA, 23 bp, Homo sapiens
gaaccaccacacccagcccactt

SEQ ID NO: 2771180 - DNA, 20 bp, Homo sapiens
gaaccatcattataaacgtg

SEQ ID NO: 2771181 - DNA, 17 bp, Homo sapiens
gaaccatccttcccatg

SEQ ID NO: 2771182 - DNA, 13 bp, Homo sapiens
gaacccacctgct

SEQ ID NO: 2771183 - DNA, 15 bp, Homo sapiens
gaacccacctgctga

SEQ ID NO: 2771184 - DNA, 19 bp, Homo sapiens
gaacccaggacaagcatgg

SEQ ID NO: 2771185 - DNA, 16 bp, Homo sapiens
gaacccaggaggtgga

SEQ ID NO: 2771186 - DNA, 13 bp, Homo sapiens
gaacccctcccct

SEQ ID NO: 2771187 - DNA, 15 bp, Homo sapiens
gaacccctcccctcc

SEQ ID NO: 2771188 - DNA, 19 bp, Homo sapiens
gaacccctcccctcccccc

SEQ ID NO: 2771189 - DNA, 12 bp, Homo sapiens
gaacccctgtgt

SEQ ID NO: 2771190 - DNA, 17 bp, Homo sapiens
gaaccccttcatcctct

SEQ ID NO: 2771191 - DNA, 16 bp, Homo sapiens
gaacccgactgtgaaa

SEQ ID NO: 2771192 - DNA, 22 bp, Homo sapiens
gaaccgacttttctaaagctct

SEQ ID NO: 2771193 - DNA, 17 bp, Homo sapiens
gaaccgtgtccagcaca

SEQ ID NO: 2771194 - DNA, 15 bp, Homo sapiens
gaacctcctatttta

SEQ ID NO: 2771195 - DNA, 13 bp, Homo sapiens
gaacctggccttc

SEQ ID NO: 2771196 - DNA, 16 bp, Homo sapiens
gaacctggccttcagt

SEQ ID NO: 2771197 - DNA, 22 bp, Homo sapiens
gaacggcatgtgaattctgtga

SEQ ID NO: 2771198 - DNA, 14 bp, Homo sapiens
gaacgtgactgccc

SEQ ID NO: 2771199 - DNA, 13 bp, Homo sapiens
gaactcaagctgc

SEQ ID NO: 2771200 - DNA, 16 bp, Homo sapiens
gaactcagctgtctgt

SEQ ID NO: 2771201 - DNA, 11 bp, Homo sapiens
gaactcccagc

SEQ ID NO: 2771202 - DNA, 17 bp, Homo sapiens
gaactcccagcaacaca

SEQ ID NO: 2771203 - DNA, 14 bp, Homo sapiens
gaactcctggcctc

SEQ ID NO: 2771204 - DNA, 15 bp, Homo sapiens
gaactcctggcctca

SEQ ID NO: 2771205 - DNA, 17 bp, Homo sapiens
gaactcgaagcccttcc

SEQ ID NO: 2771206 - DNA, 20 bp, Homo sapiens
gaactgcagtatggccatgg

SEQ ID NO: 2771207 - DNA, 17 bp, Homo sapiens
gaactgcttactagccc

SEQ ID NO: 2771208 - DNA, 19 bp, Homo sapiens
gaactggacgcccagctga

SEQ ID NO: 2771209 - DNA, 21 bp, Homo sapiens
gaactgtctctcatgaacctc

SEQ ID NO: 2771210 - DNA, 13 bp, Homo sapiens
gaactgtgacagg

SEQ ID NO: 2771211 - DNA, 17 bp, Homo sapiens
gaactgtgacaggaagc

SEQ ID NO: 2771212 - DNA, 21 bp, Homo sapiens
gaactgtgatggggtgggcag

SEQ ID NO: 2771213 - DNA, 16 bp, Homo sapiens
gaactgttctggcctc

SEQ ID NO: 2771214 - DNA, 13 bp, Homo sapiens
gaacttgaggaca

SEQ ID NO: 2771215 - DNA, 15 bp, Homo sapiens
gaacttgaggacaca

SEQ ID NO: 2771216 - DNA, 16 bp, Homo sapiens
gaacttgaggacacat

SEQ ID NO: 2771217 - DNA, 19 bp, Homo sapiens
gaacttgaggacacatgtc

SEQ ID NO: 2771218 - DNA, 23 bp, Homo sapiens
gaactttgtacagtggagaaata

SEQ ID NO: 2771219 - DNA, 14 bp, Homo sapiens
gaagaaaaatgttt

SEQ ID NO: 2771220 - DNA, 20 bp, Homo sapiens
gaagaaacaaggttttcagt

SEQ ID NO: 2771221 - DNA, 14 bp, Homo sapiens
gaccactgttatca

SEQ ID NO: 2771222 - DNA, 16 bp, Homo sapiens
gaccagaagccaaaga

SEQ ID NO: 2771223 - DNA, 21 bp, Homo sapiens
gaccagacaccttgacagggc

SEQ ID NO: 2771224 - DNA, 24 bp, Homo sapiens
gaccagacaccttgacagggcaca

SEQ ID NO: 2771225 - DNA, 20 bp, Homo sapiens
gaccagcctccatgctgcct

SEQ ID NO: 2771226 - DNA, 22 bp, Homo sapiens
gaccagcctccatgctgcctcc

SEQ ID NO: 2771227 - DNA, 11 bp, Homo sapiens
gagaccagcac

SEQ ID NO: 2771228 - DNA, 19 bp, Homo sapiens
gagaccagcctgggcagca

SEQ ID NO: 2771229 - DNA, 16 bp, Homo sapiens
gagaccagctcagagg

SEQ ID NO: 2771230 - DNA, 21 bp, Homo sapiens
gagaccagttgggagcactgg

SEQ ID NO: 2771231 - DNA, 14 bp, Homo sapiens
gagacccaaggagg

SEQ ID NO: 2771232 - DNA, 18 bp, Homo sapiens
gagacccagatctcatgg

SEQ ID NO: 2771233 - DNA, 19 bp, Homo sapiens
gagacccagatctcatgga

SEQ ID NO: 2771234 - DNA, 14 bp, Homo sapiens
gagaccccttcctt

SEQ ID NO: 2771235 - DNA, 19 bp, Homo sapiens
gagaccccttcctttcctc

SEQ ID NO: 2771236 - DNA, 12 bp, Homo sapiens
gagaccctcact

SEQ ID NO: 2771237 - DNA, 11 bp, Homo sapiens
gagacctcagc

SEQ ID NO: 2771238 - DNA, 18 bp, Homo sapiens
gagacctgacaagcactg

SEQ ID NO: 2771239 - DNA, 14 bp, Homo sapiens
gagacggagtccca

SEQ ID NO: 2771240 - DNA, 16 bp, Homo sapiens
gagactaagccctgtc

SEQ ID NO: 2771241 - DNA, 13 bp, Homo sapiens
gagactatgtgtc

SEQ ID NO: 2771242 - DNA, 17 bp, Homo sapiens
gagactcagggccccag

SEQ ID NO: 2771243 - DNA, 21 bp, Homo sapiens
gagactcagggccccagcact

SEQ ID NO: 2771244 - DNA, 17 bp, Homo sapiens
gagactcctgccctgtt

SEQ ID NO: 2771245 - DNA, 14 bp, Homo sapiens
gagactctgtctca

SEQ ID NO: 2771246 - DNA, 23 bp, Homo sapiens
gagactctgtggggccttggttc

SEQ ID NO: 2771247 - DNA, 18 bp, Homo sapiens
gagactgacacctcactg

SEQ ID NO: 2771248 - DNA, 22 bp, Homo sapiens
gagactgcgggatggtcctggg

SEQ ID NO: 2771249 - DNA, 13 bp, Homo sapiens
gagacttgtatga

SEQ ID NO: 2771250 - DNA, 14 bp, Homo sapiens
gagagacccaagga

SEQ ID NO: 2771251 - DNA, 13 bp, Homo sapiens
gagagaccctcac

SEQ ID NO: 2771252 - DNA, 14 bp, Homo sapiens
gagagaccctcact

SEQ ID NO: 2771253 - DNA, 22 bp, Homo sapiens
gagagaccctcactgctgggga

SEQ ID NO: 2771254 - DNA, 23 bp, Homo sapiens
gagagaccctcactgctggggag

SEQ ID NO: 2771255 - DNA, 14 bp, Homo sapiens
gagagagtgctgag

SEQ ID NO: 2771256 - DNA, 17 bp, Homo sapiens
gagagataccttgaaaa

SEQ ID NO: 2771257 - DNA, 18 bp, Homo sapiens
gagagataccttgaaaaa

SEQ ID NO: 2771258 - DNA, 11 bp, Homo sapiens
gagagccagcc

SEQ ID NO: 2771259 - DNA, 13 bp, Homo sapiens
gagagccagccct

SEQ ID NO: 2771260 - DNA, 14 bp, Homo sapiens
gagagccagccctc

SEQ ID NO: 2771261 - DNA, 17 bp, Homo sapiens
gagagcctgctccccca

SEQ ID NO: 2771262 - DNA, 21 bp, Homo sapiens
gagagcctgctcccccacccc

SEQ ID NO: 2771263 - DNA, 13 bp, Homo sapiens
gagagctaggagc

SEQ ID NO: 2771264 - DNA, 13 bp, Homo sapiens
gagagctgggtgt

SEQ ID NO: 2771265 - DNA, 17 bp, Homo sapiens
gagaggagatcagggcg

SEQ ID NO: 2771266 - DNA, 16 bp, Homo sapiens
gagaggcagagaaaga

SEQ ID NO: 2771267 - DNA, 15 bp, Homo sapiens
gagaggcatggctgg

SEQ ID NO: 2771268 - DNA, 18 bp, Homo sapiens
gagaggctgtggtggctg

SEQ ID NO: 2771269 - DNA, 23 bp, Homo sapiens
gagaggctgtggtggctgtctct

SEQ ID NO: 2771270 - DNA, 17 bp, Homo sapiens
gagagggacgaagaaag

SEQ ID NO: 2771271 - DNA, 13 bp, Homo sapiens
gagaggggaacag

SEQ ID NO: 2771272 - DNA, 18 bp, Homo sapiens
gagagggtctggagaagc

SEQ ID NO: 2771273 - DNA, 16 bp, Homo sapiens
gagaggtggagaactg

SEQ ID NO: 2771274 - DNA, 17 bp, Homo sapiens
gagaggtggagaactgg

SEQ ID NO: 2771275 - DNA, 21 bp, Homo sapiens
gagaggtggagaactgggatt

SEQ ID NO: 2771276 - DNA, 18 bp, Homo sapiens
gagagtagccgagagcct

SEQ ID NO: 2771277 - DNA, 14 bp, Homo sapiens
gagagtctgtctca

SEQ ID NO: 2771278 - DNA, 24 bp, Homo sapiens
gagagtgagaataattgtgtacaa

SEQ ID NO: 2771279 - DNA, 11 bp, Homo sapiens
gagagtgtgac

SEQ ID NO: 2771280 - DNA, 18 bp, Homo sapiens
gagataatatctgtgagg

SEQ ID NO: 2771281 - DNA, 18 bp, Homo sapiens
gagatatatctgaaaact

SEQ ID NO: 2771282 - DNA, 22 bp, Homo sapiens
gagatatttatggggggagaac

SEQ ID NO: 2771283 - DNA, 20 bp, Homo sapiens
gagatcaaccccttcgctcc

SEQ ID NO: 2771284 - DNA, 16 bp, Homo sapiens
gagatcacgccactgc

SEQ ID NO: 2771285 - DNA, 22 bp, Homo sapiens
gagatcagggcgacctgcacgc

SEQ ID NO: 2771286 - DNA, 17 bp, Homo sapiens
gagatcgctggcagaga

SEQ ID NO: 2771287 - DNA, 21 bp, Homo sapiens
gagatgaagagtgagagggca

SEQ ID NO: 2771288 - DNA, 12 bp, Homo sapiens
gagatgcagagg

SEQ ID NO: 2771289 - DNA, 20 bp, Homo sapiens
gagatgcctccaccgctgcc

SEQ ID NO: 2771290 - DNA, 21 bp, Homo sapiens
gagatgggctgaactgagcct

SEQ ID NO: 2771291 - DNA, 16 bp, Homo sapiens
gagatgtaattgtttt

SEQ ID NO: 2771292 - DNA, 20 bp, Homo sapiens
gagattccctctcctccccc

SEQ ID NO: 2771293 - DNA, 14 bp, Homo sapiens
gagatttcaacata

SEQ ID NO: 2771294 - DNA, 21 bp, Homo sapiens
gagatttgtatttatattaga

SEQ ID NO: 2771295 - DNA, 23 bp, Homo sapiens
gagcaaagcctgttcatggcaga

SEQ ID NO: 2771296 - DNA, 14 bp, Homo sapiens
gagcaaatgtttct

SEQ ID NO: 2771297 - DNA, 15 bp, Homo sapiens
gagcaaccgtggccc

SEQ ID NO: 2771298 - DNA, 21 bp, Homo sapiens
gagcaaccgtggcccttcctg

SEQ ID NO: 2771299 - DNA, 23 bp, Homo sapiens
gagcaaccgtggcccttcctgga

SEQ ID NO: 2771300 - DNA, 14 bp, Homo sapiens
gagcaagagctggc

SEQ ID NO: 2771301 - DNA, 16 bp, Homo sapiens
gagcaattcatttcac

SEQ ID NO: 2771302 - DNA, 19 bp, Homo sapiens
gagcaattcatttcacttt

SEQ ID NO: 2771303 - DNA, 22 bp, Homo sapiens
gagcaattcatttcactttaaa

SEQ ID NO: 2771304 - DNA, 12 bp, Homo sapiens
gagcaccccctc

SEQ ID NO: 2771305 - DNA, 17 bp, Homo sapiens
gagcaccccctcattcc

SEQ ID NO: 2771306 - DNA, 12 bp, Homo sapiens
gagcactgccag

SEQ ID NO: 2771307 - DNA, 17 bp, Homo sapiens
gagcactgccaggaggg

SEQ ID NO: 2771308 - DNA, 17 bp, Homo sapiens
gattccctctcccaggc

SEQ ID NO: 2771309 - DNA, 16 bp, Homo sapiens
gattcgaatgacactg

SEQ ID NO: 2771310 - DNA, 17 bp, Homo sapiens
gattcgaatgacactgt

SEQ ID NO: 2771311 - DNA, 22 bp, Homo sapiens
gattctgggaggaagcaggttg

SEQ ID NO: 2771312 - DNA, 22 bp, Homo sapiens
gattgaggcctgccctcaggga

SEQ ID NO: 2771313 - DNA, 14 bp, Homo sapiens
gattgcttaaaata

SEQ ID NO: 2771314 - DNA, 18 bp, Homo sapiens
gattggctcacccaagca

SEQ ID NO: 2771315 - DNA, 20 bp, Homo sapiens
gattggggaagactgtggct

SEQ ID NO: 2771316 - DNA, 14 bp, Homo sapiens
gattgttaaaataa

SEQ ID NO: 2771317 - DNA, 16 bp, Homo sapiens
gattgttaaaataact

SEQ ID NO: 2771318 - DNA, 22 bp, Homo sapiens
gattgttctgtccagtttccaa

SEQ ID NO: 2771319 - DNA, 19 bp, Homo sapiens
gatttaaaaaataaatata

SEQ ID NO: 2771320 - DNA, 19 bp, Homo sapiens
gatttacagcctcacttga

SEQ ID NO: 2771321 - DNA, 18 bp, Homo sapiens
gatttatttaaaatagca

SEQ ID NO: 2771322 - DNA, 20 bp, Homo sapiens
gatttcatgctatctctgtg

SEQ ID NO: 2771323 - DNA, 21 bp, Homo sapiens
gatttcatttcaactgtttgc

SEQ ID NO: 2771324 - DNA, 19 bp, Homo sapiens
gatttcctattttaaaacc

SEQ ID NO: 2771325 - DNA, 20 bp, Homo sapiens
gatttcctattttaaaacca

SEQ ID NO: 2771326 - DNA, 16 bp, Homo sapiens
gatttgaagcaaagca

SEQ ID NO: 2771327 - DNA, 14 bp, Homo sapiens
gatttgtactgaaa

SEQ ID NO: 2771328 - DNA, 16 bp, Homo sapiens
gatttgtatttatatt

SEQ ID NO: 2771329 - DNA, 22 bp, Homo sapiens
gatttgtatttatattagagtg

SEQ ID NO: 2771330 - DNA, 19 bp, Homo sapiens
gatttgttaatgatagcta

SEQ ID NO: 2771331 - DNA, 22 bp, Homo sapiens
gattttaaaaggttgactcaag

SEQ ID NO: 2771332 - DNA, 20 bp, Homo sapiens
gattttaacaaaagcaagac

SEQ ID NO: 2771333 - DNA, 19 bp, Homo sapiens
gattttcaaagctttttcc

SEQ ID NO: 2771334 - DNA, 18 bp, Homo sapiens
gattttcctgaatattaa

SEQ ID NO: 2771335 - DNA, 20 bp, Homo sapiens
gattttctgctactttgctg

SEQ ID NO: 2771336 - DNA, 15 bp, Homo sapiens
gattttgtacagaat

SEQ ID NO: 2771337 - DNA, 16 bp, Homo sapiens
gattttgtacagaatt

SEQ ID NO: 2771338 - DNA, 18 bp, Homo sapiens
gattttgtacagaatttt

SEQ ID NO: 2771339 - DNA, 20 bp, Homo sapiens
gattttgtgttttttcgttc

SEQ ID NO: 2771340 - DNA, 21 bp, Homo sapiens
gattttttccttcaaagttta

SEQ ID NO: 2771341 - DNA, 17 bp, Homo sapiens
gcaaaaccccatctcta

SEQ ID NO: 2771342 - DNA, 16 bp, Homo sapiens
gcaaaagaagtaaaag

SEQ ID NO: 2771343 - DNA, 16 bp, Homo sapiens
gcaaaattttatagct

SEQ ID NO: 2771344 - DNA, 13 bp, Homo sapiens
gcaaacatttctt

SEQ ID NO: 2771345 - DNA, 16 bp, Homo sapiens
gcaaacatttcttaaa

SEQ ID NO: 2771346 - DNA, 20 bp, Homo sapiens
gcaaacatttcttaaaatgt

SEQ ID NO: 2771347 - DNA, 21 bp, Homo sapiens
gcaaagcaccagcttctccag

SEQ ID NO: 2771348 - DNA, 23 bp, Homo sapiens
gcaaagcaccagcttctccaggc

SEQ ID NO: 2771349 - DNA, 12 bp, Homo sapiens
gcaaagcctgtt

SEQ ID NO: 2771350 - DNA, 20 bp, Homo sapiens
gcaaagcctgttcatggcag

SEQ ID NO: 2771351 - DNA, 20 bp, Homo sapiens
gcaaagggagcactgggttg

SEQ ID NO: 2771352 - DNA, 13 bp, Homo sapiens
gcaaagtgcaaat

SEQ ID NO: 2771353 - DNA, 16 bp, Homo sapiens
gcaaagtgcaaatact

SEQ ID NO: 2771354 - DNA, 14 bp, Homo sapiens
gcaaatactccaag

SEQ ID NO: 2771355 - DNA, 20 bp, Homo sapiens
gcaaatactccaagcttcaa

SEQ ID NO: 2771356 - DNA, 16 bp, Homo sapiens
gcaacaaatatttata

SEQ ID NO: 2771357 - DNA, 16 bp, Homo sapiens
gcaacacaagctggaa

SEQ ID NO: 2771358 - DNA, 18 bp, Homo sapiens
gcaacaggaatctcagag

SEQ ID NO: 2771359 - DNA, 20 bp, Homo sapiens
gcaacaggaatctcagagac

SEQ ID NO: 2771360 - DNA, 13 bp, Homo sapiens
gcaacaggctggg

SEQ ID NO: 2771361 - DNA, 15 bp, Homo sapiens
gcaacaggctgggct

SEQ ID NO: 2771362 - DNA, 22 bp, Homo sapiens
gcaaccccagttctgctcctct

SEQ ID NO: 2771363 - DNA, 22 bp, Homo sapiens
gcaacccgtgccaagtccaggt

SEQ ID NO: 2771364 - DNA, 18 bp, Homo sapiens
gcaaccgtggcccttcct

SEQ ID NO: 2771365 - DNA, 22 bp, Homo sapiens
gcaaccgtggcccttcctggac

SEQ ID NO: 2771366 - DNA, 20 bp, Homo sapiens
gcaacctccgcctcttgggt

SEQ ID NO: 2771367 - DNA, 15 bp, Homo sapiens
gcaactgaggcagac

SEQ ID NO: 2771368 - DNA, 21 bp, Homo sapiens
gcaactgaggcagacagcagc

SEQ ID NO: 2771369 - DNA, 16 bp, Homo sapiens
gcaactgttggataat

SEQ ID NO: 2771370 - DNA, 19 bp, Homo sapiens
gcaacttgaaattatatct

SEQ ID NO: 2771371 - DNA, 16 bp, Homo sapiens
gcaagaaggcaaaaat

SEQ ID NO: 2771372 - DNA, 19 bp, Homo sapiens
gcaagacgtcctggaatga

SEQ ID NO: 2771373 - DNA, 22 bp, Homo sapiens
gcaagacttctctttgcctcaa

SEQ ID NO: 2771374 - DNA, 13 bp, Homo sapiens
gcaagagccttgg

SEQ ID NO: 2771375 - DNA, 15 bp, Homo sapiens
gcaagcacctcctgc

SEQ ID NO: 2771376 - DNA, 18 bp, Homo sapiens
gcaagcacctcctgcctc

SEQ ID NO: 2771377 - DNA, 20 bp, Homo sapiens
gcaagcacctcctgcctcga

SEQ ID NO: 2771378 - DNA, 14 bp, Homo sapiens
gcaaggcccgagca

SEQ ID NO: 2771379 - DNA, 15 bp, Homo sapiens
gcaagggccatgctg

SEQ ID NO: 2771380 - DNA, 21 bp, Homo sapiens
gcaagttctagagaagaggct

SEQ ID NO: 2771381 - DNA, 23 bp, Homo sapiens
gccactctcccctccctcttcct

SEQ ID NO: 2771382 - DNA, 13 bp, Homo sapiens
gccactcttccaa

SEQ ID NO: 2771383 - DNA, 17 bp, Homo sapiens
gccactgcaccgggcca

SEQ ID NO: 2771384 - DNA, 18 bp, Homo sapiens
gccactgcaccgggccac

SEQ ID NO: 2771385 - DNA, 21 bp, Homo sapiens
gccactgcactatagcctagg

SEQ ID NO: 2771386 - DNA, 18 bp, Homo sapiens
gccactgcactccagcct

SEQ ID NO: 2771387 - DNA, 19 bp, Homo sapiens
gccactgcactccagcctg

SEQ ID NO: 2771388 - DNA, 21 bp, Homo sapiens
gccactgcactccagcctggg

SEQ ID NO: 2771389 - DNA, 15 bp, Homo sapiens
gccactgcactccgg

SEQ ID NO: 2771390 - DNA, 16 bp, Homo sapiens
gccactgcctcttcct

SEQ ID NO: 2771391 - DNA, 21 bp, Homo sapiens
gccacttaccttcaataaagt

SEQ ID NO: 2771392 - DNA, 19 bp, Homo sapiens
gccactttcgggagggtgg

SEQ ID NO: 2771393 - DNA, 12 bp, Homo sapiens
gccagaaataaa

SEQ ID NO: 2771394 - DNA, 23 bp, Homo sapiens
gccagaaggggcacgcctgccca

SEQ ID NO: 2771395 - DNA, 16 bp, Homo sapiens
gccagagcctggggct

SEQ ID NO: 2771396 - DNA, 17 bp, Homo sapiens
gccagagcctggggctc

SEQ ID NO: 2771397 - DNA, 18 bp, Homo sapiens
gccagagggagtgacaga

SEQ ID NO: 2771398 - DNA, 19 bp, Homo sapiens
gccagagggagtgacagag

SEQ ID NO: 2771399 - DNA, 20 bp, Homo sapiens
gccagagggagtgacagagg

SEQ ID NO: 2771400 - DNA, 15 bp, Homo sapiens
gcctgcctcagctgc

SEQ ID NO: 2771401 - DNA, 23 bp, Homo sapiens
gcctgcctcagctgctcgcacag

SEQ ID NO: 2771402 - DNA, 16 bp, Homo sapiens
gcctgcctctgactca

SEQ ID NO: 2771403 - DNA, 20 bp, Homo sapiens
gcctgcctctgactcacact

SEQ ID NO: 2771404 - DNA, 16 bp, Homo sapiens
gcctgccttgaagcca

SEQ ID NO: 2771405 - DNA, 13 bp, Homo sapiens
gcctgctcccagc

SEQ ID NO: 2771406 - DNA, 16 bp, Homo sapiens
gcctgctcccccaccc

SEQ ID NO: 2771407 - DNA, 19 bp, Homo sapiens
gcctgctgctgagaacctg

SEQ ID NO: 2771408 - DNA, 16 bp, Homo sapiens
gcctgctgggctctcc

SEQ ID NO: 2771409 - DNA, 22 bp, Homo sapiens
gcctgctgggctctccacctca

SEQ ID NO: 2771410 - DNA, 17 bp, Homo sapiens
gcctggaggacctgagc

SEQ ID NO: 2771411 - DNA, 21 bp, Homo sapiens
gcctggaggacctgagcctgc

SEQ ID NO: 2771412 - DNA, 22 bp, Homo sapiens
gcctggccagatgcaccagccc

SEQ ID NO: 2771413 - DNA, 12 bp, Homo sapiens
gcctggccaggc

SEQ ID NO: 2771414 - DNA, 14 bp, Homo sapiens
gcctggcctcctgc

SEQ ID NO: 2771415 - DNA, 15 bp, Homo sapiens
gcctggcctcctgcc

SEQ ID NO: 2771416 - DNA, 16 bp, Homo sapiens
gcctggcctcctgcct

SEQ ID NO: 2771417 - DNA, 19 bp, Homo sapiens
gcctggcctcctgcctcta

SEQ ID NO: 2771418 - DNA, 22 bp, Homo sapiens
gcctggcctcctgcctctactg

SEQ ID NO: 2771419 - DNA, 16 bp, Homo sapiens
gcctgggcaacagagc

SEQ ID NO: 2771420 - DNA, 20 bp, Homo sapiens
gcctgggcaacagagcaaga

SEQ ID NO: 2771421 - DNA, 14 bp, Homo sapiens
gcctgggcctatgg

SEQ ID NO: 2771422 - DNA, 22 bp, Homo sapiens
gcctgggcctatggagagccct

SEQ ID NO: 2771423 - DNA, 20 bp, Homo sapiens
gcctgggcgacagagcgaga

SEQ ID NO: 2771424 - DNA, 22 bp, Homo sapiens
gcctggggctcctttctccagc

SEQ ID NO: 2771425 - DNA, 16 bp, Homo sapiens
gcctgggggcctggct

SEQ ID NO: 2771426 - DNA, 17 bp, Homo sapiens
gcctgggggcctggctg

SEQ ID NO: 2771427 - DNA, 22 bp, Homo sapiens
gcctggggtgacccggcacccc

SEQ ID NO: 2771428 - DNA, 20 bp, Homo sapiens
gcctgggtgacagagcaaga

SEQ ID NO: 2771429 - DNA, 18 bp, Homo sapiens
gcctgggtggggctgctc

SEQ ID NO: 2771430 - DNA, 21 bp, Homo sapiens
gcctggtagaattgggaagct

SEQ ID NO: 2771431 - DNA, 16 bp, Homo sapiens
gcctggtggcagctgc

SEQ ID NO: 2771432 - DNA, 19 bp, Homo sapiens
gcctgtaatcccagcactt

SEQ ID NO: 2771433 - DNA, 20 bp, Homo sapiens
gcctgtaatcccagcacttt

SEQ ID NO: 2771434 - DNA, 17 bp, Homo sapiens
gcctgtaatcccagcag

SEQ ID NO: 2771435 - DNA, 18 bp, Homo sapiens
gcctgtaatcccagctac

SEQ ID NO: 2771436 - DNA, 11 bp, Homo sapiens
gcctgtactgc

SEQ ID NO: 2771437 - DNA, 16 bp, Homo sapiens
gcctgtactgcctgct

SEQ ID NO: 2771438 - DNA, 21 bp, Homo sapiens
gcctgtagccccagtgacagc

SEQ ID NO: 2771439 - DNA, 22 bp, Homo sapiens
gcctgtagttaggaaataaaac

SEQ ID NO: 2771440 - DNA, 19 bp, Homo sapiens
gcctgtctttcagcattca

SEQ ID NO: 2771441 - DNA, 17 bp, Homo sapiens
gcctgtgaacccaggac

SEQ ID NO: 2771442 - DNA, 14 bp, Homo sapiens
gcctgtgaggcagg

SEQ ID NO: 2771443 - DNA, 18 bp, Homo sapiens
gcctgtgaggcaggggcg

SEQ ID NO: 2771444 - DNA, 14 bp, Homo sapiens
gcctgtgctgcccg

SEQ ID NO: 2771445 - DNA, 16 bp, Homo sapiens
gcctgtggcggtgcct

SEQ ID NO: 2771446 - DNA, 18 bp, Homo sapiens
gcctgtggcggtgcctgg

SEQ ID NO: 2771447 - DNA, 16 bp, Homo sapiens
gcctgttcagctccag

SEQ ID NO: 2771448 - DNA, 15 bp, Homo sapiens
gcctgttcatggcag

SEQ ID NO: 2771449 - DNA, 18 bp, Homo sapiens
gccttacctcctgcccag

SEQ ID NO: 2771450 - DNA, 19 bp, Homo sapiens
gccttacctcctgcccagg

SEQ ID NO: 2771451 - DNA, 20 bp, Homo sapiens
gccttacctcctgcccagga

SEQ ID NO: 2771452 - DNA, 22 bp, Homo sapiens
gccttacctcctgcccaggaga

SEQ ID NO: 2771453 - DNA, 17 bp, Homo sapiens
gccttcacaaccagcca

SEQ ID NO: 2771454 - DNA, 13 bp, Homo sapiens
gccttccataatt

SEQ ID NO: 2771455 - DNA, 23 bp, Homo sapiens
gccttccccctcccagggccagg

SEQ ID NO: 2771456 - DNA, 15 bp, Homo sapiens
gccttctctgaagga

SEQ ID NO: 2771457 - DNA, 13 bp, Homo sapiens
gccttgaaaaaca

SEQ ID NO: 2771458 - DNA, 15 bp, Homo sapiens
gccttgcccagagat

SEQ ID NO: 2771459 - DNA, 16 bp, Homo sapiens
gccttgcccagagatg

SEQ ID NO: 2771460 - DNA, 20 bp, Homo sapiens
gccttgcccagagatgcctc

SEQ ID NO: 2771461 - DNA, 22 bp, Homo sapiens
gccttgcccagagatgcctcca

SEQ ID NO: 2771462 - DNA, 16 bp, Homo sapiens
gccttggtgtccacct

SEQ ID NO: 2771463 - DNA, 17 bp, Homo sapiens
gccttggtgtccacctg

SEQ ID NO: 2771464 - DNA, 18 bp, Homo sapiens
gccttggtgtccacctgg

SEQ ID NO: 2771465 - DNA, 22 bp, Homo sapiens
gccttggtgtccacctggcccc

SEQ ID NO: 2771466 - DNA, 18 bp, Homo sapiens
gccttggttcccttgtgt

SEQ ID NO: 2771467 - DNA, 17 bp, Homo sapiens
gccttgtaattctaaat

SEQ ID NO: 2771468 - DNA, 12 bp, Homo sapiens
gccttgttctgt

SEQ ID NO: 2771469 - DNA, 16 bp, Homo sapiens
gccttgttctgtcacc

SEQ ID NO: 2771470 - DNA, 22 bp, Homo sapiens
gcctttagggcttatggccagg

SEQ ID NO: 2771471 - DNA, 23 bp, Homo sapiens
gcctttccacctgctttctcctg

SEQ ID NO: 2771472 - DNA, 21 bp, Homo sapiens
gcctttccataaggaatgtag

SEQ ID NO: 2771473 - DNA, 12 bp, Homo sapiens
gcctttctgtgg

SEQ ID NO: 2771474 - DNA, 20 bp, Homo sapiens
gcctttgaggcaaaggccag

SEQ ID NO: 2771475 - DNA, 15 bp, Homo sapiens
gcctttggaagaaac

SEQ ID NO: 2771476 - DNA, 23 bp, Homo sapiens
gcgaaaggatgtaaacagtgcct

SEQ ID NO: 2771477 - DNA, 19 bp, Homo sapiens
gcgacagagcgagagtctg

SEQ ID NO: 2771478 - DNA, 17 bp, Homo sapiens
gcgagatcgctggcaga

SEQ ID NO: 2771479 - DNA, 18 bp, Homo sapiens
gcgagatcgctggcagag

SEQ ID NO: 2771480 - DNA, 19 bp, Homo sapiens
gcgagatcgctggcagaga

SEQ ID NO: 2771481 - DNA, 16 bp, Homo sapiens
gcgagcatcctggcca

SEQ ID NO: 2771482 - DNA, 21 bp, Homo sapiens
gcgagctatgatcgcgccact

SEQ ID NO: 2771483 - DNA, 18 bp, Homo sapiens
gcgaggtcaacagagaag

SEQ ID NO: 2771484 - DNA, 23 bp, Homo sapiens
gcgaggtcaacagagaaggcagg

SEQ ID NO: 2771485 - DNA, 16 bp, Homo sapiens
gcgaggtgcggccacc

SEQ ID NO: 2771486 - DNA, 22 bp, Homo sapiens
gcgattccctctcccaggcccc

SEQ ID NO: 2771487 - DNA, 13 bp, Homo sapiens
gcgattcttctgc

SEQ ID NO: 2771488 - DNA, 22 bp, Homo sapiens
gcgattcttctgcttcagcctc

SEQ ID NO: 2771489 - DNA, 12 bp, Homo sapiens
gcgcaagcctgt

SEQ ID NO: 2771490 - DNA, 18 bp, Homo sapiens
gccagatgcaccagccct

SEQ ID NO: 2771491 - DNA, 22 bp, Homo sapiens
gccagcaatgatgtccagaaga

SEQ ID NO: 2771492 - DNA, 13 bp, Homo sapiens
gccagcagccagc

SEQ ID NO: 2771493 - DNA, 20 bp, Homo sapiens
gccagcagccagctctcagc

SEQ ID NO: 2771494 - DNA, 21 bp, Homo sapiens
gccagcagccagctctcagcc

SEQ ID NO: 2771495 - DNA, 13 bp, Homo sapiens
gccagccagaagc

SEQ ID NO: 2771496 - DNA, 19 bp, Homo sapiens
gccagccagcagccagctc

SEQ ID NO: 2771497 - DNA, 13 bp, Homo sapiens
gccagcccagccc

SEQ ID NO: 2771498 - DNA, 14 bp, Homo sapiens
gccagcccagccca

SEQ ID NO: 2771499 - DNA, 14 bp, Homo sapiens
gccagccctccctg

SEQ ID NO: 2771500 - DNA, 13 bp, Homo sapiens
gccagccctgcct

SEQ ID NO: 2771501 - DNA, 17 bp, Homo sapiens
gccagccctgcctggag

SEQ ID NO: 2771502 - DNA, 20 bp, Homo sapiens
gccagccctgcctggaggac

SEQ ID NO: 2771503 - DNA, 22 bp, Homo sapiens
gccagccgggtacctcagtttc

SEQ ID NO: 2771504 - DNA, 15 bp, Homo sapiens
gccagccggtgcctg

SEQ ID NO: 2771505 - DNA, 15 bp, Homo sapiens
gccagcctggcctcc

SEQ ID NO: 2771506 - DNA, 19 bp, Homo sapiens
gccagcctggcctcctgcc

SEQ ID NO: 2771507 - DNA, 20 bp, Homo sapiens
gccagcctggcctcctgcct

SEQ ID NO: 2771508 - DNA, 16 bp, Homo sapiens
gccagcctggcttctg

SEQ ID NO: 2771509 - DNA, 21 bp, Homo sapiens
gccagcctggcttctggagcc

SEQ ID NO: 2771510 - DNA, 22 bp, Homo sapiens
gccagcctggcttctggagccc

SEQ ID NO: 2771511 - DNA, 17 bp, Homo sapiens
gccagcgcctccctcca

SEQ ID NO: 2771512 - DNA, 22 bp, Homo sapiens
gccagcgcctccctccacccca

SEQ ID NO: 2771513 - DNA, 16 bp, Homo sapiens
gccagctcagtcccat

SEQ ID NO: 2771514 - DNA, 14 bp, Homo sapiens
gccagctctcagcc

SEQ ID NO: 2771515 - DNA, 18 bp, Homo sapiens
gccagcttgttatttata

SEQ ID NO: 2771516 - DNA, 17 bp, Homo sapiens
gccaggacgaattgaga

SEQ ID NO: 2771517 - DNA, 19 bp, Homo sapiens
gccaggactccccaggcca

SEQ ID NO: 2771518 - DNA, 20 bp, Homo sapiens
gccaggagcaaatgtttctg

SEQ ID NO: 2771519 - DNA, 13 bp, Homo sapiens
gccaggagggaca

SEQ ID NO: 2771520 - DNA, 23 bp, Homo sapiens
gccaggagggacaaaggagcctg

SEQ ID NO: 2771521 - DNA, 19 bp, Homo sapiens
gccaggagtttgagaccag

SEQ ID NO: 2771522 - DNA, 21 bp, Homo sapiens
gccaggcaccccctggagaga

SEQ ID NO: 2771523 - DNA, 21 bp, Homo sapiens
gccaggctgagtgagccacag

SEQ ID NO: 2771524 - DNA, 13 bp, Homo sapiens
gccaggctggtct

SEQ ID NO: 2771525 - DNA, 15 bp, Homo sapiens
gccaggctggtctca

SEQ ID NO: 2771526 - DNA, 13 bp, Homo sapiens
gccagggccaggg

SEQ ID NO: 2771527 - DNA, 15 bp, Homo sapiens
gccagggccctgcag

SEQ ID NO: 2771528 - DNA, 16 bp, Homo sapiens
gccagggccctgcaga

SEQ ID NO: 2771529 - DNA, 21 bp, Homo sapiens
gccaggggtctccctggagtg

SEQ ID NO: 2771530 - DNA, 17 bp, Homo sapiens
gccagggtgagagctgc

SEQ ID NO: 2771531 - DNA, 13 bp, Homo sapiens
gccaggtgcagtg

SEQ ID NO: 2771532 - DNA, 13 bp, Homo sapiens
gccagtctgggct

SEQ ID NO: 2771533 - DNA, 19 bp, Homo sapiens
gccagtgatgctaaaggtt

SEQ ID NO: 2771534 - DNA, 10 bp, Homo sapiens
gccagtgcct

SEQ ID NO: 2771535 - DNA, 11 bp, Homo sapiens
gccagtgcctt

SEQ ID NO: 2771536 - DNA, 15 bp, Homo sapiens
gccagtgccttacct

SEQ ID NO: 2771537 - DNA, 20 bp, Homo sapiens
gccagtgccttacctcctgc

SEQ ID NO: 2771538 - DNA, 21 bp, Homo sapiens
gccagtgccttacctcctgcc

SEQ ID NO: 2771539 - DNA, 13 bp, Homo sapiens
gccagtgtgacaa

SEQ ID NO: 2771540 - DNA, 21 bp, Homo sapiens
gccagtgtttagaagagcctg

SEQ ID NO: 2771541 - DNA, 16 bp, Homo sapiens
gccatagtcacatggc

SEQ ID NO: 2771542 - DNA, 16 bp, Homo sapiens
gccatcaagagactga

SEQ ID NO: 2771543 - DNA, 24 bp, Homo sapiens
gccatcagggtgggccactctccc

SEQ ID NO: 2771544 - DNA, 18 bp, Homo sapiens
gccatcatgtgcctggaa

SEQ ID NO: 2771545 - DNA, 19 bp, Homo sapiens
gccatcatgtgcctggaaa

SEQ ID NO: 2771546 - DNA, 14 bp, Homo sapiens
gccatccaggttca

SEQ ID NO: 2771547 - DNA, 12 bp, Homo sapiens
gccatccttcac

SEQ ID NO: 2771548 - DNA, 13 bp, Homo sapiens
gccatgcttcttg

SEQ ID NO: 2771549 - DNA, 16 bp, Homo sapiens
gccatgcttcttgccc

SEQ ID NO: 2771550 - DNA, 13 bp, Homo sapiens
gccatggagttgt

SEQ ID NO: 2771551 - DNA, 15 bp, Homo sapiens
gccatgtcgcctgcc

SEQ ID NO: 2771552 - DNA, 17 bp, Homo sapiens
gccatgtcgcctgcccc

SEQ ID NO: 2771553 - DNA, 14 bp, Homo sapiens
gccatgttggccag

SEQ ID NO: 2771554 - DNA, 18 bp, Homo sapiens
gccatgttggccaggctg

SEQ ID NO: 2771555 - DNA, 20 bp, Homo sapiens
gccatgttggccaggctggt

SEQ ID NO: 2771556 - DNA, 22 bp, Homo sapiens
gccatttcattgagggaaaaca

SEQ ID NO: 2771557 - DNA, 20 bp, Homo sapiens
gccatttgcaccctccgcct

SEQ ID NO: 2771558 - DNA, 14 bp, Homo sapiens
ctctcctcttgcca

SEQ ID NO: 2771559 - DNA, 13 bp, Homo sapiens
ctctcctgagagg

SEQ ID NO: 2771560 - DNA, 17 bp, Homo sapiens
ctctcctgagaggtgct

SEQ ID NO: 2771561 - DNA, 18 bp, Homo sapiens
ctctcctgagaggtgctg

SEQ ID NO: 2771562 - DNA, 22 bp, Homo sapiens
ctctcctggcttcccatcccca

SEQ ID NO: 2771563 - DNA, 12 bp, Homo sapiens
ctctcctgtcca

SEQ ID NO: 2771564 - DNA, 19 bp, Homo sapiens
ctctcctttggccattcca

SEQ ID NO: 2771565 - DNA, 19 bp, Homo sapiens
ctctcggaaggctggctgg

SEQ ID NO: 2771566 - DNA, 20 bp, Homo sapiens
ctctcggggcgacccctcag

SEQ ID NO: 2771567 - DNA, 19 bp, Homo sapiens
ctcttctatttaaaaaata

SEQ ID NO: 2771568 - DNA, 15 bp, Homo sapiens
ctcttctccaggctg

SEQ ID NO: 2771569 - DNA, 14 bp, Homo sapiens
ctcttctcttcctg

SEQ ID NO: 2771570 - DNA, 15 bp, Homo sapiens
ctcttctcttcctgt

SEQ ID NO: 2771571 - DNA, 16 bp, Homo sapiens
ctcttctcttcctgta

SEQ ID NO: 2771572 - DNA, 19 bp, Homo sapiens
ctcttctgtcatcccgctc

SEQ ID NO: 2771573 - DNA, 16 bp, Homo sapiens
ctcttctgttctcaaa

SEQ ID NO: 2771574 - DNA, 15 bp, Homo sapiens
ctcttcttcttcaga

SEQ ID NO: 2771575 - DNA, 18 bp, Homo sapiens
ctcttcttcttcagaaga

SEQ ID NO: 2771576 - DNA, 16 bp, Homo sapiens
ctcttgaggccaggag

SEQ ID NO: 2771577 - DNA, 12 bp, Homo sapiens
ctcttgcctgca

SEQ ID NO: 2771578 - DNA, 15 bp, Homo sapiens
ctcttgcctgcaccc

SEQ ID NO: 2771579 - DNA, 16 bp, Homo sapiens
ctcttgcctgcaccct

SEQ ID NO: 2771580 - DNA, 20 bp, Homo sapiens
ctcttgcctttccacctgct

SEQ ID NO: 2771581 - DNA, 21 bp, Homo sapiens
ctcttgcctttcttatttgca

SEQ ID NO: 2771582 - DNA, 20 bp, Homo sapiens
ctcttgctcaaaaatctgtt

SEQ ID NO: 2771583 - DNA, 17 bp, Homo sapiens
ctcttggacctctgctc

SEQ ID NO: 2771584 - DNA, 19 bp, Homo sapiens
ctcttggacctctgctctg

SEQ ID NO: 2771585 - DNA, 13 bp, Homo sapiens
ctcttggcccctg

SEQ ID NO: 2771586 - DNA, 16 bp, Homo sapiens
ctcttgttttcagttt

SEQ ID NO: 2771587 - DNA, 18 bp, Homo sapiens
ctctttaatgtcacaggc

SEQ ID NO: 2771588 - DNA, 17 bp, Homo sapiens
ctctttatgactgtttt

SEQ ID NO: 2771589 - DNA, 16 bp, Homo sapiens
ctctttcactcaggct

SEQ ID NO: 2771590 - DNA, 22 bp, Homo sapiens
ctctttcctgttgttgttaatg

SEQ ID NO: 2771591 - DNA, 20 bp, Homo sapiens
ctctttcttattttgtaata

SEQ ID NO: 2771592 - DNA, 22 bp, Homo sapiens
ctctttctttcttttgtgttgg

SEQ ID NO: 2771593 - DNA, 15 bp, Homo sapiens
ctgaaaacccagaga

SEQ ID NO: 2771594 - DNA, 13 bp, Homo sapiens
ctgaaaactggaa

SEQ ID NO: 2771595 - DNA, 15 bp, Homo sapiens
ctgaaaactggaata

SEQ ID NO: 2771596 - DNA, 14 bp, Homo sapiens
ctgaaaactgtaaa

SEQ ID NO: 2771597 - DNA, 15 bp, Homo sapiens
ctgaaaactgtaaat

SEQ ID NO: 2771598 - DNA, 19 bp, Homo sapiens
ctgaaaactgtaaatacaa

SEQ ID NO: 2771599 - DNA, 20 bp, Homo sapiens
ctgaaaactgtaaatacaaa

SEQ ID NO: 2771600 - DNA, 19 bp, Homo sapiens
ctgaaaagactcagtgttc

SEQ ID NO: 2771601 - DNA, 17 bp, Homo sapiens
ctgaaaaggtttatgaa

SEQ ID NO: 2771602 - DNA, 16 bp, Homo sapiens
ctgaaacacctcccag

SEQ ID NO: 2771603 - DNA, 19 bp, Homo sapiens
ctgaaataaaagcctctgg

SEQ ID NO: 2771604 - DNA, 23 bp, Homo sapiens
ctgaaataaaagcctctggtgga

SEQ ID NO: 2771605 - DNA, 19 bp, Homo sapiens
ctgaaatctcagaattcct

SEQ ID NO: 2771606 - DNA, 18 bp, Homo sapiens
ctgaaatgaaacaaataa

SEQ ID NO: 2771607 - DNA, 13 bp, Homo sapiens
ctgaacaaaagct

SEQ ID NO: 2771608 - DNA, 14 bp, Homo sapiens
ctgaacaatgaatg

SEQ ID NO: 2771609 - DNA, 17 bp, Homo sapiens
ctgaacacatactagaa

SEQ ID NO: 2771610 - DNA, 18 bp, Homo sapiens
ctgaacacatactagaaa

SEQ ID NO: 2771611 - DNA, 19 bp, Homo sapiens
ctgaacacatactagaaag

SEQ ID NO: 2771612 - DNA, 15 bp, Homo sapiens
ctgaacatctgtgtg

SEQ ID NO: 2771613 - DNA, 16 bp, Homo sapiens
ctgaacatctgtgtgt

SEQ ID NO: 2771614 - DNA, 21 bp, Homo sapiens
ctgaacatttgctttgttttc

SEQ ID NO: 2771615 - DNA, 17 bp, Homo sapiens
ctgaacggggagaaaag

SEQ ID NO: 2771616 - DNA, 15 bp, Homo sapiens
ctgaacgtcctgcag

SEQ ID NO: 2771617 - DNA, 16 bp, Homo sapiens
ctgaactcaagctgcg

SEQ ID NO: 2771618 - DNA, 20 bp, Homo sapiens
ctgaagatttcagaggctgc

SEQ ID NO: 2771619 - DNA, 17 bp, Homo sapiens
ctgaagcccatgctttc

SEQ ID NO: 2771620 - DNA, 20 bp, Homo sapiens
ctgaaggacattgcggacag

SEQ ID NO: 2771621 - DNA, 15 bp, Homo sapiens
ctgaagggggcggcc

SEQ ID NO: 2771622 - DNA, 14 bp, Homo sapiens
ctgaagtcacacag

SEQ ID NO: 2771623 - DNA, 23 bp, Homo sapiens
ctgaagtgatgatggatgagaaa

SEQ ID NO: 2771624 - DNA, 16 bp, Homo sapiens
ctgaagttaacagaga

SEQ ID NO: 2771625 - DNA, 15 bp, Homo sapiens
ctgaataacatttgt

SEQ ID NO: 2771626 - DNA, 15 bp, Homo sapiens
ctgaataatttctta

SEQ ID NO: 2771627 - DNA, 16 bp, Homo sapiens
ctgaataatttcttac

SEQ ID NO: 2771628 - DNA, 17 bp, Homo sapiens
ctgaatgctctgtgcga

SEQ ID NO: 2771629 - DNA, 16 bp, Homo sapiens
ctgaatggtccagggt

SEQ ID NO: 2771630 - DNA, 18 bp, Homo sapiens
ctgaatggttccatgcct

SEQ ID NO: 2771631 - DNA, 22 bp, Homo sapiens
ctgaatggttccatgcctgagg

SEQ ID NO: 2771632 - DNA, 22 bp, Homo sapiens
ctgaatgtttgaactgccaaga

SEQ ID NO: 2771633 - DNA, 21 bp, Homo sapiens
ctgaatttggcctgcactaat

SEQ ID NO: 2771634 - DNA, 12 bp, Homo sapiens
ctgaatttttaa

SEQ ID NO: 2771635 - DNA, 21 bp, Homo sapiens
ctgaatttttaaacaagtatt

SEQ ID NO: 2771636 - DNA, 22 bp, Homo sapiens
ctgaatttttaaacaagtattt

SEQ ID NO: 2771637 - DNA, 13 bp, Homo sapiens
ctgacacacagct

SEQ ID NO: 2771638 - DNA, 18 bp, Homo sapiens
ctgacacacagctctgtc

SEQ ID NO: 2771639 - DNA, 21 bp, Homo sapiens
ctgacacacagctctgtcctg

SEQ ID NO: 2771640 - DNA, 23 bp, Homo sapiens
ctgacacacagctctgtcctggg

SEQ ID NO: 2771641 - DNA, 14 bp, Homo sapiens
ctgacacctcactg

SEQ ID NO: 2771642 - DNA, 19 bp, Homo sapiens
ctgacacctcactgaggaa

SEQ ID NO: 2771643 - DNA, 13 bp, Homo sapiens
ctgacagaaatgc

SEQ ID NO: 2771644 - DNA, 14 bp, Homo sapiens
ctgacagacacagg

SEQ ID NO: 2771645 - DNA, 17 bp, Homo sapiens
ctgacagacacaggccc

SEQ ID NO: 2771646 - DNA, 17 bp, Homo sapiens
ctgacaggcaatgctgg

SEQ ID NO: 2771647 - DNA, 14 bp, Homo sapiens
ctgaccaagagaga

SEQ ID NO: 2771648 - DNA, 13 bp, Homo sapiens
ctaccacagtgtc

SEQ ID NO: 2771649 - DNA, 14 bp, Homo sapiens
ctaccaccccttcc

SEQ ID NO: 2771650 - DNA, 18 bp, Homo sapiens
ctaccaccccttcctgtc

SEQ ID NO: 2771651 - DNA, 22 bp, Homo sapiens
ctaccaggtcaaaatagtgcca

SEQ ID NO: 2771652 - DNA, 13 bp, Homo sapiens
ctaccatttcaga

SEQ ID NO: 2771653 - DNA, 17 bp, Homo sapiens
ctacccaccctcctttc

SEQ ID NO: 2771654 - DNA, 22 bp, Homo sapiens
ctacccaccctcctttcaccac

SEQ ID NO: 2771655 - DNA, 18 bp, Homo sapiens
ctacccagagccttctcc

SEQ ID NO: 2771656 - DNA, 20 bp, Homo sapiens
ctacccagcgagccctggtg

SEQ ID NO: 2771657 - DNA, 14 bp, Homo sapiens
ctacccggcccaga

SEQ ID NO: 2771658 - DNA, 14 bp, Homo sapiens
ctaccctcccccag

SEQ ID NO: 2771659 - DNA, 19 bp, Homo sapiens
ctaccctggtaggaaagca

SEQ ID NO: 2771660 - DNA, 21 bp, Homo sapiens
ctaccgacctgtctccctggg

SEQ ID NO: 2771661 - DNA, 12 bp, Homo sapiens
ctacctgtgcct

SEQ ID NO: 2771662 - DNA, 13 bp, Homo sapiens
ctacctgtgcctg

SEQ ID NO: 2771663 - DNA, 15 bp, Homo sapiens
ctaccttatcaggca

SEQ ID NO: 2771664 - DNA, 14 bp, Homo sapiens
ctacgtataaatat

SEQ ID NO: 2771665 - DNA, 16 bp, Homo sapiens
ctacgttaagggaagg

SEQ ID NO: 2771666 - DNA, 15 bp, Homo sapiens
ctactagatgtcttt

SEQ ID NO: 2771667 - DNA, 12 bp, Homo sapiens
ctactattctgt

SEQ ID NO: 2771668 - DNA, 15 bp, Homo sapiens
ctactcacacaggca

SEQ ID NO: 2771669 - DNA, 15 bp, Homo sapiens
ctactcacagtctct

SEQ ID NO: 2771670 - DNA, 13 bp, Homo sapiens
ctactcagaagcc

SEQ ID NO: 2771671 - DNA, 21 bp, Homo sapiens
ctactcagaagcctgaggctg

SEQ ID NO: 2771672 - DNA, 18 bp, Homo sapiens
ctactcagcagccctcct

SEQ ID NO: 2771673 - DNA, 16 bp, Homo sapiens
ctactcaggaggctga

SEQ ID NO: 2771674 - DNA, 17 bp, Homo sapiens
ctactcctacctcagcc

SEQ ID NO: 2771675 - DNA, 21 bp, Homo sapiens
ctactcctacctcagcctaga

SEQ ID NO: 2771676 - DNA, 16 bp, Homo sapiens
ctactctgtgtcaggt

SEQ ID NO: 2771677 - DNA, 22 bp, Homo sapiens
ctactgactgatgacaaaccca

SEQ ID NO: 2771678 - DNA, 20 bp, Homo sapiens
ctactgtggaaaaatattta

SEQ ID NO: 2771679 - DNA, 17 bp, Homo sapiens
ctacttcattttcagag

SEQ ID NO: 2771680 - DNA, 19 bp, Homo sapiens
ctacttcattttcagagtg

SEQ ID NO: 2771681 - DNA, 15 bp, Homo sapiens
ctacttcctgcactg

SEQ ID NO: 2771682 - DNA, 20 bp, Homo sapiens
ctacttcctgtgacttcagc

SEQ ID NO: 2771683 - DNA, 22 bp, Homo sapiens
ctacttcttttgctcttagctg

SEQ ID NO: 2771684 - DNA, 12 bp, Homo sapiens
ctacttgggagg

SEQ ID NO: 2771685 - DNA, 15 bp, Homo sapiens
ctacttgtaatttct

SEQ ID NO: 2771686 - DNA, 23 bp, Homo sapiens
ctacttgttacctttcccatgct

SEQ ID NO: 2771687 - DNA, 15 bp, Homo sapiens
ctactttagccactg

SEQ ID NO: 2771688 - DNA, 21 bp, Homo sapiens
ctactttgatatgactgtttt

SEQ ID NO: 2771689 - DNA, 13 bp, Homo sapiens
ctacttttcagaa

SEQ ID NO: 2771690 - DNA, 15 bp, Homo sapiens
ctactttttatactc

SEQ ID NO: 2771691 - DNA, 16 bp, Homo sapiens
ctactttttatactcc

SEQ ID NO: 2771692 - DNA, 20 bp, Homo sapiens
ctagaaagctctgcatgtgt

SEQ ID NO: 2771693 - DNA, 18 bp, Homo sapiens
ctagaactctccatctta

SEQ ID NO: 2771694 - DNA, 19 bp, Homo sapiens
ctagaaggccacatgtcac

SEQ ID NO: 2771695 - DNA, 17 bp, Homo sapiens
ctagaagtgggccagga

SEQ ID NO: 2771696 - DNA, 19 bp, Homo sapiens
ctagaattgagtgtttaaa

SEQ ID NO: 2771697 - DNA, 19 bp, Homo sapiens
ctagaatttgtattttgct

SEQ ID NO: 2771698 - DNA, 12 bp, Homo sapiens
ctagagaagagg

SEQ ID NO: 2771699 - DNA, 17 bp, Homo sapiens
ctagagatatggcagcg

SEQ ID NO: 2771700 - DNA, 15 bp, Homo sapiens
ctagaggcagggagg

SEQ ID NO: 2771701 - DNA, 19 bp, Homo sapiens
ctagaggcagggaggggac

SEQ ID NO: 2771702 - DNA, 22 bp, Homo sapiens
ctagagggatacactgaagtta

SEQ ID NO: 2771703 - DNA, 15 bp, Homo sapiens
ctagaggtgagaaat

SEQ ID NO: 2771704 - DNA, 19 bp, Homo sapiens
ctagaggtgagaaatttaa

SEQ ID NO: 2771705 - DNA, 18 bp, Homo sapiens
ctagatcaaggagcccag

SEQ ID NO: 2771706 - DNA, 19 bp, Homo sapiens
ctagatcaaggagcccaga

SEQ ID NO: 2771707 - DNA, 18 bp, Homo sapiens
ctagatccacacacagag

SEQ ID NO: 2771708 - DNA, 21 bp, Homo sapiens
ctagatccacacacagaggaa

SEQ ID NO: 2771709 - DNA, 11 bp, Homo sapiens
ctagcagaagt

SEQ ID NO: 2771710 - DNA, 23 bp, Homo sapiens
ctagcagagcaggggcagggtga

SEQ ID NO: 2771711 - DNA, 12 bp, Homo sapiens
ctagcagctgca

SEQ ID NO: 2771712 - DNA, 22 bp, Homo sapiens
ctaaagctctgaacaaaagctt

SEQ ID NO: 2771713 - DNA, 19 bp, Homo sapiens
ctaaatacctcaatcagtc

SEQ ID NO: 2771714 - DNA, 11 bp, Homo sapiens
ctaaatccaaa

SEQ ID NO: 2771715 - DNA, 13 bp, Homo sapiens
ctaaatccaaaga

SEQ ID NO: 2771716 - DNA, 21 bp, Homo sapiens
ctaaatcctttactgttagtc

SEQ ID NO: 2771717 - DNA, 15 bp, Homo sapiens
ctaaatcttccttgt

SEQ ID NO: 2771718 - DNA, 17 bp, Homo sapiens
ctaaatcttccttgtga

SEQ ID NO: 2771719 - DNA, 12 bp, Homo sapiens
ctaaatgaatgt

SEQ ID NO: 2771720 - DNA, 16 bp, Homo sapiens
ctaaatgaatgtttac

SEQ ID NO: 2771721 - DNA, 23 bp, Homo sapiens
ctaaatgagctcctgcgggagta

SEQ ID NO: 2771722 - DNA, 17 bp, Homo sapiens
ctaaatgcaaacactgt

SEQ ID NO: 2771723 - DNA, 18 bp, Homo sapiens
ctaaatgcctaataaaca

SEQ ID NO: 2771724 - DNA, 19 bp, Homo sapiens
ctaaatggtcgcccaggag

SEQ ID NO: 2771725 - DNA, 20 bp, Homo sapiens
ctaaatggtcgcccaggaga

SEQ ID NO: 2771726 - DNA, 18 bp, Homo sapiens
ctaaatgttggaattttc

SEQ ID NO: 2771727 - DNA, 17 bp, Homo sapiens
ctaacacattatcggga

SEQ ID NO: 2771728 - DNA, 17 bp, Homo sapiens
ctaacactcagaagcct

SEQ ID NO: 2771729 - DNA, 22 bp, Homo sapiens
ctaacactcagaagcctggggg

SEQ ID NO: 2771730 - DNA, 12 bp, Homo sapiens
ctaaccacgctg

SEQ ID NO: 2771731 - DNA, 19 bp, Homo sapiens
ctaacccccagtgccacag

SEQ ID NO: 2771732 - DNA, 22 bp, Homo sapiens
ctaacctaagcaaaaccactga

SEQ ID NO: 2771733 - DNA, 17 bp, Homo sapiens
ctaacgcctgagcccag

SEQ ID NO: 2771734 - DNA, 18 bp, Homo sapiens
ctaacgcctgagcccagg

SEQ ID NO: 2771735 - DNA, 20 bp, Homo sapiens
ctaacgcctgagcccaggga

SEQ ID NO: 2771736 - DNA, 22 bp, Homo sapiens
ctaacgcctgagcccagggagg

SEQ ID NO: 2771737 - DNA, 14 bp, Homo sapiens
ctaactccagtgaa

SEQ ID NO: 2771738 - DNA, 15 bp, Homo sapiens
ctaagaagctctggc

SEQ ID NO: 2771739 - DNA, 21 bp, Homo sapiens
ctaagaagctctggccccagg

SEQ ID NO: 2771740 - DNA, 17 bp, Homo sapiens
ctaagagaagtagaaat

SEQ ID NO: 2771741 - DNA, 20 bp, Homo sapiens
ctaagagctagcgctgccgc

SEQ ID NO: 2771742 - DNA, 13 bp, Homo sapiens
ctaagattgtaca

SEQ ID NO: 2771743 - DNA, 16 bp, Homo sapiens
ctaagcagtgcttgta

SEQ ID NO: 2771744 - DNA, 16 bp, Homo sapiens
ctaagcctttccataa

SEQ ID NO: 2771745 - DNA, 15 bp, Homo sapiens
ctaagctaaccccct

SEQ ID NO: 2771746 - DNA, 17 bp, Homo sapiens
ctaagctaggaatgaaa

SEQ ID NO: 2771747 - DNA, 22 bp, Homo sapiens
ctaagctaggaatgaaatcctg

SEQ ID NO: 2771748 - DNA, 13 bp, Homo sapiens
ctaagctgcagct

SEQ ID NO: 2771749 - DNA, 19 bp, Homo sapiens
ctaagctgcagcttcctgt

SEQ ID NO: 2771750 - DNA, 12 bp, Homo sapiens
ctaaggatctct

SEQ ID NO: 2771751 - DNA, 17 bp, Homo sapiens
ctaaggatctctcagga

SEQ ID NO: 2771752 - DNA, 10 bp, Homo sapiens
ctaataaaac

SEQ ID NO: 2771753 - DNA, 12 bp, Homo sapiens
ctaatacaccag

SEQ ID NO: 2771754 - DNA, 22 bp, Homo sapiens
ctaatcaagagtgagtgaacaa

SEQ ID NO: 2771755 - DNA, 20 bp, Homo sapiens
ctaatcaggctgaggtgtct

SEQ ID NO: 2771756 - DNA, 21 bp, Homo sapiens
ctaatcagggaggtcattttg

SEQ ID NO: 2771757 - DNA, 15 bp, Homo sapiens
ctaatccaacccatg

SEQ ID NO: 2771758 - DNA, 22 bp, Homo sapiens
ctaatcttgttaaattgcttat

SEQ ID NO: 2771759 - DNA, 15 bp, Homo sapiens
ctaattcaatttatg

SEQ ID NO: 2771760 - DNA, 14 bp, Homo sapiens
ctaattcccagagt

SEQ ID NO: 2771761 - DNA, 16 bp, Homo sapiens
ctaattcccagagtgt

SEQ ID NO: 2771762 - DNA, 18 bp, Homo sapiens
ctaattcccattttgcaa

SEQ ID NO: 2771763 - DNA, 20 bp, Homo sapiens
ctaattcccattttgcaaaa

SEQ ID NO: 2771764 - DNA, 19 bp, Homo sapiens
ctaattggaagaaattcct

SEQ ID NO: 2771765 - DNA, 22 bp, Homo sapiens
ctaattggaagaaattcctgta

SEQ ID NO: 2771766 - DNA, 19 bp, Homo sapiens
ctaatttaaaccagcagaa

SEQ ID NO: 2771767 - DNA, 23 bp, Homo sapiens
ctaatttaaaccagcagaaaagt

SEQ ID NO: 2771768 - DNA, 16 bp, Homo sapiens
ctaattttttgttgtt

SEQ ID NO: 2771769 - DNA, 23 bp, Homo sapiens
ctacaaaaaattagaaattggct

SEQ ID NO: 2771770 - DNA, 14 bp, Homo sapiens
ctacaaattatcat

SEQ ID NO: 2771771 - DNA, 13 bp, Homo sapiens
ctacaaccagagc

SEQ ID NO: 2771772 - DNA, 16 bp, Homo sapiens
ctacaaccagagcccc

SEQ ID NO: 2771773 - DNA, 19 bp, Homo sapiens
ctacaagctaaaattagat

SEQ ID NO: 2771774 - DNA, 16 bp, Homo sapiens
ctacaatttaaagcaa

SEQ ID NO: 2771775 - DNA, 20 bp, Homo sapiens
ctgggtacttgtggacacag

SEQ ID NO: 2771776 - DNA, 13 bp, Homo sapiens
ctgggtgacagag

SEQ ID NO: 2771777 - DNA, 22 bp, Homo sapiens
ctgggtgacagagcaagactct

SEQ ID NO: 2771778 - DNA, 15 bp, Homo sapiens
ctgggtggctactct

SEQ ID NO: 2771779 - DNA, 19 bp, Homo sapiens
ctgggtggctactctgtgc

SEQ ID NO: 2771780 - DNA, 20 bp, Homo sapiens
ctgggtggctactctgtgcc

SEQ ID NO: 2771781 - DNA, 13 bp, Homo sapiens
ctgggttggaggg

SEQ ID NO: 2771782 - DNA, 23 bp, Homo sapiens
ctgggtttattacatggcagtgt

SEQ ID NO: 2771783 - DNA, 14 bp, Homo sapiens
ctggtaggaaagca

SEQ ID NO: 2771784 - DNA, 20 bp, Homo sapiens
ctggtatgaacttgaggaca

SEQ ID NO: 2771785 - DNA, 23 bp, Homo sapiens
ctggtatgaacttgaggacacat

SEQ ID NO: 2771786 - DNA, 19 bp, Homo sapiens
ctggtcacaggactctgcc

SEQ ID NO: 2771787 - DNA, 20 bp, Homo sapiens
ctggtcacaggactctgcct

SEQ ID NO: 2771788 - DNA, 21 bp, Homo sapiens
ctggtcaggcccactgcagag

SEQ ID NO: 2771789 - DNA, 15 bp, Homo sapiens
ctggtcccactcagt

SEQ ID NO: 2771790 - DNA, 19 bp, Homo sapiens
ctggtccttccaggccccc

SEQ ID NO: 2771791 - DNA, 16 bp, Homo sapiens
ctggtctccctccagc

SEQ ID NO: 2771792 - DNA, 14 bp, Homo sapiens
ctggtctctccttg

SEQ ID NO: 2771793 - DNA, 14 bp, Homo sapiens
ctggtctgccctgg

SEQ ID NO: 2771794 - DNA, 22 bp, Homo sapiens
ctggtgactgcgatcttcagag

SEQ ID NO: 2771795 - DNA, 16 bp, Homo sapiens
ctggtgcactggcccc

SEQ ID NO: 2771796 - DNA, 21 bp, Homo sapiens
ctggtgctataggctggagaa

SEQ ID NO: 2771797 - DNA, 23 bp, Homo sapiens
ctggtgctataggctggagaagc

SEQ ID NO: 2771798 - DNA, 19 bp, Homo sapiens
ctggtgctgtggccagggt

SEQ ID NO: 2771799 - DNA, 20 bp, Homo sapiens
ctggtgctgtggccagggtg

SEQ ID NO: 2771800 - DNA, 12 bp, Homo sapiens
ctggtggacagt

SEQ ID NO: 2771801 - DNA, 17 bp, Homo sapiens
ctggtggacagtcctgg

SEQ ID NO: 2771802 - DNA, 15 bp, Homo sapiens
ctggtggaccacagg

SEQ ID NO: 2771803 - DNA, 20 bp, Homo sapiens
ctggtggaccacaggcatct

SEQ ID NO: 2771804 - DNA, 13 bp, Homo sapiens
ctggtggcagctg

SEQ ID NO: 2771805 - DNA, 14 bp, Homo sapiens
ctggtggcagctgc

SEQ ID NO: 2771806 - DNA, 14 bp, Homo sapiens
ctggtggcagtggg

SEQ ID NO: 2771807 - DNA, 23 bp, Homo sapiens
ctggtggcagtgggagctgcctg

SEQ ID NO: 2771808 - DNA, 22 bp, Homo sapiens
ctggtggccatgtcgcctgccc

SEQ ID NO: 2771809 - DNA, 12 bp, Homo sapiens
ctggtgggcctc

SEQ ID NO: 2771810 - DNA, 15 bp, Homo sapiens
ctggtggggcagctc

SEQ ID NO: 2771811 - DNA, 20 bp, Homo sapiens
ctggtggggcagctcctctg

SEQ ID NO: 2771812 - DNA, 15 bp, Homo sapiens
ctgtaaaatgaaatt

SEQ ID NO: 2771813 - DNA, 16 bp, Homo sapiens
ctgtaaaatgaaatta

SEQ ID NO: 2771814 - DNA, 13 bp, Homo sapiens
ctgtaaacacagt

SEQ ID NO: 2771815 - DNA, 16 bp, Homo sapiens
ctgtaaatacaaaata

SEQ ID NO: 2771816 - DNA, 21 bp, Homo sapiens
ctgtaaatacaaaataaaatt

SEQ ID NO: 2771817 - DNA, 16 bp, Homo sapiens
ctgtaaatacatgtgt

SEQ ID NO: 2771818 - DNA, 18 bp, Homo sapiens
ctgtaaatacatgtgtgg

SEQ ID NO: 2771819 - DNA, 19 bp, Homo sapiens
ctgtaacacaagccacaga

SEQ ID NO: 2771820 - DNA, 20 bp, Homo sapiens
ctgtaacacaagccacagaa

SEQ ID NO: 2771821 - DNA, 15 bp, Homo sapiens
ctgtaaggaactgga

SEQ ID NO: 2771822 - DNA, 13 bp, Homo sapiens
ctgtaatcccagc

SEQ ID NO: 2771823 - DNA, 20 bp, Homo sapiens
ctgtaatcccagcactttgg

SEQ ID NO: 2771824 - DNA, 15 bp, Homo sapiens
ctgtaatcccagcag

SEQ ID NO: 2771825 - DNA, 20 bp, Homo sapiens
ctgtaatcccagctacacct

SEQ ID NO: 2771826 - DNA, 14 bp, Homo sapiens
ctgtaattttgtag

SEQ ID NO: 2771827 - DNA, 15 bp, Homo sapiens
ctgtaattttgtagt

SEQ ID NO: 2771828 - DNA, 17 bp, Homo sapiens
ctgtaattttgtttgta

SEQ ID NO: 2771829 - DNA, 20 bp, Homo sapiens
ctgtaattttgtttgtaatc

SEQ ID NO: 2771830 - DNA, 14 bp, Homo sapiens
ctgtacaatattta

SEQ ID NO: 2771831 - DNA, 18 bp, Homo sapiens
ctgtacaatatttaaaat

SEQ ID NO: 2771832 - DNA, 20 bp, Homo sapiens
ctgtacccaatttaattcca

SEQ ID NO: 2771833 - DNA, 20 bp, Homo sapiens
ctgtacgaacccctcccctc

SEQ ID NO: 2771834 - DNA, 18 bp, Homo sapiens
ctgtacgtctggtgttct

SEQ ID NO: 2771835 - DNA, 20 bp, Homo sapiens
ctgtactcaggaggctgagg

SEQ ID NO: 2771836 - DNA, 13 bp, Homo sapiens
ctgtactgcctgc

SEQ ID NO: 2771837 - DNA, 14 bp, Homo sapiens
ctgtactgcctgct

SEQ ID NO: 2771838 - DNA, 12 bp, Homo sapiens
ctgtactgtaat

SEQ ID NO: 2771839 - DNA, 14 bp, Homo sapiens
ctgtactgtaattt

SEQ ID NO: 2771840 - DNA, 17 bp, Homo sapiens
ctgtacttattttccaa

SEQ ID NO: 2771841 - DNA, 20 bp, Homo sapiens
ctgtacttcaagttaaagtg

SEQ ID NO: 2771842 - DNA, 19 bp, Homo sapiens
ctgtagagtcactgaccct

SEQ ID NO: 2771843 - DNA, 12 bp, Homo sapiens
ctgtagcatctt

SEQ ID NO: 2771844 - DNA, 21 bp, Homo sapiens
ctgtagccccagtgacagcta

SEQ ID NO: 2771845 - DNA, 22 bp, Homo sapiens
ctgtaggttgcttaaaagggac

SEQ ID NO: 2771846 - DNA, 17 bp, Homo sapiens
ctgtagtcccagccact

SEQ ID NO: 2771847 - DNA, 18 bp, Homo sapiens
ctgtagtcccagccactc

SEQ ID NO: 2771848 - DNA, 23 bp, Homo sapiens
ctgtagtcccagccactcgggag

SEQ ID NO: 2771849 - DNA, 23 bp, Homo sapiens
ctgtagtcctagccactcaggag

SEQ ID NO: 2771850 - DNA, 18 bp, Homo sapiens
ctgtatatacaataacat

SEQ ID NO: 2771851 - DNA, 15 bp, Homo sapiens
ctgtatcccatgagc

SEQ ID NO: 2771852 - DNA, 20 bp, Homo sapiens
ctgtatcccatgagcctcag

SEQ ID NO: 2771853 - DNA, 23 bp, Homo sapiens
ctgtatggcacttattatgaggc

SEQ ID NO: 2771854 - DNA, 18 bp, Homo sapiens
ctgtatgtgtctttatca

SEQ ID NO: 2771855 - DNA, 20 bp, Homo sapiens
ctgtattcagatcgtattaa

SEQ ID NO: 2771856 - DNA, 15 bp, Homo sapiens
ctgtatttgttccca

SEQ ID NO: 2771857 - DNA, 19 bp, Homo sapiens
ctgtcaatttccctgactc

SEQ ID NO: 2771858 - DNA, 14 bp, Homo sapiens
ctgtcaccaagctc

SEQ ID NO: 2771859 - DNA, 21 bp, Homo sapiens
ctgtcagatgggaagacatga

SEQ ID NO: 2771860 - DNA, 19 bp, Homo sapiens
ctgtcataagaatgaataa

SEQ ID NO: 2771861 - DNA, 16 bp, Homo sapiens
ctgtcatcaattaaag

SEQ ID NO: 2771862 - DNA, 23 bp, Homo sapiens
ctgtcatcaattaaaggcaaagg

SEQ ID NO: 2771863 - DNA, 13 bp, Homo sapiens
ctgtcatcccgct

SEQ ID NO: 2771864 - DNA, 17 bp, Homo sapiens
ctgtcatcccgctcctg

SEQ ID NO: 2771865 - DNA, 21 bp, Homo sapiens
ctggcctggatctccccactc

SEQ ID NO: 2771866 - DNA, 14 bp, Homo sapiens
ctggcctggcacac

SEQ ID NO: 2771867 - DNA, 22 bp, Homo sapiens
ctggcctggcacacatcaggag

SEQ ID NO: 2771868 - DNA, 23 bp, Homo sapiens
ctgcggtccacccaggagccccg

SEQ ID NO: 2771869 - DNA, 19 bp, Homo sapiens
ctgcgtagagcctggaagg

SEQ ID NO: 2771870 - DNA, 14 bp, Homo sapiens
ctgcgtctccatca

SEQ ID NO: 2771871 - DNA, 22 bp, Homo sapiens
ctgctacaccttagcagctctt

SEQ ID NO: 2771872 - DNA, 13 bp, Homo sapiens
ctgctacctcact

SEQ ID NO: 2771873 - DNA, 14 bp, Homo sapiens
ctgctacctcactg

SEQ ID NO: 2771874 - DNA, 22 bp, Homo sapiens
ctgaccacgctttctagctgtt

SEQ ID NO: 2771875 - DNA, 21 bp, Homo sapiens
ctgaccagcctccatgctgcc

SEQ ID NO: 2771876 - DNA, 12 bp, Homo sapiens
ctgacccactgc

SEQ ID NO: 2771877 - DNA, 11 bp, Homo sapiens
ctgacccagtc

SEQ ID NO: 2771878 - DNA, 14 bp, Homo sapiens
ctgacccagtccct

SEQ ID NO: 2771879 - DNA, 17 bp, Homo sapiens
ctgacccagtccctggg

SEQ ID NO: 2771880 - DNA, 23 bp, Homo sapiens
ctgaccccaaagagcctggagaa

SEQ ID NO: 2771881 - DNA, 14 bp, Homo sapiens
ctgacctcccagcc

SEQ ID NO: 2771882 - DNA, 21 bp, Homo sapiens
ctgacctccctctaatttatc

SEQ ID NO: 2771883 - DNA, 15 bp, Homo sapiens
ctcactgttgcccag

SEQ ID NO: 2771884 - DNA, 22 bp, Homo sapiens
ctcactgttgcccaggctggcg

SEQ ID NO: 2771885 - DNA, 22 bp, Homo sapiens
ctcacttttaatgaacaaatgg

SEQ ID NO: 2771886 - DNA, 22 bp, Homo sapiens
ctcagaaaagaaaaccatttta

SEQ ID NO: 2771887 - DNA, 13 bp, Homo sapiens
ctcagaagaaaga

SEQ ID NO: 2771888 - DNA, 14 bp, Homo sapiens
ctcagaagcctgag

SEQ ID NO: 2771889 - DNA, 18 bp, Homo sapiens
ctcagaagcctgaggctg

SEQ ID NO: 2771890 - DNA, 14 bp, Homo sapiens
ctcagaagcctggg

SEQ ID NO: 2771891 - DNA, 15 bp, Homo sapiens
ctcagaagcctgggg

SEQ ID NO: 2771892 - DNA, 22 bp, Homo sapiens
ctcagaagcctgggggcctggc

SEQ ID NO: 2771893 - DNA, 19 bp, Homo sapiens
ctcagaaggtattcctttt

SEQ ID NO: 2771894 - DNA, 15 bp, Homo sapiens
ctcagacccccactc

SEQ ID NO: 2771895 - DNA, 23 bp, Homo sapiens
ctcagacccccactctcattccc

SEQ ID NO: 2771896 - DNA, 23 bp, Homo sapiens
ctcagagaatttctaccatttca

SEQ ID NO: 2771897 - DNA, 19 bp, Homo sapiens
ctcagagacaggtggccta

SEQ ID NO: 2771898 - DNA, 18 bp, Homo sapiens
ctcagaggcagcaggagg

SEQ ID NO: 2771899 - DNA, 13 bp, Homo sapiens
ctcagaggcccag

SEQ ID NO: 2771900 - DNA, 15 bp, Homo sapiens
ctcagaggcccagga

SEQ ID NO: 2771901 - DNA, 20 bp, Homo sapiens
ctcagaggctatagctggga

SEQ ID NO: 2771902 - DNA, 13 bp, Homo sapiens
ctcagcagccctc

SEQ ID NO: 2771903 - DNA, 21 bp, Homo sapiens
ctcagcatcctggcacccggc

SEQ ID NO: 2771904 - DNA, 21 bp, Homo sapiens
ctcagccatgaggagttgctg

SEQ ID NO: 2771905 - DNA, 13 bp, Homo sapiens
ctcagccctgact

SEQ ID NO: 2771906 - DNA, 23 bp, Homo sapiens
ctcagcctcccgaatagctggga

SEQ ID NO: 2771907 - DNA, 16 bp, Homo sapiens
ctcagcctggtgggcc

SEQ ID NO: 2771908 - DNA, 11 bp, Homo sapiens
ctcagccttgg

SEQ ID NO: 2771909 - DNA, 19 bp, Homo sapiens
ctcagcggggacagctcct

SEQ ID NO: 2771910 - DNA, 20 bp, Homo sapiens
ctcagcggggacagctcctt

SEQ ID NO: 2771911 - DNA, 13 bp, Homo sapiens
ctcagctccagaa

SEQ ID NO: 2771912 - DNA, 23 bp, Homo sapiens
ctcagctctgacattctgattcg

SEQ ID NO: 2771913 - DNA, 14 bp, Homo sapiens
ctcagctgacacat

SEQ ID NO: 2771914 - DNA, 17 bp, Homo sapiens
ctcagctgctcgcacag

SEQ ID NO: 2771915 - DNA, 19 bp, Homo sapiens
ctcagctgctcgcacagat

SEQ ID NO: 2771916 - DNA, 14 bp, Homo sapiens
ctcagcttcatttc

SEQ ID NO: 2771917 - DNA, 18 bp, Homo sapiens
ctcagcttcatttccgtg

SEQ ID NO: 2771918 - DNA, 20 bp, Homo sapiens
ctcagcttcatttccgtgaa

SEQ ID NO: 2771919 - DNA, 21 bp, Homo sapiens
ctcagctttttgtcttttctg

SEQ ID NO: 2771920 - DNA, 24 bp, Homo sapiens
ctcaggaattgaagatgtaaggaa

SEQ ID NO: 2771921 - DNA, 19 bp, Homo sapiens
ctcaggacacaggcctgtg

SEQ ID NO: 2771922 - DNA, 20 bp, Homo sapiens
ctcaggacacaggcctgtgt

SEQ ID NO: 2771923 - DNA, 15 bp, Homo sapiens
ctcaggagcacaggc

SEQ ID NO: 2771924 - DNA, 18 bp, Homo sapiens
ctcaggagcacaggcagc

SEQ ID NO: 2771925 - DNA, 22 bp, Homo sapiens
ctcaggagcacaggcagctgga

SEQ ID NO: 2771926 - DNA, 21 bp, Homo sapiens
ctcaggagcttgcaagaagca

SEQ ID NO: 2771927 - DNA, 14 bp, Homo sapiens
ctcaggaggctgag

SEQ ID NO: 2771928 - DNA, 17 bp, Homo sapiens
ctcaggaggctgaggca

SEQ ID NO: 2771929 - DNA, 23 bp, Homo sapiens
ctcaggaggctgaggcagaagaa

SEQ ID NO: 2771930 - DNA, 17 bp, Homo sapiens
ctcaggcttccttggca

SEQ ID NO: 2771931 - DNA, 15 bp, Homo sapiens
ctcaggcttgaaatg

SEQ ID NO: 2771932 - DNA, 12 bp, Homo sapiens
ctcagggcccca

SEQ ID NO: 2771933 - DNA, 18 bp, Homo sapiens
ctcagggccccagcacta

SEQ ID NO: 2771934 - DNA, 21 bp, Homo sapiens
ctcaggggcctcaggggagcc

SEQ ID NO: 2771935 - DNA, 17 bp, Homo sapiens
ctcaggtccctgcaggg

SEQ ID NO: 2771936 - DNA, 18 bp, Homo sapiens
ctcaggtgatccacccac

SEQ ID NO: 2771937 - DNA, 19 bp, Homo sapiens
ctcaggtgatccacccacc

SEQ ID NO: 2771938 - DNA, 17 bp, Homo sapiens
ctcaggtgtccctgcac

SEQ ID NO: 2771939 - DNA, 18 bp, Homo sapiens
ctcaggtgtccctgcact

SEQ ID NO: 2771940 - DNA, 19 bp, Homo sapiens
ctcaggttctgtgtgtcct

SEQ ID NO: 2771941 - DNA, 22 bp, Homo sapiens
ctcagtcccccaccacactgaa

SEQ ID NO: 2771942 - DNA, 13 bp, Homo sapiens
ctcagtcctggaa

SEQ ID NO: 2771943 - DNA, 16 bp, Homo sapiens
ctcagtgctcggcagt

SEQ ID NO: 2771944 - DNA, 13 bp, Homo sapiens
ctcagtgctctcc

SEQ ID NO: 2771945 - DNA, 22 bp, Homo sapiens
ctcagtgggacaaaccagagca

SEQ ID NO: 2771946 - DNA, 17 bp, Homo sapiens
ctcagtgtcatttatga

SEQ ID NO: 2771947 - DNA, 18 bp, Homo sapiens
ctcagtgtcatttatgaa

SEQ ID NO: 2771948 - DNA, 13 bp, Homo sapiens
ctcagttaaaatg

SEQ ID NO: 2771949 - DNA, 20 bp, Homo sapiens
ctcataagttggaccagagg

SEQ ID NO: 2771950 - DNA, 21 bp, Homo sapiens
ctcataagttggaccagagga

SEQ ID NO: 2771951 - DNA, 12 bp, Homo sapiens
ctcataccatct

SEQ ID NO: 2771952 - DNA, 20 bp, Homo sapiens
ctcataccatctgctgcccc

SEQ ID NO: 2771953 - DNA, 18 bp, Homo sapiens
ctcatagtatggtggctg

SEQ ID NO: 2771954 - DNA, 18 bp, Homo sapiens
cctggaagggaagtgaga

SEQ ID NO: 2771955 - DNA, 14 bp, Homo sapiens
cctggacagctgtg

SEQ ID NO: 2771956 - DNA, 15 bp, Homo sapiens
cctggacagctgtgc

SEQ ID NO: 2771957 - DNA, 22 bp, Homo sapiens
cctggacagctgtgcctcgctc

SEQ ID NO: 2771958 - DNA, 17 bp, Homo sapiens
cctggagaagctgatgc

SEQ ID NO: 2771959 - DNA, 16 bp, Homo sapiens
cctggagcggctctcc

SEQ ID NO: 2771960 - DNA, 20 bp, Homo sapiens
cctggagcggctctcctgag

SEQ ID NO: 2771961 - DNA, 18 bp, Homo sapiens
cctggatcagcgtggcct

SEQ ID NO: 2771962 - DNA, 19 bp, Homo sapiens
cctggatctccccactcta

SEQ ID NO: 2771963 - DNA, 13 bp, Homo sapiens
cctggcacacatc

SEQ ID NO: 2771964 - DNA, 15 bp, Homo sapiens
cctggcacacatcag

SEQ ID NO: 2771965 - DNA, 18 bp, Homo sapiens
cctggcacccggcccctg

SEQ ID NO: 2771966 - DNA, 20 bp, Homo sapiens
cctggcacccggcccctgct

SEQ ID NO: 2771967 - DNA, 23 bp, Homo sapiens
cctggcacccggcccctgctggt

SEQ ID NO: 2771968 - DNA, 18 bp, Homo sapiens
cctggcacggtggctcag

SEQ ID NO: 2771969 - DNA, 17 bp, Homo sapiens
cctggcaggatgaccct

SEQ ID NO: 2771970 - DNA, 22 bp, Homo sapiens
cctggcaggatgaccctgcgaa

SEQ ID NO: 2771971 - DNA, 15 bp, Homo sapiens
cctggccagatgcac

SEQ ID NO: 2771972 - DNA, 19 bp, Homo sapiens
cctggcccagagctggaac

SEQ ID NO: 2771973 - DNA, 17 bp, Homo sapiens
cctggccccagccccca

SEQ ID NO: 2771974 - DNA, 18 bp, Homo sapiens
cctggccccatgtctctc

SEQ ID NO: 2771975 - DNA, 19 bp, Homo sapiens
cctggcccccctccaggca

SEQ ID NO: 2771976 - DNA, 17 bp, Homo sapiens
cctggccgcctccagga

SEQ ID NO: 2771977 - DNA, 15 bp, Homo sapiens
cctggccggctccag

SEQ ID NO: 2771978 - DNA, 19 bp, Homo sapiens
cctggcctcacgcccagcc

SEQ ID NO: 2771979 - DNA, 20 bp, Homo sapiens
cctggcctcacgcccagcct

SEQ ID NO: 2771980 - DNA, 18 bp, Homo sapiens
cctggcctcctgcctcta

SEQ ID NO: 2771981 - DNA, 17 bp, Homo sapiens
cctgtatattatggtgt

SEQ ID NO: 2771982 - DNA, 19 bp, Homo sapiens
cctgtatattatggtgtaa

SEQ ID NO: 2771983 - DNA, 21 bp, Homo sapiens
cctgtatattatggtgtaatg

SEQ ID NO: 2771984 - DNA, 17 bp, Homo sapiens
cctgtatgtctccagta

SEQ ID NO: 2771985 - DNA, 19 bp, Homo sapiens
cctgtatttgttcccaaga

SEQ ID NO: 2771986 - DNA, 22 bp, Homo sapiens
cctgtatttgttcccaagagca

SEQ ID NO: 2771987 - DNA, 14 bp, Homo sapiens
cctgtccataaagt

SEQ ID NO: 2771988 - DNA, 13 bp, Homo sapiens
cctgtcccacctc

SEQ ID NO: 2771989 - DNA, 16 bp, Homo sapiens
cctgtcccacctcttc

SEQ ID NO: 2771990 - DNA, 14 bp, Homo sapiens
cctgtcctccagct

SEQ ID NO: 2771991 - DNA, 17 bp, Homo sapiens
cctgtcctttgttatta

SEQ ID NO: 2771992 - DNA, 18 bp, Homo sapiens
cctgtcgagacacttgcc

SEQ ID NO: 2771993 - DNA, 14 bp, Homo sapiens
cctgtctccctggg

SEQ ID NO: 2771994 - DNA, 15 bp, Homo sapiens
cctgtctgccagcca

SEQ ID NO: 2771995 - DNA, 17 bp, Homo sapiens
cctgtctgccagccagc

SEQ ID NO: 2771996 - DNA, 22 bp, Homo sapiens
cctgtcttatggcgttgcaggc

SEQ ID NO: 2771997 - DNA, 18 bp, Homo sapiens
cctgtctttcagcattca

SEQ ID NO: 2771998 - DNA, 15 bp, Homo sapiens
cctgtgaacccagga

SEQ ID NO: 2771999 - DNA, 18 bp, Homo sapiens
cctgtgacttcagctctg

SEQ ID NO: 2772000 - DNA, 14 bp, Homo sapiens
cctgtgaggcaggg

SEQ ID NO: 2772001 - DNA, 14 bp, Homo sapiens
cctgtgcatgtatg

SEQ ID NO: 2772002 - DNA, 22 bp, Homo sapiens
cctgtgctgcccgtcttcagcc

SEQ ID NO: 2772003 - DNA, 23 bp, Homo sapiens
cctgtgctgcccgtcttcagcct

SEQ ID NO: 2772004 - DNA, 16 bp, Homo sapiens
cctgtggcggtgcctg

SEQ ID NO: 2772005 - DNA, 17 bp, Homo sapiens
cctgtggcggtgcctgg

SEQ ID NO: 2772006 - DNA, 20 bp, Homo sapiens
cctgtggcggtgcctgggtg

SEQ ID NO: 2772007 - DNA, 15 bp, Homo sapiens
cctgtgggagcctcg

SEQ ID NO: 2772008 - DNA, 14 bp, Homo sapiens
cctgtgggagcctg

SEQ ID NO: 2772009 - DNA, 15 bp, Homo sapiens
cctgtgggagcctgc

SEQ ID NO: 2772010 - DNA, 19 bp, Homo sapiens
cctgtgggggcggctgtgg

SEQ ID NO: 2772011 - DNA, 12 bp, Homo sapiens
cctgtgggtgtg

SEQ ID NO: 2772012 - DNA, 14 bp, Homo sapiens
cctgtgtagctgtg

SEQ ID NO: 2772013 - DNA, 22 bp, Homo sapiens
cctgtgtagctgtgacctgctg

SEQ ID NO: 2772014 - DNA, 23 bp, Homo sapiens
cctgtgtagctgtgacctgctga

SEQ ID NO: 2772015 - DNA, 21 bp, Homo sapiens
cctgtgtcttgcaatggcagc

SEQ ID NO: 2772016 - DNA, 22 bp, Homo sapiens
cctgtgtgagcatctctgtgta

SEQ ID NO: 2772017 - DNA, 23 bp, Homo sapiens
cctgttacttgaaataccagtga

SEQ ID NO: 2772018 - DNA, 16 bp, Homo sapiens
cctgttcagctccagc

SEQ ID NO: 2772019 - DNA, 19 bp, Homo sapiens
cctgttcagctccagctca

SEQ ID NO: 2772020 - DNA, 22 bp, Homo sapiens
cctgttcccccgctggcagcca

SEQ ID NO: 2772021 - DNA, 17 bp, Homo sapiens
cctgttccctctttctt

SEQ ID NO: 2772022 - DNA, 12 bp, Homo sapiens
cctgtttatata

SEQ ID NO: 2772023 - DNA, 12 bp, Homo sapiens
cctgtttcctga

SEQ ID NO: 2772024 - DNA, 17 bp, Homo sapiens
cctgttttgttggaagg

SEQ ID NO: 2772025 - DNA, 16 bp, Homo sapiens
ccttacctcctgccca

SEQ ID NO: 2772026 - DNA, 14 bp, Homo sapiens
ccttactcctgtgg

SEQ ID NO: 2772027 - DNA, 19 bp, Homo sapiens
ccttactcctgtgggagcc

SEQ ID NO: 2772028 - DNA, 21 bp, Homo sapiens
ccttactcctgtgggagcctc

SEQ ID NO: 2772029 - DNA, 12 bp, Homo sapiens
ccttactgcaga

SEQ ID NO: 2772030 - DNA, 14 bp, Homo sapiens
ccttagcacttctt

SEQ ID NO: 2772031 - DNA, 21 bp, Homo sapiens
ccttagcacttctttcctctc

SEQ ID NO: 2772032 - DNA, 17 bp, Homo sapiens
ccttagcttagacctca

SEQ ID NO: 2772033 - DNA, 19 bp, Homo sapiens
ccttagcttagacctcagc

SEQ ID NO: 2772034 - DNA, 13 bp, Homo sapiens
ccttatccaggac

SEQ ID NO: 2772035 - DNA, 14 bp, Homo sapiens
ccttatccaggact

SEQ ID NO: 2772036 - DNA, 13 bp, Homo sapiens
ccttatgtattat

SEQ ID NO: 2772037 - DNA, 18 bp, Homo sapiens
ccttattttcaagaaact

SEQ ID NO: 2772038 - DNA, 23 bp, Homo sapiens
ccttcaagcaccctgttccctct

SEQ ID NO: 2772039 - DNA, 17 bp, Homo sapiens
ccttcaagttagctcag

SEQ ID NO: 2772040 - DNA, 14 bp, Homo sapiens
ccttcaattcctgg

SEQ ID NO: 2772041 - DNA, 15 bp, Homo sapiens
ccttcaattcctggg

SEQ ID NO: 2772042 - DNA, 22 bp, Homo sapiens
ccttcacaaccagccacacaga

SEQ ID NO: 2772043 - DNA, 12 bp, Homo sapiens
ccttcacagtgt

SEQ ID NO: 2772044 - DNA, 13 bp, Homo sapiens
ccttcaccagagc

SEQ ID NO: 2772045 - DNA, 20 bp, Homo sapiens
ccttcactccggtgtgcctg

SEQ ID NO: 2772046 - DNA, 20 bp, Homo sapiens
ccttcagtcttgaatttcta

SEQ ID NO: 2772047 - DNA, 21 bp, Homo sapiens
ccttcagtcttgaatttctaa

SEQ ID NO: 2772048 - DNA, 16 bp, Homo sapiens
ccttcagtgcccacca

SEQ ID NO: 2772049 - DNA, 12 bp, Homo sapiens
ccttcatttcct

SEQ ID NO: 2772050 - DNA, 13 bp, Homo sapiens
ccttcatttcctc

SEQ ID NO: 2772051 - DNA, 23 bp, Homo sapiens
ccttccagctagtgacccacatg

SEQ ID NO: 2772052 - DNA, 15 bp, Homo sapiens
ccttccataattatg

SEQ ID NO: 2772053 - DNA, 19 bp, Homo sapiens
ccttccatgtcgcctctgc

SEQ ID NO: 2772054 - DNA, 20 bp, Homo sapiens
ccttccatgtcgcctctgca

SEQ ID NO: 2772055 - DNA, 21 bp, Homo sapiens
ccttcccagctctccctctgg

SEQ ID NO: 2772056 - DNA, 19 bp, Homo sapiens
ccttccccagactcagctc

SEQ ID NO: 2772057 - DNA, 17 bp, Homo sapiens
ccttccccctcccaggg

SEQ ID NO: 2772058 - DNA, 18 bp, Homo sapiens
ccttccccttgcccaggg

SEQ ID NO: 2772059 - DNA, 13 bp, Homo sapiens
ccttccctgcttt

SEQ ID NO: 2772060 - DNA, 19 bp, Homo sapiens
ccttcctcctcctttgcct

SEQ ID NO: 2772061 - DNA, 23 bp, Homo sapiens
ccttcctgccccaactccttcca

SEQ ID NO: 2772062 - DNA, 16 bp, Homo sapiens
ccttcctggacagctg

SEQ ID NO: 2772063 - DNA, 22 bp, Homo sapiens
ccttcctggacagctgtgcctc

SEQ ID NO: 2772064 - DNA, 15 bp, Homo sapiens
ccttccttccctggc

SEQ ID NO: 2772065 - DNA, 14 bp, Homo sapiens
ccttcctttcctct

SEQ ID NO: 2772066 - DNA, 20 bp, Homo sapiens
ccttctcgcattttctctag

SEQ ID NO: 2772067 - DNA, 13 bp, Homo sapiens
ccttctctgttca

SEQ ID NO: 2772068 - DNA, 19 bp, Homo sapiens
ccttctctgttcatttcct

SEQ ID NO: 2772069 - DNA, 21 bp, Homo sapiens
ccttctctgttcatttcctca

SEQ ID NO: 2772070 - DNA, 20 bp, Homo sapiens
ccttctgggcagaccttgac

SEQ ID NO: 2772071 - DNA, 11 bp, Homo sapiens
cccggcacccc

SEQ ID NO: 2772072 - DNA, 13 bp, Homo sapiens
cccggcaccccct

SEQ ID NO: 2772073 - DNA, 14 bp, Homo sapiens
cccggcccagagac

SEQ ID NO: 2772074 - DNA, 15 bp, Homo sapiens
cccggcccctgctgg

SEQ ID NO: 2772075 - DNA, 17 bp, Homo sapiens
cccggcctgctcccagc

SEQ ID NO: 2772076 - DNA, 14 bp, Homo sapiens
cccggctccaggct

SEQ ID NO: 2772077 - DNA, 16 bp, Homo sapiens
cccggctccaggctcc

SEQ ID NO: 2772078 - DNA, 18 bp, Homo sapiens
cccggctccccctgcttc

SEQ ID NO: 2772079 - DNA, 19 bp, Homo sapiens
cccgggggcagacacctgt

SEQ ID NO: 2772080 - DNA, 23 bp, Homo sapiens
cccgggggcagacacctgtgcac

SEQ ID NO: 2772081 - DNA, 21 bp, Homo sapiens
cccgggtccccagctccccag

SEQ ID NO: 2772082 - DNA, 22 bp, Homo sapiens
cccggtcccttgagacctcagc

SEQ ID NO: 2772083 - DNA, 17 bp, Homo sapiens
cccggtcctggccccag

SEQ ID NO: 2772084 - DNA, 18 bp, Homo sapiens
cccgtcagccacacctgt

SEQ ID NO: 2772085 - DNA, 15 bp, Homo sapiens
cccgtgccaagtcca

SEQ ID NO: 2772086 - DNA, 22 bp, Homo sapiens
cccgtgccaagtccaggtcctg

SEQ ID NO: 2772087 - DNA, 13 bp, Homo sapiens
cccgtggtctttg

SEQ ID NO: 2772088 - DNA, 19 bp, Homo sapiens
cccgtggtctttgaataaa

SEQ ID NO: 2772089 - DNA, 19 bp, Homo sapiens
cccgttctgctggcctgga

SEQ ID NO: 2772090 - DNA, 14 bp, Homo sapiens
ccctaatcctccaa

SEQ ID NO: 2772091 - DNA, 12 bp, Homo sapiens
ccctatcaaaac

SEQ ID NO: 2772092 - DNA, 14 bp, Homo sapiens
ccctatccacccag

SEQ ID NO: 2772093 - DNA, 13 bp, Homo sapiens
ccctatgctccag

SEQ ID NO: 2772094 - DNA, 17 bp, Homo sapiens
ccctcaaaaaaagcctt

SEQ ID NO: 2772095 - DNA, 20 bp, Homo sapiens
ccctcaaatgacccaaagac

SEQ ID NO: 2772096 - DNA, 18 bp, Homo sapiens
ccctcactgaatgcctca

SEQ ID NO: 2772097 - DNA, 21 bp, Homo sapiens
ccctcagtgctcggcagtcat

SEQ ID NO: 2772098 - DNA, 15 bp, Homo sapiens
ccctcattcaggaaa

SEQ ID NO: 2772099 - DNA, 22 bp, Homo sapiens
ccctcattccaccttcccatgc

SEQ ID NO: 2772100 - DNA, 12 bp, Homo sapiens
ccctcattcccc

SEQ ID NO: 2772101 - DNA, 14 bp, Homo sapiens
ccctcattcccctc

SEQ ID NO: 2772102 - DNA, 23 bp, Homo sapiens
ccctccagctggaattgctgctc

SEQ ID NO: 2772103 - DNA, 14 bp, Homo sapiens
ccctccaggcatgc

SEQ ID NO: 2772104 - DNA, 22 bp, Homo sapiens
ccctcccaccatgcgctgctca

SEQ ID NO: 2772105 - DNA, 14 bp, Homo sapiens
ccctccccagggga

SEQ ID NO: 2772106 - DNA, 16 bp, Homo sapiens
ccctccccattcacag

SEQ ID NO: 2772107 - DNA, 18 bp, Homo sapiens
ccctccccattcacagag

SEQ ID NO: 2772108 - DNA, 21 bp, Homo sapiens
ccctccccattcacagagcct

SEQ ID NO: 2772109 - DNA, 18 bp, Homo sapiens
ccctccccattcagacac

SEQ ID NO: 2772110 - DNA, 15 bp, Homo sapiens
ccctcccccctgtaa

SEQ ID NO: 2772111 - DNA, 12 bp, Homo sapiens
ccctccctggcc

SEQ ID NO: 2772112 - DNA, 13 bp, Homo sapiens
ccctccgccttca

SEQ ID NO: 2772113 - DNA, 19 bp, Homo sapiens
ccctcctccccttcctgca

SEQ ID NO: 2772114 - DNA, 23 bp, Homo sapiens
ccctcgtggacacctgccctgcc

SEQ ID NO: 2772115 - DNA, 12 bp, Homo sapiens
ccctctcccagg

SEQ ID NO: 2772116 - DNA, 20 bp, Homo sapiens
ccctctcccaggccccatga

SEQ ID NO: 2772117 - DNA, 13 bp, Homo sapiens
ccctctcttccct

SEQ ID NO: 2772118 - DNA, 14 bp, Homo sapiens
ccctctcttcccta

SEQ ID NO: 2772119 - DNA, 15 bp, Homo sapiens
ccctctcttccctat

SEQ ID NO: 2772120 - DNA, 19 bp, Homo sapiens
ccctctgaatggtccaggg

SEQ ID NO: 2772121 - DNA, 20 bp, Homo sapiens
ccctctgctccccagtgcta

SEQ ID NO: 2772122 - DNA, 16 bp, Homo sapiens
ccctcttccttccccc

SEQ ID NO: 2772123 - DNA, 21 bp, Homo sapiens
ccctctttgcctgtgtgagca

SEQ ID NO: 2772124 - DNA, 18 bp, Homo sapiens
ccctgaaaacccagagag

SEQ ID NO: 2772125 - DNA, 16 bp, Homo sapiens
ccctgaacatctgtgt

SEQ ID NO: 2772126 - DNA, 18 bp, Homo sapiens
ccctgaacatctgtgtgt

SEQ ID NO: 2772127 - DNA, 16 bp, Homo sapiens
ccctgacccctgcacc

SEQ ID NO: 2772128 - DNA, 16 bp, Homo sapiens
ccctgacctcccagcc

SEQ ID NO: 2772129 - DNA, 22 bp, Homo sapiens
ccctgacctcccagccctatgg

SEQ ID NO: 2772130 - DNA, 17 bp, Homo sapiens
ccctgacctccctctaa

SEQ ID NO: 2772131 - DNA, 13 bp, Homo sapiens
ccctgactctctg

SEQ ID NO: 2772132 - DNA, 14 bp, Homo sapiens
ccctgactggtgct

SEQ ID NO: 2772133 - DNA, 15 bp, Homo sapiens
ccctgagcctgacct

SEQ ID NO: 2772134 - DNA, 18 bp, Homo sapiens
ccctgagcctgacctttc

SEQ ID NO: 2772135 - DNA, 12 bp, Homo sapiens
ccctgagctcgg

SEQ ID NO: 2772136 - DNA, 22 bp, Homo sapiens
ccctgagctcggtggacccagg

SEQ ID NO: 2772137 - DNA, 14 bp, Homo sapiens
ccctgaggagtctg

SEQ ID NO: 2772138 - DNA, 16 bp, Homo sapiens
ccctgaggagtctgag

SEQ ID NO: 2772139 - DNA, 16 bp, Homo sapiens
ccctgagtcaccagga

SEQ ID NO: 2772140 - DNA, 23 bp, Homo sapiens
ccctgcacaaagcccttccatgt

SEQ ID NO: 2772141 - DNA, 19 bp, Homo sapiens
ccctgcacagatatttcca

SEQ ID NO: 2772142 - DNA, 17 bp, Homo sapiens
ccctgcagaccctgccc

SEQ ID NO: 2772143 - DNA, 17 bp, Homo sapiens
ccctgcagagcacacag

SEQ ID NO: 2772144 - DNA, 19 bp, Homo sapiens
ccctgcagccaaacagagc

SEQ ID NO: 2772145 - DNA, 21 bp, Homo sapiens
ccctgcagccaaacagagcct

SEQ ID NO: 2772146 - DNA, 14 bp, Homo sapiens
ccctgccaccctgg

SEQ ID NO: 2772147 - DNA, 14 bp, Homo sapiens
ccctgccacctgtc

SEQ ID NO: 2772148 - DNA, 23 bp, Homo sapiens
ccctgccaggcccccgctggctc

SEQ ID NO: 2772149 - DNA, 17 bp, Homo sapiens
ccctgccctgtcctcca

SEQ ID NO: 2772150 - DNA, 18 bp, Homo sapiens
ccctgcctggaggacctg

SEQ ID NO: 2772151 - DNA, 23 bp, Homo sapiens
ccctgcctggaggacctgagcct

SEQ ID NO: 2772152 - DNA, 24 bp, Homo sapiens
ccctgcctggaggacctgagcctg

SEQ ID NO: 2772153 - DNA, 17 bp, Homo sapiens
ccctgcgaaggggccct

SEQ ID NO: 2772154 - DNA, 19 bp, Homo sapiens
ccctgcgaaggggccctgg

SEQ ID NO: 2772155 - DNA, 21 bp, Homo sapiens
ccctgcgaaggggccctggtc

SEQ ID NO: 2772156 - DNA, 19 bp, Homo sapiens
ccctgctgccgcctcccag

SEQ ID NO: 2772157 - DNA, 13 bp, Homo sapiens
cccaacccgtgga

SEQ ID NO: 2772158 - DNA, 18 bp, Homo sapiens
cccaacccgtggaggctg

SEQ ID NO: 2772159 - DNA, 21 bp, Homo sapiens
cccaacctgctctcctcttgc

SEQ ID NO: 2772160 - DNA, 15 bp, Homo sapiens
cccaacctttccctc

SEQ ID NO: 2772161 - DNA, 13 bp, Homo sapiens
cccaactcctgga

SEQ ID NO: 2772162 - DNA, 15 bp, Homo sapiens
cccaactcctggaag

SEQ ID NO: 2772163 - DNA, 17 bp, Homo sapiens
cccaagagatgaagagt

SEQ ID NO: 2772164 - DNA, 18 bp, Homo sapiens
cccaagagcatcatgcct

SEQ ID NO: 2772165 - DNA, 21 bp, Homo sapiens
cccaagagcatcatgcctctg

SEQ ID NO: 2772166 - DNA, 22 bp, Homo sapiens
cccaagagcatcatgcctctga

SEQ ID NO: 2772167 - DNA, 14 bp, Homo sapiens
cccaagctctgctc

SEQ ID NO: 2772168 - DNA, 14 bp, Homo sapiens
cccaaggaaagccc

SEQ ID NO: 2772169 - DNA, 22 bp, Homo sapiens
cccaaggaggaaaaacagacaa

SEQ ID NO: 2772170 - DNA, 17 bp, Homo sapiens
cccaaggctctgagcaa

SEQ ID NO: 2772171 - DNA, 19 bp, Homo sapiens
cccaagtagtagtgtcttc

SEQ ID NO: 2772172 - DNA, 15 bp, Homo sapiens
cccaagtgccagtct

SEQ ID NO: 2772173 - DNA, 14 bp, Homo sapiens
cccaagtgggggca

SEQ ID NO: 2772174 - DNA, 11 bp, Homo sapiens
cccaataaaag

SEQ ID NO: 2772175 - DNA, 14 bp, Homo sapiens
cccaataaaagtga

SEQ ID NO: 2772176 - DNA, 19 bp, Homo sapiens
cccaataaaagtgactctc

SEQ ID NO: 2772177 - DNA, 11 bp, Homo sapiens
cccaatattat

SEQ ID NO: 2772178 - DNA, 21 bp, Homo sapiens
cccaattcttacaaacatgtg

SEQ ID NO: 2772179 - DNA, 18 bp, Homo sapiens
cccacagcctctgcctgt

SEQ ID NO: 2772180 - DNA, 14 bp, Homo sapiens
cccacagctcccac

SEQ ID NO: 2772181 - DNA, 19 bp, Homo sapiens
cccacagctcccaccccac

SEQ ID NO: 2772182 - DNA, 18 bp, Homo sapiens
cccacagggaccaagaag

SEQ ID NO: 2772183 - DNA, 16 bp, Homo sapiens
cccacatcccaggctt

SEQ ID NO: 2772184 - DNA, 18 bp, Homo sapiens
cccacatccctgggcctg

SEQ ID NO: 2772185 - DNA, 21 bp, Homo sapiens
cccacatccctgggcctgctg

SEQ ID NO: 2772186 - DNA, 22 bp, Homo sapiens
cccacatccctgggcctgctgc

SEQ ID NO: 2772187 - DNA, 23 bp, Homo sapiens
cccacatccctgggcctgctgct

SEQ ID NO: 2772188 - DNA, 16 bp, Homo sapiens
cccacatgtgacacat

SEQ ID NO: 2772189 - DNA, 19 bp, Homo sapiens
cccacatgtgacacatatg

SEQ ID NO: 2772190 - DNA, 20 bp, Homo sapiens
cccaccacctaggccactcc

SEQ ID NO: 2772191 - DNA, 22 bp, Homo sapiens
cccaccacctaggccactcctc

SEQ ID NO: 2772192 - DNA, 19 bp, Homo sapiens
cccaccacgatgtggccct

SEQ ID NO: 2772193 - DNA, 20 bp, Homo sapiens
cccaccagcctaagaagctc

SEQ ID NO: 2772194 - DNA, 18 bp, Homo sapiens
cccaccatcatgtctggc

SEQ ID NO: 2772195 - DNA, 14 bp, Homo sapiens
cccacccacatgtg

SEQ ID NO: 2772196 - DNA, 15 bp, Homo sapiens
cccaccccaccccct

SEQ ID NO: 2772197 - DNA, 20 bp, Homo sapiens
cccaccctcgtggacacctg

SEQ ID NO: 2772198 - DNA, 18 bp, Homo sapiens
cccaccgggccactcctt

SEQ ID NO: 2772199 - DNA, 22 bp, Homo sapiens
cccaccgggccactccttcctg

SEQ ID NO: 2772200 - DNA, 12 bp, Homo sapiens
cccacctcagcc

SEQ ID NO: 2772201 - DNA, 21 bp, Homo sapiens
cccacctcagcctcccaaagt

SEQ ID NO: 2772202 - DNA, 16 bp, Homo sapiens
cccacctcatgcctgg

SEQ ID NO: 2772203 - DNA, 18 bp, Homo sapiens
cccacctcatgcctggcc

SEQ ID NO: 2772204 - DNA, 16 bp, Homo sapiens
cccacctccgccccag

SEQ ID NO: 2772205 - DNA, 21 bp, Homo sapiens
cccaccttcaattcctgggcc

SEQ ID NO: 2772206 - DNA, 15 bp, Homo sapiens
cccaccttccccaga

SEQ ID NO: 2772207 - DNA, 20 bp, Homo sapiens
cccaccttgccaagctttct

SEQ ID NO: 2772208 - DNA, 16 bp, Homo sapiens
cccaccttggctgcag

SEQ ID NO: 2772209 - DNA, 20 bp, Homo sapiens
cccaccttggctgcagggag

SEQ ID NO: 2772210 - DNA, 23 bp, Homo sapiens
cccactaaaacaaaacaaaaaac

SEQ ID NO: 2772211 - DNA, 23 bp, Homo sapiens
cccactaagtagaataaagaaaa

SEQ ID NO: 2772212 - DNA, 22 bp, Homo sapiens
cccactccctggctctcagaag

SEQ ID NO: 2772213 - DNA, 23 bp, Homo sapiens
cccactcctcactgccccaccag

SEQ ID NO: 2772214 - DNA, 14 bp, Homo sapiens
cccactctcattcc

SEQ ID NO: 2772215 - DNA, 15 bp, Homo sapiens
cccactgcaggcccc

SEQ ID NO: 2772216 - DNA, 23 bp, Homo sapiens
cccactgcaggccccgcttgtcc

SEQ ID NO: 2772217 - DNA, 21 bp, Homo sapiens
cccagaaataggacaattcac

SEQ ID NO: 2772218 - DNA, 13 bp, Homo sapiens
cccagaaggcagg

SEQ ID NO: 2772219 - DNA, 21 bp, Homo sapiens
cccagaattcccagctgtctg

SEQ ID NO: 2772220 - DNA, 19 bp, Homo sapiens
cccagacacaccccccagt

SEQ ID NO: 2772221 - DNA, 16 bp, Homo sapiens
cccagacactggtttg

SEQ ID NO: 2772222 - DNA, 21 bp, Homo sapiens
cccagaccttttatccactta

SEQ ID NO: 2772223 - DNA, 22 bp, Homo sapiens
cccagacttctctttcttattt

SEQ ID NO: 2772224 - DNA, 14 bp, Homo sapiens
cccagagacaggaa

SEQ ID NO: 2772225 - DNA, 17 bp, Homo sapiens
cccagagaccccttcct

SEQ ID NO: 2772226 - DNA, 21 bp, Homo sapiens
cccagagaggggacatttccc

SEQ ID NO: 2772227 - DNA, 22 bp, Homo sapiens
cccagagaggggacatttccct

SEQ ID NO: 2772228 - DNA, 21 bp, Homo sapiens
cccagagatgcctccaccgct

SEQ ID NO: 2772229 - DNA, 22 bp, Homo sapiens
cccagagcattacgtgagccag

SEQ ID NO: 2772230 - DNA, 23 bp, Homo sapiens
cccagagccttctcctgcctaca

SEQ ID NO: 2772231 - DNA, 13 bp, Homo sapiens
cccagagggccca

SEQ ID NO: 2772232 - DNA, 22 bp, Homo sapiens
ccctgctgccgcctcccagcct

SEQ ID NO: 2772233 - DNA, 22 bp, Homo sapiens
ccctggaccaccagccccagca

SEQ ID NO: 2772234 - DNA, 19 bp, Homo sapiens
ccctggagcggctctcctg

SEQ ID NO: 2772235 - DNA, 21 bp, Homo sapiens
ccctggagcggctctcctgag

SEQ ID NO: 2772236 - DNA, 15 bp, Homo sapiens
ccctggagtgcagtt

SEQ ID NO: 2772237 - DNA, 18 bp, Homo sapiens
ccctggatgtgcccacag

SEQ ID NO: 2772238 - DNA, 19 bp, Homo sapiens
ccctggatgtgcccacagg

SEQ ID NO: 2772239 - DNA, 22 bp, Homo sapiens
ccctggatgtgcccacagggac

SEQ ID NO: 2772240 - DNA, 21 bp, Homo sapiens
ccctggcctcacgcccagcct

SEQ ID NO: 2772241 - DNA, 19 bp, Homo sapiens
ccctggcttgtaactccac

SEQ ID NO: 2772242 - DNA, 23 bp, Homo sapiens
ccctggcttgtaactccaccaac

SEQ ID NO: 2772243 - DNA, 18 bp, Homo sapiens
ccctgggccccaccacct

SEQ ID NO: 2772244 - DNA, 16 bp, Homo sapiens
ccctgggcctgctgct

SEQ ID NO: 2772245 - DNA, 20 bp, Homo sapiens
ccctggggcctgtactgcct

SEQ ID NO: 2772246 - DNA, 22 bp, Homo sapiens
ccctggggcctgtactgcctgc

SEQ ID NO: 2772247 - DNA, 23 bp, Homo sapiens
ccctggggcctgtactgcctgct

SEQ ID NO: 2772248 - DNA, 19 bp, Homo sapiens
ccctggggcttctcctgac

SEQ ID NO: 2772249 - DNA, 21 bp, Homo sapiens
ccctggggcttctcctgaccc

SEQ ID NO: 2772250 - DNA, 17 bp, Homo sapiens
ccctgggggaagccctg

SEQ ID NO: 2772251 - DNA, 19 bp, Homo sapiens
ccctgggggaagccctgga

SEQ ID NO: 2772252 - DNA, 17 bp, Homo sapiens
ccctggtccttccaggc

SEQ ID NO: 2772253 - DNA, 15 bp, Homo sapiens
ccctggtctgccctg

SEQ ID NO: 2772254 - DNA, 16 bp, Homo sapiens
ccctggtctgccctgg

SEQ ID NO: 2772255 - DNA, 21 bp, Homo sapiens
ccctggtgcactggccccacc

SEQ ID NO: 2772256 - DNA, 15 bp, Homo sapiens
ccctggtgcagaggt

SEQ ID NO: 2772257 - DNA, 21 bp, Homo sapiens
ccctggtggacagtcctggga

SEQ ID NO: 2772258 - DNA, 23 bp, Homo sapiens
ccctggtggacagtcctgggaga

SEQ ID NO: 2772259 - DNA, 14 bp, Homo sapiens
ccctggtggcagtg

SEQ ID NO: 2772260 - DNA, 15 bp, Homo sapiens
ccctggtggcagtgg

SEQ ID NO: 2772261 - DNA, 19 bp, Homo sapiens
ccctggtggcagtgggagc

SEQ ID NO: 2772262 - DNA, 21 bp, Homo sapiens
ccctggtggcagtgggagctg

SEQ ID NO: 2772263 - DNA, 22 bp, Homo sapiens
ccctggtggcagtgggagctgc

SEQ ID NO: 2772264 - DNA, 19 bp, Homo sapiens
ccctggttatattctcacg

SEQ ID NO: 2772265 - DNA, 20 bp, Homo sapiens
ccctgtaaacacagtgctgc

SEQ ID NO: 2772266 - DNA, 18 bp, Homo sapiens
ccctgtacaatatttaaa

SEQ ID NO: 2772267 - DNA, 15 bp, Homo sapiens
ccctgtagagtcact

SEQ ID NO: 2772268 - DNA, 18 bp, Homo sapiens
ccctgtcctccagcttcc

SEQ ID NO: 2772269 - DNA, 16 bp, Homo sapiens
ccctgtcgagacactt

SEQ ID NO: 2772270 - DNA, 20 bp, Homo sapiens
ccctgtcgagacacttgcct

SEQ ID NO: 2772271 - DNA, 14 bp, Homo sapiens
ccctgttttatact

SEQ ID NO: 2772272 - DNA, 15 bp, Homo sapiens
cccttacacgtacct

SEQ ID NO: 2772273 - DNA, 16 bp, Homo sapiens
cccttacacgtacctc

SEQ ID NO: 2772274 - DNA, 22 bp, Homo sapiens
cccttactatgatctcaggagc

SEQ ID NO: 2772275 - DNA, 15 bp, Homo sapiens
cccttatccaggact

SEQ ID NO: 2772276 - DNA, 12 bp, Homo sapiens
cccttattttca

SEQ ID NO: 2772277 - DNA, 16 bp, Homo sapiens
cccttcacagtgtttc

SEQ ID NO: 2772278 - DNA, 16 bp, Homo sapiens
cccttcccactggagg

SEQ ID NO: 2772279 - DNA, 17 bp, Homo sapiens
cccttcctcctcctttg

SEQ ID NO: 2772280 - DNA, 13 bp, Homo sapiens
cccttcctgcacc

SEQ ID NO: 2772281 - DNA, 14 bp, Homo sapiens
cccttcctgcaccc

SEQ ID NO: 2772282 - DNA, 11 bp, Homo sapiens
cccttcctgga

SEQ ID NO: 2772283 - DNA, 14 bp, Homo sapiens
cccttcctggacag

SEQ ID NO: 2772284 - DNA, 20 bp, Homo sapiens
cccttcctggacagctgtgc

SEQ ID NO: 2772285 - DNA, 14 bp, Homo sapiens
cccttcctttcctc

SEQ ID NO: 2772286 - DNA, 19 bp, Homo sapiens
cccttcctttcctctgcag

SEQ ID NO: 2772287 - DNA, 13 bp, Homo sapiens
cccttcgctcctg

SEQ ID NO: 2772288 - DNA, 14 bp, Homo sapiens
cccttcgggagggc

SEQ ID NO: 2772289 - DNA, 19 bp, Homo sapiens
cccttctttaaatcaaaag

SEQ ID NO: 2772290 - DNA, 23 bp, Homo sapiens
cccttgacgtcaagtctccttcc

SEQ ID NO: 2772291 - DNA, 13 bp, Homo sapiens
cccttgccagaca

SEQ ID NO: 2772292 - DNA, 16 bp, Homo sapiens
cccttgccctgacctc

SEQ ID NO: 2772293 - DNA, 20 bp, Homo sapiens
cccttgccctgacctcccag

SEQ ID NO: 2772294 - DNA, 21 bp, Homo sapiens
cccttgccctgacctcccagc

SEQ ID NO: 2772295 - DNA, 17 bp, Homo sapiens
cccttgcccttgccctg

SEQ ID NO: 2772296 - DNA, 18 bp, Homo sapiens
cccttggcgggcagccca

SEQ ID NO: 2772297 - DNA, 22 bp, Homo sapiens
cccttggcgggcagcccagcct

SEQ ID NO: 2772298 - DNA, 23 bp, Homo sapiens
cccttggcgggcagcccagcctc

SEQ ID NO: 2772299 - DNA, 20 bp, Homo sapiens
cccttgtacctatggctgcc

SEQ ID NO: 2772300 - DNA, 12 bp, Homo sapiens
cccttgtgtgtg

SEQ ID NO: 2772301 - DNA, 13 bp, Homo sapiens
ccctttccagcca

SEQ ID NO: 2772302 - DNA, 13 bp, Homo sapiens
ccctttcctgcgg

SEQ ID NO: 2772303 - DNA, 21 bp, Homo sapiens
ccctttccttccttccctggc

SEQ ID NO: 2772304 - DNA, 14 bp, Homo sapiens
ccctttctggctct

SEQ ID NO: 2772305 - DNA, 24 bp, Homo sapiens
ccgaaacaggctactctcctcggc

SEQ ID NO: 2772306 - DNA, 21 bp, Homo sapiens
ccgaagctaacagggaaggca

SEQ ID NO: 2772307 - DNA, 15 bp, Homo sapiens
ccgaccacctgccca

SEQ ID NO: 2772308 - DNA, 17 bp, Homo sapiens
ccgaccagacaccttga

SEQ ID NO: 2772309 - DNA, 14 bp, Homo sapiens
ccgacctcagcctt

SEQ ID NO: 2772310 - DNA, 23 bp, Homo sapiens
ccgacctcgtcctccccctgcca

SEQ ID NO: 2772311 - DNA, 10 bp, Homo sapiens
ccgactcagg

SEQ ID NO: 2772312 - DNA, 11 bp, Homo sapiens
ccgactcaggg

SEQ ID NO: 2772313 - DNA, 15 bp, Homo sapiens
ccgactccagccagc

SEQ ID NO: 2772314 - DNA, 13 bp, Homo sapiens
ccgagagcctgct

SEQ ID NO: 2772315 - DNA, 14 bp, Homo sapiens
ccgagagcctgctc

SEQ ID NO: 2772316 - DNA, 22 bp, Homo sapiens
ccgagagtagccgagagcctgc

SEQ ID NO: 2772317 - DNA, 18 bp, Homo sapiens
ccgagatcacgccactgc

SEQ ID NO: 2772318 - DNA, 16 bp, Homo sapiens
ccgagcagctgagcag

SEQ ID NO: 2772319 - DNA, 21 bp, Homo sapiens
ccgagcagctgagcagggccg

SEQ ID NO: 2772320 - DNA, 19 bp, Homo sapiens
ccgagccgggcctggggct

SEQ ID NO: 2772321 - DNA, 18 bp, Homo sapiens
ccgagcgctttctggaaa

SEQ ID NO: 2772322 - DNA, 14 bp, Homo sapiens
ccacatctgtgtct

SEQ ID NO: 2772323 - DNA, 14 bp, Homo sapiens
ccacatcttgctct

SEQ ID NO: 2772324 - DNA, 19 bp, Homo sapiens
ccacatcttgctctgctga

SEQ ID NO: 2772325 - DNA, 20 bp, Homo sapiens
ccacatcttgctctgctgac

SEQ ID NO: 2772326 - DNA, 22 bp, Homo sapiens
ccacatcttgctctgctgacag

SEQ ID NO: 2772327 - DNA, 16 bp, Homo sapiens
ccacatgtgcacatgc

SEQ ID NO: 2772328 - DNA, 15 bp, Homo sapiens
ccaccaacatcccat

SEQ ID NO: 2772329 - DNA, 21 bp, Homo sapiens
ccaccaacccatcagaaggag

SEQ ID NO: 2772330 - DNA, 16 bp, Homo sapiens
ccaccacacccagccc

SEQ ID NO: 2772331 - DNA, 17 bp, Homo sapiens
ccaccacaccgcagaag

SEQ ID NO: 2772332 - DNA, 11 bp, Homo sapiens
ccaccacccaa

SEQ ID NO: 2772333 - DNA, 21 bp, Homo sapiens
ccaccacctaggccactcctc

SEQ ID NO: 2772334 - DNA, 20 bp, Homo sapiens
ccaccactaggactctgagg

SEQ ID NO: 2772335 - DNA, 15 bp, Homo sapiens
ccaccagatgagaag

SEQ ID NO: 2772336 - DNA, 18 bp, Homo sapiens
ccaccagatgagaagtta

SEQ ID NO: 2772337 - DNA, 12 bp, Homo sapiens
ccaccagcctaa

SEQ ID NO: 2772338 - DNA, 18 bp, Homo sapiens
ccaccatcatgtctggct

SEQ ID NO: 2772339 - DNA, 19 bp, Homo sapiens
ccaccatcatgtctggcta

SEQ ID NO: 2772340 - DNA, 15 bp, Homo sapiens
ccaccatcctgcagc

SEQ ID NO: 2772341 - DNA, 13 bp, Homo sapiens
ccaccattcacat

SEQ ID NO: 2772342 - DNA, 22 bp, Homo sapiens
ccagctctccctctggccctgc

SEQ ID NO: 2772343 - DNA, 23 bp, Homo sapiens
ccagctctccctctggccctgcc

SEQ ID NO: 2772344 - DNA, 14 bp, Homo sapiens
ccagctctggcttc

SEQ ID NO: 2772345 - DNA, 11 bp, Homo sapiens
ccagctcttgg

SEQ ID NO: 2772346 - DNA, 15 bp, Homo sapiens
ccagctgaggctggg

SEQ ID NO: 2772347 - DNA, 17 bp, Homo sapiens
ccagctgcacctgccag

SEQ ID NO: 2772348 - DNA, 18 bp, Homo sapiens
ccagctgcacctgccagc

SEQ ID NO: 2772349 - DNA, 12 bp, Homo sapiens
ccagctgcagat

SEQ ID NO: 2772350 - DNA, 10 bp, Homo sapiens
ccagctgcta

SEQ ID NO: 2772351 - DNA, 21 bp, Homo sapiens
ccagctgtgctctggacaggc

SEQ ID NO: 2772352 - DNA, 23 bp, Homo sapiens
ccagctgtgctctggacaggcat

SEQ ID NO: 2772353 - DNA, 23 bp, Homo sapiens
ccagcttcccctcgctgtcctgc

SEQ ID NO: 2772354 - DNA, 14 bp, Homo sapiens
ccagcttctccagg

SEQ ID NO: 2772355 - DNA, 14 bp, Homo sapiens
ccagcttgctcttc

SEQ ID NO: 2772356 - DNA, 16 bp, Homo sapiens
ccagcttgctcttcag

SEQ ID NO: 2772357 - DNA, 12 bp, Homo sapiens
ccagctttcctg

SEQ ID NO: 2772358 - DNA, 20 bp, Homo sapiens
ccagctttgctaccaaagca

SEQ ID NO: 2772359 - DNA, 14 bp, Homo sapiens
ccaggaactgggcc

SEQ ID NO: 2772360 - DNA, 21 bp, Homo sapiens
ccaggaagggggtccacccag

SEQ ID NO: 2772361 - DNA, 18 bp, Homo sapiens
ccaggaaggtagcccagc

SEQ ID NO: 2772362 - DNA, 23 bp, Homo sapiens
ccaggaaggtagcccagcactgt

SEQ ID NO: 2772363 - DNA, 23 bp, Homo sapiens
ccaggaatcggagcgaagcagag

SEQ ID NO: 2772364 - DNA, 19 bp, Homo sapiens
ccaggaatgcctcctccct

SEQ ID NO: 2772365 - DNA, 20 bp, Homo sapiens
ccaggaatgttaaagtcagt

SEQ ID NO: 2772366 - DNA, 17 bp, Homo sapiens
ccaggacaagcatggtc

SEQ ID NO: 2772367 - DNA, 14 bp, Homo sapiens
ccaggacaggacca

SEQ ID NO: 2772368 - DNA, 16 bp, Homo sapiens
ccaggacgaattgaga

SEQ ID NO: 2772369 - DNA, 23 bp, Homo sapiens
ccaggacgccactcatttcatct

SEQ ID NO: 2772370 - DNA, 17 bp, Homo sapiens
ccaggactccccaggcc

SEQ ID NO: 2772371 - DNA, 15 bp, Homo sapiens
ccaggagcaaatgtt

SEQ ID NO: 2772372 - DNA, 23 bp, Homo sapiens
ccaggagcaaatgtttctgcagt

SEQ ID NO: 2772373 - DNA, 16 bp, Homo sapiens
ccaggagccccgaggc

SEQ ID NO: 2772374 - DNA, 23 bp, Homo sapiens
ccaggagggacaaaggagcctgt

SEQ ID NO: 2772375 - DNA, 24 bp, Homo sapiens
ccaggagggacaaaggagcctgtg

SEQ ID NO: 2772376 - DNA, 18 bp, Homo sapiens
ccaggagtttgagaccag

SEQ ID NO: 2772377 - DNA, 17 bp, Homo sapiens
ccaggagtttgaggctg

SEQ ID NO: 2772378 - DNA, 22 bp, Homo sapiens
ccaggagtttgaggctgcagcg

SEQ ID NO: 2772379 - DNA, 17 bp, Homo sapiens
ccaggattgaagagcat

SEQ ID NO: 2772380 - DNA, 15 bp, Homo sapiens
ccaggattttgtgtt

SEQ ID NO: 2772381 - DNA, 17 bp, Homo sapiens
ccaggcaccaaaagaag

SEQ ID NO: 2772382 - DNA, 22 bp, Homo sapiens
ccaggcacccttctttcctctt

SEQ ID NO: 2772383 - DNA, 18 bp, Homo sapiens
ccaggcactgctgcccag

SEQ ID NO: 2772384 - DNA, 13 bp, Homo sapiens
ccaggcagagaca

SEQ ID NO: 2772385 - DNA, 17 bp, Homo sapiens
ccaggcaggccctgcct

SEQ ID NO: 2772386 - DNA, 18 bp, Homo sapiens
ccaggcaggggtgggaga

SEQ ID NO: 2772387 - DNA, 12 bp, Homo sapiens
ccaggcaggtct

SEQ ID NO: 2772388 - DNA, 12 bp, Homo sapiens
ccaggcatgctg

SEQ ID NO: 2772389 - DNA, 21 bp, Homo sapiens
ccaggccagagggagtgacag

SEQ ID NO: 2772390 - DNA, 18 bp, Homo sapiens
ccaggccaggccaccagg

SEQ ID NO: 2772391 - DNA, 21 bp, Homo sapiens
ccaggccccatgacctccagc

SEQ ID NO: 2772392 - DNA, 22 bp, Homo sapiens
ccaggccccatgacctccagct

SEQ ID NO: 2772393 - DNA, 23 bp, Homo sapiens
ccaggccccatgacctccagctt

SEQ ID NO: 2772394 - DNA, 13 bp, Homo sapiens
ccaggcccctgcc

SEQ ID NO: 2772395 - DNA, 14 bp, Homo sapiens
ccaggcccctgcca

SEQ ID NO: 2772396 - DNA, 15 bp, Homo sapiens
ccaggcccctgccac

SEQ ID NO: 2772397 - DNA, 16 bp, Homo sapiens
ccaggcccggggctgg

SEQ ID NO: 2772398 - DNA, 21 bp, Homo sapiens
ccaggctgagtgagccacaga

SEQ ID NO: 2772399 - DNA, 23 bp, Homo sapiens
ccaggctgagtgagccacagacc

SEQ ID NO: 2772400 - DNA, 19 bp, Homo sapiens
ccaggctggcgtgcagtgg

SEQ ID NO: 2772401 - DNA, 19 bp, Homo sapiens
ccaggctggtctcaaactc

SEQ ID NO: 2772402 - DNA, 23 bp, Homo sapiens
ccaggcttgtcactagcagctgc

SEQ ID NO: 2772403 - DNA, 17 bp, Homo sapiens
ccagggcacaggagcta

SEQ ID NO: 2772404 - DNA, 15 bp, Homo sapiens
ccagggcatcccatg

SEQ ID NO: 2772405 - DNA, 22 bp, Homo sapiens
ccagggccacgtgccaggcccg

SEQ ID NO: 2772406 - DNA, 21 bp, Homo sapiens
ccagggcccaaagcccagctc

SEQ ID NO: 2772407 - DNA, 16 bp, Homo sapiens
ccagggcccccacagg

SEQ ID NO: 2772408 - DNA, 17 bp, Homo sapiens
ccagggcccccacaggc

SEQ ID NO: 2772409 - DNA, 14 bp, Homo sapiens
ccagggccctgcag

SEQ ID NO: 2772410 - DNA, 20 bp, Homo sapiens
ccagggcgggagtgggggct

SEQ ID NO: 2772411 - DNA, 19 bp, Homo sapiens
ccagggctgcccctgtagg

SEQ ID NO: 2772412 - DNA, 18 bp, Homo sapiens
ccaggggagagggtctgg

SEQ ID NO: 2772413 - DNA, 21 bp, Homo sapiens
ccaggggagagggtctggaga

SEQ ID NO: 2772414 - DNA, 19 bp, Homo sapiens
ccaggggcccacagggaac

SEQ ID NO: 2772415 - DNA, 15 bp, Homo sapiens
ccaggggctccacct

SEQ ID NO: 2772416 - DNA, 16 bp, Homo sapiens
ccaggggctccacctg

SEQ ID NO: 2772417 - DNA, 19 bp, Homo sapiens
ccaggggtgatttcagaga

SEQ ID NO: 2772418 - DNA, 20 bp, Homo sapiens
ccaggggtgatttcagagag

SEQ ID NO: 2772419 - DNA, 14 bp, Homo sapiens
ccagggtgagagct

SEQ ID NO: 2772420 - DNA, 15 bp, Homo sapiens
ccaggtatctccagg

SEQ ID NO: 2772421 - DNA, 22 bp, Homo sapiens
ccaggtcctctgatacccagag

SEQ ID NO: 2772422 - DNA, 18 bp, Homo sapiens
ccaggtctctccactgct

SEQ ID NO: 2772423 - DNA, 14 bp, Homo sapiens
ccaggtgcagtggc

SEQ ID NO: 2772424 - DNA, 15 bp, Homo sapiens
ccaggttatgcctca

SEQ ID NO: 2772425 - DNA, 16 bp, Homo sapiens
ccaggtttctatgtgt

SEQ ID NO: 2772426 - DNA, 15 bp, Homo sapiens
ccagtaactcatctg

SEQ ID NO: 2772427 - DNA, 17 bp, Homo sapiens
ccagtccccgtgccccg

SEQ ID NO: 2772428 - DNA, 12 bp, Homo sapiens
ccagtccctggg

SEQ ID NO: 2772429 - DNA, 23 bp, Homo sapiens
ccagtccctgggggaagccctgg

SEQ ID NO: 2772430 - DNA, 16 bp, Homo sapiens
ccagtcgagccctgca

SEQ ID NO: 2772431 - DNA, 18 bp, Homo sapiens
ccagtctgggctgccggg

SEQ ID NO: 2772432 - DNA, 14 bp, Homo sapiens
catttaattcataa

SEQ ID NO: 2772433 - DNA, 24 bp, Homo sapiens
catttaattcataattagaacaat

SEQ ID NO: 2772434 - DNA, 21 bp, Homo sapiens
catttactttgtgttcacctt

SEQ ID NO: 2772435 - DNA, 15 bp, Homo sapiens
catttataaatgtgt

SEQ ID NO: 2772436 - DNA, 14 bp, Homo sapiens
catttataatgttt

SEQ ID NO: 2772437 - DNA, 17 bp, Homo sapiens
catttataatgtttgct

SEQ ID NO: 2772438 - DNA, 21 bp, Homo sapiens
catttataatgtttgctattg

SEQ ID NO: 2772439 - DNA, 14 bp, Homo sapiens
catttatatatata

SEQ ID NO: 2772440 - DNA, 22 bp, Homo sapiens
catttatctaaaagaatttaaa

SEQ ID NO: 2772441 - DNA, 16 bp, Homo sapiens
catttattctgctcac

SEQ ID NO: 2772442 - DNA, 15 bp, Homo sapiens
catttcatctcattt

SEQ ID NO: 2772443 - DNA, 13 bp, Homo sapiens
catttccgtgaag

SEQ ID NO: 2772444 - DNA, 12 bp, Homo sapiens
catttcctgggt

SEQ ID NO: 2772445 - DNA, 21 bp, Homo sapiens
catttcctgggtggctactct

SEQ ID NO: 2772446 - DNA, 22 bp, Homo sapiens
catttcctgggtggctactctg

SEQ ID NO: 2772447 - DNA, 16 bp, Homo sapiens
catttccttggaggcc

SEQ ID NO: 2772448 - DNA, 17 bp, Homo sapiens
catttcgcccctcattt

SEQ ID NO: 2772449 - DNA, 13 bp, Homo sapiens
catttctatttat

SEQ ID NO: 2772450 - DNA, 22 bp, Homo sapiens
catttctcagtcggtgtgtaat

SEQ ID NO: 2772451 - DNA, 19 bp, Homo sapiens
catttctctttgagagagt

SEQ ID NO: 2772452 - DNA, 19 bp, Homo sapiens
catttctggcttctagtct

SEQ ID NO: 2772453 - DNA, 14 bp, Homo sapiens
catttctgtctctc

SEQ ID NO: 2772454 - DNA, 13 bp, Homo sapiens
catttcttcctca

SEQ ID NO: 2772455 - DNA, 14 bp, Homo sapiens
catttcttcctcac

SEQ ID NO: 2772456 - DNA, 19 bp, Homo sapiens
catttgataaactaaaagc

SEQ ID NO: 2772457 - DNA, 16 bp, Homo sapiens
catttgatgctaaata

SEQ ID NO: 2772458 - DNA, 16 bp, Homo sapiens
catttgatgtacatgt

SEQ ID NO: 2772459 - DNA, 16 bp, Homo sapiens
catttgctttttcacc

SEQ ID NO: 2772460 - DNA, 18 bp, Homo sapiens
catttgtaatgtatctta

SEQ ID NO: 2772461 - DNA, 21 bp, Homo sapiens
catttgtaatgtatcttattt

SEQ ID NO: 2772462 - DNA, 12 bp, Homo sapiens
catttgtacatt

SEQ ID NO: 2772463 - DNA, 17 bp, Homo sapiens
catttgtacattcctga

SEQ ID NO: 2772464 - DNA, 18 bp, Homo sapiens
catttgtacattcctgat

SEQ ID NO: 2772465 - DNA, 16 bp, Homo sapiens
cattttaacatctgag

SEQ ID NO: 2772466 - DNA, 14 bp, Homo sapiens
cattttacgtcttt

SEQ ID NO: 2772467 - DNA, 12 bp, Homo sapiens
cattttactact

SEQ ID NO: 2772468 - DNA, 15 bp, Homo sapiens
cattttactacttgt

SEQ ID NO: 2772469 - DNA, 12 bp, Homo sapiens
cattttcagagt

SEQ ID NO: 2772470 - DNA, 13 bp, Homo sapiens
cattttcagagtg

SEQ ID NO: 2772471 - DNA, 14 bp, Homo sapiens
cattttcagagtga

SEQ ID NO: 2772472 - DNA, 12 bp, Homo sapiens
cattttcccaga

SEQ ID NO: 2772473 - DNA, 22 bp, Homo sapiens
cattttcttcagagagctaaat

SEQ ID NO: 2772474 - DNA, 16 bp, Homo sapiens
cattttgcagcagtga

SEQ ID NO: 2772475 - DNA, 14 bp, Homo sapiens
cattttggtacttt

SEQ ID NO: 2772476 - DNA, 18 bp, Homo sapiens
catttttagtagagacag

SEQ ID NO: 2772477 - DNA, 18 bp, Homo sapiens
catttttttccttgcaaa

SEQ ID NO: 2772478 - DNA, 22 bp, Homo sapiens
ccaaaacctcatgacagccaga

SEQ ID NO: 2772479 - DNA, 16 bp, Homo sapiens
ccaaaagtacttaccc

SEQ ID NO: 2772480 - DNA, 22 bp, Homo sapiens
ccaaaagtcaaaaggtgcctgt

SEQ ID NO: 2772481 - DNA, 15 bp, Homo sapiens
ccaaacctgacagat

SEQ ID NO: 2772482 - DNA, 13 bp, Homo sapiens
ccaaactctgcca

SEQ ID NO: 2772483 - DNA, 22 bp, Homo sapiens
ccaaagaaaaagggctgccggg

SEQ ID NO: 2772484 - DNA, 13 bp, Homo sapiens
ccaaagagaaaag

SEQ ID NO: 2772485 - DNA, 12 bp, Homo sapiens
ccaaagagcctg

SEQ ID NO: 2772486 - DNA, 22 bp, Homo sapiens
ccaaagagcctggagaagctga

SEQ ID NO: 2772487 - DNA, 19 bp, Homo sapiens
ccaaagccaaagctaggcc

SEQ ID NO: 2772488 - DNA, 15 bp, Homo sapiens
ccaaagctaggcctg

SEQ ID NO: 2772489 - DNA, 16 bp, Homo sapiens
ccaaagctaggcctgg

SEQ ID NO: 2772490 - DNA, 16 bp, Homo sapiens
ccaaagtcttaaaata

SEQ ID NO: 2772491 - DNA, 15 bp, Homo sapiens
ccaaataaatgtgta

SEQ ID NO: 2772492 - DNA, 16 bp, Homo sapiens
ccaaatgaatgacctt

SEQ ID NO: 2772493 - DNA, 17 bp, Homo sapiens
ccaaatgtccaatataa

SEQ ID NO: 2772494 - DNA, 19 bp, Homo sapiens
ccaaatttatatgccaccg

SEQ ID NO: 2772495 - DNA, 20 bp, Homo sapiens
ccaacaccctgtctaaaaaa

SEQ ID NO: 2772496 - DNA, 17 bp, Homo sapiens
ccaacatcccattgccc

SEQ ID NO: 2772497 - DNA, 15 bp, Homo sapiens
ccaacatggagaaac

SEQ ID NO: 2772498 - DNA, 22 bp, Homo sapiens
ccaacatggagaaaccctgtct

SEQ ID NO: 2772499 - DNA, 23 bp, Homo sapiens
ccaaccccagggcccccacaggc

SEQ ID NO: 2772500 - DNA, 18 bp, Homo sapiens
ccaaccccccacctgcca

SEQ ID NO: 2772501 - DNA, 21 bp, Homo sapiens
atacaaaataatttaactaat

SEQ ID NO: 2772502 - DNA, 18 bp, Homo sapiens
tcgtggacacctgccctg

SEQ ID NO: 2772503 - DNA, 10 bp, Homo sapiens
tcgtggagag

SEQ ID NO: 2772504 - DNA, 14 bp, Homo sapiens
actccagcctgggc

SEQ ID NO: 2772505 - DNA, 23 bp, Homo sapiens
actccagcctgggcaacagagca

SEQ ID NO: 2772506 - DNA, 15 bp, Homo sapiens
actccagcctgggcg

SEQ ID NO: 2772507 - DNA, 18 bp, Homo sapiens
actccagcctgggcgaca

SEQ ID NO: 2772508 - DNA, 12 bp, Homo sapiens
actccagctccc

SEQ ID NO: 2772509 - DNA, 18 bp, Homo sapiens
actccagtggtgaagaaa

SEQ ID NO: 2772510 - DNA, 21 bp, Homo sapiens
actccatacataacttgatat

SEQ ID NO: 2772511 - DNA, 19 bp, Homo sapiens
actccatctcaaaaaataa

SEQ ID NO: 2772512 - DNA, 21 bp, Homo sapiens
actccattactaaagacagaa

SEQ ID NO: 2772513 - DNA, 16 bp, Homo sapiens
actccggtgtgcctgc

SEQ ID NO: 2772514 - DNA, 19 bp, Homo sapiens
actccggtgtgcctgcagc

SEQ ID NO: 2772515 - DNA, 15 bp, Homo sapiens
actcctacctcagcc

SEQ ID NO: 2772516 - DNA, 17 bp, Homo sapiens
actcctacctcagccta

SEQ ID NO: 2772517 - DNA, 20 bp, Homo sapiens
actcctcaaaagcaaatgag

SEQ ID NO: 2772518 - DNA, 20 bp, Homo sapiens
actcctcactgccccaccag

SEQ ID NO: 2772519 - DNA, 12 bp, Homo sapiens
actcctctgtct

SEQ ID NO: 2772520 - DNA, 17 bp, Homo sapiens
actcctctgtctctgct

SEQ ID NO: 2772521 - DNA, 13 bp, Homo sapiens
actcctgcaaaat

SEQ ID NO: 2772522 - DNA, 16 bp, Homo sapiens
actcctgttacttacc

SEQ ID NO: 2772523 - DNA, 12 bp, Homo sapiens
actccttagaga

SEQ ID NO: 2772524 - DNA, 20 bp, Homo sapiens
actccttcaacaattctaaa

SEQ ID NO: 2772525 - DNA, 11 bp, Homo sapiens
actccttcctg

SEQ ID NO: 2772526 - DNA, 12 bp, Homo sapiens
actccttcctgc

SEQ ID NO: 2772527 - DNA, 14 bp, Homo sapiens
actccttcctgccc

SEQ ID NO: 2772528 - DNA, 23 bp, Homo sapiens
actccttgattttagccttctct

SEQ ID NO: 2772529 - DNA, 19 bp, Homo sapiens
actccttgtggtttatgtc

SEQ ID NO: 2772530 - DNA, 14 bp, Homo sapiens
actcgtatatgtct

SEQ ID NO: 2772531 - DNA, 14 bp, Homo sapiens
actcgttttttaca

SEQ ID NO: 2772532 - DNA, 20 bp, Homo sapiens
actctaattcccattttgca

SEQ ID NO: 2772533 - DNA, 17 bp, Homo sapiens
actctacccatattaca

SEQ ID NO: 2772534 - DNA, 17 bp, Homo sapiens
actctagaacatgcaca

SEQ ID NO: 2772535 - DNA, 18 bp, Homo sapiens
actctagaacatgcacat

SEQ ID NO: 2772536 - DNA, 15 bp, Homo sapiens
actctatagactcta

SEQ ID NO: 2772537 - DNA, 18 bp, Homo sapiens
actctatagactctagga

SEQ ID NO: 2772538 - DNA, 14 bp, Homo sapiens
actctatagacttt

SEQ ID NO: 2772539 - DNA, 18 bp, Homo sapiens
actctcaggatcaagaaa

SEQ ID NO: 2772540 - DNA, 22 bp, Homo sapiens
actctcaggatcaagaaagtgt

SEQ ID NO: 2772541 - DNA, 16 bp, Homo sapiens
actctcccctccctct

SEQ ID NO: 2772542 - DNA, 17 bp, Homo sapiens
actctcccctccctctt

SEQ ID NO: 2772543 - DNA, 19 bp, Homo sapiens
actctcccctccctcttcc

SEQ ID NO: 2772544 - DNA, 22 bp, Homo sapiens
actctcctcggccccctccatc

SEQ ID NO: 2772545 - DNA, 20 bp, Homo sapiens
actctctccaccctatatgt

SEQ ID NO: 2772546 - DNA, 21 bp, Homo sapiens
actctgaggctctttctgggc

SEQ ID NO: 2772547 - DNA, 23 bp, Homo sapiens
actctgaggctctttctgggcca

SEQ ID NO: 2772548 - DNA, 19 bp, Homo sapiens
actctgcacatgtcttgta

SEQ ID NO: 2772549 - DNA, 13 bp, Homo sapiens
actctgctctgat

SEQ ID NO: 2772550 - DNA, 16 bp, Homo sapiens
actctgctctgatgca

SEQ ID NO: 2772551 - DNA, 19 bp, Homo sapiens
actctgggaaataagagag

SEQ ID NO: 2772552 - DNA, 19 bp, Homo sapiens
actctgtcgcccagtctgg

SEQ ID NO: 2772553 - DNA, 19 bp, Homo sapiens
actctgtctcaaaaaaaca

SEQ ID NO: 2772554 - DNA, 11 bp, Homo sapiens
actctgtgcca

SEQ ID NO: 2772555 - DNA, 16 bp, Homo sapiens
actctgtgccagagcc

SEQ ID NO: 2772556 - DNA, 19 bp, Homo sapiens
actctgtgccagagcctgg

SEQ ID NO: 2772557 - DNA, 17 bp, Homo sapiens
actctgtggggccttgg

SEQ ID NO: 2772558 - DNA, 19 bp, Homo sapiens
actctgtgtcaggtggggc

SEQ ID NO: 2772559 - DNA, 19 bp, Homo sapiens
actcttattgcccacgctg

SEQ ID NO: 2772560 - DNA, 21 bp, Homo sapiens
actcttatttggtataaaggg

SEQ ID NO: 2772561 - DNA, 15 bp, Homo sapiens
actcttcctgcaagg

SEQ ID NO: 2772562 - DNA, 23 bp, Homo sapiens
actcttctgagcacctacttaca

SEQ ID NO: 2772563 - DNA, 16 bp, Homo sapiens
actcttgacctcaggt

SEQ ID NO: 2772564 - DNA, 15 bp, Homo sapiens
actgaaaactgtaaa

SEQ ID NO: 2772565 - DNA, 19 bp, Homo sapiens
actgaaaactgtaaataca

SEQ ID NO: 2772566 - DNA, 20 bp, Homo sapiens
actgaaaactgtaaatacaa

SEQ ID NO: 2772567 - DNA, 14 bp, Homo sapiens
actgaaagtggttt

SEQ ID NO: 2772568 - DNA, 18 bp, Homo sapiens
actgaagccagaaataaa

SEQ ID NO: 2772569 - DNA, 14 bp, Homo sapiens
actgaaggagaagg

SEQ ID NO: 2772570 - DNA, 17 bp, Homo sapiens
actgaattgtccccagt

SEQ ID NO: 2772571 - DNA, 20 bp, Homo sapiens
actgacacctcactgaggaa

SEQ ID NO: 2772572 - DNA, 22 bp, Homo sapiens
actgacattgttggccaaagcc

SEQ ID NO: 2772573 - DNA, 15 bp, Homo sapiens
actgaccagcctcca

SEQ ID NO: 2772574 - DNA, 24 bp, Homo sapiens
actgaccctggagcggctctcctg

SEQ ID NO: 2772575 - DNA, 22 bp, Homo sapiens
actgagcaagatcttgtctcca

SEQ ID NO: 2772576 - DNA, 14 bp, Homo sapiens
actgagccttgtaa

SEQ ID NO: 2772577 - DNA, 20 bp, Homo sapiens
actgaggaattttctttgtg

SEQ ID NO: 2772578 - DNA, 13 bp, Homo sapiens
actgaggcagaca

SEQ ID NO: 2772579 - DNA, 22 bp, Homo sapiens
actgaggcagacagcagctcag

SEQ ID NO: 2772580 - DNA, 20 bp, Homo sapiens
actgaggcatttttactact

SEQ ID NO: 2772581 - DNA, 16 bp, Homo sapiens
actgaggccttctcaa

SEQ ID NO: 2772582 - DNA, 12 bp, Homo sapiens
actgagtgactc

SEQ ID NO: 2772583 - DNA, 17 bp, Homo sapiens
actgatgacaaacccag

SEQ ID NO: 2772584 - DNA, 20 bp, Homo sapiens
actgattcacatctcatttt

SEQ ID NO: 2772585 - DNA, 15 bp, Homo sapiens
actgcaaaggcgcag

SEQ ID NO: 2772586 - DNA, 14 bp, Homo sapiens
actgcaacctccgc

SEQ ID NO: 2772587 - DNA, 16 bp, Homo sapiens
actgcaacctccgcct

SEQ ID NO: 2772588 - DNA, 14 bp, Homo sapiens
actgcaccgggcca

SEQ ID NO: 2772589 - DNA, 21 bp, Homo sapiens
actgcagaatacagtaagctg

SEQ ID NO: 2772590 - DNA, 17 bp, Homo sapiens
actgcatctcaaaaaaa

SEQ ID NO: 2772591 - DNA, 15 bp, Homo sapiens
actaaatgagctcct

SEQ ID NO: 2772592 - DNA, 13 bp, Homo sapiens
acctgtttatata

SEQ ID NO: 2772593 - DNA, 19 bp, Homo sapiens
acctgtttttaagctgttt

SEQ ID NO: 2772594 - DNA, 19 bp, Homo sapiens
accttacttaaagcttgtt

SEQ ID NO: 2772595 - DNA, 19 bp, Homo sapiens
accttagcagctcttcccc

SEQ ID NO: 2772596 - DNA, 13 bp, Homo sapiens
accttatgtatta

SEQ ID NO: 2772597 - DNA, 15 bp, Homo sapiens
accttatgtattatt

SEQ ID NO: 2772598 - DNA, 17 bp, Homo sapiens
accttatgtattatttt

SEQ ID NO: 2772599 - DNA, 19 bp, Homo sapiens
accttcaataaagtatcta

SEQ ID NO: 2772600 - DNA, 18 bp, Homo sapiens
accttcccagctctccct

SEQ ID NO: 2772601 - DNA, 14 bp, Homo sapiens
accttccccagact

SEQ ID NO: 2772602 - DNA, 14 bp, Homo sapiens
accttctccaaatg

SEQ ID NO: 2772603 - DNA, 21 bp, Homo sapiens
accttgccaagctttcttcta

SEQ ID NO: 2772604 - DNA, 18 bp, Homo sapiens
accttgcgaccatgtgta

SEQ ID NO: 2772605 - DNA, 14 bp, Homo sapiens
accttggctcaagt

SEQ ID NO: 2772606 - DNA, 12 bp, Homo sapiens
accttggctgca

SEQ ID NO: 2772607 - DNA, 17 bp, Homo sapiens
accttggctgcagggag

SEQ ID NO: 2772608 - DNA, 21 bp, Homo sapiens
accttgtcatgtaccatcaat

SEQ ID NO: 2772609 - DNA, 22 bp, Homo sapiens
accttgtcatgtaccatcaata

SEQ ID NO: 2772610 - DNA, 15 bp, Homo sapiens
accttgtgtctgtac

SEQ ID NO: 2772611 - DNA, 21 bp, Homo sapiens
accttgtgtctgtacacgtgt

SEQ ID NO: 2772612 - DNA, 15 bp, Homo sapiens
acctttatggtttct

SEQ ID NO: 2772613 - DNA, 21 bp, Homo sapiens
acctttattaatgaactgtga

SEQ ID NO: 2772614 - DNA, 18 bp, Homo sapiens
acctttattgtgatctat

SEQ ID NO: 2772615 - DNA, 15 bp, Homo sapiens
acctttcccatgctg

SEQ ID NO: 2772616 - DNA, 18 bp, Homo sapiens
acctttcccatgctgaat

SEQ ID NO: 2772617 - DNA, 14 bp, Homo sapiens
acctttccctcacc

SEQ ID NO: 2772618 - DNA, 22 bp, Homo sapiens
acctttccctcaccccctccca

SEQ ID NO: 2772619 - DNA, 13 bp, Homo sapiens
acgaacaggggcc

SEQ ID NO: 2772620 - DNA, 14 bp, Homo sapiens
acgaacaggggcca

SEQ ID NO: 2772621 - DNA, 17 bp, Homo sapiens
acgaacccctcccctcc

SEQ ID NO: 2772622 - DNA, 22 bp, Homo sapiens
acgagggatgggatttcatgta

SEQ ID NO: 2772623 - DNA, 16 bp, Homo sapiens
acgatgtggccctggc

SEQ ID NO: 2772624 - DNA, 16 bp, Homo sapiens
acgccactcatttcat

SEQ ID NO: 2772625 - DNA, 21 bp, Homo sapiens
acgccactcatttcatctcat

SEQ ID NO: 2772626 - DNA, 20 bp, Homo sapiens
acgccactgcactccagcct

SEQ ID NO: 2772627 - DNA, 22 bp, Homo sapiens
acgccactgcactccagcctgg

SEQ ID NO: 2772628 - DNA, 18 bp, Homo sapiens
acgcccagctgaggctgg

SEQ ID NO: 2772629 - DNA, 17 bp, Homo sapiens
acgcctgagcccaggga

SEQ ID NO: 2772630 - DNA, 12 bp, Homo sapiens
acgcctgcccag

SEQ ID NO: 2772631 - DNA, 14 bp, Homo sapiens
acgcctgcccagcc

SEQ ID NO: 2772632 - DNA, 17 bp, Homo sapiens
acgcctgcttgtccctg

SEQ ID NO: 2772633 - DNA, 21 bp, Homo sapiens
acgcctgcttgtccctgccca

SEQ ID NO: 2772634 - DNA, 21 bp, Homo sapiens
acgcctgtaatcccagcactt

SEQ ID NO: 2772635 - DNA, 20 bp, Homo sapiens
acgctctctgtctggctgta

SEQ ID NO: 2772636 - DNA, 23 bp, Homo sapiens
acgctggaccttgaactgggtac

SEQ ID NO: 2772637 - DNA, 16 bp, Homo sapiens
acgctggagtgcagtg

SEQ ID NO: 2772638 - DNA, 14 bp, Homo sapiens
acggagatgtttca

SEQ ID NO: 2772639 - DNA, 19 bp, Homo sapiens
acggagtcccaccttggct

SEQ ID NO: 2772640 - DNA, 21 bp, Homo sapiens
acggagtcccaccttggctgc

SEQ ID NO: 2772641 - DNA, 23 bp, Homo sapiens
acggagtcccaccttggctgcag

SEQ ID NO: 2772642 - DNA, 19 bp, Homo sapiens
acggcacctgggccctggg

SEQ ID NO: 2772643 - DNA, 23 bp, Homo sapiens
acggcacctgggccctggggcct

SEQ ID NO: 2772644 - DNA, 22 bp, Homo sapiens
acggcatgtgaattctgtgaag

SEQ ID NO: 2772645 - DNA, 23 bp, Homo sapiens
acggcatgtgaattctgtgaaga

SEQ ID NO: 2772646 - DNA, 16 bp, Homo sapiens
acggccaggccagagg

SEQ ID NO: 2772647 - DNA, 20 bp, Homo sapiens
acgggctcagcagccagagg

SEQ ID NO: 2772648 - DNA, 12 bp, Homo sapiens
acggggagaaaa

SEQ ID NO: 2772649 - DNA, 14 bp, Homo sapiens
acggggtccttcaa

SEQ ID NO: 2772650 - DNA, 16 bp, Homo sapiens
acggtttcaaaccagg

SEQ ID NO: 2772651 - DNA, 23 bp, Homo sapiens
acgtacttaactgtgtgaagaaa

SEQ ID NO: 2772652 - DNA, 23 bp, Homo sapiens
acgtatgtcggcacgtcccatgt

SEQ ID NO: 2772653 - DNA, 17 bp, Homo sapiens
acgtcaaacatgaagtg

SEQ ID NO: 2772654 - DNA, 13 bp, Homo sapiens
acgtcatctcagg

SEQ ID NO: 2772655 - DNA, 17 bp, Homo sapiens
acgtcatctcagggtcc

SEQ ID NO: 2772656 - DNA, 13 bp, Homo sapiens
acgtcctggaatg

SEQ ID NO: 2772657 - DNA, 22 bp, Homo sapiens
acgtcctggaatgaagcatgta

SEQ ID NO: 2772658 - DNA, 18 bp, Homo sapiens
acgtctggtgttctcaat

SEQ ID NO: 2772659 - DNA, 19 bp, Homo sapiens
acgtgaaagatgcaagcac

SEQ ID NO: 2772660 - DNA, 20 bp, Homo sapiens
acgtgcacctgtactcagga

SEQ ID NO: 2772661 - DNA, 13 bp, Homo sapiens
acgtgccaggccc

SEQ ID NO: 2772662 - DNA, 18 bp, Homo sapiens
acgtgtactacaatttaa

SEQ ID NO: 2772663 - DNA, 17 bp, Homo sapiens
acgtgtctttagaactc

SEQ ID NO: 2772664 - DNA, 22 bp, Homo sapiens
acgttaagtccaaggagaagaa

SEQ ID NO: 2772665 - DNA, 16 bp, Homo sapiens
acgttccttactgcag

SEQ ID NO: 2772666 - DNA, 23 bp, Homo sapiens
acgtttaagccaaaacaatgttt

SEQ ID NO: 2772667 - DNA, 15 bp, Homo sapiens
acgtttcctgagaag

SEQ ID NO: 2772668 - DNA, 18 bp, Homo sapiens
acgtttggcatttctctt

SEQ ID NO: 2772669 - DNA, 14 bp, Homo sapiens
actaaaaagtggct

SEQ ID NO: 2772670 - DNA, 12 bp, Homo sapiens
actaaaaataca

SEQ ID NO: 2772671 - DNA, 11 bp, Homo sapiens
actaaaagaat

SEQ ID NO: 2772672 - DNA, 19 bp, Homo sapiens
actaaagcagtgttttcac

SEQ ID NO: 2772673 - DNA, 13 bp, Homo sapiens
actaaatctttta

SEQ ID NO: 2772674 - DNA, 14 bp, Homo sapiens
actaaatgagctcc

SEQ ID NO: 2772675 - DNA, 20 bp, Homo sapiens
accccccagtcgagccctgc

SEQ ID NO: 2772676 - DNA, 15 bp, Homo sapiens
acccccgtggtcttt

SEQ ID NO: 2772677 - DNA, 15 bp, Homo sapiens
accccctcattcccc

SEQ ID NO: 2772678 - DNA, 16 bp, Homo sapiens
accccctcattcccct

SEQ ID NO: 2772679 - DNA, 18 bp, Homo sapiens
accccctcattcccctcg

SEQ ID NO: 2772680 - DNA, 16 bp, Homo sapiens
accccctcattgttta

SEQ ID NO: 2772681 - DNA, 16 bp, Homo sapiens
accccctcccaccccc

SEQ ID NO: 2772682 - DNA, 17 bp, Homo sapiens
accccctcccaccccca

SEQ ID NO: 2772683 - DNA, 12 bp, Homo sapiens
accccctcccca

SEQ ID NO: 2772684 - DNA, 12 bp, Homo sapiens
accccctgcagc

SEQ ID NO: 2772685 - DNA, 13 bp, Homo sapiens
accccctgcagct

SEQ ID NO: 2772686 - DNA, 16 bp, Homo sapiens
acccccttcagtgccc

SEQ ID NO: 2772687 - DNA, 22 bp, Homo sapiens
accccgtctggggttcagcccc

SEQ ID NO: 2772688 - DNA, 14 bp, Homo sapiens
acccctcagtgctc

SEQ ID NO: 2772689 - DNA, 20 bp, Homo sapiens
acccctcagtgctcggcagt

SEQ ID NO: 2772690 - DNA, 16 bp, Homo sapiens
acccctccatgtgggc

SEQ ID NO: 2772691 - DNA, 12 bp, Homo sapiens
acccctccccat

SEQ ID NO: 2772692 - DNA, 15 bp, Homo sapiens
acccctccccattca

SEQ ID NO: 2772693 - DNA, 22 bp, Homo sapiens
acccctccccattcacagagcc

SEQ ID NO: 2772694 - DNA, 14 bp, Homo sapiens
accccttcctgtcc

SEQ ID NO: 2772695 - DNA, 22 bp, Homo sapiens
accccttcctttcctctgcagc

SEQ ID NO: 2772696 - DNA, 24 bp, Homo sapiens
accccttcctttcctctgcagcac

SEQ ID NO: 2772697 - DNA, 14 bp, Homo sapiens
acccgaggctgccc

SEQ ID NO: 2772698 - DNA, 15 bp, Homo sapiens
acccgaggctgccca

SEQ ID NO: 2772699 - DNA, 19 bp, Homo sapiens
acccggcaccccctgcagc

SEQ ID NO: 2772700 - DNA, 22 bp, Homo sapiens
acccggcaccccctgcagcttg

SEQ ID NO: 2772701 - DNA, 15 bp, Homo sapiens
acccggcccctgctg

SEQ ID NO: 2772702 - DNA, 22 bp, Homo sapiens
acccggcccctgctggttcagg

SEQ ID NO: 2772703 - DNA, 15 bp, Homo sapiens
acccgtacccccgtg

SEQ ID NO: 2772704 - DNA, 22 bp, Homo sapiens
acccgtacccccgtggtctttg

SEQ ID NO: 2772705 - DNA, 18 bp, Homo sapiens
acccgtgccaagtccagg

SEQ ID NO: 2772706 - DNA, 23 bp, Homo sapiens
acccgtgccaagtccaggtcctg

SEQ ID NO: 2772707 - DNA, 20 bp, Homo sapiens
acccgttctgctggcctgga

SEQ ID NO: 2772708 - DNA, 15 bp, Homo sapiens
accctaccccaccac

SEQ ID NO: 2772709 - DNA, 13 bp, Homo sapiens
accctacctgtgc

SEQ ID NO: 2772710 - DNA, 17 bp, Homo sapiens
accctatatgtagtata

SEQ ID NO: 2772711 - DNA, 16 bp, Homo sapiens
accctcataccatctg

SEQ ID NO: 2772712 - DNA, 23 bp, Homo sapiens
accctcataccatctgctgcccc

SEQ ID NO: 2772713 - DNA, 21 bp, Homo sapiens
accctcccaccatgcgctgct

SEQ ID NO: 2772714 - DNA, 10 bp, Homo sapiens
accctccccc

SEQ ID NO: 2772715 - DNA, 23 bp, Homo sapiens
accctcccccaggaggtcgaccc

SEQ ID NO: 2772716 - DNA, 15 bp, Homo sapiens
accctccgccttcac

SEQ ID NO: 2772717 - DNA, 21 bp, Homo sapiens
accctcctttcaccacatgtg

SEQ ID NO: 2772718 - DNA, 17 bp, Homo sapiens
accctcgtggacacctg

SEQ ID NO: 2772719 - DNA, 20 bp, Homo sapiens
accctcgtggacacctgccc

SEQ ID NO: 2772720 - DNA, 22 bp, Homo sapiens
accctcgtggacacctgccctg

SEQ ID NO: 2772721 - DNA, 23 bp, Homo sapiens
accctcgtggacacctgccctgc

SEQ ID NO: 2772722 - DNA, 19 bp, Homo sapiens
accctctgaatggtccagg

SEQ ID NO: 2772723 - DNA, 13 bp, Homo sapiens
accctgaggagtc

SEQ ID NO: 2772724 - DNA, 19 bp, Homo sapiens
accctgcagagcacacagg

SEQ ID NO: 2772725 - DNA, 19 bp, Homo sapiens
accctggagcggctctcct

SEQ ID NO: 2772726 - DNA, 16 bp, Homo sapiens
accctgttttatactg

SEQ ID NO: 2772727 - DNA, 21 bp, Homo sapiens
acccttcacataccctccccc

SEQ ID NO: 2772728 - DNA, 16 bp, Homo sapiens
acccttctttaaatca

SEQ ID NO: 2772729 - DNA, 17 bp, Homo sapiens
acccttctttaaatcaa

SEQ ID NO: 2772730 - DNA, 23 bp, Homo sapiens
acccttctttaaatcaaaagctg

SEQ ID NO: 2772731 - DNA, 18 bp, Homo sapiens
acccttctttcctcttcc

SEQ ID NO: 2772732 - DNA, 14 bp, Homo sapiens
acccttgcattaga

SEQ ID NO: 2772733 - DNA, 15 bp, Homo sapiens
acccttgcattagaa

SEQ ID NO: 2772734 - DNA, 18 bp, Homo sapiens
accctttccttccttccc

SEQ ID NO: 2772735 - DNA, 22 bp, Homo sapiens
accctttccttccttccctggc

SEQ ID NO: 2772736 - DNA, 13 bp, Homo sapiens
acccttttaacat

SEQ ID NO: 2772737 - DNA, 13 bp, Homo sapiens
accgcagcatgtg

SEQ ID NO: 2772738 - DNA, 14 bp, Homo sapiens
accgcagcatgtgg

SEQ ID NO: 2772739 - DNA, 18 bp, Homo sapiens
accgcgtctaccctggga

SEQ ID NO: 2772740 - DNA, 15 bp, Homo sapiens
accgctaaaagaaac

SEQ ID NO: 2772741 - DNA, 17 bp, Homo sapiens
accgctacaccactctg

SEQ ID NO: 2772742 - DNA, 21 bp, Homo sapiens
accgctacaccactctggcag

SEQ ID NO: 2772743 - DNA, 23 bp, Homo sapiens
accggagctttcaaagaaggaat

SEQ ID NO: 2772744 - DNA, 12 bp, Homo sapiens
accggcagaaaa

SEQ ID NO: 2772745 - DNA, 16 bp, Homo sapiens
accgggacagacctgg

SEQ ID NO: 2772746 - DNA, 14 bp, Homo sapiens
accgggcactcaga

SEQ ID NO: 2772747 - DNA, 20 bp, Homo sapiens
accgggcactcagaagacac

SEQ ID NO: 2772748 - DNA, 21 bp, Homo sapiens
accgggccactccttcctgcc

SEQ ID NO: 2772749 - DNA, 12 bp, Homo sapiens
accgtaatttta

SEQ ID NO: 2772750 - DNA, 16 bp, Homo sapiens
accgtaattttattat

SEQ ID NO: 2772751 - DNA, 14 bp, Homo sapiens
accgtctacagatg

SEQ ID NO: 2772752 - DNA, 12 bp, Homo sapiens
acaggagggaga

SEQ ID NO: 2772753 - DNA, 20 bp, Homo sapiens
acaggagggggtcgtggaga

SEQ ID NO: 2772754 - DNA, 23 bp, Homo sapiens
acaggagggggtcgtggagagct

SEQ ID NO: 2772755 - DNA, 15 bp, Homo sapiens
acaggatcagtctga

SEQ ID NO: 2772756 - DNA, 19 bp, Homo sapiens
acaggcaaaatccttgctt

SEQ ID NO: 2772757 - DNA, 22 bp, Homo sapiens
acaggcaactgaggcagacagc

SEQ ID NO: 2772758 - DNA, 12 bp, Homo sapiens
acaggcaagcac

SEQ ID NO: 2772759 - DNA, 18 bp, Homo sapiens
acaggcaatgctggctgt

SEQ ID NO: 2772760 - DNA, 19 bp, Homo sapiens
acaggcaatgctggctgtt

SEQ ID NO: 2772761 - DNA, 23 bp, Homo sapiens
acaggcacccaccatcatgtctg

SEQ ID NO: 2772762 - DNA, 15 bp, Homo sapiens
acaggcagatacagg

SEQ ID NO: 2772763 - DNA, 16 bp, Homo sapiens
acaggcaggtccaggg

SEQ ID NO: 2772764 - DNA, 18 bp, Homo sapiens
acaggcatctacacagcc

SEQ ID NO: 2772765 - DNA, 22 bp, Homo sapiens
acaggcatgttctctgaggaca

SEQ ID NO: 2772766 - DNA, 20 bp, Homo sapiens
acaggccccccgcagcaccc

SEQ ID NO: 2772767 - DNA, 21 bp, Homo sapiens
acaggccccccgcagcaccct

SEQ ID NO: 2772768 - DNA, 24 bp, Homo sapiens
acaggccccccgcagcaccctgca

SEQ ID NO: 2772769 - DNA, 20 bp, Homo sapiens
acaggcctgtgtagctgtga

SEQ ID NO: 2772770 - DNA, 23 bp, Homo sapiens
acaggcctgtgtagctgtgacct

SEQ ID NO: 2772771 - DNA, 22 bp, Homo sapiens
acaggctgggcttcagtggcag

SEQ ID NO: 2772772 - DNA, 12 bp, Homo sapiens
acagggaaggca

SEQ ID NO: 2772773 - DNA, 21 bp, Homo sapiens
acagggaaggcaggcagggct

SEQ ID NO: 2772774 - DNA, 22 bp, Homo sapiens
acagggaaggcaggcagggctc

SEQ ID NO: 2772775 - DNA, 23 bp, Homo sapiens
acagggaaggcaggcagggctct

SEQ ID NO: 2772776 - DNA, 22 bp, Homo sapiens
acagggcacaccgggcactcag

SEQ ID NO: 2772777 - DNA, 14 bp, Homo sapiens
acagggccagatgt

SEQ ID NO: 2772778 - DNA, 19 bp, Homo sapiens
acagggttttgccatgttg

SEQ ID NO: 2772779 - DNA, 15 bp, Homo sapiens
acaggtacagcaaca

SEQ ID NO: 2772780 - DNA, 18 bp, Homo sapiens
acaggtctcctcttaaaa

SEQ ID NO: 2772781 - DNA, 16 bp, Homo sapiens
acaggtggcaggacca

SEQ ID NO: 2772782 - DNA, 21 bp, Homo sapiens
acaggtggcaggaccaggact

SEQ ID NO: 2772783 - DNA, 13 bp, Homo sapiens
acaggtgtaaata

SEQ ID NO: 2772784 - DNA, 16 bp, Homo sapiens
acaggtgtaaatatag

SEQ ID NO: 2772785 - DNA, 17 bp, Homo sapiens
acagtaaagtttaaaaa

SEQ ID NO: 2772786 - DNA, 19 bp, Homo sapiens
acagtaaagtttaaaaaat

SEQ ID NO: 2772787 - DNA, 22 bp, Homo sapiens
acagtagcagggaattgatcca

SEQ ID NO: 2772788 - DNA, 20 bp, Homo sapiens
acagtagcttaaataaattc

SEQ ID NO: 2772789 - DNA, 21 bp, Homo sapiens
acagtagcttaaataaattca

SEQ ID NO: 2772790 - DNA, 15 bp, Homo sapiens
acagtattacttctg

SEQ ID NO: 2772791 - DNA, 17 bp, Homo sapiens
acagtcaaaacagagat

SEQ ID NO: 2772792 - DNA, 12 bp, Homo sapiens
acagtgagcctg

SEQ ID NO: 2772793 - DNA, 17 bp, Homo sapiens
acagtgagcctgaattt

SEQ ID NO: 2772794 - DNA, 21 bp, Homo sapiens
acagtgatctccatatgttac

SEQ ID NO: 2772795 - DNA, 22 bp, Homo sapiens
acagtgatctccatatgttaca

SEQ ID NO: 2772796 - DNA, 15 bp, Homo sapiens
acagtgctctaggct

SEQ ID NO: 2772797 - DNA, 13 bp, Homo sapiens
acagtgctgttct

SEQ ID NO: 2772798 - DNA, 16 bp, Homo sapiens
acagtgctgttctgga

SEQ ID NO: 2772799 - DNA, 20 bp, Homo sapiens
acagtgcttcagcctgaggc

SEQ ID NO: 2772800 - DNA, 16 bp, Homo sapiens
acagtggaactacatt

SEQ ID NO: 2772801 - DNA, 18 bp, Homo sapiens
acagtggaactacattag

SEQ ID NO: 2772802 - DNA, 14 bp, Homo sapiens
acagtggagaaata

SEQ ID NO: 2772803 - DNA, 23 bp, Homo sapiens
acagtgtctgtatcggagacagt

SEQ ID NO: 2772804 - DNA, 24 bp, Homo sapiens
acagtgtctgtatcggagacagtg

SEQ ID NO: 2772805 - DNA, 16 bp, Homo sapiens
acagtgttattttctt

SEQ ID NO: 2772806 - DNA, 18 bp, Homo sapiens
acagtgtttcccataatt

SEQ ID NO: 2772807 - DNA, 18 bp, Homo sapiens
acagttactcttcagttt

SEQ ID NO: 2772808 - DNA, 15 bp, Homo sapiens
acagttatctaagtt

SEQ ID NO: 2772809 - DNA, 17 bp, Homo sapiens
acagttcaaagaagtca

SEQ ID NO: 2772810 - DNA, 12 bp, Homo sapiens
acagttcctcgc

SEQ ID NO: 2772811 - DNA, 15 bp, Homo sapiens
acagttgctgtcata

SEQ ID NO: 2772812 - DNA, 21 bp, Homo sapiens
acagttgctgtcataagaatg

SEQ ID NO: 2772813 - DNA, 19 bp, Homo sapiens
acataaaaatgatctaaac

SEQ ID NO: 2772814 - DNA, 13 bp, Homo sapiens
acataaaatatac

SEQ ID NO: 2772815 - DNA, 13 bp, Homo sapiens
acataaattagag

SEQ ID NO: 2772816 - DNA, 15 bp, Homo sapiens
acataagccattatt

SEQ ID NO: 2772817 - DNA, 21 bp, Homo sapiens
accagtgtagccttgcccgga

SEQ ID NO: 2772818 - DNA, 20 bp, Homo sapiens
accagttgggagcactggag

SEQ ID NO: 2772819 - DNA, 21 bp, Homo sapiens
accagttgggagcactggagt

SEQ ID NO: 2772820 - DNA, 13 bp, Homo sapiens
accataatgttac

SEQ ID NO: 2772821 - DNA, 19 bp, Homo sapiens
accatattcagtgctgtgg

SEQ ID NO: 2772822 - DNA, 20 bp, Homo sapiens
accatcagttactggtttca

SEQ ID NO: 2772823 - DNA, 13 bp, Homo sapiens
accatcctattta

SEQ ID NO: 2772824 - DNA, 13 bp, Homo sapiens
accatctgctgcc

SEQ ID NO: 2772825 - DNA, 22 bp, Homo sapiens
accatctgtcttgccagccaga

SEQ ID NO: 2772826 - DNA, 23 bp, Homo sapiens
accatctgtcttgccagccagaa

SEQ ID NO: 2772827 - DNA, 16 bp, Homo sapiens
accatgcaaatgctat

SEQ ID NO: 2772828 - DNA, 21 bp, Homo sapiens
accatgcagcttcatcaattt

SEQ ID NO: 2772829 - DNA, 21 bp, Homo sapiens
accatgtgtagattgcgtgga

SEQ ID NO: 2772830 - DNA, 19 bp, Homo sapiens
accattacaactagatcaa

SEQ ID NO: 2772831 - DNA, 18 bp, Homo sapiens
accattatgaagaagaga

SEQ ID NO: 2772832 - DNA, 15 bp, Homo sapiens
accatttaattcata

SEQ ID NO: 2772833 - DNA, 11 bp, Homo sapiens
accatttcaga

SEQ ID NO: 2772834 - DNA, 20 bp, Homo sapiens
accatttcagagaggccttt

SEQ ID NO: 2772835 - DNA, 18 bp, Homo sapiens
acccaaagaccaatattc

SEQ ID NO: 2772836 - DNA, 15 bp, Homo sapiens
acccaaataaatgtg

SEQ ID NO: 2772837 - DNA, 15 bp, Homo sapiens
acccaagcaaggcca

SEQ ID NO: 2772838 - DNA, 14 bp, Homo sapiens
acccaatttaattc

SEQ ID NO: 2772839 - DNA, 12 bp, Homo sapiens
acccacagcctc

SEQ ID NO: 2772840 - DNA, 19 bp, Homo sapiens
acccacagcctctgcctgt

SEQ ID NO: 2772841 - DNA, 21 bp, Homo sapiens
acccaccagcctaagaagctc

SEQ ID NO: 2772842 - DNA, 21 bp, Homo sapiens
acccaccccctctttgtgtac

SEQ ID NO: 2772843 - DNA, 15 bp, Homo sapiens
acccaccctcctttc

SEQ ID NO: 2772844 - DNA, 14 bp, Homo sapiens
acccaccgggccac

SEQ ID NO: 2772845 - DNA, 16 bp, Homo sapiens
acccaccgggccactc

SEQ ID NO: 2772846 - DNA, 22 bp, Homo sapiens
acccaccgggccactccttcct

SEQ ID NO: 2772847 - DNA, 16 bp, Homo sapiens
acccacctcagcctcc

SEQ ID NO: 2772848 - DNA, 17 bp, Homo sapiens
acccacctgctgagaga

SEQ ID NO: 2772849 - DNA, 19 bp, Homo sapiens
acccactcctcactgcccc

SEQ ID NO: 2772850 - DNA, 11 bp, Homo sapiens
acccactgctc

SEQ ID NO: 2772851 - DNA, 15 bp, Homo sapiens
acccactgctctggt

SEQ ID NO: 2772852 - DNA, 20 bp, Homo sapiens
acccactgcttttggtctgt

SEQ ID NO: 2772853 - DNA, 14 bp, Homo sapiens
acccagagaatata

SEQ ID NO: 2772854 - DNA, 17 bp, Homo sapiens
acccagagaggaatcag

SEQ ID NO: 2772855 - DNA, 23 bp, Homo sapiens
acccagagccttctcctgcctac

SEQ ID NO: 2772856 - DNA, 15 bp, Homo sapiens
acccagatctcatgg

SEQ ID NO: 2772857 - DNA, 17 bp, Homo sapiens
acccagcccacttctgc

SEQ ID NO: 2772858 - DNA, 22 bp, Homo sapiens
acccagcccattctctctcctg

SEQ ID NO: 2772859 - DNA, 23 bp, Homo sapiens
acccagcccattctctctcctgt

SEQ ID NO: 2772860 - DNA, 16 bp, Homo sapiens
acccagccccttgaga

SEQ ID NO: 2772861 - DNA, 17 bp, Homo sapiens
acccagccccttgagaa

SEQ ID NO: 2772862 - DNA, 20 bp, Homo sapiens
acccagccccttgagaaacc

SEQ ID NO: 2772863 - DNA, 17 bp, Homo sapiens
acccagcgagccctggt

SEQ ID NO: 2772864 - DNA, 19 bp, Homo sapiens
acccagcgagccctggtgg

SEQ ID NO: 2772865 - DNA, 23 bp, Homo sapiens
acccagcgagccctggtggcagt

SEQ ID NO: 2772866 - DNA, 17 bp, Homo sapiens
acccaggacaagcatgg

SEQ ID NO: 2772867 - DNA, 23 bp, Homo sapiens
acccaggagatggaagttgcagt

SEQ ID NO: 2772868 - DNA, 20 bp, Homo sapiens
acccaggaggtggaggttgc

SEQ ID NO: 2772869 - DNA, 16 bp, Homo sapiens
acccaggagtttgtgt

SEQ ID NO: 2772870 - DNA, 18 bp, Homo sapiens
acccagtaactcatctgt

SEQ ID NO: 2772871 - DNA, 17 bp, Homo sapiens
acccagtccccgtgccc

SEQ ID NO: 2772872 - DNA, 13 bp, Homo sapiens
acccagtccctgg

SEQ ID NO: 2772873 - DNA, 14 bp, Homo sapiens
acccagtgtaaaga

SEQ ID NO: 2772874 - DNA, 22 bp, Homo sapiens
acccatagatcttctgaaatga

SEQ ID NO: 2772875 - DNA, 16 bp, Homo sapiens
acccatagcttccatg

SEQ ID NO: 2772876 - DNA, 16 bp, Homo sapiens
acccatatatcttatg

SEQ ID NO: 2772877 - DNA, 18 bp, Homo sapiens
acccatcagaaggagaag

SEQ ID NO: 2772878 - DNA, 20 bp, Homo sapiens
acccatgaggcaatgtcagg

SEQ ID NO: 2772879 - DNA, 14 bp, Homo sapiens
acccatgtgccaag

SEQ ID NO: 2772880 - DNA, 17 bp, Homo sapiens
acccatgtgccaaggtg

SEQ ID NO: 2772881 - DNA, 14 bp, Homo sapiens
accccaaagagcct

SEQ ID NO: 2772882 - DNA, 21 bp, Homo sapiens
accccaaagagcctggagaag

SEQ ID NO: 2772883 - DNA, 16 bp, Homo sapiens
accccaaagccccttg

SEQ ID NO: 2772884 - DNA, 22 bp, Homo sapiens
accccaccttgccaagctttct

SEQ ID NO: 2772885 - DNA, 13 bp, Homo sapiens
accccagagtgtg

SEQ ID NO: 2772886 - DNA, 13 bp, Homo sapiens
accccagcatcct

SEQ ID NO: 2772887 - DNA, 13 bp, Homo sapiens
accccagcggctg

SEQ ID NO: 2772888 - DNA, 11 bp, Homo sapiens
accccagggca

SEQ ID NO: 2772889 - DNA, 12 bp, Homo sapiens
accccagggcac

SEQ ID NO: 2772890 - DNA, 18 bp, Homo sapiens
accccagggcacaggagc

SEQ ID NO: 2772891 - DNA, 19 bp, Homo sapiens
accccagggcacaggagct

SEQ ID NO: 2772892 - DNA, 19 bp, Homo sapiens
actgcccaggcctgcctgt

SEQ ID NO: 2772893 - DNA, 15 bp, Homo sapiens
actgccccaactcct

SEQ ID NO: 2772894 - DNA, 18 bp, Homo sapiens
actgccccaactcctgga

SEQ ID NO: 2772895 - DNA, 21 bp, Homo sapiens
actgccccaactcctggaagc

SEQ ID NO: 2772896 - DNA, 15 bp, Homo sapiens
actgccccaccagcc

SEQ ID NO: 2772897 - DNA, 17 bp, Homo sapiens
actgccccaccagccac

SEQ ID NO: 2772898 - DNA, 22 bp, Homo sapiens
actgccccaccagccacctctt

SEQ ID NO: 2772899 - DNA, 14 bp, Homo sapiens
actgcctcttcctc

SEQ ID NO: 2772900 - DNA, 15 bp, Homo sapiens
actgcctcttcctcc

SEQ ID NO: 2772901 - DNA, 12 bp, Homo sapiens
actgccttccag

SEQ ID NO: 2772902 - DNA, 15 bp, Homo sapiens
actgcgtagagcctg

SEQ ID NO: 2772903 - DNA, 22 bp, Homo sapiens
actgctaggcgagtgccaggac

SEQ ID NO: 2772904 - DNA, 23 bp, Homo sapiens
actgctaggcgagtgccaggact

SEQ ID NO: 2772905 - DNA, 19 bp, Homo sapiens
actgctcatcattccttga

SEQ ID NO: 2772906 - DNA, 23 bp, Homo sapiens
actgctcatcattccttgagaaa

SEQ ID NO: 2772907 - DNA, 16 bp, Homo sapiens
actgctctcagcctcc

SEQ ID NO: 2772908 - DNA, 20 bp, Homo sapiens
actgctctcagcctcccaac

SEQ ID NO: 2772909 - DNA, 19 bp, Homo sapiens
actgctgcaaagtgcaaat

SEQ ID NO: 2772910 - DNA, 16 bp, Homo sapiens
actgctgcccagcctc

SEQ ID NO: 2772911 - DNA, 21 bp, Homo sapiens
actgctgcccagcctccaagc

SEQ ID NO: 2772912 - DNA, 13 bp, Homo sapiens
actgctgtcattg

SEQ ID NO: 2772913 - DNA, 15 bp, Homo sapiens
actgctgtcattgtc

SEQ ID NO: 2772914 - DNA, 16 bp, Homo sapiens
actgctgtcattgtcc

SEQ ID NO: 2772915 - DNA, 17 bp, Homo sapiens
actgctgtgtccgcttt

SEQ ID NO: 2772916 - DNA, 16 bp, Homo sapiens
actggaaccagggaga

SEQ ID NO: 2772917 - DNA, 14 bp, Homo sapiens
actggaagcacagc

SEQ ID NO: 2772918 - DNA, 19 bp, Homo sapiens
actggaagcacagcttcat

SEQ ID NO: 2772919 - DNA, 19 bp, Homo sapiens
actggaagcatgtaggaga

SEQ ID NO: 2772920 - DNA, 12 bp, Homo sapiens
actggacagctt

SEQ ID NO: 2772921 - DNA, 17 bp, Homo sapiens
actggacgcccagctga

SEQ ID NO: 2772922 - DNA, 22 bp, Homo sapiens
actggacgcccagctgaggctg

SEQ ID NO: 2772923 - DNA, 15 bp, Homo sapiens
actggagcaccaggc

SEQ ID NO: 2772924 - DNA, 16 bp, Homo sapiens
actggagcaccaggca

SEQ ID NO: 2772925 - DNA, 19 bp, Homo sapiens
actggagcaccaggcacga

SEQ ID NO: 2772926 - DNA, 13 bp, Homo sapiens
actggagcatctg

SEQ ID NO: 2772927 - DNA, 13 bp, Homo sapiens
actggagcccagg

SEQ ID NO: 2772928 - DNA, 14 bp, Homo sapiens
actggagcccagga

SEQ ID NO: 2772929 - DNA, 16 bp, Homo sapiens
actggagcccaggagt

SEQ ID NO: 2772930 - DNA, 14 bp, Homo sapiens
actggaggtcacat

SEQ ID NO: 2772931 - DNA, 21 bp, Homo sapiens
actggaggtcacattcaggaa

SEQ ID NO: 2772932 - DNA, 16 bp, Homo sapiens
actggagtagttgcta

SEQ ID NO: 2772933 - DNA, 14 bp, Homo sapiens
actggatatgttgt

SEQ ID NO: 2772934 - DNA, 17 bp, Homo sapiens
actggcacgtttgtgag

SEQ ID NO: 2772935 - DNA, 20 bp, Homo sapiens
actggcacgtttgtgagaag

SEQ ID NO: 2772936 - DNA, 14 bp, Homo sapiens
actggccaagctga

SEQ ID NO: 2772937 - DNA, 19 bp, Homo sapiens
actggccaagctgaggtgc

SEQ ID NO: 2772938 - DNA, 11 bp, Homo sapiens
actgggaaggc

SEQ ID NO: 2772939 - DNA, 12 bp, Homo sapiens
actgggaaggct

SEQ ID NO: 2772940 - DNA, 17 bp, Homo sapiens
actgggaaggctacttc

SEQ ID NO: 2772941 - DNA, 13 bp, Homo sapiens
actgggcaatgat

SEQ ID NO: 2772942 - DNA, 21 bp, Homo sapiens
actggggagttataaaaatac

SEQ ID NO: 2772943 - DNA, 13 bp, Homo sapiens
actgggggagggg

SEQ ID NO: 2772944 - DNA, 14 bp, Homo sapiens
actgggtaatgaaa

SEQ ID NO: 2772945 - DNA, 13 bp, Homo sapiens
actgggttgactt

SEQ ID NO: 2772946 - DNA, 20 bp, Homo sapiens
actgggttgactttcaggta

SEQ ID NO: 2772947 - DNA, 20 bp, Homo sapiens
actgggtttctctgtatagt

SEQ ID NO: 2772948 - DNA, 18 bp, Homo sapiens
actgggtttgtttttcaa

SEQ ID NO: 2772949 - DNA, 21 bp, Homo sapiens
actggtgactgcgatcttcag

SEQ ID NO: 2772950 - DNA, 14 bp, Homo sapiens
actggtttctcaga

SEQ ID NO: 2772951 - DNA, 20 bp, Homo sapiens
actggtttgaagaatgttaa

SEQ ID NO: 2772952 - DNA, 15 bp, Homo sapiens
actgtaatcttaaaa

SEQ ID NO: 2772953 - DNA, 13 bp, Homo sapiens
actgtaattttgt

SEQ ID NO: 2772954 - DNA, 17 bp, Homo sapiens
actgtacttaataaatt

SEQ ID NO: 2772955 - DNA, 19 bp, Homo sapiens
actgtagaatgatttcatg

SEQ ID NO: 2772956 - DNA, 13 bp, Homo sapiens
actgtatgctgga

SEQ ID NO: 2772957 - DNA, 13 bp, Homo sapiens
actgtcatagaaa

SEQ ID NO: 2772958 - DNA, 13 bp, Homo sapiens
actgtccctcaaa

SEQ ID NO: 2772959 - DNA, 14 bp, Homo sapiens
actgtccctcaaat

SEQ ID NO: 2772960 - DNA, 17 bp, Homo sapiens
actgtctctcatgaacc

SEQ ID NO: 2772961 - DNA, 18 bp, Homo sapiens
actgtctctcatgaacct

SEQ ID NO: 2772962 - DNA, 21 bp, Homo sapiens
actgtcttgcctgccagggcc

SEQ ID NO: 2772963 - DNA, 23 bp, Homo sapiens
actgtcttgcctgccagggcccc

SEQ ID NO: 2772964 - DNA, 10 bp, Homo sapiens
actgtgaaag

SEQ ID NO: 2772965 - DNA, 21 bp, Homo sapiens
actgtgaagacccagcaggaa

SEQ ID NO: 2772966 - DNA, 11 bp, Homo sapiens
actgtgactga

SEQ ID NO: 2772967 - DNA, 17 bp, Homo sapiens
actgtgccatgtgccag

SEQ ID NO: 2772968 - DNA, 20 bp, Homo sapiens
actgtgcgttttagagtatg

SEQ ID NO: 2772969 - DNA, 14 bp, Homo sapiens
actgtgcttacagt

SEQ ID NO: 2772970 - DNA, 18 bp, Homo sapiens
actgtgcttacagtgact

SEQ ID NO: 2772971 - DNA, 15 bp, Homo sapiens
actgtggaaaaatat

SEQ ID NO: 2772972 - DNA, 19 bp, Homo sapiens
actgtggaaaaatatttaa

SEQ ID NO: 2772973 - DNA, 14 bp, Homo sapiens
actgtggctgcaga

SEQ ID NO: 2772974 - DNA, 19 bp, Homo sapiens
actgtggctgctagcactt

SEQ ID NO: 2772975 - DNA, 18 bp, Homo sapiens
actgtgtgaagaaatgga

SEQ ID NO: 2772976 - DNA, 15 bp, Homo sapiens
actgtgttcagtgcc

SEQ ID NO: 2772977 - DNA, 21 bp, Homo sapiens
actgttaatagttcaggtaac

SEQ ID NO: 2772978 - DNA, 13 bp, Homo sapiens
agcagctgagcag

SEQ ID NO: 2772979 - DNA, 16 bp, Homo sapiens
agcagctgagcagggc

SEQ ID NO: 2772980 - DNA, 17 bp, Homo sapiens
agcagctgagcagggcc

SEQ ID NO: 2772981 - DNA, 16 bp, Homo sapiens
agcaggcacatggagg

SEQ ID NO: 2772982 - DNA, 14 bp, Homo sapiens
agcagggctcagcg

SEQ ID NO: 2772983 - DNA, 14 bp, Homo sapiens
agcaggtaccactg

SEQ ID NO: 2772984 - DNA, 17 bp, Homo sapiens
agcaggtgggaaatggt

SEQ ID NO: 2772985 - DNA, 18 bp, Homo sapiens
agcaggtggtcctgagac

SEQ ID NO: 2772986 - DNA, 20 bp, Homo sapiens
agcaggtggtcctgagacct

SEQ ID NO: 2772987 - DNA, 21 bp, Homo sapiens
agcaggtggtcctgagacctg

SEQ ID NO: 2772988 - DNA, 20 bp, Homo sapiens
agcaggttgaggggctcctg

SEQ ID NO: 2772989 - DNA, 21 bp, Homo sapiens
agcaggttgaggggctcctgg

SEQ ID NO: 2772990 - DNA, 17 bp, Homo sapiens
agcagtatgaatgatgt

SEQ ID NO: 2772991 - DNA, 15 bp, Homo sapiens
agcagtccaaagaac

SEQ ID NO: 2772992 - DNA, 14 bp, Homo sapiens
agcagtcctcttat

SEQ ID NO: 2772993 - DNA, 19 bp, Homo sapiens
agcagtcctcttattccta

SEQ ID NO: 2772994 - DNA, 14 bp, Homo sapiens
agcagtgagccgca

SEQ ID NO: 2772995 - DNA, 20 bp, Homo sapiens
agcagtgccttccataatta

SEQ ID NO: 2772996 - DNA, 23 bp, Homo sapiens
agcagtgccttccataattatga

SEQ ID NO: 2772997 - DNA, 12 bp, Homo sapiens
agcagtggacac

SEQ ID NO: 2772998 - DNA, 15 bp, Homo sapiens
agcagtggacaccag

SEQ ID NO: 2772999 - DNA, 16 bp, Homo sapiens
agcagtgtcttccata

SEQ ID NO: 2773000 - DNA, 13 bp, Homo sapiens
agcataaatgcaa

SEQ ID NO: 2773001 - DNA, 17 bp, Homo sapiens
agcataagtttctggga

SEQ ID NO: 2773002 - DNA, 18 bp, Homo sapiens
agcgccctgcagaccctg

SEQ ID NO: 2773003 - DNA, 20 bp, Homo sapiens
agcgccctgcagaccctgcc

SEQ ID NO: 2773004 - DNA, 21 bp, Homo sapiens
agcgccctgcagaccctgccc

SEQ ID NO: 2773005 - DNA, 21 bp, Homo sapiens
agcgcctagtggggtctccct

SEQ ID NO: 2773006 - DNA, 13 bp, Homo sapiens
agcgcctccctcc

SEQ ID NO: 2773007 - DNA, 19 bp, Homo sapiens
agcgcctccctccacccca

SEQ ID NO: 2773008 - DNA, 21 bp, Homo sapiens
agcgcctccctccaccccagg

SEQ ID NO: 2773009 - DNA, 18 bp, Homo sapiens
agcgctgccgcaccccag

SEQ ID NO: 2773010 - DNA, 21 bp, Homo sapiens
agcgctttctggaaaagagga

SEQ ID NO: 2773011 - DNA, 15 bp, Homo sapiens
agcggaggagaccag

SEQ ID NO: 2773012 - DNA, 20 bp, Homo sapiens
agcggaggagaccagctcag

SEQ ID NO: 2773013 - DNA, 21 bp, Homo sapiens
agcggaggagaccagctcaga

SEQ ID NO: 2773014 - DNA, 23 bp, Homo sapiens
agcggaggttgcagggagccgag

SEQ ID NO: 2773015 - DNA, 13 bp, Homo sapiens
agcggctctcctg

SEQ ID NO: 2773016 - DNA, 22 bp, Homo sapiens
agcgggatctcgtatctttaaa

SEQ ID NO: 2773017 - DNA, 20 bp, Homo sapiens
agcggggacagctccttctg

SEQ ID NO: 2773018 - DNA, 16 bp, Homo sapiens
agcggtttccaggcca

SEQ ID NO: 2773019 - DNA, 13 bp, Homo sapiens
agcgtgagccact

SEQ ID NO: 2773020 - DNA, 15 bp, Homo sapiens
agcgtgagccactgc

SEQ ID NO: 2773021 - DNA, 19 bp, Homo sapiens
agcgtgagccactgcaccg

SEQ ID NO: 2773022 - DNA, 22 bp, Homo sapiens
agcgtggccttgttctgtcacc

SEQ ID NO: 2773023 - DNA, 20 bp, Homo sapiens
agctaacagggaaggcaggc

SEQ ID NO: 2773024 - DNA, 17 bp, Homo sapiens
agctaagctaggaatga

SEQ ID NO: 2773025 - DNA, 20 bp, Homo sapiens
agctaatctgtagggctgga

SEQ ID NO: 2773026 - DNA, 18 bp, Homo sapiens
agctacacctgaggctga

SEQ ID NO: 2773027 - DNA, 15 bp, Homo sapiens
agctacataatttag

SEQ ID NO: 2773028 - DNA, 22 bp, Homo sapiens
agctacctgtgtggacaggact

SEQ ID NO: 2773029 - DNA, 16 bp, Homo sapiens
agctacgtatttaata

SEQ ID NO: 2773030 - DNA, 19 bp, Homo sapiens
agctactcagaagcctgag

SEQ ID NO: 2773031 - DNA, 21 bp, Homo sapiens
agctactcagaagcctgaggc

SEQ ID NO: 2773032 - DNA, 17 bp, Homo sapiens
agctactcaggaggctg

SEQ ID NO: 2773033 - DNA, 21 bp, Homo sapiens
aggatctatgcaatttttaaa

SEQ ID NO: 2773034 - DNA, 21 bp, Homo sapiens
aggatctctcaggagcacagg

SEQ ID NO: 2773035 - DNA, 23 bp, Homo sapiens
aggatctgtttttaaaaatcata

SEQ ID NO: 2773036 - DNA, 19 bp, Homo sapiens
aggatgaatgaggtcccag

SEQ ID NO: 2773037 - DNA, 16 bp, Homo sapiens
aggatgcaacaaatat

SEQ ID NO: 2773038 - DNA, 14 bp, Homo sapiens
aggatggagagagg

SEQ ID NO: 2773039 - DNA, 16 bp, Homo sapiens
aggatggagagagggg

SEQ ID NO: 2773040 - DNA, 19 bp, Homo sapiens
aggatggagagaggggaat

SEQ ID NO: 2773041 - DNA, 21 bp, Homo sapiens
aggatgtaaacagtgcctgct

SEQ ID NO: 2773042 - DNA, 15 bp, Homo sapiens
aggatgttctgggac

SEQ ID NO: 2773043 - DNA, 14 bp, Homo sapiens
aggatgtttttcat

SEQ ID NO: 2773044 - DNA, 19 bp, Homo sapiens
aggattccaaagttttgaa

SEQ ID NO: 2773045 - DNA, 21 bp, Homo sapiens
aggattgatggtgctcccctt

SEQ ID NO: 2773046 - DNA, 15 bp, Homo sapiens
aggattgctactgtc

SEQ ID NO: 2773047 - DNA, 18 bp, Homo sapiens
aggattgcttgagcccag

SEQ ID NO: 2773048 - DNA, 21 bp, Homo sapiens
aggattgcttgagcccaggag

SEQ ID NO: 2773049 - DNA, 23 bp, Homo sapiens
aggattttaacaaaagcaagact

SEQ ID NO: 2773050 - DNA, 19 bp, Homo sapiens
aggattttgatccaagctg

SEQ ID NO: 2773051 - DNA, 17 bp, Homo sapiens
aggcaaaatccttgctt

SEQ ID NO: 2773052 - DNA, 15 bp, Homo sapiens
aggcaactgaggcag

SEQ ID NO: 2773053 - DNA, 14 bp, Homo sapiens
aggcaatgctggct

SEQ ID NO: 2773054 - DNA, 18 bp, Homo sapiens
aggcacaggacacctggc

SEQ ID NO: 2773055 - DNA, 14 bp, Homo sapiens
aggcacatggagga

SEQ ID NO: 2773056 - DNA, 17 bp, Homo sapiens
aggcacatggaggagct

SEQ ID NO: 2773057 - DNA, 20 bp, Homo sapiens
aggcacccaccatcatgtct

SEQ ID NO: 2773058 - DNA, 22 bp, Homo sapiens
aggcacccaccatcatgtctgg

SEQ ID NO: 2773059 - DNA, 15 bp, Homo sapiens
aggcaccccctggag

SEQ ID NO: 2773060 - DNA, 17 bp, Homo sapiens
aggcaccccctggagag

SEQ ID NO: 2773061 - DNA, 19 bp, Homo sapiens
aggcaccccctggagagaa

SEQ ID NO: 2773062 - DNA, 18 bp, Homo sapiens
aggcacgaacccacctgc

SEQ ID NO: 2773063 - DNA, 21 bp, Homo sapiens
aggcacgaacccacctgctga

SEQ ID NO: 2773064 - DNA, 21 bp, Homo sapiens
aggcacgccagtttcaccatt

SEQ ID NO: 2773065 - DNA, 22 bp, Homo sapiens
aggcacgccagtttcaccattt

SEQ ID NO: 2773066 - DNA, 16 bp, Homo sapiens
aggcactgctgcccag

SEQ ID NO: 2773067 - DNA, 22 bp, Homo sapiens
aggcactgctgcccagcctcca

SEQ ID NO: 2773068 - DNA, 18 bp, Homo sapiens
aggcagagaaagaagaga

SEQ ID NO: 2773069 - DNA, 21 bp, Homo sapiens
aggcagagaaagaagagacag

SEQ ID NO: 2773070 - DNA, 21 bp, Homo sapiens
aggcagccccattctgcctgc

SEQ ID NO: 2773071 - DNA, 15 bp, Homo sapiens
aggcaggagaattgc

SEQ ID NO: 2773072 - DNA, 16 bp, Homo sapiens
aggcaggcagggctct

SEQ ID NO: 2773073 - DNA, 14 bp, Homo sapiens
aggcagggagggga

SEQ ID NO: 2773074 - DNA, 16 bp, Homo sapiens
aggcagggaggggact

SEQ ID NO: 2773075 - DNA, 20 bp, Homo sapiens
aggcagggccttgcccagag

SEQ ID NO: 2773076 - DNA, 13 bp, Homo sapiens
aggcagggctctc

SEQ ID NO: 2773077 - DNA, 15 bp, Homo sapiens
aggcagggctctcct

SEQ ID NO: 2773078 - DNA, 23 bp, Homo sapiens
aggcagggctctcctggcttccc

SEQ ID NO: 2773079 - DNA, 13 bp, Homo sapiens
aggcaggggcgga

SEQ ID NO: 2773080 - DNA, 18 bp, Homo sapiens
aggcaggggtgggagagc

SEQ ID NO: 2773081 - DNA, 22 bp, Homo sapiens
aggcaggggtgggagagccagc

SEQ ID NO: 2773082 - DNA, 14 bp, Homo sapiens
agcttctctgtgaa

SEQ ID NO: 2773083 - DNA, 13 bp, Homo sapiens
agcttgagcctgt

SEQ ID NO: 2773084 - DNA, 19 bp, Homo sapiens
agcttgtaaatagctcagg

SEQ ID NO: 2773085 - DNA, 15 bp, Homo sapiens
agcttgtatatacat

SEQ ID NO: 2773086 - DNA, 18 bp, Homo sapiens
agcttgtatatacatatt

SEQ ID NO: 2773087 - DNA, 19 bp, Homo sapiens
agcttgtatatacatatta

SEQ ID NO: 2773088 - DNA, 16 bp, Homo sapiens
agcttgttatttataa

SEQ ID NO: 2773089 - DNA, 22 bp, Homo sapiens
agctttattttttaagtattta

SEQ ID NO: 2773090 - DNA, 15 bp, Homo sapiens
agctttcatttgaca

SEQ ID NO: 2773091 - DNA, 20 bp, Homo sapiens
agctttcatttgacacacag

SEQ ID NO: 2773092 - DNA, 16 bp, Homo sapiens
agctttccacaggagg

SEQ ID NO: 2773093 - DNA, 21 bp, Homo sapiens
agctttcttctacaaccagag

SEQ ID NO: 2773094 - DNA, 23 bp, Homo sapiens
agctttgctctttggtagaaaag

SEQ ID NO: 2773095 - DNA, 16 bp, Homo sapiens
agcttttcccttcttt

SEQ ID NO: 2773096 - DNA, 13 bp, Homo sapiens
agctttttgtctt

SEQ ID NO: 2773097 - DNA, 14 bp, Homo sapiens
aggaaaaaaatgac

SEQ ID NO: 2773098 - DNA, 12 bp, Homo sapiens
aggaaaactgtt

SEQ ID NO: 2773099 - DNA, 16 bp, Homo sapiens
aggaaaagctgctgac

SEQ ID NO: 2773100 - DNA, 13 bp, Homo sapiens
aggaaaaggcctg

SEQ ID NO: 2773101 - DNA, 14 bp, Homo sapiens
aggaaaaggcctgg

SEQ ID NO: 2773102 - DNA, 15 bp, Homo sapiens
aggaaaaggcctggg

SEQ ID NO: 2773103 - DNA, 16 bp, Homo sapiens
aggaaaaggcctgggg

SEQ ID NO: 2773104 - DNA, 21 bp, Homo sapiens
aggaaactctgcattctagta

SEQ ID NO: 2773105 - DNA, 11 bp, Homo sapiens
aggaaagcacc

SEQ ID NO: 2773106 - DNA, 20 bp, Homo sapiens
aggaaagcaccgcagcatgt

SEQ ID NO: 2773107 - DNA, 21 bp, Homo sapiens
aggaaagcaccgcagcatgtg

SEQ ID NO: 2773108 - DNA, 20 bp, Homo sapiens
aggaaagccccagcactaac

SEQ ID NO: 2773109 - DNA, 14 bp, Homo sapiens
aggaaataaaacct

SEQ ID NO: 2773110 - DNA, 14 bp, Homo sapiens
aggaaatagtgttc

SEQ ID NO: 2773111 - DNA, 20 bp, Homo sapiens
aggaacacccggaaagactg

SEQ ID NO: 2773112 - DNA, 14 bp, Homo sapiens
aggaacagaaggat

SEQ ID NO: 2773113 - DNA, 21 bp, Homo sapiens
aggaacagaaggatgaatgag

SEQ ID NO: 2773114 - DNA, 16 bp, Homo sapiens
aggaacagagtatata

SEQ ID NO: 2773115 - DNA, 19 bp, Homo sapiens
aggaacagagtatatatgt

SEQ ID NO: 2773116 - DNA, 14 bp, Homo sapiens
aggaactcccagca

SEQ ID NO: 2773117 - DNA, 21 bp, Homo sapiens
aggaactctggcttccaggta

SEQ ID NO: 2773118 - DNA, 12 bp, Homo sapiens
aggaagagcagg

SEQ ID NO: 2773119 - DNA, 17 bp, Homo sapiens
aggaagagcaggcacat

SEQ ID NO: 2773120 - DNA, 18 bp, Homo sapiens
aggaagccacagctggtg

SEQ ID NO: 2773121 - DNA, 14 bp, Homo sapiens
aggaagccaggctg

SEQ ID NO: 2773122 - DNA, 18 bp, Homo sapiens
aggaagccaggctgagtg

SEQ ID NO: 2773123 - DNA, 19 bp, Homo sapiens
aggaaggagactcacctct

SEQ ID NO: 2773124 - DNA, 17 bp, Homo sapiens
aggaagtgaaaataggt

SEQ ID NO: 2773125 - DNA, 16 bp, Homo sapiens
aggaatatgactgttt

SEQ ID NO: 2773126 - DNA, 17 bp, Homo sapiens
aggaatcaaaaattgaa

SEQ ID NO: 2773127 - DNA, 14 bp, Homo sapiens
aggaatcagctgca

SEQ ID NO: 2773128 - DNA, 16 bp, Homo sapiens
aggaatcatgatctga

SEQ ID NO: 2773129 - DNA, 23 bp, Homo sapiens
aggaatccagacccggctgcgtg

SEQ ID NO: 2773130 - DNA, 16 bp, Homo sapiens
aggaatctcagagaca

SEQ ID NO: 2773131 - DNA, 16 bp, Homo sapiens
aggaatgcctgtgtga

SEQ ID NO: 2773132 - DNA, 23 bp, Homo sapiens
aggaattcccagcccaaagctgt

SEQ ID NO: 2773133 - DNA, 21 bp, Homo sapiens
aggaattgaagatgtaaggaa

SEQ ID NO: 2773134 - DNA, 14 bp, Homo sapiens
aggacaattcactt

SEQ ID NO: 2773135 - DNA, 14 bp, Homo sapiens
aggacacaggcctg

SEQ ID NO: 2773136 - DNA, 15 bp, Homo sapiens
aggacacaggcctgt

SEQ ID NO: 2773137 - DNA, 23 bp, Homo sapiens
aggacacctggccgcctccagga

SEQ ID NO: 2773138 - DNA, 18 bp, Homo sapiens
aggacaggaccagatttt

SEQ ID NO: 2773139 - DNA, 22 bp, Homo sapiens
aggacagggaggtgaccccagg

SEQ ID NO: 2773140 - DNA, 18 bp, Homo sapiens
aggacagtgcttcagcct

SEQ ID NO: 2773141 - DNA, 22 bp, Homo sapiens
aggacagtgcttcagcctgagg

SEQ ID NO: 2773142 - DNA, 17 bp, Homo sapiens
aggacattgcggacagc

SEQ ID NO: 2773143 - DNA, 18 bp, Homo sapiens
aggacattttctctttaa

SEQ ID NO: 2773144 - DNA, 20 bp, Homo sapiens
aggacccctccatgtgggct

SEQ ID NO: 2773145 - DNA, 12 bp, Homo sapiens
aggacctgagcc

SEQ ID NO: 2773146 - DNA, 15 bp, Homo sapiens
aggacctgagcctgc

SEQ ID NO: 2773147 - DNA, 17 bp, Homo sapiens
aggacgccactcatttc

SEQ ID NO: 2773148 - DNA, 19 bp, Homo sapiens
aggacgccactcatttcat

SEQ ID NO: 2773149 - DNA, 19 bp, Homo sapiens
aggactgaattgtccccag

SEQ ID NO: 2773150 - DNA, 22 bp, Homo sapiens
aggacttgagcctccatttctg

SEQ ID NO: 2773151 - DNA, 23 bp, Homo sapiens
aggacttttctttgtggcttcct

SEQ ID NO: 2773152 - DNA, 14 bp, Homo sapiens
aggagaaacagaga

SEQ ID NO: 2773153 - DNA, 16 bp, Homo sapiens
aggagaaacagagaca

SEQ ID NO: 2773154 - DNA, 16 bp, Homo sapiens
aggagaaggaaggaga

SEQ ID NO: 2773155 - DNA, 15 bp, Homo sapiens
aggagaatgagcctc

SEQ ID NO: 2773156 - DNA, 18 bp, Homo sapiens
aggagacaagaaatccag

SEQ ID NO: 2773157 - DNA, 20 bp, Homo sapiens
aggagacacgtgtggcgggc

SEQ ID NO: 2773158 - DNA, 17 bp, Homo sapiens
aggagaccaaggcggga

SEQ ID NO: 2773159 - DNA, 13 bp, Homo sapiens
aggagaccagctc

SEQ ID NO: 2773160 - DNA, 14 bp, Homo sapiens
aggagaccagctca

SEQ ID NO: 2773161 - DNA, 16 bp, Homo sapiens
aggagaccagctcaga

SEQ ID NO: 2773162 - DNA, 23 bp, Homo sapiens
aggagaccagctcagaggcccag

SEQ ID NO: 2773163 - DNA, 14 bp, Homo sapiens
aggagacccacagg

SEQ ID NO: 2773164 - DNA, 15 bp, Homo sapiens
aggagactcacctct

SEQ ID NO: 2773165 - DNA, 19 bp, Homo sapiens
aggagagataccttgaaaa

SEQ ID NO: 2773166 - DNA, 15 bp, Homo sapiens
aggagagccagccct

SEQ ID NO: 2773167 - DNA, 12 bp, Homo sapiens
aggagatataaa

SEQ ID NO: 2773168 - DNA, 15 bp, Homo sapiens
aggagatataaaatc

SEQ ID NO: 2773169 - DNA, 19 bp, Homo sapiens
aggagatataaaatctaga

SEQ ID NO: 2773170 - DNA, 20 bp, Homo sapiens
aggagatataaaatctagat

SEQ ID NO: 2773171 - DNA, 18 bp, Homo sapiens
aggagcaatttgcacatg

SEQ ID NO: 2773172 - DNA, 17 bp, Homo sapiens
aggagccccgaggcctt

SEQ ID NO: 2773173 - DNA, 19 bp, Homo sapiens
agccgggcctggggctcct

SEQ ID NO: 2773174 - DNA, 14 bp, Homo sapiens
agccggtgcctggc

SEQ ID NO: 2773175 - DNA, 16 bp, Homo sapiens
agccgtcagccaaatg

SEQ ID NO: 2773176 - DNA, 19 bp, Homo sapiens
agccgtgatgctcaggctt

SEQ ID NO: 2773177 - DNA, 14 bp, Homo sapiens
agcctaaatctaat

SEQ ID NO: 2773178 - DNA, 16 bp, Homo sapiens
agcctaagaagctctg

SEQ ID NO: 2773179 - DNA, 15 bp, Homo sapiens
agcctagaccctcct

SEQ ID NO: 2773180 - DNA, 17 bp, Homo sapiens
agcctagccgacctcag

SEQ ID NO: 2773181 - DNA, 18 bp, Homo sapiens
agcctagccgacctcagc

SEQ ID NO: 2773182 - DNA, 21 bp, Homo sapiens
agcctagccgacctcagcctt

SEQ ID NO: 2773183 - DNA, 20 bp, Homo sapiens
agcctcaacctcctgggcta

SEQ ID NO: 2773184 - DNA, 15 bp, Homo sapiens
agcctcaatttctga

SEQ ID NO: 2773185 - DNA, 15 bp, Homo sapiens
agcctcacagaagaa

SEQ ID NO: 2773186 - DNA, 14 bp, Homo sapiens
agcctcagcatcct

SEQ ID NO: 2773187 - DNA, 20 bp, Homo sapiens
agcctcatccgaggcagggt

SEQ ID NO: 2773188 - DNA, 18 bp, Homo sapiens
agcctccatgctgcctcc

SEQ ID NO: 2773189 - DNA, 20 bp, Homo sapiens
agcctccatgctgcctccag

SEQ ID NO: 2773190 - DNA, 15 bp, Homo sapiens
agcctccatttagtt

SEQ ID NO: 2773191 - DNA, 17 bp, Homo sapiens
agcctccatttagttct

SEQ ID NO: 2773192 - DNA, 20 bp, Homo sapiens
agcctccatttagttctttg

SEQ ID NO: 2773193 - DNA, 14 bp, Homo sapiens
agcctccatttctg

SEQ ID NO: 2773194 - DNA, 19 bp, Homo sapiens
agcctccatttctggcttc

SEQ ID NO: 2773195 - DNA, 22 bp, Homo sapiens
agcctcctcccaccaccctccc

SEQ ID NO: 2773196 - DNA, 18 bp, Homo sapiens
agcctcgcaacccgtgcc

SEQ ID NO: 2773197 - DNA, 23 bp, Homo sapiens
agcctcgcaacccgtgccaagtc

SEQ ID NO: 2773198 - DNA, 18 bp, Homo sapiens
agcctctccttgcctggt

SEQ ID NO: 2773199 - DNA, 19 bp, Homo sapiens
agcctctccttgcctggtg

SEQ ID NO: 2773200 - DNA, 16 bp, Homo sapiens
agcctctgcctcccta

SEQ ID NO: 2773201 - DNA, 18 bp, Homo sapiens
agcctctgctgccatggc

SEQ ID NO: 2773202 - DNA, 22 bp, Homo sapiens
agcctctgtcccccttggagga

SEQ ID NO: 2773203 - DNA, 23 bp, Homo sapiens
agagttctttaggtgcctcctgt

SEQ ID NO: 2773204 - DNA, 13 bp, Homo sapiens
agagttgaaccta

SEQ ID NO: 2773205 - DNA, 13 bp, Homo sapiens
agataaagtggtt

SEQ ID NO: 2773206 - DNA, 14 bp, Homo sapiens
agataactgagaat

SEQ ID NO: 2773207 - DNA, 16 bp, Homo sapiens
agataatatctgtgag

SEQ ID NO: 2773208 - DNA, 16 bp, Homo sapiens
agataatctagaacac

SEQ ID NO: 2773209 - DNA, 23 bp, Homo sapiens
agataatctagaacacaggcaaa

SEQ ID NO: 2773210 - DNA, 20 bp, Homo sapiens
agataatttattttgtattt

SEQ ID NO: 2773211 - DNA, 19 bp, Homo sapiens
agataccaggttgaaagac

SEQ ID NO: 2773212 - DNA, 20 bp, Homo sapiens
agatactggaagttttgcat

SEQ ID NO: 2773213 - DNA, 16 bp, Homo sapiens
agatacttaagtgctg

SEQ ID NO: 2773214 - DNA, 14 bp, Homo sapiens
agatagtacataaa

SEQ ID NO: 2773215 - DNA, 18 bp, Homo sapiens
agatagtacataaaggtg

SEQ ID NO: 2773216 - DNA, 23 bp, Homo sapiens
agatagttttgccagaacagttt

SEQ ID NO: 2773217 - DNA, 12 bp, Homo sapiens
agatataaaatc

SEQ ID NO: 2773218 - DNA, 15 bp, Homo sapiens
agatatatctgaaaa

SEQ ID NO: 2773219 - DNA, 20 bp, Homo sapiens
agatatatctgaaaactgga

SEQ ID NO: 2773220 - DNA, 15 bp, Homo sapiens
agatatgagttgttt

SEQ ID NO: 2773221 - DNA, 13 bp, Homo sapiens
agatatttatata

SEQ ID NO: 2773222 - DNA, 22 bp, Homo sapiens
agatattttttcagaaatatgt

SEQ ID NO: 2773223 - DNA, 23 bp, Homo sapiens
agatcaaatttcacgtcgtcttc

SEQ ID NO: 2773224 - DNA, 15 bp, Homo sapiens
agatcaccagcccgg

SEQ ID NO: 2773225 - DNA, 15 bp, Homo sapiens
agatcacgccactgc

SEQ ID NO: 2773226 - DNA, 17 bp, Homo sapiens
agatcacgccactgcac

SEQ ID NO: 2773227 - DNA, 21 bp, Homo sapiens
agatcatccagaagttcctca

SEQ ID NO: 2773228 - DNA, 16 bp, Homo sapiens
agatccacacacagag

SEQ ID NO: 2773229 - DNA, 22 bp, Homo sapiens
agatcccatccatcagctccct

SEQ ID NO: 2773230 - DNA, 19 bp, Homo sapiens
agatcccgcctcttcttct

SEQ ID NO: 2773231 - DNA, 22 bp, Homo sapiens
agatcccgcctcttcttcttca

SEQ ID NO: 2773232 - DNA, 18 bp, Homo sapiens
agatcgtattaattatct

SEQ ID NO: 2773233 - DNA, 17 bp, Homo sapiens
agatcgttagtatctaa

SEQ ID NO: 2773234 - DNA, 13 bp, Homo sapiens
agatctcctattt

SEQ ID NO: 2773235 - DNA, 18 bp, Homo sapiens
agatctcctatttttcag

SEQ ID NO: 2773236 - DNA, 13 bp, Homo sapiens
agatctcctgtaa

SEQ ID NO: 2773237 - DNA, 20 bp, Homo sapiens
agatctcctgtaattttgta

SEQ ID NO: 2773238 - DNA, 17 bp, Homo sapiens
agatcttctgaaatgaa

SEQ ID NO: 2773239 - DNA, 12 bp, Homo sapiens
agatctttcagg

SEQ ID NO: 2773240 - DNA, 15 bp, Homo sapiens
agatctttttgtgaa

SEQ ID NO: 2773241 - DNA, 21 bp, Homo sapiens
agatgatcgtgcctataaata

SEQ ID NO: 2773242 - DNA, 21 bp, Homo sapiens
agatgcccagagggcccaggc

SEQ ID NO: 2773243 - DNA, 12 bp, Homo sapiens
agatgcctccac

SEQ ID NO: 2773244 - DNA, 14 bp, Homo sapiens
agatgcctccaccg

SEQ ID NO: 2773245 - DNA, 17 bp, Homo sapiens
agatgcctccaccgctg

SEQ ID NO: 2773246 - DNA, 21 bp, Homo sapiens
agatgcctccaccgctgccta

SEQ ID NO: 2773247 - DNA, 22 bp, Homo sapiens
agatggctgactttgctctttc

SEQ ID NO: 2773248 - DNA, 18 bp, Homo sapiens
agatggctgtgcctctgc

SEQ ID NO: 2773249 - DNA, 20 bp, Homo sapiens
agatggctgtgcctctgcct

SEQ ID NO: 2773250 - DNA, 23 bp, Homo sapiens
agatggctgtgcctctgcctgtc

SEQ ID NO: 2773251 - DNA, 16 bp, Homo sapiens
agatgggtattaaact

SEQ ID NO: 2773252 - DNA, 17 bp, Homo sapiens
agatgggtctggctgag

SEQ ID NO: 2773253 - DNA, 22 bp, Homo sapiens
agatgggtctggctgagctgaa

SEQ ID NO: 2773254 - DNA, 14 bp, Homo sapiens
agatgtaccatgtt

SEQ ID NO: 2773255 - DNA, 20 bp, Homo sapiens
agatgtaccatgttaaagag

SEQ ID NO: 2773256 - DNA, 15 bp, Homo sapiens
agatgtaggagggac

SEQ ID NO: 2773257 - DNA, 15 bp, Homo sapiens
agatgtcaaatatct

SEQ ID NO: 2773258 - DNA, 18 bp, Homo sapiens
agatgtcaaatatctcag

SEQ ID NO: 2773259 - DNA, 15 bp, Homo sapiens
agatgtcagactggc

SEQ ID NO: 2773260 - DNA, 18 bp, Homo sapiens
agatgtcagactggctgg

SEQ ID NO: 2773261 - DNA, 12 bp, Homo sapiens
agatgtgatgct

SEQ ID NO: 2773262 - DNA, 17 bp, Homo sapiens
agatgtttgatagattt

SEQ ID NO: 2773263 - DNA, 24 bp, Homo sapiens
agatgtttgtcagatatgatatgt

SEQ ID NO: 2773264 - DNA, 16 bp, Homo sapiens
agattaaaattagtga

SEQ ID NO: 2773265 - DNA, 17 bp, Homo sapiens
agattaaaggaaggaaa

SEQ ID NO: 2773266 - DNA, 18 bp, Homo sapiens
agattaaaggaaggaaaa

SEQ ID NO: 2773267 - DNA, 18 bp, Homo sapiens
agattaatttgtgtagat

SEQ ID NO: 2773268 - DNA, 21 bp, Homo sapiens
agattaccccctcattgttta

SEQ ID NO: 2773269 - DNA, 15 bp, Homo sapiens
agattagaagtgttt

SEQ ID NO: 2773270 - DNA, 14 bp, Homo sapiens
agattagctctgga

SEQ ID NO: 2773271 - DNA, 15 bp, Homo sapiens
agattatatatcata

SEQ ID NO: 2773272 - DNA, 18 bp, Homo sapiens
agattatatatcataaag

SEQ ID NO: 2773273 - DNA, 22 bp, Homo sapiens
agattattttagtctgtcatcc

SEQ ID NO: 2773274 - DNA, 12 bp, Homo sapiens
agattcattttt

SEQ ID NO: 2773275 - DNA, 13 bp, Homo sapiens
agattcccagagc

SEQ ID NO: 2773276 - DNA, 18 bp, Homo sapiens
agattgagagaagagaca

SEQ ID NO: 2773277 - DNA, 13 bp, Homo sapiens
agattgaggcctg

SEQ ID NO: 2773278 - DNA, 16 bp, Homo sapiens
agattgcaacaggctg

SEQ ID NO: 2773279 - DNA, 19 bp, Homo sapiens
agattgtacatatggaaat

SEQ ID NO: 2773280 - DNA, 12 bp, Homo sapiens
agattgtttgca

SEQ ID NO: 2773281 - DNA, 14 bp, Homo sapiens
agatttcaacatat

SEQ ID NO: 2773282 - DNA, 19 bp, Homo sapiens
agatttcagaggctgcagg

SEQ ID NO: 2773283 - DNA, 20 bp, Homo sapiens
agatttgtatttatattaga

SEQ ID NO: 2773284 - DNA, 16 bp, Homo sapiens
agatttgtggaaaaat

SEQ ID NO: 2773285 - DNA, 14 bp, Homo sapiens
agattttaattttg

SEQ ID NO: 2773286 - DNA, 14 bp, Homo sapiens
agattttttaataa

SEQ ID NO: 2773287 - DNA, 12 bp, Homo sapiens
agcaaaaaagaa

SEQ ID NO: 2773288 - DNA, 17 bp, Homo sapiens
agcaaaactccatctca

SEQ ID NO: 2773289 - DNA, 21 bp, Homo sapiens
agcaaaataattttaaacaaa

SEQ ID NO: 2773290 - DNA, 15 bp, Homo sapiens
agcaaaatctaccag

SEQ ID NO: 2773291 - DNA, 12 bp, Homo sapiens
agcaaagcctgt

SEQ ID NO: 2773292 - DNA, 18 bp, Homo sapiens
agcaaatgtttctgcagt

SEQ ID NO: 2773293 - DNA, 23 bp, Homo sapiens
agcaacagagtgagaccctgtct

SEQ ID NO: 2773294 - DNA, 22 bp, Homo sapiens
agcatatgcctacttgtaattt

SEQ ID NO: 2773295 - DNA, 15 bp, Homo sapiens
agcatcacctcaggc

SEQ ID NO: 2773296 - DNA, 16 bp, Homo sapiens
agcatcatgcctctga

SEQ ID NO: 2773297 - DNA, 19 bp, Homo sapiens
agcatcatgcctctgaggc

SEQ ID NO: 2773298 - DNA, 13 bp, Homo sapiens
agcatcctggcac

SEQ ID NO: 2773299 - DNA, 23 bp, Homo sapiens
agcatcctggcacccggcccctg

SEQ ID NO: 2773300 - DNA, 21 bp, Homo sapiens
agcatctctgtgtacccactc

SEQ ID NO: 2773301 - DNA, 17 bp, Homo sapiens
agcatctcttgaggcca

SEQ ID NO: 2773302 - DNA, 22 bp, Homo sapiens
agcatctcttgaggccaggagt

SEQ ID NO: 2773303 - DNA, 15 bp, Homo sapiens
agcatcttctggagt

SEQ ID NO: 2773304 - DNA, 20 bp, Homo sapiens
agcatgatcttgttaatgca

SEQ ID NO: 2773305 - DNA, 17 bp, Homo sapiens
agcatggctattttata

SEQ ID NO: 2773306 - DNA, 16 bp, Homo sapiens
agcatggtcacaagca

SEQ ID NO: 2773307 - DNA, 21 bp, Homo sapiens
agcatggtcccacatccctgg

SEQ ID NO: 2773308 - DNA, 21 bp, Homo sapiens
agcatgtactgagccttgtaa

SEQ ID NO: 2773309 - DNA, 17 bp, Homo sapiens
agcatgtggcatgttca

SEQ ID NO: 2773310 - DNA, 18 bp, Homo sapiens
agcatgtggcatgttcat

SEQ ID NO: 2773311 - DNA, 19 bp, Homo sapiens
agcattatgatgtgggtca

SEQ ID NO: 2773312 - DNA, 14 bp, Homo sapiens
agcattcagaagaa

SEQ ID NO: 2773313 - DNA, 15 bp, Homo sapiens
agcattcagaagaaa

SEQ ID NO: 2773314 - DNA, 19 bp, Homo sapiens
agcattcagaagaaaaaga

SEQ ID NO: 2773315 - DNA, 12 bp, Homo sapiens
agcattctgtct

SEQ ID NO: 2773316 - DNA, 13 bp, Homo sapiens
agcatttatgttt

SEQ ID NO: 2773317 - DNA, 23 bp, Homo sapiens
agcatttcttatttgtttggtca

SEQ ID NO: 2773318 - DNA, 19 bp, Homo sapiens
agcattttactacttgtta

SEQ ID NO: 2773319 - DNA, 17 bp, Homo sapiens
agcattttactgtctgt

SEQ ID NO: 2773320 - DNA, 18 bp, Homo sapiens
agcattttactgtctgta

SEQ ID NO: 2773321 - DNA, 14 bp, Homo sapiens
agccaaaaatagct

SEQ ID NO: 2773322 - DNA, 20 bp, Homo sapiens
agccaaacagagccttcaca

SEQ ID NO: 2773323 - DNA, 14 bp, Homo sapiens
agccaaactctgcc

SEQ ID NO: 2773324 - DNA, 16 bp, Homo sapiens
agccaaagctaggcct

SEQ ID NO: 2773325 - DNA, 20 bp, Homo sapiens
agccaaatgtaattgaataa

SEQ ID NO: 2773326 - DNA, 21 bp, Homo sapiens
agccaacgacaaagccaaact

SEQ ID NO: 2773327 - DNA, 20 bp, Homo sapiens
agccaactcactcttatgaa

SEQ ID NO: 2773328 - DNA, 22 bp, Homo sapiens
agccaagggttcagagactcag

SEQ ID NO: 2773329 - DNA, 19 bp, Homo sapiens
agccaaggtgggctgagcc

SEQ ID NO: 2773330 - DNA, 22 bp, Homo sapiens
agccaaggtgggctgagccctg

SEQ ID NO: 2773331 - DNA, 18 bp, Homo sapiens
agccacacagagcctgcc

SEQ ID NO: 2773332 - DNA, 22 bp, Homo sapiens
agccacacagagcctgcctcag

SEQ ID NO: 2773333 - DNA, 18 bp, Homo sapiens
agccacacttctcaggac

SEQ ID NO: 2773334 - DNA, 18 bp, Homo sapiens
agccacagaagccaggag

SEQ ID NO: 2773335 - DNA, 13 bp, Homo sapiens
agccacagaccac

SEQ ID NO: 2773336 - DNA, 13 bp, Homo sapiens
agccacagctggt

SEQ ID NO: 2773337 - DNA, 13 bp, Homo sapiens
agccaccctgagg

SEQ ID NO: 2773338 - DNA, 21 bp, Homo sapiens
agccaccgtctacagatggct

SEQ ID NO: 2773339 - DNA, 17 bp, Homo sapiens
agccacgttccttactg

SEQ ID NO: 2773340 - DNA, 20 bp, Homo sapiens
agccacgttccttactgcag

SEQ ID NO: 2773341 - DNA, 22 bp, Homo sapiens
agccacgttccttactgcagaa

SEQ ID NO: 2773342 - DNA, 15 bp, Homo sapiens
agccactcgggaggc

SEQ ID NO: 2773343 - DNA, 19 bp, Homo sapiens
agccactggtttctcagaa

SEQ ID NO: 2773344 - DNA, 23 bp, Homo sapiens
agccagaaataaagttggtgaca

SEQ ID NO: 2773345 - DNA, 20 bp, Homo sapiens
agccagagcctgtctttcag

SEQ ID NO: 2773346 - DNA, 12 bp, Homo sapiens
agccagcccagc

SEQ ID NO: 2773347 - DNA, 14 bp, Homo sapiens
agccagcccagccc

SEQ ID NO: 2773348 - DNA, 15 bp, Homo sapiens
agccagcccagccca

SEQ ID NO: 2773349 - DNA, 17 bp, Homo sapiens
agccagcccagcccagc

SEQ ID NO: 2773350 - DNA, 18 bp, Homo sapiens
agccagcccagcccagct

SEQ ID NO: 2773351 - DNA, 15 bp, Homo sapiens
agccagccctccctg

SEQ ID NO: 2773352 - DNA, 16 bp, Homo sapiens
agccagccctccctgt

SEQ ID NO: 2773353 - DNA, 16 bp, Homo sapiens
agccagccctgcctgg

SEQ ID NO: 2773354 - DNA, 19 bp, Homo sapiens
agccagccctgcctggagg

SEQ ID NO: 2773355 - DNA, 23 bp, Homo sapiens
agccagccctgcctggaggacct

SEQ ID NO: 2773356 - DNA, 17 bp, Homo sapiens
agccagccggtgcctgg

SEQ ID NO: 2773357 - DNA, 18 bp, Homo sapiens
agccagccggtgcctggc

SEQ ID NO: 2773358 - DNA, 19 bp, Homo sapiens
agccagcgcctccctccac

SEQ ID NO: 2773359 - DNA, 23 bp, Homo sapiens
agccagcgcctccctccacccca

SEQ ID NO: 2773360 - DNA, 17 bp, Homo sapiens
agccagctcctgggcag

SEQ ID NO: 2773361 - DNA, 16 bp, Homo sapiens
agccagctctcagcca

SEQ ID NO: 2773362 - DNA, 14 bp, Homo sapiens
agccagctctctct

SEQ ID NO: 2773363 - DNA, 16 bp, Homo sapiens
agccagctgccgacca

SEQ ID NO: 2773364 - DNA, 22 bp, Homo sapiens
agccaggctgagtgagccacag

SEQ ID NO: 2773365 - DNA, 12 bp, Homo sapiens
agccagggtctc

SEQ ID NO: 2773366 - DNA, 23 bp, Homo sapiens
agccaggtaatgagggactggaa

SEQ ID NO: 2773367 - DNA, 17 bp, Homo sapiens
agccatcaagagactga

SEQ ID NO: 2773368 - DNA, 20 bp, Homo sapiens
agccatgaggagttgctgtt

SEQ ID NO: 2773369 - DNA, 19 bp, Homo sapiens
agccatgtaccagtgtact

SEQ ID NO: 2773370 - DNA, 18 bp, Homo sapiens
agccattaccatggagac

SEQ ID NO: 2773371 - DNA, 13 bp, Homo sapiens
agcccaaagaagg

SEQ ID NO: 2773372 - DNA, 16 bp, Homo sapiens
agcccaaagaaggaaa

SEQ ID NO: 2773373 - DNA, 16 bp, Homo sapiens
agcccaaatggctctg

SEQ ID NO: 2773374 - DNA, 23 bp, Homo sapiens
agcccaacagacaccatcttttg

SEQ ID NO: 2773375 - DNA, 13 bp, Homo sapiens
agcccacttctgc

SEQ ID NO: 2773376 - DNA, 14 bp, Homo sapiens
agcccacttctgcc

SEQ ID NO: 2773377 - DNA, 15 bp, Homo sapiens
agcccacttctgcca

SEQ ID NO: 2773378 - DNA, 18 bp, Homo sapiens
agcccagaaaacctccag

SEQ ID NO: 2773379 - DNA, 19 bp, Homo sapiens
agcccagaaaacctccagt

SEQ ID NO: 2773380 - DNA, 15 bp, Homo sapiens
agcccagcactgtga

SEQ ID NO: 2773381 - DNA, 20 bp, Homo sapiens
agcccagcagggcctcaaag

SEQ ID NO: 2773382 - DNA, 23 bp, Homo sapiens
agcccagccattaccatggagac

SEQ ID NO: 2773383 - DNA, 15 bp, Homo sapiens
agcccagcctctgtc

SEQ ID NO: 2773384 - DNA, 19 bp, Homo sapiens
cacttaccttcaataaagt

SEQ ID NO: 2773385 - DNA, 17 bp, Homo sapiens
cacttatttcataaaca

SEQ ID NO: 2773386 - DNA, 19 bp, Homo sapiens
cacttcatggaccaagaat

SEQ ID NO: 2773387 - DNA, 20 bp, Homo sapiens
cacttccataatctggactc

SEQ ID NO: 2773388 - DNA, 17 bp, Homo sapiens
cacttctaaatgaagtg

SEQ ID NO: 2773389 - DNA, 15 bp, Homo sapiens
cacttctcaggacac

SEQ ID NO: 2773390 - DNA, 19 bp, Homo sapiens
cacttctcaggacacaggc

SEQ ID NO: 2773391 - DNA, 19 bp, Homo sapiens
cacttctcatcatattgta

SEQ ID NO: 2773392 - DNA, 23 bp, Homo sapiens
cacttctcatcatattgtatgta

SEQ ID NO: 2773393 - DNA, 16 bp, Homo sapiens
cacttctctactctgg

SEQ ID NO: 2773394 - DNA, 18 bp, Homo sapiens
cacttctctactctggaa

SEQ ID NO: 2773395 - DNA, 12 bp, Homo sapiens
cacttctctaga

SEQ ID NO: 2773396 - DNA, 14 bp, Homo sapiens
cacttctttcctct

SEQ ID NO: 2773397 - DNA, 15 bp, Homo sapiens
cacttcttttataac

SEQ ID NO: 2773398 - DNA, 13 bp, Homo sapiens
cacttgcagactc

SEQ ID NO: 2773399 - DNA, 14 bp, Homo sapiens
cacttgcagactct

SEQ ID NO: 2773400 - DNA, 12 bp, Homo sapiens
cacttggagcca

SEQ ID NO: 2773401 - DNA, 13 bp, Homo sapiens
caccttatgtatt

SEQ ID NO: 2773402 - DNA, 18 bp, Homo sapiens
caccttcaattcctgggc

SEQ ID NO: 2773403 - DNA, 12 bp, Homo sapiens
caccttcccagc

SEQ ID NO: 2773404 - DNA, 11 bp, Homo sapiens
caccttcccca

SEQ ID NO: 2773405 - DNA, 14 bp, Homo sapiens
caccttccccagac

SEQ ID NO: 2773406 - DNA, 20 bp, Homo sapiens
caccttccccagactcagct

SEQ ID NO: 2773407 - DNA, 17 bp, Homo sapiens
caccttggactcctccc

SEQ ID NO: 2773408 - DNA, 15 bp, Homo sapiens
caccttggctcaagt

SEQ ID NO: 2773409 - DNA, 13 bp, Homo sapiens
caccttggctgca

SEQ ID NO: 2773410 - DNA, 13 bp, Homo sapiens
caccttgtcatgt

SEQ ID NO: 2773411 - DNA, 14 bp, Homo sapiens
cacgaacccacctg

SEQ ID NO: 2773412 - DNA, 22 bp, Homo sapiens
cacgaacccacctgctgagaga

SEQ ID NO: 2773413 - DNA, 21 bp, Homo sapiens
cacgatgtggccctggcctgc

SEQ ID NO: 2773414 - DNA, 13 bp, Homo sapiens
cacgcaacttgaa

SEQ ID NO: 2773415 - DNA, 15 bp, Homo sapiens
cacgcaacttgaaat

SEQ ID NO: 2773416 - DNA, 13 bp, Homo sapiens
cacgcaggaactc

SEQ ID NO: 2773417 - DNA, 17 bp, Homo sapiens
cacgcaggaactcccag

SEQ ID NO: 2773418 - DNA, 19 bp, Homo sapiens
cacgccagtttcaccattt

SEQ ID NO: 2773419 - DNA, 21 bp, Homo sapiens
cacgcctataatcccagcact

SEQ ID NO: 2773420 - DNA, 19 bp, Homo sapiens
cacgcctatgatcccagca

SEQ ID NO: 2773421 - DNA, 22 bp, Homo sapiens
cacgcctatgatcccagcactt

SEQ ID NO: 2773422 - DNA, 11 bp, Homo sapiens
cacgcctgccc

SEQ ID NO: 2773423 - DNA, 14 bp, Homo sapiens
cacgcctgtaatcc

SEQ ID NO: 2773424 - DNA, 18 bp, Homo sapiens
cacgcctgtaatcccagc

SEQ ID NO: 2773425 - DNA, 20 bp, Homo sapiens
cacgcctgtaatcccagcac

SEQ ID NO: 2773426 - DNA, 21 bp, Homo sapiens
cacgcctgtaatcccagcagt

SEQ ID NO: 2773427 - DNA, 15 bp, Homo sapiens
cacgcgtgcacacac

SEQ ID NO: 2773428 - DNA, 21 bp, Homo sapiens
cacgcgtgcacacaccagagc

SEQ ID NO: 2773429 - DNA, 23 bp, Homo sapiens
cacgcgtgcacacaccagagccc

SEQ ID NO: 2773430 - DNA, 20 bp, Homo sapiens
cacgctggaccttgaactgg

SEQ ID NO: 2773431 - DNA, 15 bp, Homo sapiens
cacgctggagtgcag

SEQ ID NO: 2773432 - DNA, 14 bp, Homo sapiens
cacgctttctagct

SEQ ID NO: 2773433 - DNA, 11 bp, Homo sapiens
cacggcagctt

SEQ ID NO: 2773434 - DNA, 14 bp, Homo sapiens
cacggcagcttgag

SEQ ID NO: 2773435 - DNA, 15 bp, Homo sapiens
cacggcagcttgagc

SEQ ID NO: 2773436 - DNA, 22 bp, Homo sapiens
cacggccagctgcatctactca

SEQ ID NO: 2773437 - DNA, 14 bp, Homo sapiens
cacggccaggccag

SEQ ID NO: 2773438 - DNA, 16 bp, Homo sapiens
cacggccaggccagag

SEQ ID NO: 2773439 - DNA, 17 bp, Homo sapiens
cacggctcactgcagcc

SEQ ID NO: 2773440 - DNA, 21 bp, Homo sapiens
cacgtagagatgattcggatt

SEQ ID NO: 2773441 - DNA, 20 bp, Homo sapiens
cacgtgaaatatttaagtat

SEQ ID NO: 2773442 - DNA, 13 bp, Homo sapiens
cacgtgccaggcc

SEQ ID NO: 2773443 - DNA, 14 bp, Homo sapiens
cacgtgccaggccc

SEQ ID NO: 2773444 - DNA, 15 bp, Homo sapiens
cacgtgtcctgtagt

SEQ ID NO: 2773445 - DNA, 16 bp, Homo sapiens
cacgtgtcctgtagtt

SEQ ID NO: 2773446 - DNA, 20 bp, Homo sapiens
cacgtgtgcagactgtggct

SEQ ID NO: 2773447 - DNA, 18 bp, Homo sapiens
cacgtttgtgagaagaaa

SEQ ID NO: 2773448 - DNA, 16 bp, Homo sapiens
cactaaatgagctcct

SEQ ID NO: 2773449 - DNA, 18 bp, Homo sapiens
cactaaatgagctcctgc

SEQ ID NO: 2773450 - DNA, 18 bp, Homo sapiens
cactaaccacgctggacc

SEQ ID NO: 2773451 - DNA, 21 bp, Homo sapiens
cactaacggttgagttttgac

SEQ ID NO: 2773452 - DNA, 18 bp, Homo sapiens
cactaaggtgtgctctga

SEQ ID NO: 2773453 - DNA, 17 bp, Homo sapiens
cactaagttatagtata

SEQ ID NO: 2773454 - DNA, 17 bp, Homo sapiens
cactaatttgatgttta

SEQ ID NO: 2773455 - DNA, 21 bp, Homo sapiens
cactacactccagcctgagca

SEQ ID NO: 2773456 - DNA, 15 bp, Homo sapiens
cactagaactctcca

SEQ ID NO: 2773457 - DNA, 14 bp, Homo sapiens
cactagcctctcca

SEQ ID NO: 2773458 - DNA, 16 bp, Homo sapiens
cactaggactctgagg

SEQ ID NO: 2773459 - DNA, 23 bp, Homo sapiens
cactataaccatcagttactggt

SEQ ID NO: 2773460 - DNA, 17 bp, Homo sapiens
cactatctttctgataa

SEQ ID NO: 2773461 - DNA, 15 bp, Homo sapiens
cactatgacactgag

SEQ ID NO: 2773462 - DNA, 17 bp, Homo sapiens
cactatgacactgagca

SEQ ID NO: 2773463 - DNA, 15 bp, Homo sapiens
cactatgttgcccag

SEQ ID NO: 2773464 - DNA, 18 bp, Homo sapiens
cactatgttgcccaggca

SEQ ID NO: 2773465 - DNA, 20 bp, Homo sapiens
cactatgttgcccaggcagg

SEQ ID NO: 2773466 - DNA, 21 bp, Homo sapiens
cactatgttgcccaggcaggt

SEQ ID NO: 2773467 - DNA, 17 bp, Homo sapiens
cactcaaccaacctccc

SEQ ID NO: 2773468 - DNA, 19 bp, Homo sapiens
cactcacatgccgccccca

SEQ ID NO: 2773469 - DNA, 19 bp, Homo sapiens
cactcacatttattctgct

SEQ ID NO: 2773470 - DNA, 17 bp, Homo sapiens
cactcagaagacactga

SEQ ID NO: 2773471 - DNA, 15 bp, Homo sapiens
atattttatgattta

SEQ ID NO: 2773472 - DNA, 16 bp, Homo sapiens
atattttatgatttaa

SEQ ID NO: 2773473 - DNA, 18 bp, Homo sapiens
atattttccctctcttgc

SEQ ID NO: 2773474 - DNA, 19 bp, Homo sapiens
atattttcttccaagcaaa

SEQ ID NO: 2773475 - DNA, 19 bp, Homo sapiens
atatttttatagacaaata

SEQ ID NO: 2773476 - DNA, 13 bp, Homo sapiens
atatttttcaacc

SEQ ID NO: 2773477 - DNA, 18 bp, Homo sapiens
atatttttcaaccagcat

SEQ ID NO: 2773478 - DNA, 22 bp, Homo sapiens
atatttttcaaccagcatttta

SEQ ID NO: 2773479 - DNA, 16 bp, Homo sapiens
atatttttgatggtaa

SEQ ID NO: 2773480 - DNA, 18 bp, Homo sapiens
atattttttcagaaatat

SEQ ID NO: 2773481 - DNA, 12 bp, Homo sapiens
atcaaaacatat

SEQ ID NO: 2773482 - DNA, 21 bp, Homo sapiens
atcaaaactttcttttctgga

SEQ ID NO: 2773483 - DNA, 16 bp, Homo sapiens
atcaaaagctgcttga

SEQ ID NO: 2773484 - DNA, 19 bp, Homo sapiens
atcaaaataaattgaaata

SEQ ID NO: 2773485 - DNA, 18 bp, Homo sapiens
atcaaaatcactatcttt

SEQ ID NO: 2773486 - DNA, 15 bp, Homo sapiens
atcaaactgaagcca

SEQ ID NO: 2773487 - DNA, 20 bp, Homo sapiens
atcaaatttcacgtcgtctt

SEQ ID NO: 2773488 - DNA, 18 bp, Homo sapiens
atcaaccccagacactgg

SEQ ID NO: 2773489 - DNA, 20 bp, Homo sapiens
atcaaccccttcgctcctgt

SEQ ID NO: 2773490 - DNA, 22 bp, Homo sapiens
atcaaccccttcgctcctgtgt

SEQ ID NO: 2773491 - DNA, 16 bp, Homo sapiens
atcaactccagctccc

SEQ ID NO: 2773492 - DNA, 15 bp, Homo sapiens
atcaagaaagtgttg

SEQ ID NO: 2773493 - DNA, 22 bp, Homo sapiens
atcaagagtgagtgaacaacta

SEQ ID NO: 2773494 - DNA, 22 bp, Homo sapiens
atcaagatgagagaactggagg

SEQ ID NO: 2773495 - DNA, 18 bp, Homo sapiens
atcaagatgtcagactgg

SEQ ID NO: 2773496 - DNA, 16 bp, Homo sapiens
atcaaggagcccagaa

SEQ ID NO: 2773497 - DNA, 12 bp, Homo sapiens
atcaagtcaccg

SEQ ID NO: 2773498 - DNA, 15 bp, Homo sapiens
atcaataaaaatctt

SEQ ID NO: 2773499 - DNA, 22 bp, Homo sapiens
atcaatagactgtacttatttt

SEQ ID NO: 2773500 - DNA, 21 bp, Homo sapiens
atcaatgttcacgcaacttga

SEQ ID NO: 2773501 - DNA, 23 bp, Homo sapiens
atcaatgttcacgcaacttgaaa

SEQ ID NO: 2773502 - DNA, 14 bp, Homo sapiens
atcaattaaatgta

SEQ ID NO: 2773503 - DNA, 15 bp, Homo sapiens
atcaattaaatgtag

SEQ ID NO: 2773504 - DNA, 19 bp, Homo sapiens
atcaatttaaaatcattca

SEQ ID NO: 2773505 - DNA, 21 bp, Homo sapiens
atcaatttaaaatcattcaat

SEQ ID NO: 2773506 - DNA, 13 bp, Homo sapiens
atcaatttttata

SEQ ID NO: 2773507 - DNA, 17 bp, Homo sapiens
atcaatttttatacata

SEQ ID NO: 2773508 - DNA, 19 bp, Homo sapiens
atcaatttttatacatatc

SEQ ID NO: 2773509 - DNA, 23 bp, Homo sapiens
atcaatttttatacatatcagaa

SEQ ID NO: 2773510 - DNA, 14 bp, Homo sapiens
atcacaagcaataa

SEQ ID NO: 2773511 - DNA, 20 bp, Homo sapiens
atcacaagcaataattagga

SEQ ID NO: 2773512 - DNA, 21 bp, Homo sapiens
atcacaagcaataattaggat

SEQ ID NO: 2773513 - DNA, 14 bp, Homo sapiens
atcacagaggcttc

SEQ ID NO: 2773514 - DNA, 20 bp, Homo sapiens
atcacagatgggtattaaac

SEQ ID NO: 2773515 - DNA, 15 bp, Homo sapiens
atcacagggcagagc

SEQ ID NO: 2773516 - DNA, 19 bp, Homo sapiens
atcacagggcagagccggg

SEQ ID NO: 2773517 - DNA, 21 bp, Homo sapiens
atcacagggccccagaaggca

SEQ ID NO: 2773518 - DNA, 21 bp, Homo sapiens
atcacatacaatttgcactgt

SEQ ID NO: 2773519 - DNA, 21 bp, Homo sapiens
atcaccagcccggcctgctcc

SEQ ID NO: 2773520 - DNA, 19 bp, Homo sapiens
atcacctactcacacaggc

SEQ ID NO: 2773521 - DNA, 15 bp, Homo sapiens
atcacctcaggccag

SEQ ID NO: 2773522 - DNA, 14 bp, Homo sapiens
atcacgccactgca

SEQ ID NO: 2773523 - DNA, 23 bp, Homo sapiens
atcacgccactgcactccagcct

SEQ ID NO: 2773524 - DNA, 18 bp, Homo sapiens
atcacgctttttgaaaaa

SEQ ID NO: 2773525 - DNA, 19 bp, Homo sapiens
atcacggctcactgcagcc

SEQ ID NO: 2773526 - DNA, 20 bp, Homo sapiens
atcactataaccatcagtta

SEQ ID NO: 2773527 - DNA, 16 bp, Homo sapiens
atcactggagcccagg

SEQ ID NO: 2773528 - DNA, 16 bp, Homo sapiens
atcactggcaatgaaa

SEQ ID NO: 2773529 - DNA, 18 bp, Homo sapiens
atcactggcaatgaaaaa

SEQ ID NO: 2773530 - DNA, 22 bp, Homo sapiens
atcactggcaatgaaaaattct

SEQ ID NO: 2773531 - DNA, 16 bp, Homo sapiens
atcacttgtacaaaat

SEQ ID NO: 2773532 - DNA, 16 bp, Homo sapiens
atcagaaaagtagaat

SEQ ID NO: 2773533 - DNA, 15 bp, Homo sapiens
atcagaaagggaggg

SEQ ID NO: 2773534 - DNA, 20 bp, Homo sapiens
atcagaaagggagggctctg

SEQ ID NO: 2773535 - DNA, 20 bp, Homo sapiens
atcagaaatgtcatcaaata

SEQ ID NO: 2773536 - DNA, 18 bp, Homo sapiens
atcagaatcgctaataga

SEQ ID NO: 2773537 - DNA, 16 bp, Homo sapiens
atcagaccataatgtt

SEQ ID NO: 2773538 - DNA, 14 bp, Homo sapiens
atcagaccctaccc

SEQ ID NO: 2773539 - DNA, 14 bp, Homo sapiens
atcagatctgtctt

SEQ ID NO: 2773540 - DNA, 11 bp, Homo sapiens
atcagcctctt

SEQ ID NO: 2773541 - DNA, 15 bp, Homo sapiens
atcagcctcttaaag

SEQ ID NO: 2773542 - DNA, 12 bp, Homo sapiens
atcagcctgagt

SEQ ID NO: 2773543 - DNA, 15 bp, Homo sapiens
atcagcgtggccttg

SEQ ID NO: 2773544 - DNA, 18 bp, Homo sapiens
atcagctccactttcagt

SEQ ID NO: 2773545 - DNA, 15 bp, Homo sapiens
atcaggacttgggaa

SEQ ID NO: 2773546 - DNA, 17 bp, Homo sapiens
atcaggcttggaatgaa

SEQ ID NO: 2773547 - DNA, 18 bp, Homo sapiens
atcaggcttggaatgaat

SEQ ID NO: 2773548 - DNA, 17 bp, Homo sapiens
atcaggtgctgccatcc

SEQ ID NO: 2773549 - DNA, 16 bp, Homo sapiens
atcaggttgttaatgt

SEQ ID NO: 2773550 - DNA, 22 bp, Homo sapiens
atcagtatgctgttttaataat

SEQ ID NO: 2773551 - DNA, 20 bp, Homo sapiens
atcagtatgggaaccccaaa

SEQ ID NO: 2773552 - DNA, 19 bp, Homo sapiens
atcagtctgattcccaagc

SEQ ID NO: 2773553 - DNA, 16 bp, Homo sapiens
atcagttactcagccc

SEQ ID NO: 2773554 - DNA, 17 bp, Homo sapiens
atcagttactcagccct

SEQ ID NO: 2773555 - DNA, 18 bp, Homo sapiens
atcagttactcagccctg

SEQ ID NO: 2773556 - DNA, 14 bp, Homo sapiens
atcagttactggtt

SEQ ID NO: 2773557 - DNA, 15 bp, Homo sapiens
atcagttactggttt

SEQ ID NO: 2773558 - DNA, 13 bp, Homo sapiens
atcataaaataaa

SEQ ID NO: 2773559 - DNA, 11 bp, Homo sapiens
atcataaagta

SEQ ID NO: 2773560 - DNA, 14 bp, Homo sapiens
atcataattttcaa

SEQ ID NO: 2773561 - DNA, 12 bp, Homo sapiens
atgagctgaggg

SEQ ID NO: 2773562 - DNA, 13 bp, Homo sapiens
atgagctgagggg

SEQ ID NO: 2773563 - DNA, 15 bp, Homo sapiens
atgaggaacctcaaa

SEQ ID NO: 2773564 - DNA, 18 bp, Homo sapiens
atgaggcaatgtcaggaa

SEQ ID NO: 2773565 - DNA, 15 bp, Homo sapiens
atgaggcctcttgga

SEQ ID NO: 2773566 - DNA, 23 bp, Homo sapiens
atgaggcctcttggacctctgct

SEQ ID NO: 2773567 - DNA, 14 bp, Homo sapiens
atgaggcctttccc

SEQ ID NO: 2773568 - DNA, 14 bp, Homo sapiens
atgagggactggaa

SEQ ID NO: 2773569 - DNA, 17 bp, Homo sapiens
atgagggcagcagccag

SEQ ID NO: 2773570 - DNA, 22 bp, Homo sapiens
atgagggcagcagccagccctg

SEQ ID NO: 2773571 - DNA, 14 bp, Homo sapiens
atgaggtctgaaat

SEQ ID NO: 2773572 - DNA, 22 bp, Homo sapiens
atgagtgattgacacacagcac

SEQ ID NO: 2773573 - DNA, 20 bp, Homo sapiens
atgagttgttttcagactca

SEQ ID NO: 2773574 - DNA, 23 bp, Homo sapiens
atgagttgttttcagactcagac

SEQ ID NO: 2773575 - DNA, 13 bp, Homo sapiens
atgagtttatggg

SEQ ID NO: 2773576 - DNA, 21 bp, Homo sapiens
atgagtttttgatagctttat

SEQ ID NO: 2773577 - DNA, 14 bp, Homo sapiens
atgataaagatgtc

SEQ ID NO: 2773578 - DNA, 17 bp, Homo sapiens
atgatccaagtatttta

SEQ ID NO: 2773579 - DNA, 15 bp, Homo sapiens
atgatctccctgccg

SEQ ID NO: 2773580 - DNA, 14 bp, Homo sapiens
atgatctctgatga

SEQ ID NO: 2773581 - DNA, 17 bp, Homo sapiens
atgatcttgttaatgca

SEQ ID NO: 2773582 - DNA, 18 bp, Homo sapiens
atgatgaaatgaggtcag

SEQ ID NO: 2773583 - DNA, 17 bp, Homo sapiens
atgatgaccaagaatta

SEQ ID NO: 2773584 - DNA, 17 bp, Homo sapiens
atgatgattaaacacct

SEQ ID NO: 2773585 - DNA, 19 bp, Homo sapiens
atgatgattaaacacctga

SEQ ID NO: 2773586 - DNA, 21 bp, Homo sapiens
atgatgattccttgagcattt

SEQ ID NO: 2773587 - DNA, 20 bp, Homo sapiens
atgatgccgctcttctgtca

SEQ ID NO: 2773588 - DNA, 13 bp, Homo sapiens
atgattaaacacc

SEQ ID NO: 2773589 - DNA, 20 bp, Homo sapiens
atgattaaacacctgacaca

SEQ ID NO: 2773590 - DNA, 22 bp, Homo sapiens
atgattaaacacctgacacatc

SEQ ID NO: 2773591 - DNA, 21 bp, Homo sapiens
atgattccttgagcattttat

SEQ ID NO: 2773592 - DNA, 22 bp, Homo sapiens
atgattccttgatggagatatt

SEQ ID NO: 2773593 - DNA, 16 bp, Homo sapiens
atgatttaaaaaataa

SEQ ID NO: 2773594 - DNA, 16 bp, Homo sapiens
atgatttaagcatttt

SEQ ID NO: 2773595 - DNA, 21 bp, Homo sapiens
atgatttaagcattttactgt

SEQ ID NO: 2773596 - DNA, 20 bp, Homo sapiens
atgatttcatgctatctctg

SEQ ID NO: 2773597 - DNA, 14 bp, Homo sapiens
atgatttcatttca

SEQ ID NO: 2773598 - DNA, 11 bp, Homo sapiens
atgattttaca

SEQ ID NO: 2773599 - DNA, 15 bp, Homo sapiens
atgattttacagaga

SEQ ID NO: 2773600 - DNA, 16 bp, Homo sapiens
atgattttacagagaa

SEQ ID NO: 2773601 - DNA, 22 bp, Homo sapiens
atgattttatacatagtcacaa

SEQ ID NO: 2773602 - DNA, 23 bp, Homo sapiens
atgattttctatttttcttctaa

SEQ ID NO: 2773603 - DNA, 13 bp, Homo sapiens
atgcaaaatgaaa

SEQ ID NO: 2773604 - DNA, 13 bp, Homo sapiens
atgcaaacactgt

SEQ ID NO: 2773605 - DNA, 20 bp, Homo sapiens
atgcaaacactgtgtattta

SEQ ID NO: 2773606 - DNA, 20 bp, Homo sapiens
atgcaacaaaatatttaatt

SEQ ID NO: 2773607 - DNA, 19 bp, Homo sapiens
atgcaacaaatatttatat

SEQ ID NO: 2773608 - DNA, 22 bp, Homo sapiens
atgcaagaagaatataaataaa

SEQ ID NO: 2773609 - DNA, 18 bp, Homo sapiens
atgcaaggaaggaaagaa

SEQ ID NO: 2773610 - DNA, 20 bp, Homo sapiens
atgcaaggaaggaaagaaag

SEQ ID NO: 2773611 - DNA, 20 bp, Homo sapiens
atgcaattttgcatttgaat

SEQ ID NO: 2773612 - DNA, 14 bp, Homo sapiens
atgcaatttttaaa

SEQ ID NO: 2773613 - DNA, 17 bp, Homo sapiens
atgcaatttttaaacta

SEQ ID NO: 2773614 - DNA, 20 bp, Homo sapiens
atgcacaatttagaaaacat

SEQ ID NO: 2773615 - DNA, 22 bp, Homo sapiens
atgcacactagcctctccagga

SEQ ID NO: 2773616 - DNA, 18 bp, Homo sapiens
atgcacatatggactctg

SEQ ID NO: 2773617 - DNA, 21 bp, Homo sapiens
atgcacatatggactctgcac

SEQ ID NO: 2773618 - DNA, 22 bp, Homo sapiens
atgcacatgtaacccaaatgtc

SEQ ID NO: 2773619 - DNA, 22 bp, Homo sapiens
atgcacatttatatatatatgt

SEQ ID NO: 2773620 - DNA, 18 bp, Homo sapiens
atgcaccagtgccgcctg

SEQ ID NO: 2773621 - DNA, 19 bp, Homo sapiens
atgcaccagtgccgcctgt

SEQ ID NO: 2773622 - DNA, 14 bp, Homo sapiens
atgcacctaaagaa

SEQ ID NO: 2773623 - DNA, 18 bp, Homo sapiens
atgcacctaaagaaaaac

SEQ ID NO: 2773624 - DNA, 23 bp, Homo sapiens
atgcacctaaagaaaaacaaact

SEQ ID NO: 2773625 - DNA, 21 bp, Homo sapiens
atgcaccttgtgtctgtacac

SEQ ID NO: 2773626 - DNA, 23 bp, Homo sapiens
atgcagaggtaaaagtgtgagca

SEQ ID NO: 2773627 - DNA, 22 bp, Homo sapiens
atgcagcgaaccaatatttgta

SEQ ID NO: 2773628 - DNA, 21 bp, Homo sapiens
atgcagcttcatcaattttta

SEQ ID NO: 2773629 - DNA, 17 bp, Homo sapiens
atgcagtagccagcacg

SEQ ID NO: 2773630 - DNA, 14 bp, Homo sapiens
atgcagtccagaat

SEQ ID NO: 2773631 - DNA, 19 bp, Homo sapiens
atgcagtccagaataagtg

SEQ ID NO: 2773632 - DNA, 17 bp, Homo sapiens
atgcatagtgctaagaa

SEQ ID NO: 2773633 - DNA, 22 bp, Homo sapiens
atgcatagttcccatgttaaat

SEQ ID NO: 2773634 - DNA, 11 bp, Homo sapiens
atgcatatact

SEQ ID NO: 2773635 - DNA, 11 bp, Homo sapiens
atgcatgattt

SEQ ID NO: 2773636 - DNA, 12 bp, Homo sapiens
atgcatgatttt

SEQ ID NO: 2773637 - DNA, 19 bp, Homo sapiens
atgcatgattttatacata

SEQ ID NO: 2773638 - DNA, 20 bp, Homo sapiens
atgcatgattttatacatag

SEQ ID NO: 2773639 - DNA, 19 bp, Homo sapiens
atgcatggtgcagttgaca

SEQ ID NO: 2773640 - DNA, 19 bp, Homo sapiens
atgccaaaaaaaaatacat

SEQ ID NO: 2773641 - DNA, 21 bp, Homo sapiens
atgccaacatacccttcttta

SEQ ID NO: 2773642 - DNA, 20 bp, Homo sapiens
atgccaccctgttttcagct

SEQ ID NO: 2773643 - DNA, 13 bp, Homo sapiens
atgccagagcctg

SEQ ID NO: 2773644 - DNA, 22 bp, Homo sapiens
atgccagccgggtacctcagtt

SEQ ID NO: 2773645 - DNA, 18 bp, Homo sapiens
atgccatggacagaagaa

SEQ ID NO: 2773646 - DNA, 20 bp, Homo sapiens
atgcccagagggcccaggca

SEQ ID NO: 2773647 - DNA, 14 bp, Homo sapiens
atgccgctcttctg

SEQ ID NO: 2773648 - DNA, 15 bp, Homo sapiens
atgcctcaatgtgac

SEQ ID NO: 2773649 - DNA, 14 bp, Homo sapiens
attcatgtaataaa

SEQ ID NO: 2773650 - DNA, 16 bp, Homo sapiens
attcattgtataaaaa

SEQ ID NO: 2773651 - DNA, 16 bp, Homo sapiens
attcatttcactttaa

SEQ ID NO: 2773652 - DNA, 17 bp, Homo sapiens
attccaaacttctaaat

SEQ ID NO: 2773653 - DNA, 15 bp, Homo sapiens
attccacagtctctg

SEQ ID NO: 2773654 - DNA, 16 bp, Homo sapiens
attccaccattcacat

SEQ ID NO: 2773655 - DNA, 23 bp, Homo sapiens
attccagactgcttccaattttc

SEQ ID NO: 2773656 - DNA, 22 bp, Homo sapiens
attccatgattttacagagaat

SEQ ID NO: 2773657 - DNA, 22 bp, Homo sapiens
attcccaagctctagtgggaag

SEQ ID NO: 2773658 - DNA, 14 bp, Homo sapiens
attcccaccaaggt

SEQ ID NO: 2773659 - DNA, 15 bp, Homo sapiens
attcccaccaaggtc

SEQ ID NO: 2773660 - DNA, 22 bp, Homo sapiens
attcccacccaattcaaaacat

SEQ ID NO: 2773661 - DNA, 12 bp, Homo sapiens
attcccagccca

SEQ ID NO: 2773662 - DNA, 17 bp, Homo sapiens
attcccagctgtctgtg

SEQ ID NO: 2773663 - DNA, 20 bp, Homo sapiens
attccccagattgcaacagg

SEQ ID NO: 2773664 - DNA, 22 bp, Homo sapiens
attccccaggtggctgacccag

SEQ ID NO: 2773665 - DNA, 21 bp, Homo sapiens
attcccctatctctagaattt

SEQ ID NO: 2773666 - DNA, 16 bp, Homo sapiens
attccctatcaaaaca

SEQ ID NO: 2773667 - DNA, 15 bp, Homo sapiens
attccctctcccagg

SEQ ID NO: 2773668 - DNA, 16 bp, Homo sapiens
attccctctcccaggc

SEQ ID NO: 2773669 - DNA, 19 bp, Homo sapiens
attcctaagcagtgcttgt

SEQ ID NO: 2773670 - DNA, 20 bp, Homo sapiens
attcctaagcagtgcttgta

SEQ ID NO: 2773671 - DNA, 21 bp, Homo sapiens
attcctaagcagtgcttgtaa

SEQ ID NO: 2773672 - DNA, 19 bp, Homo sapiens
attcctaaggtaatcctat

SEQ ID NO: 2773673 - DNA, 22 bp, Homo sapiens
attcctattgtgcaatgtaaat

SEQ ID NO: 2773674 - DNA, 14 bp, Homo sapiens
attcctcagggaca

SEQ ID NO: 2773675 - DNA, 22 bp, Homo sapiens
attcctctgggaatgttacatt

SEQ ID NO: 2773676 - DNA, 15 bp, Homo sapiens
attcctgcatttgtg

SEQ ID NO: 2773677 - DNA, 16 bp, Homo sapiens
attcctgtagcatctt

SEQ ID NO: 2773678 - DNA, 23 bp, Homo sapiens
attcctgtagcatcttctggagt

SEQ ID NO: 2773679 - DNA, 20 bp, Homo sapiens
attccttagcttagacctca

SEQ ID NO: 2773680 - DNA, 20 bp, Homo sapiens
attctaaaatgattgtagta

SEQ ID NO: 2773681 - DNA, 14 bp, Homo sapiens
attctaaaatgcct

SEQ ID NO: 2773682 - DNA, 15 bp, Homo sapiens
attctaagattgtac

SEQ ID NO: 2773683 - DNA, 17 bp, Homo sapiens
attctaagattgtacat

SEQ ID NO: 2773684 - DNA, 24 bp, Homo sapiens
attctacacatatatgtatatgta

SEQ ID NO: 2773685 - DNA, 13 bp, Homo sapiens
attctaggcatcc

SEQ ID NO: 2773686 - DNA, 13 bp, Homo sapiens
attctcaccagga

SEQ ID NO: 2773687 - DNA, 15 bp, Homo sapiens
attctcatgtgatcc

SEQ ID NO: 2773688 - DNA, 16 bp, Homo sapiens
attctccaaatgattt

SEQ ID NO: 2773689 - DNA, 15 bp, Homo sapiens
attctcctgcctcag

SEQ ID NO: 2773690 - DNA, 19 bp, Homo sapiens
attctcctgcctcagcctc

SEQ ID NO: 2773691 - DNA, 22 bp, Homo sapiens
attctctcctcagactgctcaa

SEQ ID NO: 2773692 - DNA, 11 bp, Homo sapiens
attctgcctgc

SEQ ID NO: 2773693 - DNA, 13 bp, Homo sapiens
attctgcctgccc

SEQ ID NO: 2773694 - DNA, 18 bp, Homo sapiens
attctgctcacatatctg

SEQ ID NO: 2773695 - DNA, 21 bp, Homo sapiens
attctgctcacatatctgtca

SEQ ID NO: 2773696 - DNA, 19 bp, Homo sapiens
attctggaggaagaagaca

SEQ ID NO: 2773697 - DNA, 20 bp, Homo sapiens
attctgtaaaatgtctgtta

SEQ ID NO: 2773698 - DNA, 15 bp, Homo sapiens
attctgtgaagaatg

SEQ ID NO: 2773699 - DNA, 21 bp, Homo sapiens
attcttacaaacatgtggtta

SEQ ID NO: 2773700 - DNA, 14 bp, Homo sapiens
attcttccatctga

SEQ ID NO: 2773701 - DNA, 11 bp, Homo sapiens
attcttctgct

SEQ ID NO: 2773702 - DNA, 12 bp, Homo sapiens
attcttctgctt

SEQ ID NO: 2773703 - DNA, 13 bp, Homo sapiens
attctttccctag

SEQ ID NO: 2773704 - DNA, 15 bp, Homo sapiens
attgaaagagaacca

SEQ ID NO: 2773705 - DNA, 21 bp, Homo sapiens
attgaagagatttcaacatat

SEQ ID NO: 2773706 - DNA, 19 bp, Homo sapiens
attgaagatgtaaggaatt

SEQ ID NO: 2773707 - DNA, 14 bp, Homo sapiens
attgaatctgattg

SEQ ID NO: 2773708 - DNA, 20 bp, Homo sapiens
attgacaacattttattacc

SEQ ID NO: 2773709 - DNA, 18 bp, Homo sapiens
attgacaataatttcagg

SEQ ID NO: 2773710 - DNA, 20 bp, Homo sapiens
attgacaataatttcaggtt

SEQ ID NO: 2773711 - DNA, 13 bp, Homo sapiens
attgagaatttta

SEQ ID NO: 2773712 - DNA, 14 bp, Homo sapiens
attgagggaaaaca

SEQ ID NO: 2773713 - DNA, 15 bp, Homo sapiens
attgagtttaagtct

SEQ ID NO: 2773714 - DNA, 22 bp, Homo sapiens
attgagtttaagtctctgactc

SEQ ID NO: 2773715 - DNA, 16 bp, Homo sapiens
attgatatgaaaaata

SEQ ID NO: 2773716 - DNA, 19 bp, Homo sapiens
attgatcggagcctcctct

SEQ ID NO: 2773717 - DNA, 18 bp, Homo sapiens
atttataactcatcataa

SEQ ID NO: 2773718 - DNA, 21 bp, Homo sapiens
atttataactcatcataaaat

SEQ ID NO: 2773719 - DNA, 23 bp, Homo sapiens
atttataactcatcataaaataa

SEQ ID NO: 2773720 - DNA, 22 bp, Homo sapiens
atttatacaaaataatttaact

SEQ ID NO: 2773721 - DNA, 15 bp, Homo sapiens
atttatatatgtatt

SEQ ID NO: 2773722 - DNA, 15 bp, Homo sapiens
atttatatattggta

SEQ ID NO: 2773723 - DNA, 17 bp, Homo sapiens
atttatatctatagtag

SEQ ID NO: 2773724 - DNA, 18 bp, Homo sapiens
atttatatctatagtagt

SEQ ID NO: 2773725 - DNA, 16 bp, Homo sapiens
atttatattagagtgc

SEQ ID NO: 2773726 - DNA, 20 bp, Homo sapiens
atttatattagagtgccctt

SEQ ID NO: 2773727 - DNA, 18 bp, Homo sapiens
atttatattgtaaatatt

SEQ ID NO: 2773728 - DNA, 20 bp, Homo sapiens
atttatattgtaaatattgt

SEQ ID NO: 2773729 - DNA, 14 bp, Homo sapiens
atttatatttggaa

SEQ ID NO: 2773730 - DNA, 18 bp, Homo sapiens
atttatatttggaaagag

SEQ ID NO: 2773731 - DNA, 14 bp, Homo sapiens
atttatcagtgaca

SEQ ID NO: 2773732 - DNA, 17 bp, Homo sapiens
atttatcagtgacagag

SEQ ID NO: 2773733 - DNA, 20 bp, Homo sapiens
atttatcctgaaatttcaga

SEQ ID NO: 2773734 - DNA, 22 bp, Homo sapiens
atttatctttacttttaaacag

SEQ ID NO: 2773735 - DNA, 15 bp, Homo sapiens
atttatgagtttttg

SEQ ID NO: 2773736 - DNA, 19 bp, Homo sapiens
atttatgagtttttgatag

SEQ ID NO: 2773737 - DNA, 18 bp, Homo sapiens
atttatgatcacttggaa

SEQ ID NO: 2773738 - DNA, 18 bp, Homo sapiens
atttatggtcaacactta

SEQ ID NO: 2773739 - DNA, 14 bp, Homo sapiens
atttattacctctg

SEQ ID NO: 2773740 - DNA, 18 bp, Homo sapiens
atttattagctgtaaata

SEQ ID NO: 2773741 - DNA, 16 bp, Homo sapiens
atttattcactgtaag

SEQ ID NO: 2773742 - DNA, 20 bp, Homo sapiens
atttattgcttgatactttt

SEQ ID NO: 2773743 - DNA, 20 bp, Homo sapiens
atttattgtttatttatcag

SEQ ID NO: 2773744 - DNA, 22 bp, Homo sapiens
atttattgtttatttatcagtg

SEQ ID NO: 2773745 - DNA, 14 bp, Homo sapiens
atttatttaaaata

SEQ ID NO: 2773746 - DNA, 16 bp, Homo sapiens
atttatttaaaatagc

SEQ ID NO: 2773747 - DNA, 21 bp, Homo sapiens
atttattttgtatttttgaat

SEQ ID NO: 2773748 - DNA, 23 bp, Homo sapiens
atttattttgtatttttgaataa

SEQ ID NO: 2773749 - DNA, 19 bp, Homo sapiens
atttcaacatatcattttt

SEQ ID NO: 2773750 - DNA, 18 bp, Homo sapiens
atttcaaccgcttgccat

SEQ ID NO: 2773751 - DNA, 18 bp, Homo sapiens
atttcaatgattgtttaa

SEQ ID NO: 2773752 - DNA, 19 bp, Homo sapiens
atttcacaacagcctgaca

SEQ ID NO: 2773753 - DNA, 13 bp, Homo sapiens
atttcacattaat

SEQ ID NO: 2773754 - DNA, 20 bp, Homo sapiens
atttcacgtcgtcttctgta

SEQ ID NO: 2773755 - DNA, 16 bp, Homo sapiens
atttcactttaaagtc

SEQ ID NO: 2773756 - DNA, 19 bp, Homo sapiens
atttcaggatactctgtca

SEQ ID NO: 2773757 - DNA, 19 bp, Homo sapiens
atttcaggggtcgtcacca

SEQ ID NO: 2773758 - DNA, 20 bp, Homo sapiens
atttcaggttttgtaaagat

SEQ ID NO: 2773759 - DNA, 21 bp, Homo sapiens
atttcaggttttgtaaagatg

SEQ ID NO: 2773760 - DNA, 15 bp, Homo sapiens
atttcatctcattta

SEQ ID NO: 2773761 - DNA, 18 bp, Homo sapiens
atttcatgctatctctgt

SEQ ID NO: 2773762 - DNA, 20 bp, Homo sapiens
atttccagtacctttgtcac

SEQ ID NO: 2773763 - DNA, 18 bp, Homo sapiens
atttccatttcttcctca

SEQ ID NO: 2773764 - DNA, 15 bp, Homo sapiens
atttccctcccggga

SEQ ID NO: 2773765 - DNA, 22 bp, Homo sapiens
atttccgaagaccttctgaaga

SEQ ID NO: 2773766 - DNA, 13 bp, Homo sapiens
atttcctatttta

SEQ ID NO: 2773767 - DNA, 18 bp, Homo sapiens
atttcctattttaaaacc

SEQ ID NO: 2773768 - DNA, 21 bp, Homo sapiens
atttcctattttaaaaccatg

SEQ ID NO: 2773769 - DNA, 23 bp, Homo sapiens
atttcctattttaaaaccatgca

SEQ ID NO: 2773770 - DNA, 24 bp, Homo sapiens
atttcctcaacgttgctccccatc

SEQ ID NO: 2773771 - DNA, 15 bp, Homo sapiens
atttccttggaggcc

SEQ ID NO: 2773772 - DNA, 14 bp, Homo sapiens
atttctaaaaaaca

SEQ ID NO: 2773773 - DNA, 18 bp, Homo sapiens
atttctactgtgactgat

SEQ ID NO: 2773774 - DNA, 11 bp, Homo sapiens
atttctaggta

SEQ ID NO: 2773775 - DNA, 17 bp, Homo sapiens
atttctgagaaggtcct

SEQ ID NO: 2773776 - DNA, 15 bp, Homo sapiens
atttcttaaaatgtt

SEQ ID NO: 2773777 - DNA, 16 bp, Homo sapiens
atttcttaaaatgttt

SEQ ID NO: 2773778 - DNA, 18 bp, Homo sapiens
atttcttttttaaatgaa

SEQ ID NO: 2773779 - DNA, 17 bp, Homo sapiens
atttgaaaataattgtt

SEQ ID NO: 2773780 - DNA, 18 bp, Homo sapiens
atttgaaaataattgttc

SEQ ID NO: 2773781 - DNA, 21 bp, Homo sapiens
atttgaacccccgccatcctt

SEQ ID NO: 2773782 - DNA, 16 bp, Homo sapiens
atttgaagtaaaggat

SEQ ID NO: 2773783 - DNA, 13 bp, Homo sapiens
atttgaagtgtaa

SEQ ID NO: 2773784 - DNA, 21 bp, Homo sapiens
atttgagcaattcatttcact

SEQ ID NO: 2773785 - DNA, 19 bp, Homo sapiens
atttgagtgttttaagata

SEQ ID NO: 2773786 - DNA, 14 bp, Homo sapiens
atttgatgctaaat

SEQ ID NO: 2773787 - DNA, 15 bp, Homo sapiens
atttgatgtacatgt

SEQ ID NO: 2773788 - DNA, 20 bp, Homo sapiens
atttgatgtttacaggtgga

SEQ ID NO: 2773789 - DNA, 15 bp, Homo sapiens
atttgcctgtaacaa

SEQ ID NO: 2773790 - DNA, 17 bp, Homo sapiens
atttgctatcaaaataa

SEQ ID NO: 2773791 - DNA, 13 bp, Homo sapiens
atttggaaagaga

SEQ ID NO: 2773792 - DNA, 11 bp, Homo sapiens
atttggagact

SEQ ID NO: 2773793 - DNA, 17 bp, Homo sapiens
atttggagactctgtgg

SEQ ID NO: 2773794 - DNA, 14 bp, Homo sapiens
atttggatttacga

SEQ ID NO: 2773795 - DNA, 14 bp, Homo sapiens
atttggtgaccatc

SEQ ID NO: 2773796 - DNA, 15 bp, Homo sapiens
atttggttctaatag

SEQ ID NO: 2773797 - DNA, 23 bp, Homo sapiens
atttgtaaaagaacagtaaacat

SEQ ID NO: 2773798 - DNA, 17 bp, Homo sapiens
atttgtaatagatgttt

SEQ ID NO: 2773799 - DNA, 15 bp, Homo sapiens
atttgtaatgtatct

SEQ ID NO: 2773800 - DNA, 23 bp, Homo sapiens
atttgtaatgtatcttatttata

SEQ ID NO: 2773801 - DNA, 16 bp, Homo sapiens
atttgtacatatgtaa

SEQ ID NO: 2773802 - DNA, 18 bp, Homo sapiens
atttgtacatatgtaaaa

SEQ ID NO: 2773803 - DNA, 13 bp, Homo sapiens
atttgtatttata

SEQ ID NO: 2773804 - DNA, 14 bp, Homo sapiens
atttgtatttatat

SEQ ID NO: 2773805 - DNA, 20 bp, Homo sapiens
atttgtatttatattagagt

SEQ ID NO: 2773806 - DNA, 23 bp, Homo sapiens
atttgtgaaatgatggtgaaagt

SEQ ID NO: 2773807 - DNA, 17 bp, Homo sapiens
attttcaagagaagaaa

SEQ ID NO: 2773808 - DNA, 20 bp, Homo sapiens
attttcaagagaagaaaaaa

SEQ ID NO: 2773809 - DNA, 21 bp, Homo sapiens
attttcacctgtttttaagct

SEQ ID NO: 2773810 - DNA, 11 bp, Homo sapiens
attttcagtat

SEQ ID NO: 2773811 - DNA, 19 bp, Homo sapiens
attttcagtataatttaac

SEQ ID NO: 2773812 - DNA, 17 bp, Homo sapiens
attttcatgtatatgtg

SEQ ID NO: 2773813 - DNA, 13 bp, Homo sapiens
attttccaataaa

SEQ ID NO: 2773814 - DNA, 22 bp, Homo sapiens
attttccaataaaattttcaaa

SEQ ID NO: 2773815 - DNA, 23 bp, Homo sapiens
attttccacaagattcccagaga

SEQ ID NO: 2773816 - DNA, 19 bp, Homo sapiens
attttcttatcttctgcaa

SEQ ID NO: 2773817 - DNA, 14 bp, Homo sapiens
attttcttcatgca

SEQ ID NO: 2773818 - DNA, 18 bp, Homo sapiens
attttcttcatgcaatga

SEQ ID NO: 2773819 - DNA, 21 bp, Homo sapiens
attttcttcatgcaatgacat

SEQ ID NO: 2773820 - DNA, 15 bp, Homo sapiens
attttcttcccattt

SEQ ID NO: 2773821 - DNA, 22 bp, Homo sapiens
attttcttcccatttgtaatgt

SEQ ID NO: 2773822 - DNA, 17 bp, Homo sapiens
attttcttttgtaaatg

SEQ ID NO: 2773823 - DNA, 14 bp, Homo sapiens
attttgagtgactc

SEQ ID NO: 2773824 - DNA, 18 bp, Homo sapiens
attttgcaaaatttccag

SEQ ID NO: 2773825 - DNA, 15 bp, Homo sapiens
attttgcagcagtga

SEQ ID NO: 2773826 - DNA, 15 bp, Homo sapiens
attttgccagactta

SEQ ID NO: 2773827 - DNA, 18 bp, Homo sapiens
attttgtaacgaagacac

SEQ ID NO: 2773828 - DNA, 10 bp, Homo sapiens
attttgtaat

SEQ ID NO: 2773829 - DNA, 11 bp, Homo sapiens
attttgtaata

SEQ ID NO: 2773830 - DNA, 13 bp, Homo sapiens
attttgtaataaa

SEQ ID NO: 2773831 - DNA, 20 bp, Homo sapiens
attttgtaataaactctcta

SEQ ID NO: 2773832 - DNA, 23 bp, Homo sapiens
attttgtacagaatttttaatga

SEQ ID NO: 2773833 - DNA, 23 bp, Homo sapiens
attttgtagtagttgatgaccaa

SEQ ID NO: 2773834 - DNA, 19 bp, Homo sapiens
attttgtgaaagaaggagc

SEQ ID NO: 2773835 - DNA, 22 bp, Homo sapiens
attttgtgcagttaatacttaa

SEQ ID NO: 2773836 - DNA, 19 bp, Homo sapiens
attttgttaataataagat

SEQ ID NO: 2773837 - DNA, 22 bp, Homo sapiens
attttgttgtgattttgtacag

SEQ ID NO: 2773838 - DNA, 17 bp, Homo sapiens
attttgtttgtaatcct

SEQ ID NO: 2773839 - DNA, 14 bp, Homo sapiens
atttttaaacaagt

SEQ ID NO: 2773840 - DNA, 12 bp, Homo sapiens
atttttaaacta

SEQ ID NO: 2773841 - DNA, 18 bp, Homo sapiens
atttttactaaagcagtg

SEQ ID NO: 2773842 - DNA, 13 bp, Homo sapiens
atttttagagatt

SEQ ID NO: 2773843 - DNA, 20 bp, Homo sapiens
atttttagagattaatttgt

SEQ ID NO: 2773844 - DNA, 16 bp, Homo sapiens
atttttatacatatca

SEQ ID NO: 2773845 - DNA, 20 bp, Homo sapiens
atttttatacatatcagaaa

SEQ ID NO: 2773846 - DNA, 21 bp, Homo sapiens
atttttatacatatcagaaaa

SEQ ID NO: 2773847 - DNA, 23 bp, Homo sapiens
atttttatacatatcagaaaagt

SEQ ID NO: 2773848 - DNA, 15 bp, Homo sapiens
atttttcaaccagca

SEQ ID NO: 2773849 - DNA, 19 bp, Homo sapiens
atttttcattgatatgaaa

SEQ ID NO: 2773850 - DNA, 19 bp, Homo sapiens
atttttgataaattatgtt

SEQ ID NO: 2773851 - DNA, 19 bp, Homo sapiens
atttttgatactaagcatt

SEQ ID NO: 2773852 - DNA, 14 bp, Homo sapiens
attttttaaaaaag

SEQ ID NO: 2773853 - DNA, 20 bp, Homo sapiens
attttttaaaaaagcttaaa

SEQ ID NO: 2773854 - DNA, 17 bp, Homo sapiens
attttttaagtatttat

SEQ ID NO: 2773855 - DNA, 14 bp, Homo sapiens
attttttaataatt

SEQ ID NO: 2773856 - DNA, 18 bp, Homo sapiens
attttttgagtaattcta

SEQ ID NO: 2773857 - DNA, 14 bp, Homo sapiens
atttttttaagtta

SEQ ID NO: 2773858 - DNA, 16 bp, Homo sapiens
atttttttattactga

SEQ ID NO: 2773859 - DNA, 14 bp, Homo sapiens
caaaaaaaaataca

SEQ ID NO: 2773860 - DNA, 19 bp, Homo sapiens
caaaaaaagggcaataaat

SEQ ID NO: 2773861 - DNA, 20 bp, Homo sapiens
caaaaacaaaaccagctgct

SEQ ID NO: 2773862 - DNA, 14 bp, Homo sapiens
caaaaacagcctca

SEQ ID NO: 2773863 - DNA, 20 bp, Homo sapiens
caaaaagggaaactattgtc

SEQ ID NO: 2773864 - DNA, 20 bp, Homo sapiens
caaaaatgagctaggcatgg

SEQ ID NO: 2773865 - DNA, 20 bp, Homo sapiens
caaaaatggtggtttgtcat

SEQ ID NO: 2773866 - DNA, 14 bp, Homo sapiens
caaaaattagccgg

SEQ ID NO: 2773867 - DNA, 15 bp, Homo sapiens
caaaaattagccggg

SEQ ID NO: 2773868 - DNA, 21 bp, Homo sapiens
caaaaattgtgtttagatttt

SEQ ID NO: 2773869 - DNA, 14 bp, Homo sapiens
caaaacaagaaaga

SEQ ID NO: 2773870 - DNA, 16 bp, Homo sapiens
caaaacaagaaagaaa

SEQ ID NO: 2773871 - DNA, 19 bp, Homo sapiens
caagatgagagaactggag

SEQ ID NO: 2773872 - DNA, 16 bp, Homo sapiens
caagattgcttaaaat

SEQ ID NO: 2773873 - DNA, 19 bp, Homo sapiens
caagcaaaggtgaagagac

SEQ ID NO: 2773874 - DNA, 14 bp, Homo sapiens
caagcaataattag

SEQ ID NO: 2773875 - DNA, 18 bp, Homo sapiens
caagcaataattaggatc

SEQ ID NO: 2773876 - DNA, 21 bp, Homo sapiens
caagcaataattaggatctat

SEQ ID NO: 2773877 - DNA, 15 bp, Homo sapiens
caagcaccctgttcc

SEQ ID NO: 2773878 - DNA, 18 bp, Homo sapiens
caagcacctagcctcgct

SEQ ID NO: 2773879 - DNA, 15 bp, Homo sapiens
caagcacctcctgcc

SEQ ID NO: 2773880 - DNA, 18 bp, Homo sapiens
caagcacctcctgcctcg

SEQ ID NO: 2773881 - DNA, 16 bp, Homo sapiens
caagcactaaaaagtg

SEQ ID NO: 2773882 - DNA, 18 bp, Homo sapiens
caagcactgctaggcgag

SEQ ID NO: 2773883 - DNA, 21 bp, Homo sapiens
caagcatggctattttatatt

SEQ ID NO: 2773884 - DNA, 14 bp, Homo sapiens
caagcctgcctagg

SEQ ID NO: 2773885 - DNA, 17 bp, Homo sapiens
caagcgattcttctgct

SEQ ID NO: 2773886 - DNA, 22 bp, Homo sapiens
caagctatgagggtccccggga

SEQ ID NO: 2773887 - DNA, 21 bp, Homo sapiens
caagctcacagttcctcgccc

SEQ ID NO: 2773888 - DNA, 14 bp, Homo sapiens
caagctctgctcct

SEQ ID NO: 2773889 - DNA, 15 bp, Homo sapiens
caagctctgctcctc

SEQ ID NO: 2773890 - DNA, 17 bp, Homo sapiens
caagctgaggtgcccag

SEQ ID NO: 2773891 - DNA, 23 bp, Homo sapiens
caagctggtcccactcagtccat

SEQ ID NO: 2773892 - DNA, 22 bp, Homo sapiens
caagcttcaaccctcagccttg

SEQ ID NO: 2773893 - DNA, 14 bp, Homo sapiens
caagcttcaagtga

SEQ ID NO: 2773894 - DNA, 13 bp, Homo sapiens
caagcttctttta

SEQ ID NO: 2773895 - DNA, 16 bp, Homo sapiens
caagcttgtatataca

SEQ ID NO: 2773896 - DNA, 21 bp, Homo sapiens
caagctttcttctacaaccag

SEQ ID NO: 2773897 - DNA, 22 bp, Homo sapiens
caagctttcttctacaaccaga

SEQ ID NO: 2773898 - DNA, 17 bp, Homo sapiens
caaggaaagccccagca

SEQ ID NO: 2773899 - DNA, 20 bp, Homo sapiens
caaggaaagccccagcacta

SEQ ID NO: 2773900 - DNA, 16 bp, Homo sapiens
caaggaaggaaagaaa

SEQ ID NO: 2773901 - DNA, 23 bp, Homo sapiens
caaggaaggaaagaaagaaggaa

SEQ ID NO: 2773902 - DNA, 18 bp, Homo sapiens
caaggaccgtttttacta

SEQ ID NO: 2773903 - DNA, 15 bp, Homo sapiens
caaggactgcaggga

SEQ ID NO: 2773904 - DNA, 23 bp, Homo sapiens
caaggagatataaaatctagatc

SEQ ID NO: 2773905 - DNA, 15 bp, Homo sapiens
caaggattgctactg

SEQ ID NO: 2773906 - DNA, 15 bp, Homo sapiens
caaggcagcgggatc

SEQ ID NO: 2773907 - DNA, 13 bp, Homo sapiens
caaggcagtgttc

SEQ ID NO: 2773908 - DNA, 16 bp, Homo sapiens
caaggcccgagcagct

SEQ ID NO: 2773909 - DNA, 18 bp, Homo sapiens
caaggcccgagcagctga

SEQ ID NO: 2773910 - DNA, 21 bp, Homo sapiens
caaggcccgagcagctgagca

SEQ ID NO: 2773911 - DNA, 15 bp, Homo sapiens
caaggctctgagcaa

SEQ ID NO: 2773912 - DNA, 22 bp, Homo sapiens
caaggctcttctccttggagga

SEQ ID NO: 2773913 - DNA, 18 bp, Homo sapiens
caaggctgaccaagagag

SEQ ID NO: 2773914 - DNA, 21 bp, Homo sapiens
caaggctgaccaagagagaaa

SEQ ID NO: 2773915 - DNA, 23 bp, Homo sapiens
caaggctgaccaagagagaaaga

SEQ ID NO: 2773916 - DNA, 16 bp, Homo sapiens
caaggctgctcagagg

SEQ ID NO: 2773917 - DNA, 18 bp, Homo sapiens
caagggcggggctatgcc

SEQ ID NO: 2773918 - DNA, 21 bp, Homo sapiens
caaggtgggctgagccctggc

SEQ ID NO: 2773919 - DNA, 19 bp, Homo sapiens
caagtatttgttaatttag

SEQ ID NO: 2773920 - DNA, 18 bp, Homo sapiens
caagtattttatctgtgt

SEQ ID NO: 2773921 - DNA, 20 bp, Homo sapiens
caagtattttatctgtgttg

SEQ ID NO: 2773922 - DNA, 19 bp, Homo sapiens
caagtcaaccaatgtagaa

SEQ ID NO: 2773923 - DNA, 19 bp, Homo sapiens
caagtcaggcccttatttt

SEQ ID NO: 2773924 - DNA, 12 bp, Homo sapiens
caagtcatttta

SEQ ID NO: 2773925 - DNA, 17 bp, Homo sapiens
caagtcattttaacttt

SEQ ID NO: 2773926 - DNA, 16 bp, Homo sapiens
caagtccacctgccta

SEQ ID NO: 2773927 - DNA, 13 bp, Homo sapiens
caagtccaggtcc

SEQ ID NO: 2773928 - DNA, 22 bp, Homo sapiens
caataattaggatctatgcaat

SEQ ID NO: 2773929 - DNA, 23 bp, Homo sapiens
caataattaggatctatgcaatt

SEQ ID NO: 2773930 - DNA, 13 bp, Homo sapiens
caataattttcta

SEQ ID NO: 2773931 - DNA, 14 bp, Homo sapiens
caataattttctac

SEQ ID NO: 2773932 - DNA, 22 bp, Homo sapiens
caatactattatattatgtagt

SEQ ID NO: 2773933 - DNA, 19 bp, Homo sapiens
caatagcagacagtgtttt

SEQ ID NO: 2773934 - DNA, 15 bp, Homo sapiens
caatagctattgcat

SEQ ID NO: 2773935 - DNA, 17 bp, Homo sapiens
caatagctattgcatgt

SEQ ID NO: 2773936 - DNA, 16 bp, Homo sapiens
caatagtcaagaaaaa

SEQ ID NO: 2773937 - DNA, 14 bp, Homo sapiens
caatattaaataca

SEQ ID NO: 2773938 - DNA, 15 bp, Homo sapiens
caatatttgtagaag

SEQ ID NO: 2773939 - DNA, 20 bp, Homo sapiens
caatattttccatgaaaatg

SEQ ID NO: 2773940 - DNA, 15 bp, Homo sapiens
caatcatgagtcaga

SEQ ID NO: 2773941 - DNA, 17 bp, Homo sapiens
caatcattttaattatt

SEQ ID NO: 2773942 - DNA, 21 bp, Homo sapiens
caatccatgttagtttttact

SEQ ID NO: 2773943 - DNA, 22 bp, Homo sapiens
caatccatgttagtttttactt

SEQ ID NO: 2773944 - DNA, 23 bp, Homo sapiens
caatccatgttagtttttacttt

SEQ ID NO: 2773945 - DNA, 21 bp, Homo sapiens
caatcccctcattcaggaaaa

SEQ ID NO: 2773946 - DNA, 18 bp, Homo sapiens
caatcccgtgaaagaatt

SEQ ID NO: 2773947 - DNA, 22 bp, Homo sapiens
caatcccttaatatcctaaaca

SEQ ID NO: 2773948 - DNA, 12 bp, Homo sapiens
caatctccaggg

SEQ ID NO: 2773949 - DNA, 17 bp, Homo sapiens
caatgaaatatttgctt

SEQ ID NO: 2773950 - DNA, 20 bp, Homo sapiens
caatgaaggaaaacctcact

SEQ ID NO: 2773951 - DNA, 22 bp, Homo sapiens
caatgaaggaaaacctcacttg

SEQ ID NO: 2773952 - DNA, 18 bp, Homo sapiens
caatgatgattaaacacc

SEQ ID NO: 2773953 - DNA, 22 bp, Homo sapiens
caatgatgattaaacacctgac

SEQ ID NO: 2773954 - DNA, 21 bp, Homo sapiens
caatgatggcaattttgtaac

SEQ ID NO: 2773955 - DNA, 19 bp, Homo sapiens
caatgattgtttaattgta

SEQ ID NO: 2773956 - DNA, 23 bp, Homo sapiens
caatgcacctaaagaaaaacaaa

SEQ ID NO: 2773957 - DNA, 14 bp, Homo sapiens
caatgcactgacat

SEQ ID NO: 2773958 - DNA, 21 bp, Homo sapiens
caatgcccgtaagatggctta

SEQ ID NO: 2773959 - DNA, 13 bp, Homo sapiens
caatgctggctgt

SEQ ID NO: 2773960 - DNA, 21 bp, Homo sapiens
caatgctggctgttggctggg

SEQ ID NO: 2773961 - DNA, 22 bp, Homo sapiens
caatgctggctgttggctgggg

SEQ ID NO: 2773962 - DNA, 22 bp, Homo sapiens
caatgcttttctagcaactgtt

SEQ ID NO: 2773963 - DNA, 11 bp, Homo sapiens
caatggcagcc

SEQ ID NO: 2773964 - DNA, 12 bp, Homo sapiens
caatggcagcct

SEQ ID NO: 2773965 - DNA, 16 bp, Homo sapiens
caatggctaattccca

SEQ ID NO: 2773966 - DNA, 19 bp, Homo sapiens
caatggctaattcccagag

SEQ ID NO: 2773967 - DNA, 18 bp, Homo sapiens
caatggcttactccagga

SEQ ID NO: 2773968 - DNA, 22 bp, Homo sapiens
caatggtgttgccctgagtgga

SEQ ID NO: 2773969 - DNA, 13 bp, Homo sapiens
caatggtttgcaa

SEQ ID NO: 2773970 - DNA, 19 bp, Homo sapiens
caatggtttgcaaggaagc

SEQ ID NO: 2773971 - DNA, 20 bp, Homo sapiens
caatggtttgcaaggaagcc

SEQ ID NO: 2773972 - DNA, 15 bp, Homo sapiens
caatgtaacattaat

SEQ ID NO: 2773973 - DNA, 18 bp, Homo sapiens
caatgtaacattaattct

SEQ ID NO: 2773974 - DNA, 22 bp, Homo sapiens
caatgtatgtgaaagtgtaaaa

SEQ ID NO: 2773975 - DNA, 14 bp, Homo sapiens
caatgtcagaaact

SEQ ID NO: 2773976 - DNA, 13 bp, Homo sapiens
caatgtgctctcg

SEQ ID NO: 2773977 - DNA, 21 bp, Homo sapiens
caatgtggttgcaaggccgct

SEQ ID NO: 2773978 - DNA, 12 bp, Homo sapiens
cacaagccacag

SEQ ID NO: 2773979 - DNA, 14 bp, Homo sapiens
cacaagctggaagc

SEQ ID NO: 2773980 - DNA, 15 bp, Homo sapiens
cacaagctggaagca

SEQ ID NO: 2773981 - DNA, 20 bp, Homo sapiens
cacaagcttgtatatacata

SEQ ID NO: 2773982 - DNA, 14 bp, Homo sapiens
cacaaggcagcaag

SEQ ID NO: 2773983 - DNA, 18 bp, Homo sapiens
cacaaggctgaccaagag

SEQ ID NO: 2773984 - DNA, 13 bp, Homo sapiens
cacaagtaaacat

SEQ ID NO: 2773985 - DNA, 16 bp, Homo sapiens
cacaagttatttaaat

SEQ ID NO: 2773986 - DNA, 12 bp, Homo sapiens
cacaatatgaat

SEQ ID NO: 2773987 - DNA, 14 bp, Homo sapiens
cacaatcctgtccc

SEQ ID NO: 2773988 - DNA, 18 bp, Homo sapiens
cacaatctgggactttca

SEQ ID NO: 2773989 - DNA, 22 bp, Homo sapiens
cacaatgatgattaaacacctg

SEQ ID NO: 2773990 - DNA, 23 bp, Homo sapiens
cacaattccatttccagttcatc

SEQ ID NO: 2773991 - DNA, 16 bp, Homo sapiens
cacaatttgagcaatt

SEQ ID NO: 2773992 - DNA, 18 bp, Homo sapiens
cacacaaaggtataattt

SEQ ID NO: 2773993 - DNA, 13 bp, Homo sapiens
cacacacactcta

SEQ ID NO: 2773994 - DNA, 13 bp, Homo sapiens
cacacacaggcaa

SEQ ID NO: 2773995 - DNA, 15 bp, Homo sapiens
cacacaccagagccc

SEQ ID NO: 2773996 - DNA, 16 bp, Homo sapiens
cacacaccagagccca

SEQ ID NO: 2773997 - DNA, 17 bp, Homo sapiens
cacacacgcgtgcacac

SEQ ID NO: 2773998 - DNA, 15 bp, Homo sapiens
cacacagagcctgcc

SEQ ID NO: 2773999 - DNA, 18 bp, Homo sapiens
cacacagaggaagagcag

SEQ ID NO: 2774000 - DNA, 12 bp, Homo sapiens
cacacagcactc

SEQ ID NO: 2774001 - DNA, 17 bp, Homo sapiens
cacacagctctgtcctg

SEQ ID NO: 2774002 - DNA, 10 bp, Homo sapiens
cacacaggca

SEQ ID NO: 2774003 - DNA, 16 bp, Homo sapiens
cacacaggcaactgag

SEQ ID NO: 2774004 - DNA, 19 bp, Homo sapiens
cacacaggcaactgaggca

SEQ ID NO: 2774005 - DNA, 16 bp, Homo sapiens
cacacaggcatttcct

SEQ ID NO: 2774006 - DNA, 19 bp, Homo sapiens
cacacaggcatttcctggg

SEQ ID NO: 2774007 - DNA, 20 bp, Homo sapiens
cacacaggcatttcctgggt

SEQ ID NO: 2774008 - DNA, 13 bp, Homo sapiens
cacaccagagccc

SEQ ID NO: 2774009 - DNA, 21 bp, Homo sapiens
cacaccagagcccaccttggc

SEQ ID NO: 2774010 - DNA, 20 bp, Homo sapiens
cacacccggctccccctgct

SEQ ID NO: 2774011 - DNA, 23 bp, Homo sapiens
cacaccctccccattcagacact

SEQ ID NO: 2774012 - DNA, 17 bp, Homo sapiens
cacacctccctgaacca

SEQ ID NO: 2774013 - DNA, 14 bp, Homo sapiens
cacacgcaggaact

SEQ ID NO: 2774014 - DNA, 20 bp, Homo sapiens
cacacgcaggaactcccagc

SEQ ID NO: 2774015 - DNA, 18 bp, Homo sapiens
cacacggaggcatctgca

SEQ ID NO: 2774016 - DNA, 17 bp, Homo sapiens
cacacgtacttaaatga

SEQ ID NO: 2774017 - DNA, 20 bp, Homo sapiens
cacactcagtcccccaccac

SEQ ID NO: 2774018 - DNA, 20 bp, Homo sapiens
cacactgcaagagccttggt

SEQ ID NO: 2774019 - DNA, 23 bp, Homo sapiens
cacactgtagcattacagtgggt

SEQ ID NO: 2774020 - DNA, 20 bp, Homo sapiens
cacactgtgcgttttagagt

SEQ ID NO: 2774021 - DNA, 19 bp, Homo sapiens
cacactgttactccacagc

SEQ ID NO: 2774022 - DNA, 17 bp, Homo sapiens
cacacttctcaggacac

SEQ ID NO: 2774023 - DNA, 15 bp, Homo sapiens
atcataattttcaag

SEQ ID NO: 2774024 - DNA, 23 bp, Homo sapiens
atcatagtggcttaaaacaacac

SEQ ID NO: 2774025 - DNA, 16 bp, Homo sapiens
atcatataataaatgt

SEQ ID NO: 2774026 - DNA, 20 bp, Homo sapiens
atcatataataaatgtacat

SEQ ID NO: 2774027 - DNA, 14 bp, Homo sapiens
atcatccagaagtt

SEQ ID NO: 2774028 - DNA, 19 bp, Homo sapiens
atcatgaaacacttctcat

SEQ ID NO: 2774029 - DNA, 16 bp, Homo sapiens
atcatgcctctgaggc

SEQ ID NO: 2774030 - DNA, 23 bp, Homo sapiens
atcatgcctctgaggccagcctg

SEQ ID NO: 2774031 - DNA, 12 bp, Homo sapiens
atcatggagtga

SEQ ID NO: 2774032 - DNA, 13 bp, Homo sapiens
atcatgtacattt

SEQ ID NO: 2774033 - DNA, 14 bp, Homo sapiens
atcatgtacatttc

SEQ ID NO: 2774034 - DNA, 15 bp, Homo sapiens
atcatgtacatttct

SEQ ID NO: 2774035 - DNA, 17 bp, Homo sapiens
atcatgtgcctggaaat

SEQ ID NO: 2774036 - DNA, 23 bp, Homo sapiens
atcattaaattggaattttctta

SEQ ID NO: 2774037 - DNA, 23 bp, Homo sapiens
atcattataaacgtgatgatcag

SEQ ID NO: 2774038 - DNA, 15 bp, Homo sapiens
atcattcatttttgt

SEQ ID NO: 2774039 - DNA, 17 bp, Homo sapiens
atcatttgaacaactag

SEQ ID NO: 2774040 - DNA, 15 bp, Homo sapiens
atcattttaattatt

SEQ ID NO: 2774041 - DNA, 22 bp, Homo sapiens
atcattttcttatcttctgcaa

SEQ ID NO: 2774042 - DNA, 14 bp, Homo sapiens
atcatttttttaac

SEQ ID NO: 2774043 - DNA, 21 bp, Homo sapiens
atccaaagaaaaagggctgcc

SEQ ID NO: 2774044 - DNA, 15 bp, Homo sapiens
atccaaaggaatcag

SEQ ID NO: 2774045 - DNA, 18 bp, Homo sapiens
atccaaccccccacctgc

SEQ ID NO: 2774046 - DNA, 21 bp, Homo sapiens
atccaagctggtcccactcag

SEQ ID NO: 2774047 - DNA, 22 bp, Homo sapiens
atccaaggagaaacagagacag

SEQ ID NO: 2774048 - DNA, 22 bp, Homo sapiens
atccaagtattttatctgtgtt

SEQ ID NO: 2774049 - DNA, 14 bp, Homo sapiens
atccaattatgtga

SEQ ID NO: 2774050 - DNA, 17 bp, Homo sapiens
atccaattatgtgacaa

SEQ ID NO: 2774051 - DNA, 15 bp, Homo sapiens
atccacacacagagg

SEQ ID NO: 2774052 - DNA, 18 bp, Homo sapiens
atccacccacctcagcct

SEQ ID NO: 2774053 - DNA, 13 bp, Homo sapiens
atccacccagccc

SEQ ID NO: 2774054 - DNA, 21 bp, Homo sapiens
atccactgtgccatgtgccag

SEQ ID NO: 2774055 - DNA, 15 bp, Homo sapiens
atccacttcttaatg

SEQ ID NO: 2774056 - DNA, 12 bp, Homo sapiens
atccactttgca

SEQ ID NO: 2774057 - DNA, 15 bp, Homo sapiens
atccagaaaatgtgt

SEQ ID NO: 2774058 - DNA, 22 bp, Homo sapiens
atccagaaaatgtgtcagcatg

SEQ ID NO: 2774059 - DNA, 23 bp, Homo sapiens
atccagaaaatgtgtcagcatgc

SEQ ID NO: 2774060 - DNA, 14 bp, Homo sapiens
atccagaaagaaaa

SEQ ID NO: 2774061 - DNA, 15 bp, Homo sapiens
atccagacccggctg

SEQ ID NO: 2774062 - DNA, 20 bp, Homo sapiens
atccagagggttgtgatttt

SEQ ID NO: 2774063 - DNA, 22 bp, Homo sapiens
atccagagtttagaggaaaaaa

SEQ ID NO: 2774064 - DNA, 23 bp, Homo sapiens
atccagtgtgcacccctccccat

SEQ ID NO: 2774065 - DNA, 13 bp, Homo sapiens
atccatcaggcca

SEQ ID NO: 2774066 - DNA, 13 bp, Homo sapiens
atccatcctgcga

SEQ ID NO: 2774067 - DNA, 18 bp, Homo sapiens
atccatgttagtttttac

SEQ ID NO: 2774068 - DNA, 19 bp, Homo sapiens
atccatgttagtttttact

SEQ ID NO: 2774069 - DNA, 23 bp, Homo sapiens
atccatttcatctatttctgaga

SEQ ID NO: 2774070 - DNA, 23 bp, Homo sapiens
atcccagccctttgggaggctga

SEQ ID NO: 2774071 - DNA, 18 bp, Homo sapiens
atcccagctactcaggag

SEQ ID NO: 2774072 - DNA, 20 bp, Homo sapiens
atcccagctactcgggaggc

SEQ ID NO: 2774073 - DNA, 22 bp, Homo sapiens
atcccagctacttgggaggctg

SEQ ID NO: 2774074 - DNA, 19 bp, Homo sapiens
atcccatctaagctgcagc

SEQ ID NO: 2774075 - DNA, 16 bp, Homo sapiens
atcccatgagcctcag

SEQ ID NO: 2774076 - DNA, 18 bp, Homo sapiens
atccccaagctggcagct

SEQ ID NO: 2774077 - DNA, 20 bp, Homo sapiens
atcccccactgccacaccct

SEQ ID NO: 2774078 - DNA, 19 bp, Homo sapiens
atcccctttcctccccacc

SEQ ID NO: 2774079 - DNA, 20 bp, Homo sapiens
atcccctttcctccccacct

SEQ ID NO: 2774080 - DNA, 14 bp, Homo sapiens
atcccgaaaatctc

SEQ ID NO: 2774081 - DNA, 14 bp, Homo sapiens
atccctagctgtga

SEQ ID NO: 2774082 - DNA, 17 bp, Homo sapiens
atccctatgggattcag

SEQ ID NO: 2774083 - DNA, 13 bp, Homo sapiens
atccctatttaat

SEQ ID NO: 2774084 - DNA, 16 bp, Homo sapiens
atccctgggcctgctg

SEQ ID NO: 2774085 - DNA, 18 bp, Homo sapiens
atccctgggcctgctgct

SEQ ID NO: 2774086 - DNA, 22 bp, Homo sapiens
atcccttgtacctatggctgcc

SEQ ID NO: 2774087 - DNA, 12 bp, Homo sapiens
atccgaggcagg

SEQ ID NO: 2774088 - DNA, 18 bp, Homo sapiens
atcctaggcttaaatgca

SEQ ID NO: 2774089 - DNA, 18 bp, Homo sapiens
atcctattctcaccagga

SEQ ID NO: 2774090 - DNA, 20 bp, Homo sapiens
atcctccaacgttaaaagac

SEQ ID NO: 2774091 - DNA, 19 bp, Homo sapiens
atcctcccacctcagcctc

SEQ ID NO: 2774092 - DNA, 20 bp, Homo sapiens
atcctcccacctcagcctcc

SEQ ID NO: 2774093 - DNA, 18 bp, Homo sapiens
atcctctgagtgtgacca

SEQ ID NO: 2774094 - DNA, 14 bp, Homo sapiens
atcctgaaatttca

SEQ ID NO: 2774095 - DNA, 16 bp, Homo sapiens
atcctgaaatttcaga

SEQ ID NO: 2774096 - DNA, 12 bp, Homo sapiens
atcctgataaac

SEQ ID NO: 2774097 - DNA, 19 bp, Homo sapiens
atcctgataaacattaaac

SEQ ID NO: 2774098 - DNA, 16 bp, Homo sapiens
atcctgcagcctcctc

SEQ ID NO: 2774099 - DNA, 17 bp, Homo sapiens
atcctgcagcctcctcc

SEQ ID NO: 2774100 - DNA, 22 bp, Homo sapiens
atcctgcattttacgtctttgg

SEQ ID NO: 2774101 - DNA, 17 bp, Homo sapiens
atcctgccttcatggaa

SEQ ID NO: 2774102 - DNA, 16 bp, Homo sapiens
atcctgctagctgtag

SEQ ID NO: 2774103 - DNA, 14 bp, Homo sapiens
atcctgctgctgtg

SEQ ID NO: 2774104 - DNA, 20 bp, Homo sapiens
atcctggcacccggcccctg

SEQ ID NO: 2774105 - DNA, 21 bp, Homo sapiens
atcctggcacccggcccctgc

SEQ ID NO: 2774106 - DNA, 19 bp, Homo sapiens
atcctgttaggggaaaata

SEQ ID NO: 2774107 - DNA, 20 bp, Homo sapiens
atccttcaccagagcccatg

SEQ ID NO: 2774108 - DNA, 15 bp, Homo sapiens
atcctttctattgaa

SEQ ID NO: 2774109 - DNA, 20 bp, Homo sapiens
atcctttgccccaaggctgc

SEQ ID NO: 2774110 - DNA, 14 bp, Homo sapiens
atcgaatgaaatta

SEQ ID NO: 2774111 - DNA, 20 bp, Homo sapiens
atcgcaccactgtgtattta

SEQ ID NO: 2774112 - DNA, 23 bp, Homo sapiens
atcgcgccactacactccagcct

SEQ ID NO: 2774113 - DNA, 13 bp, Homo sapiens
atcggagacagtg

SEQ ID NO: 2774114 - DNA, 16 bp, Homo sapiens
atcggagcgaagcaga

SEQ ID NO: 2774115 - DNA, 17 bp, Homo sapiens
atcgggagcagtgtctt

SEQ ID NO: 2774116 - DNA, 20 bp, Homo sapiens
atcgggataacaaaatcaca

SEQ ID NO: 2774117 - DNA, 22 bp, Homo sapiens
atcgggataacaaaatcacaag

SEQ ID NO: 2774118 - DNA, 14 bp, Homo sapiens
atcgtattaattat

SEQ ID NO: 2774119 - DNA, 18 bp, Homo sapiens
atcgtctcctttgacatt

SEQ ID NO: 2774120 - DNA, 18 bp, Homo sapiens
atcgtgccgttactctcc

SEQ ID NO: 2774121 - DNA, 23 bp, Homo sapiens
atcgtgccgttactctccaacct

SEQ ID NO: 2774122 - DNA, 15 bp, Homo sapiens
atcgtgcctataaat

SEQ ID NO: 2774123 - DNA, 14 bp, Homo sapiens
atcgttatgtgtgt

SEQ ID NO: 2774124 - DNA, 17 bp, Homo sapiens
atctaatacctctgtgt

SEQ ID NO: 2774125 - DNA, 20 bp, Homo sapiens
atctaatcaggttgttaatg

SEQ ID NO: 2774126 - DNA, 21 bp, Homo sapiens
atctaatcaggttgttaatgt

SEQ ID NO: 2774127 - DNA, 14 bp, Homo sapiens
atctacacagcctg

SEQ ID NO: 2774128 - DNA, 17 bp, Homo sapiens
atctacacagcctggac

SEQ ID NO: 2774129 - DNA, 22 bp, Homo sapiens
atctacacagcctggactttgg

SEQ ID NO: 2774130 - DNA, 20 bp, Homo sapiens
atctactaaaaatacaaaaa

SEQ ID NO: 2774131 - DNA, 21 bp, Homo sapiens
atctagaatgtgttttctgaa

SEQ ID NO: 2774132 - DNA, 23 bp, Homo sapiens
atctagaggcttccttcatttcc

SEQ ID NO: 2774133 - DNA, 18 bp, Homo sapiens
atctagctctagttcaaa

SEQ ID NO: 2774134 - DNA, 22 bp, Homo sapiens
atctatagtagtcaattagtac

SEQ ID NO: 2774135 - DNA, 15 bp, Homo sapiens
atctatatttaacaa

SEQ ID NO: 2774136 - DNA, 15 bp, Homo sapiens
atctatcaatagtca

SEQ ID NO: 2774137 - DNA, 17 bp, Homo sapiens
atctatcaatagtcaag

SEQ ID NO: 2774138 - DNA, 20 bp, Homo sapiens
atctatcaatagtcaagaaa

SEQ ID NO: 2774139 - DNA, 14 bp, Homo sapiens
atctatctatttga

SEQ ID NO: 2774140 - DNA, 19 bp, Homo sapiens
atctatctgtattttcatt

SEQ ID NO: 2774141 - DNA, 13 bp, Homo sapiens
atctatgcaattt

SEQ ID NO: 2774142 - DNA, 15 bp, Homo sapiens
atctatgcaattttt

SEQ ID NO: 2774143 - DNA, 20 bp, Homo sapiens
atctatgcaatttttaaact

SEQ ID NO: 2774144 - DNA, 24 bp, Homo sapiens
atctatgcaatttttaaactagta

SEQ ID NO: 2774145 - DNA, 19 bp, Homo sapiens
atctatggcagtccagcca

SEQ ID NO: 2774146 - DNA, 20 bp, Homo sapiens
atctatggcagtccagccag

SEQ ID NO: 2774147 - DNA, 17 bp, Homo sapiens
atctattataaaaccat

SEQ ID NO: 2774148 - DNA, 15 bp, Homo sapiens
atctattcagacaag

SEQ ID NO: 2774149 - DNA, 15 bp, Homo sapiens
atctatttctgagaa

SEQ ID NO: 2774150 - DNA, 14 bp, Homo sapiens
atctcaaaaaataa

SEQ ID NO: 2774151 - DNA, 22 bp, Homo sapiens
atctcagagacaggtggcctag

SEQ ID NO: 2774152 - DNA, 19 bp, Homo sapiens
atctcagaggctatagctg

SEQ ID NO: 2774153 - DNA, 12 bp, Homo sapiens
atctcaggagct

SEQ ID NO: 2774154 - DNA, 14 bp, Homo sapiens
atctcagtgaagaa

SEQ ID NO: 2774155 - DNA, 17 bp, Homo sapiens
atctcatggaaactggc

SEQ ID NO: 2774156 - DNA, 13 bp, Homo sapiens
atctcatttaagg

SEQ ID NO: 2774157 - DNA, 20 bp, Homo sapiens
atctcatttaagggaaaaat

SEQ ID NO: 2774158 - DNA, 21 bp, Homo sapiens
atctcatttttccgtaaaaat

SEQ ID NO: 2774159 - DNA, 12 bp, Homo sapiens
atctccaaggac

SEQ ID NO: 2774160 - DNA, 20 bp, Homo sapiens
atctccaggattgaagagca

SEQ ID NO: 2774161 - DNA, 17 bp, Homo sapiens
atctccagggctgcccc

SEQ ID NO: 2774162 - DNA, 20 bp, Homo sapiens
atctcccccatcccccactg

SEQ ID NO: 2774163 - DNA, 23 bp, Homo sapiens
atctcccctcctcacagttgcca

SEQ ID NO: 2774164 - DNA, 18 bp, Homo sapiens
atctcctatttttcagaa

SEQ ID NO: 2774165 - DNA, 20 bp, Homo sapiens
atctcctatttttcagaatg

SEQ ID NO: 2774166 - DNA, 13 bp, Homo sapiens
atctcctgtaatt

SEQ ID NO: 2774167 - DNA, 23 bp, Homo sapiens
atctctaattggaagaaattcct

SEQ ID NO: 2774168 - DNA, 21 bp, Homo sapiens
atctctagaattttaagtgct

SEQ ID NO: 2774169 - DNA, 14 bp, Homo sapiens
atctctcaggagca

SEQ ID NO: 2774170 - DNA, 21 bp, Homo sapiens
atctctcaggagcacaggcag

SEQ ID NO: 2774171 - DNA, 20 bp, Homo sapiens
atctctcggttccacgtccc

SEQ ID NO: 2774172 - DNA, 22 bp, Homo sapiens
atctctctgaatcctaagggct

SEQ ID NO: 2774173 - DNA, 23 bp, Homo sapiens
atctctcttccctaatcctccaa

SEQ ID NO: 2774174 - DNA, 22 bp, Homo sapiens
atctctgtgtacccactcctca

SEQ ID NO: 2774175 - DNA, 24 bp, Homo sapiens
atctctgtgtacccactcctcact

SEQ ID NO: 2774176 - DNA, 15 bp, Homo sapiens
atctcttgaggccag

SEQ ID NO: 2774177 - DNA, 18 bp, Homo sapiens
atctgaaccactttgcct

SEQ ID NO: 2774178 - DNA, 18 bp, Homo sapiens
atctgaagacctaccagg

SEQ ID NO: 2774179 - DNA, 18 bp, Homo sapiens
atctgaatttttaaacaa

SEQ ID NO: 2774180 - DNA, 22 bp, Homo sapiens
atctgacactaccttatcaggc

SEQ ID NO: 2774181 - DNA, 19 bp, Homo sapiens
atctgacagttactcttca

SEQ ID NO: 2774182 - DNA, 17 bp, Homo sapiens
atctgactttaattgtg

SEQ ID NO: 2774183 - DNA, 18 bp, Homo sapiens
atctgagaaaagctttga

SEQ ID NO: 2774184 - DNA, 17 bp, Homo sapiens
atctgagaagtgtatat

SEQ ID NO: 2774185 - DNA, 18 bp, Homo sapiens
atctgattggacattttc

SEQ ID NO: 2774186 - DNA, 22 bp, Homo sapiens
atctgcatttataaatgtgtgg

SEQ ID NO: 2774187 - DNA, 24 bp, Homo sapiens
atctgcatttataaatgtgtggtg

SEQ ID NO: 2774188 - DNA, 14 bp, Homo sapiens
atctgctaataaaa

SEQ ID NO: 2774189 - DNA, 13 bp, Homo sapiens
atctgctgccccg

SEQ ID NO: 2774190 - DNA, 18 bp, Homo sapiens
atctgcttgtattttcca

SEQ ID NO: 2774191 - DNA, 16 bp, Homo sapiens
atctggaatttaatta

SEQ ID NO: 2774192 - DNA, 17 bp, Homo sapiens
atctggactcctctgtc

SEQ ID NO: 2774193 - DNA, 16 bp, Homo sapiens
atctgggaccctttcc

SEQ ID NO: 2774194 - DNA, 22 bp, Homo sapiens
atctgggaccctttccttcctt

SEQ ID NO: 2774195 - DNA, 23 bp, Homo sapiens
atctgggaccctttccttccttc

SEQ ID NO: 2774196 - DNA, 19 bp, Homo sapiens
atctgtaaggaactggaac

SEQ ID NO: 2774197 - DNA, 21 bp, Homo sapiens
atctgtatatacaataacata

SEQ ID NO: 2774198 - DNA, 12 bp, Homo sapiens
atctgtcatttg

SEQ ID NO: 2774199 - DNA, 22 bp, Homo sapiens
atctgtcatttgagcagggctc

SEQ ID NO: 2774200 - DNA, 18 bp, Homo sapiens
atctgtcttgccagccag

SEQ ID NO: 2774201 - DNA, 23 bp, Homo sapiens
atatctcctgaaaaggtttatga

SEQ ID NO: 2774202 - DNA, 17 bp, Homo sapiens
atatctctaaactgctg

SEQ ID NO: 2774203 - DNA, 22 bp, Homo sapiens
atatctgaacacatactagaaa

SEQ ID NO: 2774204 - DNA, 11 bp, Homo sapiens
atatctgcttt

SEQ ID NO: 2774205 - DNA, 15 bp, Homo sapiens
atatctggacaagcc

SEQ ID NO: 2774206 - DNA, 18 bp, Homo sapiens
atatctgtggtcttcaaa

SEQ ID NO: 2774207 - DNA, 15 bp, Homo sapiens
atatcttatgttaaa

SEQ ID NO: 2774208 - DNA, 12 bp, Homo sapiens
atatcttgaaga

SEQ ID NO: 2774209 - DNA, 17 bp, Homo sapiens
atatcttgaagaatatt

SEQ ID NO: 2774210 - DNA, 13 bp, Homo sapiens
atatgaaaaatat

SEQ ID NO: 2774211 - DNA, 18 bp, Homo sapiens
atatgaaatgataaagat

SEQ ID NO: 2774212 - DNA, 22 bp, Homo sapiens
atatgaaatgataaagatgtca

SEQ ID NO: 2774213 - DNA, 13 bp, Homo sapiens
atatgaaatgttt

SEQ ID NO: 2774214 - DNA, 22 bp, Homo sapiens
atatgaacaaagaaaaaaatat

SEQ ID NO: 2774215 - DNA, 18 bp, Homo sapiens
atatgaagtaagttctga

SEQ ID NO: 2774216 - DNA, 20 bp, Homo sapiens
atatgaagtaagttctgaaa

SEQ ID NO: 2774217 - DNA, 21 bp, Homo sapiens
atatgaagtaagttctgaaaa

SEQ ID NO: 2774218 - DNA, 14 bp, Homo sapiens
atatgacagctgtc

SEQ ID NO: 2774219 - DNA, 15 bp, Homo sapiens
atatgactgttttta

SEQ ID NO: 2774220 - DNA, 15 bp, Homo sapiens
atatgatgttaaaaa

SEQ ID NO: 2774221 - DNA, 19 bp, Homo sapiens
atatgcaccttgtgtctgt

SEQ ID NO: 2774222 - DNA, 21 bp, Homo sapiens
atatgcaccttgtgtctgtac

SEQ ID NO: 2774223 - DNA, 18 bp, Homo sapiens
atatggactcagttttct

SEQ ID NO: 2774224 - DNA, 16 bp, Homo sapiens
atatggggatgcagca

SEQ ID NO: 2774225 - DNA, 20 bp, Homo sapiens
atatggggatgcagcattat

SEQ ID NO: 2774226 - DNA, 18 bp, Homo sapiens
atatgtaaaacatttatt

SEQ ID NO: 2774227 - DNA, 20 bp, Homo sapiens
atatgtaaaataaaattatg

SEQ ID NO: 2774228 - DNA, 14 bp, Homo sapiens
atatgtacagttat

SEQ ID NO: 2774229 - DNA, 18 bp, Homo sapiens
atatgtagtataaagaaa

SEQ ID NO: 2774230 - DNA, 19 bp, Homo sapiens
atatgtagtataaagaaaa

SEQ ID NO: 2774231 - DNA, 13 bp, Homo sapiens
atatgtatatcta

SEQ ID NO: 2774232 - DNA, 22 bp, Homo sapiens
atatgtatatctatatctctaa

SEQ ID NO: 2774233 - DNA, 15 bp, Homo sapiens
atatgtatgtgtgta

SEQ ID NO: 2774234 - DNA, 16 bp, Homo sapiens
atatgttcaactggag

SEQ ID NO: 2774235 - DNA, 19 bp, Homo sapiens
atatgttcattaaattttc

SEQ ID NO: 2774236 - DNA, 12 bp, Homo sapiens
atatgttgctga

SEQ ID NO: 2774237 - DNA, 16 bp, Homo sapiens
atatgttgttaaacac

SEQ ID NO: 2774238 - DNA, 20 bp, Homo sapiens
atatgttttaagaggcaggg

SEQ ID NO: 2774239 - DNA, 14 bp, Homo sapiens
atattaaacttctg

SEQ ID NO: 2774240 - DNA, 14 bp, Homo sapiens
atattaaaggcttt

SEQ ID NO: 2774241 - DNA, 15 bp, Homo sapiens
atattacactacaca

SEQ ID NO: 2774242 - DNA, 12 bp, Homo sapiens
atattaccaaaa

SEQ ID NO: 2774243 - DNA, 18 bp, Homo sapiens
atattaccaaaaaagtat

SEQ ID NO: 2774244 - DNA, 15 bp, Homo sapiens
atattacctcaaatt

SEQ ID NO: 2774245 - DNA, 20 bp, Homo sapiens
atattagagtgcccttaaaa

SEQ ID NO: 2774246 - DNA, 18 bp, Homo sapiens
atattaggggatggagag

SEQ ID NO: 2774247 - DNA, 13 bp, Homo sapiens
atattataaataa

SEQ ID NO: 2774248 - DNA, 15 bp, Homo sapiens
atattataaataaat

SEQ ID NO: 2774249 - DNA, 20 bp, Homo sapiens
atattataaataaatgccaa

SEQ ID NO: 2774250 - DNA, 19 bp, Homo sapiens
atattataataatgttctc

SEQ ID NO: 2774251 - DNA, 17 bp, Homo sapiens
atattatggtgtaatgc

SEQ ID NO: 2774252 - DNA, 22 bp, Homo sapiens
atattatggtgtaatgcacaat

SEQ ID NO: 2774253 - DNA, 23 bp, Homo sapiens
atattcagagatgtaccatgtta

SEQ ID NO: 2774254 - DNA, 22 bp, Homo sapiens
atattcagtgctgtggcctggg

SEQ ID NO: 2774255 - DNA, 14 bp, Homo sapiens
atattcatgtaata

SEQ ID NO: 2774256 - DNA, 15 bp, Homo sapiens
atattcatgtaataa

SEQ ID NO: 2774257 - DNA, 16 bp, Homo sapiens
atattcatgtaataaa

SEQ ID NO: 2774258 - DNA, 16 bp, Homo sapiens
atattcattgtataaa

SEQ ID NO: 2774259 - DNA, 18 bp, Homo sapiens
atattccaccattcacat

SEQ ID NO: 2774260 - DNA, 19 bp, Homo sapiens
atattccaccattcacatt

SEQ ID NO: 2774261 - DNA, 15 bp, Homo sapiens
atattcctgaatgaa

SEQ ID NO: 2774262 - DNA, 22 bp, Homo sapiens
atattcctgaatgaaatatcag

SEQ ID NO: 2774263 - DNA, 16 bp, Homo sapiens
atattgcatatgcata

SEQ ID NO: 2774264 - DNA, 17 bp, Homo sapiens
atattgtcagatatttt

SEQ ID NO: 2774265 - DNA, 14 bp, Homo sapiens
atatttaagtatat

SEQ ID NO: 2774266 - DNA, 15 bp, Homo sapiens
atatttaagtatata

SEQ ID NO: 2774267 - DNA, 12 bp, Homo sapiens
atatttaattgt

SEQ ID NO: 2774268 - DNA, 13 bp, Homo sapiens
atatttaattgtg

SEQ ID NO: 2774269 - DNA, 15 bp, Homo sapiens
atatttaattgtgtc

SEQ ID NO: 2774270 - DNA, 18 bp, Homo sapiens
atatttacatatgaaatt

SEQ ID NO: 2774271 - DNA, 17 bp, Homo sapiens
atatttataactcatca

SEQ ID NO: 2774272 - DNA, 20 bp, Homo sapiens
atatttataactcatcataa

SEQ ID NO: 2774273 - DNA, 15 bp, Homo sapiens
atatttatagtcaca

SEQ ID NO: 2774274 - DNA, 23 bp, Homo sapiens
atatttattgtttatttatcagt

SEQ ID NO: 2774275 - DNA, 19 bp, Homo sapiens
atatttattttttttaagt

SEQ ID NO: 2774276 - DNA, 15 bp, Homo sapiens
atatttgcttattta

SEQ ID NO: 2774277 - DNA, 14 bp, Homo sapiens
atatttggaaagag

SEQ ID NO: 2774278 - DNA, 21 bp, Homo sapiens
atatttgttaaatatttacat

SEQ ID NO: 2774279 - DNA, 22 bp, Homo sapiens
atatttgttaaatatttacata

SEQ ID NO: 2774280 - DNA, 14 bp, Homo sapiens
atattttaaagaat

SEQ ID NO: 2774281 - DNA, 20 bp, Homo sapiens
atattttaaagaattgtgtc

SEQ ID NO: 2774282 - DNA, 14 bp, Homo sapiens
atattttataattt

SEQ ID NO: 2774283 - DNA, 22 bp, Homo sapiens
atattttatatgaaatgtttca

SEQ ID NO: 2774284 - DNA, 12 bp, Homo sapiens
ataattccctat

SEQ ID NO: 2774285 - DNA, 12 bp, Homo sapiens
ataattgtgtac

SEQ ID NO: 2774286 - DNA, 17 bp, Homo sapiens
ataattgtgtacaaagt

SEQ ID NO: 2774287 - DNA, 21 bp, Homo sapiens
ataattgttttatctgaattt

SEQ ID NO: 2774288 - DNA, 15 bp, Homo sapiens
ataatttaactaatt

SEQ ID NO: 2774289 - DNA, 16 bp, Homo sapiens
ataatttaactaattt

SEQ ID NO: 2774290 - DNA, 23 bp, Homo sapiens
ataatttaactaatttaaaccag

SEQ ID NO: 2774291 - DNA, 18 bp, Homo sapiens
ataatttcttactaaaca

SEQ ID NO: 2774292 - DNA, 22 bp, Homo sapiens
ataatttgtacatatgtaaaat

SEQ ID NO: 2774293 - DNA, 15 bp, Homo sapiens
ataattttatgaatg

SEQ ID NO: 2774294 - DNA, 11 bp, Homo sapiens
ataattttcct

SEQ ID NO: 2774295 - DNA, 19 bp, Homo sapiens
ataatttttaaagtatata

SEQ ID NO: 2774296 - DNA, 22 bp, Homo sapiens
ataatttttttcaatatttatt

SEQ ID NO: 2774297 - DNA, 18 bp, Homo sapiens
atacaaaataaaattatg

SEQ ID NO: 2774298 - DNA, 14 bp, Homo sapiens
atacaatttgcact

SEQ ID NO: 2774299 - DNA, 16 bp, Homo sapiens
atacacagatgattaa

SEQ ID NO: 2774300 - DNA, 20 bp, Homo sapiens
atacacatccccagccagaa

SEQ ID NO: 2774301 - DNA, 14 bp, Homo sapiens
atacagacactaag

SEQ ID NO: 2774302 - DNA, 15 bp, Homo sapiens
atacagacactaagt

SEQ ID NO: 2774303 - DNA, 19 bp, Homo sapiens
atacaggaaaagctgctga

SEQ ID NO: 2774304 - DNA, 22 bp, Homo sapiens
atacaggaaaagctgctgacag

SEQ ID NO: 2774305 - DNA, 13 bp, Homo sapiens
atacatacctact

SEQ ID NO: 2774306 - DNA, 17 bp, Homo sapiens
atacatacctctctcta

SEQ ID NO: 2774307 - DNA, 14 bp, Homo sapiens
atacatatcagaaa

SEQ ID NO: 2774308 - DNA, 16 bp, Homo sapiens
atacatatcagaaaag

SEQ ID NO: 2774309 - DNA, 18 bp, Homo sapiens
atacatatcagaaaagta

SEQ ID NO: 2774310 - DNA, 20 bp, Homo sapiens
atacatatcagaaaagtaga

SEQ ID NO: 2774311 - DNA, 22 bp, Homo sapiens
atacatatcagaaaagtagaat

SEQ ID NO: 2774312 - DNA, 22 bp, Homo sapiens
atacatattataaataaatgcc

SEQ ID NO: 2774313 - DNA, 22 bp, Homo sapiens
atacatgctaagagaagtagaa

SEQ ID NO: 2774314 - DNA, 13 bp, Homo sapiens
atacatgtatagt

SEQ ID NO: 2774315 - DNA, 22 bp, Homo sapiens
atacattccctatcaaaacata

SEQ ID NO: 2774316 - DNA, 20 bp, Homo sapiens
atacatttataatgtttgct

SEQ ID NO: 2774317 - DNA, 21 bp, Homo sapiens
atacatttataatgtttgcta

SEQ ID NO: 2774318 - DNA, 23 bp, Homo sapiens
atacatttataatgtttgctatt

SEQ ID NO: 2774319 - DNA, 19 bp, Homo sapiens
atacccagtgtttggggtg

SEQ ID NO: 2774320 - DNA, 18 bp, Homo sapiens
atacccttctttaaatca

SEQ ID NO: 2774321 - DNA, 19 bp, Homo sapiens
atacccttctttaaatcaa

SEQ ID NO: 2774322 - DNA, 21 bp, Homo sapiens
atacccttctttaaatcaaaa

SEQ ID NO: 2774323 - DNA, 24 bp, Homo sapiens
atacccttctttaaatcaaaagct

SEQ ID NO: 2774324 - DNA, 22 bp, Homo sapiens
atacctactgactgatgacaaa

SEQ ID NO: 2774325 - DNA, 14 bp, Homo sapiens
atacctctctctat

SEQ ID NO: 2774326 - DNA, 18 bp, Homo sapiens
atacctctctctatatat

SEQ ID NO: 2774327 - DNA, 20 bp, Homo sapiens
atacctctctctatatatac

SEQ ID NO: 2774328 - DNA, 12 bp, Homo sapiens
atacctctgtgt

SEQ ID NO: 2774329 - DNA, 13 bp, Homo sapiens
atacctctgtgtg

SEQ ID NO: 2774330 - DNA, 14 bp, Homo sapiens
atacctctgtgtgc

SEQ ID NO: 2774331 - DNA, 14 bp, Homo sapiens
ataccttcttcgct

SEQ ID NO: 2774332 - DNA, 21 bp, Homo sapiens
atactaagcattgaatggcta

SEQ ID NO: 2774333 - DNA, 17 bp, Homo sapiens
atactctagaacatgca

SEQ ID NO: 2774334 - DNA, 20 bp, Homo sapiens
atactctagaacatgcacat

SEQ ID NO: 2774335 - DNA, 22 bp, Homo sapiens
atactctagaacatgcacattt

SEQ ID NO: 2774336 - DNA, 21 bp, Homo sapiens
atactcttaggaagagaaacc

SEQ ID NO: 2774337 - DNA, 19 bp, Homo sapiens
atactggaagttttgcatt

SEQ ID NO: 2774338 - DNA, 19 bp, Homo sapiens
atactgggtacaagagcca

SEQ ID NO: 2774339 - DNA, 12 bp, Homo sapiens
atacttaacatt

SEQ ID NO: 2774340 - DNA, 21 bp, Homo sapiens
atagaaactcaccatgtaaaa

SEQ ID NO: 2774341 - DNA, 21 bp, Homo sapiens
atagaactcagttttaactag

SEQ ID NO: 2774342 - DNA, 20 bp, Homo sapiens
atagaagaatacaaacatat

SEQ ID NO: 2774343 - DNA, 19 bp, Homo sapiens
atagaatatttattacctc

SEQ ID NO: 2774344 - DNA, 16 bp, Homo sapiens
atagacatttgtaaat

SEQ ID NO: 2774345 - DNA, 21 bp, Homo sapiens
atagatcttctgaaatgaaac

SEQ ID NO: 2774346 - DNA, 22 bp, Homo sapiens
atagatgggtctggctgagctg

SEQ ID NO: 2774347 - DNA, 17 bp, Homo sapiens
atagcaaaagaagaagt

SEQ ID NO: 2774348 - DNA, 14 bp, Homo sapiens
atagcaaagaattg

SEQ ID NO: 2774349 - DNA, 22 bp, Homo sapiens
atagcaatccatgttagttttt

SEQ ID NO: 2774350 - DNA, 14 bp, Homo sapiens
atagcagattttaa

SEQ ID NO: 2774351 - DNA, 15 bp, Homo sapiens
atagccaaaaatagc

SEQ ID NO: 2774352 - DNA, 22 bp, Homo sapiens
atagccacatccctttgaaaca

SEQ ID NO: 2774353 - DNA, 21 bp, Homo sapiens
atagccacttaccttcaataa

SEQ ID NO: 2774354 - DNA, 17 bp, Homo sapiens
agtctgaggtcctgagc

SEQ ID NO: 2774355 - DNA, 18 bp, Homo sapiens
agtctgaggtcctgagca

SEQ ID NO: 2774356 - DNA, 19 bp, Homo sapiens
agtctgaggtcctgagcac

SEQ ID NO: 2774357 - DNA, 20 bp, Homo sapiens
agtctgaggtcctgagcact

SEQ ID NO: 2774358 - DNA, 13 bp, Homo sapiens
agtctgagtgggc

SEQ ID NO: 2774359 - DNA, 16 bp, Homo sapiens
agtctgattcccaagc

SEQ ID NO: 2774360 - DNA, 17 bp, Homo sapiens
agtctggaatgcagtgg

SEQ ID NO: 2774361 - DNA, 15 bp, Homo sapiens
agtctggatctggga

SEQ ID NO: 2774362 - DNA, 16 bp, Homo sapiens
agtctgggctgccggg

SEQ ID NO: 2774363 - DNA, 14 bp, Homo sapiens
agtctgggtgtctc

SEQ ID NO: 2774364 - DNA, 12 bp, Homo sapiens
agtctgtcatcc

SEQ ID NO: 2774365 - DNA, 23 bp, Homo sapiens
agtcttaaaataacttatatcat

SEQ ID NO: 2774366 - DNA, 22 bp, Homo sapiens
agtcttaatatatatatccaga

SEQ ID NO: 2774367 - DNA, 13 bp, Homo sapiens
agtcttccctgat

SEQ ID NO: 2774368 - DNA, 15 bp, Homo sapiens
agtgaacaactattt

SEQ ID NO: 2774369 - DNA, 13 bp, Homo sapiens
agtgaaccaaaga

SEQ ID NO: 2774370 - DNA, 23 bp, Homo sapiens
agtgaaccaaagagactggagca

SEQ ID NO: 2774371 - DNA, 13 bp, Homo sapiens
agtgaaccatcat

SEQ ID NO: 2774372 - DNA, 22 bp, Homo sapiens
agtgaagaaaagtgaatgctca

SEQ ID NO: 2774373 - DNA, 23 bp, Homo sapiens
agtgaagaaaagtgaatgctcaa

SEQ ID NO: 2774374 - DNA, 14 bp, Homo sapiens
agtgaagaatactt

SEQ ID NO: 2774375 - DNA, 19 bp, Homo sapiens
agtgaagagggagaaggga

SEQ ID NO: 2774376 - DNA, 21 bp, Homo sapiens
agtgaagttcttttactgtaa

SEQ ID NO: 2774377 - DNA, 15 bp, Homo sapiens
agtgaataaacttca

SEQ ID NO: 2774378 - DNA, 17 bp, Homo sapiens
agtgaataaacttcagc

SEQ ID NO: 2774379 - DNA, 18 bp, Homo sapiens
agtgaataaacttcagca

SEQ ID NO: 2774380 - DNA, 19 bp, Homo sapiens
agtgaataaacttcagcac

SEQ ID NO: 2774381 - DNA, 20 bp, Homo sapiens
agtgaataaacttcagcacc

SEQ ID NO: 2774382 - DNA, 21 bp, Homo sapiens
agtgaataaacttcagcacca

SEQ ID NO: 2774383 - DNA, 21 bp, Homo sapiens
agtgaattgtgaccaagttat

SEQ ID NO: 2774384 - DNA, 14 bp, Homo sapiens
agtgaatttgcctg

SEQ ID NO: 2774385 - DNA, 19 bp, Homo sapiens
agtgacaaaattggccaga

SEQ ID NO: 2774386 - DNA, 18 bp, Homo sapiens
agtgacagagacccagat

SEQ ID NO: 2774387 - DNA, 14 bp, Homo sapiens
agtgacagaggcag

SEQ ID NO: 2774388 - DNA, 16 bp, Homo sapiens
agtgacagaggcagcc

SEQ ID NO: 2774389 - DNA, 15 bp, Homo sapiens
agtgacagagttcac

SEQ ID NO: 2774390 - DNA, 11 bp, Homo sapiens
agtgacagcta

SEQ ID NO: 2774391 - DNA, 22 bp, Homo sapiens
agtgacatctctttgatgtcat

SEQ ID NO: 2774392 - DNA, 14 bp, Homo sapiens
agtgacgtgcacct

SEQ ID NO: 2774393 - DNA, 14 bp, Homo sapiens
agtgactcgagggt

SEQ ID NO: 2774394 - DNA, 19 bp, Homo sapiens
agtgagaataattgtgtac

SEQ ID NO: 2774395 - DNA, 16 bp, Homo sapiens
agtgagactctgtctc

SEQ ID NO: 2774396 - DNA, 21 bp, Homo sapiens
agtgagagacattaactcatt

SEQ ID NO: 2774397 - DNA, 14 bp, Homo sapiens
agtgagagggcatg

SEQ ID NO: 2774398 - DNA, 16 bp, Homo sapiens
agtgagatttgtattt

SEQ ID NO: 2774399 - DNA, 13 bp, Homo sapiens
agtgagcagtaga

SEQ ID NO: 2774400 - DNA, 24 bp, Homo sapiens
agtgagccgcatcttctccatctg

SEQ ID NO: 2774401 - DNA, 11 bp, Homo sapiens
agtgagcctga

SEQ ID NO: 2774402 - DNA, 21 bp, Homo sapiens
agtgagcctgaattttgttgc

SEQ ID NO: 2774403 - DNA, 12 bp, Homo sapiens
agtgagctggtt

SEQ ID NO: 2774404 - DNA, 23 bp, Homo sapiens
agtgagctggtttttagcggaga

SEQ ID NO: 2774405 - DNA, 16 bp, Homo sapiens
agtgatatatgtattt

SEQ ID NO: 2774406 - DNA, 21 bp, Homo sapiens
agtgatcagtatgctgtttta

SEQ ID NO: 2774407 - DNA, 18 bp, Homo sapiens
agtgatcctcccacctca

SEQ ID NO: 2774408 - DNA, 20 bp, Homo sapiens
agtgatcctcccacctcagc

SEQ ID NO: 2774409 - DNA, 23 bp, Homo sapiens
agtgatcctcccacctcagcctc

SEQ ID NO: 2774410 - DNA, 24 bp, Homo sapiens
agtgatcctcccacctcagcctcc

SEQ ID NO: 2774411 - DNA, 13 bp, Homo sapiens
agtgatctccata

SEQ ID NO: 2774412 - DNA, 17 bp, Homo sapiens
agtgattctcctgcctc

SEQ ID NO: 2774413 - DNA, 18 bp, Homo sapiens
agtgattctcctgcctca

SEQ ID NO: 2774414 - DNA, 22 bp, Homo sapiens
agtgattctcctgcctcagcct

SEQ ID NO: 2774415 - DNA, 17 bp, Homo sapiens
agtgattgtcttaatat

SEQ ID NO: 2774416 - DNA, 23 bp, Homo sapiens
agtgcaaatactccaagcttcaa

SEQ ID NO: 2774417 - DNA, 18 bp, Homo sapiens
agtgcaaatttgatacat

SEQ ID NO: 2774418 - DNA, 13 bp, Homo sapiens
agtgcacacttgt

SEQ ID NO: 2774419 - DNA, 16 bp, Homo sapiens
agtgcacttgctggaa

SEQ ID NO: 2774420 - DNA, 17 bp, Homo sapiens
agtgcagtgagccgaga

SEQ ID NO: 2774421 - DNA, 15 bp, Homo sapiens
agtgcatgctctctg

SEQ ID NO: 2774422 - DNA, 15 bp, Homo sapiens
agtgcattttcccag

SEQ ID NO: 2774423 - DNA, 20 bp, Homo sapiens
agtgccagtcttgtgtctgc

SEQ ID NO: 2774424 - DNA, 20 bp, Homo sapiens
agtgcccaccaacatcccat

SEQ ID NO: 2774425 - DNA, 21 bp, Homo sapiens
agtgccctccacagccgcagc

SEQ ID NO: 2774426 - DNA, 14 bp, Homo sapiens
agtgccgcctgtgc

SEQ ID NO: 2774427 - DNA, 17 bp, Homo sapiens
agtgcctggcaaggcct

SEQ ID NO: 2774428 - DNA, 16 bp, Homo sapiens
agtgccttacctcctg

SEQ ID NO: 2774429 - DNA, 19 bp, Homo sapiens
agtgccttacctcctgccc

SEQ ID NO: 2774430 - DNA, 13 bp, Homo sapiens
agtgccttccata

SEQ ID NO: 2774431 - DNA, 15 bp, Homo sapiens
agtgccttccataat

SEQ ID NO: 2774432 - DNA, 19 bp, Homo sapiens
agtgctctaggctgccccg

SEQ ID NO: 2774433 - DNA, 21 bp, Homo sapiens
agtgctgggattacaggtgtg

SEQ ID NO: 2774434 - DNA, 17 bp, Homo sapiens
agtgcttcagcctgagg

SEQ ID NO: 2774435 - DNA, 22 bp, Homo sapiens
agtgcttgccaccaccagatga

SEQ ID NO: 2774436 - DNA, 15 bp, Homo sapiens
agtggaaaaaagaga

SEQ ID NO: 2774437 - DNA, 20 bp, Homo sapiens
agtggaaaaaagagaaaaac

SEQ ID NO: 2774438 - DNA, 20 bp, Homo sapiens
agtggacaccaggagtccct

SEQ ID NO: 2774439 - DNA, 13 bp, Homo sapiens
agtggacaggagt

SEQ ID NO: 2774440 - DNA, 13 bp, Homo sapiens
agtggaccaggac

SEQ ID NO: 2774441 - DNA, 20 bp, Homo sapiens
agtggaccaggacaggacca

SEQ ID NO: 2774442 - DNA, 23 bp, Homo sapiens
agtggatctccaaggaccaggtt

SEQ ID NO: 2774443 - DNA, 16 bp, Homo sapiens
agtggattttcctgaa

SEQ ID NO: 2774444 - DNA, 11 bp, Homo sapiens
agtggcagctg

SEQ ID NO: 2774445 - DNA, 12 bp, Homo sapiens
agtggcagctgc

SEQ ID NO: 2774446 - DNA, 14 bp, Homo sapiens
agtggcagctgctt

SEQ ID NO: 2774447 - DNA, 15 bp, Homo sapiens
agtggcccagaattg

SEQ ID NO: 2774448 - DNA, 16 bp, Homo sapiens
agtggccggggaagct

SEQ ID NO: 2774449 - DNA, 23 bp, Homo sapiens
agtggctgaaataaaagcctctg

SEQ ID NO: 2774450 - DNA, 14 bp, Homo sapiens
agtggctgctgact

SEQ ID NO: 2774451 - DNA, 23 bp, Homo sapiens
agtggcttaaaacaacactcaca

SEQ ID NO: 2774452 - DNA, 20 bp, Homo sapiens
agtgggaacgtgactgcccc

SEQ ID NO: 2774453 - DNA, 15 bp, Homo sapiens
agtgggacaaaccag

SEQ ID NO: 2774454 - DNA, 12 bp, Homo sapiens
agtgggagaaaa

SEQ ID NO: 2774455 - DNA, 17 bp, Homo sapiens
agtgggagaaaacactt

SEQ ID NO: 2774456 - DNA, 16 bp, Homo sapiens
agtgggagctgcctgt

SEQ ID NO: 2774457 - DNA, 22 bp, Homo sapiens
agtgggagggtaccagcagaaa

SEQ ID NO: 2774458 - DNA, 22 bp, Homo sapiens
agtggggtctccctctcctgcc

SEQ ID NO: 2774459 - DNA, 16 bp, Homo sapiens
agtggtaagctctggc

SEQ ID NO: 2774460 - DNA, 14 bp, Homo sapiens
agtggtaccagctc

SEQ ID NO: 2774461 - DNA, 15 bp, Homo sapiens
agtggtaccagctca

SEQ ID NO: 2774462 - DNA, 20 bp, Homo sapiens
agtggtctttcctatcatgg

SEQ ID NO: 2774463 - DNA, 22 bp, Homo sapiens
agtggtttgatggtgacttcct

SEQ ID NO: 2774464 - DNA, 14 bp, Homo sapiens
agtgtaaatccttt

SEQ ID NO: 2774465 - DNA, 18 bp, Homo sapiens
agtgtagccttgcccgga

SEQ ID NO: 2774466 - DNA, 18 bp, Homo sapiens
agtgtccccaaagactac

SEQ ID NO: 2774467 - DNA, 14 bp, Homo sapiens
agtgtcctcagggg

SEQ ID NO: 2774468 - DNA, 22 bp, Homo sapiens
agtgtctgtatcggagacagtg

SEQ ID NO: 2774469 - DNA, 14 bp, Homo sapiens
agtgtcttccataa

SEQ ID NO: 2774470 - DNA, 12 bp, Homo sapiens
agtgtgagaatc

SEQ ID NO: 2774471 - DNA, 16 bp, Homo sapiens
agtgtgagcagtgagt

SEQ ID NO: 2774472 - DNA, 19 bp, Homo sapiens
agtgtgcacccctccccat

SEQ ID NO: 2774473 - DNA, 22 bp, Homo sapiens
agtgtgcacccctccccattca

SEQ ID NO: 2774474 - DNA, 18 bp, Homo sapiens
agtgtgcttgtcatctgc

SEQ ID NO: 2774475 - DNA, 17 bp, Homo sapiens
agtgtgggaagggagag

SEQ ID NO: 2774476 - DNA, 16 bp, Homo sapiens
agtgtgttgtctgtgc

SEQ ID NO: 2774477 - DNA, 17 bp, Homo sapiens
agtgtgttgtctgtgca

SEQ ID NO: 2774478 - DNA, 20 bp, Homo sapiens
agtgtgttgtctgtgcagct

SEQ ID NO: 2774479 - DNA, 20 bp, Homo sapiens
agtgtgtttccttcagtgca

SEQ ID NO: 2774480 - DNA, 23 bp, Homo sapiens
agtgttatcagtcataactaaat

SEQ ID NO: 2774481 - DNA, 17 bp, Homo sapiens
agtgttattatttggca

SEQ ID NO: 2774482 - DNA, 16 bp, Homo sapiens
agtgttcctatttggg

SEQ ID NO: 2774483 - DNA, 20 bp, Homo sapiens
agtgttcctatttggggctt

SEQ ID NO: 2774484 - DNA, 21 bp, Homo sapiens
agtgttcctcaccaataactt

SEQ ID NO: 2774485 - DNA, 16 bp, Homo sapiens
agtgtttagaagagcc

SEQ ID NO: 2774486 - DNA, 19 bp, Homo sapiens
agtgtttcgacagctgatt

SEQ ID NO: 2774487 - DNA, 13 bp, Homo sapiens
agtgttttctggg

SEQ ID NO: 2774488 - DNA, 15 bp, Homo sapiens
agtgttttctgggat

SEQ ID NO: 2774489 - DNA, 18 bp, Homo sapiens
agttaactttaagactga

SEQ ID NO: 2774490 - DNA, 20 bp, Homo sapiens
agttaagcagcctttctgtg

SEQ ID NO: 2774491 - DNA, 14 bp, Homo sapiens
agttaagtcatcca

SEQ ID NO: 2774492 - DNA, 17 bp, Homo sapiens
agttaatacttaacatt

SEQ ID NO: 2774493 - DNA, 20 bp, Homo sapiens
agttaatacttaacattgat

SEQ ID NO: 2774494 - DNA, 14 bp, Homo sapiens
agttaatttaaagt

SEQ ID NO: 2774495 - DNA, 22 bp, Homo sapiens
agttacagcgagaggcagagaa

SEQ ID NO: 2774496 - DNA, 14 bp, Homo sapiens
agttactcagccct

SEQ ID NO: 2774497 - DNA, 18 bp, Homo sapiens
agttactcagccctgggc

SEQ ID NO: 2774498 - DNA, 22 bp, Homo sapiens
agttacttcactttaattctca

SEQ ID NO: 2774499 - DNA, 19 bp, Homo sapiens
agttagagaatatattttt

SEQ ID NO: 2774500 - DNA, 14 bp, Homo sapiens
agttagctcaggag

SEQ ID NO: 2774501 - DNA, 19 bp, Homo sapiens
agttagctcaggaggcttg

SEQ ID NO: 2774502 - DNA, 22 bp, Homo sapiens
agttagctcaggaggcttggaa

SEQ ID NO: 2774503 - DNA, 20 bp, Homo sapiens
agttagctttaacttaaata

SEQ ID NO: 2774504 - DNA, 21 bp, Homo sapiens
agttagctttaacttaaatag

SEQ ID NO: 2774505 - DNA, 13 bp, Homo sapiens
agttaggaaataa

SEQ ID NO: 2774506 - DNA, 17 bp, Homo sapiens
agttaggaaataaaacc

SEQ ID NO: 2774507 - DNA, 13 bp, Homo sapiens
agttataaaaata

SEQ ID NO: 2774508 - DNA, 21 bp, Homo sapiens
agttataagtagcaggccaag

SEQ ID NO: 2774509 - DNA, 19 bp, Homo sapiens
agttatagtatatctggac

SEQ ID NO: 2774510 - DNA, 15 bp, Homo sapiens
agttatgtgaatgat

SEQ ID NO: 2774511 - DNA, 12 bp, Homo sapiens
agttatttaaat

SEQ ID NO: 2774512 - DNA, 20 bp, Homo sapiens
agttattttaggagacagtc

SEQ ID NO: 2774513 - DNA, 13 bp, Homo sapiens
agttcaaagaagt

SEQ ID NO: 2774514 - DNA, 23 bp, Homo sapiens
agttcaaagaagtcatggcccaa

SEQ ID NO: 2774515 - DNA, 18 bp, Homo sapiens
agttcaaattttgcattg

SEQ ID NO: 2774516 - DNA, 19 bp, Homo sapiens
agttcaggagtcccaagga

SEQ ID NO: 2774517 - DNA, 21 bp, Homo sapiens
agttcaggagtcccaaggaaa

SEQ ID NO: 2774518 - DNA, 18 bp, Homo sapiens
agttcatatgtaccatgt

SEQ ID NO: 2774519 - DNA, 22 bp, Homo sapiens
agttcatatgtaccatgtacat

SEQ ID NO: 2774520 - DNA, 20 bp, Homo sapiens
agttcatctatggcagtcca

SEQ ID NO: 2774521 - DNA, 13 bp, Homo sapiens
agttcatgagaat

SEQ ID NO: 2774522 - DNA, 13 bp, Homo sapiens
agttcctcgccct

SEQ ID NO: 2774523 - DNA, 19 bp, Homo sapiens
agttcctgttcaccttatg

SEQ ID NO: 2774524 - DNA, 14 bp, Homo sapiens
agttcgagaccagc

SEQ ID NO: 2774525 - DNA, 18 bp, Homo sapiens
agttcgagaccagcctgg

SEQ ID NO: 2774526 - DNA, 21 bp, Homo sapiens
agttcgagaccagcctggcca

SEQ ID NO: 2774527 - DNA, 17 bp, Homo sapiens
agttcgcagccaccctg

SEQ ID NO: 2774528 - DNA, 21 bp, Homo sapiens
agttcgcagccaccctgagga

SEQ ID NO: 2774529 - DNA, 15 bp, Homo sapiens
agttctagagaagag

SEQ ID NO: 2774530 - DNA, 16 bp, Homo sapiens
agttctagagaagagg

SEQ ID NO: 2774531 - DNA, 17 bp, Homo sapiens
agttctagagaagaggc

SEQ ID NO: 2774532 - DNA, 17 bp, Homo sapiens
agttctctcgtaactgg

SEQ ID NO: 2774533 - DNA, 16 bp, Homo sapiens
agttctgaaaactgtt

SEQ ID NO: 2774534 - DNA, 12 bp, Homo sapiens
agttctgctcct

SEQ ID NO: 2774535 - DNA, 19 bp, Homo sapiens
ataaagatgtcaaatatct

SEQ ID NO: 2774536 - DNA, 13 bp, Homo sapiens
ataaagatttttt

SEQ ID NO: 2774537 - DNA, 16 bp, Homo sapiens
ataaaggttgacaata

SEQ ID NO: 2774538 - DNA, 22 bp, Homo sapiens
ataaaggttgacaataaatgtg

SEQ ID NO: 2774539 - DNA, 14 bp, Homo sapiens
ataaagtatcatca

SEQ ID NO: 2774540 - DNA, 14 bp, Homo sapiens
ataaagtatctaca

SEQ ID NO: 2774541 - DNA, 20 bp, Homo sapiens
ataaagttgataaagatttt

SEQ ID NO: 2774542 - DNA, 21 bp, Homo sapiens
ataaagttgataaagattttt

SEQ ID NO: 2774543 - DNA, 17 bp, Homo sapiens
ataaataaaaatattct

SEQ ID NO: 2774544 - DNA, 12 bp, Homo sapiens
ataaataaatgc

SEQ ID NO: 2774545 - DNA, 15 bp, Homo sapiens
ataaataaatgccaa

SEQ ID NO: 2774546 - DNA, 14 bp, Homo sapiens
ataaatatatattt

SEQ ID NO: 2774547 - DNA, 18 bp, Homo sapiens
ataaatatatatttttca

SEQ ID NO: 2774548 - DNA, 19 bp, Homo sapiens
ataaatatatatttttcaa

SEQ ID NO: 2774549 - DNA, 21 bp, Homo sapiens
ataaatatatatttttcaacc

SEQ ID NO: 2774550 - DNA, 15 bp, Homo sapiens
ataaatattctgcat

SEQ ID NO: 2774551 - DNA, 22 bp, Homo sapiens
ataaatctgagcctaaatctaa

SEQ ID NO: 2774552 - DNA, 15 bp, Homo sapiens
ataaatgaatcttac

SEQ ID NO: 2774553 - DNA, 17 bp, Homo sapiens
ataaatgcaatatgtat

SEQ ID NO: 2774554 - DNA, 23 bp, Homo sapiens
ataaatgcatgattttatacata

SEQ ID NO: 2774555 - DNA, 16 bp, Homo sapiens
ataaatggctggtttt

SEQ ID NO: 2774556 - DNA, 17 bp, Homo sapiens
ataaatgtatcatagaa

SEQ ID NO: 2774557 - DNA, 12 bp, Homo sapiens
ataaatgtctgt

SEQ ID NO: 2774558 - DNA, 15 bp, Homo sapiens
ataaatgtctgttga

SEQ ID NO: 2774559 - DNA, 14 bp, Homo sapiens
ataaatgtgtaaat

SEQ ID NO: 2774560 - DNA, 15 bp, Homo sapiens
ataaatgtgtaaatg

SEQ ID NO: 2774561 - DNA, 19 bp, Homo sapiens
ataaatgtgtaaatgtgga

SEQ ID NO: 2774562 - DNA, 21 bp, Homo sapiens
ataaatgtgtaaatgtggaca

SEQ ID NO: 2774563 - DNA, 13 bp, Homo sapiens
ataaattataagt

SEQ ID NO: 2774564 - DNA, 16 bp, Homo sapiens
ataaattcaaaccatt

SEQ ID NO: 2774565 - DNA, 12 bp, Homo sapiens
ataaattcagat

SEQ ID NO: 2774566 - DNA, 22 bp, Homo sapiens
ataaattgaaatataatgcaaa

SEQ ID NO: 2774567 - DNA, 11 bp, Homo sapiens
ataacaaaatc

SEQ ID NO: 2774568 - DNA, 16 bp, Homo sapiens
ataacaagatctttca

SEQ ID NO: 2774569 - DNA, 21 bp, Homo sapiens
ataacaaggttcttctaaaat

SEQ ID NO: 2774570 - DNA, 18 bp, Homo sapiens
ataacaatgtatgtgaaa

SEQ ID NO: 2774571 - DNA, 19 bp, Homo sapiens
ataaccacaaccaggaaga

SEQ ID NO: 2774572 - DNA, 22 bp, Homo sapiens
ataaccacttaaaaaatgtcca

SEQ ID NO: 2774573 - DNA, 20 bp, Homo sapiens
ataaccccagctccctagga

SEQ ID NO: 2774574 - DNA, 17 bp, Homo sapiens
ataactagatctcctgt

SEQ ID NO: 2774575 - DNA, 16 bp, Homo sapiens
ataactcatcataaaa

SEQ ID NO: 2774576 - DNA, 20 bp, Homo sapiens
ataactgaaaattatttaaa

SEQ ID NO: 2774577 - DNA, 15 bp, Homo sapiens
ataactgcatagtaa

SEQ ID NO: 2774578 - DNA, 19 bp, Homo sapiens
ataacttaaaaaaatgaca

SEQ ID NO: 2774579 - DNA, 16 bp, Homo sapiens
ataacttaaaatattt

SEQ ID NO: 2774580 - DNA, 18 bp, Homo sapiens
ataacttcagagaagtca

SEQ ID NO: 2774581 - DNA, 15 bp, Homo sapiens
ataacttgatataga

SEQ ID NO: 2774582 - DNA, 22 bp, Homo sapiens
ataagaaacttttttatttaaa

SEQ ID NO: 2774583 - DNA, 13 bp, Homo sapiens
ataagaacttgat

SEQ ID NO: 2774584 - DNA, 14 bp, Homo sapiens
ataagaagcaaata

SEQ ID NO: 2774585 - DNA, 21 bp, Homo sapiens
ataagaatgctggttttccta

SEQ ID NO: 2774586 - DNA, 20 bp, Homo sapiens
ataagagagaacaactactg

SEQ ID NO: 2774587 - DNA, 15 bp, Homo sapiens
ataagataatgatga

SEQ ID NO: 2774588 - DNA, 19 bp, Homo sapiens
ataagattaaaggaaggaa

SEQ ID NO: 2774589 - DNA, 17 bp, Homo sapiens
ataagattagaatgaaa

SEQ ID NO: 2774590 - DNA, 20 bp, Homo sapiens
ataagattagaatgaaaatt

SEQ ID NO: 2774591 - DNA, 21 bp, Homo sapiens
ataagcccaaatggctctgtg

SEQ ID NO: 2774592 - DNA, 16 bp, Homo sapiens
ataagtactgtgtaca

SEQ ID NO: 2774593 - DNA, 19 bp, Homo sapiens
ataagtactgtgtacagaa

SEQ ID NO: 2774594 - DNA, 17 bp, Homo sapiens
ataagtgctgtttgaga

SEQ ID NO: 2774595 - DNA, 14 bp, Homo sapiens
ataagtggaaaaaa

SEQ ID NO: 2774596 - DNA, 22 bp, Homo sapiens
ataagtggaaaaaagagaaaaa

SEQ ID NO: 2774597 - DNA, 16 bp, Homo sapiens
ataagttccatgttaa

SEQ ID NO: 2774598 - DNA, 15 bp, Homo sapiens
ataataactagatct

SEQ ID NO: 2774599 - DNA, 16 bp, Homo sapiens
ataataactagatctc

SEQ ID NO: 2774600 - DNA, 17 bp, Homo sapiens
ataataactagatctcc

SEQ ID NO: 2774601 - DNA, 14 bp, Homo sapiens
ataatatctgtgag

SEQ ID NO: 2774602 - DNA, 23 bp, Homo sapiens
ataatatcttgaagaatattgtt

SEQ ID NO: 2774603 - DNA, 22 bp, Homo sapiens
agggatgtgaattgcctgcaga

SEQ ID NO: 2774604 - DNA, 16 bp, Homo sapiens
agggcaaacccaaaac

SEQ ID NO: 2774605 - DNA, 22 bp, Homo sapiens
agggcaagggccatgctgaagg

SEQ ID NO: 2774606 - DNA, 17 bp, Homo sapiens
agggcacaccgggcact

SEQ ID NO: 2774607 - DNA, 21 bp, Homo sapiens
agggcacaccgggcactcaga

SEQ ID NO: 2774608 - DNA, 15 bp, Homo sapiens
agggcacaggagcta

SEQ ID NO: 2774609 - DNA, 22 bp, Homo sapiens
agggcacaggagctacctgtgt

SEQ ID NO: 2774610 - DNA, 17 bp, Homo sapiens
agggcactcacatgccg

SEQ ID NO: 2774611 - DNA, 15 bp, Homo sapiens
agggcagaggctgga

SEQ ID NO: 2774612 - DNA, 15 bp, Homo sapiens
agggcagcagccagc

SEQ ID NO: 2774613 - DNA, 23 bp, Homo sapiens
agggcagcagccagccctgcctg

SEQ ID NO: 2774614 - DNA, 14 bp, Homo sapiens
agggcagttcgcag

SEQ ID NO: 2774615 - DNA, 17 bp, Homo sapiens
agggcagttcgcagcca

SEQ ID NO: 2774616 - DNA, 19 bp, Homo sapiens
agggcagttcgcagccacc

SEQ ID NO: 2774617 - DNA, 20 bp, Homo sapiens
agggcagttcgcagccaccc

SEQ ID NO: 2774618 - DNA, 23 bp, Homo sapiens
agggcagttcgcagccaccctga

SEQ ID NO: 2774619 - DNA, 16 bp, Homo sapiens
agggcatattaaaggc

SEQ ID NO: 2774620 - DNA, 18 bp, Homo sapiens
agggccacactattacca

SEQ ID NO: 2774621 - DNA, 15 bp, Homo sapiens
agggccacgtgccag

SEQ ID NO: 2774622 - DNA, 19 bp, Homo sapiens
agggccacgtgccaggccc

SEQ ID NO: 2774623 - DNA, 20 bp, Homo sapiens
agggccacgtgccaggcccg

SEQ ID NO: 2774624 - DNA, 15 bp, Homo sapiens
agggccagggccctg

SEQ ID NO: 2774625 - DNA, 19 bp, Homo sapiens
agggccagggccctgcaga

SEQ ID NO: 2774626 - DNA, 20 bp, Homo sapiens
agggccaggggtctccctgg

SEQ ID NO: 2774627 - DNA, 15 bp, Homo sapiens
agggccagtctgggc

SEQ ID NO: 2774628 - DNA, 14 bp, Homo sapiens
agggcccaggcagg

SEQ ID NO: 2774629 - DNA, 12 bp, Homo sapiens
agggccccagca

SEQ ID NO: 2774630 - DNA, 14 bp, Homo sapiens
agggcccccacagg

SEQ ID NO: 2774631 - DNA, 13 bp, Homo sapiens
agggccctgcaga

SEQ ID NO: 2774632 - DNA, 17 bp, Homo sapiens
agggcccttagctctcc

SEQ ID NO: 2774633 - DNA, 22 bp, Homo sapiens
agggccggggaactggccaagc

SEQ ID NO: 2774634 - DNA, 14 bp, Homo sapiens
agggccttgcccag

SEQ ID NO: 2774635 - DNA, 17 bp, Homo sapiens
agggccttgcccagaga

SEQ ID NO: 2774636 - DNA, 18 bp, Homo sapiens
agggccttgcccagagat

SEQ ID NO: 2774637 - DNA, 16 bp, Homo sapiens
agggccttttgtggat

SEQ ID NO: 2774638 - DNA, 21 bp, Homo sapiens
agggcggggctatgccttgtc

SEQ ID NO: 2774639 - DNA, 23 bp, Homo sapiens
agggctaagagctagcgctgccg

SEQ ID NO: 2774640 - DNA, 12 bp, Homo sapiens
agggctcagcct

SEQ ID NO: 2774641 - DNA, 13 bp, Homo sapiens
agggctcagcctg

SEQ ID NO: 2774642 - DNA, 12 bp, Homo sapiens
agggctgcccct

SEQ ID NO: 2774643 - DNA, 22 bp, Homo sapiens
agggctgcccctgtaggttgct

SEQ ID NO: 2774644 - DNA, 20 bp, Homo sapiens
agggctggaaaagtcacaca

SEQ ID NO: 2774645 - DNA, 22 bp, Homo sapiens
agggctggaaaagtcacacaga

SEQ ID NO: 2774646 - DNA, 22 bp, Homo sapiens
agggctggacctatgtcctaag

SEQ ID NO: 2774647 - DNA, 21 bp, Homo sapiens
agggcttttttttgagaatac

SEQ ID NO: 2774648 - DNA, 23 bp, Homo sapiens
aggggaagggccagtctgggctg

SEQ ID NO: 2774649 - DNA, 13 bp, Homo sapiens
aggggacatttcc

SEQ ID NO: 2774650 - DNA, 21 bp, Homo sapiens
aggggatagagagagaccact

SEQ ID NO: 2774651 - DNA, 20 bp, Homo sapiens
aggggcacgcctgcccagcc

SEQ ID NO: 2774652 - DNA, 14 bp, Homo sapiens
aggggcagaacagc

SEQ ID NO: 2774653 - DNA, 21 bp, Homo sapiens
aggggcccacagggaaccctg

SEQ ID NO: 2774654 - DNA, 12 bp, Homo sapiens
aggggccctggt

SEQ ID NO: 2774655 - DNA, 15 bp, Homo sapiens
aggggcctagggagc

SEQ ID NO: 2774656 - DNA, 21 bp, Homo sapiens
aggggcctcaggggagccccc

SEQ ID NO: 2774657 - DNA, 13 bp, Homo sapiens
aggggcctgccca

SEQ ID NO: 2774658 - DNA, 13 bp, Homo sapiens
aggggctcctgga

SEQ ID NO: 2774659 - DNA, 15 bp, Homo sapiens
agggggaagagaaat

SEQ ID NO: 2774660 - DNA, 17 bp, Homo sapiens
agggggaagagaaattt

SEQ ID NO: 2774661 - DNA, 16 bp, Homo sapiens
agggggtccacccagc

SEQ ID NO: 2774662 - DNA, 18 bp, Homo sapiens
agggggtcgtggagagct

SEQ ID NO: 2774663 - DNA, 19 bp, Homo sapiens
aggggtaggcagagccttt

SEQ ID NO: 2774664 - DNA, 15 bp, Homo sapiens
aggggtcaggctcca

SEQ ID NO: 2774665 - DNA, 16 bp, Homo sapiens
aggggtctccctggag

SEQ ID NO: 2774666 - DNA, 17 bp, Homo sapiens
aggggtgatttcagaga

SEQ ID NO: 2774667 - DNA, 21 bp, Homo sapiens
aggggtgggttcctcttcccc

SEQ ID NO: 2774668 - DNA, 15 bp, Homo sapiens
agggtaaggtgcctt

SEQ ID NO: 2774669 - DNA, 14 bp, Homo sapiens
agggtaccagcaga

SEQ ID NO: 2774670 - DNA, 23 bp, Homo sapiens
agggtaccttgaacactggggga

SEQ ID NO: 2774671 - DNA, 19 bp, Homo sapiens
agggtatcaggtgctgcca

SEQ ID NO: 2774672 - DNA, 20 bp, Homo sapiens
agggtcaacggccctgttta

SEQ ID NO: 2774673 - DNA, 13 bp, Homo sapiens
agggtccagaccc

SEQ ID NO: 2774674 - DNA, 17 bp, Homo sapiens
agggtccccgggagcac

SEQ ID NO: 2774675 - DNA, 22 bp, Homo sapiens
agggtccccgggagcacacgaa

SEQ ID NO: 2774676 - DNA, 23 bp, Homo sapiens
agggtcgccacacccggctcccc

SEQ ID NO: 2774677 - DNA, 19 bp, Homo sapiens
agggtctagggagagaccc

SEQ ID NO: 2774678 - DNA, 23 bp, Homo sapiens
agggtctagggagagacccttgt

SEQ ID NO: 2774679 - DNA, 22 bp, Homo sapiens
agggtctcactctgtcgcccag

SEQ ID NO: 2774680 - DNA, 15 bp, Homo sapiens
agggtctggagaagc

SEQ ID NO: 2774681 - DNA, 14 bp, Homo sapiens
agggtgagagctgc

SEQ ID NO: 2774682 - DNA, 12 bp, Homo sapiens
agggtggagact

SEQ ID NO: 2774683 - DNA, 21 bp, Homo sapiens
agggtggagactaagccctgt

SEQ ID NO: 2774684 - DNA, 18 bp, Homo sapiens
agggtgggatggaggaga

SEQ ID NO: 2774685 - DNA, 22 bp, Homo sapiens
agggtgggccactctcccctcc

SEQ ID NO: 2774686 - DNA, 23 bp, Homo sapiens
agggtgggccactctcccctccc

SEQ ID NO: 2774687 - DNA, 17 bp, Homo sapiens
agggtggtctgagcacc

SEQ ID NO: 2774688 - DNA, 17 bp, Homo sapiens
agggtggtgacctctgc

SEQ ID NO: 2774689 - DNA, 21 bp, Homo sapiens
agggtggtgacctctgcctga

SEQ ID NO: 2774690 - DNA, 17 bp, Homo sapiens
agggtgtatctagctct

SEQ ID NO: 2774691 - DNA, 18 bp, Homo sapiens
agggttactatgcacaat

SEQ ID NO: 2774692 - DNA, 16 bp, Homo sapiens
agggttagggaggggt

SEQ ID NO: 2774693 - DNA, 19 bp, Homo sapiens
agggttgaattctggagga

SEQ ID NO: 2774694 - DNA, 21 bp, Homo sapiens
agggttgagttacttcctatc

SEQ ID NO: 2774695 - DNA, 17 bp, Homo sapiens
agggttggcccctgccc

SEQ ID NO: 2774696 - DNA, 15 bp, Homo sapiens
agggttgggctggtg

SEQ ID NO: 2774697 - DNA, 22 bp, Homo sapiens
agggttgtgattttgtctgctt

SEQ ID NO: 2774698 - DNA, 21 bp, Homo sapiens
agggttgttaatggtgcaaat

SEQ ID NO: 2774699 - DNA, 19 bp, Homo sapiens
agggttttccaccctggaa

SEQ ID NO: 2774700 - DNA, 13 bp, Homo sapiens
aggtaacaggcag

SEQ ID NO: 2774701 - DNA, 13 bp, Homo sapiens
aggtaatgaggga

SEQ ID NO: 2774702 - DNA, 12 bp, Homo sapiens
aggtacactctt

SEQ ID NO: 2774703 - DNA, 17 bp, Homo sapiens
aggtacccctttctggc

SEQ ID NO: 2774704 - DNA, 12 bp, Homo sapiens
aggtactattat

SEQ ID NO: 2774705 - DNA, 19 bp, Homo sapiens
aggtagcccagcactgtga

SEQ ID NO: 2774706 - DNA, 17 bp, Homo sapiens
aggtagtgggtgaatgt

SEQ ID NO: 2774707 - DNA, 14 bp, Homo sapiens
aggtatctccagga

SEQ ID NO: 2774708 - DNA, 15 bp, Homo sapiens
aggtatctccaggat

SEQ ID NO: 2774709 - DNA, 22 bp, Homo sapiens
aggtattccttttgtgtacagt

SEQ ID NO: 2774710 - DNA, 14 bp, Homo sapiens
aggtatttatcttt

SEQ ID NO: 2774711 - DNA, 19 bp, Homo sapiens
aggtcaacagagaaggcag

SEQ ID NO: 2774712 - DNA, 21 bp, Homo sapiens
aggtcaacagagaaggcagga

SEQ ID NO: 2774713 - DNA, 15 bp, Homo sapiens
aggtcaatgaaatat

SEQ ID NO: 2774714 - DNA, 19 bp, Homo sapiens
aggtcaatgaaatatttgc

SEQ ID NO: 2774715 - DNA, 15 bp, Homo sapiens
aggtcacattcagga

SEQ ID NO: 2774716 - DNA, 19 bp, Homo sapiens
aggtcacattcaggaagat

SEQ ID NO: 2774717 - DNA, 23 bp, Homo sapiens
aggtcactcttcctgcaaggact

SEQ ID NO: 2774718 - DNA, 19 bp, Homo sapiens
agtagccgagagcctgctc

SEQ ID NO: 2774719 - DNA, 11 bp, Homo sapiens
agtagctgagc

SEQ ID NO: 2774720 - DNA, 14 bp, Homo sapiens
agtagctgagctca

SEQ ID NO: 2774721 - DNA, 22 bp, Homo sapiens
agtagctgagctcacaaggcag

SEQ ID NO: 2774722 - DNA, 19 bp, Homo sapiens
agtagctgggactacaggc

SEQ ID NO: 2774723 - DNA, 14 bp, Homo sapiens
agtagcttaaataa

SEQ ID NO: 2774724 - DNA, 15 bp, Homo sapiens
agtagtcaattagta

SEQ ID NO: 2774725 - DNA, 13 bp, Homo sapiens
agtagtctctgtg

SEQ ID NO: 2774726 - DNA, 19 bp, Homo sapiens
agtagtttgagaccagcct

SEQ ID NO: 2774727 - DNA, 13 bp, Homo sapiens
agtagtttttcag

SEQ ID NO: 2774728 - DNA, 15 bp, Homo sapiens
agtatatagtatatt

SEQ ID NO: 2774729 - DNA, 17 bp, Homo sapiens
agtatatagtatattta

SEQ ID NO: 2774730 - DNA, 12 bp, Homo sapiens
agtatatatgta

SEQ ID NO: 2774731 - DNA, 21 bp, Homo sapiens
agtatatattctacacatata

SEQ ID NO: 2774732 - DNA, 13 bp, Homo sapiens
agtatatctggac

SEQ ID NO: 2774733 - DNA, 15 bp, Homo sapiens
agtatatttatactc

SEQ ID NO: 2774734 - DNA, 13 bp, Homo sapiens
agtatattttctt

SEQ ID NO: 2774735 - DNA, 20 bp, Homo sapiens
agtatcatcagatagcatct

SEQ ID NO: 2774736 - DNA, 13 bp, Homo sapiens
agtatccaattat

SEQ ID NO: 2774737 - DNA, 17 bp, Homo sapiens
agtatccaattatgtga

SEQ ID NO: 2774738 - DNA, 20 bp, Homo sapiens
agtatccaattatgtgacaa

SEQ ID NO: 2774739 - DNA, 21 bp, Homo sapiens
agtatctcatcaacaaagaaa

SEQ ID NO: 2774740 - DNA, 14 bp, Homo sapiens
agtatgaatgatgt

SEQ ID NO: 2774741 - DNA, 19 bp, Homo sapiens
agtatgcaagaagaatata

SEQ ID NO: 2774742 - DNA, 23 bp, Homo sapiens
agtatgcaagaagaatataaata

SEQ ID NO: 2774743 - DNA, 16 bp, Homo sapiens
agtatggcctgtgtca

SEQ ID NO: 2774744 - DNA, 14 bp, Homo sapiens
agtatggtggctgg

SEQ ID NO: 2774745 - DNA, 14 bp, Homo sapiens
agtatgtgatatct

SEQ ID NO: 2774746 - DNA, 18 bp, Homo sapiens
agtattacttctgctaca

SEQ ID NO: 2774747 - DNA, 20 bp, Homo sapiens
agtattccagacctgaagaa

SEQ ID NO: 2774748 - DNA, 19 bp, Homo sapiens
agtatttatatatttataa

SEQ ID NO: 2774749 - DNA, 15 bp, Homo sapiens
agtatttatttaatg

SEQ ID NO: 2774750 - DNA, 20 bp, Homo sapiens
agtatttatttaatgttatg

SEQ ID NO: 2774751 - DNA, 23 bp, Homo sapiens
agtatttttttaagttagagaat

SEQ ID NO: 2774752 - DNA, 21 bp, Homo sapiens
agtcaaaacagagatgtgata

SEQ ID NO: 2774753 - DNA, 15 bp, Homo sapiens
agtcaaaaggtgcct

SEQ ID NO: 2774754 - DNA, 16 bp, Homo sapiens
agtcaaaaggtgcctg

SEQ ID NO: 2774755 - DNA, 17 bp, Homo sapiens
agtcaaaccataaactt

SEQ ID NO: 2774756 - DNA, 18 bp, Homo sapiens
agtcaacagttcaaagaa

SEQ ID NO: 2774757 - DNA, 17 bp, Homo sapiens
agtcaattagtacagta

SEQ ID NO: 2774758 - DNA, 21 bp, Homo sapiens
agtcaattagtacagtagctt

SEQ ID NO: 2774759 - DNA, 16 bp, Homo sapiens
agtcacaagagcccag

SEQ ID NO: 2774760 - DNA, 11 bp, Homo sapiens
agtcacacaga

SEQ ID NO: 2774761 - DNA, 15 bp, Homo sapiens
agtcacacagacaca

SEQ ID NO: 2774762 - DNA, 23 bp, Homo sapiens
agtcacacagtattacttctgct

SEQ ID NO: 2774763 - DNA, 23 bp, Homo sapiens
agtcacacagtgagtcgaggaca

SEQ ID NO: 2774764 - DNA, 23 bp, Homo sapiens
agtcacatggcctatgcacatat

SEQ ID NO: 2774765 - DNA, 15 bp, Homo sapiens
agtcaccaagcccag

SEQ ID NO: 2774766 - DNA, 17 bp, Homo sapiens
agtcacccatgaagaca

SEQ ID NO: 2774767 - DNA, 15 bp, Homo sapiens
agtcaggacctggct

SEQ ID NO: 2774768 - DNA, 13 bp, Homo sapiens
agtcatccacagc

SEQ ID NO: 2774769 - DNA, 14 bp, Homo sapiens
agtcatgaagccca

SEQ ID NO: 2774770 - DNA, 19 bp, Homo sapiens
agtcatgatctccctgccg

SEQ ID NO: 2774771 - DNA, 19 bp, Homo sapiens
agtcattttaactttatca

SEQ ID NO: 2774772 - DNA, 17 bp, Homo sapiens
agtccaaggagaagaag

SEQ ID NO: 2774773 - DNA, 17 bp, Homo sapiens
agtccaatgtcttttta

SEQ ID NO: 2774774 - DNA, 22 bp, Homo sapiens
agtccacctgcctatccatcct

SEQ ID NO: 2774775 - DNA, 19 bp, Homo sapiens
agtccagaataagtgctgt

SEQ ID NO: 2774776 - DNA, 12 bp, Homo sapiens
agtccagccagc

SEQ ID NO: 2774777 - DNA, 17 bp, Homo sapiens
agtccagccagctcctg

SEQ ID NO: 2774778 - DNA, 18 bp, Homo sapiens
agtccaggtcctggtggg

SEQ ID NO: 2774779 - DNA, 19 bp, Homo sapiens
agtccaggtcctggtgggg

SEQ ID NO: 2774780 - DNA, 23 bp, Homo sapiens
agtccatatttcaatttccaaga

SEQ ID NO: 2774781 - DNA, 15 bp, Homo sapiens
agtcccaccttggct

SEQ ID NO: 2774782 - DNA, 21 bp, Homo sapiens
agtcccaccttggctgcaggg

SEQ ID NO: 2774783 - DNA, 19 bp, Homo sapiens
gaaggggacagcgccacct

SEQ ID NO: 2774784 - DNA, 19 bp, Homo sapiens
gaaggggcacgcctgccca

SEQ ID NO: 2774785 - DNA, 22 bp, Homo sapiens
gaaggggcacgcctgcccagcc

SEQ ID NO: 2774786 - DNA, 22 bp, Homo sapiens
gaagggggattggagggaagac

SEQ ID NO: 2774787 - DNA, 17 bp, Homo sapiens
gaagggggtccacccag

SEQ ID NO: 2774788 - DNA, 16 bp, Homo sapiens
gaaggtagcccagcac

SEQ ID NO: 2774789 - DNA, 18 bp, Homo sapiens
gaaggtagcccagcactg

SEQ ID NO: 2774790 - DNA, 21 bp, Homo sapiens
gaaggtagcccagcactgtga

SEQ ID NO: 2774791 - DNA, 12 bp, Homo sapiens
gaaggttgtaag

SEQ ID NO: 2774792 - DNA, 20 bp, Homo sapiens
gaaggtttggtgtgtggaga

SEQ ID NO: 2774793 - DNA, 16 bp, Homo sapiens
gaaggtttgtatattg

SEQ ID NO: 2774794 - DNA, 13 bp, Homo sapiens
gaagtatccaatt

SEQ ID NO: 2774795 - DNA, 21 bp, Homo sapiens
gaagtatccaattatgtgaca

SEQ ID NO: 2774796 - DNA, 23 bp, Homo sapiens
gaagtatccaattatgtgacaac

SEQ ID NO: 2774797 - DNA, 15 bp, Homo sapiens
gaagtctaggagctg

SEQ ID NO: 2774798 - DNA, 21 bp, Homo sapiens
gaagtgggccaggacaggccc

SEQ ID NO: 2774799 - DNA, 13 bp, Homo sapiens
gaagtgtatatag

SEQ ID NO: 2774800 - DNA, 17 bp, Homo sapiens
gaataaaaaacatttgt

SEQ ID NO: 2774801 - DNA, 12 bp, Homo sapiens
gaataaacttca

SEQ ID NO: 2774802 - DNA, 14 bp, Homo sapiens
gaataaacttcagc

SEQ ID NO: 2774803 - DNA, 16 bp, Homo sapiens
gaataaacttcagcac

SEQ ID NO: 2774804 - DNA, 18 bp, Homo sapiens
gaataaacttcagcacca

SEQ ID NO: 2774805 - DNA, 19 bp, Homo sapiens
gaataaagacttcatgttc

SEQ ID NO: 2774806 - DNA, 18 bp, Homo sapiens
gaataaagtctgagtggg

SEQ ID NO: 2774807 - DNA, 14 bp, Homo sapiens
gaataaagttgaag

SEQ ID NO: 2774808 - DNA, 23 bp, Homo sapiens
gaataaccacttaaaaaatgtcc

SEQ ID NO: 2774809 - DNA, 17 bp, Homo sapiens
gaataaggtacaagaag

SEQ ID NO: 2774810 - DNA, 20 bp, Homo sapiens
gaataaggtacaagaagcat

SEQ ID NO: 2774811 - DNA, 13 bp, Homo sapiens
gaataagtattct

SEQ ID NO: 2774812 - DNA, 14 bp, Homo sapiens
gaataagtgctgtt

SEQ ID NO: 2774813 - DNA, 22 bp, Homo sapiens
gaataatctttgggtaacttca

SEQ ID NO: 2774814 - DNA, 14 bp, Homo sapiens
gaataattgtgtac

SEQ ID NO: 2774815 - DNA, 13 bp, Homo sapiens
gaatacagtgtta

SEQ ID NO: 2774816 - DNA, 20 bp, Homo sapiens
gaatacagtgttattttctt

SEQ ID NO: 2774817 - DNA, 22 bp, Homo sapiens
gaatagctgggactacaggtgt

SEQ ID NO: 2774818 - DNA, 23 bp, Homo sapiens
gaatagctgggactacaggtgtg

SEQ ID NO: 2774819 - DNA, 13 bp, Homo sapiens
gaatataaacact

SEQ ID NO: 2774820 - DNA, 12 bp, Homo sapiens
gaatataattat

SEQ ID NO: 2774821 - DNA, 13 bp, Homo sapiens
gaatatggacaaa

SEQ ID NO: 2774822 - DNA, 12 bp, Homo sapiens
gaatatttatta

SEQ ID NO: 2774823 - DNA, 15 bp, Homo sapiens
gaatatttattacct

SEQ ID NO: 2774824 - DNA, 19 bp, Homo sapiens
gaatatttattacctctga

SEQ ID NO: 2774825 - DNA, 14 bp, Homo sapiens
gaatcaaaactctc

SEQ ID NO: 2774826 - DNA, 17 bp, Homo sapiens
gaatcaaagacatggaa

SEQ ID NO: 2774827 - DNA, 22 bp, Homo sapiens
gaatcaaagcagttaactttaa

SEQ ID NO: 2774828 - DNA, 22 bp, Homo sapiens
gaatcaagctagaaggccacat

SEQ ID NO: 2774829 - DNA, 14 bp, Homo sapiens
gaatcaataaaaat

SEQ ID NO: 2774830 - DNA, 20 bp, Homo sapiens
gaatcacttgaacccgggag

SEQ ID NO: 2774831 - DNA, 14 bp, Homo sapiens
gaccagttgggagc

SEQ ID NO: 2774832 - DNA, 15 bp, Homo sapiens
gaccataatgttaca

SEQ ID NO: 2774833 - DNA, 15 bp, Homo sapiens
gaccatttcaggggt

SEQ ID NO: 2774834 - DNA, 12 bp, Homo sapiens
gacccaaagacc

SEQ ID NO: 2774835 - DNA, 13 bp, Homo sapiens
gacccaaagacca

SEQ ID NO: 2774836 - DNA, 14 bp, Homo sapiens
gacccacagcctct

SEQ ID NO: 2774837 - DNA, 23 bp, Homo sapiens
gacccacatgccatttgtactga

SEQ ID NO: 2774838 - DNA, 15 bp, Homo sapiens
gacccagatcctcac

SEQ ID NO: 2774839 - DNA, 16 bp, Homo sapiens
gacccagatcctcaca

SEQ ID NO: 2774840 - DNA, 15 bp, Homo sapiens
gacccagatctcatg

SEQ ID NO: 2774841 - DNA, 15 bp, Homo sapiens
gacccagcaggaagc

SEQ ID NO: 2774842 - DNA, 23 bp, Homo sapiens
gacccagcaggaagccaggctga

SEQ ID NO: 2774843 - DNA, 22 bp, Homo sapiens
gacccagccccttgagaaacct

SEQ ID NO: 2774844 - DNA, 18 bp, Homo sapiens
gaccccaaagagcctgga

SEQ ID NO: 2774845 - DNA, 19 bp, Homo sapiens
gaccccaaagagcctggag

SEQ ID NO: 2774846 - DNA, 15 bp, Homo sapiens
gaccccagggcacag

SEQ ID NO: 2774847 - DNA, 16 bp, Homo sapiens
gaccccagggcacagg

SEQ ID NO: 2774848 - DNA, 19 bp, Homo sapiens
gaccccagggcacaggagc

SEQ ID NO: 2774849 - DNA, 18 bp, Homo sapiens
gacccccactctcattcc

SEQ ID NO: 2774850 - DNA, 18 bp, Homo sapiens
gacccctccatgtgggct

SEQ ID NO: 2774851 - DNA, 21 bp, Homo sapiens
gacccctccatgtgggctagt

SEQ ID NO: 2774852 - DNA, 22 bp, Homo sapiens
gacccctggaccaccagcccca

SEQ ID NO: 2774853 - DNA, 17 bp, Homo sapiens
gaccccttcctttcctc

SEQ ID NO: 2774854 - DNA, 14 bp, Homo sapiens
gacccgctctggac

SEQ ID NO: 2774855 - DNA, 16 bp, Homo sapiens
gacccgctctggacca

SEQ ID NO: 2774856 - DNA, 11 bp, Homo sapiens
gaccctacccc

SEQ ID NO: 2774857 - DNA, 14 bp, Homo sapiens
gaccctaccccacc

SEQ ID NO: 2774858 - DNA, 16 bp, Homo sapiens
gaccctaccccaccac

SEQ ID NO: 2774859 - DNA, 21 bp, Homo sapiens
gaccctacttcctgcactgac

SEQ ID NO: 2774860 - DNA, 19 bp, Homo sapiens
gaccctcctcctcccccag

SEQ ID NO: 2774861 - DNA, 22 bp, Homo sapiens
gaccctcctcctcccccagagg

SEQ ID NO: 2774862 - DNA, 14 bp, Homo sapiens
gaccctcctgtcca

SEQ ID NO: 2774863 - DNA, 15 bp, Homo sapiens
gaccctctgaatggt

SEQ ID NO: 2774864 - DNA, 15 bp, Homo sapiens
gaccctgcccttgtt

SEQ ID NO: 2774865 - DNA, 21 bp, Homo sapiens
gaccctggagcggctctcctg

SEQ ID NO: 2774866 - DNA, 12 bp, Homo sapiens
gaccctggctct

SEQ ID NO: 2774867 - DNA, 14 bp, Homo sapiens
gaccctggctcttc

SEQ ID NO: 2774868 - DNA, 15 bp, Homo sapiens
gaccctggctcttct

SEQ ID NO: 2774869 - DNA, 16 bp, Homo sapiens
gaccctggctcttctc

SEQ ID NO: 2774870 - DNA, 22 bp, Homo sapiens
gaccctgtagagtcactgaccc

SEQ ID NO: 2774871 - DNA, 15 bp, Homo sapiens
gacccttgcattaga

SEQ ID NO: 2774872 - DNA, 22 bp, Homo sapiens
gaccctttccttccttccctgg

SEQ ID NO: 2774873 - DNA, 21 bp, Homo sapiens
gaccggccctgcccctcttcc

SEQ ID NO: 2774874 - DNA, 12 bp, Homo sapiens
ctgttttaaatt

SEQ ID NO: 2774875 - DNA, 13 bp, Homo sapiens
ctgttttaataat

SEQ ID NO: 2774876 - DNA, 20 bp, Homo sapiens
ctgttttgtcctttgagaaa

SEQ ID NO: 2774877 - DNA, 15 bp, Homo sapiens
ctgtttttaagctgt

SEQ ID NO: 2774878 - DNA, 17 bp, Homo sapiens
ctgtttttaagctgttt

SEQ ID NO: 2774879 - DNA, 15 bp, Homo sapiens
ctgtttttcggacag

SEQ ID NO: 2774880 - DNA, 14 bp, Homo sapiens
ctgtttttgaagaa

SEQ ID NO: 2774881 - DNA, 14 bp, Homo sapiens
ctgtttttgtagtg

SEQ ID NO: 2774882 - DNA, 13 bp, Homo sapiens
ctgttttttagtt

SEQ ID NO: 2774883 - DNA, 18 bp, Homo sapiens
cttaaaaaacttgtaaat

SEQ ID NO: 2774884 - DNA, 20 bp, Homo sapiens
cttaaaaaagcaacagtagc

SEQ ID NO: 2774885 - DNA, 17 bp, Homo sapiens
cttaaaaaataaaaact

SEQ ID NO: 2774886 - DNA, 17 bp, Homo sapiens
cttaaaatatatttcag

SEQ ID NO: 2774887 - DNA, 12 bp, Homo sapiens
cttaaataaatt

SEQ ID NO: 2774888 - DNA, 13 bp, Homo sapiens
cttaaataaattc

SEQ ID NO: 2774889 - DNA, 14 bp, Homo sapiens
cttaaataaattca

SEQ ID NO: 2774890 - DNA, 17 bp, Homo sapiens
cttaaataaattcaaac

SEQ ID NO: 2774891 - DNA, 13 bp, Homo sapiens
cttaaataagaaa

SEQ ID NO: 2774892 - DNA, 14 bp, Homo sapiens
cttaacattctgta

SEQ ID NO: 2774893 - DNA, 14 bp, Homo sapiens
cttaacattgattt

SEQ ID NO: 2774894 - DNA, 20 bp, Homo sapiens
cttaaccagcacatttctcc

SEQ ID NO: 2774895 - DNA, 14 bp, Homo sapiens
cttaacggctccag

SEQ ID NO: 2774896 - DNA, 17 bp, Homo sapiens
cttaactcatctgttat

SEQ ID NO: 2774897 - DNA, 17 bp, Homo sapiens
cttaactgtgtgaagaa

SEQ ID NO: 2774898 - DNA, 20 bp, Homo sapiens
cttaagccttttgctcacaa

SEQ ID NO: 2774899 - DNA, 20 bp, Homo sapiens
cttaaggattgtgatatttt

SEQ ID NO: 2774900 - DNA, 18 bp, Homo sapiens
cttaagtcagaacagcag

SEQ ID NO: 2774901 - DNA, 13 bp, Homo sapiens
cttaataggcttt

SEQ ID NO: 2774902 - DNA, 22 bp, Homo sapiens
cttaatggctgataattttaaa

SEQ ID NO: 2774903 - DNA, 22 bp, Homo sapiens
cttaatgttctgaataatttct

SEQ ID NO: 2774904 - DNA, 12 bp, Homo sapiens
cttacatgattc

SEQ ID NO: 2774905 - DNA, 19 bp, Homo sapiens
cttacatgcattactgcat

SEQ ID NO: 2774906 - DNA, 19 bp, Homo sapiens
cttaccaggcaccaaaaga

SEQ ID NO: 2774907 - DNA, 21 bp, Homo sapiens
cttacccggagaaggccgctg

SEQ ID NO: 2774908 - DNA, 19 bp, Homo sapiens
cttacctaaacagatataa

SEQ ID NO: 2774909 - DNA, 22 bp, Homo sapiens
cttacctaaacagatataaatg

SEQ ID NO: 2774910 - DNA, 19 bp, Homo sapiens
cttacctcctgcccaggag

SEQ ID NO: 2774911 - DNA, 19 bp, Homo sapiens
cttacctgggcattcttgt

SEQ ID NO: 2774912 - DNA, 18 bp, Homo sapiens
cttaccttcaataaagta

SEQ ID NO: 2774913 - DNA, 22 bp, Homo sapiens
cttaccttcaataaagtatcta

SEQ ID NO: 2774914 - DNA, 12 bp, Homo sapiens
cttacgctctct

SEQ ID NO: 2774915 - DNA, 12 bp, Homo sapiens
cttactcctgtg

SEQ ID NO: 2774916 - DNA, 14 bp, Homo sapiens
cttacttggaactg

SEQ ID NO: 2774917 - DNA, 15 bp, Homo sapiens
cttagaagtcacaca

SEQ ID NO: 2774918 - DNA, 21 bp, Homo sapiens
cttagaagtggaccaggacag

SEQ ID NO: 2774919 - DNA, 16 bp, Homo sapiens
cttagacctcagcctg

SEQ ID NO: 2774920 - DNA, 16 bp, Homo sapiens
cttagattagctctgg

SEQ ID NO: 2774921 - DNA, 17 bp, Homo sapiens
cttagattagctctgga

SEQ ID NO: 2774922 - DNA, 18 bp, Homo sapiens
cttagattagctctggac

SEQ ID NO: 2774923 - DNA, 21 bp, Homo sapiens
cttagattagctctggaccag

SEQ ID NO: 2774924 - DNA, 17 bp, Homo sapiens
cttagcagctcttcccc

SEQ ID NO: 2774925 - DNA, 23 bp, Homo sapiens
cttagcagctcttcccctttcct

SEQ ID NO: 2774926 - DNA, 18 bp, Homo sapiens
cttagcagggaaacagct

SEQ ID NO: 2774927 - DNA, 17 bp, Homo sapiens
cttagctgtctgctcag

SEQ ID NO: 2774928 - DNA, 14 bp, Homo sapiens
cttagcttagacct

SEQ ID NO: 2774929 - DNA, 16 bp, Homo sapiens
cttagcttagacctca

SEQ ID NO: 2774930 - DNA, 20 bp, Homo sapiens
cttagcttagacctcagcct

SEQ ID NO: 2774931 - DNA, 23 bp, Homo sapiens
cttagcttagacctcagcctgtg

SEQ ID NO: 2774932 - DNA, 17 bp, Homo sapiens
cttagctttccacagga

SEQ ID NO: 2774933 - DNA, 19 bp, Homo sapiens
cttagctttccacaggagg

SEQ ID NO: 2774934 - DNA, 22 bp, Homo sapiens
cttataagtgggagctaaataa

SEQ ID NO: 2774935 - DNA, 13 bp, Homo sapiens
cttatagaatatt

SEQ ID NO: 2774936 - DNA, 15 bp, Homo sapiens
cttatagaatattta

SEQ ID NO: 2774937 - DNA, 16 bp, Homo sapiens
cttatagaatatttat

SEQ ID NO: 2774938 - DNA, 14 bp, Homo sapiens
cttataggtttcca

SEQ ID NO: 2774939 - DNA, 23 bp, Homo sapiens
cttatagtcaatgtttcttttat

SEQ ID NO: 2774940 - DNA, 17 bp, Homo sapiens
cttatgaaatgggcttt

SEQ ID NO: 2774941 - DNA, 19 bp, Homo sapiens
cttatgtattattttctat

SEQ ID NO: 2774942 - DNA, 18 bp, Homo sapiens
cttatgtttgaagagaaa

SEQ ID NO: 2774943 - DNA, 18 bp, Homo sapiens
cttattgcccacgctgga

SEQ ID NO: 2774944 - DNA, 14 bp, Homo sapiens
cttattgtacctct

SEQ ID NO: 2774945 - DNA, 18 bp, Homo sapiens
cttatttaatttttgcaa

SEQ ID NO: 2774946 - DNA, 13 bp, Homo sapiens
cttatttatatat

SEQ ID NO: 2774947 - DNA, 22 bp, Homo sapiens
ctttaacaaaacaagaaagaaa

SEQ ID NO: 2774948 - DNA, 20 bp, Homo sapiens
ctttaaccgtttttcaagaa

SEQ ID NO: 2774949 - DNA, 21 bp, Homo sapiens
ctttaaccgtttttcaagaaa

SEQ ID NO: 2774950 - DNA, 15 bp, Homo sapiens
ctttaacttaaatag

SEQ ID NO: 2774951 - DNA, 18 bp, Homo sapiens
ctttaagaatctatttcc

SEQ ID NO: 2774952 - DNA, 21 bp, Homo sapiens
ctttaatcttcagttttatct

SEQ ID NO: 2774953 - DNA, 22 bp, Homo sapiens
ctttaatgtcacaggcaggtcc

SEQ ID NO: 2774954 - DNA, 14 bp, Homo sapiens
ctttacattttatt

SEQ ID NO: 2774955 - DNA, 13 bp, Homo sapiens
ctttaccactatg

SEQ ID NO: 2774956 - DNA, 14 bp, Homo sapiens
ctttacttttaaac

SEQ ID NO: 2774957 - DNA, 13 bp, Homo sapiens
ctttagagtagca

SEQ ID NO: 2774958 - DNA, 18 bp, Homo sapiens
ctttaggcagcagctttt

SEQ ID NO: 2774959 - DNA, 21 bp, Homo sapiens
ctttagggcttatggccaggg

SEQ ID NO: 2774960 - DNA, 17 bp, Homo sapiens
ctttaggtgcctcctgt

SEQ ID NO: 2774961 - DNA, 21 bp, Homo sapiens
ctttaggtgcctcctgtctta

SEQ ID NO: 2774962 - DNA, 21 bp, Homo sapiens
ctttatccctgaggtcacctg

SEQ ID NO: 2774963 - DNA, 21 bp, Homo sapiens
ctttatctaatacctctgtgt

SEQ ID NO: 2774964 - DNA, 14 bp, Homo sapiens
ctttatcttgacat

SEQ ID NO: 2774965 - DNA, 19 bp, Homo sapiens
ctttattttgttaataata

SEQ ID NO: 2774966 - DNA, 21 bp, Homo sapiens
ctttcaaagaaggaattctag

SEQ ID NO: 2774967 - DNA, 14 bp, Homo sapiens
ctttcaaatttcac

SEQ ID NO: 2774968 - DNA, 12 bp, Homo sapiens
ctttcaacttaa

SEQ ID NO: 2774969 - DNA, 22 bp, Homo sapiens
ctttcaacttaaatcactgagg

SEQ ID NO: 2774970 - DNA, 17 bp, Homo sapiens
ctttcacaaaattttat

SEQ ID NO: 2774971 - DNA, 19 bp, Homo sapiens
ctttcagcactcagaaaag

SEQ ID NO: 2774972 - DNA, 15 bp, Homo sapiens
ctttcagtgaaagca

SEQ ID NO: 2774973 - DNA, 17 bp, Homo sapiens
ctttcagtgaaagcatc

SEQ ID NO: 2774974 - DNA, 17 bp, Homo sapiens
ctttcatccccaccttg

SEQ ID NO: 2774975 - DNA, 20 bp, Homo sapiens
ctttcattaaagcatttact

SEQ ID NO: 2774976 - DNA, 13 bp, Homo sapiens
ctttccacctgct

SEQ ID NO: 2774977 - DNA, 22 bp, Homo sapiens
ctttccacctgctttctcctgg

SEQ ID NO: 2774978 - DNA, 15 bp, Homo sapiens
ctttcccatgctgaa

SEQ ID NO: 2774979 - DNA, 18 bp, Homo sapiens
ctttcccatgctgaatta

SEQ ID NO: 2774980 - DNA, 21 bp, Homo sapiens
ctttccccgggggaggaaggg

SEQ ID NO: 2774981 - DNA, 22 bp, Homo sapiens
ctttccccgggggaggaagggg

SEQ ID NO: 2774982 - DNA, 20 bp, Homo sapiens
ctttccgtctccctaaaata

SEQ ID NO: 2774983 - DNA, 17 bp, Homo sapiens
ctttcctccccaccttc

SEQ ID NO: 2774984 - DNA, 14 bp, Homo sapiens
ctttcctcttcccc

SEQ ID NO: 2774985 - DNA, 22 bp, Homo sapiens
ctttcggggagaggctgaggac

SEQ ID NO: 2774986 - DNA, 17 bp, Homo sapiens
ctttctaatgtgtgaat

SEQ ID NO: 2774987 - DNA, 21 bp, Homo sapiens
ctttctagtcctattctattg

SEQ ID NO: 2774988 - DNA, 14 bp, Homo sapiens
ctttctagttgaaa

SEQ ID NO: 2774989 - DNA, 16 bp, Homo sapiens
ctttctagttgaaaat

SEQ ID NO: 2774990 - DNA, 21 bp, Homo sapiens
ctttctcagccgcttctgact

SEQ ID NO: 2774991 - DNA, 13 bp, Homo sapiens
ctttctccagcca

SEQ ID NO: 2774992 - DNA, 19 bp, Homo sapiens
ctttctccagccagcaatg

SEQ ID NO: 2774993 - DNA, 20 bp, Homo sapiens
ctttctccagccagcaatga

SEQ ID NO: 2774994 - DNA, 16 bp, Homo sapiens
ctttctgttgccacaa

SEQ ID NO: 2774995 - DNA, 16 bp, Homo sapiens
ctttcttattttgtaa

SEQ ID NO: 2774996 - DNA, 17 bp, Homo sapiens
ctttcttattttgtaat

SEQ ID NO: 2774997 - DNA, 18 bp, Homo sapiens
ctttcttattttgtaata

SEQ ID NO: 2774998 - DNA, 15 bp, Homo sapiens
ctttcttcctctgct

SEQ ID NO: 2774999 - DNA, 20 bp, Homo sapiens
ctttcttctacaaccagagc

SEQ ID NO: 2775000 - DNA, 15 bp, Homo sapiens
ctttcttctatttta

SEQ ID NO: 2775001 - DNA, 16 bp, Homo sapiens
ctttcttctattttat

SEQ ID NO: 2775002 - DNA, 17 bp, Homo sapiens
ctttgaataaagtctga

SEQ ID NO: 2775003 - DNA, 19 bp, Homo sapiens
ctttgaataaagtctgagt

SEQ ID NO: 2775004 - DNA, 23 bp, Homo sapiens
ctttgaatcctctctctgtgtta

SEQ ID NO: 2775005 - DNA, 16 bp, Homo sapiens
ctttgacatgaaaaga

SEQ ID NO: 2775006 - DNA, 14 bp, Homo sapiens
ctttgactcacctg

SEQ ID NO: 2775007 - DNA, 13 bp, Homo sapiens
ctttgagtgatcc

SEQ ID NO: 2775008 - DNA, 13 bp, Homo sapiens
ctttgagttatag

SEQ ID NO: 2775009 - DNA, 15 bp, Homo sapiens
ctttgatatttcaat

SEQ ID NO: 2775010 - DNA, 13 bp, Homo sapiens
ctttgattccatt

SEQ ID NO: 2775011 - DNA, 15 bp, Homo sapiens
ctttgcaaagttaca

SEQ ID NO: 2775012 - DNA, 22 bp, Homo sapiens
ctttgcactgagggccacacta

SEQ ID NO: 2775013 - DNA, 16 bp, Homo sapiens
ctttgcagacaggcaa

SEQ ID NO: 2775014 - DNA, 18 bp, Homo sapiens
ctttgccagaaagcataa

SEQ ID NO: 2775015 - DNA, 16 bp, Homo sapiens
ctttgccccagttaca

SEQ ID NO: 2775016 - DNA, 18 bp, Homo sapiens
ctttgcctgtgtgagcat

SEQ ID NO: 2775017 - DNA, 17 bp, Homo sapiens
ctttggaaggagtgaga

SEQ ID NO: 2775018 - DNA, 17 bp, Homo sapiens
ctttggccattccaaca

SEQ ID NO: 2775019 - DNA, 18 bp, Homo sapiens
ctttgggaggctgaggcg

SEQ ID NO: 2775020 - DNA, 17 bp, Homo sapiens
ctttggggtcagccagg

SEQ ID NO: 2775021 - DNA, 21 bp, Homo sapiens
ctttggggtcagccagggcca

SEQ ID NO: 2775022 - DNA, 21 bp, Homo sapiens
ctttgggtactactgctgcaa

SEQ ID NO: 2775023 - DNA, 14 bp, Homo sapiens
ctttggtagaaaag

SEQ ID NO: 2775024 - DNA, 15 bp, Homo sapiens
ctttggttctctcca

SEQ ID NO: 2775025 - DNA, 13 bp, Homo sapiens
ctttgtaatggga

SEQ ID NO: 2775026 - DNA, 22 bp, Homo sapiens
ctttgtaatgtcaccaccttcc

SEQ ID NO: 2775027 - DNA, 19 bp, Homo sapiens
ctttgtgagagtgagctgt

SEQ ID NO: 2775028 - DNA, 22 bp, Homo sapiens
ctttgtgtacttcagtcttgga

SEQ ID NO: 2775029 - DNA, 18 bp, Homo sapiens
ctttgtgtagctttgctc

SEQ ID NO: 2775030 - DNA, 19 bp, Homo sapiens
ctttgttattatcctgcat

SEQ ID NO: 2775031 - DNA, 21 bp, Homo sapiens
ctttgttattatcctgcattt

SEQ ID NO: 2775032 - DNA, 20 bp, Homo sapiens
ctttgttatttttgtttctt

SEQ ID NO: 2775033 - DNA, 22 bp, Homo sapiens
ctttgttatttttgtttcttcc

SEQ ID NO: 2775034 - DNA, 20 bp, Homo sapiens
cttttaacatttatctaaaa

SEQ ID NO: 2775035 - DNA, 14 bp, Homo sapiens
cttttaataaaatt

SEQ ID NO: 2775036 - DNA, 15 bp, Homo sapiens
cttttaatgaacaaa

SEQ ID NO: 2775037 - DNA, 11 bp, Homo sapiens
ctgcccggctg

SEQ ID NO: 2775038 - DNA, 19 bp, Homo sapiens
ctgccctagagcacactgt

SEQ ID NO: 2775039 - DNA, 12 bp, Homo sapiens
ctgccctcaggg

SEQ ID NO: 2775040 - DNA, 23 bp, Homo sapiens
ctgccctcccacctccgctggga

SEQ ID NO: 2775041 - DNA, 14 bp, Homo sapiens
ctgccctccctggc

SEQ ID NO: 2775042 - DNA, 20 bp, Homo sapiens
ctgccctccctggcctcacg

SEQ ID NO: 2775043 - DNA, 15 bp, Homo sapiens
ctgccctgccacctg

SEQ ID NO: 2775044 - DNA, 17 bp, Homo sapiens
ctgccctgccacctgtc

SEQ ID NO: 2775045 - DNA, 13 bp, Homo sapiens
ctgccctgccact

SEQ ID NO: 2775046 - DNA, 14 bp, Homo sapiens
ctgccctgccctgc

SEQ ID NO: 2775047 - DNA, 21 bp, Homo sapiens
ctgccctgctgccgcctccca

SEQ ID NO: 2775048 - DNA, 22 bp, Homo sapiens
ctgccctgtcctccagcttccc

SEQ ID NO: 2775049 - DNA, 19 bp, Homo sapiens
ctgccgacctcgtcctccc

SEQ ID NO: 2775050 - DNA, 14 bp, Homo sapiens
ctgccgagcaaccg

SEQ ID NO: 2775051 - DNA, 16 bp, Homo sapiens
ctgccgagcaaccgtg

SEQ ID NO: 2775052 - DNA, 15 bp, Homo sapiens
ctgccgcctcccagc

SEQ ID NO: 2775053 - DNA, 16 bp, Homo sapiens
ctgccgcctcccagcc

SEQ ID NO: 2775054 - DNA, 19 bp, Homo sapiens
ctgccgcctcccagcctgg

SEQ ID NO: 2775055 - DNA, 19 bp, Homo sapiens
ctgccgggttctagtctcc

SEQ ID NO: 2775056 - DNA, 21 bp, Homo sapiens
ctgccgggttctagtctcctt

SEQ ID NO: 2775057 - DNA, 18 bp, Homo sapiens
ctgcctaagtggctgctg

SEQ ID NO: 2775058 - DNA, 18 bp, Homo sapiens
ctgcctacattccctggc

SEQ ID NO: 2775059 - DNA, 14 bp, Homo sapiens
ctgcctactcacga

SEQ ID NO: 2775060 - DNA, 18 bp, Homo sapiens
ctgcctatccatcctgcg

SEQ ID NO: 2775061 - DNA, 21 bp, Homo sapiens
ctgcctcaatgtgaatcagac

SEQ ID NO: 2775062 - DNA, 14 bp, Homo sapiens
ctgcctcagcctcc

SEQ ID NO: 2775063 - DNA, 16 bp, Homo sapiens
ctgcctcagcctctca

SEQ ID NO: 2775064 - DNA, 22 bp, Homo sapiens
ctgcctcatgaccctcctgtcc

SEQ ID NO: 2775065 - DNA, 23 bp, Homo sapiens
ctgcctcatgaccctcctgtcca

SEQ ID NO: 2775066 - DNA, 14 bp, Homo sapiens
ctgcctccagaatg

SEQ ID NO: 2775067 - DNA, 24 bp, Homo sapiens
ctgcctcctcttcaactgaccagc

SEQ ID NO: 2775068 - DNA, 17 bp, Homo sapiens
ctgcctcgaactggctg

SEQ ID NO: 2775069 - DNA, 19 bp, Homo sapiens
ctgcctcgaactggctgca

SEQ ID NO: 2775070 - DNA, 18 bp, Homo sapiens
ctgcctctgacacacagc

SEQ ID NO: 2775071 - DNA, 16 bp, Homo sapiens
ctgcctgaagtcacac

SEQ ID NO: 2775072 - DNA, 19 bp, Homo sapiens
ctgcctgaagtcacacagt

SEQ ID NO: 2775073 - DNA, 20 bp, Homo sapiens
ctgcctgcagtactttacct

SEQ ID NO: 2775074 - DNA, 13 bp, Homo sapiens
ctgcctgcccagg

SEQ ID NO: 2775075 - DNA, 14 bp, Homo sapiens
ctgcctgcccaggc

SEQ ID NO: 2775076 - DNA, 17 bp, Homo sapiens
ctgcctgcccaggcccc

SEQ ID NO: 2775077 - DNA, 22 bp, Homo sapiens
ctgcctgcccaggcccctgcca

SEQ ID NO: 2775078 - DNA, 13 bp, Homo sapiens
ctgcctgcttggg

SEQ ID NO: 2775079 - DNA, 19 bp, Homo sapiens
ctgcctggaggacctgagc

SEQ ID NO: 2775080 - DNA, 20 bp, Homo sapiens
ctgcctggaggacctgagcc

SEQ ID NO: 2775081 - DNA, 17 bp, Homo sapiens
ctgcctgtagttaggaa

SEQ ID NO: 2775082 - DNA, 20 bp, Homo sapiens
ctgcctgtagttaggaaata

SEQ ID NO: 2775083 - DNA, 21 bp, Homo sapiens
ctgcctgtagttaggaaataa

SEQ ID NO: 2775084 - DNA, 22 bp, Homo sapiens
ctgcctgtagttaggaaataaa

SEQ ID NO: 2775085 - DNA, 21 bp, Homo sapiens
ctgcctgtgcacggccagctg

SEQ ID NO: 2775086 - DNA, 19 bp, Homo sapiens
ctgcctgttcagctccagc

SEQ ID NO: 2775087 - DNA, 20 bp, Homo sapiens
ctgcctgttcagctccagct

SEQ ID NO: 2775088 - DNA, 23 bp, Homo sapiens
ctgcctgttcagctccagctcac

SEQ ID NO: 2775089 - DNA, 12 bp, Homo sapiens
ctgccttccagg

SEQ ID NO: 2775090 - DNA, 13 bp, Homo sapiens
ctgcctttggaag

SEQ ID NO: 2775091 - DNA, 18 bp, Homo sapiens
ctgcctttggaagaaaca

SEQ ID NO: 2775092 - DNA, 16 bp, Homo sapiens
ctgcgagcatttccct

SEQ ID NO: 2775093 - DNA, 23 bp, Homo sapiens
ctgcgagcatttccctcccggga

SEQ ID NO: 2775094 - DNA, 19 bp, Homo sapiens
ctgcgatcttcagagcagg

SEQ ID NO: 2775095 - DNA, 20 bp, Homo sapiens
ctgcgatcttcagagcaggg

SEQ ID NO: 2775096 - DNA, 18 bp, Homo sapiens
ctgcgggacagaggacca

SEQ ID NO: 2775097 - DNA, 20 bp, Homo sapiens
ctgcgggatggtcctggggc

SEQ ID NO: 2775098 - DNA, 22 bp, Homo sapiens
ctgcgggatggtcctggggctc

SEQ ID NO: 2775099 - DNA, 19 bp, Homo sapiens
ctgcgtgccagtgtcccca

SEQ ID NO: 2775100 - DNA, 19 bp, Homo sapiens
ctgcgtttattaatgcctc

SEQ ID NO: 2775101 - DNA, 22 bp, Homo sapiens
ctgctaagtaggggcagtgatg

SEQ ID NO: 2775102 - DNA, 23 bp, Homo sapiens
ctgctacaaatactcttaggaag

SEQ ID NO: 2775103 - DNA, 17 bp, Homo sapiens
ctgctacccagaaatca

SEQ ID NO: 2775104 - DNA, 17 bp, Homo sapiens
ctgctacctcactgggg

SEQ ID NO: 2775105 - DNA, 16 bp, Homo sapiens
ctgctagctgtagaaa

SEQ ID NO: 2775106 - DNA, 19 bp, Homo sapiens
ctgctaggcgagtgccagg

SEQ ID NO: 2775107 - DNA, 15 bp, Homo sapiens
ctgctcaacctctct

SEQ ID NO: 2775108 - DNA, 23 bp, Homo sapiens
ctgctcaacctctctccttctgg

SEQ ID NO: 2775109 - DNA, 20 bp, Homo sapiens
ctgctcaagaagacatggag

SEQ ID NO: 2775110 - DNA, 14 bp, Homo sapiens
ctgctcacatatct

SEQ ID NO: 2775111 - DNA, 23 bp, Homo sapiens
ctgctcaggaattgaagatgtaa

SEQ ID NO: 2775112 - DNA, 14 bp, Homo sapiens
ctgctcccagcagc

SEQ ID NO: 2775113 - DNA, 16 bp, Homo sapiens
ctgctcccagcagccc

SEQ ID NO: 2775114 - DNA, 22 bp, Homo sapiens
ctgctcccccaccccctcccca

SEQ ID NO: 2775115 - DNA, 11 bp, Homo sapiens
ctgctcctcca

SEQ ID NO: 2775116 - DNA, 12 bp, Homo sapiens
ctgctcctccag

SEQ ID NO: 2775117 - DNA, 13 bp, Homo sapiens
ctgctcctccagg

SEQ ID NO: 2775118 - DNA, 24 bp, Homo sapiens
ctgctcctccagggccacgtgcca

SEQ ID NO: 2775119 - DNA, 16 bp, Homo sapiens
ctgctcctctccccag

SEQ ID NO: 2775120 - DNA, 22 bp, Homo sapiens
ctgtaaatagttttaaatatga

SEQ ID NO: 2775121 - DNA, 16 bp, Homo sapiens
ctgtaacaagccagat

SEQ ID NO: 2775122 - DNA, 17 bp, Homo sapiens
ctgtaacacaagccaca

SEQ ID NO: 2775123 - DNA, 14 bp, Homo sapiens
ctgtaagtttattt

SEQ ID NO: 2775124 - DNA, 21 bp, Homo sapiens
ctgtaagtttattttttctac

SEQ ID NO: 2775125 - DNA, 22 bp, Homo sapiens
ctgtaagtttattttttctaca

SEQ ID NO: 2775126 - DNA, 23 bp, Homo sapiens
ctgtaagtttattttttctacac

SEQ ID NO: 2775127 - DNA, 19 bp, Homo sapiens
ctgtaatcatataataaat

SEQ ID NO: 2775128 - DNA, 14 bp, Homo sapiens
ctgtaatcccagca

SEQ ID NO: 2775129 - DNA, 14 bp, Homo sapiens
ctgtaatcccagct

SEQ ID NO: 2775130 - DNA, 19 bp, Homo sapiens
ctgtaatcccagctactca

SEQ ID NO: 2775131 - DNA, 18 bp, Homo sapiens
ctgtaattaagtaaacca

SEQ ID NO: 2775132 - DNA, 19 bp, Homo sapiens
ctgtcttcatagcagattt

SEQ ID NO: 2775133 - DNA, 15 bp, Homo sapiens
ctgtcttgccagcca

SEQ ID NO: 2775134 - DNA, 22 bp, Homo sapiens
ctgtctttcagcattcagtccg

SEQ ID NO: 2775135 - DNA, 18 bp, Homo sapiens
ctgtgaaagtatgtgata

SEQ ID NO: 2775136 - DNA, 19 bp, Homo sapiens
ctgtgaacccaggacaagc

SEQ ID NO: 2775137 - DNA, 16 bp, Homo sapiens
ctgtgaacgatttaga

SEQ ID NO: 2775138 - DNA, 18 bp, Homo sapiens
ctgtgaacgatttagaaa

SEQ ID NO: 2775139 - DNA, 17 bp, Homo sapiens
ctgtgaagacccagcag

SEQ ID NO: 2775140 - DNA, 19 bp, Homo sapiens
ctgtgaagacccagcagga

SEQ ID NO: 2775141 - DNA, 20 bp, Homo sapiens
ctgtgaagacccagcaggaa

SEQ ID NO: 2775142 - DNA, 14 bp, Homo sapiens
ctgtgacaggaagc

SEQ ID NO: 2775143 - DNA, 17 bp, Homo sapiens
ctgtgacctctcccctg

SEQ ID NO: 2775144 - DNA, 16 bp, Homo sapiens
ctgtgacctgccccgc

SEQ ID NO: 2775145 - DNA, 14 bp, Homo sapiens
ctgtgacctgctga

SEQ ID NO: 2775146 - DNA, 21 bp, Homo sapiens
cttcaagtgatatatgtattt

SEQ ID NO: 2775147 - DNA, 17 bp, Homo sapiens
cttcaagttagctcagg

SEQ ID NO: 2775148 - DNA, 18 bp, Homo sapiens
cttcaagttagctcagga

SEQ ID NO: 2775149 - DNA, 15 bp, Homo sapiens
cttcaattcctgggc

SEQ ID NO: 2775150 - DNA, 21 bp, Homo sapiens
cttcacacacaggcaactgag

SEQ ID NO: 2775151 - DNA, 12 bp, Homo sapiens
cttcacactgca

SEQ ID NO: 2775152 - DNA, 13 bp, Homo sapiens
cttcacactgcaa

SEQ ID NO: 2775153 - DNA, 20 bp, Homo sapiens
cttcacactgcaagagcctt

SEQ ID NO: 2775154 - DNA, 18 bp, Homo sapiens
cttcaccagagcccatgc

SEQ ID NO: 2775155 - DNA, 24 bp, Homo sapiens
cttcacccagctaatctgtagggc

SEQ ID NO: 2775156 - DNA, 21 bp, Homo sapiens
cttcaccctgaatggttccat

SEQ ID NO: 2775157 - DNA, 18 bp, Homo sapiens
cttcactattcctaggag

SEQ ID NO: 2775158 - DNA, 14 bp, Homo sapiens
cttcactccctccc

SEQ ID NO: 2775159 - DNA, 14 bp, Homo sapiens
cttcactccggtgt

SEQ ID NO: 2775160 - DNA, 17 bp, Homo sapiens
cttcagaagacactgca

SEQ ID NO: 2775161 - DNA, 12 bp, Homo sapiens
cttcagagaagt

SEQ ID NO: 2775162 - DNA, 19 bp, Homo sapiens
cttcagagtagagggcttg

SEQ ID NO: 2775163 - DNA, 18 bp, Homo sapiens
cttcagatttgtgttata

SEQ ID NO: 2775164 - DNA, 16 bp, Homo sapiens
cttcagcctcccgagt

SEQ ID NO: 2775165 - DNA, 20 bp, Homo sapiens
cttcagcctcccgagtagct

SEQ ID NO: 2775166 - DNA, 22 bp, Homo sapiens
cttcagtcctggtctgctcagg

SEQ ID NO: 2775167 - DNA, 19 bp, Homo sapiens
cttcagtgcatctgggaag

SEQ ID NO: 2775168 - DNA, 11 bp, Homo sapiens
cttcagtgccc

SEQ ID NO: 2775169 - DNA, 15 bp, Homo sapiens
cttcagtggcagctg

SEQ ID NO: 2775170 - DNA, 17 bp, Homo sapiens
cttcagtggcagctgct

SEQ ID NO: 2775171 - DNA, 19 bp, Homo sapiens
cttcataacaattttagga

SEQ ID NO: 2775172 - DNA, 17 bp, Homo sapiens
cttcatcaatttttata

SEQ ID NO: 2775173 - DNA, 19 bp, Homo sapiens
cttcatcaatttttataca

SEQ ID NO: 2775174 - DNA, 22 bp, Homo sapiens
cttcatcaatttttatacatat

SEQ ID NO: 2775175 - DNA, 24 bp, Homo sapiens
cttcatcaatttttatacatatca

SEQ ID NO: 2775176 - DNA, 17 bp, Homo sapiens
cttcatgcaatgacatc

SEQ ID NO: 2775177 - DNA, 17 bp, Homo sapiens
cttcatgctcagccctg

SEQ ID NO: 2775178 - DNA, 14 bp, Homo sapiens
cttcatggaactca

SEQ ID NO: 2775179 - DNA, 15 bp, Homo sapiens
cttcatggaccaaga

SEQ ID NO: 2775180 - DNA, 18 bp, Homo sapiens
cttcatggaccaagaatg

SEQ ID NO: 2775181 - DNA, 19 bp, Homo sapiens
cttcatggccatagctttt

SEQ ID NO: 2775182 - DNA, 20 bp, Homo sapiens
cttcatttccgtgaagggca

SEQ ID NO: 2775183 - DNA, 22 bp, Homo sapiens
cttcatttccgtgaagggcacc

SEQ ID NO: 2775184 - DNA, 13 bp, Homo sapiens
cttcatttggaga

SEQ ID NO: 2775185 - DNA, 16 bp, Homo sapiens
cttcattttcagagtg

SEQ ID NO: 2775186 - DNA, 17 bp, Homo sapiens
cttcattttcagagtga

SEQ ID NO: 2775187 - DNA, 19 bp, Homo sapiens
cttccaggcccccaccact

SEQ ID NO: 2775188 - DNA, 20 bp, Homo sapiens
cttccagtggtaccagctca

SEQ ID NO: 2775189 - DNA, 17 bp, Homo sapiens
cttccagtttgctttgc

SEQ ID NO: 2775190 - DNA, 21 bp, Homo sapiens
cttccagtttgctttgccctt

SEQ ID NO: 2775191 - DNA, 11 bp, Homo sapiens
cttccataatc

SEQ ID NO: 2775192 - DNA, 21 bp, Homo sapiens
cttccataatctggactcctc

SEQ ID NO: 2775193 - DNA, 14 bp, Homo sapiens
cttccataattatg

SEQ ID NO: 2775194 - DNA, 15 bp, Homo sapiens
cttccatgtcgcctc

SEQ ID NO: 2775195 - DNA, 16 bp, Homo sapiens
cttccatgtcgcctct

SEQ ID NO: 2775196 - DNA, 18 bp, Homo sapiens
cttccatgtcgcctctgc

SEQ ID NO: 2775197 - DNA, 14 bp, Homo sapiens
cttcccagctctcc

SEQ ID NO: 2775198 - DNA, 15 bp, Homo sapiens
cttcccagctctccc

SEQ ID NO: 2775199 - DNA, 21 bp, Homo sapiens
cttcccagctctccctctggc

SEQ ID NO: 2775200 - DNA, 22 bp, Homo sapiens
cttcccagttcaggagtcccaa

SEQ ID NO: 2775201 - DNA, 15 bp, Homo sapiens
cttcccatccccagc

SEQ ID NO: 2775202 - DNA, 12 bp, Homo sapiens
cttccccacaga

SEQ ID NO: 2775203 - DNA, 13 bp, Homo sapiens
cttccccacagaa

SEQ ID NO: 2775204 - DNA, 13 bp, Homo sapiens
cttccccagactc

SEQ ID NO: 2775205 - DNA, 18 bp, Homo sapiens
cttccccagactcagctc

SEQ ID NO: 2775206 - DNA, 22 bp, Homo sapiens
cttcccccatcccctttcctcc

SEQ ID NO: 2775207 - DNA, 18 bp, Homo sapiens
cttcccctcgctgtcctg

SEQ ID NO: 2775208 - DNA, 23 bp, Homo sapiens
cttcccctcgctgtcctgctgtg

SEQ ID NO: 2775209 - DNA, 19 bp, Homo sapiens
cttccccttgcccagggct

SEQ ID NO: 2775210 - DNA, 14 bp, Homo sapiens
cttccccttgccct

SEQ ID NO: 2775211 - DNA, 17 bp, Homo sapiens
cttccccttgcccttgc

SEQ ID NO: 2775212 - DNA, 13 bp, Homo sapiens
cttcccctttccc

SEQ ID NO: 2775213 - DNA, 22 bp, Homo sapiens
cttcccgggatcacttaatgaa

SEQ ID NO: 2775214 - DNA, 12 bp, Homo sapiens
cttccctggctt

SEQ ID NO: 2775215 - DNA, 22 bp, Homo sapiens
cttccctgtatgattccttgat

SEQ ID NO: 2775216 - DNA, 13 bp, Homo sapiens
cttccgatgacag

SEQ ID NO: 2775217 - DNA, 19 bp, Homo sapiens
cttcctcactatgacactg

SEQ ID NO: 2775218 - DNA, 18 bp, Homo sapiens
cttcctcagtcctggaag

SEQ ID NO: 2775219 - DNA, 13 bp, Homo sapiens
cttcctccctcat

SEQ ID NO: 2775220 - DNA, 15 bp, Homo sapiens
cttcctcctcctttg

SEQ ID NO: 2775221 - DNA, 13 bp, Homo sapiens
cttcctctgctga

SEQ ID NO: 2775222 - DNA, 11 bp, Homo sapiens
cttcctgcacc

SEQ ID NO: 2775223 - DNA, 13 bp, Homo sapiens
cttcctgcacccg

SEQ ID NO: 2775224 - DNA, 18 bp, Homo sapiens
cttcctgccaccagtcac

SEQ ID NO: 2775225 - DNA, 23 bp, Homo sapiens
cttcctggacagctgtgcctcgc

SEQ ID NO: 2775226 - DNA, 23 bp, Homo sapiens
cttcctggggcatctggcgaatc

SEQ ID NO: 2775227 - DNA, 21 bp, Homo sapiens
cttcctgtcccacctcttctc

SEQ ID NO: 2775228 - DNA, 13 bp, Homo sapiens
cttccttccccca

SEQ ID NO: 2775229 - DNA, 16 bp, Homo sapiens
cttcgactcaggatcc

SEQ ID NO: 2775230 - DNA, 14 bp, Homo sapiens
cttcgctcctgtgt

SEQ ID NO: 2775231 - DNA, 16 bp, Homo sapiens
cttcgctcctgtgtct

SEQ ID NO: 2775232 - DNA, 20 bp, Homo sapiens
cttcgctgctagagaagggg

SEQ ID NO: 2775233 - DNA, 21 bp, Homo sapiens
cttctaaaatgcttttaatta

SEQ ID NO: 2775234 - DNA, 20 bp, Homo sapiens
cttctacaaccagagccccc

SEQ ID NO: 2775235 - DNA, 19 bp, Homo sapiens
cttctagttagctgcttta

SEQ ID NO: 2775236 - DNA, 20 bp, Homo sapiens
ctctccacctcagccttgga

SEQ ID NO: 2775237 - DNA, 12 bp, Homo sapiens
ctctccactgct

SEQ ID NO: 2775238 - DNA, 14 bp, Homo sapiens
ctctccagcctgac

SEQ ID NO: 2775239 - DNA, 12 bp, Homo sapiens
ctctcccaggcc

SEQ ID NO: 2775240 - DNA, 24 bp, Homo sapiens
ctctccccagcaagtgagagctgg

SEQ ID NO: 2775241 - DNA, 18 bp, Homo sapiens
ctctcccctgccctgctg

SEQ ID NO: 2775242 - DNA, 16 bp, Homo sapiens
ctctcccgcaccaggc

SEQ ID NO: 2775243 - DNA, 13 bp, Homo sapiens
ctctccctctggc

SEQ ID NO: 2775244 - DNA, 21 bp, Homo sapiens
ctctccgaccagacaccttga

SEQ ID NO: 2775245 - DNA, 13 bp, Homo sapiens
ctctcctcagact

SEQ ID NO: 2775246 - DNA, 13 bp, Homo sapiens
ctctcctgcctac

SEQ ID NO: 2775247 - DNA, 13 bp, Homo sapiens
ctctcctggcttc

SEQ ID NO: 2775248 - DNA, 16 bp, Homo sapiens
ctctcctggcttccca

SEQ ID NO: 2775249 - DNA, 17 bp, Homo sapiens
ctctccttgcctggtga

SEQ ID NO: 2775250 - DNA, 22 bp, Homo sapiens
ctctcggaaggctggctgggca

SEQ ID NO: 2775251 - DNA, 19 bp, Homo sapiens
ctctcggggcgacccctca

SEQ ID NO: 2775252 - DNA, 21 bp, Homo sapiens
ctctcggggcgacccctcagt

SEQ ID NO: 2775253 - DNA, 16 bp, Homo sapiens
ctctcgtaactggttt

SEQ ID NO: 2775254 - DNA, 18 bp, Homo sapiens
ctctctaaaaataaaatg

SEQ ID NO: 2775255 - DNA, 22 bp, Homo sapiens
ctctctaaaaataaaatgatgt

SEQ ID NO: 2775256 - DNA, 24 bp, Homo sapiens
ctctctaaaaataaaatgatgtat

SEQ ID NO: 2775257 - DNA, 12 bp, Homo sapiens
ctctctcctgta

SEQ ID NO: 2775258 - DNA, 14 bp, Homo sapiens
ctctctcctgtcca

SEQ ID NO: 2775259 - DNA, 22 bp, Homo sapiens
ctctctctacccggcccagaga

SEQ ID NO: 2775260 - DNA, 19 bp, Homo sapiens
ctctcttatagaatattta

SEQ ID NO: 2775261 - DNA, 10 bp, Homo sapiens
ctctcttgcc

SEQ ID NO: 2775262 - DNA, 20 bp, Homo sapiens
ctctgaaacttaattacatc

SEQ ID NO: 2775263 - DNA, 22 bp, Homo sapiens
ctctgaataccaagtgtgttgg

SEQ ID NO: 2775264 - DNA, 18 bp, Homo sapiens
ctctgaatggtccagggt

SEQ ID NO: 2775265 - DNA, 14 bp, Homo sapiens
ctctgacacacagc

SEQ ID NO: 2775266 - DNA, 15 bp, Homo sapiens
ctctgacacacagct

SEQ ID NO: 2775267 - DNA, 16 bp, Homo sapiens
ctctgactcacacttg

SEQ ID NO: 2775268 - DNA, 15 bp, Homo sapiens
ctctgactcttgcct

SEQ ID NO: 2775269 - DNA, 12 bp, Homo sapiens
ctctgagaacag

SEQ ID NO: 2775270 - DNA, 14 bp, Homo sapiens
ctcttttctctgtg

SEQ ID NO: 2775271 - DNA, 20 bp, Homo sapiens
ctcttttgaatccatgcttg

SEQ ID NO: 2775272 - DNA, 21 bp, Homo sapiens
ctgaaaaatggtaattgttgc

SEQ ID NO: 2775273 - DNA, 17 bp, Homo sapiens
ctgaaaacccagagagg

SEQ ID NO: 2775274 - DNA, 21 bp, Homo sapiens
ctgaaaactggaataagaagc

SEQ ID NO: 2775275 - DNA, 16 bp, Homo sapiens
ctgaaaactgtaaata

SEQ ID NO: 2775276 - DNA, 13 bp, Homo sapiens
ctgaaaactgttt

SEQ ID NO: 2775277 - DNA, 21 bp, Homo sapiens
ctgaaagaaacagttaacttt

SEQ ID NO: 2775278 - DNA, 23 bp, Homo sapiens
ctgaaagccagctgccgaccaga

SEQ ID NO: 2775279 - DNA, 16 bp, Homo sapiens
ctgaaataaaagcctc

SEQ ID NO: 2775280 - DNA, 18 bp, Homo sapiens
ctgaaataaaagcctctg

SEQ ID NO: 2775281 - DNA, 22 bp, Homo sapiens
ctgaaatgaaacaaataatcac

SEQ ID NO: 2775282 - DNA, 13 bp, Homo sapiens
ctgaaatttcaga

SEQ ID NO: 2775283 - DNA, 12 bp, Homo sapiens
ctgaacaagaat

SEQ ID NO: 2775284 - DNA, 14 bp, Homo sapiens
ctgaacaagaattg

SEQ ID NO: 2775285 - DNA, 22 bp, Homo sapiens
ctgaacaccataggtagaatgt

SEQ ID NO: 2775286 - DNA, 22 bp, Homo sapiens
ctgaacctggggtcatcgattc

SEQ ID NO: 2775287 - DNA, 16 bp, Homo sapiens
ctgaacgtcctgcagc

SEQ ID NO: 2775288 - DNA, 12 bp, Homo sapiens
ctgaactgagcc

SEQ ID NO: 2775289 - DNA, 15 bp, Homo sapiens
ctgaactgagcctag

SEQ ID NO: 2775290 - DNA, 13 bp, Homo sapiens
ctgaagaacagta

SEQ ID NO: 2775291 - DNA, 12 bp, Homo sapiens
ctgaagatctca

SEQ ID NO: 2775292 - DNA, 21 bp, Homo sapiens
ctgaagatttcagaggctgca

SEQ ID NO: 2775293 - DNA, 15 bp, Homo sapiens
ctgaagcccatgctt

SEQ ID NO: 2775294 - DNA, 19 bp, Homo sapiens
ctgaagctattgatgtttc

SEQ ID NO: 2775295 - DNA, 19 bp, Homo sapiens
ctgaaggacattgcggaca

SEQ ID NO: 2775296 - DNA, 21 bp, Homo sapiens
ctgaaggacattgcggacagc

SEQ ID NO: 2775297 - DNA, 12 bp, Homo sapiens
ctgaaggagaag

SEQ ID NO: 2775298 - DNA, 16 bp, Homo sapiens
ctgaagggggcggcct

SEQ ID NO: 2775299 - DNA, 20 bp, Homo sapiens
ctgaagggggcggcctatga

SEQ ID NO: 2775300 - DNA, 17 bp, Homo sapiens
ctgaagtcacacagtga

SEQ ID NO: 2775301 - DNA, 13 bp, Homo sapiens
ctgaataatttct

SEQ ID NO: 2775302 - DNA, 17 bp, Homo sapiens
ctgaatataggaagcat

SEQ ID NO: 2775303 - DNA, 18 bp, Homo sapiens
ctgaatggtccagggttg

SEQ ID NO: 2775304 - DNA, 11 bp, Homo sapiens
ctgaatgtatt

SEQ ID NO: 2775305 - DNA, 12 bp, Homo sapiens
ctgaattatttt

SEQ ID NO: 2775306 - DNA, 14 bp, Homo sapiens
ctgaattattttgt

SEQ ID NO: 2775307 - DNA, 15 bp, Homo sapiens
ctgaattgtccccag

SEQ ID NO: 2775308 - DNA, 18 bp, Homo sapiens
ctgaatttttaaacaagt

SEQ ID NO: 2775309 - DNA, 19 bp, Homo sapiens
ctgacacacagctctgtcc

SEQ ID NO: 2775310 - DNA, 20 bp, Homo sapiens
ctgacacacagctctgtcct

SEQ ID NO: 2775311 - DNA, 22 bp, Homo sapiens
ctgacacacagctctgtcctgg

SEQ ID NO: 2775312 - DNA, 19 bp, Homo sapiens
ctgacacataatttgaatg

SEQ ID NO: 2775313 - DNA, 18 bp, Homo sapiens
ctgacactaccttatcag

SEQ ID NO: 2775314 - DNA, 12 bp, Homo sapiens
ctgacagacaca

SEQ ID NO: 2775315 - DNA, 21 bp, Homo sapiens
ctgacagacacaggcccggct

SEQ ID NO: 2775316 - DNA, 11 bp, Homo sapiens
ctgacaggcaa

SEQ ID NO: 2775317 - DNA, 18 bp, Homo sapiens
ctgacaggcaatgctggc

SEQ ID NO: 2775318 - DNA, 20 bp, Homo sapiens
ctgacaggcaatgctggctg

SEQ ID NO: 2775319 - DNA, 21 bp, Homo sapiens
ctgacaggcaatgctggctgt

SEQ ID NO: 2775320 - DNA, 21 bp, Homo sapiens
ctgacattgttggccaaagcc

SEQ ID NO: 2775321 - DNA, 17 bp, Homo sapiens
ctgaccaagagagaaag

SEQ ID NO: 2775322 - DNA, 22 bp, Homo sapiens
ctgaccacggacgtttccatca

SEQ ID NO: 2775323 - DNA, 23 bp, Homo sapiens
ctgaccacggacgtttccatcag

SEQ ID NO: 2775324 - DNA, 17 bp, Homo sapiens
ctgaccagcctccatgc

SEQ ID NO: 2775325 - DNA, 18 bp, Homo sapiens
ctgaccatttcaggggtc

SEQ ID NO: 2775326 - DNA, 12 bp, Homo sapiens
ctgacccagtcc

SEQ ID NO: 2775327 - DNA, 13 bp, Homo sapiens
ctgacccagtccc

SEQ ID NO: 2775328 - DNA, 16 bp, Homo sapiens
ctgaccccatcaccta

SEQ ID NO: 2775329 - DNA, 14 bp, Homo sapiens
ctgacccctgcacc

SEQ ID NO: 2775330 - DNA, 17 bp, Homo sapiens
ctgaccctccgctgcag

SEQ ID NO: 2775331 - DNA, 14 bp, Homo sapiens
ctgaccctggagcg

SEQ ID NO: 2775332 - DNA, 13 bp, Homo sapiens
ctgacctcccagc

SEQ ID NO: 2775333 - DNA, 21 bp, Homo sapiens
ctatcttatatagtttactat

SEQ ID NO: 2775334 - DNA, 16 bp, Homo sapiens
ctatgacactgagcaa

SEQ ID NO: 2775335 - DNA, 14 bp, Homo sapiens
ctatgatctcagga

SEQ ID NO: 2775336 - DNA, 15 bp, Homo sapiens
ctatgatctcaggag

SEQ ID NO: 2775337 - DNA, 15 bp, Homo sapiens
ctatgcaatttttaa

SEQ ID NO: 2775338 - DNA, 17 bp, Homo sapiens
ctatgcaatttttaaac

SEQ ID NO: 2775339 - DNA, 19 bp, Homo sapiens
ctatgcaatttttaaacta

SEQ ID NO: 2775340 - DNA, 20 bp, Homo sapiens
ctatgcaatttttaaactag

SEQ ID NO: 2775341 - DNA, 22 bp, Homo sapiens
ctatgcaatttttaaactagta

SEQ ID NO: 2775342 - DNA, 20 bp, Homo sapiens
ctatgccagctcagtcccat

SEQ ID NO: 2775343 - DNA, 16 bp, Homo sapiens
ctatggagagccctgg

SEQ ID NO: 2775344 - DNA, 18 bp, Homo sapiens
ctatggatgtggggtccc

SEQ ID NO: 2775345 - DNA, 14 bp, Homo sapiens
ctatggcagtccag

SEQ ID NO: 2775346 - DNA, 17 bp, Homo sapiens
ctatggcagtccagcca

SEQ ID NO: 2775347 - DNA, 18 bp, Homo sapiens
ctatggcagtccagccag

SEQ ID NO: 2775348 - DNA, 21 bp, Homo sapiens
ctatggcagtccagccagctc

SEQ ID NO: 2775349 - DNA, 17 bp, Homo sapiens
ctatggctgcctgcatc

SEQ ID NO: 2775350 - DNA, 15 bp, Homo sapiens
ctatggtcagttgag

SEQ ID NO: 2775351 - DNA, 14 bp, Homo sapiens
ctatgtatggaata

SEQ ID NO: 2775352 - DNA, 18 bp, Homo sapiens
ctatgtcatttcatttcc

SEQ ID NO: 2775353 - DNA, 13 bp, Homo sapiens
ctatgtcccttgc

SEQ ID NO: 2775354 - DNA, 14 bp, Homo sapiens
ctatgtcctaagga

SEQ ID NO: 2775355 - DNA, 15 bp, Homo sapiens
ctatgtcctaaggac

SEQ ID NO: 2775356 - DNA, 21 bp, Homo sapiens
ctatgtgggacacctcaaata

SEQ ID NO: 2775357 - DNA, 16 bp, Homo sapiens
ctatgttgcccaggca

SEQ ID NO: 2775358 - DNA, 17 bp, Homo sapiens
ctatgttgcccaggcag

SEQ ID NO: 2775359 - DNA, 14 bp, Homo sapiens
ctatgtttttaatg

SEQ ID NO: 2775360 - DNA, 17 bp, Homo sapiens
ctattaccatgagaaga

SEQ ID NO: 2775361 - DNA, 16 bp, Homo sapiens
ctattataaaaccatg

SEQ ID NO: 2775362 - DNA, 15 bp, Homo sapiens
ctattataatttaat

SEQ ID NO: 2775363 - DNA, 16 bp, Homo sapiens
ctattataatttaatg

SEQ ID NO: 2775364 - DNA, 21 bp, Homo sapiens
ctattataatttaatgcatgt

SEQ ID NO: 2775365 - DNA, 22 bp, Homo sapiens
ctattattttcactgtagaatg

SEQ ID NO: 2775366 - DNA, 15 bp, Homo sapiens
ctattcagacaagca

SEQ ID NO: 2775367 - DNA, 17 bp, Homo sapiens
ctattctgttaaaatca

SEQ ID NO: 2775368 - DNA, 19 bp, Homo sapiens
ctattgaacctaggacttg

SEQ ID NO: 2775369 - DNA, 18 bp, Homo sapiens
ctattgcagttatagaaa

SEQ ID NO: 2775370 - DNA, 14 bp, Homo sapiens
ctattgcatgtaaa

SEQ ID NO: 2775371 - DNA, 17 bp, Homo sapiens
ctattgcatgtaaaatg

SEQ ID NO: 2775372 - DNA, 19 bp, Homo sapiens
ctattgcatgtaaaatgca

SEQ ID NO: 2775373 - DNA, 16 bp, Homo sapiens
ctatttaaaaaataaa

SEQ ID NO: 2775374 - DNA, 19 bp, Homo sapiens
ctatttaaaaaataaaaaa

SEQ ID NO: 2775375 - DNA, 11 bp, Homo sapiens
ctatttatgaa

SEQ ID NO: 2775376 - DNA, 15 bp, Homo sapiens
ctatttatttactga

SEQ ID NO: 2775377 - DNA, 23 bp, Homo sapiens
ctatttgttttcttctgtatgtt

SEQ ID NO: 2775378 - DNA, 19 bp, Homo sapiens
ctattttaaaaccatgcag

SEQ ID NO: 2775379 - DNA, 19 bp, Homo sapiens
ctattttgtaaactcaaaa

SEQ ID NO: 2775380 - DNA, 17 bp, Homo sapiens
ctattttttaaaaaaat

SEQ ID NO: 2775381 - DNA, 17 bp, Homo sapiens
ctcaaaaaaagccttta

SEQ ID NO: 2775382 - DNA, 21 bp, Homo sapiens
ctcaaataaaaagtgcttttg

SEQ ID NO: 2775383 - DNA, 22 bp, Homo sapiens
ctcaaatacatacctactgact

SEQ ID NO: 2775384 - DNA, 16 bp, Homo sapiens
ctcaaatctattcaga

SEQ ID NO: 2775385 - DNA, 16 bp, Homo sapiens
ctcaaattaatctttc

SEQ ID NO: 2775386 - DNA, 22 bp, Homo sapiens
ctcaacctaccaccccttcctg

SEQ ID NO: 2775387 - DNA, 23 bp, Homo sapiens
ctcaacctaccaccccttcctgt

SEQ ID NO: 2775388 - DNA, 21 bp, Homo sapiens
ctcaccctcataccatctgct

SEQ ID NO: 2775389 - DNA, 12 bp, Homo sapiens
ctcacctctgcc

SEQ ID NO: 2775390 - DNA, 14 bp, Homo sapiens
ctcacctctgcctc

SEQ ID NO: 2775391 - DNA, 19 bp, Homo sapiens
ctcacctgagtcaccctac

SEQ ID NO: 2775392 - DNA, 22 bp, Homo sapiens
ctcaccttgtgctggggacagg

SEQ ID NO: 2775393 - DNA, 23 bp, Homo sapiens
ctcacctttgcaaagttacagat

SEQ ID NO: 2775394 - DNA, 17 bp, Homo sapiens
ctcacgcccagcctcct

SEQ ID NO: 2775395 - DNA, 19 bp, Homo sapiens
ctcacgcctgtaatcccag

SEQ ID NO: 2775396 - DNA, 23 bp, Homo sapiens
ctcacgcctgtaatcccagcact

SEQ ID NO: 2775397 - DNA, 22 bp, Homo sapiens
ctcacgcctgtaatcccagcag

SEQ ID NO: 2775398 - DNA, 18 bp, Homo sapiens
ctcactatgttgcccagg

SEQ ID NO: 2775399 - DNA, 20 bp, Homo sapiens
ctcactatgttgcccaggca

SEQ ID NO: 2775400 - DNA, 21 bp, Homo sapiens
ctcactatgttgcccaggcag

SEQ ID NO: 2775401 - DNA, 22 bp, Homo sapiens
ctcactatgttgcccaggcagg

SEQ ID NO: 2775402 - DNA, 20 bp, Homo sapiens
ctcactccaccacccaaaag

SEQ ID NO: 2775403 - DNA, 11 bp, Homo sapiens
ctcactcctgt

SEQ ID NO: 2775404 - DNA, 12 bp, Homo sapiens
ctcactcctgtt

SEQ ID NO: 2775405 - DNA, 11 bp, Homo sapiens
ctcactctgtc

SEQ ID NO: 2775406 - DNA, 12 bp, Homo sapiens
ctcactctgtcg

SEQ ID NO: 2775407 - DNA, 13 bp, Homo sapiens
ctcactctgtcgc

SEQ ID NO: 2775408 - DNA, 22 bp, Homo sapiens
ctcactctgtcgcccagtctgg

SEQ ID NO: 2775409 - DNA, 18 bp, Homo sapiens
ctcactcttatgaaatgg

SEQ ID NO: 2775410 - DNA, 16 bp, Homo sapiens
ctcactgaggaaggga

SEQ ID NO: 2775411 - DNA, 15 bp, Homo sapiens
ctcactgatatattt

SEQ ID NO: 2775412 - DNA, 14 bp, Homo sapiens
ctcactgcagcctc

SEQ ID NO: 2775413 - DNA, 12 bp, Homo sapiens
ctcactgcccca

SEQ ID NO: 2775414 - DNA, 15 bp, Homo sapiens
ctcactgccccacca

SEQ ID NO: 2775415 - DNA, 19 bp, Homo sapiens
ctcactgccccaccagcca

SEQ ID NO: 2775416 - DNA, 13 bp, Homo sapiens
ctcactgccttcc

SEQ ID NO: 2775417 - DNA, 14 bp, Homo sapiens
ctcactgccttcca

SEQ ID NO: 2775418 - DNA, 15 bp, Homo sapiens
ctcactgccttccag

SEQ ID NO: 2775419 - DNA, 12 bp, Homo sapiens
ctcactgctcaa

SEQ ID NO: 2775420 - DNA, 14 bp, Homo sapiens
ctcactgctcaaga

SEQ ID NO: 2775421 - DNA, 20 bp, Homo sapiens
ctcactgctcaagaagacat

SEQ ID NO: 2775422 - DNA, 21 bp, Homo sapiens
ctcactgctcaagaagacatg

SEQ ID NO: 2775423 - DNA, 18 bp, Homo sapiens
ctcactgctggggagtcc

SEQ ID NO: 2775424 - DNA, 19 bp, Homo sapiens
ctcactgctggggagtccc

SEQ ID NO: 2775425 - DNA, 20 bp, Homo sapiens
ctcactgctggggagtccct

SEQ ID NO: 2775426 - DNA, 17 bp, Homo sapiens
ctcagaagacactgatg

SEQ ID NO: 2775427 - DNA, 20 bp, Homo sapiens
ctcagaagacactgatgggc

SEQ ID NO: 2775428 - DNA, 11 bp, Homo sapiens
ctcagaagcct

SEQ ID NO: 2775429 - DNA, 13 bp, Homo sapiens
ctcagaagcctgg

SEQ ID NO: 2775430 - DNA, 16 bp, Homo sapiens
ctcagaagcctggggg

SEQ ID NO: 2775431 - DNA, 21 bp, Homo sapiens
ctcagaagcctgggggcctgg

SEQ ID NO: 2775432 - DNA, 16 bp, Homo sapiens
ctcagaagtttcttct

SEQ ID NO: 2775433 - DNA, 19 bp, Homo sapiens
ctcagaagtttcttcttta

SEQ ID NO: 2775434 - DNA, 14 bp, Homo sapiens
ctcagaatccaaag

SEQ ID NO: 2775435 - DNA, 15 bp, Homo sapiens
ctcagaatccaaaga

SEQ ID NO: 2775436 - DNA, 22 bp, Homo sapiens
ctcagacccccactctcattcc

SEQ ID NO: 2775437 - DNA, 14 bp, Homo sapiens
ctcagactccattt

SEQ ID NO: 2775438 - DNA, 14 bp, Homo sapiens
ctcagactgctcaa

SEQ ID NO: 2775439 - DNA, 16 bp, Homo sapiens
ctcagagacaggtggc

SEQ ID NO: 2775440 - DNA, 12 bp, Homo sapiens
ctcagaggccca

SEQ ID NO: 2775441 - DNA, 14 bp, Homo sapiens
ctcagaggcccagg

SEQ ID NO: 2775442 - DNA, 18 bp, Homo sapiens
cgtgaactgcgtgccagt

SEQ ID NO: 2775443 - DNA, 13 bp, Homo sapiens
cgtgactcaccca

SEQ ID NO: 2775444 - DNA, 18 bp, Homo sapiens
cgtgactcacccaagcat

SEQ ID NO: 2775445 - DNA, 13 bp, Homo sapiens
cgtgactgcccca

SEQ ID NO: 2775446 - DNA, 16 bp, Homo sapiens
cgtgactgccccaact

SEQ ID NO: 2775447 - DNA, 20 bp, Homo sapiens
cgtgagccactgcaccgggc

SEQ ID NO: 2775448 - DNA, 12 bp, Homo sapiens
cgtgagccaggt

SEQ ID NO: 2775449 - DNA, 16 bp, Homo sapiens
cgtgcacacaccagag

SEQ ID NO: 2775450 - DNA, 18 bp, Homo sapiens
cgtgcacacaccagagcc

SEQ ID NO: 2775451 - DNA, 20 bp, Homo sapiens
cgtgccaagtccaggtcctg

SEQ ID NO: 2775452 - DNA, 13 bp, Homo sapiens
cgtgccaggcccg

SEQ ID NO: 2775453 - DNA, 20 bp, Homo sapiens
cgtgccctgacccctgcacc

SEQ ID NO: 2775454 - DNA, 19 bp, Homo sapiens
cgtgctcttctgttctcaa

SEQ ID NO: 2775455 - DNA, 17 bp, Homo sapiens
cgtggacacctgccctg

SEQ ID NO: 2775456 - DNA, 18 bp, Homo sapiens
cgtggacacctgccctgc

SEQ ID NO: 2775457 - DNA, 19 bp, Homo sapiens
cgtggacacctgccctgcc

SEQ ID NO: 2775458 - DNA, 17 bp, Homo sapiens
cgtggaccttcctgcca

SEQ ID NO: 2775459 - DNA, 16 bp, Homo sapiens
cgtggactctgcacat

SEQ ID NO: 2775460 - DNA, 13 bp, Homo sapiens
cgtggaggctgct

SEQ ID NO: 2775461 - DNA, 14 bp, Homo sapiens
cgtggaggctgctc

SEQ ID NO: 2775462 - DNA, 21 bp, Homo sapiens
cgtggcagataatcagcctct

SEQ ID NO: 2775463 - DNA, 14 bp, Homo sapiens
cgtggcccttcctg

SEQ ID NO: 2775464 - DNA, 22 bp, Homo sapiens
cgtggcccttcctggacagctg

SEQ ID NO: 2775465 - DNA, 13 bp, Homo sapiens
cgtgggtggagga

SEQ ID NO: 2775466 - DNA, 23 bp, Homo sapiens
cgtgggtgtgtgtagccaaggtc

SEQ ID NO: 2775467 - DNA, 18 bp, Homo sapiens
cgtggtctttgaataaag

SEQ ID NO: 2775468 - DNA, 23 bp, Homo sapiens
cgtggtctttgaataaagtctga

SEQ ID NO: 2775469 - DNA, 17 bp, Homo sapiens
cgtgtcctacagcctca

SEQ ID NO: 2775470 - DNA, 14 bp, Homo sapiens
cgtgtgcagactgt

SEQ ID NO: 2775471 - DNA, 22 bp, Homo sapiens
cgttatgtgtgtatatgtatgt

SEQ ID NO: 2775472 - DNA, 13 bp, Homo sapiens
cgttcaccttctt

SEQ ID NO: 2775473 - DNA, 13 bp, Homo sapiens
cgtttattgctta

SEQ ID NO: 2775474 - DNA, 11 bp, Homo sapiens
cgtttccatca

SEQ ID NO: 2775475 - DNA, 16 bp, Homo sapiens
cgtttgtgagaagaaa

SEQ ID NO: 2775476 - DNA, 16 bp, Homo sapiens
cgtttttcaagaaaac

SEQ ID NO: 2775477 - DNA, 11 bp, Homo sapiens
ctaaaaaacag

SEQ ID NO: 2775478 - DNA, 17 bp, Homo sapiens
ctaaaaaacagaggcca

SEQ ID NO: 2775479 - DNA, 22 bp, Homo sapiens
ctaaaaaacataaatttcttta

SEQ ID NO: 2775480 - DNA, 16 bp, Homo sapiens
ctaaaaataaaatgat

SEQ ID NO: 2775481 - DNA, 22 bp, Homo sapiens
ctaaaaatattataacttaaaa

SEQ ID NO: 2775482 - DNA, 13 bp, Homo sapiens
ctaaaactatggt

SEQ ID NO: 2775483 - DNA, 22 bp, Homo sapiens
ctaaaactatggttcccaataa

SEQ ID NO: 2775484 - DNA, 16 bp, Homo sapiens
ctaaaagaatttaaat

SEQ ID NO: 2775485 - DNA, 16 bp, Homo sapiens
ctaaaataaaaaccag

SEQ ID NO: 2775486 - DNA, 17 bp, Homo sapiens
ctaaaataaaaaccaga

SEQ ID NO: 2775487 - DNA, 19 bp, Homo sapiens
ctaaaatagccacttacct

SEQ ID NO: 2775488 - DNA, 13 bp, Homo sapiens
ctaaacatcattc

SEQ ID NO: 2775489 - DNA, 11 bp, Homo sapiens
ctaaagcagtg

SEQ ID NO: 2775490 - DNA, 18 bp, Homo sapiens
ctaaagctggtttaatgt

SEQ ID NO: 2775491 - DNA, 16 bp, Homo sapiens
ctaaagtcacatataa

SEQ ID NO: 2775492 - DNA, 18 bp, Homo sapiens
ctaaatcttccttgtgag

SEQ ID NO: 2775493 - DNA, 20 bp, Homo sapiens
ctaaatcttttataggattt

SEQ ID NO: 2775494 - DNA, 22 bp, Homo sapiens
ctaaatgaaaatcgtgacaaca

SEQ ID NO: 2775495 - DNA, 21 bp, Homo sapiens
ctaaatgcaaacactgtgtat

SEQ ID NO: 2775496 - DNA, 17 bp, Homo sapiens
ctaaatgcctaataaac

SEQ ID NO: 2775497 - DNA, 19 bp, Homo sapiens
ctaaatgcctaataaacaa

SEQ ID NO: 2775498 - DNA, 21 bp, Homo sapiens
ctaaatgttggaattttcaaa

SEQ ID NO: 2775499 - DNA, 16 bp, Homo sapiens
ctaacactcagaagcc

SEQ ID NO: 2775500 - DNA, 19 bp, Homo sapiens
ctaacactcagaagcctgg

SEQ ID NO: 2775501 - DNA, 20 bp, Homo sapiens
ctaacactcagaagcctggg

SEQ ID NO: 2775502 - DNA, 14 bp, Homo sapiens
ctaacagggaaggc

SEQ ID NO: 2775503 - DNA, 17 bp, Homo sapiens
ctaacagggaaggcagg

SEQ ID NO: 2775504 - DNA, 18 bp, Homo sapiens
ctaacagggaaggcaggc

SEQ ID NO: 2775505 - DNA, 12 bp, Homo sapiens
ctaacatataat

SEQ ID NO: 2775506 - DNA, 17 bp, Homo sapiens
ctaaccacgctggacct

SEQ ID NO: 2775507 - DNA, 22 bp, Homo sapiens
ctaacccccagtgccacagaga

SEQ ID NO: 2775508 - DNA, 23 bp, Homo sapiens
ctaacccccagtgccacagagaa

SEQ ID NO: 2775509 - DNA, 16 bp, Homo sapiens
ctaacccctttcctgc

SEQ ID NO: 2775510 - DNA, 15 bp, Homo sapiens
ctaacgcctgagccc

SEQ ID NO: 2775511 - DNA, 19 bp, Homo sapiens
ctaacgcctgagcccaggg

SEQ ID NO: 2775512 - DNA, 21 bp, Homo sapiens
ctaacgcctgagcccagggag

SEQ ID NO: 2775513 - DNA, 15 bp, Homo sapiens
ctaacgtaaatacac

SEQ ID NO: 2775514 - DNA, 20 bp, Homo sapiens
ctaactgctacaaatactct

SEQ ID NO: 2775515 - DNA, 22 bp, Homo sapiens
ctaagaagctctggccccaggc

SEQ ID NO: 2775516 - DNA, 20 bp, Homo sapiens
ctaagacttcagtcctggtc

SEQ ID NO: 2775517 - DNA, 18 bp, Homo sapiens
ctaagagctagcgctgcc

SEQ ID NO: 2775518 - DNA, 19 bp, Homo sapiens
ctaagagctagcgctgccg

SEQ ID NO: 2775519 - DNA, 24 bp, Homo sapiens
ctaagaggcgacttcctctccagc

SEQ ID NO: 2775520 - DNA, 12 bp, Homo sapiens
ctaagattgtac

SEQ ID NO: 2775521 - DNA, 15 bp, Homo sapiens
ctaagattgtacata

SEQ ID NO: 2775522 - DNA, 17 bp, Homo sapiens
ctaagcctttccataag

SEQ ID NO: 2775523 - DNA, 14 bp, Homo sapiens
ctaagctaggaatg

SEQ ID NO: 2775524 - DNA, 17 bp, Homo sapiens
ctaagctgcagcttcct

SEQ ID NO: 2775525 - DNA, 13 bp, Homo sapiens
ctaaggacacact

SEQ ID NO: 2775526 - DNA, 16 bp, Homo sapiens
ctaaggacacactaat

SEQ ID NO: 2775527 - DNA, 18 bp, Homo sapiens
ctaaggatctctcaggag

SEQ ID NO: 2775528 - DNA, 22 bp, Homo sapiens
ctaagtagaataaagaaaaacg

SEQ ID NO: 2775529 - DNA, 19 bp, Homo sapiens
ctaagtaggggcagtgatg

SEQ ID NO: 2775530 - DNA, 23 bp, Homo sapiens
ctaagtgatcctcccacctcagc

SEQ ID NO: 2775531 - DNA, 18 bp, Homo sapiens
ctaagtgttgaagaagag

SEQ ID NO: 2775532 - DNA, 16 bp, Homo sapiens
ctaatacctctgtgtg

SEQ ID NO: 2775533 - DNA, 17 bp, Homo sapiens
ctaatacctctgtgtgc

SEQ ID NO: 2775534 - DNA, 20 bp, Homo sapiens
ctaatagaactcagttttaa

SEQ ID NO: 2775535 - DNA, 19 bp, Homo sapiens
ctaatcaagagtgagtgaa

SEQ ID NO: 2775536 - DNA, 19 bp, Homo sapiens
ctaatcagggaggtcattt

SEQ ID NO: 2775537 - DNA, 20 bp, Homo sapiens
ctaatcagggaggtcatttt

SEQ ID NO: 2775538 - DNA, 17 bp, Homo sapiens
ctaatcaggttgttaat

SEQ ID NO: 2775539 - DNA, 13 bp, Homo sapiens
ctaatccaaccca

SEQ ID NO: 2775540 - DNA, 15 bp, Homo sapiens
ctaatcgaactatga

SEQ ID NO: 2775541 - DNA, 13 bp, Homo sapiens
ctaatctgtaggg

SEQ ID NO: 2775542 - DNA, 14 bp, Homo sapiens
ctaatctgtagggc

SEQ ID NO: 2775543 - DNA, 18 bp, Homo sapiens
ctaatgaagggaaaggat

SEQ ID NO: 2775544 - DNA, 12 bp, Homo sapiens
ctaatgggacac

SEQ ID NO: 2775545 - DNA, 16 bp, Homo sapiens
ctaattaaaaagttaa

SEQ ID NO: 2775546 - DNA, 15 bp, Homo sapiens
ctaattcaattcaaa

SEQ ID NO: 2775547 - DNA, 19 bp, Homo sapiens
ctaattcccattttgcaaa

SEQ ID NO: 2775548 - DNA, 21 bp, Homo sapiens
ctaattcccattttgcaaaat

SEQ ID NO: 2775549 - DNA, 21 bp, Homo sapiens
ctaattggaagaaattcctgt

SEQ ID NO: 2775550 - DNA, 12 bp, Homo sapiens
ctaatttaaacc

SEQ ID NO: 2775551 - DNA, 15 bp, Homo sapiens
ctaatttaaaccagc

SEQ ID NO: 2775552 - DNA, 20 bp, Homo sapiens
ctaatttaaaccagcagaaa

SEQ ID NO: 2775553 - DNA, 12 bp, Homo sapiens
ctaatttataca

SEQ ID NO: 2775554 - DNA, 14 bp, Homo sapiens
ctaatttatacaaa

SEQ ID NO: 2775555 - DNA, 20 bp, Homo sapiens
ctaatttatacaaaataatt

SEQ ID NO: 2775556 - DNA, 23 bp, Homo sapiens
ctaatttatacaaaataatttaa

SEQ ID NO: 2775557 - DNA, 21 bp, Homo sapiens
ctaatttatcttgtctctggg

SEQ ID NO: 2775558 - DNA, 14 bp, Homo sapiens
ctaattttttgttg

SEQ ID NO: 2775559 - DNA, 14 bp, Homo sapiens
ctacacagcctgga

SEQ ID NO: 2775560 - DNA, 14 bp, Homo sapiens
ctacacatatatgt

SEQ ID NO: 2775561 - DNA, 22 bp, Homo sapiens
ctacaccactctggcagccaca

SEQ ID NO: 2775562 - DNA, 16 bp, Homo sapiens
ctacactccagcctga

SEQ ID NO: 2775563 - DNA, 14 bp, Homo sapiens
ctacagatagtcaa

SEQ ID NO: 2775564 - DNA, 15 bp, Homo sapiens
ctacagatagtcaaa

SEQ ID NO: 2775565 - DNA, 21 bp, Homo sapiens
ctacaggagagggaagagtgc

SEQ ID NO: 2775566 - DNA, 16 bp, Homo sapiens
ctacaggagtgagcac

SEQ ID NO: 2775567 - DNA, 14 bp, Homo sapiens
ctacaggtgtgagt

SEQ ID NO: 2775568 - DNA, 16 bp, Homo sapiens
ctacatccccaggtct

SEQ ID NO: 2775569 - DNA, 18 bp, Homo sapiens
ctacatgaaacagaaaca

SEQ ID NO: 2775570 - DNA, 21 bp, Homo sapiens
ctacatggtattgtaatgaat

SEQ ID NO: 2775571 - DNA, 22 bp, Homo sapiens
ctacattataaatgtctcttta

SEQ ID NO: 2775572 - DNA, 15 bp, Homo sapiens
ctacattccctggcc

SEQ ID NO: 2775573 - DNA, 14 bp, Homo sapiens
ctaccaaagcacct

SEQ ID NO: 2775574 - DNA, 15 bp, Homo sapiens
ctaccaaagcacctt

SEQ ID NO: 2775575 - DNA, 11 bp, Homo sapiens
ctaccagaggg

SEQ ID NO: 2775576 - DNA, 14 bp, Homo sapiens
ctacccaaccactc

SEQ ID NO: 2775577 - DNA, 15 bp, Homo sapiens
ctacccaaccactca

SEQ ID NO: 2775578 - DNA, 14 bp, Homo sapiens
ctacccacttctaa

SEQ ID NO: 2775579 - DNA, 13 bp, Homo sapiens
ctacccagagcct

SEQ ID NO: 2775580 - DNA, 22 bp, Homo sapiens
ctacccagagccttctcctgcc

SEQ ID NO: 2775581 - DNA, 15 bp, Homo sapiens
ctacccggcccagag

SEQ ID NO: 2775582 - DNA, 17 bp, Homo sapiens
ctacctcactggggtcc

SEQ ID NO: 2775583 - DNA, 14 bp, Homo sapiens
ctacctcagcctag

SEQ ID NO: 2775584 - DNA, 16 bp, Homo sapiens
ctacctggtctctcct

SEQ ID NO: 2775585 - DNA, 15 bp, Homo sapiens
ctaccttctctaccc

SEQ ID NO: 2775586 - DNA, 21 bp, Homo sapiens
ctacgctctcctttctttcta

SEQ ID NO: 2775587 - DNA, 19 bp, Homo sapiens
ctacgtataaatatgaaat

SEQ ID NO: 2775588 - DNA, 13 bp, Homo sapiens
ctactcacacagg

SEQ ID NO: 2775589 - DNA, 14 bp, Homo sapiens
ctactcacacaggc

SEQ ID NO: 2775590 - DNA, 22 bp, Homo sapiens
ctactcacacaggcatttcctg

SEQ ID NO: 2775591 - DNA, 17 bp, Homo sapiens
ctactcagaagcctgag

SEQ ID NO: 2775592 - DNA, 19 bp, Homo sapiens
ctactcagcagccctcctc

SEQ ID NO: 2775593 - DNA, 20 bp, Homo sapiens
ctactcagcagccctcctca

SEQ ID NO: 2775594 - DNA, 22 bp, Homo sapiens
ctactcagcagccctcctcacc

SEQ ID NO: 2775595 - DNA, 15 bp, Homo sapiens
ctactcaggaggctg

SEQ ID NO: 2775596 - DNA, 23 bp, Homo sapiens
ccttgctcaccaagctgttccac

SEQ ID NO: 2775597 - DNA, 18 bp, Homo sapiens
ccttgctcgctgtaaaat

SEQ ID NO: 2775598 - DNA, 18 bp, Homo sapiens
ccttggactcctcccaca

SEQ ID NO: 2775599 - DNA, 22 bp, Homo sapiens
ccttggagcagaaagccagggt

SEQ ID NO: 2775600 - DNA, 12 bp, Homo sapiens
ccttggaggaca

SEQ ID NO: 2775601 - DNA, 17 bp, Homo sapiens
ccttggaggacagtggg

SEQ ID NO: 2775602 - DNA, 18 bp, Homo sapiens
ccttggaggacagtggga

SEQ ID NO: 2775603 - DNA, 12 bp, Homo sapiens
ccttggaggcca

SEQ ID NO: 2775604 - DNA, 20 bp, Homo sapiens
ccttggcgggcagcccagcc

SEQ ID NO: 2775605 - DNA, 22 bp, Homo sapiens
ccttggctcaagtcctcttttc

SEQ ID NO: 2775606 - DNA, 13 bp, Homo sapiens
ccttggctgcagg

SEQ ID NO: 2775607 - DNA, 23 bp, Homo sapiens
ccttgggcctccccccagcccct

SEQ ID NO: 2775608 - DNA, 19 bp, Homo sapiens
ccttgtaattctaaatgaa

SEQ ID NO: 2775609 - DNA, 13 bp, Homo sapiens
ccttgtatttaaa

SEQ ID NO: 2775610 - DNA, 14 bp, Homo sapiens
ccttgtatttaaat

SEQ ID NO: 2775611 - DNA, 21 bp, Homo sapiens
ccttgttctgataatgaaaat

SEQ ID NO: 2775612 - DNA, 22 bp, Homo sapiens
ccttgtttgattttagctgcag

SEQ ID NO: 2775613 - DNA, 16 bp, Homo sapiens
ccttgtttggggcagg

SEQ ID NO: 2775614 - DNA, 17 bp, Homo sapiens
ccttgtttggggcagga

SEQ ID NO: 2775615 - DNA, 15 bp, Homo sapiens
cctttacttgacctc

SEQ ID NO: 2775616 - DNA, 14 bp, Homo sapiens
cctttagcgcccag

SEQ ID NO: 2775617 - DNA, 22 bp, Homo sapiens
cctttcacaaaattttattcct

SEQ ID NO: 2775618 - DNA, 12 bp, Homo sapiens
cctttcagggaa

SEQ ID NO: 2775619 - DNA, 15 bp, Homo sapiens
cctttccacctgctt

SEQ ID NO: 2775620 - DNA, 14 bp, Homo sapiens
cctttcccatgctg

SEQ ID NO: 2775621 - DNA, 16 bp, Homo sapiens
cctttcccatgctgaa

SEQ ID NO: 2775622 - DNA, 20 bp, Homo sapiens
cctttcccatgctgaattat

SEQ ID NO: 2775623 - DNA, 15 bp, Homo sapiens
cctttccccagtgtg

SEQ ID NO: 2775624 - DNA, 19 bp, Homo sapiens
cctttcctctgcagcactt

SEQ ID NO: 2775625 - DNA, 21 bp, Homo sapiens
cctttcctctgcagcacttta

SEQ ID NO: 2775626 - DNA, 13 bp, Homo sapiens
cctttccttcctt

SEQ ID NO: 2775627 - DNA, 21 bp, Homo sapiens
cctttccttccttccctggct

SEQ ID NO: 2775628 - DNA, 13 bp, Homo sapiens
cctttctccagcc

SEQ ID NO: 2775629 - DNA, 11 bp, Homo sapiens
cctttctctga

SEQ ID NO: 2775630 - DNA, 14 bp, Homo sapiens
cctttctggctctc

SEQ ID NO: 2775631 - DNA, 17 bp, Homo sapiens
cctttgagaaagaaata

SEQ ID NO: 2775632 - DNA, 13 bp, Homo sapiens
cctttgcactgag

SEQ ID NO: 2775633 - DNA, 18 bp, Homo sapiens
cctttgcactgagggcca

SEQ ID NO: 2775634 - DNA, 19 bp, Homo sapiens
cctttgccccaaggctgct

SEQ ID NO: 2775635 - DNA, 22 bp, Homo sapiens
cctttgggtactactgctgcaa

SEQ ID NO: 2775636 - DNA, 18 bp, Homo sapiens
ccttttgcataagattaa

SEQ ID NO: 2775637 - DNA, 18 bp, Homo sapiens
ccttttgcttgaaaccaa

SEQ ID NO: 2775638 - DNA, 19 bp, Homo sapiens
ccttttgtaccatggtgtg

SEQ ID NO: 2775639 - DNA, 22 bp, Homo sapiens
ccttttttaggaagcaagctta

SEQ ID NO: 2775640 - DNA, 20 bp, Homo sapiens
cgaaacctgtccataaagta

SEQ ID NO: 2775641 - DNA, 22 bp, Homo sapiens
cgaaaggatgtaaacagtgcct

SEQ ID NO: 2775642 - DNA, 23 bp, Homo sapiens
cgaaaggatgtaaacagtgcctg

SEQ ID NO: 2775643 - DNA, 12 bp, Homo sapiens
cgaaagtttctt

SEQ ID NO: 2775644 - DNA, 13 bp, Homo sapiens
cgaaatgttattt

SEQ ID NO: 2775645 - DNA, 22 bp, Homo sapiens
cgaaatgttattttttaattat

SEQ ID NO: 2775646 - DNA, 14 bp, Homo sapiens
cgaacccacctgct

SEQ ID NO: 2775647 - DNA, 15 bp, Homo sapiens
cgaactccttgattt

SEQ ID NO: 2775648 - DNA, 12 bp, Homo sapiens
cgaactggctgc

SEQ ID NO: 2775649 - DNA, 13 bp, Homo sapiens
cgaagacacagac

SEQ ID NO: 2775650 - DNA, 18 bp, Homo sapiens
cgaagaccttctgaagat

SEQ ID NO: 2775651 - DNA, 17 bp, Homo sapiens
cgaagcccttccagtgg

SEQ ID NO: 2775652 - DNA, 18 bp, Homo sapiens
cgaagcccttccagtggt

SEQ ID NO: 2775653 - DNA, 13 bp, Homo sapiens
cgaatagctggga

SEQ ID NO: 2775654 - DNA, 14 bp, Homo sapiens
cgaatagctgggac

SEQ ID NO: 2775655 - DNA, 15 bp, Homo sapiens
cgaatagctgggact

SEQ ID NO: 2775656 - DNA, 16 bp, Homo sapiens
cgaatagctgggacta

SEQ ID NO: 2775657 - DNA, 14 bp, Homo sapiens
cgaatctacagaac

SEQ ID NO: 2775658 - DNA, 13 bp, Homo sapiens
cgaatgacactgt

SEQ ID NO: 2775659 - DNA, 23 bp, Homo sapiens
cgaatttggtgtggctgtattca

SEQ ID NO: 2775660 - DNA, 19 bp, Homo sapiens
cgacaggcatgcaccagtg

SEQ ID NO: 2775661 - DNA, 17 bp, Homo sapiens
cgaccacttttcagttc

SEQ ID NO: 2775662 - DNA, 15 bp, Homo sapiens
cgaccagagccccac

SEQ ID NO: 2775663 - DNA, 14 bp, Homo sapiens
cgacctcagccttc

SEQ ID NO: 2775664 - DNA, 14 bp, Homo sapiens
cgacctcgtcctcc

SEQ ID NO: 2775665 - DNA, 22 bp, Homo sapiens
cgacctcgtcctccccctgcca

SEQ ID NO: 2775666 - DNA, 12 bp, Homo sapiens
cgactcagggac

SEQ ID NO: 2775667 - DNA, 11 bp, Homo sapiens
cgactccagcc

SEQ ID NO: 2775668 - DNA, 12 bp, Homo sapiens
cgactccagcca

SEQ ID NO: 2775669 - DNA, 18 bp, Homo sapiens
cgactctatagactctag

SEQ ID NO: 2775670 - DNA, 14 bp, Homo sapiens
cgagaccagcctgg

SEQ ID NO: 2775671 - DNA, 13 bp, Homo sapiens
cgagagcctgctc

SEQ ID NO: 2775672 - DNA, 14 bp, Homo sapiens
cgagagcctgctcc

SEQ ID NO: 2775673 - DNA, 19 bp, Homo sapiens
cgagagcctgctcccccac

SEQ ID NO: 2775674 - DNA, 15 bp, Homo sapiens
cgagaggcagagaaa

SEQ ID NO: 2775675 - DNA, 16 bp, Homo sapiens
cgagatcacgccactg

SEQ ID NO: 2775676 - DNA, 17 bp, Homo sapiens
cgagatcacgccactgc

SEQ ID NO: 2775677 - DNA, 20 bp, Homo sapiens
cgagatcacgccactgcact

SEQ ID NO: 2775678 - DNA, 14 bp, Homo sapiens
cgagcaaccgtggc

SEQ ID NO: 2775679 - DNA, 15 bp, Homo sapiens
cgagcagctgagcag

SEQ ID NO: 2775680 - DNA, 16 bp, Homo sapiens
cgagcagctgagcagg

SEQ ID NO: 2775681 - DNA, 15 bp, Homo sapiens
cgagcatcctggcca

SEQ ID NO: 2775682 - DNA, 12 bp, Homo sapiens
cgagcatttccc

SEQ ID NO: 2775683 - DNA, 15 bp, Homo sapiens
cgagccctgcagcca

SEQ ID NO: 2775684 - DNA, 14 bp, Homo sapiens
cgagcgccctgcag

SEQ ID NO: 2775685 - DNA, 17 bp, Homo sapiens
cgaggagcttccagtgc

SEQ ID NO: 2775686 - DNA, 21 bp, Homo sapiens
cgaggagcttccagtgcatgt

SEQ ID NO: 2775687 - DNA, 19 bp, Homo sapiens
cgaggccttctctgaagga

SEQ ID NO: 2775688 - DNA, 19 bp, Homo sapiens
cgaggcggtttccaggaag

SEQ ID NO: 2775689 - DNA, 15 bp, Homo sapiens
cgaggtcaacagaga

SEQ ID NO: 2775690 - DNA, 23 bp, Homo sapiens
cgaggtcaacagagaaggcagga

SEQ ID NO: 2775691 - DNA, 13 bp, Homo sapiens
cgagtagctggga

SEQ ID NO: 2775692 - DNA, 16 bp, Homo sapiens
cgagtcaatcccctca

SEQ ID NO: 2775693 - DNA, 21 bp, Homo sapiens
cgagtttgggccactgcactc

SEQ ID NO: 2775694 - DNA, 16 bp, Homo sapiens
cgatctgtactgtaat

SEQ ID NO: 2775695 - DNA, 23 bp, Homo sapiens
cgatgaatgtgttgatttgagaa

SEQ ID NO: 2775696 - DNA, 23 bp, Homo sapiens
cgatgaatttggagactctgtgg

SEQ ID NO: 2775697 - DNA, 21 bp, Homo sapiens
cgatgggcccaattcttacaa

SEQ ID NO: 2775698 - DNA, 11 bp, Homo sapiens
cgatgtggccc

SEQ ID NO: 2775699 - DNA, 18 bp, Homo sapiens
cgattccctctcccaggc

SEQ ID NO: 2775700 - DNA, 20 bp, Homo sapiens
cctgactgtgttcagtgcct

SEQ ID NO: 2775701 - DNA, 18 bp, Homo sapiens
cctgagaccacagagaga

SEQ ID NO: 2775702 - DNA, 15 bp, Homo sapiens
cctgagatcagagtc

SEQ ID NO: 2775703 - DNA, 12 bp, Homo sapiens
cctgagcactgc

SEQ ID NO: 2775704 - DNA, 19 bp, Homo sapiens
cctgagcactgccaggagg

SEQ ID NO: 2775705 - DNA, 20 bp, Homo sapiens
cctgagcactgccaggaggg

SEQ ID NO: 2775706 - DNA, 14 bp, Homo sapiens
cctgagcccaggga

SEQ ID NO: 2775707 - DNA, 17 bp, Homo sapiens
cctgagcccagggaggc

SEQ ID NO: 2775708 - DNA, 19 bp, Homo sapiens
cctgagcccagggaggccg

SEQ ID NO: 2775709 - DNA, 14 bp, Homo sapiens
cctgagcctgacct

SEQ ID NO: 2775710 - DNA, 17 bp, Homo sapiens
cctgagcctgccgagca

SEQ ID NO: 2775711 - DNA, 23 bp, Homo sapiens
cctgagcctgccgagcaaccgtg

SEQ ID NO: 2775712 - DNA, 21 bp, Homo sapiens
cctgaggagctgttggcctgg

SEQ ID NO: 2775713 - DNA, 20 bp, Homo sapiens
cctgaggagtctgaggtcct

SEQ ID NO: 2775714 - DNA, 23 bp, Homo sapiens
cctgaggcatgagaatcacttga

SEQ ID NO: 2775715 - DNA, 21 bp, Homo sapiens
cctgaggctgagactgcggga

SEQ ID NO: 2775716 - DNA, 15 bp, Homo sapiens
cctgagtctcctgtg

SEQ ID NO: 2775717 - DNA, 13 bp, Homo sapiens
cctgagtggatct

SEQ ID NO: 2775718 - DNA, 20 bp, Homo sapiens
cctgagtggatctccaagga

SEQ ID NO: 2775719 - DNA, 19 bp, Homo sapiens
cctgagtggctgaaataaa

SEQ ID NO: 2775720 - DNA, 22 bp, Homo sapiens
cctgataaacattaaacactgt

SEQ ID NO: 2775721 - DNA, 15 bp, Homo sapiens
cctgatactgggtac

SEQ ID NO: 2775722 - DNA, 21 bp, Homo sapiens
cctgatggggtggaaggcatg

SEQ ID NO: 2775723 - DNA, 16 bp, Homo sapiens
cctgatgttaaaattc

SEQ ID NO: 2775724 - DNA, 17 bp, Homo sapiens
cctgatgttaaaattcc

SEQ ID NO: 2775725 - DNA, 15 bp, Homo sapiens
cctgcaaactcactg

SEQ ID NO: 2775726 - DNA, 17 bp, Homo sapiens
cctgcaaactcactgct

SEQ ID NO: 2775727 - DNA, 22 bp, Homo sapiens
cctgcaaactcactgctcaaga

SEQ ID NO: 2775728 - DNA, 13 bp, Homo sapiens
cctgcaaggacta

SEQ ID NO: 2775729 - DNA, 21 bp, Homo sapiens
cctgcaatctccagggctgcc

SEQ ID NO: 2775730 - DNA, 23 bp, Homo sapiens
cctgcaatctccagggctgcccc

SEQ ID NO: 2775731 - DNA, 16 bp, Homo sapiens
cctgcaattctacagt

SEQ ID NO: 2775732 - DNA, 22 bp, Homo sapiens
cctgcacaaagcccttccatgt

SEQ ID NO: 2775733 - DNA, 19 bp, Homo sapiens
cctgcacagatatttccat

SEQ ID NO: 2775734 - DNA, 18 bp, Homo sapiens
cctgcaccagcccttccc

SEQ ID NO: 2775735 - DNA, 14 bp, Homo sapiens
cctgcacctccccc

SEQ ID NO: 2775736 - DNA, 17 bp, Homo sapiens
cctgcacctccccccac

SEQ ID NO: 2775737 - DNA, 19 bp, Homo sapiens
cctgcacctccccccactg

SEQ ID NO: 2775738 - DNA, 21 bp, Homo sapiens
cctgcacctccccccactgca

SEQ ID NO: 2775739 - DNA, 17 bp, Homo sapiens
cctgcacttgcagactc

SEQ ID NO: 2775740 - DNA, 18 bp, Homo sapiens
cctgcacttgcagactct

SEQ ID NO: 2775741 - DNA, 19 bp, Homo sapiens
cctgcacttgcagactcta

SEQ ID NO: 2775742 - DNA, 14 bp, Homo sapiens
cctgcagaccctgc

SEQ ID NO: 2775743 - DNA, 16 bp, Homo sapiens
cctgcagaccctgccc

SEQ ID NO: 2775744 - DNA, 16 bp, Homo sapiens
cctgcagactcactgt

SEQ ID NO: 2775745 - DNA, 13 bp, Homo sapiens
cctgcagagagaa

SEQ ID NO: 2775746 - DNA, 18 bp, Homo sapiens
cctgcagccaaacagagc

SEQ ID NO: 2775747 - DNA, 18 bp, Homo sapiens
cctgcagcctcctcctga

SEQ ID NO: 2775748 - DNA, 12 bp, Homo sapiens
cctgcagcttgt

SEQ ID NO: 2775749 - DNA, 16 bp, Homo sapiens
cctgcagcttgtagcc

SEQ ID NO: 2775750 - DNA, 17 bp, Homo sapiens
cctgcagcttgtagcca

SEQ ID NO: 2775751 - DNA, 22 bp, Homo sapiens
cctgcaggccaagagcagaggc

SEQ ID NO: 2775752 - DNA, 22 bp, Homo sapiens
cctgcaggtgtctatccacctg

SEQ ID NO: 2775753 - DNA, 20 bp, Homo sapiens
cctgcagtactttacctcct

SEQ ID NO: 2775754 - DNA, 19 bp, Homo sapiens
cctgcatcatgacaaagtt

SEQ ID NO: 2775755 - DNA, 15 bp, Homo sapiens
cctgccacactcagt

SEQ ID NO: 2775756 - DNA, 20 bp, Homo sapiens
cctgccacactcagtccccc

SEQ ID NO: 2775757 - DNA, 13 bp, Homo sapiens
cctgccaccctgg

SEQ ID NO: 2775758 - DNA, 13 bp, Homo sapiens
cctgccacctgtc

SEQ ID NO: 2775759 - DNA, 23 bp, Homo sapiens
cctgccactttggtacatggcca

SEQ ID NO: 2775760 - DNA, 14 bp, Homo sapiens
cctgccagtgcctt

SEQ ID NO: 2775761 - DNA, 18 bp, Homo sapiens
cctgccagtgccttacct

SEQ ID NO: 2775762 - DNA, 20 bp, Homo sapiens
cctgccagtgccttacctcc

SEQ ID NO: 2775763 - DNA, 23 bp, Homo sapiens
cctgccagtgccttacctcctgc

SEQ ID NO: 2775764 - DNA, 13 bp, Homo sapiens
cctgcccagcctc

SEQ ID NO: 2775765 - DNA, 22 bp, Homo sapiens
cctgcccagtgcacttgctgga

SEQ ID NO: 2775766 - DNA, 15 bp, Homo sapiens
cctgccccaactcct

SEQ ID NO: 2775767 - DNA, 17 bp, Homo sapiens
cctgccccagggctccc

SEQ ID NO: 2775768 - DNA, 22 bp, Homo sapiens
cctgcccccagaccttttatcc

SEQ ID NO: 2775769 - DNA, 14 bp, Homo sapiens
cctgccccctggtg

SEQ ID NO: 2775770 - DNA, 11 bp, Homo sapiens
cctgccctgcc

SEQ ID NO: 2775771 - DNA, 15 bp, Homo sapiens
cctgccctgccacct

SEQ ID NO: 2775772 - DNA, 20 bp, Homo sapiens
cctgccctgctgccgcctcc

SEQ ID NO: 2775773 - DNA, 21 bp, Homo sapiens
cctgccctgttgtgtatagat

SEQ ID NO: 2775774 - DNA, 18 bp, Homo sapiens
cctgccgacctcgtcctc

SEQ ID NO: 2775775 - DNA, 22 bp, Homo sapiens
cctgccgagcaaccgtggccct

SEQ ID NO: 2775776 - DNA, 14 bp, Homo sapiens
cctgccgcctcaat

SEQ ID NO: 2775777 - DNA, 14 bp, Homo sapiens
cctgcctacatccc

SEQ ID NO: 2775778 - DNA, 11 bp, Homo sapiens
cctgcctcagc

SEQ ID NO: 2775779 - DNA, 14 bp, Homo sapiens
cctgcctcagctgc

SEQ ID NO: 2775780 - DNA, 15 bp, Homo sapiens
cctgcctctgactca

SEQ ID NO: 2775781 - DNA, 14 bp, Homo sapiens
cctgcctggaggac

SEQ ID NO: 2775782 - DNA, 24 bp, Homo sapiens
cctgcctggaggacctgagcctgc

SEQ ID NO: 2775783 - DNA, 14 bp, Homo sapiens
cctgccttcatgga

SEQ ID NO: 2775784 - DNA, 18 bp, Homo sapiens
cctgccttcttcggggaa

SEQ ID NO: 2775785 - DNA, 16 bp, Homo sapiens
cctgccttgaagccac

SEQ ID NO: 2775786 - DNA, 17 bp, Homo sapiens
cctgccttgaagccact

SEQ ID NO: 2775787 - DNA, 23 bp, Homo sapiens
cctgccttgaagccactgaagct

SEQ ID NO: 2775788 - DNA, 15 bp, Homo sapiens
cctgctatttgaagt

SEQ ID NO: 2775789 - DNA, 13 bp, Homo sapiens
cctcactcctgtt

SEQ ID NO: 2775790 - DNA, 13 bp, Homo sapiens
cctcactgcccca

SEQ ID NO: 2775791 - DNA, 17 bp, Homo sapiens
cctcactgccccaccag

SEQ ID NO: 2775792 - DNA, 16 bp, Homo sapiens
cctcactgccttccag

SEQ ID NO: 2775793 - DNA, 21 bp, Homo sapiens
cctccttcctcagtcctggaa

SEQ ID NO: 2775794 - DNA, 17 bp, Homo sapiens
cctccttggtgcctggc

SEQ ID NO: 2775795 - DNA, 14 bp, Homo sapiens
cctcgcctctccca

SEQ ID NO: 2775796 - DNA, 21 bp, Homo sapiens
cctcgctccccactctgctct

SEQ ID NO: 2775797 - DNA, 16 bp, Homo sapiens
cctcgctgcgtctcca

SEQ ID NO: 2775798 - DNA, 14 bp, Homo sapiens
cctcgctgtcctgc

SEQ ID NO: 2775799 - DNA, 16 bp, Homo sapiens
cctcgctgtcctgctg

SEQ ID NO: 2775800 - DNA, 17 bp, Homo sapiens
cctcgctgtcctgctgt

SEQ ID NO: 2775801 - DNA, 19 bp, Homo sapiens
cctcgctgtcctgctgtgt

SEQ ID NO: 2775802 - DNA, 13 bp, Homo sapiens
cctcggagcctca

SEQ ID NO: 2775803 - DNA, 16 bp, Homo sapiens
cctcggagcctcatcc

SEQ ID NO: 2775804 - DNA, 23 bp, Homo sapiens
cctcggagcctcatccgaggcag

SEQ ID NO: 2775805 - DNA, 15 bp, Homo sapiens
cctcggtggccatgc

SEQ ID NO: 2775806 - DNA, 16 bp, Homo sapiens
cctcggtggccatgct

SEQ ID NO: 2775807 - DNA, 17 bp, Homo sapiens
cctcggtggccatgctt

SEQ ID NO: 2775808 - DNA, 15 bp, Homo sapiens
cctcgtcctccccct

SEQ ID NO: 2775809 - DNA, 16 bp, Homo sapiens
cctcgtcctccccctg

SEQ ID NO: 2775810 - DNA, 14 bp, Homo sapiens
cctctaagccactc

SEQ ID NO: 2775811 - DNA, 19 bp, Homo sapiens
cctctaagccactcttcca

SEQ ID NO: 2775812 - DNA, 13 bp, Homo sapiens
cctctagtgccct

SEQ ID NO: 2775813 - DNA, 15 bp, Homo sapiens
cctctagtgccctcc

SEQ ID NO: 2775814 - DNA, 17 bp, Homo sapiens
cctctccaattgtaaaa

SEQ ID NO: 2775815 - DNA, 14 bp, Homo sapiens
cctctccagccttc

SEQ ID NO: 2775816 - DNA, 22 bp, Homo sapiens
cctctccagccttctctctctg

SEQ ID NO: 2775817 - DNA, 13 bp, Homo sapiens
cctctccaggcac

SEQ ID NO: 2775818 - DNA, 11 bp, Homo sapiens
cctctcctgcc

SEQ ID NO: 2775819 - DNA, 13 bp, Homo sapiens
cctctcctgccta

SEQ ID NO: 2775820 - DNA, 14 bp, Homo sapiens
cctctcctgcctac

SEQ ID NO: 2775821 - DNA, 15 bp, Homo sapiens
cctctccttgcctgg

SEQ ID NO: 2775822 - DNA, 14 bp, Homo sapiens
cctctctccttctg

SEQ ID NO: 2775823 - DNA, 11 bp, Homo sapiens
cctctcttccc

SEQ ID NO: 2775824 - DNA, 12 bp, Homo sapiens
cctctcttgcct

SEQ ID NO: 2775825 - DNA, 15 bp, Homo sapiens
cctctcttgcctttc

SEQ ID NO: 2775826 - DNA, 16 bp, Homo sapiens
cctctgacacacagct

SEQ ID NO: 2775827 - DNA, 20 bp, Homo sapiens
cctctgacacacagctctgt

SEQ ID NO: 2775828 - DNA, 19 bp, Homo sapiens
cctctgagaattccaagga

SEQ ID NO: 2775829 - DNA, 12 bp, Homo sapiens
cctctgaggcca

SEQ ID NO: 2775830 - DNA, 19 bp, Homo sapiens
cctctgaggccagcctggc

SEQ ID NO: 2775831 - DNA, 22 bp, Homo sapiens
cctctgaggccagcctggcctc

SEQ ID NO: 2775832 - DNA, 19 bp, Homo sapiens
cctctgatacccagagcat

SEQ ID NO: 2775833 - DNA, 14 bp, Homo sapiens
cctctgcagcactt

SEQ ID NO: 2775834 - DNA, 16 bp, Homo sapiens
cctctgcagcacttta

SEQ ID NO: 2775835 - DNA, 14 bp, Homo sapiens
cctctgccacctcc

SEQ ID NO: 2775836 - DNA, 13 bp, Homo sapiens
cctctgcctcaat

SEQ ID NO: 2775837 - DNA, 14 bp, Homo sapiens
cctctgcctcaatg

SEQ ID NO: 2775838 - DNA, 23 bp, Homo sapiens
cctctgcctctgacacacagctc

SEQ ID NO: 2775839 - DNA, 20 bp, Homo sapiens
cctctgcctgaagtcacaca

SEQ ID NO: 2775840 - DNA, 14 bp, Homo sapiens
cctctgctctgagg

SEQ ID NO: 2775841 - DNA, 12 bp, Homo sapiens
cctctggccctg

SEQ ID NO: 2775842 - DNA, 15 bp, Homo sapiens
cctctggccctgcct

SEQ ID NO: 2775843 - DNA, 20 bp, Homo sapiens
cctctgtccagggccctgag

SEQ ID NO: 2775844 - DNA, 16 bp, Homo sapiens
cctctgtccctctttg

SEQ ID NO: 2775845 - DNA, 15 bp, Homo sapiens
cctctgtctcgagcg

SEQ ID NO: 2775846 - DNA, 19 bp, Homo sapiens
cctctgtctcgagcgccct

SEQ ID NO: 2775847 - DNA, 21 bp, Homo sapiens
cctctgtctcgagcgccctgc

SEQ ID NO: 2775848 - DNA, 22 bp, Homo sapiens
cctctgtctcgagcgccctgca

SEQ ID NO: 2775849 - DNA, 13 bp, Homo sapiens
cctctgtctctgc

SEQ ID NO: 2775850 - DNA, 19 bp, Homo sapiens
cctcttaaaaaataaaaac

SEQ ID NO: 2775851 - DNA, 19 bp, Homo sapiens
cctcttaaagctgcctgta

SEQ ID NO: 2775852 - DNA, 20 bp, Homo sapiens
cctcttaaagctgcctgtag

SEQ ID NO: 2775853 - DNA, 22 bp, Homo sapiens
cctcttaaagctgcctgtagtt

SEQ ID NO: 2775854 - DNA, 23 bp, Homo sapiens
cctcttaaagctgcctgtagtta

SEQ ID NO: 2775855 - DNA, 17 bp, Homo sapiens
cctcttctattttgtaa

SEQ ID NO: 2775856 - DNA, 15 bp, Homo sapiens
cctcttcttcttcag

SEQ ID NO: 2775857 - DNA, 17 bp, Homo sapiens
cctcttcttcttcagaa

SEQ ID NO: 2775858 - DNA, 18 bp, Homo sapiens
cctcttggacctctgctc

SEQ ID NO: 2775859 - DNA, 12 bp, Homo sapiens
cctctttaagag

SEQ ID NO: 2775860 - DNA, 22 bp, Homo sapiens
cctctttgtcagtctgggtgtc

SEQ ID NO: 2775861 - DNA, 17 bp, Homo sapiens
cctgaaaacccagagag

SEQ ID NO: 2775862 - DNA, 13 bp, Homo sapiens
cctgaacaagaat

SEQ ID NO: 2775863 - DNA, 15 bp, Homo sapiens
cctgaacaagaattg

SEQ ID NO: 2775864 - DNA, 21 bp, Homo sapiens
cctgaagactcattcttctgt

SEQ ID NO: 2775865 - DNA, 14 bp, Homo sapiens
cctgaagatttcag

SEQ ID NO: 2775866 - DNA, 18 bp, Homo sapiens
cctgaagatttcagaggc

SEQ ID NO: 2775867 - DNA, 20 bp, Homo sapiens
cctgaagtcacacagtgagt

SEQ ID NO: 2775868 - DNA, 15 bp, Homo sapiens
cctgaatccatcagg

SEQ ID NO: 2775869 - DNA, 21 bp, Homo sapiens
cctgaatccatcaggacttgg

SEQ ID NO: 2775870 - DNA, 13 bp, Homo sapiens
cctgaatgaaata

SEQ ID NO: 2775871 - DNA, 23 bp, Homo sapiens
cctgaatggttccatgcctgagg

SEQ ID NO: 2775872 - DNA, 14 bp, Homo sapiens
cctgacaagcactg

SEQ ID NO: 2775873 - DNA, 19 bp, Homo sapiens
cctgacaagcactgctagg

SEQ ID NO: 2775874 - DNA, 20 bp, Homo sapiens
cctgaccaacagttccttca

SEQ ID NO: 2775875 - DNA, 14 bp, Homo sapiens
cctgacctcccagc

SEQ ID NO: 2775876 - DNA, 16 bp, Homo sapiens
cctgacctccctctaa

SEQ ID NO: 2775877 - DNA, 15 bp, Homo sapiens
cctgactcctctaag

SEQ ID NO: 2775878 - DNA, 15 bp, Homo sapiens
cctgactctctgtga

SEQ ID NO: 2775879 - DNA, 15 bp, Homo sapiens
cccatgacctccagc

SEQ ID NO: 2775880 - DNA, 20 bp, Homo sapiens
cccatgatgccgctcttctg

SEQ ID NO: 2775881 - DNA, 21 bp, Homo sapiens
cccatgatgccgctcttctgt

SEQ ID NO: 2775882 - DNA, 19 bp, Homo sapiens
cccatgctcaaccactgtg

SEQ ID NO: 2775883 - DNA, 21 bp, Homo sapiens
cccatgctcaaccactgtggc

SEQ ID NO: 2775884 - DNA, 21 bp, Homo sapiens
cccatgctgaattattttgtt

SEQ ID NO: 2775885 - DNA, 17 bp, Homo sapiens
cccattcagacacttca

SEQ ID NO: 2775886 - DNA, 15 bp, Homo sapiens
cccattccccttaag

SEQ ID NO: 2775887 - DNA, 21 bp, Homo sapiens
cccattctgcctccattctga

SEQ ID NO: 2775888 - DNA, 15 bp, Homo sapiens
cccattctgcctgcc

SEQ ID NO: 2775889 - DNA, 19 bp, Homo sapiens
cccattctgcctgcccagg

SEQ ID NO: 2775890 - DNA, 20 bp, Homo sapiens
cccattcttcctagttttct

SEQ ID NO: 2775891 - DNA, 21 bp, Homo sapiens
cccattcttcctagttttctc

SEQ ID NO: 2775892 - DNA, 14 bp, Homo sapiens
cccattgccctggt

SEQ ID NO: 2775893 - DNA, 19 bp, Homo sapiens
cccatttccttggaggcca

SEQ ID NO: 2775894 - DNA, 15 bp, Homo sapiens
cccatttctatttat

SEQ ID NO: 2775895 - DNA, 19 bp, Homo sapiens
cccatttctatttatttac

SEQ ID NO: 2775896 - DNA, 12 bp, Homo sapiens
cccattttgcaa

SEQ ID NO: 2775897 - DNA, 20 bp, Homo sapiens
ccagccgtgatgctcaggct

SEQ ID NO: 2775898 - DNA, 21 bp, Homo sapiens
ccagcctaagaagctctggcc

SEQ ID NO: 2775899 - DNA, 21 bp, Homo sapiens
ccagcctccaagctccatctc

SEQ ID NO: 2775900 - DNA, 16 bp, Homo sapiens
ccagcctcctcccacc

SEQ ID NO: 2775901 - DNA, 16 bp, Homo sapiens
ccagcctcgcatgcca

SEQ ID NO: 2775902 - DNA, 22 bp, Homo sapiens
ccagcctcgcatgccagagcct

SEQ ID NO: 2775903 - DNA, 11 bp, Homo sapiens
ccagcctgagc

SEQ ID NO: 2775904 - DNA, 10 bp, Homo sapiens
ccagcctggc

SEQ ID NO: 2775905 - DNA, 21 bp, Homo sapiens
ccagcctggcctcctgcctct

SEQ ID NO: 2775906 - DNA, 17 bp, Homo sapiens
ccagcctggcttctgga

SEQ ID NO: 2775907 - DNA, 11 bp, Homo sapiens
ccagcctgggc

SEQ ID NO: 2775908 - DNA, 13 bp, Homo sapiens
ccagcctgggcct

SEQ ID NO: 2775909 - DNA, 14 bp, Homo sapiens
ccagcctgggccta

SEQ ID NO: 2775910 - DNA, 21 bp, Homo sapiens
ccagcctgggcctatggagag

SEQ ID NO: 2775911 - DNA, 22 bp, Homo sapiens
ccagcctgggcctatggagagc

SEQ ID NO: 2775912 - DNA, 19 bp, Homo sapiens
ccagcctgggcgacagagc

SEQ ID NO: 2775913 - DNA, 14 bp, Homo sapiens
ccagcctgttggac

SEQ ID NO: 2775914 - DNA, 15 bp, Homo sapiens
ccagccttctctctc

SEQ ID NO: 2775915 - DNA, 17 bp, Homo sapiens
ccagccttctctctctg

SEQ ID NO: 2775916 - DNA, 14 bp, Homo sapiens
ccagcgagccctgg

SEQ ID NO: 2775917 - DNA, 15 bp, Homo sapiens
ccagcgagccctggt

SEQ ID NO: 2775918 - DNA, 17 bp, Homo sapiens
ccagcgcctccctccac

SEQ ID NO: 2775919 - DNA, 23 bp, Homo sapiens
ccagcgcctccctccaccccagg

SEQ ID NO: 2775920 - DNA, 17 bp, Homo sapiens
ccagctaatctgtaggg

SEQ ID NO: 2775921 - DNA, 21 bp, Homo sapiens
ccagctaatctgtagggctgg

SEQ ID NO: 2775922 - DNA, 22 bp, Homo sapiens
ccagctaatctgtagggctgga

SEQ ID NO: 2775923 - DNA, 20 bp, Homo sapiens
ccagctactcaagaggctga

SEQ ID NO: 2775924 - DNA, 16 bp, Homo sapiens
ccagctactcagaagc

SEQ ID NO: 2775925 - DNA, 13 bp, Homo sapiens
ccagctactcagg

SEQ ID NO: 2775926 - DNA, 14 bp, Homo sapiens
ccagctactcagga

SEQ ID NO: 2775927 - DNA, 17 bp, Homo sapiens
ccagctactcgggaggc

SEQ ID NO: 2775928 - DNA, 20 bp, Homo sapiens
ccagctagtgacccacatgc

SEQ ID NO: 2775929 - DNA, 15 bp, Homo sapiens
ccagctcactccctg

SEQ ID NO: 2775930 - DNA, 15 bp, Homo sapiens
ccagctcagtcccat

SEQ ID NO: 2775931 - DNA, 16 bp, Homo sapiens
ccagctccccaggact

SEQ ID NO: 2775932 - DNA, 19 bp, Homo sapiens
ccagctccccaggactcac

SEQ ID NO: 2775933 - DNA, 15 bp, Homo sapiens
ccagctcctgggcag

SEQ ID NO: 2775934 - DNA, 21 bp, Homo sapiens
ccagctcctgggcagcttgag

SEQ ID NO: 2775935 - DNA, 14 bp, Homo sapiens
ccagctctccctct

SEQ ID NO: 2775936 - DNA, 14 bp, Homo sapiens
ccagctctctctac

SEQ ID NO: 2775937 - DNA, 21 bp, Homo sapiens
ccagctcttggcccctgtgtg

SEQ ID NO: 2775938 - DNA, 16 bp, Homo sapiens
ccagctctttgttcag

SEQ ID NO: 2775939 - DNA, 19 bp, Homo sapiens
ccagctgcacctgccagcc

SEQ ID NO: 2775940 - DNA, 22 bp, Homo sapiens
ccagctgcacctgccagcctgg

SEQ ID NO: 2775941 - DNA, 19 bp, Homo sapiens
ccagctgcaggaatcaaaa

SEQ ID NO: 2775942 - DNA, 20 bp, Homo sapiens
ccagctgcaggaatcaaaaa

SEQ ID NO: 2775943 - DNA, 23 bp, Homo sapiens
ccagctgcaggaatcaaaaattg

SEQ ID NO: 2775944 - DNA, 19 bp, Homo sapiens
ccagctgccgaccagagcc

SEQ ID NO: 2775945 - DNA, 20 bp, Homo sapiens
ccagctgtgctctggacagg

SEQ ID NO: 2775946 - DNA, 19 bp, Homo sapiens
cccagcctgggcctatgga

SEQ ID NO: 2775947 - DNA, 14 bp, Homo sapiens
cccagcgagccctg

SEQ ID NO: 2775948 - DNA, 19 bp, Homo sapiens
cccagcgagccctggtggc

SEQ ID NO: 2775949 - DNA, 14 bp, Homo sapiens
cccagcgattccct

SEQ ID NO: 2775950 - DNA, 23 bp, Homo sapiens
cccagcgattccctctcccaggc

SEQ ID NO: 2775951 - DNA, 18 bp, Homo sapiens
cccagctaatctgtaggg

SEQ ID NO: 2775952 - DNA, 19 bp, Homo sapiens
cccagctaatctgtagggc

SEQ ID NO: 2775953 - DNA, 14 bp, Homo sapiens
cccagctacacctg

SEQ ID NO: 2775954 - DNA, 21 bp, Homo sapiens
cccagctactcagaagcctga

SEQ ID NO: 2775955 - DNA, 14 bp, Homo sapiens
cccagctactcagg

SEQ ID NO: 2775956 - DNA, 20 bp, Homo sapiens
cccagctactcaggaggctg

SEQ ID NO: 2775957 - DNA, 15 bp, Homo sapiens
cccagctccccagga

SEQ ID NO: 2775958 - DNA, 16 bp, Homo sapiens
cccagctctccctctg

SEQ ID NO: 2775959 - DNA, 18 bp, Homo sapiens
cccagctgcacctgccag

SEQ ID NO: 2775960 - DNA, 16 bp, Homo sapiens
cccagctggtgggaag

SEQ ID NO: 2775961 - DNA, 22 bp, Homo sapiens
cccagctggtgggaagcgtctg

SEQ ID NO: 2775962 - DNA, 21 bp, Homo sapiens
cccagctgtgctctggacagg

SEQ ID NO: 2775963 - DNA, 23 bp, Homo sapiens
cccagctgtgctctggacaggca

SEQ ID NO: 2775964 - DNA, 22 bp, Homo sapiens
cccaggacgccactcatttcat

SEQ ID NO: 2775965 - DNA, 16 bp, Homo sapiens
cccaggactcaccctc

SEQ ID NO: 2775966 - DNA, 21 bp, Homo sapiens
cccaggagccccgaggccttc

SEQ ID NO: 2775967 - DNA, 23 bp, Homo sapiens
cccaggagtttgaggctgcagcg

SEQ ID NO: 2775968 - DNA, 18 bp, Homo sapiens
cccaggagtttgtgtgtc

SEQ ID NO: 2775969 - DNA, 20 bp, Homo sapiens
cccaggccaggccaccagga

SEQ ID NO: 2775970 - DNA, 22 bp, Homo sapiens
cccaggccaggccaccaggatg

SEQ ID NO: 2775971 - DNA, 18 bp, Homo sapiens
cccaggcccctgccaccc

SEQ ID NO: 2775972 - DNA, 19 bp, Homo sapiens
cccaggctggcgtgcagtg

SEQ ID NO: 2775973 - DNA, 18 bp, Homo sapiens
cccagggaggccgaagct

SEQ ID NO: 2775974 - DNA, 15 bp, Homo sapiens
cccagggcacaggag

SEQ ID NO: 2775975 - DNA, 18 bp, Homo sapiens
cccagggcacaggagcta

SEQ ID NO: 2775976 - DNA, 22 bp, Homo sapiens
cccagggcacaggagctacctg

SEQ ID NO: 2775977 - DNA, 17 bp, Homo sapiens
cccagggccagggccct

SEQ ID NO: 2775978 - DNA, 15 bp, Homo sapiens
cccagggctaccctc

SEQ ID NO: 2775979 - DNA, 14 bp, Homo sapiens
cccagggctcagcc

SEQ ID NO: 2775980 - DNA, 21 bp, Homo sapiens
cccaggggagagggtctggag

SEQ ID NO: 2775981 - DNA, 22 bp, Homo sapiens
cccaggggagagggtctggaga

SEQ ID NO: 2775982 - DNA, 17 bp, Homo sapiens
cccaggggctccacctg

SEQ ID NO: 2775983 - DNA, 19 bp, Homo sapiens
cccaggtctctccactgct

SEQ ID NO: 2775984 - DNA, 22 bp, Homo sapiens
cccaggtggctgacccagtccc

SEQ ID NO: 2775985 - DNA, 15 bp, Homo sapiens
cccagtaactcatct

SEQ ID NO: 2775986 - DNA, 13 bp, Homo sapiens
cccagtcgagccc

SEQ ID NO: 2775987 - DNA, 18 bp, Homo sapiens
cccagtcgagccctgcag

SEQ ID NO: 2775988 - DNA, 20 bp, Homo sapiens
cccagtctggaatgcagtgg

SEQ ID NO: 2775989 - DNA, 13 bp, Homo sapiens
cccagtgccacag

SEQ ID NO: 2775990 - DNA, 13 bp, Homo sapiens
cccagtgcccaca

SEQ ID NO: 2775991 - DNA, 20 bp, Homo sapiens
cccagtgcccacaggatcag

SEQ ID NO: 2775992 - DNA, 19 bp, Homo sapiens
cccagttcaggagtcccaa

SEQ ID NO: 2775993 - DNA, 14 bp, Homo sapiens
cccagttctgctcc

SEQ ID NO: 2775994 - DNA, 23 bp, Homo sapiens
cccagttctgctcctctccaggc

SEQ ID NO: 2775995 - DNA, 15 bp, Homo sapiens
cccagtttgcagaaa

SEQ ID NO: 2775996 - DNA, 19 bp, Homo sapiens
cccataattttcttcatgc

SEQ ID NO: 2775997 - DNA, 22 bp, Homo sapiens
cccataattttttttttccttt

SEQ ID NO: 2775998 - DNA, 22 bp, Homo sapiens
cccatagatcttctgaaatgaa

SEQ ID NO: 2775999 - DNA, 16 bp, Homo sapiens
cccatagcttccatga

SEQ ID NO: 2776000 - DNA, 21 bp, Homo sapiens
cccatcacctactcacacagg

SEQ ID NO: 2776001 - DNA, 13 bp, Homo sapiens
cccatcactggag

SEQ ID NO: 2776002 - DNA, 15 bp, Homo sapiens
cccatcactggagca

SEQ ID NO: 2776003 - DNA, 14 bp, Homo sapiens
cccatcatggctgc

SEQ ID NO: 2776004 - DNA, 14 bp, Homo sapiens
cccatccagttcat

SEQ ID NO: 2776005 - DNA, 18 bp, Homo sapiens
cccatccatcagctccct

SEQ ID NO: 2776006 - DNA, 13 bp, Homo sapiens
cccatccccagcg

SEQ ID NO: 2776007 - DNA, 17 bp, Homo sapiens
cccatcccctttcctcc

SEQ ID NO: 2776008 - DNA, 16 bp, Homo sapiens
cccatctaagctgcag

SEQ ID NO: 2776009 - DNA, 22 bp, Homo sapiens
cccatctaagctgcagcttcct

SEQ ID NO: 2776010 - DNA, 21 bp, Homo sapiens
ccaggtggctgacccagtccc

SEQ ID NO: 2776011 - DNA, 23 bp, Homo sapiens
ccaggtggctgacccagtccctg

SEQ ID NO: 2776012 - DNA, 14 bp, Homo sapiens
ccaggttcagcttg

SEQ ID NO: 2776013 - DNA, 13 bp, Homo sapiens
ccaggttgaaaga

SEQ ID NO: 2776014 - DNA, 13 bp, Homo sapiens
ccaggttggcctg

SEQ ID NO: 2776015 - DNA, 17 bp, Homo sapiens
ccaggtttttggtctga

SEQ ID NO: 2776016 - DNA, 16 bp, Homo sapiens
ccagtaactcatctgt

SEQ ID NO: 2776017 - DNA, 16 bp, Homo sapiens
ccagtacctttgtcac

SEQ ID NO: 2776018 - DNA, 16 bp, Homo sapiens
ccagtacgtgctaaca

SEQ ID NO: 2776019 - DNA, 22 bp, Homo sapiens
ccagtccccgtgccccgcctcc

SEQ ID NO: 2776020 - DNA, 13 bp, Homo sapiens
ccagtccctgggg

SEQ ID NO: 2776021 - DNA, 22 bp, Homo sapiens
ccagtccctgggggaagccctg

SEQ ID NO: 2776022 - DNA, 14 bp, Homo sapiens
ccagtgacagctag

SEQ ID NO: 2776023 - DNA, 16 bp, Homo sapiens
ccagtgcacttgctgg

SEQ ID NO: 2776024 - DNA, 12 bp, Homo sapiens
ccagtgccacag

SEQ ID NO: 2776025 - DNA, 17 bp, Homo sapiens
ccagtgccgcctgtgcc

SEQ ID NO: 2776026 - DNA, 17 bp, Homo sapiens
ccagtgccttacctcct

SEQ ID NO: 2776027 - DNA, 22 bp, Homo sapiens
ccagtgccttacctcctgccca

SEQ ID NO: 2776028 - DNA, 23 bp, Homo sapiens
ccagtgccttacctcctgcccag

SEQ ID NO: 2776029 - DNA, 17 bp, Homo sapiens
ccagtgctacctctctc

SEQ ID NO: 2776030 - DNA, 20 bp, Homo sapiens
ccagtgtaaagaataaatga

SEQ ID NO: 2776031 - DNA, 15 bp, Homo sapiens
ccagtgtgatcccaa

SEQ ID NO: 2776032 - DNA, 19 bp, Homo sapiens
ccagtgtttagaagagcct

SEQ ID NO: 2776033 - DNA, 23 bp, Homo sapiens
ccagttcctttcaatggtttgca

SEQ ID NO: 2776034 - DNA, 14 bp, Homo sapiens
ccagttctgctcct

SEQ ID NO: 2776035 - DNA, 16 bp, Homo sapiens
ccagttctgctcctct

SEQ ID NO: 2776036 - DNA, 17 bp, Homo sapiens
ccagttctgctcctctc

SEQ ID NO: 2776037 - DNA, 19 bp, Homo sapiens
ccagttctgctcctctcca

SEQ ID NO: 2776038 - DNA, 21 bp, Homo sapiens
ccagttctgctcctctccagg

SEQ ID NO: 2776039 - DNA, 22 bp, Homo sapiens
ccagttctgctcctctccaggc

SEQ ID NO: 2776040 - DNA, 20 bp, Homo sapiens
ccagttgggagcactggagt

SEQ ID NO: 2776041 - DNA, 19 bp, Homo sapiens
ccagttgggtggatgcctg

SEQ ID NO: 2776042 - DNA, 23 bp, Homo sapiens
ccagttgggtggatgcctggtgg

SEQ ID NO: 2776043 - DNA, 12 bp, Homo sapiens
ccagtttcccac

SEQ ID NO: 2776044 - DNA, 21 bp, Homo sapiens
ccataagcctccatttagttc

SEQ ID NO: 2776045 - DNA, 20 bp, Homo sapiens
ccataattttttttttcctt

SEQ ID NO: 2776046 - DNA, 16 bp, Homo sapiens
ccatacacatccccag

SEQ ID NO: 2776047 - DNA, 17 bp, Homo sapiens
ccatagatcttctgaaa

SEQ ID NO: 2776048 - DNA, 18 bp, Homo sapiens
ccatagcaagattgctta

SEQ ID NO: 2776049 - DNA, 15 bp, Homo sapiens
ccatagcttccatga

SEQ ID NO: 2776050 - DNA, 15 bp, Homo sapiens
ccatagtcacatggc

SEQ ID NO: 2776051 - DNA, 18 bp, Homo sapiens
ccatatcagacctctgat

SEQ ID NO: 2776052 - DNA, 22 bp, Homo sapiens
ccatattcagtgctgtggcctg

SEQ ID NO: 2776053 - DNA, 23 bp, Homo sapiens
ccatattctgttggccagtgtga

SEQ ID NO: 2776054 - DNA, 11 bp, Homo sapiens
ccatcaataaa

SEQ ID NO: 2776055 - DNA, 17 bp, Homo sapiens
ccatcaataaagtaccc

SEQ ID NO: 2776056 - DNA, 12 bp, Homo sapiens
ccatcaggactt

SEQ ID NO: 2776057 - DNA, 18 bp, Homo sapiens
ccatcagttactggtttc

SEQ ID NO: 2776058 - DNA, 14 bp, Homo sapiens
ccatcatcccagct

SEQ ID NO: 2776059 - DNA, 16 bp, Homo sapiens
ccatcatcccagctgc

SEQ ID NO: 2776060 - DNA, 14 bp, Homo sapiens
ccatcatgtctggc

SEQ ID NO: 2776061 - DNA, 16 bp, Homo sapiens
ccatcatgtctggcta

SEQ ID NO: 2776062 - DNA, 19 bp, Homo sapiens
ccatcatgtgcctggaaat

SEQ ID NO: 2776063 - DNA, 19 bp, Homo sapiens
ccatccaggttcagcttgt

SEQ ID NO: 2776064 - DNA, 16 bp, Homo sapiens
ccatccatcagctccc

SEQ ID NO: 2776065 - DNA, 14 bp, Homo sapiens
ccatcccccactgc

SEQ ID NO: 2776066 - DNA, 22 bp, Homo sapiens
ccatcccccactgccacaccct

SEQ ID NO: 2776067 - DNA, 19 bp, Homo sapiens
ccatcccgcccttcccaca

SEQ ID NO: 2776068 - DNA, 15 bp, Homo sapiens
ccatcctgcagcctc

SEQ ID NO: 2776069 - DNA, 17 bp, Homo sapiens
ccatccttcaccagagc

SEQ ID NO: 2776070 - DNA, 18 bp, Homo sapiens
ccatccttcaccagagcc

SEQ ID NO: 2776071 - DNA, 15 bp, Homo sapiens
ccatctaagctgcag

SEQ ID NO: 2776072 - DNA, 22 bp, Homo sapiens
ccatctatgtcccttgctgtga

SEQ ID NO: 2776073 - DNA, 19 bp, Homo sapiens
ccatctccaccctgagcct

SEQ ID NO: 2776074 - DNA, 24 bp, Homo sapiens
ccatctccaccctgagcctgacct

SEQ ID NO: 2776075 - DNA, 13 bp, Homo sapiens
ccatctcccccat

SEQ ID NO: 2776076 - DNA, 23 bp, Homo sapiens
ccatctcccccatcccccactgc

SEQ ID NO: 2776077 - DNA, 18 bp, Homo sapiens
ccatctgaaccactttgc

SEQ ID NO: 2776078 - DNA, 14 bp, Homo sapiens
ccatctgctcctcc

SEQ ID NO: 2776079 - DNA, 16 bp, Homo sapiens
ccatctgctcctccca

SEQ ID NO: 2776080 - DNA, 12 bp, Homo sapiens
ccatctgcttgt

SEQ ID NO: 2776081 - DNA, 18 bp, Homo sapiens
ccatctgtcttgccagcc

SEQ ID NO: 2776082 - DNA, 21 bp, Homo sapiens
ccatctgtcttgccagccaga

SEQ ID NO: 2776083 - DNA, 17 bp, Homo sapiens
ccatgaagacaggacag

SEQ ID NO: 2776084 - DNA, 21 bp, Homo sapiens
ccatgaagctggaagcactgc

SEQ ID NO: 2776085 - DNA, 14 bp, Homo sapiens
ccatgacctccagc

SEQ ID NO: 2776086 - DNA, 20 bp, Homo sapiens
ccatgacctccagctttcct

SEQ ID NO: 2776087 - DNA, 13 bp, Homo sapiens
ccatgagaagagg

SEQ ID NO: 2776088 - DNA, 22 bp, Homo sapiens
ccatgagaataagagaaagaaa

SEQ ID NO: 2776089 - DNA, 13 bp, Homo sapiens
ccatgagcctcag

SEQ ID NO: 2776090 - DNA, 19 bp, Homo sapiens
ccatgagcctcagcatcct

SEQ ID NO: 2776091 - DNA, 19 bp, Homo sapiens
ccatgcagcttcatcaatt

SEQ ID NO: 2776092 - DNA, 16 bp, Homo sapiens
ccatgcctgagggtgg

SEQ ID NO: 2776093 - DNA, 14 bp, Homo sapiens
ccatgcgctgctca

SEQ ID NO: 2776094 - DNA, 13 bp, Homo sapiens
ccatgctgaaggg

SEQ ID NO: 2776095 - DNA, 14 bp, Homo sapiens
ccatgctgaattat

SEQ ID NO: 2776096 - DNA, 21 bp, Homo sapiens
ccatggcgtgtccctctcgga

SEQ ID NO: 2776097 - DNA, 22 bp, Homo sapiens
ccatgggagctggttagaaatg

SEQ ID NO: 2776098 - DNA, 18 bp, Homo sapiens
ccatgtaccagtgtactg

SEQ ID NO: 2776099 - DNA, 23 bp, Homo sapiens
ccatgtaccagtgtactgctttc

SEQ ID NO: 2776100 - DNA, 15 bp, Homo sapiens
cagactcagctccag

SEQ ID NO: 2776101 - DNA, 18 bp, Homo sapiens
cagactccttcaacaatt

SEQ ID NO: 2776102 - DNA, 17 bp, Homo sapiens
cagactctacagaggcc

SEQ ID NO: 2776103 - DNA, 21 bp, Homo sapiens
cagactctacagaggccatgg

SEQ ID NO: 2776104 - DNA, 18 bp, Homo sapiens
cagactgcgatttgtccc

SEQ ID NO: 2776105 - DNA, 15 bp, Homo sapiens
cagactgctgggact

SEQ ID NO: 2776106 - DNA, 16 bp, Homo sapiens
cagactgctgggactg

SEQ ID NO: 2776107 - DNA, 13 bp, Homo sapiens
cagactggaagca

SEQ ID NO: 2776108 - DNA, 14 bp, Homo sapiens
cagactggaagcac

SEQ ID NO: 2776109 - DNA, 16 bp, Homo sapiens
cagactggaagcacag

SEQ ID NO: 2776110 - DNA, 14 bp, Homo sapiens
cagactgtggctgc

SEQ ID NO: 2776111 - DNA, 22 bp, Homo sapiens
tgtgtcacactgagctgggcac

SEQ ID NO: 2776112 - DNA, 14 bp, Homo sapiens
tgtgtcagcatgca

SEQ ID NO: 2776113 - DNA, 19 bp, Homo sapiens
tgtgtcaggtggggcagct

SEQ ID NO: 2776114 - DNA, 18 bp, Homo sapiens
tgtgtccttgcacctgca

SEQ ID NO: 2776115 - DNA, 19 bp, Homo sapiens
tgtgtccttgcacctgcat

SEQ ID NO: 2776116 - DNA, 20 bp, Homo sapiens
tgtgtccttgcacctgcatc

SEQ ID NO: 2776117 - DNA, 14 bp, Homo sapiens
tgtgtctgctcagt

SEQ ID NO: 2776118 - DNA, 21 bp, Homo sapiens
tgtgtcttgcaatggcagcct

SEQ ID NO: 2776119 - DNA, 14 bp, Homo sapiens
tgtgtgaagaaatg

SEQ ID NO: 2776120 - DNA, 21 bp, Homo sapiens
tgtgtgaaggtcttgcctgaa

SEQ ID NO: 2776121 - DNA, 17 bp, Homo sapiens
tgtgtgagcaagcattt

SEQ ID NO: 2776122 - DNA, 13 bp, Homo sapiens
tgtgtgagcatct

SEQ ID NO: 2776123 - DNA, 13 bp, Homo sapiens
tgtgtgagttgag

SEQ ID NO: 2776124 - DNA, 14 bp, Homo sapiens
tgtgtgagttgagt

SEQ ID NO: 2776125 - DNA, 19 bp, Homo sapiens
tgtgtgcagactcaataaa

SEQ ID NO: 2776126 - DNA, 22 bp, Homo sapiens
tgtgtggggttcagcgtagaaa

SEQ ID NO: 2776127 - DNA, 13 bp, Homo sapiens
tgtgtgtatgcta

SEQ ID NO: 2776128 - DNA, 22 bp, Homo sapiens
tgtgttcagtgccttggagcag

SEQ ID NO: 2776129 - DNA, 15 bp, Homo sapiens
tgtgttgctatcctg

SEQ ID NO: 2776130 - DNA, 14 bp, Homo sapiens
tgtgttgtctgtgc

SEQ ID NO: 2776131 - DNA, 15 bp, Homo sapiens
tgtgttgtctgtgca

SEQ ID NO: 2776132 - DNA, 11 bp, Homo sapiens
tgtgtttcctt

SEQ ID NO: 2776133 - DNA, 11 bp, Homo sapiens
tgtgtttgtgt

SEQ ID NO: 2776134 - DNA, 13 bp, Homo sapiens
tgtgttttctgaa

SEQ ID NO: 2776135 - DNA, 14 bp, Homo sapiens
tgtgttttctgaat

SEQ ID NO: 2776136 - DNA, 22 bp, Homo sapiens
tgttaaaaaaataagaagaatg

SEQ ID NO: 2776137 - DNA, 14 bp, Homo sapiens
tgttaaaataacta

SEQ ID NO: 2776138 - DNA, 15 bp, Homo sapiens
tgttaaaatgtacac

SEQ ID NO: 2776139 - DNA, 16 bp, Homo sapiens
tgttaaaatgtacact

SEQ ID NO: 2776140 - DNA, 24 bp, Homo sapiens
tgttaaatcccattcataactttc

SEQ ID NO: 2776141 - DNA, 15 bp, Homo sapiens
tgttaacctcagtgt

SEQ ID NO: 2776142 - DNA, 23 bp, Homo sapiens
tgttaatcttaggggagagcttt

SEQ ID NO: 2776143 - DNA, 19 bp, Homo sapiens
tgttaatgatagctactgt

SEQ ID NO: 2776144 - DNA, 14 bp, Homo sapiens
tgttaatgcatttt

SEQ ID NO: 2776145 - DNA, 17 bp, Homo sapiens
tgttaatttagaaaact

SEQ ID NO: 2776146 - DNA, 18 bp, Homo sapiens
tgttaatttagaaaactt

SEQ ID NO: 2776147 - DNA, 16 bp, Homo sapiens
tgttacaggtgtacta

SEQ ID NO: 2776148 - DNA, 12 bp, Homo sapiens
tgttacatcaca

SEQ ID NO: 2776149 - DNA, 20 bp, Homo sapiens
tgttacctttcccatgctga

SEQ ID NO: 2776150 - DNA, 23 bp, Homo sapiens
tgttactccacagcggaggagac

SEQ ID NO: 2776151 - DNA, 13 bp, Homo sapiens
tgttacttaaata

SEQ ID NO: 2776152 - DNA, 15 bp, Homo sapiens
tgttacttaaatagc

SEQ ID NO: 2776153 - DNA, 14 bp, Homo sapiens
tgttacttacctaa

SEQ ID NO: 2776154 - DNA, 18 bp, Homo sapiens
tgttacttacctaaacag

SEQ ID NO: 2776155 - DNA, 17 bp, Homo sapiens
tgttagccccataattt

SEQ ID NO: 2776156 - DNA, 20 bp, Homo sapiens
tgttatcaaaactttctttt

SEQ ID NO: 2776157 - DNA, 23 bp, Homo sapiens
tgttatcctgctagctgtagaaa

SEQ ID NO: 2776158 - DNA, 16 bp, Homo sapiens
tgttattatcctgcat

SEQ ID NO: 2776159 - DNA, 21 bp, Homo sapiens
tgttattgggcaagtgattga

SEQ ID NO: 2776160 - DNA, 15 bp, Homo sapiens
tgttatttaaatgag

SEQ ID NO: 2776161 - DNA, 17 bp, Homo sapiens
tgttatttgtaatagat

SEQ ID NO: 2776162 - DNA, 19 bp, Homo sapiens
tgttattttctttgaaatt

SEQ ID NO: 2776163 - DNA, 21 bp, Homo sapiens
tgttattttttatttccacat

SEQ ID NO: 2776164 - DNA, 19 bp, Homo sapiens
tgttcaaaaaaacactagt

SEQ ID NO: 2776165 - DNA, 16 bp, Homo sapiens
tgttcaccttatgtat

SEQ ID NO: 2776166 - DNA, 18 bp, Homo sapiens
tgttcaccttatgtatta

SEQ ID NO: 2776167 - DNA, 17 bp, Homo sapiens
tgttcacgcaacttgaa

SEQ ID NO: 2776168 - DNA, 18 bp, Homo sapiens
tgttcagaaggttgctct

SEQ ID NO: 2776169 - DNA, 14 bp, Homo sapiens
tgttcagctccagc

SEQ ID NO: 2776170 - DNA, 16 bp, Homo sapiens
tgttcagctccagctc

SEQ ID NO: 2776171 - DNA, 18 bp, Homo sapiens
tgttcagctccagctcac

SEQ ID NO: 2776172 - DNA, 20 bp, Homo sapiens
tgttcagctccagctcacca

SEQ ID NO: 2776173 - DNA, 21 bp, Homo sapiens
tgttcagcttcagacttttat

SEQ ID NO: 2776174 - DNA, 14 bp, Homo sapiens
tgttcagtgccttg

SEQ ID NO: 2776175 - DNA, 18 bp, Homo sapiens
tgttcagtgccttggagc

SEQ ID NO: 2776176 - DNA, 13 bp, Homo sapiens
tgttcatggcaga

SEQ ID NO: 2776177 - DNA, 22 bp, Homo sapiens
tgttcattaaagcatgaatggt

SEQ ID NO: 2776178 - DNA, 18 bp, Homo sapiens
tgttcattaaattttcta

SEQ ID NO: 2776179 - DNA, 22 bp, Homo sapiens
tgttccacttctctagagaaca

SEQ ID NO: 2776180 - DNA, 23 bp, Homo sapiens
tgttcccaagagcatcatgcctc

SEQ ID NO: 2776181 - DNA, 16 bp, Homo sapiens
tgttcccattcttgca

SEQ ID NO: 2776182 - DNA, 14 bp, Homo sapiens
tgttccctctttct

SEQ ID NO: 2776183 - DNA, 23 bp, Homo sapiens
tgttcctcaccaataacttcaga

SEQ ID NO: 2776184 - DNA, 18 bp, Homo sapiens
tgttctactcatatatat

SEQ ID NO: 2776185 - DNA, 19 bp, Homo sapiens
tgttctagttagcaggaaa

SEQ ID NO: 2776186 - DNA, 14 bp, Homo sapiens
tgttctcaatgctt

SEQ ID NO: 2776187 - DNA, 21 bp, Homo sapiens
tgttctcaatgcttttctagc

SEQ ID NO: 2776188 - DNA, 16 bp, Homo sapiens
tgttctctgaggacac

SEQ ID NO: 2776189 - DNA, 18 bp, Homo sapiens
tgttctctgaggacacta

SEQ ID NO: 2776190 - DNA, 18 bp, Homo sapiens
tgttctgaataatttctt

SEQ ID NO: 2776191 - DNA, 15 bp, Homo sapiens
tgttctgagtacttg

SEQ ID NO: 2776192 - DNA, 15 bp, Homo sapiens
tgttctggagctgct

SEQ ID NO: 2776193 - DNA, 16 bp, Homo sapiens
tgttctggctttacat

SEQ ID NO: 2776194 - DNA, 15 bp, Homo sapiens
tgttctgggacacag

SEQ ID NO: 2776195 - DNA, 16 bp, Homo sapiens
tgttctgggacacagt

SEQ ID NO: 2776196 - DNA, 12 bp, Homo sapiens
tgttctgtattt

SEQ ID NO: 2776197 - DNA, 13 bp, Homo sapiens
tgttctgtatttt

SEQ ID NO: 2776198 - DNA, 15 bp, Homo sapiens
tgttctgtattttca

SEQ ID NO: 2776199 - DNA, 13 bp, Homo sapiens
tgttctgtcacca

SEQ ID NO: 2776200 - DNA, 13 bp, Homo sapiens
tgttctttgggga

SEQ ID NO: 2776201 - DNA, 21 bp, Homo sapiens
tgttgaaaatgagcctgtaat

SEQ ID NO: 2776202 - DNA, 12 bp, Homo sapiens
tgggtgggagag

SEQ ID NO: 2776203 - DNA, 15 bp, Homo sapiens
tgggtggtggatctg

SEQ ID NO: 2776204 - DNA, 22 bp, Homo sapiens
tgggtgtaacaggtctcctctt

SEQ ID NO: 2776205 - DNA, 23 bp, Homo sapiens
tgggtgtaacaggtctcctctta

SEQ ID NO: 2776206 - DNA, 15 bp, Homo sapiens
tgggtgtgccaggct

SEQ ID NO: 2776207 - DNA, 14 bp, Homo sapiens
tgggtgttaatttt

SEQ ID NO: 2776208 - DNA, 23 bp, Homo sapiens
tgggttctttggaaggagtgaga

SEQ ID NO: 2776209 - DNA, 23 bp, Homo sapiens
tggtaaaaagattatatatcata

SEQ ID NO: 2776210 - DNA, 14 bp, Homo sapiens
tggtaagctctggc

SEQ ID NO: 2776211 - DNA, 15 bp, Homo sapiens
tggtacatggccagt

SEQ ID NO: 2776212 - DNA, 14 bp, Homo sapiens
tggtaccagctcac

SEQ ID NO: 2776213 - DNA, 18 bp, Homo sapiens
tggtagaattgggaagct

SEQ ID NO: 2776214 - DNA, 17 bp, Homo sapiens
tggtagcttttcccttc

SEQ ID NO: 2776215 - DNA, 15 bp, Homo sapiens
tggtatcaagaaagt

SEQ ID NO: 2776216 - DNA, 23 bp, Homo sapiens
tggtatgaacttgaggacacatg

SEQ ID NO: 2776217 - DNA, 14 bp, Homo sapiens
tggtatgagctgag

SEQ ID NO: 2776218 - DNA, 16 bp, Homo sapiens
tggtatgagctgaggg

SEQ ID NO: 2776219 - DNA, 15 bp, Homo sapiens
tggtatgtgtgtgta

SEQ ID NO: 2776220 - DNA, 21 bp, Homo sapiens
tggtatgtgtgtgtatgctac

SEQ ID NO: 2776221 - DNA, 17 bp, Homo sapiens
tggtattatttacaatg

SEQ ID NO: 2776222 - DNA, 17 bp, Homo sapiens
tggtattttcgtgcatt

SEQ ID NO: 2776223 - DNA, 20 bp, Homo sapiens
tggtcaaaccgcactcaccc

SEQ ID NO: 2776224 - DNA, 22 bp, Homo sapiens
tggtcaatccgaagtatgaggg

SEQ ID NO: 2776225 - DNA, 15 bp, Homo sapiens
tggtcacaagcacaa

SEQ ID NO: 2776226 - DNA, 19 bp, Homo sapiens
tggtcacaggactctgcct

SEQ ID NO: 2776227 - DNA, 20 bp, Homo sapiens
tggtcacaggactctgcctc

SEQ ID NO: 2776228 - DNA, 23 bp, Homo sapiens
tggtcacaggactctgcctcctc

SEQ ID NO: 2776229 - DNA, 18 bp, Homo sapiens
tggtcaggcccactgcag

SEQ ID NO: 2776230 - DNA, 21 bp, Homo sapiens
tggtccagctcttggcccctg

SEQ ID NO: 2776231 - DNA, 15 bp, Homo sapiens
tggtcccacatccct

SEQ ID NO: 2776232 - DNA, 17 bp, Homo sapiens
tggtctcaaactcttga

SEQ ID NO: 2776233 - DNA, 14 bp, Homo sapiens
tggtctccctccag

SEQ ID NO: 2776234 - DNA, 19 bp, Homo sapiens
tggtctccctccagctgga

SEQ ID NO: 2776235 - DNA, 17 bp, Homo sapiens
tggtctgacccactgct

SEQ ID NO: 2776236 - DNA, 16 bp, Homo sapiens
tggtctgagcaccccc

SEQ ID NO: 2776237 - DNA, 14 bp, Homo sapiens
tggtctttgaataa

SEQ ID NO: 2776238 - DNA, 18 bp, Homo sapiens
tggtctttgaataaagtc

SEQ ID NO: 2776239 - DNA, 19 bp, Homo sapiens
tggtctttgaataaagtct

SEQ ID NO: 2776240 - DNA, 22 bp, Homo sapiens
tggtctttgaataaagtctgag

SEQ ID NO: 2776241 - DNA, 11 bp, Homo sapiens
tggtgaaatta

SEQ ID NO: 2776242 - DNA, 22 bp, Homo sapiens
tggtgacctctgcctgaagtca

SEQ ID NO: 2776243 - DNA, 23 bp, Homo sapiens
tggtgagcacatctgggaggctg

SEQ ID NO: 2776244 - DNA, 15 bp, Homo sapiens
tggtgataagtggaa

SEQ ID NO: 2776245 - DNA, 17 bp, Homo sapiens
tggtgatcaattaaatg

SEQ ID NO: 2776246 - DNA, 18 bp, Homo sapiens
tggtgatcaattaaatgt

SEQ ID NO: 2776247 - DNA, 19 bp, Homo sapiens
tggtgcagaggtgagcaga

SEQ ID NO: 2776248 - DNA, 12 bp, Homo sapiens
tggtgcctggcc

SEQ ID NO: 2776249 - DNA, 17 bp, Homo sapiens
tggtgcctggcctggca

SEQ ID NO: 2776250 - DNA, 18 bp, Homo sapiens
tggtgcctggcctggcac

SEQ ID NO: 2776251 - DNA, 12 bp, Homo sapiens
tggtgccttcat

SEQ ID NO: 2776252 - DNA, 17 bp, Homo sapiens
tggtgcgatctgggttc

SEQ ID NO: 2776253 - DNA, 14 bp, Homo sapiens
tggtgctaactgta

SEQ ID NO: 2776254 - DNA, 22 bp, Homo sapiens
tggtgctaactgtatgtgtctt

SEQ ID NO: 2776255 - DNA, 20 bp, Homo sapiens
tggtgctccccttcctgcca

SEQ ID NO: 2776256 - DNA, 17 bp, Homo sapiens
tggtggacagtcctggg

SEQ ID NO: 2776257 - DNA, 19 bp, Homo sapiens
tggtggaccacaggcatct

SEQ ID NO: 2776258 - DNA, 23 bp, Homo sapiens
tggtggctgtctctgtccctcac

SEQ ID NO: 2776259 - DNA, 15 bp, Homo sapiens
tggtggtatctgagt

SEQ ID NO: 2776260 - DNA, 12 bp, Homo sapiens
tggtgtaatgca

SEQ ID NO: 2776261 - DNA, 16 bp, Homo sapiens
tggtgtaatgcacaat

SEQ ID NO: 2776262 - DNA, 17 bp, Homo sapiens
tggtgtaatgcacaatt

SEQ ID NO: 2776263 - DNA, 19 bp, Homo sapiens
tggtgtaatgcacaattta

SEQ ID NO: 2776264 - DNA, 22 bp, Homo sapiens
tggtgtaatgcacaatttagaa

SEQ ID NO: 2776265 - DNA, 16 bp, Homo sapiens
tggtgtcacctgaaga

SEQ ID NO: 2776266 - DNA, 15 bp, Homo sapiens
tggtgtgaaagtcag

SEQ ID NO: 2776267 - DNA, 21 bp, Homo sapiens
tggtgttctcaatgcttttct

SEQ ID NO: 2776268 - DNA, 20 bp, Homo sapiens
tggttcagggttggcccctg

SEQ ID NO: 2776269 - DNA, 21 bp, Homo sapiens
tggttcccaataaaagtgact

SEQ ID NO: 2776270 - DNA, 22 bp, Homo sapiens
tggttgaggtggaagccctcct

SEQ ID NO: 2776271 - DNA, 17 bp, Homo sapiens
tggttgtcaatattaaa

SEQ ID NO: 2776272 - DNA, 11 bp, Homo sapiens
tggtttactgc

SEQ ID NO: 2776273 - DNA, 14 bp, Homo sapiens
tggtttactgctgt

SEQ ID NO: 2776274 - DNA, 15 bp, Homo sapiens
tggtttactgctgtc

SEQ ID NO: 2776275 - DNA, 12 bp, Homo sapiens
tggtttatgtca

SEQ ID NO: 2776276 - DNA, 20 bp, Homo sapiens
tggtttccacgatgaaaaac

SEQ ID NO: 2776277 - DNA, 18 bp, Homo sapiens
tggtttctcagaatccaa

SEQ ID NO: 2776278 - DNA, 17 bp, Homo sapiens
tggtttgcaaggaagcc

SEQ ID NO: 2776279 - DNA, 20 bp, Homo sapiens
tggttttctccaagagctac

SEQ ID NO: 2776280 - DNA, 13 bp, Homo sapiens
tggtttttatatt

SEQ ID NO: 2776281 - DNA, 15 bp, Homo sapiens
tgtaaaaaaggaaca

SEQ ID NO: 2776282 - DNA, 19 bp, Homo sapiens
tgtaaaacatttattttga

SEQ ID NO: 2776283 - DNA, 14 bp, Homo sapiens
tgtaaaataaaatt

SEQ ID NO: 2776284 - DNA, 22 bp, Homo sapiens
tgtaaaatcttggcacagaaac

SEQ ID NO: 2776285 - DNA, 14 bp, Homo sapiens
tgtaaaatgaaatt

SEQ ID NO: 2776286 - DNA, 15 bp, Homo sapiens
tgtaaaatgaaatta

SEQ ID NO: 2776287 - DNA, 19 bp, Homo sapiens
tgtaaaatgcagtccagaa

SEQ ID NO: 2776288 - DNA, 21 bp, Homo sapiens
tgtaaaatgcagtccagaata

SEQ ID NO: 2776289 - DNA, 12 bp, Homo sapiens
tgtaaacagtgc

SEQ ID NO: 2776290 - DNA, 19 bp, Homo sapiens
tgtaaacagtgcctgctga

SEQ ID NO: 2776291 - DNA, 16 bp, Homo sapiens
tgtaaacatagatagt

SEQ ID NO: 2776292 - DNA, 23 bp, Homo sapiens
tgtaaactcaaaatatttgtaca

SEQ ID NO: 2776293 - DNA, 18 bp, Homo sapiens
tgtaaactgcattagaaa

SEQ ID NO: 2776294 - DNA, 13 bp, Homo sapiens
tgtaaagcttgtc

SEQ ID NO: 2776295 - DNA, 16 bp, Homo sapiens
tgtaaagtgtaaatcc

SEQ ID NO: 2776296 - DNA, 17 bp, Homo sapiens
tgtaaagtgtaaatcct

SEQ ID NO: 2776297 - DNA, 21 bp, Homo sapiens
tgtaaatacaaaataaaatta

SEQ ID NO: 2776298 - DNA, 14 bp, Homo sapiens
tgtaaatattgtgt

SEQ ID NO: 2776299 - DNA, 15 bp, Homo sapiens
tgtaaatattgtgtg

SEQ ID NO: 2776300 - DNA, 18 bp, Homo sapiens
tgtaaatattttaaagaa

SEQ ID NO: 2776301 - DNA, 20 bp, Homo sapiens
tgtaaatattttaaagaatt

SEQ ID NO: 2776302 - DNA, 17 bp, Homo sapiens
tgtaaatggagcttgta

SEQ ID NO: 2776303 - DNA, 18 bp, Homo sapiens
tgtaaatggagcttgtac

SEQ ID NO: 2776304 - DNA, 20 bp, Homo sapiens
tgtaaatggagcttgtacat

SEQ ID NO: 2776305 - DNA, 16 bp, Homo sapiens
tgtaaatttggattta

SEQ ID NO: 2776306 - DNA, 14 bp, Homo sapiens
tgtaacaagccacc

SEQ ID NO: 2776307 - DNA, 15 bp, Homo sapiens
tgtaacacaagccac

SEQ ID NO: 2776308 - DNA, 12 bp, Homo sapiens
tgtaactccacc

SEQ ID NO: 2776309 - DNA, 13 bp, Homo sapiens
tgtaactccacca

SEQ ID NO: 2776310 - DNA, 15 bp, Homo sapiens
tgtaaggaactggaa

SEQ ID NO: 2776311 - DNA, 21 bp, Homo sapiens
tgtaagtaattgcatttctgc

SEQ ID NO: 2776312 - DNA, 23 bp, Homo sapiens
tgtaagtaattgcatttctgctc

SEQ ID NO: 2776313 - DNA, 11 bp, Homo sapiens
tgtaataaact

SEQ ID NO: 2776314 - DNA, 13 bp, Homo sapiens
tgtaataaactct

SEQ ID NO: 2776315 - DNA, 17 bp, Homo sapiens
tgtaataaactctctag

SEQ ID NO: 2776316 - DNA, 18 bp, Homo sapiens
tgtaatagatgtttgata

SEQ ID NO: 2776317 - DNA, 16 bp, Homo sapiens
tgtaatcccagctact

SEQ ID NO: 2776318 - DNA, 23 bp, Homo sapiens
tgtaatcccagctactcaggagg

SEQ ID NO: 2776319 - DNA, 22 bp, Homo sapiens
tgtaatcctcagctgacacata

SEQ ID NO: 2776320 - DNA, 16 bp, Homo sapiens
tgtaatcgttatgtgt

SEQ ID NO: 2776321 - DNA, 22 bp, Homo sapiens
tgtaatgcacaatttagaaaac

SEQ ID NO: 2776322 - DNA, 19 bp, Homo sapiens
tgtaatgtcaccaccttcc

SEQ ID NO: 2776323 - DNA, 20 bp, Homo sapiens
tgtaatgtcaccaccttccc

SEQ ID NO: 2776324 - DNA, 14 bp, Homo sapiens
tgtaattctaaatg

SEQ ID NO: 2776325 - DNA, 15 bp, Homo sapiens
tgtaattgaataaag

SEQ ID NO: 2776326 - DNA, 17 bp, Homo sapiens
tgtaattggtgacaatg

SEQ ID NO: 2776327 - DNA, 15 bp, Homo sapiens
tgtaattttgtagta

SEQ ID NO: 2776328 - DNA, 19 bp, Homo sapiens
tgtaattttgtttgtaatc

SEQ ID NO: 2776329 - DNA, 13 bp, Homo sapiens
tgtacaaaataaa

SEQ ID NO: 2776330 - DNA, 17 bp, Homo sapiens
tgtacaaagtagagaag

SEQ ID NO: 2776331 - DNA, 19 bp, Homo sapiens
tgtacaaagtagagaagta

SEQ ID NO: 2776332 - DNA, 23 bp, Homo sapiens
tgtacaattgaacttaaataaat

SEQ ID NO: 2776333 - DNA, 19 bp, Homo sapiens
tgtacagaatttttaatga

SEQ ID NO: 2776334 - DNA, 17 bp, Homo sapiens
tgtacagacgtatgctt

SEQ ID NO: 2776335 - DNA, 18 bp, Homo sapiens
tgtacagacgtatgctta

SEQ ID NO: 2776336 - DNA, 19 bp, Homo sapiens
tgtacagacgtatgcttat

SEQ ID NO: 2776337 - DNA, 19 bp, Homo sapiens
tgtacagtgtgtaaagtgt

SEQ ID NO: 2776338 - DNA, 17 bp, Homo sapiens
tgtacagttatctaagt

SEQ ID NO: 2776339 - DNA, 18 bp, Homo sapiens
tgtacagttatctaagtt

SEQ ID NO: 2776340 - DNA, 22 bp, Homo sapiens
tgtacagttatctaagttaatt

SEQ ID NO: 2776341 - DNA, 17 bp, Homo sapiens
tgtacatatggaaatcc

SEQ ID NO: 2776342 - DNA, 16 bp, Homo sapiens
tgtacatatgtaaaat

SEQ ID NO: 2776343 - DNA, 18 bp, Homo sapiens
tgtacatatgtaaaataa

SEQ ID NO: 2776344 - DNA, 21 bp, Homo sapiens
tgtacatatgtaaaataaaat

SEQ ID NO: 2776345 - DNA, 22 bp, Homo sapiens
tgtacatgaagaagctaaatcc

SEQ ID NO: 2776346 - DNA, 20 bp, Homo sapiens
tgtacatgtgtagcctgtgc

SEQ ID NO: 2776347 - DNA, 14 bp, Homo sapiens
tgtacattaattac

SEQ ID NO: 2776348 - DNA, 13 bp, Homo sapiens
tgtacatttctga

SEQ ID NO: 2776349 - DNA, 20 bp, Homo sapiens
tgtaccagtgtactgctttc

SEQ ID NO: 2776350 - DNA, 14 bp, Homo sapiens
tgtaccatgttaaa

SEQ ID NO: 2776351 - DNA, 16 bp, Homo sapiens
tgtacccaatttaatt

SEQ ID NO: 2776352 - DNA, 20 bp, Homo sapiens
tgtacccaccgggccactcc

SEQ ID NO: 2776353 - DNA, 16 bp, Homo sapiens
tgtacccactcctcac

SEQ ID NO: 2776354 - DNA, 16 bp, Homo sapiens
tgtacgaacccctccc

SEQ ID NO: 2776355 - DNA, 16 bp, Homo sapiens
tgtacgtctgacaggc

SEQ ID NO: 2776356 - DNA, 19 bp, Homo sapiens
tgtactatggctgtatttt

SEQ ID NO: 2776357 - DNA, 12 bp, Homo sapiens
tgtactgaaaaa

SEQ ID NO: 2776358 - DNA, 13 bp, Homo sapiens
tgtactgcctgct

SEQ ID NO: 2776359 - DNA, 13 bp, Homo sapiens
tgtactgctttca

SEQ ID NO: 2776360 - DNA, 22 bp, Homo sapiens
tgtactgtaattttgtttgtaa

SEQ ID NO: 2776361 - DNA, 23 bp, Homo sapiens
tgtactgtaattttgtttgtaat

SEQ ID NO: 2776362 - DNA, 21 bp, Homo sapiens
tgtacttaataaattcagata

SEQ ID NO: 2776363 - DNA, 14 bp, Homo sapiens
tgtacttcaagtta

SEQ ID NO: 2776364 - DNA, 16 bp, Homo sapiens
tgtagattgtgtaaat

SEQ ID NO: 2776365 - DNA, 16 bp, Homo sapiens
tgtagcatcttctgga

SEQ ID NO: 2776366 - DNA, 12 bp, Homo sapiens
tgtagccagccg

SEQ ID NO: 2776367 - DNA, 15 bp, Homo sapiens
tgtagccagccgggg

SEQ ID NO: 2776368 - DNA, 22 bp, Homo sapiens
tgtagcctcgccgtctgtgaat

SEQ ID NO: 2776369 - DNA, 11 bp, Homo sapiens
tgtagctgtga

SEQ ID NO: 2776370 - DNA, 14 bp, Homo sapiens
tgtaggagggactg

SEQ ID NO: 2776371 - DNA, 15 bp, Homo sapiens
tgtaggtcaatgaaa

SEQ ID NO: 2776372 - DNA, 18 bp, Homo sapiens
tgtaggtcaatgaaatat

SEQ ID NO: 2776373 - DNA, 19 bp, Homo sapiens
tgtagtaatctgcattatt

SEQ ID NO: 2776374 - DNA, 15 bp, Homo sapiens
tgtagtcccagccac

SEQ ID NO: 2776375 - DNA, 17 bp, Homo sapiens
tgtagtgagaaactgat

SEQ ID NO: 2776376 - DNA, 12 bp, Homo sapiens
tgtagttaggaa

SEQ ID NO: 2776377 - DNA, 15 bp, Homo sapiens
tgtagttgcgtggac

SEQ ID NO: 2776378 - DNA, 19 bp, Homo sapiens
tgtatagatgcaagatatt

SEQ ID NO: 2776379 - DNA, 23 bp, Homo sapiens
tgtatagttttataaaactcagt

SEQ ID NO: 2776380 - DNA, 16 bp, Homo sapiens
tgtatatacaataaca

SEQ ID NO: 2776381 - DNA, 16 bp, Homo sapiens
tgtatatgtatatcta

SEQ ID NO: 2776382 - DNA, 23 bp, Homo sapiens
tgtatattatggaagattttaaa

SEQ ID NO: 2776383 - DNA, 23 bp, Homo sapiens
tgtatattatggtgtaatgcaca

SEQ ID NO: 2776384 - DNA, 21 bp, Homo sapiens
tgtatattccaccattcacat

SEQ ID NO: 2776385 - DNA, 16 bp, Homo sapiens
tgtatattgaaaagat

SEQ ID NO: 2776386 - DNA, 17 bp, Homo sapiens
tgtatcatagaaatgta

SEQ ID NO: 2776387 - DNA, 15 bp, Homo sapiens
tgtatcccatgagcc

SEQ ID NO: 2776388 - DNA, 16 bp, Homo sapiens
tgtatcccatgagcct

SEQ ID NO: 2776389 - DNA, 18 bp, Homo sapiens
tgtatcggagacagtgat

SEQ ID NO: 2776390 - DNA, 14 bp, Homo sapiens
tgtatctagctcta

SEQ ID NO: 2776391 - DNA, 23 bp, Homo sapiens
tgtatgtaagtaattgcatttct

SEQ ID NO: 2776392 - DNA, 13 bp, Homo sapiens
tgtatgtgaaagt

SEQ ID NO: 2776393 - DNA, 19 bp, Homo sapiens
tgtatgtgaaagtgtaaaa

SEQ ID NO: 2776394 - DNA, 14 bp, Homo sapiens
tgtatttataaata

SEQ ID NO: 2776395 - DNA, 15 bp, Homo sapiens
tgtatttatattaga

SEQ ID NO: 2776396 - DNA, 21 bp, Homo sapiens
tgtatttatattttgtgctat

SEQ ID NO: 2776397 - DNA, 17 bp, Homo sapiens
tgtatttattgtcatta

SEQ ID NO: 2776398 - DNA, 12 bp, Homo sapiens
tgtattttccat

SEQ ID NO: 2776399 - DNA, 13 bp, Homo sapiens
tgtcaaaatcatg

SEQ ID NO: 2776400 - DNA, 13 bp, Homo sapiens
tgtcaaacaaata

SEQ ID NO: 2776401 - DNA, 15 bp, Homo sapiens
tgtcaactatgatat

SEQ ID NO: 2776402 - DNA, 18 bp, Homo sapiens
tgtcaagagagagtcaaa

SEQ ID NO: 2776403 - DNA, 17 bp, Homo sapiens
tgtcaagtataaagtca

SEQ ID NO: 2776404 - DNA, 19 bp, Homo sapiens
tgtcaagtataaagtcagg

SEQ ID NO: 2776405 - DNA, 20 bp, Homo sapiens
tgtcaagtataaagtcagga

SEQ ID NO: 2776406 - DNA, 19 bp, Homo sapiens
tgtcaatattaaatacaga

SEQ ID NO: 2776407 - DNA, 21 bp, Homo sapiens
tgtcacaatcctaacacatta

SEQ ID NO: 2776408 - DNA, 14 bp, Homo sapiens
tgtcacaggcaggt

SEQ ID NO: 2776409 - DNA, 17 bp, Homo sapiens
tgtcacaggcaggtcca

SEQ ID NO: 2776410 - DNA, 16 bp, Homo sapiens
tgtcaccaccttccca

SEQ ID NO: 2776411 - DNA, 22 bp, Homo sapiens
tgtcaccagctgccaaaatcgt

SEQ ID NO: 2776412 - DNA, 16 bp, Homo sapiens
tgtcaccgtgagcagc

SEQ ID NO: 2776413 - DNA, 22 bp, Homo sapiens
tgtcaccgtgagcagctttgga

SEQ ID NO: 2776414 - DNA, 22 bp, Homo sapiens
tgtcaccgtggaccttcctgcc

SEQ ID NO: 2776415 - DNA, 19 bp, Homo sapiens
tgtcacgtcttgaaaagcc

SEQ ID NO: 2776416 - DNA, 22 bp, Homo sapiens
tgtcacgtgaaatatttaagta

SEQ ID NO: 2776417 - DNA, 22 bp, Homo sapiens
tgtcactactcacagtctcttt

SEQ ID NO: 2776418 - DNA, 14 bp, Homo sapiens
tgtcactcccagac

SEQ ID NO: 2776419 - DNA, 23 bp, Homo sapiens
tgtcactggtagaccaaaataaa

SEQ ID NO: 2776420 - DNA, 16 bp, Homo sapiens
tgtcagaaaccagtta

SEQ ID NO: 2776421 - DNA, 21 bp, Homo sapiens
tgtcagaaaccagttatgtga

SEQ ID NO: 2776422 - DNA, 14 bp, Homo sapiens
tgtcagactttaaa

SEQ ID NO: 2776423 - DNA, 15 bp, Homo sapiens
tgtcagatatgatat

SEQ ID NO: 2776424 - DNA, 21 bp, Homo sapiens
tgtcagatattttttcagaaa

SEQ ID NO: 2776425 - DNA, 21 bp, Homo sapiens
tgtcagccgagccgggcctgg

SEQ ID NO: 2776426 - DNA, 16 bp, Homo sapiens
tgtcaggaacagaagg

SEQ ID NO: 2776427 - DNA, 17 bp, Homo sapiens
tgtcaggaacagaagga

SEQ ID NO: 2776428 - DNA, 17 bp, Homo sapiens
tgtcaggtggggcagct

SEQ ID NO: 2776429 - DNA, 18 bp, Homo sapiens
tgtcaggtggggcagctt

SEQ ID NO: 2776430 - DNA, 15 bp, Homo sapiens
tgtcataagaatgaa

SEQ ID NO: 2776431 - DNA, 17 bp, Homo sapiens
tgtcataagaatgaata

SEQ ID NO: 2776432 - DNA, 21 bp, Homo sapiens
tgtcatatgtaggtgtctgca

SEQ ID NO: 2776433 - DNA, 12 bp, Homo sapiens
tgtcatattaaa

SEQ ID NO: 2776434 - DNA, 15 bp, Homo sapiens
tgtcatcaattaaag

SEQ ID NO: 2776435 - DNA, 14 bp, Homo sapiens
tgtcatccagaaaa

SEQ ID NO: 2776436 - DNA, 18 bp, Homo sapiens
tgtcatcccgctcctgct

SEQ ID NO: 2776437 - DNA, 17 bp, Homo sapiens
tgtcatgtaccatcaat

SEQ ID NO: 2776438 - DNA, 18 bp, Homo sapiens
tgtcattaaaataaataa

SEQ ID NO: 2776439 - DNA, 17 bp, Homo sapiens
tgtcattactgcctttg

SEQ ID NO: 2776440 - DNA, 12 bp, Homo sapiens
tgtcattcagga

SEQ ID NO: 2776441 - DNA, 14 bp, Homo sapiens
tgtcatttcatttc

SEQ ID NO: 2776442 - DNA, 17 bp, Homo sapiens
tgtcatttcatttccta

SEQ ID NO: 2776443 - DNA, 16 bp, Homo sapiens
tgtcatttgagcaggg

SEQ ID NO: 2776444 - DNA, 15 bp, Homo sapiens
tgtccaacctaaccc

SEQ ID NO: 2776445 - DNA, 21 bp, Homo sapiens
tgtccaacctaacccctttcc

SEQ ID NO: 2776446 - DNA, 14 bp, Homo sapiens
tgtccaaggaaact

SEQ ID NO: 2776447 - DNA, 16 bp, Homo sapiens
tgtccaatataaattg

SEQ ID NO: 2776448 - DNA, 12 bp, Homo sapiens
tgtccacctggc

SEQ ID NO: 2776449 - DNA, 17 bp, Homo sapiens
tgtccagggccctgagc

SEQ ID NO: 2776450 - DNA, 14 bp, Homo sapiens
tgtccagtttccaa

SEQ ID NO: 2776451 - DNA, 12 bp, Homo sapiens
tgtcccacctct

SEQ ID NO: 2776452 - DNA, 22 bp, Homo sapiens
tgtcccacctcttctcttcctg

SEQ ID NO: 2776453 - DNA, 16 bp, Homo sapiens
tgtcccaggtcctcac

SEQ ID NO: 2776454 - DNA, 19 bp, Homo sapiens
tgtcccatctgctcctccc

SEQ ID NO: 2776455 - DNA, 21 bp, Homo sapiens
tgtcccatttccttggaggcc

SEQ ID NO: 2776456 - DNA, 23 bp, Homo sapiens
tgtcccatttccttggaggccac

SEQ ID NO: 2776457 - DNA, 21 bp, Homo sapiens
tgtccccacgtatgtcggcac

SEQ ID NO: 2776458 - DNA, 14 bp, Homo sapiens
tgtcccctcttgac

SEQ ID NO: 2776459 - DNA, 19 bp, Homo sapiens
tgtccctacacccctcccc

SEQ ID NO: 2776460 - DNA, 19 bp, Homo sapiens
tgtccctcaaatgacccaa

SEQ ID NO: 2776461 - DNA, 22 bp, Homo sapiens
tgtccctcactgccttccagga

SEQ ID NO: 2776462 - DNA, 21 bp, Homo sapiens
tgtccctctcggaaggctggc

SEQ ID NO: 2776463 - DNA, 17 bp, Homo sapiens
tgtccctggtgcagagg

SEQ ID NO: 2776464 - DNA, 21 bp, Homo sapiens
tgtcccttttgcataagatta

SEQ ID NO: 2776465 - DNA, 15 bp, Homo sapiens
tgtccgactcttctg

SEQ ID NO: 2776466 - DNA, 11 bp, Homo sapiens
tgtcctcctcg

SEQ ID NO: 2776467 - DNA, 12 bp, Homo sapiens
tgtcctgggagt

SEQ ID NO: 2776468 - DNA, 15 bp, Homo sapiens
tgtcgagacacttgc

SEQ ID NO: 2776469 - DNA, 14 bp, Homo sapiens
tgtcgattagactg

SEQ ID NO: 2776470 - DNA, 23 bp, Homo sapiens
tgtcgattagactggacagcttg

SEQ ID NO: 2776471 - DNA, 15 bp, Homo sapiens
tgtcgcccagtctgg

SEQ ID NO: 2776472 - DNA, 23 bp, Homo sapiens
tgtcggttttttttaaataaaag

SEQ ID NO: 2776473 - DNA, 18 bp, Homo sapiens
tgtcgtttttttcttgtg

SEQ ID NO: 2776474 - DNA, 18 bp, Homo sapiens
tgtctataatggaaacat

SEQ ID NO: 2776475 - DNA, 18 bp, Homo sapiens
tgtctattacctgttagt

SEQ ID NO: 2776476 - DNA, 19 bp, Homo sapiens
tgtctattcaaaatatcaa

SEQ ID NO: 2776477 - DNA, 17 bp, Homo sapiens
tgtctccactaaatgag

SEQ ID NO: 2776478 - DNA, 15 bp, Homo sapiens
tgtctcgagcgccct

SEQ ID NO: 2776479 - DNA, 12 bp, Homo sapiens
tgtctctcatga

SEQ ID NO: 2776480 - DNA, 19 bp, Homo sapiens
tgtctctgtccctcactgc

SEQ ID NO: 2776481 - DNA, 21 bp, Homo sapiens
tgtctctttaatgtcacaggc

SEQ ID NO: 2776482 - DNA, 21 bp, Homo sapiens
tgtctggtggtggcaccatct

SEQ ID NO: 2776483 - DNA, 14 bp, Homo sapiens
tgtctgtaagagaa

SEQ ID NO: 2776484 - DNA, 15 bp, Homo sapiens
tgtctgtctgtccca

SEQ ID NO: 2776485 - DNA, 15 bp, Homo sapiens
tgtctgtggattttt

SEQ ID NO: 2776486 - DNA, 13 bp, Homo sapiens
tgtcttccataat

SEQ ID NO: 2776487 - DNA, 20 bp, Homo sapiens
tgtcttgcaatggcagcctt

SEQ ID NO: 2776488 - DNA, 18 bp, Homo sapiens
tgtcttgccagccagaag

SEQ ID NO: 2776489 - DNA, 21 bp, Homo sapiens
tgtctttaggcagcagctttt

SEQ ID NO: 2776490 - DNA, 16 bp, Homo sapiens
tgtgaaagtatgtgat

SEQ ID NO: 2776491 - DNA, 23 bp, Homo sapiens
tgtgaaattcaacctgtgtctta

SEQ ID NO: 2776492 - DNA, 16 bp, Homo sapiens
tgtgaaccaccacacc

SEQ ID NO: 2776493 - DNA, 19 bp, Homo sapiens
tgtgaaccaccacacccag

SEQ ID NO: 2776494 - DNA, 20 bp, Homo sapiens
tgtgaaccaccacacccagc

SEQ ID NO: 2776495 - DNA, 21 bp, Homo sapiens
tgtgaaccaccacacccagcc

SEQ ID NO: 2776496 - DNA, 22 bp, Homo sapiens
tgtgaaccaccacacccagccc

SEQ ID NO: 2776497 - DNA, 13 bp, Homo sapiens
tgtgaacccagga

SEQ ID NO: 2776498 - DNA, 21 bp, Homo sapiens
tgtgaacccaggacaagcatg

SEQ ID NO: 2776499 - DNA, 21 bp, Homo sapiens
tgtgaacgatttagaaagaag

SEQ ID NO: 2776500 - DNA, 14 bp, Homo sapiens
tgtgaatcagaccc

SEQ ID NO: 2776501 - DNA, 15 bp, Homo sapiens
tgtgaatcagaccct

SEQ ID NO: 2776502 - DNA, 18 bp, Homo sapiens
tgtgaatcagaccctacc

SEQ ID NO: 2776503 - DNA, 14 bp, Homo sapiens
tgtgacaacctttg

SEQ ID NO: 2776504 - DNA, 15 bp, Homo sapiens
tgtgacaacctttgt

SEQ ID NO: 2776505 - DNA, 16 bp, Homo sapiens
tgtgacaacctttgtg

SEQ ID NO: 2776506 - DNA, 17 bp, Homo sapiens
tgtgacacatatgcacc

SEQ ID NO: 2776507 - DNA, 21 bp, Homo sapiens
tgtgacaggaagcccaaggca

SEQ ID NO: 2776508 - DNA, 21 bp, Homo sapiens
tgtgacccagatcctcacaac

SEQ ID NO: 2776509 - DNA, 13 bp, Homo sapiens
tgtgacctgctga

SEQ ID NO: 2776510 - DNA, 14 bp, Homo sapiens
tgtgacctgctgag

SEQ ID NO: 2776511 - DNA, 22 bp, Homo sapiens
tgtgacctgctgagctctgaga

SEQ ID NO: 2776512 - DNA, 22 bp, Homo sapiens
tgtgactgatgttacatcacag

SEQ ID NO: 2776513 - DNA, 18 bp, Homo sapiens
tgtgacttcagctctgtt

SEQ ID NO: 2776514 - DNA, 19 bp, Homo sapiens
tgtgacttcagctctgttt

SEQ ID NO: 2776515 - DNA, 15 bp, Homo sapiens
tgtgagaagaaatga

SEQ ID NO: 2776516 - DNA, 18 bp, Homo sapiens
tgtgagcatctctgtgta

SEQ ID NO: 2776517 - DNA, 19 bp, Homo sapiens
tgtgagcatctctgtgtac

SEQ ID NO: 2776518 - DNA, 23 bp, Homo sapiens
tgtgaggattatgggtcctgcaa

SEQ ID NO: 2776519 - DNA, 23 bp, Homo sapiens
tgtgatcccaagtgccagtcttg

SEQ ID NO: 2776520 - DNA, 13 bp, Homo sapiens
tgtgatgctggta

SEQ ID NO: 2776521 - DNA, 20 bp, Homo sapiens
tgtgatgggatctgtaagga

SEQ ID NO: 2776522 - DNA, 14 bp, Homo sapiens
tgtgatggggtggg

SEQ ID NO: 2776523 - DNA, 12 bp, Homo sapiens
tgtgcaaatcct

SEQ ID NO: 2776524 - DNA, 20 bp, Homo sapiens
tgtgcatggaaatgtcctcc

SEQ ID NO: 2776525 - DNA, 20 bp, Homo sapiens
tgtgcatgtatgtcttggac

SEQ ID NO: 2776526 - DNA, 21 bp, Homo sapiens
tgtgccagagcctggggctct

SEQ ID NO: 2776527 - DNA, 12 bp, Homo sapiens
tgtgccatgtgc

SEQ ID NO: 2776528 - DNA, 14 bp, Homo sapiens
tgtgcccacaggga

SEQ ID NO: 2776529 - DNA, 21 bp, Homo sapiens
tgtgcccacatcccaggcttc

SEQ ID NO: 2776530 - DNA, 16 bp, Homo sapiens
tgtgcctcctcacccc

SEQ ID NO: 2776531 - DNA, 20 bp, Homo sapiens
tgtgcctcgctccccactct

SEQ ID NO: 2776532 - DNA, 14 bp, Homo sapiens
tgtgcctctgcctg

SEQ ID NO: 2776533 - DNA, 15 bp, Homo sapiens
tgtgcctgaccctac

SEQ ID NO: 2776534 - DNA, 12 bp, Homo sapiens
tgtgcctggaaa

SEQ ID NO: 2776535 - DNA, 12 bp, Homo sapiens
tgtgctctgatc

SEQ ID NO: 2776536 - DNA, 22 bp, Homo sapiens
tgtgctctgatcatccactgtg

SEQ ID NO: 2776537 - DNA, 23 bp, Homo sapiens
tgtgctctgatcatccactgtgc

SEQ ID NO: 2776538 - DNA, 13 bp, Homo sapiens
tgtgcttatgttt

SEQ ID NO: 2776539 - DNA, 19 bp, Homo sapiens
tgtggaaagcctctgctgc

SEQ ID NO: 2776540 - DNA, 16 bp, Homo sapiens
tgtggacacagctctt

SEQ ID NO: 2776541 - DNA, 17 bp, Homo sapiens
tgtggatgtgtaaatgg

SEQ ID NO: 2776542 - DNA, 23 bp, Homo sapiens
tgtggatgtgtaaatggagcttg

SEQ ID NO: 2776543 - DNA, 14 bp, Homo sapiens
tgtggcaagtgaat

SEQ ID NO: 2776544 - DNA, 20 bp, Homo sapiens
tgtggccctggcctgctggg

SEQ ID NO: 2776545 - DNA, 20 bp, Homo sapiens
tgtggcgttctgctgcccct

SEQ ID NO: 2776546 - DNA, 19 bp, Homo sapiens
tgtggctgcagagaccttg

SEQ ID NO: 2776547 - DNA, 17 bp, Homo sapiens
tgtggctttctttcttt

SEQ ID NO: 2776548 - DNA, 22 bp, Homo sapiens
tgtgggacacctcaaatacata

SEQ ID NO: 2776549 - DNA, 12 bp, Homo sapiens
tgtgggagcctc

SEQ ID NO: 2776550 - DNA, 16 bp, Homo sapiens
tgtggtggctgtctct

SEQ ID NO: 2776551 - DNA, 14 bp, Homo sapiens
tgtggtggggagag

SEQ ID NO: 2776552 - DNA, 20 bp, Homo sapiens
tgtggttaatgccatggaca

SEQ ID NO: 2776553 - DNA, 22 bp, Homo sapiens
tgtgtaataaaaatttgtttaa

SEQ ID NO: 2776554 - DNA, 19 bp, Homo sapiens
tgtgtacaaagtagagaag

SEQ ID NO: 2776555 - DNA, 23 bp, Homo sapiens
tgtgtacagaattctgctacctc

SEQ ID NO: 2776556 - DNA, 18 bp, Homo sapiens
tgtgtacttcagtcttgg

SEQ ID NO: 2776557 - DNA, 14 bp, Homo sapiens
tgtgtagcctgtgc

SEQ ID NO: 2776558 - DNA, 16 bp, Homo sapiens
tgtgtagcctgtgcat

SEQ ID NO: 2776559 - DNA, 23 bp, Homo sapiens
tgtgtagcctgtgcatgtatgtc

SEQ ID NO: 2776560 - DNA, 14 bp, Homo sapiens
tgtgtagctttgct

SEQ ID NO: 2776561 - DNA, 20 bp, Homo sapiens
tgtgtagggcttttttttga

SEQ ID NO: 2776562 - DNA, 14 bp, Homo sapiens
tggagcggctctcc

SEQ ID NO: 2776563 - DNA, 17 bp, Homo sapiens
tggaggacctgagcctg

SEQ ID NO: 2776564 - DNA, 19 bp, Homo sapiens
tggaggacctgagcctgcc

SEQ ID NO: 2776565 - DNA, 15 bp, Homo sapiens
tggaggatggagaga

SEQ ID NO: 2776566 - DNA, 22 bp, Homo sapiens
tggaggcagggccttgcccaga

SEQ ID NO: 2776567 - DNA, 16 bp, Homo sapiens
tggagggaagacaggt

SEQ ID NO: 2776568 - DNA, 14 bp, Homo sapiens
tggaggtacactct

SEQ ID NO: 2776569 - DNA, 18 bp, Homo sapiens
tggaggtcacattcagga

SEQ ID NO: 2776570 - DNA, 13 bp, Homo sapiens
tggagtctccagt

SEQ ID NO: 2776571 - DNA, 13 bp, Homo sapiens
tggagttcagaga

SEQ ID NO: 2776572 - DNA, 16 bp, Homo sapiens
tggagttcttgtgcca

SEQ ID NO: 2776573 - DNA, 14 bp, Homo sapiens
tggataagcgtggg

SEQ ID NO: 2776574 - DNA, 17 bp, Homo sapiens
tggatatgtaaaacatt

SEQ ID NO: 2776575 - DNA, 18 bp, Homo sapiens
tggatcagcgtggccttg

SEQ ID NO: 2776576 - DNA, 20 bp, Homo sapiens
tggatctgggaccctttcct

SEQ ID NO: 2776577 - DNA, 21 bp, Homo sapiens
tggatctgggaccctttcctt

SEQ ID NO: 2776578 - DNA, 15 bp, Homo sapiens
tggatgcctggtggc

SEQ ID NO: 2776579 - DNA, 19 bp, Homo sapiens
tggatgcctggtggcagct

SEQ ID NO: 2776580 - DNA, 20 bp, Homo sapiens
tggatgcctggtggcagctg

SEQ ID NO: 2776581 - DNA, 17 bp, Homo sapiens
tggatgggagtgagaca

SEQ ID NO: 2776582 - DNA, 18 bp, Homo sapiens
tggatgtagtctgaggcc

SEQ ID NO: 2776583 - DNA, 23 bp, Homo sapiens
tggatgtggggtccccatcatcc

SEQ ID NO: 2776584 - DNA, 17 bp, Homo sapiens
tggattaattaaatgca

SEQ ID NO: 2776585 - DNA, 16 bp, Homo sapiens
tggattcctaagcagt

SEQ ID NO: 2776586 - DNA, 22 bp, Homo sapiens
tggattcctaagcagtgcttgt

SEQ ID NO: 2776587 - DNA, 13 bp, Homo sapiens
tggattctaaaat

SEQ ID NO: 2776588 - DNA, 15 bp, Homo sapiens
tggattctaaaatgc

SEQ ID NO: 2776589 - DNA, 13 bp, Homo sapiens
tggattgagggta

SEQ ID NO: 2776590 - DNA, 19 bp, Homo sapiens
tggatttacgactgaagaa

SEQ ID NO: 2776591 - DNA, 19 bp, Homo sapiens
tggatttcctattttaaaa

SEQ ID NO: 2776592 - DNA, 14 bp, Homo sapiens
tggatttttacaaa

SEQ ID NO: 2776593 - DNA, 13 bp, Homo sapiens
tggcaacagagca

SEQ ID NO: 2776594 - DNA, 15 bp, Homo sapiens
tggcaattttgtaac

SEQ ID NO: 2776595 - DNA, 14 bp, Homo sapiens
tggcacagaaacac

SEQ ID NO: 2776596 - DNA, 18 bp, Homo sapiens
tggcaccactgcactcca

SEQ ID NO: 2776597 - DNA, 19 bp, Homo sapiens
tggcaccagaggctgcaga

SEQ ID NO: 2776598 - DNA, 23 bp, Homo sapiens
tggcaccagaggctgcagaaggc

SEQ ID NO: 2776599 - DNA, 18 bp, Homo sapiens
tggcacccggcccctgct

SEQ ID NO: 2776600 - DNA, 16 bp, Homo sapiens
tggcagagaaggcttc

SEQ ID NO: 2776601 - DNA, 19 bp, Homo sapiens
tggcagagaaggcttcctc

SEQ ID NO: 2776602 - DNA, 21 bp, Homo sapiens
tggcagagaaggcttcctcca

SEQ ID NO: 2776603 - DNA, 19 bp, Homo sapiens
tggcagccacacttctcag

SEQ ID NO: 2776604 - DNA, 15 bp, Homo sapiens
tggcagccaccccct

SEQ ID NO: 2776605 - DNA, 21 bp, Homo sapiens
tggcagctgcggtccacccag

SEQ ID NO: 2776606 - DNA, 17 bp, Homo sapiens
tggcagctggaatttaa

SEQ ID NO: 2776607 - DNA, 18 bp, Homo sapiens
tggcagctgtcattcagg

SEQ ID NO: 2776608 - DNA, 23 bp, Homo sapiens
tggcaggagaatcaataaaaatc

SEQ ID NO: 2776609 - DNA, 21 bp, Homo sapiens
tggcaggccgaggcaggtgga

SEQ ID NO: 2776610 - DNA, 15 bp, Homo sapiens
tggcagtccagccag

SEQ ID NO: 2776611 - DNA, 18 bp, Homo sapiens
tggcagtccagccagctc

SEQ ID NO: 2776612 - DNA, 23 bp, Homo sapiens
tggcagtgtgtcacactgagctg

SEQ ID NO: 2776613 - DNA, 20 bp, Homo sapiens
tggcagtttatatttaactc

SEQ ID NO: 2776614 - DNA, 22 bp, Homo sapiens
tggcatacgcctgtagtcctag

SEQ ID NO: 2776615 - DNA, 15 bp, Homo sapiens
tggcatcacagggca

SEQ ID NO: 2776616 - DNA, 18 bp, Homo sapiens
tggcatcccctttattaa

SEQ ID NO: 2776617 - DNA, 14 bp, Homo sapiens
tggccaaagtgtta

SEQ ID NO: 2776618 - DNA, 17 bp, Homo sapiens
tggccaagctgaggtgc

SEQ ID NO: 2776619 - DNA, 19 bp, Homo sapiens
tggccaagctgaggtgccc

SEQ ID NO: 2776620 - DNA, 22 bp, Homo sapiens
tggccaagctgaggtgcccagg

SEQ ID NO: 2776621 - DNA, 22 bp, Homo sapiens
tggccacccgttctgctggcct

SEQ ID NO: 2776622 - DNA, 15 bp, Homo sapiens
tggccagatgcacca

SEQ ID NO: 2776623 - DNA, 17 bp, Homo sapiens
tggccagatgcaccagc

SEQ ID NO: 2776624 - DNA, 20 bp, Homo sapiens
tggccaggcaccccctggag

SEQ ID NO: 2776625 - DNA, 17 bp, Homo sapiens
tggccaggctggtctca

SEQ ID NO: 2776626 - DNA, 12 bp, Homo sapiens
tggccagggtga

SEQ ID NO: 2776627 - DNA, 16 bp, Homo sapiens
tggccatgcttcttgc

SEQ ID NO: 2776628 - DNA, 19 bp, Homo sapiens
tggccatgcttcttgcccc

SEQ ID NO: 2776629 - DNA, 20 bp, Homo sapiens
tggccatgggctgagcaggc

SEQ ID NO: 2776630 - DNA, 17 bp, Homo sapiens
tggccatgtcgcctgcc

SEQ ID NO: 2776631 - DNA, 21 bp, Homo sapiens
tggccatgtcgcctgccccca

SEQ ID NO: 2776632 - DNA, 14 bp, Homo sapiens
tggccatttgcttt

SEQ ID NO: 2776633 - DNA, 13 bp, Homo sapiens
tggcccagaattg

SEQ ID NO: 2776634 - DNA, 22 bp, Homo sapiens
tggccccagcccgacaggcatg

SEQ ID NO: 2776635 - DNA, 15 bp, Homo sapiens
tggcccccctccagg

SEQ ID NO: 2776636 - DNA, 14 bp, Homo sapiens
tggcccctgtgtga

SEQ ID NO: 2776637 - DNA, 12 bp, Homo sapiens
tggccctgcctt

SEQ ID NO: 2776638 - DNA, 16 bp, Homo sapiens
tggccctgccttcttc

SEQ ID NO: 2776639 - DNA, 13 bp, Homo sapiens
tggccctggcctg

SEQ ID NO: 2776640 - DNA, 17 bp, Homo sapiens
tggcccttcctggacag

SEQ ID NO: 2776641 - DNA, 21 bp, Homo sapiens
tggcccttcctggacagctgt

SEQ ID NO: 2776642 - DNA, 13 bp, Homo sapiens
tggccgactcagg

SEQ ID NO: 2776643 - DNA, 19 bp, Homo sapiens
tggccggcaaccccagttc

SEQ ID NO: 2776644 - DNA, 14 bp, Homo sapiens
tggccggctccagt

SEQ ID NO: 2776645 - DNA, 17 bp, Homo sapiens
tggccgggtgcggtggc

SEQ ID NO: 2776646 - DNA, 18 bp, Homo sapiens
tgggagcctgaggcatga

SEQ ID NO: 2776647 - DNA, 20 bp, Homo sapiens
tgggagcctgcaaactcact

SEQ ID NO: 2776648 - DNA, 16 bp, Homo sapiens
tgggagcttgggaatg

SEQ ID NO: 2776649 - DNA, 24 bp, Homo sapiens
tgggaggaagcaggttgaggggct

SEQ ID NO: 2776650 - DNA, 13 bp, Homo sapiens
tgggaggtcgagg

SEQ ID NO: 2776651 - DNA, 15 bp, Homo sapiens
tgggagtgagctggt

SEQ ID NO: 2776652 - DNA, 15 bp, Homo sapiens
tgggatctgtaagga

SEQ ID NO: 2776653 - DNA, 14 bp, Homo sapiens
tgggatggaggaga

SEQ ID NO: 2776654 - DNA, 14 bp, Homo sapiens
tgggatgtttctgt

SEQ ID NO: 2776655 - DNA, 19 bp, Homo sapiens
tgctcaggcttgaaatgca

SEQ ID NO: 2776656 - DNA, 22 bp, Homo sapiens
tgctccaagtggtgggaatcag

SEQ ID NO: 2776657 - DNA, 15 bp, Homo sapiens
tgctcccagcagccc

SEQ ID NO: 2776658 - DNA, 21 bp, Homo sapiens
tgctcccagcagccctaagga

SEQ ID NO: 2776659 - DNA, 16 bp, Homo sapiens
tgctcccccaccccct

SEQ ID NO: 2776660 - DNA, 21 bp, Homo sapiens
tgctcccccaccccctcccca

SEQ ID NO: 2776661 - DNA, 21 bp, Homo sapiens
tgctcctccagggccacgtgc

SEQ ID NO: 2776662 - DNA, 22 bp, Homo sapiens
tgctcctccagggccacgtgcc

SEQ ID NO: 2776663 - DNA, 12 bp, Homo sapiens
tgctcctctcca

SEQ ID NO: 2776664 - DNA, 13 bp, Homo sapiens
tgctcctctccag

SEQ ID NO: 2776665 - DNA, 16 bp, Homo sapiens
tgctcctctccaggca

SEQ ID NO: 2776666 - DNA, 18 bp, Homo sapiens
tgctcctctccccagcaa

SEQ ID NO: 2776667 - DNA, 21 bp, Homo sapiens
tgctcctgtacgaacccctcc

SEQ ID NO: 2776668 - DNA, 14 bp, Homo sapiens
tgctcgaagaacaa

SEQ ID NO: 2776669 - DNA, 16 bp, Homo sapiens
tgctcggggtgcacag

SEQ ID NO: 2776670 - DNA, 21 bp, Homo sapiens
tgctcggggtgcacaggaggg

SEQ ID NO: 2776671 - DNA, 21 bp, Homo sapiens
tgctctattgtagcatttctt

SEQ ID NO: 2776672 - DNA, 13 bp, Homo sapiens
tgctctcagcctc

SEQ ID NO: 2776673 - DNA, 15 bp, Homo sapiens
tgctctcagcctccc

SEQ ID NO: 2776674 - DNA, 23 bp, Homo sapiens
tgctctccgaccagacaccttga

SEQ ID NO: 2776675 - DNA, 14 bp, Homo sapiens
tgctctcctcttgc

SEQ ID NO: 2776676 - DNA, 16 bp, Homo sapiens
tgctctcctcttgcca

SEQ ID NO: 2776677 - DNA, 17 bp, Homo sapiens
tgctctctgcagccagc

SEQ ID NO: 2776678 - DNA, 19 bp, Homo sapiens
tgctctgatcatccactgt

SEQ ID NO: 2776679 - DNA, 14 bp, Homo sapiens
tgctctgctgacag

SEQ ID NO: 2776680 - DNA, 16 bp, Homo sapiens
tgctctggacaggcat

SEQ ID NO: 2776681 - DNA, 18 bp, Homo sapiens
tgctcttagctgtctgct

SEQ ID NO: 2776682 - DNA, 15 bp, Homo sapiens
tgctcttccaaagct

SEQ ID NO: 2776683 - DNA, 12 bp, Homo sapiens
tgctcttgcctg

SEQ ID NO: 2776684 - DNA, 13 bp, Homo sapiens
tgctcttgcctgc

SEQ ID NO: 2776685 - DNA, 14 bp, Homo sapiens
tgctcttgcctgca

SEQ ID NO: 2776686 - DNA, 21 bp, Homo sapiens
tgctcttgcctgcacccttcc

SEQ ID NO: 2776687 - DNA, 23 bp, Homo sapiens
tgctgaaacacacaggccatttc

SEQ ID NO: 2776688 - DNA, 15 bp, Homo sapiens
tgctgaaacacctcc

SEQ ID NO: 2776689 - DNA, 19 bp, Homo sapiens
tgctgaaacacctcccagg

SEQ ID NO: 2776690 - DNA, 13 bp, Homo sapiens
tgctgaagggacc

SEQ ID NO: 2776691 - DNA, 16 bp, Homo sapiens
tgctgacagacacagg

SEQ ID NO: 2776692 - DNA, 19 bp, Homo sapiens
tgctgagaacctggccttc

SEQ ID NO: 2776693 - DNA, 21 bp, Homo sapiens
tgctgagaacctggccttcag

SEQ ID NO: 2776694 - DNA, 15 bp, Homo sapiens
tgctgagagacccaa

SEQ ID NO: 2776695 - DNA, 17 bp, Homo sapiens
tgctgagagacccaagg

SEQ ID NO: 2776696 - DNA, 13 bp, Homo sapiens
tgctgagctctga

SEQ ID NO: 2776697 - DNA, 14 bp, Homo sapiens
tgctgagctctgag

SEQ ID NO: 2776698 - DNA, 22 bp, Homo sapiens
tgctgagctctgagaggccctg

SEQ ID NO: 2776699 - DNA, 14 bp, Homo sapiens
tgctgcaaagtgca

SEQ ID NO: 2776700 - DNA, 18 bp, Homo sapiens
tgctgcaaagtgcaaata

SEQ ID NO: 2776701 - DNA, 21 bp, Homo sapiens
tgctgcaaagtgcaaatactc

SEQ ID NO: 2776702 - DNA, 13 bp, Homo sapiens
tgctgccatccag

SEQ ID NO: 2776703 - DNA, 21 bp, Homo sapiens
tgctgccatccaggttcagct

SEQ ID NO: 2776704 - DNA, 16 bp, Homo sapiens
tgctgcccagcctcca

SEQ ID NO: 2776705 - DNA, 20 bp, Homo sapiens
tgctgccgcctcccagcctg

SEQ ID NO: 2776706 - DNA, 14 bp, Homo sapiens
tgctgcctccagaa

SEQ ID NO: 2776707 - DNA, 18 bp, Homo sapiens
tgctgctgagaacctggc

SEQ ID NO: 2776708 - DNA, 22 bp, Homo sapiens
tgctgctgagaacctggccttc

SEQ ID NO: 2776709 - DNA, 19 bp, Homo sapiens
tgctggacggcattcctgc

SEQ ID NO: 2776710 - DNA, 20 bp, Homo sapiens
tgctggacggcattcctgct

SEQ ID NO: 2776711 - DNA, 15 bp, Homo sapiens
tgctggactgtcata

SEQ ID NO: 2776712 - DNA, 19 bp, Homo sapiens
tgctggctgttggctgggg

SEQ ID NO: 2776713 - DNA, 17 bp, Homo sapiens
tgctgggattacaggtg

SEQ ID NO: 2776714 - DNA, 15 bp, Homo sapiens
tgctgggctctccac

SEQ ID NO: 2776715 - DNA, 20 bp, Homo sapiens
tgctgggctctccacctcag

SEQ ID NO: 2776716 - DNA, 22 bp, Homo sapiens
tgctgggctctccacctcagcc

SEQ ID NO: 2776717 - DNA, 23 bp, Homo sapiens
tgctgtcctaggccacaccatct

SEQ ID NO: 2776718 - DNA, 12 bp, Homo sapiens
tgctgtggccag

SEQ ID NO: 2776719 - DNA, 12 bp, Homo sapiens
tgctgtggcctg

SEQ ID NO: 2776720 - DNA, 14 bp, Homo sapiens
tgctgtggcctggg

SEQ ID NO: 2776721 - DNA, 15 bp, Homo sapiens
tgctgtggcctgggc

SEQ ID NO: 2776722 - DNA, 20 bp, Homo sapiens
tgctgtggtggggagaggca

SEQ ID NO: 2776723 - DNA, 11 bp, Homo sapiens
tgctgtgtagc

SEQ ID NO: 2776724 - DNA, 16 bp, Homo sapiens
tgctgtgtagctctgt

SEQ ID NO: 2776725 - DNA, 21 bp, Homo sapiens
tgctgttccaacagacagggc

SEQ ID NO: 2776726 - DNA, 14 bp, Homo sapiens
tgctgttgcctcat

SEQ ID NO: 2776727 - DNA, 14 bp, Homo sapiens
tgctgtttcctttt

SEQ ID NO: 2776728 - DNA, 13 bp, Homo sapiens
tgctgtttgagat

SEQ ID NO: 2776729 - DNA, 19 bp, Homo sapiens
tgctgtttgtttgacaaag

SEQ ID NO: 2776730 - DNA, 18 bp, Homo sapiens
tgctgttttgatttgtac

SEQ ID NO: 2776731 - DNA, 12 bp, Homo sapiens
tgcttaaatatt

SEQ ID NO: 2776732 - DNA, 14 bp, Homo sapiens
tgcttaggatgttt

SEQ ID NO: 2776733 - DNA, 23 bp, Homo sapiens
tgcttaggatgtttttcatgaaa

SEQ ID NO: 2776734 - DNA, 23 bp, Homo sapiens
tgcttagtcacttatttcataaa

SEQ ID NO: 2776735 - DNA, 13 bp, Homo sapiens
tgcttattgtact

SEQ ID NO: 2776736 - DNA, 19 bp, Homo sapiens
tgcttcaaatccatccaga

SEQ ID NO: 2776737 - DNA, 15 bp, Homo sapiens
tgcttcaattaataa

SEQ ID NO: 2776738 - DNA, 23 bp, Homo sapiens
tgcttcaattaataaaaaatgga

SEQ ID NO: 2776739 - DNA, 12 bp, Homo sapiens
tgcttcagcctg

SEQ ID NO: 2776740 - DNA, 15 bp, Homo sapiens
tgcttcagcctgagg

SEQ ID NO: 2776741 - DNA, 17 bp, Homo sapiens
tgcttcagcctgaggct

SEQ ID NO: 2776742 - DNA, 22 bp, Homo sapiens
tgcttcagcctgaggctgagac

SEQ ID NO: 2776743 - DNA, 23 bp, Homo sapiens
tgcttcagcctgaggctgagact

SEQ ID NO: 2776744 - DNA, 21 bp, Homo sapiens
tgcttctcagccccgggcctg

SEQ ID NO: 2776745 - DNA, 15 bp, Homo sapiens
tgcttcttgcccctt

SEQ ID NO: 2776746 - DNA, 19 bp, Homo sapiens
tgagtcgaggacagggagg

SEQ ID NO: 2776747 - DNA, 17 bp, Homo sapiens
tgagtctcctctctgag

SEQ ID NO: 2776748 - DNA, 19 bp, Homo sapiens
tgagtctcctctctgagac

SEQ ID NO: 2776749 - DNA, 21 bp, Homo sapiens
tgagtctcctctctgagactg

SEQ ID NO: 2776750 - DNA, 23 bp, Homo sapiens
tgagtgagccacagaccacctgc

SEQ ID NO: 2776751 - DNA, 20 bp, Homo sapiens
tgagtgcccactacgtgcca

SEQ ID NO: 2776752 - DNA, 23 bp, Homo sapiens
tgagtgtgtgtgatgggatctgt

SEQ ID NO: 2776753 - DNA, 17 bp, Homo sapiens
tgagttcataccctgtt

SEQ ID NO: 2776754 - DNA, 18 bp, Homo sapiens
tgagttcataccctgtta

SEQ ID NO: 2776755 - DNA, 18 bp, Homo sapiens
tgagttttattgagaatt

SEQ ID NO: 2776756 - DNA, 19 bp, Homo sapiens
tgagtttttgatagcttta

SEQ ID NO: 2776757 - DNA, 13 bp, Homo sapiens
tgataaacacaga

SEQ ID NO: 2776758 - DNA, 22 bp, Homo sapiens
tgataaacattaaacactgtaa

SEQ ID NO: 2776759 - DNA, 20 bp, Homo sapiens
tgataaagattttttaataa

SEQ ID NO: 2776760 - DNA, 14 bp, Homo sapiens
tgataagtggaaaa

SEQ ID NO: 2776761 - DNA, 15 bp, Homo sapiens
tgataagtggaaaaa

SEQ ID NO: 2776762 - DNA, 20 bp, Homo sapiens
tgataagtggaaaaaagaga

SEQ ID NO: 2776763 - DNA, 15 bp, Homo sapiens
tgataatgaacagaa

SEQ ID NO: 2776764 - DNA, 13 bp, Homo sapiens
tgataattttaaa

SEQ ID NO: 2776765 - DNA, 13 bp, Homo sapiens
tgatacccagagc

SEQ ID NO: 2776766 - DNA, 21 bp, Homo sapiens
tgatacccatagcttccatga

SEQ ID NO: 2776767 - DNA, 16 bp, Homo sapiens
tgatactaagcattga

SEQ ID NO: 2776768 - DNA, 15 bp, Homo sapiens
tgatacttttgacaa

SEQ ID NO: 2776769 - DNA, 21 bp, Homo sapiens
tgatacttttgacaacaaatt

SEQ ID NO: 2776770 - DNA, 21 bp, Homo sapiens
tgataggccctggatgtgccc

SEQ ID NO: 2776771 - DNA, 22 bp, Homo sapiens
tgatatacttttttcttattta

SEQ ID NO: 2776772 - DNA, 13 bp, Homo sapiens
tgatatatgtatt

SEQ ID NO: 2776773 - DNA, 21 bp, Homo sapiens
tgatatcatgcccctgtactc

SEQ ID NO: 2776774 - DNA, 12 bp, Homo sapiens
tgatatgaaaaa

SEQ ID NO: 2776775 - DNA, 16 bp, Homo sapiens
tgatcaattaaatgta

SEQ ID NO: 2776776 - DNA, 12 bp, Homo sapiens
tgatcacactct

SEQ ID NO: 2776777 - DNA, 13 bp, Homo sapiens
tgatcacactctg

SEQ ID NO: 2776778 - DNA, 15 bp, Homo sapiens
tgatcacactctggg

SEQ ID NO: 2776779 - DNA, 19 bp, Homo sapiens
tgatcacggctcactgcag

SEQ ID NO: 2776780 - DNA, 21 bp, Homo sapiens
tgatcacggctcactgcagcc

SEQ ID NO: 2776781 - DNA, 23 bp, Homo sapiens
tgatcatcccatctaagctgcag

SEQ ID NO: 2776782 - DNA, 21 bp, Homo sapiens
tgatccaagctggtcccactc

SEQ ID NO: 2776783 - DNA, 23 bp, Homo sapiens
tgatccacttcttaatgctttcc

SEQ ID NO: 2776784 - DNA, 17 bp, Homo sapiens
tgatcctccaacttcat

SEQ ID NO: 2776785 - DNA, 15 bp, Homo sapiens
tgatcctcccacctc

SEQ ID NO: 2776786 - DNA, 21 bp, Homo sapiens
tgatcctcccacctcagcctc

SEQ ID NO: 2776787 - DNA, 19 bp, Homo sapiens
tgatcgggataacaaaatc

SEQ ID NO: 2776788 - DNA, 23 bp, Homo sapiens
tgatcgggataacaaaatcacaa

SEQ ID NO: 2776789 - DNA, 15 bp, Homo sapiens
tgatcgtgctaaatt

SEQ ID NO: 2776790 - DNA, 13 bp, Homo sapiens
tgatctccctgcc

SEQ ID NO: 2776791 - DNA, 13 bp, Homo sapiens
tgatctgtatata

SEQ ID NO: 2776792 - DNA, 19 bp, Homo sapiens
tgatctgtatatacaataa

SEQ ID NO: 2776793 - DNA, 20 bp, Homo sapiens
tgatctttgcagacaggcaa

SEQ ID NO: 2776794 - DNA, 22 bp, Homo sapiens
tgatgaaatgaggtcagagcct

SEQ ID NO: 2776795 - DNA, 18 bp, Homo sapiens
tgatgaactcttaatcaa

SEQ ID NO: 2776796 - DNA, 15 bp, Homo sapiens
tgatgacagagcgag

SEQ ID NO: 2776797 - DNA, 22 bp, Homo sapiens
tgatgaggcctcttggacctct

SEQ ID NO: 2776798 - DNA, 15 bp, Homo sapiens
tgatgagggcagcag

SEQ ID NO: 2776799 - DNA, 16 bp, Homo sapiens
tgatgagggcagcagc

SEQ ID NO: 2776800 - DNA, 22 bp, Homo sapiens
tgatgagggcagcagccagccc

SEQ ID NO: 2776801 - DNA, 23 bp, Homo sapiens
tgatgagggcagcagccagccct

SEQ ID NO: 2776802 - DNA, 21 bp, Homo sapiens
tgatgagtgattgacacacag

SEQ ID NO: 2776803 - DNA, 15 bp, Homo sapiens
tgatgattaaacacc

SEQ ID NO: 2776804 - DNA, 18 bp, Homo sapiens
tgatgattaaacacctga

SEQ ID NO: 2776805 - DNA, 22 bp, Homo sapiens
tgatgcatcagaaagggagggc

SEQ ID NO: 2776806 - DNA, 14 bp, Homo sapiens
tgatgccaaaaaaa

SEQ ID NO: 2776807 - DNA, 17 bp, Homo sapiens
tgatgccgctcttctgt

SEQ ID NO: 2776808 - DNA, 23 bp, Homo sapiens
tgatgccgctcttctgtcatccc

SEQ ID NO: 2776809 - DNA, 11 bp, Homo sapiens
tgatgctaaat

SEQ ID NO: 2776810 - DNA, 17 bp, Homo sapiens
tgatggcaattttgtaa

SEQ ID NO: 2776811 - DNA, 17 bp, Homo sapiens
tgatgggtcccaaaagc

SEQ ID NO: 2776812 - DNA, 15 bp, Homo sapiens
tgatggtgacttcct

SEQ ID NO: 2776813 - DNA, 14 bp, Homo sapiens
tgatgtacatgtgt

SEQ ID NO: 2776814 - DNA, 16 bp, Homo sapiens
tgatgtacatgtgtag

SEQ ID NO: 2776815 - DNA, 12 bp, Homo sapiens
tgatgtccagaa

SEQ ID NO: 2776816 - DNA, 16 bp, Homo sapiens
tgatgttaaaattcca

SEQ ID NO: 2776817 - DNA, 12 bp, Homo sapiens
tgattaaacacc

SEQ ID NO: 2776818 - DNA, 14 bp, Homo sapiens
tgattaaacacctg

SEQ ID NO: 2776819 - DNA, 15 bp, Homo sapiens
tgattaaacacctga

SEQ ID NO: 2776820 - DNA, 16 bp, Homo sapiens
tgattaaacacctgac

SEQ ID NO: 2776821 - DNA, 15 bp, Homo sapiens
tgattcataacaatg

SEQ ID NO: 2776822 - DNA, 23 bp, Homo sapiens
tgaagagaccaagactctgaaat

SEQ ID NO: 2776823 - DNA, 22 bp, Homo sapiens
tgaagagagatatatctgaaaa

SEQ ID NO: 2776824 - DNA, 17 bp, Homo sapiens
tgaagagatttcaacat

SEQ ID NO: 2776825 - DNA, 20 bp, Homo sapiens
tgaagataggagagatacct

SEQ ID NO: 2776826 - DNA, 13 bp, Homo sapiens
tgaagatgtaagg

SEQ ID NO: 2776827 - DNA, 15 bp, Homo sapiens
tgaagatttcagagg

SEQ ID NO: 2776828 - DNA, 20 bp, Homo sapiens
tgaagatttcagaggctgca

SEQ ID NO: 2776829 - DNA, 18 bp, Homo sapiens
tgaagcaaagcaccagct

SEQ ID NO: 2776830 - DNA, 20 bp, Homo sapiens
tgaagcaaatcgaatgaaat

SEQ ID NO: 2776831 - DNA, 19 bp, Homo sapiens
tgaagccactgaagctggg

SEQ ID NO: 2776832 - DNA, 15 bp, Homo sapiens
tgaagcccaataaac

SEQ ID NO: 2776833 - DNA, 19 bp, Homo sapiens
tgaagcccaataaacctct

SEQ ID NO: 2776834 - DNA, 17 bp, Homo sapiens
tgaagcccatgctttcc

SEQ ID NO: 2776835 - DNA, 16 bp, Homo sapiens
tgaagctattgatgtt

SEQ ID NO: 2776836 - DNA, 23 bp, Homo sapiens
tgaagctattgatgtttccagaa

SEQ ID NO: 2776837 - DNA, 20 bp, Homo sapiens
tgaagctggaagcactgctg

SEQ ID NO: 2776838 - DNA, 13 bp, Homo sapiens
tgaagctgtaccc

SEQ ID NO: 2776839 - DNA, 12 bp, Homo sapiens
tgaaggaacagt

SEQ ID NO: 2776840 - DNA, 20 bp, Homo sapiens
tgaaggacattgcggacagc

SEQ ID NO: 2776841 - DNA, 15 bp, Homo sapiens
tgaagggggcggcct

SEQ ID NO: 2776842 - DNA, 16 bp, Homo sapiens
tgaaggtcttgcctga

SEQ ID NO: 2776843 - DNA, 13 bp, Homo sapiens
tgaaggtttctga

SEQ ID NO: 2776844 - DNA, 23 bp, Homo sapiens
tgaagtaagttctgaaaactgtt

SEQ ID NO: 2776845 - DNA, 13 bp, Homo sapiens
tgaagtcacacag

SEQ ID NO: 2776846 - DNA, 18 bp, Homo sapiens
tgaagtcacatcacagga

SEQ ID NO: 2776847 - DNA, 18 bp, Homo sapiens
tgaagtcatcttagcttt

SEQ ID NO: 2776848 - DNA, 14 bp, Homo sapiens
tgaagttaacagag

SEQ ID NO: 2776849 - DNA, 18 bp, Homo sapiens
tgaagttagctttaactt

SEQ ID NO: 2776850 - DNA, 18 bp, Homo sapiens
tgaataaaaaacatttgt

SEQ ID NO: 2776851 - DNA, 23 bp, Homo sapiens
tgaataaaaaacatttgtacatt

SEQ ID NO: 2776852 - DNA, 14 bp, Homo sapiens
tgaataaaaaccct

SEQ ID NO: 2776853 - DNA, 21 bp, Homo sapiens
tgacctcaggtgatccaccca

SEQ ID NO: 2776854 - DNA, 22 bp, Homo sapiens
tgacctcaggtgatccacccac

SEQ ID NO: 2776855 - DNA, 18 bp, Homo sapiens
tgacctccagctttcctg

SEQ ID NO: 2776856 - DNA, 12 bp, Homo sapiens
tgacctcccagc

SEQ ID NO: 2776857 - DNA, 14 bp, Homo sapiens
tgacctcccagccc

SEQ ID NO: 2776858 - DNA, 23 bp, Homo sapiens
tgacctcccagccctatggatgt

SEQ ID NO: 2776859 - DNA, 13 bp, Homo sapiens
tgacctccctcta

SEQ ID NO: 2776860 - DNA, 14 bp, Homo sapiens
tgacctccctctaa

SEQ ID NO: 2776861 - DNA, 22 bp, Homo sapiens
tgacctccctctaatttatctt

SEQ ID NO: 2776862 - DNA, 13 bp, Homo sapiens
tgacctctgcctg

SEQ ID NO: 2776863 - DNA, 14 bp, Homo sapiens
tgacctgctgagct

SEQ ID NO: 2776864 - DNA, 17 bp, Homo sapiens
tgacctgctgagctctg

SEQ ID NO: 2776865 - DNA, 18 bp, Homo sapiens
tgacctgctgagctctga

SEQ ID NO: 2776866 - DNA, 19 bp, Homo sapiens
tgacgtcaagtctccttcc

SEQ ID NO: 2776867 - DNA, 23 bp, Homo sapiens
tgacgtcagtagtttgagaccag

SEQ ID NO: 2776868 - DNA, 14 bp, Homo sapiens
tgactaaaatattt

SEQ ID NO: 2776869 - DNA, 18 bp, Homo sapiens
tgactatcacatacaatt

SEQ ID NO: 2776870 - DNA, 19 bp, Homo sapiens
tgactatcacatacaattt

SEQ ID NO: 2776871 - DNA, 20 bp, Homo sapiens
tgactatcacatacaatttg

SEQ ID NO: 2776872 - DNA, 20 bp, Homo sapiens
tgactattgaagttgcagat

SEQ ID NO: 2776873 - DNA, 12 bp, Homo sapiens
tgactcaagttt

SEQ ID NO: 2776874 - DNA, 17 bp, Homo sapiens
tgactcctctaagccac

SEQ ID NO: 2776875 - DNA, 14 bp, Homo sapiens
tgactcttgccttt

SEQ ID NO: 2776876 - DNA, 15 bp, Homo sapiens
tgactgccccaactc

SEQ ID NO: 2776877 - DNA, 23 bp, Homo sapiens
tgactgggtttctctgtatagta

SEQ ID NO: 2776878 - DNA, 15 bp, Homo sapiens
tgactgtcgtgttta

SEQ ID NO: 2776879 - DNA, 17 bp, Homo sapiens
tgactgtcgtgtttaca

SEQ ID NO: 2776880 - DNA, 15 bp, Homo sapiens
tgactgtgttcagtg

SEQ ID NO: 2776881 - DNA, 17 bp, Homo sapiens
tgactgtttttgtagtg

SEQ ID NO: 2776882 - DNA, 19 bp, Homo sapiens
tgacttgggcacccccagc

SEQ ID NO: 2776883 - DNA, 21 bp, Homo sapiens
tgacttgggcacccccagcct

SEQ ID NO: 2776884 - DNA, 23 bp, Homo sapiens
tgacttgggcacccccagcctgg

SEQ ID NO: 2776885 - DNA, 18 bp, Homo sapiens
tgacttggggagatggag

SEQ ID NO: 2776886 - DNA, 19 bp, Homo sapiens
tgacttggggagatggagt

SEQ ID NO: 2776887 - DNA, 14 bp, Homo sapiens
tgactttaattgtg

SEQ ID NO: 2776888 - DNA, 15 bp, Homo sapiens
tgactttaattgtgt

SEQ ID NO: 2776889 - DNA, 12 bp, Homo sapiens
tgactttcaggt

SEQ ID NO: 2776890 - DNA, 15 bp, Homo sapiens
tgactttttataatg

SEQ ID NO: 2776891 - DNA, 11 bp, Homo sapiens
tgagaaatgtg

SEQ ID NO: 2776892 - DNA, 14 bp, Homo sapiens
tgagaaatttaaac

SEQ ID NO: 2776893 - DNA, 15 bp, Homo sapiens
tgagaacctggcctt

SEQ ID NO: 2776894 - DNA, 16 bp, Homo sapiens
tgagaagagggcctgt

SEQ ID NO: 2776895 - DNA, 20 bp, Homo sapiens
tgagaagagggcctgtggga

SEQ ID NO: 2776896 - DNA, 16 bp, Homo sapiens
tgagaaggtccttaat

SEQ ID NO: 2776897 - DNA, 14 bp, Homo sapiens
tgagaagtgtatat

SEQ ID NO: 2776898 - DNA, 23 bp, Homo sapiens
tgagaagttaagcagcctttctg

SEQ ID NO: 2776899 - DNA, 20 bp, Homo sapiens
tgagaataattgtgtacaaa

SEQ ID NO: 2776900 - DNA, 23 bp, Homo sapiens
tgagaatctatatttaacaagat

SEQ ID NO: 2776901 - DNA, 16 bp, Homo sapiens
tgagaattccaaggag

SEQ ID NO: 2776902 - DNA, 19 bp, Homo sapiens
tgagaccacctctcaatat

SEQ ID NO: 2776903 - DNA, 13 bp, Homo sapiens
tgagaccagcctg

SEQ ID NO: 2776904 - DNA, 17 bp, Homo sapiens
tgagaccagcctgggca

SEQ ID NO: 2776905 - DNA, 14 bp, Homo sapiens
tgagacctcagcca

SEQ ID NO: 2776906 - DNA, 17 bp, Homo sapiens
tgagacctcagccatga

SEQ ID NO: 2776907 - DNA, 14 bp, Homo sapiens
tgagactctgtctc

SEQ ID NO: 2776908 - DNA, 18 bp, Homo sapiens
tgagagaattgtatcatt

SEQ ID NO: 2776909 - DNA, 14 bp, Homo sapiens
tgagagagtgctga

SEQ ID NO: 2776910 - DNA, 13 bp, Homo sapiens
tgagaggccctgg

SEQ ID NO: 2776911 - DNA, 22 bp, Homo sapiens
tgagagggcatgcgcacaaggc

SEQ ID NO: 2776912 - DNA, 19 bp, Homo sapiens
tgagaggggaacagactgg

SEQ ID NO: 2776913 - DNA, 12 bp, Homo sapiens
tgagagtgtgac

SEQ ID NO: 2776914 - DNA, 16 bp, Homo sapiens
tgagataatatctgtg

SEQ ID NO: 2776915 - DNA, 23 bp, Homo sapiens
tgagatagtagcatacatttata

SEQ ID NO: 2776916 - DNA, 22 bp, Homo sapiens
tgagatctaagcctttccataa

SEQ ID NO: 2776917 - DNA, 23 bp, Homo sapiens
tgagatctaagcctttccataag

SEQ ID NO: 2776918 - DNA, 13 bp, Homo sapiens
tgagattccctct

SEQ ID NO: 2776919 - DNA, 19 bp, Homo sapiens
tgagatttgtatttatatt

SEQ ID NO: 2776920 - DNA, 18 bp, Homo sapiens
tgagcaaatgtggctcct

SEQ ID NO: 2776921 - DNA, 17 bp, Homo sapiens
tgagcaagatcttgtct

SEQ ID NO: 2776922 - DNA, 22 bp, Homo sapiens
tgagcaagatcttgtctccact

SEQ ID NO: 2776923 - DNA, 14 bp, Homo sapiens
tgagcaattcattt

SEQ ID NO: 2776924 - DNA, 16 bp, Homo sapiens
tgagcaattcatttca

SEQ ID NO: 2776925 - DNA, 20 bp, Homo sapiens
tgagcaattcatttcacttt

SEQ ID NO: 2776926 - DNA, 14 bp, Homo sapiens
tgagcacatctggg

SEQ ID NO: 2776927 - DNA, 15 bp, Homo sapiens
tgagcacatctggga

SEQ ID NO: 2776928 - DNA, 22 bp, Homo sapiens
tgagcactaaggtgtgctctga

SEQ ID NO: 2776929 - DNA, 23 bp, Homo sapiens
tgagcactaaggtgtgctctgat

SEQ ID NO: 2776930 - DNA, 16 bp, Homo sapiens
tgagcactgccaggag

SEQ ID NO: 2776931 - DNA, 22 bp, Homo sapiens
tgagcactgccaggagggacaa

SEQ ID NO: 2776932 - DNA, 20 bp, Homo sapiens
tgagcagaggagtccagggc

SEQ ID NO: 2776933 - DNA, 20 bp, Homo sapiens
tgagcagggccggggaactg

SEQ ID NO: 2776934 - DNA, 17 bp, Homo sapiens
tgagcagggctcagcgg

SEQ ID NO: 2776935 - DNA, 15 bp, Homo sapiens
tgagcagtcacactg

SEQ ID NO: 2776936 - DNA, 18 bp, Homo sapiens
tgagcagtcacactgtta

SEQ ID NO: 2776937 - DNA, 23 bp, Homo sapiens
tgagcagtgagttacagcgagag

SEQ ID NO: 2776938 - DNA, 14 bp, Homo sapiens
tgagcatctctgtg

SEQ ID NO: 2776939 - DNA, 15 bp, Homo sapiens
tgagcatctctgtgt

SEQ ID NO: 2776940 - DNA, 21 bp, Homo sapiens
tgagcatctctgtgtacccac

SEQ ID NO: 2776941 - DNA, 19 bp, Homo sapiens
tgagcattagctacttttc

SEQ ID NO: 2776942 - DNA, 21 bp, Homo sapiens
tgagcattttatatccacatc

SEQ ID NO: 2776943 - DNA, 15 bp, Homo sapiens
tgagccacagaccac

SEQ ID NO: 2776944 - DNA, 19 bp, Homo sapiens
tgagccacagaccacctgc

SEQ ID NO: 2776945 - DNA, 12 bp, Homo sapiens
tgagccactgca

SEQ ID NO: 2776946 - DNA, 14 bp, Homo sapiens
tgagccactgcacc

SEQ ID NO: 2776947 - DNA, 23 bp, Homo sapiens
tgagccactgcaccgggccacag

SEQ ID NO: 2776948 - DNA, 21 bp, Homo sapiens
tgagccaggtaatgagggact

SEQ ID NO: 2776949 - DNA, 16 bp, Homo sapiens
tgagccattttttaaa

SEQ ID NO: 2776950 - DNA, 13 bp, Homo sapiens
tgagcccaggagt

SEQ ID NO: 2776951 - DNA, 11 bp, Homo sapiens
tgagcccaggg

SEQ ID NO: 2776952 - DNA, 17 bp, Homo sapiens
tgagccgcatcttctcc

SEQ ID NO: 2776953 - DNA, 22 bp, Homo sapiens
tgagcctcagcatcctggcacc

SEQ ID NO: 2776954 - DNA, 16 bp, Homo sapiens
tgagcctccatttctg

SEQ ID NO: 2776955 - DNA, 19 bp, Homo sapiens
tgagcctgtcacgtggtca

SEQ ID NO: 2776956 - DNA, 16 bp, Homo sapiens
tgagctcagaccccca

SEQ ID NO: 2776957 - DNA, 15 bp, Homo sapiens
tgagctccccaaaaa

SEQ ID NO: 2776958 - DNA, 17 bp, Homo sapiens
tgagctctgagaggccc

SEQ ID NO: 2776959 - DNA, 18 bp, Homo sapiens
tgagctctgagaggccct

SEQ ID NO: 2776960 - DNA, 22 bp, Homo sapiens
tgagctctgagaggccctggat

SEQ ID NO: 2776961 - DNA, 23 bp, Homo sapiens
tgagctctgagaggccctggatc

SEQ ID NO: 2776962 - DNA, 15 bp, Homo sapiens
tgagctcttcatgtt

SEQ ID NO: 2776963 - DNA, 16 bp, Homo sapiens
tgagctcttcatgttt

SEQ ID NO: 2776964 - DNA, 20 bp, Homo sapiens
tgagcttggcagctgaacta

SEQ ID NO: 2776965 - DNA, 21 bp, Homo sapiens
tgaggaatccagacccggctg

SEQ ID NO: 2776966 - DNA, 22 bp, Homo sapiens
tgaggaatccagacccggctgc

SEQ ID NO: 2776967 - DNA, 14 bp, Homo sapiens
tgaggaattttctt

SEQ ID NO: 2776968 - DNA, 18 bp, Homo sapiens
tgaggaattttctttgtg

SEQ ID NO: 2776969 - DNA, 15 bp, Homo sapiens
tgaggacaaagagaa

SEQ ID NO: 2776970 - DNA, 20 bp, Homo sapiens
tgaggacaaccattccagac

SEQ ID NO: 2776971 - DNA, 15 bp, Homo sapiens
tgaggacacatgtcc

SEQ ID NO: 2776972 - DNA, 16 bp, Homo sapiens
tgaggacacatgtcca

SEQ ID NO: 2776973 - DNA, 15 bp, Homo sapiens
tgaggagtctgaggt

SEQ ID NO: 2776974 - DNA, 22 bp, Homo sapiens
tgaggagtctgaggtcctgagc

SEQ ID NO: 2776975 - DNA, 19 bp, Homo sapiens
tgaggattatgggtcctgc

SEQ ID NO: 2776976 - DNA, 20 bp, Homo sapiens
tgaggcaaaggccagcagca

SEQ ID NO: 2776977 - DNA, 16 bp, Homo sapiens
tgaggcaatgtcagga

SEQ ID NO: 2776978 - DNA, 20 bp, Homo sapiens
tgaggcaatgtcaggaacag

SEQ ID NO: 2776979 - DNA, 12 bp, Homo sapiens
tgaggcagacag

SEQ ID NO: 2776980 - DNA, 15 bp, Homo sapiens
tgaggcagacagcag

SEQ ID NO: 2776981 - DNA, 16 bp, Homo sapiens
tgaggcaggagaattg

SEQ ID NO: 2776982 - DNA, 15 bp, Homo sapiens
tgaggcaggggcgga

SEQ ID NO: 2776983 - DNA, 12 bp, Homo sapiens
tgaggccagcct

SEQ ID NO: 2776984 - DNA, 20 bp, Homo sapiens
tgaggccagcctggcctcct

SEQ ID NO: 2776985 - DNA, 12 bp, Homo sapiens
tgaggccaggag

SEQ ID NO: 2776986 - DNA, 15 bp, Homo sapiens
tgaggccattatttc

SEQ ID NO: 2776987 - DNA, 16 bp, Homo sapiens
tgaggccattatttca

SEQ ID NO: 2776988 - DNA, 23 bp, Homo sapiens
tgaggcgccccaacccgtggagg

SEQ ID NO: 2776989 - DNA, 17 bp, Homo sapiens
tgaggctctttctgggc

SEQ ID NO: 2776990 - DNA, 18 bp, Homo sapiens
tgaggctctttctgggcc

SEQ ID NO: 2776991 - DNA, 15 bp, Homo sapiens
tgaggctgaggcagg

SEQ ID NO: 2776992 - DNA, 16 bp, Homo sapiens
tgagggaacagacagg

SEQ ID NO: 2776993 - DNA, 22 bp, Homo sapiens
tgagggaacagacaggagaaat

SEQ ID NO: 2776994 - DNA, 14 bp, Homo sapiens
tgagggcagcagcc

SEQ ID NO: 2776995 - DNA, 17 bp, Homo sapiens
tgagggcagcagccagc

SEQ ID NO: 2776996 - DNA, 18 bp, Homo sapiens
tgagggcagcagccagcc

SEQ ID NO: 2776997 - DNA, 22 bp, Homo sapiens
tgagggcagcagccagccctgc

SEQ ID NO: 2776998 - DNA, 23 bp, Homo sapiens
tgagggcagcagccagccctgcc

SEQ ID NO: 2776999 - DNA, 21 bp, Homo sapiens
tgagggcagttcgcagccacc

SEQ ID NO: 2777000 - DNA, 18 bp, Homo sapiens
tgaggggagaggcgccct

SEQ ID NO: 2777001 - DNA, 20 bp, Homo sapiens
tgaggggggccgtgcccagg

SEQ ID NO: 2777002 - DNA, 22 bp, Homo sapiens
tgaggggggccgtgcccagggg

SEQ ID NO: 2777003 - DNA, 20 bp, Homo sapiens
tgagggttgggctggtgtca

SEQ ID NO: 2777004 - DNA, 14 bp, Homo sapiens
tctgtcacgtgaaa

SEQ ID NO: 2777005 - DNA, 18 bp, Homo sapiens
tctgtcagatgggaagac

SEQ ID NO: 2777006 - DNA, 20 bp, Homo sapiens
tctgtcatcccgctcctgct

SEQ ID NO: 2777007 - DNA, 15 bp, Homo sapiens
tctgtcatttgagca

SEQ ID NO: 2777008 - DNA, 20 bp, Homo sapiens
tctgtcatttgagcagggct

SEQ ID NO: 2777009 - DNA, 13 bp, Homo sapiens
tctgtccagggcc

SEQ ID NO: 2777010 - DNA, 17 bp, Homo sapiens
tctgtccagggccctga

SEQ ID NO: 2777011 - DNA, 19 bp, Homo sapiens
tctgtccagggccctgagc

SEQ ID NO: 2777012 - DNA, 14 bp, Homo sapiens
tctgtccctcactg

SEQ ID NO: 2777013 - DNA, 15 bp, Homo sapiens
tctgtcctactctgt

SEQ ID NO: 2777014 - DNA, 16 bp, Homo sapiens
tctgtcgcccagtctg

SEQ ID NO: 2777015 - DNA, 21 bp, Homo sapiens
tctgtctcgagcgccctgcag

SEQ ID NO: 2777016 - DNA, 11 bp, Homo sapiens
tctgtctctgc

SEQ ID NO: 2777017 - DNA, 18 bp, Homo sapiens
tctgtctggctgtacgtc

SEQ ID NO: 2777018 - DNA, 15 bp, Homo sapiens
tctgtctgtcccaaa

SEQ ID NO: 2777019 - DNA, 15 bp, Homo sapiens
tctgtctgtctgtcc

SEQ ID NO: 2777020 - DNA, 12 bp, Homo sapiens
tctgtcttgaag

SEQ ID NO: 2777021 - DNA, 14 bp, Homo sapiens
tctgtcttgccagc

SEQ ID NO: 2777022 - DNA, 21 bp, Homo sapiens
tctgtgaacgatttagaaaga

SEQ ID NO: 2777023 - DNA, 16 bp, Homo sapiens
tctgtgaggtgctgat

SEQ ID NO: 2777024 - DNA, 15 bp, Homo sapiens
tctgtgccagagcct

SEQ ID NO: 2777025 - DNA, 16 bp, Homo sapiens
tctgtgccagagcctg

SEQ ID NO: 2777026 - DNA, 22 bp, Homo sapiens
tctgtgccagagcctggggctc

SEQ ID NO: 2777027 - DNA, 20 bp, Homo sapiens
tctgttccccatggccactt

SEQ ID NO: 2777028 - DNA, 21 bp, Homo sapiens
tctgttctcaaatgctaaatg

SEQ ID NO: 2777029 - DNA, 19 bp, Homo sapiens
tctgttggccagtgtgaca

SEQ ID NO: 2777030 - DNA, 18 bp, Homo sapiens
tctgtttttctaactggg

SEQ ID NO: 2777031 - DNA, 21 bp, Homo sapiens
tcttaaaataacttatatcat

SEQ ID NO: 2777032 - DNA, 20 bp, Homo sapiens
tcttaaaatatatttcagat

SEQ ID NO: 2777033 - DNA, 17 bp, Homo sapiens
tcttaaaatgtttcatt

SEQ ID NO: 2777034 - DNA, 17 bp, Homo sapiens
tcttaaacaaatgtatg

SEQ ID NO: 2777035 - DNA, 20 bp, Homo sapiens
tcttaaagctgcctgtagtt

SEQ ID NO: 2777036 - DNA, 23 bp, Homo sapiens
tcttaacacatgtccttgtgtgt

SEQ ID NO: 2777037 - DNA, 21 bp, Homo sapiens
tcttaagccttttgctcacaa

SEQ ID NO: 2777038 - DNA, 23 bp, Homo sapiens
tcttaaggattgtgatattttta

SEQ ID NO: 2777039 - DNA, 22 bp, Homo sapiens
tcttaatgctttcctccctggc

SEQ ID NO: 2777040 - DNA, 14 bp, Homo sapiens
tcttaccttaaaaa

SEQ ID NO: 2777041 - DNA, 18 bp, Homo sapiens
tcttaccttaaaaagtaa

SEQ ID NO: 2777042 - DNA, 15 bp, Homo sapiens
tcttacgctctctgt

SEQ ID NO: 2777043 - DNA, 20 bp, Homo sapiens
tctgagaaggtccttaatga

SEQ ID NO: 2777044 - DNA, 16 bp, Homo sapiens
tctgagaagtgtatat

SEQ ID NO: 2777045 - DNA, 13 bp, Homo sapiens
tctgagaggccct

SEQ ID NO: 2777046 - DNA, 14 bp, Homo sapiens
tctgagaggccctg

SEQ ID NO: 2777047 - DNA, 16 bp, Homo sapiens
tctgagcaagagctgg

SEQ ID NO: 2777048 - DNA, 20 bp, Homo sapiens
tctgagcctaaatctaatca

SEQ ID NO: 2777049 - DNA, 20 bp, Homo sapiens
tctgaggccagcctggcctc

SEQ ID NO: 2777050 - DNA, 16 bp, Homo sapiens
tctgaggcttccagag

SEQ ID NO: 2777051 - DNA, 19 bp, Homo sapiens
tctgaggcttccagagagt

SEQ ID NO: 2777052 - DNA, 17 bp, Homo sapiens
tctgagggagaggctgt

SEQ ID NO: 2777053 - DNA, 14 bp, Homo sapiens
tctgaggtcctgag

SEQ ID NO: 2777054 - DNA, 15 bp, Homo sapiens
tctgaggtcctgagc

SEQ ID NO: 2777055 - DNA, 16 bp, Homo sapiens
tctgaggtcctgagca

SEQ ID NO: 2777056 - DNA, 17 bp, Homo sapiens
tctgaggtcctgagcac

SEQ ID NO: 2777057 - DNA, 17 bp, Homo sapiens
tctgagtacttgatttc

SEQ ID NO: 2777058 - DNA, 14 bp, Homo sapiens
tctgagtgggcggc

SEQ ID NO: 2777059 - DNA, 14 bp, Homo sapiens
tctgatacccagag

SEQ ID NO: 2777060 - DNA, 16 bp, Homo sapiens
tctgatacccagagca

SEQ ID NO: 2777061 - DNA, 17 bp, Homo sapiens
tctgatcatccactgtg

SEQ ID NO: 2777062 - DNA, 18 bp, Homo sapiens
tctgattcccaagctctg

SEQ ID NO: 2777063 - DNA, 19 bp, Homo sapiens
tctgattcgaatgacactg

SEQ ID NO: 2777064 - DNA, 20 bp, Homo sapiens
tctgattcgaatgacactgt

SEQ ID NO: 2777065 - DNA, 16 bp, Homo sapiens
tctgattggacatttt

SEQ ID NO: 2777066 - DNA, 19 bp, Homo sapiens
tctgattggacattttctt

SEQ ID NO: 2777067 - DNA, 20 bp, Homo sapiens
tctgattggacattttcttc

SEQ ID NO: 2777068 - DNA, 23 bp, Homo sapiens
tctgattggacattttcttcaga

SEQ ID NO: 2777069 - DNA, 21 bp, Homo sapiens
tctgcaaggccctctatttct

SEQ ID NO: 2777070 - DNA, 18 bp, Homo sapiens
tctgcaatgtcccttgca

SEQ ID NO: 2777071 - DNA, 20 bp, Homo sapiens
tctgcagcactttaaccctc

SEQ ID NO: 2777072 - DNA, 20 bp, Homo sapiens
tctgccacctcccctatcca

SEQ ID NO: 2777073 - DNA, 18 bp, Homo sapiens
tctgccatattctgttgg

SEQ ID NO: 2777074 - DNA, 14 bp, Homo sapiens
tctgccccagctct

SEQ ID NO: 2777075 - DNA, 20 bp, Homo sapiens
tctgccccagctctggcttc

SEQ ID NO: 2777076 - DNA, 20 bp, Homo sapiens
tctgcccccgtcttctctcc

SEQ ID NO: 2777077 - DNA, 21 bp, Homo sapiens
tctgcccccgtcttctctcca

SEQ ID NO: 2777078 - DNA, 16 bp, Homo sapiens
tctgccctccctggcc

SEQ ID NO: 2777079 - DNA, 15 bp, Homo sapiens
tctgcctcctcttca

SEQ ID NO: 2777080 - DNA, 23 bp, Homo sapiens
tctgcctctgacacacagctctg

SEQ ID NO: 2777081 - DNA, 14 bp, Homo sapiens
tctcctcggccccc

SEQ ID NO: 2777082 - DNA, 21 bp, Homo sapiens
tctcctcggccccctccatcg

SEQ ID NO: 2777083 - DNA, 13 bp, Homo sapiens
tctcctctctgag

SEQ ID NO: 2777084 - DNA, 15 bp, Homo sapiens
tctcctctctgagac

SEQ ID NO: 2777085 - DNA, 23 bp, Homo sapiens
tctcctcttaaaaaataaaaact

SEQ ID NO: 2777086 - DNA, 16 bp, Homo sapiens
tctcctcttgccactg

SEQ ID NO: 2777087 - DNA, 22 bp, Homo sapiens
tctcctgagaggtgctgcaggc

SEQ ID NO: 2777088 - DNA, 12 bp, Homo sapiens
tctcctgcctac

SEQ ID NO: 2777089 - DNA, 14 bp, Homo sapiens
tctcctgcctacat

SEQ ID NO: 2777090 - DNA, 23 bp, Homo sapiens
tctcctgcctacattccctggcc

SEQ ID NO: 2777091 - DNA, 15 bp, Homo sapiens
tctcctgcctactca

SEQ ID NO: 2777092 - DNA, 19 bp, Homo sapiens
tctcctgcctcagcctccc

SEQ ID NO: 2777093 - DNA, 12 bp, Homo sapiens
tctcctggcttc

SEQ ID NO: 2777094 - DNA, 15 bp, Homo sapiens
tctcctggcttccca

SEQ ID NO: 2777095 - DNA, 14 bp, Homo sapiens
tctcctgtccaacc

SEQ ID NO: 2777096 - DNA, 18 bp, Homo sapiens
tctcctgtgcccacatcc

SEQ ID NO: 2777097 - DNA, 19 bp, Homo sapiens
tctccttcccctttcccca

SEQ ID NO: 2777098 - DNA, 21 bp, Homo sapiens
tctcctttgcactgagggcca

SEQ ID NO: 2777099 - DNA, 22 bp, Homo sapiens
tctcctttgcactgagggccac

SEQ ID NO: 2777100 - DNA, 23 bp, Homo sapiens
tctcctttgcactgagggccaca

SEQ ID NO: 2777101 - DNA, 16 bp, Homo sapiens
tctcgagcgccctgca

SEQ ID NO: 2777102 - DNA, 17 bp, Homo sapiens
tctcgagcgccctgcag

SEQ ID NO: 2777103 - DNA, 18 bp, Homo sapiens
tctcgagcgccctgcaga

SEQ ID NO: 2777104 - DNA, 19 bp, Homo sapiens
tctcgcattttctctagct

SEQ ID NO: 2777105 - DNA, 22 bp, Homo sapiens
tctcggggcgacccctcagtgc

SEQ ID NO: 2777106 - DNA, 17 bp, Homo sapiens
tctcggttccacgtccc

SEQ ID NO: 2777107 - DNA, 18 bp, Homo sapiens
tctctaaaaataaaatga

SEQ ID NO: 2777108 - DNA, 18 bp, Homo sapiens
tctctacccggcccagag

SEQ ID NO: 2777109 - DNA, 17 bp, Homo sapiens
tctctagaattttaagt

SEQ ID NO: 2777110 - DNA, 22 bp, Homo sapiens
tctctagaattttaagtgcttt

SEQ ID NO: 2777111 - DNA, 12 bp, Homo sapiens
tctctagagaac

SEQ ID NO: 2777112 - DNA, 20 bp, Homo sapiens
tctctagctgatcagaattt

SEQ ID NO: 2777113 - DNA, 14 bp, Homo sapiens
tctctcaggagcac

SEQ ID NO: 2777114 - DNA, 15 bp, Homo sapiens
tctctcaggagcaca

SEQ ID NO: 2777115 - DNA, 18 bp, Homo sapiens
tctctcaggagcacaggc

SEQ ID NO: 2777116 - DNA, 21 bp, Homo sapiens
tctctcaggagcacaggcagc

SEQ ID NO: 2777117 - DNA, 14 bp, Homo sapiens
tctctccaggaagg

SEQ ID NO: 2777118 - DNA, 16 bp, Homo sapiens
tgaaatatgatgttaa

SEQ ID NO: 2777119 - DNA, 16 bp, Homo sapiens
tgaaatatttgcttat

SEQ ID NO: 2777120 - DNA, 17 bp, Homo sapiens
tgaaatatttgcttatt

SEQ ID NO: 2777121 - DNA, 19 bp, Homo sapiens
tgaaatatttgcttattta

SEQ ID NO: 2777122 - DNA, 19 bp, Homo sapiens
tgaaatgaggtcagagcct

SEQ ID NO: 2777123 - DNA, 20 bp, Homo sapiens
tgaaatgaggtcagagcctg

SEQ ID NO: 2777124 - DNA, 22 bp, Homo sapiens
tgaaatgaggtcagagcctgca

SEQ ID NO: 2777125 - DNA, 16 bp, Homo sapiens
tgaaatgctctccttt

SEQ ID NO: 2777126 - DNA, 17 bp, Homo sapiens
tgaaatgctctcctttc

SEQ ID NO: 2777127 - DNA, 16 bp, Homo sapiens
tgaaatgggctttaac

SEQ ID NO: 2777128 - DNA, 18 bp, Homo sapiens
tgaaatgggctttaacaa

SEQ ID NO: 2777129 - DNA, 15 bp, Homo sapiens
tgaaatgtttcacta

SEQ ID NO: 2777130 - DNA, 14 bp, Homo sapiens
tgaaattatatctg

SEQ ID NO: 2777131 - DNA, 17 bp, Homo sapiens
tgaaattcaacctgtgt

SEQ ID NO: 2777132 - DNA, 12 bp, Homo sapiens
tgaaatttcaga

SEQ ID NO: 2777133 - DNA, 17 bp, Homo sapiens
tgaacaaaagcttttct

SEQ ID NO: 2777134 - DNA, 23 bp, Homo sapiens
tgaacaccaacttttatttggaa

SEQ ID NO: 2777135 - DNA, 19 bp, Homo sapiens
tgaacaccactttgtctct

SEQ ID NO: 2777136 - DNA, 23 bp, Homo sapiens
tgaacaccactttgtctctgaga

SEQ ID NO: 2777137 - DNA, 13 bp, Homo sapiens
tgaacagaacata

SEQ ID NO: 2777138 - DNA, 22 bp, Homo sapiens
tgaacatggagaggacttttgg

SEQ ID NO: 2777139 - DNA, 20 bp, Homo sapiens
tgaacatttgctttgttttc

SEQ ID NO: 2777140 - DNA, 21 bp, Homo sapiens
tgaaccacatcttgctctgct

SEQ ID NO: 2777141 - DNA, 16 bp, Homo sapiens
tgaaccactttgcctc

SEQ ID NO: 2777142 - DNA, 14 bp, Homo sapiens
tgaacccaggaggt

SEQ ID NO: 2777143 - DNA, 22 bp, Homo sapiens
tgaacccccgccatccttcacc

SEQ ID NO: 2777144 - DNA, 16 bp, Homo sapiens
tgaacggggagaaaag

SEQ ID NO: 2777145 - DNA, 17 bp, Homo sapiens
tgaactcaactttgaca

SEQ ID NO: 2777146 - DNA, 15 bp, Homo sapiens
tgaactcaagctgcg

SEQ ID NO: 2777147 - DNA, 14 bp, Homo sapiens
tgaactcctggcct

SEQ ID NO: 2777148 - DNA, 20 bp, Homo sapiens
tgaactgagcctagctacct

SEQ ID NO: 2777149 - DNA, 12 bp, Homo sapiens
tgaactgattca

SEQ ID NO: 2777150 - DNA, 19 bp, Homo sapiens
tgaactgggtacttgtgga

SEQ ID NO: 2777151 - DNA, 23 bp, Homo sapiens
tgaactgggtacttgtggacaca

SEQ ID NO: 2777152 - DNA, 11 bp, Homo sapiens
tgaactgtgac

SEQ ID NO: 2777153 - DNA, 14 bp, Homo sapiens
tgaactgtgacagg

SEQ ID NO: 2777154 - DNA, 22 bp, Homo sapiens
tgaacttaaataaatgtcatta

SEQ ID NO: 2777155 - DNA, 16 bp, Homo sapiens
tgaacttgaggacaca

SEQ ID NO: 2777156 - DNA, 18 bp, Homo sapiens
tgaacttgaggacacatg

SEQ ID NO: 2777157 - DNA, 21 bp, Homo sapiens
tgaacttgaggacacatgtcc

SEQ ID NO: 2777158 - DNA, 19 bp, Homo sapiens
tgaagaaaaaatacatttt

SEQ ID NO: 2777159 - DNA, 19 bp, Homo sapiens
tgaagaaaaaggctggctg

SEQ ID NO: 2777160 - DNA, 11 bp, Homo sapiens
tgaagaagaga

SEQ ID NO: 2777161 - DNA, 17 bp, Homo sapiens
tgaagaagagtttgcaa

SEQ ID NO: 2777162 - DNA, 20 bp, Homo sapiens
tgaagaatacttctcatttt

SEQ ID NO: 2777163 - DNA, 21 bp, Homo sapiens
tgaagaatacttctcattttt

SEQ ID NO: 2777164 - DNA, 22 bp, Homo sapiens
tgaagacccagcaggaagccag

SEQ ID NO: 2777165 - DNA, 19 bp, Homo sapiens
tgaagacccagtgtaaaga

SEQ ID NO: 2777166 - DNA, 23 bp, Homo sapiens
tgaagacccagtgtaaagaataa

SEQ ID NO: 2777167 - DNA, 19 bp, Homo sapiens
tgaagactcattcttctgt

SEQ ID NO: 2777168 - DNA, 20 bp, Homo sapiens
tattttccatgaaaatgcaa

SEQ ID NO: 2777169 - DNA, 21 bp, Homo sapiens
tattttccctctcttgccttt

SEQ ID NO: 2777170 - DNA, 13 bp, Homo sapiens
tattttgtaataa

SEQ ID NO: 2777171 - DNA, 17 bp, Homo sapiens
tattttgtaataaactc

SEQ ID NO: 2777172 - DNA, 19 bp, Homo sapiens
tattttgtaataaactctc

SEQ ID NO: 2777173 - DNA, 21 bp, Homo sapiens
tattttgtaataaactctcta

SEQ ID NO: 2777174 - DNA, 19 bp, Homo sapiens
tattttgttaataataaga

SEQ ID NO: 2777175 - DNA, 15 bp, Homo sapiens
tattttgttgtgatt

SEQ ID NO: 2777176 - DNA, 12 bp, Homo sapiens
tatttttagaga

SEQ ID NO: 2777177 - DNA, 16 bp, Homo sapiens
tatttttcaaccagca

SEQ ID NO: 2777178 - DNA, 17 bp, Homo sapiens
tatttttcaaccagcat

SEQ ID NO: 2777179 - DNA, 19 bp, Homo sapiens
tatttttgaacccctgtgt

SEQ ID NO: 2777180 - DNA, 15 bp, Homo sapiens
tattttttaagtatt

SEQ ID NO: 2777181 - DNA, 12 bp, Homo sapiens
tattttttaatt

SEQ ID NO: 2777182 - DNA, 15 bp, Homo sapiens
tattttttctacaca

SEQ ID NO: 2777183 - DNA, 18 bp, Homo sapiens
tattttttctacacagta

SEQ ID NO: 2777184 - DNA, 17 bp, Homo sapiens
tattttttttaagtatt

SEQ ID NO: 2777185 - DNA, 17 bp, Homo sapiens
tcaaaaattacactaca

SEQ ID NO: 2777186 - DNA, 18 bp, Homo sapiens
tcaaaaattacactacaa

SEQ ID NO: 2777187 - DNA, 16 bp, Homo sapiens
tcaaaaattgaagaga

SEQ ID NO: 2777188 - DNA, 22 bp, Homo sapiens
tcaaaaattgtgtttagatttt

SEQ ID NO: 2777189 - DNA, 16 bp, Homo sapiens
tcaaaacagattgttt

SEQ ID NO: 2777190 - DNA, 22 bp, Homo sapiens
tcaaaacattgtgccatgtcaa

SEQ ID NO: 2777191 - DNA, 18 bp, Homo sapiens
tcaaaacggggcagccaa

SEQ ID NO: 2777192 - DNA, 13 bp, Homo sapiens
tcaaaaggtgcct

SEQ ID NO: 2777193 - DNA, 19 bp, Homo sapiens
tcaaaatatttgtacatag

SEQ ID NO: 2777194 - DNA, 21 bp, Homo sapiens
tcaaaatcactatctttctga

SEQ ID NO: 2777195 - DNA, 21 bp, Homo sapiens
tcaaaccataaacttcatggt

SEQ ID NO: 2777196 - DNA, 15 bp, Homo sapiens
tcaaaccatttaatt

SEQ ID NO: 2777197 - DNA, 18 bp, Homo sapiens
tcaaaccatttaattcat

SEQ ID NO: 2777198 - DNA, 19 bp, Homo sapiens
tcaaaccatttaattcata

SEQ ID NO: 2777199 - DNA, 23 bp, Homo sapiens
tcaaaccatttaattcataatta

SEQ ID NO: 2777200 - DNA, 12 bp, Homo sapiens
tcaaagaaggaa

SEQ ID NO: 2777201 - DNA, 21 bp, Homo sapiens
tcaaagcaagcattcagaaga

SEQ ID NO: 2777202 - DNA, 19 bp, Homo sapiens
tcaaagctgtgtgtttgga

SEQ ID NO: 2777203 - DNA, 15 bp, Homo sapiens
tcaaagctttttcca

SEQ ID NO: 2777204 - DNA, 19 bp, Homo sapiens
tcaaagtaaaacttgctgc

SEQ ID NO: 2777205 - DNA, 13 bp, Homo sapiens
tcaaagtttaata

SEQ ID NO: 2777206 - DNA, 15 bp, Homo sapiens
tcaaatatctcagag

SEQ ID NO: 2777207 - DNA, 20 bp, Homo sapiens
tcaaatatctcagaggctat

SEQ ID NO: 2777208 - DNA, 16 bp, Homo sapiens
tcaaatattaccaaaa

SEQ ID NO: 2777209 - DNA, 14 bp, Homo sapiens
tcaaatctattcag

SEQ ID NO: 2777210 - DNA, 16 bp, Homo sapiens
tcaaatgctaaatgca

SEQ ID NO: 2777211 - DNA, 14 bp, Homo sapiens
tcaacaaagaaata

SEQ ID NO: 2777212 - DNA, 15 bp, Homo sapiens
tcaacaaagaaatat

SEQ ID NO: 2777213 - DNA, 18 bp, Homo sapiens
tcaacaaagaaatattat

SEQ ID NO: 2777214 - DNA, 12 bp, Homo sapiens
tcaacagagaag

SEQ ID NO: 2777215 - DNA, 15 bp, Homo sapiens
tcaacatctaagcct

SEQ ID NO: 2777216 - DNA, 19 bp, Homo sapiens
tcaaccaacctccccgcag

SEQ ID NO: 2777217 - DNA, 14 bp, Homo sapiens
tcaaccactgtggc

SEQ ID NO: 2777218 - DNA, 17 bp, Homo sapiens
tcaaccagcattttact

SEQ ID NO: 2777219 - DNA, 18 bp, Homo sapiens
tcaacccccatttctatt

SEQ ID NO: 2777220 - DNA, 17 bp, Homo sapiens
tcaaccctcagccttga

SEQ ID NO: 2777221 - DNA, 17 bp, Homo sapiens
tcaaccgcttgccatat

SEQ ID NO: 2777222 - DNA, 15 bp, Homo sapiens
tcaacctaccacccc

SEQ ID NO: 2777223 - DNA, 18 bp, Homo sapiens
tcaacctaccaccccttc

SEQ ID NO: 2777224 - DNA, 20 bp, Homo sapiens
tcaacctctctccttctggc

SEQ ID NO: 2777225 - DNA, 14 bp, Homo sapiens
tcaactccagctcc

SEQ ID NO: 2777226 - DNA, 24 bp, Homo sapiens
tcaactgaccagcctccatgctgc

SEQ ID NO: 2777227 - DNA, 15 bp, Homo sapiens
tcaacttttcctttg

SEQ ID NO: 2777228 - DNA, 18 bp, Homo sapiens
tcaagaaaaattattgta

SEQ ID NO: 2777229 - DNA, 17 bp, Homo sapiens
tcaagaaaactggaaat

SEQ ID NO: 2777230 - DNA, 18 bp, Homo sapiens
tcaagaaactgaggaatt

SEQ ID NO: 2777231 - DNA, 17 bp, Homo sapiens
tcaagaaataagttttt

SEQ ID NO: 2777232 - DNA, 15 bp, Homo sapiens
tcaagagaagaaaaa

SEQ ID NO: 2777233 - DNA, 17 bp, Homo sapiens
tcaagagaagaaaaaat

SEQ ID NO: 2777234 - DNA, 23 bp, Homo sapiens
tcaagagaagaaaaaattaagag

SEQ ID NO: 2777235 - DNA, 12 bp, Homo sapiens
tcaagaggctga

SEQ ID NO: 2777236 - DNA, 17 bp, Homo sapiens
tcaagatgacagctctt

SEQ ID NO: 2777237 - DNA, 18 bp, Homo sapiens
gacttgggcacccccagc

SEQ ID NO: 2777238 - DNA, 20 bp, Homo sapiens
gacttgggcacccccagcct

SEQ ID NO: 2777239 - DNA, 12 bp, Homo sapiens
gactttcaggta

SEQ ID NO: 2777240 - DNA, 18 bp, Homo sapiens
gactttggttctctccag

SEQ ID NO: 2777241 - DNA, 16 bp, Homo sapiens
gacttttctaaagctc

SEQ ID NO: 2777242 - DNA, 21 bp, Homo sapiens
gacttttctttgtggcttcct

SEQ ID NO: 2777243 - DNA, 19 bp, Homo sapiens
gacttttggtttttatatt

SEQ ID NO: 2777244 - DNA, 22 bp, Homo sapiens
gactttttataatgtggatttc

SEQ ID NO: 2777245 - DNA, 23 bp, Homo sapiens
gagaaaccttattgtacctctct

SEQ ID NO: 2777246 - DNA, 13 bp, Homo sapiens
gagaaagaagaga

SEQ ID NO: 2777247 - DNA, 18 bp, Homo sapiens
gagaaagaagagacagga

SEQ ID NO: 2777248 - DNA, 23 bp, Homo sapiens
gagaaagtacttctccaccctgc

SEQ ID NO: 2777249 - DNA, 12 bp, Homo sapiens
gagaacctggcc

SEQ ID NO: 2777250 - DNA, 14 bp, Homo sapiens
gagaacctggcctt

SEQ ID NO: 2777251 - DNA, 17 bp, Homo sapiens
gagaactcgaagccctt

SEQ ID NO: 2777252 - DNA, 18 bp, Homo sapiens
gagaactcgaagcccttc

SEQ ID NO: 2777253 - DNA, 23 bp, Homo sapiens
gagaactcgaagcccttccagtg

SEQ ID NO: 2777254 - DNA, 20 bp, Homo sapiens
gagaactgggatttgaaccc

SEQ ID NO: 2777255 - DNA, 13 bp, Homo sapiens
gagaagaggctgg

SEQ ID NO: 2777256 - DNA, 15 bp, Homo sapiens
gagaagagggcctgt

SEQ ID NO: 2777257 - DNA, 14 bp, Homo sapiens
gagaagcagtgagc

SEQ ID NO: 2777258 - DNA, 12 bp, Homo sapiens
gagaagccgcag

SEQ ID NO: 2777259 - DNA, 23 bp, Homo sapiens
gagaagctgatgctttgcttcaa

SEQ ID NO: 2777260 - DNA, 18 bp, Homo sapiens
gagaaggaaaattttagc

SEQ ID NO: 2777261 - DNA, 21 bp, Homo sapiens
gagaaggaaggagactcacct

SEQ ID NO: 2777262 - DNA, 14 bp, Homo sapiens
gagaaggccgctgc

SEQ ID NO: 2777263 - DNA, 15 bp, Homo sapiens
gagaagggatggagg

SEQ ID NO: 2777264 - DNA, 21 bp, Homo sapiens
gagaagggggattggagggaa

SEQ ID NO: 2777265 - DNA, 23 bp, Homo sapiens
gagaagtatccaattatgtgaca

SEQ ID NO: 2777266 - DNA, 17 bp, Homo sapiens
gagaagtttctggccct

SEQ ID NO: 2777267 - DNA, 22 bp, Homo sapiens
gagaataagagaaagaaaatga

SEQ ID NO: 2777268 - DNA, 16 bp, Homo sapiens
gagaataattgtgtac

SEQ ID NO: 2777269 - DNA, 17 bp, Homo sapiens
gagaataattgtgtaca

SEQ ID NO: 2777270 - DNA, 14 bp, Homo sapiens
gagaatatatacat

SEQ ID NO: 2777271 - DNA, 15 bp, Homo sapiens
gagaatctatattta

SEQ ID NO: 2777272 - DNA, 13 bp, Homo sapiens
gagaattctaaga

SEQ ID NO: 2777273 - DNA, 17 bp, Homo sapiens
tcactattcctaggagg

SEQ ID NO: 2777274 - DNA, 11 bp, Homo sapiens
tcactcccaga

SEQ ID NO: 2777275 - DNA, 20 bp, Homo sapiens
tcactcctgttacttaccta

SEQ ID NO: 2777276 - DNA, 16 bp, Homo sapiens
tcactctgtcgcccag

SEQ ID NO: 2777277 - DNA, 22 bp, Homo sapiens
tcactctgtcgcccagtctgga

SEQ ID NO: 2777278 - DNA, 23 bp, Homo sapiens
tcactcttattgcccacgctgga

SEQ ID NO: 2777279 - DNA, 17 bp, Homo sapiens
tcactgaccctggagcg

SEQ ID NO: 2777280 - DNA, 18 bp, Homo sapiens
tcactgaccctggagcgg

SEQ ID NO: 2777281 - DNA, 19 bp, Homo sapiens
tcactgccccaccagccac

SEQ ID NO: 2777282 - DNA, 21 bp, Homo sapiens
tcactgccccaccagccacct

SEQ ID NO: 2777283 - DNA, 22 bp, Homo sapiens
tcactgccccaccagccacctc

SEQ ID NO: 2777284 - DNA, 22 bp, Homo sapiens
tcactgctacaccttagcagct

SEQ ID NO: 2777285 - DNA, 21 bp, Homo sapiens
tcactggggtcctggggcctc

SEQ ID NO: 2777286 - DNA, 19 bp, Homo sapiens
tcactggtagaccaaaata

SEQ ID NO: 2777287 - DNA, 18 bp, Homo sapiens
tcactgtccctcaaatga

SEQ ID NO: 2777288 - DNA, 14 bp, Homo sapiens
tcactgttgcccag

SEQ ID NO: 2777289 - DNA, 18 bp, Homo sapiens
tcactgttgcccaggctg

SEQ ID NO: 2777290 - DNA, 14 bp, Homo sapiens
tcacttcaatgaac

SEQ ID NO: 2777291 - DNA, 18 bp, Homo sapiens
tcactttaattctcatgt

SEQ ID NO: 2777292 - DNA, 19 bp, Homo sapiens
tcacttttaatgaacaaat

SEQ ID NO: 2777293 - DNA, 21 bp, Homo sapiens
tcacttttaatgaacaaatgg

SEQ ID NO: 2777294 - DNA, 13 bp, Homo sapiens
tcagaaaccagtt

SEQ ID NO: 2777295 - DNA, 22 bp, Homo sapiens
tcagaaactcgatgaatgtgtt

SEQ ID NO: 2777296 - DNA, 14 bp, Homo sapiens
tcagaaagagcaag

SEQ ID NO: 2777297 - DNA, 23 bp, Homo sapiens
tcagaaagagcaagtctggatct

SEQ ID NO: 2777298 - DNA, 14 bp, Homo sapiens
tcagaaagggaggg

SEQ ID NO: 2777299 - DNA, 14 bp, Homo sapiens
tcagaacagcagac

SEQ ID NO: 2777300 - DNA, 14 bp, Homo sapiens
tcagaagacactga

SEQ ID NO: 2777301 - DNA, 12 bp, Homo sapiens
tcagaagcctgg

SEQ ID NO: 2777302 - DNA, 15 bp, Homo sapiens
tcagaagcctggggg

SEQ ID NO: 2777303 - DNA, 20 bp, Homo sapiens
tcagaagcctgggggcctgg

SEQ ID NO: 2777304 - DNA, 16 bp, Homo sapiens
tcagaaggagaaggaa

SEQ ID NO: 2777305 - DNA, 19 bp, Homo sapiens
tcagaaggagaaggaagga

SEQ ID NO: 2777306 - DNA, 19 bp, Homo sapiens
tcagaatatggacaaagaa

SEQ ID NO: 2777307 - DNA, 17 bp, Homo sapiens
tcagaattgaaggagaa

SEQ ID NO: 2777308 - DNA, 15 bp, Homo sapiens
tcagaattttaccaa

SEQ ID NO: 2777309 - DNA, 11 bp, Homo sapiens
tcagacaagca

SEQ ID NO: 2777310 - DNA, 19 bp, Homo sapiens
tcagacacttcatggacca

SEQ ID NO: 2777311 - DNA, 20 bp, Homo sapiens
tcagacacttcatggaccaa

SEQ ID NO: 2777312 - DNA, 18 bp, Homo sapiens
tcagacagaacccctaca

SEQ ID NO: 2777313 - DNA, 12 bp, Homo sapiens
tcagaccccagc

SEQ ID NO: 2777314 - DNA, 13 bp, Homo sapiens
tcagaccccagcg

SEQ ID NO: 2777315 - DNA, 17 bp, Homo sapiens
tcagaccccagcggctg

SEQ ID NO: 2777316 - DNA, 16 bp, Homo sapiens
tcagaccctaccccac

SEQ ID NO: 2777317 - DNA, 17 bp, Homo sapiens
tcagactgctgggactg

SEQ ID NO: 2777318 - DNA, 21 bp, Homo sapiens
tcagactgctgggactggcca

SEQ ID NO: 2777319 - DNA, 23 bp, Homo sapiens
tcagactgctgggactggccagg

SEQ ID NO: 2777320 - DNA, 13 bp, Homo sapiens
tcagactggctgg

SEQ ID NO: 2777321 - DNA, 14 bp, Homo sapiens
tcagactggctggc

SEQ ID NO: 2777322 - DNA, 16 bp, Homo sapiens
tcagactttaaagaat

SEQ ID NO: 2777323 - DNA, 12 bp, Homo sapiens
tcagagaagtca

SEQ ID NO: 2777324 - DNA, 12 bp, Homo sapiens
tcagagaatttc

SEQ ID NO: 2777325 - DNA, 13 bp, Homo sapiens
tcagagaatttct

SEQ ID NO: 2777326 - DNA, 20 bp, Homo sapiens
tcagagacaggtggcctagc

SEQ ID NO: 2777327 - DNA, 16 bp, Homo sapiens
tcagagaggccttttg

SEQ ID NO: 2777328 - DNA, 21 bp, Homo sapiens
tcagagaggccttttggaatg

SEQ ID NO: 2777329 - DNA, 18 bp, Homo sapiens
tcagagatgtaccatgtt

SEQ ID NO: 2777330 - DNA, 13 bp, Homo sapiens
tcagagcctgcag

SEQ ID NO: 2777331 - DNA, 14 bp, Homo sapiens
tcagaggctgcagg

SEQ ID NO: 2777332 - DNA, 16 bp, Homo sapiens
tcagagttgcttttct

SEQ ID NO: 2777333 - DNA, 19 bp, Homo sapiens
tcagagttgcttttctaat

SEQ ID NO: 2777334 - DNA, 17 bp, Homo sapiens
tcagataaagtgaccag

SEQ ID NO: 2777335 - DNA, 21 bp, Homo sapiens
tcatcaatttttatacatatc

SEQ ID NO: 2777336 - DNA, 21 bp, Homo sapiens
tcatcagcatacctttattgt

SEQ ID NO: 2777337 - DNA, 21 bp, Homo sapiens
tcatcagcatttaataaatgt

SEQ ID NO: 2777338 - DNA, 18 bp, Homo sapiens
tcatcaggcttggaatga

SEQ ID NO: 2777339 - DNA, 23 bp, Homo sapiens
tcatcaggcttggaatgaattct

SEQ ID NO: 2777340 - DNA, 14 bp, Homo sapiens
tcatcatattgtat

SEQ ID NO: 2777341 - DNA, 17 bp, Homo sapiens
tcatcatattgtatgta

SEQ ID NO: 2777342 - DNA, 17 bp, Homo sapiens
tcatccactgtgccatg

SEQ ID NO: 2777343 - DNA, 15 bp, Homo sapiens
tcatccagttgcaat

SEQ ID NO: 2777344 - DNA, 16 bp, Homo sapiens
tcatccagttgcaata

SEQ ID NO: 2777345 - DNA, 17 bp, Homo sapiens
tcatccagttgcaataa

SEQ ID NO: 2777346 - DNA, 19 bp, Homo sapiens
tcatccagttgcaataaaa

SEQ ID NO: 2777347 - DNA, 21 bp, Homo sapiens
tcatcccatctaagctgcagc

SEQ ID NO: 2777348 - DNA, 14 bp, Homo sapiens
tcatccgaggcagg

SEQ ID NO: 2777349 - DNA, 15 bp, Homo sapiens
tcatcctgccttcat

SEQ ID NO: 2777350 - DNA, 23 bp, Homo sapiens
tcatcctgccttcatggaactca

SEQ ID NO: 2777351 - DNA, 20 bp, Homo sapiens
tcatctatggcagtccagcc

SEQ ID NO: 2777352 - DNA, 23 bp, Homo sapiens
tcatctatggcagtccagccagc

SEQ ID NO: 2777353 - DNA, 23 bp, Homo sapiens
tcatctattctttccctagaggc

SEQ ID NO: 2777354 - DNA, 14 bp, Homo sapiens
tcatctatttctga

SEQ ID NO: 2777355 - DNA, 17 bp, Homo sapiens
tcatctatttctgagaa

SEQ ID NO: 2777356 - DNA, 18 bp, Homo sapiens
tcatctatttctgagaag

SEQ ID NO: 2777357 - DNA, 21 bp, Homo sapiens
tcatctcatttaagggaaaaa

SEQ ID NO: 2777358 - DNA, 13 bp, Homo sapiens
tcatgaaaagtgc

SEQ ID NO: 2777359 - DNA, 15 bp, Homo sapiens
tcatgaacacagcct

SEQ ID NO: 2777360 - DNA, 11 bp, Homo sapiens
tcatgaacctc

SEQ ID NO: 2777361 - DNA, 14 bp, Homo sapiens
tcatgacagccaga

SEQ ID NO: 2777362 - DNA, 18 bp, Homo sapiens
tcatgaccctcctgtcca

SEQ ID NO: 2777363 - DNA, 21 bp, Homo sapiens
tcatgaggggagaggcgccct

SEQ ID NO: 2777364 - DNA, 17 bp, Homo sapiens
tcatgataatgaacaga

SEQ ID NO: 2777365 - DNA, 17 bp, Homo sapiens
tcatgatctccctgccg

SEQ ID NO: 2777366 - DNA, 11 bp, Homo sapiens
tcatgattttt

SEQ ID NO: 2777367 - DNA, 17 bp, Homo sapiens
tcatgccaaagcaaaag

SEQ ID NO: 2777368 - DNA, 14 bp, Homo sapiens
tcatgcctctgagg

SEQ ID NO: 2777369 - DNA, 16 bp, Homo sapiens
tcatgcctctgaggcc

SEQ ID NO: 2777370 - DNA, 17 bp, Homo sapiens
tcatgctgacttgcaga

SEQ ID NO: 2777371 - DNA, 18 bp, Homo sapiens
tcatgctgacttgcagag

SEQ ID NO: 2777372 - DNA, 13 bp, Homo sapiens
tcatgcttcagtt

SEQ ID NO: 2777373 - DNA, 21 bp, Homo sapiens
tcatggaccaagaatgagctg

SEQ ID NO: 2777374 - DNA, 18 bp, Homo sapiens
tcatggcccaaatccagt

SEQ ID NO: 2777375 - DNA, 15 bp, Homo sapiens
tcatgtaccatcaat

SEQ ID NO: 2777376 - DNA, 18 bp, Homo sapiens
tcatgtaccatcaataaa

SEQ ID NO: 2777377 - DNA, 21 bp, Homo sapiens
tcatgtggaatggattataga

SEQ ID NO: 2777378 - DNA, 15 bp, Homo sapiens
tcattaaatggggct

SEQ ID NO: 2777379 - DNA, 15 bp, Homo sapiens
tcattaaattttcta

SEQ ID NO: 2777380 - DNA, 15 bp, Homo sapiens
tcattactgcctttg

SEQ ID NO: 2777381 - DNA, 13 bp, Homo sapiens
tcattagctgtga

SEQ ID NO: 2777382 - DNA, 15 bp, Homo sapiens
tcattcaatatctga

SEQ ID NO: 2777383 - DNA, 13 bp, Homo sapiens
tcattcccctcgt

SEQ ID NO: 2777384 - DNA, 14 bp, Homo sapiens
tcattcctgaaaga

SEQ ID NO: 2777385 - DNA, 23 bp, Homo sapiens
tcattccttgagaaaaacaatga

SEQ ID NO: 2777386 - DNA, 19 bp, Homo sapiens
tcattctcttatatagtat

SEQ ID NO: 2777387 - DNA, 14 bp, Homo sapiens
tcattgaagtattt

SEQ ID NO: 2777388 - DNA, 13 bp, Homo sapiens
tcattgatatgaa

SEQ ID NO: 2777389 - DNA, 17 bp, Homo sapiens
tcattgatatgaaaaat

SEQ ID NO: 2777390 - DNA, 14 bp, Homo sapiens
tcattgtataaaaa

SEQ ID NO: 2777391 - DNA, 16 bp, Homo sapiens
tcattgtccatgccta

SEQ ID NO: 2777392 - DNA, 15 bp, Homo sapiens
tcatttaactacaaa

SEQ ID NO: 2777393 - DNA, 14 bp, Homo sapiens
tcatttaagggaaa

SEQ ID NO: 2777394 - DNA, 23 bp, Homo sapiens
tcatttaagggaaaaatatatat

SEQ ID NO: 2777395 - DNA, 22 bp, Homo sapiens
tcatttaccataaaaatccttc

SEQ ID NO: 2777396 - DNA, 18 bp, Homo sapiens
tcatttcactttaaagtc

SEQ ID NO: 2777397 - DNA, 14 bp, Homo sapiens
tcatttcatctcat

SEQ ID NO: 2777398 - DNA, 15 bp, Homo sapiens
tcatttcatctcatt

SEQ ID NO: 2777399 - DNA, 16 bp, Homo sapiens
tcatttcatctcattt

SEQ ID NO: 2777400 - DNA, 17 bp, Homo sapiens
tcatttcatctcattta

SEQ ID NO: 2777401 - DNA, 15 bp, Homo sapiens
tcatttcatttccta

SEQ ID NO: 2777402 - DNA, 16 bp, Homo sapiens
tcatttgtcacacact

SEQ ID NO: 2777403 - DNA, 22 bp, Homo sapiens
tcattttaacatctgagaaaag

SEQ ID NO: 2777404 - DNA, 22 bp, Homo sapiens
tcattttggtaaaatacttctt

SEQ ID NO: 2777405 - DNA, 19 bp, Homo sapiens
tcatttttagtagagacag

SEQ ID NO: 2777406 - DNA, 16 bp, Homo sapiens
tcatttttttaacaca

SEQ ID NO: 2777407 - DNA, 21 bp, Homo sapiens
tccaaacctcctgttagctgt

SEQ ID NO: 2777408 - DNA, 19 bp, Homo sapiens
tccaaacttctaaatgttg

SEQ ID NO: 2777409 - DNA, 22 bp, Homo sapiens
tccaaacttctaaatgttggaa

SEQ ID NO: 2777410 - DNA, 19 bp, Homo sapiens
tccaaagcacattgaaaga

SEQ ID NO: 2777411 - DNA, 16 bp, Homo sapiens
tccaaatgaatgacct

SEQ ID NO: 2777412 - DNA, 20 bp, Homo sapiens
tccaaatgaatgttgtctgt

SEQ ID NO: 2777413 - DNA, 19 bp, Homo sapiens
tccaacaactccaggaaaa

SEQ ID NO: 2777414 - DNA, 18 bp, Homo sapiens
tccaacaataaagagctc

SEQ ID NO: 2777415 - DNA, 15 bp, Homo sapiens
tccaacagacagggc

SEQ ID NO: 2777416 - DNA, 19 bp, Homo sapiens
tccaacagctcaagtcttc

SEQ ID NO: 2777417 - DNA, 21 bp, Homo sapiens
tccaactggattataaataaa

SEQ ID NO: 2777418 - DNA, 12 bp, Homo sapiens
tccaagagaatt

SEQ ID NO: 2777419 - DNA, 19 bp, Homo sapiens
tccaagagaattcacttta

SEQ ID NO: 2777420 - DNA, 21 bp, Homo sapiens
tccaagagctacataatttag

SEQ ID NO: 2777421 - DNA, 11 bp, Homo sapiens
tccaagcaaag

SEQ ID NO: 2777422 - DNA, 11 bp, Homo sapiens
tccaagctggt

SEQ ID NO: 2777423 - DNA, 16 bp, Homo sapiens
tccaagctggtcccac

SEQ ID NO: 2777424 - DNA, 21 bp, Homo sapiens
tccaagctggtcccactcagt

SEQ ID NO: 2777425 - DNA, 13 bp, Homo sapiens
tcagcctgaggct

SEQ ID NO: 2777426 - DNA, 20 bp, Homo sapiens
tcagcctgaggctgagactg

SEQ ID NO: 2777427 - DNA, 12 bp, Homo sapiens
tcagcctgtgct

SEQ ID NO: 2777428 - DNA, 24 bp, Homo sapiens
tcagccttccccctcccagggcca

SEQ ID NO: 2777429 - DNA, 21 bp, Homo sapiens
tcagccttgaaaaacaagtct

SEQ ID NO: 2777430 - DNA, 14 bp, Homo sapiens
tcagcgagaccctt

SEQ ID NO: 2777431 - DNA, 16 bp, Homo sapiens
tcagcggggacagctc

SEQ ID NO: 2777432 - DNA, 18 bp, Homo sapiens
tcagcggggacagctcct

SEQ ID NO: 2777433 - DNA, 18 bp, Homo sapiens
tcagctaaagcccaacct

SEQ ID NO: 2777434 - DNA, 18 bp, Homo sapiens
tcagctccactttcagtg

SEQ ID NO: 2777435 - DNA, 19 bp, Homo sapiens
tcagctccagaataccttc

SEQ ID NO: 2777436 - DNA, 22 bp, Homo sapiens
tcagctccagaataccttcttc

SEQ ID NO: 2777437 - DNA, 15 bp, Homo sapiens
tcagctccagctcac

SEQ ID NO: 2777438 - DNA, 18 bp, Homo sapiens
tcagctgacacataattt

SEQ ID NO: 2777439 - DNA, 14 bp, Homo sapiens
tcagcttcatttcc

SEQ ID NO: 2777440 - DNA, 20 bp, Homo sapiens
tcagcttgtaaatagctcag

SEQ ID NO: 2777441 - DNA, 20 bp, Homo sapiens
tcaggaaaactgacagagga

SEQ ID NO: 2777442 - DNA, 14 bp, Homo sapiens
tcaggaacagaagg

SEQ ID NO: 2777443 - DNA, 16 bp, Homo sapiens
tcaggaacagaaggat

SEQ ID NO: 2777444 - DNA, 19 bp, Homo sapiens
tcaggaagggaaagccaga

SEQ ID NO: 2777445 - DNA, 15 bp, Homo sapiens
tcaggacacaggcct

SEQ ID NO: 2777446 - DNA, 16 bp, Homo sapiens
tcaggacacaggcctg

SEQ ID NO: 2777447 - DNA, 17 bp, Homo sapiens
tcaggacacaggcctgt

SEQ ID NO: 2777448 - DNA, 23 bp, Homo sapiens
tcaggacacaggcctgtgtagct

SEQ ID NO: 2777449 - DNA, 14 bp, Homo sapiens
tcaggacctggctt

SEQ ID NO: 2777450 - DNA, 20 bp, Homo sapiens
tcaggagaggggcagaacag

SEQ ID NO: 2777451 - DNA, 21 bp, Homo sapiens
tcaggagcttgcaagaagcag

SEQ ID NO: 2777452 - DNA, 17 bp, Homo sapiens
tcaggatcaagaaagtg

SEQ ID NO: 2777453 - DNA, 17 bp, Homo sapiens
tcaggcaaattggggag

SEQ ID NO: 2777454 - DNA, 20 bp, Homo sapiens
tcaggcccccacctggctca

SEQ ID NO: 2777455 - DNA, 21 bp, Homo sapiens
tcaggcccccacctggctcac

SEQ ID NO: 2777456 - DNA, 22 bp, Homo sapiens
tcaggcctataaccccagctcc

SEQ ID NO: 2777457 - DNA, 19 bp, Homo sapiens
tcaggcggggtgctgtggt

SEQ ID NO: 2777458 - DNA, 15 bp, Homo sapiens
tcaggctccattagg

SEQ ID NO: 2777459 - DNA, 16 bp, Homo sapiens
tcaggctccattagga

SEQ ID NO: 2777460 - DNA, 13 bp, Homo sapiens
tcaggctgaggtg

SEQ ID NO: 2777461 - DNA, 16 bp, Homo sapiens
tcaggcttgaaatgca

SEQ ID NO: 2777462 - DNA, 18 bp, Homo sapiens
tcagggacagagacacct

SEQ ID NO: 2777463 - DNA, 21 bp, Homo sapiens
tcagggcaactcggagagggc

SEQ ID NO: 2777464 - DNA, 16 bp, Homo sapiens
tcagggccccagcact

SEQ ID NO: 2777465 - DNA, 21 bp, Homo sapiens
tcagggtgggccactctcccc

SEQ ID NO: 2777466 - DNA, 23 bp, Homo sapiens
tcagggtgggccactctcccctc

SEQ ID NO: 2777467 - DNA, 19 bp, Homo sapiens
tcagggttggcccctgccc

SEQ ID NO: 2777468 - DNA, 23 bp, Homo sapiens
tcaggtaacaggcagatacagga

SEQ ID NO: 2777469 - DNA, 12 bp, Homo sapiens
tcaggtccctgc

SEQ ID NO: 2777470 - DNA, 15 bp, Homo sapiens
tcaggtggggcagct

SEQ ID NO: 2777471 - DNA, 17 bp, Homo sapiens
tcaggtggggcagcttg

SEQ ID NO: 2777472 - DNA, 19 bp, Homo sapiens
tcaggtggggcagcttgag

SEQ ID NO: 2777473 - DNA, 21 bp, Homo sapiens
tcaggtggggcagcttgaggg

SEQ ID NO: 2777474 - DNA, 15 bp, Homo sapiens
tcaggtgtccctgca

SEQ ID NO: 2777475 - DNA, 14 bp, Homo sapiens
tcaggttccatccc

SEQ ID NO: 2777476 - DNA, 15 bp, Homo sapiens
tcaggttgttaatgt

SEQ ID NO: 2777477 - DNA, 13 bp, Homo sapiens
tcaggttttgtaa

SEQ ID NO: 2777478 - DNA, 18 bp, Homo sapiens
tcagtaatttagaaatca

SEQ ID NO: 2777479 - DNA, 19 bp, Homo sapiens
tcagtaatttagaaatcat

SEQ ID NO: 2777480 - DNA, 21 bp, Homo sapiens
tcagtagtttgagaccagcct

SEQ ID NO: 2777481 - DNA, 16 bp, Homo sapiens
tcagtataaattgtcg

SEQ ID NO: 2777482 - DNA, 12 bp, Homo sapiens
tcagtcctggtc

SEQ ID NO: 2777483 - DNA, 20 bp, Homo sapiens
tcagtcctggtctgctcagg

SEQ ID NO: 2777484 - DNA, 23 bp, Homo sapiens
tcagtctgattcccaagctctgc

SEQ ID NO: 2777485 - DNA, 12 bp, Homo sapiens
tcagtgccacta

SEQ ID NO: 2777486 - DNA, 22 bp, Homo sapiens
tcagtgcccaccaacatcccat

SEQ ID NO: 2777487 - DNA, 17 bp, Homo sapiens
tcagtgctcggcagtca

SEQ ID NO: 2777488 - DNA, 14 bp, Homo sapiens
tcagtggcagctgc

SEQ ID NO: 2777489 - DNA, 15 bp, Homo sapiens
tcagtggcagctgct

SEQ ID NO: 2777490 - DNA, 16 bp, Homo sapiens
tcagtggcagctgctt

SEQ ID NO: 2777491 - DNA, 22 bp, Homo sapiens
tcagtgggaacgtgactgcccc

SEQ ID NO: 2777492 - DNA, 14 bp, Homo sapiens
tcagtgggagaaaa

SEQ ID NO: 2777493 - DNA, 20 bp, Homo sapiens
tcagtgtcatttatgaaaag

SEQ ID NO: 2777494 - DNA, 16 bp, Homo sapiens
tcagttactcagccct

SEQ ID NO: 2777495 - DNA, 17 bp, Homo sapiens
tcagttactcagccctg

SEQ ID NO: 2777496 - DNA, 19 bp, Homo sapiens
tcagttactcagccctggg

SEQ ID NO: 2777497 - DNA, 16 bp, Homo sapiens
tcagttactggtttca

SEQ ID NO: 2777498 - DNA, 13 bp, Homo sapiens
tcagttggagaaa

SEQ ID NO: 2777499 - DNA, 16 bp, Homo sapiens
tcagttttatcatttt

SEQ ID NO: 2777500 - DNA, 21 bp, Homo sapiens
tcataaaataaagtatatata

SEQ ID NO: 2777501 - DNA, 12 bp, Homo sapiens
tcataacaatgt

SEQ ID NO: 2777502 - DNA, 17 bp, Homo sapiens
tcataactttcattaaa

SEQ ID NO: 2777503 - DNA, 12 bp, Homo sapiens
tcataattttca

SEQ ID NO: 2777504 - DNA, 14 bp, Homo sapiens
tcataattttcaag

SEQ ID NO: 2777505 - DNA, 23 bp, Homo sapiens
tcatacaatgacaagtatgatga

SEQ ID NO: 2777506 - DNA, 15 bp, Homo sapiens
tcataccatctgctg

SEQ ID NO: 2777507 - DNA, 12 bp, Homo sapiens
tcatagctgaga

SEQ ID NO: 2777508 - DNA, 16 bp, Homo sapiens
tcatatattcatgtaa

SEQ ID NO: 2777509 - DNA, 21 bp, Homo sapiens
tcatatattcatgtaataaat

SEQ ID NO: 2777510 - DNA, 18 bp, Homo sapiens
tcatatcctttgccccaa

SEQ ID NO: 2777511 - DNA, 18 bp, Homo sapiens
tcatcaacaaagaaatat

SEQ ID NO: 2777512 - DNA, 14 bp, Homo sapiens
tcatcaatttaaaa

SEQ ID NO: 2777513 - DNA, 21 bp, Homo sapiens
tcatcaatttaaaatcattca

SEQ ID NO: 2777514 - DNA, 15 bp, Homo sapiens
tcatcaatttttata

SEQ ID NO: 2777515 - DNA, 22 bp, Homo sapiens
tatgagttgttttcagactcag

SEQ ID NO: 2777516 - DNA, 18 bp, Homo sapiens
tatgatattgcatatgca

SEQ ID NO: 2777517 - DNA, 14 bp, Homo sapiens
tatgatcacggctc

SEQ ID NO: 2777518 - DNA, 23 bp, Homo sapiens
tatgatcacggctcactgcagcc

SEQ ID NO: 2777519 - DNA, 15 bp, Homo sapiens
tatgatcccagcact

SEQ ID NO: 2777520 - DNA, 13 bp, Homo sapiens
tatgatctcagga

SEQ ID NO: 2777521 - DNA, 14 bp, Homo sapiens
tatgatgttaaaaa

SEQ ID NO: 2777522 - DNA, 18 bp, Homo sapiens
tatgatgttaaaaaaata

SEQ ID NO: 2777523 - DNA, 14 bp, Homo sapiens
tatgatttaaaaaa

SEQ ID NO: 2777524 - DNA, 20 bp, Homo sapiens
tatgatttaaaaaataaata

SEQ ID NO: 2777525 - DNA, 16 bp, Homo sapiens
tatgcaagaagaatat

SEQ ID NO: 2777526 - DNA, 20 bp, Homo sapiens
tatgcaaggaaggaaagaaa

SEQ ID NO: 2777527 - DNA, 16 bp, Homo sapiens
tatgcaatttcctttt

SEQ ID NO: 2777528 - DNA, 21 bp, Homo sapiens
tatgcaatttttaaactagta

SEQ ID NO: 2777529 - DNA, 20 bp, Homo sapiens
tatgcaccttgtgtctgtac

SEQ ID NO: 2777530 - DNA, 16 bp, Homo sapiens
tatgcctctgtattta

SEQ ID NO: 2777531 - DNA, 20 bp, Homo sapiens
tatgctgccaaattttggcc

SEQ ID NO: 2777532 - DNA, 14 bp, Homo sapiens
tatgcttattttaa

SEQ ID NO: 2777533 - DNA, 19 bp, Homo sapiens
tatgcttattttaaaattt

SEQ ID NO: 2777534 - DNA, 17 bp, Homo sapiens
tatggaaataaatgtat

SEQ ID NO: 2777535 - DNA, 24 bp, Homo sapiens
tatggaatacagtgttattttctt

SEQ ID NO: 2777536 - DNA, 15 bp, Homo sapiens
tatggactctgcaca

SEQ ID NO: 2777537 - DNA, 15 bp, Homo sapiens
tatggaggatggaga

SEQ ID NO: 2777538 - DNA, 11 bp, Homo sapiens
tatggatgtgg

SEQ ID NO: 2777539 - DNA, 14 bp, Homo sapiens
tatggcagcgaaag

SEQ ID NO: 2777540 - DNA, 18 bp, Homo sapiens
tatggcagtccagccagc

SEQ ID NO: 2777541 - DNA, 20 bp, Homo sapiens
tatggcagtccagccagctc

SEQ ID NO: 2777542 - DNA, 21 bp, Homo sapiens
tatggcagtccagccagctcc

SEQ ID NO: 2777543 - DNA, 13 bp, Homo sapiens
tatggctgtattt

SEQ ID NO: 2777544 - DNA, 16 bp, Homo sapiens
tatgggactcaatgca

SEQ ID NO: 2777545 - DNA, 20 bp, Homo sapiens
tatggggctgaacggggaga

SEQ ID NO: 2777546 - DNA, 14 bp, Homo sapiens
tatgggtcctgcaa

SEQ ID NO: 2777547 - DNA, 13 bp, Homo sapiens
tatggtataatgg

SEQ ID NO: 2777548 - DNA, 22 bp, Homo sapiens
tatggtattttcgtgcatttgt

SEQ ID NO: 2777549 - DNA, 16 bp, Homo sapiens
tatggtgtgttcctaa

SEQ ID NO: 2777550 - DNA, 13 bp, Homo sapiens
tatgtaaaacatt

SEQ ID NO: 2777551 - DNA, 14 bp, Homo sapiens
tatgtaaacataat

SEQ ID NO: 2777552 - DNA, 23 bp, Homo sapiens
tatgtaaactgcattagaaatta

SEQ ID NO: 2777553 - DNA, 17 bp, Homo sapiens
tatgtacagttatacat

SEQ ID NO: 2777554 - DNA, 23 bp, Homo sapiens
tatgtagaaaaaagtaaatgtga

SEQ ID NO: 2777555 - DNA, 16 bp, Homo sapiens
tatgtatatgtatatc

SEQ ID NO: 2777556 - DNA, 13 bp, Homo sapiens
tatgtatgtgtgt

SEQ ID NO: 2777557 - DNA, 17 bp, Homo sapiens
tatgtattattttctat

SEQ ID NO: 2777558 - DNA, 12 bp, Homo sapiens
tatgtatttata

SEQ ID NO: 2777559 - DNA, 21 bp, Homo sapiens
tatgtatttattgtcattact

SEQ ID NO: 2777560 - DNA, 15 bp, Homo sapiens
tatgtcatcatacat

SEQ ID NO: 2777561 - DNA, 13 bp, Homo sapiens
tatgtcctaagga

SEQ ID NO: 2777562 - DNA, 17 bp, Homo sapiens
tatgtgaaagtgtaaaa

SEQ ID NO: 2777563 - DNA, 15 bp, Homo sapiens
tatgtgacaaccttt

SEQ ID NO: 2777564 - DNA, 20 bp, Homo sapiens
tatgtgacaacctttgtgta

SEQ ID NO: 2777565 - DNA, 16 bp, Homo sapiens
tatgtgtcatgatttc

SEQ ID NO: 2777566 - DNA, 19 bp, Homo sapiens
tatgtgtgtatatgtatgt

SEQ ID NO: 2777567 - DNA, 19 bp, Homo sapiens
tatgtgtgtgtatgctact

SEQ ID NO: 2777568 - DNA, 20 bp, Homo sapiens
tatgttaacctcagtgtcat

SEQ ID NO: 2777569 - DNA, 19 bp, Homo sapiens
tatgttacatctgttttaa

SEQ ID NO: 2777570 - DNA, 15 bp, Homo sapiens
tatgttcattaaatt

SEQ ID NO: 2777571 - DNA, 13 bp, Homo sapiens
tatgttgcccagg

SEQ ID NO: 2777572 - DNA, 15 bp, Homo sapiens
tatgttgctgaaaca

SEQ ID NO: 2777573 - DNA, 19 bp, Homo sapiens
tatgttttaagaggcaggg

SEQ ID NO: 2777574 - DNA, 14 bp, Homo sapiens
tatgtttttgtgta

SEQ ID NO: 2777575 - DNA, 13 bp, Homo sapiens
tattaaaaaacaa

SEQ ID NO: 2777576 - DNA, 12 bp, Homo sapiens
tattaaacttct

SEQ ID NO: 2777577 - DNA, 18 bp, Homo sapiens
tattaaacttgtcagaat

SEQ ID NO: 2777578 - DNA, 13 bp, Homo sapiens
tattaaaggcttt

SEQ ID NO: 2777579 - DNA, 13 bp, Homo sapiens
tattaaatacaga

SEQ ID NO: 2777580 - DNA, 16 bp, Homo sapiens
tattaaggtgtggctt

SEQ ID NO: 2777581 - DNA, 17 bp, Homo sapiens
tattaatattcattgta

SEQ ID NO: 2777582 - DNA, 17 bp, Homo sapiens
tattaatgaactgtgac

SEQ ID NO: 2777583 - DNA, 22 bp, Homo sapiens
tattaatgaactgtgacaggaa

SEQ ID NO: 2777584 - DNA, 15 bp, Homo sapiens
tattaattatctgat

SEQ ID NO: 2777585 - DNA, 24 bp, Homo sapiens
tattagagtgcccttaaaataatg

SEQ ID NO: 2777586 - DNA, 20 bp, Homo sapiens
tattagatgttttacaaatt

SEQ ID NO: 2777587 - DNA, 15 bp, Homo sapiens
tattagcaactgtgc

SEQ ID NO: 2777588 - DNA, 20 bp, Homo sapiens
tacctgtgcgttactaattg

SEQ ID NO: 2777589 - DNA, 20 bp, Homo sapiens
taccttagattagctctgga

SEQ ID NO: 2777590 - DNA, 22 bp, Homo sapiens
taccttagattagctctggacc

SEQ ID NO: 2777591 - DNA, 13 bp, Homo sapiens
taccttcaataaa

SEQ ID NO: 2777592 - DNA, 16 bp, Homo sapiens
taccttcaataaagta

SEQ ID NO: 2777593 - DNA, 14 bp, Homo sapiens
tacctttatggttt

SEQ ID NO: 2777594 - DNA, 18 bp, Homo sapiens
tacctttattaatgaact

SEQ ID NO: 2777595 - DNA, 19 bp, Homo sapiens
tacctttcccatgctgaat

SEQ ID NO: 2777596 - DNA, 21 bp, Homo sapiens
tacgaacccctcccctccccc

SEQ ID NO: 2777597 - DNA, 13 bp, Homo sapiens
tacgactgaagaa

SEQ ID NO: 2777598 - DNA, 13 bp, Homo sapiens
tagaccaaaataa

SEQ ID NO: 2777599 - DNA, 13 bp, Homo sapiens
tagacctcagcct

SEQ ID NO: 2777600 - DNA, 22 bp, Homo sapiens
tagacctcagcctgtgctgccc

SEQ ID NO: 2777601 - DNA, 14 bp, Homo sapiens
tagactggacagct

SEQ ID NO: 2777602 - DNA, 22 bp, Homo sapiens
tagacttcgactcaggatccag

SEQ ID NO: 2777603 - DNA, 15 bp, Homo sapiens
tagactttctcagtg

SEQ ID NO: 2777604 - DNA, 20 bp, Homo sapiens
tagagattaatttgtgtaga

SEQ ID NO: 2777605 - DNA, 14 bp, Homo sapiens
tagagccagggtct

SEQ ID NO: 2777606 - DNA, 18 bp, Homo sapiens
tagaggaaaaaaatgact

SEQ ID NO: 2777607 - DNA, 22 bp, Homo sapiens
tagaggaaaaaaatgactaaaa

SEQ ID NO: 2777608 - DNA, 16 bp, Homo sapiens
tagaggcttccttcat

SEQ ID NO: 2777609 - DNA, 16 bp, Homo sapiens
tagaggtgagaaattt

SEQ ID NO: 2777610 - DNA, 20 bp, Homo sapiens
tagagtgcccttaaaataat

SEQ ID NO: 2777611 - DNA, 13 bp, Homo sapiens
tagatagtgcttt

SEQ ID NO: 2777612 - DNA, 22 bp, Homo sapiens
tagatctcctatttttcagaat

SEQ ID NO: 2777613 - DNA, 23 bp, Homo sapiens
tagatctcctatttttcagaatg

SEQ ID NO: 2777614 - DNA, 20 bp, Homo sapiens
tagatctcctgtaattttgt

SEQ ID NO: 2777615 - DNA, 13 bp, Homo sapiens
tagatcttctgaa

SEQ ID NO: 2777616 - DNA, 14 bp, Homo sapiens
tagatcttctgaaa

SEQ ID NO: 2777617 - DNA, 15 bp, Homo sapiens
tagatgaactcaact

SEQ ID NO: 2777618 - DNA, 19 bp, Homo sapiens
tagatgcaagatatttata

SEQ ID NO: 2777619 - DNA, 16 bp, Homo sapiens
tagatgggtctggctg

SEQ ID NO: 2777620 - DNA, 20 bp, Homo sapiens
tagatgggtctggctgagct

SEQ ID NO: 2777621 - DNA, 22 bp, Homo sapiens
tagatgggtctggctgagctga

SEQ ID NO: 2777622 - DNA, 20 bp, Homo sapiens
tagattctacatattcttta

SEQ ID NO: 2777623 - DNA, 15 bp, Homo sapiens
tagattctccaaatg

SEQ ID NO: 2777624 - DNA, 17 bp, Homo sapiens
tagattttcatgttctt

SEQ ID NO: 2777625 - DNA, 16 bp, Homo sapiens
tagcaaagatatctca

SEQ ID NO: 2777626 - DNA, 19 bp, Homo sapiens
tagcaaagatatctcatct

SEQ ID NO: 2777627 - DNA, 12 bp, Homo sapiens
tagcaactgtgc

SEQ ID NO: 2777628 - DNA, 20 bp, Homo sapiens
tagcaagattgcttaaaata

SEQ ID NO: 2777629 - DNA, 24 bp, Homo sapiens
tagcaagattgcttaaaatagcaa

SEQ ID NO: 2777630 - DNA, 16 bp, Homo sapiens
tagcaaggcatgatgt

SEQ ID NO: 2777631 - DNA, 18 bp, Homo sapiens
tagcaagttctagagaag

SEQ ID NO: 2777632 - DNA, 21 bp, Homo sapiens
tagcaatccatgttagttttt

SEQ ID NO: 2777633 - DNA, 14 bp, Homo sapiens
tagcacaatttata

SEQ ID NO: 2777634 - DNA, 23 bp, Homo sapiens
tagcagagaatgaaagggcccag

SEQ ID NO: 2777635 - DNA, 13 bp, Homo sapiens
tagcaggaaatag

SEQ ID NO: 2777636 - DNA, 15 bp, Homo sapiens
tagcaggcacaggac

SEQ ID NO: 2777637 - DNA, 17 bp, Homo sapiens
tagcaggtaccactgat

SEQ ID NO: 2777638 - DNA, 15 bp, Homo sapiens
tagcatacatttata

SEQ ID NO: 2777639 - DNA, 21 bp, Homo sapiens
tagcatacatttataatgttt

SEQ ID NO: 2777640 - DNA, 13 bp, Homo sapiens
tagcatttcttga

SEQ ID NO: 2777641 - DNA, 16 bp, Homo sapiens
tagcatttcttgatgt

SEQ ID NO: 2777642 - DNA, 16 bp, Homo sapiens
tagccaaaaatagcta

SEQ ID NO: 2777643 - DNA, 20 bp, Homo sapiens
tagccaaggtgggctgagcc

SEQ ID NO: 2777644 - DNA, 19 bp, Homo sapiens
tagccacatccctttgaaa

SEQ ID NO: 2777645 - DNA, 14 bp, Homo sapiens
tagccactcaggag

SEQ ID NO: 2777646 - DNA, 19 bp, Homo sapiens
tagccactggtttctcaga

SEQ ID NO: 2777647 - DNA, 16 bp, Homo sapiens
tagccacttaccttca

SEQ ID NO: 2777648 - DNA, 18 bp, Homo sapiens
tagccacttaccttcaat

SEQ ID NO: 2777649 - DNA, 14 bp, Homo sapiens
tagcccagcactgt

SEQ ID NO: 2777650 - DNA, 13 bp, Homo sapiens
tagccgacctcag

SEQ ID NO: 2777651 - DNA, 16 bp, Homo sapiens
tagccgacctcagcct

SEQ ID NO: 2777652 - DNA, 15 bp, Homo sapiens
tagccgagagcctgc

SEQ ID NO: 2777653 - DNA, 19 bp, Homo sapiens
tagccgggcatggtggcgc

SEQ ID NO: 2777654 - DNA, 19 bp, Homo sapiens
tagcctcaatttctgaaca

SEQ ID NO: 2777655 - DNA, 23 bp, Homo sapiens
tagcctcacttttaatgaacaaa

SEQ ID NO: 2777656 - DNA, 21 bp, Homo sapiens
tagccttagaagtcacacagt

SEQ ID NO: 2777657 - DNA, 14 bp, Homo sapiens
tagcgcccagttgg

SEQ ID NO: 2777658 - DNA, 16 bp, Homo sapiens
tagcgtgctcactgac

SEQ ID NO: 2777659 - DNA, 18 bp, Homo sapiens
tagcgtgggttatcagtt

SEQ ID NO: 2777660 - DNA, 23 bp, Homo sapiens
tagctaccttctctacccatctc

SEQ ID NO: 2777661 - DNA, 20 bp, Homo sapiens
tagctagaagtgggccagga

SEQ ID NO: 2777662 - DNA, 23 bp, Homo sapiens
tagctattgcatgtaaaatgcag

SEQ ID NO: 2777663 - DNA, 11 bp, Homo sapiens
tagctcagttt

SEQ ID NO: 2777664 - DNA, 17 bp, Homo sapiens
tagctctgtccactctg

SEQ ID NO: 2777665 - DNA, 17 bp, Homo sapiens
tagctgaacaatgaatg

SEQ ID NO: 2777666 - DNA, 21 bp, Homo sapiens
tagctgacccagccccttgag

SEQ ID NO: 2777667 - DNA, 17 bp, Homo sapiens
tagctgagcgtggtggc

SEQ ID NO: 2777668 - DNA, 21 bp, Homo sapiens
tagctgagctcacaaggcagc

SEQ ID NO: 2777669 - DNA, 11 bp, Homo sapiens
tagctgagtgt

SEQ ID NO: 2777670 - DNA, 16 bp, Homo sapiens
tagctgatcagaattt

SEQ ID NO: 2777671 - DNA, 12 bp, Homo sapiens
tagctgctttaa

SEQ ID NO: 2777672 - DNA, 12 bp, Homo sapiens
tagctgggacta

SEQ ID NO: 2777673 - DNA, 14 bp, Homo sapiens
tagctgggactaca

SEQ ID NO: 2777674 - DNA, 15 bp, Homo sapiens
tagctgggactacag

SEQ ID NO: 2777675 - DNA, 21 bp, Homo sapiens
tatatgcacatgtaacccaaa

SEQ ID NO: 2777676 - DNA, 17 bp, Homo sapiens
tatatggaaattctgct

SEQ ID NO: 2777677 - DNA, 12 bp, Homo sapiens
tatatgtacagt

SEQ ID NO: 2777678 - DNA, 13 bp, Homo sapiens
tatatgtacagtt

SEQ ID NO: 2777679 - DNA, 14 bp, Homo sapiens
tatatgtacagtta

SEQ ID NO: 2777680 - DNA, 13 bp, Homo sapiens
tatatgtatatat

SEQ ID NO: 2777681 - DNA, 14 bp, Homo sapiens
tatatgtatatcta

SEQ ID NO: 2777682 - DNA, 19 bp, Homo sapiens
tatatgtatatctatatct

SEQ ID NO: 2777683 - DNA, 15 bp, Homo sapiens
tatatgtatatgtat

SEQ ID NO: 2777684 - DNA, 22 bp, Homo sapiens
tatattacactacacactgtgt

SEQ ID NO: 2777685 - DNA, 16 bp, Homo sapiens
tatattagcatttagt

SEQ ID NO: 2777686 - DNA, 23 bp, Homo sapiens
tatattataataatgttctctgg

SEQ ID NO: 2777687 - DNA, 18 bp, Homo sapiens
tatattatggtgtaatgc

SEQ ID NO: 2777688 - DNA, 22 bp, Homo sapiens
tatattatggtgtaatgcacaa

SEQ ID NO: 2777689 - DNA, 24 bp, Homo sapiens
tatattatggtgtaatgcacaatt

SEQ ID NO: 2777690 - DNA, 19 bp, Homo sapiens
taaaaccccatctctacta

SEQ ID NO: 2777691 - DNA, 13 bp, Homo sapiens
taaaacctttcaa

SEQ ID NO: 2777692 - DNA, 20 bp, Homo sapiens
taaaacctttcaaatttcac

SEQ ID NO: 2777693 - DNA, 18 bp, Homo sapiens
taaaactatggttcccaa

SEQ ID NO: 2777694 - DNA, 23 bp, Homo sapiens
taaaactatggttcccaataaaa

SEQ ID NO: 2777695 - DNA, 18 bp, Homo sapiens
taaaactcagttaaaatg

SEQ ID NO: 2777696 - DNA, 13 bp, Homo sapiens
taaaacttgctgc

SEQ ID NO: 2777697 - DNA, 21 bp, Homo sapiens
taaaactttgaagttagcttt

SEQ ID NO: 2777698 - DNA, 14 bp, Homo sapiens
taaaagaaactttc

SEQ ID NO: 2777699 - DNA, 12 bp, Homo sapiens
taaaagacagtg

SEQ ID NO: 2777700 - DNA, 17 bp, Homo sapiens
taaaagcaaaaaagaaa

SEQ ID NO: 2777701 - DNA, 20 bp, Homo sapiens
taaaagcaaaaaagaaaacc

SEQ ID NO: 2777702 - DNA, 20 bp, Homo sapiens
taaaagcagcatctgctaat

SEQ ID NO: 2777703 - DNA, 12 bp, Homo sapiens
taaaagctaatt

SEQ ID NO: 2777704 - DNA, 13 bp, Homo sapiens
taaaagtaaacat

SEQ ID NO: 2777705 - DNA, 14 bp, Homo sapiens
taaaagtaaacatt

SEQ ID NO: 2777706 - DNA, 14 bp, Homo sapiens
taaaagtgtgagca

SEQ ID NO: 2777707 - DNA, 24 bp, Homo sapiens
taaaagttgggaaaagtgttatta

SEQ ID NO: 2777708 - DNA, 14 bp, Homo sapiens
taaaataaaaacca

SEQ ID NO: 2777709 - DNA, 15 bp, Homo sapiens
taaaataaaaaccag

SEQ ID NO: 2777710 - DNA, 17 bp, Homo sapiens
taaaataaaaaccagaa

SEQ ID NO: 2777711 - DNA, 17 bp, Homo sapiens
taaaataaagtatatat

SEQ ID NO: 2777712 - DNA, 18 bp, Homo sapiens
taaaataatgatttaagc

SEQ ID NO: 2777713 - DNA, 13 bp, Homo sapiens
taaaatagcaaaa

SEQ ID NO: 2777714 - DNA, 15 bp, Homo sapiens
taaaatagtattgaa

SEQ ID NO: 2777715 - DNA, 19 bp, Homo sapiens
taaaatatatataaatata

SEQ ID NO: 2777716 - DNA, 22 bp, Homo sapiens
taaaatattcctgcatttgtga

SEQ ID NO: 2777717 - DNA, 13 bp, Homo sapiens
taaaatatttatt

SEQ ID NO: 2777718 - DNA, 15 bp, Homo sapiens
taaaatcatgtacat

SEQ ID NO: 2777719 - DNA, 14 bp, Homo sapiens
taaaatgaaattac

SEQ ID NO: 2777720 - DNA, 18 bp, Homo sapiens
taaaatgcagtccagaat

SEQ ID NO: 2777721 - DNA, 20 bp, Homo sapiens
taaaatgcagtccagaataa

SEQ ID NO: 2777722 - DNA, 12 bp, Homo sapiens
taaaattagtga

SEQ ID NO: 2777723 - DNA, 21 bp, Homo sapiens
taaaattagtgagatttgtat

SEQ ID NO: 2777724 - DNA, 22 bp, Homo sapiens
taaaattagtgagatttgtatt

SEQ ID NO: 2777725 - DNA, 20 bp, Homo sapiens
taaaattttacttttgttct

SEQ ID NO: 2777726 - DNA, 13 bp, Homo sapiens
taaacaaaggttg

SEQ ID NO: 2777727 - DNA, 14 bp, Homo sapiens
taaacacctgacac

SEQ ID NO: 2777728 - DNA, 15 bp, Homo sapiens
taaacacgtgtctat

SEQ ID NO: 2777729 - DNA, 20 bp, Homo sapiens
taaacactgtaatcttaaaa

SEQ ID NO: 2777730 - DNA, 21 bp, Homo sapiens
taaacagatataaatggctgg

SEQ ID NO: 2777731 - DNA, 12 bp, Homo sapiens
taaacagtgcct

SEQ ID NO: 2777732 - DNA, 15 bp, Homo sapiens
taaacatcattcatt

SEQ ID NO: 2777733 - DNA, 17 bp, Homo sapiens
taaacatcattcatttt

SEQ ID NO: 2777734 - DNA, 20 bp, Homo sapiens
taaacattggtatatttcca

SEQ ID NO: 2777735 - DNA, 11 bp, Homo sapiens
taaaccagcag

SEQ ID NO: 2777736 - DNA, 17 bp, Homo sapiens
taaaccagcagaaaagt

SEQ ID NO: 2777737 - DNA, 21 bp, Homo sapiens
taaaccagcagaaaagtgctt

SEQ ID NO: 2777738 - DNA, 22 bp, Homo sapiens
taaaccagcagaaaagtgctta

SEQ ID NO: 2777739 - DNA, 20 bp, Homo sapiens
taaaccctgccccacttctc

SEQ ID NO: 2777740 - DNA, 17 bp, Homo sapiens
taaacgtgatgatcagc

SEQ ID NO: 2777741 - DNA, 19 bp, Homo sapiens
taaactcaaaatatttgta

SEQ ID NO: 2777742 - DNA, 21 bp, Homo sapiens
taaactcaaaatatttgtaca

SEQ ID NO: 2777743 - DNA, 22 bp, Homo sapiens
taaactcaaaatatttgtacat

SEQ ID NO: 2777744 - DNA, 16 bp, Homo sapiens
taaactgcattagaaa

SEQ ID NO: 2777745 - DNA, 22 bp, Homo sapiens
taaacttagtgcggacaagttt

SEQ ID NO: 2777746 - DNA, 13 bp, Homo sapiens
taaacttgtgtat

SEQ ID NO: 2777747 - DNA, 18 bp, Homo sapiens
taaactttagagtagcat

SEQ ID NO: 2777748 - DNA, 14 bp, Homo sapiens
taaagaaaaacaaa

SEQ ID NO: 2777749 - DNA, 12 bp, Homo sapiens
taaagaaaactg

SEQ ID NO: 2777750 - DNA, 13 bp, Homo sapiens
taaagaataaatg

SEQ ID NO: 2777751 - DNA, 20 bp, Homo sapiens
taaagacagaaaaaaataaa

SEQ ID NO: 2777752 - DNA, 15 bp, Homo sapiens
taaagacttcatgtt

SEQ ID NO: 2777753 - DNA, 22 bp, Homo sapiens
taaagatgtcaaatatctcaga

SEQ ID NO: 2777754 - DNA, 17 bp, Homo sapiens
taaagattttttaataa

SEQ ID NO: 2777755 - DNA, 22 bp, Homo sapiens
taaagattttttaataatttag

SEQ ID NO: 2777756 - DNA, 20 bp, Homo sapiens
taaagcagagggactttgta

SEQ ID NO: 2777757 - DNA, 16 bp, Homo sapiens
taaagcctgcttttta

SEQ ID NO: 2777758 - DNA, 21 bp, Homo sapiens
taaagcctgctttttaagtgt

SEQ ID NO: 2777759 - DNA, 16 bp, Homo sapiens
taaagctgcctgtagt

SEQ ID NO: 2777760 - DNA, 23 bp, Homo sapiens
taaagctgcctgtagttaggaaa

SEQ ID NO: 2777761 - DNA, 20 bp, Homo sapiens
taaagctggacaagaagctg

SEQ ID NO: 2777762 - DNA, 21 bp, Homo sapiens
taaagctggacaagaagctgc

SEQ ID NO: 2777763 - DNA, 23 bp, Homo sapiens
taaagctggacaagaagctgcta

SEQ ID NO: 2777764 - DNA, 15 bp, Homo sapiens
taaagctggtttaat

SEQ ID NO: 2777765 - DNA, 19 bp, Homo sapiens
taaagctggtttaatgttt

SEQ ID NO: 2777766 - DNA, 11 bp, Homo sapiens
taaagcttgtc

SEQ ID NO: 2777767 - DNA, 16 bp, Homo sapiens
taaaggagttaagagt

SEQ ID NO: 2777768 - DNA, 22 bp, Homo sapiens
taaaggattgatcactttgtta

SEQ ID NO: 2777769 - DNA, 16 bp, Homo sapiens
taaaggcaaaggcaat

SEQ ID NO: 2777770 - DNA, 13 bp, Homo sapiens
taaaggcttttgg

SEQ ID NO: 2777771 - DNA, 20 bp, Homo sapiens
taaagggcaggtggttctaa

SEQ ID NO: 2777772 - DNA, 15 bp, Homo sapiens
taaagtacctgtagt

SEQ ID NO: 2777773 - DNA, 14 bp, Homo sapiens
taaagtatatattt

SEQ ID NO: 2777774 - DNA, 19 bp, Homo sapiens
taaagtcaggacctggctt

SEQ ID NO: 2777775 - DNA, 14 bp, Homo sapiens
taaagtctgagtgg

SEQ ID NO: 2777776 - DNA, 16 bp, Homo sapiens
taaagtgtaaatcctt

SEQ ID NO: 2777777 - DNA, 17 bp, Homo sapiens
taaagttctgagtgttt

SEQ ID NO: 2777778 - DNA, 15 bp, Homo sapiens
tacacacacatacac

SEQ ID NO: 2777779 - DNA, 23 bp, Homo sapiens
tacacagtaaaaacttgtactat

SEQ ID NO: 2777780 - DNA, 18 bp, Homo sapiens
tacaccacctcactcctg

SEQ ID NO: 2777781 - DNA, 19 bp, Homo sapiens
tacaccacctcactcctgt

SEQ ID NO: 2777782 - DNA, 17 bp, Homo sapiens
tacaccactctggcagc

SEQ ID NO: 2777783 - DNA, 19 bp, Homo sapiens
tacaccactctggcagcca

SEQ ID NO: 2777784 - DNA, 15 bp, Homo sapiens
tacacctgaggctga

SEQ ID NO: 2777785 - DNA, 15 bp, Homo sapiens
tacactccagcctga

SEQ ID NO: 2777786 - DNA, 15 bp, Homo sapiens
tagaatgtaaagctt

SEQ ID NO: 2777787 - DNA, 18 bp, Homo sapiens
tagaatgtaaagcttgtc

SEQ ID NO: 2777788 - DNA, 20 bp, Homo sapiens
tagaatgtgttttctgaata

SEQ ID NO: 2777789 - DNA, 14 bp, Homo sapiens
tagaattatatcta

SEQ ID NO: 2777790 - DNA, 21 bp, Homo sapiens
tagaattatatctaatttata

SEQ ID NO: 2777791 - DNA, 24 bp, Homo sapiens
tagaattatatctaatttatacaa

SEQ ID NO: 2777792 - DNA, 20 bp, Homo sapiens
tagaattgagtgtttaaagt

SEQ ID NO: 2777793 - DNA, 20 bp, Homo sapiens
tagaatttattcaattcctc

SEQ ID NO: 2777794 - DNA, 23 bp, Homo sapiens
tagaatttattcaattcctctgg

SEQ ID NO: 2777795 - DNA, 23 bp, Homo sapiens
tagaatttgtattttgcttaaaa

SEQ ID NO: 2777796 - DNA, 12 bp, Homo sapiens
tagacagaagaa

SEQ ID NO: 2777797 - DNA, 12 bp, Homo sapiens
gtttaagtgttg

SEQ ID NO: 2777798 - DNA, 20 bp, Homo sapiens
gtttacaaaaggcagccctt

SEQ ID NO: 2777799 - DNA, 19 bp, Homo sapiens
gtttactgctgtcattgtc

SEQ ID NO: 2777800 - DNA, 19 bp, Homo sapiens
gtttacttttcagggcatc

SEQ ID NO: 2777801 - DNA, 18 bp, Homo sapiens
gtttagaagagcctgact

SEQ ID NO: 2777802 - DNA, 14 bp, Homo sapiens
gtttagattttatg

SEQ ID NO: 2777803 - DNA, 18 bp, Homo sapiens
gtttatcattgggagaag

SEQ ID NO: 2777804 - DNA, 18 bp, Homo sapiens
gtttatgaaaaagaagaa

SEQ ID NO: 2777805 - DNA, 23 bp, Homo sapiens
gtttattaacaaattatgttaca

SEQ ID NO: 2777806 - DNA, 22 bp, Homo sapiens
gtttattaatgcctctcccgca

SEQ ID NO: 2777807 - DNA, 12 bp, Homo sapiens
gtttcaccattt

SEQ ID NO: 2777808 - DNA, 22 bp, Homo sapiens
gtttcaggagagagttgaacct

SEQ ID NO: 2777809 - DNA, 19 bp, Homo sapiens
gtttcatttctactgtgac

SEQ ID NO: 2777810 - DNA, 22 bp, Homo sapiens
gtttccacgatgaaaaacttcc

SEQ ID NO: 2777811 - DNA, 23 bp, Homo sapiens
gtttccactgtcttgcctgccag

SEQ ID NO: 2777812 - DNA, 13 bp, Homo sapiens
gtttccagaaaat

SEQ ID NO: 2777813 - DNA, 17 bp, Homo sapiens
gtttccagaaaatataa

SEQ ID NO: 2777814 - DNA, 19 bp, Homo sapiens
gtttccagaaaatataaat

SEQ ID NO: 2777815 - DNA, 20 bp, Homo sapiens
gtttccagaaaatataaatg

SEQ ID NO: 2777816 - DNA, 12 bp, Homo sapiens
gtttccaggaag

SEQ ID NO: 2777817 - DNA, 13 bp, Homo sapiens
gtttccaggaaga

SEQ ID NO: 2777818 - DNA, 14 bp, Homo sapiens
gtttccaggaagag

SEQ ID NO: 2777819 - DNA, 16 bp, Homo sapiens
gtttcccaagagctac

SEQ ID NO: 2777820 - DNA, 17 bp, Homo sapiens
gtttctaaaactatggt

SEQ ID NO: 2777821 - DNA, 14 bp, Homo sapiens
gtttctcagctccc

SEQ ID NO: 2777822 - DNA, 22 bp, Homo sapiens
gtttctccccctgggctctgcc

SEQ ID NO: 2777823 - DNA, 21 bp, Homo sapiens
gtttctgaaaattaacactgc

SEQ ID NO: 2777824 - DNA, 20 bp, Homo sapiens
gtttctgcagtagtctctgt

SEQ ID NO: 2777825 - DNA, 11 bp, Homo sapiens
gtttcttccaa

SEQ ID NO: 2777826 - DNA, 14 bp, Homo sapiens
gtttcttgcctcat

SEQ ID NO: 2777827 - DNA, 17 bp, Homo sapiens
gtttcttggtctcagct

SEQ ID NO: 2777828 - DNA, 18 bp, Homo sapiens
gtttgaaagtgaataaac

SEQ ID NO: 2777829 - DNA, 13 bp, Homo sapiens
gtttgaatataaa

SEQ ID NO: 2777830 - DNA, 15 bp, Homo sapiens
gtttgagaccagcct

SEQ ID NO: 2777831 - DNA, 15 bp, Homo sapiens
gtttgagctcagacc

SEQ ID NO: 2777832 - DNA, 15 bp, Homo sapiens
gtttgcaaggaagcc

SEQ ID NO: 2777833 - DNA, 13 bp, Homo sapiens
gtttgcctctgcc

SEQ ID NO: 2777834 - DNA, 16 bp, Homo sapiens
gtttgcctctgcctct

SEQ ID NO: 2777835 - DNA, 17 bp, Homo sapiens
gtttgcctctgcctctg

SEQ ID NO: 2777836 - DNA, 21 bp, Homo sapiens
gtttggatatgtaaaacattt

SEQ ID NO: 2777837 - DNA, 22 bp, Homo sapiens
gtttggggaatgcggccgcatt

SEQ ID NO: 2777838 - DNA, 18 bp, Homo sapiens
gtttggggatgagaaagg

SEQ ID NO: 2777839 - DNA, 17 bp, Homo sapiens
gtttgtcatatattcat

SEQ ID NO: 2777840 - DNA, 18 bp, Homo sapiens
gtttgtctgtcttcatag

SEQ ID NO: 2777841 - DNA, 19 bp, Homo sapiens
gtttgtggaaaatgaaaat

SEQ ID NO: 2777842 - DNA, 19 bp, Homo sapiens
gttttaaatttatttcaaa

SEQ ID NO: 2777843 - DNA, 14 bp, Homo sapiens
gttttaagaggcag

SEQ ID NO: 2777844 - DNA, 23 bp, Homo sapiens
gttttacaataaaatcttgaaaa

SEQ ID NO: 2777845 - DNA, 14 bp, Homo sapiens
gttttagttgcaga

SEQ ID NO: 2777846 - DNA, 16 bp, Homo sapiens
gttttccaccctggaa

SEQ ID NO: 2777847 - DNA, 16 bp, Homo sapiens
gttttcctaaatgcag

SEQ ID NO: 2777848 - DNA, 17 bp, Homo sapiens
gttttcctaaatgcagt

SEQ ID NO: 2777849 - DNA, 12 bp, Homo sapiens
gttttcttccca

SEQ ID NO: 2777850 - DNA, 20 bp, Homo sapiens
gttttcttcccatcactgga

SEQ ID NO: 2777851 - DNA, 21 bp, Homo sapiens
gttttgccatgttggccaggc

SEQ ID NO: 2777852 - DNA, 19 bp, Homo sapiens
gtttttaactcaatatttt

SEQ ID NO: 2777853 - DNA, 21 bp, Homo sapiens
gtttttatgaagaaaaaatac

SEQ ID NO: 2777854 - DNA, 16 bp, Homo sapiens
gtttttatggggctga

SEQ ID NO: 2777855 - DNA, 18 bp, Homo sapiens
gtttttatggggctgaac

SEQ ID NO: 2777856 - DNA, 11 bp, Homo sapiens
gtttttcaaga

SEQ ID NO: 2777857 - DNA, 12 bp, Homo sapiens
gtttttgaagaa

SEQ ID NO: 2777858 - DNA, 18 bp, Homo sapiens
gtttttgatagctttatt

SEQ ID NO: 2777859 - DNA, 18 bp, Homo sapiens
taaaaaaagtatatattc

SEQ ID NO: 2777860 - DNA, 22 bp, Homo sapiens
taaaaaaataagaagaatgctt

SEQ ID NO: 2777861 - DNA, 12 bp, Homo sapiens
taaaaaaataca

SEQ ID NO: 2777862 - DNA, 13 bp, Homo sapiens
taaaaaaatacag

SEQ ID NO: 2777863 - DNA, 14 bp, Homo sapiens
taaaaaacatttgt

SEQ ID NO: 2777864 - DNA, 17 bp, Homo sapiens
taaaaaagcttaaaact

SEQ ID NO: 2777865 - DNA, 15 bp, Homo sapiens
taaaaaataaatata

SEQ ID NO: 2777866 - DNA, 13 bp, Homo sapiens
taaaaaatacacc

SEQ ID NO: 2777867 - DNA, 13 bp, Homo sapiens
taaaaaatgtcca

SEQ ID NO: 2777868 - DNA, 21 bp, Homo sapiens
taaaaacaaaaacaaaaccag

SEQ ID NO: 2777869 - DNA, 17 bp, Homo sapiens
taaaaacataaaatata

SEQ ID NO: 2777870 - DNA, 18 bp, Homo sapiens
taaaaacatgagaaatgt

SEQ ID NO: 2777871 - DNA, 20 bp, Homo sapiens
taaaaacatgagaaatgtga

SEQ ID NO: 2777872 - DNA, 17 bp, Homo sapiens
taaaaaccagaatcata

SEQ ID NO: 2777873 - DNA, 16 bp, Homo sapiens
taaaaactgactcctt

SEQ ID NO: 2777874 - DNA, 17 bp, Homo sapiens
taaaaactgactcctta

SEQ ID NO: 2777875 - DNA, 16 bp, Homo sapiens
taaaaactgagtgact

SEQ ID NO: 2777876 - DNA, 22 bp, Homo sapiens
taaaaagtaattgtagatggaa

SEQ ID NO: 2777877 - DNA, 15 bp, Homo sapiens
taaaaataaaatgat

SEQ ID NO: 2777878 - DNA, 16 bp, Homo sapiens
taaaaataaaatgatg

SEQ ID NO: 2777879 - DNA, 17 bp, Homo sapiens
taaaaataaaatgatgt

SEQ ID NO: 2777880 - DNA, 15 bp, Homo sapiens
taaaaatattctcca

SEQ ID NO: 2777881 - DNA, 15 bp, Homo sapiens
taaaaatgatctaaa

SEQ ID NO: 2777882 - DNA, 19 bp, Homo sapiens
taaaaatgatttcagtagc

SEQ ID NO: 2777883 - DNA, 16 bp, Homo sapiens
taaaaatttgtttaaa

SEQ ID NO: 2777884 - DNA, 14 bp, Homo sapiens
taaaacacagcttt

SEQ ID NO: 2777885 - DNA, 20 bp, Homo sapiens
taaaacatttattttgacat

SEQ ID NO: 2777886 - DNA, 16 bp, Homo sapiens
taaaaccatgcagctt

SEQ ID NO: 2777887 - DNA, 19 bp, Homo sapiens
taaaaccatgcagcttcat

SEQ ID NO: 2777888 - DNA, 16 bp, Homo sapiens
gtgtgggaagggagag

SEQ ID NO: 2777889 - DNA, 13 bp, Homo sapiens
gtgtgggctgcag

SEQ ID NO: 2777890 - DNA, 14 bp, Homo sapiens
gtgtgtagccaagg

SEQ ID NO: 2777891 - DNA, 18 bp, Homo sapiens
gtgtgtcacactgagctg

SEQ ID NO: 2777892 - DNA, 20 bp, Homo sapiens
gtgtgtcacactgagctggg

SEQ ID NO: 2777893 - DNA, 14 bp, Homo sapiens
gtgtgtcttctatt

SEQ ID NO: 2777894 - DNA, 14 bp, Homo sapiens
gtgtgtttgtgtga

SEQ ID NO: 2777895 - DNA, 20 bp, Homo sapiens
gtgtgttttgagagtatatt

SEQ ID NO: 2777896 - DNA, 15 bp, Homo sapiens
gtgttattatttggc

SEQ ID NO: 2777897 - DNA, 17 bp, Homo sapiens
gtgttatttaaatgagt

SEQ ID NO: 2777898 - DNA, 16 bp, Homo sapiens
gtgttgaaaatgttca

SEQ ID NO: 2777899 - DNA, 17 bp, Homo sapiens
gtgttgaaaatgttcag

SEQ ID NO: 2777900 - DNA, 22 bp, Homo sapiens
gtgttgccttagcacttctttc

SEQ ID NO: 2777901 - DNA, 18 bp, Homo sapiens
gtgttgcgtgtcgtgggt

SEQ ID NO: 2777902 - DNA, 21 bp, Homo sapiens
gtgttggctaatgaagggaaa

SEQ ID NO: 2777903 - DNA, 13 bp, Homo sapiens
gtgttgtctgtgc

SEQ ID NO: 2777904 - DNA, 15 bp, Homo sapiens
gtgtttcttgcctca

SEQ ID NO: 2777905 - DNA, 13 bp, Homo sapiens
gtgttttctgaat

SEQ ID NO: 2777906 - DNA, 19 bp, Homo sapiens
gtgttttctgaataacatt

SEQ ID NO: 2777907 - DNA, 13 bp, Homo sapiens
gttaaaagacagt

SEQ ID NO: 2777908 - DNA, 21 bp, Homo sapiens
gttaaagaggcgtcttgtatt

SEQ ID NO: 2777909 - DNA, 15 bp, Homo sapiens
gttaaagctgccggc

SEQ ID NO: 2777910 - DNA, 20 bp, Homo sapiens
gttaaaggaagtttgttcac

SEQ ID NO: 2777911 - DNA, 20 bp, Homo sapiens
gttaaagtcagtgggaacgt

SEQ ID NO: 2777912 - DNA, 13 bp, Homo sapiens
gttaaatatttac

SEQ ID NO: 2777913 - DNA, 15 bp, Homo sapiens
gttaaatatttacat

SEQ ID NO: 2777914 - DNA, 22 bp, Homo sapiens
gttaaatatttacatatgaaat

SEQ ID NO: 2777915 - DNA, 16 bp, Homo sapiens
gttaacactacttaaa

SEQ ID NO: 2777916 - DNA, 23 bp, Homo sapiens
gttaacagagacagataactctc

SEQ ID NO: 2777917 - DNA, 15 bp, Homo sapiens
gttaacattaacatc

SEQ ID NO: 2777918 - DNA, 20 bp, Homo sapiens
gttaaccagaataaagttct

SEQ ID NO: 2777919 - DNA, 15 bp, Homo sapiens
gttaagacttgacag

SEQ ID NO: 2777920 - DNA, 19 bp, Homo sapiens
gttaagacttgacagtgga

SEQ ID NO: 2777921 - DNA, 18 bp, Homo sapiens
gttaagcagcctttctgt

SEQ ID NO: 2777922 - DNA, 14 bp, Homo sapiens
gttaagggaaggaa

SEQ ID NO: 2777923 - DNA, 17 bp, Homo sapiens
gttaatgaaaatgtcag

SEQ ID NO: 2777924 - DNA, 19 bp, Homo sapiens
gttaattgattaaaatctg

SEQ ID NO: 2777925 - DNA, 14 bp, Homo sapiens
gttacatgtttgca

SEQ ID NO: 2777926 - DNA, 13 bp, Homo sapiens
gttacctttccca

SEQ ID NO: 2777927 - DNA, 15 bp, Homo sapiens
gttactacatgcact

SEQ ID NO: 2777928 - DNA, 12 bp, Homo sapiens
gttactcagccc

SEQ ID NO: 2777929 - DNA, 22 bp, Homo sapiens
gttactctccaacctggacaac

SEQ ID NO: 2777930 - DNA, 13 bp, Homo sapiens
gttactttttagt

SEQ ID NO: 2777931 - DNA, 20 bp, Homo sapiens
gttactttttagtcttttac

SEQ ID NO: 2777932 - DNA, 20 bp, Homo sapiens
gttagagaatatatttttga

SEQ ID NO: 2777933 - DNA, 11 bp, Homo sapiens
gttagctgagc

SEQ ID NO: 2777934 - DNA, 14 bp, Homo sapiens
gttaggaaataaaa

SEQ ID NO: 2777935 - DNA, 18 bp, Homo sapiens
gttaggaaataaaacctt

SEQ ID NO: 2777936 - DNA, 12 bp, Homo sapiens
gttagtcatttg

SEQ ID NO: 2777937 - DNA, 22 bp, Homo sapiens
gttagtcatttgctgagcatgt

SEQ ID NO: 2777938 - DNA, 17 bp, Homo sapiens
gttagtgtgttgtctgt

SEQ ID NO: 2777939 - DNA, 20 bp, Homo sapiens
gttagtgtgttgtctgtgca

SEQ ID NO: 2777940 - DNA, 13 bp, Homo sapiens
gttataaaaatac

SEQ ID NO: 2777941 - DNA, 16 bp, Homo sapiens
gttataaaaatacaac

SEQ ID NO: 2777942 - DNA, 16 bp, Homo sapiens
gttataagaaacagag

SEQ ID NO: 2777943 - DNA, 15 bp, Homo sapiens
gttatagtatatctg

SEQ ID NO: 2777944 - DNA, 14 bp, Homo sapiens
gttatgtgtgtata

SEQ ID NO: 2777945 - DNA, 19 bp, Homo sapiens
gttatgtgtgtatatgtat

SEQ ID NO: 2777946 - DNA, 20 bp, Homo sapiens
gttattgggcaagtgattga

SEQ ID NO: 2777947 - DNA, 16 bp, Homo sapiens
gttatttgtaatagat

SEQ ID NO: 2777948 - DNA, 16 bp, Homo sapiens
gttatttttatatcag

SEQ ID NO: 2777949 - DNA, 22 bp, Homo sapiens
gttatttttgtttcttccaaag

SEQ ID NO: 2777950 - DNA, 19 bp, Homo sapiens
gttcaacttttcctttgaa

SEQ ID NO: 2777951 - DNA, 18 bp, Homo sapiens
gttcaagcgattcttctg

SEQ ID NO: 2777952 - DNA, 17 bp, Homo sapiens
gttcaccttatgtatta

SEQ ID NO: 2777953 - DNA, 16 bp, Homo sapiens
gttcagcccctcctct

SEQ ID NO: 2777954 - DNA, 19 bp, Homo sapiens
gttcagctaagctaggaat

SEQ ID NO: 2777955 - DNA, 22 bp, Homo sapiens
gttcagctaagctaggaatgaa

SEQ ID NO: 2777956 - DNA, 23 bp, Homo sapiens
gttcagcttgtaaatagctcagg

SEQ ID NO: 2777957 - DNA, 12 bp, Homo sapiens
gttcaggagctg

SEQ ID NO: 2777958 - DNA, 17 bp, Homo sapiens
gttcaggagctgaagcc

SEQ ID NO: 2777959 - DNA, 20 bp, Homo sapiens
gttcaggagtcccaaggaaa

SEQ ID NO: 2777960 - DNA, 17 bp, Homo sapiens
gttcagggttggcccct

SEQ ID NO: 2777961 - DNA, 21 bp, Homo sapiens
gttcagggttggcccctgccc

SEQ ID NO: 2777962 - DNA, 16 bp, Homo sapiens
gttcagtgccttggag

SEQ ID NO: 2777963 - DNA, 17 bp, Homo sapiens
gttcagtgccttggagc

SEQ ID NO: 2777964 - DNA, 19 bp, Homo sapiens
gttcatatgtaccatgtac

SEQ ID NO: 2777965 - DNA, 17 bp, Homo sapiens
gttcatcgtataacaca

SEQ ID NO: 2777966 - DNA, 20 bp, Homo sapiens
gttcattaaagcatgaatgg

SEQ ID NO: 2777967 - DNA, 15 bp, Homo sapiens
gttccaaatgaatgt

SEQ ID NO: 2777968 - DNA, 20 bp, Homo sapiens
gttccacgtccccctggggc

SEQ ID NO: 2777969 - DNA, 23 bp, Homo sapiens
gttccatgaagaccacatccaca

SEQ ID NO: 2777970 - DNA, 23 bp, Homo sapiens
gttccctgagaaacccaccagcc

SEQ ID NO: 2777971 - DNA, 13 bp, Homo sapiens
gttcctcaccaat

SEQ ID NO: 2777972 - DNA, 15 bp, Homo sapiens
gttcctcaccaataa

SEQ ID NO: 2777973 - DNA, 17 bp, Homo sapiens
gttcctcaccaataact

SEQ ID NO: 2777974 - DNA, 13 bp, Homo sapiens
gttcctcgccctg

SEQ ID NO: 2777975 - DNA, 19 bp, Homo sapiens
gttcctggctttgacatga

SEQ ID NO: 2777976 - DNA, 21 bp, Homo sapiens
gttccttccgatgacagtgct

SEQ ID NO: 2777977 - DNA, 19 bp, Homo sapiens
gttcgagaccaacctgacc

SEQ ID NO: 2777978 - DNA, 18 bp, Homo sapiens
gttcgagaccagcctggc

SEQ ID NO: 2777979 - DNA, 19 bp, Homo sapiens
gttcgagaccagcctggcc

SEQ ID NO: 2777980 - DNA, 16 bp, Homo sapiens
gttcgcagccaccctg

SEQ ID NO: 2777981 - DNA, 19 bp, Homo sapiens
gttcgcagccaccctgagg

SEQ ID NO: 2777982 - DNA, 21 bp, Homo sapiens
gttctagttagcaggaaatag

SEQ ID NO: 2777983 - DNA, 16 bp, Homo sapiens
gttctcaatgcttttc

SEQ ID NO: 2777984 - DNA, 16 bp, Homo sapiens
gttctctccaggaagg

SEQ ID NO: 2777985 - DNA, 16 bp, Homo sapiens
gttctgaataatttct

SEQ ID NO: 2777986 - DNA, 16 bp, Homo sapiens
gttctgacacacgtat

SEQ ID NO: 2777987 - DNA, 11 bp, Homo sapiens
gttctgctcct

SEQ ID NO: 2777988 - DNA, 18 bp, Homo sapiens
gttctgctcctctccagg

SEQ ID NO: 2777989 - DNA, 19 bp, Homo sapiens
gttctgctcctctccaggc

SEQ ID NO: 2777990 - DNA, 13 bp, Homo sapiens
gttctgctggcct

SEQ ID NO: 2777991 - DNA, 19 bp, Homo sapiens
gttctggctttacatttta

SEQ ID NO: 2777992 - DNA, 15 bp, Homo sapiens
gttctgggacacagt

SEQ ID NO: 2777993 - DNA, 13 bp, Homo sapiens
gttctgtattttc

SEQ ID NO: 2777994 - DNA, 12 bp, Homo sapiens
gttcttgtctga

SEQ ID NO: 2777995 - DNA, 20 bp, Homo sapiens
gttctttaggtgcctcctgt

SEQ ID NO: 2777996 - DNA, 21 bp, Homo sapiens
gttctttaggtgcctcctgtc

SEQ ID NO: 2777997 - DNA, 18 bp, Homo sapiens
gttctttcttcctctgct

SEQ ID NO: 2777998 - DNA, 17 bp, Homo sapiens
gttgaaaatgagcctgt

SEQ ID NO: 2777999 - DNA, 20 bp, Homo sapiens
gttgaacatctcactttgcc

SEQ ID NO: 2778000 - DNA, 20 bp, Homo sapiens
gttgaagaagagtttgcaaa

SEQ ID NO: 2778001 - DNA, 19 bp, Homo sapiens
gttgacttgacagaacact

SEQ ID NO: 2778002 - DNA, 20 bp, Homo sapiens
gttgacttgacagaacactg

SEQ ID NO: 2778003 - DNA, 23 bp, Homo sapiens
gttgagaacaaaaattgggtttt

SEQ ID NO: 2778004 - DNA, 17 bp, Homo sapiens
gttgagagtgtgaccaa

SEQ ID NO: 2778005 - DNA, 17 bp, Homo sapiens
gttgagggaacagacag

SEQ ID NO: 2778006 - DNA, 23 bp, Homo sapiens
gttgaggtggaagccctccttcc

SEQ ID NO: 2778007 - DNA, 22 bp, Homo sapiens
gttgagtctcctctctgagact

SEQ ID NO: 2778008 - DNA, 23 bp, Homo sapiens
gttgagtctcctctctgagactg

SEQ ID NO: 2778009 - DNA, 12 bp, Homo sapiens
gttgatgaccaa

SEQ ID NO: 2778010 - DNA, 23 bp, Homo sapiens
gttgatgatctttgcagacaggc

SEQ ID NO: 2778011 - DNA, 13 bp, Homo sapiens
gttgcaaccactg

SEQ ID NO: 2778012 - DNA, 15 bp, Homo sapiens
gttgcaaggccgctg

SEQ ID NO: 2778013 - DNA, 16 bp, Homo sapiens
gttgcaaggccgctgt

SEQ ID NO: 2778014 - DNA, 14 bp, Homo sapiens
gttgcaataaaata

SEQ ID NO: 2778015 - DNA, 16 bp, Homo sapiens
gttgcacagctatgaa

SEQ ID NO: 2778016 - DNA, 13 bp, Homo sapiens
gttgcagtgagct

SEQ ID NO: 2778017 - DNA, 16 bp, Homo sapiens
gttgcatgatgtattt

SEQ ID NO: 2778018 - DNA, 18 bp, Homo sapiens
gttgccacctgttaaaat

SEQ ID NO: 2778019 - DNA, 15 bp, Homo sapiens
gttgccatgaggcct

SEQ ID NO: 2778020 - DNA, 19 bp, Homo sapiens
gttgcccaggcaggtcttg

SEQ ID NO: 2778021 - DNA, 23 bp, Homo sapiens
gttgcccaggcaggtcttgaact

SEQ ID NO: 2778022 - DNA, 14 bp, Homo sapiens
gttgcccaggctgg

SEQ ID NO: 2778023 - DNA, 21 bp, Homo sapiens
gttgcccaggctggcgtgcag

SEQ ID NO: 2778024 - DNA, 23 bp, Homo sapiens
gttgcgtggactctgcacatgtc

SEQ ID NO: 2778025 - DNA, 14 bp, Homo sapiens
gttgcttttctaat

SEQ ID NO: 2778026 - DNA, 15 bp, Homo sapiens
gttggaaaagaatac

SEQ ID NO: 2778027 - DNA, 22 bp, Homo sapiens
gttggaaaagaatacagaaaga

SEQ ID NO: 2778028 - DNA, 16 bp, Homo sapiens
gttggaaagcaggtgg

SEQ ID NO: 2778029 - DNA, 23 bp, Homo sapiens
gttggaaccgtgtccagcacaga

SEQ ID NO: 2778030 - DNA, 22 bp, Homo sapiens
gttggaatgaattaaataaacc

SEQ ID NO: 2778031 - DNA, 21 bp, Homo sapiens
gttggaccagaggaagcccct

SEQ ID NO: 2778032 - DNA, 15 bp, Homo sapiens
gttggacccgctctg

SEQ ID NO: 2778033 - DNA, 16 bp, Homo sapiens
gttggacccgctctgg

SEQ ID NO: 2778034 - DNA, 18 bp, Homo sapiens
gttggacccgctctggac

SEQ ID NO: 2778035 - DNA, 20 bp, Homo sapiens
gttggacccgctctggacca

SEQ ID NO: 2778036 - DNA, 23 bp, Homo sapiens
gttggccaaagccaaagctaggc

SEQ ID NO: 2778037 - DNA, 15 bp, Homo sapiens
gttggccaggctggt

SEQ ID NO: 2778038 - DNA, 20 bp, Homo sapiens
gttggctgacttccacacct

SEQ ID NO: 2778039 - DNA, 19 bp, Homo sapiens
gttggctgggggcctcagt

SEQ ID NO: 2778040 - DNA, 23 bp, Homo sapiens
gttggctgggggcctcagtgcca

SEQ ID NO: 2778041 - DNA, 15 bp, Homo sapiens
gttgggagcactgga

SEQ ID NO: 2778042 - DNA, 15 bp, Homo sapiens
gttgggttcatctga

SEQ ID NO: 2778043 - DNA, 14 bp, Homo sapiens
gttgtgaggcctgg

SEQ ID NO: 2778044 - DNA, 20 bp, Homo sapiens
gttgtgattttgtacagaat

SEQ ID NO: 2778045 - DNA, 22 bp, Homo sapiens
gttgtgattttgtacagaattt

SEQ ID NO: 2778046 - DNA, 15 bp, Homo sapiens
gttgtgggtgggaga

SEQ ID NO: 2778047 - DNA, 16 bp, Homo sapiens
gttgtgggtgggagag

SEQ ID NO: 2778048 - DNA, 19 bp, Homo sapiens
gttgttttttgaaaacatg

SEQ ID NO: 2778049 - DNA, 18 bp, Homo sapiens
gtttaaaaaaagtatata

SEQ ID NO: 2778050 - DNA, 23 bp, Homo sapiens
gtttaaaaaaagtatatattcta

SEQ ID NO: 2778051 - DNA, 13 bp, Homo sapiens
gtttaaaaaatac

SEQ ID NO: 2778052 - DNA, 17 bp, Homo sapiens
gtttaagccaaaacaat

SEQ ID NO: 2778053 - DNA, 20 bp, Homo sapiens
gtttaagccaaaacaatgtt

SEQ ID NO: 2778054 - DNA, 18 bp, Homo sapiens
gtggccatgtcgcctgcc

SEQ ID NO: 2778055 - DNA, 19 bp, Homo sapiens
gtggccctggcctgctggg

SEQ ID NO: 2778056 - DNA, 13 bp, Homo sapiens
gtggcccttcctg

SEQ ID NO: 2778057 - DNA, 14 bp, Homo sapiens
gtggcccttcctgg

SEQ ID NO: 2778058 - DNA, 17 bp, Homo sapiens
gtggcccttcctggaca

SEQ ID NO: 2778059 - DNA, 14 bp, Homo sapiens
gtggccggggaagc

SEQ ID NO: 2778060 - DNA, 12 bp, Homo sapiens
gtggcctgggca

SEQ ID NO: 2778061 - DNA, 13 bp, Homo sapiens
gtggcggtgcctg

SEQ ID NO: 2778062 - DNA, 22 bp, Homo sapiens
gtggcgttctgctgcccctgca

SEQ ID NO: 2778063 - DNA, 17 bp, Homo sapiens
gtggctactctgtgcca

SEQ ID NO: 2778064 - DNA, 21 bp, Homo sapiens
gtggctactctgtgccagagc

SEQ ID NO: 2778065 - DNA, 23 bp, Homo sapiens
gtggctactctgtgccagagcct

SEQ ID NO: 2778066 - DNA, 22 bp, Homo sapiens
gtggctcacgcctataatccca

SEQ ID NO: 2778067 - DNA, 13 bp, Homo sapiens
gtggctctccagt

SEQ ID NO: 2778068 - DNA, 14 bp, Homo sapiens
gtggctgacccagt

SEQ ID NO: 2778069 - DNA, 19 bp, Homo sapiens
gtggctgacccagtccctg

SEQ ID NO: 2778070 - DNA, 17 bp, Homo sapiens
gtggctgctagcacttg

SEQ ID NO: 2778071 - DNA, 13 bp, Homo sapiens
gtggcttcctccg

SEQ ID NO: 2778072 - DNA, 14 bp, Homo sapiens
gtgggaactggagg

SEQ ID NO: 2778073 - DNA, 14 bp, Homo sapiens
gtgggaagggagag

SEQ ID NO: 2778074 - DNA, 22 bp, Homo sapiens
gtgggacccatagatcttctga

SEQ ID NO: 2778075 - DNA, 13 bp, Homo sapiens
gtgggagcctcgc

SEQ ID NO: 2778076 - DNA, 14 bp, Homo sapiens
gtgggagcctcgca

SEQ ID NO: 2778077 - DNA, 20 bp, Homo sapiens
gtgggagggtaccagcagaa

SEQ ID NO: 2778078 - DNA, 19 bp, Homo sapiens
gtgggccactctcccctcc

SEQ ID NO: 2778079 - DNA, 23 bp, Homo sapiens
gtgggcctcctctgtccagggcc

SEQ ID NO: 2778080 - DNA, 14 bp, Homo sapiens
gtgggctaattaaa

SEQ ID NO: 2778081 - DNA, 13 bp, Homo sapiens
gtgggctgagccc

SEQ ID NO: 2778082 - DNA, 18 bp, Homo sapiens
gtgggctgagccctggca

SEQ ID NO: 2778083 - DNA, 17 bp, Homo sapiens
gtggggcagctcctctg

SEQ ID NO: 2778084 - DNA, 13 bp, Homo sapiens
gtggggccccaga

SEQ ID NO: 2778085 - DNA, 17 bp, Homo sapiens
gtggggccccagagagg

SEQ ID NO: 2778086 - DNA, 13 bp, Homo sapiens
gtggggccttggt

SEQ ID NO: 2778087 - DNA, 17 bp, Homo sapiens
gtggggctgctcctcca

SEQ ID NO: 2778088 - DNA, 18 bp, Homo sapiens
gtggggctgctcctccag

SEQ ID NO: 2778089 - DNA, 14 bp, Homo sapiens
gtgggggcagaggg

SEQ ID NO: 2778090 - DNA, 16 bp, Homo sapiens
gtgggggcggctgtgg

SEQ ID NO: 2778091 - DNA, 22 bp, Homo sapiens
gtggggtctccctctcctgcct

SEQ ID NO: 2778092 - DNA, 17 bp, Homo sapiens
gtgggttatcagttaac

SEQ ID NO: 2778093 - DNA, 22 bp, Homo sapiens
gtggtcaaaccgcactcaccca

SEQ ID NO: 2778094 - DNA, 12 bp, Homo sapiens
gtggtccagctc

SEQ ID NO: 2778095 - DNA, 13 bp, Homo sapiens
gtggtccagctct

SEQ ID NO: 2778096 - DNA, 14 bp, Homo sapiens
gtggtccagctctt

SEQ ID NO: 2778097 - DNA, 16 bp, Homo sapiens
gtggtccagctcttgg

SEQ ID NO: 2778098 - DNA, 19 bp, Homo sapiens
gtggtcttcaaattgtctt

SEQ ID NO: 2778099 - DNA, 23 bp, Homo sapiens
gtggtcttcaaattgtcttttgt

SEQ ID NO: 2778100 - DNA, 15 bp, Homo sapiens
gtggtctttgaataa

SEQ ID NO: 2778101 - DNA, 18 bp, Homo sapiens
gtggtctttgaataaagt

SEQ ID NO: 2778102 - DNA, 22 bp, Homo sapiens
gtggtctttgaataaagtctga

SEQ ID NO: 2778103 - DNA, 15 bp, Homo sapiens
gtggtgaagaaaact

SEQ ID NO: 2778104 - DNA, 21 bp, Homo sapiens
gtggtgaaggaccctggctct

SEQ ID NO: 2778105 - DNA, 17 bp, Homo sapiens
gtggtgacctctgcctg

SEQ ID NO: 2778106 - DNA, 23 bp, Homo sapiens
gtggtggcatacgcctgtagtcc

SEQ ID NO: 2778107 - DNA, 16 bp, Homo sapiens
gtggtggctgtctctg

SEQ ID NO: 2778108 - DNA, 14 bp, Homo sapiens
gtggtgggaatcag

SEQ ID NO: 2778109 - DNA, 22 bp, Homo sapiens
gtgtaaagaataaatgaatctt

SEQ ID NO: 2778110 - DNA, 17 bp, Homo sapiens
gtgtaaatgtggacaca

SEQ ID NO: 2778111 - DNA, 14 bp, Homo sapiens
gtgtaatgcacaat

SEQ ID NO: 2778112 - DNA, 17 bp, Homo sapiens
gtgtaatgcacaattta

SEQ ID NO: 2778113 - DNA, 18 bp, Homo sapiens
gtgtaatgcacaatttag

SEQ ID NO: 2778114 - DNA, 20 bp, Homo sapiens
gtgtaccgcgtctaccctgg

SEQ ID NO: 2778115 - DNA, 16 bp, Homo sapiens
gtgtagcaactacagt

SEQ ID NO: 2778116 - DNA, 14 bp, Homo sapiens
gtgtagcctgtgca

SEQ ID NO: 2778117 - DNA, 15 bp, Homo sapiens
gtgtagctctgtcca

SEQ ID NO: 2778118 - DNA, 17 bp, Homo sapiens
gtgtagctctgtccact

SEQ ID NO: 2778119 - DNA, 19 bp, Homo sapiens
gtgtagctgtgacctgctg

SEQ ID NO: 2778120 - DNA, 22 bp, Homo sapiens
gtgtagctgtgacctgctgagc

SEQ ID NO: 2778121 - DNA, 23 bp, Homo sapiens
gtgtagctgtgacctgctgagct

SEQ ID NO: 2778122 - DNA, 17 bp, Homo sapiens
gtgtatatgtatgtgtg

SEQ ID NO: 2778123 - DNA, 12 bp, Homo sapiens
gtgtcagcatgc

SEQ ID NO: 2778124 - DNA, 19 bp, Homo sapiens
gtgtcaggtggggcagctt

SEQ ID NO: 2778125 - DNA, 17 bp, Homo sapiens
gtgtccagcacagaagg

SEQ ID NO: 2778126 - DNA, 18 bp, Homo sapiens
gtgtccctgcacttgcag

SEQ ID NO: 2778127 - DNA, 14 bp, Homo sapiens
gtgtcctacagcct

SEQ ID NO: 2778128 - DNA, 23 bp, Homo sapiens
gtgtcgctctgctggcctggccg

SEQ ID NO: 2778129 - DNA, 14 bp, Homo sapiens
gtgtctaaaaacac

SEQ ID NO: 2778130 - DNA, 21 bp, Homo sapiens
gtgtctgcacccaggggtggg

SEQ ID NO: 2778131 - DNA, 15 bp, Homo sapiens
gtgtctgctcagtaa

SEQ ID NO: 2778132 - DNA, 12 bp, Homo sapiens
gtgtcttccata

SEQ ID NO: 2778133 - DNA, 18 bp, Homo sapiens
gtgtcttttataaaaagt

SEQ ID NO: 2778134 - DNA, 13 bp, Homo sapiens
gtcttgtattttc

SEQ ID NO: 2778135 - DNA, 17 bp, Homo sapiens
gtctttaggcagcagct

SEQ ID NO: 2778136 - DNA, 12 bp, Homo sapiens
gtctttgaataa

SEQ ID NO: 2778137 - DNA, 17 bp, Homo sapiens
gtctttggaggaacagc

SEQ ID NO: 2778138 - DNA, 15 bp, Homo sapiens
gtctttggttcagct

SEQ ID NO: 2778139 - DNA, 21 bp, Homo sapiens
gtctttgtaatgtcaccacct

SEQ ID NO: 2778140 - DNA, 22 bp, Homo sapiens
gtctttgtaatgtcaccacctt

SEQ ID NO: 2778141 - DNA, 15 bp, Homo sapiens
gtgaaagaattattt

SEQ ID NO: 2778142 - DNA, 18 bp, Homo sapiens
gtgaaagtgtaaaataga

SEQ ID NO: 2778143 - DNA, 17 bp, Homo sapiens
gtgaaatcaaaggtgct

SEQ ID NO: 2778144 - DNA, 12 bp, Homo sapiens
gtgaaccaaaga

SEQ ID NO: 2778145 - DNA, 22 bp, Homo sapiens
gtgaaccaaagagactggagca

SEQ ID NO: 2778146 - DNA, 21 bp, Homo sapiens
gtgaaccaccacacccagccc

SEQ ID NO: 2778147 - DNA, 16 bp, Homo sapiens
gtgaacgatttagaaa
